United States Patent 8,207,316 (HCMV-RELATED NUCLEIC ACIDS AND MICRORNA) - sequence listing, part 2

SEQ ID NO: 2799 - DNA, 24 bp, Plutella xylostella granulovirus
cctggcaatctaaactagccatat

SEQ ID NO: 2800 - DNA, 24 bp, Plutella xylostella granulovirus
gaggttatcgcagcttatcttgaa

SEQ ID NO: 2801 - DNA, 21 bp, Plutella xylostella granulovirus
ttaaaattgattctgattttc

SEQ ID NO: 2802 - DNA, 24 bp, Plutella xylostella granulovirus
gagcttaaacaacatgaacagctg

SEQ ID NO: 2803 - DNA, 24 bp, Plutella xylostella granulovirus
ttagcgctgtgtttctcgggtggc

SEQ ID NO: 2804 - DNA, 24 bp, Plutella xylostella granulovirus
agtctagaacaaattatatccggg

SEQ ID NO: 2805 - DNA, 22 bp, Plutella xylostella granulovirus
tcactcgtggtgtcacgtggcc

SEQ ID NO: 2806 - DNA, 22 bp, Plutella xylostella granulovirus
ttgctgcaacagagccaaaacc

SEQ ID NO: 2807 - DNA, 24 bp, Plutella xylostella granulovirus
tactgcagggaatcggggttcgct

SEQ ID NO: 2808 - DNA, 24 bp, Plutella xylostella granulovirus
tgaggagattatgattgaggtcgc

SEQ ID NO: 2809 - DNA, 24 bp, Plutella xylostella granulovirus
aaaaatatcaaacatagcatgaat

SEQ ID NO: 2810 - DNA, 24 bp, Plutella xylostella granulovirus
tgcggcaaatcttgagtaaaagtg

SEQ ID NO: 2811 - DNA, 24 bp, Plutella xylostella granulovirus
tgtaaccgttttcgtctattatct

SEQ ID NO: 2812 - DNA, 21 bp, Plutella xylostella granulovirus
gataacagttatctggaatta

SEQ ID NO: 2813 - DNA, 24 bp, Plutella xylostella granulovirus
aatcacgggcgcctgataaaaatg

SEQ ID NO: 2814 - DNA, 24 bp, Plutella xylostella granulovirus
aaaggtatctctctgatggacatt

SEQ ID NO: 2815 - DNA, 24 bp, Plutella xylostella granulovirus
tgaggggtagcgtcgtgttgggtt

SEQ ID NO: 2816 - DNA, 24 bp, Plutella xylostella granulovirus
ttaccgcccatcagcaacgataaa

SEQ ID NO: 2817 - DNA, 24 bp, Saimiriine herpesvirus 2
tgggagcagtaaatgtactatgac

SEQ ID NO: 2818 - DNA, 21 bp, Saimiriine herpesvirus 2
ggggatgattgtggtctactc

SEQ ID NO: 2819 - DNA, 24 bp, Saimiriine herpesvirus 2
taatacagcagttgggcttacatg

SEQ ID NO: 2820 - DNA, 24 bp, Saimiriine herpesvirus 2
tgtgcaagaagttatacaagggca

SEQ ID NO: 2821 - DNA, 21 bp, shrimp white spot syndrome virus (white spot bacilliform virus)
ttgccagattctcccaacttt

SEQ ID NO: 2822 - DNA, 24 bp, shrimp white spot syndrome virus (white spot bacilliform virus)
aaaaatgtccaggtcaatttcttc

SEQ ID NO: 2823 - DNA, 24 bp, shrimp white spot syndrome virus (white spot bacilliform virus)
tttcaaaggcttattgtgatttct

SEQ ID NO: 2824 - DNA, 24 bp, shrimp white spot syndrome virus (white spot bacilliform virus)
aagcagcattaaaaactgccgaag

SEQ ID NO: 2825 - DNA, 24 bp, shrimp white spot syndrome virus (white spot bacilliform virus)
tgggtaagaagatctggatctgga

SEQ ID NO: 2826 - DNA, 24 bp, shrimp white spot syndrome virus (white spot bacilliform virus)
ttacttggacgagaaaagaaatgg

SEQ ID NO: 2827 - DNA, 24 bp, shrimp white spot syndrome virus (white spot bacilliform virus)
tgcatagcaaggagaaatctcggt

SEQ ID NO: 2828 - DNA, 24 bp, shrimp white spot syndrome virus (white spot bacilliform virus)
agcagtagtatcaataacgaagat

SEQ ID NO: 2829 - DNA, 24 bp, shrimp white spot syndrome virus (white spot bacilliform virus)
tagattgtctagatgcagtagcaa

SEQ ID NO: 2830 - DNA, 24 bp, shrimp white spot syndrome virus (white spot bacilliform virus)
tctactgtttacacttctgtaaag

SEQ ID NO: 2831 - DNA, 24 bp, shrimp white spot syndrome virus (white spot bacilliform virus)
aaaagcaatgggtatcaatacaga

SEQ ID NO: 2832 - DNA, 24 bp, shrimp white spot syndrome virus (white spot bacilliform virus)
tgtggataaaaaggtggtaaatct

SEQ ID NO: 2833 - DNA, 24 bp, shrimp white spot syndrome virus (white spot bacilliform virus)
ttcaaagctgtacgcatgatacat

SEQ ID NO: 2834 - DNA, 24 bp, shrimp white spot syndrome virus (white spot bacilliform virus)
tctaaaacggataggtttttacta

SEQ ID NO: 2835 - DNA, 22 bp, shrimp white spot syndrome virus (white spot bacilliform virus)
tgttatatgtgtaggaggagct

SEQ ID NO: 2836 - DNA, 24 bp, shrimp white spot syndrome virus (white spot bacilliform virus)
caaggtattttgccctccctgtcc

SEQ ID NO: 2837 - DNA, 24 bp, shrimp white spot syndrome virus (white spot bacilliform virus)
caggagtggttcaagggatccttc

SEQ ID NO: 2838 - DNA, 24 bp, shrimp white spot syndrome virus (white spot bacilliform virus)
tattacatttgtttgttttgacac

SEQ ID NO: 2839 - DNA, 24 bp, shrimp white spot syndrome virus (white spot bacilliform virus)
acgaagaagacgaaaaagatgtca

SEQ ID NO: 2840 - DNA, 24 bp, shrimp white spot syndrome virus (white spot bacilliform virus)
tgtcagggttttcaccagaaatag

SEQ ID NO: 2841 - DNA, 24 bp, shrimp white spot syndrome virus (white spot bacilliform virus)
tgatatgtctggagctctgatgaa

SEQ ID NO: 2842 - DNA, 24 bp, shrimp white spot syndrome virus (white spot bacilliform virus)
aacagtgccaatgtaatggaagct

SEQ ID NO: 2843 - DNA, 21 bp, shrimp white spot syndrome virus (white spot bacilliform virus)
tcagaggatgaaagggatatg

SEQ ID NO: 2844 - DNA, 24 bp, shrimp white spot syndrome virus (white spot bacilliform virus)
taccagaaaacaacttcaagattg

SEQ ID NO: 2845 - DNA, 24 bp, shrimp white spot syndrome virus (white spot bacilliform virus)
catcagatggctcaagatatttgc

SEQ ID NO: 2846 - DNA, 24 bp, shrimp white spot syndrome virus (white spot bacilliform virus)
taataagattgtccacatcgacaa

SEQ ID NO: 2847 - DNA, 24 bp, shrimp white spot syndrome virus (white spot bacilliform virus)
ctggaacagacgtttctgggcata

SEQ ID NO: 2848 - DNA, 22 bp, shrimp white spot syndrome virus (white spot bacilliform virus)
ttcaatgcatgggaatcgtgtg

SEQ ID NO: 2849 - DNA, 24 bp, shrimp white spot syndrome virus (white spot bacilliform virus)
tgcaaacgtatggcggtatagaag

SEQ ID NO: 2850 - DNA, 24 bp, shrimp white spot syndrome virus (white spot bacilliform virus)
tcaccaattcctttgagtaccggg

SEQ ID NO: 2851 - DNA, 21 bp, shrimp white spot syndrome virus (white spot bacilliform virus)
atctcataaacacgacagatg

SEQ ID NO: 2852 - DNA, 24 bp, shrimp white spot syndrome virus (white spot bacilliform virus)
agttggtgtcctacatcaacgctc

SEQ ID NO: 2853 - DNA, 24 bp, shrimp white spot syndrome virus (white spot bacilliform virus)
tttaaaggcaaattttggaaaatc

SEQ ID NO: 2854 - DNA, 24 bp, shrimp white spot syndrome virus (white spot bacilliform virus)
tgttatccttcctacttctgagtt

SEQ ID NO: 2855 - DNA, 24 bp, shrimp white spot syndrome virus (white spot bacilliform virus)
cacctgaggatgaagaagaggatg

SEQ ID NO: 2856 - DNA, 24 bp, shrimp white spot syndrome virus (white spot bacilliform virus)
ataggaaacatttatgtgttatta

SEQ ID NO: 2857 - DNA, 24 bp, shrimp white spot syndrome virus (white spot bacilliform virus)
tgatgtcaagttcggagggtggac

SEQ ID NO: 2858 - DNA, 24 bp, shrimp white spot syndrome virus (white spot bacilliform virus)
ggactagataaggcctcatgtggc

SEQ ID NO: 2859 - DNA, 24 bp, shrimp white spot syndrome virus (white spot bacilliform virus)
tggcatggatgatgatgatgatga

SEQ ID NO: 2860 - DNA, 24 bp, shrimp white spot syndrome virus (white spot bacilliform virus)
tcgtggagctgctttaaaggttgt

SEQ ID NO: 2861 - DNA, 24 bp, shrimp white spot syndrome virus (white spot bacilliform virus)
gtgcgcttggacgtgaaaagcgcg

SEQ ID NO: 2862 - DNA, 22 bp, shrimp white spot syndrome virus (white spot bacilliform virus)
tcttacaaaactcgtatccgag

SEQ ID NO: 2863 - DNA, 24 bp, shrimp white spot syndrome virus (white spot bacilliform virus)
tgaagaataaggagaaggtacagg

SEQ ID NO: 2864 - DNA, 24 bp, shrimp white spot syndrome virus (white spot bacilliform virus)
tgactggattacttagccctgcgt

SEQ ID NO: 2865 - DNA, 24 bp, shrimp white spot syndrome virus (white spot bacilliform virus)
ggaggaacaacaacgacaccaact

SEQ ID NO: 2866 - DNA, 24 bp, shrimp white spot syndrome virus (white spot bacilliform virus)
tggaaagggttacaatttattgta

SEQ ID NO: 2867 - DNA, 24 bp, shrimp white spot syndrome virus (white spot bacilliform virus)
caacagctgcagcatggaatacgt

SEQ ID NO: 2868 - DNA, 24 bp, shrimp white spot syndrome virus (white spot bacilliform virus)
tacggcatctgtgaaaaatgtgca

SEQ ID NO: 2869 - DNA, 24 bp, shrimp white spot syndrome virus (white spot bacilliform virus)
ttagtgatgatgaggatgatattg

SEQ ID NO: 2870 - DNA, 24 bp, shrimp white spot syndrome virus (white spot bacilliform virus)
tcactgcactgcactagtagtagt

SEQ ID NO: 2871 - DNA, 24 bp, shrimp white spot syndrome virus (white spot bacilliform virus)
tccccagtgtcgattttgatagct

SEQ ID NO: 2872 - DNA, 24 bp, shrimp white spot syndrome virus (white spot bacilliform virus)
gaagttatgcaagtaattggtact

SEQ ID NO: 2873 - DNA, 24 bp, shrimp white spot syndrome virus (white spot bacilliform virus)
tttaaagttgggaaaattactgtg

SEQ ID NO: 2874 - DNA, 24 bp, shrimp white spot syndrome virus (white spot bacilliform virus)
gcgaatctatgtctgtaaagcaag

SEQ ID NO: 2875 - DNA, 24 bp, shrimp white spot syndrome virus (white spot bacilliform virus)
taaggtatactgtatttgtcaata

SEQ ID NO: 2876 - DNA, 24 bp, shrimp white spot syndrome virus (white spot bacilliform virus)
gaaggtgctcgtgtatggttggcc

SEQ ID NO: 2877 - DNA, 24 bp, shrimp white spot syndrome virus (white spot bacilliform virus)
taggatctgtatctgccatctctg

SEQ ID NO: 2878 - DNA, 24 bp, shrimp white spot syndrome virus (white spot bacilliform virus)
tgggatatattgacaagttcttcc

SEQ ID NO: 2879 - DNA, 24 bp, shrimp white spot syndrome virus (white spot bacilliform virus)
tgggtaaatagtccctataattgg

SEQ ID NO: 2880 - DNA, 22 bp, shrimp white spot syndrome virus (white spot bacilliform virus)
ttgacaggtatcataattgtcc

SEQ ID NO: 2881 - DNA, 24 bp, shrimp white spot syndrome virus (white spot bacilliform virus)
tcattctttaaaaatttaacaatt

SEQ ID NO: 2882 - DNA, 24 bp, shrimp white spot syndrome virus (white spot bacilliform virus)
tgggacgctattatgcccacagca

SEQ ID NO: 2883 - DNA, 24 bp, shrimp white spot syndrome virus (white spot bacilliform virus)
aagcagacacctttcgtcccaaaa

SEQ ID NO: 2884 - DNA, 24 bp, shrimp white spot syndrome virus (white spot bacilliform virus)
ctggaacagtcatttctggaaagg

SEQ ID NO: 2885 - DNA, 24 bp, shrimp white spot syndrome virus (white spot bacilliform virus)
tcgaatcttcttttcgggagttct

SEQ ID NO: 2886 - DNA, 24 bp, shrimp white spot syndrome virus (white spot bacilliform virus)
ggagggatttgtttaggggctgga

SEQ ID NO: 2887 - DNA, 24 bp, shrimp white spot syndrome virus (white spot bacilliform virus)
agaggaacttccttcagcaatatc

SEQ ID NO: 2888 - DNA, 23 bp, shrimp white spot syndrome virus (white spot bacilliform virus)
tagaatcttgtaaccctcggatt

SEQ ID NO: 2889 - DNA, 24 bp, shrimp white spot syndrome virus (white spot bacilliform virus)
aaaagaagggcggtggtggtggtg

SEQ ID NO: 2890 - DNA, 24 bp, shrimp white spot syndrome virus (white spot bacilliform virus)
tgtacactggagaaggaaaaaggg

SEQ ID NO: 2891 - DNA, 24 bp, shrimp white spot syndrome virus (white spot bacilliform virus)
cagcattatgtatagtaaaaagca

SEQ ID NO: 2892 - DNA, 24 bp, shrimp white spot syndrome virus (white spot bacilliform virus)
tggaaattgcccttgacgtattga

SEQ ID NO: 2893 - DNA, 24 bp, shrimp white spot syndrome virus (white spot bacilliform virus)
tatactggaaagggtattgatcaa

SEQ ID NO: 2894 - DNA, 24 bp, shrimp white spot syndrome virus (white spot bacilliform virus)
tagtagcttccgtcgtttttacaa

SEQ ID NO: 2895 - DNA, 24 bp, shrimp white spot syndrome virus (white spot bacilliform virus)
tgagtagtacttccaatggtattt

SEQ ID NO: 2896 - DNA, 24 bp, shrimp white spot syndrome virus (white spot bacilliform virus)
tgtcacatatggcaactacgcaga

SEQ ID NO: 2897 - DNA, 24 bp, shrimp white spot syndrome virus (white spot bacilliform virus)
ttgtattttgtatatagagaaaag

SEQ ID NO: 2898 - DNA, 24 bp, shrimp white spot syndrome virus (white spot bacilliform virus)
tagcgtgtatacaactgcagcatt

SEQ ID NO: 2899 - DNA, 24 bp, shrimp white spot syndrome virus (white spot bacilliform virus)
ttgacagataaccctattgtagat

SEQ ID NO: 2900 - DNA, 24 bp, shrimp white spot syndrome virus (white spot bacilliform virus)
tcagaagaatcactatttcttaga

SEQ ID NO: 2901 - DNA, 24 bp, shrimp white spot syndrome virus (white spot bacilliform virus)
tcaaatgtctgattgtaatgcaat

SEQ ID NO: 2902 - DNA, 22 bp, shrimp white spot syndrome virus (white spot bacilliform virus)
agaaatgtttctattagacata

SEQ ID NO: 2903 - DNA, 24 bp, shrimp white spot syndrome virus (white spot bacilliform virus)
ttggatgaagatactgtacatcct

SEQ ID NO: 2904 - DNA, 24 bp, shrimp white spot syndrome virus (white spot bacilliform virus)
aagaagcagagtcgtatgaccatt

SEQ ID NO: 2905 - DNA, 24 bp, shrimp white spot syndrome virus (white spot bacilliform virus)
ttcacagtatttgtcccttctggt

SEQ ID NO: 2906 - DNA, 24 bp, shrimp white spot syndrome virus (white spot bacilliform virus)
tagtgtaccaagggcaatatctta

SEQ ID NO: 2907 - DNA, 24 bp, shrimp white spot syndrome virus (white spot bacilliform virus)
ttagaggatcaacaactgtagaac

SEQ ID NO: 2908 - DNA, 24 bp, shrimp white spot syndrome virus (white spot bacilliform virus)
tgacgcacacatttataataccca

SEQ ID NO: 2909 - DNA, 24 bp, shrimp white spot syndrome virus (white spot bacilliform virus)
gataaacttaaatcaattaaatcc

SEQ ID NO: 2910 - DNA, 23 bp, shrimp white spot syndrome virus (white spot bacilliform virus)
ttcaccgagtggtggccgagtta

SEQ ID NO: 2911 - DNA, 22 bp, shrimp white spot syndrome virus (white spot bacilliform virus)
ctggaacaggcgtttctgggca

SEQ ID NO: 2912 - DNA, 24 bp, shrimp white spot syndrome virus (white spot bacilliform virus)
tcagtggagattacggatggtttt

SEQ ID NO: 2913 - DNA, 24 bp, shrimp white spot syndrome virus (white spot bacilliform virus)
tgagaggcgtattttattcacaat

SEQ ID NO: 2914 - DNA, 24 bp, shrimp white spot syndrome virus (white spot bacilliform virus)
tgaccagcttagaatttctccagt

SEQ ID NO: 2915 - DNA, 24 bp, shrimp white spot syndrome virus (white spot bacilliform virus)
tgtcgtatccagaaaaattgatca

SEQ ID NO: 2916 - DNA, 24 bp, shrimp white spot syndrome virus (white spot bacilliform virus)
tcaaattaattggagtaactttgg

SEQ ID NO: 2917 - DNA, 21 bp, shrimp white spot syndrome virus (white spot bacilliform virus)
ctggaacagtcatttctggaa

SEQ ID NO: 2918 - DNA, 24 bp, shrimp white spot syndrome virus (white spot bacilliform virus)
ttaagtacatagccatcgtacgaa

SEQ ID NO: 2919 - DNA, 24 bp, shrimp white spot syndrome virus (white spot bacilliform virus)
tgtaagaagagttgcggaattctg

SEQ ID NO: 2920 - DNA, 24 bp, shrimp white spot syndrome virus (white spot bacilliform virus)
tgacttgactaccttattccaacg

SEQ ID NO: 2921 - DNA, 24 bp, shrimp white spot syndrome virus (white spot bacilliform virus)
tctctaacaccagtccatgaagat

SEQ ID NO: 2922 - DNA, 24 bp, Simian virus 40
agaagtatgcaaagcatgcatctc

SEQ ID NO: 2923 - DNA, 24 bp, Simian virus 40
tgtcagctttgcacaagggcccaa

SEQ ID NO: 2924 - DNA, 24 bp, Simian virus 40
taaggtaaatataaaatttttaag

SEQ ID NO: 2925 - DNA, 24 bp, Autographa californica nucleopolyhedrovirus
tttggcggtgaatcgtttgtttgg

SEQ ID NO: 2926 - DNA, 24 bp, Autographa californica nucleopolyhedrovirus
ttaaagagattgaaagcgcgtacg

SEQ ID NO: 2927 - DNA, 24 bp, Avian leukosis virus
tccccgggacattatcaggcgcag

SEQ ID NO: 2928 - DNA, 24 bp, Avian leukosis virus
cagcttagcaccactgctgccttg

SEQ ID NO: 2929 - DNA, 24 bp, Bovine leukemia virus
tcagtcattttttatagccgattg

SEQ ID NO: 2930 - DNA, 24 bp, Bovine leukemia virus
aacgctgacgggggcgatttcttg

SEQ ID NO: 2931 - DNA, 24 bp, Callitrichine herpesvirus 3
tgcaaactcttcgcatgtttcttg

SEQ ID NO: 2932 - DNA, 24 bp, Callitrichine herpesvirus 3
tcagaggagccatcacatacatga

SEQ ID NO: 2933 - DNA, 23 bp, Callitrichine herpesvirus 3
tactatgatacatatctaaatgt

SEQ ID NO: 2934 - DNA, 24 bp, Callitrichine herpesvirus 3
gttggcaccaacaaacgttgccca

SEQ ID NO: 2935 - DNA, 24 bp, Callitrichine herpesvirus 3
taaagtaatcaataacggtaagat

SEQ ID NO: 2936 - DNA, 24 bp, Callitrichine herpesvirus 3
ttagttaaagcagaacgatttatt

SEQ ID NO: 2937 - DNA, 24 bp, Callitrichine herpesvirus 3
tggcatatattagagggacccggt

SEQ ID NO: 2938 - DNA, 24 bp, Callitrichine herpesvirus 3
tttgacacgctatttgaaataata

SEQ ID NO: 2939 - DNA, 24 bp, Callitrichine herpesvirus 3
tctactgtctacatacagaagggt

SEQ ID NO: 2940 - DNA, 24 bp, Callitrichine herpesvirus 3
taagccaaaaatcattacttcctc

SEQ ID NO: 2941 - DNA, 24 bp, Callitrichine herpesvirus 3
taggacaggaggtatcaatgacat

SEQ ID NO: 2942 - DNA, 24 bp, Callitrichine herpesvirus 3
taggtgaacacccactgacagtaa

SEQ ID NO: 2943 - DNA, 24 bp, Callitrichine herpesvirus 3
tccccgaaacccccaaggggcggc

SEQ ID NO: 2944 - DNA, 21 bp, Callitrichine herpesvirus 3
taagacaaggtgtttccacgg

SEQ ID NO: 2945 - DNA, 24 bp, Callitrichine herpesvirus 3
cagcacacacccaacacaattaca

SEQ ID NO: 2946 - DNA, 24 bp, Callitrichine herpesvirus 3
tgactgttgtactcgcgatggcaa

SEQ ID NO: 2947 - DNA, 24 bp, Callitrichine herpesvirus 3
tgaccagccgtattcatgcatctt

SEQ ID NO: 2948 - DNA, 24 bp, Callitrichine herpesvirus 3
tggcggattctctggctgcggctg

SEQ ID NO: 2949 - DNA, 24 bp, Callitrichine herpesvirus 3
ttgacagttttgtgaattctccgc

SEQ ID NO: 2950 - DNA, 23 bp, Callitrichine herpesvirus 3
tggctcaacctgtcatacacgtt

SEQ ID NO: 2951 - DNA, 24 bp, Callitrichine herpesvirus 3
tgcgtgatttccttgatgttgaca

SEQ ID NO: 2952 - DNA, 24 bp, Callitrichine herpesvirus 3
tgtggcagaggggactttagttta

SEQ ID NO: 2953 - DNA, 24 bp, Callitrichine herpesvirus 3
tgaggtttggtgaaggtctggagg

SEQ ID NO: 2954 - DNA, 24 bp, Callitrichine herpesvirus 3
agaggtggctgattttattggtat

SEQ ID NO: 2955 - DNA, 24 bp, Callitrichine herpesvirus 3
gggaaagtaatcaagatccctagt

SEQ ID NO: 2956 - DNA, 24 bp, Callitrichine herpesvirus 3
cgaggtaggagattgatccaaagt

SEQ ID NO: 2957 - DNA, 24 bp, Callitrichine herpesvirus 3
tggcgcggtagccttagtgggaga

SEQ ID NO: 2958 - DNA, 22 bp, Callitrichine herpesvirus 3
tggcaaagttttcaccccgccc

SEQ ID NO: 2959 - DNA, 24 bp, Callitrichine herpesvirus 3
tggaatggctgtagagcacatcat

SEQ ID NO: 2960 - DNA, 24 bp, Callitrichine herpesvirus 3
tagactattaggtggggcatctgc

SEQ ID NO: 2961 - DNA, 24 bp, Callitrichine herpesvirus 3
cctacaggttaatcctcctggttc

SEQ ID NO: 2962 - DNA, 23 bp, Callitrichine herpesvirus 3
tgccttggtggagttcaactact

SEQ ID NO: 2963 - DNA, 24 bp, Callitrichine herpesvirus 3
taaggttttgcgagttgaactctg

SEQ ID NO: 2964 - DNA, 24 bp, Callitrichine herpesvirus 3
tagccgatgtggtgcttgccgcca

SEQ ID NO: 2965 - DNA, 24 bp, Callitrichine herpesvirus 3
tgtgatgtagcacgtggctataat

SEQ ID NO: 2966 - DNA, 22 bp, Callitrichine herpesvirus 3
tattgcatatagattgtagtta

SEQ ID NO: 2967 - DNA, 24 bp, Callitrichine herpesvirus 3
tgtagtagaaggtgatactacaca

SEQ ID NO: 2968 - DNA, 24 bp, Callitrichine herpesvirus 3
attggttgcctctagttcatagga

SEQ ID NO: 2969 - DNA, 24 bp, Callitrichine herpesvirus 3
tgaaatgtttgatctgatgcctgc

SEQ ID NO: 2970 - DNA, 22 bp, Callitrichine herpesvirus 3
aagctccgccctgtgggttgta

SEQ ID NO: 2971 - DNA, 24 bp, Callitrichine herpesvirus 3
tatcttatgatctgaccaacagaa

SEQ ID NO: 2972 - DNA, 24 bp, Callitrichine herpesvirus 3
tgggatggggcctctcttagtagg

SEQ ID NO: 2973 - DNA, 24 bp, Callitrichine herpesvirus 3
acacccgatatgcgtattttggtg

SEQ ID NO: 2974 - DNA, 24 bp, Callitrichine herpesvirus 3
ttaaagacagccataacttatcct

SEQ ID NO: 2975 - DNA, 24 bp, Callitrichine herpesvirus 3
ttccctgctacatcaccctggaca

SEQ ID NO: 2976 - DNA, 24 bp, Callitrichine herpesvirus 3
taccatatctatgtagaagtttta

SEQ ID NO: 2977 - DNA, 22 bp, Epiphyas postvittana nucleopolyhedrovirus
tgccatgaagtttacgttgttt

SEQ ID NO: 2978 - DNA, 24 bp, Epiphyas postvittana nucleopolyhedrovirus
ttcgttgtgtgtgcgacgacgggt

SEQ ID NO: 2979 - DNA, 24 bp, Epiphyas postvittana nucleopolyhedrovirus
ttcatcaaaccgttcgtgaaacgc

SEQ ID NO: 2980 - DNA, 24 bp, Epiphyas postvittana nucleopolyhedrovirus
tcaaataagcgtagactagtttgc

SEQ ID NO: 2981 - DNA, 24 bp, Epiphyas postvittana nucleopolyhedrovirus
ttgaatggacaattttgctagaac

SEQ ID NO: 2982 - DNA, 21 bp, Epiphyas postvittana nucleopolyhedrovirus
tgtctcgactgctttaagatg

SEQ ID NO: 2983 - DNA, 24 bp, Epiphyas postvittana nucleopolyhedrovirus
aattgcagcgtgaatttgctcagc

SEQ ID NO: 2984 - DNA, 24 bp, Epiphyas postvittana nucleopolyhedrovirus
ggtaaacgcttcattgtgctttgc

SEQ ID NO: 2985 - DNA, 24 bp, Epiphyas postvittana nucleopolyhedrovirus
tgaaattggcgttgacaaattatt

SEQ ID NO: 2986 - DNA, 24 bp, Epiphyas postvittana nucleopolyhedrovirus
aagaatgtttaggcgacgcgtcgt

SEQ ID NO: 2987 - DNA, 21 bp, Epiphyas postvittana nucleopolyhedrovirus
taaaacacgtgtgggatgatg

SEQ ID NO: 2988 - DNA, 24 bp, Epiphyas postvittana nucleopolyhedrovirus
tgttgtacaaattgctgctcaaat

SEQ ID NO: 2989 - DNA, 24 bp, Epiphyas postvittana nucleopolyhedrovirus
tcactggcaaatgttcgaagcgta

SEQ ID NO: 2990 - DNA, 23 bp, Epiphyas postvittana nucleopolyhedrovirus
accagcagattaatgccaacacg

SEQ ID NO: 2991 - DNA, 24 bp, Epiphyas postvittana nucleopolyhedrovirus
tgtcggagccgagcactagcggga

SEQ ID NO: 2992 - DNA, 24 bp, Epiphyas postvittana nucleopolyhedrovirus
tcaatgctctcttagtttaacaca

SEQ ID NO: 2993 - DNA, 24 bp, Epiphyas postvittana nucleopolyhedrovirus
tggcaaagtgaaacccgacgtgtt

SEQ ID NO: 2994 - DNA, 24 bp, Epiphyas postvittana nucleopolyhedrovirus
ttcatcgtgtcgggcttgacgttg

SEQ ID NO: 2995 - DNA, 24 bp, Epiphyas postvittana nucleopolyhedrovirus
tgtcacgcacatcatcgcagtcgt

SEQ ID NO: 2996 - DNA, 24 bp, Epiphyas postvittana nucleopolyhedrovirus
aacgcgtttgtattgacgggtgac

SEQ ID NO: 2997 - DNA, 24 bp, Epiphyas postvittana nucleopolyhedrovirus
tcgacacatttgatacaattttgt

SEQ ID NO: 2998 - DNA, 24 bp, Epiphyas postvittana nucleopolyhedrovirus
taagctaatcatataaattaaacc

SEQ ID NO: 2999 - DNA, 24 bp, Epiphyas postvittana nucleopolyhedrovirus
aaagttgtcctgaccatgctcacc

SEQ ID NO: 3000 - DNA, 24 bp, Epiphyas postvittana nucleopolyhedrovirus
gctacatttgtacattgacttatc

SEQ ID NO: 3001 - DNA, 24 bp, Epiphyas postvittana nucleopolyhedrovirus
tgtagtagtgatagtagctttact

SEQ ID NO: 3002 - DNA, 24 bp, Epiphyas postvittana nucleopolyhedrovirus
ttacaggcctttatatacccatgt

SEQ ID NO: 3003 - DNA, 24 bp, Epiphyas postvittana nucleopolyhedrovirus
aaaaagcttttatttagtgataac

SEQ ID NO: 3004 - DNA, 24 bp, Epiphyas postvittana nucleopolyhedrovirus
catgacaaagagcgcgtttgtgaa

SEQ ID NO: 3005 - DNA, 24 bp, Epiphyas postvittana nucleopolyhedrovirus
tgttaacttttacgaattgctgta

SEQ ID NO: 3006 - DNA, 24 bp, Epiphyas postvittana nucleopolyhedrovirus
tcaccactcttgtttacattgttg

SEQ ID NO: 3007 - DNA, 24 bp, Epiphyas postvittana nucleopolyhedrovirus
ataacatttatttgcgtttgtttt

SEQ ID NO: 3008 - DNA, 24 bp, Epiphyas postvittana nucleopolyhedrovirus
ttcagagcacatgagtcaccgagc

SEQ ID NO: 3009 - DNA, 24 bp, Epiphyas postvittana nucleopolyhedrovirus
aaaagcaaatcgcaaaaagcgttt

SEQ ID NO: 3010 - DNA, 23 bp, Epiphyas postvittana nucleopolyhedrovirus
catcacagccgatattggcgaca

SEQ ID NO: 3011 - DNA, 24 bp, Epiphyas postvittana nucleopolyhedrovirus
tgaggcggctacgcgcggtcaaag

SEQ ID NO: 3012 - DNA, 24 bp, Epiphyas postvittana nucleopolyhedrovirus
tcaattggccaacagcgcgacttg

SEQ ID NO: 3013 - DNA, 23 bp, Epiphyas postvittana nucleopolyhedrovirus
tgatattgttaaacaaggcaaca

SEQ ID NO: 3014 - DNA, 24 bp, Epiphyas postvittana nucleopolyhedrovirus
tcatgtgcttcgcgaactagcttt

SEQ ID NO: 3015 - DNA, 24 bp, Equine herpesvirus 4
tatggtgagttgtcggttggggga

SEQ ID NO: 3016 - DNA, 24 bp, Equine herpesvirus 4
tgaggggggttgagttttcggggg

SEQ ID NO: 3017 - DNA, 24 bp, Equine herpesvirus 4
tagcgtagagagtagcatccacaa

SEQ ID NO: 3018 - DNA, 23 bp, Human adenovirus E
tttacagtaagtgtgattaagtt

SEQ ID NO: 3019 - DNA, 21 bp, Paramecium bursaria Chlorella virus 1
taatcggaacgtcgagtggtg

SEQ ID NO: 3020 - DNA, 24 bp, Human herpesvirus 6
tgactggacctggcattctagaga

SEQ ID NO: 3021 - DNA, 24 bp, Pothos latent virus
tgtcagggctatagccaaagtggg

SEQ ID NO: 3022 - DNA, 24 bp, Pothos latent virus
ttgaacgtgacctgatgaattgga

SEQ ID NO: 3023 - DNA, 24 bp, Pothos latent virus
ttgaatcacgaagggatggtggta

SEQ ID NO: 3024 - DNA, 24 bp, porcine enteric calicivirus
tggcaaggaggtttgttcagagtc

SEQ ID NO: 3025 - DNA, 24 bp, Murine adenovirus A
tggcaagcagtgtaccttcttgcc

SEQ ID NO: 3026 - DNA, 24 bp, Cryphonectria hypovirus 3
tggcttgcacaggatgattgaggc

SEQ ID NO: 3027 - DNA, 24 bp, Cryphonectria hypovirus 3
aagaagctacggaaaaaaggtttc

SEQ ID NO: 3028 - DNA, 24 bp, Cryphonectria hypovirus 3
ctagcaaatatagatctgatggtg

SEQ ID NO: 3029 - DNA, 24 bp, Cryphonectria hypovirus 3
tttgtcatgcttctgaagatgtta

SEQ ID NO: 3030 - DNA, 23 bp, Myxoma virus
tgtgatcaacccaaacatcgtat

SEQ ID NO: 3031 - DNA, 24 bp, Myxoma virus
tgattctttcgttcttcgtcagcg

SEQ ID NO: 3032 - DNA, 24 bp, Myxoma virus
ataaagctaagcaattatacagct

SEQ ID NO: 3033 - DNA, 24 bp, Myxoma virus
tacccgtcaatacaaacaccgtaa

SEQ ID NO: 3034 - DNA, 21 bp, Myxoma virus
tgttatcaaacggggcagata

SEQ ID NO: 3035 - DNA, 24 bp, Rabbit fibroma virus
taatactagccgttagtgccttgt

SEQ ID NO: 3036 - DNA, 24 bp, Rabbit fibroma virus
tcactggtgttccaactatcataa

SEQ ID NO: 3037 - DNA, 24 bp, Rabbit fibroma virus
aaaaaggcagataaagtggatccg

SEQ ID NO: 3038 - DNA, 24 bp, Rabbit fibroma virus
tggcaagttccctaacataacgta

SEQ ID NO: 3039 - DNA, 24 bp, Rabbit fibroma virus
gtgcattggatatgattatcctgt

SEQ ID NO: 3040 - DNA, 24 bp, Rabbit fibroma virus
aaaagagtgcaatgcccagcagaa

SEQ ID NO: 3041 - DNA, 24 bp, Human herpesvirus 5
cgtcacagaaacaaaggagtcgta

SEQ ID NO: 3042 - DNA, 24 bp, Human herpesvirus 5
tggcatcatgagacgcgcgaaaac

SEQ ID NO: 3043 - DNA, 22 bp, Human herpesvirus 3
tagccgttctaacgcctatcga

SEQ ID NO: 3044 - DNA, 24 bp, Human herpesvirus 3
tagctgccttaaccctggagttat

SEQ ID NO: 3045 - DNA, 24 bp, Human herpesvirus 3
tgatgtaatttttacggcacttaa

SEQ ID NO: 3046 - DNA, 24 bp, Saimiriine herpesvirus 2
agaggaattaacattttctacaga

SEQ ID NO: 3047 - DNA, 24 bp, Saimiriine herpesvirus 2
tgaggtaaaagcagctgctcagct

SEQ ID NO: 3048 - DNA, 24 bp, Saimiriine herpesvirus 2
tgccatgcataagcattgcagaga

SEQ ID NO: 3049 - DNA, 24 bp, Saimiriine herpesvirus 2
tctttaggaacgtgctcagctgtt

SEQ ID NO: 3050 - DNA, 24 bp, Saimiriine herpesvirus 2
tattaggcaaaagcttgctgaatg

SEQ ID NO: 3051 - DNA, 24 bp, Tobacco mosaic virus
catggcaagatcctgacttttacc

SEQ ID NO: 3052 - DNA, 24 bp, Tobacco mosaic virus
tttcatgatgaattttgggaaaag

SEQ ID NO: 3053 - DNA, 24 bp, Tobacco mosaic virus
agagatctagagaaacttagctcg

SEQ ID NO: 3054 - DNA, 24 bp, Tobacco mosaic virus
tgaggcgaatgttgcgctagcttt

SEQ ID NO: 3055 - DNA, 24 bp, Tobacco mosaic virus
tagcatcactatctgctgcggtgt

SEQ ID NO: 3056 - DNA, 24 bp, Human adenovirus C
tggaatcaggctgtagacagctat

SEQ ID NO: 3057 - DNA, 24 bp, Black beetle virus
tggcaagaaggtagtgtcaccaat

SEQ ID NO: 3058 - DNA, 24 bp, Black beetle virus
tgagatcgccgacggtgtttgtga

SEQ ID NO: 3059 - DNA, 24 bp, Human enterovirus C
tgaggtacaaagatctgaagattg

SEQ ID NO: 3060 - DNA, 24 bp, Human enterovirus C
gtgcatccagtgatgccaatgaaa

SEQ ID NO: 3061 - DNA, 21 bp, Avian infectious bronchitis virus
tcaccgaaaccttctgtgttt

SEQ ID NO: 3062 - DNA, 24 bp, Avian infectious bronchitis virus
ttaaagcttatgcaaccactgttt

SEQ ID NO: 3063 - DNA, 24 bp, Avian infectious bronchitis virus
tttacagccgatgatgttgaggac

SEQ ID NO: 3064 - DNA, 24 bp, Avian infectious bronchitis virus
tgtctagtataatatctgtagata

SEQ ID NO: 3065 - DNA, 24 bp, Avian infectious bronchitis virus
ttcaccccatgtatgatgtaaact

SEQ ID NO: 3066 - DNA, 24 bp, Avian infectious bronchitis virus
tgaaatttttgaccccactgaaat

SEQ ID NO: 3067 - DNA, 21 bp, Avian infectious bronchitis virus
aactctggctataacttttgt

SEQ ID NO: 3068 - DNA, 24 bp, Avian infectious bronchitis virus
tcttcatttactgaaaagtctttt

SEQ ID NO: 3069 - DNA, 24 bp, Avian infectious bronchitis virus
ttaatgctgtatcagtttgtgaag

SEQ ID NO: 3070 - DNA, 24 bp, Avian infectious bronchitis virus
tacagttgtaggactctaccctgt

SEQ ID NO: 3071 - DNA, 24 bp, Avian infectious bronchitis virus
tgctatatctaatgttgttgtctt

SEQ ID NO: 3072 - DNA, 24 bp, Avian infectious bronchitis virus
tattatgcgcaatatctgtgtaag

SEQ ID NO: 3073 - DNA, 24 bp, Avian infectious bronchitis virus
gcgcaaataatacggatgaagtaa

SEQ ID NO: 3074 - DNA, 24 bp, Avian infectious bronchitis virus
tctacacaagtaacccagtaatgt

SEQ ID NO: 3075 - DNA, 24 bp, Avian infectious bronchitis virus
tgagtgagtattgtgatgacatac

SEQ ID NO: 3076 - DNA, 24 bp, Avian infectious bronchitis virus
tgtgaccgactcagctgttagtta

SEQ ID NO: 3077 - DNA, 22 bp, Avian infectious bronchitis virus
taccgcaaaatgcacctaatgg

SEQ ID NO: 3078 - DNA, 24 bp, Avian infectious bronchitis virus
tgagtacatacaaacgcgtatgga

SEQ ID NO: 3079 - DNA, 21 bp, Avian infectious bronchitis virus
taactggtagattgtcatcac

SEQ ID NO: 3080 - DNA, 24 bp, Avian infectious bronchitis virus
cagagagcttaccgtatgcttgga

SEQ ID NO: 3081 - DNA, 24 bp, Avian infectious bronchitis virus
tgagggacttgtagatacttcaat

SEQ ID NO: 3082 - DNA, 24 bp, Avian infectious bronchitis virus
agagctaagcgtggtatactagtt

SEQ ID NO: 3083 - DNA, 24 bp, Avian infectious bronchitis virus
taagtggtgctaatatagcatggc

SEQ ID NO: 3084 - DNA, 24 bp, Avian infectious bronchitis virus
ttaaacctggtggcactagcagtg

SEQ ID NO: 3085 - DNA, 21 bp, Avian infectious bronchitis virus
taacaggcctaccatgtttga

SEQ ID NO: 3086 - DNA, 24 bp, Avian infectious bronchitis virus
tattgtagactatgtgtctgatgc

SEQ ID NO: 3087 - DNA, 24 bp, Eggplant mosaic virus
tgtcaatgccccccaccgccccca

SEQ ID NO: 3088 - DNA, 23 bp, Eggplant mosaic virus
tggaatcatgtcttctctcactg

SEQ ID NO: 3089 - DNA, 24 bp, Feline immunodeficiency virus
tggtggaatcaaatggcctattat

SEQ ID NO: 3090 - DNA, 24 bp, Feline immunodeficiency virus
tattgtacagacccattacaaatc

SEQ ID NO: 3091 - DNA, 24 bp, Feline immunodeficiency virus
tggaatcatggaaatataactttg

SEQ ID NO: 3092 - DNA, 24 bp, Feline immunodeficiency virus
aaaagtgggaagattgggtaggat

SEQ ID NO: 3093 - DNA, 24 bp, Hepatitis A virus
tgatatgttgaatgttaatttagc

SEQ ID NO: 3094 - DNA, 23 bp, Hepatitis A virus
tgattagagaagcaggtagaatc

SEQ ID NO: 3095 - DNA, 24 bp, Hepatitis A virus
gtaatgttgttattcaatctttgg

SEQ ID NO: 3096 - DNA, 24 bp, Hepatitis A virus
ttgagagtcatgaattatgcagat

SEQ ID NO: 3097 - DNA, 24 bp, Hepatitis A virus
tagcatcattgactgtttatcctc

SEQ ID NO: 3098 - DNA, 24 bp, Equine herpesvirus 1
tccgcgggcggcgatcgtaaatgt

SEQ ID NO: 3099 - DNA, 24 bp, Equine herpesvirus 1
cgcggtagcgactacaccgcagag

SEQ ID NO: 3100 - DNA, 24 bp, Equine herpesvirus 1
tgcctcgtgcgacgcggatgaatc

SEQ ID NO: 3101 - DNA, 23 bp, Equine herpesvirus 1
tggccggctctaggtatgagcgc

SEQ ID NO: 3102 - DNA, 24 bp, Equine herpesvirus 1
tgaggtggttagattgagggcacg

SEQ ID NO: 3103 - DNA, 24 bp, Equine herpesvirus 1
tacccgtttgtggaggagctggcg

SEQ ID NO: 3104 - DNA, 24 bp, Cryphonectria hypovirus 1
cttcacactctatgtgccgtacct

SEQ ID NO: 3105 - DNA, 24 bp, Cryphonectria hypovirus 1
tctgaccaacccggcaaggctcag

SEQ ID NO: 3106 - DNA, 24 bp, Cryphonectria hypovirus 1
taaggtgcgcatctaccaaggcat

SEQ ID NO: 3107 - DNA, 24 bp, Cryphonectria hypovirus 1
ttgaagcttcctgactcctatgtt

SEQ ID NO: 3108 - DNA, 24 bp, Cryphonectria hypovirus 1
tgtggaggcaagggtttgatgtta

SEQ ID NO: 3109 - DNA, 24 bp, Cryphonectria hypovirus 1
tgaggggttacaaagccgcgttca

SEQ ID NO: 3110 - DNA, 23 bp, Cryphonectria hypovirus 1
tgactctttgctgtcgacacctt

SEQ ID NO: 3111 - DNA, 24 bp, Cryphonectria hypovirus 1
gcagtctgattatgacaattatgg

SEQ ID NO: 3112 - DNA, 24 bp, Cryphonectria hypovirus 1
tgagatcagcatgcacccgaagaa

SEQ ID NO: 3113 - DNA, 24 bp, Cryphonectria hypovirus 1
tggcaactgggccaagttaataga

SEQ ID NO: 3114 - DNA, 24 bp, Cryphonectria hypovirus 1
taggatgaagatgcaggttataaa

SEQ ID NO: 3115 - DNA, 24 bp, Cryphonectria hypovirus 1
ttgaagcctggggagtatgaagtg

SEQ ID NO: 3116 - DNA, 24 bp, Cryphonectria hypovirus 1
tgagaacgagcctgacatcctcgt

SEQ ID NO: 3117 - DNA, 24 bp, Cryphonectria hypovirus 1
tgaggaacacgggcatccatgggc

SEQ ID NO: 3118 - DNA, 24 bp, Melon necrotic spot virus
tggcaggaggcgcacgatttatga

SEQ ID NO: 3119 - DNA, 24 bp, Melon necrotic spot virus
ttggttatcttggggttaggattg

SEQ ID NO: 3120 - DNA, 24 bp, Melon necrotic spot virus
gaggagctcgctgggttctgtact

SEQ ID NO: 3121 - DNA, 24 bp, O'nyong-nyong virus
tgagatcaaagagcaactactact

SEQ ID NO: 3122 - DNA, 24 bp, Igbo Ora virus
tagtgcaagcttttaaagaagata

SEQ ID NO: 3123 - DNA, 22 bp, O'nyong-nyong virus
tatcactaagatcccaggtaga

SEQ ID NO: 3124 - DNA, 23 bp, Pepper mottle virus
tggaaagagtatgttgaataagg

SEQ ID NO: 3125 - DNA, 24 bp, Pepper mottle virus
aagggtgttctcaacttggctcat

SEQ ID NO: 3126 - DNA, 22 bp, Pepper mottle virus
tagcacatggggttcactattt

SEQ ID NO: 3127 - DNA, 24 bp, Pepper mottle virus
tcagatccacggctttcgcaaatg

SEQ ID NO: 3128 - DNA, 24 bp, Pepper mottle virus
tgagcttcaggtcttacctcaagt

SEQ ID NO: 3129 - DNA, 24 bp, Pepper mottle virus
tgggttcgctttgcatttctttgc

SEQ ID NO: 3130 - DNA, 21 bp, Pepper mottle virus
ttggatgcttgaagtcttgaa

SEQ ID NO: 3131 - DNA, 24 bp, Human papillomavirus type 39
aacacatatttagatactgcattt

SEQ ID NO: 3132 - DNA, 24 bp, Human papillomavirus type 39
ttgctgacaaaattttacagtgga

SEQ ID NO: 3133 - DNA, 24 bp, canine parvovirus
tggctaactatacacatcattggg

SEQ ID NO: 3134 - DNA, 24 bp, canine parvovirus
tagaatgcacggatggaattggat

SEQ ID NO: 3135 - DNA, 24 bp, Rabies virus
ataatgcatttggaaggtatcttg

SEQ ID NO: 3136 - DNA, 24 bp, Rabies virus
taatgttcatgtggtgaagagagc

SEQ ID NO: 3137 - DNA, 24 bp, Rabies virus
tcacgctaggaaatagagggctga

SEQ ID NO: 3138 - DNA, 24 bp, Rabies virus
taacagacaattgctccaggtctt

SEQ ID NO: 3139 - DNA, 24 bp, Rabies virus
gtgcttagcaagcgacctagccag

SEQ ID NO: 3140 - DNA, 24 bp, Rabbit hemorrhagic disease virus
aagctgcgttcaacactctagacc

SEQ ID NO: 3141 - DNA, 24 bp, Rabbit hemorrhagic disease virus
cagtgcaagttactctgggagcaa

SEQ ID NO: 3142 - DNA, 24 bp, Rabbit hemorrhagic disease virus
tgcggaacccagacctcccgttag

SEQ ID NO: 3143 - DNA, 24 bp, Rabbit hemorrhagic disease virus
tggcgtatgacggttgcacacaga

SEQ ID NO: 3144 - DNA, 24 bp, Rabbit hemorrhagic disease virus
ttgctcaagaggctgtttgacaca

SEQ ID NO: 3145 - DNA, 24 bp, Sendai virus
tggcccatgcatcaactattataa

SEQ ID NO: 3146 - DNA, 24 bp, Sendai virus
tagggtaatgaatcaagagcctgg

SEQ ID NO: 3147 - DNA, 24 bp, Sendai virus
tggaatgaactacagaataattcg

SEQ ID NO: 3148 - DNA, 24 bp, Tomato bushy stunt virus
gtacattgttctcttggttgccag

SEQ ID NO: 3149 - DNA, 24 bp, Tomato bushy stunt virus
gatcacaaacttatcgacttgggt

SEQ ID NO: 3150 - DNA, 24 bp, Tomato bushy stunt virus
tggcaggacgtctggctctgtcac

SEQ ID NO: 3151 - DNA, 24 bp, Vaccinia virus
tggtatggaatcccgaggcaccta

SEQ ID NO: 3152 - DNA, 24 bp, Vaccinia virus
tgtaaacatttgggccattatacc

SEQ ID NO: 3153 - DNA, 24 bp, Vaccinia virus
gatgacaatattattatgaagact

SEQ ID NO: 3154 - DNA, 24 bp, Vaccinia virus
tctcctgcctattatatgttaaaa

SEQ ID NO: 3155 - DNA, 24 bp, Vaccinia virus
tgagatgtttgttagaagtcagtc

SEQ ID NO: 3156 - DNA, 22 bp, Human papillomavirus type 17
tacagcacagtatgaattttct

SEQ ID NO: 3157 - DNA, 24 bp, Human papillomavirus type 17
ttcgctgcaagttttgtttaaaga

SEQ ID NO: 3158 - DNA, 24 bp, Human papillomavirus type 40
tggagtggggtttggagacctggt

SEQ ID NO: 3159 - DNA, 24 bp, Human papillomavirus type 40
tggaatgagcctgatgcactttat

SEQ ID NO: 3160 - DNA, 23 bp, Human papillomavirus type 7
ttcatagtgatccactgtccagt

SEQ ID NO: 3161 - DNA, 24 bp, Cardamine chlorotic fleck virus
taccggagtttctcgcccacaagc

SEQ ID NO: 3162 - DNA, 24 bp, Cardamine chlorotic fleck virus
tgtgcaatttgtccgctaggggtg

SEQ ID NO: 3163 - DNA, 24 bp, Cardamine chlorotic fleck virus
tactatgataatctggcgttagaa

SEQ ID NO: 3164 - DNA, 24 bp, Borna disease virus
gtgagcccgttgaagacggagtta

SEQ ID NO: 3165 - DNA, 24 bp, Borna disease virus
caggttagagtcagtttgttatgc

SEQ ID NO: 3166 - DNA, 24 bp, Borna disease virus
tcacgggtgacggattctactgga

SEQ ID NO: 3167 - DNA, 24 bp, Variola virus
taagtgtactatagttgacagtat

SEQ ID NO: 3168 - DNA, 24 bp, Variola virus
tgatgaatattacaagattagaag

SEQ ID NO: 3169 - DNA, 21 bp, Camelpox virus
tcgcatgatttatatgattac

SEQ ID NO: 3170 - DNA, 24 bp, Ectromelia virus
cgaatgaaatatatacatctataa

SEQ ID NO: 3171 - DNA, 24 bp, Variola virus
tctcctgcctattatatgttaaaa

SEQ ID NO: 3172 - DNA, 24 bp, Variola virus
tagaacgctctttcgatgataatt

SEQ ID NO: 3173 - DNA, 24 bp, Variola virus
tgaatagcgagagtgagagtgata

SEQ ID NO: 3174 - DNA, 24 bp, Variola virus
aatgacgcggaacacatatctcag

SEQ ID NO: 3175 - DNA, 21 bp, Variola virus
ttatttggcaaagtcaaatga

SEQ ID NO: 3176 - DNA, 24 bp, Variola virus
tctcagaatccgctaatggaaacg

SEQ ID NO: 3177 - DNA, 24 bp, Autographa californica nucleopolyhedrovirus
tacagtagctttgcccacaaatag

SEQ ID NO: 3178 - DNA, 24 bp, Autographa californica nucleopolyhedrovirus
tttgcaagctcttcaacttgacga

SEQ ID NO: 3179 - DNA, 24 bp, Equine herpesvirus 2
tgccaagttgataggggacgtggt

SEQ ID NO: 3180 - DNA, 24 bp, Equine herpesvirus 2
tggcccagctccagatcaccgccg

SEQ ID NO: 3181 - DNA, 24 bp, African swine fever virus
tatcatggatgtattttacgagac

SEQ ID NO: 3182 - DNA, 24 bp, Human herpesvirus 6
tgggttagtgaaaaaggtggcatc

SEQ ID NO: 3183 - DNA, 24 bp, Tick-borne encephalitis virus
tgcgggagcaatacagcgaaacct

SEQ ID NO: 3184 - DNA, 24 bp, Tick-borne encephalitis virus
tcaccggggtgcggctggagtgtc

SEQ ID NO: 3185 - DNA, 24 bp, Tick-borne encephalitis virus
taacagaggcttcagcagtgggac

SEQ ID NO: 3186 - DNA, 21 bp, Tick-borne encephalitis virus
tgtgggaaacaggaaggctca

SEQ ID NO: 3187 - DNA, 24 bp, Tick-borne encephalitis virus
cagccttgggagcttggtcagatg

SEQ ID NO: 3188 - DNA, 24 bp, Hepatitis G virus
tgaggtacaggtggggtatgtctg

SEQ ID NO: 3189 - DNA, 24 bp, Hepatitis G virus
tgagcgacctcaagctccctggct

SEQ ID NO: 3190 - DNA, 24 bp, Hepatitis G virus
tcactgactcccccctgacgtatt

SEQ ID NO: 3191 - DNA, 24 bp, Hepatitis G virus
tggccagttctccgctaggggggt

SEQ ID NO: 3192 - DNA, 24 bp, Hepatitis G virus
ggagatcttggtgtcccggccctc

SEQ ID NO: 3193 - DNA, 24 bp, Hepatitis G virus
tgtcaaggagcgcctgttggaatg

SEQ ID NO: 3194 - DNA, 24 bp, Hepatitis G virus
tgatatcggagaagccgcggtgtt

SEQ ID NO: 3195 - DNA, 24 bp, Hepatitis G virus
cattgcggggaggggtggtccggg

SEQ ID NO: 3196 - DNA, 24 bp, Hepatitis G virus
agtggtcgcgactcgaagatagat

SEQ ID NO: 3197 - DNA, 24 bp, Hepatitis G virus
agggttacgtccgctgcgacgctg

SEQ ID NO: 3198 - DNA, 24 bp, Hepatitis G virus
ctgctcatcgtagccctcttcggg

SEQ ID NO: 3199 - DNA, 24 bp, Hepatitis G virus
tgctatggtggtgggtgaaccagc

SEQ ID NO: 3200 - DNA, 22 bp, Hepatitis G virus
tattgcagatcctcgggtgtcc

SEQ ID NO: 3201 - DNA, 24 bp, Hepatitis G virus
tgggatcctgggcctgggtgaggt

SEQ ID NO: 3202 - DNA, 24 bp, Hepatitis G virus
tcggtgcggcgtggggcctcggct

SEQ ID NO: 3203 - DNA, 23 bp, Hepatitis G virus
ccggatcccctatgacgcagcac

SEQ ID NO: 3204 - DNA, 24 bp, Hepatitis G virus
tccacagagcgacgcgaccaggaa

SEQ ID NO: 3205 - DNA, 24 bp, Hepatitis G virus
tgcaaagacgaggacgcacgggta

SEQ ID NO: 3206 - DNA, 24 bp, Hepatitis G virus
tcatcggcgtcttccaggatgtga

SEQ ID NO: 3207 - DNA, 24 bp, Human herpesvirus 7
tcaggaaaaacggtgttgtaataa

SEQ ID NO: 3208 - DNA, 24 bp, Human herpesvirus 7
atcacaaatatttttcaacagcaa

SEQ ID NO: 3209 - DNA, 24 bp, Human herpesvirus 7
tggaatgagtactgaagaaagtga

SEQ ID NO: 3210 - DNA, 22 bp, Strawberry vein banding virus (SVBV)
tatgttgatgacatcatcgtct

SEQ ID NO: 3211 - DNA, 24 bp, Strawberry vein banding virus (SVBV)
tttggcaggtacgccttgctccag

SEQ ID NO: 3212 - DNA, 24 bp, Carrot mottle mimic virus
tatgacaatcttaagagaccaggt

SEQ ID NO: 3213 - DNA, 24 bp, Carrot mottle mimic virus
agtgtttggcagtttttaccgttg

SEQ ID NO: 3214 - DNA, 24 bp, Molluscum contagiosum virus
tgacaagcgagtgctgcaatgtcc

SEQ ID NO: 3215 - DNA, 24 bp, Molluscum contagiosum virus
agcgggtgctcttgtcccgcggag

SEQ ID NO: 3216 - DNA, 24 bp, Molluscum contagiosum virus
tacgtcttcctggactttcgcaac

SEQ ID NO: 3217 - DNA, 23 bp, Saguaro cactus virus
tatcgcagaggaaccagtctatg

SEQ ID NO: 3218 - DNA, 24 bp, Saguaro cactus virus
tgagatttccgatgctgccagatt

SEQ ID NO: 3219 - DNA, 24 bp, Saguaro cactus virus
tatcacaatgctcgcttatctctt

SEQ ID NO: 3220 - DNA, 24 bp, Papaya ringspot virus
tgaaaggagttagctccgctccta

SEQ ID NO: 3221 - DNA, 24 bp, Papaya ringspot virus
tcaccagtctttagatgacattcg

SEQ ID NO: 3222 - DNA, 24 bp, Cucumber green mottle mosaic virus
ttaaatctgccgtagaaggactag

SEQ ID NO: 3223 - DNA, 24 bp, Cucumber green mottle mosaic virus
tggcaagtgacgataccactcgca

SEQ ID NO: 3224 - DNA, 24 bp, Cucumber green mottle mosaic virus
ttggttccacgctgggtaatctgg

SEQ ID NO: 3225 - DNA, 24 bp, Cucumber green mottle mosaic virus
tggggtaacagtaacgggtctggg

SEQ ID NO: 3226 - DNA, 24 bp, Cucumber green mottle mosaic virus
tactgcaagatttccaagccggga

SEQ ID NO: 3227 - DNA, 24 bp, Galinsoga mosaic virus
tggcagggtggggttgtacttcga

SEQ ID NO: 3228 - DNA, 24 bp, Galinsoga mosaic virus
gcactggcaccagtactactctta

SEQ ID NO: 3229 - DNA, 24 bp, Lymphocystis disease virus 1
tgaagtaaaatggttgttcctgaa

SEQ ID NO: 3230 - DNA, 24 bp, Lymphocystis disease virus 1
ttacaagatgagcaatttctacag

SEQ ID NO: 3231 - DNA, 24 bp, Lymphocystis disease virus 1
tagtacaacgtttaagcttaaaca

SEQ ID NO: 3232 - DNA, 24 bp, Lymphocystis disease virus 1
ttaaaaacaattgcgcgatttaac

SEQ ID NO: 3233 - DNA, 24 bp, Lymphocystis disease virus 1
ataacgttcgatgtttaatctaca

SEQ ID NO: 3234 - DNA, 22 bp, murid herpesvirus 4
tgagataaatccagattcaatt

SEQ ID NO: 3235 - DNA, 24 bp, murid herpesvirus 4
tggcatatactcacaagcttggtt

SEQ ID NO: 3236 - DNA, 24 bp, murid herpesvirus 4
taacacactgcgatgttagccctt

SEQ ID NO: 3237 - DNA, 24 bp, murid herpesvirus 4
ttcgttgtgccttttctaagattg

SEQ ID NO: 3238 - DNA, 24 bp, murid herpesvirus 4
tggatagatatggaggtctgcttg

SEQ ID NO: 3239 - DNA, 24 bp, murid herpesvirus 4
tgatgtacaccacctctaagctca

SEQ ID NO: 3240 - DNA, 24 bp, murid herpesvirus 4
tagctgacaggtgcctgagtacag

SEQ ID NO: 3241 - DNA, 24 bp, Common chimpanzee papillomavirus 1
tatcacagactaagggacatgagg

SEQ ID NO: 3242 - DNA, 24 bp, Equine herpesvirus 4
tggaatgtgtgatgagcgatcaaa

SEQ ID NO: 3243 - DNA, 24 bp, Murine hepatitis virus
agaggcagtcatagctatggccgt

SEQ ID NO: 3244 - DNA, 24 bp, Turnip vein-clearing virus
agagatcttgccgaaggctctaac

SEQ ID NO: 3245 - DNA, 24 bp, Orgyia pseudotsugata single capsid nuclear polyhedrosis virus
tggcgagcactttaaccccacccg

SEQ ID NO: 3246 - DNA, 24 bp, Hendra virus
tgaggtattggataggggtgataa

SEQ ID NO: 3247 - DNA, 24 bp, Ateline herpesvirus 3
tagcatacggtatcgaagttacat

SEQ ID NO: 3248 - DNA, 24 bp, Ateline herpesvirus 3
tagctttgcggggccgcttctgtt

SEQ ID NO: 3249 - DNA, 23 bp, Ateline herpesvirus 3
taaaacaaaacagcgatcacagc

SEQ ID NO: 3250 - DNA, 24 bp, Bovine respiratory syncytial virus
tatcatatgggtggtatagaaggt

SEQ ID NO: 3251 - DNA, 24 bp, Bovine respiratory syncytial virus
tacaatggccatataagtatagat

SEQ ID NO: 3252 - DNA, 24 bp, Bovine respiratory syncytial virus
tcatatattaaattttcgatctct

SEQ ID NO: 3253 - DNA, 24 bp, Melanoplus sanguinipes entomopoxvirus
tgtaatggtgataatacaaaatct

SEQ ID NO: 3254 - DNA, 24 bp, Melanoplus sanguinipes entomopoxvirus
tatcacaatatcaagaattatcag

SEQ ID NO: 3255 - DNA, 24 bp, infectious spleen and kidney necrosis virus
tataacatgacattttttggctgg

SEQ ID NO: 3256 - DNA, 24 bp, Melanoplus sanguinipes entomopoxvirus
taaattagatgattcatttccatt

SEQ ID NO: 3257 - DNA, 24 bp, Peanut stunt virus
tacatcagaatgttatttcgaatc

SEQ ID NO: 3258 - DNA, 24 bp, Peanut stunt virus
tagctatgaggtgttacaatgata

SEQ ID NO: 3259 - DNA, 24 bp, tomato leaf curl virus
tggatggacgagaacatcaagctc

SEQ ID NO: 3260 - DNA, 24 bp, Leishmania RNA virus 1-1
ctgcattggttcatctttctgatc

SEQ ID NO: 3261 - DNA, 24 bp, Leishmania RNA virus 2-1
tcagtccttcaagtatgcgcgtca

SEQ ID NO: 3262 - DNA, 24 bp, Leishmania RNA virus 2-1
tgtgtgctcgagcagtggcggaat

SEQ ID NO: 3263 - DNA, 24 bp, Human adenovirus D
ccaccgggataagaccggagacac

SEQ ID NO: 3264 - DNA, 24 bp, Bovine parainfluenza virus 3
tgtcaagatatagggaaatcttac

SEQ ID NO: 3265 - DNA, 23 bp, Spodoptera exigua nucleopolyhedrovirus
tcacccgaccatttgctccacat

SEQ ID NO: 3266 - DNA, 23 bp, Spodoptera exigua nucleopolyhedrovirus
taagatcgacaacgtgatgagtc

SEQ ID NO: 3267 - DNA, 23 bp, Spodoptera exigua nucleopolyhedrovirus
ccaccggcaactcgggcggtcgc

SEQ ID NO: 3268 - DNA, 24 bp, Spodoptera exigua nucleopolyhedrovirus
tgatgtgcgtcgacgccgaaccgt

SEQ ID NO: 3269 - DNA, 22 bp, Spodoptera exigua nucleopolyhedrovirus
tgcaaagttcgagtgaaaaaga

SEQ ID NO: 3270 - DNA, 24 bp, Fowlpox virus
tatcatgctgtagaacaagaaaac

SEQ ID NO: 3271 - DNA, 24 bp, Fowlpox virus
tattacacactttagcagcgtgtt

SEQ ID NO: 3272 - DNA, 24 bp, Fowlpox virus
ttggttaatatctatgtcaagcgg

SEQ ID NO: 3273 - DNA, 23 bp, Fowlpox virus
tgaaacaataagcgataaattat

SEQ ID NO: 3274 - DNA, 24 bp, Fowlpox virus
ttagttgtaggagatgttagtttt

SEQ ID NO: 3275 - DNA, 24 bp, Fowlpox virus
aacacatattaatatcattcgata

SEQ ID NO: 3276 - DNA, 24 bp, Fowlpox virus
taaagtagattacagactacctaa

SEQ ID NO: 3277 - DNA, 24 bp, Fowlpox virus
aacagtaaacaccggcagttattt

SEQ ID NO: 3278 - DNA, 24 bp, Fowlpox virus
tgaagtattacttactaagtacaa

SEQ ID NO: 3279 - DNA, 24 bp, Fowlpox virus
taagttacgcggcttatatcaagc

SEQ ID NO: 3280 - DNA, 24 bp, Fowlpox virus
ttattggaaatttctccattaagg

SEQ ID NO: 3281 - DNA, 24 bp, Fowlpox virus
tatttcatcctgtgaaaatcgtgt

SEQ ID NO: 3282 - DNA, 22 bp, Fowlpox virus
ttcaaggacattctaaattttg

SEQ ID NO: 3283 - DNA, 24 bp, Fowlpox virus
tgccttggcggtctaggaaatgtg

SEQ ID NO: 3284 - DNA, 24 bp, Fowlpox virus
tgatgtatgaattcgacatgaata

SEQ ID NO: 3285 - DNA, 24 bp, Fowlpox virus
tgagagctaacatgctaatatata

SEQ ID NO: 3286 - DNA, 23 bp, Fowlpox virus
tacccgttttaaaagtaaagaac

SEQ ID NO: 3287 - DNA, 24 bp, Fowlpox virus
tgactgaatggtctcctactcttc

SEQ ID NO: 3288 - DNA, 24 bp, Fowlpox virus
taagtgctttaaagcgcgctacat

SEQ ID NO: 3289 - DNA, 24 bp, Fowlpox virus
aagagtactaccctatttcttacc

SEQ ID NO: 3290 - DNA, 24 bp, Fowlpox virus
taggttacggaaataaaaaccctc

SEQ ID NO: 3291 - DNA, 24 bp, Fowlpox virus
taggtaagatgatatacaacgtag

SEQ ID NO: 3292 - DNA, 24 bp, Fowlpox virus
tatcataactacatatttcctaca

SEQ ID NO: 3293 - DNA, 24 bp, Fowlpox virus
tgttatgccatgtatctaggatat

SEQ ID NO: 3294 - DNA, 24 bp, Fowlpox virus
tgttaacagctatcaaaataggat

SEQ ID NO: 3295 - DNA, 24 bp, Fowlpox virus
ataggtatgtattctcctaataca

SEQ ID NO: 3296 - DNA, 24 bp, Gallid herpesvirus 2
tggccagggtatatataactccgt

SEQ ID NO: 3297 - DNA, 24 bp, Gallid herpesvirus 2
tgaggtttcaatttcctactcgaa

SEQ ID NO: 3298 - DNA, 24 bp, Gallid herpesvirus 2
taaggtagcagaaaatgtttttgt

SEQ ID NO: 3299 - DNA, 24 bp, Gallid herpesvirus 2
tatgtgacgaacatatgaagcatg

SEQ ID NO: 3300 - DNA, 21 bp, Gallid herpesvirus 2
tggaatgtgcagcccatcgca

SEQ ID NO: 3301 - DNA, 24 bp, Gallid herpesvirus 2
taactgctgcgatagtttgggtat

SEQ ID NO: 3302 - DNA, 24 bp, Gallid herpesvirus 2
tacggtagatcaaatgcttagaat

SEQ ID NO: 3303 - DNA, 24 bp, Gallid herpesvirus 2
gtgcagttttctcttacacaaccc

SEQ ID NO: 3304 - DNA, 24 bp, Gallid herpesvirus 2
tgggccaaaggcgaatgtaatcct

SEQ ID NO: 3305 - DNA, 24 bp, Northern cereal mosaic virus
tggcagacggatcttacaacccca

SEQ ID NO: 3306 - DNA, 21 bp, Northern cereal mosaic virus
tactctgaatcaatctcttca

SEQ ID NO: 3307 - DNA, 24 bp, Northern cereal mosaic virus
tgagatagctgaattgattcaatg

SEQ ID NO: 3308 - DNA, 24 bp, Transmissible gastroenteritis virus
ttagtgctaaattgattggtgttg

SEQ ID NO: 3309 - DNA, 24 bp, Transmissible gastroenteritis virus
tttcatgtgttcataacacttata

SEQ ID NO: 3310 - DNA, 24 bp, Transmissible gastroenteritis virus
tgcctaaagttaaagtcaaaccac

SEQ ID NO: 3311 - DNA, 24 bp, Transmissible gastroenteritis virus
tttcattgtgcataagcagactga

SEQ ID NO: 3312 - DNA, 24 bp, Transmissible gastroenteritis virus
tgagaatactaacactatgttttt

SEQ ID NO: 3313 - DNA, 22 bp, Transmissible gastroenteritis virus
tgtaatgccatctgcttttgta

SEQ ID NO: 3314 - DNA, 24 bp, Transmissible gastroenteritis virus
tattatacctattgaacttgaagc

SEQ ID NO: 3315 - DNA, 24 bp, Transmissible gastroenteritis virus
tgaaatgtctagtgtgagacttca

SEQ ID NO: 3316 - DNA, 24 bp, Transmissible gastroenteritis virus
ttaatgctgctaatggtgatctta

SEQ ID NO: 3317 - DNA, 24 bp, Transmissible gastroenteritis virus
acggtgctgtacaggcatataaaa

SEQ ID NO: 3318 - DNA, 24 bp, Rice grassy stunt virus
tgacatagatctacctagcatgat

SEQ ID NO: 3319 - DNA, 24 bp, Rice grassy stunt virus
aagctaaatactgtaggagagaca

SEQ ID NO: 3320 - DNA, 24 bp, Rice grassy stunt virus
tgtaaaaagtggtttgccagtgac

SEQ ID NO: 3321 - DNA, 24 bp, Rice grassy stunt virus
tgatatcattctcaactaaatcta

SEQ ID NO: 3322 - DNA, 24 bp, Xestia c-nigrum granulovirus
tatagtgtgcacgtataacgtctg

SEQ ID NO: 3323 - DNA, 24 bp, Xestia c-nigrum granulovirus
tgatatggcgcctggtaccacgct

SEQ ID NO: 3324 - DNA, 24 bp, Xestia c-nigrum granulovirus
tgtcacgttcgtgcgattctactt

SEQ ID NO: 3325 - DNA, 24 bp, Xestia c-nigrum granulovirus
tacgaagatttttacacgttgggt

SEQ ID NO: 3326 - DNA, 24 bp, Xestia c-nigrum granulovirus
aatggtggcgggtgtaaaagcggg

SEQ ID NO: 3327 - DNA, 24 bp, Xestia c-nigrum granulovirus
tacactgtaaaacaatgtgtcaag

SEQ ID NO: 3328 - DNA, 24 bp, Xestia c-nigrum granulovirus
agagttaatttttagagataaatt

SEQ ID NO: 3329 - DNA, 24 bp, rabbit oral papillomavirus
ggaggtaccgatacccagacatat

SEQ ID NO: 3330 - DNA, 24 bp, Hepatitis GB virus C
tagccgtccaccgcaagaaggccg

SEQ ID NO: 3331 - DNA, 24 bp, Hepatitis GB virus C
ttggggacggctacctcgcgcagc

SEQ ID NO: 3332 - DNA, 24 bp, Hepatitis GB virus C
tacgggcccttgtcggtctcggct

SEQ ID NO: 3333 - DNA, 24 bp, Hepatitis GB virus C
tgaggtccaggtggggtacgtctg

SEQ ID NO: 3334 - DNA, 24 bp, Hepatitis GB virus C
tggcacctgtgtgagggactgctg

SEQ ID NO: 3335 - DNA, 22 bp, Hepatitis GB virus C
tgatttgccatcaaaagtggcc

SEQ ID NO: 3336 - DNA, 24 bp, Hepatitis GB virus C
caaagtgttaccattgatggggag

SEQ ID NO: 3337 - DNA, 24 bp, Hepatitis GB virus C
tcagaggtattgggtggggcgggc

SEQ ID NO: 3338 - DNA, 24 bp, Hepatitis GB virus C
tcggatcgcgacacagtggttgag

SEQ ID NO: 3339 - DNA, 24 bp, Hepatitis GB virus C
tgaggtcctgattggggtctttca

SEQ ID NO: 3340 - DNA, 24 bp, Hepatitis GB virus C
gaccgtggctgacgtggctagcct

SEQ ID NO: 3341 - DNA, 24 bp, Hepatitis GB virus C
tgaggactggtcgccaccttgtat

SEQ ID NO: 3342 - DNA, 24 bp, Ovine astrovirus
catgacatactctgtggccactcg

SEQ ID NO: 3343 - DNA, 24 bp, Ovine astrovirus
tggggtgcccaagaagacatggca

SEQ ID NO: 3344 - DNA, 24 bp, Turkey astrovirus
taaggtatcacatgcagctatttt

SEQ ID NO: 3345 - DNA, 24 bp, Turkey astrovirus
aaaagtgagtcaacacaagtgaaa

SEQ ID NO: 3346 - DNA, 24 bp, Cherry mottle leaf virus
tttaacaggcttgtaacttcaagg

SEQ ID NO: 3347 - DNA, 24 bp, Cherry mottle leaf virus
ttggttgctagcatgatagagaaa

SEQ ID NO: 3348 - DNA, 24 bp, Frog adenovirus 1
ttaaagctgtaacagaattttatt

SEQ ID NO: 3349 - DNA, 24 bp, Turnip mosaic virus
aagcacacgagtgggtcaagcact

SEQ ID NO: 3350 - DNA, 24 bp, Turnip mosaic virus
taatgtaacggtaaagcaggcacg

SEQ ID NO: 3351 - DNA, 24 bp, Turnip mosaic virus
ctaggactccaatacgtgcgagag

SEQ ID NO: 3352 - DNA, 24 bp, Rat cytomegalovirus
tgcgatcctgccgccgccgaagat

SEQ ID NO: 3353 - DNA, 24 bp, Rat cytomegalovirus
tggcggacaacggcctgttcacgc

SEQ ID NO: 3354 - DNA, 23 bp, Rat cytomegalovirus
ggagatcgacgcgtgggtccgcc

SEQ ID NO: 3355 - DNA, 24 bp, Parvovirus H1
tcactctggtcggttactcactct

SEQ ID NO: 3356 - DNA, 24 bp, Parvovirus H1
tcactagcgtttcacatggttggt

SEQ ID NO: 3357 - DNA, 24 bp, Lactate dehydrogenase-elevating virus
tggcttgttgctgagcggtactga

SEQ ID NO: 3358 - DNA, 24 bp, acute bee paralysis virus
ttagtgaatggttcaacatggaaa

SEQ ID NO: 3359 - DNA, 22 bp, acute bee paralysis virus
caccgggtttcccatggatacg

SEQ ID NO: 3360 - DNA, 24 bp, acute bee paralysis virus
tgagagaagaccaattgaaaaagt

SEQ ID NO: 3361 - DNA, 24 bp, Saimiriine herpesvirus 2
aaaagtttaagtaagatacttatt

SEQ ID NO: 3362 - DNA, 24 bp, Meleagrid herpesvirus 1
tggcaagcatagataagtatttgc

SEQ ID NO: 3363 - DNA, 24 bp, Meleagrid herpesvirus 1
gatcacagaatgtggtaaacgagt

SEQ ID NO: 3364 - DNA, 24 bp, Meleagrid herpesvirus 1
tgggatgcaggtgccaatcagttt

SEQ ID NO: 3365 - DNA, 24 bp, Meleagrid herpesvirus 1
tgaaggaagcaatagcagatatta

SEQ ID NO: 3366 - DNA, 24 bp, Meleagrid herpesvirus 1
tgaccagattactttcttccctgt

SEQ ID NO: 3367 - DNA, 22 bp, Meleagrid herpesvirus 1
gagaatggtgcacagactgtta

SEQ ID NO: 3368 - DNA, 24 bp, Meleagrid herpesvirus 1
tgaaataaaatcggaatttgatgc

SEQ ID NO: 3369 - DNA, 24 bp, Meleagrid herpesvirus 1
tagtttgttggaggaggccagtat

SEQ ID NO: 3370 - DNA, 24 bp, Meleagrid herpesvirus 1
tgatatgaggctcaaagtggtaac

SEQ ID NO: 3371 - DNA, 24 bp, Meleagrid herpesvirus 1
tcgataatagcgaaatggatatgg

SEQ ID NO: 3372 - DNA, 21 bp, Heliothis zea virus 1 (HZV-1)
tacccgttattttacaagtgt

SEQ ID NO: 3373 - DNA, 24 bp, Vaccinia virus
tgaagtaattaatttttctgcctc

SEQ ID NO: 3374 - DNA, 22 bp, Rachiplusia ou multiple nucleopolyhedrovirus
tgagataagattaaaagcacgt

SEQ ID NO: 3375 - DNA, 24 bp, Rachiplusia ou multiple nucleopolyhedrovirus
atgacatcatttatataatgacat

SEQ ID NO: 3376 - DNA, 22 bp, Rachiplusia ou multiple nucleopolyhedrovirus
atgacatagcctatgagtcata

SEQ ID NO: 3377 - DNA, 24 bp, Yaba-like disease virus
taacgtaatagaaatactatctgt

SEQ ID NO: 3378 - DNA, 24 bp, Fowlpox virus
tatgatatatctactataattagt

SEQ ID NO: 3379 - DNA, 24 bp, Fowlpox virus
tattttgctaactatgtagtacaa

SEQ ID NO: 3380 - DNA, 24 bp, Yaba-like disease virus
tataatgatagtgcttttttttgg

SEQ ID NO: 3381 - DNA, 24 bp, Yaba-like disease virus
atcagatgttgctgtttatgatat

SEQ ID NO: 3382 - DNA, 24 bp, Yaba-like disease virus
tgggatgttttaacttggatatct

SEQ ID NO: 3383 - DNA, 24 bp, Yaba-like disease virus
tatgtcaaaattacgacattttac

SEQ ID NO: 3384 - DNA, 24 bp, Human coronavirus 229E
gattacggttctgatacggttact

SEQ ID NO: 3385 - DNA, 24 bp, Human coronavirus 229E
tatgctactttgtgcaatttctaa

SEQ ID NO: 3386 - DNA, 24 bp, Human coronavirus 229E
aaaggcaagtgggtacaagtgcct

SEQ ID NO: 3387 - DNA, 24 bp, Human coronavirus 229E
ttcacagaacataaggaggttttg

SEQ ID NO: 3388 - DNA, 24 bp, Human coronavirus 229E
taaggaagaatttgttgttaaaga

SEQ ID NO: 3389 - DNA, 24 bp, Human coronavirus 229E
ttactagagcaaagaaaggtattt

SEQ ID NO: 3390 - DNA, 24 bp, Human coronavirus 229E
taagtctatttgcaattcagctgt

SEQ ID NO: 3391 - DNA, 24 bp, Human coronavirus 229E
tggccgatgttgatgatcctaaat

SEQ ID NO: 3392 - DNA, 24 bp, Human coronavirus 229E
tgtacacacctccgactgtcagtt

SEQ ID NO: 3393 - DNA, 24 bp, Human coronavirus 229E
tttggtaaagatcttaatgctaat

SEQ ID NO: 3394 - DNA, 23 bp, Human coronavirus 229E
tacgtctgagtaaaatgggcatc

SEQ ID NO: 3395 - DNA, 24 bp, Human coronavirus 229E
agaggatgtttgtacttgttacga

SEQ ID NO: 3396 - DNA, 24 bp, Human coronavirus 229E
ttaatactgtcgctggcattccat

SEQ ID NO: 3397 - DNA, 24 bp, Human coronavirus 229E
tactatgactacaagacagtttca

SEQ ID NO: 3398 - DNA, 24 bp, Human coronavirus 229E
taacattaattgcgttttgagcgt

SEQ ID NO: 3399 - DNA, 24 bp, Human coronavirus 229E
tttggcgttacaactttgatataa

SEQ ID NO: 3400 - DNA, 24 bp, Human coronavirus 229E
tggaatgcttaatggtaatgcaat

SEQ ID NO: 3401 - DNA, 24 bp, Human coronavirus 229E
tcgaacagcttgaaccgtgtgctc

SEQ ID NO: 3402 - DNA, 24 bp, Human coronavirus 229E
tattggacaagctcgcgtagcata

SEQ ID NO: 3403 - DNA, 24 bp, Human coronavirus 229E
taatatgcaacctttcattgtcat

SEQ ID NO: 3404 - DNA, 24 bp, Human coronavirus 229E
tattaaggattgtgttgacataaa

SEQ ID NO: 3405 - DNA, 24 bp, Human coronavirus 229E
gttcatttattaatggtgcgtgtg

SEQ ID NO: 3406 - DNA, 24 bp, Human coronavirus 229E
catgccaattgcagaccctacaca

SEQ ID NO: 3407 - DNA, 24 bp, Human coronavirus 229E
tatgatgcctgttatgggtatgac

SEQ ID NO: 3408 - DNA, 24 bp, Human coronavirus 229E
ttaatgacaaaattactgaattcc

SEQ ID NO: 3409 - DNA, 24 bp, Human coronavirus 229E
tgacttgtctgtgattaaccagcg

SEQ ID NO: 3410 - DNA, 24 bp, Human coronavirus 229E
tgaagtaaaagacattgaacctgt

SEQ ID NO: 3411 - DNA, 23 bp, Human coronavirus 229E
ttaatggtattagagtgttaaaa

SEQ ID NO: 3412 - DNA, 24 bp, Human coronavirus 229E
ttaatggctatcgctatttcactt

SEQ ID NO: 3413 - DNA, 24 bp, Human coronavirus 229E
ttgcattgcagactgatgttttac

SEQ ID NO: 3414 - DNA, 24 bp, Human coronavirus 229E
agatgttagtgagatgctcacttt

SEQ ID NO: 3415 - DNA, 22 bp, Human coronavirus 229E
acacgggaaattgccctttttc

SEQ ID NO: 3416 - DNA, 24 bp, Human coronavirus 229E
atcacatctcgcataatgtttgaa

SEQ ID NO: 3417 - DNA, 24 bp, Human coronavirus 229E
taagacgctgcaagaattaagtta

SEQ ID NO: 3418 - DNA, 21 bp, Invertebrate iridescent virus 6
tataacaaataatctccggcc

SEQ ID NO: 3419 - DNA, 23 bp, Potato virus V
tgaggtaaactcattgatttcaa

SEQ ID NO: 3420 - DNA, 24 bp, Helicoverpa armigera nuclear polyhedrosis virus
tcagcggcaatacagtgaatgttg

SEQ ID NO: 3421 - DNA, 24 bp, pestivirus type 2
ggagggaccaacttcatctcaaga

SEQ ID NO: 3422 - DNA, 24 bp, pestivirus type 2
tgagggatttaaccagggtctgga

SEQ ID NO: 3423 - DNA, 24 bp, pestivirus type 2
tgcccgttcgatacgagtcctgtt

SEQ ID NO: 3424 - DNA, 24 bp, Bovine herpesvirus 4
actccatcaagaaacatcagcaga

SEQ ID NO: 3425 - DNA, 24 bp, Bovine herpesvirus 4
tagcatgagaactgaaaataaatc

SEQ ID NO: 3426 - DNA, 24 bp, Cercopithecine herpesvirus 7
ttacccgacttgtcgtctgaaatt

SEQ ID NO: 3427 - DNA, 24 bp, Cercopithecine herpesvirus 7
ttggtcctgcgtccggagtttcct

SEQ ID NO: 3428 - DNA, 24 bp, Cercopithecine herpesvirus 7
tggcagattttgtcggacttagat

SEQ ID NO: 3429 - DNA, 24 bp, Cercopithecine herpesvirus 7
atgcattgtattcgttaagagtta

SEQ ID NO: 3430 - DNA, 24 bp, Ectocarpus siliculosus virus
gtgcgcaacggagccgagtgtacg

SEQ ID NO: 3431 - DNA, 24 bp, Ectocarpus siliculosus virus
tggagtacattctccgtccggtgg

SEQ ID NO: 3432 - DNA, 24 bp, Tomato mosaic virus
tgaggaaatgtacaatgcactgtc

SEQ ID NO: 3433 - DNA, 24 bp, Tomato mosaic virus
tgtcactttccatgataggttagt

SEQ ID NO: 3434 - DNA, 24 bp, Tomato mosaic virus
tgcgggaagacaaaggaaattctt

SEQ ID NO: 3435 - DNA, 24 bp, Tomato mosaic virus
tagaacgggttagtagttacttat

SEQ ID NO: 3436 - DNA, 24 bp, Tomato mosaic virus
taaaaggagccttctgcggagatg

SEQ ID NO: 3437 - DNA, 22 bp, Tomato mosaic virus
tagaacgggttagtagttactt

SEQ ID NO: 3438 - DNA, 24 bp, Aconitum latent virus
ataaagctcaaaccggcgtattgc

SEQ ID NO: 3439 - DNA, 24 bp, Aconitum latent virus
tacaatgcttcgggtacgcttcgg

SEQ ID NO: 3440 - DNA, 24 bp, Cydia pomonella granulovirus
tatgatgattaagcggagcggtca

SEQ ID NO: 3441 - DNA, 24 bp, Cydia pomonella granulovirus
tgaggcagcagtgtaatgtgtggt

SEQ ID NO: 3442 - DNA, 24 bp, Cydia pomonella granulovirus
aaaagtggtttgagtacatggtga

SEQ ID NO: 3443 - DNA, 24 bp, Cydia pomonella granulovirus
tattggttgacggatatgacaggg

SEQ ID NO: 3444 - DNA, 24 bp, Barley yellow mosaic virus
taacaactcagttgcactcgaatc

SEQ ID NO: 3445 - DNA, 24 bp, Barley yellow mosaic virus
ttcaacatgaactgttacttctac

SEQ ID NO: 3446 - DNA, 24 bp, Barley yellow mosaic virus
gtacatactttggcgaacatgttg

SEQ ID NO: 3447 - DNA, 24 bp, Barley yellow mosaic virus
agagggatatggatgaagccgttg

SEQ ID NO: 3448 - DNA, 24 bp, Barley yellow mosaic virus
aagcagctaggaaatatcctttac

SEQ ID NO: 3449 - DNA, 24 bp, Barley yellow mosaic virus
ctgacaaactgcgctcttttctcg

SEQ ID NO: 3450 - DNA, 24 bp, Taura syndrome virus
tattgtaatatgtgaaatgggaaa

SEQ ID NO: 3451 - DNA, 24 bp, Taura syndrome virus
tgacgtaaagcgaattttgaatgc

SEQ ID NO: 3452 - DNA, 24 bp, Taura syndrome virus
caggcgcgtatgtccccaagtcta

SEQ ID NO: 3453 - DNA, 24 bp, Taura syndrome virus
atgtagcctattagttgttgctga

SEQ ID NO: 3454 - DNA, 21 bp, Invertebrate iridescent virus 6
tatcaaaagacggaactagac

SEQ ID NO: 3455 - DNA, 24 bp, Bovine coronavirus
tgcgaacaagacttgtgtgatttt

SEQ ID NO: 3456 - DNA, 24 bp, Bovine coronavirus
tgcaatgctctgcaacagatatac

SEQ ID NO: 3457 - DNA, 24 bp, Bovine coronavirus
tgacactactgttcagtcaaaaga

SEQ ID NO: 3458 - DNA, 24 bp, Bovine coronavirus
tagtttattttggaggttgtgtgt

SEQ ID NO: 3459 - DNA, 24 bp, Bovine coronavirus
ttcatgctttggtgtaacgatgag

SEQ ID NO: 3460 - DNA, 24 bp, Bovine coronavirus
aacccggtaatgtcggtggtaatg

SEQ ID NO: 3461 - DNA, 24 bp, Bovine coronavirus
tattgctggtgctatacttgctgt

SEQ ID NO: 3462 - DNA, 24 bp, Bovine coronavirus
tgagtaatatgcagttgtttgaag

SEQ ID NO: 3463 - DNA, 24 bp, Bovine coronavirus
aacgcgtgcgtgcttgggttggct

SEQ ID NO: 3464 - DNA, 24 bp, Bovine coronavirus
tggtatcaagttacaatcaaagcg

SEQ ID NO: 3465 - DNA, 24 bp, Bovine coronavirus
tggctaatgtctctgttttaacta

SEQ ID NO: 3466 - DNA, 24 bp, Bovine coronavirus
ttaaagcccaatttaaaacatttg

SEQ ID NO: 3467 - DNA, 24 bp, Bovine coronavirus
ttggatagctacagtgttatttta

SEQ ID NO: 3468 - DNA, 24 bp, Bovine coronavirus
gtggattgtcgccgacttcttaaa

SEQ ID NO: 3469 - DNA, 24 bp, Bovine coronavirus
tgtcctgccaacacttactcaaat

SEQ ID NO: 3470 - DNA, 24 bp, Bovine coronavirus
ttttatgcacagtctttgtttaga

SEQ ID NO: 3471 - DNA, 24 bp, Bovine coronavirus
ttagtgctaagaatagagcccgca

SEQ ID NO: 3472 - DNA, 24 bp, Bovine coronavirus
gtacattgagtcgtgaagatcttg

SEQ ID NO: 3473 - DNA, 24 bp, Bovine coronavirus
tgtgattggcagtgtgttgcatac

SEQ ID NO: 3474 - DNA, 24 bp, Bovine coronavirus
catagtgttacatgtgattacttg

SEQ ID NO: 3475 - DNA, 24 bp, Bovine coronavirus
tgtggtacatgggttctaacttag

SEQ ID NO: 3476 - DNA, 24 bp, Bovine coronavirus
ttgatactaagtgtttagctgatt

SEQ ID NO: 3477 - DNA, 24 bp, Bovine coronavirus
tgtagtagaccaggatcttggctc

SEQ ID NO: 3478 - DNA, 24 bp, Bovine coronavirus
ttaaatggctttttgtcttattat

SEQ ID NO: 3479 - DNA, 24 bp, Bovine coronavirus
tgtgcaaattacgcggcaagtttg

SEQ ID NO: 3480 - DNA, 24 bp, Bovine coronavirus
tgaatggtatggtttttggtctat

SEQ ID NO: 3481 - DNA, 24 bp, Bovine coronavirus
tgacactactgttcagtcaaaaga

SEQ ID NO: 3482 - DNA, 24 bp, Bovine coronavirus
ttactggccaaggtatttttgttg

SEQ ID NO: 3483 - DNA, 24 bp, Bovine coronavirus
ttgattgtaagagtgattttatga

SEQ ID NO: 3484 - DNA, 24 bp, Bovine coronavirus
ttatagtgtggtagtacaaccaca

SEQ ID NO: 3485 - DNA, 24 bp, Bovine coronavirus
tgttataggagatttaaagtgtac

SEQ ID NO: 3486 - DNA, 24 bp, Bovine coronavirus
tcggtgccctctccattaaattgg

SEQ ID NO: 3487 - DNA, 24 bp, Culex nigripalpus baculovirus
tggcggttcagtcggcaatattcc

SEQ ID NO: 3488 - DNA, 24 bp, Culex nigripalpus baculovirus
tgtacacaatacgaattgcaggta

SEQ ID NO: 3489 - DNA, 24 bp, Culex nigripalpus baculovirus
tgtgatgccaaactgtcggtgaag

SEQ ID NO: 3490 - DNA, 24 bp, Spodoptera litura nucleopolyhedrovirus
tatgactattttggatttaaaacg

SEQ ID NO: 3491 - DNA, 24 bp, Spodoptera litura nucleopolyhedrovirus
ttcaacgtaaacaattcgatcaac

SEQ ID NO: 3492 - DNA, 24 bp, deer tick virus
tgaggtggccggacactttcgttt

SEQ ID NO: 3493 - DNA, 24 bp, deer tick virus
tgagggagggcgagtcatgggggc

SEQ ID NO: 3494 - DNA, 24 bp, deer tick virus
ggtcatgtttatgactcaacaaaa

SEQ ID NO: 3495 - DNA, 24 bp, deer tick virus
tttggcttggctcatgctggatag

SEQ ID NO: 3496 - DNA, 24 bp, Zucchini yellow mosaic virus
aacccgtcactgttaatcaattgg

SEQ ID NO: 3497 - DNA, 24 bp, Zucchini yellow mosaic virus
tcaggtgagaagacagtagcagct

SEQ ID NO: 3498 - DNA, 24 bp, Zucchini yellow mosaic virus
taatactgtacgcaacatgatagc

SEQ ID NO: 3499 - DNA, 24 bp, Zucchini yellow mosaic virus
taggatgcgtcattttgagcgagg

SEQ ID NO: 3500 - DNA, 24 bp, shrimp white spot syndrome virus (white spot bacilliform virus)
tcagtgcctcatttacgccgtaaa

SEQ ID NO: 3501 - DNA, 24 bp, shrimp white spot syndrome virus (white spot bacilliform virus)
tcagcggttttcgtgacattttgg

SEQ ID NO: 3502 - DNA, 24 bp, shrimp white spot syndrome virus (white spot bacilliform virus)
aaggagaatgtggatcttgggcaa

SEQ ID NO: 3503 - DNA, 24 bp, shrimp white spot syndrome virus (white spot bacilliform virus)
tgtggaaaattctgtatcgtctgc

SEQ ID NO: 3504 - DNA, 24 bp, shrimp white spot syndrome virus (white spot bacilliform virus)
tggtatcttcactgaagtaattgt

SEQ ID NO: 3505 - DNA, 24 bp, shrimp white spot syndrome virus (white spot bacilliform virus)
agcagtagtatcaataacgaagat

SEQ ID NO: 3506 - DNA, 24 bp, shrimp white spot syndrome virus (white spot bacilliform virus)
tgatatgcatgaaggaagaaacaa

SEQ ID NO: 3507 - DNA, 24 bp, shrimp white spot syndrome virus (white spot bacilliform virus)
tataattgtactctatgttgtcta

SEQ ID NO: 3508 - DNA, 24 bp, shrimp white spot syndrome virus (white spot bacilliform virus)
tgaggcaaagtttgtgcctatacc

SEQ ID NO: 3509 - DNA, 24 bp, shrimp white spot syndrome virus (white spot bacilliform virus)
tattgtattgggaaaatcaaacaa

SEQ ID NO: 3510 - DNA, 24 bp, shrimp white spot syndrome virus (white spot bacilliform virus)
tggatagtatttctagttgttctt

SEQ ID NO: 3511 - DNA, 24 bp, shrimp white spot syndrome virus (white spot bacilliform virus)
tgtcaaacgtataagcttggtcaa

SEQ ID NO: 3512 - DNA, 24 bp, murid herpesvirus 4
tagcatgtgccgtcctctttgttt

SEQ ID NO: 3513 - DNA, 22 bp, murid herpesvirus 4
gtgagcaggagttgcgcttttc

SEQ ID NO: 3514 - DNA, 24 bp, murid herpesvirus 4
ggaagtgggtccaactttatccct

SEQ ID NO: 3515 - DNA, 24 bp, shrimp white spot syndrome virus (white spot bacilliform virus)
tccctggttacatatggggagaaa

SEQ ID NO: 3516 - DNA, 24 bp, Feline immunodeficiency virus
ggaggaatgatgaagtatctcaga

SEQ ID NO: 3517 - DNA, 24 bp, shrimp white spot syndrome virus (white spot bacilliform virus)
tctccagtaaatttctggtagcgc

SEQ ID NO: 3518 - DNA, 24 bp, Equine herpesvirus 2
tagcggcgagcgcgtttctcctga

SEQ ID NO: 3519 - DNA, 24 bp, Equine herpesvirus 2
tgaggtagacgatgtccctggcgc

SEQ ID NO: 3520 - DNA, 24 bp, Equine herpesvirus 2
tgaggtgcccgccgagggtctggc

SEQ ID NO: 3521 - DNA, 24 bp, Amsacta moorei entomopoxvirus
tcaatagtaacatctgttgtatta

SEQ ID NO: 3522 - DNA, 24 bp, Melanoplus sanguinipes entomopoxvirus
tgatgtatataatgcatgtgttct

SEQ ID NO: 3523 - DNA, 24 bp, murid herpesvirus 4
tcactgataaaatcttcaaccacg

SEQ ID NO: 3524 - DNA, 24 bp, murid herpesvirus 4
tgatgtagttccctttttccattt

SEQ ID NO: 3525 - DNA, 24 bp, murid herpesvirus 4
tgaggtgtttagtaaaaatggtgg

SEQ ID NO: 3526 - DNA, 24 bp, Macaca mulatta rhadinovirus
tgtgacattcggataggttaatgg

SEQ ID NO: 3527 - DNA, 22 bp, Macaca mulatta rhadinovirus
tctccgttaaactccacagaca

SEQ ID NO: 3528 - DNA, 24 bp, Monkeypox virus
tggtatggaatcctgaggcaccta

SEQ ID NO: 3529 - DNA, 24 bp, Monkeypox virus
tcaccgtttgggtattcgttttct

SEQ ID NO: 3530 - DNA, 24 bp, Ateline herpesvirus 3
ttaatgccatgcgtagtctccaaa

SEQ ID NO: 3531 - DNA, 24 bp, Saimiriine herpesvirus 2
ttaaagcaaattcatggctttggt

SEQ ID NO: 3532 - DNA, 24 bp, Human herpesvirus 6
aaaagtgcatgtatcaattttagt

SEQ ID NO: 3533 - DNA, 24 bp, Human herpesvirus 6
aagcagccgcgaactcgttaatag

SEQ ID NO: 3534 - DNA, 24 bp, African swine fever virus
ttcgtttgactcgctatttccatg

SEQ ID NO: 3535 - DNA, 24 bp, African swine fever virus
tatcatgattcttttgttttgcta

SEQ ID NO: 3536 - DNA, 23 bp, Monkeypox virus
tatcgcattttctaacgtgatgg

SEQ ID NO: 3537 - DNA, 24 bp, Bovine herpesvirus 4
tgggttcttgtattctgagactga

SEQ ID NO: 3538 - DNA, 24 bp, Bovine herpesvirus 4
aacactgttgtgctatcagaaaaa

SEQ ID NO: 3539 - DNA, 24 bp, African swine fever virus
taagttataaattggttccaaaac

SEQ ID NO: 3540 - DNA, 24 bp, African swine fever virus
tagatgatttctacgactgaaata

SEQ ID NO: 3541 - DNA, 24 bp, African swine fever virus
aaaggcatacatatgatcaatatc

SEQ ID NO: 3542 - DNA, 24 bp, Human herpesvirus 6B
tgacgtgcgtcggaatcggaagca

SEQ ID NO: 3543 - DNA, 24 bp, Human herpesvirus 6B
tgagtgatctgattcgacaaatca

SEQ ID NO: 3544 - DNA, 24 bp, Monkeypox virus
ggaaatggatatgacaaccctaat

SEQ ID NO: 3545 - DNA, 21 bp, Monkeypox virus
tttcttagatgttatcgactc

SEQ ID NO: 3546 - DNA, 24 bp, Monkeypox virus
tacccatcagtgatatgcaactac

SEQ ID NO: 3547 - DNA, 24 bp, Monkeypox virus
ttagatctgacgtctaaggaagta

SEQ ID NO: 3548 - DNA, 24 bp, Monkeypox virus
taataagtacgctggcttaatgtc

SEQ ID NO: 3549 - DNA, 24 bp, Monkeypox virus
agaagagcaagctctggagtcata

SEQ ID NO: 3550 - DNA, 21 bp, Fowlpox virus
tgactagatatggtagtccta

SEQ ID NO: 3551 - DNA, 24 bp, ictalurid herpesvirus 1
tacacaacttccgaatccacggag

SEQ ID NO: 3552 - DNA, 24 bp, Equine herpesvirus 2
tttcacactgtaaagagtggcata

SEQ ID NO: 3553 - DNA, 24 bp, Equine herpesvirus 2
caacacacaactttacattacagc

SEQ ID NO: 3554 - DNA, 24 bp, Monkeypox virus
tatcgcatagaaatagtaaagttt

SEQ ID NO: 3555 - DNA, 24 bp, Monkeypox virus
ttagttacggatcctaatgagtta

SEQ ID NO: 3556 - DNA, 24 bp, Gallid herpesvirus 2
ttgcataatacggagggttctgat

SEQ ID NO: 3557 - DNA, 24 bp, Gallid herpesvirus 2
ttcacatttttaagttgtatgtag

SEQ ID NO: 3558 - DNA, 24 bp, Gallid herpesvirus 2
tgacagcatgacctttctggggga

SEQ ID NO: 3559 - DNA, 24 bp, Gallid herpesvirus 2
aaagaaagttgtattctgcccggt

SEQ ID NO: 3560 - DNA, 21 bp, Lymphocystis disease virus 1
atcataccacaggtacctttt

SEQ ID NO: 3561 - DNA, 21 bp, Lymphocystis disease virus 1
taaaatgggatcacagaagcc

SEQ ID NO: 3562 - DNA, 22 bp, Lymphocystis disease virus 1
taatgctgtatttaatacaact

SEQ ID NO: 3563 - DNA, 24 bp, Molluscum contagiosum virus
tgaggtccgcgtagagcgacttgg

SEQ ID NO: 3564 - DNA, 24 bp, Ectromelia virus
tataatgtcttatctcgtatatat

SEQ ID NO: 3565 - DNA, 24 bp, Amsacta moorei entomopoxvirus
caatacgtttgaccaaagcaggat

SEQ ID NO: 3566 - DNA, 24 bp, African swine fever virus
tcgcaggaactcggtgttgtttct

SEQ ID NO: 3567 - DNA, 24 bp, African swine fever virus
cgaggcaatgtttacatagtcctg

SEQ ID NO: 3568 - DNA, 24 bp, Ectromelia virus
tttaaactgttaaatgttggtata

SEQ ID NO: 3569 - DNA, 24 bp, Ectromelia virus
tatggtaaaattaaatagtagtac

SEQ ID NO: 3570 - DNA, 21 bp, Camelpox virus
tatcacatgcgccggcagtca

SEQ ID NO: 3571 - DNA, 24 bp, Camelpox virus
tatggtaaaattaaatagtagtac

SEQ ID NO: 3572 - DNA, 24 bp, ictalurid herpesvirus 1
tgcccggccgttatcgaaaaaaca

SEQ ID NO: 3573 - DNA, 23 bp, ictalurid herpesvirus 1
tggcacacgtgaacggtgaagtg

SEQ ID NO: 3574 - DNA, 24 bp, ictalurid herpesvirus 1
tgacctattctcggcatttctcct

SEQ ID NO: 3575 - DNA, 24 bp, ictalurid herpesvirus 1
tgatatcgatgacattgtggaacg

SEQ ID NO: 3576 - DNA, 24 bp, Swinepox virus
aacggcaaatctaatggtatagta

SEQ ID NO: 3577 - DNA, 24 bp, Swinepox virus
tattattgggctatgcattcgata

SEQ ID NO: 3578 - DNA, 24 bp, turkey adenovirus 3
tgaactccgtactaatgaagtttt

SEQ ID NO: 3579 - DNA, 24 bp, turkey adenovirus 3
tgtgaaagtatttcacttttatta

SEQ ID NO: 3580 - DNA, 24 bp, Fowlpox virus
aaagggatttcgtttactacctgt

SEQ ID NO: 3581 - DNA, 24 bp, Fowlpox virus
taagaaaatatagctaccaaagat

SEQ ID NO: 3582 - DNA, 24 bp, Fowlpox virus
tagtttatagtcgtgataaacgta

SEQ ID NO: 3583 - DNA, 24 bp, Fowlpox virus
ttatgtggtccgcgatgaagattt

SEQ ID NO: 3584 - DNA, 22 bp, Fowlpox virus
aatcacacaaaccatagttaga

SEQ ID NO: 3585 - DNA, 21 bp, Swinepox virus
tatctgacaccgtatggtact

SEQ ID NO: 3586 - DNA, 24 bp, Human herpesvirus 5
tggccagacgctgtgcatcccgtc

SEQ ID NO: 3587 - DNA, 24 bp, Human herpesvirus 5
tggcctgcgttgatgcgcacgtaa

SEQ ID NO: 3588 - DNA, 24 bp, Human herpesvirus 5
tcaccagaatgctagtttgtagag

SEQ ID NO: 3589 - DNA, 24 bp, Swinepox virus
tgagatcgtatgatgctacagata

SEQ ID NO: 3590 - DNA, 24 bp, Amsacta moorei entomopoxvirus
gagcattttccaaagaatttatat

SEQ ID NO: 3591 - DNA, 24 bp, Gallid herpesvirus 3
tacaatgtttcgatgcaactgaaa

SEQ ID NO: 3592 - DNA, 24 bp, Gallid herpesvirus 3
tgatatgttcccagtaggtatgtc

SEQ ID NO: 3593 - DNA, 24 bp, Meleagrid herpesvirus 1
tgaaatgcatgacggatcactaat

SEQ ID NO: 3594 - DNA, 24 bp, Gallid herpesvirus 3
tggagtggtcggggagggcaggcg

SEQ ID NO: 3595 - DNA, 24 bp, Rat cytomegalovirus
tgaagtagttcttgtacagggcgt

SEQ ID NO: 3596 - DNA, 24 bp, Human adenovirus E
tcgcagcccccctgctcccagagc

SEQ ID NO: 3597 - DNA, 24 bp, Vaccinia virus
tcaccacgtgtgtttcaggatcat

SEQ ID NO: 3598 - DNA, 24 bp, Vaccinia virus
tctggcggctagaatggcataatc

SEQ ID NO: 3599 - DNA, 24 bp, Human herpesvirus 4
tagcatatgctacccagatataga

SEQ ID NO: 3600 - DNA, 24 bp, Human herpesvirus 4
agctgtaaaaatagaacgccctgg

SEQ ID NO: 3601 - DNA, 24 bp, Human herpesvirus 4
tgaggaccaacaaccctgtgcttg

SEQ ID NO: 3602 - DNA, 24 bp, Human herpesvirus 4
tagcatatgctacccagatataga

SEQ ID NO: 3603 - DNA, 24 bp, Periplaneta fuliginosa densovirus
taaggtaccggcgaaaaggtccga

SEQ ID NO: 3604 - DNA, 24 bp, Periplaneta fuliginosa densovirus
tagcttcgctataccccaccacaa

SEQ ID NO: 3605 - DNA, 22 bp, Periplaneta fuliginosa densovirus
ttcagaaatatctgccaacaca

SEQ ID NO: 3606 - DNA, 24 bp, Gallid herpesvirus 2
ttgcatagatgtgttttattatgt

SEQ ID NO: 3607 - DNA, 24 bp, Gallid herpesvirus 2
tgaggttgtattttgcgtctaatc

SEQ ID NO: 3608 - DNA, 24 bp, Gallid herpesvirus 2
tcgacaacaatgagtgtacctacc

SEQ ID NO: 3609 - DNA, 24 bp, Cowpea mottle virus
gtgcagtgctcgtttgctggccat

SEQ ID NO: 3610 - DNA, 24 bp, Human herpesvirus 2
tgggatgtaaagcagctgcccggg

SEQ ID NO: 3611 - DNA, 24 bp, Human herpesvirus 5
tgagggagctcacccaacaccgtc

SEQ ID NO: 3612 - DNA, 24 bp, Sulfolobus virus SIRV-1
tctgcaggatatttaactttaaag

SEQ ID NO: 3613 - DNA, 24 bp, Sulfolobus virus SIRV-1
aaaagtgatataatgcatttttgt

SEQ ID NO: 3614 - DNA, 24 bp, Melanoplus sanguinipes entomopoxvirus
tatcaaataaattttttaatcctt

SEQ ID NO: 3615 - DNA, 24 bp, Melanoplus sanguinipes entomopoxvirus
tattgtgatatatattcccaatgt

SEQ ID NO: 3616 - DNA, 22 bp, Saimiriine herpesvirus 2
ggcaatgacagaaaggtaacat

SEQ ID NO: 3617 - DNA, 24 bp, Saimiriine herpesvirus 2
tatgaaattttcatttgtgtctgc

SEQ ID NO: 3618 - DNA, 24 bp, Saimiriine herpesvirus 2
tggtaagcatactgcataagctaa

SEQ ID NO: 3619 - DNA, 24 bp, Saimiriine herpesvirus 2
cagcagcttctcgcactctgtctg

SEQ ID NO: 3620 - DNA, 22 bp, Alcelaphine herpesvirus 1
tccagagaaacaccaaaaattc

SEQ ID NO: 3621 - DNA, 24 bp, Alcelaphine herpesvirus 1
tgaaaaggcttcaaagtcctctgc

SEQ ID NO: 3622 - DNA, 24 bp, Human herpesvirus 8
taggtaacactggaagaggacgca

SEQ ID NO: 3623 - DNA, 24 bp, Human herpesvirus 8
tgagggacgtttgcagatagatag

SEQ ID NO: 3624 - DNA, 24 bp, Pothos latent virus
ccgaatgccaaccaaaaactataa

SEQ ID NO: 3625 - DNA, 24 bp, Pothos latent virus
tacccggtctgcaggttcaacatc

SEQ ID NO: 3626 - DNA, 24 bp, Trichoplusia ni cytoplasmic polyhedrosis virus 15
taagacagcagaattagttaatga

SEQ ID NO: 3627 - DNA, 24 bp, Trichoplusia ni cytoplasmic polyhedrosis virus 15
tgagtatatatttgttgaagattt

SEQ ID NO: 3628 - DNA, 23 bp, Vaccinia virus
tatccagagatatcttgtaatgg

SEQ ID NO: 3629 - DNA, 24 bp, Vaccinia virus
tgagaccatcgaaggagactccat

SEQ ID NO: 3630 - DNA, 24 bp, Vaccinia virus
taatatttttgtgagaccatcgaa

SEQ ID NO: 3631 - DNA, 24 bp, Vaccinia virus
taatatttttgtgagaccatcgaa

SEQ ID NO: 3632 - DNA, 24 bp, Peanut clump virus
tccacagtaggcgatccagaccat

SEQ ID NO: 3633 - DNA, 24 bp, Peanut clump virus
tccctgaacaaaaaccataccaaa

SEQ ID NO: 3634 - DNA, 24 bp, Peanut clump virus
tgaagtaagagaattgacttcgta

SEQ ID NO: 3635 - DNA, 24 bp, infectious spleen and kidney necrosis virus
tcatatcgaatagatccaccacat

SEQ ID NO: 3636 - DNA, 24 bp, infectious spleen and kidney necrosis virus
gagctgcgtggggccatagggtga

SEQ ID NO: 3637 - DNA, 24 bp, infectious spleen and kidney necrosis virus
tgtacaccggctgccagtggattg

SEQ ID NO: 3638 - DNA, 22 bp, infectious spleen and kidney necrosis virus
tgtaatgccaaatgccaagtcc

SEQ ID NO: 3639 - DNA, 24 bp, infectious spleen and kidney necrosis virus
ttgaatgccgccaccgggaccatg

SEQ ID NO: 3640 - DNA, 24 bp, infectious spleen and kidney necrosis virus
tatgacacggccgcaaaatgagct

SEQ ID NO: 3641 - DNA, 24 bp, Amsacta moorei entomopoxvirus
aaaggattattgcatttattaagt

SEQ ID NO: 3642 - DNA, 24 bp, African swine fever virus
tcaccagaatttcaatggtttctg

SEQ ID NO: 3643 - DNA, 24 bp, Human herpesvirus 4
tgtcattctcttggactaacgagg

SEQ ID NO: 3644 - DNA, 24 bp, Human herpesvirus 4
tggctcgagggcctgtcgcagctc

SEQ ID NO: 3645 - DNA, 24 bp, Human herpesvirus 4
ggaggtgatcacagcgcgtcatgt

SEQ ID NO: 3646 - DNA, 24 bp, Melanoplus sanguinipes entomopoxvirus
ttataactaaaaaatcctactaaa

SEQ ID NO: 3647 - DNA, 24 bp, Melanoplus sanguinipes entomopoxvirus
ttcatataattttaatatttcaga

SEQ ID NO: 3648 - DNA, 24 bp, Melanoplus sanguinipes entomopoxvirus
taacaaattttgtaattcctttag

SEQ ID NO: 3649 - DNA, 24 bp, beet soil-borne mosaic virus
agcagcatttaattgctaattggt

SEQ ID NO: 3650 - DNA, 23 bp, beet soil-borne mosaic virus
ttcccgggcatacgctcaacctc

SEQ ID NO: 3651 - DNA, 24 bp, beet soil-borne mosaic virus
tacccatcctccaccaatgttttc

SEQ ID NO: 3652 - DNA, 23 bp, infectious spleen and kidney necrosis virus
tgaccgggctcatttttcttctg

SEQ ID NO: 3653 - DNA, 24 bp, infectious spleen and kidney necrosis virus
tagcttacaggatagggaagcctg

SEQ ID NO: 3654 - DNA, 24 bp, infectious spleen and kidney necrosis virus
tggccagctgctgaagcttgttca

SEQ ID NO: 3655 - DNA, 24 bp, Human herpesvirus 7
agaggtatttttttgttaggtctg

SEQ ID NO: 3656 - DNA, 24 bp, Human herpesvirus 7
tcagctaaaactttgcaacaagca

SEQ ID NO: 3657 - DNA, 21 bp, Human herpesvirus 6
tggctcgagttcgatatgttc

SEQ ID NO: 3658 - DNA, 24 bp, Human herpesvirus 6
ttactagatggtaaagcgttgtta

SEQ ID NO: 3659 - DNA, 24 bp, Carnation Italian ringspot virus
tatcccacttctcccgaaaaattg

SEQ ID NO: 3660 - DNA, 24 bp, Carnation Italian ringspot virus
aacacagtcatccccacagtttgc

SEQ ID NO: 3661 - DNA, 24 bp, Tomato bushy stunt virus
tcacaaaatctcttaatcttatcg

SEQ ID NO: 3662 - DNA, 24 bp, Tomato bushy stunt virus
tgtcccatttagcccggaaaattg

SEQ ID NO: 3663 - DNA, 24 bp, Tomato bushy stunt virus
ttcaacgggttaagctgtaacaaa

SEQ ID NO: 3664 - DNA, 24 bp, Tomato spotted wilt virus
tagctttgttgatctatttcccta

SEQ ID NO: 3665 - DNA, 24 bp, Tomato spotted wilt virus
taagatgagaattctaaaactact

SEQ ID NO: 3666 - DNA, 24 bp, Tomato spotted wilt virus
ggaggaaaattcttcatttcagaa

SEQ ID NO: 3667 - DNA, 24 bp, Tomato spotted wilt virus
tggaatggttccatctaatagtga

SEQ ID NO: 3668 - DNA, 24 bp, Tomato spotted wilt virus
tccaagaatacatgacactaccaa

SEQ ID NO: 3669 - DNA, 21 bp, Tomato spotted wilt virus
aagaagcttggtgttttgcaa

SEQ ID NO: 3670 - DNA, 24 bp, lumpy skin disease virus
tatgttgtaactaatatactttgt

SEQ ID NO: 3671 - DNA, 24 bp, lumpy skin disease virus
ttaaaggcttgtttctatacgata

SEQ ID NO: 3672 - DNA, 24 bp, Goatpox virus
taaattaatatatgtgcgcttaat

SEQ ID NO: 3673 - DNA, 24 bp, Meleagrid herpesvirus 1
tcacgggtcgcttcgtagccgtct

SEQ ID NO: 3674 - DNA, 24 bp, Meleagrid herpesvirus 1
tcagtctattagcgctttcattac

SEQ ID NO: 3675 - DNA, 24 bp, Meleagrid herpesvirus 1
aaggatctatactgcaattattcc

SEQ ID NO: 3676 - DNA, 24 bp, Meleagrid herpesvirus 1
aaggatattgtgggtttaatgtat

SEQ ID NO: 3677 - DNA, 24 bp, Meleagrid herpesvirus 1
tggaatgcattatcggacacatgc

SEQ ID NO: 3678 - DNA, 24 bp, sheeppox virus
tcaatagttcgttttgtcgatttt

SEQ ID NO: 3679 - DNA, 23 bp, sheeppox virus
ttcgataaaatctacaggtgata

SEQ ID NO: 3680 - DNA, 24 bp, Goatpox virus
taataatacatttatatcaattgt

SEQ ID NO: 3681 - DNA, 24 bp, sheeppox virus
taaattaatatatgtgcacttaat

SEQ ID NO: 3682 - DNA, 24 bp, Melanoplus sanguinipes entomopoxvirus
taatacaaatttaatattttggcc

SEQ ID NO: 3683 - DNA, 24 bp, Melanoplus sanguinipes entomopoxvirus
tggaaaaacaagttttaagtgttt

SEQ ID NO: 3684 - DNA, 24 bp, Equine herpesvirus 1
tatctcatcgtgcgcaacaccggg

SEQ ID NO: 3685 - DNA, 22 bp, Melanoplus sanguinipes entomopoxvirus
tggcttgtaatagatccttggt

SEQ ID NO: 3686 - DNA, 24 bp, Variola virus
ttcatcatcgaatttaagagatcc

SEQ ID NO: 3687 - DNA, 24 bp, Camelpox virus
tgtaatgtctttcatgttataagt

SEQ ID NO: 3688 - DNA, 23 bp, Variola virus
tcgtcggagctgtacaccatagc

SEQ ID NO: 3689 - DNA, 24 bp, Ectromelia virus
tataattattttgtaagatgatgt

SEQ ID NO: 3690 - DNA, 24 bp, Camelpox virus
taggatatactcaatagaatttgt

SEQ ID NO: 3691 - DNA, 24 bp, Ectromelia virus
tgtaatgtctttcatgttataagt

SEQ ID NO: 3692 - DNA, 24 bp, Cowpox virus
tatattaataaagtactcattagg

SEQ ID NO: 3693 - DNA, 24 bp, Ectromelia virus
gtggattagtatactctcttccct

SEQ ID NO: 3694 - DNA, 21 bp, Ectromelia virus
tttaacatatgatattcgttc

SEQ ID NO: 3695 - DNA, 24 bp, Cowpox virus
tccacgttttttaattttgttata

SEQ ID NO: 3696 - DNA, 24 bp, Human herpesvirus 3
tacccgcaacgattcatcccctct

SEQ ID NO: 3697 - DNA, 24 bp, Leishmania RNA virus 1-4
tatcagccattttgctcaagaatt

SEQ ID NO: 3698 - DNA, 24 bp, Leishmania RNA virus 1-4
tgagttacaactccgacgacttgg

SEQ ID NO: 3699 - DNA, 24 bp, Leishmania RNA virus 1-4
aacccgggccgtagcagccgcaag

SEQ ID NO: 3700 - DNA, 24 bp, Leishmania RNA virus 1-4
tgtcacagaatcgggttgcgctgt

SEQ ID NO: 3701 - DNA, 22 bp, Leishmania RNA virus 1-4
tataacaactccaccacaagga

SEQ ID NO: 3702 - DNA, 24 bp, Leishmania RNA virus 1-1
tccaagaattgtatactcagggta

SEQ ID NO: 3703 - DNA, 22 bp, Leishmania RNA virus 1-1
tcacacgcgagtaacagcctcg

SEQ ID NO: 3704 - DNA, 24 bp, Leishmania RNA virus 1-1
ggaggtagtttctcttcagatctc

SEQ ID NO: 3705 - DNA, 24 bp, Leishmania RNA virus 1-1
tgagattagctatcaagttatcag

SEQ ID NO: 3706 - DNA, 21 bp, Leishmania RNA virus 1-1
ttcatcaatgcctcctgctga

SEQ ID NO: 3707 - DNA, 24 bp, Leishmania RNA virus 1-1
tgtatgcttgtccttctttccttg

SEQ ID NO: 3708 - DNA, 24 bp, Cowpox virus
tatgttaataattatggtgtggtg

SEQ ID NO: 3709 - DNA, 24 bp, Cowpox virus
tgacgtaaccaagaagtgtatcta

SEQ ID NO: 3710 - DNA, 24 bp, Cowpox virus
tgtaatgtctttcatgttataagt

SEQ ID NO: 3711 - DNA, 24 bp, Cowpox virus
agagatgtaacgggaactgggttt

SEQ ID NO: 3712 - DNA, 24 bp, Cowpox virus
gtggattagtgtactctcttccct

SEQ ID NO: 3713 - DNA, 24 bp, Chimpanzee cytomegalovirus
tgccgagcgtgagtacgagatacc

SEQ ID NO: 3714 - DNA, 24 bp, Chimpanzee cytomegalovirus
tttgggatgaaatctaggtccggg

SEQ ID NO: 3715 - DNA, 24 bp, Chimpanzee cytomegalovirus
tatggccaacccaattcccatact

SEQ ID NO: 3716 - DNA, 24 bp, Chimpanzee cytomegalovirus
cagcagcacgaaatgcggcgcgcg

SEQ ID NO: 3717 - DNA, 24 bp, Chimpanzee cytomegalovirus
tgaggccggggcggaaggcgggtc

SEQ ID NO: 3718 - DNA, 24 bp, Chimpanzee cytomegalovirus
gaaagtatagcccccctcctccgc

SEQ ID NO: 3719 - DNA, 24 bp, Chimpanzee cytomegalovirus
tgacgtagacggtgtatgttgcaa

SEQ ID NO: 3720 - DNA, 24 bp, Equine herpesvirus 4
tcaggtgcccactgatataacgcg

SEQ ID NO: 3721 - DNA, 24 bp, Equine herpesvirus 4
tggcgcggatgtctgcgtgccagg

SEQ ID NO: 3722 - DNA, 24 bp, Equine herpesvirus 4
caaagtggtagtgcctgttgcacg

SEQ ID NO: 3723 - DNA, 24 bp, Equine herpesvirus 1
tgtaaagggtatgtttttatttac

SEQ ID NO: 3724 - DNA, 24 bp, Equine herpesvirus 1
tgaaatctggatgccgcccatgtt

SEQ ID NO: 3725 - DNA, 24 bp, Rana tigrina ranavirus
tgagagagattacatcttaagatg

SEQ ID NO: 3726 - DNA, 22 bp, Broad bean necrosis virus
ttcgtagaggccaagtaagtca

SEQ ID NO: 3727 - DNA, 24 bp, Broad bean necrosis virus
tgagaggcttcaatattactaatc

SEQ ID NO: 3728 - DNA, 23 bp, Beet western yellows virus
tatgacaagtcaaatctccatct

SEQ ID NO: 3729 - DNA, 24 bp, Beet western yellows virus
tgagggcgctgagcgcgtcgtgtt

SEQ ID NO: 3730 - DNA, 22 bp, Beet western yellows virus
tggaatatccggggttcacatc

SEQ ID NO: 3731 - DNA, 24 bp, Cereal yellow dwarf virus - RPV
tgtctcgccacggccccctcctcc

SEQ ID NO: 3732 - DNA, 24 bp, Cereal yellow dwarf virus - RPV
gaggttagttctgcggtggcgcca

SEQ ID NO: 3733 - DNA, 24 bp, Cereal yellow dwarf virus - RPV
tcaatccgaaagtcatcccagttc

SEQ ID NO: 3734 - DNA, 22 bp, Cereal yellow dwarf virus - RPV
tcttatactcatggtaggcctt

SEQ ID NO: 3735 - DNA, 24 bp, Cereal yellow dwarf virus - RPV
tgagagaggcgacctgtaagtagt

SEQ ID NO: 3736 - DNA, 22 bp, Cereal yellow dwarf virus - RPV
accacatatgcaataacgcgca

SEQ ID NO: 3737 - DNA, 24 bp, Cereal yellow dwarf virus - RPV
tgagacatcccagaagggacactt

SEQ ID NO: 3738 - DNA, 22 bp, ictalurid herpesvirus 1
gcacgggtacggacgccgcgcg

SEQ ID NO: 3739 - DNA, 24 bp, ictalurid herpesvirus 1
tgatgtactcgggggggatgcctt

SEQ ID NO: 3740 - DNA, 23 bp, Barley yellow dwarf virus - PAV
tgtgcagggtatgttttacagta

SEQ ID NO: 3741 - DNA, 24 bp, Beet mild yellowing virus
tgtctcgctcgaacctgttcctct

SEQ ID NO: 3742 - DNA, 24 bp, Beet mild yellowing virus
agtggtaagcggccatcactcgaa

SEQ ID NO: 3743 - DNA, 23 bp, Cercopithecine herpesvirus 7
tgaggacgacgatgacgaggagg

SEQ ID NO: 3744 - DNA, 24 bp, Cercopithecine herpesvirus 7
ggaggtagacgggtcgcaggggcg

SEQ ID NO: 3745 - DNA, 24 bp, Cercopithecine herpesvirus 7
gcgaaagatgtggcgggcgggttt

SEQ ID NO: 3746 - DNA, 24 bp, Cercopithecine herpesvirus 7
tcacccggtagggggtcgtatatt

SEQ ID NO: 3747 - DNA, 24 bp, Cercopithecine herpesvirus 7
tgtcacagaactgtttatccaata

SEQ ID NO: 3748 - DNA, 24 bp, Molluscum contagiosum virus
tgtggaagtcgtcataggcctggt

SEQ ID NO: 3749 - DNA, 24 bp, Molluscum contagiosum virus
agaggtagtccaggccctcgccgt

SEQ ID NO: 3750 - DNA, 24 bp, Molluscum contagiosum virus
ctcgcgcacgtcctctaccaccgc

SEQ ID NO: 3751 - DNA, 24 bp, Molluscum contagiosum virus
tgtcctggcgagagcgcgcttctt

SEQ ID NO: 3752 - DNA, 24 bp, White clover mosaic virus
tgtcaagtgggacagtggttggct

SEQ ID NO: 3753 - DNA, 24 bp, White clover mosaic virus
tgactgaggcaacgtaatcgatgg

SEQ ID NO: 3754 - DNA, 21 bp, White clover mosaic virus
tgagatttcaatggaagctcc

SEQ ID NO: 3755 - DNA, 24 bp, Human herpesvirus 8
cagcctaagggccatgtgccttgg

SEQ ID NO: 3756 - DNA, 24 bp, Sulfolobus virus SIRV-1
tctaaaaatcaaaaattctatgac

SEQ ID NO: 3757 - DNA, 24 bp, Human herpesvirus 8
tgtgtaacgaccctacctgtgcct

SEQ ID NO: 3758 - DNA, 24 bp, Strawberry mild yellow edge virus
tagctaattgcagggaggcgtaga

SEQ ID NO: 3759 - DNA, 24 bp, Strawberry mild yellow edge virus
ttgaccatgtgtgtcagttgcatt

SEQ ID NO: 3760 - DNA, 24 bp, Strawberry mild yellow edge virus
ttggttccgtcggaatacttccct

SEQ ID NO: 3761 - DNA, 24 bp, Meleagrid herpesvirus 1
tgaaatgctatctcggtcatttct

SEQ ID NO: 3762 - DNA, 24 bp, Meleagrid herpesvirus 1
ttcattaacttagatttccggaca

SEQ ID NO: 3763 - DNA, 24 bp, Meleagrid herpesvirus 1
tcagcaggtaaggtggtgggacgg

SEQ ID NO: 3764 - DNA, 24 bp, Meleagrid herpesvirus 1
tggagtgcgaggttgaaatcgtca

SEQ ID NO: 3765 - DNA, 24 bp, Melanoplus sanguinipes entomopoxvirus
tatattacacgtttttgagcaact

SEQ ID NO: 3766 - DNA, 24 bp, Mayaro virus
tcgccgacagcgccttcacaagat

SEQ ID NO: 3767 - DNA, 24 bp, Mayaro virus
tcaacgccttggacaccgttcgat

SEQ ID NO: 3768 - DNA, 24 bp, murid herpesvirus 4
ttggttacgcccaaaaatccgacc

SEQ ID NO: 3769 - DNA, 24 bp, murid herpesvirus 4
tccactgaaatgtcataattgccc

SEQ ID NO: 3770 - DNA, 23 bp, murid herpesvirus 4
gcaccagagggtcagttttcaga

SEQ ID NO: 3771 - DNA, 24 bp, Potato mop-top virus
tgtgaaactgaccataaataaaat

SEQ ID NO: 3772 - DNA, 24 bp, Canine adenovirus type 1
tcacacttttgcattggggaaatg

SEQ ID NO: 3773 - DNA, 24 bp, Canine adenovirus type 1
taagttaacagagttttttataaa

SEQ ID NO: 3774 - DNA, 24 bp, Tulip virus X
taggatacgtggagtggggaaggg

SEQ ID NO: 3775 - DNA, 24 bp, Tulip virus X
tcacagttaatcatgatgttgttg

SEQ ID NO: 3776 - DNA, 24 bp, Tulip virus X
tgaagagccttgatcagtttcgtg

SEQ ID NO: 3777 - DNA, 24 bp, Tulip virus X
tgagatcctcggtttggacgcagt

SEQ ID NO: 3778 - DNA, 24 bp, porcine epidemic diarrhea virus
tacaacactccttataaaacttac

SEQ ID NO: 3779 - DNA, 24 bp, porcine epidemic diarrhea virus
gagcacatgttgagcatccatcta

SEQ ID NO: 3780 - DNA, 24 bp, porcine epidemic diarrhea virus
tgagtgcaaccctgaaggtttgat

SEQ ID NO: 3781 - DNA, 24 bp, porcine epidemic diarrhea virus
tgagtactgcaacagtgttatttg

SEQ ID NO: 3782 - DNA, 24 bp, porcine epidemic diarrhea virus
tttacaattacagtttgctagatt

SEQ ID NO: 3783 - DNA, 24 bp, porcine epidemic diarrhea virus
ttcacactcaagcataagacattg

SEQ ID NO: 3784 - DNA, 24 bp, porcine epidemic diarrhea virus
tttggtatgttgagacgtttggat

SEQ ID NO: 3785 - DNA, 24 bp, porcine epidemic diarrhea virus
tatgatggaacactatactatccc

SEQ ID NO: 3786 - DNA, 24 bp, porcine epidemic diarrhea virus
tgactcgctgtctggccatacatg

SEQ ID NO: 3787 - DNA, 24 bp, porcine epidemic diarrhea virus
tgagtctggtgactacattaaacc

SEQ ID NO: 3788 - DNA, 24 bp, porcine epidemic diarrhea virus
tacaacaacatgttcctgcgccat

SEQ ID NO: 3789 - DNA, 22 bp, porcine epidemic diarrhea virus
tggcaagttttctgatgaagtc

SEQ ID NO: 3790 - DNA, 24 bp, porcine epidemic diarrhea virus
tcagagcagacggctgttgtgatt

SEQ ID NO: 3791 - DNA, 24 bp, porcine epidemic diarrhea virus
tacccgttatctaagcatgaaaac

SEQ ID NO: 3792 - DNA, 24 bp, porcine epidemic diarrhea virus
aagcagcgctccattaaggcagaa

SEQ ID NO: 3793 - DNA, 24 bp, porcine epidemic diarrhea virus
tcattgcgtctatttgcagcggaa

SEQ ID NO: 3794 - DNA, 24 bp, porcine epidemic diarrhea virus
taagacagcactcttcaacaagta

SEQ ID NO: 3795 - DNA, 24 bp, porcine epidemic diarrhea virus
tatcaaggacaatgatggcaaggt

SEQ ID NO: 3796 - DNA, 24 bp, porcine epidemic diarrhea virus
tgatacgcatgatttcagccatga

SEQ ID NO: 3797 - DNA, 24 bp, porcine epidemic diarrhea virus
gtgcattggttgtactggcttact

SEQ ID NO: 3798 - DNA, 24 bp, porcine epidemic diarrhea virus
tcaatgtaggaaaacctgtagtgg

SEQ ID NO: 3799 - DNA, 24 bp, porcine epidemic diarrhea virus
ggatgtaaccctcaacaccactgg

SEQ ID NO: 3800 - DNA, 24 bp, porcine epidemic diarrhea virus
tgaagtagactcctctgcacctga

SEQ ID NO: 3801 - DNA, 24 bp, porcine epidemic diarrhea virus
tcactggtcttaatacaatgtggg

SEQ ID NO: 3802 - DNA, 24 bp, Poinsettia mosaic virus
tggcacgtcgaagctgacgaagtc

SEQ ID NO: 3803 - DNA, 24 bp, Poinsettia mosaic virus
tggataggttgttgaaagcgtctt

SEQ ID NO: 3804 - DNA, 24 bp, Poinsettia mosaic virus
tgcgagcaagcgagggtgatgtcc

SEQ ID NO: 3805 - DNA, 24 bp, Poinsettia mosaic virus
cgacgtggttggattcgagctgtt

SEQ ID NO: 3806 - DNA, 24 bp, Poinsettia mosaic virus
tgttggactgtgtgcgaacaaagc

SEQ ID NO: 3807 - DNA, 24 bp, Strawberry mottle virus
tgagattttacccttccactataa

SEQ ID NO: 3808 - DNA, 24 bp, Strawberry mottle virus
ttacacaggcttagccatgttgac

SEQ ID NO: 3809 - DNA, 24 bp, Strawberry mottle virus
taaggtaggcctcaacgtttacag

SEQ ID NO: 3810 - DNA, 24 bp, African swine fever virus
ttcaatgaattgttattcatgtcg

SEQ ID NO: 3811 - DNA, 24 bp, Strawberry mottle virus
tgggttctttattccggacaaggt

SEQ ID NO: 3812 - DNA, 24 bp, African swine fever virus
tgaggccgtttgtctcggcctcgc

SEQ ID NO: 3813 - DNA, 24 bp, African swine fever virus
tatcacaacgtgccctaagatgtg

SEQ ID NO: 3814 - DNA, 24 bp, Strawberry mottle virus
tcactgagaaactagctttctggg

SEQ ID NO: 3815 - DNA, 24 bp, Human herpesvirus 2
tggcggtctcgtccccgacggcgt

SEQ ID NO: 3816 - DNA, 24 bp, Human herpesvirus 2
tgccacgtcagctggcaggtgaag

SEQ ID NO: 3817 - DNA, 24 bp, Human herpesvirus 2
tgtggttcggggggcggatgcgtt

SEQ ID NO: 3818 - DNA, 22 bp, Porcine adenovirus C
tgtgcaacactaccaggactga

SEQ ID NO: 3819 - DNA, 24 bp, Chimpanzee cytomegalovirus
tgacgtagaaggccgactccgaga

SEQ ID NO: 3820 - DNA, 24 bp, Chimpanzee cytomegalovirus
cggcgagccgcccagacggatctt

SEQ ID NO: 3821 - DNA, 23 bp, Duck adenovirus 1
tactttgcccccggtttctacgc

SEQ ID NO: 3822 - DNA, 24 bp, Camelpox virus
ataggaacatgatattttctgtac

SEQ ID NO: 3823 - DNA, 24 bp, Camelpox virus
tttacggagatgaaatatcctcta

SEQ ID NO: 3824 - DNA, 21 bp, Camelpox virus
aacaataacacgcttctgttc

SEQ ID NO: 3825 - DNA, 24 bp, Camelpox virus
gatctcatggattttattacattt

SEQ ID NO: 3826 - DNA, 24 bp, Camelpox virus
tggcggtctctagctgctggatga

SEQ ID NO: 3827 - DNA, 24 bp, Monkeypox virus
tcagtgtcctatgatcaatgacga

SEQ ID NO: 3828 - DNA, 24 bp, Monkeypox virus
tattatatgtttgagtttgtttag

SEQ ID NO: 3829 - DNA, 21 bp, Monkeypox virus
tttaacatatgatattcgttc

SEQ ID NO: 3830 - DNA, 24 bp, Camelpox virus
agagatgtaacgggaacagggttt

SEQ ID NO: 3831 - DNA, 24 bp, Monkeypox virus
ttaggaactatgttcatggtatcc

SEQ ID NO: 3832 - DNA, 24 bp, Saimiriine herpesvirus 2
ttacatggtcgatctgaagtttta

SEQ ID NO: 3833 - DNA, 24 bp, Saimiriine herpesvirus 2
tgacatgattgagtccagaagcta

SEQ ID NO: 3834 - DNA, 21 bp, Saimiriine herpesvirus 2
tgtgttcagcaacaacttcat

SEQ ID NO: 3835 - DNA, 24 bp, Saimiriine herpesvirus 2
tctgatgccgtaaatgtttaagtt

SEQ ID NO: 3836 - DNA, 24 bp, Saimiriine herpesvirus 2
taaattgtttttgcttttgtgggc

SEQ ID NO: 3837 - DNA, 21 bp, Ononis yellow mosaic virus
aggagcagagatggagggttg

SEQ ID NO: 3838 - DNA, 24 bp, Barley stripe mosaic virus
tgtggtttgttccaaatactctct

SEQ ID NO: 3839 - DNA, 24 bp, Barley stripe mosaic virus
ttctcagataaagtggccgttcca

SEQ ID NO: 3840 - DNA, 24 bp, Barley stripe mosaic virus
tgaaggaccttgtgtaccgcaagc

SEQ ID NO: 3841 - DNA, 24 bp, Barley stripe mosaic virus
taaggaattttacaaagttaaagg

SEQ ID NO: 3842 - DNA, 24 bp, Barley stripe mosaic virus
ttggtcagagcgctgtgtagacct

SEQ ID NO: 3843 - DNA, 24 bp, Barley stripe mosaic virus
tgctgtattgataggtcagaagga

SEQ ID NO: 3844 - DNA, 24 bp, maize rayado fino virus
taacaggcccgcccacggtgatct

SEQ ID NO: 3845 - DNA, 24 bp, maize rayado fino virus
tgcgcaaactcgttgaggttgatg

SEQ ID NO: 3846 - DNA, 24 bp, maize rayado fino virus
tggaatgggagacgaggccagaac

SEQ ID NO: 3847 - DNA, 24 bp, Beet mild yellowing virus
tatgacgaatggccgagatgctgg

SEQ ID NO: 3848 - DNA, 24 bp, Beet mild yellowing virus
tgagatccgatcaagaactcgttg

SEQ ID NO: 3849 - DNA, 24 bp, Beet mild yellowing virus
tgagctccccaagttttacttctc

SEQ ID NO: 3850 - DNA, 24 bp, Chayote mosaic tymovirus
tcagtgttgtcgtcataggtgccg

SEQ ID NO: 3851 - DNA, 24 bp, Chayote mosaic tymovirus
tagctgccggcgtgatggctttcg

SEQ ID NO: 3852 - DNA, 24 bp, Chayote mosaic tymovirus
cgggatccgagacgcgaagggttc

SEQ ID NO: 3853 - DNA, 22 bp, Bamboo mosaic virus
tggctaggtagtaggtgacctt

SEQ ID NO: 3854 - DNA, 24 bp, Bamboo mosaic virus
ttcggtagttgctgcgtctgtgta

SEQ ID NO: 3855 - DNA, 24 bp, Bamboo mosaic virus
tggcgagcagggtctctagttgtg

SEQ ID NO: 3856 - DNA, 24 bp, Bamboo mosaic virus
tttcacatggtgggggcagatgct

SEQ ID NO: 3857 - DNA, 21 bp, Fowlpox virus
aggtatgaaaacaattcatac

SEQ ID NO: 3858 - DNA, 24 bp, Fowlpox virus
tactatatcttctatagcgaatgt

SEQ ID NO: 3859 - DNA, 24 bp, Cercopithecine herpesvirus 7
ttaaatgtgattccaatgtccaag

SEQ ID NO: 3860 - DNA, 24 bp, Cercopithecine herpesvirus 7
tcgtttaaattgatactctgtgtc

SEQ ID NO: 3861 - DNA, 22 bp, Cercopithecine herpesvirus 7
gttgttgtggaattgttaacgg

SEQ ID NO: 3862 - DNA, 24 bp, Cowpox virus
tgagaccattgaagagagaaagag

SEQ ID NO: 3863 - DNA, 24 bp, Cowpox virus
agcagcaatagcaatatatatgac

SEQ ID NO: 3864 - DNA, 24 bp, Cowpox virus
tgaatagggttatcgattcagaca

SEQ ID NO: 3865 - DNA, 24 bp, Cowpox virus
taaaaacttgtgtgaaattttgta

SEQ ID NO: 3866 - DNA, 21 bp, Cowpox virus
ttggatctaactgtagtactc

SEQ ID NO: 3867 - DNA, 24 bp, Camelpox virus
tatccagagatatcttgtaatggc

SEQ ID NO: 3868 - DNA, 24 bp, Camelpox virus
tgatatactcacaaattttctttt

SEQ ID NO: 3869 - DNA, 23 bp, Swinepox virus
tatgatacaccaaaggattaata

SEQ ID NO: 3870 - DNA, 24 bp, Meleagrid herpesvirus 1
tatcctagcattgtgaagtagaac

SEQ ID NO: 3871 - DNA, 24 bp, Meleagrid herpesvirus 1
tgccatgaattacggcttcgatga

SEQ ID NO: 3872 - DNA, 24 bp, Meleagrid herpesvirus 1
gtgcaatgcaccatcgaacgttct

SEQ ID NO: 3873 - DNA, 24 bp, Ectromelia virus
tgtagtgctcaaatactcatcaga

SEQ ID NO: 3874 - DNA, 23 bp, Ectromelia virus
tatccagagatatcttgtaatgg

SEQ ID NO: 3875 - DNA, 24 bp, Camelpox virus
tgatatactcacaaattttctttt

SEQ ID NO: 3876 - DNA, 24 bp, Ectromelia virus
tgaaatctttacttgatcaggata

SEQ ID NO: 3877 - DNA, 24 bp, Cucumber green mottle mosaic virus
tgagatctttaacgcaaaattaag

SEQ ID NO: 3878 - DNA, 24 bp, Cucumber green mottle mosaic virus
tggcaacaataaccacttgcactt

SEQ ID NO: 3879 - DNA, 24 bp, Rana tigrina ranavirus
tacaatcttaagtttctttatact

SEQ ID NO: 3880 - DNA, 24 bp, Rana tigrina ranavirus
tggcaatcaccagcctcctccccc

SEQ ID NO: 3881 - DNA, 24 bp, Melanoplus sanguinipes entomopoxvirus
tgagtaaccagtaataacttcatg

SEQ ID NO: 3882 - DNA, 24 bp, Cucumber fruit mottle mosaic virus
tggaaacatctagctctagaatct

SEQ ID NO: 3883 - DNA, 24 bp, Cucumber fruit mottle mosaic virus
taagacatcttgattatgaactta

SEQ ID NO: 3884 - DNA, 24 bp, Cucumber fruit mottle mosaic virus
acaccagaaatcctaacaaacaaa

SEQ ID NO: 3885 - DNA, 24 bp, Rift Valley fever virus
tagcttatagctctcactgtatgg

SEQ ID NO: 3886 - DNA, 24 bp, Rift Valley fever virus
tcgtaagggccactaacatccaac

SEQ ID NO: 3887 - DNA, 22 bp, Rift Valley fever virus
aacttgcagctctgacctgaga

SEQ ID NO: 3888 - DNA, 24 bp, Odontoglossum ringspot virus
gagcttccattggcaccgtcgagt

SEQ ID NO: 3889 - DNA, 24 bp, Odontoglossum ringspot virus
agatgtatgataagagccaagtgt

SEQ ID NO: 3890 - DNA, 24 bp, Odontoglossum ringspot virus
aatagtgtaagacatattcaatac

SEQ ID NO: 3891 - DNA, 24 bp, Odontoglossum ringspot virus
taaagggaatttgttcagtatcac

SEQ ID NO: 3892 - DNA, 23 bp, Odontoglossum ringspot virus
ttcaaaggctgataaattaataa

SEQ ID NO: 3893 - DNA, 24 bp, Human herpesvirus 4
tgaccagctggttgctcccattct

SEQ ID NO: 3894 - DNA, 24 bp, Cactus virus X
tcaaagcagtaattaactatttct

SEQ ID NO: 3895 - DNA, 22 bp, Cactus virus X
tcgcgagttggaagatggcttc

SEQ ID NO: 3896 - DNA, 24 bp, Cactus virus X
tgagaaaacacggcctccacctgc

SEQ ID NO: 3897 - DNA, 24 bp, Human adenovirus C
taggtttttctcccaccataagca

SEQ ID NO: 3898 - DNA, 24 bp, Human adenovirus C
gcagtgccggcggcgcctgaggag

SEQ ID NO: 3899 - DNA, 24 bp, Human adenovirus C
tgaaatgtcccgtccggacggaga

SEQ ID NO: 3900 - DNA, 24 bp, Botrytis virus F
aagctgcaggggggttgggcgggg

SEQ ID NO: 3901 - DNA, 24 bp, Botrytis virus F
aggcagtcattgcgggtgggatat

SEQ ID NO: 3902 - DNA, 24 bp, Botrytis virus F
tgtgatcccagtgggcagctacga

SEQ ID NO: 3903 - DNA, 24 bp, Cowpox virus
tagtttataccattcaatataatc

SEQ ID NO: 3904 - DNA, 24 bp, Vaccinia virus
ttagatacatggtctcagaagtag

SEQ ID NO: 3905 - DNA, 21 bp, Camelpox virus
tatgaagtaaagtatctacga

SEQ ID NO: 3906 - DNA, 24 bp, Equine herpesvirus 1
tggcagctcgccgtttcctaggta

SEQ ID NO: 3907 - DNA, 24 bp, Equine herpesvirus 1
tttggtatcagcgagagcagcaca

SEQ ID NO: 3908 - DNA, 24 bp, Equine herpesvirus 1
tgaggtacaatcgggtttctcttg

SEQ ID NO: 3909 - DNA, 24 bp, Equine herpesvirus 1
tacagcagttaccgcgcgagaatg

SEQ ID NO: 3910 - DNA, 24 bp, Avian nephritis virus
taccacgtagtgccagattggttt

SEQ ID NO: 3911 - DNA, 21 bp, Avian nephritis virus
gtcacagtttgaccaccagta

SEQ ID NO: 3912 - DNA, 24 bp, Avian nephritis virus
tcaagtgcagtagctgcaactttg

SEQ ID NO: 3913 - DNA, 24 bp, Avian nephritis virus
tgggttgcctttcttgacatgagt

SEQ ID NO: 3914 - DNA, 24 bp, Scallion virus X
tggcacacgtggaattagcagtgg

SEQ ID NO: 3915 - DNA, 24 bp, Scallion virus X
tgaggtggtgggaggcgaaattga

SEQ ID NO: 3916 - DNA, 22 bp, Scallion virus X
tgagctggctcgttggtggtca

SEQ ID NO: 3917 - DNA, 24 bp, Clover yellow mosaic virus
tgacgtacatgaatagttgcatga

SEQ ID NO: 3918 - DNA, 24 bp, Clover yellow mosaic virus
tgagctgtataactccctttcgtg

SEQ ID NO: 3919 - DNA, 24 bp, Clover yellow mosaic virus
tacctgctggcctctttgagttgt

SEQ ID NO: 3920 - DNA, 24 bp, Clover yellow mosaic virus
tggctggtggttttgatgaagtgg

SEQ ID NO: 3921 - DNA, 24 bp, Camelpox virus
tatccagagatatcttgtaatggc

SEQ ID NO: 3922 - DNA, 24 bp, Camelpox virus
agaggttggaatatcaactagttg

SEQ ID NO: 3923 - DNA, 24 bp, Camelpox virus
tctatagtttgtaatatggagctt

SEQ ID NO: 3924 - DNA, 24 bp, Strawberry mottle virus
taaagtgataagcaaacctattgt

SEQ ID NO: 3925 - DNA, 24 bp, Tupaia herpesvirus
aaaggtgggcccggtcagctggac

SEQ ID NO: 3926 - DNA, 24 bp, Tupaia herpesvirus
tggagtggtgactttctgtggact

SEQ ID NO: 3927 - DNA, 21 bp, Tupaia herpesvirus
tctgatcaaaactcagtggac

SEQ ID NO: 3928 - DNA, 24 bp, Tupaia herpesvirus
tccaggggctcctgttgggatacc

SEQ ID NO: 3929 - DNA, 24 bp, Fowlpox virus
ttcaaagtcttgcgttatcgtact

SEQ ID NO: 3930 - DNA, 24 bp, Fowlpox virus
ttaatgcgttcttgatctaacagt

SEQ ID NO: 3931 - DNA, 24 bp, Fowl adenovirus D
tggaagggagcgtcggtctcttcc

SEQ ID NO: 3932 - DNA, 22 bp, Fowl adenovirus D
tgccatggtaacaatggttcgt

SEQ ID NO: 3933 - DNA, 24 bp, Fowl adenovirus D
tgacgagattcagaatgaccgtgg

SEQ ID NO: 3934 - DNA, 24 bp, Equine herpesvirus 2
agatggaggcggtcctgttgctct

SEQ ID NO: 3935 - DNA, 24 bp, Equine herpesvirus 2
cgaggtattaaggggaaaaaagga

SEQ ID NO: 3936 - DNA, 24 bp, Human herpesvirus 1
tggcatccagagggcgctgaagat

SEQ ID NO: 3937 - DNA, 24 bp, Tacaribe virus
tgaggtcaggcatcacacttgttc

SEQ ID NO: 3938 - DNA, 24 bp, Tacaribe virus
tgaagttcttagatgtttgcatag

SEQ ID NO: 3939 - DNA, 24 bp, Tacaribe virus
tgagatgacaggcttcattagaag

SEQ ID NO: 3940 - DNA, 24 bp, Tacaribe virus
aacactgattaagacattgcagtc

SEQ ID NO: 3941 - DNA, 24 bp, Equine herpesvirus 2
ttaaacactaactggctggtttta

SEQ ID NO: 3942 - DNA, 24 bp, Equine herpesvirus 2
aagcaccagcattaatcttttgac

SEQ ID NO: 3943 - DNA, 24 bp, Equine herpesvirus 2
taagggagcgagctgttggattat

SEQ ID NO: 3944 - DNA, 24 bp, Equine herpesvirus 2
ccagaacctgatcacacctctctt

SEQ ID NO: 3945 - DNA, 24 bp, Equine herpesvirus 2
tgaggtcgggtatgctaatgggac

SEQ ID NO: 3946 - DNA, 24 bp, Bovine herpesvirus 4
tcaaatgtggatcctgccagggtc

SEQ ID NO: 3947 - DNA, 24 bp, Bovine herpesvirus 4
taaaatgtttttttcaaagtgtag

SEQ ID NO: 3948 - DNA, 24 bp, Bovine herpesvirus 4
tatggtggcaagatgtctcccatc

SEQ ID NO: 3949 - DNA, 23 bp, Bovine herpesvirus 4
tagccaggctcaggcttcctgtt

SEQ ID NO: 3950 - DNA, 24 bp, Bovine herpesvirus 4
tttattgtttacctgctagaagat

SEQ ID NO: 3951 - DNA, 24 bp, Bovine herpesvirus 4
accacatctttgtgtcatttttaa

SEQ ID NO: 3952 - DNA, 24 bp, Gallid herpesvirus 3
tgacgtgcgcatagttgagcgacg

SEQ ID NO: 3953 - DNA, 24 bp, Gallid herpesvirus 3
tgaagtgcatagtgaagatggact

SEQ ID NO: 3954 - DNA, 24 bp, turkey adenovirus 3
taagcaaattgagttacatgcttc

SEQ ID NO: 3955 - DNA, 24 bp, turkey adenovirus 3
tactacacgctcagattcttggct

SEQ ID NO: 3956 - DNA, 24 bp, turkey adenovirus 3
cagctcactatattacttctcgct

SEQ ID NO: 3957 - DNA, 24 bp, turkey adenovirus 3
gtaaaggagttgtggttaaagcca

SEQ ID NO: 3958 - DNA, 24 bp, Monkeypox virus
tgagatttttgtttaatgtgttca

SEQ ID NO: 3959 - DNA, 24 bp, Monkeypox virus
tatccagagatatcttgtaatggc

SEQ ID NO: 3960 - DNA, 24 bp, Monkeypox virus
tgtagtgctcagatactcatcaga

SEQ ID NO: 3961 - DNA, 24 bp, Camelpox virus
tacctttgtacgacattaatgcta

SEQ ID NO: 3962 - DNA, 23 bp, Monkeypox virus
ttcatcatgtgccaacgtctcaa

SEQ ID NO: 3963 - DNA, 24 bp, Human adenovirus D
tggcaaaggagccatagagggcgt

SEQ ID NO: 3964 - DNA, 24 bp, Human adenovirus D
cattgcatgagcccgtagctgcgc

SEQ ID NO: 3965 - DNA, 24 bp, Human adenovirus D
tgagctcggcgatggtggcgcgca

SEQ ID NO: 3966 - DNA, 24 bp, Human adenovirus D
aggggtagcggtcgttgtccacca

SEQ ID NO: 3967 - DNA, 24 bp, Human adenovirus D
tagcaggggcgctgggcgtggtgc

SEQ ID NO: 3968 - DNA, 24 bp, Yaba-like disease virus
taaagtgtagatacagtccttaaa

SEQ ID NO: 3969 - DNA, 24 bp, Yaba-like disease virus
ttaaaagttttttcctctatattg

SEQ ID NO: 3970 - DNA, 24 bp, Blackcurrant reversion virus
tgtcttggaatgggccaccttcct

SEQ ID NO: 3971 - DNA, 24 bp, Blackcurrant reversion virus
cacccgtggtgagaggctgcgact

SEQ ID NO: 3972 - DNA, 24 bp, Blackcurrant reversion virus
ttaatgttatggacacacgtattg

SEQ ID NO: 3973 - DNA, 24 bp, Blackcurrant reversion virus
tgacgagactcgaatcatctacgt

SEQ ID NO: 3974 - DNA, 24 bp, beet soil-borne mosaic virus
taagagagcttgaggttgagcgta

SEQ ID NO: 3975 - DNA, 24 bp, beet soil-borne mosaic virus
tgaccacgatcaatttgatctcaa

SEQ ID NO: 3976 - DNA, 24 bp, beet soil-borne mosaic virus
aagcttacctgttattaaggccaa

SEQ ID NO: 3977 - DNA, 24 bp, beet soil-borne mosaic virus
taaagagtctatggttttctaggg

SEQ ID NO: 3978 - DNA, 24 bp, beet soil-borne mosaic virus
cgactagagaatttgttactgtgt

SEQ ID NO: 3979 - DNA, 24 bp, Grapevine virus A
tatctcaacagcctgctcgccgat

SEQ ID NO: 3980 - DNA, 24 bp, Grapevine virus A
tagcatggttcatcatctgcgtgg

SEQ ID NO: 3981 - DNA, 24 bp, Grapevine virus A
tggaatgtagtaatcaaatagtcc

SEQ ID NO: 3982 - DNA, 24 bp, Grapevine virus A
tacccgaagagagtgttcaggtac

SEQ ID NO: 3983 - DNA, 24 bp, Grapevine virus A
aacagtgtttaagtatggtttggc

SEQ ID NO: 3984 - DNA, 24 bp, A-2 plaque virus
caagcacttgccgactggtactga

SEQ ID NO: 3985 - DNA, 24 bp, A-2 plaque virus
tacggtaatttcaagattgactcc

SEQ ID NO: 3986 - DNA, 24 bp, A-2 plaque virus
agagattgcagatggggctggtgt

SEQ ID NO: 3987 - DNA, 24 bp, A-2 plaque virus
ttgaatatactggtccctgagcat

SEQ ID NO: 3988 - DNA, 24 bp, Human enterovirus C
tcaccggggaaacagaagtgcttg

SEQ ID NO: 3989 - DNA, 24 bp, Human enterovirus C
taatttagaatttcacccaacatg

SEQ ID NO: 3990 - DNA, 24 bp, Human enterovirus C
tagcttccaccaccatccccttga

SEQ ID NO: 3991 - DNA, 22 bp, Human enterovirus C
tacacatgggtgcgatggtcac

SEQ ID NO: 3992 - DNA, 24 bp, Beet virus Q
tgacgtaaaagacaaagttcctca

SEQ ID NO: 3993 - DNA, 24 bp, Beet virus Q
taggtcaccattggatgttgccgc

SEQ ID NO: 3994 - DNA, 24 bp, Beet virus Q
agagatggagaaatacttgggcaa

SEQ ID NO: 3995 - DNA, 24 bp, Human enterovirus A
tggcatcagagtcggacaccgttg

SEQ ID NO: 3996 - DNA, 24 bp, Beet virus Q
ttgggcaacacacgctatgagaag

SEQ ID NO: 3997 - DNA, 24 bp, Human enterovirus A
taccctgcaaatctccaacagatt

SEQ ID NO: 3998 - DNA, 24 bp, Beet virus Q
tgaaagagaatcaattaaatgtgg

SEQ ID NO: 3999 - DNA, 24 bp, Saimiriine herpesvirus 2
tgagctactgatccaaaaaggcta

SEQ ID NO: 4000 - DNA, 24 bp, Saimiriine herpesvirus 2
tgaggtacactgttattaggtaac

SEQ ID NO: 4001 - DNA, 24 bp, Grapevine fleck virus
ggaggtactgggtgtagaggatgg

SEQ ID NO: 4002 - DNA, 24 bp, Swinepox virus
catcacataatctattatcaatgg

SEQ ID NO: 4003 - DNA, 24 bp, Swinepox virus
tatgtgatcacctctatccgttaa

SEQ ID NO: 4004 - DNA, 24 bp, Swinepox virus
tattaaaatgtttagctagttttt

SEQ ID NO: 4005 - DNA, 24 bp, Vaccinia virus
tatcaaacatggagacgcctgata

SEQ ID NO: 4006 - DNA, 24 bp, Vaccinia virus
atgcagaagtaatgaagaaaagta

SEQ ID NO: 4007 - DNA, 24 bp, Vaccinia virus
taacaccacgaacatgtcgcagta

SEQ ID NO: 4008 - DNA, 24 bp, Yaba-like disease virus
taaggtaataattccaaggaaata

SEQ ID NO: 4009 - DNA, 24 bp, Yaba-like disease virus
tgtaacagtctttttgtagtagat

SEQ ID NO: 4010 - DNA, 24 bp, Yaba-like disease virus
ttaattcgtgcggacttaagttga

SEQ ID NO: 4011 - DNA, 24 bp, Yaba-like disease virus
tgttaggaaccaaaatgtaaactt

SEQ ID NO: 4012 - DNA, 24 bp, Yaba-like disease virus
tataacattgtcgttgtaattaag

SEQ ID NO: 4013 - DNA, 23 bp, Human herpesvirus 5
ttaaatccgagataattgcccgg

SEQ ID NO: 4014 - DNA, 24 bp, Human herpesvirus 5
agcagcaacccgaacgcgaccagg

SEQ ID NO: 4015 - DNA, 24 bp, Human herpesvirus 5
tgacgtgatagttacggtgattgt

SEQ ID NO: 4016 - DNA, 21 bp, Foot-and-mouth disease virus SAT 2 (FMDV-SAT2)
ttcagagaacgtggctttcgg

SEQ ID NO: 4017 - DNA, 24 bp, Foot-and-mouth disease virus SAT 2 (FMDV-SAT2)
tgcaatgatgaccttgctgttgaa

SEQ ID NO: 4018 - DNA, 24 bp, Foot-and-mouth disease virus SAT 2 (FMDV-SAT2)
tgacgaggcacgagataggcagta

SEQ ID NO: 4019 - DNA, 24 bp, Foot-and-mouth disease virus SAT 2 (FMDV-SAT2)
tgagaagggcacaatcatactgga

SEQ ID NO: 4020 - DNA, 21 bp, Human adenovirus D
tctgacactacaacctcatac

SEQ ID NO: 4021 - DNA, 24 bp, Human adenovirus D
gcaggtacgcggaagtccacaacc

SEQ ID NO: 4022 - DNA, 24 bp, Foot-and-mouth disease virus C
tgtacacttgttgtttcagccttg

SEQ ID NO: 4023 - DNA, 24 bp, Foot-and-mouth disease virus C
ggaaaagtgctattacctctttga

SEQ ID NO: 4024 - DNA, 24 bp, Foot-and-mouth disease virus C
aaagtgaaacctccggttcagagc

SEQ ID NO: 4025 - DNA, 22 bp, Foot-and-mouth disease virus C
tggcaaggatcagcttgaccag

SEQ ID NO: 4026 - DNA, 22 bp, Foot-and-mouth disease virus C
tggcaagcaaacttgtattctc

SEQ ID NO: 4027 - DNA, 22 bp, Foot-and-mouth disease virus C
tcaccgggcccttgtggtaggc

SEQ ID NO: 4028 - DNA, 24 bp, Foot-and-mouth disease virus O
tcaccgttgtaaagtgtgaattcc

SEQ ID NO: 4029 - DNA, 24 bp, Foot-and-mouth disease virus O
tggaatccgaactccgtgcggaac

SEQ ID NO: 4030 - DNA, 24 bp, Foot-and-mouth disease virus O
tgacgaggcacgaggtaggcagtg

SEQ ID NO: 4031 - DNA, 22 bp, Melanoplus sanguinipes entomopoxvirus
tataattaatgtttccaaattt

SEQ ID NO: 4032 - DNA, 24 bp, Melanoplus sanguinipes entomopoxvirus
tcaatgtattttttacatgtttta

SEQ ID NO: 4033 - DNA, 22 bp, Garlic latent virus
agagatctgggtagaccaagat

SEQ ID NO: 4034 - DNA, 24 bp, Garlic latent virus
tcagtgcagatcccatggaactta

SEQ ID NO: 4035 - DNA, 24 bp, Garlic latent virus
ttgctcacttttttttcctcaaaa

SEQ ID NO: 4036 - DNA, 24 bp, Garlic latent virus
tcactgtggagtggatccccgagt

SEQ ID NO: 4037 - DNA, 24 bp, Myxoma virus
taactgctgcaacaaagtgaaact

SEQ ID NO: 4038 - DNA, 24 bp, Myxoma virus
tcgataaactccttgtccgcggag

SEQ ID NO: 4039 - DNA, 24 bp, Myxoma virus
taaagtgtacgtttacataccgcc

SEQ ID NO: 4040 - DNA, 24 bp, Garlic virus C
tccctgggcagacgtggcctggtt

SEQ ID NO: 4041 - DNA, 24 bp, Human adenovirus A
tggaaaaatttgtactactcttaa

SEQ ID NO: 4042 - DNA, 24 bp, Human adenovirus A
tagcagtatttggttacgccgggc

SEQ ID NO: 4043 - DNA, 23 bp, Human adenovirus A
tagtatttccttgatctttttcc

SEQ ID NO: 4044 - DNA, 24 bp, Human adenovirus A
tattgcaaaccaaagaacggtggg

SEQ ID NO: 4045 - DNA, 24 bp, Human adenovirus A
cataaacccagcctatgtagtttg

SEQ ID NO: 4046 - DNA, 24 bp, Human adenovirus A
ttaaagcttttagtaatacctgaa

SEQ ID NO: 4047 - DNA, 24 bp, sheeppox virus
taagtttaaatctggcaaatgttc

SEQ ID NO: 4048 - DNA, 24 bp, sheeppox virus
ttacgtaaataaaatctttaacaa

SEQ ID NO: 4049 - DNA, 24 bp, Variola virus
ttacttgtttaatatctatatccg

SEQ ID NO: 4050 - DNA, 24 bp, Fowlpox virus
ttaatgttgttttcttactaacgg

SEQ ID NO: 4051 - DNA, 24 bp, Garlic virus A
tcactgggtgtgacgcgaagttca

SEQ ID NO: 4052 - DNA, 24 bp, Garlic virus A
tgacggggagttgattggatttaa

SEQ ID NO: 4053 - DNA, 24 bp, Garlic virus A
tcagtgtatggtgagaaatgggcc

SEQ ID NO: 4054 - DNA, 24 bp, Garlic virus A
tgaagtcgaagtttcggaggtttg

SEQ ID NO: 4055 - DNA, 24 bp, Macaca mulatta rhadinovirus
tcaccgcggcgcatattgggtctc

SEQ ID NO: 4056 - DNA, 24 bp, Bovine herpesvirus 1
tgagctcgaggatggggatggaca

SEQ ID NO: 4057 - DNA, 24 bp, Fowlpox virus
ttagataagattcctgaactcact

SEQ ID NO: 4058 - DNA, 22 bp, Fowlpox virus
tgtcacgtatagaggcatcggc

SEQ ID NO: 4059 - DNA, 24 bp, Fowlpox virus
cagccaaatgcaagggtgtttgat

SEQ ID NO: 4060 - DNA, 24 bp, Fowlpox virus
taccatggtagtgttatttaggct

SEQ ID NO: 4061 - DNA, 24 bp, Fowlpox virus
cattataggatagtaatagtttta

SEQ ID NO: 4062 - DNA, 24 bp, Fowlpox virus
tactataccataatctattaggta

SEQ ID NO: 4063 - DNA, 24 bp, Fowlpox virus
tgaaaataatttataagctattaa

SEQ ID NO: 4064 - DNA, 22 bp, Fowlpox virus
taccgtgttataatattaagaa

SEQ ID NO: 4065 - DNA, 24 bp, Triatoma virus
tgaaatgtaatttggactcttcca

SEQ ID NO: 4066 - DNA, 24 bp, Triatoma virus
ttcacattttaccacaggtcgttg

SEQ ID NO: 4067 - DNA, 24 bp, Triatoma virus
taagattctttcaccaatacattc

SEQ ID NO: 4068 - DNA, 24 bp, Triatoma virus
agaaaagtaattaggtatttttaa

SEQ ID NO: 4069 - DNA, 24 bp, Triatoma virus
tagcagaggatcccgtaaagttat

SEQ ID NO: 4070 - DNA, 24 bp, Triatoma virus
taagatagtgtacttttgcccaca

SEQ ID NO: 4071 - DNA, 24 bp, Triatoma virus
tgacataagtgcatcaggtaattt

SEQ ID NO: 4072 - DNA, 24 bp, Triatoma virus
tcatctggagacagatcatctagt

SEQ ID NO: 4073 - DNA, 24 bp, Duck adenovirus 1
acaggtaatacctctgccggatat

SEQ ID NO: 4074 - DNA, 24 bp, Duck adenovirus 1
tggtttgaaagatggtcctctgtc

SEQ ID NO: 4075 - DNA, 24 bp, Duck adenovirus 1
tgaagtttttgtgaccggtcagtg

SEQ ID NO: 4076 - DNA, 24 bp, Duck adenovirus 1
aaaagtgttagaatttgtaaatgg

SEQ ID NO: 4077 - DNA, 24 bp, Human herpesvirus 6
tgtggaaacagtactgtcttcaga

SEQ ID NO: 4078 - DNA, 24 bp, Human herpesvirus 6
tcgaatgaaagttttgttatatgg

SEQ ID NO: 4079 - DNA, 24 bp, Human herpesvirus 6
ggaggtagttggtatacgcgttta

SEQ ID NO: 4080 - DNA, 24 bp, Human herpesvirus 6
tcgaatgtgcgtgctctgaggaca

SEQ ID NO: 4081 - DNA, 24 bp, Human herpesvirus 6
gaaggtatctttcataagtttggc

SEQ ID NO: 4082 - DNA, 24 bp, Human herpesvirus 6
gtccagttgaaattagatttcatt

SEQ ID NO: 4083 - DNA, 24 bp, Alcelaphine herpesvirus 1
tgaggcaggccacttgcacttgca

SEQ ID NO: 4084 - DNA, 24 bp, Alcelaphine herpesvirus 1
cggaaaagctattttcaaatacat

SEQ ID NO: 4085 - DNA, 24 bp, Alcelaphine herpesvirus 1
tcagttaaagcccggaatgttttt

SEQ ID NO: 4086 - DNA, 24 bp, Alcelaphine herpesvirus 1
tgagcaacactccctgccccagct

SEQ ID NO: 4087 - DNA, 24 bp, Alcelaphine herpesvirus 1
agactcgcctgaccactagcccgg

SEQ ID NO: 4088 - DNA, 24 bp, Alcelaphine herpesvirus 1
tttgtccagactagcctaacacga

SEQ ID NO: 4089 - DNA, 24 bp, Human herpesvirus 1
tccccgggggaaaacaggatagct

SEQ ID NO: 4090 - DNA, 24 bp, Human herpesvirus 1
tggcggcgagattgatgcccatcg

SEQ ID NO: 4091 - DNA, 24 bp, Himetobi P virus
taacacatagtataagtcgattta

SEQ ID NO: 4092 - DNA, 24 bp, Himetobi P virus
ttagggatatattcgatgagattc

SEQ ID NO: 4093 - DNA, 24 bp, Himetobi P virus
agcagcaagaaagtgatgaggcat

SEQ ID NO: 4094 - DNA, 24 bp, Himetobi P virus
cagagtagggggagatatatggta

SEQ ID NO: 4095 - DNA, 24 bp, Himetobi P virus
aacaccattacctatcctggaaac

SEQ ID NO: 4096 - DNA, 24 bp, Himetobi P virus
ttatacggctcaccaagctcctcc

SEQ ID NO: 4097 - DNA, 24 bp, Himetobi P virus
tgtgatgcgtgcatacgttgtggg

SEQ ID NO: 4098 - DNA, 24 bp, Himetobi P virus
atgacatttcatccatcttactac

SEQ ID NO: 4099 - DNA, 24 bp, Cercopithecine herpesvirus 7
ttacatgcgaagagttgtattttg

SEQ ID NO: 4100 - DNA, 24 bp, Cercopithecine herpesvirus 7
ttgcatttaaagatccaagttctg

SEQ ID NO: 4101 - DNA, 24 bp, Cercopithecine herpesvirus 7
tgtaatatatatgccgtctaaact

SEQ ID NO: 4102 - DNA, 24 bp, Wheat streak mosaic virus
tggaatcccacaacttttaggtct

SEQ ID NO: 4103 - DNA, 24 bp, Wheat streak mosaic virus
tgcaaacagcttgttctgtattcc

SEQ ID NO: 4104 - DNA, 24 bp, Wheat streak mosaic virus
tgttaacttgatgagcttgccctc

SEQ ID NO: 4105 - DNA, 23 bp, Wheat streak mosaic virus
taccatatggtgttggcacgtgc

SEQ ID NO: 4106 - DNA, 24 bp, Cowpea aphid-borne mosaic virus
tgagagagaaattgcccagcactt

SEQ ID NO: 4107 - DNA, 24 bp, Cowpea aphid-borne mosaic virus
tgagatcatccaggccctgaacgc

SEQ ID NO: 4108 - DNA, 24 bp, Cowpea aphid-borne mosaic virus
taggacagttcaacagtaatgagt

SEQ ID NO: 4109 - DNA, 22 bp, Perina nuda picorna-like virus
tcaaaagtaggaagctcggggt

SEQ ID NO: 4110 - DNA, 24 bp, Perina nuda picorna-like virus
ctgcagtctgcataactcgtagtt

SEQ ID NO: 4111 - DNA, 24 bp, Perina nuda picorna-like virus
tttaatggtgtgacatcaaacgag

SEQ ID NO: 4112 - DNA, 24 bp, Perina nuda picorna-like virus
ttacaggttcaatagctttaccca

SEQ ID NO: 4113 - DNA, 24 bp, Perina nuda picorna-like virus
tgtggtaaagtaattgaccatgtt

SEQ ID NO: 4114 - DNA, 24 bp, Perina nuda picorna-like virus
tgaggtgccagaacgaaatttgag

SEQ ID NO: 4115 - DNA, 24 bp, Perina nuda picorna-like virus
taacaccagatttatccctattga

SEQ ID NO: 4116 - DNA, 24 bp, Perina nuda picorna-like virus
cggcacatgaaaaacggtcacatt

SEQ ID NO: 4117 - DNA, 24 bp, Perina nuda picorna-like virus
gtgtatttggtgcttccgtcttct

SEQ ID NO: 4118 - DNA, 24 bp, acute bee paralysis virus
tgtctgaacaacagtccccacatt

SEQ ID NO: 4119 - DNA, 24 bp, acute bee paralysis virus
tgatatccaaacaatctccagtgg

SEQ ID NO: 4120 - DNA, 24 bp, acute bee paralysis virus
aagaagcttataattataagccct

SEQ ID NO: 4121 - DNA, 21 bp, acute bee paralysis virus
taactgagtcaagtccgggga

SEQ ID NO: 4122 - DNA, 24 bp, acute bee paralysis virus
tggctagtttaaatgctaatgatg

SEQ ID NO: 4123 - DNA, 24 bp, Bean yellow mosaic virus
tgagaagttccttcgccacataat

SEQ ID NO: 4124 - DNA, 24 bp, Bean yellow mosaic virus
tatgacaaacttatactctttcat

SEQ ID NO: 4125 - DNA, 23 bp, Bean yellow mosaic virus
ttaaatccaaattaacgtgggtc

SEQ ID NO: 4126 - DNA, 24 bp, Bean yellow mosaic virus
tgatttaggtctgttggtctattg

SEQ ID NO: 4127 - DNA, 22 bp, Ryegrass mosaic virus
tgatatcgtacgtcgacttgct

SEQ ID NO: 4128 - DNA, 24 bp, Ryegrass mosaic virus
tgcgatgttgttgctaagtcgacc

SEQ ID NO: 4129 - DNA, 24 bp, Ryegrass mosaic virus
tgtcgtacatcaattcctcaaatt

SEQ ID NO: 4130 - DNA, 21 bp, Ryegrass mosaic virus
tttcatagttcgtccatcaac

SEQ ID NO: 4131 - DNA, 24 bp, Hepatitis GB virus A
tcaccggctggaatttctgtttcc

SEQ ID NO: 4132 - DNA, 23 bp, Hepatitis GB virus A
tgcgataccacctaagcttcacc

SEQ ID NO: 4133 - DNA, 24 bp, Hepatitis GB virus A
gatgccaccctgtgcctcgcccac

SEQ ID NO: 4134 - DNA, 24 bp, Hepatitis GB virus A
aatcaaagcaagtggcatccacag

SEQ ID NO: 4135 - DNA, 24 bp, Clover yellow vein virus
ttaaatggagtctctgtaagtgat

SEQ ID NO: 4136 - DNA, 24 bp, Clover yellow vein virus
ttgagccatattttgagaaagttg

SEQ ID NO: 4137 - DNA, 24 bp, Clover yellow vein virus
gtgcttggtcaagaacccataaat

SEQ ID NO: 4138 - DNA, 22 bp, Clover yellow vein virus
ttggtctagataccactcatga

SEQ ID NO: 4139 - DNA, 22 bp, Clover yellow vein virus
tcgaatgtacctagtaatttca

SEQ ID NO: 4140 - DNA, 24 bp, Clover yellow vein virus
taaagtggcagtttggaactgttt

SEQ ID NO: 4141 - DNA, 24 bp, Clover yellow vein virus
tgaggtataagtgctgtttgtcaa

SEQ ID NO: 4142 - DNA, 24 bp, Potato virus A
ttggtcctcaactcgaatctctac

SEQ ID NO: 4143 - DNA, 21 bp, Potato virus A
tatgatggatgttaccagctg

SEQ ID NO: 4144 - DNA, 24 bp, Potato virus A
tgtcatctagactttgaaactgaa

SEQ ID NO: 4145 - DNA, 24 bp, Potato virus A
tagggtagccctgttgatttgcca

SEQ ID NO: 4146 - DNA, 24 bp, Potato virus A
cagctgtgaatgttcgagtcttgt

SEQ ID NO: 4147 - DNA, 24 bp, Potato virus A
tgggatgtttctgacaccatactt

SEQ ID NO: 4148 - DNA, 24 bp, Potato virus A
tttaaactgaatttgggtgtttga

SEQ ID NO: 4149 - DNA, 24 bp, Bean common mosaic necrosis virus
tttcatgttcaatgagtcatagat

SEQ ID NO: 4150 - DNA, 24 bp, Bean common mosaic necrosis virus
taacattttcagcaagaggacgtg

SEQ ID NO: 4151 - DNA, 24 bp, Bean common mosaic necrosis virus
tgagtgaggagctaattgtgtcaa

SEQ ID NO: 4152 - DNA, 24 bp, Bean common mosaic necrosis virus
ttactattaaattcaaggagttgc

SEQ ID NO: 4153 - DNA, 21 bp, Bean common mosaic necrosis virus
ttaaaagcctctttgttgagc

SEQ ID NO: 4154 - DNA, 24 bp, Pepper mottle virus
taggctatcttcaaccactaattt

SEQ ID NO: 4155 - DNA, 24 bp, Pepper mottle virus
tgactggtaaattgtacgcaaagc

SEQ ID NO: 4156 - DNA, 24 bp, Pepper mottle virus
catcgcgaacaatgagtgatttat

SEQ ID NO: 4157 - DNA, 24 bp, Pepper mottle virus
tgaaatgcccaaacaccttgcgtc

SEQ ID NO: 4158 - DNA, 21 bp, Pepper mottle virus
tttgttggaagaagttcagga

SEQ ID NO: 4159 - DNA, 24 bp, Pepper mottle virus
tgatttattcctcgtccgagatga

SEQ ID NO: 4160 - DNA, 24 bp, Equine herpesvirus 2
tagtttaggcacttgaattctgcc

SEQ ID NO: 4161 - DNA, 24 bp, Equine herpesvirus 2
tgtgttagtagcctagaggcgttt

SEQ ID NO: 4162 - DNA, 24 bp, Equine herpesvirus 2
tacagcagcgcatcggcgccttat

SEQ ID NO: 4163 - DNA, 24 bp, Equine herpesvirus 2
tggctctgcagcgaactctacccg

SEQ ID NO: 4164 - DNA, 24 bp, Equine herpesvirus 2
tggcttcccaaacactctgtttgg

SEQ ID NO: 4165 - DNA, 24 bp, Equine herpesvirus 2
tcagactccgctcggtgctctgga

SEQ ID NO: 4166 - DNA, 24 bp, Equine herpesvirus 2
taatacttcagaagtctccggacg

SEQ ID NO: 4167 - DNA, 24 bp, Equine herpesvirus 2
agaagagattgggaacttctgtcg

SEQ ID NO: 4168 - DNA, 24 bp, Equine herpesvirus 2
taaggtttacgaggaacgtggttt

SEQ ID NO: 4169 - DNA, 23 bp, Equine herpesvirus 2
tgagatcttgtgcagtgttttgt

SEQ ID NO: 4170 - DNA, 24 bp, Equine herpesvirus 2
taagatagaaagggttggctatgt

SEQ ID NO: 4171 - DNA, 24 bp, Equine herpesvirus 2
tgagatattagggaacctggaccg

SEQ ID NO: 4172 - DNA, 24 bp, Equine herpesvirus 2
ttaacgctttttgaaagccgatac

SEQ ID NO: 4173 - DNA, 24 bp, Equine herpesvirus 2
tatttcaacaccacccctcgttca

SEQ ID NO: 4174 - DNA, 24 bp, Equine herpesvirus 2
tcagtacggatgtgtggtgtctat

SEQ ID NO: 4175 - DNA, 24 bp, Equine herpesvirus 2
cgaggtagtgatctgctgaaggct

SEQ ID NO: 4176 - DNA, 24 bp, Equine herpesvirus 2
tggatcaaccctgacgatgcacag

SEQ ID NO: 4177 - DNA, 21 bp, Equine herpesvirus 2
gttcacagactcttaggacca

SEQ ID NO: 4178 - DNA, 24 bp, Equine herpesvirus 2
agaggagaggaggacttgcgatta

SEQ ID NO: 4179 - DNA, 21 bp, Infectious flacherie virus
ttcaaaagcgtaggattacgt

SEQ ID NO: 4180 - DNA, 24 bp, Infectious flacherie virus
tcagttttcataagtgtaaacggt

SEQ ID NO: 4181 - DNA, 24 bp, Cocksfoot streak virus (CSV)
tgttatcaaccatttgttcgcgaa

SEQ ID NO: 4182 - DNA, 24 bp, Cocksfoot streak virus (CSV)
tgaagcgttctgagtgacgacagg

SEQ ID NO: 4183 - DNA, 22 bp, Cocksfoot streak virus (CSV)
tatcagcagtttaccgagggcg

SEQ ID NO: 4184 - DNA, 24 bp, Cocksfoot streak virus (CSV)
ttgaaaggctccattcctaatagc

SEQ ID NO: 4185 - DNA, 24 bp, Cocksfoot streak virus (CSV)
tgacgtgtttcaaccttaaacacg

SEQ ID NO: 4186 - DNA, 21 bp, Cocksfoot streak virus (CSV)
catcgcagttgatttaagcgc

SEQ ID NO: 4187 - DNA, 24 bp, Cocksfoot streak virus (CSV)
taaggaaaccttctccatcggacg

SEQ ID NO: 4188 - DNA, 24 bp, Cocksfoot streak virus (CSV)
aagcttagaagaagtttgatgttg

SEQ ID NO: 4189 - DNA, 24 bp, Brome streak mosaic virus
tcagtgatatcgtctcgctccatg

SEQ ID NO: 4190 - DNA, 24 bp, Brome streak mosaic virus
ttcgttgtcctggttaagtttttc

SEQ ID NO: 4191 - DNA, 24 bp, Brome streak mosaic virus
aaaagtggcgaaacacgcgccctg

SEQ ID NO: 4192 - DNA, 24 bp, Brome streak mosaic virus
tcagatcgtagatttccactgtgt

SEQ ID NO: 4193 - DNA, 24 bp, Brome streak mosaic virus
tagaaggctttgtgtgagtttgtg

SEQ ID NO: 4194 - DNA, 24 bp, Brome streak mosaic virus
tgatgtgaatgttctcgtcttgtt

SEQ ID NO: 4195 - DNA, 24 bp, Gallid herpesvirus 2
tcgattagatcgagctttgaaaag

SEQ ID NO: 4196 - DNA, 24 bp, Gallid herpesvirus 2
tcaacagtttgcgagtccaactct

SEQ ID NO: 4197 - DNA, 24 bp, Gallid herpesvirus 2
tttacagatggaattataatagag

SEQ ID NO: 4198 - DNA, 24 bp, Gallid herpesvirus 2
tgtcataacttcataaatagtctt

SEQ ID NO: 4199 - DNA, 24 bp, Plum pox virus
aaaactgattattgaagtcatcaa

SEQ ID NO: 4200 - DNA, 24 bp, Plum pox virus
agagatagtttcgaagtcattgcc

SEQ ID NO: 4201 - DNA, 24 bp, Plum pox virus
ttcacaaatttgcgtgttttcgtt

SEQ ID NO: 4202 - DNA, 24 bp, Plum pox virus
ttgaattctagcaactgagacttc

SEQ ID NO: 4203 - DNA, 24 bp, Johnsongrass mosaic virus
taagtgagccaaaagtgtcaacta

SEQ ID NO: 4204 - DNA, 22 bp, Johnsongrass mosaic virus
tgagatgattctggtagaactg

SEQ ID NO: 4205 - DNA, 24 bp, Johnsongrass mosaic virus
tatcttgaggaccagcttctttac

SEQ ID NO: 4206 - DNA, 24 bp, Johnsongrass mosaic virus
tgatatgctttggaaatgactatg

SEQ ID NO: 4207 - DNA, 24 bp, Alcelaphine herpesvirus 1
acaagtgcatgttaattagtttgt

SEQ ID NO: 4208 - DNA, 24 bp, Alcelaphine herpesvirus 1
tagctgagccacgaggtcacagat

SEQ ID NO: 4209 - DNA, 23 bp, Alcelaphine herpesvirus 1
tgagtaggagggctcctgtgtac

SEQ ID NO: 4210 - DNA, 24 bp, Alcelaphine herpesvirus 1
tgttattgttttggttggagtttc

SEQ ID NO: 4211 - DNA, 24 bp, Aphid lethal paralysis virus
ataaagatcggctgttttaaatcc

SEQ ID NO: 4212 - DNA, 24 bp, Aphid lethal paralysis virus
taatttattaatataaagcgtatt

SEQ ID NO: 4213 - DNA, 24 bp, Aphid lethal paralysis virus
tagcattagtcaaatctgcaaaca

SEQ ID NO: 4214 - DNA, 24 bp, Aphid lethal paralysis virus
tgaaatcatcgcccacagctctat

SEQ ID NO: 4215 - DNA, 24 bp, Aphid lethal paralysis virus
tgagtacgtacaacctaccaacag

SEQ ID NO: 4216 - DNA, 24 bp, Aphid lethal paralysis virus
tcaccaggaacaaataaaatccta

SEQ ID NO: 4217 - DNA, 24 bp, Aphid lethal paralysis virus
agctgttctagtctcatcgatgac

SEQ ID NO: 4218 - DNA, 24 bp, Aphid lethal paralysis virus
tgagatagcattactacaattctc

SEQ ID NO: 4219 - DNA, 24 bp, Potato virus V
aaagagctgtcgaactgagatccg

SEQ ID NO: 4220 - DNA, 24 bp, Potato virus V
ttaagtgcaagctcagtaatgtat

SEQ ID NO: 4221 - DNA, 24 bp, Potato virus V
tgagatcgcactatgagtgttcca

SEQ ID NO: 4222 - DNA, 24 bp, Potato virus V
tgtggtatgcatgtatcagacttc

SEQ ID NO: 4223 - DNA, 24 bp, Parsnip yellow fleck virus
tttgtccaaggctcttctctcatc

SEQ ID NO: 4224 - DNA, 22 bp, Parsnip yellow fleck virus
tgtaatcgatgcaattgctttt

SEQ ID NO: 4225 - DNA, 22 bp, Parsnip yellow fleck virus
tcagtttaaagccatgaagggc

SEQ ID NO: 4226 - DNA, 24 bp, Parsnip yellow fleck virus
tgagtattaggattgtgccaaact

SEQ ID NO: 4227 - DNA, 24 bp, Parsnip yellow fleck virus
tgagttactatcatgcgcagaaac

SEQ ID NO: 4228 - DNA, 24 bp, Pea seed-borne mosaic virus
taagctatgtgtcttctcaatggt

SEQ ID NO: 4229 - DNA, 24 bp, Pea seed-borne mosaic virus
tgaaatgcgccattatctgtctga

SEQ ID NO: 4230 - DNA, 24 bp, Pea seed-borne mosaic virus
tatcagagccaaacatcattgcca

SEQ ID NO: 4231 - DNA, 22 bp, Ectromelia virus
cagaatgtcggtgattcgtgtt

SEQ ID NO: 4232 - DNA, 24 bp, Ectromelia virus
tatcataagcttgactacatttgg

SEQ ID NO: 4233 - DNA, 24 bp, Ectromelia virus
taataccattggatgcaccattgg

SEQ ID NO: 4234 - DNA, 24 bp, Cowpox virus
tcaggaatccaaagagctataaat

SEQ ID NO: 4235 - DNA, 24 bp, Cowpox virus
tgagatcttctattttatcatttt

SEQ ID NO: 4236 - DNA, 22 bp, Camelpox virus
taatatcgacaatttcatacgc

SEQ ID NO: 4237 - DNA, 24 bp, Ectromelia virus
taatcgttcgaactcgtctcccca

SEQ ID NO: 4238 - DNA, 24 bp, Camelpox virus
taggttattgacattgtatggttt

SEQ ID NO: 4239 - DNA, 24 bp, Ectromelia virus
tctggcggctagaatggcataatc

SEQ ID NO: 4240 - DNA, 24 bp, Ectromelia virus
tgatttatcgatggtattaagaat

SEQ ID NO: 4241 - DNA, 24 bp, Ectromelia virus
tgacgtacgtagcgtacaaaatga

SEQ ID NO: 4242 - DNA, 24 bp, Ectromelia virus
tggctgatagtgtcactgcacaag

SEQ ID NO: 4243 - DNA, 24 bp, Cowpox virus
tagcgcatctttaactcgtcagtt

SEQ ID NO: 4244 - DNA, 22 bp, Cowpox virus
tcaccacgtgtgtttcaggatc

SEQ ID NO: 4245 - DNA, 24 bp, Cowpox virus
taaaatggcataatctggatgttg

SEQ ID NO: 4246 - DNA, 24 bp, Cowpox virus
tttcaacgatcttgttatttattt

SEQ ID NO: 4247 - DNA, 24 bp, Cowpox virus
tgatttatcgatggtattaagaat

SEQ ID NO: 4248 - DNA, 24 bp, Cowpox virus
tgactagataaactatcagtaagt

SEQ ID NO: 4249 - DNA, 24 bp, Monkeypox virus
taagtgatacaaaactatctcgac

SEQ ID NO: 4250 - DNA, 24 bp, Monkeypox virus
tgatttatcgatggtattaagaat

SEQ ID NO: 4251 - DNA, 24 bp, Monkeypox virus
tgactagataaactatcagtaagt

SEQ ID NO: 4252 - DNA, 24 bp, Monkeypox virus
tcaggaatccaaagagctataaat

SEQ ID NO: 4253 - DNA, 23 bp, Variola virus
ttagtatttttattaatcctttg

SEQ ID NO: 4254 - DNA, 24 bp, Vaccinia virus
tcaggaatccaaagagctataaat

SEQ ID NO: 4255 - DNA, 24 bp, Variola virus
tgtaaacttgacaaaaattgtgac

SEQ ID NO: 4256 - DNA, 24 bp, Variola virus
ttagagatttcagcttctggaata

SEQ ID NO: 4257 - DNA, 24 bp, Variola virus
aaccaattcctttttgcctgtatc

SEQ ID NO: 4258 - DNA, 24 bp, Vaccinia virus
tgactagataaactatcagtaagt

SEQ ID NO: 4259 - DNA, 22 bp, Macaca mulatta rhadinovirus
tgggttccgggggcgttacgat

SEQ ID NO: 4260 - DNA, 24 bp, Macaca mulatta rhadinovirus
ttaaataccagggatacaggctgt

SEQ ID NO: 4261 - DNA, 24 bp, Macaca mulatta rhadinovirus
tggaaaaattaaggctttgcgtta

SEQ ID NO: 4262 - DNA, 24 bp, Macaca mulatta rhadinovirus
tgggtcccttccacgtcgcaatga

SEQ ID NO: 4263 - DNA, 24 bp, Macaca mulatta rhadinovirus
cggccaacgcgccagcgtccaacc

SEQ ID NO: 4264 - DNA, 24 bp, Macaca mulatta rhadinovirus
taaactgcgaaagggcgtacatcg

SEQ ID NO: 4265 - DNA, 24 bp, Macaca mulatta rhadinovirus
tgcgatcgcggggtctgacccacc

SEQ ID NO: 4266 - DNA, 24 bp, Macaca mulatta rhadinovirus
tgatatgttctgatgaccgccgcc

SEQ ID NO: 4267 - DNA, 24 bp, Macaca mulatta rhadinovirus
ttgggcagcgaatcagtgtctgtc

SEQ ID NO: 4268 - DNA, 24 bp, Macaca mulatta rhadinovirus
ttagggaatctaaaaacgaaatcc

SEQ ID NO: 4269 - DNA, 22 bp, Bean common mosaic virus
ttgaatctcctgcaccacggct

SEQ ID NO: 4270 - DNA, 22 bp, Bean common mosaic virus
tgtgcattgttgacatcatttg

SEQ ID NO: 4271 - DNA, 24 bp, Bean common mosaic virus
tgaaataagcttgaattccaggtt

SEQ ID NO: 4272 - DNA, 24 bp, Bean common mosaic virus
tgagattttgaattcttcttttgg

SEQ ID NO: 4273 - DNA, 23 bp, Bean common mosaic virus
ttcagaatacattggtgttccat

SEQ ID NO: 4274 - DNA, 22 bp, Bean common mosaic virus
atcaaaagcgtagcgagctaga

SEQ ID NO: 4275 - DNA, 24 bp, Human herpesvirus 5
tgaggtagaagacaaactcgcgta

SEQ ID NO: 4276 - DNA, 21 bp, Human herpesvirus 5
tacaatagtgacgtgggatcc

SEQ ID NO: 4277 - DNA, 24 bp, Human herpesvirus 5
cacccgtctcgtggtacgaagtag

SEQ ID NO: 4278 - DNA, 24 bp, Human herpesvirus 5
tgagattgagatcccgggagcgtt

SEQ ID NO: 4279 - DNA, 24 bp, Human herpesvirus 5
tatcggaactgacgaaagagctca

SEQ ID NO: 4280 - DNA, 24 bp, Human herpesvirus 5
ttggtccaagtggtttagcgaggc

SEQ ID NO: 4281 - DNA, 24 bp, Human herpesvirus 5
tagctgcaggccgcctagcgcttc

SEQ ID NO: 4282 - DNA, 24 bp, Rhopalosiphum padi virus
agccgtaattcctaatgagcagca

SEQ ID NO: 4283 - DNA, 24 bp, Rhopalosiphum padi virus
tgtaaagcgtaacaatggcatttt

SEQ ID NO: 4284 - DNA, 24 bp, Rhopalosiphum padi virus
gcgagcacaaacacaaacacacgg

SEQ ID NO: 4285 - DNA, 24 bp, Rhopalosiphum padi virus
tagaataagcttcagactggcgag

SEQ ID NO: 4286 - DNA, 22 bp, Rhopalosiphum padi virus
ttcaaaggtacaatagttcggg

SEQ ID NO: 4287 - DNA, 24 bp, Rhopalosiphum padi virus
taacgaaaaagcaccaattgcagc

SEQ ID NO: 4288 - DNA, 24 bp, Rhopalosiphum padi virus
tgtaaacgttgtaaattagaagtc

SEQ ID NO: 4289 - DNA, 21 bp, Rhopalosiphum padi virus
tgagattggtatcgtatagcc

SEQ ID NO: 4290 - DNA, 24 bp, Rhopalosiphum padi virus
cggggttatggcactaaaacgctt

SEQ ID NO: 4291 - DNA, 24 bp, Rhopalosiphum padi virus
tatccgaaccatctgaattacaca

SEQ ID NO: 4292 - DNA, 24 bp, Saimiriine herpesvirus 2
ttgaatcagatgtgtttgcaggat

SEQ ID NO: 4293 - DNA, 24 bp, Saimiriine herpesvirus 2
tcagtgcctggagttgttctttca

SEQ ID NO: 4294 - DNA, 24 bp, Saimiriine herpesvirus 2
tgacatatttgatatgatgtcttc

SEQ ID NO: 4295 - DNA, 24 bp, Saimiriine herpesvirus 2
tgatatgtctgttttatcttgttt

SEQ ID NO: 4296 - DNA, 24 bp, Saimiriine herpesvirus 2
tgactcaatgtttcactttctata

SEQ ID NO: 4297 - DNA, 21 bp, Saimiriine herpesvirus 2
tattttgagctgactctagtt

SEQ ID NO: 4298 - DNA, 24 bp, Saimiriine herpesvirus 2
tagcattttgtaaaactgaaagat

SEQ ID NO: 4299 - DNA, 21 bp, Saimiriine herpesvirus 2
tgtgtagtttcagtatctagg

SEQ ID NO: 4300 - DNA, 24 bp, Ateline herpesvirus 3
tgatatgttatctagcaaggcttt

SEQ ID NO: 4301 - DNA, 24 bp, Ateline herpesvirus 3
tataacagtggtgtttctgcaata

SEQ ID NO: 4302 - DNA, 24 bp, Ateline herpesvirus 3
tacacagggtttgggttccctggc

SEQ ID NO: 4303 - DNA, 24 bp, Ateline herpesvirus 3
tcattcataattatctttattatg

SEQ ID NO: 4304 - DNA, 24 bp, Ateline herpesvirus 3
taagatcttttgtaggtattgaaa

SEQ ID NO: 4305 - DNA, 24 bp, Leek yellow stripe potyvirus
caaagtgtttataaggtggttgta

SEQ ID NO: 4306 - DNA, 24 bp, Leek yellow stripe potyvirus
tactgcaactggtgcgcctgtttg

SEQ ID NO: 4307 - DNA, 24 bp, Leek yellow stripe potyvirus
tgggatccgcatctgttaagttga

SEQ ID NO: 4308 - DNA, 24 bp, Leek yellow stripe potyvirus
gagcgtagttaaaagatgaacagg

SEQ ID NO: 4309 - DNA, 24 bp, Human adenovirus E
tttgacagtttggtgatggatcag

SEQ ID NO: 4310 - DNA, 24 bp, Human adenovirus E
tccacagacccttgagttcttctg

SEQ ID NO: 4311 - DNA, 24 bp, Human adenovirus E
tgggacggccgcgtcggaggtggc

SEQ ID NO: 4312 - DNA, 24 bp, Human adenovirus E
taaggtaagctttatgtttccatc

SEQ ID NO: 4313 - DNA, 24 bp, Human adenovirus E
tgaggtacttcttgtggggcttac

SEQ ID NO: 4314 - DNA, 22 bp, Taura syndrome virus
tgggattcaactacagcacttt

SEQ ID NO: 4315 - DNA, 23 bp, Taura syndrome virus
tgaattgcgtgcctccttgagtc

SEQ ID NO: 4316 - DNA, 24 bp, Taura syndrome virus
taagtggattgagaacggaaatga

SEQ ID NO: 4317 - DNA, 24 bp, Taura syndrome virus
tactacatttgccaccgcaccaac

SEQ ID NO: 4318 - DNA, 24 bp, Taura syndrome virus
tggaatgtgtgatttgtagcgtcg

SEQ ID NO: 4319 - DNA, 24 bp, Taura syndrome virus
ttagatccagctacgatgcgtgca

SEQ ID NO: 4320 - DNA, 24 bp, Chimpanzee cytomegalovirus
taatgggtctggtggtaactgtat

SEQ ID NO: 4321 - DNA, 24 bp, Chimpanzee cytomegalovirus
cgggatcctcatgtggctctgggt

SEQ ID NO: 4322 - DNA, 24 bp, Chimpanzee cytomegalovirus
tacatagacactgacgcgcgctag

SEQ ID NO: 4323 - DNA, 24 bp, Chimpanzee cytomegalovirus
tcattgaactgaataatacctgcg

SEQ ID NO: 4324 - DNA, 24 bp, Chimpanzee cytomegalovirus
tgagcgaaccgccggcggcggtgg

SEQ ID NO: 4325 - DNA, 21 bp, Chimpanzee cytomegalovirus
cgtcatgaccgtcaatgagcg

SEQ ID NO: 4326 - DNA, 21 bp, Chimpanzee cytomegalovirus
tctcatggcggtgtagcggcg

SEQ ID NO: 4327 - DNA, 24 bp, Chimpanzee cytomegalovirus
tagtatgtgtatatatggttatag

SEQ ID NO: 4328 - DNA, 24 bp, Fowl adenovirus D
tcgaagacggtatacgtctcgatg

SEQ ID NO: 4329 - DNA, 24 bp, Fowl adenovirus D
tcggaaaagccgttcgatgagcgc

SEQ ID NO: 4330 - DNA, 24 bp, Fowl adenovirus D
tgagggactcgggttcctcgtagg

SEQ ID NO: 4331 - DNA, 24 bp, Fowl adenovirus D
cgtgcatgccgagttcgtctttga

SEQ ID NO: 4332 - DNA, 24 bp, Fowl adenovirus D
tgagatggccattgggaagcagga

SEQ ID NO: 4333 - DNA, 24 bp, Bovine herpesvirus 4
taggatgagttctttaattttcaa

SEQ ID NO: 4334 - DNA, 24 bp, Bovine herpesvirus 4
taatgtatctattagttcatctat

SEQ ID NO: 4335 - DNA, 24 bp, Bovine herpesvirus 4
tgaggtgcttctcattttctatga

SEQ ID NO: 4336 - DNA, 24 bp, Bovine herpesvirus 4
ttctcagttttagggattcaatat

SEQ ID NO: 4337 - DNA, 24 bp, Bovine herpesvirus 4
tcattgggtggtggtatgccaagg

SEQ ID NO: 4338 - DNA, 24 bp, Bovine herpesvirus 4
tagcatgggtgtcatatcagcagt

SEQ ID NO: 4339 - DNA, 24 bp, Bovine herpesvirus 4
tgggaactatatataggaatgtac

SEQ ID NO: 4340 - DNA, 24 bp, Bovine herpesvirus 4
tcacaactataggtgttgttgggg

SEQ ID NO: 4341 - DNA, 24 bp, Bovine herpesvirus 4
ttacattgagatattccatgaatg

SEQ ID NO: 4342 - DNA, 21 bp, Bovine herpesvirus 4
tatcaataaatgtaattaagg

SEQ ID NO: 4343 - DNA, 24 bp, Bovine herpesvirus 4
ttgggcatctatttgttttttgga

SEQ ID NO: 4344 - DNA, 24 bp, Bovine herpesvirus 4
tgaggtctaggatgagattttcag

SEQ ID NO: 4345 - DNA, 24 bp, Bovine herpesvirus 4
tatggtatcctctggagttggggg

SEQ ID NO: 4346 - DNA, 24 bp, Human herpesvirus 8
tcagatcgacccggactacagtta

SEQ ID NO: 4347 - DNA, 24 bp, Human herpesvirus 8
ccacctgagtaccccattggttta

SEQ ID NO: 4348 - DNA, 24 bp, Human herpesvirus 8
tgcgacctgcacgaaacagacatt

SEQ ID NO: 4349 - DNA, 24 bp, Human herpesvirus 8
gtgtattatctcctggtgggctac

SEQ ID NO: 4350 - DNA, 24 bp, Human herpesvirus 8
tagagtactgcggtttagctagtt

SEQ ID NO: 4351 - DNA, 24 bp, Human herpesvirus 8
tcagtgccacaatttcattaacaa

SEQ ID NO: 4352 - DNA, 24 bp, Cell fusing agent virus
tgccgtattttgagtgtgttcgtg

SEQ ID NO: 4353 - DNA, 24 bp, Cell fusing agent virus
tgtaatcgtcctgttgacccgccg

SEQ ID NO: 4354 - DNA, 24 bp, Cell fusing agent virus
agcggtatgtcgccaaccatctgt

SEQ ID NO: 4355 - DNA, 24 bp, Dengue virus
tggaatgatgctgaggagacagca

SEQ ID NO: 4356 - DNA, 24 bp, Dengue virus
tttggtatcttattggaagtcctc

SEQ ID NO: 4357 - DNA, 24 bp, Dengue virus
tgtcaacatgtcttccgtcgtcat

SEQ ID NO: 4358 - DNA, 24 bp, Human herpesvirus 8
tgcggtagtggtttgcgatgtagt

SEQ ID NO: 4359 - DNA, 24 bp, Human herpesvirus 8
tgcgtgtcgggagggcgccggcct

SEQ ID NO: 4360 - DNA, 24 bp, Human herpesvirus 8
tggcatacctgtccgcatccgtgc

SEQ ID NO: 4361 - DNA, 24 bp, Human herpesvirus 8
tgcggtgttccgggcagaccccgt

SEQ ID NO: 4362 - DNA, 24 bp, Human herpesvirus 8
tcacctgcgcctcaaccagggtca

SEQ ID NO: 4363 - DNA, 24 bp, Yellow fever virus
ctcacagacctctggaggaaaagc

SEQ ID NO: 4364 - DNA, 24 bp, Yellow fever virus
taatgtagctgtctccaaaaggtg

SEQ ID NO: 4365 - DNA, 24 bp, Yellow fever virus
tgactattgtcattgcctcaggca

SEQ ID NO: 4366 - DNA, 24 bp, Yellow fever virus
tcagcgatgtaactgttaccaaag

SEQ ID NO: 4367 - DNA, 24 bp, Molluscum contagiosum virus
cggcatggtctccaggctggtcag

SEQ ID NO: 4368 - DNA, 24 bp, Molluscum contagiosum virus
tgcccgtagctacacatacgcgcg

SEQ ID NO: 4369 - DNA, 24 bp, Molluscum contagiosum virus
tccacggaaacaagagagttcacg

SEQ ID NO: 4370 - DNA, 24 bp, Molluscum contagiosum virus
tacgcagtgccggatggcggggaa

SEQ ID NO: 4371 - DNA, 24 bp, Molluscum contagiosum virus
taacttttgtccgaggttcttccg

SEQ ID NO: 4372 - DNA, 24 bp, Cercopithecine herpesvirus 7
ttcttcgccgttgtttacccgctg

SEQ ID NO: 4373 - DNA, 24 bp, Cercopithecine herpesvirus 7
taatacagttaatattgatggcac

SEQ ID NO: 4374 - DNA, 21 bp, Cercopithecine herpesvirus 7
tgtcgtctatgtaagcgtgcg

SEQ ID NO: 4375 - DNA, 21 bp, Cercopithecine herpesvirus 7
ttgccgatagtcccgtgggga

SEQ ID NO: 4376 - DNA, 24 bp, infectious spleen and kidney necrosis virus
tgcaagtacaggccggcgcactgg

SEQ ID NO: 4377 - DNA, 24 bp, infectious spleen and kidney necrosis virus
tgcacagtgacctgcgggtcaggc

SEQ ID NO: 4378 - DNA, 24 bp, infectious spleen and kidney necrosis virus
tgtcatggaccatcgtggctacgg

SEQ ID NO: 4379 - DNA, 24 bp, Human adenovirus D
tgagacagcggtcgggcgaagagg

SEQ ID NO: 4380 - DNA, 24 bp, Human adenovirus D
tgtcataatctttaggttgctgcc

SEQ ID NO: 4381 - DNA, 24 bp, Human adenovirus D
tatcacagcacacggattaaagga

SEQ ID NO: 4382 - DNA, 24 bp, Human adenovirus D
ccccctgtgggtgttttctagcca

SEQ ID NO: 4383 - DNA, 24 bp, Tick-borne encephalitis virus
tgagttaatggcaagcccgagcgt

SEQ ID NO: 4384 - DNA, 24 bp, Tick-borne encephalitis virus
tgtcggaagtgctttcttttctct

SEQ ID NO: 4385 - DNA, 24 bp, Tick-borne encephalitis virus
tcaagtgaaagttacccatcgcgt

SEQ ID NO: 4386 - DNA, 24 bp, Viral hemorrhagic septicemia virus
tgacctgttgtctttgggggcgtt

SEQ ID NO: 4387 - DNA, 24 bp, Viral hemorrhagic septicemia virus
tgaaaggggtattcccaccctttc

SEQ ID NO: 4388 - DNA, 24 bp, Viral hemorrhagic septicemia virus
tctggcagatggccgtgagcagga

SEQ ID NO: 4389 - DNA, 24 bp, Viral hemorrhagic septicemia virus
ttcccagtctcctgattttagtcc

SEQ ID NO: 4390 - DNA, 24 bp, Viral hemorrhagic septicemia virus
tgagacgggagtgccttttagtca

SEQ ID NO: 4391 - DNA, 24 bp, Viral hemorrhagic septicemia virus
tgaacggaggtgaggttgcacacg

SEQ ID NO: 4392 - DNA, 24 bp, Vesicular stomatitis Indiana virus
agagttatggacagtggggcatat

SEQ ID NO: 4393 - DNA, 24 bp, Vesicular stomatitis Indiana virus
tgggttcatcgattaatttcttca

SEQ ID NO: 4394 - DNA, 23 bp, Vesicular stomatitis Indiana virus
tagaaaacctatacatctgccga

SEQ ID NO: 4395 - DNA, 24 bp, Vesicular stomatitis Indiana virus
ttgcatatcggttccaccatttta

SEQ ID NO: 4396 - DNA, 24 bp, Vesicular stomatitis Indiana virus
tgggattggcttgacatgatgtta

SEQ ID NO: 4397 - DNA, 24 bp, Vesicular stomatitis Indiana virus
tctcaggccgagcaggatggcctc

SEQ ID NO: 4398 - DNA, 22 bp, Chimpanzee cytomegalovirus
tcaacggtgttgatgttctgcg

SEQ ID NO: 4399 - DNA, 24 bp, Chimpanzee cytomegalovirus
tacagcgtgagcgacgacagcgtc

SEQ ID NO: 4400 - DNA, 24 bp, Chimpanzee cytomegalovirus
tgccaggcgcgcagctcgtggaag

SEQ ID NO: 4401 - DNA, 24 bp, Ectocarpus siliculosus virus
tttcttgccacatcacacgatttg

SEQ ID NO: 4402 - DNA, 24 bp, Ectocarpus siliculosus virus
tcagatactcaagtaccaaacatg

SEQ ID NO: 4403 - DNA, 24 bp, Ectocarpus siliculosus virus
gcagcacgatttagtgagctacgc

SEQ ID NO: 4404 - DNA, 24 bp, Ectocarpus siliculosus virus
cagcacgataaatcgtattacgtt

SEQ ID NO: 4405 - DNA, 24 bp, Ectocarpus siliculosus virus
cagcacgataaatcgtattacgtt

SEQ ID NO: 4406 - DNA, 24 bp, Ectocarpus siliculosus virus
cagcacgataaatcgtattacgtt

SEQ ID NO: 4407 - DNA, 24 bp, Ectocarpus siliculosus virus
gcagcacgatttagtgagctgcac

SEQ ID NO: 4408 - DNA, 24 bp, Ectocarpus siliculosus virus
cagcacgataaatcgtattacgtt

SEQ ID NO: 4409 - DNA, 24 bp, Ectocarpus siliculosus virus
atcgtattacgttgcagcacgatt

SEQ ID NO: 4410 - DNA, 24 bp, Ectocarpus siliculosus virus
cagcacgataaatcgtgttacgtt

SEQ ID NO: 4411 - DNA, 24 bp, Ectocarpus siliculosus virus
aagcacaataaatcgtgttacgtt

SEQ ID NO: 4412 - DNA, 24 bp, Ectocarpus siliculosus virus
cagcacgatttagtgagctgcaca

SEQ ID NO: 4413 - DNA, 23 bp, Ectocarpus siliculosus virus
gcagcacgatttagtgagctacg

SEQ ID NO: 4414 - DNA, 24 bp, Ectocarpus siliculosus virus
aagcacgataaatcgtgttacgtt

SEQ ID NO: 4415 - DNA, 23 bp, Ectocarpus siliculosus virus
gcagcacgatttagtgagctgca

SEQ ID NO: 4416 - DNA, 24 bp, Ectocarpus siliculosus virus
gcagcacgatttagtgagctatgc

SEQ ID NO: 4417 - DNA, 23 bp, Ectocarpus siliculosus virus
gcagcacgatttagtgagctgca

SEQ ID NO: 4418 - DNA, 24 bp, Ectocarpus siliculosus virus
tgagggaagaagcggggccgtgga

SEQ ID NO: 4419 - DNA, 24 bp, Bovine adenovirus B
agtcagtggccgctaaacaaaaaa

SEQ ID NO: 4420 - DNA, 24 bp, Semliki forest virus
tcaatggcttcctggattttcttc

SEQ ID NO: 4421 - DNA, 24 bp, Semliki forest virus
agaggtgtataacaggtcctctca

SEQ ID NO: 4422 - DNA, 21 bp, Semliki forest virus
taggatggtgcacacccggcc

SEQ ID NO: 4423 - DNA, 24 bp, Sindbis virus
tagctaagccttctacacggtcct

SEQ ID NO: 4424 - DNA, 24 bp, Sindbis virus
tgcctcacttctcatgttgactgg

SEQ ID NO: 4425 - DNA, 24 bp, Sindbis virus
tggtgtacacaggatggcgatggt

SEQ ID NO: 4426 - DNA, 24 bp, Sindbis virus
tgagatccttgctagtcaaggagg

SEQ ID NO: 4427 - DNA, 24 bp, Sindbis virus
caaggaatttttttaccgtgaacg

SEQ ID NO: 4428 - DNA, 23 bp, Molluscum contagiosum virus
tcccgtgcacgctggcgcatgtg

SEQ ID NO: 4429 - DNA, 21 bp, Molluscum contagiosum virus
tggccagcacgccgtcgcggt

SEQ ID NO: 4430 - DNA, 24 bp, Rat cytomegalovirus
cgagatctgccggatcatcaccag

SEQ ID NO: 4431 - DNA, 24 bp, Rat cytomegalovirus
tcccagccgctctttgctccgcgc

SEQ ID NO: 4432 - DNA, 24 bp, Myxoma virus
tcagtctggcccaagacacgacgt

SEQ ID NO: 4433 - DNA, 24 bp, Myxoma virus
tgagagaaggcagataagagtacg

SEQ ID NO: 4434 - DNA, 24 bp, Myxoma virus
tgacttcgtacgcacgacgtgtcg

SEQ ID NO: 4435 - DNA, 24 bp, Rabies virus
tccctagtctcggattctcgggca

SEQ ID NO: 4436 - DNA, 24 bp, Rabies virus
tgaggaactgtcgtgcctaccact

SEQ ID NO: 4437 - DNA, 24 bp, Rabies virus
tcaagaggtctattaatattgata

SEQ ID NO: 4438 - DNA, 24 bp, Rabies virus
tagattcttttaacgatagagctc

SEQ ID NO: 4439 - DNA, 24 bp, Rabies virus
tgtcatcaggaaaattatcaacat

SEQ ID NO: 4440 - DNA, 24 bp, Rabies virus
tttaaggtggtaggatcttctaga

SEQ ID NO: 4441 - DNA, 24 bp, Rabies virus
taccacttggagtacttatcaaaa

SEQ ID NO: 4442 - DNA, 24 bp, Rabies virus
gtgcatccttcgtcctccactacc

SEQ ID NO: 4443 - DNA, 24 bp, Rabies virus
tgagggatagaaaatatctcttct

SEQ ID NO: 4444 - DNA, 24 bp, Human herpesvirus 3
tgtaaaaactgtcgttgccccggt

SEQ ID NO: 4445 - DNA, 24 bp, Human herpesvirus 3
tgaccggtaataacagtatccaac

SEQ ID NO: 4446 - DNA, 24 bp, Human herpesvirus 3
tattacattgtgaagttaaaaccg

SEQ ID NO: 4447 - DNA, 24 bp, Human herpesvirus 3
tccacaggcaataaaaaaaattcg

SEQ ID NO: 4448 - DNA, 24 bp, Human herpesvirus 3
taagagcagatagttttgtgcgat

SEQ ID NO: 4449 - DNA, 24 bp, Human herpesvirus 3
ggaggtaatctcaagtattggttt

SEQ ID NO: 4450 - DNA, 24 bp, Human herpesvirus 3
caccctatctttataagtatgcag

SEQ ID NO: 4451 - DNA, 22 bp, Human herpesvirus 3
ttggatcattggatcacttaaa

SEQ ID NO: 4452 - DNA, 24 bp, Cercopithecine herpesvirus 7
tgaggtcaatatccccaaaagagg

SEQ ID NO: 4453 - DNA, 24 bp, Cercopithecine herpesvirus 7
tatcggaaggtttgagtgactgaa

SEQ ID NO: 4454 - DNA, 24 bp, Cercopithecine herpesvirus 7
aggggtattggctaaaggtttgct

SEQ ID NO: 4455 - DNA, 24 bp, Cercopithecine herpesvirus 7
tcacatgcagatatagattggcgc

SEQ ID NO: 4456 - DNA, 24 bp, Cercopithecine herpesvirus 7
ttaatgctggaaccgacgatacta

SEQ ID NO: 4457 - DNA, 24 bp, Cercopithecine herpesvirus 7
tgatattttcacagttttccagtc

SEQ ID NO: 4458 - DNA, 24 bp, Camelpox virus
ttcacggtcttagtatttttagat

SEQ ID NO: 4459 - DNA, 22 bp, Camelpox virus
taatatttttgtgagaccatcg

SEQ ID NO: 4460 - DNA, 24 bp, Camelpox virus
tacaacatactgtttagatgatag

SEQ ID NO: 4461 - DNA, 24 bp, Camelpox virus
taatatttttgtgagaccatcgaa

SEQ ID NO: 4462 - DNA, 24 bp, Camelpox virus
taatatttttgtgagaccatcgaa

SEQ ID NO: 4463 - DNA, 24 bp, Camelpox virus
ataacatcgattcccatatgatgt

SEQ ID NO: 4464 - DNA, 24 bp, Camelpox virus
tgaatagagttatcgattcagaca

SEQ ID NO: 4465 - DNA, 23 bp, Camelpox virus
tcagagcaagaaacactgcagta

SEQ ID NO: 4466 - DNA, 24 bp, Camelpox virus
ttcacgccgttgtgtaacaatatc

SEQ ID NO: 4467 - DNA, 24 bp, Camelpox virus
tgatgtagtggttatagtctctgg

SEQ ID NO: 4468 - DNA, 24 bp, Camelpox virus
tgacctgttgcacaatcattcttt

SEQ ID NO: 4469 - DNA, 24 bp, Camelpox virus
taatatttttgtgagaccatcgaa

SEQ ID NO: 4470 - DNA, 24 bp, Bovine viral diarrhea virus genotype 2 (BVDV-2)
taaagtgcttagtgcattggaggt

SEQ ID NO: 4471 - DNA, 24 bp, Bovine viral diarrhea virus genotype 2 (BVDV-2)
tgccaagcttttgtagagtgctgt

SEQ ID NO: 4472 - DNA, 24 bp, Bovine viral diarrhea virus genotype 2 (BVDV-2)
tggccactgtcatcagcatcaccc

SEQ ID NO: 4473 - DNA, 24 bp, Bovine viral diarrhea virus genotype 2 (BVDV-2)
tggcatattggaagccctctttgc

SEQ ID NO: 4474 - DNA, 24 bp, Bovine viral diarrhea virus genotype 2 (BVDV-2)
attccatgagtacatcaaaaggaa

SEQ ID NO: 4475 - DNA, 23 bp, Bovine viral diarrhea virus genotype 2 (BVDV-2)
tagcaatgatacaatcagtggta

SEQ ID NO: 4476 - DNA, 24 bp, Bovine viral diarrhea virus genotype 2 (BVDV-2)
tgttgtggttttcctcttaattgg

SEQ ID NO: 4477 - DNA, 24 bp, Bovine viral diarrhea virus genotype 2 (BVDV-2)
tgtcacacactagtagatcctttc

SEQ ID NO: 4478 - DNA, 24 bp, Rabbit fibroma virus
tattccacgaagtcatcgacctcc

SEQ ID NO: 4479 - DNA, 24 bp, Rabbit fibroma virus
tgtcatcatcgagtagttcgccgt

SEQ ID NO: 4480 - DNA, 24 bp, Rabbit fibroma virus
tctccggtagaagtagaaaataga

SEQ ID NO: 4481 - DNA, 24 bp, Rabbit fibroma virus
agatgtgactgtgaggaaccaaat

SEQ ID NO: 4482 - DNA, 24 bp, pestivirus type 1
tatctgccacccaagagggctact

SEQ ID NO: 4483 - DNA, 24 bp, pestivirus type 1
ttaggtacattacactagctgttt

SEQ ID NO: 4484 - DNA, 24 bp, Cryphonectria hypovirus 1
tacgcgaatacaaaacctagtgca

SEQ ID NO: 4485 - DNA, 23 bp, Cryphonectria hypovirus 1
actcatgaagatggttggtcctt

SEQ ID NO: 4486 - DNA, 24 bp, Cryphonectria hypovirus 1
tagcagcctaagatagtctgccac

SEQ ID NO: 4487 - DNA, 24 bp, Cryphonectria hypovirus 1
agtcatgccttggtagatgcgcac

SEQ ID NO: 4488 - DNA, 24 bp, Cryphonectria hypovirus 1
ccaggtagtcctttcccgggttcc

SEQ ID NO: 4489 - DNA, 22 bp, Cryphonectria hypovirus 1
tggaacggaggcatcgccatcg

SEQ ID NO: 4490 - DNA, 24 bp, Cryphonectria hypovirus 1
tgaccgaacccagtctgcattagc

SEQ ID NO: 4491 - DNA, 24 bp, Cryphonectria hypovirus 1
tggtatgcgttccttttcgtcctg

SEQ ID NO: 4492 - DNA, 21 bp, Cryphonectria hypovirus 1
ctggttgtgagtgtgccacgg

SEQ ID NO: 4493 - DNA, 24 bp, Cryphonectria hypovirus 1
tgtacagtgcgggctggaatgccg

SEQ ID NO: 4494 - DNA, 24 bp, Fowlpox virus
taagtaagctacattagaagatgt

SEQ ID NO: 4495 - DNA, 24 bp, Fowlpox virus
ttctatgatatagttctgtatcat

SEQ ID NO: 4496 - DNA, 24 bp, Fowlpox virus
taatactttacttgctttattaag

SEQ ID NO: 4497 - DNA, 24 bp, Fowlpox virus
taaaataacaattattatacttga

SEQ ID NO: 4498 - DNA, 24 bp, Fowlpox virus
taaggtaagttttctttatgttta

SEQ ID NO: 4499 - DNA, 24 bp, Fowlpox virus
tatgtcagttatcctaccaaaacg

SEQ ID NO: 4500 - DNA, 24 bp, Fowlpox virus
tattagagaataagaatgatcgca

SEQ ID NO: 4501 - DNA, 24 bp, Rana tigrina ranavirus
tattatcttaatatatagtcttta

SEQ ID NO: 4502 - DNA, 24 bp, Rana tigrina ranavirus
caggaggctcggcggagtgtggct

SEQ ID NO: 4503 - DNA, 24 bp, Rana tigrina ranavirus
tgacgtggttctcgaaaaagtttg

SEQ ID NO: 4504 - DNA, 21 bp, Rana tigrina ranavirus
tgaggtgctggcgcaaggacg

SEQ ID NO: 4505 - DNA, 24 bp, Rana tigrina ranavirus
tgaggcacacggcagccgtcctgg

SEQ ID NO: 4506 - DNA, 24 bp, Rana tigrina ranavirus
tatattaagagtactactatcttg

SEQ ID NO: 4507 - DNA, 24 bp, Rana tigrina ranavirus
ttaaagttggtggaacagtaggcg

SEQ ID NO: 4508 - DNA, 23 bp, Rana tigrina ranavirus
tctcacaataatagtttcaggac

SEQ ID NO: 4509 - DNA, 24 bp, Rana tigrina ranavirus
tgaaagagtatcttactatagtag

SEQ ID NO: 4510 - DNA, 24 bp, Tupaia herpesvirus
taagacgatacgacacgggcggat

SEQ ID NO: 4511 - DNA, 23 bp, Tupaia herpesvirus
cgactagtttagcgtagctactc

SEQ ID NO: 4512 - DNA, 24 bp, Tupaia herpesvirus
actccgttagcggtcttcgctgta

SEQ ID NO: 4513 - DNA, 24 bp, Tupaia herpesvirus
cgatatcggagaaagtaccgtttg

SEQ ID NO: 4514 - DNA, 24 bp, Tupaia herpesvirus
tgacgatattaactgtccgtagtc

SEQ ID NO: 4515 - DNA, 24 bp, Tupaia herpesvirus
ccgccaatcatccgtataagttga

SEQ ID NO: 4516 - DNA, 24 bp, Tupaia herpesvirus
acaccatttatcctccacttgaat

SEQ ID NO: 4517 - DNA, 24 bp, Tupaia herpesvirus
tacaacaaacacacgactcgaaaa

SEQ ID NO: 4518 - DNA, 24 bp, Rana tigrina ranavirus
taatatcctaagatgtcgttacac

SEQ ID NO: 4519 - DNA, 23 bp, Rana tigrina ranavirus
tggcatctgccatgtttaggact

SEQ ID NO: 4520 - DNA, 24 bp, Rana tigrina ranavirus
tgagatattttacgctgacatttt

SEQ ID NO: 4521 - DNA, 24 bp, Equine herpesvirus 1
tgagtccatgaatcatgccacagg

SEQ ID NO: 4522 - DNA, 24 bp, Equine herpesvirus 1
tgtgcagactttttcagttccttc

SEQ ID NO: 4523 - DNA, 24 bp, Equine herpesvirus 1
tcgcagtagctgtggtggtttccg

SEQ ID NO: 4524 - DNA, 24 bp, Equine herpesvirus 1
tggtacggctgccgcgatctcagg

SEQ ID NO: 4525 - DNA, 24 bp, Equine herpesvirus 1
tagcttacatctatgggtggatct

SEQ ID NO: 4526 - DNA, 24 bp, Equine herpesvirus 1
tcgccggcgactagattcgtgggg

SEQ ID NO: 4527 - DNA, 24 bp, Camelpox virus
taactaatggcaaatgtataaaac

SEQ ID NO: 4528 - DNA, 24 bp, Variola virus
tgagctaatttttgtaaataacta

SEQ ID NO: 4529 - DNA, 24 bp, Variola virus
tttggtaataaaattattcactat

SEQ ID NO: 4530 - DNA, 24 bp, Cryphonectria hypovirus
tgacgagtaccagaagaggatcga

SEQ ID NO: 4531 - DNA, 23 bp, Cryphonectria hypovirus
tatgacagcaagtgcaagcctgc

SEQ ID NO: 4532 - DNA, 24 bp, Variola virus
tagaatgcgagcagcgattttggc

SEQ ID NO: 4533 - DNA, 24 bp, Cryphonectria hypovirus
tgtaatccaaacgaatcctaactg

SEQ ID NO: 4534 - DNA, 24 bp, Cryphonectria hypovirus
tgtctcatcattgcctggacgttc

SEQ ID NO: 4535 - DNA, 24 bp, Cryphonectria hypovirus
tagcggccggtcgttcaatgtatc

SEQ ID NO: 4536 - DNA, 24 bp, Vaccinia virus
tgagttaatattcatgttgaacat

SEQ ID NO: 4537 - DNA, 24 bp, Variola virus
caagatagagagctcctttggtga

SEQ ID NO: 4538 - DNA, 24 bp, Rabbit fibroma virus
taatacaagtaatgttattcgtag

SEQ ID NO: 4539 - DNA, 24 bp, Rabbit fibroma virus
tagcagattgtgtccatatacgtc

SEQ ID NO: 4540 - DNA, 24 bp, Rabbit fibroma virus
taagaacttacatgatccatagtg

SEQ ID NO: 4541 - DNA, 24 bp, Camelpox virus
tttggtaatgaaattattcactat

SEQ ID NO: 4542 - DNA, 24 bp, Camelpox virus
tagaatgcgagcagcgattttggc

SEQ ID NO: 4543 - DNA, 24 bp, Camelpox virus
gggcggagccgaacattctccaat

SEQ ID NO: 4544 - DNA, 24 bp, Camelpox virus
tgtaaaccacaatttgcttccgcc

SEQ ID NO: 4545 - DNA, 24 bp, Camelpox virus
tgtcatgatattgaattggaaaaa

SEQ ID NO: 4546 - DNA, 24 bp, Fowlpox virus
tagaatatcggcgtatcgttgatt

SEQ ID NO: 4547 - DNA, 24 bp, Fowlpox virus
taatagctatttttatctatttta

SEQ ID NO: 4548 - DNA, 24 bp, Fowlpox virus
taagcaaagaagtaaaatcttcgt

SEQ ID NO: 4549 - DNA, 24 bp, Fowlpox virus
tcgaataattttattttattaggc

SEQ ID NO: 4550 - DNA, 24 bp, Fowlpox virus
agatgtaaccgagtatgcgattgc

SEQ ID NO: 4551 - DNA, 24 bp, Cowpea mottle virus
tatcatggcaggaggaacacaatc

SEQ ID NO: 4552 - DNA, 24 bp, Cowpea mottle virus
tgacatgctgatcacgcctaggac

SEQ ID NO: 4553 - DNA, 24 bp, Chimpanzee cytomegalovirus
tgaggtagttgttgatcactcgtc

SEQ ID NO: 4554 - DNA, 21 bp, Chimpanzee cytomegalovirus
tgggatacgtaggcaaaacag

SEQ ID NO: 4555 - DNA, 24 bp, Chimpanzee cytomegalovirus
tcactgtaaaattacgaatctccg

SEQ ID NO: 4556 - DNA, 24 bp, Chimpanzee cytomegalovirus
tgaggcaggtgaaacccgtgatgc

SEQ ID NO: 4557 - DNA, 24 bp, Chimpanzee cytomegalovirus
ttagttaccggctcttgtggcctc

SEQ ID NO: 4558 - DNA, 24 bp, Sonchus yellow net virus
ttgaaccatcacggtgagcaagtc

SEQ ID NO: 4559 - DNA, 24 bp, Sonchus yellow net virus
tgtgacaccaacgttcgaattgct

SEQ ID NO: 4560 - DNA, 24 bp, Cowpea chlorotic mottle virus
taacttggtgtctgtgcctgatcc

SEQ ID NO: 4561 - DNA, 24 bp, Sonchus yellow net virus
tatggcatatatatttaacggtga

SEQ ID NO: 4562 - DNA, 24 bp, Sonchus yellow net virus
catcagagcttcttctgcatcata

SEQ ID NO: 4563 - DNA, 24 bp, Sonchus yellow net virus
tagcatactatgcagctcttccat

SEQ ID NO: 4564 - DNA, 22 bp, Sonchus yellow net virus
tattgcatcttgaaatagcacc

SEQ ID NO: 4565 - DNA, 24 bp, Cowpea chlorotic mottle virus
tgatattaaaccagttgtctcgga

SEQ ID NO: 4566 - DNA, 24 bp, Sonchus yellow net virus
tatatagatcaggttggttgattc

SEQ ID NO: 4567 - DNA, 23 bp, Rice yellow stunt virus
tgagataataaatattatgatat

SEQ ID NO: 4568 - DNA, 22 bp, Rice yellow stunt virus
ttgcatgtcgagcaaattagag

SEQ ID NO: 4569 - DNA, 24 bp, Rice yellow stunt virus
tatccctgcacaaattgttgcagc

SEQ ID NO: 4570 - DNA, 21 bp, Rice yellow stunt virus
taaaacattgataaatacata

SEQ ID NO: 4571 - DNA, 24 bp, Rice yellow stunt virus
tgagatctagaatatagccctgga

SEQ ID NO: 4572 - DNA, 24 bp, Rice yellow stunt virus
ttagatatcctcaccgttatgtga

SEQ ID NO: 4573 - DNA, 21 bp, Lactate dehydrogenase-elevating virus
tcactggcagaatctcattca

SEQ ID NO: 4574 - DNA, 24 bp, Callitrichine herpesvirus 3
tgaggggactaagtggaggcctga

SEQ ID NO: 4575 - DNA, 24 bp, Callitrichine herpesvirus 3
tccccagaacccccaaggggtggc

SEQ ID NO: 4576 - DNA, 24 bp, Callitrichine herpesvirus 3
tgtggaaacctgcccagtgacgtc

SEQ ID NO: 4577 - DNA, 24 bp, Callitrichine herpesvirus 3
tgggggaggtccgaatgggggtct

SEQ ID NO: 4578 - DNA, 24 bp, Callitrichine herpesvirus 3
tgagaccccaggcttcttccctta

SEQ ID NO: 4579 - DNA, 24 bp, Callitrichine herpesvirus 3
tagctgatgacagacaaagcatgt

SEQ ID NO: 4580 - DNA, 24 bp, Equine herpesvirus 2
tggccgggcgaggcgccccgcccg

SEQ ID NO: 4581 - DNA, 21 bp, Fowlpox virus
ttcatcgttcgattcattatt

SEQ ID NO: 4582 - DNA, 24 bp, Fowlpox virus
tataacagcttttacatatttggt

SEQ ID NO: 4583 - DNA, 24 bp, Fowlpox virus
tttgatatttaacaaagtaaaaat

SEQ ID NO: 4584 - DNA, 24 bp, Fowlpox virus
taggcaaaaaatatgtttacaact

SEQ ID NO: 4585 - DNA, 24 bp, Fowlpox virus
tctggcatatgtcgaggctgggtt

SEQ ID NO: 4586 - DNA, 24 bp, Fowlpox virus
tgtagtatatatagaccacagata

SEQ ID NO: 4587 - DNA, 21 bp, Fowlpox virus
tattactcagaatagatatag

SEQ ID NO: 4588 - DNA, 21 bp, Fowlpox virus
acgctaccctatgatgtataa

SEQ ID NO: 4589 - DNA, 24 bp, Bovine respiratory syncytial virus
tggcggatagaacttttgaatgta

SEQ ID NO: 4590 - DNA, 24 bp, Bovine respiratory syncytial virus
tattatatggaggtgtgttgttag

SEQ ID NO: 4591 - DNA, 24 bp, Bovine respiratory syncytial virus
tattacattacatataatcatggt

SEQ ID NO: 4592 - DNA, 24 bp, Bovine respiratory syncytial virus
tatgactaaaatgacattttttac

SEQ ID NO: 4593 - DNA, 24 bp, Bovine respiratory syncytial virus
taattgatttgaatatttagctaa

SEQ ID NO: 4594 - DNA, 24 bp, Bovine respiratory syncytial virus
cataaattgcatatcacgggatat

SEQ ID NO: 4595 - DNA, 24 bp, Bovine respiratory syncytial virus
ataacatcattttcattcttaatt

SEQ ID NO: 4596 - DNA, 24 bp, Newcastle disease virus
caatgtggcttcattctgtttccc

SEQ ID NO: 4597 - DNA, 24 bp, Newcastle disease virus
ttgcttgttcaccatcaagcattg

SEQ ID NO: 4598 - DNA, 24 bp, Newcastle disease virus
agaggtaacctcgtggtcagcggt

SEQ ID NO: 4599 - DNA, 24 bp, Newcastle disease virus
tataagacaatattgtctaggcct

SEQ ID NO: 4600 - DNA, 24 bp, Newcastle disease virus
tcgcactcgagattcacaccttct

SEQ ID NO: 4601 - DNA, 24 bp, Newcastle disease virus
taggatgtctgtcacacgctgccg

SEQ ID NO: 4602 - DNA, 24 bp, Newcastle disease virus
taggataatctgatgctctgccct

SEQ ID NO: 4603 - DNA, 24 bp, Newcastle disease virus
tacagaaaggagatgggatgcctt

SEQ ID NO: 4604 - DNA, 24 bp, Newcastle disease virus
tggctctgctttgatcggagacca

SEQ ID NO: 4605 - DNA, 24 bp, respiratory syncytial virus
tagagtaactttgctgtctaacta

SEQ ID NO: 4606 - DNA, 24 bp, Garlic latent virus
tgaggaactctttgagaaaaatag

SEQ ID NO: 4607 - DNA, 24 bp, respiratory syncytial virus
ttggtgaatgctatgtattgactc

SEQ ID NO: 4608 - DNA, 24 bp, Garlic latent virus
taacatgcttttcacgtttttgag

SEQ ID NO: 4609 - DNA, 24 bp, Garlic latent virus
taaatgggacaatcgctttcgatc

SEQ ID NO: 4610 - DNA, 22 bp, respiratory syncytial virus
tatcatgatatttatggtggat

SEQ ID NO: 4611 - DNA, 22 bp, respiratory syncytial virus
ttgaatcacttagttttttgga

SEQ ID NO: 4612 - DNA, 24 bp, respiratory syncytial virus
ctaggaatttggtagctctgttgt

SEQ ID NO: 4613 - DNA, 24 bp, respiratory syncytial virus
taagtaatgactgaaaataagtag

SEQ ID NO: 4614 - DNA, 24 bp, respiratory syncytial virus
tcacagacaaaaagactgataggt

SEQ ID NO: 4615 - DNA, 24 bp, respiratory syncytial virus
tgtggtaagcattaggattgagtg

SEQ ID NO: 4616 - DNA, 24 bp, Sendai virus
tgatgttgccactccaagtgctat

SEQ ID NO: 4617 - DNA, 24 bp, Sendai virus
tagtattctcaaacctatctaata

SEQ ID NO: 4618 - DNA, 24 bp, Human parainfluenza virus 3
ttagatcattggtattatccgatg

SEQ ID NO: 4619 - DNA, 24 bp, Human parainfluenza virus 3
tagagtatgtcagatacagtgcca

SEQ ID NO: 4620 - DNA, 24 bp, Human parainfluenza virus 3
taaagggagtctgacttggagggt

SEQ ID NO: 4621 - DNA, 24 bp, Human parainfluenza virus 3
ataccaggtatatataatttgaac

SEQ ID NO: 4622 - DNA, 24 bp, Human parainfluenza virus 3
ttgcatggctctattttgtacaac

SEQ ID NO: 4623 - DNA, 24 bp, Human parainfluenza virus 3
tatctcatcattaccaaatgccca

SEQ ID NO: 4624 - DNA, 24 bp, Human parainfluenza virus 3
ttcatcgtttcctggtcttgatag

SEQ ID NO: 4625 - DNA, 24 bp, Human parainfluenza virus 3
aagaatctgtgtcacatttcctaa

SEQ ID NO: 4626 - DNA, 24 bp, Human parainfluenza virus 3
tgagataaaaaaagaagagctaat

SEQ ID NO: 4627 - DNA, 24 bp, Human parainfluenza virus 1 strain Washington/1964
tatcctcctgattttcccgatgct

SEQ ID NO: 4628 - DNA, 24 bp, Human parainfluenza virus 1 strain Washington/1964
taatacaattttttgtgtctacta

SEQ ID NO: 4629 - DNA, 24 bp, Human parainfluenza virus 1 strain Washington/1964
tttggcactttcgttcatggagga

SEQ ID NO: 4630 - DNA, 24 bp, Equine herpesvirus 1
tggaataggtaaacgcttgggggt

SEQ ID NO: 4631 - DNA, 24 bp, Canine distemper virus
tcaagtgagatgtccgctctctgt

SEQ ID NO: 4632 - DNA, 24 bp, Canine distemper virus
tacctgatcctgacatgcaaagtt

SEQ ID NO: 4633 - DNA, 24 bp, Canine distemper virus
taagaggggttctatcacatcccg

SEQ ID NO: 4634 - DNA, 24 bp, Canine distemper virus
tagtcgagtgatgctcatatatac

SEQ ID NO: 4635 - DNA, 24 bp, Canine distemper virus
aaaagtgatttgggattgcttagg

SEQ ID NO: 4636 - DNA, 23 bp, Canine distemper virus
cacctgcaagtaccactcctgca

SEQ ID NO: 4637 - DNA, 24 bp, Canine distemper virus
tatgttaagttgaaggtcaacact

SEQ ID NO: 4638 - DNA, 24 bp, Canine distemper virus
tgaggtcaataatacatacaaggt

SEQ ID NO: 4639 - DNA, 24 bp, Canine distemper virus
tgactgggcctagtcatgatcttg

SEQ ID NO: 4640 - DNA, 24 bp, Simian hemorrhagic fever virus
aaggttaaggcagctatgaagagg

SEQ ID NO: 4641 - DNA, 24 bp, Human herpesvirus 4
taggcaattgcgtgcctagaacat

SEQ ID NO: 4642 - DNA, 24 bp, Human herpesvirus 4
tagcaccgctatccactatgtctc

SEQ ID NO: 4643 - DNA, 24 bp, Human herpesvirus 4
aggaagtggttgcgcatgcgggcc

SEQ ID NO: 4644 - DNA, 21 bp, Human herpesvirus 4
ttgcagccacgtggccacgtg

SEQ ID NO: 4645 - DNA, 24 bp, Human herpesvirus 4
agttgtactcccggaagatgccct

SEQ ID NO: 4646 - DNA, 24 bp, Human herpesvirus 4
agatgtgcctggctctgtccagaa

SEQ ID NO: 4647 - DNA, 24 bp, Human herpesvirus 4
aggtggagtgggacacagttagag

SEQ ID NO: 4648 - DNA, 23 bp, Human herpesvirus 4
tcactggcagcgtgacaaccgga

SEQ ID NO: 4649 - DNA, 24 bp, Human herpesvirus 4
tcagtggttttgtttccttgatag

SEQ ID NO: 4650 - DNA, 24 bp, Measles virus
tgagatctgtcataactaaataag

SEQ ID NO: 4651 - DNA, 24 bp, Variola virus
ttagtgtttaataaaaatatggga

SEQ ID NO: 4652 - DNA, 22 bp, Variola virus
tttgttggatcagtctctaagt

SEQ ID NO: 4653 - DNA, 24 bp, Variola virus
gtgaattgattccggaagatcgct

SEQ ID NO: 4654 - DNA, 24 bp, Variola virus
tgaatatattaaagttatttatgt

SEQ ID NO: 4655 - DNA, 24 bp, Variola virus
tagcgtagtgaggacacaagtgaa

SEQ ID NO: 4656 - DNA, 24 bp, Variola virus
tattatcagattctatatattcga

SEQ ID NO: 4657 - DNA, 24 bp, Variola virus
tcaacggacacaaagtagctaaca

SEQ ID NO: 4658 - DNA, 24 bp, Variola virus
taatatagaggcgttttatgctgt

SEQ ID NO: 4659 - DNA, 24 bp, Avian paramyxovirus 6
tcagtggagatggctcccttggct

SEQ ID NO: 4660 - DNA, 24 bp, Avian paramyxovirus 6
ttagtgatgaacggatttaatttg

SEQ ID NO: 4661 - DNA, 24 bp, Avian paramyxovirus 6
tgtgcagtatattggtcataaccc

SEQ ID NO: 4662 - DNA, 24 bp, Avian paramyxovirus 6
tggccagattccacaacaaactga

SEQ ID NO: 4663 - DNA, 24 bp, Avian paramyxovirus 6
tgacatccctttgattgttgtcag

SEQ ID NO: 4664 - DNA, 22 bp, Avian paramyxovirus 6
tgcgatgtaagaaggtcaatga

SEQ ID NO: 4665 - DNA, 24 bp, Avian paramyxovirus 6
ttagtgccattagtgttcttgctt

SEQ ID NO: 4666 - DNA, 24 bp, Macaca mulatta rhadinovirus
tataaactgcgtgtacccaaagag

SEQ ID NO: 4667 - DNA, 24 bp, Macaca mulatta rhadinovirus
agagttcgccggtggccgaggcgc

SEQ ID NO: 4668 - DNA, 24 bp, Macaca mulatta rhadinovirus
cacgacatgccttttccatttact

SEQ ID NO: 4669 - DNA, 24 bp, Macaca mulatta rhadinovirus
gggccaggcggtcgcggttcaggt

SEQ ID NO: 4670 - DNA, 24 bp, Macaca mulatta rhadinovirus
ttcgcaggtcttccgtcgtcaggg

SEQ ID NO: 4671 - DNA, 24 bp, Macaca mulatta rhadinovirus
ttgaaagaacgtcacggagcaatc

SEQ ID NO: 4672 - DNA, 21 bp, Camelpox virus
ttaacgatttattatatatgt

SEQ ID NO: 4673 - DNA, 24 bp, Camelpox virus
ttaaacaatactaaaatatcttta

SEQ ID NO: 4674 - DNA, 24 bp, Camelpox virus
tattatcagattctatatattcga

SEQ ID NO: 4675 - DNA, 24 bp, Rana tigrina ranavirus
tgatctgtaaaactttaggataag

SEQ ID NO: 4676 - DNA, 24 bp, Rana tigrina ranavirus
tagtttcatgttggggtccattta

SEQ ID NO: 4677 - DNA, 24 bp, Rana tigrina ranavirus
catcttaagattctttctatatca

SEQ ID NO: 4678 - DNA, 23 bp, Rana tigrina ranavirus
tgccgtgttaaaggactgggcgc

SEQ ID NO: 4679 - DNA, 24 bp, Rana tigrina ranavirus
tgacgaaggctctcttgaagctgc

SEQ ID NO: 4680 - DNA, 24 bp, Rana tigrina ranavirus
ctagcccggtgacgtgagccatca

SEQ ID NO: 4681 - DNA, 24 bp, Rana tigrina ranavirus
tcagatcgaggtagcactggacta

SEQ ID NO: 4682 - DNA, 24 bp, Rana tigrina ranavirus
tgagctggctagaaaacttccacc

SEQ ID NO: 4683 - DNA, 24 bp, Bovine herpesvirus 4
tgaggtttgagatctctaagatat

SEQ ID NO: 4684 - DNA, 22 bp, Bovine herpesvirus 4
tattgtcttatcacaagtgggg

SEQ ID NO: 4685 - DNA, 24 bp, Bovine herpesvirus 4
tgtcttctaaaaaacatattttat

SEQ ID NO: 4686 - DNA, 24 bp, Bovine herpesvirus 4
agagggatgggagatatattcctc

SEQ ID NO: 4687 - DNA, 24 bp, Bovine herpesvirus 4
taaaaacaacaaaaaccacaacta

SEQ ID NO: 4688 - DNA, 24 bp, Bovine herpesvirus 4
taaggtatgaaattttatatattt

SEQ ID NO: 4689 - DNA, 23 bp, Bovine herpesvirus 4
tagcacatccggccttaaggaca

SEQ ID NO: 4690 - DNA, 24 bp, Bovine herpesvirus 4
tgaatagttctccagaggaagatg

SEQ ID NO: 4691 - DNA, 24 bp, Bovine herpesvirus 4
tagagcatcaatgagaagtttaag

SEQ ID NO: 4692 - DNA, 24 bp, Hendra virus
tacaaagagtcatatgatctctgt

SEQ ID NO: 4693 - DNA, 24 bp, Hendra virus
taatttaacctatcagtgtcatgg

SEQ ID NO: 4694 - DNA, 24 bp, Hendra virus
tgaggtatactagaagattgaaag

SEQ ID NO: 4695 - DNA, 24 bp, Hendra virus
tgattatgtttcctagaacaactg

SEQ ID NO: 4696 - DNA, 24 bp, Hendra virus
acgatgcccatcaatactgactcc

SEQ ID NO: 4697 - DNA, 24 bp, Hendra virus
taagacactggccattatgatgtg

SEQ ID NO: 4698 - DNA, 24 bp, Hendra virus
tatcagagatagataattcatgag

SEQ ID NO: 4699 - DNA, 24 bp, Hendra virus
tagattgttggaagttgagacagg

SEQ ID NO: 4700 - DNA, 24 bp, Hendra virus
tagcctttgcagctaatctggatc

SEQ ID NO: 4701 - DNA, 24 bp, Nipah virus
tgagatatagcctgtatagtcatt

SEQ ID NO: 4702 - DNA, 24 bp, Nipah virus
tgatgtgtaatcactccaccctct

SEQ ID NO: 4703 - DNA, 24 bp, Nipah virus
taagattcggatttaggattattt

SEQ ID NO: 4704 - DNA, 24 bp, Nipah virus
tgttatttttgatgtgataaagtt

SEQ ID NO: 4705 - DNA, 24 bp, Nipah virus
tattagatgggaatgttctactag

SEQ ID NO: 4706 - DNA, 24 bp, Nipah virus
tcacctctgtctagtacctctcca

SEQ ID NO: 4707 - DNA, 24 bp, Nipah virus
tatcataatccaatttgaatcctt

SEQ ID NO: 4708 - DNA, 24 bp, Nipah virus
tagaatattggaaatagacgtcac

SEQ ID NO: 4709 - DNA, 24 bp, Nipah virus
tcagcctttgttataatctcaaga

SEQ ID NO: 4710 - DNA, 24 bp, Nipah virus
tatcaagtttgctagtcatgcctt

SEQ ID NO: 4711 - DNA, 24 bp, Nipah virus
taaagtgtacatataaagaattga

SEQ ID NO: 4712 - DNA, 24 bp, Nipah virus
ttggatcctaagtttttcttaatg

SEQ ID NO: 4713 - DNA, 24 bp, Nipah virus
cagccagtcttgatctgaggttta

SEQ ID NO: 4714 - DNA, 24 bp, Nipah virus
tgagaggcactcttaccaacaccc

SEQ ID NO: 4715 - DNA, 24 bp, Chimpanzee cytomegalovirus
ttgcacacgtccagtctccggcgg

SEQ ID NO: 4716 - DNA, 24 bp, Chimpanzee cytomegalovirus
tacggtacgctgcccgtggcgccc

SEQ ID NO: 4717 - DNA, 24 bp, Chimpanzee cytomegalovirus
tggaggaccaggctcatgggatag

SEQ ID NO: 4718 - DNA, 24 bp, Reston Ebola virus (REBOV)
taggtaatttggggaggtaagaaa

SEQ ID NO: 4719 - DNA, 24 bp, Reston Ebola virus (REBOV)
cggcagtgttgctacaggtgtatc

SEQ ID NO: 4720 - DNA, 22 bp, Reston Ebola virus (REBOV)
tattttgtgaaaatctctaatc

SEQ ID NO: 4721 - DNA, 24 bp, Reston Ebola virus (REBOV)
tagcatactgtgcgatgtgactca

SEQ ID NO: 4722 - DNA, 24 bp, Reston Ebola virus (REBOV)
tgaggttccatctaaggttgtggc

SEQ ID NO: 4723 - DNA, 23 bp, Reston Ebola virus (REBOV)
tactgtttaatattttgattcat

SEQ ID NO: 4724 - DNA, 24 bp, Reston Ebola virus (REBOV)
aatagtgcttggcaatattgtact

SEQ ID NO: 4725 - DNA, 21 bp, Reston Ebola virus (REBOV)
ttcaaagactgcatcccaaca

SEQ ID NO: 4726 - DNA, 24 bp, Kyuri green mottle mosaic virus
tatgatcaagcgacagccaaagtc

SEQ ID NO: 4727 - DNA, 24 bp, Kyuri green mottle mosaic virus
tgaagcattcgaaggatgcaatgc

SEQ ID NO: 4728 - DNA, 21 bp, Zaire Ebola virus (ZEBOV)
gtgagcacgattatattggat

SEQ ID NO: 4729 - DNA, 24 bp, Zaire Ebola virus (ZEBOV)
tgacatgcatataacactgtggga

SEQ ID NO: 4730 - DNA, 24 bp, Kyuri green mottle mosaic virus
tagctgacaacgagtttaacctgc

SEQ ID NO: 4731 - DNA, 24 bp, Zaire Ebola virus (ZEBOV)
aagctccagtgtattatattatca

SEQ ID NO: 4732 - DNA, 24 bp, Zaire Ebola virus (ZEBOV)
taagaactgttggcaccgcggctc

SEQ ID NO: 4733 - DNA, 24 bp, Zaire Ebola virus (ZEBOV)
ttaatgaaaaaacactctctcagc

SEQ ID NO: 4734 - DNA, 24 bp, Zaire Ebola virus (ZEBOV)
tggcttacagtgaggatttatctg

SEQ ID NO: 4735 - DNA, 23 bp, Kyuri green mottle mosaic virus
tgatatcggaggaaactattccc

SEQ ID NO: 4736 - DNA, 24 bp, Kyuri green mottle mosaic virus
tgagatgttaatctgggaaagatt

SEQ ID NO: 4737 - DNA, 23 bp, Zaire Ebola virus (ZEBOV)
taatctgtatgttaataaccaac

SEQ ID NO: 4738 - DNA, 24 bp, Kyuri green mottle mosaic virus
taagttagttaatgcggttttcgg

SEQ ID NO: 4739 - DNA, 24 bp, Zaire Ebola virus (ZEBOV)
tggcttaagtattcgcaatgagcg

SEQ ID NO: 4740 - DNA, 24 bp, Zaire Ebola virus (ZEBOV)
tgtaagatcaatttatatacagct

SEQ ID NO: 4741 - DNA, 24 bp, Zaire Ebola virus (ZEBOV)
tatagggcgtaatgcttttagcac

SEQ ID NO: 4742 - DNA, 24 bp, Zaire Ebola virus (ZEBOV)
tgaagaatgcctcttggggcctaa

SEQ ID NO: 4743 - DNA, 24 bp, Kyuri green mottle mosaic virus
tacgataggtaatctcgagcggat

SEQ ID NO: 4744 - DNA, 24 bp, Zaire Ebola virus (ZEBOV)
tagtgtatgaagcaagcatgatgg

SEQ ID NO: 4745 - DNA, 24 bp, Kyuri green mottle mosaic virus
tcgagaagcggtacacaagcaaac

SEQ ID NO: 4746 - DNA, 24 bp, Zaire Ebola virus (ZEBOV)
aacactgtaccaagatccttgact

SEQ ID NO: 4747 - DNA, 24 bp, Marburg virus
tatgtcaattattgcctctaaagt

SEQ ID NO: 4748 - DNA, 24 bp, Marburg virus
tgtaatatctgtaatttggatagt

SEQ ID NO: 4749 - DNA, 24 bp, Kyuri green mottle mosaic virus
tacgataggtaatctcgagcggat

SEQ ID NO: 4750 - DNA, 21 bp, Marburg virus
atcagatggcttgaaggagag

SEQ ID NO: 4751 - DNA, 24 bp, Marburg virus
tatgttagtaaatcaaagtaaaac

SEQ ID NO: 4752 - DNA, 24 bp, Marburg virus
tagcttaagaatattttaatcgag

SEQ ID NO: 4753 - DNA, 24 bp, Human herpesvirus 5
tgcgatggagcggcacgatggtga

SEQ ID NO: 4754 - DNA, 24 bp, Human herpesvirus 5
tagcatgtagtcttgcacgtcacg

SEQ ID NO: 4755 - DNA, 24 bp, Human herpesvirus 5
tcgaacatggtaaagtgcagacgc

SEQ ID NO: 4756 - DNA, 23 bp, Human herpesvirus 5
tgtcgtacatgaatgaggacggt

SEQ ID NO: 4757 - DNA, 24 bp, Human herpesvirus 5
tttcagcgtgtgtccgcgggcgtg

SEQ ID NO: 4758 - DNA, 24 bp, Human herpesvirus 5
tccatgaggcgggtgatgcgcccg

SEQ ID NO: 4759 - DNA, 24 bp, Human herpesvirus 5
tgagatgagaaagcggcggtgggt

SEQ ID NO: 4760 - DNA, 24 bp, Human herpesvirus 5
tgacaagcctgacgagagcgttca

SEQ ID NO: 4761 - DNA, 24 bp, Ovine adenovirus A
tggggtcattttcgtcataattct

SEQ ID NO: 4762 - DNA, 24 bp, Ovine adenovirus A
agagttagcagagtgttaatgctg

SEQ ID NO: 4763 - DNA, 21 bp, Ovine adenovirus A
tttgcaaggtggagatggtga

SEQ ID NO: 4764 - DNA, 24 bp, Ovine adenovirus A
tgtaatgctgcaatttaattcaac

SEQ ID NO: 4765 - DNA, 22 bp, Ectromelia virus
ttgagtgctttgtctacgagtt

SEQ ID NO: 4766 - DNA, 24 bp, peanut bud necrosis virus
caaagtgaagtccattacatcaaa

SEQ ID NO: 4767 - DNA, 24 bp, peanut bud necrosis virus
ttccagtctatgataacacaaatc

SEQ ID NO: 4768 - DNA, 24 bp, Ectromelia virus
tatcaaagatcttgttatcgattg

SEQ ID NO: 4769 - DNA, 24 bp, peanut bud necrosis virus
agagggaaatccctatatgtgctg

SEQ ID NO: 4770 - DNA, 22 bp, Ectromelia virus
taatcgcacaatgatatacgtc

SEQ ID NO: 4771 - DNA, 24 bp, Ectromelia virus
agagatactttcagtctgtggtgg

SEQ ID NO: 4772 - DNA, 24 bp, Ectromelia virus
taaaaactgtgtgaaattttgtac

SEQ ID NO: 4773 - DNA, 21 bp, peanut bud necrosis virus
tccgatgttttcttaaaggac

SEQ ID NO: 4774 - DNA, 24 bp, Ectromelia virus
tagcttattatctgtttgtgctaa

SEQ ID NO: 4775 - DNA, 24 bp, peanut bud necrosis virus
tggaatctctagaaaaattaggtc

SEQ ID NO: 4776 - DNA, 22 bp, Ectromelia virus
tatcagaattgtcttccatagg

SEQ ID NO: 4777 - DNA, 24 bp, Ectromelia virus
tattaaacatggaatcagttgaaa

SEQ ID NO: 4778 - DNA, 24 bp, Ectromelia virus
taagtggacatatagacgcagaag

SEQ ID NO: 4779 - DNA, 24 bp, Monkeypox virus
cttgcacttaaagtctacattgta

SEQ ID NO: 4780 - DNA, 24 bp, Monkeypox virus
taagatagtggtcagttcatcctt

SEQ ID NO: 4781 - DNA, 24 bp, Monkeypox virus
tacccgttgaaatagaaaattcta

SEQ ID NO: 4782 - DNA, 24 bp, Monkeypox virus
cggaatgggaggatcagcatctgg

SEQ ID NO: 4783 - DNA, 21 bp, Ectromelia virus
tatcatattcgtctctagtat

SEQ ID NO: 4784 - DNA, 24 bp, Monkeypox virus
agagctcgttctcatcatcagaat

SEQ ID NO: 4785 - DNA, 24 bp, Monkeypox virus
atagatattaatgtcgtatttgaa

SEQ ID NO: 4786 - DNA, 24 bp, Variola virus
ttgctgctaaaccacatgtcaatc

SEQ ID NO: 4787 - DNA, 24 bp, Variola virus
tgaactagtccctgttagcattat

SEQ ID NO: 4788 - DNA, 24 bp, Variola virus
tttacagatttaaatgtatagttg

SEQ ID NO: 4789 - DNA, 24 bp, Variola virus
tattttacacaactgtttaataga

SEQ ID NO: 4790 - DNA, 24 bp, Variola virus
attaacctatggtacatacatatg

SEQ ID NO: 4791 - DNA, 24 bp, Variola virus
taccacatacgactccagaggttg

SEQ ID NO: 4792 - DNA, 24 bp, Variola virus
tgtgatgtctgttccatttaaaga

SEQ ID NO: 4793 - DNA, 24 bp, Variola virus
tgatggagtcacttttagttcttc

SEQ ID NO: 4794 - DNA, 24 bp, Camelpox virus
taacttaccacaccattttttaaa

SEQ ID NO: 4795 - DNA, 24 bp, Variola virus
tattggaatttactgtattaatta

SEQ ID NO: 4796 - DNA, 24 bp, Fowlpox virus
tattctacagcgggtgtaattttt

SEQ ID NO: 4797 - DNA, 24 bp, Fowlpox virus
tgttatcataagttctgaacctac

SEQ ID NO: 4798 - DNA, 24 bp, Fowlpox virus
ggaagtactggtttatttcctaaa

SEQ ID NO: 4799 - DNA, 24 bp, Fowlpox virus
ttctatgtctcttcttatatcaaa

SEQ ID NO: 4800 - DNA, 24 bp, Fowlpox virus
taatactactgtagtactaataga

SEQ ID NO: 4801 - DNA, 24 bp, Fowlpox virus
tacagtaatttaactagaaaagct

SEQ ID NO: 4802 - DNA, 24 bp, Fowlpox virus
cattatgctatttggtggtgtttc

SEQ ID NO: 4803 - DNA, 24 bp, Fowlpox virus
tcggatcttataggaattctagga

SEQ ID NO: 4804 - DNA, 24 bp, Camelpox virus
tgttttgtatttacgtgaacgttt

SEQ ID NO: 4805 - DNA, 24 bp, Camelpox virus
atcacatgtaaatgtaactttctg

SEQ ID NO: 4806 - DNA, 24 bp, Camelpox virus
catcatatgcaggtggataattcc

SEQ ID NO: 4807 - DNA, 24 bp, Camelpox virus
tatgccattaagtgtatctatcac

SEQ ID NO: 4808 - DNA, 22 bp, Camelpox virus
taaccggtagtatatctgaaat

SEQ ID NO: 4809 - DNA, 24 bp, Camelpox virus
catcaatctatcatactcgttata

SEQ ID NO: 4810 - DNA, 24 bp, Camelpox virus
taatatttgtatacatctagtatt

SEQ ID NO: 4811 - DNA, 24 bp, Camelpox virus
ttaggcaaatatataaaatctgga

SEQ ID NO: 4812 - DNA, 24 bp, Camelpox virus
ctggtacatttgtatacattgttt

SEQ ID NO: 4813 - DNA, 21 bp, Camelpox virus
tatcatagacagtatcatata

SEQ ID NO: 4814 - DNA, 24 bp, Camelpox virus
taagtaattaaagcaataaaacta

SEQ ID NO: 4815 - DNA, 24 bp, Camelpox virus
tggtatcccataaatgtaatcgat

SEQ ID NO: 4816 - DNA, 24 bp, grapevine chrome mosaic virus
tgaatgcgtttgccatcatgtgtg

SEQ ID NO: 4817 - DNA, 24 bp, grapevine chrome mosaic virus
ttggttaacctctctaacggtaga

SEQ ID NO: 4818 - DNA, 24 bp, grapevine chrome mosaic virus
gtcaaagtcttaatttttctgggc

SEQ ID NO: 4819 - DNA, 24 bp, grapevine chrome mosaic virus
tggctcaataaattttccactgtc

SEQ ID NO: 4820 - DNA, 24 bp, Goatpox virus
tatcaaataacgatattaaacttg

SEQ ID NO: 4821 - DNA, 24 bp, grapevine chrome mosaic virus
tggctccaccttggaagccatggg

SEQ ID NO: 4822 - DNA, 22 bp, sheeppox virus
ttctttgtttgtgatgttttta

SEQ ID NO: 4823 - DNA, 24 bp, grapevine chrome mosaic virus
tagtctaagttcccaactagagga

SEQ ID NO: 4824 - DNA, 24 bp, sheeppox virus
ttactgctactaactgttctaaga

SEQ ID NO: 4825 - DNA, 24 bp, Cowpox virus
cgagaactccttcaactcgctacc

SEQ ID NO: 4826 - DNA, 22 bp, Cowpox virus
taatacacgtatcattgattat

SEQ ID NO: 4827 - DNA, 24 bp, Cowpox virus
ttgctgctagaccacatgtcaatc

SEQ ID NO: 4828 - DNA, 24 bp, Cowpox virus
tgttacattcatattttgtgttat

SEQ ID NO: 4829 - DNA, 24 bp, Cowpox virus
tgaaacacattatcactccatgat

SEQ ID NO: 4830 - DNA, 24 bp, Cowpox virus
tgaactagtccctgttagcattag

SEQ ID NO: 4831 - DNA, 24 bp, Cowpox virus
tagcttaagaaggcatttacgtat

SEQ ID NO: 4832 - DNA, 24 bp, Cowpox virus
tatcaaagatcttgttatcgattg

SEQ ID NO: 4833 - DNA, 24 bp, Cowpox virus
tgacaggcgacacaatcgttcttt

SEQ ID NO: 4834 - DNA, 24 bp, Cowpox virus
tatcataccacatacgactccaga

SEQ ID NO: 4835 - DNA, 21 bp, Cowpox virus
tcaatagtcatactaacagca

SEQ ID NO: 4836 - DNA, 23 bp, Ateline herpesvirus 3
ttcagaaatttcaacatgtgttt

SEQ ID NO: 4837 - DNA, 24 bp, Ateline herpesvirus 3
taccctattgttttatgataaaac

SEQ ID NO: 4838 - DNA, 22 bp, Ateline herpesvirus 3
tgtgatgttagcatatgtagat

SEQ ID NO: 4839 - DNA, 24 bp, Ateline herpesvirus 3
gagctttatttgtcatagttaagc

SEQ ID NO: 4840 - DNA, 22 bp, Ateline herpesvirus 3
tggactgcttttacattaaagg

SEQ ID NO: 4841 - DNA, 24 bp, Ateline herpesvirus 3
tataaactctttattcaaagcatg

SEQ ID NO: 4842 - DNA, 24 bp, Ateline herpesvirus 3
tgacataaaacaactatcttttgt

SEQ ID NO: 4843 - DNA, 24 bp, Ateline herpesvirus 3
tggtaagagcatcgtgggcccaat

SEQ ID NO: 4844 - DNA, 24 bp, Ateline herpesvirus 3
tttttctctcaaagatgcttcggt

SEQ ID NO: 4845 - DNA, 23 bp, Ateline herpesvirus 3
tgttgcttattgagaacaggcca

SEQ ID NO: 4846 - DNA, 24 bp, Ateline herpesvirus 3
ttggcacatggaaatcctttttcg

SEQ ID NO: 4847 - DNA, 24 bp, Ectromelia virus
aaaggaaacaataatgtagtgtga

SEQ ID NO: 4848 - DNA, 24 bp, Ectromelia virus
taggatgttgattagatgaatgca

SEQ ID NO: 4849 - DNA, 24 bp, Ectromelia virus
taatgtatggtaacatgataatca

SEQ ID NO: 4850 - DNA, 24 bp, Ectromelia virus
tcatggtgttgtttgttatttgac

SEQ ID NO: 4851 - DNA, 23 bp, Ectromelia virus
taatacggtcctgtagtatctga

SEQ ID NO: 4852 - DNA, 24 bp, Ectromelia virus
tagcagtttatggaaatcttatca

SEQ ID NO: 4853 - DNA, 24 bp, Ectromelia virus
tttggtatacaatctcgacaatct

SEQ ID NO: 4854 - DNA, 24 bp, Ectromelia virus
gagagtactggtttcatgtttcta

SEQ ID NO: 4855 - DNA, 24 bp, Ectromelia virus
tgtggtatatgtatgaggtaggca

SEQ ID NO: 4856 - DNA, 24 bp, Ectromelia virus
agtggatccgttagctccataata

SEQ ID NO: 4857 - DNA, 24 bp, Rana tigrina ranavirus
ttagatctgggcccccgtcctctt

SEQ ID NO: 4858 - DNA, 24 bp, Rana tigrina ranavirus
tccctgactgccgaggagcaggcc

SEQ ID NO: 4859 - DNA, 21 bp, Rana tigrina ranavirus
tgagagataatacatcttact

SEQ ID NO: 4860 - DNA, 24 bp, Rana tigrina ranavirus
acagtgcccattgggttcttgtag

SEQ ID NO: 4861 - DNA, 24 bp, Rana tigrina ranavirus
tgacattgtagtctgaaggatcta

SEQ ID NO: 4862 - DNA, 24 bp, Rana tigrina ranavirus
gccacagccgccgtcgccatcccc

SEQ ID NO: 4863 - DNA, 24 bp, Rana tigrina ranavirus
tcaccggcgattggcccgacgcca

SEQ ID NO: 4864 - DNA, 22 bp, Rana tigrina ranavirus
tcagaactcccaggtcgtccac

SEQ ID NO: 4865 - DNA, 24 bp, Rana tigrina ranavirus
tagaatgtcttgagatatagtaca

SEQ ID NO: 4866 - DNA, 24 bp, Monkeypox virus
tctgtgtatcaattctgacacatg

SEQ ID NO: 4867 - DNA, 24 bp, Monkeypox virus
ttagatatcagatatccgtaacac

SEQ ID NO: 4868 - DNA, 24 bp, Monkeypox virus
cgaggtagtctcatcaccaggttt

SEQ ID NO: 4869 - DNA, 21 bp, Monkeypox virus
tattatgtaatatggtgttac

SEQ ID NO: 4870 - DNA, 24 bp, Monkeypox virus
gagagtactggtttcatgtttcta

SEQ ID NO: 4871 - DNA, 24 bp, Monkeypox virus
ttactgaatttaatatatgtatga

SEQ ID NO: 4872 - DNA, 24 bp, Camelpox virus
taggtaatatatatcttttgccgt

SEQ ID NO: 4873 - DNA, 24 bp, Camelpox virus
ttgctgctaaaccacatgtcaatc

SEQ ID NO: 4874 - DNA, 24 bp, Camelpox virus
tttcatataatttctgaaggtagt

SEQ ID NO: 4875 - DNA, 24 bp, Parsnip yellow fleck virus
cggcagtgaaatgtgatgatcttg

SEQ ID NO: 4876 - DNA, 24 bp, Camelpox virus
tatccatatgtctctatattctat

SEQ ID NO: 4877 - DNA, 24 bp, Camelpox virus
tacatttccatgtatctatctaac

SEQ ID NO: 4878 - DNA, 24 bp, Parsnip yellow fleck virus
tgagtattatgagccattgaatat

SEQ ID NO: 4879 - DNA, 24 bp, Parsnip yellow fleck virus
tgtgaaagtttctggtcttactgg

SEQ ID NO: 4880 - DNA, 24 bp, Camelpox virus
tatcacattcttatctacgatata

SEQ ID NO: 4881 - DNA, 24 bp, Parsnip yellow fleck virus
ttgcttaaagaagccaccaagaac

SEQ ID NO: 4882 - DNA, 24 bp, Parsnip yellow fleck virus
tgaggttcacattgctaaatcctt

SEQ ID NO: 4883 - DNA, 24 bp, Parsnip yellow fleck virus
tgaggaaataatggccaccacttt

SEQ ID NO: 4884 - DNA, 24 bp, Parsnip yellow fleck virus
gggaaagtgaggggtgtcctttct

SEQ ID NO: 4885 - DNA, 24 bp, Rabbit fibroma virus
tcaccggattgtgttttcttaata

SEQ ID NO: 4886 - DNA, 24 bp, Rabbit fibroma virus
catgacaaaattcctactgtatta

SEQ ID NO: 4887 - DNA, 24 bp, Rabbit fibroma virus
cacggggaacttattcatcgtcaa

SEQ ID NO: 4888 - DNA, 24 bp, Rabbit fibroma virus
aacacggttataattacacctcgg

SEQ ID NO: 4889 - DNA, 24 bp, Rabbit fibroma virus
tgagtgatttattaaagagacgtg

SEQ ID NO: 4890 - DNA, 24 bp, Rabbit fibroma virus
tgatgaattccaatataacgtctt

SEQ ID NO: 4891 - DNA, 24 bp, Yaba-like disease virus
taagtaacgttgtttatacccttt

SEQ ID NO: 4892 - DNA, 23 bp, Yaba-like disease virus
tcacagaggttcttctagtgttc

SEQ ID NO: 4893 - DNA, 24 bp, Yaba-like disease virus
tgagatacccaaccatgttttgat

SEQ ID NO: 4894 - DNA, 24 bp, Yaba-like disease virus
ttatagtgatgatgttttgttgtg

SEQ ID NO: 4895 - DNA, 24 bp, Monkeypox virus
tttcatagacacaacgaatttgta

SEQ ID NO: 4896 - DNA, 24 bp, Camelpox virus
ttgctgctaaaccacatgtcaatc

SEQ ID NO: 4897 - DNA, 24 bp, Monkeypox virus
ttgcatatcactgatgggtacctc

SEQ ID NO: 4898 - DNA, 22 bp, Monkeypox virus
taatagcacttacgtttttatc

SEQ ID NO: 4899 - DNA, 24 bp, Monkeypox virus
tcaatgcctttgctaatctgttta

SEQ ID NO: 4900 - DNA, 24 bp, Monkeypox virus
atatgtacaaatagtcgattatat

SEQ ID NO: 4901 - DNA, 24 bp, Monkeypox virus
tgaactagttcctgttagcattag

SEQ ID NO: 4902 - DNA, 24 bp, Monkeypox virus
tgaatagagttatcgattcagaca

SEQ ID NO: 4903 - DNA, 24 bp, Monkeypox virus
tatcacatcttccgttacaactta

SEQ ID NO: 4904 - DNA, 24 bp, Cowpox virus
taatggaagttttgataggagatt

SEQ ID NO: 4905 - DNA, 24 bp, Monkeypox virus
taaaaacttgtgtgaaattatgta

SEQ ID NO: 4906 - DNA, 24 bp, Yaba-like disease virus
ttaggtctgttaattataagttcg

SEQ ID NO: 4907 - DNA, 24 bp, Yaba-like disease virus
ttgggtaactttttttaaaaatat

SEQ ID NO: 4908 - DNA, 24 bp, Yaba-like disease virus
tcaactccttcttcaatcaaaaag

SEQ ID NO: 4909 - DNA, 24 bp, Yaba-like disease virus
taaccttaacacctctattaatag

SEQ ID NO: 4910 - DNA, 24 bp, Yaba-like disease virus
ttgatactatgcttattatatcat

SEQ ID NO: 4911 - DNA, 24 bp, Cowpox virus
ttaaatgacgaactatatgttcat

SEQ ID NO: 4912 - DNA, 24 bp, Cowpox virus
taggacacgtaacagtatcattcc

SEQ ID NO: 4913 - DNA, 24 bp, Camelpox virus
tattttagctctggtatatcatat

SEQ ID NO: 4914 - DNA, 24 bp, Cowpox virus
gagagtactggtttcatgtttcta

SEQ ID NO: 4915 - DNA, 24 bp, Cowpox virus
tatgatacacaaattgttagttat

SEQ ID NO: 4916 - DNA, 24 bp, Cowpox virus
tctacatatttcaatgtgtggaaa

SEQ ID NO: 4917 - DNA, 24 bp, Cowpox virus
tgctatggtatctaggaaatgatt

SEQ ID NO: 4918 - DNA, 24 bp, Myxoma virus
tatctcgtcgttggtataaaaaaa

SEQ ID NO: 4919 - DNA, 24 bp, Myxoma virus
tgtcacgtacgaattttgccgcgt

SEQ ID NO: 4920 - DNA, 24 bp, Myxoma virus
tgtggtaagtacttccgatcacga

SEQ ID NO: 4921 - DNA, 24 bp, Myxoma virus
tcgcctatggcgcgtttacgtatg

SEQ ID NO: 4922 - DNA, 24 bp, Myxoma virus
atcacctggttcgtagtagtcaga

SEQ ID NO: 4923 - DNA, 23 bp, Myxoma virus
cgatatctcgacacgcgcacgac

SEQ ID NO: 4924 - DNA, 24 bp, Myxoma virus
cgaggtaaagtctccattaaacag

SEQ ID NO: 4925 - DNA, 24 bp, Myxoma virus
cacggaaacagtcgatcgcagtaa

SEQ ID NO: 4926 - DNA, 22 bp, Ectromelia virus
tcaatgcctttgctaatctgtt

SEQ ID NO: 4927 - DNA, 22 bp, Ectromelia virus
tattgcatcgggcatatcaggt

SEQ ID NO: 4928 - DNA, 21 bp, Ectromelia virus
tgaccagttagtaacattgcg

SEQ ID NO: 4929 - DNA, 24 bp, Ectromelia virus
tcaccgtttttaacacgtctatta

SEQ ID NO: 4930 - DNA, 24 bp, Ectromelia virus
ttatatggttagtcagtgagcata

SEQ ID NO: 4931 - DNA, 24 bp, Ectromelia virus
tgaactagtccctgttagcattag

SEQ ID NO: 4932 - DNA, 24 bp, Equine herpesvirus 2
tttcacactgtaaagaatggggta

SEQ ID NO: 4933 - DNA, 24 bp, Equine herpesvirus 2
ttaatccataaataaattatgtaa

SEQ ID NO: 4934 - DNA, 24 bp, Equine herpesvirus 2
tgcagtactattactctttacttt

SEQ ID NO: 4935 - DNA, 24 bp, Equine herpesvirus 2
ttgcacaaccctcatctttttagg

SEQ ID NO: 4936 - DNA, 24 bp, Equine herpesvirus 2
aaagaaatagcaagtcagatattg

SEQ ID NO: 4937 - DNA, 24 bp, Equine herpesvirus 2
cttgcacagtttattctttttgtt

SEQ ID NO: 4938 - DNA, 24 bp, Equine herpesvirus 2
tattccaaaaacacattccacaca

SEQ ID NO: 4939 - DNA, 24 bp, Equine herpesvirus 2
taagaataattcctaaaagacaag

SEQ ID NO: 4940 - DNA, 24 bp, Potato aucuba mosaic virus
ttagatcctttaagaaagatagtc

SEQ ID NO: 4941 - DNA, 22 bp, Potato aucuba mosaic virus
ttgctagacatttgggtaccac

SEQ ID NO: 4942 - DNA, 23 bp, Potato aucuba mosaic virus
tgagttgtgtcaatgatcatcaa

SEQ ID NO: 4943 - DNA, 24 bp, porcine epidemic diarrhea virus
tcacctctcactacgcagctgtaa

SEQ ID NO: 4944 - DNA, 24 bp, porcine epidemic diarrhea virus
tgtgcaaaagagagtgtggtggtt

SEQ ID NO: 4945 - DNA, 24 bp, porcine epidemic diarrhea virus
ttcatgcttagataacgggtaggc

SEQ ID NO: 4946 - DNA, 24 bp, porcine epidemic diarrhea virus
taaaatagccatcaggatagtcct

SEQ ID NO: 4947 - DNA, 24 bp, porcine epidemic diarrhea virus
tgccaagcaattgtagctgcacca

SEQ ID NO: 4948 - DNA, 24 bp, porcine epidemic diarrhea virus
aagcaggaggtgtgttaggttcaa

SEQ ID NO: 4949 - DNA, 22 bp, porcine epidemic diarrhea virus
tcaaaacccaatgtgctcttgc

SEQ ID NO: 4950 - DNA, 23 bp, porcine epidemic diarrhea virus
tatcagaggtaacaatgttaagc

SEQ ID NO: 4951 - DNA, 24 bp, porcine epidemic diarrhea virus
tagctcacgaacagccacattacc

SEQ ID NO: 4952 - DNA, 24 bp, porcine epidemic diarrhea virus
taagacacggattttcaacaccat

SEQ ID NO: 4953 - DNA, 24 bp, porcine epidemic diarrhea virus
ttcaagcactgctggacactgtgg

SEQ ID NO: 4954 - DNA, 24 bp, porcine epidemic diarrhea virus
tgaagttgtggataaaatgtctgg

SEQ ID NO: 4955 - DNA, 24 bp, porcine epidemic diarrhea virus
tgagttgtaatgctgactctatgg

SEQ ID NO: 4956 - DNA, 24 bp, porcine epidemic diarrhea virus
atggagcgctgcttcagcttacca

SEQ ID NO: 4957 - DNA, 24 bp, porcine epidemic diarrhea virus
gtcacatggaagtttaacaaggtc

SEQ ID NO: 4958 - DNA, 24 bp, Transmissible gastroenteritis virus
atcacgtacaatttcgtcacagat

SEQ ID NO: 4959 - DNA, 24 bp, Transmissible gastroenteritis virus
tgcgttcttaggtgcagaaaggtt

SEQ ID NO: 4960 - DNA, 24 bp, Transmissible gastroenteritis virus
aaatgtagaaaatgaaacattaag

SEQ ID NO: 4961 - DNA, 24 bp, Transmissible gastroenteritis virus
taaagcacggtcacacttaggata

SEQ ID NO: 4962 - DNA, 24 bp, Transmissible gastroenteritis virus
aacattgacagggatagaacaaga

SEQ ID NO: 4963 - DNA, 24 bp, Transmissible gastroenteritis virus
tcactagcaataacatgtctaggg

SEQ ID NO: 4964 - DNA, 22 bp, Transmissible gastroenteritis virus
taacaggtgcaatttcttgaac

SEQ ID NO: 4965 - DNA, 24 bp, Transmissible gastroenteritis virus
cagtcataatagggtagaagaaag

SEQ ID NO: 4966 - DNA, 24 bp, Transmissible gastroenteritis virus
tgcatagcagaaacaatctttgac

SEQ ID NO: 4967 - DNA, 24 bp, Oat chlorotic stunt virus
tcagtgcaggccggtgtttgatgg

SEQ ID NO: 4968 - DNA, 24 bp, Oat chlorotic stunt virus
tagcacgccgagccgcaagaggaa

SEQ ID NO: 4969 - DNA, 21 bp, Oat chlorotic stunt virus
ttcaacatggccatcgaggag

SEQ ID NO: 4970 - DNA, 24 bp, Alcelaphine herpesvirus 1
cgagagctcctgagttcatattca

SEQ ID NO: 4971 - DNA, 24 bp, Alcelaphine herpesvirus 1
aaagctatgtttcaaatacgtttg

SEQ ID NO: 4972 - DNA, 24 bp, Alcelaphine herpesvirus 1
taacagcaggccaactgccactgg

SEQ ID NO: 4973 - DNA, 24 bp, Alcelaphine herpesvirus 1
agtggttgccataccagtaaaagt

SEQ ID NO: 4974 - DNA, 24 bp, Alcelaphine herpesvirus 1
tagcttgtgtgttgtgtctgtgga

SEQ ID NO: 4975 - DNA, 24 bp, Alcelaphine herpesvirus 1
tctctcagcatggtattgaatgtc

SEQ ID NO: 4976 - DNA, 24 bp, Alcelaphine herpesvirus 1
tagtttgggggaggcctttgtttt

SEQ ID NO: 4977 - DNA, 24 bp, Alcelaphine herpesvirus 1
tcagttacagcaggaattgttaat

SEQ ID NO: 4978 - DNA, 24 bp, Alcelaphine herpesvirus 1
ttaccagtttttgtaccagtacga

SEQ ID NO: 4979 - DNA, 24 bp, Alcelaphine herpesvirus 1
tgacagtgcaagtatgcgtgaaaa

SEQ ID NO: 4980 - DNA, 24 bp, Alcelaphine herpesvirus 1
tgaaagcgtgcgaactgagggaaa

SEQ ID NO: 4981 - DNA, 24 bp, Alcelaphine herpesvirus 1
gttggcacctgggttattacatgt

SEQ ID NO: 4982 - DNA, 24 bp, Alcelaphine herpesvirus 1
ttaaagcaggctatctctcacctg

SEQ ID NO: 4983 - DNA, 24 bp, Alcelaphine herpesvirus 1
ttgacacccaattggcccttgtag

SEQ ID NO: 4984 - DNA, 24 bp, Alcelaphine herpesvirus 1
tagattgggttaggatctgtgtgt

SEQ ID NO: 4985 - DNA, 24 bp, Alcelaphine herpesvirus 1
ttactggtcatttttaagggactg

SEQ ID NO: 4986 - DNA, 24 bp, Alcelaphine herpesvirus 1
tgtagacagacagtgagcgggtgc

SEQ ID NO: 4987 - DNA, 21 bp, Alcelaphine herpesvirus 1
tgcacggctacctggtaggga

SEQ ID NO: 4988 - DNA, 24 bp, Alcelaphine herpesvirus 1
tgccaagtactctggtaggagact

SEQ ID NO: 4989 - DNA, 24 bp, Alcelaphine herpesvirus 1
tataacggaacacctgcatcggca

SEQ ID NO: 4990 - DNA, 24 bp, Alcelaphine herpesvirus 1
tgtagacaacttcttgagattctt

SEQ ID NO: 4991 - DNA, 24 bp, Alcelaphine herpesvirus 1
taggctagtctggacaaaacactg

SEQ ID NO: 4992 - DNA, 24 bp, Murine hepatitis virus
cgtgcaaccccttctgcggagaat

SEQ ID NO: 4993 - DNA, 22 bp, Murine hepatitis virus
tgacaacacaggaggtaatact

SEQ ID NO: 4994 - DNA, 24 bp, Murine hepatitis virus
gcaccgtttgaattcacaagctgg

SEQ ID NO: 4995 - DNA, 24 bp, Murine hepatitis virus
ttatcgtgcacatgtctgaagaag

SEQ ID NO: 4996 - DNA, 24 bp, Murine hepatitis virus
cagtattgcagagttggaggcata

SEQ ID NO: 4997 - DNA, 24 bp, Murine hepatitis virus
tgtcgcagcgcttcaacttcctgc

SEQ ID NO: 4998 - DNA, 24 bp, Murine hepatitis virus
ttgggcacgctcttaactagtttg

SEQ ID NO: 4999 - DNA, 24 bp, Murine hepatitis virus
taaagtattgtctttgcaaatgga

SEQ ID NO: 5000 - DNA, 21 bp, Murine hepatitis virus
tgacttagcaatattacacgc

SEQ ID NO: 5001 - DNA, 24 bp, Murine hepatitis virus
tgggttctcatggtatactaaagg

SEQ ID NO: 5002 - DNA, 24 bp, Murine hepatitis virus
ataatgcctcataatagagcctgg

SEQ ID NO: 5003 - DNA, 24 bp, Murine hepatitis virus
tacgttaaattgggtgcaatgcac

SEQ ID NO: 5004 - DNA, 24 bp, Murine hepatitis virus
tttggcagcgatcattaacaaggc

SEQ ID NO: 5005 - DNA, 24 bp, Murine hepatitis virus
aattacacaactttgggtcgaggt

SEQ ID NO: 5006 - DNA, 24 bp, Ectromelia virus
tccaatgtatttatgtctgatttt

SEQ ID NO: 5007 - DNA, 24 bp, Ectromelia virus
ttgctcaaaaacgatggtagtgac

SEQ ID NO: 5008 - DNA, 24 bp, Ectromelia virus
tagcattagtcataaacttgggat

SEQ ID NO: 5009 - DNA, 24 bp, Ectromelia virus
tgatataattttgtccattgtagt

SEQ ID NO: 5010 - DNA, 24 bp, Ectromelia virus
tcgcggagtatagcctattatttt

SEQ ID NO: 5011 - DNA, 24 bp, Ectromelia virus
tcgctagccttatcctctatatcc

SEQ ID NO: 5012 - DNA, 24 bp, Ectromelia virus
atccgataacttttttgacgaatt

SEQ ID NO: 5013 - DNA, 24 bp, Ectromelia virus
tgtaaaccacaatttgcgtccgcc

SEQ ID NO: 5014 - DNA, 24 bp, Ectromelia virus
tatgtcataaactgtaaatgattc

SEQ ID NO: 5015 - DNA, 24 bp, Ectromelia virus
ggactagtatcgtataattcatag

SEQ ID NO: 5016 - DNA, 24 bp, Camelpox virus
gggcggagccgaacattctccaat

SEQ ID NO: 5017 - DNA, 24 bp, Ectromelia virus
taccagtcaagtcaatgatattag

SEQ ID NO: 5018 - DNA, 24 bp, lumpy skin disease virus
tcatctgaataataactatatgta

SEQ ID NO: 5019 - DNA, 22 bp, Goatpox virus
taagtgattgtttttttaatgg

SEQ ID NO: 5020 - DNA, 24 bp, lumpy skin disease virus
tatgataatgtatcgacgtaaata

SEQ ID NO: 5021 - DNA, 24 bp, lumpy skin disease virus
atcacatcattaaaacatattgat

SEQ ID NO: 5022 - DNA, 24 bp, lumpy skin disease virus
tgaaagattactctaatatccctc

SEQ ID NO: 5023 - DNA, 24 bp, lumpy skin disease virus
tgaatagttgcaaaaagaaaatga

SEQ ID NO: 5024 - DNA, 24 bp, lumpy skin disease virus
agaggtggagcatcttcccatttt

SEQ ID NO: 5025 - DNA, 24 bp, lumpy skin disease virus
aaatgaacgggaaaaaagtctctt

SEQ ID NO: 5026 - DNA, 24 bp, lumpy skin disease virus
tagtaatagtacatagatatttac

SEQ ID NO: 5027 - DNA, 24 bp, Rana tigrina ranavirus
tatcctcttttccaggtccgacaa

SEQ ID NO: 5028 - DNA, 24 bp, Rana tigrina ranavirus
tgagccaagtctgcctgtcgtcgg

SEQ ID NO: 5029 - DNA, 24 bp, Rana tigrina ranavirus
gtccagtccccgaggcaagaaggg

SEQ ID NO: 5030 - DNA, 24 bp, Rana tigrina ranavirus
tatgacaacgagcttagttccgcc

SEQ ID NO: 5031 - DNA, 22 bp, Rana tigrina ranavirus
attacatctcattctcttttgg

SEQ ID NO: 5032 - DNA, 24 bp, Rana tigrina ranavirus
tccagcactcgtcctcgtcgcact

SEQ ID NO: 5033 - DNA, 22 bp, Rana tigrina ranavirus
tgactgcaaaggcaccagcctt

SEQ ID NO: 5034 - DNA, 24 bp, Rana tigrina ranavirus
cgtcagggtgggcgtcatatcctg

SEQ ID NO: 5035 - DNA, 24 bp, Rana tigrina ranavirus
gatggtaatatcttaagatattta

SEQ ID NO: 5036 - DNA, 23 bp, Rana tigrina ranavirus
ttgacagtaggcttgttgtggca

SEQ ID NO: 5037 - DNA, 24 bp, Rana tigrina ranavirus
tgggagactttctgggagactttc

SEQ ID NO: 5038 - DNA, 24 bp, Rana tigrina ranavirus
tataacaggcagtagttttagagt

SEQ ID NO: 5039 - DNA, 24 bp, Rana tigrina ranavirus
tcagagtctttaccatctcggaaa

SEQ ID NO: 5040 - DNA, 21 bp, Equine herpesvirus 2
tgagatcttgattcagtgttt

SEQ ID NO: 5041 - DNA, 24 bp, Equine herpesvirus 2
tgaggtaggcggttgccaggcaga

SEQ ID NO: 5042 - DNA, 24 bp, Equine herpesvirus 2
gatcactacctcgggtgtgacggt

SEQ ID NO: 5043 - DNA, 24 bp, Equine herpesvirus 2
tgaggtcaggcctctccccggggt

SEQ ID NO: 5044 - DNA, 24 bp, Equine herpesvirus 2
tgttgtagcccgtcacaaactcca

SEQ ID NO: 5045 - DNA, 24 bp, Equine herpesvirus 2
aacacagcacttgaagtcctgtgt

SEQ ID NO: 5046 - DNA, 23 bp, Equine herpesvirus 2
ttgaatgaggttggagtcggggg

SEQ ID NO: 5047 - DNA, 24 bp, Equine herpesvirus 2
tttcactacagaacagcacgcggc

SEQ ID NO: 5048 - DNA, 24 bp, Equine herpesvirus 2
ctggcagagaactctgccacgggg

SEQ ID NO: 5049 - DNA, 21 bp, Equine herpesvirus 2
tccctgcacacctggtacatg

SEQ ID NO: 5050 - DNA, 24 bp, Equine herpesvirus 2
tgaaaacaccgtccggagacttct

SEQ ID NO: 5051 - DNA, 24 bp, Equine herpesvirus 2
tgagttctctagggaaacaggtgt

SEQ ID NO: 5052 - DNA, 24 bp, Equine herpesvirus 2
cagtttaagcactgaatgtatcaa

SEQ ID NO: 5053 - DNA, 24 bp, Equine herpesvirus 2
aagcagtgcatagagtgcctggag

SEQ ID NO: 5054 - DNA, 24 bp, Equine herpesvirus 2
gtaaaccttacactcggggctctg

SEQ ID NO: 5055 - DNA, 24 bp, Equine herpesvirus 2
tagtttaagcaccttttcatgacc

SEQ ID NO: 5056 - DNA, 24 bp, Equine herpesvirus 2
tggcatctatctgtacggttactc

SEQ ID NO: 5057 - DNA, 24 bp, Equine herpesvirus 2
cactgcaggatgttggccgccccg

SEQ ID NO: 5058 - DNA, 24 bp, Equine herpesvirus 2
tcacaactaacggctcagagggac

SEQ ID NO: 5059 - DNA, 24 bp, Equine herpesvirus 2
ttaatgcacatcccctattactca

SEQ ID NO: 5060 - DNA, 22 bp, Equine herpesvirus 2
tgactcctgagaggacagaggc

SEQ ID NO: 5061 - DNA, 23 bp, Equine herpesvirus 2
tggcagcgtccccctcagcaggc

SEQ ID NO: 5062 - DNA, 24 bp, Equine herpesvirus 2
agtggtaggtgcttaggaacctca

SEQ ID NO: 5063 - DNA, 22 bp, Equine herpesvirus 2
tgcccagtggggtctctctggt

SEQ ID NO: 5064 - DNA, 24 bp, Equine herpesvirus 2
agaggaagcgggcggggccgtccc

SEQ ID NO: 5065 - DNA, 24 bp, Equine herpesvirus 2
aaggtgcttatttctctctctcct

SEQ ID NO: 5066 - DNA, 23 bp, Equine herpesvirus 2
tgtcacagactgcttaagccatc

SEQ ID NO: 5067 - DNA, 23 bp, Equine herpesvirus 2
tctcccgtacgcaaggggcaacc

SEQ ID NO: 5068 - DNA, 24 bp, Equine herpesvirus 2
tagagtgtggtcttttcaagattt

SEQ ID NO: 5069 - DNA, 24 bp, Equine herpesvirus 2
aaaaagcgttaacaagcaggagaa

SEQ ID NO: 5070 - DNA, 24 bp, Equine herpesvirus 2
tgagcagcatgcccccaaagggat

SEQ ID NO: 5071 - DNA, 24 bp, Equine herpesvirus 2
tgactccactcggacgattcacag

SEQ ID NO: 5072 - DNA, 24 bp, Equine herpesvirus 2
tatcctggctatgggggccagggc

SEQ ID NO: 5073 - DNA, 21 bp, Equine herpesvirus 2
tggccacgtcgctcccgtaga

SEQ ID NO: 5074 - DNA, 24 bp, Equine herpesvirus 2
agaggggtagttacgattactcca

SEQ ID NO: 5075 - DNA, 24 bp, Equine herpesvirus 2
cagcccaccgtggggtgcctcagg

SEQ ID NO: 5076 - DNA, 24 bp, Rat cytomegalovirus
tctccagacacggtatttttgaac

SEQ ID NO: 5077 - DNA, 24 bp, Rat cytomegalovirus
tacccagaaacacgctaacaccgc

SEQ ID NO: 5078 - DNA, 21 bp, Rat cytomegalovirus
tattataagcgcaattacgat

SEQ ID NO: 5079 - DNA, 24 bp, Rat cytomegalovirus
agaattgatcatcgagtagtttcg

SEQ ID NO: 5080 - DNA, 24 bp, Rat cytomegalovirus
atcataggcattggtattgttatt

SEQ ID NO: 5081 - DNA, 24 bp, Rat cytomegalovirus
tcgaagtcaaatcggtcgattcat

SEQ ID NO: 5082 - DNA, 24 bp, Rat cytomegalovirus
tgacacatgacacaagaacgtcgc

SEQ ID NO: 5083 - DNA, 24 bp, Rat cytomegalovirus
tacgatacagcgaaatcaaaaaga

SEQ ID NO: 5084 - DNA, 24 bp, Rat cytomegalovirus
taacgtgacaccgtttctcggtcc

SEQ ID NO: 5085 - DNA, 24 bp, Rat cytomegalovirus
tatcatagacaacttgacattttc

SEQ ID NO: 5086 - DNA, 24 bp, Rat cytomegalovirus
taaatagaaataaagagtgttaat

SEQ ID NO: 5087 - DNA, 22 bp, Rat cytomegalovirus
ttcgttcttcggttggtaagat

SEQ ID NO: 5088 - DNA, 24 bp, Rat cytomegalovirus
aaaagtcgacgttccacgttcacg

SEQ ID NO: 5089 - DNA, 24 bp, Rat cytomegalovirus
tcagatctctcgctctcctgacat

SEQ ID NO: 5090 - DNA, 23 bp, Rat cytomegalovirus
taccacacaaggatcaaagcaga

SEQ ID NO: 5091 - DNA, 24 bp, Human herpesvirus 4
tagcatatgctatcctaatctata

SEQ ID NO: 5092 - DNA, 24 bp, Human herpesvirus 4
tgacagttgttcctggtagggatt

SEQ ID NO: 5093 - DNA, 24 bp, Human herpesvirus 4
tgtagaccagccgccctgttgatg

SEQ ID NO: 5094 - DNA, 24 bp, Human herpesvirus 4
taataaggagccgtccttattctt

SEQ ID NO: 5095 - DNA, 24 bp, Human herpesvirus 4
tctctggacattaacttccacgcc

SEQ ID NO: 5096 - DNA, 24 bp, Human herpesvirus 4
tagcatatgctatcctaatctata

SEQ ID NO: 5097 - DNA, 21 bp, Human herpesvirus 4
tgcaacgttaagccccgttta

SEQ ID NO: 5098 - DNA, 24 bp, Human herpesvirus 4
agagggattagagaatcctgactt

SEQ ID NO: 5099 - DNA, 24 bp, Human herpesvirus 4
ttttaacgaagagcgtgaagcacc

SEQ ID NO: 5100 - DNA, 24 bp, Goatpox virus
taaattgatggacctaatggagtt

SEQ ID NO: 5101 - DNA, 24 bp, Goatpox virus
aggcagtaatgttaccttaggttc

SEQ ID NO: 5102 - DNA, 24 bp, Goatpox virus
tatcaaataacgatattaaacttg

SEQ ID NO: 5103 - DNA, 24 bp, Goatpox virus
tgaagtaaaataatatgttaagtt

SEQ ID NO: 5104 - DNA, 24 bp, Goatpox virus
tgaaataactgatagacctacttt

SEQ ID NO: 5105 - DNA, 21 bp, Goatpox virus
tctctgattatttgttttggt

SEQ ID NO: 5106 - DNA, 24 bp, Goatpox virus
taatatcaatgaaataaaaaataa

SEQ ID NO: 5107 - DNA, 24 bp, Goatpox virus
tattattctacttttgcattaacc

SEQ ID NO: 5108 - DNA, 24 bp, Goatpox virus
tatttcgctagttaaatcagcact

SEQ ID NO: 5109 - DNA, 24 bp, Goatpox virus
tatcacttctcatgagaatattag

SEQ ID NO: 5110 - DNA, 24 bp, Goatpox virus
tattttttcttgtttgattactga

SEQ ID NO: 5111 - DNA, 24 bp, Goatpox virus
taatatagacttatacgaagattt

SEQ ID NO: 5112 - DNA, 24 bp, Goatpox virus
cagcaaacacaataacagaagtat

SEQ ID NO: 5113 - DNA, 24 bp, Goatpox virus
aatgacagatcattatttatttct

SEQ ID NO: 5114 - DNA, 24 bp, Goatpox virus
tgaaggatctagtgtacgtatgtc

SEQ ID NO: 5115 - DNA, 24 bp, Goatpox virus
tgttatctttttaaattgttccca

SEQ ID NO: 5116 - DNA, 24 bp, Goatpox virus
tggaaaaggatgattatgaaataa

SEQ ID NO: 5117 - DNA, 24 bp, Goatpox virus
ttaggaaatattatgaatttaata

SEQ ID NO: 5118 - DNA, 24 bp, Goatpox virus
attagattcatctatatcttcttc

SEQ ID NO: 5119 - DNA, 24 bp, Goatpox virus
tttgttggtggtacgttaagcgta

SEQ ID NO: 5120 - DNA, 24 bp, Goatpox virus
tgatataaatgataaaatgttttg

SEQ ID NO: 5121 - DNA, 24 bp, Goatpox virus
taagatctctcttgttggagatta

SEQ ID NO: 5122 - DNA, 24 bp, Goatpox virus
tagtacaaatcaaaatattgtgtt

SEQ ID NO: 5123 - DNA, 24 bp, Goatpox virus
taatactgtggttaaagattttga

SEQ ID NO: 5124 - DNA, 24 bp, Goatpox virus
tttaaaaaagtttatatattagta

SEQ ID NO: 5125 - DNA, 24 bp, Goatpox virus
ggaaatgaacctagtacatttgat

SEQ ID NO: 5126 - DNA, 24 bp, Goatpox virus
ttcgttagaaaagtactgataata

SEQ ID NO: 5127 - DNA, 24 bp, Goatpox virus
tctgatgataaaatatatttcaaa

SEQ ID NO: 5128 - DNA, 21 bp, Goatpox virus
aatgacaactataccggttac

SEQ ID NO: 5129 - DNA, 24 bp, Goatpox virus
atcagagttataacaaatcctatg

SEQ ID NO: 5130 - DNA, 24 bp, Goatpox virus
tctgcagtatatggtaactttaat

SEQ ID NO: 5131 - DNA, 24 bp, Goatpox virus
ttcttcatgtttggtaatggattt

SEQ ID NO: 5132 - DNA, 24 bp, Goatpox virus
ttatttgttcttcgtccgacataa

SEQ ID NO: 5133 - DNA, 24 bp, Goatpox virus
taagtttaaatctggcaaatgttt

SEQ ID NO: 5134 - DNA, 24 bp, Goatpox virus
agaaggattttgttattaggttta

SEQ ID NO: 5135 - DNA, 24 bp, Goatpox virus
tttatcaaattcatccaaatactt

SEQ ID NO: 5136 - DNA, 24 bp, Goatpox virus
ttgctcagctgtaaaatttagtga

SEQ ID NO: 5137 - DNA, 22 bp, Goatpox virus
ttaatgcctatacgaactgata

SEQ ID NO: 5138 - DNA, 24 bp, Goatpox virus
tgtcaagaagcaaaaaaaatagca

SEQ ID NO: 5139 - DNA, 24 bp, Goatpox virus
tctaaagaagagacgatgactggc

SEQ ID NO: 5140 - DNA, 22 bp, Goatpox virus
taatacaactataaaatatgga

SEQ ID NO: 5141 - DNA, 24 bp, Goatpox virus
tataacaatcctaaattgtcgaga

SEQ ID NO: 5142 - DNA, 24 bp, Goatpox virus
tgagttaaatgtttatagatcatg

SEQ ID NO: 5143 - DNA, 24 bp, Goatpox virus
tatcacattcctacaatgagatta

SEQ ID NO: 5144 - DNA, 22 bp, Goatpox virus
tggaatgttaacaaatatatca

SEQ ID NO: 5145 - DNA, 23 bp, Goatpox virus
ttgaacctaagagcaatggacca

SEQ ID NO: 5146 - DNA, 24 bp, Goatpox virus
aatggaacaaatgacgataatggt

SEQ ID NO: 5147 - DNA, 24 bp, Goatpox virus
ttgcacaacatgttatataacaga

SEQ ID NO: 5148 - DNA, 24 bp, Goatpox virus
gtgataagtttccaaataaacata

SEQ ID NO: 5149 - DNA, 22 bp, Goatpox virus
tcaattggcacagttgtattgg

SEQ ID NO: 5150 - DNA, 24 bp, Goatpox virus
tatctagacatagtaggttgcata

SEQ ID NO: 5151 - DNA, 24 bp, Goatpox virus
tatcgtagatgaaaaacttactat

SEQ ID NO: 5152 - DNA, 24 bp, Goatpox virus
aaatgaacgggaaaaagtctcttt

SEQ ID NO: 5153 - DNA, 24 bp, Goatpox virus
tagtatcataaatgtcatcgtttg

SEQ ID NO: 5154 - DNA, 24 bp, Mouse cytomegalovirus 1
tatggtactactgctgctgctgag

SEQ ID NO: 5155 - DNA, 24 bp, Mouse cytomegalovirus 1
tctgacacaccctgtgatattggt

SEQ ID NO: 5156 - DNA, 24 bp, Mouse cytomegalovirus 1
tataccagagtttggtattttttt

SEQ ID NO: 5157 - DNA, 24 bp, Mouse cytomegalovirus 1
tgaaattttaacagagtgtccatg

SEQ ID NO: 5158 - DNA, 21 bp, Mouse cytomegalovirus 1
tacagtatcccaatcaaacgt

SEQ ID NO: 5159 - DNA, 24 bp, Mouse cytomegalovirus 1
tgtcatagggagcgtgatcgaggg

SEQ ID NO: 5160 - DNA, 22 bp, Mouse cytomegalovirus 1
cgccgcggactaaaagatgagt

SEQ ID NO: 5161 - DNA, 24 bp, Mouse cytomegalovirus 1
ctcgtcgtctttattatggggtgg

SEQ ID NO: 5162 - DNA, 24 bp, Mouse cytomegalovirus 1
tgatgaatcgagcggaggatcgca

SEQ ID NO: 5163 - DNA, 24 bp, Mouse cytomegalovirus 1
tggcagatcttcttgtggatgcgc

SEQ ID NO: 5164 - DNA, 24 bp, Mouse cytomegalovirus 1
cggttcaccgacgttatccgacag

SEQ ID NO: 5165 - DNA, 24 bp, Mouse cytomegalovirus 1
tagctgcggcggatcgacgaagga

SEQ ID NO: 5166 - DNA, 24 bp, Mouse cytomegalovirus 1
tgaataaatgtgtgataagttaac

SEQ ID NO: 5167 - DNA, 24 bp, Mouse cytomegalovirus 1
agcggttggaactcgctcccgttg

SEQ ID NO: 5168 - DNA, 24 bp, Mouse cytomegalovirus 1
gacgagccggaccgaaaccccgtc

SEQ ID NO: 5169 - DNA, 24 bp, Mouse cytomegalovirus 1
tggaaagtccctattgagtcagtg

SEQ ID NO: 5170 - DNA, 24 bp, Mouse cytomegalovirus 1
aggccgtcagcctgttgccgcggc

SEQ ID NO: 5171 - DNA, 24 bp, Mouse cytomegalovirus 1
agactgtcgcctcctggatatcgg

SEQ ID NO: 5172 - DNA, 24 bp, Mouse cytomegalovirus 1
tagcgtgttattaggaagactccc

SEQ ID NO: 5173 - DNA, 24 bp, Mouse cytomegalovirus 1
tgggaagattctggcgggaacttc

SEQ ID NO: 5174 - DNA, 24 bp, Mouse cytomegalovirus 1
agaggcagaggaggacagagaagc

SEQ ID NO: 5175 - DNA, 24 bp, Mouse cytomegalovirus 1
tgggctcgggacgcggacgctcct

SEQ ID NO: 5176 - DNA, 24 bp, Mouse cytomegalovirus 1
gtaaagcagtacgaggcggcatcg

SEQ ID NO: 5177 - DNA, 24 bp, Mouse cytomegalovirus 1
cgaggcactgctccttttgagcgg

SEQ ID NO: 5178 - DNA, 24 bp, Mouse cytomegalovirus 1
tagaacgtgcaccgagcgtcgagt

SEQ ID NO: 5179 - DNA, 24 bp, Mouse cytomegalovirus 1
taccgagaagtcgcaggcggcggg

SEQ ID NO: 5180 - DNA, 24 bp, Mouse cytomegalovirus 1
aagcaccatccgatctgacaccgt

SEQ ID NO: 5181 - DNA, 24 bp, Mouse cytomegalovirus 1
cgaggtcttccacggcgagccgta

SEQ ID NO: 5182 - DNA, 24 bp, Mouse cytomegalovirus 1
taaagtctgacagaactatgatta

SEQ ID NO: 5183 - DNA, 24 bp, Mouse cytomegalovirus 1
gctgcaacgacttgtagggggaat

SEQ ID NO: 5184 - DNA, 24 bp, Mouse cytomegalovirus 1
tgacccgtctcgtcttttttacga

SEQ ID NO: 5185 - DNA, 24 bp, Mouse cytomegalovirus 1
ttgaaggagagccggtacaggttg

SEQ ID NO: 5186 - DNA, 24 bp, Mouse cytomegalovirus 1
agagggagagggacattctgtggt

SEQ ID NO: 5187 - DNA, 24 bp, Mouse cytomegalovirus 1
tccccgtcaagctaggattctcgc

SEQ ID NO: 5188 - DNA, 24 bp, Mouse cytomegalovirus 1
tacagtgagaataaataacaaacc

SEQ ID NO: 5189 - DNA, 24 bp, Mouse cytomegalovirus 1
gtgagcaggtgcagcacggggacg

SEQ ID NO: 5190 - DNA, 24 bp, Mouse cytomegalovirus 1
tgatgtgggtgctggcggggctgt

SEQ ID NO: 5191 - DNA, 24 bp, Mouse cytomegalovirus 1
tgtcggggtctcggtcgtctccgt

SEQ ID NO: 5192 - DNA, 24 bp, Mouse cytomegalovirus 1
tggtggagctcacggtcgaaggcg

SEQ ID NO: 5193 - DNA, 24 bp, Mouse cytomegalovirus 1
tacggtggtcagaccgaagactgc

SEQ ID NO: 5194 - DNA, 24 bp, Mouse cytomegalovirus 1
tagcagcacgagcacggacagcac

SEQ ID NO: 5195 - DNA, 24 bp, Mouse cytomegalovirus 1
tcagtgtacttggcagcaatgggt

SEQ ID NO: 5196 - DNA, 24 bp, Mouse cytomegalovirus 1
tgtcaggacatcatgtgtttaact

SEQ ID NO: 5197 - DNA, 24 bp, Mouse cytomegalovirus 1
agatggagatggagttctctccgc

SEQ ID NO: 5198 - DNA, 24 bp, Mouse cytomegalovirus 1
tgagttgaccgtgaatgagagata

SEQ ID NO: 5199 - DNA, 24 bp, Mouse cytomegalovirus 1
aagagcaaggcgctgaaggcgctc

SEQ ID NO: 5200 - DNA, 24 bp, Mouse cytomegalovirus 1
ttagatcggtttgaagttgaaact

SEQ ID NO: 5201 - DNA, 24 bp, Mouse cytomegalovirus 1
acgctgcgcatcccctcgagcgtg

SEQ ID NO: 5202 - DNA, 24 bp, Mouse cytomegalovirus 1
ccagcaccgcttgaactcggggtc

SEQ ID NO: 5203 - DNA, 22 bp, Mouse cytomegalovirus 1
tggctcacgtggaacaccgtgt

SEQ ID NO: 5204 - DNA, 24 bp, Mouse cytomegalovirus 1
catcagatagagttctgtctgtaa

SEQ ID NO: 5205 - DNA, 21 bp, Mouse cytomegalovirus 1
tgtcacgttgtgaacagccgc

SEQ ID NO: 5206 - DNA, 24 bp, Mouse cytomegalovirus 1
tcaccgatccgcgttcgcggtagc

SEQ ID NO: 5207 - DNA, 24 bp, Mouse cytomegalovirus 1
tgggttatctcgacgtggcggaga

SEQ ID NO: 5208 - DNA, 24 bp, Mouse cytomegalovirus 1
tcgcacgggagtcccggccggcgc

SEQ ID NO: 5209 - DNA, 23 bp, Mouse cytomegalovirus 1
ggagaaccgaagacggaccgtcc

SEQ ID NO: 5210 - DNA, 24 bp, Mouse cytomegalovirus 1
tgggaagttcgaactcgtcgtccc

SEQ ID NO: 5211 - DNA, 24 bp, Mouse cytomegalovirus 1
tggcacgaattcgtcctcgtccac

SEQ ID NO: 5212 - DNA, 21 bp, Mouse cytomegalovirus 1
cacccggagtacgtgtacgcc

SEQ ID NO: 5213 - DNA, 24 bp, Mouse cytomegalovirus 1
tcgccgcgatggcgccccgatacc

SEQ ID NO: 5214 - DNA, 24 bp, Mouse cytomegalovirus 1
agctggttctcggccgtgtccacc

SEQ ID NO: 5215 - DNA, 24 bp, Mouse cytomegalovirus 1
tgacatggaggccgctgctgtaac

SEQ ID NO: 5216 - DNA, 24 bp, Mouse cytomegalovirus 1
ggaggtggaagtggaggtcggcga

SEQ ID NO: 5217 - DNA, 24 bp, Mouse cytomegalovirus 1
tgatatacttactgttgttgttca

SEQ ID NO: 5218 - DNA, 24 bp, Mouse cytomegalovirus 1
tcaccggagttgatgcccagcatg

SEQ ID NO: 5219 - DNA, 24 bp, Mouse cytomegalovirus 1
ggaggcagaagcggctgctggcgc

SEQ ID NO: 5220 - DNA, 21 bp, Mouse cytomegalovirus 1
acaccggaagcgcggaagaac

SEQ ID NO: 5221 - DNA, 24 bp, Mouse cytomegalovirus 1
tctaccgccccgaaacgacgttgt

SEQ ID NO: 5222 - DNA, 23 bp, Mouse cytomegalovirus 1
ggcgatcgcgcatatatagacac

SEQ ID NO: 5223 - DNA, 21 bp, Mouse cytomegalovirus 1
tagctagtattggtgtcagta

SEQ ID NO: 5224 - DNA, 24 bp, Mouse cytomegalovirus 1
tgaaatggtgtgtataggatgggt

SEQ ID NO: 5225 - DNA, 22 bp, Mouse cytomegalovirus 1
tagtacaggcgaaagttgttga

SEQ ID NO: 5226 - DNA, 24 bp, Mouse cytomegalovirus 1
tcagatcgccgtgactcctggcac

SEQ ID NO: 5227 - DNA, 24 bp, Mouse cytomegalovirus 1
taaattgcagttgagcataggtga

SEQ ID NO: 5228 - DNA, 24 bp, Mouse cytomegalovirus 1
cacccctattgcctaaaattatgg

SEQ ID NO: 5229 - DNA, 24 bp, Mouse cytomegalovirus 1
tgagtcaccaaacacgatcgtgac

SEQ ID NO: 5230 - DNA, 24 bp, Mouse cytomegalovirus 1
tgacggagcgcacgcactcatcga

SEQ ID NO: 5231 - DNA, 24 bp, Mouse cytomegalovirus 1
ggaaatcggagacgtttctcgaaa

SEQ ID NO: 5232 - DNA, 24 bp, Mouse cytomegalovirus 1
ttcaacggcatctcgtgcgtctta

SEQ ID NO: 5233 - DNA, 24 bp, Mouse cytomegalovirus 1
tagctgctcgtcggccgagctcat

SEQ ID NO: 5234 - DNA, 24 bp, Mouse cytomegalovirus 1
tgttgtagttggtcctcgagcggg

SEQ ID NO: 5235 - DNA, 24 bp, Mouse cytomegalovirus 1
tcagtggcttcaccagcaggttcc

SEQ ID NO: 5236 - DNA, 24 bp, Mouse cytomegalovirus 1
tgtcgtgctaggtttcgaagatgt

SEQ ID NO: 5237 - DNA, 24 bp, Mouse cytomegalovirus 1
gtcaacagaaaccatgttctccgt

SEQ ID NO: 5238 - DNA, 24 bp, Mouse cytomegalovirus 1
ttgctgattgatgttcttcccgac

SEQ ID NO: 5239 - DNA, 24 bp, Cowpox virus
tataacagccgtcaattgtttagg

SEQ ID NO: 5240 - DNA, 22 bp, Pepper ringspot virus
ttatatgttcatgatcaagtcg

SEQ ID NO: 5241 - DNA, 24 bp, Pepper ringspot virus
tcaaaggtgcaaagaaagacagaa

SEQ ID NO: 5242 - DNA, 24 bp, Pepper ringspot virus
agaggttatccgaatggtttagat

SEQ ID NO: 5243 - DNA, 24 bp, Rio Bravo virus
tcaatgatcgaattggcaagagtg

SEQ ID NO: 5244 - DNA, 24 bp, Rio Bravo virus
tggaacaaaagtccaaattctaga

SEQ ID NO: 5245 - DNA, 24 bp, Rio Bravo virus
tcactggtccgaggagatttcttt

SEQ ID NO: 5246 - DNA, 24 bp, Rio Bravo virus
ttaaaccaatggaaaaaggcaata

SEQ ID NO: 5247 - DNA, 24 bp, pestivirus Reindeer-1
tattatctccataaaaaaataata

SEQ ID NO: 5248 - DNA, 24 bp, pestivirus Reindeer-1
tggaaagaaattggttggggaagg

SEQ ID NO: 5249 - DNA, 24 bp, pestivirus Reindeer-1
gtgcattccaattagtgtgcccat

SEQ ID NO: 5250 - DNA, 24 bp, pestivirus Giraffe-1
tatctcagaggggtgaacaggagc

SEQ ID NO: 5251 - DNA, 24 bp, pestivirus Giraffe-1
taatgtacctagctatagatctcc

SEQ ID NO: 5252 - DNA, 24 bp, Langat virus
tcactggctggggtccctgtagct

SEQ ID NO: 5253 - DNA, 24 bp, Langat virus
tcactgggcgtccagggcttctag

SEQ ID NO: 5254 - DNA, 24 bp, Langat virus
cctcacattggttctcgagctggg

SEQ ID NO: 5255 - DNA, 22 bp, Langat virus
tgtcatggacatcataacgcgt

SEQ ID NO: 5256 - DNA, 24 bp, Langat virus
tctggctcttttggtgacgggact

SEQ ID NO: 5257 - DNA, 24 bp, Langat virus
tgacaacggggctctactcagtga

SEQ ID NO: 5258 - DNA, 24 bp, Langat virus
gcactggtgttttacaccctactg

SEQ ID NO: 5259 - DNA, 23 bp, Saccharomyces cerevisiae virus L-A
ttcggagttggtgatgacgttgt

SEQ ID NO: 5260 - DNA, 24 bp, Saccharomyces cerevisiae virus L-A
agcagcagtagctactattctcgc

SEQ ID NO: 5261 - DNA, 24 bp, Saccharomyces cerevisiae virus L-A
tatgctaacctgagcaaattcatg

SEQ ID NO: 5262 - DNA, 23 bp, Rice yellow stunt virus
atcacagaagaaagatggatgct

SEQ ID NO: 5263 - DNA, 24 bp, rice ragged stunt virus
tcatcgcatggatttgattacaat

SEQ ID NO: 5264 - DNA, 24 bp, rice ragged stunt virus
atttagctgttgttaatcgtaagc

SEQ ID NO: 5265 - DNA, 24 bp, Plautia stali intestine virus
tgatatggatggtaaagattctta

SEQ ID NO: 5266 - DNA, 24 bp, Plautia stali intestine virus
tttaatggtgagactacaccactg

SEQ ID NO: 5267 - DNA, 24 bp, Plautia stali intestine virus
tcaggtacatgtggtgcccctgtt

SEQ ID NO: 5268 - DNA, 24 bp, Himetobi P virus
tctcatcgaatatatccctaaata

SEQ ID NO: 5269 - DNA, 24 bp, Himetobi P virus
tatcttgggtaatgttttaccgca

SEQ ID NO: 5270 - DNA, 24 bp, Himetobi P virus
ttactccagccgctactggtaggg

SEQ ID NO: 5271 - DNA, 24 bp, Himetobi P virus
tacccctttcaaacgcattagacc

SEQ ID NO: 5272 - DNA, 24 bp, Himetobi P virus
tcaatcggttgcttttacaaatac

SEQ ID NO: 5273 - DNA, 24 bp, Himetobi P virus
attacattgattcattttcctatt

SEQ ID NO: 5274 - DNA, 24 bp, Himetobi P virus
tggctgctgctgatgattttgatt

SEQ ID NO: 5275 - DNA, 24 bp, Triatoma virus
ttgcagcctttcccacgcatttta

SEQ ID NO: 5276 - DNA, 21 bp, Triatoma virus
tgtttcaggattttgcctatt

SEQ ID NO: 5277 - DNA, 24 bp, Triatoma virus
tagcgaatttgctcgctttattgc

SEQ ID NO: 5278 - DNA, 24 bp, Triatoma virus
tagggtagcatggtctcataatga

SEQ ID NO: 5279 - DNA, 24 bp, Triatoma virus
tcaatgaaccaataacttggaatg

SEQ ID NO: 5280 - DNA, 24 bp, Triatoma virus
aacggtacaagaatgggcccttct

SEQ ID NO: 5281 - DNA, 24 bp, Triatoma virus
tgttgtaatgtggggtcatgcatt

SEQ ID NO: 5282 - DNA, 24 bp, Triatoma virus
tatttcatgattgggcagatacta

SEQ ID NO: 5283 - DNA, 24 bp, Triatoma virus
acaggtagggtatttacctggcga

SEQ ID NO: 5284 - DNA, 24 bp, Triatoma virus
aaaagtggaacaacgacctgtggt

SEQ ID NO: 5285 - DNA, 24 bp, Triatoma virus
tattacatgaaatatttggaatct

SEQ ID NO: 5286 - DNA, 24 bp, Triatoma virus
tggtaagaaacagatttttggaaa

SEQ ID NO: 5287 - DNA, 24 bp, Triatoma virus
tatcttaaatccaagtctgatggt

SEQ ID NO: 5288 - DNA, 24 bp, Triatoma virus
tgaaagattgagaggatatccatg

SEQ ID NO: 5289 - DNA, 24 bp, Triatoma virus
tgattcggaaagagtatattatga

SEQ ID NO: 5290 - DNA, 24 bp, Triatoma virus
tgttatggattcggatggtaagat

SEQ ID NO: 5291 - DNA, 24 bp, Triatoma virus
taactggaatgtctagaaatcatg

SEQ ID NO: 5292 - DNA, 24 bp, Triatoma virus
tacctgttccagatattttacctc

SEQ ID NO: 5293 - DNA, 24 bp, Triatoma virus
tgaaagaatcttatctttttctga

SEQ ID NO: 5294 - DNA, 24 bp, Triatoma virus
tatggaaatgaggttattttgaaa

SEQ ID NO: 5295 - DNA, 24 bp, Satsuma dwarf virus
ttgaaacgggcgatactattagtg

SEQ ID NO: 5296 - DNA, 24 bp, Satsuma dwarf virus
tatgtgaggctttctttcatggta

SEQ ID NO: 5297 - DNA, 24 bp, Satsuma dwarf virus
agaggcaatttgttgcagactctg

SEQ ID NO: 5298 - DNA, 24 bp, Satsuma dwarf virus
tcagtgaatgtcgtaaagaactca

SEQ ID NO: 5299 - DNA, 22 bp, Satsuma dwarf virus
ttaaagccaaattgccttcgta

SEQ ID NO: 5300 - DNA, 24 bp, Apple latent spherical virus
tggcatgttatggatcgttatgtg

SEQ ID NO: 5301 - DNA, 24 bp, Apple latent spherical virus
ttcagagaatggcggcacaggaaa

SEQ ID NO: 5302 - DNA, 24 bp, Apple latent spherical virus
taggagcagttctaggggtctttt

SEQ ID NO: 5303 - DNA, 24 bp, Apple latent spherical virus
aaatgtgttggtatgataaacgat

SEQ ID NO: 5304 - DNA, 24 bp, Apple latent spherical virus
tgagaaagttgattcttctaaagt

SEQ ID NO: 5305 - DNA, 24 bp, Apple latent spherical virus
tgataacaccttctccaaatttgt

SEQ ID NO: 5306 - DNA, 24 bp, Apple latent spherical virus
caaattgcaaaaattcttaatgca

SEQ ID NO: 5307 - DNA, 24 bp, Tobacco rattle virus
tgaggaagattgtgtctaaagaac

SEQ ID NO: 5308 - DNA, 24 bp, Tobacco rattle virus
tcaacgatttctttagcagtctgt

SEQ ID NO: 5309 - DNA, 24 bp, Tobacco rattle virus
atcatatttgagttcaaataattg

SEQ ID NO: 5310 - DNA, 24 bp, Obuda pepper virus
tgtaatgaatccggtcactaagcc

SEQ ID NO: 5311 - DNA, 24 bp, Obuda pepper virus
ttaatggagttactgcgagatctg

SEQ ID NO: 5312 - DNA, 24 bp, Obuda pepper virus
tgaggtagtatgcaataatacttt

SEQ ID NO: 5313 - DNA, 24 bp, Obuda pepper virus
tagtatactccggaccgctacaag

SEQ ID NO: 5314 - DNA, 24 bp, Sugarcane striate mosaic associated virus
tgaggtttattcttaaaaattcaa

SEQ ID NO: 5315 - DNA, 24 bp, Sugarcane striate mosaic associated virus
tgaagtccaggaaaatggtcacaa

SEQ ID NO: 5316 - DNA, 24 bp, Salmon pancreas disease virus
tgatgtgtatgacgctctgccgat

SEQ ID NO: 5317 - DNA, 24 bp, Salmon pancreas disease virus
tacccgcaaattaaaggatccgaa

SEQ ID NO: 5318 - DNA, 24 bp, Ljungan virus
tcgcatgctacgctatgtttttga

SEQ ID NO: 5319 - DNA, 24 bp, Ljungan virus
tgagatatggagtggaaatacttg

SEQ ID NO: 5320 - DNA, 24 bp, Ljungan virus
aatgacactttgtgtaccctatta

SEQ ID NO: 5321 - DNA, 24 bp, Ljungan virus
cagcccaaaattttggaatggaag

SEQ ID NO: 5322 - DNA, 24 bp, Equine rhinitis A virus
ggtcacaaatgtgggagaggatgg

SEQ ID NO: 5323 - DNA, 24 bp, Equine rhinitis A virus
taccaaggcaaaatttttggttgc

SEQ ID NO: 5324 - DNA, 24 bp, Equine rhinitis A virus
tatcagatttttaaaaccccagat

SEQ ID NO: 5325 - DNA, 24 bp, Equine rhinitis B virus
tacaacgcgtgggaagactttgat

SEQ ID NO: 5326 - DNA, 24 bp, Equine rhinitis B virus
gtgcagtgcaatgccagccagttc

SEQ ID NO: 5327 - DNA, 24 bp, Equine rhinitis B virus
tgggatactctgattatgaaaccg

SEQ ID NO: 5328 - DNA, 24 bp, Equine rhinitis B virus
ccgcagcgtatgatgtcttcacca

SEQ ID NO: 5329 - DNA, 24 bp, Equine rhinitis B virus
ttgcattcctttctggcattcatg

SEQ ID NO: 5330 - DNA, 24 bp, Equine rhinitis B virus
tggctcaactttcttacaaaactt

SEQ ID NO: 5331 - DNA, 24 bp, Porcine enterovirus A (PEV8)
tattacaaagtttaaagcttttac

SEQ ID NO: 5332 - DNA, 24 bp, Porcine enterovirus A (PEV8)
ttatagcaatagaccatttggttt

SEQ ID NO: 5333 - DNA, 24 bp, Porcine enterovirus A (PEV8)
tatagttacagctaagactgaaag

SEQ ID NO: 5334 - DNA, 24 bp, A-2 plaque virus
aggcagcaaggccatgtgatgagg

SEQ ID NO: 5335 - DNA, 24 bp, A-2 plaque virus
tcaatcttgaaattaccgtattga

SEQ ID NO: 5336 - DNA, 24 bp, A-2 plaque virus
tatggcagaagcaattgatgatta

SEQ ID NO: 5337 - DNA, 24 bp, Avian encephalomyelitis virus
taaagagaacattctatgtggatg

SEQ ID NO: 5338 - DNA, 24 bp, Avian encephalomyelitis virus
tccacaggaggttattaaatgtcc

SEQ ID NO: 5339 - DNA, 21 bp, Avian encephalomyelitis virus
atggtccaagttttgttcttg

SEQ ID NO: 5340 - DNA, 24 bp, Avian encephalomyelitis virus
tggcttgatgatgacgagttggta

SEQ ID NO: 5341 - DNA, 24 bp, Tamana bat virus
tgacaagtatgttctaatggttga

SEQ ID NO: 5342 - DNA, 24 bp, Tamana bat virus
tatggcatgttgccaggaaggcct

SEQ ID NO: 5343 - DNA, 24 bp, Tamana bat virus
tcacttgtgcagcagtaacttact

SEQ ID NO: 5344 - DNA, 22 bp, Tamana bat virus
tacgttggtaactgcaacagac

SEQ ID NO: 5345 - DNA, 24 bp, Tamana bat virus
agttatgaacataaaccttgcaaa

SEQ ID NO: 5346 - DNA, 24 bp, Tamana bat virus
tccagtagtgggcttcttcaagag

SEQ ID NO: 5347 - DNA, 24 bp, sheeppox virus
taattgatataataaaaggatcta

SEQ ID NO: 5348 - DNA, 24 bp, Goatpox virus
agaggaactaatgtttttatatct

SEQ ID NO: 5349 - DNA, 24 bp, Foot-and-mouth disease virus O
tggcaaagactttgacttgcgtct

SEQ ID NO: 5350 - DNA, 24 bp, Foot-and-mouth disease virus O
tggcatgcagcgatggttacggtg

SEQ ID NO: 5351 - DNA, 24 bp, Foot-and-mouth disease virus O
tgtggcagcacggtccaaggaccc

SEQ ID NO: 5352 - DNA, 24 bp, Foot-and-mouth disease virus O
gtgtgcatggtggacggtacagac

SEQ ID NO: 5353 - DNA, 24 bp, Foot-and-mouth disease virus O
cacccgtaacggccacacgacctc

SEQ ID NO: 5354 - DNA, 24 bp, Cowpea aphid-borne mosaic virus
taaatgcactgtacagcaagcaaa

SEQ ID NO: 5355 - DNA, 24 bp, Cowpea aphid-borne mosaic virus
ggaggaagactcggaacttcattc

SEQ ID NO: 5356 - DNA, 24 bp, Cowpea aphid-borne mosaic virus
taaggtagagcagttctcacatag

SEQ ID NO: 5357 - DNA, 24 bp, Cowpea aphid-borne mosaic virus
tgagggtgtggcaagaaaaccact

SEQ ID NO: 5358 - DNA, 24 bp, Cowpea aphid-borne mosaic virus
gaggttagttttctttgctaatgg

SEQ ID NO: 5359 - DNA, 24 bp, Cowpea aphid-borne mosaic virus
ttcacacccatccttacaccagat

SEQ ID NO: 5360 - DNA, 23 bp, Cowpea aphid-borne mosaic virus
tgttacggaaaatactttgacaa

SEQ ID NO: 5361 - DNA, 24 bp, Trichomonas vaginalis virus 3
ttaaagtgaactgttacgcgcgaa

SEQ ID NO: 5362 - DNA, 24 bp, Trichomonas vaginalis virus 3
taccctaccctatgaattaaacaa

SEQ ID NO: 5363 - DNA, 24 bp, Sorghum mosaic virus
gtgcatcattgagaatcactcgaa

SEQ ID NO: 5364 - DNA, 23 bp, Sorghum mosaic virus
tacaacagcccgtgctaaggagg

SEQ ID NO: 5365 - DNA, 24 bp, Sorghum mosaic virus
agagttaatcgtacagcaaatgtc

SEQ ID NO: 5366 - DNA, 23 bp, Sorghum mosaic virus
tgagcggactaatggtatggtgc

SEQ ID NO: 5367 - DNA, 24 bp, Potato virus A
aatcacaaaggacttgttgatagt

SEQ ID NO: 5368 - DNA, 24 bp, Potato virus A
gaggagcaagacagcgtctgtgca

SEQ ID NO: 5369 - DNA, 24 bp, Potato virus A
tcaaatgctagagccacccacgaa

SEQ ID NO: 5370 - DNA, 24 bp, Potato virus A
agaagtggttctgtttcaagcaaa

SEQ ID NO: 5371 - DNA, 24 bp, Potato virus A
aagctcaagggaatggatcgaatc

SEQ ID NO: 5372 - DNA, 24 bp, Potato virus A
tggcaagagttaagctattttgga

SEQ ID NO: 5373 - DNA, 24 bp, Potato virus A
tgagatcatcaccaagggcagtgc

SEQ ID NO: 5374 - DNA, 24 bp, Potato virus A
taaagttcatcaatacaatgttag

SEQ ID NO: 5375 - DNA, 24 bp, Cryphonectria parasitica mitovirus 1-NB631
tcaagtgaatttactgaatttgca

SEQ ID NO: 5376 - DNA, 24 bp, Cryphonectria parasitica mitovirus 1-NB631
tgacttatgcggtagggcaaccca

SEQ ID NO: 5377 - DNA, 24 bp, Cryphonectria parasitica mitovirus 1-NB631
ttcaaagactatagatcagaagct

SEQ ID NO: 5378 - DNA, 24 bp, Bean common mosaic necrosis virus
tgaggaattctgaagggttctaca

SEQ ID NO: 5379 - DNA, 24 bp, Bean common mosaic necrosis virus
tgttatgggattatttccgtcact

SEQ ID NO: 5380 - DNA, 24 bp, Bean common mosaic necrosis virus
agagagaagatctgacgcttgctt

SEQ ID NO: 5381 - DNA, 24 bp, Bean common mosaic necrosis virus
tcacagggcattcattttcattgg

SEQ ID NO: 5382 - DNA, 24 bp, Ophiostoma mitovirus 3a
tgatactcttcctaagtccgagat

SEQ ID NO: 5383 - DNA, 24 bp, Ophiostoma mitovirus 3a
tgagtctttagtaaattaaaggac

SEQ ID NO: 5384 - DNA, 24 bp, Ophiostoma mitovirus 3a
ttcctcattgaataagattattag

SEQ ID NO: 5385 - DNA, 24 bp, Ophiostoma mitovirus 3a
tgtgcaagataaaccggtgagaag

SEQ ID NO: 5386 - DNA, 24 bp, Ophiostoma mitovirus 3a
aggattctagtactataaggggag

SEQ ID NO: 5387 - DNA, 22 bp, Ophiostoma mitovirus 3a
tgaatagaggtaacgttcttat

SEQ ID NO: 5388 - DNA, 24 bp, Ophiostoma mitovirus 3a
ctcccattcactaattatgcgtta

SEQ ID NO: 5389 - DNA, 24 bp, Ophiostoma novo-ulmi mitovirus 4-Ld
tgaatatatttacatatttacaaa

SEQ ID NO: 5390 - DNA, 24 bp, Ophiostoma novo-ulmi mitovirus 4-Ld
ataatgatcattatctaagcataa

SEQ ID NO: 5391 - DNA, 24 bp, Ophiostoma novo-ulmi mitovirus 4-Ld
tataacaagatatatgtgtggtaa

SEQ ID NO: 5392 - DNA, 24 bp, Ophiostoma novo-ulmi mitovirus 4-Ld
tgtcatattctacactaacattcg

SEQ ID NO: 5393 - DNA, 24 bp, Ophiostoma novo-ulmi mitovirus 4-Ld
tagatttccaatattcttacaaca

SEQ ID NO: 5394 - DNA, 24 bp, Ophiostoma novo-ulmi mitovirus 4-Ld
tatgatgcctagtatttgagatat

SEQ ID NO: 5395 - DNA, 24 bp, Ophiostoma novo-ulmi mitovirus 5-Ld
tgaagtagagatgatcattatttg

SEQ ID NO: 5396 - DNA, 24 bp, Ophiostoma novo-ulmi mitovirus 5-Ld
agaggtattttaaataatctaaat

SEQ ID NO: 5397 - DNA, 24 bp, Ophiostoma novo-ulmi mitovirus 5-Ld
tattactaaatatattgcaaatga

SEQ ID NO: 5398 - DNA, 24 bp, Southern bean mosaic virus
ttcaagtaaacccctcatggatta

SEQ ID NO: 5399 - DNA, 24 bp, Southern bean mosaic virus
tgatgtagagatgagaattgttct

SEQ ID NO: 5400 - DNA, 24 bp, Southern bean mosaic virus
tgagaactcggctgctcccagagg

SEQ ID NO: 5401 - DNA, 24 bp, Phthorimaea operculella granulovirus
tattgtattgaatagcgtgtgggt

SEQ ID NO: 5402 - DNA, 24 bp, Phthorimaea operculella granulovirus
tcggatggatgttatatttgcgtt

SEQ ID NO: 5403 - DNA, 24 bp, Phthorimaea operculella granulovirus
tcgattaaacaaattggtacaaaa

SEQ ID NO: 5404 - DNA, 21 bp, Phthorimaea operculella granulovirus
tttacagttgattcaaaatgt

SEQ ID NO: 5405 - DNA, 24 bp, Phthorimaea operculella granulovirus
tttggcaaacgttttgcgttacaa

SEQ ID NO: 5406 - DNA, 24 bp, Fringilla coelebs papillomavirus (FPV)
tagcttaccattatgctatacatg

SEQ ID NO: 5407 - DNA, 24 bp, Paprika mild mottle virus
tataacagatagggagcatctgga

SEQ ID NO: 5408 - DNA, 24 bp, Paprika mild mottle virus
tttgcaaattcactaaactagata

SEQ ID NO: 5409 - DNA, 24 bp, Paprika mild mottle virus
tgtcacagcgaggtcagaatggga

SEQ ID NO: 5410 - DNA, 24 bp, Paprika mild mottle virus
atgaagcctttgtctttggagata

SEQ ID NO: 5411 - DNA, 24 bp, La Crosse virus
tattggagataaggctattgagta

SEQ ID NO: 5412 - DNA, 24 bp, La Crosse virus
tcaatgattagtacagttggattg

SEQ ID NO: 5413 - DNA, 24 bp, La Crosse virus
agagatggaccctagtgatattat

SEQ ID NO: 5414 - DNA, 24 bp, Mamestra configurata nucleopolyhedrovirus B
tatagtaaaaacgaaacacccgtt

SEQ ID NO: 5415 - DNA, 24 bp, Mamestra configurata nucleopolyhedrovirus B
ttaaaggcaactatacgggacacg

SEQ ID NO: 5416 - DNA, 24 bp, Heliothis zea virus 1 (HZV-1)
acaagtgcattcaactggaccgac

SEQ ID NO: 5417 - DNA, 24 bp, Heliothis zea virus 1 (HZV-1)
tctaaactctagtcaaaaggtggc

SEQ ID NO: 5418 - DNA, 24 bp, Heliothis zea virus 1 (HZV-1)
agcggtagcgttgcctcaaaacta

SEQ ID NO: 5419 - DNA, 24 bp, Heliothis zea virus 1 (HZV-1)
tggtgtagagggtgattttaacaa

SEQ ID NO: 5420 - DNA, 24 bp, Heliothis zea virus 1 (HZV-1)
tattacatcggtggaccaagtgat

SEQ ID NO: 5421 - DNA, 24 bp, Heliothis zea virus 1 (HZV-1)
taatgtagagtccccggagcttac

SEQ ID NO: 5422 - DNA, 24 bp, Chikungunya virus
tccgatgaattgatggcagccaga

SEQ ID NO: 5423 - DNA, 24 bp, Chikungunya virus
tgactagcggaaagaaagaaaact

SEQ ID NO: 5424 - DNA, 24 bp, Mammalian orthoreovirus 2
tgagcgactcgggaagttgtatca

SEQ ID NO: 5425 - DNA, 24 bp, Mammalian orthoreovirus 2
tgagatggaagtgcttggtgtgcg

SEQ ID NO: 5426 - DNA, 24 bp, Mammalian orthoreovirus 2
tgcaagatgggtggtgcgggtgtg

SEQ ID NO: 5427 - DNA, 24 bp, Tacaribe virus
tgagatgacaggcttcattagaag

SEQ ID NO: 5428 - DNA, 24 bp, Rachiplusia ou multiple nucleopolyhedrovirus
tttggaaacgactaaaattaaaga

SEQ ID NO: 5429 - DNA, 24 bp, Rachiplusia ou multiple nucleopolyhedrovirus
tacagcaatatgaacgatcagaaa

SEQ ID NO: 5430 - DNA, 24 bp, Aphid lethal paralysis virus
ttgaacagtatcgttaatcattgt

SEQ ID NO: 5431 - DNA, 24 bp, Aphid lethal paralysis virus
acattgccattgtacaattaccca

SEQ ID NO: 5432 - DNA, 24 bp, Aphid lethal paralysis virus
atcaagaatcccgaactgaaacga

SEQ ID NO: 5433 - DNA, 24 bp, Aphid lethal paralysis virus
ttgatgctgtttatgaagcaatga

SEQ ID NO: 5434 - DNA, 24 bp, Aphid lethal paralysis virus
ttagctgcacagaatctattaccc

SEQ ID NO: 5435 - DNA, 24 bp, Aphid lethal paralysis virus
ttagagcatattttgtggcaccaa

SEQ ID NO: 5436 - DNA, 24 bp, Aphid lethal paralysis virus
tgtgataactgctctcctatcgat

SEQ ID NO: 5437 - DNA, 24 bp, Aphid lethal paralysis virus
agtcgcagattgtgattgtaatac

SEQ ID NO: 5438 - DNA, 21 bp, Aphid lethal paralysis virus
ttgcaggaattacgcatatga

SEQ ID NO: 5439 - DNA, 21 bp, Aphid lethal paralysis virus
aagctggcgacgtactatatg

SEQ ID NO: 5440 - DNA, 24 bp, Aphid lethal paralysis virus
ttagtgctattaatgagttggaag

SEQ ID NO: 5441 - DNA, 24 bp, Callitrichine herpesvirus 3
tgtttactttttactccgggcggc

SEQ ID NO: 5442 - DNA, 24 bp, Callitrichine herpesvirus 3
tgggatcaatcatacggagttccg

SEQ ID NO: 5443 - DNA, 24 bp, Callitrichine herpesvirus 3
tgacatagaatggtctatgctttg

SEQ ID NO: 5444 - DNA, 24 bp, Broad bean necrosis virus
tgaagtgcagaggagacaacaaga

SEQ ID NO: 5445 - DNA, 23 bp, Broad bean necrosis virus
tgagatgaagcagtatcttggtt

SEQ ID NO: 5446 - DNA, 24 bp, Broad bean necrosis virus
tgatgtgtgatactacttatttga

SEQ ID NO: 5447 - DNA, 24 bp, Broad bean necrosis virus
tgagtatacgactgatgactttga

SEQ ID NO: 5448 - DNA, 24 bp, Broad bean necrosis virus
tatcaaagttgtgattgaattgta

SEQ ID NO: 5449 - DNA, 24 bp, Broad bean necrosis virus
tgagcaggcgaagaaacaattgat

SEQ ID NO: 5450 - DNA, 24 bp, Broad bean necrosis virus
tgagtatacgactgatgactttga

SEQ ID NO: 5451 - DNA, 23 bp, Homo sapiens
ccgcctcttcccgccccgcccca

SEQ ID NO: 5452 - DNA, 20 bp, Homo sapiens
gaactttcttgaaaatctta

SEQ ID NO: 5453 - DNA, 21 bp, Homo sapiens
tcccgggaggctgccgcgcca

SEQ ID NO: 5454 - DNA, 23 bp, Homo sapiens
actcattaccgtctgtgattgcc

SEQ ID NO: 5455 - DNA, 19 bp, Homo sapiens
atttctcatcaattctcta

SEQ ID NO: 5456 - DNA, 19 bp, Homo sapiens
ccacagcaaatgagatgta

SEQ ID NO: 5457 - DNA, 18 bp, Homo sapiens
tggatgtttcttctttga

SEQ ID NO: 5458 - DNA, 20 bp, Homo sapiens
agctacaaaaatctgtatta

SEQ ID NO: 5459 - DNA, 22 bp, Homo sapiens
ccctccttccttctttccctac

SEQ ID NO: 5460 - DNA, 24 bp, Homo sapiens
gcaaagagagctcccctggttcca

SEQ ID NO: 5461 - DNA, 22 bp, Homo sapiens
ggacttggacagagggcccaca

SEQ ID NO: 5462 - DNA, 25 bp, Homo sapiens
tcccatgggattccccggctgtgac

SEQ ID NO: 5463 - DNA, 19 bp, Homo sapiens
tctaccttcccactcacct

SEQ ID NO: 5464 - DNA, 20 bp, Homo sapiens
acagttgtgacagtaatctg

SEQ ID NO: 5465 - DNA, 20 bp, Homo sapiens
cagaaaaccagcatatttaa

SEQ ID NO: 5466 - DNA, 21 bp, Homo sapiens
cctaataaaataatggtattt

SEQ ID NO: 5467 - DNA, 23 bp, Homo sapiens
gtatattttatatgatttactta

SEQ ID NO: 5468 - DNA, 22 bp, Homo sapiens
ttctattgagtattataagata

SEQ ID NO: 5469 - DNA, 15 bp, Homo sapiens
cccccagtctcccac

SEQ ID NO: 5470 - DNA, 22 bp, Homo sapiens
acctgcctcaactgctgcccca

SEQ ID NO: 5471 - DNA, 19 bp, Homo sapiens
gccctgacctcaggggcca

SEQ ID NO: 5472 - DNA, 19 bp, Homo sapiens
gccctgtccctcccactcc

SEQ ID NO: 5473 - DNA, 22 bp, Homo sapiens
aagaatttcctctgaagcaccg

SEQ ID NO: 5474 - DNA, 18 bp, Homo sapiens
aacaataaatactatgca

SEQ ID NO: 5475 - DNA, 17 bp, Homo sapiens
aatgctgcagtctgcac

SEQ ID NO: 5476 - DNA, 23 bp, Homo sapiens
ccctccccaacccacatacctcc

SEQ ID NO: 5477 - DNA, 24 bp, Homo sapiens
ccctccccaacccacatacctcca

SEQ ID NO: 5478 - DNA, 22 bp, Homo sapiens
ccctggccgcggggcctgtgag

SEQ ID NO: 5479 - DNA, 22 bp, Homo sapiens
aattgtgtctcaacagaaacta

SEQ ID NO: 5480 - DNA, 20 bp, Homo sapiens
agaatttttgctatgctgta

SEQ ID NO: 5481 - DNA, 22 bp, Homo sapiens
cccatcccaacttcctttaatt

SEQ ID NO: 5482 - DNA, 19 bp, Homo sapiens
tgaacaagctttacccagc

SEQ ID NO: 5483 - DNA, 23 bp, Homo sapiens
tgtatattctggtatttgaggtg

SEQ ID NO: 5484 - DNA, 19 bp, Homo sapiens
aatgtctatccacaggcta

SEQ ID NO: 5485 - DNA, 18 bp, Homo sapiens
aaaaacaaaacaaacaaa

SEQ ID NO: 5486 - DNA, 19 bp, Homo sapiens
cctcccccgtcttctctcc

SEQ ID NO: 5487 - DNA, 23 bp, Homo sapiens
ggtggaagattcagccaagctca

SEQ ID NO: 5488 - DNA, 18 bp, Homo sapiens
cctgggttcacttggccc

SEQ ID NO: 5489 - DNA, 18 bp, Homo sapiens
aagtctcatttacatttc

SEQ ID NO: 5490 - DNA, 22 bp, Homo sapiens
atcttggctcactgcaacctct

SEQ ID NO: 5491 - DNA, 23 bp, Homo sapiens
cagtgccggttcagactcaccta

SEQ ID NO: 5492 - DNA, 17 bp, Homo sapiens
ccacatttgaatcctct

SEQ ID NO: 5493 - DNA, 18 bp, Homo sapiens
gtagctcaaaagacctta

SEQ ID NO: 5494 - DNA, 18 bp, Homo sapiens
tacaggagaaagaggtga

SEQ ID NO: 5495 - DNA, 23 bp, Homo sapiens
tcagtaataaatacaaaaaaaaa

SEQ ID NO: 5496 - DNA, 23 bp, Homo sapiens
tctttttggcaatcttgaacttt

SEQ ID NO: 5497 - DNA, 18 bp, Homo sapiens
tgcatccttgtccttgca

SEQ ID NO: 5498 - DNA, 22 bp, Homo sapiens
tgcatccttgtccttgcaggtg

SEQ ID NO: 5499 - DNA, 18 bp, Homo sapiens
tgtttcttttctacattt

SEQ ID NO: 5500 - DNA, 21 bp, Homo sapiens
ttacaggtgtgagcctccatg

SEQ ID NO: 5501 - DNA, 25 bp, Homo sapiens
ttcttcatgtagtctgctgatctca

SEQ ID NO: 5502 - DNA, 19 bp, Homo sapiens
acatttccgctgtccgtca

SEQ ID NO: 5503 - DNA, 20 bp, Homo sapiens
accaaaaaacctcactgggc

SEQ ID NO: 5504 - DNA, 22 bp, Homo sapiens
agccagggagcttgccacactc

SEQ ID NO: 5505 - DNA, 21 bp, Homo sapiens
gcagttttagcagcacttttg

SEQ ID NO: 5506 - DNA, 22 bp, Homo sapiens
gcttgaacctgcttcctggctc

SEQ ID NO: 5507 - DNA, 20 bp, Homo sapiens
ggacggccctgcctgcctct

SEQ ID NO: 5508 - DNA, 18 bp, Homo sapiens
taaaacttttaggaccat

SEQ ID NO: 5509 - DNA, 20 bp, Homo sapiens
tgagaccacagtttacctca

SEQ ID NO: 5510 - DNA, 21 bp, Homo sapiens
ttctgatgacgcctgtctgtg

SEQ ID NO: 5511 - DNA, 17 bp, Homo sapiens
tcaatcttccctgccca

SEQ ID NO: 5512 - DNA, 21 bp, Homo sapiens
aaactttaccatctttgttgc

SEQ ID NO: 5513 - DNA, 18 bp, Homo sapiens
gctagttaaggcaaatca

SEQ ID NO: 5514 - DNA, 22 bp, Homo sapiens
ggttgctttgtgtctagttttc

SEQ ID NO: 5515 - DNA, 24 bp, Homo sapiens
cccgggcagccgccttctgagccc

SEQ ID NO: 5516 - DNA, 19 bp, Homo sapiens
cccttgcccacttctcctt

SEQ ID NO: 5517 - DNA, 21 bp, Homo sapiens
ccgaagcaagaagttaaccaa

SEQ ID NO: 5518 - DNA, 22 bp, Homo sapiens
cctcccccagtctctcttctca

SEQ ID NO: 5519 - DNA, 17 bp, Homo sapiens
ctctctctctccatctc

SEQ ID NO: 5520 - DNA, 22 bp, Homo sapiens
tgtcaccttgcaggctgtggtg

SEQ ID NO: 5521 - DNA, 19 bp, Homo sapiens
cgtccggacgagacaggcg

SEQ ID NO: 5522 - DNA, 24 bp, Homo sapiens
ctctggtggctgccagcttgtgag

SEQ ID NO: 5523 - DNA, 24 bp, Homo sapiens
agccgtctgtctctcccatatgat

SEQ ID NO: 5524 - DNA, 19 bp, Homo sapiens
agtatgcaagaagtttgca

SEQ ID NO: 5525 - DNA, 20 bp, Homo sapiens
atgttgtagcaaacatttct

SEQ ID NO: 5526 - DNA, 23 bp, Homo sapiens
caaataatgataaagtctattca

SEQ ID NO: 5527 - DNA, 21 bp, Homo sapiens
gaattataaaagcttacttta

SEQ ID NO: 5528 - DNA, 23 bp, Homo sapiens
ggggagtgcgcggcggccgcagc

SEQ ID NO: 5529 - DNA, 24 bp, Homo sapiens
acttctgtatagtttatttagtca

SEQ ID NO: 5530 - DNA, 24 bp, Homo sapiens
atagtagttgaaatggtaacatca

SEQ ID NO: 5531 - DNA, 18 bp, Homo sapiens
ctataagatgcagtctca

SEQ ID NO: 5532 - DNA, 16 bp, Homo sapiens
tggcttaaacatgaaa

SEQ ID NO: 5533 - DNA, 19 bp, Homo sapiens
ttttattctttcttcttca

SEQ ID NO: 5534 - DNA, 21 bp, Homo sapiens
ttttggggctcaatgtctcct

SEQ ID NO: 5535 - DNA, 19 bp, Homo sapiens
cataaactgaaatacctaa

SEQ ID NO: 5536 - DNA, 22 bp, Homo sapiens
taagattgctatggtttaatta

SEQ ID NO: 5537 - DNA, 22 bp, Homo sapiens
aaacaatgtattgtctgcccag

SEQ ID NO: 5538 - DNA, 19 bp, Homo sapiens
cttctcaggcctctgctct

SEQ ID NO: 5539 - DNA, 21 bp, Homo sapiens
tcactttccaccctctctcca

SEQ ID NO: 5540 - DNA, 23 bp, Homo sapiens
ttttgtggatggggacttgtgaa

SEQ ID NO: 5541 - DNA, 24 bp, Homo sapiens
aggtgctgacctagacagagatga

SEQ ID NO: 5542 - DNA, 19 bp, Homo sapiens
attgttaggtgctgaccta

SEQ ID NO: 5543 - DNA, 20 bp, Homo sapiens
ctgtaaaggtcaacaataaa

SEQ ID NO: 5544 - DNA, 20 bp, Homo sapiens
aaggcctgatggaacacaga

SEQ ID NO: 5545 - DNA, 22 bp, Homo sapiens
acaaaacattaaactagtgtta

SEQ ID NO: 5546 - DNA, 21 bp, Homo sapiens
agcatataaaattttccccct

SEQ ID NO: 5547 - DNA, 20 bp, Homo sapiens
ctcttaccagtatttaactt

SEQ ID NO: 5548 - DNA, 23 bp, Homo sapiens
ctgtatggttttgttttgttttg

SEQ ID NO: 5549 - DNA, 19 bp, Homo sapiens
ggctactgcttcaatctca

SEQ ID NO: 5550 - DNA, 19 bp, Homo sapiens
acgaaacaaagacaattta

SEQ ID NO: 5551 - DNA, 18 bp, Homo sapiens
caaggtccgggggcccag

SEQ ID NO: 5552 - DNA, 18 bp, Homo sapiens
cacattaagcaaatgctg

SEQ ID NO: 5553 - DNA, 26 bp, Homo sapiens
gcctccaacttgcggccgccgggctt

SEQ ID NO: 5554 - DNA, 23 bp, Homo sapiens
tagttattcacaaaaattgactc

SEQ ID NO: 5555 - DNA, 17 bp, Homo sapiens
tcatttgacccatttga

SEQ ID NO: 5556 - DNA, 19 bp, Homo sapiens
gcccgtgggcgagcgcgcc

SEQ ID NO: 5557 - DNA, 22 bp, Homo sapiens
ttgggattctctgcacttttga

SEQ ID NO: 5558 - DNA, 18 bp, Homo sapiens
aagaacgtggtcagagta

SEQ ID NO: 5559 - DNA, 21 bp, Homo sapiens
aagagataactgtaaatgtga

SEQ ID NO: 5560 - DNA, 19 bp, Homo sapiens
ccaggctacaagagaaaaa

SEQ ID NO: 5561 - DNA, 18 bp, Homo sapiens
cgtatccataaagacccg

SEQ ID NO: 5562 - DNA, 20 bp, Homo sapiens
tcatccccttatccttctcc

SEQ ID NO: 5563 - DNA, 17 bp, Homo sapiens
ttccaaacaccacttta

SEQ ID NO: 5564 - DNA, 19 bp, Homo sapiens
cttggagtttacctggctt

SEQ ID NO: 5565 - DNA, 23 bp, Homo sapiens
gtgtgaaatatattacttaactg

SEQ ID NO: 5566 - DNA, 23 bp, Homo sapiens
taattaatatattaaaattccaa

SEQ ID NO: 5567 - DNA, 24 bp, Homo sapiens
tgtcaaccaggtccagatgtgcta

SEQ ID NO: 5568 - DNA, 15 bp, Homo sapiens
ttggttatttctgaa

SEQ ID NO: 5569 - DNA, 23 bp, Homo sapiens
caacaaagaggattagacagtaa

SEQ ID NO: 5570 - DNA, 20 bp, Homo sapiens
ctgctttactgtgtatctca

SEQ ID NO: 5571 - DNA, 20 bp, Homo sapiens
gctgcataataaatgactga

SEQ ID NO: 5572 - DNA, 20 bp, Homo sapiens
gtataggttttgttcgactg

SEQ ID NO: 5573 - DNA, 19 bp, Homo sapiens
tctttttgatttttaaatc

SEQ ID NO: 5574 - DNA, 18 bp, Homo sapiens
tggtttttgttgcttttt

SEQ ID NO: 5575 - DNA, 20 bp, Homo sapiens
tttggagagtgggctgacat

SEQ ID NO: 5576 - DNA, 21 bp, Homo sapiens
ggcaagaagaagtgttcacca

SEQ ID NO: 5577 - DNA, 19 bp, Homo sapiens
caagcacacatgcatggca

SEQ ID NO: 5578 - DNA, 22 bp, Homo sapiens
ccacacttccacccccagctcc

SEQ ID NO: 5579 - DNA, 21 bp, Homo sapiens
gtccttccacacttccacccc

SEQ ID NO: 5580 - DNA, 19 bp, Homo sapiens
ccagctcaaggctattagg

SEQ ID NO: 5581 - DNA, 18 bp, Homo sapiens
ctcgaacccccacagctg

SEQ ID NO: 5582 - DNA, 21 bp, Homo sapiens
taagtggactccaagctaact

SEQ ID NO: 5583 - DNA, 21 bp, Homo sapiens
tataccgtctgacagttcaaa

SEQ ID NO: 5584 - DNA, 18 bp, Homo sapiens
aaaggacctcagctgctt

SEQ ID NO: 5585 - DNA, 22 bp, Homo sapiens
cttctccatcctttctgcctct

SEQ ID NO: 5586 - DNA, 23 bp, Homo sapiens
gcctgaggtctggctgcttgccc

SEQ ID NO: 5587 - DNA, 19 bp, Homo sapiens
gctcaaacgtggcttttag

SEQ ID NO: 5588 - DNA, 20 bp, Homo sapiens
tctgcctgagcttccccccc

SEQ ID NO: 5589 - DNA, 21 bp, Homo sapiens
acaggataaggcccagcgcac

SEQ ID NO: 5590 - DNA, 20 bp, Homo sapiens
acccaagtccctgtcatttg

SEQ ID NO: 5591 - DNA, 17 bp, Homo sapiens
ccagaatggagcctgct

SEQ ID NO: 5592 - DNA, 20 bp, Homo sapiens
ccccggtgcccgcccgcagc

SEQ ID NO: 5593 - DNA, 16 bp, Homo sapiens
cccggccccccgcgct

SEQ ID NO: 5594 - DNA, 18 bp, Homo sapiens
ccctgtgtattcaccacc

SEQ ID NO: 5595 - DNA, 21 bp, Homo sapiens
ggagcccagtgaagcctctga

SEQ ID NO: 5596 - DNA, 19 bp, Homo sapiens
cttaggacgcagccgcctc

SEQ ID NO: 5597 - DNA, 24 bp, Homo sapiens
aagttaaaatgtaaaagatgtgat

SEQ ID NO: 5598 - DNA, 24 bp, Homo sapiens
agaaacaacatacttgtcccatga

SEQ ID NO: 5599 - DNA, 21 bp, Homo sapiens
ccccgccccgttccctaccgc

SEQ ID NO: 5600 - DNA, 20 bp, Homo sapiens
tcccctagttggccaagact

SEQ ID NO: 5601 - DNA, 21 bp, Homo sapiens
tgataagcactttttaaatgg

SEQ ID NO: 5602 - DNA, 18 bp, Homo sapiens
tgtgttcctacaattggc

SEQ ID NO: 5603 - DNA, 17 bp, Homo sapiens
gcgcgggggcctgcgaa

SEQ ID NO: 5604 - DNA, 19 bp, Homo sapiens
agtagaggcatgaacacac

SEQ ID NO: 5605 - DNA, 21 bp, Homo sapiens
cacggatgcacagagatatgc

SEQ ID NO: 5606 - DNA, 17 bp, Homo sapiens
cccccaaactctccccc

SEQ ID NO: 5607 - DNA, 19 bp, Homo sapiens
gagagagacagagacagag

SEQ ID NO: 5608 - DNA, 21 bp, Homo sapiens
gatatgcacacacatggatga

SEQ ID NO: 5609 - DNA, 18 bp, Homo sapiens
gctgagcctccttacctc

SEQ ID NO: 5610 - DNA, 25 bp, Homo sapiens
ggctgcgtctcctccgcacacctgt

SEQ ID NO: 5611 - DNA, 19 bp, Homo sapiens
tgaacacacatggatgcac

SEQ ID NO: 5612 - DNA, 24 bp, Homo sapiens
aacaggggaaattatataccgtga

SEQ ID NO: 5613 - DNA, 22 bp, Homo sapiens
ataacacaacaaaaatgtaaca

SEQ ID NO: 5614 - DNA, 16 bp, Homo sapiens
atttcctgctgaaaat

SEQ ID NO: 5615 - DNA, 18 bp, Homo sapiens
cctgaccccttcactatg

SEQ ID NO: 5616 - DNA, 21 bp, Homo sapiens
gcagacactgccttgaagcct

SEQ ID NO: 5617 - DNA, 19 bp, Homo sapiens
tatcctgatcaagcatgga

SEQ ID NO: 5618 - DNA, 23 bp, Homo sapiens
tccaatttaacttaactcttacc

SEQ ID NO: 5619 - DNA, 19 bp, Homo sapiens
tcttgaaatttgtgatggc

SEQ ID NO: 5620 - DNA, 20 bp, Homo sapiens
aattaaattattgtattaca

SEQ ID NO: 5621 - DNA, 21 bp, Homo sapiens
acatcttgaactggttgtgaa

SEQ ID NO: 5622 - DNA, 24 bp, Homo sapiens
agctctcttccctgggggcagata

SEQ ID NO: 5623 - DNA, 19 bp, Homo sapiens
caattttccagggctcaaa

SEQ ID NO: 5624 - DNA, 23 bp, Homo sapiens
cctcagcctctcaagttgttttt

SEQ ID NO: 5625 - DNA, 18 bp, Homo sapiens
tacattccacagtgccca

SEQ ID NO: 5626 - DNA, 20 bp, Homo sapiens
tatgcaatatatcaatgtaa

SEQ ID NO: 5627 - DNA, 24 bp, Homo sapiens
tgtaacctcaaactcctggactca

SEQ ID NO: 5628 - DNA, 24 bp, Homo sapiens
catcctcactgccgtcctcaggtg

SEQ ID NO: 5629 - DNA, 18 bp, Homo sapiens
ccagcccagctcccgtgt

SEQ ID NO: 5630 - DNA, 21 bp, Homo sapiens
ccggacaccaagcccgcctcc

SEQ ID NO: 5631 - DNA, 20 bp, Homo sapiens
actgacatgatattatttgc

SEQ ID NO: 5632 - DNA, 22 bp, Homo sapiens
ccttttcatccagccttaattt

SEQ ID NO: 5633 - DNA, 18 bp, Homo sapiens
gtccacagtgataagcaa

SEQ ID NO: 5634 - DNA, 18 bp, Homo sapiens
tggtttaccaggacctct

SEQ ID NO: 5635 - DNA, 17 bp, Homo sapiens
tttcaacttcaatgtca

SEQ ID NO: 5636 - DNA, 19 bp, Homo sapiens
taatgcaataactgttatc

SEQ ID NO: 5637 - DNA, 21 bp, Homo sapiens
acacccactcactttgcaata

SEQ ID NO: 5638 - DNA, 26 bp, Homo sapiens
agccaccatgtaacccctctcacctg

SEQ ID NO: 5639 - DNA, 19 bp, Homo sapiens
gagccttcgcaactcgcga

SEQ ID NO: 5640 - DNA, 21 bp, Homo sapiens
ggatcttcaagtcccatcata

SEQ ID NO: 5641 - DNA, 19 bp, Homo sapiens
tagaaaattgaaacacaga

SEQ ID NO: 5642 - DNA, 19 bp, Homo sapiens
tcagatcctttgaaaagag

SEQ ID NO: 5643 - DNA, 19 bp, Homo sapiens
atttatgggcccctggcac

SEQ ID NO: 5644 - DNA, 19 bp, Homo sapiens
cgaccgccctccgatttcc

SEQ ID NO: 5645 - DNA, 20 bp, Homo sapiens
ggcaggtaccgtgctcattg

SEQ ID NO: 5646 - DNA, 20 bp, Homo sapiens
ttccagatggctgcccccag

SEQ ID NO: 5647 - DNA, 19 bp, Homo sapiens
tcctgaaggtcactgacaa

SEQ ID NO: 5648 - DNA, 18 bp, Homo sapiens
accagaagagagcatctg

SEQ ID NO: 5649 - DNA, 21 bp, Homo sapiens
agccttttcactttgtactca

SEQ ID NO: 5650 - DNA, 20 bp, Homo sapiens
cctcggctgttggggacttt

SEQ ID NO: 5651 - DNA, 19 bp, Homo sapiens
ctgcctggggattcaccta

SEQ ID NO: 5652 - DNA, 20 bp, Homo sapiens
tgctcccagagaccttccac

SEQ ID NO: 5653 - DNA, 22 bp, Homo sapiens
actaattatatagtataccata

SEQ ID NO: 5654 - DNA, 23 bp, Homo sapiens
attatatagtataccatacatta

SEQ ID NO: 5655 - DNA, 19 bp, Homo sapiens
gccaaccaagagcacattc

SEQ ID NO: 5656 - DNA, 20 bp, Homo sapiens
gtacatctttgaaaagaaaa

SEQ ID NO: 5657 - DNA, 21 bp, Homo sapiens
tcacattacatcatcctcctt

SEQ ID NO: 5658 - DNA, 20 bp, Homo sapiens
tgagacggcgcacctatcac

SEQ ID NO: 5659 - DNA, 22 bp, Homo sapiens
ttcaagcgattctcatgtctca

SEQ ID NO: 5660 - DNA, 19 bp, Homo sapiens
ttggagggtcgcctggctt

SEQ ID NO: 5661 - DNA, 23 bp, Homo sapiens
tttctctatcccaagccaaccaa

SEQ ID NO: 5662 - DNA, 19 bp, Homo sapiens
ggctctatgtagcaaatca

SEQ ID NO: 5663 - DNA, 23 bp, Homo sapiens
tcattgaactaattctactattt

SEQ ID NO: 5664 - DNA, 22 bp, Homo sapiens
ccagtgtgcagcccctgccaga

SEQ ID NO: 5665 - DNA, 19 bp, Homo sapiens
ccacagaaacacaaacaca

SEQ ID NO: 5666 - DNA, 21 bp, Homo sapiens
ccttttcatatccatgatctt

SEQ ID NO: 5667 - DNA, 22 bp, Homo sapiens
ctttgatgcttgctttaacttt

SEQ ID NO: 5668 - DNA, 18 bp, Homo sapiens
gtacagtaatttgcctca

SEQ ID NO: 5669 - DNA, 18 bp, Homo sapiens
gtgtgtgtgcgttggttg

SEQ ID NO: 5670 - DNA, 20 bp, Homo sapiens
ccacagctcaacacaaccag

SEQ ID NO: 5671 - DNA, 22 bp, Homo sapiens
atttattttcttggattcctga

SEQ ID NO: 5672 - DNA, 19 bp, Homo sapiens
ctataaccagacacatact

SEQ ID NO: 5673 - DNA, 19 bp, Homo sapiens
ctgcaatctccacctccca

SEQ ID NO: 5674 - DNA, 20 bp, Homo sapiens
cttttcccaaaatgttgaaa

SEQ ID NO: 5675 - DNA, 24 bp, Homo sapiens
aacttgccttttcattttacttca

SEQ ID NO: 5676 - DNA, 20 bp, Homo sapiens
acttttcttcttgcatgcat

SEQ ID NO: 5677 - DNA, 21 bp, Homo sapiens
gatatagcagtaatgctatta

SEQ ID NO: 5678 - DNA, 18 bp, Homo sapiens
gtccttaagtccctgcta

SEQ ID NO: 5679 - DNA, 18 bp, Homo sapiens
tactcaacagccttattc

SEQ ID NO: 5680 - DNA, 20 bp, Homo sapiens
tctttttccatccacttgca

SEQ ID NO: 5681 - DNA, 22 bp, Homo sapiens
ttttttaaaactcatcacagaa

SEQ ID NO: 5682 - DNA, 23 bp, Homo sapiens
gcccccataactcgtggactaca

SEQ ID NO: 5683 - DNA, 17 bp, Homo sapiens
cctgaccaaaggcttca

SEQ ID NO: 5684 - DNA, 19 bp, Homo sapiens
aggtaccagcaatatgtaa

SEQ ID NO: 5685 - DNA, 24 bp, Homo sapiens
atatcccagaaattagaaacctta

SEQ ID NO: 5686 - DNA, 19 bp, Homo sapiens
ccaaaaactaaatctctaa

SEQ ID NO: 5687 - DNA, 15 bp, Homo sapiens
ctcctgctgttgcct

SEQ ID NO: 5688 - DNA, 17 bp, Homo sapiens
gaagccacctcaagaca

SEQ ID NO: 5689 - DNA, 19 bp, Homo sapiens
accagcagacactgccggg

SEQ ID NO: 5690 - DNA, 23 bp, Homo sapiens
ggaccgcgccgcccgcctcccct

SEQ ID NO: 5691 - DNA, 21 bp, Homo sapiens
tttgtgtcttatgttcatcac

SEQ ID NO: 5692 - DNA, 21 bp, Homo sapiens
aggccccagatccttctctct

SEQ ID NO: 5693 - DNA, 19 bp, Homo sapiens
cgatggcacctccgtccca

SEQ ID NO: 5694 - DNA, 21 bp, Homo sapiens
ctgagagccctgggactggga

SEQ ID NO: 5695 - DNA, 21 bp, Homo sapiens
tgagaaggtggcagtgaggaa

SEQ ID NO: 5696 - DNA, 20 bp, Homo sapiens
tgggactgggagtgtctgct

SEQ ID NO: 5697 - DNA, 22 bp, Homo sapiens
cgcacggacgcactcgcgctgc

SEQ ID NO: 5698 - DNA, 20 bp, Homo sapiens
gccaagtctctaacgtgaca

SEQ ID NO: 5699 - DNA, 19 bp, Homo sapiens
acaacccaaaaggtttaag

SEQ ID NO: 5700 - DNA, 21 bp, Homo sapiens
accaaaacagttaatcagtga

SEQ ID NO: 5701 - DNA, 22 bp, Homo sapiens
atttggatttaaaagcctgctc

SEQ ID NO: 5702 - DNA, 16 bp, Homo sapiens
ccatcacgttagctgt

SEQ ID NO: 5703 - DNA, 18 bp, Homo sapiens
gccaaatttaaaactgtt

SEQ ID NO: 5704 - DNA, 21 bp, Homo sapiens
tctacttctgtaattgtgtgg

SEQ ID NO: 5705 - DNA, 22 bp, Homo sapiens
ttgatacatttttgtactaact

SEQ ID NO: 5706 - DNA, 21 bp, Homo sapiens
tttctgggttgcctttgtttt

SEQ ID NO: 5707 - DNA, 19 bp, Homo sapiens
ctctcgcaagggaagtcct

SEQ ID NO: 5708 - DNA, 18 bp, Homo sapiens
cttgtgaaggaattattc

SEQ ID NO: 5709 - DNA, 21 bp, Homo sapiens
taggaactgctgggcttggca

SEQ ID NO: 5710 - DNA, 18 bp, Homo sapiens
ccccccaaccccccgcgc

SEQ ID NO: 5711 - DNA, 17 bp, Homo sapiens
gggctgctgtgaagctg

SEQ ID NO: 5712 - DNA, 23 bp, Homo sapiens
ggtataataggctctgcctgaca

SEQ ID NO: 5713 - DNA, 20 bp, Homo sapiens
acaacagaactcagttttcc

SEQ ID NO: 5714 - DNA, 22 bp, Homo sapiens
acacccaagccagaggaactca

SEQ ID NO: 5715 - DNA, 21 bp, Homo sapiens
cacttttgtttcaccatctga

SEQ ID NO: 5716 - DNA, 21 bp, Homo sapiens
ctctactgaatattctagtga

SEQ ID NO: 5717 - DNA, 16 bp, Homo sapiens
ctgctaccttctcatc

SEQ ID NO: 5718 - DNA, 21 bp, Homo sapiens
gtcttgatattctgtgactca

SEQ ID NO: 5719 - DNA, 20 bp, Homo sapiens
tcatcaaaaatattgtcatc

SEQ ID NO: 5720 - DNA, 19 bp, Homo sapiens
ttcactgcagctcctgtca

SEQ ID NO: 5721 - DNA, 22 bp, Homo sapiens
aggcacaggcagggcaggacca

SEQ ID NO: 5722 - DNA, 21 bp, Homo sapiens
cagagcaacccctggacccca

SEQ ID NO: 5723 - DNA, 17 bp, Homo sapiens
gcaagcttttcctaata

SEQ ID NO: 5724 - DNA, 23 bp, Homo sapiens
gccctggcccccacatggtgatg

SEQ ID NO: 5725 - DNA, 19 bp, Homo sapiens
tgcgcctgcacatgtgtgt

SEQ ID NO: 5726 - DNA, 17 bp, Homo sapiens
ccgaataataaagactt

SEQ ID NO: 5727 - DNA, 26 bp, Homo sapiens
gcctgctgcccagagaccttagctga

SEQ ID NO: 5728 - DNA, 17 bp, Homo sapiens
ttggtaaatattagcta

SEQ ID NO: 5729 - DNA, 16 bp, Homo sapiens
ctgaactgctctggct

SEQ ID NO: 5730 - DNA, 18 bp, Homo sapiens
gaggtccgatctggaaca

SEQ ID NO: 5731 - DNA, 18 bp, Homo sapiens
ctttccaaggcttctcca

SEQ ID NO: 5732 - DNA, 23 bp, Homo sapiens
gaaccatccatagtagtatgatg

SEQ ID NO: 5733 - DNA, 19 bp, Homo sapiens
gtttcccccttctacattt

SEQ ID NO: 5734 - DNA, 21 bp, Homo sapiens
atgggtccagggttgatcaca

SEQ ID NO: 5735 - DNA, 18 bp, Homo sapiens
cagaagggagaaggatct

SEQ ID NO: 5736 - DNA, 21 bp, Homo sapiens
gaacaaggttccctctgagaa

SEQ ID NO: 5737 - DNA, 18 bp, Homo sapiens
gaatgtgttttctgaata

SEQ ID NO: 5738 - DNA, 22 bp, Homo sapiens
gagccaagatcgcgccactgca

SEQ ID NO: 5739 - DNA, 21 bp, Homo sapiens
ggaaaatgtgacccagatcct

SEQ ID NO: 5740 - DNA, 19 bp, Homo sapiens
ggccgggtgcggtggctca

SEQ ID NO: 5741 - DNA, 21 bp, Homo sapiens
tagatgggtctggctgagctg

SEQ ID NO: 5742 - DNA, 17 bp, Homo sapiens
gcagctgcacatcgtga

SEQ ID NO: 5743 - DNA, 18 bp, Homo sapiens
gctcaacatcatatagta

SEQ ID NO: 5744 - DNA, 25 bp, Homo sapiens
aagcacatttcagcctatttgctta

SEQ ID NO: 5745 - DNA, 22 bp, Homo sapiens
atctatattcatgagctctcaa

SEQ ID NO: 5746 - DNA, 21 bp, Homo sapiens
gctgtgatttgacacgtttta

SEQ ID NO: 5747 - DNA, 17 bp, Homo sapiens
acacagaggttttaaac

SEQ ID NO: 5748 - DNA, 23 bp, Homo sapiens
acattttatttattagctgtaaa

SEQ ID NO: 5749 - DNA, 23 bp, Homo sapiens
atttgggttgtgacccagggtgc

SEQ ID NO: 5750 - DNA, 21 bp, Homo sapiens
caatatctgacagttactctt

SEQ ID NO: 5751 - DNA, 22 bp, Homo sapiens
tagaacctcctattttaattgg

SEQ ID NO: 5752 - DNA, 23 bp, Homo sapiens
tccagtgcgtctcttttgttcct

SEQ ID NO: 5753 - DNA, 19 bp, Homo sapiens
tccctaccattggcctgca

SEQ ID NO: 5754 - DNA, 25 bp, Homo sapiens
tctctcccccttcttttttgtctca

SEQ ID NO: 5755 - DNA, 25 bp, Homo sapiens
ccagtctgtgcgcgcccgtgctcgc

SEQ ID NO: 5756 - DNA, 20 bp, Homo sapiens
agctcattttgtctctctca

SEQ ID NO: 5757 - DNA, 18 bp, Homo sapiens
cctgcaacctccacctcc

SEQ ID NO: 5758 - DNA, 23 bp, Homo sapiens
tcacactaccattatttcccctt

SEQ ID NO: 5759 - DNA, 21 bp, Homo sapiens
ttaagcctacaacatttttca

SEQ ID NO: 5760 - DNA, 17 bp, Homo sapiens
ccatttacaacaaacac

SEQ ID NO: 5761 - DNA, 17 bp, Homo sapiens
ctcctcctagtactaac

SEQ ID NO: 5762 - DNA, 23 bp, Homo sapiens
cttcttcccaattgctttacctt

SEQ ID NO: 5763 - DNA, 18 bp, Homo sapiens
ggacatttttgactccct

SEQ ID NO: 5764 - DNA, 20 bp, Homo sapiens
tcaacttatgcagaactggc

SEQ ID NO: 5765 - DNA, 24 bp, Homo sapiens
tgtgtcaaacagtacactatctta

SEQ ID NO: 5766 - DNA, 19 bp, Homo sapiens
aaactcctgacctcaggtg

SEQ ID NO: 5767 - DNA, 21 bp, Homo sapiens
atcttggctcactgcaacctc

SEQ ID NO: 5768 - DNA, 18 bp, Homo sapiens
cctgcaacctccacctcc

SEQ ID NO: 5769 - DNA, 19 bp, Homo sapiens
ctgcaacctccacctccca

SEQ ID NO: 5770 - DNA, 19 bp, Homo sapiens
ctgcaacctccgcctccca

SEQ ID NO: 5771 - DNA, 18 bp, Homo sapiens
tccacctcccaggttcaa

SEQ ID NO: 5772 - DNA, 18 bp, Homo sapiens
tccgcctcccaggttcaa

SEQ ID NO: 5773 - DNA, 25 bp, Homo sapiens
agcccggggagcctaggaccactca

SEQ ID NO: 5774 - DNA, 16 bp, Homo sapiens
cccacgattttctcca

SEQ ID NO: 5775 - DNA, 21 bp, Homo sapiens
aaacagctaatgggacactaa

SEQ ID NO: 5776 - DNA, 18 bp, Homo sapiens
agtattacttctgctaca

SEQ ID NO: 5777 - DNA, 21 bp, Homo sapiens
cagatacaggaaaagctgctg

SEQ ID NO: 5778 - DNA, 22 bp, Homo sapiens
ccttgaactgggtacttgtgga

SEQ ID NO: 5779 - DNA, 18 bp, Homo sapiens
gcctgcccaggcccctgc

SEQ ID NO: 5780 - DNA, 23 bp, Homo sapiens
gctggtccactcagtccatagca

SEQ ID NO: 5781 - DNA, 17 bp, Homo sapiens
tcaagtgattctcctgc

SEQ ID NO: 5782 - DNA, 26 bp, Homo sapiens
tcaattctcatttgtcacacactttg

SEQ ID NO: 5783 - DNA, 18 bp, Homo sapiens
tccgcctcttgggttcaa

SEQ ID NO: 5784 - DNA, 21 bp, Homo sapiens
tctggaatccagtggtatgat

SEQ ID NO: 5785 - DNA, 19 bp, Homo sapiens
tgtggcttcctaaaattca

SEQ ID NO: 5786 - DNA, 22 bp, Homo sapiens
gcctgggttccaatcctggctc

SEQ ID NO: 5787 - DNA, 22 bp, Homo sapiens
tggctcccctttttcttcctca

SEQ ID NO: 5788 - DNA, 25 bp, Homo sapiens
acttgaagtaccaggccgtttgctt

SEQ ID NO: 5789 - DNA, 19 bp, Homo sapiens
atctcaaatacagtagtat

SEQ ID NO: 5790 - DNA, 21 bp, Homo sapiens
gtattgtgtttatgcatttca

SEQ ID NO: 5791 - DNA, 23 bp, Homo sapiens
tatttgtaaaagctaaggctcga

SEQ ID NO: 5792 - DNA, 21 bp, Homo sapiens
tttaagtaattgccagctttt

SEQ ID NO: 5793 - DNA, 24 bp, Homo sapiens
tttgtaaatgctgtaaatatttca

SEQ ID NO: 5794 - DNA, 21 bp, Homo sapiens
atgactaagtacttgctctct

SEQ ID NO: 5795 - DNA, 21 bp, Homo sapiens
accacaatgagattccatttt

SEQ ID NO: 5796 - DNA, 19 bp, Homo sapiens
cctaagtaatcccagaaca

SEQ ID NO: 5797 - DNA, 21 bp, Homo sapiens
gatctgtagggacttgtacaa

SEQ ID NO: 5798 - DNA, 22 bp, Homo sapiens
cagcagtcccctggccagcacc

SEQ ID NO: 5799 - DNA, 23 bp, Homo sapiens
ccctggtggctctcccctttgga

SEQ ID NO: 5800 - DNA, 18 bp, Homo sapiens
cctggacttgaccaatta

SEQ ID NO: 5801 - DNA, 19 bp, Homo sapiens
ccttcattctttcaacaaa

SEQ ID NO: 5802 - DNA, 21 bp, Homo sapiens
ctctgaaatcaggatttggaa

SEQ ID NO: 5803 - DNA, 19 bp, Homo sapiens
gttgtttcgtatttctgaa

SEQ ID NO: 5804 - DNA, 24 bp, Homo sapiens
cccggaagccgcgactcctggccc

SEQ ID NO: 5805 - DNA, 20 bp, Homo sapiens
atgtgaaacatgttgccaaa

SEQ ID NO: 5806 - DNA, 22 bp, Homo sapiens
cgatttcaaagtccagatacca

SEQ ID NO: 5807 - DNA, 19 bp, Homo sapiens
cgggcatcattctctaata

SEQ ID NO: 5808 - DNA, 19 bp, Homo sapiens
gctataattattattcaga

SEQ ID NO: 5809 - DNA, 18 bp, Homo sapiens
tatttgtgggtgtgctat

SEQ ID NO: 5810 - DNA, 18 bp, Homo sapiens
tctagtaataaagactct

SEQ ID NO: 5811 - DNA, 19 bp, Homo sapiens
ttggctctcaatgctgttt

SEQ ID NO: 5812 - DNA, 18 bp, Homo sapiens
ccagggcgccggcccacc

SEQ ID NO: 5813 - DNA, 21 bp, Homo sapiens
gccgccccccggccgcgggga

SEQ ID NO: 5814 - DNA, 22 bp, Homo sapiens
ctttgaacgtagcgcctgtgaa

SEQ ID NO: 5815 - DNA, 21 bp, Homo sapiens
tgaacaccggatggtgccaac

SEQ ID NO: 5816 - DNA, 22 bp, Homo sapiens
tttaacattcctaaattgtttt

SEQ ID NO: 5817 - DNA, 18 bp, Homo sapiens
agcgtttcctaatccctc

SEQ ID NO: 5818 - DNA, 22 bp, Homo sapiens
ccatggctattccagcacccca

SEQ ID NO: 5819 - DNA, 22 bp, Homo sapiens
ctgtaattgccaagtcctctaa

SEQ ID NO: 5820 - DNA, 25 bp, Homo sapiens
tcctggatcactcctttgcactcca

SEQ ID NO: 5821 - DNA, 22 bp, Homo sapiens
tcttagatcacatttagtagca

SEQ ID NO: 5822 - DNA, 19 bp, Homo sapiens
agtaatctgtcgcatttca

SEQ ID NO: 5823 - DNA, 16 bp, Homo sapiens
atccccataacttcca

SEQ ID NO: 5824 - DNA, 18 bp, Homo sapiens
gttcccaggcttctgaga

SEQ ID NO: 5825 - DNA, 20 bp, Homo sapiens
aaaccccaaccaaacaaaac

SEQ ID NO: 5826 - DNA, 21 bp, Homo sapiens
aggccggcgccgcacacacac

SEQ ID NO: 5827 - DNA, 18 bp, Homo sapiens
cctgcaacctccacctcc

SEQ ID NO: 5828 - DNA, 19 bp, Homo sapiens
ctgcaacctccacctccca

SEQ ID NO: 5829 - DNA, 17 bp, Homo sapiens
tcaagcgattctcgtgc

SEQ ID NO: 5830 - DNA, 18 bp, Homo sapiens
tccacctcccaggttcaa

SEQ ID NO: 5831 - DNA, 20 bp, Homo sapiens
agtattgcgctgtaatgtca

SEQ ID NO: 5832 - DNA, 23 bp, Homo sapiens
ggtctttttttcccagttcattt

SEQ ID NO: 5833 - DNA, 19 bp, Homo sapiens
tggtttcagcatggtattg

SEQ ID NO: 5834 - DNA, 21 bp, Homo sapiens
acacttgtgtctctctgtgga

SEQ ID NO: 5835 - DNA, 22 bp, Homo sapiens
atcattttctaggttcatttct

SEQ ID NO: 5836 - DNA, 18 bp, Homo sapiens
tctggaacatttgctgta

SEQ ID NO: 5837 - DNA, 16 bp, Homo sapiens
ccagccaacatggtga

SEQ ID NO: 5838 - DNA, 20 bp, Homo sapiens
ttcaagaccagcccagccaa

SEQ ID NO: 5839 - DNA, 18 bp, Homo sapiens
ctcctcagcttcaggcac

SEQ ID NO: 5840 - DNA, 18 bp, Homo sapiens
gagtcggagtggacaccg

SEQ ID NO: 5841 - DNA, 20 bp, Homo sapiens
gcctgagctgcggtctccgc

SEQ ID NO: 5842 - DNA, 23 bp, Homo sapiens
tcctggcgggggtgggccgtgga

SEQ ID NO: 5843 - DNA, 23 bp, Homo sapiens
agccaccaatcaaagagattcaa

SEQ ID NO: 5844 - DNA, 18 bp, Homo sapiens
cttcccccacctcttcca

SEQ ID NO: 5845 - DNA, 19 bp, Homo sapiens
gttctcactcttaggttca

SEQ ID NO: 5846 - DNA, 28 bp, Homo sapiens
agaaatcagtgacaacaagtctttgaaa

SEQ ID NO: 5847 - DNA, 24 bp, Homo sapiens
ctccttctccctcattttctctca

SEQ ID NO: 5848 - DNA, 25 bp, Homo sapiens
ctttgaaatatgcatgtactttata

SEQ ID NO: 5849 - DNA, 18 bp, Homo sapiens
gaaagcaccatcatcata

SEQ ID NO: 5850 - DNA, 19 bp, Homo sapiens
aggagaagcaggcccagtc

SEQ ID NO: 5851 - DNA, 17 bp, Homo sapiens
catccagcagccgccgc

SEQ ID NO: 5852 - DNA, 21 bp, Homo sapiens
ccagcagcttctgccatctct

SEQ ID NO: 5853 - DNA, 18 bp, Homo sapiens
gacggcggcggccgcggc

SEQ ID NO: 5854 - DNA, 22 bp, Homo sapiens
ggagatgagagacggcggcggc

SEQ ID NO: 5855 - DNA, 18 bp, Homo sapiens
ggccgcggcggctgcagc

SEQ ID NO: 5856 - DNA, 18 bp, Homo sapiens
ggcggcggcggccgcggc

SEQ ID NO: 5857 - DNA, 15 bp, Homo sapiens
ggcggcggcggcggc

SEQ ID NO: 5858 - DNA, 18 bp, Homo sapiens
gtgtcagattaccagtta

SEQ ID NO: 5859 - DNA, 18 bp, Homo sapiens
tctcctcctttttcttca

SEQ ID NO: 5860 - DNA, 18 bp, Homo sapiens
ttccagagaatgtttcag

SEQ ID NO: 5861 - DNA, 21 bp, Homo sapiens
actgcattcacggggatccca

SEQ ID NO: 5862 - DNA, 23 bp, Homo sapiens
caccctttggagaccaggcctca

SEQ ID NO: 5863 - DNA, 20 bp, Homo sapiens
ctgagaaatagtgcactcca

SEQ ID NO: 5864 - DNA, 26 bp, Homo sapiens
cttcccccaagatacccatcttgaaa

SEQ ID NO: 5865 - DNA, 21 bp, Homo sapiens
taggatatgccctcctggtga

SEQ ID NO: 5866 - DNA, 18 bp, Homo sapiens
acgtaaatgcagaagtta

SEQ ID NO: 5867 - DNA, 21 bp, Homo sapiens
cgagggttaggccaacaggga

SEQ ID NO: 5868 - DNA, 22 bp, Homo sapiens
ctgtgtataacatttcgtacaa

SEQ ID NO: 5869 - DNA, 19 bp, Homo sapiens
tggagaggccaggacagag

SEQ ID NO: 5870 - DNA, 18 bp, Homo sapiens
aaactttttctcaaacca

SEQ ID NO: 5871 - DNA, 18 bp, Homo sapiens
aaatggcttttaattcct

SEQ ID NO: 5872 - DNA, 20 bp, Homo sapiens
cttgaaagcattacagatca

SEQ ID NO: 5873 - DNA, 22 bp, Homo sapiens
agacacagggtagtctttgcta

SEQ ID NO: 5874 - DNA, 18 bp, Homo sapiens
catttccgagttactttt

SEQ ID NO: 5875 - DNA, 20 bp, Homo sapiens
ccaccctctgccttgcaata

SEQ ID NO: 5876 - DNA, 18 bp, Homo sapiens
cctgcacccatcagccaa

SEQ ID NO: 5877 - DNA, 18 bp, Homo sapiens
cgaatcgactgtctctgt

SEQ ID NO: 5878 - DNA, 21 bp, Homo sapiens
gcttctcaccctccaccctct

SEQ ID NO: 5879 - DNA, 19 bp, Homo sapiens
tcattggcacttagagcgc

SEQ ID NO: 5880 - DNA, 17 bp, Homo sapiens
gctgctgttggcggatt

SEQ ID NO: 5881 - DNA, 23 bp, Homo sapiens
tggtgaagtataggctgaggcta

SEQ ID NO: 5882 - DNA, 20 bp, Homo sapiens
acagcaagtatcgacagcaa

SEQ ID NO: 5883 - DNA, 18 bp, Homo sapiens
ccctccttccttttacta

SEQ ID NO: 5884 - DNA, 19 bp, Homo sapiens
cgtcctcacccggcaccca

SEQ ID NO: 5885 - DNA, 22 bp, Homo sapiens
ctatgtgactgtccctatctta

SEQ ID NO: 5886 - DNA, 18 bp, Homo sapiens
gagaccagaaaccttcca

SEQ ID NO: 5887 - DNA, 22 bp, Homo sapiens
tgtagttgtttggagcacactg

SEQ ID NO: 5888 - DNA, 21 bp, Homo sapiens
atctgggactgtgcctggctc

SEQ ID NO: 5889 - DNA, 19 bp, Homo sapiens
cctgagcgggagtcaggga

SEQ ID NO: 5890 - DNA, 18 bp, Homo sapiens
ggggcgtgcagcagggaa

SEQ ID NO: 5891 - DNA, 23 bp, Homo sapiens
gtgtgtgttcaagtgcgtgactg

SEQ ID NO: 5892 - DNA, 16 bp, Homo sapiens
cttctttgtcttagct

SEQ ID NO: 5893 - DNA, 23 bp, Homo sapiens
ccctcccccaccattccacatcc

SEQ ID NO: 5894 - DNA, 19 bp, Homo sapiens
cccttccccactctgctcc

SEQ ID NO: 5895 - DNA, 16 bp, Homo sapiens
gcggtcctcccggcca

SEQ ID NO: 5896 - DNA, 19 bp, Homo sapiens
gaccccaactactattgta

SEQ ID NO: 5897 - DNA, 18 bp, Homo sapiens
ttcaatcctgtcaatgtt

SEQ ID NO: 5898 - DNA, 21 bp, Homo sapiens
agcgcccccacttttgctctt

SEQ ID NO: 5899 - DNA, 19 bp, Homo sapiens
atgatcctaaaaataaccg

SEQ ID NO: 5900 - DNA, 23 bp, Homo sapiens
ctgggaaacatttgcactctttt

SEQ ID NO: 5901 - DNA, 21 bp, Homo sapiens
gctctttttcctcccctcctc

SEQ ID NO: 5902 - DNA, 18 bp, Homo sapiens
tctcagaacaccagcagt

SEQ ID NO: 5903 - DNA, 21 bp, Homo sapiens
cacagaacaagcagcacccca

SEQ ID NO: 5904 - DNA, 19 bp, Homo sapiens
tccctactggaagcctgca

SEQ ID NO: 5905 - DNA, 18 bp, Homo sapiens
ttccagaaatatagtcca

SEQ ID NO: 5906 - DNA, 18 bp, Homo sapiens
atgattttgttttcatcc

SEQ ID NO: 5907 - DNA, 24 bp, Homo sapiens
cataatttcctttagttctagtta

SEQ ID NO: 5908 - DNA, 20 bp, Homo sapiens
ccctggtgaagcagctgctt

SEQ ID NO: 5909 - DNA, 21 bp, Homo sapiens
gaaccagttatttaacctgta

SEQ ID NO: 5910 - DNA, 19 bp, Homo sapiens
tcaccatcttcactacaaa

SEQ ID NO: 5911 - DNA, 18 bp, Homo sapiens
tccactgcccatgaccct

SEQ ID NO: 5912 - DNA, 22 bp, Homo sapiens
tggcactggggaaacataactc

SEQ ID NO: 5913 - DNA, 18 bp, Homo sapiens
cctgcaacctccacctcc

SEQ ID NO: 5914 - DNA, 18 bp, Homo sapiens
tccacctcctgggttcaa

SEQ ID NO: 5915 - DNA, 22 bp, Homo sapiens
ccagctgtggtcaggagagcct

SEQ ID NO: 5916 - DNA, 19 bp, Homo sapiens
gacttagccgtgcattgca

SEQ ID NO: 5917 - DNA, 18 bp, Homo sapiens
accttagctggcattaca

SEQ ID NO: 5918 - DNA, 20 bp, Homo sapiens
cctggccgatccgcatgtca

SEQ ID NO: 5919 - DNA, 19 bp, Homo sapiens
gaagagacaaacacctccc

SEQ ID NO: 5920 - DNA, 25 bp, Homo sapiens
gccagagaacccagcaatccgagta

SEQ ID NO: 5921 - DNA, 18 bp, Homo sapiens
gcggccagagaacccagc

SEQ ID NO: 5922 - DNA, 16 bp, Homo sapiens
gggcaatgatggcaat

SEQ ID NO: 5923 - DNA, 23 bp, Homo sapiens
tttctttgtgtagctttgctctt

SEQ ID NO: 5924 - DNA, 20 bp, Homo sapiens
ttttgttgctgttttgattt

SEQ ID NO: 5925 - DNA, 19 bp, Homo sapiens
agaaaggtctatgctgtca

SEQ ID NO: 5926 - DNA, 22 bp, Homo sapiens
ccagaagtgatggagagaaacc

SEQ ID NO: 5927 - DNA, 22 bp, Homo sapiens
cggggtccccgggggcccagcg

SEQ ID NO: 5928 - DNA, 21 bp, Homo sapiens
cttcatagccctagcatcaca

SEQ ID NO: 5929 - DNA, 21 bp, Homo sapiens
gacctctgtcttgcatgtgac

SEQ ID NO: 5930 - DNA, 25 bp, Homo sapiens
gattgctctctgtctcttttttcag

SEQ ID NO: 5931 - DNA, 18 bp, Homo sapiens
gcccacccactcgcgtgc

SEQ ID NO: 5932 - DNA, 20 bp, Homo sapiens
ggaaacagagctgccaattg

SEQ ID NO: 5933 - DNA, 18 bp, Homo sapiens
tcccagatgatgacaatg

SEQ ID NO: 5934 - DNA, 18 bp, Homo sapiens
tgatgacaatgaaattag

SEQ ID NO: 5935 - DNA, 24 bp, Homo sapiens
ttacttcaccccaagtcctgctgc

SEQ ID NO: 5936 - DNA, 17 bp, Homo sapiens
aagttattgggctcagt

SEQ ID NO: 5937 - DNA, 19 bp, Homo sapiens
aacccttgtcttttactca

SEQ ID NO: 5938 - DNA, 21 bp, Homo sapiens
gcaactccttgctcacagtga

SEQ ID NO: 5939 - DNA, 19 bp, Homo sapiens
gcttctctgagacctgctc

SEQ ID NO: 5940 - DNA, 20 bp, Homo sapiens
tatgatagatctttactaaa

SEQ ID NO: 5941 - DNA, 17 bp, Homo sapiens
ggtgctataggcatgca

SEQ ID NO: 5942 - DNA, 21 bp, Homo sapiens
agacccccactctcattcccc

SEQ ID NO: 5943 - DNA, 16 bp, Homo sapiens
agttgctaaacgagtc

SEQ ID NO: 5944 - DNA, 21 bp, Homo sapiens
cacccccttcagtgcccacca

SEQ ID NO: 5945 - DNA, 17 bp, Homo sapiens
ccaggtggctgacccag

SEQ ID NO: 5946 - DNA, 19 bp, Homo sapiens
cggggaactcctgaaatat

SEQ ID NO: 5947 - DNA, 17 bp, Homo sapiens
ctctccctctggccctg

SEQ ID NO: 5948 - DNA, 21 bp, Homo sapiens
gtgccctggctgctgggctct

SEQ ID NO: 5949 - DNA, 18 bp, Homo sapiens
taggtggatcacctgagg

SEQ ID NO: 5950 - DNA, 21 bp, Homo sapiens
aagaattttaccattcagtta

SEQ ID NO: 5951 - DNA, 18 bp, Homo sapiens
agaactaaccagtacctc

SEQ ID NO: 5952 - DNA, 19 bp, Homo sapiens
ttatagatgtacatacctc

SEQ ID NO: 5953 - DNA, 18 bp, Homo sapiens
ttcagttgatcttcttca

SEQ ID NO: 5954 - DNA, 18 bp, Homo sapiens
aatagcagcaccactttg

SEQ ID NO: 5955 - DNA, 17 bp, Homo sapiens
cggtgtttccgctctga

SEQ ID NO: 5956 - DNA, 18 bp, Homo sapiens
tagagttgtaagaccaaa

SEQ ID NO: 5957 - DNA, 23 bp, Homo sapiens
tttcgccgggttgcttttgtctt

SEQ ID NO: 5958 - DNA, 18 bp, Homo sapiens
actctgacaagctggcca

SEQ ID NO: 5959 - DNA, 22 bp, Homo sapiens
attcacccactcccttgaagtt

SEQ ID NO: 5960 - DNA, 20 bp, Homo sapiens
catgatgggaggtgtgccag

SEQ ID NO: 5961 - DNA, 21 bp, Homo sapiens
catgtgtccccactgcaggga

SEQ ID NO: 5962 - DNA, 19 bp, Homo sapiens
atcttccagagtaaaatgc

SEQ ID NO: 5963 - DNA, 22 bp, Homo sapiens
atcttggttctgatatggacta

SEQ ID NO: 5964 - DNA, 15 bp, Homo sapiens
cctgaaatgcggtga

SEQ ID NO: 5965 - DNA, 17 bp, Homo sapiens
cgcccttcctcccttgc

SEQ ID NO: 5966 - DNA, 21 bp, Homo sapiens
cttaagtaaaaaatcattttt

SEQ ID NO: 5967 - DNA, 23 bp, Homo sapiens
cttcttcatggaatgctgacctt

SEQ ID NO: 5968 - DNA, 17 bp, Homo sapiens
gtttacttgtctgcctt

SEQ ID NO: 5969 - DNA, 24 bp, Homo sapiens
accctttcctgtccctctctccct

SEQ ID NO: 5970 - DNA, 18 bp, Homo sapiens
gtgttacctttgtagtca

SEQ ID NO: 5971 - DNA, 22 bp, Homo sapiens
tattatggagaaaaaaatcact

SEQ ID NO: 5972 - DNA, 23 bp, Homo sapiens
tgcaattgtgttggaagtgtcct

SEQ ID NO: 5973 - DNA, 20 bp, Homo sapiens
tggatgtcagagttgatcta

SEQ ID NO: 5974 - DNA, 16 bp, Homo sapiens
tctttggtttggcttt

SEQ ID NO: 5975 - DNA, 23 bp, Homo sapiens
tgcttcctgattagatccagtca

SEQ ID NO: 5976 - DNA, 22 bp, Homo sapiens
tggaggtctgaatgtgaggctg

SEQ ID NO: 5977 - DNA, 18 bp, Homo sapiens
ttggtgggatttgataaa

SEQ ID NO: 5978 - DNA, 17 bp, Homo sapiens
cattgacctcagctgca

SEQ ID NO: 5979 - DNA, 19 bp, Homo sapiens
cgcggagctgcacccgtgc

SEQ ID NO: 5980 - DNA, 17 bp, Homo sapiens
gaccccgagtcgggagg

SEQ ID NO: 5981 - DNA, 18 bp, Homo sapiens
ggcacccacctccacccc

SEQ ID NO: 5982 - DNA, 16 bp, Homo sapiens
acagaaaaagttccta

SEQ ID NO: 5983 - DNA, 18 bp, Homo sapiens
gtgctcaacagtgtgttt

SEQ ID NO: 5984 - DNA, 21 bp, Homo sapiens
ccaaaagaagcggagatttaa

SEQ ID NO: 5985 - DNA, 22 bp, Homo sapiens
ggttgtgaagaggtgttttttc

SEQ ID NO: 5986 - DNA, 17 bp, Homo sapiens
aaaaacaaacaaacaaa

SEQ ID NO: 5987 - DNA, 17 bp, Homo sapiens
acagagatcatcctctt

SEQ ID NO: 5988 - DNA, 20 bp, Homo sapiens
acggaatatagaagacatgg

SEQ ID NO: 5989 - DNA, 19 bp, Homo sapiens
agttttctctcttccagtc

SEQ ID NO: 5990 - DNA, 19 bp, Homo sapiens
atacaagtccacaccatcc

SEQ ID NO: 5991 - DNA, 19 bp, Homo sapiens
ggacagccagggcttcctt

SEQ ID NO: 5992 - DNA, 20 bp, Homo sapiens
ggtcgccccttgccctggag

SEQ ID NO: 5993 - DNA, 19 bp, Homo sapiens
tgagatttctgttccccac

SEQ ID NO: 5994 - DNA, 20 bp, Homo sapiens
tttgggaaaaaatgttatca

SEQ ID NO: 5995 - DNA, 19 bp, Homo sapiens
cctgaggcaccccaacatg

SEQ ID NO: 5996 - DNA, 18 bp, Homo sapiens
gtaaccatggtcatgtga

SEQ ID NO: 5997 - DNA, 19 bp, Homo sapiens
accaaaaagggatccgtac

SEQ ID NO: 5998 - DNA, 18 bp, Homo sapiens
agtataaagaaaagtagg

SEQ ID NO: 5999 - DNA, 25 bp, Homo sapiens
ccaggcggaccgatcttcccatccc

SEQ ID NO: 6000 - DNA, 19 bp, Homo sapiens
ctgttatctgtgtttgctg

SEQ ID NO: 6001 - DNA, 19 bp, Homo sapiens
ctcccccagccactcccca

SEQ ID NO: 6002 - DNA, 18 bp, Homo sapiens
ctttgccatctctgctcc

SEQ ID NO: 6003 - DNA, 22 bp, Homo sapiens
gaggccatctggagagcccaga

SEQ ID NO: 6004 - DNA, 18 bp, Homo sapiens
atccaccctcccaagctg

SEQ ID NO: 6005 - DNA, 20 bp, Homo sapiens
cctctattacataaacactg

SEQ ID NO: 6006 - DNA, 17 bp, Homo sapiens
agcttctattttccaca

SEQ ID NO: 6007 - DNA, 20 bp, Homo sapiens
agtaagatttgttgctctca

SEQ ID NO: 6008 - DNA, 28 bp, Homo sapiens
agtggtaattgaggaaaacagttcccca

SEQ ID NO: 6009 - DNA, 22 bp, Homo sapiens
ccgttcgcctctttctgtttct

SEQ ID NO: 6010 - DNA, 20 bp, Homo sapiens
cctcccccctccttccctcc

SEQ ID NO: 6011 - DNA, 20 bp, Homo sapiens
ggagcccgcccgctcccctc

SEQ ID NO: 6012 - DNA, 20 bp, Homo sapiens
tcatgacacatttgccaaat

SEQ ID NO: 6013 - DNA, 20 bp, Homo sapiens
tgcccagagcactactctca

SEQ ID NO: 6014 - DNA, 20 bp, Homo sapiens
tgtttttcaacatgaatctg

SEQ ID NO: 6015 - DNA, 24 bp, Homo sapiens
ttgacagtgtcattttatgttgga

SEQ ID NO: 6016 - DNA, 21 bp, Homo sapiens
actccctctgccccagcccca

SEQ ID NO: 6017 - DNA, 18 bp, Homo sapiens
cctccccaccccacctcc

SEQ ID NO: 6018 - DNA, 18 bp, Homo sapiens
gtctttttcatcctcttc

SEQ ID NO: 6019 - DNA, 19 bp, Homo sapiens
ggcatgctgtgacatttta

SEQ ID NO: 6020 - DNA, 18 bp, Homo sapiens
gtttttataataggtaat

SEQ ID NO: 6021 - DNA, 23 bp, Homo sapiens
tttcttcagcctcctctgacttt

SEQ ID NO: 6022 - DNA, 18 bp, Homo sapiens
tgacagaacaacagtgtt

SEQ ID NO: 6023 - DNA, 18 bp, Homo sapiens
accttctggcttccttct

SEQ ID NO: 6024 - DNA, 23 bp, Homo sapiens
gtttgcttatgtaatctcacctc

SEQ ID NO: 6025 - DNA, 21 bp, Homo sapiens
tttgagcaattttcgaacatt

SEQ ID NO: 6026 - DNA, 22 bp, Homo sapiens
atgctgcctcattttcacagca

SEQ ID NO: 6027 - DNA, 23 bp, Homo sapiens
gaaccaggccaatatattttgaa

SEQ ID NO: 6028 - DNA, 20 bp, Homo sapiens
gcaaactgcgggaatactgt

SEQ ID NO: 6029 - DNA, 21 bp, Homo sapiens
atggaagaaataacagtatgt

SEQ ID NO: 6030 - DNA, 19 bp, Homo sapiens
atggtcatggtagactgat

SEQ ID NO: 6031 - DNA, 21 bp, Homo sapiens
ggtaagtggaaaaatatcatg

SEQ ID NO: 6032 - DNA, 21 bp, Homo sapiens
agtctctatgatcttggcaca

SEQ ID NO: 6033 - DNA, 20 bp, Homo sapiens
tggtagtgctggtgggtttt

SEQ ID NO: 6034 - DNA, 22 bp, Homo sapiens
gcctgctgagaagaagaaacca

SEQ ID NO: 6035 - DNA, 18 bp, Homo sapiens
gtcaggagagtgatgtga

SEQ ID NO: 6036 - DNA, 19 bp, Homo sapiens
agcttctgcatacagtctt

SEQ ID NO: 6037 - DNA, 20 bp, Homo sapiens
atgtcttactgaaacatttt

SEQ ID NO: 6038 - DNA, 21 bp, Homo sapiens
gcaggggtaagcggcttttaa

SEQ ID NO: 6039 - DNA, 19 bp, Homo sapiens
gtggattcagaattgtgta

SEQ ID NO: 6040 - DNA, 19 bp, Homo sapiens
gttacatcaggacaacttt

SEQ ID NO: 6041 - DNA, 21 bp, Homo sapiens
tccgctaagtttagatggagt

SEQ ID NO: 6042 - DNA, 19 bp, Homo sapiens
tctacaagttttctgccaa

SEQ ID NO: 6043 - DNA, 18 bp, Homo sapiens
tgtatttggtgcttcttc

SEQ ID NO: 6044 - DNA, 16 bp, Homo sapiens
agaaacactgattttc

SEQ ID NO: 6045 - DNA, 24 bp, Homo sapiens
ccaagaaacactgattttctttca

SEQ ID NO: 6046 - DNA, 19 bp, Homo sapiens
ccttccttttcctgtttct

SEQ ID NO: 6047 - DNA, 22 bp, Homo sapiens
ccttttcctgtttcttaatttt

SEQ ID NO: 6048 - DNA, 25 bp, Homo sapiens
ggtgaccttaaagacttcctagcca

SEQ ID NO: 6049 - DNA, 23 bp, Homo sapiens
tgaagacctactttgtcctctac

SEQ ID NO: 6050 - DNA, 21 bp, Homo sapiens
ttcagtctcatttagatgata

SEQ ID NO: 6051 - DNA, 23 bp, Homo sapiens
aagagttcttaaggattgtgata

SEQ ID NO: 6052 - DNA, 16 bp, Homo sapiens
tgtgatcaggctatgt

SEQ ID NO: 6053 - DNA, 24 bp, Homo sapiens
agcgctggtgatccacccgcgcgc

SEQ ID NO: 6054 - DNA, 20 bp, Homo sapiens
atgtggacttcggaatccca

SEQ ID NO: 6055 - DNA, 18 bp, Homo sapiens
cctgagctgtttctggtt

SEQ ID NO: 6056 - DNA, 17 bp, Homo sapiens
ggccaccgtgctccggg

SEQ ID NO: 6057 - DNA, 18 bp, Homo sapiens
tagagtctattgaaactg

SEQ ID NO: 6058 - DNA, 22 bp, Homo sapiens
tcccagcgctggccgcctggca

SEQ ID NO: 6059 - DNA, 21 bp, Homo sapiens
tggtctccgatgaaaatgcca

SEQ ID NO: 6060 - DNA, 17 bp, Homo sapiens
aacaaaccttcatggca

SEQ ID NO: 6061 - DNA, 24 bp, Homo sapiens
acttaactgaaattatccaacaaa

SEQ ID NO: 6062 - DNA, 24 bp, Homo sapiens
acttaactgaaattatccaacaaa

SEQ ID NO: 6063 - DNA, 17 bp, Homo sapiens
ctaatttgctagtggga

SEQ ID NO: 6064 - DNA, 17 bp, Homo sapiens
gacttggctttcttaca

SEQ ID NO: 6065 - DNA, 20 bp, Homo sapiens
ggaaaaacataattctttca

SEQ ID NO: 6066 - DNA, 23 bp, Homo sapiens
taagtgtcacttaactgaaatta

SEQ ID NO: 6067 - DNA, 23 bp, Homo sapiens
tcttgtaatttcaacacacccaa

SEQ ID NO: 6068 - DNA, 23 bp, Homo sapiens
cccgccctccccgtcctgcctcc

SEQ ID NO: 6069 - DNA, 24 bp, Homo sapiens
atttgagctgtggctgtgaggggt

SEQ ID NO: 6070 - DNA, 30 bp, Homo sapiens
tacctggaagccgcgcggccgctttggttt

SEQ ID NO: 6071 - DNA, 20 bp, Homo sapiens
gcacagagctgtggtcctca

SEQ ID NO: 6072 - DNA, 22 bp, Homo sapiens
cacttggggcaccttgctcctc

SEQ ID NO: 6073 - DNA, 22 bp, Homo sapiens
caccccctcacccccttctttt

SEQ ID NO: 6074 - DNA, 20 bp, Homo sapiens
cagaagaaaaagttgcagtc

SEQ ID NO: 6075 - DNA, 21 bp, Homo sapiens
ctgctggcacctcagacaatc

SEQ ID NO: 6076 - DNA, 19 bp, Homo sapiens
gaaaagagacctcctgctc

SEQ ID NO: 6077 - DNA, 17 bp, Homo sapiens
gaaggagatgtcagtga

SEQ ID NO: 6078 - DNA, 20 bp, Homo sapiens
agaattacattgtatagccc

SEQ ID NO: 6079 - DNA, 22 bp, Homo sapiens
attactgctgttctagccccca

SEQ ID NO: 6080 - DNA, 20 bp, Homo sapiens
ctgttagggtacatacgcta

SEQ ID NO: 6081 - DNA, 19 bp, Homo sapiens
tcgttgttgttttaagttt

SEQ ID NO: 6082 - DNA, 21 bp, Homo sapiens
gtcccaccgctgcccctactg

SEQ ID NO: 6083 - DNA, 20 bp, Homo sapiens
ctgaacagttgtttgtgttt

SEQ ID NO: 6084 - DNA, 19 bp, Homo sapiens
actcaatgtccccctcacc

SEQ ID NO: 6085 - DNA, 19 bp, Homo sapiens
agaaataaacaggagttca

SEQ ID NO: 6086 - DNA, 18 bp, Homo sapiens
caaccctccgttcctcct

SEQ ID NO: 6087 - DNA, 22 bp, Homo sapiens
gagccaagattgcgccactgca

SEQ ID NO: 6088 - DNA, 19 bp, Homo sapiens
ggtgggtggggagtcagtc

SEQ ID NO: 6089 - DNA, 19 bp, Homo sapiens
gttggaagccaaatgtact

SEQ ID NO: 6090 - DNA, 19 bp, Homo sapiens
tgagtgacggaccagctca

SEQ ID NO: 6091 - DNA, 18 bp, Homo sapiens
tggctcagggtggggctg

SEQ ID NO: 6092 - DNA, 25 bp, Homo sapiens
ttgctgcttctgctatatttgtgat

SEQ ID NO: 6093 - DNA, 24 bp, Homo sapiens
actgaagttgtggttgttaggttc

SEQ ID NO: 6094 - DNA, 24 bp, Homo sapiens
cagttctgcaaaaatgacctataa

SEQ ID NO: 6095 - DNA, 18 bp, Homo sapiens
ctcaacatggcagaacca

SEQ ID NO: 6096 - DNA, 18 bp, Homo sapiens
gttttaatgttcttttga

SEQ ID NO: 6097 - DNA, 20 bp, Homo sapiens
tgttttataaacaacatcaa

SEQ ID NO: 6098 - DNA, 21 bp, Homo sapiens
ttctttgggtgtaaagcgttt

SEQ ID NO: 6099 - DNA, 15 bp, Homo sapiens
tttaattgggtgggg

SEQ ID NO: 6100 - DNA, 17 bp, Homo sapiens
caactatctcatttcca

SEQ ID NO: 6101 - DNA, 21 bp, Homo sapiens
ctgaaaacccttgccatgtgc

SEQ ID NO: 6102 - DNA, 19 bp, Homo sapiens
ggaattggagctcgtggaa

SEQ ID NO: 6103 - DNA, 18 bp, Homo sapiens
tatgccttttcccaactc

SEQ ID NO: 6104 - DNA, 18 bp, Homo sapiens
tgtttgctaagcattcca

SEQ ID NO: 6105 - DNA, 20 bp, Homo sapiens
atatttctgatggtgcacta

SEQ ID NO: 6106 - DNA, 19 bp, Homo sapiens
atactagagttcatggata

SEQ ID NO: 6107 - DNA, 19 bp, Homo sapiens
gataaaaaaaaagtgagca

SEQ ID NO: 6108 - DNA, 18 bp, Homo sapiens
ataaaggtgttaagctta

SEQ ID NO: 6109 - DNA, 21 bp, Homo sapiens
caagattatgtcaattggtta

SEQ ID NO: 6110 - DNA, 22 bp, Homo sapiens
tctattatttttctactaaaga

SEQ ID NO: 6111 - DNA, 22 bp, Homo sapiens
acacaacaatccttctattcta

SEQ ID NO: 6112 - DNA, 21 bp, Homo sapiens
atctgggctgtgggcaagcct

SEQ ID NO: 6113 - DNA, 19 bp, Homo sapiens
ccattgatttaatgtaata

SEQ ID NO: 6114 - DNA, 21 bp, Homo sapiens
ctgggaacatcacattcctct

SEQ ID NO: 6115 - DNA, 18 bp, Homo sapiens
acagaacggtgggagctg

SEQ ID NO: 6116 - DNA, 20 bp, Homo sapiens
gaatttttggtgtaaatttg

SEQ ID NO: 6117 - DNA, 26 bp, Homo sapiens
tcaatgtgatataaacagcttctcca

SEQ ID NO: 6118 - DNA, 19 bp, Homo sapiens
aacttataattacaatgca

SEQ ID NO: 6119 - DNA, 24 bp, Homo sapiens
aatgcacaatttataattacaata

SEQ ID NO: 6120 - DNA, 19 bp, Homo sapiens
cataaactatattctgtga

SEQ ID NO: 6121 - DNA, 23 bp, Homo sapiens
ccagttggccctgcaagtgcctg

SEQ ID NO: 6122 - DNA, 22 bp, Homo sapiens
cctcctcgcccacggcgcctca

SEQ ID NO: 6123 - DNA, 22 bp, Homo sapiens
cctcctcgcccacggcgcctca

SEQ ID NO: 6124 - DNA, 18 bp, Homo sapiens
ctcccccaaccctgccca

SEQ ID NO: 6125 - DNA, 22 bp, Homo sapiens
agagaaacaggcccggggggac

SEQ ID NO: 6126 - DNA, 19 bp, Homo sapiens
agtaagaccccatctctta

SEQ ID NO: 6127 - DNA, 24 bp, Homo sapiens
gcttcggacagtgcccatgcaatg

SEQ ID NO: 6128 - DNA, 22 bp, Homo sapiens
gcttgggttgggattttggttt

SEQ ID NO: 6129 - DNA, 18 bp, Homo sapiens
ccagatcagactctcctt

SEQ ID NO: 6130 - DNA, 23 bp, Homo sapiens
gacaagtgatcgccaccccccca

SEQ ID NO: 6131 - DNA, 20 bp, Homo sapiens
ggaggaagaggctgcactgc

SEQ ID NO: 6132 - DNA, 25 bp, Homo sapiens
aaataaatggaaatagtactactca

SEQ ID NO: 6133 - DNA, 18 bp, Homo sapiens
ttctctatcatcttgcac

SEQ ID NO: 6134 - DNA, 18 bp, Homo sapiens
atgttgatggctattttg

SEQ ID NO: 6135 - DNA, 20 bp, Homo sapiens
cggggtcgtggaccccggcc

SEQ ID NO: 6136 - DNA, 22 bp, Homo sapiens
ggtataggcgccttttacccca

SEQ ID NO: 6137 - DNA, 19 bp, Homo sapiens
ggtcaatttgattgtcata

SEQ ID NO: 6138 - DNA, 21 bp, Homo sapiens
ccatcccctacaccttccccc

SEQ ID NO: 6139 - DNA, 16 bp, Homo sapiens
gggatgtgtgcccctc

SEQ ID NO: 6140 - DNA, 20 bp, Homo sapiens
cctcttccggccattcttca

SEQ ID NO: 6141 - DNA, 23 bp, Homo sapiens
tcaaagaggctcaatgactttcc

SEQ ID NO: 6142 - DNA, 22 bp, Homo sapiens
tcctatatccttccttgttcct

SEQ ID NO: 6143 - DNA, 22 bp, Homo sapiens
ttcagagcacacactgttccag

SEQ ID NO: 6144 - DNA, 23 bp, Homo sapiens
ttctgccttccccaacacctttg

SEQ ID NO: 6145 - DNA, 20 bp, Homo sapiens
cccggcaccccctgcagctt

SEQ ID NO: 6146 - DNA, 19 bp, Homo sapiens
cctgccccaactccttcca

SEQ ID NO: 6147 - DNA, 21 bp, Homo sapiens
cctgccccaactccttccagc

SEQ ID NO: 6148 - DNA, 19 bp, Homo sapiens
ctggccaagctgaggtgcc

SEQ ID NO: 6149 - DNA, 19 bp, Homo sapiens
cttgttctgtcaccaatgt

SEQ ID NO: 6150 - DNA, 24 bp, Homo sapiens
gagcgccctgcagaccctgccctt

SEQ ID NO: 6151 - DNA, 19 bp, Homo sapiens
cacttcaccgtactaacca

SEQ ID NO: 6152 - DNA, 18 bp, Homo sapiens
cagccaaaccctgtctga

SEQ ID NO: 6153 - DNA, 20 bp, Homo sapiens
tgagccaccacgtggagctg

SEQ ID NO: 6154 - DNA, 19 bp, Homo sapiens
aaactcctgacctcaggtg

SEQ ID NO: 6155 - DNA, 21 bp, Homo sapiens
aacttacactgtttcatctca

SEQ ID NO: 6156 - DNA, 18 bp, Homo sapiens
aagaaaaacattcacatc

SEQ ID NO: 6157 - DNA, 19 bp, Homo sapiens
aatgcttctatcagactca

SEQ ID NO: 6158 - DNA, 21 bp, Homo sapiens
agaggaacaaaccaggggaca

SEQ ID NO: 6159 - DNA, 18 bp, Homo sapiens
cagtactttgggaagcca

SEQ ID NO: 6160 - DNA, 19 bp, Homo sapiens
ccatgaaaacagaacccaa

SEQ ID NO: 6161 - DNA, 17 bp, Homo sapiens
ctttttcatttaacttt

SEQ ID NO: 6162 - DNA, 18 bp, Homo sapiens
gccaccagcctcattcca

SEQ ID NO: 6163 - DNA, 20 bp, Homo sapiens
tagatacacttcttaaatac

SEQ ID NO: 6164 - DNA, 22 bp, Homo sapiens
tgggtatttcttggcatgcatc

SEQ ID NO: 6165 - DNA, 23 bp, Homo sapiens
ttcaagtgattctcctggctcac

SEQ ID NO: 6166 - DNA, 20 bp, Homo sapiens
tttgtaaatatgtgacattc

SEQ ID NO: 6167 - DNA, 22 bp, Homo sapiens
gcctgggttgcaggccctgctt

SEQ ID NO: 6168 - DNA, 20 bp, Homo sapiens
tgcaggccctgcttgtggtg

SEQ ID NO: 6169 - DNA, 20 bp, Homo sapiens
ctgtcttatacaaccagaga

SEQ ID NO: 6170 - DNA, 21 bp, Homo sapiens
ttccagaaaaaaactatccag

SEQ ID NO: 6171 - DNA, 18 bp, Homo sapiens
aagatgcttctcactgcc

SEQ ID NO: 6172 - DNA, 17 bp, Homo sapiens
ccccgccccgcccctgc

SEQ ID NO: 6173 - DNA, 15 bp, Homo sapiens
cgcacacagtatcta

SEQ ID NO: 6174 - DNA, 19 bp, Homo sapiens
gcttcataaagtctttgaa

SEQ ID NO: 6175 - DNA, 21 bp, Homo sapiens
ggtctaatttattcaaagggg

SEQ ID NO: 6176 - DNA, 16 bp, Homo sapiens
tctcacctctcctact

SEQ ID NO: 6177 - DNA, 16 bp, Homo sapiens
atgactcgtatatgtc

SEQ ID NO: 6178 - DNA, 20 bp, Homo sapiens
catggcaaggactgcaggga

SEQ ID NO: 6179 - DNA, 20 bp, Homo sapiens
tgcccaggcctgcctgttcc

SEQ ID NO: 6180 - DNA, 20 bp, Homo sapiens
tggtcacaggactctgcctc

SEQ ID NO: 6181 - DNA, 23 bp, Homo sapiens
agaaaaaatcgtctctccctccc

SEQ ID NO: 6182 - DNA, 18 bp, Homo sapiens
agaagcctcactgcaagc

SEQ ID NO: 6183 - DNA, 18 bp, Homo sapiens
atggcttagttttcatac

SEQ ID NO: 6184 - DNA, 19 bp, Homo sapiens
cccacaaaagtacaattta

SEQ ID NO: 6185 - DNA, 18 bp, Homo sapiens
gtcaaagacattctgaca

SEQ ID NO: 6186 - DNA, 19 bp, Homo sapiens
gtcagagaggagtcagaga

SEQ ID NO: 6187 - DNA, 20 bp, Homo sapiens
agtctcactttgttgcccag

SEQ ID NO: 6188 - DNA, 21 bp, Homo sapiens
ctatttctatcctgagtagta

SEQ ID NO: 6189 - DNA, 22 bp, Homo sapiens
ctctttggggttttagtatgtg

SEQ ID NO: 6190 - DNA, 19 bp, Homo sapiens
gagtgaaaacatctgcaca

SEQ ID NO: 6191 - DNA, 20 bp, Homo sapiens
tctacaaaatgactaggata

SEQ ID NO: 6192 - DNA, 24 bp, Homo sapiens
tgaatgctccattcaggcctatca

SEQ ID NO: 6193 - DNA, 18 bp, Homo sapiens
aggagaaacagagacagg

SEQ ID NO: 6194 - DNA, 22 bp, Homo sapiens
aggcaaaaaaattaaattattt

SEQ ID NO: 6195 - DNA, 23 bp, Homo sapiens
ccacctctcctttggccattcca

SEQ ID NO: 6196 - DNA, 18 bp, Homo sapiens
acattcagaggcatcaca

SEQ ID NO: 6197 - DNA, 21 bp, Homo sapiens
atcccaacgcatgctcctgga

SEQ ID NO: 6198 - DNA, 17 bp, Homo sapiens
cctccttagcacaatgt

SEQ ID NO: 6199 - DNA, 18 bp, Homo sapiens
ctgcttggggactattgg

SEQ ID NO: 6200 - DNA, 19 bp, Homo sapiens
ttagagtcattctcatgct

SEQ ID NO: 6201 - DNA, 18 bp, Homo sapiens
agaggtgttagggtttgg

SEQ ID NO: 6202 - DNA, 21 bp, Homo sapiens
tcccacccccaacgccatctc

SEQ ID NO: 6203 - DNA, 23 bp, Homo sapiens
ttctgacccgctcaggcttgagg

SEQ ID NO: 6204 - DNA, 18 bp, Homo sapiens
ccctctccctccacctcc

SEQ ID NO: 6205 - DNA, 22 bp, Homo sapiens
cctccctgccaccaggcactgc

SEQ ID NO: 6206 - DNA, 19 bp, Homo sapiens
cgcacggtacccgtgctgc

SEQ ID NO: 6207 - DNA, 18 bp, Homo sapiens
ctgttttgccttcaccca

SEQ ID NO: 6208 - DNA, 21 bp, Homo sapiens
gcacaagccacggcggactct

SEQ ID NO: 6209 - DNA, 22 bp, Homo sapiens
gctacttttgctgttttatttt

SEQ ID NO: 6210 - DNA, 19 bp, Homo sapiens
gcttgaaaagccgcggaac

SEQ ID NO: 6211 - DNA, 21 bp, Homo sapiens
cagggttaatagggcctggtc

SEQ ID NO: 6212 - DNA, 22 bp, Homo sapiens
gacccaagcttctagagatccc

SEQ ID NO: 6213 - DNA, 23 bp, Homo sapiens
tctgcagccctcagattattttt

SEQ ID NO: 6214 - DNA, 18 bp, Homo sapiens
caaccttcccttcgctcc

SEQ ID NO: 6215 - DNA, 18 bp, Homo sapiens
ctggcccgccccagcccg

SEQ ID NO: 6216 - DNA, 18 bp, Homo sapiens
cctggcaattgtctgccc

SEQ ID NO: 6217 - DNA, 19 bp, Homo sapiens
acccttcctcaccacttcc

SEQ ID NO: 6218 - DNA, 24 bp, Homo sapiens
agtgccggactagcaagtgctgga

SEQ ID NO: 6219 - DNA, 19 bp, Homo sapiens
tttgcttactttgcatttg

SEQ ID NO: 6220 - DNA, 23 bp, Homo sapiens
acaaagctgctgcttttacttca

SEQ ID NO: 6221 - DNA, 21 bp, Homo sapiens
agcccctcaagtaatatagca

SEQ ID NO: 6222 - DNA, 19 bp, Homo sapiens
agctgctgcttttacttca

SEQ ID NO: 6223 - DNA, 20 bp, Homo sapiens
atggtgttgaaggacttctc

SEQ ID NO: 6224 - DNA, 20 bp, Homo sapiens
ccttttcagttattttaatt

SEQ ID NO: 6225 - DNA, 21 bp, Homo sapiens
gggtctgggtgggtccagtca

SEQ ID NO: 6226 - DNA, 18 bp, Homo sapiens
ggtgttgaaggacttctc

SEQ ID NO: 6227 - DNA, 19 bp, Homo sapiens
tgcacagactgtgtttatg

SEQ ID NO: 6228 - DNA, 20 bp, Homo sapiens
agagggctgaagccttgtca

SEQ ID NO: 6229 - DNA, 17 bp, Homo sapiens
atcttggcctgatagca

SEQ ID NO: 6230 - DNA, 20 bp, Homo sapiens
cctgctcactcttccacaga

SEQ ID NO: 6231 - DNA, 21 bp, Homo sapiens
ctgtggccctcgctctgcctc

SEQ ID NO: 6232 - DNA, 18 bp, Homo sapiens
gtggtttcctcggccctc

SEQ ID NO: 6233 - DNA, 18 bp, Homo sapiens
tatgactcaccttgctct

SEQ ID NO: 6234 - DNA, 19 bp, Homo sapiens
tattaatccctcgtgtgtc

SEQ ID NO: 6235 - DNA, 18 bp, Homo sapiens
tttctccttttttatgat

SEQ ID NO: 6236 - DNA, 18 bp, Homo sapiens
cttgagcccagaagctca

SEQ ID NO: 6237 - DNA, 21 bp, Homo sapiens
ccaaaatcacaacagcattac

SEQ ID NO: 6238 - DNA, 17 bp, Homo sapiens
cctgagccagcctgctc

SEQ ID NO: 6239 - DNA, 21 bp, Homo sapiens
aagagaggtccagagtcctgg

SEQ ID NO: 6240 - DNA, 25 bp, Homo sapiens
tcctgaaatcatatagaaaggctgg

SEQ ID NO: 6241 - DNA, 21 bp, Homo sapiens
tcctttaagaaaaacatctgg

SEQ ID NO: 6242 - DNA, 21 bp, Homo sapiens
ccgttcttagccaagctgcta

SEQ ID NO: 6243 - DNA, 19 bp, Homo sapiens
ggagcatttttgaaattca

SEQ ID NO: 6244 - DNA, 16 bp, Homo sapiens
cttagaggtcgaggca

SEQ ID NO: 6245 - DNA, 23 bp, Homo sapiens
acattggcttccacatcacagta

SEQ ID NO: 6246 - DNA, 25 bp, Homo sapiens
gtctgaacacgttatcacttggttt

SEQ ID NO: 6247 - DNA, 18 bp, Homo sapiens
acgtgtgcacacaccaca

SEQ ID NO: 6248 - DNA, 21 bp, Homo sapiens
ctcttgttattgcatctgctg

SEQ ID NO: 6249 - DNA, 26 bp, Homo sapiens
gcgtgggtaagccgctgctgggtttt

SEQ ID NO: 6250 - DNA, 17 bp, Homo sapiens
ggtgacggcagcgtagc

SEQ ID NO: 6251 - DNA, 24 bp, Homo sapiens
caggattacatgcatgtttggtta

SEQ ID NO: 6252 - DNA, 20 bp, Homo sapiens
catgtatcactgtagaggga

SEQ ID NO: 6253 - DNA, 19 bp, Homo sapiens
cccagtccctcgctgcaca

SEQ ID NO: 6254 - DNA, 19 bp, Homo sapiens
cccccaactcccaatactg

SEQ ID NO: 6255 - DNA, 23 bp, Homo sapiens
ctaaaccttttggaaaatctgcc

SEQ ID NO: 6256 - DNA, 19 bp, Homo sapiens
ctatttgtgagcaaaggtg

SEQ ID NO: 6257 - DNA, 19 bp, Homo sapiens
gaacactggtggaggatgg

SEQ ID NO: 6258 - DNA, 23 bp, Homo sapiens
gaggggtgtggctgggcctgtca

SEQ ID NO: 6259 - DNA, 21 bp, Homo sapiens
gagtctcagctacctaagaaa

SEQ ID NO: 6260 - DNA, 19 bp, Homo sapiens
tatgactcacatgatgcat

SEQ ID NO: 6261 - DNA, 24 bp, Homo sapiens
tcacagaatcaaggaagcacctca

SEQ ID NO: 6262 - DNA, 22 bp, Homo sapiens
tcagccttgaaacattgatgga

SEQ ID NO: 6263 - DNA, 20 bp, Homo sapiens
tctgcgaagaaccttgtgtg

SEQ ID NO: 6264 - DNA, 23 bp, Homo sapiens
ttcagttaaaaatccagatggca

SEQ ID NO: 6265 - DNA, 18 bp, Homo sapiens
agtcaagggtgtgtgcag

SEQ ID NO: 6266 - DNA, 18 bp, Homo sapiens
ctccccaaatgctttcca

SEQ ID NO: 6267 - DNA, 22 bp, Homo sapiens
gtgtgtgcagcattgttggctg

SEQ ID NO: 6268 - DNA, 23 bp, Homo sapiens
ttgcctaggcatagcctgcctca

SEQ ID NO: 6269 - DNA, 18 bp, Homo sapiens
accgtcaccatcaagcca

SEQ ID NO: 6270 - DNA, 22 bp, Homo sapiens
cagcgagtcccacctggacctc

SEQ ID NO: 6271 - DNA, 15 bp, Homo sapiens
cgccgccgccataga

SEQ ID NO: 6272 - DNA, 22 bp, Homo sapiens
gagaccagagcccagcttgcca

SEQ ID NO: 6273 - DNA, 21 bp, Homo sapiens
ggctttgttaatcctatttta

SEQ ID NO: 6274 - DNA, 19 bp, Homo sapiens
gtgacctttgctgcagcag

SEQ ID NO: 6275 - DNA, 21 bp, Homo sapiens
tgcaattgtaggggtgtgtgt

SEQ ID NO: 6276 - DNA, 22 bp, Homo sapiens
tgtaggggtgtgtgtgtgtgtg

SEQ ID NO: 6277 - DNA, 19 bp, Homo sapiens
aagcaattctcctgcctca

SEQ ID NO: 6278 - DNA, 20 bp, Homo sapiens
caaagccaccaccgtccttc

SEQ ID NO: 6279 - DNA, 18 bp, Homo sapiens
caaggtcaagatggttca

SEQ ID NO: 6280 - DNA, 18 bp, Homo sapiens
gatgtcctgacatgaaac

SEQ ID NO: 6281 - DNA, 20 bp, Homo sapiens
acagttgtgacagtaatctg

SEQ ID NO: 6282 - DNA, 20 bp, Homo sapiens
cagaaaaccagcatatttaa

SEQ ID NO: 6283 - DNA, 21 bp, Homo sapiens
cctaataaaataatggtattt

SEQ ID NO: 6284 - DNA, 23 bp, Homo sapiens
gtatattttatatgatttactta

SEQ ID NO: 6285 - DNA, 22 bp, Homo sapiens
ttctattgagtattataagata

SEQ ID NO: 6286 - DNA, 20 bp, Homo sapiens
acagttgtgacagtaatctg

SEQ ID NO: 6287 - DNA, 20 bp, Homo sapiens
cagaaaaccagcatatttaa

SEQ ID NO: 6288 - DNA, 21 bp, Homo sapiens
cctaataaaataatggtattt

SEQ ID NO: 6289 - DNA, 23 bp, Homo sapiens
gtatattttatatgatttactta

SEQ ID NO: 6290 - DNA, 22 bp, Homo sapiens
ttctattgagtattataagata

SEQ ID NO: 6291 - DNA, 20 bp, Homo sapiens
acagttgtgacagtaatctg

SEQ ID NO: 6292 - DNA, 20 bp, Homo sapiens
cagaaaaccagcatatttaa

SEQ ID NO: 6293 - DNA, 21 bp, Homo sapiens
cctaataaaataatggtattt

SEQ ID NO: 6294 - DNA, 23 bp, Homo sapiens
gtatattttatatgatttactta

SEQ ID NO: 6295 - DNA, 22 bp, Homo sapiens
ttctattgagtattataagata

SEQ ID NO: 6296 - DNA, 20 bp, Homo sapiens
acagttgtgacagtaatctg

SEQ ID NO: 6297 - DNA, 20 bp, Homo sapiens
cagaaaaccagcatatttaa

SEQ ID NO: 6298 - DNA, 21 bp, Homo sapiens
cctaataaaataatggtattt

SEQ ID NO: 6299 - DNA, 23 bp, Homo sapiens
gtatattttatatgatttactta

SEQ ID NO: 6300 - DNA, 22 bp, Homo sapiens
ttctattgagtattataagata

SEQ ID NO: 6301 - DNA, 16 bp, Homo sapiens
aagaaactgggtctca

SEQ ID NO: 6302 - DNA, 20 bp, Homo sapiens
acagattcgaattttacttc

SEQ ID NO: 6303 - DNA, 20 bp, Homo sapiens
acagttgtgacagtaatctg

SEQ ID NO: 6304 - DNA, 20 bp, Homo sapiens
cagaaaaccagcatatttaa

SEQ ID NO: 6305 - DNA, 21 bp, Homo sapiens
cctaataaaataatggtattt

SEQ ID NO: 6306 - DNA, 23 bp, Homo sapiens
gtatattttatatgatttactta

SEQ ID NO: 6307 - DNA, 19 bp, Homo sapiens
tcttcagacttgaacaaga

SEQ ID NO: 6308 - DNA, 22 bp, Homo sapiens
ttctattgagtattataagata

SEQ ID NO: 6309 - DNA, 20 bp, Homo sapiens
gttcttatgttgcccagtgt

SEQ ID NO: 6310 - DNA, 24 bp, Homo sapiens
tcaacccaatagttgttgattggc

SEQ ID NO: 6311 - DNA, 20 bp, Homo sapiens
aagatgcattatctatgata

SEQ ID NO: 6312 - DNA, 17 bp, Homo sapiens
tatatgtatatgcaata

SEQ ID NO: 6313 - DNA, 19 bp, Homo sapiens
tccagaaagctcatctcag

SEQ ID NO: 6314 - DNA, 19 bp, Homo sapiens
cctgtaacatgcaattttg

SEQ ID NO: 6315 - DNA, 21 bp, Homo sapiens
ctgtagcctcgccgtctgtga

SEQ ID NO: 6316 - DNA, 18 bp, Homo sapiens
tcaaacatgaagtgtgtt

SEQ ID NO: 6317 - DNA, 19 bp, Homo sapiens
tcaggcctccctcaacccc

SEQ ID NO: 6318 - DNA, 17 bp, Homo sapiens
caccactgcgcccttct

SEQ ID NO: 6319 - DNA, 20 bp, Homo sapiens
ccccgccccgcccccgctgc

SEQ ID NO: 6320 - DNA, 20 bp, Homo sapiens
tccaccactgcgcccttctc

SEQ ID NO: 6321 - DNA, 18 bp, Homo sapiens
agaaagaaacttccaaca

SEQ ID NO: 6322 - DNA, 18 bp, Homo sapiens
tgatacacaagcttaaat

SEQ ID NO: 6323 - DNA, 21 bp, Homo sapiens
acccaagtctgcttctgtgat

SEQ ID NO: 6324 - DNA, 18 bp, Homo sapiens
tcttgttttatgctgtca

SEQ ID NO: 6325 - DNA, 19 bp, Homo sapiens
tgaacttttaagggtctca

SEQ ID NO: 6326 - DNA, 26 bp, Homo sapiens
ttcaacgattaagaatcatcattaca

SEQ ID NO: 6327 - DNA, 19 bp, Homo sapiens
cctgcaggaggcctgggag

SEQ ID NO: 6328 - DNA, 17 bp, Homo sapiens
gaggagcctggagtgta

SEQ ID NO: 6329 - DNA, 22 bp, Homo sapiens
gttggaaattgggtgtgccctg

SEQ ID NO: 6330 - DNA, 21 bp, Homo sapiens
tgaagagatacccacagagtg

SEQ ID NO: 6331 - DNA, 28 bp, Homo sapiens
gcttgggcacagcagactggcctggccc

SEQ ID NO: 6332 - DNA, 22 bp, Homo sapiens
tctgggcccctccgcctgggcc

SEQ ID NO: 6333 - DNA, 23 bp, Homo sapiens
tgctcccacctgatcctgcactg

SEQ ID NO: 6334 - DNA, 20 bp, Homo sapiens
tccagccgagaccttttgat

SEQ ID NO: 6335 - DNA, 22 bp, Homo sapiens
acagggaaaagatttctgtcca

SEQ ID NO: 6336 - DNA, 16 bp, Homo sapiens
aggcggacgcccagga

SEQ ID NO: 6337 - DNA, 19 bp, Homo sapiens
ctggctaattccccttcca

SEQ ID NO: 6338 - DNA, 19 bp, Homo sapiens
tacaagggcatggctcaca

SEQ ID NO: 6339 - DNA, 19 bp, Homo sapiens
gctgctccccgcaatgctg

SEQ ID NO: 6340 - DNA, 22 bp, Homo sapiens
tcactggcattcaccccctgca

SEQ ID NO: 6341 - DNA, 19 bp, Homo sapiens
agagaacattcctctgcag

SEQ ID NO: 6342 - DNA, 18 bp, Homo sapiens
gattgttctgtccagttt

SEQ ID NO: 6343 - DNA, 21 bp, Homo sapiens
ttagctacttttcagaattga

SEQ ID NO: 6344 - DNA, 18 bp, Homo sapiens
tgcccaggccccacctct

SEQ ID NO: 6345 - DNA, 22 bp, Homo sapiens
ttgcccaggccccacctctcct

SEQ ID NO: 6346 - DNA, 16 bp, Homo sapiens
agccaagaacaccctt

SEQ ID NO: 6347 - DNA, 20 bp, Homo sapiens
agtctcactctgtcgcccag

SEQ ID NO: 6348 - DNA, 19 bp, Homo sapiens
caaacatcccaaatgtcca

SEQ ID NO: 6349 - DNA, 19 bp, Homo sapiens
tactgacacatgctgtgac

SEQ ID NO: 6350 - DNA, 19 bp, Homo sapiens
aatgtctttaatatgaaat

SEQ ID NO: 6351 - DNA, 16 bp, Homo sapiens
acaatgcgagaatgat

SEQ ID NO: 6352 - DNA, 17 bp, Homo sapiens
agctgtaattcacttta

SEQ ID NO: 6353 - DNA, 19 bp, Homo sapiens
ccaaggcactttcttaagc

SEQ ID NO: 6354 - DNA, 20 bp, Homo sapiens
gtgtccagcagttgcttgaa

SEQ ID NO: 6355 - DNA, 20 bp, Homo sapiens
acccgcctccaacgggtcac

SEQ ID NO: 6356 - DNA, 20 bp, Homo sapiens
cacacgcgcacttccacctc

SEQ ID NO: 6357 - DNA, 22 bp, Homo sapiens
cagggttggccaggcccagtca

SEQ ID NO: 6358 - DNA, 18 bp, Homo sapiens
ggatttatcaccaagaca

SEQ ID NO: 6359 - DNA, 19 bp, Homo sapiens
acacttgtaaagtgctacg

SEQ ID NO: 6360 - DNA, 17 bp, Homo sapiens
gataatgttaattctct

SEQ ID NO: 6361 - DNA, 18 bp, Homo sapiens
gctctccccgcttcttcg

SEQ ID NO: 6362 - DNA, 18 bp, Homo sapiens
tgtggtgtcttgttccac

SEQ ID NO: 6363 - DNA, 26 bp, Homo sapiens
accagatccttttccatcccactcca

SEQ ID NO: 6364 - DNA, 21 bp, Homo sapiens
ccatttcccacttccaccccc

SEQ ID NO: 6365 - DNA, 17 bp, Homo sapiens
ctcccaaaggctgtcat

SEQ ID NO: 6366 - DNA, 18 bp, Homo sapiens
gacaatattaatttggat

SEQ ID NO: 6367 - DNA, 21 bp, Homo sapiens
gacgatcattgtgcccactta

SEQ ID NO: 6368 - DNA, 18 bp, Homo sapiens
gagcttccagaaatgcca

SEQ ID NO: 6369 - DNA, 15 bp, Homo sapiens
gatttctacacttta

SEQ ID NO: 6370 - DNA, 20 bp, Homo sapiens
tctaccaaaaacaatacttt

SEQ ID NO: 6371 - DNA, 19 bp, Homo sapiens
tgaaccttcctgtctccca

SEQ ID NO: 6372 - DNA, 19 bp, Homo sapiens
tgtacttaataacacttca

SEQ ID NO: 6373 - DNA, 20 bp, Homo sapiens
atcaatcaccttgcatttca

SEQ ID NO: 6374 - DNA, 17 bp, Homo sapiens
cccaaaccccgctgtga

SEQ ID NO: 6375 - DNA, 17 bp, Homo sapiens
gaaaatgaaccaacaca

SEQ ID NO: 6376 - DNA, 20 bp, Homo sapiens
tggatagtaaagtggaatta

SEQ ID NO: 6377 - DNA, 22 bp, Homo sapiens
ttaaaagtcacataaaatgcgg

SEQ ID NO: 6378 - DNA, 23 bp, Homo sapiens
aaaacaaacgtgtatctaaatgt

SEQ ID NO: 6379 - DNA, 21 bp, Homo sapiens
ccaatgagactacacaattga

SEQ ID NO: 6380 - DNA, 23 bp, Homo sapiens
ctcccggccagccgccggcccgc

SEQ ID NO: 6381 - DNA, 17 bp, Homo sapiens
gtctgcagaggcgggga

SEQ ID NO: 6382 - DNA, 18 bp, Homo sapiens
tccgctgagcgctctttt

SEQ ID NO: 6383 - DNA, 21 bp, Homo sapiens
ttgatcaatattttcccagta

SEQ ID NO: 6384 - DNA, 18 bp, Homo sapiens
caccactgccctcccttc

SEQ ID NO: 6385 - DNA, 22 bp, Homo sapiens
ccagatccaaggtccctcaccc

SEQ ID NO: 6386 - DNA, 15 bp, Homo sapiens
ctggagcttgtcttg

SEQ ID NO: 6387 - DNA, 22 bp, Homo sapiens
tggaacactctggtccgcctca

SEQ ID NO: 6388 - DNA, 21 bp, Homo sapiens
gttttggcatgcctgcaggaa

SEQ ID NO: 6389 - DNA, 17 bp, Homo sapiens
ggctgaaaaagcccaca

SEQ ID NO: 6390 - DNA, 22 bp, Homo sapiens
aaacgctctctgctctgctttt

SEQ ID NO: 6391 - DNA, 20 bp, Homo sapiens
gcgggagcctccctgcctca

SEQ ID NO: 6392 - DNA, 21 bp, Homo sapiens
ggaaaaacccgtcaatgtact

SEQ ID NO: 6393 - DNA, 21 bp, Homo sapiens
cctcctggtggccttgccgcc

SEQ ID NO: 6394 - DNA, 21 bp, Homo sapiens
ccttggcgctggaccagtgag

SEQ ID NO: 6395 - DNA, 19 bp, Homo sapiens
atgacataccttgcttctt

SEQ ID NO: 6396 - DNA, 23 bp, Homo sapiens
ccccaccttctatctaagacaat

SEQ ID NO: 6397 - DNA, 19 bp, Homo sapiens
gcggcggacaggaacacca

SEQ ID NO: 6398 - DNA, 20 bp, Homo sapiens
gcttttcccctgcctgtgag

SEQ ID NO: 6399 - DNA, 23 bp, Homo sapiens
tggggagaccgagtgtggagctg

SEQ ID NO: 6400 - DNA, 22 bp, Homo sapiens
acagatccatccttttgcttca

SEQ ID NO: 6401 - DNA, 20 bp, Homo sapiens
cagagatggcagagccatcc

SEQ ID NO: 6402 - DNA, 21 bp, Homo sapiens
gaaaagcctccgcctgctcat

SEQ ID NO: 6403 - DNA, 19 bp, Homo sapiens
tgggtgggccccacagtgg

SEQ ID NO: 6404 - DNA, 17 bp, Homo sapiens
tcaagtgattctcctgc

SEQ ID NO: 6405 - DNA, 17 bp, Homo sapiens
ccttctcctatatgata

SEQ ID NO: 6406 - DNA, 20 bp, Homo sapiens
ccccgcccccgccccacagc

SEQ ID NO: 6407 - DNA, 19 bp, Homo sapiens
cctgcttcccaaactccca

SEQ ID NO: 6408 - DNA, 22 bp, Homo sapiens
ctgtggataacattgctagcga

SEQ ID NO: 6409 - DNA, 21 bp, Homo sapiens
cctgcgaagcgcctgggaagc

SEQ ID NO: 6410 - DNA, 17 bp, Homo sapiens
aaaaacaaacaaacaaa

SEQ ID NO: 6411 - DNA, 20 bp, Homo sapiens
cctctgcctcccaggttcaa

SEQ ID NO: 6412 - DNA, 19 bp, Homo sapiens
ctgcaacctctgcctccca

SEQ ID NO: 6413 - DNA, 18 bp, Homo sapiens
tccacctcgcaggttcaa

SEQ ID NO: 6414 - DNA, 21 bp, Homo sapiens
cacagccacacttccatctca

SEQ ID NO: 6415 - DNA, 17 bp, Homo sapiens
tcaagtgattctcctgc

SEQ ID NO: 6416 - DNA, 16 bp, Homo sapiens
tgcaacctccaccccc

SEQ ID NO: 6417 - DNA, 21 bp, Homo sapiens
tttaggtggtcttgaactcct

SEQ ID NO: 6418 - DNA, 18 bp, Homo sapiens
agcagatgctaaaccgtc

SEQ ID NO: 6419 - DNA, 21 bp, Homo sapiens
tcttttctcactgctttgact

SEQ ID NO: 6420 - DNA, 21 bp, Homo sapiens
ttgtttgatcaccaataaata

SEQ ID NO: 6421 - DNA, 19 bp, Homo sapiens
caggactgcagaacaccct

SEQ ID NO: 6422 - DNA, 22 bp, Homo sapiens
ctgacaattatgaaaaaatgtt

SEQ ID NO: 6423 - DNA, 21 bp, Homo sapiens
gtagtttttctgtcattgtta

SEQ ID NO: 6424 - DNA, 17 bp, Homo sapiens
caacctcgccccacccc

SEQ ID NO: 6425 - DNA, 18 bp, Homo sapiens
cttcccgcgctccggtgt

SEQ ID NO: 6426 - DNA, 18 bp, Homo sapiens
gacctacaacagctaaat

SEQ ID NO: 6427 - DNA, 21 bp, Homo sapiens
gacttaaaaattgtgtttaca

SEQ ID NO: 6428 - DNA, 20 bp, Homo sapiens
gtgtgtgtgggttctaatgg

SEQ ID NO: 6429 - DNA, 24 bp, Homo sapiens
taaaatgcacagaaatgcatgcaa

SEQ ID NO: 6430 - DNA, 22 bp, Homo sapiens
tcagcaccatcttcaggtgctt

SEQ ID NO: 6431 - DNA, 17 bp, Homo sapiens
actctcctttgctctct

SEQ ID NO: 6432 - DNA, 19 bp, Homo sapiens
ctctctgcttgcttggccc

SEQ ID NO: 6433 - DNA, 17 bp, Homo sapiens
ggtatacatcttcccct

SEQ ID NO: 6434 - DNA, 20 bp, Homo sapiens
tgactaggtgtcaccataca

SEQ ID NO: 6435 - DNA, 20 bp, Homo sapiens
aactcttgtagtttactgtt

SEQ ID NO: 6436 - DNA, 22 bp, Homo sapiens
cctgtggacgaccatctgccag

SEQ ID NO: 6437 - DNA, 23 bp, Homo sapiens
cgaggggtggggctgggtttagt

SEQ ID NO: 6438 - DNA, 20 bp, Homo sapiens
tcatcgctcttgccaaataa

SEQ ID NO: 6439 - DNA, 20 bp, Homo sapiens
ccccgcccccgccccgctgc

SEQ ID NO: 6440 - DNA, 20 bp, Homo sapiens
ggaacgcccccgcccccgcc

SEQ ID NO: 6441 - DNA, 18 bp, Homo sapiens
agtaaatggtagtgtgtc

SEQ ID NO: 6442 - DNA, 21 bp, Homo sapiens
ctgtgattactctttgctttg

SEQ ID NO: 6443 - DNA, 18 bp, Homo sapiens
gcttccttctgtcattcc

SEQ ID NO: 6444 - DNA, 23 bp, Homo sapiens
tcagcatagtgactaaactacat

SEQ ID NO: 6445 - DNA, 21 bp, Homo sapiens
acctgctacagtgagctgcca

SEQ ID NO: 6446 - DNA, 18 bp, Homo sapiens
attccagctatggagcta

SEQ ID NO: 6447 - DNA, 19 bp, Homo sapiens
cagtcccagacagaaccta

SEQ ID NO: 6448 - DNA, 21 bp, Homo sapiens
cgcacacctgtattcccatct

SEQ ID NO: 6449 - DNA, 22 bp, Homo sapiens
gcccggcggcagggcccggcga

SEQ ID NO: 6450 - DNA, 19 bp, Homo sapiens
tgatgtgactgcttagccc

SEQ ID NO: 6451 - DNA, 20 bp, Homo sapiens
gccaaaagatttaaacctgt

SEQ ID NO: 6452 - DNA, 21 bp, Homo sapiens
acttggatcttcccttggtcc

SEQ ID NO: 6453 - DNA, 22 bp, Homo sapiens
agaattgtagttcttagtccca

SEQ ID NO: 6454 - DNA, 17 bp, Homo sapiens
agagggagacagagatg

SEQ ID NO: 6455 - DNA, 24 bp, Homo sapiens
agttctctttcttagtccctaatc

SEQ ID NO: 6456 - DNA, 20 bp, Homo sapiens
cagcacagccttgatttcct

SEQ ID NO: 6457 - DNA, 19 bp, Homo sapiens
gaaagaaacccacagaagg

SEQ ID NO: 6458 - DNA, 20 bp, Homo sapiens
gaatctggacatttgttcca

SEQ ID NO: 6459 - DNA, 18 bp, Homo sapiens
gagcaaaacattgggcca

SEQ ID NO: 6460 - DNA, 18 bp, Homo sapiens
ggcttaagtaccaatctc

SEQ ID NO: 6461 - DNA, 20 bp, Homo sapiens
tcaagacttctccaggccca

SEQ ID NO: 6462 - DNA, 23 bp, Homo sapiens
tctccttgatttttggtagtatc

SEQ ID NO: 6463 - DNA, 19 bp, Homo sapiens
tgcattgagaaggaactga

SEQ ID NO: 6464 - DNA, 17 bp, Homo sapiens
ttctcccgttaaccagg

SEQ ID NO: 6465 - DNA, 18 bp, Homo sapiens
ccaaacgcaccccggcga

SEQ ID NO: 6466 - DNA, 22 bp, Homo sapiens
taaattaatgagttttatccaa

SEQ ID NO: 6467 - DNA, 18 bp, Homo sapiens
tggggcttggcgtggagc

SEQ ID NO: 6468 - DNA, 16 bp, Homo sapiens
tgcaccgccgagcttc

SEQ ID NO: 6469 - DNA, 24 bp, Homo sapiens
aaagaaatccccccttcagaacag

SEQ ID NO: 6470 - DNA, 20 bp, Homo sapiens
ctgggtctgggtttggatct

SEQ ID NO: 6471 - DNA, 19 bp, Homo sapiens
caccattcccacccaccct

SEQ ID NO: 6472 - DNA, 17 bp, Homo sapiens
cacctctgtttcctctt

SEQ ID NO: 6473 - DNA, 21 bp, Homo sapiens
ccaccattcccacccaccctc

SEQ ID NO: 6474 - DNA, 19 bp, Homo sapiens
ctctgtttcctcttcccct

SEQ ID NO: 6475 - DNA, 21 bp, Homo sapiens
gttccactccactttgtatag

SEQ ID NO: 6476 - DNA, 21 bp, Homo sapiens
tcctcttcccctttctcctcg

SEQ ID NO: 6477 - DNA, 18 bp, Homo sapiens
aaacaccaccaaatgaca

SEQ ID NO: 6478 - DNA, 19 bp, Homo sapiens
aacctaaggcaacatttcc

SEQ ID NO: 6479 - DNA, 23 bp, Homo sapiens
atgctgccaaccagcttgtccaa

SEQ ID NO: 6480 - DNA, 18 bp, Homo sapiens
ctgcccccgcctaccccg

SEQ ID NO: 6481 - DNA, 19 bp, Homo sapiens
tctgaaaactgtttatggt

SEQ ID NO: 6482 - DNA, 17 bp, Homo sapiens
gacgcaatgtgaaactg

SEQ ID NO: 6483 - DNA, 19 bp, Homo sapiens
ttctctactaaaaatacaa

SEQ ID NO: 6484 - DNA, 15 bp, Homo sapiens
tcactgtccttgcca

SEQ ID NO: 6485 - DNA, 19 bp, Homo sapiens
cctgcccttacctgccagg

SEQ ID NO: 6486 - DNA, 18 bp, Homo sapiens
tccctctggggctgttca

SEQ ID NO: 6487 - DNA, 19 bp, Homo sapiens
tggtcctaatcttctgaac

SEQ ID NO: 6488 - DNA, 18 bp, Homo sapiens
acagagaggggaatactt

SEQ ID NO: 6489 - DNA, 18 bp, Homo sapiens
cacttcatagcaccaaca

SEQ ID NO: 6490 - DNA, 18 bp, Homo sapiens
cacttgcacccatgtgta

SEQ ID NO: 6491 - DNA, 20 bp, Homo sapiens
ccaacatgctcactccctta

SEQ ID NO: 6492 - DNA, 19 bp, Homo sapiens
gaagaagggactggacatt

SEQ ID NO: 6493 - DNA, 20 bp, Homo sapiens
gaacttcacagcccgagtga

SEQ ID NO: 6494 - DNA, 15 bp, Homo sapiens
cacacattattaaca

SEQ ID NO: 6495 - DNA, 21 bp, Homo sapiens
ccaggccagacccatcccaaa

SEQ ID NO: 6496 - DNA, 18 bp, Homo sapiens
gctgctgatttctcagcc

SEQ ID NO: 6497 - DNA, 22 bp, Homo sapiens
gtgtcttggctgtcataacttt

SEQ ID NO: 6498 - DNA, 20 bp, Homo sapiens
gttttatacatcattgtcat

SEQ ID NO: 6499 - DNA, 22 bp, Homo sapiens
tctgctatttgctgttgtgtaa

SEQ ID NO: 6500 - DNA, 19 bp, Homo sapiens
tcttggctgtcataacttt

SEQ ID NO: 6501 - DNA, 22 bp, Homo sapiens
ttttttcttgctgttttgattt

SEQ ID NO: 6502 - DNA, 23 bp, Homo sapiens
caagaacctgcgtcttggaccat

SEQ ID NO: 6503 - DNA, 19 bp, Homo sapiens
cgcctgcccctcctgccga

SEQ ID NO: 6504 - DNA, 20 bp, Homo sapiens
ctctgtctgtctccagccct

SEQ ID NO: 6505 - DNA, 25 bp, Homo sapiens
cttgggtcccaccagtgtcactttt

SEQ ID NO: 6506 - DNA, 25 bp, Homo sapiens
ccccgcccctctgtctccccgcagc

SEQ ID NO: 6507 - DNA, 20 bp, Homo sapiens
ccctgaataaagttttgtgg

SEQ ID NO: 6508 - DNA, 19 bp, Homo sapiens
ctccccgcccctctgtctc

SEQ ID NO: 6509 - DNA, 19 bp, Homo sapiens
gaagagcttctgtatagta

SEQ ID NO: 6510 - DNA, 21 bp, Homo sapiens
tcctttcttcctcttgcctcg

SEQ ID NO: 6511 - DNA, 20 bp, Homo sapiens
tggttttgaccgtgggacta

SEQ ID NO: 6512 - DNA, 20 bp, Homo sapiens
ttccagaattatttattcca

SEQ ID NO: 6513 - DNA, 20 bp, Homo sapiens
ttttcctgtttttttgcatg

SEQ ID NO: 6514 - DNA, 24 bp, Homo sapiens
acctggcataggactctttggtcc

SEQ ID NO: 6515 - DNA, 17 bp, Homo sapiens
actgacatcagcactgc

SEQ ID NO: 6516 - DNA, 20 bp, Homo sapiens
cactgccaacttggctgcaa

SEQ ID NO: 6517 - DNA, 24 bp, Homo sapiens
ctccagcgccgccgccgccaccgc

SEQ ID NO: 6518 - DNA, 17 bp, Homo sapiens
tttgactgatcagtgtg

SEQ ID NO: 6519 - DNA, 20 bp, Homo sapiens
agtggatgggtgtgtgtgtg

SEQ ID NO: 6520 - DNA, 19 bp, Homo sapiens
gggttttttgtcttctgtt

SEQ ID NO: 6521 - DNA, 19 bp, Homo sapiens
aagggaagaaacactctta

SEQ ID NO: 6522 - DNA, 23 bp, Homo sapiens
gtcggtttgcccagtatcactta

SEQ ID NO: 6523 - DNA, 22 bp, Homo sapiens
ctcgattaaaaagggagtgagc

SEQ ID NO: 6524 - DNA, 21 bp, Homo sapiens
ctggtaagcaaaaactagtaa

SEQ ID NO: 6525 - DNA, 22 bp, Homo sapiens
gagccaagatcacgccactgca

SEQ ID NO: 6526 - DNA, 23 bp, Homo sapiens
gtgcatttttatctgtgagttct

SEQ ID NO: 6527 - DNA, 23 bp, Homo sapiens
tgagccctcctggaatggagctg

SEQ ID NO: 6528 - DNA, 22 bp, Homo sapiens
ccaaatgtgtggaggtctgtgg

SEQ ID NO: 6529 - DNA, 19 bp, Homo sapiens
cctgtacccttccttcttc

SEQ ID NO: 6530 - DNA, 19 bp, Homo sapiens
cgcccgcctcagcatccca

SEQ ID NO: 6531 - DNA, 26 bp, Homo sapiens
atctgaatttctaaaacccttggtct

SEQ ID NO: 6532 - DNA, 20 bp, Homo sapiens
atggtgtcctgcatgtatgc

SEQ ID NO: 6533 - DNA, 19 bp, Homo sapiens
cttgccccttacctgccga

SEQ ID NO: 6534 - DNA, 21 bp, Homo sapiens
gcagctcagcgcaccgactgc

SEQ ID NO: 6535 - DNA, 21 bp, Homo sapiens
gcagctcagcgcaccgactgc

SEQ ID NO: 6536 - DNA, 18 bp, Homo sapiens
tcctcaagttgtgtgcta

SEQ ID NO: 6537 - DNA, 19 bp, Homo sapiens
gatccagctgaaggactga

SEQ ID NO: 6538 - DNA, 19 bp, Homo sapiens
gtgaggctgcagcctcaga

SEQ ID NO: 6539 - DNA, 21 bp, Homo sapiens
aggtgtcagttattgtttcca

SEQ ID NO: 6540 - DNA, 20 bp, Homo sapiens
ataatggcctccttgttcac

SEQ ID NO: 6541 - DNA, 19 bp, Homo sapiens
ccagtgcaggaacccggtg

SEQ ID NO: 6542 - DNA, 20 bp, Homo sapiens
cgtccgtcacagccatgttc

SEQ ID NO: 6543 - DNA, 17 bp, Homo sapiens
gcgccctggctgtgctg

SEQ ID NO: 6544 - DNA, 18 bp, Homo sapiens
tcattttcccctgcagct

SEQ ID NO: 6545 - DNA, 19 bp, Homo sapiens
tctgcttttgccgcgtggt

SEQ ID NO: 6546 - DNA, 20 bp, Homo sapiens
tgatcttggctgtggtttaa

SEQ ID NO: 6547 - DNA, 24 bp, Homo sapiens
accccagggagcccatccgacctc

SEQ ID NO: 6548 - DNA, 19 bp, Homo sapiens
atcactcccttgccgtcca

SEQ ID NO: 6549 - DNA, 19 bp, Homo sapiens
cggggccctcatctgcttt

SEQ ID NO: 6550 - DNA, 18 bp, Homo sapiens
gcgacccagcgcccccgc

SEQ ID NO: 6551 - DNA, 20 bp, Homo sapiens
aagtttaattagacacttca

SEQ ID NO: 6552 - DNA, 21 bp, Homo sapiens
agtggcggtggctataccatg

SEQ ID NO: 6553 - DNA, 16 bp, Homo sapiens
caccatgcctagcaaa

SEQ ID NO: 6554 - DNA, 18 bp, Homo sapiens
cccgaagaggactacagc

SEQ ID NO: 6555 - DNA, 19 bp, Homo sapiens
cttgagtgggccctgtgag

SEQ ID NO: 6556 - DNA, 22 bp, Homo sapiens
cctgtacctcagtggatcttca

SEQ ID NO: 6557 - DNA, 16 bp, Homo sapiens
ctttctctctcctctc

SEQ ID NO: 6558 - DNA, 16 bp, Homo sapiens
cagcaggggtgtgatg

SEQ ID NO: 6559 - DNA, 20 bp, Homo sapiens
ttcaggttctcatgatacca

SEQ ID NO: 6560 - DNA, 20 bp, Homo sapiens
ttggaataaggcatggctca

SEQ ID NO: 6561 - DNA, 20 bp, Homo sapiens
aaaaagggcaataaatgccc

SEQ ID NO: 6562 - DNA, 23 bp, Homo sapiens
acttgagcctccatttctggctt

SEQ ID NO: 6563 - DNA, 20 bp, Homo sapiens
atgccgctcttctgtcatcc

SEQ ID NO: 6564 - DNA, 18 bp, Homo sapiens
ccaaattcatgtacagca

SEQ ID NO: 6565 - DNA, 21 bp, Homo sapiens
cctccagctggaattgctgct

SEQ ID NO: 6566 - DNA, 18 bp, Homo sapiens
gcctgcccccagcactcc

SEQ ID NO: 6567 - DNA, 23 bp, Homo sapiens
tggtctccctccagctggaattg

SEQ ID NO: 6568 - DNA, 19 bp, Homo sapiens
acgaattaattacctggca

SEQ ID NO: 6569 - DNA, 18 bp, Homo sapiens
caggggggcagtaactcc

SEQ ID NO: 6570 - DNA, 17 bp, Homo sapiens
ccccacccagtcctgca

SEQ ID NO: 6571 - DNA, 23 bp, Homo sapiens
ccctgatgctgccaggcctggga

SEQ ID NO: 6572 - DNA, 23 bp, Homo sapiens
ccttgggagcaggtgcttgtgga

SEQ ID NO: 6573 - DNA, 20 bp, Homo sapiens
gcagaggaccttgggttccc

SEQ ID NO: 6574 - DNA, 18 bp, Homo sapiens
gcttgtggacaaggctcc

SEQ ID NO: 6575 - DNA, 24 bp, Homo sapiens
tgcaatggctcaaacaacattcca

SEQ ID NO: 6576 - DNA, 23 bp, Homo sapiens
tttcttgaggttgtctgagtctt

SEQ ID NO: 6577 - DNA, 20 bp, Homo sapiens
accccagtgtccacttttgg

SEQ ID NO: 6578 - DNA, 17 bp, Homo sapiens
cctagcctcccagcaaa

SEQ ID NO: 6579 - DNA, 20 bp, Homo sapiens
gacggggttctttccagtcc

SEQ ID NO: 6580 - DNA, 18 bp, Homo sapiens
cccagcgccccctgcagc

SEQ ID NO: 6581 - DNA, 23 bp, Homo sapiens
ccgaacgtccgcccgcggtgggc

SEQ ID NO: 6582 - DNA, 21 bp, Homo sapiens
ctctccttcctttagcccgct

SEQ ID NO: 6583 - DNA, 19 bp, Homo sapiens
gcaccacgcccgggacccc

SEQ ID NO: 6584 - DNA, 18 bp, Homo sapiens
tgcaaggggaaaatctca

SEQ ID NO: 6585 - DNA, 20 bp, Homo sapiens
aaacccagccctcacagctc

SEQ ID NO: 6586 - DNA, 24 bp, Homo sapiens
cagaagaatggcatgaacctggga

SEQ ID NO: 6587 - DNA, 19 bp, Homo sapiens
ctcagagtgcttctaatca

SEQ ID NO: 6588 - DNA, 22 bp, Homo sapiens
gagccaagatcatgccactgca

SEQ ID NO: 6589 - DNA, 22 bp, Homo sapiens
aactctgcatgtcagtagacag

SEQ ID NO: 6590 - DNA, 18 bp, Homo sapiens
catgttatacgtacactt

SEQ ID NO: 6591 - DNA, 23 bp, Homo sapiens
ctgttccacagtcctgtattcca

SEQ ID NO: 6592 - DNA, 20 bp, Homo sapiens
tccttatgggtatgctgtgg

SEQ ID NO: 6593 - DNA, 17 bp, Homo sapiens
tctctactaaagtacaa

SEQ ID NO: 6594 - DNA, 17 bp, Homo sapiens
ttatgtttatactgcca

SEQ ID NO: 6595 - DNA, 20 bp, Homo sapiens
cccgcttggggcatttgtgg

SEQ ID NO: 6596 - DNA, 24 bp, Homo sapiens
cttttctcttgccccaaatcacaa

SEQ ID NO: 6597 - DNA, 19 bp, Homo sapiens
gaacgttttaaagcttacc

SEQ ID NO: 6598 - DNA, 24 bp, Homo sapiens
gtgtagtttctggtatcgttcgct

SEQ ID NO: 6599 - DNA, 19 bp, Homo sapiens
tgtttgtttggcactgatg

SEQ ID NO: 6600 - DNA, 20 bp, Homo sapiens
aaaaagttacagaaatacta

SEQ ID NO: 6601 - DNA, 22 bp, Homo sapiens
aaacagttgtgaaccaagatct

SEQ ID NO: 6602 - DNA, 18 bp, Homo sapiens
taatatcattcactagct

SEQ ID NO: 6603 - DNA, 18 bp, Homo sapiens
tcttgctctatctctcaa

SEQ ID NO: 6604 - DNA, 19 bp, Homo sapiens
aaactcctgacctcaggtg

SEQ ID NO: 6605 - DNA, 18 bp, Homo sapiens
agcaattctcctgcctca

SEQ ID NO: 6606 - DNA, 22 bp, Homo sapiens
ctggtggtttttgctctcgaca

SEQ ID NO: 6607 - DNA, 21 bp, Homo sapiens
cctagcagggaaaaatacaca

SEQ ID NO: 6608 - DNA, 22 bp, Homo sapiens
taaatggattccaatatcggga

SEQ ID NO: 6609 - DNA, 20 bp, Homo sapiens
cccaccttcacccgcccacc

SEQ ID NO: 6610 - DNA, 19 bp, Homo sapiens
ctctagacaaaatccatca

SEQ ID NO: 6611 - DNA, 18 bp, Homo sapiens
ctgttttgctcctaccca

SEQ ID NO: 6612 - DNA, 23 bp, Homo sapiens
gcgagggggcgcccctctgggta

SEQ ID NO: 6613 - DNA, 17 bp, Homo sapiens
aacgggaggatggcttc

SEQ ID NO: 6614 - DNA, 18 bp, Homo sapiens
caacccagccctgcttct

SEQ ID NO: 6615 - DNA, 17 bp, Homo sapiens
catcctcccaaggctcc

SEQ ID NO: 6616 - DNA, 21 bp, Homo sapiens
gctgccttcagccctgtgacg

SEQ ID NO: 6617 - DNA, 21 bp, Homo sapiens
gcttcatgtgactcttggcct

SEQ ID NO: 6618 - DNA, 23 bp, Homo sapiens
atgacacagttttgtatatagaa

SEQ ID NO: 6619 - DNA, 20 bp, Homo sapiens
ccgctcatttgcagtggctc

SEQ ID NO: 6620 - DNA, 18 bp, Homo sapiens
cctcagcttagcatcaca

SEQ ID NO: 6621 - DNA, 21 bp, Homo sapiens
gaagtactcacacatgccaca

SEQ ID NO: 6622 - DNA, 23 bp, Homo sapiens
tcacaatgagattccagtttaca

SEQ ID NO: 6623 - DNA, 18 bp, Homo sapiens
tttctttatactagcaac

SEQ ID NO: 6624 - DNA, 17 bp, Homo sapiens
actgggttccatgtgat

SEQ ID NO: 6625 - DNA, 22 bp, Homo sapiens
cttactttgtgggttcttttaa

SEQ ID NO: 6626 - DNA, 17 bp, Homo sapiens
tccatgattgattcagt

SEQ ID NO: 6627 - DNA, 21 bp, Homo sapiens
ttctgttggtatcacagaaga

SEQ ID NO: 6628 - DNA, 17 bp, Homo sapiens
cgggggctgcacaccca

SEQ ID NO: 6629 - DNA, 23 bp, Homo sapiens
ggaagaggagctggtggctgcca

SEQ ID NO: 6630 - DNA, 22 bp, Homo sapiens
tggcctgttcaaggcagaacca

SEQ ID NO: 6631 - DNA, 18 bp, Homo sapiens
ccaggtctacttgcctaa

SEQ ID NO: 6632 - DNA, 20 bp, Homo sapiens
gtatggatgtcactcaacta

SEQ ID NO: 6633 - DNA, 21 bp, Homo sapiens
tgatacatcctgccaacactg

SEQ ID NO: 6634 - DNA, 16 bp, Homo sapiens
ccccaccatctctgaa

SEQ ID NO: 6635 - DNA, 20 bp, Homo sapiens
tgcactccagcctggggctg

SEQ ID NO: 6636 - DNA, 21 bp, Homo sapiens
ctttctcctccctctgcccct

SEQ ID NO: 6637 - DNA, 18 bp, Homo sapiens
agcacagcgcttcgctct

SEQ ID NO: 6638 - DNA, 23 bp, Homo sapiens
gtttttactttctgttgccacaa

SEQ ID NO: 6639 - DNA, 22 bp, Homo sapiens
gctctgggaacagaggacactg

SEQ ID NO: 6640 - DNA, 18 bp, Homo sapiens
cttgaaaatcagattcta

SEQ ID NO: 6641 - DNA, 23 bp, Homo sapiens
aaaccttttccttttcccttctt

SEQ ID NO: 6642 - DNA, 20 bp, Homo sapiens
cagataagagaagcctgttt

SEQ ID NO: 6643 - DNA, 21 bp, Homo sapiens
gactatcccaaggttatttta

SEQ ID NO: 6644 - DNA, 18 bp, Homo sapiens
tatagagaaaaaaatttt

SEQ ID NO: 6645 - DNA, 22 bp, Homo sapiens
tatcctgactaaaaaaatttca

SEQ ID NO: 6646 - DNA, 19 bp, Homo sapiens
tggttagcatgtttagcaa

SEQ ID NO: 6647 - DNA, 20 bp, Homo sapiens
tgtggatatttctccatcct

SEQ ID NO: 6648 - DNA, 22 bp, Homo sapiens
ttgctgaattaaatatttatga

SEQ ID NO: 6649 - DNA, 18 bp, Homo sapiens
ccgttcgcgaaacagctt

SEQ ID NO: 6650 - DNA, 24 bp, Homo sapiens
tgacaaaactaaagaactctccta

SEQ ID NO: 6651 - DNA, 18 bp, Homo sapiens
cacttcacacttgtttta

SEQ ID NO: 6652 - DNA, 20 bp, Homo sapiens
catgttatgctaggtgcaca

SEQ ID NO: 6653 - DNA, 26 bp, Homo sapiens
cccataaatgggtaacatattcctaa

SEQ ID NO: 6654 - DNA, 22 bp, Homo sapiens
gccaccactgtaccttgagcaa

SEQ ID NO: 6655 - DNA, 24 bp, Homo sapiens
taaatgggttgccaacataagctg

SEQ ID NO: 6656 - DNA, 22 bp, Homo sapiens
tacttccttaaagtaaatgtaa

SEQ ID NO: 6657 - DNA, 22 bp, Homo sapiens
tcacacttgttttattttcttt

SEQ ID NO: 6658 - DNA, 23 bp, Homo sapiens
gcctgtgggcgcatactacagta

SEQ ID NO: 6659 - DNA, 20 bp, Homo sapiens
attttgaaattgttccctgg

SEQ ID NO: 6660 - DNA, 19 bp, Homo sapiens
aaatcgacagccactgaga

SEQ ID NO: 6661 - DNA, 18 bp, Homo sapiens
ccatggcacaccgagcgg

SEQ ID NO: 6662 - DNA, 16 bp, Homo sapiens
ctatgttatctgagta

SEQ ID NO: 6663 - DNA, 22 bp, Homo sapiens
ggtttgttataacaacctctgc

SEQ ID NO: 6664 - DNA, 25 bp, Homo sapiens
gtctggcagacaggttgcctgaccc

SEQ ID NO: 6665 - DNA, 18 bp, Homo sapiens
agatggatccacgtgctc

SEQ ID NO: 6666 - DNA, 18 bp, Homo sapiens
caccattctcctgcctca

SEQ ID NO: 6667 - DNA, 24 bp, Homo sapiens
cattcagcagtcagtcccccaata

SEQ ID NO: 6668 - DNA, 18 bp, Homo sapiens
ccagaaggctgggtccag

SEQ ID NO: 6669 - DNA, 18 bp, Homo sapiens
cggcactccagcctgggc

SEQ ID NO: 6670 - DNA, 20 bp, Homo sapiens
tcaccacaacctccacctcc

SEQ ID NO: 6671 - DNA, 19 bp, Homo sapiens
agatataacattcagttcc

SEQ ID NO: 6672 - DNA, 20 bp, Homo sapiens
ccaaatatgtattttcctaa

SEQ ID NO: 6673 - DNA, 20 bp, Homo sapiens
cttctaaccccctctgctct

SEQ ID NO: 6674 - DNA, 23 bp, Homo sapiens
gcctgatcttgcctgtctggctc

SEQ ID NO: 6675 - DNA, 19 bp, Homo sapiens
gggatccttgggcccatca

SEQ ID NO: 6676 - DNA, 18 bp, Homo sapiens
gtttcctggaaaagaaga

SEQ ID NO: 6677 - DNA, 26 bp, Homo sapiens
tacaatcagttgactttaagtgaaag

SEQ ID NO: 6678 - DNA, 22 bp, Homo sapiens
tcccctcttctgctaatacctc

SEQ ID NO: 6679 - DNA, 18 bp, Homo sapiens
tcctggtttgactcagtt

SEQ ID NO: 6680 - DNA, 26 bp, Homo sapiens
ttctggccaaggggtgggcctgtgaa

SEQ ID NO: 6681 - DNA, 21 bp, Homo sapiens
aaacaataatttgaaatttct

SEQ ID NO: 6682 - DNA, 19 bp, Homo sapiens
agaaatagtcaatatgctt

SEQ ID NO: 6683 - DNA, 17 bp, Homo sapiens
atcacctgtaaaagctt

SEQ ID NO: 6684 - DNA, 21 bp, Homo sapiens
gtgtcaagcactgtgggtttt

SEQ ID NO: 6685 - DNA, 22 bp, Homo sapiens
taaacctcagctcaggactgct

SEQ ID NO: 6686 - DNA, 18 bp, Homo sapiens
cacctgccctcccgggca

SEQ ID NO: 6687 - DNA, 18 bp, Homo sapiens
ccccatcctcagaactca

SEQ ID NO: 6688 - DNA, 19 bp, Homo sapiens
gcccccacccccggcctca

SEQ ID NO: 6689 - DNA, 24 bp, Homo sapiens
gtgcacctgttactgttgggcttt

SEQ ID NO: 6690 - DNA, 20 bp, Homo sapiens
tcaacctcccccctgcctcg

SEQ ID NO: 6691 - DNA, 22 bp, Homo sapiens
aaggggggaccagaattcccca

SEQ ID NO: 6692 - DNA, 20 bp, Homo sapiens
atgacataactacacagtta

SEQ ID NO: 6693 - DNA, 18 bp, Homo sapiens
gacattttctagctactt

SEQ ID NO: 6694 - DNA, 18 bp, Homo sapiens
ttgttcaatcactatgaa

SEQ ID NO: 6695 - DNA, 18 bp, Homo sapiens
cagctgttcgaatcatct

SEQ ID NO: 6696 - DNA, 22 bp, Homo sapiens
gcagctgttcgaatcatctgat

SEQ ID NO: 6697 - DNA, 21 bp, Homo sapiens
agcttcttaagttaaatcact

SEQ ID NO: 6698 - DNA, 17 bp, Homo sapiens
cagtcctttaaccagca

SEQ ID NO: 6699 - DNA, 18 bp, Homo sapiens
ctaatgggagccaattca

SEQ ID NO: 6700 - DNA, 19 bp, Homo sapiens
tgtcagtcaactgctgtta

SEQ ID NO: 6701 - DNA, 20 bp, Homo sapiens
tgttgggatggaagcatgaa

SEQ ID NO: 6702 - DNA, 24 bp, Homo sapiens
aagaaaccgctgataaccaggaca

SEQ ID NO: 6703 - DNA, 20 bp, Homo sapiens
ccagggctcctctagcctca

SEQ ID NO: 6704 - DNA, 18 bp, Homo sapiens
cctgtctctcaccaacaa

SEQ ID NO: 6705 - DNA, 20 bp, Homo sapiens
ttcataccacattcacatct

SEQ ID NO: 6706 - DNA, 20 bp, Homo sapiens
tttttatttttgcttttaaa

SEQ ID NO: 6707 - DNA, 17 bp, Homo sapiens
gcgtgtactaccccagg

SEQ ID NO: 6708 - DNA, 17 bp, Homo sapiens
gcgtgtactaccccagg

SEQ ID NO: 6709 - DNA, 17 bp, Homo sapiens
gcgtgtactaccccagg

SEQ ID NO: 6710 - DNA, 17 bp, Homo sapiens
gcgtgtactaccccagg

SEQ ID NO: 6711 - DNA, 17 bp, Homo sapiens
gcgtgtactaccccagg

SEQ ID NO: 6712 - DNA, 18 bp, Homo sapiens
gttgtccgtgtctgttga

SEQ ID NO: 6713 - DNA, 24 bp, Homo sapiens
tgtctgttgaccaatctctattca

SEQ ID NO: 6714 - DNA, 19 bp, Homo sapiens
accgggtgacatcaccggg

SEQ ID NO: 6715 - DNA, 23 bp, Homo sapiens
ctccccctatagggctggaatct

SEQ ID NO: 6716 - DNA, 20 bp, Homo sapiens
ctgggtaataactgctgata

SEQ ID NO: 6717 - DNA, 22 bp, Homo sapiens
tttcagttgtctttaacaacat

SEQ ID NO: 6718 - DNA, 18 bp, Homo sapiens
aacaatgtcagtgttaaa

SEQ ID NO: 6719 - DNA, 21 bp, Homo sapiens
atgccacccttttggaagccc

SEQ ID NO: 6720 - DNA, 17 bp, Homo sapiens
cattttcccaactattc

SEQ ID NO: 6721 - DNA, 20 bp, Homo sapiens
ctggcaattccaaacaatgt

SEQ ID NO: 6722 - DNA, 20 bp, Homo sapiens
taacagtatgtcaccacttc

SEQ ID NO: 6723 - DNA, 18 bp, Homo sapiens
ttgggttcagtctcatgc

SEQ ID NO: 6724 - DNA, 19 bp, Homo sapiens
agcgcccctcccgcgcctt

SEQ ID NO: 6725 - DNA, 18 bp, Homo sapiens
cctgcaacctccacctcc

SEQ ID NO: 6726 - DNA, 18 bp, Homo sapiens
ggtatacaaattcctcca

SEQ ID NO: 6727 - DNA, 21 bp, Homo sapiens
gtgcctcagcctcccgagcag

SEQ ID NO: 6728 - DNA, 17 bp, Homo sapiens
tcaagcgattctcgtgc

SEQ ID NO: 6729 - DNA, 18 bp, Homo sapiens
tccacctcccgggttcaa

SEQ ID NO: 6730 - DNA, 18 bp, Homo sapiens
tccgcctcccgggttcaa

SEQ ID NO: 6731 - DNA, 20 bp, Homo sapiens
tggccaggctggtcttgaac

SEQ ID NO: 6732 - DNA, 25 bp, Homo sapiens
aggaataaagttgctgattcattcc

SEQ ID NO: 6733 - DNA, 20 bp, Homo sapiens
accctggaatcaagatgtca

SEQ ID NO: 6734 - DNA, 21 bp, Homo sapiens
gaaatcgtttgaacccgggaa

SEQ ID NO: 6735 - DNA, 19 bp, Homo sapiens
tccgccttcactccggtgt

SEQ ID NO: 6736 - DNA, 19 bp, Homo sapiens
ccaataaagctcggttcct

SEQ ID NO: 6737 - DNA, 18 bp, Homo sapiens
caactttcccaatgtggc

SEQ ID NO: 6738 - DNA, 22 bp, Homo sapiens
ctttcaggtactaaatacctca

SEQ ID NO: 6739 - DNA, 18 bp, Homo sapiens
tatagacaaataataagc

SEQ ID NO: 6740 - DNA, 19 bp, Homo sapiens
cacgtgcctgtggctgcag

SEQ ID NO: 6741 - DNA, 21 bp, Homo sapiens
cttaaacagatgcaaatccta

SEQ ID NO: 6742 - DNA, 23 bp, Homo sapiens
ctgttccacagtcctgtattcca

SEQ ID NO: 6743 - DNA, 22 bp, Homo sapiens
cagtgacttgtccaagtttaca

SEQ ID NO: 6744 - DNA, 20 bp, Homo sapiens
catgcgcatctccatgtctg

SEQ ID NO: 6745 - DNA, 17 bp, Homo sapiens
gctgagcaactgaacct

SEQ ID NO: 6746 - DNA, 17 bp, Homo sapiens
ggatcccactctgattg

SEQ ID NO: 6747 - DNA, 18 bp, Homo sapiens
acttgaaagactgcaata

SEQ ID NO: 6748 - DNA, 21 bp, Homo sapiens
gactgcaatagaaaactccca

SEQ ID NO: 6749 - DNA, 18 bp, Homo sapiens
gctatgggaaggctgcaa

SEQ ID NO: 6750 - DNA, 20 bp, Homo sapiens
gcttctctcttggccctgct

SEQ ID NO: 6751 - DNA, 16 bp, Homo sapiens
tgctttgccttgctgc

SEQ ID NO: 6752 - DNA, 18 bp, Homo sapiens
caccatgaggccaccctg

SEQ ID NO: 6753 - DNA, 21 bp, Homo sapiens
tcgctccggccacgtccaaca

SEQ ID NO: 6754 - DNA, 19 bp, Homo sapiens
atataacacggctaaaatg

SEQ ID NO: 6755 - DNA, 22 bp, Homo sapiens
catgctttttgttagagcttat

SEQ ID NO: 6756 - DNA, 20 bp, Homo sapiens
ccctcgcgccccgccgcagc

SEQ ID NO: 6757 - DNA, 24 bp, Homo sapiens
gaagtttttacagtatatgacata

SEQ ID NO: 6758 - DNA, 20 bp, Homo sapiens
gcttctgtaatcactcatcc

SEQ ID NO: 6759 - DNA, 17 bp, Homo sapiens
gtcagtttaattgccag

SEQ ID NO: 6760 - DNA, 20 bp, Homo sapiens
tgacacaggatgctacatgc

SEQ ID NO: 6761 - DNA, 22 bp, Homo sapiens
caaggcagacgtcgtacccagc

SEQ ID NO: 6762 - DNA, 22 bp, Homo sapiens
cattacccacgtgacaccaccg

SEQ ID NO: 6763 - DNA, 17 bp, Homo sapiens
gtgaccatagcccactg

SEQ ID NO: 6764 - DNA, 20 bp, Homo sapiens
tggaatccatctgtctccct

SEQ ID NO: 6765 - DNA, 20 bp, Homo sapiens
gagctgtgtgcttgcgggtg

SEQ ID NO: 6766 - DNA, 19 bp, Homo sapiens
gcctgctgagccggctgcc

SEQ ID NO: 6767 - DNA, 22 bp, Homo sapiens
ccaatgtacataccttgttata

SEQ ID NO: 6768 - DNA, 18 bp, Homo sapiens
ggaggcggcggcggcggc

SEQ ID NO: 6769 - DNA, 23 bp, Homo sapiens
taacttaatggcacaaagtctta

SEQ ID NO: 6770 - DNA, 24 bp, Homo sapiens
cagcaccctcagatgatttccctc

SEQ ID NO: 6771 - DNA, 17 bp, Homo sapiens
cagccatcctcccatcc

SEQ ID NO: 6772 - DNA, 23 bp, Homo sapiens
cggtcttgattaggtttcagtca

SEQ ID NO: 6773 - DNA, 20 bp, Homo sapiens
ctgaactgtggctactgtgc

SEQ ID NO: 6774 - DNA, 19 bp, Homo sapiens
gccagctgcctcttcttta

SEQ ID NO: 6775 - DNA, 19 bp, Homo sapiens
gcccccatgcccctctgag

SEQ ID NO: 6776 - DNA, 19 bp, Homo sapiens
tatgtgtcccttgataaca

SEQ ID NO: 6777 - DNA, 19 bp, Homo sapiens
gcgcccagcgtgcacggga

SEQ ID NO: 6778 - DNA, 22 bp, Homo sapiens
agacaacttggacaacctgtga

SEQ ID NO: 6779 - DNA, 18 bp, Homo sapiens
caacaatgctggtaaggg

SEQ ID NO: 6780 - DNA, 22 bp, Homo sapiens
cacacgtatctaacaaacaaac

SEQ ID NO: 6781 - DNA, 18 bp, Homo sapiens
caggagaagactctccgc

SEQ ID NO: 6782 - DNA, 20 bp, Homo sapiens
catgtaaggaggactactgt

SEQ ID NO: 6783 - DNA, 18 bp, Homo sapiens
ccagaggccctctcccca

SEQ ID NO: 6784 - DNA, 19 bp, Homo sapiens
gcaaaaagccaggttttgg

SEQ ID NO: 6785 - DNA, 19 bp, Homo sapiens
ggccgggaagccagtctcc

SEQ ID NO: 6786 - DNA, 21 bp, Homo sapiens
tctcttctttcctttagtctt

SEQ ID NO: 6787 - DNA, 18 bp, Homo sapiens
cttcctccaaattaacta

SEQ ID NO: 6788 - DNA, 24 bp, Homo sapiens
gccacccccggcccggttccgggg

SEQ ID NO: 6789 - DNA, 20 bp, Homo sapiens
ggaggaggtggtgaccacca

SEQ ID NO: 6790 - DNA, 19 bp, Homo sapiens
agctgtggttaagatctca

SEQ ID NO: 6791 - DNA, 21 bp, Homo sapiens
aggatgcccacctgtccccca

SEQ ID NO: 6792 - DNA, 23 bp, Homo sapiens
cgcctctcacccccgaccctcca

SEQ ID NO: 6793 - DNA, 16 bp, Homo sapiens
ctgacagccctgcgga

SEQ ID NO: 6794 - DNA, 18 bp, Homo sapiens
cttcgcttccttagcctt

SEQ ID NO: 6795 - DNA, 17 bp, Homo sapiens
gcgaggtgtaaagttgt

SEQ ID NO: 6796 - DNA, 18 bp, Homo sapiens
ctgcaccacccacttgca

SEQ ID NO: 6797 - DNA, 18 bp, Homo sapiens
gctgacccacatggtcaa

SEQ ID NO: 6798 - DNA, 20 bp, Homo sapiens
gtggctgtgatgtggggtta

SEQ ID NO: 6799 - DNA, 23 bp, Homo sapiens
ccacccctcccacatttacagcc

SEQ ID NO: 6800 - DNA, 17 bp, Homo sapiens
cctttttccgcacttct

SEQ ID NO: 6801 - DNA, 19 bp, Homo sapiens
gttaaaaagagcttttgtt

SEQ ID NO: 6802 - DNA, 26 bp, Homo sapiens
ttctggaggctactttgcactcttcc

SEQ ID NO: 6803 - DNA, 18 bp, Homo sapiens
acaagacacagcggagct

SEQ ID NO: 6804 - DNA, 18 bp, Homo sapiens
cttccctcctcctcccct

SEQ ID NO: 6805 - DNA, 24 bp, Homo sapiens
ccctgtcctgtggaaatttgtgga

SEQ ID NO: 6806 - DNA, 18 bp, Homo sapiens
gccctgccatataagcca

SEQ ID NO: 6807 - DNA, 19 bp, Homo sapiens
agacacctgctcactcacc

SEQ ID NO: 6808 - DNA, 23 bp, Homo sapiens
agaactaggactgaactatttta

SEQ ID NO: 6809 - DNA, 18 bp, Homo sapiens
caccctcttcccatgtcc

SEQ ID NO: 6810 - DNA, 20 bp, Homo sapiens
gacagagtctcactttgaca

SEQ ID NO: 6811 - DNA, 22 bp, Homo sapiens
gtattatctacaattattggca

SEQ ID NO: 6812 - DNA, 18 bp, Homo sapiens
aaataacacaaatgctca

SEQ ID NO: 6813 - DNA, 19 bp, Homo sapiens
acactgttccagtgtctat

SEQ ID NO: 6814 - DNA, 18 bp, Homo sapiens
cttaggcaatttttaatt

SEQ ID NO: 6815 - DNA, 24 bp, Homo sapiens
ggtctagaatatgtacacgcagct

SEQ ID NO: 6816 - DNA, 19 bp, Homo sapiens
tctaaaaactgattgaatg

SEQ ID NO: 6817 - DNA, 23 bp, Homo sapiens
ttcttggtggcttcttcatagca

SEQ ID NO: 6818 - DNA, 18 bp, Homo sapiens
gctctgtaaaagctgaca

SEQ ID NO: 6819 - DNA, 19 bp, Homo sapiens
aatccattgatcagaagaa

SEQ ID NO: 6820 - DNA, 19 bp, Homo sapiens
accagaaaccacacattca

SEQ ID NO: 6821 - DNA, 22 bp, Homo sapiens
atgctcagatgaacaacatatt

SEQ ID NO: 6822 - DNA, 21 bp, Homo sapiens
cagaagaacttcacctgcaga

SEQ ID NO: 6823 - DNA, 23 bp, Homo sapiens
acttgggtcccacagtctggtcc

SEQ ID NO: 6824 - DNA, 17 bp, Homo sapiens
ctacatacaatcaatgt

SEQ ID NO: 6825 - DNA, 21 bp, Homo sapiens
tgcttggtttgcacatgttgt

SEQ ID NO: 6826 - DNA, 24 bp, Homo sapiens
cttaagcaatctataaatcatttt

SEQ ID NO: 6827 - DNA, 19 bp, Homo sapiens
aagcaattctcctgcctca

SEQ ID NO: 6828 - DNA, 18 bp, Homo sapiens
gcattttcccttgctgta

SEQ ID NO: 6829 - DNA, 20 bp, Homo sapiens
gtctcccagtcttgtcccgg

SEQ ID NO: 6830 - DNA, 18 bp, Homo sapiens
tcagactcctgggttcaa

SEQ ID NO: 6831 - DNA, 20 bp, Homo sapiens
tcgctgcctcctgggttcaa

SEQ ID NO: 6832 - DNA, 19 bp, Homo sapiens
tcttgtttcttacatatca

SEQ ID NO: 6833 - DNA, 24 bp, Homo sapiens
ttttggaattaaaagccactgact

SEQ ID NO: 6834 - DNA, 17 bp, Homo sapiens
ccaccacccttccctct

SEQ ID NO: 6835 - DNA, 21 bp, Homo sapiens
agaaataaaaagcctgtcatt

SEQ ID NO: 6836 - DNA, 26 bp, Homo sapiens
ctctctctctcttttttgggggctca

SEQ ID NO: 6837 - DNA, 21 bp, Homo sapiens
ctgtgctcctgttttgtcttg

SEQ ID NO: 6838 - DNA, 18 bp, Homo sapiens
aaaacaaacagaacccaa

SEQ ID NO: 6839 - DNA, 20 bp, Homo sapiens
aaaacaaacagaacccaaac

SEQ ID NO: 6840 - DNA, 18 bp, Homo sapiens
acttggcattcaacatta

SEQ ID NO: 6841 - DNA, 22 bp, Homo sapiens
agtacttgaccctgagcggcgc

SEQ ID NO: 6842 - DNA, 20 bp, Homo sapiens
caagaaaaaggcagtgcctc

SEQ ID NO: 6843 - DNA, 18 bp, Homo sapiens
cgtccttctccacaccca

SEQ ID NO: 6844 - DNA, 18 bp, Homo sapiens
ctccacacccagcacccc

SEQ ID NO: 6845 - DNA, 18 bp, Homo sapiens
gagcgcctgaccttcctc

SEQ ID NO: 6846 - DNA, 16 bp, Homo sapiens
ggcccaccctgcggtg

SEQ ID NO: 6847 - DNA, 24 bp, Homo sapiens
gggataacccttccttcgatacca

SEQ ID NO: 6848 - DNA, 24 bp, Homo sapiens
tccacagcgtcttctcctgttcct

SEQ ID NO: 6849 - DNA, 21 bp, Homo sapiens
tcctggaccaaggcttgggaa

SEQ ID NO: 6850 - DNA, 20 bp, Homo sapiens
cttccttcctgttctaactg

SEQ ID NO: 6851 - DNA, 18 bp, Homo sapiens
ccgcatgggccttgtctt

SEQ ID NO: 6852 - DNA, 21 bp, Homo sapiens
gcccctcctccactctcctct

SEQ ID NO: 6853 - DNA, 19 bp, Homo sapiens
aagtaactacactacctca

SEQ ID NO: 6854 - DNA, 19 bp, Homo sapiens
aagtaactacactacctca

SEQ ID NO: 6855 - DNA, 19 bp, Homo sapiens
aagttgtaatgcagatgga

SEQ ID NO: 6856 - DNA, 19 bp, Homo sapiens
atactgtttttttccttta

SEQ ID NO: 6857 - DNA, 21 bp, Homo sapiens
caccgtgggtcaccaatgcca

SEQ ID NO: 6858 - DNA, 15 bp, Homo sapiens
ccctttttgatcagg

SEQ ID NO: 6859 - DNA, 20 bp, Homo sapiens
gcaatgttacggtgaattct

SEQ ID NO: 6860 - DNA, 23 bp, Homo sapiens
accgcagtgccgctgcctggccc

SEQ ID NO: 6861 - DNA, 20 bp, Homo sapiens
ccaaggggtgcgaaaccctg

SEQ ID NO: 6862 - DNA, 20 bp, Homo sapiens
aggcgaagttcattgttctc

SEQ ID NO: 6863 - DNA, 18 bp, Homo sapiens
ccagaccaaagccatgcc

SEQ ID NO: 6864 - DNA, 21 bp, Homo sapiens
ccccaccgtggccccccacgc

SEQ ID NO: 6865 - DNA, 20 bp, Homo sapiens
caaccctcggctccgccgcc

SEQ ID NO: 6866 - DNA, 18 bp, Homo sapiens
cgcggagcccggcccgga

SEQ ID NO: 6867 - DNA, 22 bp, Homo sapiens
gcagcttccctgagcctttcca

SEQ ID NO: 6868 - DNA, 22 bp, Homo sapiens
aacaaaaagttaaacttacaag

SEQ ID NO: 6869 - DNA, 23 bp, Homo sapiens
tcctttcaaactgtattgtgata

SEQ ID NO: 6870 - DNA, 23 bp, Homo sapiens
caccgaagccgttctgactggca

SEQ ID NO: 6871 - DNA, 24 bp, Homo sapiens
tatgcttttagttaacatcattat

SEQ ID NO: 6872 - DNA, 19 bp, Homo sapiens
aagaaacctagaccagaga

SEQ ID NO: 6873 - DNA, 19 bp, Homo sapiens
aagaggttacttcctccca

SEQ ID NO: 6874 - DNA, 21 bp, Homo sapiens
catttcagacactcctcagca

SEQ ID NO: 6875 - DNA, 22 bp, Homo sapiens
tctctattttcaaaaaatacaa

SEQ ID NO: 6876 - DNA, 24 bp, Homo sapiens
cggatctcagtccctggctgcttt

SEQ ID NO: 6877 - DNA, 20 bp, Homo sapiens
aagagatatacattgtgata

SEQ ID NO: 6878 - DNA, 18 bp, Homo sapiens
atattcttccccgaatca

SEQ ID NO: 6879 - DNA, 20 bp, Homo sapiens
ccaaatccaacctcctgtca

SEQ ID NO: 6880 - DNA, 19 bp, Homo sapiens
cggagctcccgggcacatc

SEQ ID NO: 6881 - DNA, 19 bp, Homo sapiens
gatgtcaaatcgtggttta

SEQ ID NO: 6882 - DNA, 18 bp, Homo sapiens
agcttctggtttcacatg

SEQ ID NO: 6883 - DNA, 22 bp, Homo sapiens
attagctctttactctttctca

SEQ ID NO: 6884 - DNA, 20 bp, Homo sapiens
ctatatctttgtggataata

SEQ ID NO: 6885 - DNA, 19 bp, Homo sapiens
gcagcaagcattatacggt

SEQ ID NO: 6886 - DNA, 18 bp, Homo sapiens
taggggccacatattaca

SEQ ID NO: 6887 - DNA, 18 bp, Homo sapiens
tggtttcacatgaaattg

SEQ ID NO: 6888 - DNA, 21 bp, Homo sapiens
tgtcattgaaagtgcctttaa

SEQ ID NO: 6889 - DNA, 19 bp, Homo sapiens
atgttattgttttcaacct

SEQ ID NO: 6890 - DNA, 17 bp, Homo sapiens
gtgaagttgtaaacaca

SEQ ID NO: 6891 - DNA, 18 bp, Homo sapiens
tccccatcatccacgcca

SEQ ID NO: 6892 - DNA, 18 bp, Homo sapiens
tcctgacctcatgatcca

SEQ ID NO: 6893 - DNA, 18 bp, Homo sapiens
ttctcctgcctcagcctt

SEQ ID NO: 6894 - DNA, 20 bp, Homo sapiens
tctgtattgaaaatggcttt

SEQ ID NO: 6895 - DNA, 21 bp, Homo sapiens
aaacagaaaccattctaggtg

SEQ ID NO: 6896 - DNA, 16 bp, Homo sapiens
aataacactgtctcct

SEQ ID NO: 6897 - DNA, 19 bp, Homo sapiens
gccttggccgcctgagccc

SEQ ID NO: 6898 - DNA, 23 bp, Homo sapiens
actttcctcgcctgacaaccact

SEQ ID NO: 6899 - DNA, 19 bp, Homo sapiens
cacgtggcctcttgagcag

SEQ ID NO: 6900 - DNA, 22 bp, Homo sapiens
ctcaccctgccttatcttgcac

SEQ ID NO: 6901 - DNA, 21 bp, Homo sapiens
tcctgagtggtgccaaacaaa

SEQ ID NO: 6902 - DNA, 19 bp, Homo sapiens
aactgggatgggaggttga

SEQ ID NO: 6903 - DNA, 18 bp, Homo sapiens
agtctcacatattcatca

SEQ ID NO: 6904 - DNA, 17 bp, Homo sapiens
tcagctggcttcctagc

SEQ ID NO: 6905 - DNA, 21 bp, Homo sapiens
agccaggtaccttctcacctg

SEQ ID NO: 6906 - DNA, 25 bp, Homo sapiens
ctcccggcgccgccgccgccactgc

SEQ ID NO: 6907 - DNA, 19 bp, Homo sapiens
aaacagatggcaggatggg

SEQ ID NO: 6908 - DNA, 20 bp, Homo sapiens
accaccaggcccacagccca

SEQ ID NO: 6909 - DNA, 20 bp, Homo sapiens
acccagagcctaggggatcc

SEQ ID NO: 6910 - DNA, 21 bp, Homo sapiens
ggaccctcctggtgctgccca

SEQ ID NO: 6911 - DNA, 20 bp, Homo sapiens
gtgcctgtggttgtttctcc

SEQ ID NO: 6912 - DNA, 19 bp, Homo sapiens
ttgcccagggacttcctcc

SEQ ID NO: 6913 - DNA, 22 bp, Homo sapiens
acaagttcaaagacttttactt

SEQ ID NO: 6914 - DNA, 23 bp, Homo sapiens
acagagaagtggggaatccagtc

SEQ ID NO: 6915 - DNA, 25 bp, Homo sapiens
gagactagtaccagagcagctagca

SEQ ID NO: 6916 - DNA, 18 bp, Homo sapiens
tgcagatggcctaatgct

SEQ ID NO: 6917 - DNA, 19 bp, Homo sapiens
agccacagtcccagaacca

SEQ ID NO: 6918 - DNA, 26 bp, Homo sapiens
atctggccagagggctgtctggacct

SEQ ID NO: 6919 - DNA, 16 bp, Homo sapiens
cctcatgtgttccact

SEQ ID NO: 6920 - DNA, 21 bp, Homo sapiens
ttttctggacaccaactgtgt

SEQ ID NO: 6921 - DNA, 19 bp, Homo sapiens
tactctatgatttactaac

SEQ ID NO: 6922 - DNA, 17 bp, Homo sapiens
ttgaagaattgacctca

SEQ ID NO: 6923 - DNA, 23 bp, Homo sapiens
cctttcagccacccaatatctcg

SEQ ID NO: 6924 - DNA, 20 bp, Homo sapiens
tggccaggctggtcttgaac

SEQ ID NO: 6925 - DNA, 18 bp, Homo sapiens
atctgtatgtatatatac

SEQ ID NO: 6926 - DNA, 22 bp, Homo sapiens
atgacatatgacttgatcttct

SEQ ID NO: 6927 - DNA, 17 bp, Homo sapiens
actcaaaaagcgctcaa

SEQ ID NO: 6928 - DNA, 21 bp, Homo sapiens
cctccttaaaactctgccgtt

SEQ ID NO: 6929 - DNA, 19 bp, Homo sapiens
attgaatgttctgatcaga

SEQ ID NO: 6930 - DNA, 26 bp, Homo sapiens
tggacagcattaacaagaatgagata

SEQ ID NO: 6931 - DNA, 24 bp, Homo sapiens
tgtatgatgagctatgtttggctg

SEQ ID NO: 6932 - DNA, 20 bp, Homo sapiens
ttaaaacagcctgtaattat

SEQ ID NO: 6933 - DNA, 19 bp, Homo sapiens
tgttgaagaaaattcatct

SEQ ID NO: 6934 - DNA, 15 bp, Homo sapiens
agtgggaaaatttca

SEQ ID NO: 6935 - DNA, 24 bp, Homo sapiens
taacctcatagcagctttggtttt

SEQ ID NO: 6936 - DNA, 23 bp, Homo sapiens
taccttgaatttacagtgggaaa

SEQ ID NO: 6937 - DNA, 22 bp, Homo sapiens
ttctgctggtgataaactcttt

SEQ ID NO: 6938 - DNA, 22 bp, Homo sapiens
ttttgatgtccttgtctgcgaa

SEQ ID NO: 6939 - DNA, 20 bp, Homo sapiens
taggtgcccggccccacacc

SEQ ID NO: 6940 - DNA, 18 bp, Homo sapiens
tgcaggggagcttgcggg

SEQ ID NO: 6941 - DNA, 18 bp, Homo sapiens
agctctatcaccaaggag

SEQ ID NO: 6942 - DNA, 18 bp, Homo sapiens
ggagccaaacatcctaca

SEQ ID NO: 6943 - DNA, 18 bp, Homo sapiens
ccatggctgaagcggagc

SEQ ID NO: 6944 - DNA, 24 bp, Homo sapiens
cccttcctcctgatggagtgtgca

SEQ ID NO: 6945 - DNA, 19 bp, Homo sapiens
ctctcctgccctctgctct

SEQ ID NO: 6946 - DNA, 22 bp, Homo sapiens
ctgcccttcctcctgatggagt

SEQ ID NO: 6947 - DNA, 21 bp, Homo sapiens
tctgaaaacaaggtttccata

SEQ ID NO: 6948 - DNA, 23 bp, Homo sapiens
acctgggctgtgctctccggctc

SEQ ID NO: 6949 - DNA, 25 bp, Homo sapiens
accttgagaatctccaagagaaaaa

SEQ ID NO: 6950 - DNA, 23 bp, Homo sapiens
caacccatgaactcttcactcct

SEQ ID NO: 6951 - DNA, 22 bp, Homo sapiens
caccatctttgtccctggcaaa

SEQ ID NO: 6952 - DNA, 20 bp, Homo sapiens
catgttggactgagacctaa

SEQ ID NO: 6953 - DNA, 19 bp, Homo sapiens
ccttcaaccatgctgtgat

SEQ ID NO: 6954 - DNA, 22 bp, Homo sapiens
taagatcatcccagaggttcag

SEQ ID NO: 6955 - DNA, 17 bp, Homo sapiens
tctcaggtccagttcaa

SEQ ID NO: 6956 - DNA, 23 bp, Homo sapiens
tgttgccctaagaatgcttctca

SEQ ID NO: 6957 - DNA, 21 bp, Homo sapiens
tttcttcatgatacttagtct

SEQ ID NO: 6958 - DNA, 19 bp, Homo sapiens
aagtgagcatctgggcatt

SEQ ID NO: 6959 - DNA, 19 bp, Homo sapiens
cagcagccgcctgccctga

SEQ ID NO: 6960 - DNA, 21 bp, Homo sapiens
cctaaactgactggacggctg

SEQ ID NO: 6961 - DNA, 21 bp, Homo sapiens
ctttttcatttccttaagttt

SEQ ID NO: 6962 - DNA, 19 bp, Homo sapiens
gtggtttgactctccttag

SEQ ID NO: 6963 - DNA, 19 bp, Homo sapiens
cagcttcacactggcgcca

SEQ ID NO: 6964 - DNA, 19 bp, Homo sapiens
cttgggagctgcttggcct

SEQ ID NO: 6965 - DNA, 22 bp, Homo sapiens
acaggtcttcatacttttactt

SEQ ID NO: 6966 - DNA, 18 bp, Homo sapiens
caatctcaccctgctcct

SEQ ID NO: 6967 - DNA, 25 bp, Homo sapiens
ggaggcaggaggctgacaactggca

SEQ ID NO: 6968 - DNA, 17 bp, Homo sapiens
tccaggtctgactcagt

SEQ ID NO: 6969 - DNA, 17 bp, Homo sapiens
ccagaatccactgtcaa

SEQ ID NO: 6970 - DNA, 18 bp, Homo sapiens
gcacagtggctccgtgtg

SEQ ID NO: 6971 - DNA, 21 bp, Homo sapiens
acaagagaacgagccagagtt

SEQ ID NO: 6972 - DNA, 21 bp, Homo sapiens
gtgaggtaaccaggtggcatc

SEQ ID NO: 6973 - DNA, 20 bp, Homo sapiens
gttttataaggaattttgta

SEQ ID NO: 6974 - DNA, 20 bp, Homo sapiens
ccccgccaccctcccactgc

SEQ ID NO: 6975 - DNA, 18 bp, Homo sapiens
gctttattgcagcgatta

SEQ ID NO: 6976 - DNA, 18 bp, Homo sapiens
tttctgttcttccatcac

SEQ ID NO: 6977 - DNA, 19 bp, Homo sapiens
cacagaaaaaagcatctca

SEQ ID NO: 6978 - DNA, 17 bp, Homo sapiens
gaagagacatcccctcc

SEQ ID NO: 6979 - DNA, 16 bp, Homo sapiens
atacaaaaaaggaatt

SEQ ID NO: 6980 - DNA, 18 bp, Homo sapiens
cagccagtcccttccgat

SEQ ID NO: 6981 - DNA, 19 bp, Homo sapiens
acacatggttttcagatga

SEQ ID NO: 6982 - DNA, 16 bp, Homo sapiens
agaatccagaaacatt

SEQ ID NO: 6983 - DNA, 21 bp, Homo sapiens
attaatgtatcagttatccca

SEQ ID NO: 6984 - DNA, 24 bp, Homo sapiens
gcagttttgaacttcccttcctta

SEQ ID NO: 6985 - DNA, 24 bp, Homo sapiens
gtggctttagtatttttctttgtt

SEQ ID NO: 6986 - DNA, 24 bp, Homo sapiens
taaatgcccacttgaatgaagctg

SEQ ID NO: 6987 - DNA, 18 bp, Homo sapiens
cccttggaagtcctgggg

SEQ ID NO: 6988 - DNA, 22 bp, Homo sapiens
cttctttgtggtttctgttttg

SEQ ID NO: 6989 - DNA, 18 bp, Homo sapiens
ccgcctggccttcgggga

SEQ ID NO: 6990 - DNA, 20 bp, Homo sapiens
aggagagatgagtggctatt

SEQ ID NO: 6991 - DNA, 22 bp, Homo sapiens
taggtggaccttggattttggc

SEQ ID NO: 6992 - DNA, 16 bp, Homo sapiens
agagcagtagaggatg

SEQ ID NO: 6993 - DNA, 18 bp, Homo sapiens
gaggaggaggcagccaga

SEQ ID NO: 6994 - DNA, 16 bp, Homo sapiens
gggaagaactacatta

SEQ ID NO: 6995 - DNA, 18 bp, Homo sapiens
tcactgattaaaacagct

SEQ ID NO: 6996 - DNA, 22 bp, Homo sapiens
tgagccattccagcataagctg

SEQ ID NO: 6997 - DNA, 21 bp, Homo sapiens
tgtaattgtatgtctgtgtgt

SEQ ID NO: 6998 - DNA, 16 bp, Homo sapiens
atggtgttttcattcc

SEQ ID NO: 6999 - DNA, 22 bp, Homo sapiens
ttctgaattcaaagcttgtgaa

SEQ ID NO: 7000 - DNA, 18 bp, Homo sapiens
agtaaaggcctcatctcc

SEQ ID NO: 7001 - DNA, 22 bp, Homo sapiens
caagtgatatcacctctcttca

SEQ ID NO: 7002 - DNA, 22 bp, Homo sapiens
cccataccttctggttgcttca

SEQ ID NO: 7003 - DNA, 20 bp, Homo sapiens
ggggtcgcggcagccgcacc

SEQ ID NO: 7004 - DNA, 20 bp, Homo sapiens
ggtggaagggggtgtgcgtg

SEQ ID NO: 7005 - DNA, 18 bp, Homo sapiens
tcccaataactaatgcta

SEQ ID NO: 7006 - DNA, 18 bp, Homo sapiens
agcttgtctccctcgatc

SEQ ID NO: 7007 - DNA, 26 bp, Homo sapiens
gcctcggctaaccaaaatgctgcacc

SEQ ID NO: 7008 - DNA, 21 bp, Homo sapiens
acgtgcgctcggagcggtaga

SEQ ID NO: 7009 - DNA, 18 bp, Homo sapiens
gcgcagcggtcgcttggc

SEQ ID NO: 7010 - DNA, 22 bp, Homo sapiens
tcatgcacgcagactcctgcaa

SEQ ID NO: 7011 - DNA, 20 bp, Homo sapiens
ctctccttgtccccatctgg

SEQ ID NO: 7012 - DNA, 20 bp, Homo sapiens
tctgttttttccatccccac

SEQ ID NO: 7013 - DNA, 25 bp, Homo sapiens
ttccgtctctccttccgcttctttg

SEQ ID NO: 7014 - DNA, 23 bp, Homo sapiens
aggaaatattaagagctatttta

SEQ ID NO: 7015 - DNA, 22 bp, Homo sapiens
atgaatcgcaagttaacttgga

SEQ ID NO: 7016 - DNA, 22 bp, Homo sapiens
cccttcttgtagagagatggac

SEQ ID NO: 7017 - DNA, 18 bp, Homo sapiens
tacctacaaaagattcta

SEQ ID NO: 7018 - DNA, 21 bp, Homo sapiens
agccagatcaaggatgtagta

SEQ ID NO: 7019 - DNA, 17 bp, Homo sapiens
tcaagtgattctcctgc

SEQ ID NO: 7020 - DNA, 17 bp, Homo sapiens
tccaccttcaggttcaa

SEQ ID NO: 7021 - DNA, 19 bp, Homo sapiens
accacatcccttcatatca

SEQ ID NO: 7022 - DNA, 18 bp, Homo sapiens
attattcatctctcctcc

SEQ ID NO: 7023 - DNA, 18 bp, Homo sapiens
cttagacactttggaatc

SEQ ID NO: 7024 - DNA, 17 bp, Homo sapiens
aagggaataaaccgcga

SEQ ID NO: 7025 - DNA, 21 bp, Homo sapiens
cacccctaacagagccagtgc

SEQ ID NO: 7026 - DNA, 21 bp, Homo sapiens
ccgcgaagaaggagcgccccg

SEQ ID NO: 7027 - DNA, 27 bp, Homo sapiens
tgaatggacttagggcccatgaggttg

SEQ ID NO: 7028 - DNA, 20 bp, Homo sapiens
tgaggttgtggctggcttag

SEQ ID NO: 7029 - DNA, 20 bp, Homo sapiens
gcccggaggagggtttgcgg

SEQ ID NO: 7030 - DNA, 20 bp, Homo sapiens
tgacagagcgagaccctgcc

SEQ ID NO: 7031 - DNA, 19 bp, Homo sapiens
ggagtgtgctggtgatcgc

SEQ ID NO: 7032 - DNA, 18 bp, Homo sapiens
aagacagtacaaaaacac

SEQ ID NO: 7033 - DNA, 21 bp, Homo sapiens
cccgcctacccccatcccaaa

SEQ ID NO: 7034 - DNA, 18 bp, Homo sapiens
gattgttgaacgcagctt

SEQ ID NO: 7035 - DNA, 28 bp, Homo sapiens
gcagttctcccgtgagagggccttcgcg

SEQ ID NO: 7036 - DNA, 22 bp, Homo sapiens
gcagttttagtcagttttagtt

SEQ ID NO: 7037 - DNA, 20 bp, Homo sapiens
gccgccctctcagtttcggg

SEQ ID NO: 7038 - DNA, 26 bp, Homo sapiens
tcctgcttcacaaaatggccaccgca

SEQ ID NO: 7039 - DNA, 24 bp, Homo sapiens
cctgtgagcgcccaccctctcgaa

SEQ ID NO: 7040 - DNA, 21 bp, Homo sapiens
gcaggtgggctctgcttcccg

SEQ ID NO: 7041 - DNA, 23 bp, Homo sapiens
aagagaggtggggggagagcctg

SEQ ID NO: 7042 - DNA, 19 bp, Homo sapiens
gtgctttggcccggtgctt

SEQ ID NO: 7043 - DNA, 21 bp, Homo sapiens
atgaaagaggcagagtttatc

SEQ ID NO: 7044 - DNA, 20 bp, Homo sapiens
gttttcttgttgatctcatg

SEQ ID NO: 7045 - DNA, 23 bp, Homo sapiens
ccatcctctcccacacacattcc

SEQ ID NO: 7046 - DNA, 18 bp, Homo sapiens
cctgccctcccccatcct

SEQ ID NO: 7047 - DNA, 21 bp, Homo sapiens
ttccagagactatgtgcccag

SEQ ID NO: 7048 - DNA, 18 bp, Homo sapiens
cagcactttgggaagcca

SEQ ID NO: 7049 - DNA, 16 bp, Homo sapiens
ctttgggaggctgaga

SEQ ID NO: 7050 - DNA, 20 bp, Homo sapiens
aatgattatccatatgtgtt

SEQ ID NO: 7051 - DNA, 17 bp, Homo sapiens
agtgtgtctggctctga

SEQ ID NO: 7052 - DNA, 21 bp, Homo sapiens
ttgcccaaacattctttcttt

SEQ ID NO: 7053 - DNA, 17 bp, Homo sapiens
atccatcctgcaaaggc

SEQ ID NO: 7054 - DNA, 19 bp, Homo sapiens
cttgaattagcctgcgctc

SEQ ID NO: 7055 - DNA, 23 bp, Homo sapiens
tgaatatggttggagagccctgg

SEQ ID NO: 7056 - DNA, 23 bp, Homo sapiens
tgtctctgctcctacatccagct

SEQ ID NO: 7057 - DNA, 21 bp, Homo sapiens
actcaggccccgaagctgtcc

SEQ ID NO: 7058 - DNA, 18 bp, Homo sapiens
atgcgtgttgtttggctg

SEQ ID NO: 7059 - DNA, 18 bp, Homo sapiens
ggatatgccatcatggca

SEQ ID NO: 7060 - DNA, 19 bp, Homo sapiens
gtgcagctacaggatatgc

SEQ ID NO: 7061 - DNA, 20 bp, Homo sapiens
caccgagcctcattaaccca

SEQ ID NO: 7062 - DNA, 20 bp, Homo sapiens
cagttcagaagtgctaagct

SEQ ID NO: 7063 - DNA, 21 bp, Homo sapiens
ctccttctctctctctctctc

SEQ ID NO: 7064 - DNA, 23 bp, Homo sapiens
ggttgttttggttgttttcttaa

SEQ ID NO: 7065 - DNA, 21 bp, Homo sapiens
gtatgaggctgcagaaccgga

SEQ ID NO: 7066 - DNA, 20 bp, Homo sapiens
tgtctctctacacattttgc

SEQ ID NO: 7067 - DNA, 18 bp, Homo sapiens
tttttgtaaccactgtct

SEQ ID NO: 7068 - DNA, 18 bp, Homo sapiens
aatggtacaccgatattt

SEQ ID NO: 7069 - DNA, 24 bp, Homo sapiens
accagagaaaagtacacactgggc

SEQ ID NO: 7070 - DNA, 24 bp, Homo sapiens
attactaactctccaagcatagaa

SEQ ID NO: 7071 - DNA, 19 bp, Homo sapiens
ccaagcatagaaatccctg

SEQ ID NO: 7072 - DNA, 19 bp, Homo sapiens
gatcctggcacatccatga

SEQ ID NO: 7073 - DNA, 21 bp, Homo sapiens
gcactgcccttgggacttccg

SEQ ID NO: 7074 - DNA, 18 bp, Homo sapiens
tggggaatccaagtggta

SEQ ID NO: 7075 - DNA, 16 bp, Homo sapiens
ccttgggtgccccaca

SEQ ID NO: 7076 - DNA, 19 bp, Homo sapiens
gggtgtcctaaagtgcctc

SEQ ID NO: 7077 - DNA, 19 bp, Homo sapiens
ccggctggcgcacgggagg

SEQ ID NO: 7078 - DNA, 20 bp, Homo sapiens
ctctccttcagaaccccgct

SEQ ID NO: 7079 - DNA, 24 bp, Homo sapiens
aagttgttgatcagacccttctct

SEQ ID NO: 7080 - DNA, 18 bp, Homo sapiens
cactcagaagctaacctc

SEQ ID NO: 7081 - DNA, 20 bp, Homo sapiens
ctctccttcagaaccccgct

SEQ ID NO: 7082 - DNA, 20 bp, Homo sapiens
ctgaacctgtggtcaggctc

SEQ ID NO: 7083 - DNA, 17 bp, Homo sapiens
gggagacgagagggtca

SEQ ID NO: 7084 - DNA, 18 bp, Homo sapiens
ttcaagttgttgatcaga

SEQ ID NO: 7085 - DNA, 16 bp, Homo sapiens
acacagatgaacaacc

SEQ ID NO: 7086 - DNA, 21 bp, Homo sapiens
cagtatattaagattaccttc

SEQ ID NO: 7087 - DNA, 20 bp, Homo sapiens
tcaacttgaatactggtgtt

SEQ ID NO: 7088 - DNA, 18 bp, Homo sapiens
tgtttataaactttactc

SEQ ID NO: 7089 - DNA, 18 bp, Homo sapiens
aaagttgggactgagcag

SEQ ID NO: 7090 - DNA, 19 bp, Homo sapiens
gggcagcgctggcgccagc

SEQ ID NO: 7091 - DNA, 22 bp, Homo sapiens
tctggtgggctgttttgttttt

SEQ ID NO: 7092 - DNA, 22 bp, Homo sapiens
atcttcatggatagctcagagg

SEQ ID NO: 7093 - DNA, 20 bp, Homo sapiens
ccatcttcatggatagctca

SEQ ID NO: 7094 - DNA, 22 bp, Homo sapiens
tctgttcatcctgaacattttt

SEQ ID NO: 7095 - DNA, 22 bp, Homo sapiens
ttcaagattacaacatctgtta

SEQ ID NO: 7096 - DNA, 18 bp, Homo sapiens
cccaagcttcccaacaga

SEQ ID NO: 7097 - DNA, 20 bp, Homo sapiens
ctcccctctctcccgcccct

SEQ ID NO: 7098 - DNA, 20 bp, Homo sapiens
gcctgggctcagcctggttt

SEQ ID NO: 7099 - DNA, 17 bp, Homo sapiens
gtgactcttagccctca

SEQ ID NO: 7100 - DNA, 18 bp, Homo sapiens
tcctctaggccctgtgag

SEQ ID NO: 7101 - DNA, 17 bp, Homo sapiens
tcgagagccttacttca

SEQ ID NO: 7102 - DNA, 22 bp, Homo sapiens
acttttgctattttgtctgctg

SEQ ID NO: 7103 - DNA, 19 bp, Homo sapiens
cctgcagagggtcggtgga

SEQ ID NO: 7104 - DNA, 21 bp, Homo sapiens
tgtggtgggggcggaaaaagc

SEQ ID NO: 7105 - DNA, 16 bp, Homo sapiens
aacgtccatctgagga

SEQ ID NO: 7106 - DNA, 19 bp, Homo sapiens
ctggggggcctgcccctca

SEQ ID NO: 7107 - DNA, 19 bp, Homo sapiens
gcactcatgccctgctcct

SEQ ID NO: 7108 - DNA, 18 bp, Homo sapiens
ggaaaggacaaagccaca

SEQ ID NO: 7109 - DNA, 16 bp, Homo sapiens
tgcccctcatacgcca

SEQ ID NO: 7110 - DNA, 20 bp, Homo sapiens
ccatattttatgttgcttta

SEQ ID NO: 7111 - DNA, 24 bp, Homo sapiens
cctccaggctgaaagactgttgta

SEQ ID NO: 7112 - DNA, 20 bp, Homo sapiens
tctttttaggccttcatttt

SEQ ID NO: 7113 - DNA, 22 bp, Homo sapiens
tgaatggattcgaatgaaattg

SEQ ID NO: 7114 - DNA, 21 bp, Homo sapiens
tgcgcgccaccacacttggct

SEQ ID NO: 7115 - DNA, 19 bp, Homo sapiens
cacaaaactgatcagtttt

SEQ ID NO: 7116 - DNA, 22 bp, Homo sapiens
ccttccctcccccttttttttg

SEQ ID NO: 7117 - DNA, 26 bp, Homo sapiens
tgcccttgaagtggtttttgtgggtg

SEQ ID NO: 7118 - DNA, 26 bp, Homo sapiens
tttttttgtagtgtaatgtcttaatc

SEQ ID NO: 7119 - DNA, 21 bp, Homo sapiens
ctctggggtgggagggtctgc

SEQ ID NO: 7120 - DNA, 18 bp, Homo sapiens
gcctgccctcccaccccc

SEQ ID NO: 7121 - DNA, 19 bp, Homo sapiens
ccgttgtcagctctctgaa

SEQ ID NO: 7122 - DNA, 18 bp, Homo sapiens
ctacctggctctatctca

SEQ ID NO: 7123 - DNA, 19 bp, Homo sapiens
gccacggaaacaactctaa

SEQ ID NO: 7124 - DNA, 18 bp, Homo sapiens
ggcagccaggagttcccg

SEQ ID NO: 7125 - DNA, 20 bp, Homo sapiens
ggtccagcccagaatgcagc

SEQ ID NO: 7126 - DNA, 18 bp, Homo sapiens
taaccctgactccttcac

SEQ ID NO: 7127 - DNA, 21 bp, Homo sapiens
tacttgttggtctgtatctta

SEQ ID NO: 7128 - DNA, 21 bp, Homo sapiens
tctcttcgtggctccctgctt

SEQ ID NO: 7129 - DNA, 22 bp, Homo sapiens
ttgcctggatctcctcccctct

SEQ ID NO: 7130 - DNA, 24 bp, Homo sapiens
acggctgtccctcatggagacctc

SEQ ID NO: 7131 - DNA, 29 bp, Homo sapiens
atgtccctctttggaacagatatttagct

SEQ ID NO: 7132 - DNA, 19 bp, Homo sapiens
cagggctcctaggctcagt

SEQ ID NO: 7133 - DNA, 17 bp, Homo sapiens
gaggaggaagccgttga

SEQ ID NO: 7134 - DNA, 19 bp, Homo sapiens
gagtaaaccatgtattccc

SEQ ID NO: 7135 - DNA, 21 bp, Homo sapiens
ggaagatgaactttgtcatta

SEQ ID NO: 7136 - DNA, 22 bp, Homo sapiens
tcctttttggggagttgttatg

SEQ ID NO: 7137 - DNA, 18 bp, Homo sapiens
cgcagaaggagagcgagc

SEQ ID NO: 7138 - DNA, 22 bp, Homo sapiens
ccacctcttctcccccacctcc

SEQ ID NO: 7139 - DNA, 16 bp, Homo sapiens
cccacgggccgctggc

SEQ ID NO: 7140 - DNA, 19 bp, Homo sapiens
ccccacgggccgctggcaa

SEQ ID NO: 7141 - DNA, 19 bp, Homo sapiens
cgccgctacaagccaaaga

SEQ ID NO: 7142 - DNA, 22 bp, Homo sapiens
gttgaaacgcagcatttttgaa

SEQ ID NO: 7143 - DNA, 23 bp, Homo sapiens
accttgtctttcaaaagaactca

SEQ ID NO: 7144 - DNA, 18 bp, Homo sapiens
ctggcctcgcgtctctca

SEQ ID NO: 7145 - DNA, 21 bp, Homo sapiens
gccacctcaaggccttgggga

SEQ ID NO: 7146 - DNA, 26 bp, Homo sapiens
ggggacggccgggcggcggcggcggc

SEQ ID NO: 7147 - DNA, 18 bp, Homo sapiens
tcaaaattgtgaacaccc

SEQ ID NO: 7148 - DNA, 21 bp, Homo sapiens
cctctagagccgcgagttctc

SEQ ID NO: 7149 - DNA, 18 bp, Homo sapiens
cttgggccaggccggccc

SEQ ID NO: 7150 - DNA, 21 bp, Homo sapiens
gcgaaggaggggagcgccggc

SEQ ID NO: 7151 - DNA, 23 bp, Homo sapiens
gcgcctctagagccgcgagttct

SEQ ID NO: 7152 - DNA, 20 bp, Homo sapiens
gcgcggagcgcggcggcagg

SEQ ID NO: 7153 - DNA, 23 bp, Homo sapiens
tatggaagagttaaaacatttct

SEQ ID NO: 7154 - DNA, 22 bp, Homo sapiens
catgcccttcggcagcattcca

SEQ ID NO: 7155 - DNA, 19 bp, Homo sapiens
attgatattatattaaaca

SEQ ID NO: 7156 - DNA, 20 bp, Homo sapiens
gtggataccaaggtacaact

SEQ ID NO: 7157 - DNA, 18 bp, Homo sapiens
tctgtaattgcacttttt

SEQ ID NO: 7158 - DNA, 24 bp, Homo sapiens
ttgtacaaacagtatttctggtgt

SEQ ID NO: 7159 - DNA, 18 bp, Homo sapiens
aaaaacaaaaacaaagaa

SEQ ID NO: 7160 - DNA, 20 bp, Homo sapiens
agggaaataaatcggctggc

SEQ ID NO: 7161 - DNA, 25 bp, Homo sapiens
ccaaacacttgcattcacaacttta

SEQ ID NO: 7162 - DNA, 17 bp, Homo sapiens
cctgaaaactgcttggc

SEQ ID NO: 7163 - DNA, 20 bp, Homo sapiens
gtctagttgtttgcttgata

SEQ ID NO: 7164 - DNA, 19 bp, Homo sapiens
tgcaatctactgcactcga

SEQ ID NO: 7165 - DNA, 20 bp, Homo sapiens
accaaaacatgccgcaggga

SEQ ID NO: 7166 - DNA, 17 bp, Homo sapiens
ctgacttgtattccttt

SEQ ID NO: 7167 - DNA, 19 bp, Homo sapiens
gagatcgttttgtggaata

SEQ ID NO: 7168 - DNA, 18 bp, Homo sapiens
gccatctgtgtgcagcaa

SEQ ID NO: 7169 - DNA, 18 bp, Homo sapiens
gccttcttccctcgggga

SEQ ID NO: 7170 - DNA, 20 bp, Homo sapiens
gcgcctgaccctggtgggct

SEQ ID NO: 7171 - DNA, 18 bp, Homo sapiens
tgtggtttttggacccct

SEQ ID NO: 7172 - DNA, 23 bp, Homo sapiens
ccatcaagtattacctgcagcga

SEQ ID NO: 7173 - DNA, 21 bp, Homo sapiens
cccaggctgttgtcccttgaa

SEQ ID NO: 7174 - DNA, 20 bp, Homo sapiens
gcaaagcctgattgactgtg

SEQ ID NO: 7175 - DNA, 17 bp, Homo sapiens
gtccccggggcaaagcc

SEQ ID NO: 7176 - DNA, 19 bp, Homo sapiens
ctgcagactactgctttga

SEQ ID NO: 7177 - DNA, 19 bp, Homo sapiens
ctgtgatctcgccttgttt

SEQ ID NO: 7178 - DNA, 21 bp, Homo sapiens
taggtagagctgagaatacta

SEQ ID NO: 7179 - DNA, 22 bp, Homo sapiens
tgtttttttttaaaaccaggca

SEQ ID NO: 7180 - DNA, 20 bp, Homo sapiens
tgatgcctcatttctacatt

SEQ ID NO: 7181 - DNA, 20 bp, Homo sapiens
tttctacattctgtcattag

SEQ ID NO: 7182 - DNA, 20 bp, Homo sapiens
tttgggacggagtctcgctt

SEQ ID NO: 7183 - DNA, 20 bp, Homo sapiens
atcggtaaataaaagttttt

SEQ ID NO: 7184 - DNA, 23 bp, Homo sapiens
cctcttctgttatgttttgtctt

SEQ ID NO: 7185 - DNA, 17 bp, Homo sapiens
gagctcagatctccctc

SEQ ID NO: 7186 - DNA, 15 bp, Homo sapiens
aaggcagtgctaagc

SEQ ID NO: 7187 - DNA, 23 bp, Homo sapiens
tcagtaatcagggtgtgaaaaaa

SEQ ID NO: 7188 - DNA, 19 bp, Homo sapiens
catacttattcggaggagg

SEQ ID NO: 7189 - DNA, 23 bp, Homo sapiens
gccgtgtaacgggagtctgggga

SEQ ID NO: 7190 - DNA, 22 bp, Homo sapiens
gggggtgacggggggtcgcgga

SEQ ID NO: 7191 - DNA, 24 bp, Homo sapiens
ttctgtctttcctttattttttgg

SEQ ID NO: 7192 - DNA, 19 bp, Homo sapiens
ccctcgccgaggctgcagc

SEQ ID NO: 7193 - DNA, 21 bp, Homo sapiens
tgcccagaaatctactttaat

SEQ ID NO: 7194 - DNA, 16 bp, Homo sapiens
gcttttgtgtccctga

SEQ ID NO: 7195 - DNA, 20 bp, Homo sapiens
ggtggccaattgagcttcaa

SEQ ID NO: 7196 - DNA, 18 bp, Homo sapiens
tgtttaaactcaaataga

SEQ ID NO: 7197 - DNA, 20 bp, Homo sapiens
ttgaattcctggaataaacc

SEQ ID NO: 7198 - DNA, 17 bp, Homo sapiens
aggaagcggtgattgcc

SEQ ID NO: 7199 - DNA, 22 bp, Homo sapiens
cctcttcgccgcccgccgcctc

SEQ ID NO: 7200 - DNA, 21 bp, Homo sapiens
gcgtcttggctggtagggcct

SEQ ID NO: 7201 - DNA, 19 bp, Homo sapiens
tgagcctctggctgccaga

SEQ ID NO: 7202 - DNA, 18 bp, Homo sapiens
ccgtccacattcctcact

SEQ ID NO: 7203 - DNA, 20 bp, Homo sapiens
gttgaggcccgcctgcgctt

SEQ ID NO: 7204 - DNA, 19 bp, Homo sapiens
cctcttctagttaccacgg

SEQ ID NO: 7205 - DNA, 19 bp, Homo sapiens
ctgcagctcctctgccttt

SEQ ID NO: 7206 - DNA, 20 bp, Homo sapiens
gctgcctcctcagcagcctc

SEQ ID NO: 7207 - DNA, 17 bp, Homo sapiens
tcacaatcatcttctcc

SEQ ID NO: 7208 - DNA, 16 bp, Homo sapiens
tcacgctcagcacaca

SEQ ID NO: 7209 - DNA, 21 bp, Homo sapiens
ccctcctttttccagtgccca

SEQ ID NO: 7210 - DNA, 18 bp, Homo sapiens
cctgccaggaatttccaa

SEQ ID NO: 7211 - DNA, 23 bp, Homo sapiens
gaacctaaggtggaaacactgtc

SEQ ID NO: 7212 - DNA, 21 bp, Homo sapiens
gcgcggagccgaagcagccgc

SEQ ID NO: 7213 - DNA, 18 bp, Homo sapiens
gggtcccccacaccctca

SEQ ID NO: 7214 - DNA, 20 bp, Homo sapiens
tctctgcaatgctgtgggca

SEQ ID NO: 7215 - DNA, 20 bp, Homo sapiens
gagaagtaatattgtgaact

SEQ ID NO: 7216 - DNA, 24 bp, Homo sapiens
gcggagagaagggtctttccacct

SEQ ID NO: 7217 - DNA, 21 bp, Homo sapiens
taggaaattcctaggtctagt

SEQ ID NO: 7218 - DNA, 16 bp, Homo sapiens
tcctctaaaaatgtta

SEQ ID NO: 7219 - DNA, 19 bp, Homo sapiens
actgcctaaatgatgcccg

SEQ ID NO: 7220 - DNA, 20 bp, Homo sapiens
atcagcaaatgaaagctttt

SEQ ID NO: 7221 - DNA, 20 bp, Homo sapiens
cactgcctaaatgatgcccg

SEQ ID NO: 7222 - DNA, 22 bp, Homo sapiens
gggatgaatcacccttggccca

SEQ ID NO: 7223 - DNA, 20 bp, Homo sapiens
gtgaccatctgggtctgtgt

SEQ ID NO: 7224 - DNA, 19 bp, Homo sapiens
ctatttggcttcaagtata

SEQ ID NO: 7225 - DNA, 19 bp, Homo sapiens
gtttttaatattctcatct

SEQ ID NO: 7226 - DNA, 18 bp, Homo sapiens
ctccagaaggggtccacg

SEQ ID NO: 7227 - DNA, 18 bp, Homo sapiens
gatgtttcaatgtgagac

SEQ ID NO: 7228 - DNA, 17 bp, Homo sapiens
tgactgttaccatgtga

SEQ ID NO: 7229 - DNA, 19 bp, Homo sapiens
tgtgttggccggttctgaa

SEQ ID NO: 7230 - DNA, 17 bp, Homo sapiens
accaccatcattgtcta

SEQ ID NO: 7231 - DNA, 23 bp, Homo sapiens
agaagaatttctgttctcacacc

SEQ ID NO: 7232 - DNA, 18 bp, Homo sapiens
cacagacaaagagcccat

SEQ ID NO: 7233 - DNA, 18 bp, Homo sapiens
gcccggctgctacctctg

SEQ ID NO: 7234 - DNA, 19 bp, Homo sapiens
tcagctgccccttacttca

SEQ ID NO: 7235 - DNA, 21 bp, Homo sapiens
tgctgtctcctcaactcaacc

SEQ ID NO: 7236 - DNA, 20 bp, Homo sapiens
aaaatgagaagatgtgacct

SEQ ID NO: 7237 - DNA, 18 bp, Homo sapiens
caaccttcaaggccacga

SEQ ID NO: 7238 - DNA, 20 bp, Homo sapiens
caggctgtggatccttgcca

SEQ ID NO: 7239 - DNA, 21 bp, Homo sapiens
gctgtaatatcggcacaggga

SEQ ID NO: 7240 - DNA, 20 bp, Homo sapiens
tgggcttcagcaacctgcca

SEQ ID NO: 7241 - DNA, 18 bp, Homo sapiens
caaatgttatggcagggc

SEQ ID NO: 7242 - DNA, 26 bp, Homo sapiens
tcctcctttcccctttctctttcctc

SEQ ID NO: 7243 - DNA, 19 bp, Homo sapiens
aaccaagggaaatactgct

SEQ ID NO: 7244 - DNA, 17 bp, Homo sapiens
caaggcacagccagggc

SEQ ID NO: 7245 - DNA, 20 bp, Homo sapiens
cagggcacagttaggcctgg

SEQ ID NO: 7246 - DNA, 19 bp, Homo sapiens
cgaagtgtgtcatgtgccg

SEQ ID NO: 7247 - DNA, 16 bp, Homo sapiens
cttctgtgttatttta

SEQ ID NO: 7248 - DNA, 21 bp, Homo sapiens
tgccagacctcggggaggata

SEQ ID NO: 7249 - DNA, 19 bp, Homo sapiens
tggccccttggcaggtaag

SEQ ID NO: 7250 - DNA, 18 bp, Homo sapiens
cgtcatgtctctaaactg

SEQ ID NO: 7251 - DNA, 19 bp, Homo sapiens
ctgtgggtgaagcgcctca

SEQ ID NO: 7252 - DNA, 16 bp, Homo sapiens
gcgcccgccgtctgct

SEQ ID NO: 7253 - DNA, 16 bp, Homo sapiens
tgccaggctcacttca

SEQ ID NO: 7254 - DNA, 21 bp, Homo sapiens
agacccccctacccccgccca

SEQ ID NO: 7255 - DNA, 23 bp, Homo sapiens
catccaaggaccctccaaggctg

SEQ ID NO: 7256 - DNA, 17 bp, Homo sapiens
cccccacccctgcctcc

SEQ ID NO: 7257 - DNA, 21 bp, Homo sapiens
cttgaaggtcctctgcctcca

SEQ ID NO: 7258 - DNA, 21 bp, Homo sapiens
gcttctcgagggcttggggga

SEQ ID NO: 7259 - DNA, 16 bp, Homo sapiens
tgcggctgccggcagg

SEQ ID NO: 7260 - DNA, 18 bp, Homo sapiens
ccctggccttgggtctgc

SEQ ID NO: 7261 - DNA, 19 bp, Homo sapiens
gccatctcggcaggatctc

SEQ ID NO: 7262 - DNA, 22 bp, Homo sapiens
gcctggacctttaggcctgcct

SEQ ID NO: 7263 - DNA, 17 bp, Homo sapiens
ctccctcctctccctct

SEQ ID NO: 7264 - DNA, 24 bp, Homo sapiens
agtaattttagaagcattatttta

SEQ ID NO: 7265 - DNA, 21 bp, Homo sapiens
ccgcctcgcacccccacctct

SEQ ID NO: 7266 - DNA, 18 bp, Homo sapiens
gaagaaattttttttggc

SEQ ID NO: 7267 - DNA, 20 bp, Homo sapiens
gtaaagccatttacataata

SEQ ID NO: 7268 - DNA, 19 bp, Homo sapiens
gtatgtggcatttatttgg

SEQ ID NO: 7269 - DNA, 17 bp, Homo sapiens
tgggtaaagccatttac

SEQ ID NO: 7270 - DNA, 21 bp, Homo sapiens
ccagtgtcctctggcctgctg

SEQ ID NO: 7271 - DNA, 19 bp, Homo sapiens
agaccaaaaattctgatga

SEQ ID NO: 7272 - DNA, 17 bp, Homo sapiens
gcatctagattattttt

SEQ ID NO: 7273 - DNA, 20 bp, Homo sapiens
ggccgcgatcgggcttagtc

SEQ ID NO: 7274 - DNA, 19 bp, Homo sapiens
catgtactacgtgccagct

SEQ ID NO: 7275 - DNA, 21 bp, Homo sapiens
ccttcccctacacctccctcc

SEQ ID NO: 7276 - DNA, 23 bp, Homo sapiens
actgcaaacagaaatcaggtgtt

SEQ ID NO: 7277 - DNA, 16 bp, Homo sapiens
gatgactttctgtttt

SEQ ID NO: 7278 - DNA, 21 bp, Homo sapiens
actttcttggtatgctggcca

SEQ ID NO: 7279 - DNA, 25 bp, Homo sapiens
aggaccattcatgcaatgactattt

SEQ ID NO: 7280 - DNA, 21 bp, Homo sapiens
gatgcctcatcttgcctttcc

SEQ ID NO: 7281 - DNA, 19 bp, Homo sapiens
tccctgatggctgtcaaca

SEQ ID NO: 7282 - DNA, 19 bp, Homo sapiens
catcctcttcttttagcag

SEQ ID NO: 7283 - DNA, 19 bp, Homo sapiens
cctctctactaaaactaca

SEQ ID NO: 7284 - DNA, 17 bp, Homo sapiens
gcaatttgggagtccga

SEQ ID NO: 7285 - DNA, 18 bp, Homo sapiens
gtctgggctgggtccggt

SEQ ID NO: 7286 - DNA, 23 bp, Homo sapiens
tgtaggggaactcatttggggtg

SEQ ID NO: 7287 - DNA, 20 bp, Homo sapiens
aagcaagaacaccatcctac

SEQ ID NO: 7288 - DNA, 18 bp, Homo sapiens
acaccatcctacataata

SEQ ID NO: 7289 - DNA, 22 bp, Homo sapiens
tggtctcaaactcctaggttca

SEQ ID NO: 7290 - DNA, 18 bp, Homo sapiens
tgttgggactttcttgaa

SEQ ID NO: 7291 - DNA, 19 bp, Homo sapiens
tttttttttttttttgaca

SEQ ID NO: 7292 - DNA, 21 bp, Homo sapiens
tggacagtcagcaaggaattg

SEQ ID NO: 7293 - DNA, 19 bp, Homo sapiens
tagatgtatatatttccta

SEQ ID NO: 7294 - DNA, 18 bp, Homo sapiens
tatattgttttcagtgta

SEQ ID NO: 7295 - DNA, 19 bp, Homo sapiens
ggctctggcgcgccagccg

SEQ ID NO: 7296 - DNA, 20 bp, Homo sapiens
gtttgcttagttctcactgt

SEQ ID NO: 7297 - DNA, 19 bp, Homo sapiens
aaagttgggagcatggcag

SEQ ID NO: 7298 - DNA, 22 bp, Homo sapiens
caggcttcggaggccacaagct

SEQ ID NO: 7299 - DNA, 16 bp, Homo sapiens
gagtcacactacatgc

SEQ ID NO: 7300 - DNA, 19 bp, Homo sapiens
ggccgggtgcggtggctca

SEQ ID NO: 7301 - DNA, 19 bp, Homo sapiens
tgcaggggtgtggagtagg

SEQ ID NO: 7302 - DNA, 18 bp, Homo sapiens
ctgtagccccctctgcca

SEQ ID NO: 7303 - DNA, 22 bp, Homo sapiens
taaatggatgcaatggaagcta

SEQ ID NO: 7304 - DNA, 18 bp, Homo sapiens
agcgtttcctaatccctc

SEQ ID NO: 7305 - DNA, 22 bp, Homo sapiens
ccatggctattccagcacccca

SEQ ID NO: 7306 - DNA, 22 bp, Homo sapiens
ctgtaattgccaagtcctctaa

SEQ ID NO: 7307 - DNA, 25 bp, Homo sapiens
tcctggatcactcctttgcactcca

SEQ ID NO: 7308 - DNA, 22 bp, Homo sapiens
tcttagatcacatttagtagca

SEQ ID NO: 7309 - DNA, 20 bp, Homo sapiens
aaaccccaaccaaacaaaac

SEQ ID NO: 7310 - DNA, 21 bp, Homo sapiens
aggccggcgccgcacacacac

SEQ ID NO: 7311 - DNA, 16 bp, Homo sapiens
actggcaagatcacta

SEQ ID NO: 7312 - DNA, 21 bp, Homo sapiens
atcagaaaatattcaatacag

SEQ ID NO: 7313 - DNA, 24 bp, Homo sapiens
cttaggcacaggagatccactttt

SEQ ID NO: 7314 - DNA, 18 bp, Homo sapiens
ggaaaatgcaataaaata

SEQ ID NO: 7315 - DNA, 17 bp, Homo sapiens
ggcatctgaagtacaat

SEQ ID NO: 7316 - DNA, 22 bp, Homo sapiens
ttattattgcactttatcctga

SEQ ID NO: 7317 - DNA, 22 bp, Homo sapiens
ttgaatactgtttcttcagtca

SEQ ID NO: 7318 - DNA, 18 bp, Homo sapiens
aaactggcagtcagtgtt

SEQ ID NO: 7319 - DNA, 18 bp, Homo sapiens
tgggccctcgctcctgac

SEQ ID NO: 7320 - DNA, 23 bp, Homo sapiens
acttgtttttattgcatttgctg

SEQ ID NO: 7321 - DNA, 18 bp, Homo sapiens
tcaacaaggtatacctca

SEQ ID NO: 7322 - DNA, 18 bp, Homo sapiens
tgctattttttttaaatc

SEQ ID NO: 7323 - DNA, 19 bp, Homo sapiens
catagactagtcctatgga

SEQ ID NO: 7324 - DNA, 21 bp, Homo sapiens
gcggcaagcgtgtttctaggt

SEQ ID NO: 7325 - DNA, 24 bp, Homo sapiens
gggaacggcggtggccggtgcggc

SEQ ID NO: 7326 - DNA, 18 bp, Homo sapiens
tgaacatgggagctcttg

SEQ ID NO: 7327 - DNA, 19 bp, Homo sapiens
tgcacttattgtccccttt

SEQ ID NO: 7328 - DNA, 20 bp, Homo sapiens
cccgccttttataaacctct

SEQ ID NO: 7329 - DNA, 18 bp, Homo sapiens
gcctccactcccacttcc

SEQ ID NO: 7330 - DNA, 21 bp, Homo sapiens
aacaggggcagccgtgtagcc

SEQ ID NO: 7331 - DNA, 22 bp, Homo sapiens
atcttggctcactgcaacctct

SEQ ID NO: 7332 - DNA, 18 bp, Homo sapiens
ggcagctcacctgtactg

SEQ ID NO: 7333 - DNA, 18 bp, Homo sapiens
taaatccaaccaattttc

SEQ ID NO: 7334 - DNA, 17 bp, Homo sapiens
tcaagtgattctcttgc

SEQ ID NO: 7335 - DNA, 19 bp, Homo sapiens
tcacatggaggcattgatg

SEQ ID NO: 7336 - DNA, 18 bp, Homo sapiens
tctacctcctgggttcaa

SEQ ID NO: 7337 - DNA, 16 bp, Homo sapiens
tgatgacaatcagtta

SEQ ID NO: 7338 - DNA, 18 bp, Homo sapiens
gctaggtgacagcgtacc

SEQ ID NO: 7339 - DNA, 19 bp, Homo sapiens
ccatgccctcagcaccact

SEQ ID NO: 7340 - DNA, 19 bp, Homo sapiens
ctcttcccaacttcctcca

SEQ ID NO: 7341 - DNA, 21 bp, Homo sapiens
gctgggagcccttttgtttta

SEQ ID NO: 7342 - DNA, 19 bp, Homo sapiens
caacccccaccctgcctct

SEQ ID NO: 7343 - DNA, 22 bp, Homo sapiens
ccatgcggctgcctgcacccca

SEQ ID NO: 7344 - DNA, 19 bp, Homo sapiens
gctctgggtacagggcagc

SEQ ID NO: 7345 - DNA, 27 bp, Homo sapiens
tgctgtctccccactaggatcattcca

SEQ ID NO: 7346 - DNA, 18 bp, Homo sapiens
actcttgctgtgaaattg

SEQ ID NO: 7347 - DNA, 20 bp, Homo sapiens
gttcctcttaactacggtgt

SEQ ID NO: 7348 - DNA, 18 bp, Homo sapiens
tagtaatataggctttca

SEQ ID NO: 7349 - DNA, 18 bp, Homo sapiens
tgatccaaagcagaatca

SEQ ID NO: 7350 - DNA, 16 bp, Homo sapiens
agcagacacaggtgta

SEQ ID NO: 7351 - DNA, 17 bp, Homo sapiens
actgtcagtgggaaacc

SEQ ID NO: 7352 - DNA, 19 bp, Homo sapiens
acttacttatttttatcta

SEQ ID NO: 7353 - DNA, 22 bp, Homo sapiens
agaaaacaaacagcccaagtga

SEQ ID NO: 7354 - DNA, 18 bp, Homo sapiens
cctgacttccccttattc

SEQ ID NO: 7355 - DNA, 21 bp, Homo sapiens
tcatagaaaatcaatctggtg

SEQ ID NO: 7356 - DNA, 19 bp, Homo sapiens
tctgtatctagttgtatta

SEQ ID NO: 7357 - DNA, 18 bp, Homo sapiens
tgtggttgggttcactca

SEQ ID NO: 7358 - DNA, 24 bp, Homo sapiens
cccagagacagcccccacatccca

SEQ ID NO: 7359 - DNA, 19 bp, Homo sapiens
gctctggagaggcccccac

SEQ ID NO: 7360 - DNA, 23 bp, Homo sapiens
gtttcatcatattggtcagggtg

SEQ ID NO: 7361 - DNA, 18 bp, Homo sapiens
tctacctcctgggttcaa

SEQ ID NO: 7362 - DNA, 20 bp, Homo sapiens
tgtcccattccctctctgta

SEQ ID NO: 7363 - DNA, 23 bp, Homo sapiens
aaatatagttatatttcatactt

SEQ ID NO: 7364 - DNA, 19 bp, Homo sapiens
aacaagtatatctaaccca

SEQ ID NO: 7365 - DNA, 20 bp, Homo sapiens
acattttgtaaccctgtaaa

SEQ ID NO: 7366 - DNA, 18 bp, Homo sapiens
atctgtttacaggcatta

SEQ ID NO: 7367 - DNA, 19 bp, Homo sapiens
ccagtctgtccccatctct

SEQ ID NO: 7368 - DNA, 22 bp, Homo sapiens
taaatggctgtgtgtggaattg

SEQ ID NO: 7369 - DNA, 21 bp, Homo sapiens
tcaattcattccttcatctct

SEQ ID NO: 7370 - DNA, 18 bp, Homo sapiens
tccgcctcctgggttcaa

SEQ ID NO: 7371 - DNA, 20 bp, Homo sapiens
aggtcatgctgttacaggtg

SEQ ID NO: 7372 - DNA, 17 bp, Homo sapiens
tacttcaaactgtttcc

SEQ ID NO: 7373 - DNA, 23 bp, Homo sapiens
tcaggtaaaaggtcatgctgtta

SEQ ID NO: 7374 - DNA, 19 bp, Homo sapiens
tgtgcataaataatacttc

SEQ ID NO: 7375 - DNA, 16 bp, Homo sapiens
ttttcactaattttgc

SEQ ID NO: 7376 - DNA, 19 bp, Homo sapiens
cctgggtgccagcgcccca

SEQ ID NO: 7377 - DNA, 22 bp, Homo sapiens
actttgcctcttctcctgcctc

SEQ ID NO: 7378 - DNA, 20 bp, Homo sapiens
agtggtaactgcagttcctc

SEQ ID NO: 7379 - DNA, 18 bp, Homo sapiens
ctccctctcctctcctct

SEQ ID NO: 7380 - DNA, 20 bp, Homo sapiens
ggtattctaatgaggagctg

SEQ ID NO: 7381 - DNA, 19 bp, Homo sapiens
gtagtatccctggctgcta

SEQ ID NO: 7382 - DNA, 20 bp, Homo sapiens
tgtgggtgtgtttgtgtgtg

SEQ ID NO: 7383 - DNA, 23 bp, Homo sapiens
gcttggatcgtggaagaagggcc

SEQ ID NO: 7384 - DNA, 17 bp, Homo sapiens
caagcttcagccccctc

SEQ ID NO: 7385 - DNA, 21 bp, Homo sapiens
ccacccccattctccaagctt

SEQ ID NO: 7386 - DNA, 22 bp, Homo sapiens
cctgagcaatcccaggtccagc

SEQ ID NO: 7387 - DNA, 19 bp, Homo sapiens
accccaaaggtatttttga

SEQ ID NO: 7388 - DNA, 22 bp, Homo sapiens
accccccgccacacacacacac

SEQ ID NO: 7389 - DNA, 20 bp, Homo sapiens
acttgtctgagcctcacatc

SEQ ID NO: 7390 - DNA, 17 bp, Homo sapiens
cccaccaacttctccca

SEQ ID NO: 7391 - DNA, 22 bp, Homo sapiens
ccttcccccattcgccttccca

SEQ ID NO: 7392 - DNA, 18 bp, Homo sapiens
gtcttctcctcctctcca

SEQ ID NO: 7393 - DNA, 18 bp, Homo sapiens
tccgcatcccaggttcaa

SEQ ID NO: 7394 - DNA, 22 bp, Homo sapiens
tctcttcagacccctttgcctt

SEQ ID NO: 7395 - DNA, 17 bp, Homo sapiens
tctggtgactctgtgag

SEQ ID NO: 7396 - DNA, 19 bp, Homo sapiens
tgtggatgctcctggaatg

SEQ ID NO: 7397 - DNA, 21 bp, Homo sapiens
ttctctggcttcttttagcaa

SEQ ID NO: 7398 - DNA, 16 bp, Homo sapiens
agccgtcagccaagtc

SEQ ID NO: 7399 - DNA, 17 bp, Homo sapiens
aggcctccagttcattt

SEQ ID NO: 7400 - DNA, 18 bp, Homo sapiens
atgagcgtcgcacagaca

SEQ ID NO: 7401 - DNA, 21 bp, Homo sapiens
ccagatccctctccagtgaca

SEQ ID NO: 7402 - DNA, 23 bp, Homo sapiens
tgaggctctgtaaccttatctaa

SEQ ID NO: 7403 - DNA, 17 bp, Homo sapiens
tgcaaaatgtcatagct

SEQ ID NO: 7404 - DNA, 21 bp, Homo sapiens
tccagaccctgacacctctca

SEQ ID NO: 7405 - DNA, 19 bp, Homo sapiens
tggtctgtgagtttttgaa

SEQ ID NO: 7406 - DNA, 22 bp, Homo sapiens
cgaccgcccaaggcaacggagg

SEQ ID NO: 7407 - DNA, 16 bp, Homo sapiens
gatggcggaggctgtg

SEQ ID NO: 7408 - DNA, 22 bp, Homo sapiens
gcacttaccctccacttcctcc

SEQ ID NO: 7409 - DNA, 25 bp, Homo sapiens
cttctatacaacttgttttaacctt

SEQ ID NO: 7410 - DNA, 17 bp, Homo sapiens
tcaagtgattctcctgc

SEQ ID NO: 7411 - DNA, 22 bp, Homo sapiens
tgcttccaaagtggcctactca

SEQ ID NO: 7412 - DNA, 16 bp, Homo sapiens
tttctgaccaatagtg

SEQ ID NO: 7413 - DNA, 18 bp, Homo sapiens
ctacctgggtcctcagtg

SEQ ID NO: 7414 - DNA, 23 bp, Homo sapiens
ctccaaataatacacagaatcct

SEQ ID NO: 7415 - DNA, 22 bp, Homo sapiens
gtatgcctgtattgctgggctg

SEQ ID NO: 7416 - DNA, 20 bp, Homo sapiens
tagctcacttgctatgctgc

SEQ ID NO: 7417 - DNA, 23 bp, Homo sapiens
aaggaaggggttggattgcaata

SEQ ID NO: 7418 - DNA, 22 bp, Homo sapiens
agattctagatcagatgctcca

SEQ ID NO: 7419 - DNA, 19 bp, Homo sapiens
atgttgcccccgtgagcca

SEQ ID NO: 7420 - DNA, 21 bp, Homo sapiens
caaccctccacctggtactcc

SEQ ID NO: 7421 - DNA, 18 bp, Homo sapiens
caagactctagagtccaa

SEQ ID NO: 7422 - DNA, 19 bp, Homo sapiens
ctcccctgccgctgtgcca

SEQ ID NO: 7423 - DNA, 17 bp, Homo sapiens
ctccctctcaggatcca

SEQ ID NO: 7424 - DNA, 24 bp, Homo sapiens
gggacagcccggccctgccccctc

SEQ ID NO: 7425 - DNA, 19 bp, Homo sapiens
tagcatcaccatctgtaaa

SEQ ID NO: 7426 - DNA, 20 bp, Homo sapiens
cctccgcgcggctgcagcta

SEQ ID NO: 7427 - DNA, 18 bp, Homo sapiens
aggaccttcatgtgccaa

SEQ ID NO: 7428 - DNA, 26 bp, Homo sapiens
aacaaaaagaacaaaaaaatctgcag

SEQ ID NO: 7429 - DNA, 22 bp, Homo sapiens
ctctgcttatgaggacctcgaa

SEQ ID NO: 7430 - DNA, 22 bp, Homo sapiens
gagagctgacaccaagtcctcc

SEQ ID NO: 7431 - DNA, 19 bp, Homo sapiens
gccggacaccaggttttga

SEQ ID NO: 7432 - DNA, 19 bp, Homo sapiens
gtggctttgagggcttttg

SEQ ID NO: 7433 - DNA, 27 bp, Homo sapiens
agaagagagagatgtggaaggcacctt

SEQ ID NO: 7434 - DNA, 20 bp, Homo sapiens
atctgtgacctccaggcagc

SEQ ID NO: 7435 - DNA, 21 bp, Homo sapiens
ccccacagtaccccttcagct

SEQ ID NO: 7436 - DNA, 22 bp, Homo sapiens
tgacaacagtacccatccccca

SEQ ID NO: 7437 - DNA, 17 bp, Homo sapiens
tgtagactcccggactt

SEQ ID NO: 7438 - DNA, 19 bp, Homo sapiens
tgcccccaaacctgtactg

SEQ ID NO: 7439 - DNA, 17 bp, Homo sapiens
cagaaacaactttctcc

SEQ ID NO: 7440 - DNA, 19 bp, Homo sapiens
cctggacttgttttaaact

SEQ ID NO: 7441 - DNA, 22 bp, Homo sapiens
ccttgggaaatggggctgtgag

SEQ ID NO: 7442 - DNA, 23 bp, Homo sapiens
ttaggcctaagaggctttctcca

SEQ ID NO: 7443 - DNA, 19 bp, Homo sapiens
cccagagtcctgctctcag

SEQ ID NO: 7444 - DNA, 23 bp, Homo sapiens
cccttagtaacaaacacaattta

SEQ ID NO: 7445 - DNA, 26 bp, Homo sapiens
ccccatttctagaacatccctgccag

SEQ ID NO: 7446 - DNA, 23 bp, Homo sapiens
gggaagtgtaagaaacacactga

SEQ ID NO: 7447 - DNA, 21 bp, Homo sapiens
ggggaaggaggctggcttgtc

SEQ ID NO: 7448 - DNA, 22 bp, Homo sapiens
tccaggggatgggaggttgtgg

SEQ ID NO: 7449 - DNA, 25 bp, Homo sapiens
tggatgctccttccaacaggagctg

SEQ ID NO: 7450 - DNA, 19 bp, Homo sapiens
cctgggggtggctttaaat

SEQ ID NO: 7451 - DNA, 24 bp, Homo sapiens
tcctggggaagaagactctgtgga

SEQ ID NO: 7452 - DNA, 17 bp, Homo sapiens
cccccaaaaacccacca

SEQ ID NO: 7453 - DNA, 20 bp, Homo sapiens
cgccccggacgaccatgaga

SEQ ID NO: 7454 - DNA, 16 bp, Homo sapiens
cggggcgcccttgtct

SEQ ID NO: 7455 - DNA, 22 bp, Homo sapiens
tgtactctttgctagtaccaaa

SEQ ID NO: 7456 - DNA, 25 bp, Homo sapiens
tctcattttggtttgttttaatttt

SEQ ID NO: 7457 - DNA, 19 bp, Homo sapiens
cgcccccacctccaccctc

SEQ ID NO: 7458 - DNA, 19 bp, Homo sapiens
ttgcaagattccaagttct

SEQ ID NO: 7459 - DNA, 17 bp, Homo sapiens
aaatcagttggcaggca

SEQ ID NO: 7460 - DNA, 21 bp, Homo sapiens
agtaagtttttttagaagaca

SEQ ID NO: 7461 - DNA, 22 bp, Homo sapiens
atagtaagtttttttagaagac

SEQ ID NO: 7462 - DNA, 18 bp, Homo sapiens
ctgagagcacggtggggc

SEQ ID NO: 7463 - DNA, 17 bp, Homo sapiens
gctacatatatgcaata

SEQ ID NO: 7464 - DNA, 19 bp, Homo sapiens
tgtggtaaggtacctctca

SEQ ID NO: 7465 - DNA, 21 bp, Homo sapiens
actgtctcaactgtggtgtta

SEQ ID NO: 7466 - DNA, 22 bp, Homo sapiens
tgggtgggctcctcttggggat

SEQ ID NO: 7467 - DNA, 24 bp, Homo sapiens
agggatcgagattgggtcaggtta

SEQ ID NO: 7468 - DNA, 19 bp, Homo sapiens
gtttccaggatagatgttg

SEQ ID NO: 7469 - DNA, 30 bp, Homo sapiens
tacaaaactcaaaagttgtttgcacagctg

SEQ ID NO: 7470 - DNA, 23 bp, Homo sapiens
tgggtcaggttagcatggggttg

SEQ ID NO: 7471 - DNA, 20 bp, Homo sapiens
cacaccatctttccatccca

SEQ ID NO: 7472 - DNA, 18 bp, Homo sapiens
catatggcaataggtgtg

SEQ ID NO: 7473 - DNA, 16 bp, Homo sapiens
ccagcctcccccaatg

SEQ ID NO: 7474 - DNA, 24 bp, Homo sapiens
ccccccccacacaccatctttcca

SEQ ID NO: 7475 - DNA, 18 bp, Homo sapiens
tgggtggatcacctgagg

SEQ ID NO: 7476 - DNA, 19 bp, Homo sapiens
aaatgaggaggtacattga

SEQ ID NO: 7477 - DNA, 23 bp, Homo sapiens
acttgtggttgaccgcttgtttc

SEQ ID NO: 7478 - DNA, 17 bp, Homo sapiens
ccacatgaactacgtga

SEQ ID NO: 7479 - DNA, 24 bp, Homo sapiens
gaggggaaaaaattaactgctcca

SEQ ID NO: 7480 - DNA, 22 bp, Homo sapiens
gaactgtcagcatgttgttgtt

SEQ ID NO: 7481 - DNA, 21 bp, Homo sapiens
gcaagttaacacaacgtaaca

SEQ ID NO: 7482 - DNA, 22 bp, Homo sapiens
ggtaagaaattgaagtatcctt

SEQ ID NO: 7483 - DNA, 19 bp, Homo sapiens
tgaaaatctagccatccta

SEQ ID NO: 7484 - DNA, 21 bp, Homo sapiens
aacagtccaagattaccattt

SEQ ID NO: 7485 - DNA, 17 bp, Homo sapiens
aataatgatactgtcaa

SEQ ID NO: 7486 - DNA, 22 bp, Homo sapiens
taaaggacaaaataagctgttt

SEQ ID NO: 7487 - DNA, 23 bp, Homo sapiens
taacccgctcatcactggatgaa

SEQ ID NO: 7488 - DNA, 24 bp, Homo sapiens
tgcaaatgcaagctagtggcttca

SEQ ID NO: 7489 - DNA, 19 bp, Homo sapiens
tgcgtgtttctgactctga

SEQ ID NO: 7490 - DNA, 24 bp, Homo sapiens
ttagtccctcatgcaaatcaatta

SEQ ID NO: 7491 - DNA, 20 bp, Homo sapiens
ttctgccttctcatgatcca

SEQ ID NO: 7492 - DNA, 21 bp, Homo sapiens
tttccccccatacaatacaag

SEQ ID NO: 7493 - DNA, 18 bp, Homo sapiens
agaacagagacattgcca

SEQ ID NO: 7494 - DNA, 18 bp, Homo sapiens
agttctttctttttctca

SEQ ID NO: 7495 - DNA, 21 bp, Homo sapiens
cactactgtccgtggctacaa

SEQ ID NO: 7496 - DNA, 22 bp, Homo sapiens
cctctcttccccccaatatctc

SEQ ID NO: 7497 - DNA, 18 bp, Homo sapiens
cgccggccccagcaccca

SEQ ID NO: 7498 - DNA, 21 bp, Homo sapiens
ctacagctttgggtcattttt

SEQ ID NO: 7499 - DNA, 19 bp, Homo sapiens
cttctttcttgctttgacc

SEQ ID NO: 7500 - DNA, 18 bp, Homo sapiens
gattcatgtcactactgt

SEQ ID NO: 7501 - DNA, 21 bp, Homo sapiens
ggcagttattgggtttggtca

SEQ ID NO: 7502 - DNA, 21 bp, Homo sapiens
tcaccaggctgagaccctacc

SEQ ID NO: 7503 - DNA, 18 bp, Homo sapiens
tccctccacaactcagtt

SEQ ID NO: 7504 - DNA, 19 bp, Homo sapiens
tttctgctgccttgggttt

SEQ ID NO: 7505 - DNA, 22 bp, Homo sapiens
attgatgcaatttgatattttt

SEQ ID NO: 7506 - DNA, 22 bp, Homo sapiens
catgctgggtgatgaaagatta

SEQ ID NO: 7507 - DNA, 22 bp, Homo sapiens
cttaagctaccagattgctttt

SEQ ID NO: 7508 - DNA, 23 bp, Homo sapiens
ttcccctgagggaatcgcttttt

SEQ ID NO: 7509 - DNA, 24 bp, Homo sapiens
tttgaaaaatgtattttatcatta

SEQ ID NO: 7510 - DNA, 20 bp, Homo sapiens
aacaagtgtgatgccatatc

SEQ ID NO: 7511 - DNA, 18 bp, Homo sapiens
atggaaaaaatacattga

SEQ ID NO: 7512 - DNA, 21 bp, Homo sapiens
ccagaggagctctcccccttg

SEQ ID NO: 7513 - DNA, 19 bp, Homo sapiens
ccttatatcatgtacctca

SEQ ID NO: 7514 - DNA, 23 bp, Homo sapiens
cgcagaacaccccatgcgtgctg

SEQ ID NO: 7515 - DNA, 18 bp, Homo sapiens
gagaatatgtatgcctgc

SEQ ID NO: 7516 - DNA, 22 bp, Homo sapiens
gagcagccagcaagtaagctag

SEQ ID NO: 7517 - DNA, 18 bp, Homo sapiens
gccaacaaaccctctgta

SEQ ID NO: 7518 - DNA, 21 bp, Homo sapiens
gccctgggagctctgggactg

SEQ ID NO: 7519 - DNA, 28 bp, Homo sapiens
gtatatgcgaacagttattgtttgatta

SEQ ID NO: 7520 - DNA, 20 bp, Homo sapiens
tgacatcctgcttcttcttc

SEQ ID NO: 7521 - DNA, 21 bp, Homo sapiens
tggagagcacagcatgcctta

SEQ ID NO: 7522 - DNA, 19 bp, Homo sapiens
acaacacaccctgctgcca

SEQ ID NO: 7523 - DNA, 19 bp, Homo sapiens
atccgcccacttcggtctc

SEQ ID NO: 7524 - DNA, 22 bp, Homo sapiens
catgatctcaactctcaactca

SEQ ID NO: 7525 - DNA, 19 bp, Homo sapiens
ccagaggcgttcgtatgtg

SEQ ID NO: 7526 - DNA, 21 bp, Homo sapiens
ctctgctgtgggggcccgtgg

SEQ ID NO: 7527 - DNA, 19 bp, Homo sapiens
ggcaatgatacctacctca

SEQ ID NO: 7528 - DNA, 24 bp, Homo sapiens
gtttggggcttcagtggggagctg

SEQ ID NO: 7529 - DNA, 21 bp, Homo sapiens
ccttccctttcattttttcca

SEQ ID NO: 7530 - DNA, 19 bp, Homo sapiens
tcactgatgactttttata

SEQ ID NO: 7531 - DNA, 20 bp, Homo sapiens
caaacctccaaaactcctgc

SEQ ID NO: 7532 - DNA, 23 bp, Homo sapiens
ccaacagatgcttttctgtctct

SEQ ID NO: 7533 - DNA, 17 bp, Homo sapiens
cccctgcccccacttcc

SEQ ID NO: 7534 - DNA, 22 bp, Homo sapiens
cccttccccactgcacacacct

SEQ ID NO: 7535 - DNA, 18 bp, Homo sapiens
cggccattcagcaagaca

SEQ ID NO: 7536 - DNA, 19 bp, Homo sapiens
tccagaaacggccattcag

SEQ ID NO: 7537 - DNA, 18 bp, Homo sapiens
tgcttttctgtctctgcc

SEQ ID NO: 7538 - DNA, 26 bp, Homo sapiens
agacctagaataatactagtcttata

SEQ ID NO: 7539 - DNA, 26 bp, Homo sapiens
taaatggacaaatgcttatgaaacta

SEQ ID NO: 7540 - DNA, 19 bp, Homo sapiens
gtgtttgtgtttgacccgc

SEQ ID NO: 7541 - DNA, 20 bp, Homo sapiens
cagctggtgtcggcatcata

SEQ ID NO: 7542 - DNA, 21 bp, Homo sapiens
ttgccttttctctccaccctt

SEQ ID NO: 7543 - DNA, 17 bp, Homo sapiens
ggctttggcataggctg

SEQ ID NO: 7544 - DNA, 21 bp, Homo sapiens
acctgggccagggttgcctca

SEQ ID NO: 7545 - DNA, 18 bp, Homo sapiens
tcttcaaaacgttagaga

SEQ ID NO: 7546 - DNA, 19 bp, Homo sapiens
ccacctccacacccacccc

SEQ ID NO: 7547 - DNA, 20 bp, Homo sapiens
gccacctccacacccacccc

SEQ ID NO: 7548 - DNA, 22 bp, Homo sapiens
gcccattcccaagggagactga

SEQ ID NO: 7549 - DNA, 18 bp, Homo sapiens
tctggagaaggcctggaa

SEQ ID NO: 7550 - DNA, 18 bp, Homo sapiens
cacgtggcagagctgtaa

SEQ ID NO: 7551 - DNA, 17 bp, Homo sapiens
aatctcaccctctcctc

SEQ ID NO: 7552 - DNA, 17 bp, Homo sapiens
agccttcctacacgtta

SEQ ID NO: 7553 - DNA, 21 bp, Homo sapiens
caagtaaaacaaaaccactgg

SEQ ID NO: 7554 - DNA, 21 bp, Homo sapiens
gggcggggcggggggctttgc

SEQ ID NO: 7555 - DNA, 18 bp, Homo sapiens
gtggggttatgtatcaga

SEQ ID NO: 7556 - DNA, 21 bp, Homo sapiens
tggctcgctcagctcctccac

SEQ ID NO: 7557 - DNA, 23 bp, Homo sapiens
tcctggagaaaagggatggagct

SEQ ID NO: 7558 - DNA, 20 bp, Homo sapiens
gcggagcctgagaaccaact

SEQ ID NO: 7559 - DNA, 18 bp, Homo sapiens
atgactttcctctgtaac

SEQ ID NO: 7560 - DNA, 18 bp, Homo sapiens
caccattctcctgcctca

SEQ ID NO: 7561 - DNA, 20 bp, Homo sapiens
cggggctccctgggcccggt

SEQ ID NO: 7562 - DNA, 18 bp, Homo sapiens
gccccatcgggcacccca

SEQ ID NO: 7563 - DNA, 17 bp, Homo sapiens
aaaaagaaaggaaatat

SEQ ID NO: 7564 - DNA, 22 bp, Homo sapiens
agaagggagtgtttcttgtgcc

SEQ ID NO: 7565 - DNA, 17 bp, Homo sapiens
ccacaacaaaggctcat

SEQ ID NO: 7566 - DNA, 20 bp, Homo sapiens
ccacaacaaaggctcatcaa

SEQ ID NO: 7567 - DNA, 22 bp, Homo sapiens
gtcacgggcgaactagaacact

SEQ ID NO: 7568 - DNA, 21 bp, Homo sapiens
taaaactactactatgatata

SEQ ID NO: 7569 - DNA, 18 bp, Homo sapiens
atagtgctgtatcactta

SEQ ID NO: 7570 - DNA, 24 bp, Homo sapiens
atgcacttcatactagcaatcaca

SEQ ID NO: 7571 - DNA, 18 bp, Homo sapiens
ctattggagcatacagta

SEQ ID NO: 7572 - DNA, 17 bp, Homo sapiens
ctccattagaccctcaa

SEQ ID NO: 7573 - DNA, 19 bp, Homo sapiens
gcgttttaactttatctca

SEQ ID NO: 7574 - DNA, 17 bp, Homo sapiens
tctttttcaccgttttt

SEQ ID NO: 7575 - DNA, 21 bp, Homo sapiens
tttcggtagcgttttaacttt

SEQ ID NO: 7576 - DNA, 15 bp, Homo sapiens
aacagaggctattgt

SEQ ID NO: 7577 - DNA, 21 bp, Homo sapiens
catccgatttctcctcctgcc

SEQ ID NO: 7578 - DNA, 23 bp, Homo sapiens
gagaactccatcagaaaaccaaa

SEQ ID NO: 7579 - DNA, 20 bp, Homo sapiens
tgaacctccaaatggaatta

SEQ ID NO: 7580 - DNA, 16 bp, Homo sapiens
tgaatgacttgacttc

SEQ ID NO: 7581 - DNA, 19 bp, Homo sapiens
cacaactgtcttagactgc

SEQ ID NO: 7582 - DNA, 19 bp, Homo sapiens
cacttaaattctctaaccg

SEQ ID NO: 7583 - DNA, 22 bp, Homo sapiens
aaaccctgtcctcccacccctc

SEQ ID NO: 7584 - DNA, 24 bp, Homo sapiens
agaccctcgagattaacggtgcta

SEQ ID NO: 7585 - DNA, 22 bp, Homo sapiens
ccaaaccctgtcctcccacccc

SEQ ID NO: 7586 - DNA, 18 bp, Homo sapiens
gccctgagctggcctcac

SEQ ID NO: 7587 - DNA, 20 bp, Homo sapiens
gacaaaatctgatccatata

SEQ ID NO: 7588 - DNA, 18 bp, Homo sapiens
gagttgacactgaaatct

SEQ ID NO: 7589 - DNA, 23 bp, Homo sapiens
gtacacagaaacaggactgctca

SEQ ID NO: 7590 - DNA, 20 bp, Homo sapiens
tcccccaacccccaccccac

SEQ ID NO: 7591 - DNA, 21 bp, Homo sapiens
aataggacagatgagtgtcat

SEQ ID NO: 7592 - DNA, 20 bp, Homo sapiens
aggttattttatttattgta

SEQ ID NO: 7593 - DNA, 21 bp, Homo sapiens
agtacaattagaaacactgtt

SEQ ID NO: 7594 - DNA, 19 bp, Homo sapiens
attgcgtgttcagatccaa

SEQ ID NO: 7595 - DNA, 16 bp, Homo sapiens
ccctcagactttaaga

SEQ ID NO: 7596 - DNA, 18 bp, Homo sapiens
gccactcatattaattta

SEQ ID NO: 7597 - DNA, 18 bp, Homo sapiens
gcttggtggtgaagccac

SEQ ID NO: 7598 - DNA, 26 bp, Homo sapiens
gtagtcctaagatgctggctatttta

SEQ ID NO: 7599 - DNA, 22 bp, Homo sapiens
taccgtttttattttcataaca

SEQ ID NO: 7600 - DNA, 18 bp, Homo sapiens
tctttacgatttaattga

SEQ ID NO: 7601 - DNA, 17 bp, Homo sapiens
acacacacccctgctca

SEQ ID NO: 7602 - DNA, 19 bp, Homo sapiens
aatccgaggagcaggactc

SEQ ID NO: 7603 - DNA, 19 bp, Homo sapiens
tgctctaattgtgaacttt

SEQ ID NO: 7604 - DNA, 19 bp, Homo sapiens
aatgcctctcccatcctct

SEQ ID NO: 7605 - DNA, 19 bp, Homo sapiens
cctccgatgaaagcagcca

SEQ ID NO: 7606 - DNA, 19 bp, Homo sapiens
ccttcttgggaaactgggc

SEQ ID NO: 7607 - DNA, 18 bp, Homo sapiens
ctcagggacagcaattca

SEQ ID NO: 7608 - DNA, 16 bp, Homo sapiens
ctgccaagtgctgctt

SEQ ID NO: 7609 - DNA, 19 bp, Homo sapiens
aaaggatcagtttggctgc

SEQ ID NO: 7610 - DNA, 18 bp, Homo sapiens
agaaccaccatgtcttca

SEQ ID NO: 7611 - DNA, 21 bp, Homo sapiens
ccctccccagccatcctcccc

SEQ ID NO: 7612 - DNA, 24 bp, Homo sapiens
cgctcccctgtcctcctccacctt

SEQ ID NO: 7613 - DNA, 21 bp, Homo sapiens
tcccctgccctactcatggag

SEQ ID NO: 7614 - DNA, 16 bp, Homo sapiens
tggcccttggactcca

SEQ ID NO: 7615 - DNA, 18 bp, Homo sapiens
gcatccgaactcctggat

SEQ ID NO: 7616 - DNA, 17 bp, Homo sapiens
aatctcatttggatgtg

SEQ ID NO: 7617 - DNA, 28 bp, Homo sapiens
atgtattggactttgaacattttctgaa

SEQ ID NO: 7618 - DNA, 19 bp, Homo sapiens
taacatgttagttgtcatt

SEQ ID NO: 7619 - DNA, 22 bp, Homo sapiens
tatctgcatttgtctggtaaca

SEQ ID NO: 7620 - DNA, 19 bp, Homo sapiens
tcttcagccacagttgtga

SEQ ID NO: 7621 - DNA, 22 bp, Homo sapiens
cctgttcatctcccaacatgct

SEQ ID NO: 7622 - DNA, 18 bp, Homo sapiens
ggtcttttccctgttcat

SEQ ID NO: 7623 - DNA, 18 bp, Homo sapiens
cctgcaacctccacctcc

SEQ ID NO: 7624 - DNA, 21 bp, Homo sapiens
aagggctaaacatgcatgtgt

SEQ ID NO: 7625 - DNA, 18 bp, Homo sapiens
gacttgacagtggaacta

SEQ ID NO: 7626 - DNA, 22 bp, Homo sapiens
ttctgtctctcccaaccccgga

SEQ ID NO: 7627 - DNA, 19 bp, Homo sapiens
cttgggcccagctgggctc

SEQ ID NO: 7628 - DNA, 23 bp, Homo sapiens
accccgaactctgctggccttga

SEQ ID NO: 7629 - DNA, 18 bp, Homo sapiens
ggaagacgcttccttcca

SEQ ID NO: 7630 - DNA, 19 bp, Homo sapiens
ctcctctgagctctgctct

SEQ ID NO: 7631 - DNA, 21 bp, Homo sapiens
cttctttaaaaccctttagcc

SEQ ID NO: 7632 - DNA, 19 bp, Homo sapiens
atatcctgggtaagaatgt

SEQ ID NO: 7633 - DNA, 20 bp, Homo sapiens
gacttcttaatatggtgctg

SEQ ID NO: 7634 - DNA, 20 bp, Homo sapiens
gttgaaaactgtatgccaaa

SEQ ID NO: 7635 - DNA, 18 bp, Homo sapiens
cctttccacacctgcaaa

SEQ ID NO: 7636 - DNA, 20 bp, Homo sapiens
tgtgctggaaggacaaataa

SEQ ID NO: 7637 - DNA, 15 bp, Homo sapiens
ttctctttaatctca

SEQ ID NO: 7638 - DNA, 15 bp, Homo sapiens
aataccagcataata

SEQ ID NO: 7639 - DNA, 21 bp, Homo sapiens
ctgctgccctccccctcctct

SEQ ID NO: 7640 - DNA, 24 bp, Homo sapiens
tcacactcatgcattgtcctcttt

SEQ ID NO: 7641 - DNA, 20 bp, Homo sapiens
cacctccacccccttcttcc

SEQ ID NO: 7642 - DNA, 16 bp, Homo sapiens
cccacctccaccccct

SEQ ID NO: 7643 - DNA, 24 bp, Homo sapiens
cttcaagatgcctcttctacctct

SEQ ID NO: 7644 - DNA, 21 bp, Homo sapiens
gactcacattgccttgagctt

SEQ ID NO: 7645 - DNA, 17 bp, Homo sapiens
tggctgtgcacattctc

SEQ ID NO: 7646 - DNA, 22 bp, Homo sapiens
tccagctggacaaagactctgg

SEQ ID NO: 7647 - DNA, 23 bp, Homo sapiens
tttctttgtatgcctttggcctt

SEQ ID NO: 7648 - DNA, 19 bp, Homo sapiens
cttccttggactcatttta

SEQ ID NO: 7649 - DNA, 16 bp, Homo sapiens
cctgcttcccagacca

SEQ ID NO: 7650 - DNA, 21 bp, Homo sapiens
aaacattttaaaacttacctt

SEQ ID NO: 7651 - DNA, 26 bp, Homo sapiens
aatctcaaactccagcactggaatta

SEQ ID NO: 7652 - DNA, 20 bp, Homo sapiens
acaaaaacattttaaaactt

SEQ ID NO: 7653 - DNA, 16 bp, Homo sapiens
gagctacaaaatttca

SEQ ID NO: 7654 - DNA, 16 bp, Homo sapiens
tgccattctcctgcct

SEQ ID NO: 7655 - DNA, 18 bp, Homo sapiens
ctgttggtttcacagata

SEQ ID NO: 7656 - DNA, 22 bp, Homo sapiens
ggtgaggttgaggaatatcaca

SEQ ID NO: 7657 - DNA, 18 bp, Homo sapiens
ttcttctgattctagtgt

SEQ ID NO: 7658 - DNA, 23 bp, Homo sapiens
acagtctggagaaggtattagca

SEQ ID NO: 7659 - DNA, 18 bp, Homo sapiens
cccctccaccaaacccca

SEQ ID NO: 7660 - DNA, 24 bp, Homo sapiens
cctaggcgattttgtctaccattt

SEQ ID NO: 7661 - DNA, 19 bp, Homo sapiens
ctcactttcccttgtgtca

SEQ ID NO: 7662 - DNA, 21 bp, Homo sapiens
gcctgggtcccggccaggctt

SEQ ID NO: 7663 - DNA, 15 bp, Homo sapiens
ggtttttctgtctca

SEQ ID NO: 7664 - DNA, 18 bp, Homo sapiens
aaatcctaccagttatgt

SEQ ID NO: 7665 - DNA, 20 bp, Homo sapiens
actccaggtagatttccaca

SEQ ID NO: 7666 - DNA, 21 bp, Homo sapiens
agcttttccccatttcccata

SEQ ID NO: 7667 - DNA, 23 bp, Homo sapiens
cctggtaccattgagttgctgct

SEQ ID NO: 7668 - DNA, 19 bp, Homo sapiens
gattgttgtgtgttttgtt

SEQ ID NO: 7669 - DNA, 21 bp, Homo sapiens
gttaagtgcctactggaaatg

SEQ ID NO: 7670 - DNA, 18 bp, Homo sapiens
tccaagagagtatcatga

SEQ ID NO: 7671 - DNA, 19 bp, Homo sapiens
tctgcttccagctttgtgt

SEQ ID NO: 7672 - DNA, 21 bp, Homo sapiens
tgaggtctgctaatatggaat

SEQ ID NO: 7673 - DNA, 19 bp, Homo sapiens
taaaataatgaatgtaaca

SEQ ID NO: 7674 - DNA, 19 bp, Homo sapiens
acagacaaattctctaatc

SEQ ID NO: 7675 - DNA, 19 bp, Homo sapiens
actcatttaccactctgtg

SEQ ID NO: 7676 - DNA, 21 bp, Homo sapiens
gtgataattggaaactccttt

SEQ ID NO: 7677 - DNA, 19 bp, Homo sapiens
acctgggccccactggaca

SEQ ID NO: 7678 - DNA, 21 bp, Homo sapiens
tcagctatgactcagtcccct

SEQ ID NO: 7679 - DNA, 21 bp, Homo sapiens
cttgggctgaaggatcgcttt

SEQ ID NO: 7680 - DNA, 18 bp, Homo sapiens
acttatttgccctaagaa

SEQ ID NO: 7681 - DNA, 24 bp, Homo sapiens
ccacgaacacgcatgcctcagcca

SEQ ID NO: 7682 - DNA, 24 bp, Homo sapiens
caattcgtacgtggagaagtggga

SEQ ID NO: 7683 - DNA, 24 bp, Homo sapiens
cagcgggctatggacaaggaagaa

SEQ ID NO: 7684 - DNA, 19 bp, Homo sapiens
catcccaccgccttctttt

SEQ ID NO: 7685 - DNA, 17 bp, Homo sapiens
cccgccccacccccagc

SEQ ID NO: 7686 - DNA, 18 bp, Homo sapiens
gtcacagaaaacatcagg

SEQ ID NO: 7687 - DNA, 20 bp, Homo sapiens
taaatggactccagatgaaa

SEQ ID NO: 7688 - DNA, 19 bp, Homo sapiens
cacagtatcttttctttca

SEQ ID NO: 7689 - DNA, 19 bp, Homo sapiens
tgcccgggccatgctccag

SEQ ID NO: 7690 - DNA, 23 bp, Homo sapiens
aaacagcagtcccagtattctca

SEQ ID NO: 7691 - DNA, 19 bp, Homo sapiens
atcctttctgcccacttcc

SEQ ID NO: 7692 - DNA, 22 bp, Homo sapiens
tgcagctccagccccgggctgc

SEQ ID NO: 7693 - DNA, 18 bp, Homo sapiens
tccccgccacccgcgcgc

SEQ ID NO: 7694 - DNA, 18 bp, Homo sapiens
acatctaaccttctagga

SEQ ID NO: 7695 - DNA, 18 bp, Homo sapiens
tgatggaaaaatcttgaa

SEQ ID NO: 7696 - DNA, 22 bp, Homo sapiens
atttgaatgcattttgtttggt

SEQ ID NO: 7697 - DNA, 24 bp, Homo sapiens
actttgctctattgaactgtctta

SEQ ID NO: 7698 - DNA, 21 bp, Homo sapiens
atggcttaacatcatgctaca

SEQ ID NO: 7699 - DNA, 16 bp, Homo sapiens
tccagaggtcgcccag

SEQ ID NO: 7700 - DNA, 18 bp, Homo sapiens
tcctcaacaggatgtaaa

SEQ ID NO: 7701 - DNA, 17 bp, Homo sapiens
tgttcagtctggtgcca

SEQ ID NO: 7702 - DNA, 26 bp, Homo sapiens
ttttcgttcagtgtggctttaatttt

SEQ ID NO: 7703 - DNA, 20 bp, Homo sapiens
aaagcggtggattctggcaa

SEQ ID NO: 7704 - DNA, 17 bp, Homo sapiens
cactaccaccgtctgag

SEQ ID NO: 7705 - DNA, 21 bp, Homo sapiens
ccaccgccaccgccaccgcca

SEQ ID NO: 7706 - DNA, 18 bp, Homo sapiens
tctttctctcttccctca

SEQ ID NO: 7707 - DNA, 22 bp, Homo sapiens
accgggcagaagctgggccttc

SEQ ID NO: 7708 - DNA, 17 bp, Homo sapiens
gctgctttcctcacctg

SEQ ID NO: 7709 - DNA, 22 bp, Homo sapiens
gcttggatgacttgcctcgttt

SEQ ID NO: 7710 - DNA, 18 bp, Homo sapiens
tgggaattccagcactaa

SEQ ID NO: 7711 - DNA, 21 bp, Homo sapiens
atacctctcagtgtgtttgct

SEQ ID NO: 7712 - DNA, 19 bp, Homo sapiens
tctgatgatagccagtgag

SEQ ID NO: 7713 - DNA, 20 bp, Homo sapiens
gcacccggcctttctttctc

SEQ ID NO: 7714 - DNA, 19 bp, Homo sapiens
tttctccctcttgcaacca

SEQ ID NO: 7715 - DNA, 19 bp, Homo sapiens
agtagttaaactgctaagc

SEQ ID NO: 7716 - DNA, 18 bp, Homo sapiens
caacttaggcagttccca

SEQ ID NO: 7717 - DNA, 22 bp, Homo sapiens
tcaacccctccccaccacgtca

SEQ ID NO: 7718 - DNA, 22 bp, Homo sapiens
tcctggctcgctggatttgtgg

SEQ ID NO: 7719 - DNA, 20 bp, Homo sapiens
acactctttccccgcacccc

SEQ ID NO: 7720 - DNA, 18 bp, Homo sapiens
ctgatcatgtttatgaga

SEQ ID NO: 7721 - DNA, 21 bp, Homo sapiens
gaaaccttcctgctgagcctc

SEQ ID NO: 7722 - DNA, 18 bp, Homo sapiens
gaattgacattgaaatct

SEQ ID NO: 7723 - DNA, 27 bp, Homo sapiens
gattgctcaaatcaggttttcttttaa

SEQ ID NO: 7724 - DNA, 19 bp, Homo sapiens
tcagtctgcttagaaataa

SEQ ID NO: 7725 - DNA, 18 bp, Homo sapiens
ccatatgtgctacccaca

SEQ ID NO: 7726 - DNA, 19 bp, Homo sapiens
gcaaacaaatcatgcaatg

SEQ ID NO: 7727 - DNA, 25 bp, Homo sapiens
tttctttcctccctgtcttagactt

SEQ ID NO: 7728 - DNA, 17 bp, Homo sapiens
tcaagtgattcttgtgc

SEQ ID NO: 7729 - DNA, 19 bp, Homo sapiens
tgtcgtaagaatatctgtc

SEQ ID NO: 7730 - DNA, 24 bp, Homo sapiens
aaagtaaacacattaatttcctca

SEQ ID NO: 7731 - DNA, 20 bp, Homo sapiens
acctgaaaccaagattggct

SEQ ID NO: 7732 - DNA, 22 bp, Homo sapiens
agaattatataatcactgcttt

SEQ ID NO: 7733 - DNA, 17 bp, Homo sapiens
ccagtgaagcttaccta

SEQ ID NO: 7734 - DNA, 15 bp, Homo sapiens
ccataatcgtgccac

SEQ ID NO: 7735 - DNA, 21 bp, Homo sapiens
cctaacaaagtaaagttttca

SEQ ID NO: 7736 - DNA, 22 bp, Homo sapiens
ccttctctgtacccatacagca

SEQ ID NO: 7737 - DNA, 18 bp, Homo sapiens
cggctgcccgcggttgca

SEQ ID NO: 7738 - DNA, 18 bp, Homo sapiens
ctgagtagttttgatcag

SEQ ID NO: 7739 - DNA, 16 bp, Homo sapiens
gccacatctaatctca

SEQ ID NO: 7740 - DNA, 23 bp, Homo sapiens
gctataaagcaagaaagtaaaca

SEQ ID NO: 7741 - DNA, 21 bp, Homo sapiens
gcttgaaaataaattatgggg

SEQ ID NO: 7742 - DNA, 19 bp, Homo sapiens
tactaatggaataaactgt

SEQ ID NO: 7743 - DNA, 18 bp, Homo sapiens
tctttttcacgcatttgc

SEQ ID NO: 7744 - DNA, 21 bp, Homo sapiens
tgcagtgagccataatcgtgc

SEQ ID NO: 7745 - DNA, 20 bp, Homo sapiens
gcacctcctcggttgcgcac

SEQ ID NO: 7746 - DNA, 19 bp, Homo sapiens
aaacaaaagtcaaatagca

SEQ ID NO: 7747 - DNA, 19 bp, Homo sapiens
aaataaaatttgctctagt

SEQ ID NO: 7748 - DNA, 18 bp, Homo sapiens
aggggcctccatccctct

SEQ ID NO: 7749 - DNA, 19 bp, Homo sapiens
ccacatattcttgccaatt

SEQ ID NO: 7750 - DNA, 19 bp, Homo sapiens
ctgatcaagctggacttgt

SEQ ID NO: 7751 - DNA, 18 bp, Homo sapiens
cgctgtgtcatcacatca

SEQ ID NO: 7752 - DNA, 17 bp, Homo sapiens
gggccacttgcttgatt

SEQ ID NO: 7753 - DNA, 18 bp, Homo sapiens
ctccctccctctgccttt

SEQ ID NO: 7754 - DNA, 20 bp, Homo sapiens
ccatttcttctctctgttcc

SEQ ID NO: 7755 - DNA, 18 bp, Homo sapiens
tgcggctgcctgcccccc

SEQ ID NO: 7756 - DNA, 23 bp, Homo sapiens
agacacaagaacaatctttgcta

SEQ ID NO: 7757 - DNA, 22 bp, Homo sapiens
ataattctttgctcttgtttca

SEQ ID NO: 7758 - DNA, 22 bp, Homo sapiens
gccaaaatcactgttaaaatct

SEQ ID NO: 7759 - DNA, 19 bp, Homo sapiens
tgtcaacactcatacttca

SEQ ID NO: 7760 - DNA, 20 bp, Homo sapiens
ttttgtatataagcagtaga

SEQ ID NO: 7761 - DNA, 21 bp, Homo sapiens
aagatgcactgaaaacttagc

SEQ ID NO: 7762 - DNA, 17 bp, Homo sapiens
acaaaagcaggctagag

SEQ ID NO: 7763 - DNA, 21 bp, Homo sapiens
agaaaagcccattttcaactg

SEQ ID NO: 7764 - DNA, 17 bp, Homo sapiens
agcaaatagtgataaca

SEQ ID NO: 7765 - DNA, 26 bp, Homo sapiens
atcctcatgttactcagtgttagaga

SEQ ID NO: 7766 - DNA, 17 bp, Homo sapiens
gcccagcaaatagtgat

SEQ ID NO: 7767 - DNA, 23 bp, Homo sapiens
tgtaactgtgtgtgtgtgtgtgt

SEQ ID NO: 7768 - DNA, 19 bp, Homo sapiens
gcacagcaaagatctgcca

SEQ ID NO: 7769 - DNA, 19 bp, Homo sapiens
cacttaattcttcccattt

SEQ ID NO: 7770 - DNA, 19 bp, Homo sapiens
cagcacttgacagctctcc

SEQ ID NO: 7771 - DNA, 18 bp, Homo sapiens
tccacttcacccactcca

SEQ ID NO: 7772 - DNA, 18 bp, Homo sapiens
tctctgagctatatcctc

SEQ ID NO: 7773 - DNA, 19 bp, Homo sapiens
tgccatcacatccctgata

SEQ ID NO: 7774 - DNA, 17 bp, Homo sapiens
atggcacagggcatgaa

SEQ ID NO: 7775 - DNA, 18 bp, Homo sapiens
cctgaaatgtgtgtgatg

SEQ ID NO: 7776 - DNA, 20 bp, Homo sapiens
ctgaaatgtgtgtgatgtga

SEQ ID NO: 7777 - DNA, 18 bp, Homo sapiens
ctgtaagctgtttggttt

SEQ ID NO: 7778 - DNA, 20 bp, Homo sapiens
cccttccccaccctctggcc

SEQ ID NO: 7779 - DNA, 20 bp, Homo sapiens
cttctctggtcctctgcatc

SEQ ID NO: 7780 - DNA, 19 bp, Homo sapiens
ccacttgcacgccaccatt

SEQ ID NO: 7781 - DNA, 24 bp, Homo sapiens
gcaccaggaggtgcctctgcctct

SEQ ID NO: 7782 - DNA, 20 bp, Homo sapiens
tatgactcaggatttattca

SEQ ID NO: 7783 - DNA, 19 bp, Homo sapiens
tgcacgccaccattcagtc

SEQ ID NO: 7784 - DNA, 18 bp, Homo sapiens
ttctatctttcttccacc

SEQ ID NO: 7785 - DNA, 17 bp, Homo sapiens
gggactttgcatactct

SEQ ID NO: 7786 - DNA, 16 bp, Homo sapiens
tagcaaaacaaattca

SEQ ID NO: 7787 - DNA, 19 bp, Homo sapiens
tgcacatttttttctatgc

SEQ ID NO: 7788 - DNA, 15 bp, Homo sapiens
ggcgtgactctgata

SEQ ID NO: 7789 - DNA, 20 bp, Homo sapiens
gggttttattgctgttgtta

SEQ ID NO: 7790 - DNA, 20 bp, Homo sapiens
tctcggctgttggggacttt

SEQ ID NO: 7791 - DNA, 22 bp, Homo sapiens
aatacgtcagattggaccagtg

SEQ ID NO: 7792 - DNA, 21 bp, Homo sapiens
gaccttgttctcccacccgac

SEQ ID NO: 7793 - DNA, 18 bp, Homo sapiens
gattccggagtgggactg

SEQ ID NO: 7794 - DNA, 21 bp, Homo sapiens
aatagcgccctgtgcagctga

SEQ ID NO: 7795 - DNA, 17 bp, Homo sapiens
ccgccgccgcctcccgg

SEQ ID NO: 7796 - DNA, 19 bp, Homo sapiens
cgcgcgccgcttccgtcgc

SEQ ID NO: 7797 - DNA, 27 bp, Homo sapiens
gtgctgcttagaggtgctcgcgccgct

SEQ ID NO: 7798 - DNA, 19 bp, Homo sapiens
tccgcgtccagtgctgctt

SEQ ID NO: 7799 - DNA, 16 bp, Homo sapiens
gatctcgacagctgtt

SEQ ID NO: 7800 - DNA, 18 bp, Homo sapiens
aagccgacaccactcctg

SEQ ID NO: 7801 - DNA, 22 bp, Homo sapiens
accccctcgcctcctactctga

SEQ ID NO: 7802 - DNA, 18 bp, Homo sapiens
ccgctgagaggctgcctc

SEQ ID NO: 7803 - DNA, 20 bp, Homo sapiens
ctctgggggcagatttgtgg

SEQ ID NO: 7804 - DNA, 17 bp, Homo sapiens
gctcctaccctgtaagc

SEQ ID NO: 7805 - DNA, 18 bp, Homo sapiens
gttgattgtacgtagcca

SEQ ID NO: 7806 - DNA, 21 bp, Homo sapiens
tagccgaactccaggctgggc

SEQ ID NO: 7807 - DNA, 19 bp, Homo sapiens
tgacgggccaggcctggag

SEQ ID NO: 7808 - DNA, 20 bp, Homo sapiens
tgtaattgttgtttgtatgt

SEQ ID NO: 7809 - DNA, 19 bp, Homo sapiens
ctacaatgtcccaatatca

SEQ ID NO: 7810 - DNA, 18 bp, Homo sapiens
gataataattagatcttg

SEQ ID NO: 7811 - DNA, 19 bp, Homo sapiens
tatcaactcaggaaatctc

SEQ ID NO: 7812 - DNA, 22 bp, Homo sapiens
ccacccagcacccagcaactcc

SEQ ID NO: 7813 - DNA, 22 bp, Homo sapiens
cccagaaggacctcctgagcga

SEQ ID NO: 7814 - DNA, 18 bp, Homo sapiens
ctctccaccccatagtga

SEQ ID NO: 7815 - DNA, 23 bp, Homo sapiens
gctcccctccctcctctgtccct

SEQ ID NO: 7816 - DNA, 19 bp, Homo sapiens
taggtagtgccctatttta

SEQ ID NO: 7817 - DNA, 22 bp, Homo sapiens
atccttatttatatatcagtta

SEQ ID NO: 7818 - DNA, 25 bp, Homo sapiens
taggatttatatctaagtttggtta

SEQ ID NO: 7819 - DNA, 25 bp, Homo sapiens
tggaccctccacttcaatctgagaa

SEQ ID NO: 7820 - DNA, 16 bp, Homo sapiens
tgtggaggactttgaa

SEQ ID NO: 7821 - DNA, 21 bp, Homo sapiens
cgcgcggcgccggcagcctcg

SEQ ID NO: 7822 - DNA, 19 bp, Homo sapiens
ccctccccaaaacctttcc

SEQ ID NO: 7823 - DNA, 19 bp, Homo sapiens
ccctcccctgtcttctctc

SEQ ID NO: 7824 - DNA, 16 bp, Homo sapiens
gacagagccgcaaatc

SEQ ID NO: 7825 - DNA, 20 bp, Homo sapiens
gcttctcctccaggtatttg

SEQ ID NO: 7826 - DNA, 17 bp, Homo sapiens
ggccgggtggccaatcc

SEQ ID NO: 7827 - DNA, 19 bp, Homo sapiens
ttagggaaaccaatagtcc

SEQ ID NO: 7828 - DNA, 18 bp, Homo sapiens
tttgagttgttttggtgc

SEQ ID NO: 7829 - DNA, 17 bp, Homo sapiens
ttttctttattgctgtg

SEQ ID NO: 7830 - DNA, 22 bp, Homo sapiens
gctctgaaccagtgttctccac

SEQ ID NO: 7831 - DNA, 23 bp, Homo sapiens
tcaactccaccccatcccatccc

SEQ ID NO: 7832 - DNA, 27 bp, Homo sapiens
tttcttctggatgagctctttggtttt

SEQ ID NO: 7833 - DNA, 20 bp, Homo sapiens
acttctaattgccatgtaca

SEQ ID NO: 7834 - DNA, 23 bp, Homo sapiens
caacttttctattaaaagtggga

SEQ ID NO: 7835 - DNA, 18 bp, Homo sapiens
gaggagggtggggagaca

SEQ ID NO: 7836 - DNA, 22 bp, Homo sapiens
gcttgtgggactagcctggctt

SEQ ID NO: 7837 - DNA, 26 bp, Homo sapiens
tctaggtaatttttacagaattgctt

SEQ ID NO: 7838 - DNA, 22 bp, Homo sapiens
aggagagagaaaggattcccct

SEQ ID NO: 7839 - DNA, 22 bp, Homo sapiens
cctggtcgtgaggaacagccgc

SEQ ID NO: 7840 - DNA, 21 bp, Homo sapiens
cgagctcggctgggcttggcg

SEQ ID NO: 7841 - DNA, 20 bp, Homo sapiens
tctgaccttgtttcagcaaa

SEQ ID NO: 7842 - DNA, 21 bp, Homo sapiens
tggtcctgcagtgtgaaactg

SEQ ID NO: 7843 - DNA, 19 bp, Homo sapiens
ttatatcatttctttttca

SEQ ID NO: 7844 - DNA, 21 bp, Homo sapiens
aagacttgagaagctgtcaca

SEQ ID NO: 7845 - DNA, 18 bp, Homo sapiens
cagacctccagccactca

SEQ ID NO: 7846 - DNA, 25 bp, Homo sapiens
gacctccagccactcacagctcttt

SEQ ID NO: 7847 - DNA, 20 bp, Homo sapiens
agaaagatctctgtgctgta

SEQ ID NO: 7848 - DNA, 17 bp, Homo sapiens
ccagagagtctagggca

SEQ ID NO: 7849 - DNA, 16 bp, Homo sapiens
ccccgccccccgcact

SEQ ID NO: 7850 - DNA, 15 bp, Homo sapiens
cttacccctttccac

SEQ ID NO: 7851 - DNA, 23 bp, Homo sapiens
cttgggtagcgggataagtcact

SEQ ID NO: 7852 - DNA, 25 bp, Homo sapiens
tgtcaatgatgtaaattcagtccct

SEQ ID NO: 7853 - DNA, 19 bp, Homo sapiens
cctgtaccctcccatactc

SEQ ID NO: 7854 - DNA, 21 bp, Homo sapiens
tcccaggaaccggagctggaa

SEQ ID NO: 7855 - DNA, 19 bp, Homo sapiens
atcaaaaatactaacatca

SEQ ID NO: 7856 - DNA, 18 bp, Homo sapiens
aactggtcccacacgcac

SEQ ID NO: 7857 - DNA, 23 bp, Homo sapiens
aagacccttagtaccaaatacac

SEQ ID NO: 7858 - DNA, 20 bp, Homo sapiens
acggccctttgagatggtgc

SEQ ID NO: 7859 - DNA, 23 bp, Homo sapiens
cactttttgattaaagctcttca

SEQ ID NO: 7860 - DNA, 21 bp, Homo sapiens
ctctatgggagtggcttttaa

SEQ ID NO: 7861 - DNA, 19 bp, Homo sapiens
gccagatcctgtgttgcca

SEQ ID NO: 7862 - DNA, 18 bp, Homo sapiens
gctcgtcatctgtgcagg

SEQ ID NO: 7863 - DNA, 21 bp, Homo sapiens
tcggcagtttcaggtgtagct

SEQ ID NO: 7864 - DNA, 22 bp, Homo sapiens
tctaagtgatttaatgcacttt

SEQ ID NO: 7865 - DNA, 21 bp, Homo sapiens
tctgccttccagaggccgctt

SEQ ID NO: 7866 - DNA, 21 bp, Homo sapiens
ttccagaggccgcttctccag

SEQ ID NO: 7867 - DNA, 17 bp, Homo sapiens
gacacttgcaggactga

SEQ ID NO: 7868 - DNA, 19 bp, Homo sapiens
acctccggctgcctagccc

SEQ ID NO: 7869 - DNA, 23 bp, Homo sapiens
cccatggcttgttctctggaacc

SEQ ID NO: 7870 - DNA, 22 bp, Homo sapiens
ccgggggcgccgccggccccgc

SEQ ID NO: 7871 - DNA, 17 bp, Homo sapiens
ctcaggtcagctgggag

SEQ ID NO: 7872 - DNA, 22 bp, Homo sapiens
gacccgcctgctcccatcctca

SEQ ID NO: 7873 - DNA, 21 bp, Homo sapiens
gcccaccttggaccctggtga

SEQ ID NO: 7874 - DNA, 24 bp, Homo sapiens
ggacagggagggccggcggctctg

SEQ ID NO: 7875 - DNA, 19 bp, Homo sapiens
gtgacgtgtgttcttttga

SEQ ID NO: 7876 - DNA, 22 bp, Homo sapiens
tgggctctgccaatgtgggctg

SEQ ID NO: 7877 - DNA, 19 bp, Homo sapiens
ccaaagctgtcccttctca

SEQ ID NO: 7878 - DNA, 20 bp, Homo sapiens
aattgttctgctctaactga

SEQ ID NO: 7879 - DNA, 23 bp, Homo sapiens
gccacccctgctccttcggagga

SEQ ID NO: 7880 - DNA, 20 bp, Homo sapiens
gatccagtttgggattatga

SEQ ID NO: 7881 - DNA, 18 bp, Homo sapiens
tttttttttttgcctgtg

SEQ ID NO: 7882 - DNA, 19 bp, Homo sapiens
gccccgccgccttccctca

SEQ ID NO: 7883 - DNA, 24 bp, Homo sapiens
gcggcgacgccggggatctttgtc

SEQ ID NO: 7884 - DNA, 18 bp, Homo sapiens
tctctgtccaccacacac

SEQ ID NO: 7885 - DNA, 20 bp, Homo sapiens
tgagactctgtctcaataaa

SEQ ID NO: 7886 - DNA, 18 bp, Homo sapiens
aaatttggaaacagattg

SEQ ID NO: 7887 - DNA, 19 bp, Homo sapiens
aagggacagcagctgacca

SEQ ID NO: 7888 - DNA, 21 bp, Homo sapiens
acaaaaaccaaagggacagca

SEQ ID NO: 7889 - DNA, 20 bp, Homo sapiens
agagagagaaattggggacc

SEQ ID NO: 7890 - DNA, 18 bp, Homo sapiens
acagcagcctccctgtca

SEQ ID NO: 7891 - DNA, 22 bp, Homo sapiens
agcttggtgtcttggcactgtt

SEQ ID NO: 7892 - DNA, 16 bp, Homo sapiens
ccacagctgctggcca

SEQ ID NO: 7893 - DNA, 27 bp, Homo sapiens
cgactgtcatgtggcttggtttggtca

SEQ ID NO: 7894 - DNA, 18 bp, Homo sapiens
ctgagcctctctcggtca

SEQ ID NO: 7895 - DNA, 21 bp, Homo sapiens
gacgaggacactcgcttgccg

SEQ ID NO: 7896 - DNA, 20 bp, Homo sapiens
ggtaagtggaggaaatgttg

SEQ ID NO: 7897 - DNA, 21 bp, Homo sapiens
tgagacccccaagcttccacc

SEQ ID NO: 7898 - DNA, 16 bp, Homo sapiens
tgcctgtgtgctccgg

SEQ ID NO: 7899 - DNA, 18 bp, Homo sapiens
ttgcccactaggatccca

SEQ ID NO: 7900 - DNA, 17 bp, Homo sapiens
aaaatggattttagtca

SEQ ID NO: 7901 - DNA, 18 bp, Homo sapiens
aaggtgttcattttgtca

SEQ ID NO: 7902 - DNA, 21 bp, Homo sapiens
ccctttttcctagtggtgtca

SEQ ID NO: 7903 - DNA, 20 bp, Homo sapiens
cctgcctcgcccccactttt

SEQ ID NO: 7904 - DNA, 22 bp, Homo sapiens
gaacacagagtgtgtttttgca

SEQ ID NO: 7905 - DNA, 25 bp, Homo sapiens
gattttctagtttcctgccttcaga

SEQ ID NO: 7906 - DNA, 24 bp, Homo sapiens
actgagtggcaagtccctttgtga

SEQ ID NO: 7907 - DNA, 20 bp, Homo sapiens
gctctgcgggactctgagga

SEQ ID NO: 7908 - DNA, 19 bp, Homo sapiens
aaacctccaaaagccctga

SEQ ID NO: 7909 - DNA, 23 bp, Homo sapiens
aaatgcagtatttttgttgtgtt

SEQ ID NO: 7910 - DNA, 22 bp, Homo sapiens
cctccaaaagccctgagtttca

SEQ ID NO: 7911 - DNA, 20 bp, Homo sapiens
aggtgcaagccacattgttg

SEQ ID NO: 7912 - DNA, 19 bp, Homo sapiens
caaccccgcctcttcctcc

SEQ ID NO: 7913 - DNA, 23 bp, Homo sapiens
aacaaatctggataaatgtgcaa

SEQ ID NO: 7914 - DNA, 22 bp, Homo sapiens
cagtattgtagagcaagtcttg

SEQ ID NO: 7915 - DNA, 21 bp, Homo sapiens
ggacataggcaaaataacttg

SEQ ID NO: 7916 - DNA, 17 bp, Homo sapiens
ggtatgagtatatacca

SEQ ID NO: 7917 - DNA, 18 bp, Homo sapiens
tggtggctgaatttccca

SEQ ID NO: 7918 - DNA, 22 bp, Homo sapiens
ttcataggtgttctgcatttga

SEQ ID NO: 7919 - DNA, 21 bp, Homo sapiens
tcagtcaggcccccttaccca

SEQ ID NO: 7920 - DNA, 20 bp, Homo sapiens
tgcaggtctcagcttgcggg

SEQ ID NO: 7921 - DNA, 18 bp, Homo sapiens
cgcttggaacagaccccg

SEQ ID NO: 7922 - DNA, 20 bp, Homo sapiens
tctaggcagtcttgaaaggc

SEQ ID NO: 7923 - DNA, 20 bp, Homo sapiens
ttctcctgcctgttgctttt

SEQ ID NO: 7924 - DNA, 20 bp, Homo sapiens
ttttccaaacacacatgaca

SEQ ID NO: 7925 - DNA, 24 bp, Homo sapiens
cttttggtatttgtttgtagcttt

SEQ ID NO: 7926 - DNA, 18 bp, Homo sapiens
aacacaggcttgtcgtgc

SEQ ID NO: 7927 - DNA, 18 bp, Homo sapiens
ccccgttcattttctcca

SEQ ID NO: 7928 - DNA, 21 bp, Homo sapiens
cgcacggaggcccgcgctgct

SEQ ID NO: 7929 - DNA, 20 bp, Homo sapiens
ggctgcccccccgttcattt

SEQ ID NO: 7930 - DNA, 19 bp, Homo sapiens
gtgatgatcctcccatccg

SEQ ID NO: 7931 - DNA, 23 bp, Homo sapiens
gtgcatggctgcccccccgttca

SEQ ID NO: 7932 - DNA, 19 bp, Homo sapiens
cgccaccgcctctgcctcc

SEQ ID NO: 7933 - DNA, 19 bp, Homo sapiens
tgagtcagcagatgatgaa

SEQ ID NO: 7934 - DNA, 26 bp, Homo sapiens
agcatgggcctcacctcctctgtgat

SEQ ID NO: 7935 - DNA, 21 bp, Homo sapiens
gcaccaaagacatcagtctcc

SEQ ID NO: 7936 - DNA, 17 bp, Homo sapiens
aagaaactgaaagtaca

SEQ ID NO: 7937 - DNA, 19 bp, Homo sapiens
tcctattaaaagccatgca

SEQ ID NO: 7938 - DNA, 19 bp, Homo sapiens
cccttccccttactccccg

SEQ ID NO: 7939 - DNA, 24 bp, Homo sapiens
caactatttgaactgttgagtgat

SEQ ID NO: 7940 - DNA, 19 bp, Homo sapiens
ccttgtcctcatctcaggt

SEQ ID NO: 7941 - DNA, 18 bp, Homo sapiens
tttaaatatgcctttaaa

SEQ ID NO: 7942 - DNA, 19 bp, Homo sapiens
gtatggaatgtttcatact

SEQ ID NO: 7943 - DNA, 18 bp, Homo sapiens
tcagtccctattatgcaa

SEQ ID NO: 7944 - DNA, 19 bp, Homo sapiens
tttctatctgatttgcttt

SEQ ID NO: 7945 - DNA, 19 bp, Homo sapiens
aaaccctgccccgaatctt

SEQ ID NO: 7946 - DNA, 22 bp, Homo sapiens
cccagggcccagcttcccagga

SEQ ID NO: 7947 - DNA, 25 bp, Homo sapiens
taaacccttataataaaatccttct

SEQ ID NO: 7948 - DNA, 22 bp, Homo sapiens
tgcaatttaaagggttgaccca

SEQ ID NO: 7949 - DNA, 21 bp, Homo sapiens
tttaagcgaatgattgctttt

SEQ ID NO: 7950 - DNA, 21 bp, Homo sapiens
caaccctcgtcctctgcgcct

SEQ ID NO: 7951 - DNA, 21 bp, Homo sapiens
ggctgtaaattgaacttccca

SEQ ID NO: 7952 - DNA, 18 bp, Homo sapiens
tatgatattatttgattg

SEQ ID NO: 7953 - DNA, 19 bp, Homo sapiens
acataaaaagaaatgtgaa

SEQ ID NO: 7954 - DNA, 17 bp, Homo sapiens
ctgagggtctggtgcca

SEQ ID NO: 7955 - DNA, 15 bp, Homo sapiens
tgggaggggtgctgc

SEQ ID NO: 7956 - DNA, 24 bp, Homo sapiens
ggaaaaagtatcatggaaatatta

SEQ ID NO: 7957 - DNA, 18 bp, Homo sapiens
ttttctacagcaaattta

SEQ ID NO: 7958 - DNA, 24 bp, Homo sapiens
aaagttgactttaacaaggggtta

SEQ ID NO: 7959 - DNA, 18 bp, Homo sapiens
gaaatgaatgctccatga

SEQ ID NO: 7960 - DNA, 16 bp, Homo sapiens
tcattgccttgccaaa

SEQ ID NO: 7961 - DNA, 22 bp, Homo sapiens
accttctgtggctgtcttgttt

SEQ ID NO: 7962 - DNA, 17 bp, Homo sapiens
agaaacatgaaatgctt

SEQ ID NO: 7963 - DNA, 19 bp, Homo sapiens
ttttaggaggcacaacagt

SEQ ID NO: 7964 - DNA, 16 bp, Homo sapiens
atccagccagacccca

SEQ ID NO: 7965 - DNA, 24 bp, Homo sapiens
ccctcccccatgggctgtgtccta

SEQ ID NO: 7966 - DNA, 23 bp, Homo sapiens
gaggaggggaccaattctggaca

SEQ ID NO: 7967 - DNA, 17 bp, Homo sapiens
ggaattccctccccctc

SEQ ID NO: 7968 - DNA, 19 bp, Homo sapiens
acacttccaccaccctgca

SEQ ID NO: 7969 - DNA, 19 bp, Homo sapiens
cattaccagacggttcacc

SEQ ID NO: 7970 - DNA, 19 bp, Homo sapiens
cctgctgagggaccagcca

SEQ ID NO: 7971 - DNA, 19 bp, Homo sapiens
ctcccctgcactggagtcc

SEQ ID NO: 7972 - DNA, 19 bp, Homo sapiens
gattgacgtacttagcagc

SEQ ID NO: 7973 - DNA, 19 bp, Homo sapiens
tgcccagaactggactcag

SEQ ID NO: 7974 - DNA, 25 bp, Homo sapiens
cacaaaatgagaattatatttgtca

SEQ ID NO: 7975 - DNA, 20 bp, Homo sapiens
tagctttagtgaatttcaaa

SEQ ID NO: 7976 - DNA, 20 bp, Homo sapiens
aagaaccgagcaattttctg

SEQ ID NO: 7977 - DNA, 19 bp, Homo sapiens
ccgtgcaaatcccacaaca

SEQ ID NO: 7978 - DNA, 19 bp, Homo sapiens
gctccgcagacggggctgc

SEQ ID NO: 7979 - DNA, 25 bp, Homo sapiens
gtttgggtttgattgtgtttggctc

SEQ ID NO: 7980 - DNA, 21 bp, Homo sapiens
acgccctccctggcccccgcc

SEQ ID NO: 7981 - DNA, 21 bp, Homo sapiens
ccaccccggggtctctgggga

SEQ ID NO: 7982 - DNA, 21 bp, Homo sapiens
gcttccctgccatctggccct

SEQ ID NO: 7983 - DNA, 17 bp, Homo sapiens
tcattttcctaacttca

SEQ ID NO: 7984 - DNA, 18 bp, Homo sapiens
atggctaatgagttctga

SEQ ID NO: 7985 - DNA, 18 bp, Homo sapiens
tatgtaataaatggttaa

SEQ ID NO: 7986 - DNA, 22 bp, Homo sapiens
tcacaatacatttgtagctccc

SEQ ID NO: 7987 - DNA, 19 bp, Homo sapiens
tggatgaaaaatatgaaat

SEQ ID NO: 7988 - DNA, 16 bp, Homo sapiens
aggatcatcaatgcta

SEQ ID NO: 7989 - DNA, 18 bp, Homo sapiens
cacattcgcaatgcatca

SEQ ID NO: 7990 - DNA, 24 bp, Homo sapiens
ccgagaacaatttataactgtgtt

SEQ ID NO: 7991 - DNA, 20 bp, Homo sapiens
ctgacaacataacaggatgt

SEQ ID NO: 7992 - DNA, 20 bp, Homo sapiens
gctatagggtttgctctgac

SEQ ID NO: 7993 - DNA, 23 bp, Homo sapiens
ggggagcgggcggcggctgcggc

SEQ ID NO: 7994 - DNA, 18 bp, Homo sapiens
ggtaaaaagtacacttta

SEQ ID NO: 7995 - DNA, 17 bp, Homo sapiens
tgctattaacagtatca

SEQ ID NO: 7996 - DNA, 24 bp, Homo sapiens
cccactctgccagacaccctgaca

SEQ ID NO: 7997 - DNA, 17 bp, Homo sapiens
ctagagacctttgttcc

SEQ ID NO: 7998 - DNA, 18 bp, Homo sapiens
gtgcagctccctccgtgc

SEQ ID NO: 7999 - DNA, 17 bp, Homo sapiens
tgcagctccctccgtgc

SEQ ID NO: 8000 - DNA, 19 bp, Homo sapiens
tgtgcagctccctccgtgc

SEQ ID NO: 8001 - DNA, 22 bp, Homo sapiens
ttttggcggctgcggcctctgg

SEQ ID NO: 8002 - DNA, 18 bp, Homo sapiens
ggctagtgttgtgtgatt

SEQ ID NO: 8003 - DNA, 20 bp, Homo sapiens
tgagttctccacaacagctc

SEQ ID NO: 8004 - DNA, 19 bp, Homo sapiens
acctcgcgcttgctggcca

SEQ ID NO: 8005 - DNA, 17 bp, Homo sapiens
gcgcgccgcggcgctgc

SEQ ID NO: 8006 - DNA, 21 bp, Homo sapiens
tgcccagaacgcccgctccag

SEQ ID NO: 8007 - DNA, 21 bp, Homo sapiens
tttctacgtttctttaacctt

SEQ ID NO: 8008 - DNA, 19 bp, Homo sapiens
tttgtaaatgtgtacatat

SEQ ID NO: 8009 - DNA, 19 bp, Homo sapiens
agaaaaaagaagtgtccga

SEQ ID NO: 8010 - DNA, 21 bp, Homo sapiens
caagttggactgggttcggtc

SEQ ID NO: 8011 - DNA, 21 bp, Homo sapiens
gcacccagtccggtcaccgca

SEQ ID NO: 8012 - DNA, 20 bp, Homo sapiens
ctgcctggcccccaacctca

SEQ ID NO: 8013 - DNA, 18 bp, Homo sapiens
aatcccaaatgcattttt

SEQ ID NO: 8014 - DNA, 22 bp, Homo sapiens
tgtgtggaacgtgcccccttgg

SEQ ID NO: 8015 - DNA, 23 bp, Homo sapiens
aatcatgcccagcttctgtcata

SEQ ID NO: 8016 - DNA, 21 bp, Homo sapiens
atccccagcgcccaggtcacc

SEQ ID NO: 8017 - DNA, 19 bp, Homo sapiens
gcgcagtggagaactggga

SEQ ID NO: 8018 - DNA, 20 bp, Homo sapiens
tgcggcggcggcagcgaagc

SEQ ID NO: 8019 - DNA, 16 bp, Homo sapiens
tgggtgcagttctgaa

SEQ ID NO: 8020 - DNA, 19 bp, Homo sapiens
ttgggtccacagtcactct

SEQ ID NO: 8021 - DNA, 17 bp, Homo sapiens
aaacactgaatcatgtt

SEQ ID NO: 8022 - DNA, 22 bp, Homo sapiens
cagcatgtacaaaagtaccata

SEQ ID NO: 8023 - DNA, 21 bp, Homo sapiens
catgtgttgtacaataccaga

SEQ ID NO: 8024 - DNA, 22 bp, Homo sapiens
catctgacggattcccaaaggc

SEQ ID NO: 8025 - DNA, 20 bp, Homo sapiens
ccccggccccggcccccgga

SEQ ID NO: 8026 - DNA, 20 bp, Homo sapiens
ctctgatggtcactttgtgg

SEQ ID NO: 8027 - DNA, 24 bp, Homo sapiens
ggaatctgatatcaacatatccta

SEQ ID NO: 8028 - DNA, 21 bp, Homo sapiens
tcaggatacccagttccctca

SEQ ID NO: 8029 - DNA, 21 bp, Homo sapiens
acagtgagagagttttcttca

SEQ ID NO: 8030 - DNA, 25 bp, Homo sapiens
agctgtgctctggacagtgttctca

SEQ ID NO: 8031 - DNA, 24 bp, Homo sapiens
cacaggggcgccatccaggtttaa

SEQ ID NO: 8032 - DNA, 18 bp, Homo sapiens
taaaattcatatgtgaca

SEQ ID NO: 8033 - DNA, 18 bp, Homo sapiens
tttggcggcggcggtgga

SEQ ID NO: 8034 - DNA, 19 bp, Homo sapiens
tctgaaaactctatgctgg

SEQ ID NO: 8035 - DNA, 23 bp, Homo sapiens
cccgccctgcctggccgtcacca

SEQ ID NO: 8036 - DNA, 21 bp, Homo sapiens
cctagcccctccttattctca

SEQ ID NO: 8037 - DNA, 23 bp, Homo sapiens
cctccccgccctgcctggccgtc

SEQ ID NO: 8038 - DNA, 24 bp, Homo sapiens
gccagcagagcaggctgacgacct

SEQ ID NO: 8039 - DNA, 21 bp, Homo sapiens
gtgctgcgaggtgggggaccc

SEQ ID NO: 8040 - DNA, 17 bp, Homo sapiens
aatatatccctatactc

SEQ ID NO: 8041 - DNA, 19 bp, Homo sapiens
caagtggaggtgggagcgg

SEQ ID NO: 8042 - DNA, 19 bp, Homo sapiens
ccgataaacaccttgcatc

SEQ ID NO: 8043 - DNA, 18 bp, Homo sapiens
gagcctaccatgaggctg

SEQ ID NO: 8044 - DNA, 22 bp, Homo sapiens
gcttgaactctgggcttggtgc

SEQ ID NO: 8045 - DNA, 21 bp, Homo sapiens
tccacagacagggaaacaagc

SEQ ID NO: 8046 - DNA, 19 bp, Homo sapiens
tccatctttcttctgccct

SEQ ID NO: 8047 - DNA, 19 bp, Homo sapiens
tctgaagggcccctggcct

SEQ ID NO: 8048 - DNA, 21 bp, Homo sapiens
tggatccccagagttgatcca

SEQ ID NO: 8049 - DNA, 24 bp, Homo sapiens
attttccagtgattgctttggcct

SEQ ID NO: 8050 - DNA, 18 bp, Homo sapiens
tgtgcaccacacattcca

SEQ ID NO: 8051 - DNA, 26 bp, Homo sapiens
aatgcgggaggttcaatgtgaagctg

SEQ ID NO: 8052 - DNA, 24 bp, Homo sapiens
agaagtagcagtacctggggagct

SEQ ID NO: 8053 - DNA, 18 bp, Homo sapiens
cctggaagaggcttgtga

SEQ ID NO: 8054 - DNA, 17 bp, Homo sapiens
gctctggtggaggtggg

SEQ ID NO: 8055 - DNA, 23 bp, Homo sapiens
gtttcctctgcctgcgccgggca

SEQ ID NO: 8056 - DNA, 22 bp, Homo sapiens
caggaaatgaacccttcttaca

SEQ ID NO: 8057 - DNA, 23 bp, Homo sapiens
gacagtgttgggcatctgctccc

SEQ ID NO: 8058 - DNA, 22 bp, Homo sapiens
gagctcccccagtcagatctca

SEQ ID NO: 8059 - DNA, 18 bp, Homo sapiens
gtcccctccgaggagtca

SEQ ID NO: 8060 - DNA, 16 bp, Homo sapiens
tacccaaatcagcccc

SEQ ID NO: 8061 - DNA, 21 bp, Homo sapiens
aggcacttctaggacctggct

SEQ ID NO: 8062 - DNA, 19 bp, Homo sapiens
gcttagtgttttcattgca

SEQ ID NO: 8063 - DNA, 22 bp, Homo sapiens
gtacaaagaagcctcctaccca

SEQ ID NO: 8064 - DNA, 18 bp, Homo sapiens
ttctttatgtattaacct

SEQ ID NO: 8065 - DNA, 19 bp, Homo sapiens
aaatgccgctgcaatgcaa

SEQ ID NO: 8066 - DNA, 18 bp, Homo sapiens
acccccgcccccacctcc

SEQ ID NO: 8067 - DNA, 21 bp, Homo sapiens
gggacacccccgcccccacct

SEQ ID NO: 8068 - DNA, 19 bp, Homo sapiens
cggacccactctctgcctt

SEQ ID NO: 8069 - DNA, 23 bp, Homo sapiens
gaggagggaaaataagcgaggca

SEQ ID NO: 8070 - DNA, 24 bp, Homo sapiens
ggggctcaccccaatccgtctgcc

SEQ ID NO: 8071 - DNA, 18 bp, Homo sapiens
tggttgcgcagccacctc

SEQ ID NO: 8072 - DNA, 23 bp, Homo sapiens
aagaaagggcaggcggctcggcg

SEQ ID NO: 8073 - DNA, 20 bp, Homo sapiens
acacccccttcctcctacca

SEQ ID NO: 8074 - DNA, 22 bp, Homo sapiens
cagaagaaaaacaagcctcctc

SEQ ID NO: 8075 - DNA, 23 bp, Homo sapiens
ccttttatatgtgccttcacttt

SEQ ID NO: 8076 - DNA, 20 bp, Homo sapiens
gcctccgggggacgccgcta

SEQ ID NO: 8077 - DNA, 19 bp, Homo sapiens
gtaagttttataagggagt

SEQ ID NO: 8078 - DNA, 20 bp, Homo sapiens
tcctgatgatcctaacctgc

SEQ ID NO: 8079 - DNA, 20 bp, Homo sapiens
tctagaatgacactctgttc

SEQ ID NO: 8080 - DNA, 20 bp, Homo sapiens
tggctgaagatttttctagt

SEQ ID NO: 8081 - DNA, 17 bp, Homo sapiens
agaaagccaacatgtgg

SEQ ID NO: 8082 - DNA, 22 bp, Homo sapiens
caaagaattccaaagcaaaacc

SEQ ID NO: 8083 - DNA, 20 bp, Homo sapiens
ccattgtgaaccaatgcaag

SEQ ID NO: 8084 - DNA, 22 bp, Homo sapiens
aaagccttgccagattcagaca

SEQ ID NO: 8085 - DNA, 23 bp, Homo sapiens
agaccggcgccggaggagacgca

SEQ ID NO: 8086 - DNA, 20 bp, Homo sapiens
agatggagaagagaccatca

SEQ ID NO: 8087 - DNA, 23 bp, Homo sapiens
gcaaagcacaaagaacatttatc

SEQ ID NO: 8088 - DNA, 21 bp, Homo sapiens
tacatctcaatatggttccca

SEQ ID NO: 8089 - DNA, 22 bp, Homo sapiens
tccttctgaccacacacagaca

SEQ ID NO: 8090 - DNA, 18 bp, Homo sapiens
tgctcaacccaagcttct

SEQ ID NO: 8091 - DNA, 17 bp, Homo sapiens
tgtactttgtgcaggga

SEQ ID NO: 8092 - DNA, 27 bp, Homo sapiens
gcgcctcaactgtcgttggtgtatttt

SEQ ID NO: 8093 - DNA, 16 bp, Homo sapiens
atagcgccctggaaca

SEQ ID NO: 8094 - DNA, 25 bp, Homo sapiens
cctccccatcgtccccatcgtcctc

SEQ ID NO: 8095 - DNA, 18 bp, Homo sapiens
cctctgggagattgtgga

SEQ ID NO: 8096 - DNA, 25 bp, Homo sapiens
gctcttcctctgggtaaaggtctgt

SEQ ID NO: 8097 - DNA, 19 bp, Homo sapiens
ggaggtcacttggcattca

SEQ ID NO: 8098 - DNA, 19 bp, Homo sapiens
aacaagtgtgacactgacc

SEQ ID NO: 8099 - DNA, 22 bp, Homo sapiens
agattattctcctctatccaca

SEQ ID NO: 8100 - DNA, 19 bp, Homo sapiens
catgttgtggaaaaaagcc

SEQ ID NO: 8101 - DNA, 23 bp, Homo sapiens
ccttttcattattttttagcttt

SEQ ID NO: 8102 - DNA, 16 bp, Homo sapiens
ctagcagcgttagttc

SEQ ID NO: 8103 - DNA, 18 bp, Homo sapiens
ctgaccagcccaaatcat

SEQ ID NO: 8104 - DNA, 19 bp, Homo sapiens
cttggagggatcctgtgaa

SEQ ID NO: 8105 - DNA, 19 bp, Homo sapiens
tagtgactcagaatcctca

SEQ ID NO: 8106 - DNA, 23 bp, Homo sapiens
ttctgagctttatgatctgtgga

SEQ ID NO: 8107 - DNA, 18 bp, Homo sapiens
agatgtcacagactcttt

SEQ ID NO: 8108 - DNA, 22 bp, Homo sapiens
gcagaaaaaatcagacacttca

SEQ ID NO: 8109 - DNA, 21 bp, Homo sapiens
aaacaatgtataggtacacag

SEQ ID NO: 8110 - DNA, 16 bp, Homo sapiens
aaccctcctgtgtcct

SEQ ID NO: 8111 - DNA, 18 bp, Homo sapiens
acagaacccttttcctga

SEQ ID NO: 8112 - DNA, 24 bp, Homo sapiens
agaagaaagagaaaccttcacttt

SEQ ID NO: 8113 - DNA, 19 bp, Homo sapiens
atcaaatgtatatgctttt

SEQ ID NO: 8114 - DNA, 18 bp, Homo sapiens
ccacttttgactaggtaa

SEQ ID NO: 8115 - DNA, 19 bp, Homo sapiens
ccagccaacagtaacactt

SEQ ID NO: 8116 - DNA, 19 bp, Homo sapiens
gctgtctctctgacaccag

SEQ ID NO: 8117 - DNA, 22 bp, Homo sapiens
gtcatatactctgcatcactgt

SEQ ID NO: 8118 - DNA, 17 bp, Homo sapiens
gtgaataaagttgtgtg

SEQ ID NO: 8119 - DNA, 23 bp, Homo sapiens
tatgccccaaagcttgctctttt

SEQ ID NO: 8120 - DNA, 20 bp, Homo sapiens
tcactgcactcctttgtcat

SEQ ID NO: 8121 - DNA, 16 bp, Homo sapiens
tcctgtgtcctctgaa

SEQ ID NO: 8122 - DNA, 17 bp, Homo sapiens
tggttaaaacaccatga

SEQ ID NO: 8123 - DNA, 20 bp, Homo sapiens
cagcccctgcagtcatctca

SEQ ID NO: 8124 - DNA, 24 bp, Homo sapiens
cctttccacacgccgctgccccag

SEQ ID NO: 8125 - DNA, 23 bp, Homo sapiens
ctcctcatgcccctctgtcctct

SEQ ID NO: 8126 - DNA, 25 bp, Homo sapiens
gctccctgcccctcctcatgcccct

SEQ ID NO: 8127 - DNA, 19 bp, Homo sapiens
ggaccgggcaggtgtccac

SEQ ID NO: 8128 - DNA, 21 bp, Homo sapiens
ccacgagattcccccatctct

SEQ ID NO: 8129 - DNA, 23 bp, Homo sapiens
tcctcttttcccccttctctctc

SEQ ID NO: 8130 - DNA, 20 bp, Homo sapiens
aaagggaccctcccatcatt

SEQ ID NO: 8131 - DNA, 21 bp, Homo sapiens
acagtggagccgcgctcttct

SEQ ID NO: 8132 - DNA, 18 bp, Homo sapiens
ccccatttctcctcctct

SEQ ID NO: 8133 - DNA, 22 bp, Homo sapiens
gccacgtgccctcacccagccc

SEQ ID NO: 8134 - DNA, 23 bp, Homo sapiens
gtgttttctgatttggtgagctc

SEQ ID NO: 8135 - DNA, 21 bp, Homo sapiens
accagaacgcaccccactggg

SEQ ID NO: 8136 - DNA, 19 bp, Homo sapiens
cgccccccaccccccctcc

SEQ ID NO: 8137 - DNA, 19 bp, Homo sapiens
ctccgagatggggctgtga

SEQ ID NO: 8138 - DNA, 19 bp, Homo sapiens
gcctcccctcccctgggga

SEQ ID NO: 8139 - DNA, 18 bp, Homo sapiens
ggctccgagatggggctg

SEQ ID NO: 8140 - DNA, 24 bp, Homo sapiens
tagtctgtggcccagcaaagccac

SEQ ID NO: 8141 - DNA, 20 bp, Homo sapiens
gcctgagtagggcccgggga

SEQ ID NO: 8142 - DNA, 21 bp, Homo sapiens
ccaagtcgcctccagaccgca

SEQ ID NO: 8143 - DNA, 21 bp, Homo sapiens
gcgaccgcaagggcttttgtt

SEQ ID NO: 8144 - DNA, 18 bp, Homo sapiens
agaacacacacatataca

SEQ ID NO: 8145 - DNA, 18 bp, Homo sapiens
tccatattttattactgt

SEQ ID NO: 8146 - DNA, 17 bp, Homo sapiens
ccccctgcacctccacc

SEQ ID NO: 8147 - DNA, 18 bp, Homo sapiens
gcccaccccctgcacctc

SEQ ID NO: 8148 - DNA, 21 bp, Homo sapiens
actgcaaatctccgcctccca

SEQ ID NO: 8149 - DNA, 22 bp, Homo sapiens
atctcggctcactgcaaatctc

SEQ ID NO: 8150 - DNA, 24 bp, Homo sapiens
gaaaaggtgaaaatgttttattca

SEQ ID NO: 8151 - DNA, 18 bp, Homo sapiens
tccgcctcccaggttcaa

SEQ ID NO: 8152 - DNA, 23 bp, Homo sapiens
ttttaacatgtgttaaacagaga

SEQ ID NO: 8153 - DNA, 18 bp, Homo sapiens
gggcggggcggccgcgcc

SEQ ID NO: 8154 - DNA, 19 bp, Homo sapiens
gggcggggcggccgcgcca

SEQ ID NO: 8155 - DNA, 20 bp, Homo sapiens
ctggagttgaaaatcttata

SEQ ID NO: 8156 - DNA, 26 bp, Homo sapiens
tgtactggcaagacctgatttctgag

SEQ ID NO: 8157 - DNA, 21 bp, Homo sapiens
aacaggaaacctgactggggc

SEQ ID NO: 8158 - DNA, 18 bp, Homo sapiens
aagtccctccagatttct

SEQ ID NO: 8159 - DNA, 17 bp, Homo sapiens
atatgttgtctttgata

SEQ ID NO: 8160 - DNA, 17 bp, Homo sapiens
taaaatatgggaaaggc

SEQ ID NO: 8161 - DNA, 17 bp, Homo sapiens
tcaggactggtgttagg

SEQ ID NO: 8162 - DNA, 19 bp, Homo sapiens
tgtgtcccaagatatccta

SEQ ID NO: 8163 - DNA, 18 bp, Homo sapiens
ctccagtccctcatctca

SEQ ID NO: 8164 - DNA, 21 bp, Homo sapiens
ctctgggaccggggtctgcgg

SEQ ID NO: 8165 - DNA, 21 bp, Homo sapiens
cttgctttccagtttgctttt

SEQ ID NO: 8166 - DNA, 19 bp, Homo sapiens
caccacccccacccccctc

SEQ ID NO: 8167 - DNA, 18 bp, Homo sapiens
cccccacccccctccctc

SEQ ID NO: 8168 - DNA, 17 bp, Homo sapiens
tctttattcaaaagtgt

SEQ ID NO: 8169 - DNA, 19 bp, Homo sapiens
ttgaccaatttgacttaga

SEQ ID NO: 8170 - DNA, 21 bp, Homo sapiens
atattgctgtatagctccttt

SEQ ID NO: 8171 - DNA, 22 bp, Homo sapiens
gtagtttgactcagtataggta

SEQ ID NO: 8172 - DNA, 20 bp, Homo sapiens
agcgcgacagtgagcgccgg

SEQ ID NO: 8173 - DNA, 19 bp, Homo sapiens
gggagctctgtcctggtga

SEQ ID NO: 8174 - DNA, 19 bp, Homo sapiens
atcatccaggagtacaact

SEQ ID NO: 8175 - DNA, 21 bp, Homo sapiens
cctgctgctttctctgttcct

SEQ ID NO: 8176 - DNA, 20 bp, Homo sapiens
ttagaaatttaaaataactc

SEQ ID NO: 8177 - DNA, 20 bp, Homo sapiens
cacagtgcgctgtctccttt

SEQ ID NO: 8178 - DNA, 21 bp, Homo sapiens
ccccttcccagttgccggcga

SEQ ID NO: 8179 - DNA, 24 bp, Homo sapiens
gcgcggaggtcgcgcagcccggga

SEQ ID NO: 8180 - DNA, 17 bp, Homo sapiens
tcctgccgactcagttg

SEQ ID NO: 8181 - DNA, 19 bp, Homo sapiens
caacattccactatgccat

SEQ ID NO: 8182 - DNA, 17 bp, Homo sapiens
caggagaggacctcgcc

SEQ ID NO: 8183 - DNA, 21 bp, Homo sapiens
cctcccttccccaaggatcca

SEQ ID NO: 8184 - DNA, 19 bp, Homo sapiens
cctcgccccaagcaagcca

SEQ ID NO: 8185 - DNA, 22 bp, Homo sapiens
gccctgccagactactgccaga

SEQ ID NO: 8186 - DNA, 24 bp, Homo sapiens
tcccactgctatactgttctactg

SEQ ID NO: 8187 - DNA, 22 bp, Homo sapiens
tcttggacagaggatctgggag

SEQ ID NO: 8188 - DNA, 20 bp, Homo sapiens
cccgccgcccgcaggctcgg

SEQ ID NO: 8189 - DNA, 18 bp, Homo sapiens
cctcactaaaccatccaa

SEQ ID NO: 8190 - DNA, 25 bp, Homo sapiens
cttccttcacatcctcctccgcctc

SEQ ID NO: 8191 - DNA, 19 bp, Homo sapiens
gcgcgtgcagccccggaca

SEQ ID NO: 8192 - DNA, 23 bp, Homo sapiens
ggaataattgcaatccccgatcc

SEQ ID NO: 8193 - DNA, 24 bp, Homo sapiens
agaagcaacacccctctccctccc

SEQ ID NO: 8194 - DNA, 19 bp, Homo sapiens
ggagaagcaacacccctct

SEQ ID NO: 8195 - DNA, 23 bp, Homo sapiens
gtgccggctgctgcccgtgctgc

SEQ ID NO: 8196 - DNA, 20 bp, Homo sapiens
ctaaagagcactagttgtga

SEQ ID NO: 8197 - DNA, 23 bp, Homo sapiens
taataaaagttattacctttaca

SEQ ID NO: 8198 - DNA, 19 bp, Homo sapiens
ttggtgtacttaatactca

SEQ ID NO: 8199 - DNA, 21 bp, Homo sapiens
gcccaggtggcctcctggccc

SEQ ID NO: 8200 - DNA, 19 bp, Homo sapiens
gtgagtgagtgtgtgtgtg

SEQ ID NO: 8201 - DNA, 23 bp, Homo sapiens
gtgtgtgtgggggggactcggct

SEQ ID NO: 8202 - DNA, 31 bp, Homo sapiens
gtctaagctgttctattttaaaattattttt

SEQ ID NO: 8203 - DNA, 18 bp, Homo sapiens
gctttcagcactcactct

SEQ ID NO: 8204 - DNA, 18 bp, Homo sapiens
acttggcttctttaacca

SEQ ID NO: 8205 - DNA, 21 bp, Homo sapiens
cgttcattgtaaaaagccctt

SEQ ID NO: 8206 - DNA, 21 bp, Homo sapiens
acatttacaggaggccccgga

SEQ ID NO: 8207 - DNA, 21 bp, Homo sapiens
ccccacccacctcctgcggct

SEQ ID NO: 8208 - DNA, 23 bp, Homo sapiens
attaagtgccatggattacttta

SEQ ID NO: 8209 - DNA, 20 bp, Homo sapiens
ttccatgcacatttacaata

SEQ ID NO: 8210 - DNA, 22 bp, Homo sapiens
cccttgacaatcttgtcagcaa

SEQ ID NO: 8211 - DNA, 17 bp, Homo sapiens
gataaacagaaatgctg

SEQ ID NO: 8212 - DNA, 18 bp, Homo sapiens
taaaggatgctagcctgc

SEQ ID NO: 8213 - DNA, 24 bp, Homo sapiens
tctctttgtagaagttttgttttt

SEQ ID NO: 8214 - DNA, 24 bp, Homo sapiens
tcttggaatgtgaagatctgtcga

SEQ ID NO: 8215 - DNA, 24 bp, Homo sapiens
ttcagaccctttaataagtgagtg

SEQ ID NO: 8216 - DNA, 23 bp, Homo sapiens
ttgcaacaccctaaattgttttt

SEQ ID NO: 8217 - DNA, 17 bp, Homo sapiens
cagatgcccccccatcc

SEQ ID NO: 8218 - DNA, 21 bp, Homo sapiens
ctctttctctctcttttcctc

SEQ ID NO: 8219 - DNA, 19 bp, Homo sapiens
tgttgactttatttctgag

SEQ ID NO: 8220 - DNA, 19 bp, Homo sapiens
tttttcatagtcccacctt

SEQ ID NO: 8221 - DNA, 24 bp, Homo sapiens
gcccgcgatgtggaactgctgcca

SEQ ID NO: 8222 - DNA, 24 bp, Homo sapiens
gcctgagtcgtgacctgctaggcc

SEQ ID NO: 8223 - DNA, 20 bp, Homo sapiens
gggcccgcgatgtggaactg

SEQ ID NO: 8224 - DNA, 21 bp, Homo sapiens
tcccaggttggctctgccagt

SEQ ID NO: 8225 - DNA, 18 bp, Homo sapiens
agccagggcacgagccct

SEQ ID NO: 8226 - DNA, 20 bp, Homo sapiens
gcccgctcccaggcgcccca

SEQ ID NO: 8227 - DNA, 15 bp, Homo sapiens
gggcggccgcggcag

SEQ ID NO: 8228 - DNA, 18 bp, Homo sapiens
gggggcactgggcttgtt

SEQ ID NO: 8229 - DNA, 19 bp, Homo sapiens
ttttgatttttccgagtgg

SEQ ID NO: 8230 - DNA, 24 bp, Homo sapiens
accttcatagaacacactttcttt

SEQ ID NO: 8231 - DNA, 19 bp, Homo sapiens
agaagcagctgctcctttc

SEQ ID NO: 8232 - DNA, 21 bp, Homo sapiens
ggccgccgcccgcccgcccct

SEQ ID NO: 8233 - DNA, 24 bp, Homo sapiens
tacaagttttgagttagcattaca

SEQ ID NO: 8234 - DNA, 22 bp, Homo sapiens
tctttttatctgaaactttgta

SEQ ID NO: 8235 - DNA, 22 bp, Homo sapiens
ttttgatatttgtccaaacagg

SEQ ID NO: 8236 - DNA, 25 bp, Homo sapiens
cagaacttattcctcctaaatgtaa

SEQ ID NO: 8237 - DNA, 23 bp, Homo sapiens
catgtgcagggtttatggtaatg

SEQ ID NO: 8238 - DNA, 21 bp, Homo sapiens
ctggaatcaggctgcctggtc

SEQ ID NO: 8239 - DNA, 20 bp, Homo sapiens
gagtaccatgtgagattcaa

SEQ ID NO: 8240 - DNA, 23 bp, Homo sapiens
tcctttgactgaagcatgtatgt

SEQ ID NO: 8241 - DNA, 18 bp, Homo sapiens
tgaggattcagtgagcaa

SEQ ID NO: 8242 - DNA, 18 bp, Homo sapiens
aaccacatcccactcaca

SEQ ID NO: 8243 - DNA, 22 bp, Homo sapiens
atcatttatcatatatatacat

SEQ ID NO: 8244 - DNA, 22 bp, Homo sapiens
atcccactcacaacagctgcct

SEQ ID NO: 8245 - DNA, 19 bp, Homo sapiens
caccgagatccttatcgaa

SEQ ID NO: 8246 - DNA, 19 bp, Homo sapiens
ccaattcatcctcactcag

SEQ ID NO: 8247 - DNA, 22 bp, Homo sapiens
tcatcttgtccccaacacccca

SEQ ID NO: 8248 - DNA, 19 bp, Homo sapiens
tcttgtccccaacacccca

SEQ ID NO: 8249 - DNA, 19 bp, Homo sapiens
tgattatcaattaccacac

SEQ ID NO: 8250 - DNA, 25 bp, Homo sapiens
tggaagcatgattggtgcccagtta

SEQ ID NO: 8251 - DNA, 22 bp, Homo sapiens
cagccccaccaagatcatttca

SEQ ID NO: 8252 - DNA, 18 bp, Homo sapiens
catccagtcctgagctca

SEQ ID NO: 8253 - DNA, 23 bp, Homo sapiens
ccagacatctttctccagcttca

SEQ ID NO: 8254 - DNA, 20 bp, Homo sapiens
ctagggttgctctcacctga

SEQ ID NO: 8255 - DNA, 18 bp, Homo sapiens
ctgggccaaggtttgccc

SEQ ID NO: 8256 - DNA, 18 bp, Homo sapiens
acaggcagtctcggccca

SEQ ID NO: 8257 - DNA, 21 bp, Homo sapiens
atatcttctacatgcaattta

SEQ ID NO: 8258 - DNA, 24 bp, Homo sapiens
ctatctgacttcatacatccctca

SEQ ID NO: 8259 - DNA, 18 bp, Homo sapiens
ggggaggaggccgtgtga

SEQ ID NO: 8260 - DNA, 18 bp, Homo sapiens
ctctaaagagcatctgat

SEQ ID NO: 8261 - DNA, 19 bp, Homo sapiens
agccctgaggacagatgcc

SEQ ID NO: 8262 - DNA, 17 bp, Homo sapiens
ccacaccttcttccctc

SEQ ID NO: 8263 - DNA, 19 bp, Homo sapiens
ccacccagcgctcctgcta

SEQ ID NO: 8264 - DNA, 19 bp, Homo sapiens
gcccccagctcccacctcc

SEQ ID NO: 8265 - DNA, 18 bp, Homo sapiens
ttggagactgtctggccc

SEQ ID NO: 8266 - DNA, 21 bp, Homo sapiens
aaacagaaacccaactacccc

SEQ ID NO: 8267 - DNA, 21 bp, Homo sapiens
cattttattcacatgctccca

SEQ ID NO: 8268 - DNA, 20 bp, Homo sapiens
gcaggtgggtcaatgctctc

SEQ ID NO: 8269 - DNA, 17 bp, Homo sapiens
gtcatctcttctctgga

SEQ ID NO: 8270 - DNA, 20 bp, Homo sapiens
tgttcataagagaggactga

SEQ ID NO: 8271 - DNA, 18 bp, Homo sapiens
aagtattgttatttcata

SEQ ID NO: 8272 - DNA, 22 bp, Homo sapiens
ccctctgattctgcagtgtaca

SEQ ID NO: 8273 - DNA, 19 bp, Homo sapiens
ctattgatccccctctgcc

SEQ ID NO: 8274 - DNA, 20 bp, Homo sapiens
gcagacaaagcaggtggcat

SEQ ID NO: 8275 - DNA, 21 bp, Homo sapiens
ggagctttcagaaaaacctca

SEQ ID NO: 8276 - DNA, 17 bp, Homo sapiens
tgggcaaccccacccct

SEQ ID NO: 8277 - DNA, 18 bp, Homo sapiens
acagaatactagccagag

SEQ ID NO: 8278 - DNA, 20 bp, Homo sapiens
agacacaaacaaacaagcta

SEQ ID NO: 8279 - DNA, 19 bp, Homo sapiens
ggccgggtgcggtggctca

SEQ ID NO: 8280 - DNA, 20 bp, Homo sapiens
aagtggcataaaaatgtagt

SEQ ID NO: 8281 - DNA, 17 bp, Homo sapiens
tattttaaggagctccc

SEQ ID NO: 8282 - DNA, 19 bp, Homo sapiens
cagaaggaataaggtcatg

SEQ ID NO: 8283 - DNA, 19 bp, Homo sapiens
catccccacccgcccctct

SEQ ID NO: 8284 - DNA, 19 bp, Homo sapiens
atgtccattatgtacctcc

SEQ ID NO: 8285 - DNA, 20 bp, Homo sapiens
gaagaaaatccattcattca

SEQ ID NO: 8286 - DNA, 17 bp, Homo sapiens
tgcccggcggctggcca

SEQ ID NO: 8287 - DNA, 22 bp, Homo sapiens
aatttggtaaaatgcatcaaaa

SEQ ID NO: 8288 - DNA, 20 bp, Homo sapiens
tttcatgcccttgcctatca

SEQ ID NO: 8289 - DNA, 19 bp, Homo sapiens
atatcctagcggcgaaaca

SEQ ID NO: 8290 - DNA, 19 bp, Homo sapiens
aagtatgaaaatgatttat

SEQ ID NO: 8291 - DNA, 16 bp, Homo sapiens
ccagtgtcacggtgga

SEQ ID NO: 8292 - DNA, 18 bp, Homo sapiens
ccgcactccagcactgcg

SEQ ID NO: 8293 - DNA, 24 bp, Homo sapiens
cgcccttgccgcccacctgctcac

SEQ ID NO: 8294 - DNA, 22 bp, Homo sapiens
agtctcctgcacagcacctgca

SEQ ID NO: 8295 - DNA, 21 bp, Homo sapiens
agtcccatcactgagggagcc

SEQ ID NO: 8296 - DNA, 22 bp, Homo sapiens
atcttcaccctcagtttcctca

SEQ ID NO: 8297 - DNA, 23 bp, Homo sapiens
cctgagcagcttgggctgctttt

SEQ ID NO: 8298 - DNA, 23 bp, Homo sapiens
aggaatataaaaaccaccaccct

SEQ ID NO: 8299 - DNA, 22 bp, Homo sapiens
agttttgcaccacggcaagaaa

SEQ ID NO: 8300 - DNA, 25 bp, Homo sapiens
caaacctttccaacttctcacgtca

SEQ ID NO: 8301 - DNA, 23 bp, Homo sapiens
gcaccaccaccaccacccctact

SEQ ID NO: 8302 - DNA, 20 bp, Homo sapiens
tgcaaacctttccaacttct

SEQ ID NO: 8303 - DNA, 22 bp, Homo sapiens
ttaaaaataagctgggcgtggt

SEQ ID NO: 8304 - DNA, 18 bp, Homo sapiens
cacttgctcttctgtgat

SEQ ID NO: 8305 - DNA, 21 bp, Homo sapiens
gaaaagaacacttgctcttct

SEQ ID NO: 8306 - DNA, 22 bp, Homo sapiens
ttttaaggaaaaaaaagcgcaa

SEQ ID NO: 8307 - DNA, 20 bp, Homo sapiens
aacccagccatgcaatgcca

SEQ ID NO: 8308 - DNA, 22 bp, Homo sapiens
acaaaactcagagaaatgtgtc

SEQ ID NO: 8309 - DNA, 22 bp, Homo sapiens
ctaatgctttaagatttggtca

SEQ ID NO: 8310 - DNA, 20 bp, Homo sapiens
gctcctccaatcccatttta

SEQ ID NO: 8311 - DNA, 27 bp, Homo sapiens
tgaatggtctctctttggctggaatta

SEQ ID NO: 8312 - DNA, 20 bp, Homo sapiens
gcccttcatgaccttgctgg

SEQ ID NO: 8313 - DNA, 19 bp, Homo sapiens
gacattgggcatgaggctg

SEQ ID NO: 8314 - DNA, 23 bp, Homo sapiens
agaatgagccagcagactggcca

SEQ ID NO: 8315 - DNA, 20 bp, Homo sapiens
ctccaggcatggccacctgc

SEQ ID NO: 8316 - DNA, 19 bp, Homo sapiens
ctgctgatattctgcagga

SEQ ID NO: 8317 - DNA, 20 bp, Homo sapiens
gaacacagaatgagccagca

SEQ ID NO: 8318 - DNA, 19 bp, Homo sapiens
gtccttggtgttctccaca

SEQ ID NO: 8319 - DNA, 24 bp, Homo sapiens
tgtgtagggctggctccaggcatg

SEQ ID NO: 8320 - DNA, 21 bp, Homo sapiens
ttctgagtcattgcatcctct

SEQ ID NO: 8321 - DNA, 19 bp, Homo sapiens
ttggaacttaacccttgaa

SEQ ID NO: 8322 - DNA, 21 bp, Homo sapiens
aaatgcagtccagaataagtg

SEQ ID NO: 8323 - DNA, 23 bp, Homo sapiens
ttcatcaatttttatacatatca

SEQ ID NO: 8324 - DNA, 22 bp, Homo sapiens
tttgagcaattcatttcacttt

SEQ ID NO: 8325 - DNA, 19 bp, Homo sapiens
cattcaaagaggctcttta

SEQ ID NO: 8326 - DNA, 21 bp, Homo sapiens
gcattcaaagaggctctttac

SEQ ID NO: 8327 - DNA, 18 bp, Homo sapiens
tcaaaatctttaggagca

SEQ ID NO: 8328 - DNA, 20 bp, Homo sapiens
tttgaatattccaagtagta

SEQ ID NO: 8329 - DNA, 19 bp, Homo sapiens
atgcggcaagaaggaattg

SEQ ID NO: 8330 - DNA, 19 bp, Homo sapiens
caaccctccctcagcccct

SEQ ID NO: 8331 - DNA, 19 bp, Homo sapiens
caaccctcctatcacctcc

SEQ ID NO: 8332 - DNA, 20 bp, Homo sapiens
cctgccccgtcaccatctca

SEQ ID NO: 8333 - DNA, 19 bp, Homo sapiens
gacccccaccccttcccca

SEQ ID NO: 8334 - DNA, 20 bp, Homo sapiens
gaggaatgctcccccatcct

SEQ ID NO: 8335 - DNA, 20 bp, Homo sapiens
tggggaacaagggtggcatc

SEQ ID NO: 8336 - DNA, 22 bp, Homo sapiens
ttgcaacacacagacacacgca

SEQ ID NO: 8337 - DNA, 22 bp, Homo sapiens
ttgggccctcctgaaacttaca

SEQ ID NO: 8338 - DNA, 20 bp, Homo sapiens
aaaacctaccctgtcctaga

SEQ ID NO: 8339 - DNA, 18 bp, Homo sapiens
cagttcctcaccatcatc

SEQ ID NO: 8340 - DNA, 23 bp, Homo sapiens
gcactgatgtccctcctttttca

SEQ ID NO: 8341 - DNA, 19 bp, Homo sapiens
ggattacatgcccatccca

SEQ ID NO: 8342 - DNA, 17 bp, Homo sapiens
cccaggcccaggcccca

SEQ ID NO: 8343 - DNA, 16 bp, Homo sapiens
ctggtggcagatttcg

SEQ ID NO: 8344 - DNA, 18 bp, Homo sapiens
tttctttgtggcttgttt

SEQ ID NO: 8345 - DNA, 20 bp, Homo sapiens
aagacacattgactcctttc

SEQ ID NO: 8346 - DNA, 20 bp, Homo sapiens
tatgaggacctttcatatct

SEQ ID NO: 8347 - DNA, 20 bp, Homo sapiens
gcctttgttcccaagaccca

SEQ ID NO: 8348 - DNA, 19 bp, Homo sapiens
gttgcacatttgtttttaa

SEQ ID NO: 8349 - DNA, 16 bp, Homo sapiens
tcatttctgtcaaact

SEQ ID NO: 8350 - DNA, 26 bp, Homo sapiens
tgaatgtagattttactgtgaagcta

SEQ ID NO: 8351 - DNA, 27 bp, Homo sapiens
accagatctagccccaccctcactcca

SEQ ID NO: 8352 - DNA, 18 bp, Homo sapiens
actgaataatacatgcct

SEQ ID NO: 8353 - DNA, 22 bp, Homo sapiens
gaaaagcaacatggacatttcc

SEQ ID NO: 8354 - DNA, 23 bp, Homo sapiens
gacaagtctttctagaaattcta

SEQ ID NO: 8355 - DNA, 19 bp, Homo sapiens
gcagaccaccttctgcccc

SEQ ID NO: 8356 - DNA, 17 bp, Homo sapiens
gcatccatccctgctgt

SEQ ID NO: 8357 - DNA, 20 bp, Homo sapiens
tctactgcactgcctggctc

SEQ ID NO: 8358 - DNA, 18 bp, Homo sapiens
ttcttgcttttgataaca

SEQ ID NO: 8359 - DNA, 21 bp, Homo sapiens
aaacagtgtcttgagctctaa

SEQ ID NO: 8360 - DNA, 20 bp, Homo sapiens
cctcctcacttggctgtctg

SEQ ID NO: 8361 - DNA, 19 bp, Homo sapiens
ctgttttggggctttccca

SEQ ID NO: 8362 - DNA, 20 bp, Homo sapiens
gctgtgatcagtgattttca

SEQ ID NO: 8363 - DNA, 18 bp, Homo sapiens
ttataatatttcagtgga

SEQ ID NO: 8364 - DNA, 19 bp, Homo sapiens
accatatttttcttcttca

SEQ ID NO: 8365 - DNA, 23 bp, Homo sapiens
acggtgtctctcaggatggtgct

SEQ ID NO: 8366 - DNA, 19 bp, Homo sapiens
ccccagggaaacagggcca

SEQ ID NO: 8367 - DNA, 21 bp, Homo sapiens
ccccctaacccatgtttctca

SEQ ID NO: 8368 - DNA, 19 bp, Homo sapiens
ctggccatgggtccttgcc

SEQ ID NO: 8369 - DNA, 15 bp, Homo sapiens
gccctggccccggcc

SEQ ID NO: 8370 - DNA, 19 bp, Homo sapiens
gtcctcgggggcctgggga

SEQ ID NO: 8371 - DNA, 18 bp, Homo sapiens
tcctcgggggcctgggga

SEQ ID NO: 8372 - DNA, 23 bp, Homo sapiens
tgcccaagggccaccaaccccag

SEQ ID NO: 8373 - DNA, 22 bp, Homo sapiens
acacctctccaagccctcctac

SEQ ID NO: 8374 - DNA, 18 bp, Homo sapiens
gcctttggcttttggctc

SEQ ID NO: 8375 - DNA, 19 bp, Homo sapiens
aggccccaaggtctccttc

SEQ ID NO: 8376 - DNA, 27 bp, Homo sapiens
cctgggcagtgtccttgagttgttttt

SEQ ID NO: 8377 - DNA, 21 bp, Homo sapiens
ttttggttattaagacttgtg

SEQ ID NO: 8378 - DNA, 22 bp, Homo sapiens
aggaaggttctggtgtgaacta

SEQ ID NO: 8379 - DNA, 17 bp, Homo sapiens
ccatccgagtttcaggt

SEQ ID NO: 8380 - DNA, 18 bp, Homo sapiens
ctagcacacacttttggt

SEQ ID NO: 8381 - DNA, 17 bp, Homo sapiens
ctctccctccctgcttc

SEQ ID NO: 8382 - DNA, 23 bp, Homo sapiens
ggaccgcgtcctcccgccccctc

SEQ ID NO: 8383 - DNA, 22 bp, Homo sapiens
tgaagtctctgaagtgaaactg

SEQ ID NO: 8384 - DNA, 21 bp, Homo sapiens
acgttgagatcactgtgtaga

SEQ ID NO: 8385 - DNA, 20 bp, Homo sapiens
caactgccaaccccaaagct

SEQ ID NO: 8386 - DNA, 21 bp, Homo sapiens
ccagcagccagaaatctcaca

SEQ ID NO: 8387 - DNA, 18 bp, Homo sapiens
gcaccatcacttgctttt

SEQ ID NO: 8388 - DNA, 16 bp, Homo sapiens
gtggatgagaacaccc

SEQ ID NO: 8389 - DNA, 19 bp, Homo sapiens
tggaatgcatttattcttg

SEQ ID NO: 8390 - DNA, 22 bp, Homo sapiens
gacggcaggcagcagctgtggc

SEQ ID NO: 8391 - DNA, 17 bp, Homo sapiens
gaggaaagcatgagcag

SEQ ID NO: 8392 - DNA, 22 bp, Homo sapiens
gcagagagcccagtgccggcca

SEQ ID NO: 8393 - DNA, 21 bp, Homo sapiens
taaaggtcatgtctcctagct

SEQ ID NO: 8394 - DNA, 24 bp, Homo sapiens
tcttggtgaagacagggttcgtgg

SEQ ID NO: 8395 - DNA, 23 bp, Homo sapiens
gactcctccccagaaaaccacca

SEQ ID NO: 8396 - DNA, 19 bp, Homo sapiens
gcaaagtgaagagtccacc

SEQ ID NO: 8397 - DNA, 23 bp, Homo sapiens
tctgcttctctcctcatcatcat

SEQ ID NO: 8398 - DNA, 22 bp, Homo sapiens
aaggtcttggtgcctctgcagt

SEQ ID NO: 8399 - DNA, 19 bp, Homo sapiens
aagttagagaatctggcaa

SEQ ID NO: 8400 - DNA, 21 bp, Homo sapiens
cctaggtctatttggattatt

SEQ ID NO: 8401 - DNA, 19 bp, Homo sapiens
cctgggccgtagcttgtct

SEQ ID NO: 8402 - DNA, 19 bp, Homo sapiens
cctttgccacactgtggta

SEQ ID NO: 8403 - DNA, 23 bp, Homo sapiens
ctctacaaatttttctgtggtga

SEQ ID NO: 8404 - DNA, 22 bp, Homo sapiens
cttaagaatgccaaagaatgaa

SEQ ID NO: 8405 - DNA, 18 bp, Homo sapiens
ggccctggtcaggaaact

SEQ ID NO: 8406 - DNA, 21 bp, Homo sapiens
tcccaggctcctatgcaagtt

SEQ ID NO: 8407 - DNA, 22 bp, Homo sapiens
ggaaacagcagccaatcggcga

SEQ ID NO: 8408 - DNA, 19 bp, Homo sapiens
agatatgtattctctgaca

SEQ ID NO: 8409 - DNA, 19 bp, Homo sapiens
atttggttccagcccactc

SEQ ID NO: 8410 - DNA, 22 bp, Homo sapiens
tcccctctgcaagtgccacagc

SEQ ID NO: 8411 - DNA, 20 bp, Homo sapiens
cttttcccctctttaacttt

SEQ ID NO: 8412 - DNA, 21 bp, Homo sapiens
tccaaacacctctctgttgta

SEQ ID NO: 8413 - DNA, 21 bp, Homo sapiens
aggaaggtggcttaccaagat

SEQ ID NO: 8414 - DNA, 19 bp, Homo sapiens
cgagaggagaagcgcagcg

SEQ ID NO: 8415 - DNA, 21 bp, Homo sapiens
acttttcctgctgcctggcct

SEQ ID NO: 8416 - DNA, 19 bp, Homo sapiens
ggaaaaagaccaggtctac

SEQ ID NO: 8417 - DNA, 26 bp, Homo sapiens
tttgatcaaatttgaacttcattttg

SEQ ID NO: 8418 - DNA, 20 bp, Homo sapiens
agccgagaccgacccgcccg

SEQ ID NO: 8419 - DNA, 18 bp, Homo sapiens
ccctgcgggcagccgtgc

SEQ ID NO: 8420 - DNA, 21 bp, Homo sapiens
tcccgctgcccggacccgaca

SEQ ID NO: 8421 - DNA, 17 bp, Homo sapiens
aaggaaagggggtccca

SEQ ID NO: 8422 - DNA, 20 bp, Homo sapiens
caccgtccgccctgctcctc

SEQ ID NO: 8423 - DNA, 19 bp, Homo sapiens
catcctaccctcgggccca

SEQ ID NO: 8424 - DNA, 17 bp, Homo sapiens
cggctggttttgtaaga

SEQ ID NO: 8425 - DNA, 17 bp, Homo sapiens
gccaccccctcaagcca

SEQ ID NO: 8426 - DNA, 18 bp, Homo sapiens
gccccggccccggcccca

SEQ ID NO: 8427 - DNA, 21 bp, Homo sapiens
gccctgaggtgtgggggctgc

SEQ ID NO: 8428 - DNA, 19 bp, Homo sapiens
ttgcttgttgggattcctg

SEQ ID NO: 8429 - DNA, 25 bp, Homo sapiens
accctgggccatcctcacatgtgac

SEQ ID NO: 8430 - DNA, 23 bp, Homo sapiens
gcgccgcggccgcctcctcctcc

SEQ ID NO: 8431 - DNA, 18 bp, Homo sapiens
ggcaggcactcccatcca

SEQ ID NO: 8432 - DNA, 18 bp, Homo sapiens
tgcattgttaatcatcca

SEQ ID NO: 8433 - DNA, 19 bp, Homo sapiens
gtcctccgcgggtgtgcta

SEQ ID NO: 8434 - DNA, 20 bp, Homo sapiens
ggctaggcgcacccacgggg

SEQ ID NO: 8435 - DNA, 20 bp, Homo sapiens
tcctgcctcagaggccatct

SEQ ID NO: 8436 - DNA, 21 bp, Homo sapiens
cacctgccagctctactgggc

SEQ ID NO: 8437 - DNA, 16 bp, Homo sapiens
cactccccccgaacca

SEQ ID NO: 8438 - DNA, 19 bp, Homo sapiens
cccgaaccagagccgtgca

SEQ ID NO: 8439 - DNA, 20 bp, Homo sapiens
ggcagtggagggagggacac

SEQ ID NO: 8440 - DNA, 19 bp, Homo sapiens
gtccccagaggcacattcg

SEQ ID NO: 8441 - DNA, 22 bp, Homo sapiens
tgcacattctcacagacaccgt

SEQ ID NO: 8442 - DNA, 17 bp, Homo sapiens
gctggcagctccgggtg

SEQ ID NO: 8443 - DNA, 17 bp, Homo sapiens
ttgaggaggaaagcgag

SEQ ID NO: 8444 - DNA, 22 bp, Homo sapiens
tgcaaaaagagctgacattcca

SEQ ID NO: 8445 - DNA, 20 bp, Homo sapiens
cccccaacctccaccccacc

SEQ ID NO: 8446 - DNA, 22 bp, Homo sapiens
gccactctgaggctggcggcct

SEQ ID NO: 8447 - DNA, 22 bp, Homo sapiens
cccttccccaccccacttgtat

SEQ ID NO: 8448 - DNA, 24 bp, Homo sapiens
cttgtcttttttttttatttctta

SEQ ID NO: 8449 - DNA, 24 bp, Homo sapiens
taaaccaatagaatcgctcggtgg

SEQ ID NO: 8450 - DNA, 19 bp, Homo sapiens
ctgaagcctcagtccttca

SEQ ID NO: 8451 - DNA, 15 bp, Homo sapiens
gattagcacccattg

SEQ ID NO: 8452 - DNA, 19 bp, Homo sapiens
tactgcgactgaacggcgg

SEQ ID NO: 8453 - DNA, 16 bp, Homo sapiens
aagaacaattgtccat

SEQ ID NO: 8454 - DNA, 20 bp, Homo sapiens
cacgtttgaagatgcgagcg

SEQ ID NO: 8455 - DNA, 21 bp, Homo sapiens
cagagcactaggttcaattcc

SEQ ID NO: 8456 - DNA, 16 bp, Homo sapiens
ccacagtttgatgtca

SEQ ID NO: 8457 - DNA, 20 bp, Homo sapiens
gataccatactcatttctaa

SEQ ID NO: 8458 - DNA, 21 bp, Homo sapiens
gcctctgtcccggaagagtca

SEQ ID NO: 8459 - DNA, 24 bp, Homo sapiens
tcaatcccaaaagtcaccactcca

SEQ ID NO: 8460 - DNA, 20 bp, Homo sapiens
tcccaaaagtcaccactcca

SEQ ID NO: 8461 - DNA, 16 bp, Homo sapiens
accttcctgggcctca

SEQ ID NO: 8462 - DNA, 19 bp, Homo sapiens
ggagtcccagcagaggcta

SEQ ID NO: 8463 - DNA, 19 bp, Homo sapiens
gtgagcagagtgtggcatc

SEQ ID NO: 8464 - DNA, 19 bp, Homo sapiens
aatagcagctcaggaaatc

SEQ ID NO: 8465 - DNA, 21 bp, Homo sapiens
agtcttccttctttcttgggc

SEQ ID NO: 8466 - DNA, 20 bp, Homo sapiens
cccgaactactgactttgaa

SEQ ID NO: 8467 - DNA, 23 bp, Homo sapiens
cttgagtttggagtcagaaagca

SEQ ID NO: 8468 - DNA, 19 bp, Homo sapiens
catgtaaggttgtgcaggg

SEQ ID NO: 8469 - DNA, 20 bp, Homo sapiens
cctttccagaaaatgttgca

SEQ ID NO: 8470 - DNA, 22 bp, Homo sapiens
gtggcttcttttcgttttcgtt

SEQ ID NO: 8471 - DNA, 19 bp, Homo sapiens
tgcacacttccccatcttt

SEQ ID NO: 8472 - DNA, 26 bp, Homo sapiens
tgtaaggttgtgcagggtgtgtactg

SEQ ID NO: 8473 - DNA, 17 bp, Homo sapiens
ttccagaaaatgttgca

SEQ ID NO: 8474 - DNA, 18 bp, Homo sapiens
gagtggggaatgaggctg

SEQ ID NO: 8475 - DNA, 21 bp, Homo sapiens
gccacctcctgagccctccca

SEQ ID NO: 8476 - DNA, 20 bp, Homo sapiens
gtccccctcagcaccctcca

SEQ ID NO: 8477 - DNA, 19 bp, Homo sapiens
tgcccagactcttcactcc

SEQ ID NO: 8478 - DNA, 22 bp, Homo sapiens
aacagaaagctgtccctggctg

SEQ ID NO: 8479 - DNA, 20 bp, Homo sapiens
atctgcatctcagcctgaga

SEQ ID NO: 8480 - DNA, 20 bp, Homo sapiens
cagtgagaacagcagcccca

SEQ ID NO: 8481 - DNA, 21 bp, Homo sapiens
tctacgggagtctgaacgcca

SEQ ID NO: 8482 - DNA, 19 bp, Homo sapiens
ctttccctgccttctccca

SEQ ID NO: 8483 - DNA, 23 bp, Homo sapiens
gcctctctgggaagctcttcctc

SEQ ID NO: 8484 - DNA, 20 bp, Homo sapiens
tgcccaggacactcttccct

SEQ ID NO: 8485 - DNA, 19 bp, Homo sapiens
tgttcacagctgaatctca

SEQ ID NO: 8486 - DNA, 18 bp, Homo sapiens
agttgtgtcatgttgttt

SEQ ID NO: 8487 - DNA, 19 bp, Homo sapiens
caaaaagcacttcctccca

SEQ ID NO: 8488 - DNA, 19 bp, Homo sapiens
taaaattgtaaaaggctgc

SEQ ID NO: 8489 - DNA, 20 bp, Homo sapiens
tctacctagcaactgtcttc

SEQ ID NO: 8490 - DNA, 20 bp, Homo sapiens
accgtcacactcttcagtga

SEQ ID NO: 8491 - DNA, 19 bp, Homo sapiens
gaaacagctcagccagtgg

SEQ ID NO: 8492 - DNA, 19 bp, Homo sapiens
gccgcccagctacgggagg

SEQ ID NO: 8493 - DNA, 24 bp, Homo sapiens
gtggttgcctgggggcttttgcca

SEQ ID NO: 8494 - DNA, 27 bp, Homo sapiens
tcctgtcactgatggaaggtttgcgga

SEQ ID NO: 8495 - DNA, 21 bp, Homo sapiens
tcctataaggaagatttggaa

SEQ ID NO: 8496 - DNA, 19 bp, Homo sapiens
tcttgttctgagattcaat

SEQ ID NO: 8497 - DNA, 17 bp, Homo sapiens
gagaacatttaagccac

SEQ ID NO: 8498 - DNA, 24 bp, Homo sapiens
gtaagattttaaacatttgtaata

SEQ ID NO: 8499 - DNA, 18 bp, Homo sapiens
tatgaactgttttatatc

SEQ ID NO: 8500 - DNA, 19 bp, Homo sapiens
tgctacctctatatcattc

SEQ ID NO: 8501 - DNA, 21 bp, Homo sapiens
tggggggtttttgttttttta

SEQ ID NO: 8502 - DNA, 22 bp, Homo sapiens
tcaacacagcatggaatttcca

SEQ ID NO: 8503 - DNA, 19 bp, Homo sapiens
aagcgattctcctacctca

SEQ ID NO: 8504 - DNA, 21 bp, Homo sapiens
agatggattttacatttgctc

SEQ ID NO: 8505 - DNA, 22 bp, Homo sapiens
atcaggcgcccagacaccatgt

SEQ ID NO: 8506 - DNA, 19 bp, Homo sapiens
cttttcctcattctgtggg

SEQ ID NO: 8507 - DNA, 20 bp, Homo sapiens
ggataaagctggctgcttcc

SEQ ID NO: 8508 - DNA, 19 bp, Homo sapiens
gttttgctgactcattcca

SEQ ID NO: 8509 - DNA, 22 bp, Homo sapiens
tcctgatttaaagagatctgtg

SEQ ID NO: 8510 - DNA, 19 bp, Homo sapiens
tgcagatgctactgactgc

SEQ ID NO: 8511 - DNA, 21 bp, Homo sapiens
gaacttggatttcaaatgcaa

SEQ ID NO: 8512 - DNA, 23 bp, Homo sapiens
taggattatttgcaggtttggtt

SEQ ID NO: 8513 - DNA, 22 bp, Homo sapiens
tgcccagctctacccctcccag

SEQ ID NO: 8514 - DNA, 21 bp, Homo sapiens
acaaagatcatattttttgtg

SEQ ID NO: 8515 - DNA, 21 bp, Homo sapiens
agatcttttaaatgtttagta

SEQ ID NO: 8516 - DNA, 18 bp, Homo sapiens
atcttcttaaaggtctaa

SEQ ID NO: 8517 - DNA, 19 bp, Homo sapiens
atgtatgtacaagttaggt

SEQ ID NO: 8518 - DNA, 19 bp, Homo sapiens
attcaagtgccattagatg

SEQ ID NO: 8519 - DNA, 21 bp, Homo sapiens
cctcttggtgctgccttggcc

SEQ ID NO: 8520 - DNA, 21 bp, Homo sapiens
ccttattttaggaccctttcc

SEQ ID NO: 8521 - DNA, 21 bp, Homo sapiens
ctctatactacacatattaca

SEQ ID NO: 8522 - DNA, 19 bp, Homo sapiens
cttttacaaatcccatttt

SEQ ID NO: 8523 - DNA, 19 bp, Homo sapiens
gatatatatgtaggccttt

SEQ ID NO: 8524 - DNA, 18 bp, Homo sapiens
gcactcattagccctata

SEQ ID NO: 8525 - DNA, 23 bp, Homo sapiens
tatactgactgaaacatgagcca

SEQ ID NO: 8526 - DNA, 17 bp, Homo sapiens
tctagagccattgtgga

SEQ ID NO: 8527 - DNA, 18 bp, Homo sapiens
tgttaacaccttatttta

SEQ ID NO: 8528 - DNA, 23 bp, Homo sapiens
cagggttggatgtagtttagtta

SEQ ID NO: 8529 - DNA, 17 bp, Homo sapiens
tatatgatatactatga

SEQ ID NO: 8530 - DNA, 22 bp, Homo sapiens
ttcaaaataagaaaataacctt

SEQ ID NO: 8531 - DNA, 19 bp, Homo sapiens
tttgtaccaaatttaatga

SEQ ID NO: 8532 - DNA, 21 bp, Homo sapiens
cttctacttgctcttggcctt

SEQ ID NO: 8533 - DNA, 21 bp, Homo sapiens
gcccagaggagccctattcca

SEQ ID NO: 8534 - DNA, 21 bp, Homo sapiens
tcctgcattcctcctcccctc

SEQ ID NO: 8535 - DNA, 21 bp, Homo sapiens
agcactgaactcctctgtgat

SEQ ID NO: 8536 - DNA, 21 bp, Homo sapiens
gcgccccgggccggcgggttt

SEQ ID NO: 8537 - DNA, 19 bp, Homo sapiens
catatttggctgccagctt

SEQ ID NO: 8538 - DNA, 21 bp, Homo sapiens
ttactgataacataaacagta

SEQ ID NO: 8539 - DNA, 20 bp, Homo sapiens
atatgtttttcacagcccgt

SEQ ID NO: 8540 - DNA, 24 bp, Homo sapiens
atgctcaaaatagttatatattca

SEQ ID NO: 8541 - DNA, 21 bp, Homo sapiens
tcatttgaccccttccaaata

SEQ ID NO: 8542 - DNA, 24 bp, Homo sapiens
aaataaataacaagataattgaaa

SEQ ID NO: 8543 - DNA, 15 bp, Homo sapiens
agcttgaaggggctc

SEQ ID NO: 8544 - DNA, 24 bp, Homo sapiens
ccaatcagtgtccttttctgttcc

SEQ ID NO: 8545 - DNA, 19 bp, Homo sapiens
gtctcagttaaaaggggta

SEQ ID NO: 8546 - DNA, 20 bp, Homo sapiens
accgctgtggtgtgccggga

SEQ ID NO: 8547 - DNA, 16 bp, Homo sapiens
gggtcgtgaccgctta

SEQ ID NO: 8548 - DNA, 19 bp, Homo sapiens
ctgaggtcttgcttgggcc

SEQ ID NO: 8549 - DNA, 21 bp, Homo sapiens
ggtctcagcagcggctgcggc

SEQ ID NO: 8550 - DNA, 24 bp, Homo sapiens
gcaggtggtcactgacatttccca

SEQ ID NO: 8551 - DNA, 21 bp, Homo sapiens
tgcgataactgaacatttcca

SEQ ID NO: 8552 - DNA, 20 bp, Homo sapiens
ttactttgatttttaaaaca

SEQ ID NO: 8553 - DNA, 19 bp, Homo sapiens
tactggtggcacaccagac

SEQ ID NO: 8554 - DNA, 20 bp, Homo sapiens
aactagttggtaatgtgatt

SEQ ID NO: 8555 - DNA, 17 bp, Homo sapiens
atatgatactgtataga

SEQ ID NO: 8556 - DNA, 23 bp, Homo sapiens
atctgtatcccattgtctggctt

SEQ ID NO: 8557 - DNA, 19 bp, Homo sapiens
catatagtattacccaact

SEQ ID NO: 8558 - DNA, 22 bp, Homo sapiens
gagctttacagacattcaccaa

SEQ ID NO: 8559 - DNA, 17 bp, Homo sapiens
gatatctgtttaatctt

SEQ ID NO: 8560 - DNA, 19 bp, Homo sapiens
gattgtaaggcttatgtca

SEQ ID NO: 8561 - DNA, 17 bp, Homo sapiens
gccttctatatgtgcta

SEQ ID NO: 8562 - DNA, 19 bp, Homo sapiens
tgagaaacctgttaactta

SEQ ID NO: 8563 - DNA, 24 bp, Homo sapiens
agggcaaagtcaatgagtacaact

SEQ ID NO: 8564 - DNA, 23 bp, Homo sapiens
agggttttagtcaacatgccata

SEQ ID NO: 8565 - DNA, 20 bp, Homo sapiens
atccaatatgtttccatcac

SEQ ID NO: 8566 - DNA, 21 bp, Homo sapiens
atttttactgagaatatcgaa

SEQ ID NO: 8567 - DNA, 23 bp, Homo sapiens
agaaacccggggttgggggctca

SEQ ID NO: 8568 - DNA, 22 bp, Homo sapiens
cggggcggccagggctagagtg

SEQ ID NO: 8569 - DNA, 18 bp, Homo sapiens
gggggtggggttgaaata

SEQ ID NO: 8570 - DNA, 21 bp, Homo sapiens
taattccagagtactgtcctc

SEQ ID NO: 8571 - DNA, 29 bp, Homo sapiens
taggtctcccactttctaggatcattttt

SEQ ID NO: 8572 - DNA, 20 bp, Homo sapiens
tctgtgactggtgccataga

SEQ ID NO: 8573 - DNA, 24 bp, Homo sapiens
acttgggcccggcgtgctgggcct

SEQ ID NO: 8574 - DNA, 18 bp, Homo sapiens
caaacccctttccagtat

SEQ ID NO: 8575 - DNA, 23 bp, Homo sapiens
cctgtaccccaaacccctttcca

SEQ ID NO: 8576 - DNA, 20 bp, Homo sapiens
ccttaatgcttgagaaccta

SEQ ID NO: 8577 - DNA, 21 bp, Homo sapiens
ggcttctgtgaggcccatttt

SEQ ID NO: 8578 - DNA, 22 bp, Homo sapiens
gtcagctcactccctgctccca

SEQ ID NO: 8579 - DNA, 22 bp, Homo sapiens
tcacactacatgcactgccttt

SEQ ID NO: 8580 - DNA, 19 bp, Homo sapiens
ttcccacctatcttgccca

SEQ ID NO: 8581 - DNA, 21 bp, Homo sapiens
aaggatagcagcaaacaatca

SEQ ID NO: 8582 - DNA, 22 bp, Homo sapiens
tttgtatttcacatattacaat

SEQ ID NO: 8583 - DNA, 24 bp, Homo sapiens
tttaggtaagggtagggcactttt

SEQ ID NO: 8584 - DNA, 19 bp, Homo sapiens
atctcagagacttctttta

SEQ ID NO: 8585 - DNA, 21 bp, Homo sapiens
cctccctgactgtggatctta

SEQ ID NO: 8586 - DNA, 18 bp, Homo sapiens
cctggaggcaagcgctgc

SEQ ID NO: 8587 - DNA, 22 bp, Homo sapiens
tgtgttggctggcatccctgag

SEQ ID NO: 8588 - DNA, 22 bp, Homo sapiens
tctgtagaaaatacatacttcc

SEQ ID NO: 8589 - DNA, 24 bp, Homo sapiens
cctttttagcaaggccttggtgtt

SEQ ID NO: 8590 - DNA, 19 bp, Homo sapiens
atacctcatactgctttac

SEQ ID NO: 8591 - DNA, 24 bp, Homo sapiens
gtgctgtcaatacctcatactgct

SEQ ID NO: 8592 - DNA, 16 bp, Homo sapiens
atcatcacctgcccca

SEQ ID NO: 8593 - DNA, 23 bp, Homo sapiens
cccactgccccccaactacagca

SEQ ID NO: 8594 - DNA, 22 bp, Homo sapiens
gtgtatatagaattgttcactg

SEQ ID NO: 8595 - DNA, 17 bp, Homo sapiens
ttctttacttttatatg

SEQ ID NO: 8596 - DNA, 18 bp, Homo sapiens
ccagtgcctccctccctc

SEQ ID NO: 8597 - DNA, 22 bp, Homo sapiens
gcaaatgaacgaagcgccaacc

SEQ ID NO: 8598 - DNA, 22 bp, Homo sapiens
tccagcccccacccacaccccc

SEQ ID NO: 8599 - DNA, 24 bp, Homo sapiens
tgttgtaaacatatttgaaaacta

SEQ ID NO: 8600 - DNA, 16 bp, Homo sapiens
ttctccccatcccagg

SEQ ID NO: 8601 - DNA, 17 bp, Homo sapiens
acatctgagctcacact

SEQ ID NO: 8602 - DNA, 18 bp, Homo sapiens
cgcatgtaaatgctgata

SEQ ID NO: 8603 - DNA, 19 bp, Homo sapiens
ggaaatttcaagcactttt

SEQ ID NO: 8604 - DNA, 20 bp, Homo sapiens
tttcttccttttcaatttca

SEQ ID NO: 8605 - DNA, 22 bp, Homo sapiens
aattaaaaatgaaaattatgtt

SEQ ID NO: 8606 - DNA, 18 bp, Homo sapiens
caattctgaaatactttt

SEQ ID NO: 8607 - DNA, 23 bp, Homo sapiens
tccagtataatctcctctgctca

SEQ ID NO: 8608 - DNA, 19 bp, Homo sapiens
tctctttgtgcagtgttag

SEQ ID NO: 8609 - DNA, 20 bp, Homo sapiens
tttacattttagggtgggta

SEQ ID NO: 8610 - DNA, 26 bp, Homo sapiens
acataagatgaatttaattatattca

SEQ ID NO: 8611 - DNA, 21 bp, Homo sapiens
tctgtattcttactcactttt

SEQ ID NO: 8612 - DNA, 18 bp, Homo sapiens
ttggcaattaaacatgct

SEQ ID NO: 8613 - DNA, 18 bp, Homo sapiens
ctgtgcctttgcaaatca

SEQ ID NO: 8614 - DNA, 21 bp, Homo sapiens
aagaatctttatgaatataca

SEQ ID NO: 8615 - DNA, 20 bp, Homo sapiens
aaggttgcagtgctgagctg

SEQ ID NO: 8616 - DNA, 18 bp, Homo sapiens
ccgagtggctgtcggctc

SEQ ID NO: 8617 - DNA, 18 bp, Homo sapiens
cgcccttgagctacttca

SEQ ID NO: 8618 - DNA, 24 bp, Homo sapiens
ttacagctttctgtgcagagatga

SEQ ID NO: 8619 - DNA, 24 bp, Homo sapiens
aatgtacaccactcctcatgtgcc

SEQ ID NO: 8620 - DNA, 19 bp, Homo sapiens
acagctgaggaaagcaatt

SEQ ID NO: 8621 - DNA, 19 bp, Homo sapiens
cctcagcactccctatgca

SEQ ID NO: 8622 - DNA, 20 bp, Homo sapiens
gttgaactggaccctggctt

SEQ ID NO: 8623 - DNA, 18 bp, Homo sapiens
ttaaacttgatcaggtca

SEQ ID NO: 8624 - DNA, 22 bp, Homo sapiens
ttgacaaacagcagaccctaca

SEQ ID NO: 8625 - DNA, 25 bp, Homo sapiens
agcacggtaatctgagtgcacagta

SEQ ID NO: 8626 - DNA, 23 bp, Homo sapiens
cagtgagactgtacataattgca

SEQ ID NO: 8627 - DNA, 24 bp, Homo sapiens
cactgctgagacccacaggtctaa

SEQ ID NO: 8628 - DNA, 19 bp, Homo sapiens
ggtcacagacttctggcct

SEQ ID NO: 8629 - DNA, 20 bp, Homo sapiens
gtgtgtgtgggcacgtgtgg

SEQ ID NO: 8630 - DNA, 21 bp, Homo sapiens
acctgataggattgcctgctt

SEQ ID NO: 8631 - DNA, 18 bp, Homo sapiens
agcattgaaggaactctc

SEQ ID NO: 8632 - DNA, 20 bp, Homo sapiens
ccctttgaaggctctgggga

SEQ ID NO: 8633 - DNA, 21 bp, Homo sapiens
aatgtttcttaaatggaatta

SEQ ID NO: 8634 - DNA, 19 bp, Homo sapiens
aatttttggtgaatgtggg

SEQ ID NO: 8635 - DNA, 23 bp, Homo sapiens
tgagcatcagagagtgtacatca

SEQ ID NO: 8636 - DNA, 19 bp, Homo sapiens
agaggggatgagttgtgtg

SEQ ID NO: 8637 - DNA, 21 bp, Homo sapiens
tcctggtgcaaggccggtgga

SEQ ID NO: 8638 - DNA, 20 bp, Homo sapiens
cgggagacacctcagacccc

SEQ ID NO: 8639 - DNA, 21 bp, Homo sapiens
aaaaggtgctacggtagtgat

SEQ ID NO: 8640 - DNA, 21 bp, Homo sapiens
agcaagttcactacagcatca

SEQ ID NO: 8641 - DNA, 17 bp, Homo sapiens
cagcttgcatctttgtt

SEQ ID NO: 8642 - DNA, 19 bp, Homo sapiens
ccaattttctttttactcc

SEQ ID NO: 8643 - DNA, 19 bp, Homo sapiens
cctgggtgatcaccacatc

SEQ ID NO: 8644 - DNA, 18 bp, Homo sapiens
gcctcaagttcaatatgg

SEQ ID NO: 8645 - DNA, 17 bp, Homo sapiens
agcatagaaacatccta

SEQ ID NO: 8646 - DNA, 17 bp, Homo sapiens
tcaagtgattctcctgc

SEQ ID NO: 8647 - DNA, 18 bp, Homo sapiens
gcatggggagcctccgtt

SEQ ID NO: 8648 - DNA, 18 bp, Homo sapiens
ccagaatcacttgcactg

SEQ ID NO: 8649 - DNA, 18 bp, Homo sapiens
ccaggagaaaatggtgtt

SEQ ID NO: 8650 - DNA, 22 bp, Homo sapiens
cctcctcatcacgtttctctca

SEQ ID NO: 8651 - DNA, 19 bp, Homo sapiens
tgcccagctgacgagcttt

SEQ ID NO: 8652 - DNA, 23 bp, Homo sapiens
tttccagaatcacttgcactgtc

SEQ ID NO: 8653 - DNA, 21 bp, Homo sapiens
actagcaacaaaggcaaccca

SEQ ID NO: 8654 - DNA, 24 bp, Homo sapiens
acacaatggaaattcagaccttga

SEQ ID NO: 8655 - DNA, 20 bp, Homo sapiens
ggacctggcatttatctggc

SEQ ID NO: 8656 - DNA, 19 bp, Homo sapiens
gtatttctggatcattttt

SEQ ID NO: 8657 - DNA, 17 bp, Homo sapiens
tgggaagtgtccagcaa

SEQ ID NO: 8658 - DNA, 17 bp, Homo sapiens
ttggaaaatttataatt

SEQ ID NO: 8659 - DNA, 23 bp, Homo sapiens
cttattgatactaaagaggagtt

SEQ ID NO: 8660 - DNA, 20 bp, Homo sapiens
gatgttgaacctggttaggg

SEQ ID NO: 8661 - DNA, 18 bp, Homo sapiens
accctctaccatctgtaa

SEQ ID NO: 8662 - DNA, 21 bp, Homo sapiens
accgtcactcagatccacatt

SEQ ID NO: 8663 - DNA, 23 bp, Homo sapiens
cactgctcgcttcggatactcca

SEQ ID NO: 8664 - DNA, 20 bp, Homo sapiens
ctgccttcgacaccacccca

SEQ ID NO: 8665 - DNA, 21 bp, Homo sapiens
ggcctgctccccagcccgggg

SEQ ID NO: 8666 - DNA, 19 bp, Homo sapiens
agcgcctggccacactctt

SEQ ID NO: 8667 - DNA, 19 bp, Homo sapiens
cactgcctacccacctgcc

SEQ ID NO: 8668 - DNA, 23 bp, Homo sapiens
cccactccctggccctcatccca

SEQ ID NO: 8669 - DNA, 21 bp, Homo sapiens
ccccacccggggcccagagct

SEQ ID NO: 8670 - DNA, 23 bp, Homo sapiens
gcactgcctacccacctgcccca

SEQ ID NO: 8671 - DNA, 23 bp, Homo sapiens
ttctactagttcctccaattcca

SEQ ID NO: 8672 - DNA, 23 bp, Homo sapiens
ttctactagttcctccaattcca

SEQ ID NO: 8673 - DNA, 21 bp, Homo sapiens
tgcagtgagcctagatcgcgc

SEQ ID NO: 8674 - DNA, 21 bp, Homo sapiens
aaaacaaaagggactaaacta

SEQ ID NO: 8675 - DNA, 20 bp, Homo sapiens
ctctttcttcttttgtccca

SEQ ID NO: 8676 - DNA, 24 bp, Homo sapiens
ctttttcagtagcatttagacctt

SEQ ID NO: 8677 - DNA, 18 bp, Homo sapiens
aaaccaaagctcagatgg

SEQ ID NO: 8678 - DNA, 21 bp, Homo sapiens
aaacatcctaacttgtttttc

SEQ ID NO: 8679 - DNA, 17 bp, Homo sapiens
cgaataactgttgagat

SEQ ID NO: 8680 - DNA, 18 bp, Homo sapiens
cactaggctctttgtgta

SEQ ID NO: 8681 - DNA, 19 bp, Homo sapiens
cagcaggagaggtgatgag

SEQ ID NO: 8682 - DNA, 23 bp, Homo sapiens
ctaacaaacatattccaataata

SEQ ID NO: 8683 - DNA, 19 bp, Homo sapiens
tgagatgaattggtgtgaa

SEQ ID NO: 8684 - DNA, 22 bp, Homo sapiens
ccctccacacccggggccagac

SEQ ID NO: 8685 - DNA, 18 bp, Homo sapiens
gctagtgaccatcttcat

SEQ ID NO: 8686 - DNA, 22 bp, Homo sapiens
tgcagaacagcatcatgtcata

SEQ ID NO: 8687 - DNA, 17 bp, Homo sapiens
tggtttctaccagctca

SEQ ID NO: 8688 - DNA, 21 bp, Homo sapiens
cccagacccacgtcttcccca

SEQ ID NO: 8689 - DNA, 19 bp, Homo sapiens
ggcagatgaaggagttttc

SEQ ID NO: 8690 - DNA, 19 bp, Homo sapiens
aattatactctaaattcca

SEQ ID NO: 8691 - DNA, 19 bp, Homo sapiens
gcaagagccataactttga

SEQ ID NO: 8692 - DNA, 21 bp, Homo sapiens
cttgtggtgtgaccatgttca

SEQ ID NO: 8693 - DNA, 20 bp, Homo sapiens
ttgctcgccgcagccgcctc

SEQ ID NO: 8694 - DNA, 17 bp, Homo sapiens
cccgcctccccgccagc

SEQ ID NO: 8695 - DNA, 19 bp, Homo sapiens
ccgagcgcgccggcaccgc

SEQ ID NO: 8696 - DNA, 20 bp, Homo sapiens
gcctctgccgcctcttccag

SEQ ID NO: 8697 - DNA, 23 bp, Homo sapiens
ccctgccttgggaggtgtgtgga

SEQ ID NO: 8698 - DNA, 19 bp, Homo sapiens
gccatctctaggcacctca

SEQ ID NO: 8699 - DNA, 22 bp, Homo sapiens
tctcctgcttggtcttggccct

SEQ ID NO: 8700 - DNA, 21 bp, Homo sapiens
tgggtgggctggaatggaact

SEQ ID NO: 8701 - DNA, 21 bp, Homo sapiens
acattatgttagagaggtagc

SEQ ID NO: 8702 - DNA, 16 bp, Homo sapiens
ccaaatccacaagcca

SEQ ID NO: 8703 - DNA, 23 bp, Homo sapiens
gtgccaggctgtaagcattctga

SEQ ID NO: 8704 - DNA, 20 bp, Homo sapiens
aaagaaaagcaaacaaagaa

SEQ ID NO: 8705 - DNA, 18 bp, Homo sapiens
cacaagcccaacatctca

SEQ ID NO: 8706 - DNA, 20 bp, Homo sapiens
tctctgccctccctcccttt

SEQ ID NO: 8707 - DNA, 18 bp, Homo sapiens
cgaccgctgcggcggcgg

SEQ ID NO: 8708 - DNA, 20 bp, Homo sapiens
aagaaagaagcccaggtgtc

SEQ ID NO: 8709 - DNA, 19 bp, Homo sapiens
ccccatctcagagctcaga

SEQ ID NO: 8710 - DNA, 18 bp, Homo sapiens
gcccacacctccacctcc

SEQ ID NO: 8711 - DNA, 17 bp, Homo sapiens
tgaactcactgagcagc

SEQ ID NO: 8712 - DNA, 22 bp, Homo sapiens
tctgtgcgcggccggctggctc

SEQ ID NO: 8713 - DNA, 18 bp, Homo sapiens
acagttaccaccctcatt

SEQ ID NO: 8714 - DNA, 17 bp, Homo sapiens
attgggcagcttccaca

SEQ ID NO: 8715 - DNA, 20 bp, Homo sapiens
tgacaagaggtgacacaact

SEQ ID NO: 8716 - DNA, 21 bp, Homo sapiens
tgacccttcggaatcagccca

SEQ ID NO: 8717 - DNA, 16 bp, Homo sapiens
aagacataaatgagga

SEQ ID NO: 8718 - DNA, 20 bp, Homo sapiens
ccatgttaaatcccattcat

SEQ ID NO: 8719 - DNA, 21 bp, Homo sapiens
ctaaattaacattgggaaatc

SEQ ID NO: 8720 - DNA, 21 bp, Homo sapiens
ctgtggaaaaatatttaagat

SEQ ID NO: 8721 - DNA, 19 bp, Homo sapiens
tacttttgacaacaaatta

SEQ ID NO: 8722 - DNA, 21 bp, Homo sapiens
ggaggcagtgattccaagctg

SEQ ID NO: 8723 - DNA, 19 bp, Homo sapiens
tcaccatcgtgtttgcaaa

SEQ ID NO: 8724 - DNA, 18 bp, Homo sapiens
tcataaaccaatgtggca

SEQ ID NO: 8725 - DNA, 20 bp, Homo sapiens
tgtcctcagagcaggggcca

SEQ ID NO: 8726 - DNA, 22 bp, Homo sapiens
ccgagcgcggggggcccgtgga

SEQ ID NO: 8727 - DNA, 18 bp, Homo sapiens
gcgttcccggtcactttt

SEQ ID NO: 8728 - DNA, 17 bp, Homo sapiens
tgacgacatacatgcta

SEQ ID NO: 8729 - DNA, 18 bp, Homo sapiens
atgaagctgcatatgata

SEQ ID NO: 8730 - DNA, 18 bp, Homo sapiens
cggaatatttaaacagta

SEQ ID NO: 8731 - DNA, 17 bp, Homo sapiens
gcgggacgagcgcggga

SEQ ID NO: 8732 - DNA, 21 bp, Homo sapiens
tgtctccggggaagcccgggg

SEQ ID NO: 8733 - DNA, 17 bp, Homo sapiens
ctgttacacttgtgcag

SEQ ID NO: 8734 - DNA, 25 bp, Homo sapiens
tctagaaaaaactacttttgtacca

SEQ ID NO: 8735 - DNA, 22 bp, Homo sapiens
tgtgaataaagttagtgtgttg

SEQ ID NO: 8736 - DNA, 18 bp, Homo sapiens
acaacagaaaacactttg

SEQ ID NO: 8737 - DNA, 24 bp, Homo sapiens
agggaagagaggggttctacccac

SEQ ID NO: 8738 - DNA, 18 bp, Homo sapiens
atttatgaagttatggca

SEQ ID NO: 8739 - DNA, 16 bp, Homo sapiens
ctgcagcatgctggga

SEQ ID NO: 8740 - DNA, 19 bp, Homo sapiens
cttgcttccagattgtttt

SEQ ID NO: 8741 - DNA, 19 bp, Homo sapiens
ggacatttaataatggacc

SEQ ID NO: 8742 - DNA, 19 bp, Homo sapiens
ggaatgatataatctgtcc

SEQ ID NO: 8743 - DNA, 19 bp, Homo sapiens
ttttgatgatggaggtatg

SEQ ID NO: 8744 - DNA, 26 bp, Homo sapiens
gctccatgtgaccctccctctgcctc

SEQ ID NO: 8745 - DNA, 17 bp, Homo sapiens
actgcagtattcaccta

SEQ ID NO: 8746 - DNA, 22 bp, Homo sapiens
cgtttttgagaagatagtcata

SEQ ID NO: 8747 - DNA, 19 bp, Homo sapiens
gaacagagggacaattgtt

SEQ ID NO: 8748 - DNA, 21 bp, Homo sapiens
agaagggcccatcctatttcc

SEQ ID NO: 8749 - DNA, 21 bp, Homo sapiens
agctggctgtcctggttcact

SEQ ID NO: 8750 - DNA, 18 bp, Homo sapiens
aggaaattaatggctatt

SEQ ID NO: 8751 - DNA, 18 bp, Homo sapiens
atggttaccctgcttctt

SEQ ID NO: 8752 - DNA, 21 bp, Homo sapiens
cacaaagtccttaacatgcca

SEQ ID NO: 8753 - DNA, 21 bp, Homo sapiens
gtggcagatttctttagctgc

SEQ ID NO: 8754 - DNA, 23 bp, Homo sapiens
tctgtgaatcttgaataactttt

SEQ ID NO: 8755 - DNA, 21 bp, Homo sapiens
catatcccttccccagatctg

SEQ ID NO: 8756 - DNA, 19 bp, Homo sapiens
gtagctctccctaggctgc

SEQ ID NO: 8757 - DNA, 25 bp, Homo sapiens
gtctggtgtgtagattgctttgtct

SEQ ID NO: 8758 - DNA, 17 bp, Homo sapiens
tgcccactctccatcct

SEQ ID NO: 8759 - DNA, 18 bp, Homo sapiens
ttgtctttgttctgtgat

SEQ ID NO: 8760 - DNA, 20 bp, Homo sapiens
agctgcagcaggagatgcaa

SEQ ID NO: 8761 - DNA, 17 bp, Homo sapiens
ccacctcccactgggca

SEQ ID NO: 8762 - DNA, 18 bp, Homo sapiens
cccagcgcctggctccag

SEQ ID NO: 8763 - DNA, 19 bp, Homo sapiens
agcccaccagagcactaca

SEQ ID NO: 8764 - DNA, 21 bp, Homo sapiens
atctgggctgcggggaggctc

SEQ ID NO: 8765 - DNA, 16 bp, Homo sapiens
cacacatcttgctatg

SEQ ID NO: 8766 - DNA, 20 bp, Homo sapiens
ccaggcagcggctctgtgga

SEQ ID NO: 8767 - DNA, 16 bp, Homo sapiens
ctgccccctgccctct

SEQ ID NO: 8768 - DNA, 23 bp, Homo sapiens
tcccggaggaacccatttgtgct

SEQ ID NO: 8769 - DNA, 21 bp, Homo sapiens
tgaccaccactgtgcccctca

SEQ ID NO: 8770 - DNA, 19 bp, Homo sapiens
ggtgggggggtgtgctgtg

SEQ ID NO: 8771 - DNA, 22 bp, Homo sapiens
agttgctgctattctttgcctg

SEQ ID NO: 8772 - DNA, 18 bp, Homo sapiens
ttctcaaagcacaacgtg

SEQ ID NO: 8773 - DNA, 25 bp, Homo sapiens
gatggcctcagccccagccaccata

SEQ ID NO: 8774 - DNA, 26 bp, Homo sapiens
tggtgtttcccctaatcgtggggttg

SEQ ID NO: 8775 - DNA, 22 bp, Homo sapiens
caaagcagcagttctaccaagc

SEQ ID NO: 8776 - DNA, 21 bp, Homo sapiens
ctgggagagaaaattaaccaa

SEQ ID NO: 8777 - DNA, 20 bp, Homo sapiens
gtatgagtatggcttggtta

SEQ ID NO: 8778 - DNA, 21 bp, Homo sapiens
tctttactagttattgtgaga

SEQ ID NO: 8779 - DNA, 19 bp, Homo sapiens
aaaatctcatctcttccct

SEQ ID NO: 8780 - DNA, 18 bp, Homo sapiens
actcagctccatctccaa

SEQ ID NO: 8781 - DNA, 22 bp, Homo sapiens
gcatctctaataccatgtttga

SEQ ID NO: 8782 - DNA, 19 bp, Homo sapiens
aagattatagtaccagtca

SEQ ID NO: 8783 - DNA, 17 bp, Homo sapiens
atatagaggaaaggggc

SEQ ID NO: 8784 - DNA, 18 bp, Homo sapiens
cacccccaccgccttcct

SEQ ID NO: 8785 - DNA, 22 bp, Homo sapiens
tgctattttaaaatttcttgat

SEQ ID NO: 8786 - DNA, 18 bp, Homo sapiens
gagtcttgtggtgaaaca

SEQ ID NO: 8787 - DNA, 20 bp, Homo sapiens
gcttaagtcatggaattcta

SEQ ID NO: 8788 - DNA, 20 bp, Homo sapiens
tctttttatggctgaataat

SEQ ID NO: 8789 - DNA, 24 bp, Homo sapiens
cttcttcatctctgttttgctctt

SEQ ID NO: 8790 - DNA, 18 bp, Homo sapiens
tcattctgaaccttatca

SEQ ID NO: 8791 - DNA, 21 bp, Homo sapiens
aaaaaaattgctctgtgtata

SEQ ID NO: 8792 - DNA, 19 bp, Homo sapiens
aactgggataactgatttc

SEQ ID NO: 8793 - DNA, 20 bp, Homo sapiens
aagagcatggatgcatttca

SEQ ID NO: 8794 - DNA, 18 bp, Homo sapiens
atctgaagaggcttctcc

SEQ ID NO: 8795 - DNA, 19 bp, Homo sapiens
aggattttcttcccaggga

SEQ ID NO: 8796 - DNA, 20 bp, Homo sapiens
atcccatgctgggccctcca

SEQ ID NO: 8797 - DNA, 19 bp, Homo sapiens
ccgggccaccccctctgaa

SEQ ID NO: 8798 - DNA, 21 bp, Homo sapiens
cctggagccccaggtgggctg

SEQ ID NO: 8799 - DNA, 21 bp, Homo sapiens
ggaccctccagttctgccaca

SEQ ID NO: 8800 - DNA, 20 bp, Homo sapiens
gtgagtagggggtttatgtt

SEQ ID NO: 8801 - DNA, 20 bp, Homo sapiens
gaaaaggtcagaaaatatta

SEQ ID NO: 8802 - DNA, 22 bp, Homo sapiens
gggttataagaaaaaattgcac

SEQ ID NO: 8803 - DNA, 21 bp, Homo sapiens
taccagatttttatatttgcc

SEQ ID NO: 8804 - DNA, 21 bp, Homo sapiens
tttttatatttgccactgtta

SEQ ID NO: 8805 - DNA, 18 bp, Homo sapiens
ttttggctcttttaggaa

SEQ ID NO: 8806 - DNA, 25 bp, Homo sapiens
aactgtgggattctgatttgtatta

SEQ ID NO: 8807 - DNA, 18 bp, Homo sapiens
cacaatggagtgtgtaag

SEQ ID NO: 8808 - DNA, 18 bp, Homo sapiens
tactacctcactactaca

SEQ ID NO: 8809 - DNA, 22 bp, Homo sapiens
tctcttgtgcttttttgatttt

SEQ ID NO: 8810 - DNA, 20 bp, Homo sapiens
tctgaaaatatctcttgtgc

SEQ ID NO: 8811 - DNA, 19 bp, Homo sapiens
tgccaaagcacttacacca

SEQ ID NO: 8812 - DNA, 20 bp, Homo sapiens
tttgttggtaactaatgtta

SEQ ID NO: 8813 - DNA, 18 bp, Homo sapiens
atcactgccctgctctga

SEQ ID NO: 8814 - DNA, 20 bp, Homo sapiens
cctttggaagatttggtgga

SEQ ID NO: 8815 - DNA, 20 bp, Homo sapiens
gcggccggaggagttttgtt

SEQ ID NO: 8816 - DNA, 20 bp, Homo sapiens
tgctatttttttcagtgctt

SEQ ID NO: 8817 - DNA, 23 bp, Homo sapiens
agattgtcatcttgtacagcaaa

SEQ ID NO: 8818 - DNA, 21 bp, Homo sapiens
ctacagatacttatgaagaca

SEQ ID NO: 8819 - DNA, 22 bp, Homo sapiens
cttgtatgtgtcaaagtatact

SEQ ID NO: 8820 - DNA, 19 bp, Homo sapiens
ggagcagtagtactaaggc

SEQ ID NO: 8821 - DNA, 20 bp, Homo sapiens
ggaacgagccggcggcggtg

SEQ ID NO: 8822 - DNA, 18 bp, Homo sapiens
cgtcctcccaccacccca

SEQ ID NO: 8823 - DNA, 21 bp, Homo sapiens
ctctctctctctccctctctc

SEQ ID NO: 8824 - DNA, 20 bp, Homo sapiens
tctcctcctcctcctcctct

SEQ ID NO: 8825 - DNA, 21 bp, Homo sapiens
cttttttatggcagtgtagta

SEQ ID NO: 8826 - DNA, 20 bp, Homo sapiens
ttaagttatttctcatccct

SEQ ID NO: 8827 - DNA, 21 bp, Homo sapiens
tgggattatgtggccttaggt

SEQ ID NO: 8828 - DNA, 16 bp, Homo sapiens
ctctctctctctctca

SEQ ID NO: 8829 - DNA, 19 bp, Homo sapiens
ttccgcacagaaagtttca

SEQ ID NO: 8830 - DNA, 18 bp, Homo sapiens
cctgggtgaggcctgggg

SEQ ID NO: 8831 - DNA, 21 bp, Homo sapiens
aagttgacttttagttcctaa

SEQ ID NO: 8832 - DNA, 17 bp, Homo sapiens
ctctccttcagatactg

SEQ ID NO: 8833 - DNA, 19 bp, Homo sapiens
ctgttttgcctgttgctca

SEQ ID NO: 8834 - DNA, 19 bp, Homo sapiens
gcctgtttgggaagcagca

SEQ ID NO: 8835 - DNA, 23 bp, Homo sapiens
cccttcccccataccttacccta

SEQ ID NO: 8836 - DNA, 18 bp, Homo sapiens
cttcagactggtgtctga

SEQ ID NO: 8837 - DNA, 20 bp, Homo sapiens
tctcagacaccaagctgcag

SEQ ID NO: 8838 - DNA, 19 bp, Homo sapiens
tctttttcctgaaactttg

SEQ ID NO: 8839 - DNA, 19 bp, Homo sapiens
ccaggccatctctgttcct

SEQ ID NO: 8840 - DNA, 19 bp, Homo sapiens
ccaggtcactgttgcccca

SEQ ID NO: 8841 - DNA, 23 bp, Homo sapiens
ccctgacagcacagggcctgggg

SEQ ID NO: 8842 - DNA, 23 bp, Homo sapiens
cctggcccacctgtcttggcttt

SEQ ID NO: 8843 - DNA, 23 bp, Homo sapiens
agtccccaggccagtgcttggca

SEQ ID NO: 8844 - DNA, 18 bp, Homo sapiens
cacagacccccttgctcc

SEQ ID NO: 8845 - DNA, 18 bp, Homo sapiens
ccacccctccccgcattg

SEQ ID NO: 8846 - DNA, 17 bp, Homo sapiens
ctttgccactgtccttg

SEQ ID NO: 8847 - DNA, 20 bp, Homo sapiens
atgatttcaaaatcagtttt

SEQ ID NO: 8848 - DNA, 22 bp, Homo sapiens
ccaaacaaaactgaaccacaaa

SEQ ID NO: 8849 - DNA, 18 bp, Homo sapiens
cttgttctatttttcaat

SEQ ID NO: 8850 - DNA, 20 bp, Homo sapiens
taagggaacaatccatgtga

SEQ ID NO: 8851 - DNA, 23 bp, Homo sapiens
taatcagaaaagtaattttgtca

SEQ ID NO: 8852 - DNA, 20 bp, Homo sapiens
tgcaaattaaaacatatttc

SEQ ID NO: 8853 - DNA, 23 bp, Homo sapiens
ttgtttgatccctaaccctacaa

SEQ ID NO: 8854 - DNA, 22 bp, Homo sapiens
cttttcacttcaattaatgctg

SEQ ID NO: 8855 - DNA, 18 bp, Homo sapiens
gtcccctaaggaaatccg

SEQ ID NO: 8856 - DNA, 21 bp, Homo sapiens
tgttttttttgactaaagcta

SEQ ID NO: 8857 - DNA, 26 bp, Homo sapiens
attttacagctggacctagtttcaca

SEQ ID NO: 8858 - DNA, 19 bp, Homo sapiens
tgatatcattaacatttca

SEQ ID NO: 8859 - DNA, 23 bp, Homo sapiens
cccactttgactatgagtatacc

SEQ ID NO: 8860 - DNA, 18 bp, Homo sapiens
cttagacgtcaaccctaa

SEQ ID NO: 8861 - DNA, 23 bp, Homo sapiens
cttttttgtctttgctttatctt

SEQ ID NO: 8862 - DNA, 19 bp, Homo sapiens
gccttaagattggtaagct

SEQ ID NO: 8863 - DNA, 21 bp, Homo sapiens
gcgtcccctgtggcgggctct

SEQ ID NO: 8864 - DNA, 18 bp, Homo sapiens
taagccagtataaaacac

SEQ ID NO: 8865 - DNA, 19 bp, Homo sapiens
tgcaccagatgccattaca

SEQ ID NO: 8866 - DNA, 18 bp, Homo sapiens
aaagcatctggaaaggta

SEQ ID NO: 8867 - DNA, 18 bp, Homo sapiens
cctctgggaaggacagcc

SEQ ID NO: 8868 - DNA, 19 bp, Homo sapiens
ctggtgccttttgcagcca

SEQ ID NO: 8869 - DNA, 18 bp, Homo sapiens
ctgttttctctctgcctt

SEQ ID NO: 8870 - DNA, 25 bp, Homo sapiens
ggacagccctgaccttcggttttcc

SEQ ID NO: 8871 - DNA, 20 bp, Homo sapiens
ggtggatgggggggataccg

SEQ ID NO: 8872 - DNA, 21 bp, Homo sapiens
ggtgtccctgtcgtggagctg

SEQ ID NO: 8873 - DNA, 22 bp, Homo sapiens
tcactggccttgctggaggcac

SEQ ID NO: 8874 - DNA, 20 bp, Homo sapiens
ttcccaagaattctgggctg

SEQ ID NO: 8875 - DNA, 18 bp, Homo sapiens
ttggggcctccctggctc

SEQ ID NO: 8876 - DNA, 21 bp, Homo sapiens
agggaaataaaggcagaaggc

SEQ ID NO: 8877 - DNA, 19 bp, Homo sapiens
cccagatctatgaactaca

SEQ ID NO: 8878 - DNA, 20 bp, Homo sapiens
ccgccccttccttctgttcc

SEQ ID NO: 8879 - DNA, 23 bp, Homo sapiens
ctaatctttcaaaacagatttaa

SEQ ID NO: 8880 - DNA, 23 bp, Homo sapiens
ctgctggaaaattttatcagcaa

SEQ ID NO: 8881 - DNA, 19 bp, Homo sapiens
caatgccaacagctggcca

SEQ ID NO: 8882 - DNA, 19 bp, Homo sapiens
ctcactatcctaccccacc

SEQ ID NO: 8883 - DNA, 18 bp, Homo sapiens
tgggtggatcacttgagg

SEQ ID NO: 8884 - DNA, 19 bp, Homo sapiens
gatatctattgtggatctt

SEQ ID NO: 8885 - DNA, 20 bp, Homo sapiens
ttcagaatttctaaaagttt

SEQ ID NO: 8886 - DNA, 20 bp, Homo sapiens
agggagaaaataatccagtc

SEQ ID NO: 8887 - DNA, 19 bp, Homo sapiens
cgggtggggcttggggctc

SEQ ID NO: 8888 - DNA, 23 bp, Homo sapiens
gtgtcttgggcagagctggctct

SEQ ID NO: 8889 - DNA, 17 bp, Homo sapiens
atgagagaagagccgga

SEQ ID NO: 8890 - DNA, 22 bp, Homo sapiens
cctcccccagtggccttcctcc

SEQ ID NO: 8891 - DNA, 18 bp, Homo sapiens
gctgggtcctcttctgcc

SEQ ID NO: 8892 - DNA, 23 bp, Homo sapiens
gtgtctcctcctgaccccagtgg

SEQ ID NO: 8893 - DNA, 24 bp, Homo sapiens
tctaggctctttcaagtgactttt

SEQ ID NO: 8894 - DNA, 20 bp, Homo sapiens
ttcattctctcgcacatttc

SEQ ID NO: 8895 - DNA, 23 bp, Homo sapiens
ttggcctttctgaaggcaagact

SEQ ID NO: 8896 - DNA, 22 bp, Homo sapiens
ctttgaggaaaaggtttgagag

SEQ ID NO: 8897 - DNA, 20 bp, Homo sapiens
tgggaatctctaatgtgaaa

SEQ ID NO: 8898 - DNA, 19 bp, Homo sapiens
ttgtcatgccattaagctc

SEQ ID NO: 8899 - DNA, 20 bp, Homo sapiens
acctgggacggaagctgcca

SEQ ID NO: 8900 - DNA, 21 bp, Homo sapiens
caagtcgcatttgccacttga

SEQ ID NO: 8901 - DNA, 26 bp, Homo sapiens
cacacccacaccacccactgtctgca

SEQ ID NO: 8902 - DNA, 20 bp, Homo sapiens
gctgtgatcacctgcctttg

SEQ ID NO: 8903 - DNA, 15 bp, Homo sapiens
ggaagctgccagctc

SEQ ID NO: 8904 - DNA, 26 bp, Homo sapiens
gggacgcagcagctgcacccgcccac

SEQ ID NO: 8905 - DNA, 22 bp, Homo sapiens
gttcttcccgtttccttccgtg

SEQ ID NO: 8906 - DNA, 19 bp, Homo sapiens
tggcccgcacgccgcctca

SEQ ID NO: 8907 - DNA, 20 bp, Homo sapiens
tgtaccaattaaaggattga

SEQ ID NO: 8908 - DNA, 19 bp, Homo sapiens
tgtgtgccccgtgcaggga

SEQ ID NO: 8909 - DNA, 24 bp, Homo sapiens
accaggacgcatgcccctccctct

SEQ ID NO: 8910 - DNA, 23 bp, Homo sapiens
cctcagtttccaaaatggaacca

SEQ ID NO: 8911 - DNA, 18 bp, Homo sapiens
gcacctgccgagcctctt

SEQ ID NO: 8912 - DNA, 20 bp, Homo sapiens
ggacgcatgcccctccctct

SEQ ID NO: 8913 - DNA, 19 bp, Homo sapiens
gaagaaattcctgtagcat

SEQ ID NO: 8914 - DNA, 23 bp, Homo sapiens
atcctggaaggacacagtgatga

SEQ ID NO: 8915 - DNA, 20 bp, Homo sapiens
atctcagttgtttgcttctt

SEQ ID NO: 8916 - DNA, 19 bp, Homo sapiens
caaactgtgaaaatagtgt

SEQ ID NO: 8917 - DNA, 17 bp, Homo sapiens
cagaaccaaatcgtggc

SEQ ID NO: 8918 - DNA, 17 bp, Homo sapiens
cagaaccaaatcgtggc

SEQ ID NO: 8919 - DNA, 21 bp, Homo sapiens
ggtgatgccattacagaacca

SEQ ID NO: 8920 - DNA, 20 bp, Homo sapiens
aaagagtctctacccctttc

SEQ ID NO: 8921 - DNA, 19 bp, Homo sapiens
aataggcaaaagtgtaaca

SEQ ID NO: 8922 - DNA, 17 bp, Homo sapiens
tcaataggcaaaagtgt

SEQ ID NO: 8923 - DNA, 21 bp, Homo sapiens
ttgatttttatctccaagtgg

SEQ ID NO: 8924 - DNA, 19 bp, Homo sapiens
aaagaacaatgacaaacac

SEQ ID NO: 8925 - DNA, 21 bp, Homo sapiens
aaatctgtttttctcatcaga

SEQ ID NO: 8926 - DNA, 19 bp, Homo sapiens
agactgattggcctggtca

SEQ ID NO: 8927 - DNA, 18 bp, Homo sapiens
cagcagcaaaaactacat

SEQ ID NO: 8928 - DNA, 19 bp, Homo sapiens
catttgaaaggtgtgctag

SEQ ID NO: 8929 - DNA, 21 bp, Homo sapiens
cctccccgcccgcgccgcctc

SEQ ID NO: 8930 - DNA, 20 bp, Homo sapiens
cttgcggccgcggagccggg

SEQ ID NO: 8931 - DNA, 26 bp, Homo sapiens
gaaccaaaagggaggctctctgtagg

SEQ ID NO: 8932 - DNA, 21 bp, Homo sapiens
gagcctttgtttttctccaca

SEQ ID NO: 8933 - DNA, 21 bp, Homo sapiens
gatttgtaaagctttacaata

SEQ ID NO: 8934 - DNA, 22 bp, Homo sapiens
tctctgcaacactttgaggaca

SEQ ID NO: 8935 - DNA, 18 bp, Homo sapiens
tttgtgttgtttttttaa

SEQ ID NO: 8936 - DNA, 20 bp, Homo sapiens
atgacttcagtttctgtttt

SEQ ID NO: 8937 - DNA, 17 bp, Homo sapiens
atgttttaaaatgtgat

SEQ ID NO: 8938 - DNA, 22 bp, Homo sapiens
catgtattttataaggcattca

SEQ ID NO: 8939 - DNA, 18 bp, Homo sapiens
taaaactaggaacctgta

SEQ ID NO: 8940 - DNA, 23 bp, Homo sapiens
taagggaaaggtggaggggctca

SEQ ID NO: 8941 - DNA, 21 bp, Homo sapiens
gcctccgcggctcaggagccg

SEQ ID NO: 8942 - DNA, 18 bp, Homo sapiens
gtttctgtctgtgtccca

SEQ ID NO: 8943 - DNA, 19 bp, Homo sapiens
caggccacacagacggaca

SEQ ID NO: 8944 - DNA, 18 bp, Homo sapiens
cagggaagaagcttttga

SEQ ID NO: 8945 - DNA, 16 bp, Homo sapiens
cctctgggtctgtgag

SEQ ID NO: 8946 - DNA, 19 bp, Homo sapiens
gacctcccgagacttgcca

SEQ ID NO: 8947 - DNA, 18 bp, Homo sapiens
gcacagggagcttctgtt

SEQ ID NO: 8948 - DNA, 22 bp, Homo sapiens
gcctgctgagggggcagtgcca

SEQ ID NO: 8949 - DNA, 21 bp, Homo sapiens
gctgcctcaggtcaggccagg

SEQ ID NO: 8950 - DNA, 24 bp, Homo sapiens
gctttgggaggactcactgacata

SEQ ID NO: 8951 - DNA, 17 bp, Homo sapiens
tctgatggtcgttgtgg

SEQ ID NO: 8952 - DNA, 20 bp, Homo sapiens
tggccaggctggtcttgaac

SEQ ID NO: 8953 - DNA, 20 bp, Homo sapiens
ttcctgtggttccatccgaa

SEQ ID NO: 8954 - DNA, 23 bp, Homo sapiens
ttgccccacactaacttgccctg

SEQ ID NO: 8955 - DNA, 22 bp, Homo sapiens
ctcggttggcagccatgttgga

SEQ ID NO: 8956 - DNA, 19 bp, Homo sapiens
gggtcactgggtctcggtt

SEQ ID NO: 8957 - DNA, 18 bp, Homo sapiens
ggtctgatcaggccctgg

SEQ ID NO: 8958 - DNA, 21 bp, Homo sapiens
ttttggctcggaggcctgtga

SEQ ID NO: 8959 - DNA, 20 bp, Homo sapiens
acagagaacatggtctcctg

SEQ ID NO: 8960 - DNA, 18 bp, Homo sapiens
ccacattcacattcccct

SEQ ID NO: 8961 - DNA, 22 bp, Homo sapiens
cccttccccactccatggcgcc

SEQ ID NO: 8962 - DNA, 20 bp, Homo sapiens
ccgctccccaacttctcgcc

SEQ ID NO: 8963 - DNA, 18 bp, Homo sapiens
tcacattcccctccctct

SEQ ID NO: 8964 - DNA, 20 bp, Homo sapiens
tccctgagcaggaccccaca

SEQ ID NO: 8965 - DNA, 21 bp, Homo sapiens
agttttcttccctccttgcta

SEQ ID NO: 8966 - DNA, 21 bp, Homo sapiens
ggaagaaaacactagtaacca

SEQ ID NO: 8967 - DNA, 18 bp, Homo sapiens
ggttaaccactgctttgg

SEQ ID NO: 8968 - DNA, 19 bp, Homo sapiens
gtaattccaaattattttt

SEQ ID NO: 8969 - DNA, 17 bp, Homo sapiens
ccatctcttaggtctaa

SEQ ID NO: 8970 - DNA, 17 bp, Homo sapiens
ccctccaatcctttcca

SEQ ID NO: 8971 - DNA, 17 bp, Homo sapiens
cttggccttgtgtcaga

SEQ ID NO: 8972 - DNA, 19 bp, Homo sapiens
ttccagaagatgccctcca

SEQ ID NO: 8973 - DNA, 22 bp, Homo sapiens
aggagagagaaaaataatggca

SEQ ID NO: 8974 - DNA, 17 bp, Homo sapiens
ccttctcccataccttg

SEQ ID NO: 8975 - DNA, 20 bp, Homo sapiens
gaggcagacatctgaacagg

SEQ ID NO: 8976 - DNA, 24 bp, Homo sapiens
tttcaatacctacccccaaatctt

SEQ ID NO: 8977 - DNA, 20 bp, Homo sapiens
acagagattaatgacccctt

SEQ ID NO: 8978 - DNA, 15 bp, Homo sapiens
caccagaggctccta

SEQ ID NO: 8979 - DNA, 21 bp, Homo sapiens
cgaggctgcagtgggctgtga

SEQ ID NO: 8980 - DNA, 18 bp, Homo sapiens
cttcccaaagctcattta

SEQ ID NO: 8981 - DNA, 19 bp, Homo sapiens
gaggaggacggcagagaca

SEQ ID NO: 8982 - DNA, 21 bp, Homo sapiens
tgaagaaactgaggttcagag

SEQ ID NO: 8983 - DNA, 25 bp, Homo sapiens
agtaagagaaccaaaggtgtgtgtg

SEQ ID NO: 8984 - DNA, 20 bp, Homo sapiens
cctctgcctcctgggttcaa

SEQ ID NO: 8985 - DNA, 19 bp, Homo sapiens
gcctaccacaaggctcctg

SEQ ID NO: 8986 - DNA, 25 bp, Homo sapiens
cacccggggaagccatcacagctca

SEQ ID NO: 8987 - DNA, 21 bp, Homo sapiens
ccgcagcgccgccgacaacgc

SEQ ID NO: 8988 - DNA, 17 bp, Homo sapiens
gactaacttctaaaagc

SEQ ID NO: 8989 - DNA, 21 bp, Homo sapiens
gccttactgccgcctaccccg

SEQ ID NO: 8990 - DNA, 18 bp, Homo sapiens
ggtgcagctccgcccggc

SEQ ID NO: 8991 - DNA, 18 bp, Homo sapiens
tcttcggctcctctgcac

SEQ ID NO: 8992 - DNA, 21 bp, Homo sapiens
acacactgaccaccagtcaca

SEQ ID NO: 8993 - DNA, 17 bp, Homo sapiens
acaggacaggtttcaca

SEQ ID NO: 8994 - DNA, 22 bp, Homo sapiens
ccatttcacttcttggatatca

SEQ ID NO: 8995 - DNA, 19 bp, Homo sapiens
ctgtggtggtctctggtcc

SEQ ID NO: 8996 - DNA, 20 bp, Homo sapiens
cttccaccatggttctgggc

SEQ ID NO: 8997 - DNA, 18 bp, Homo sapiens
gagaaaaccatgtactaa

SEQ ID NO: 8998 - DNA, 17 bp, Homo sapiens
gtgtgtagttacttgac

SEQ ID NO: 8999 - DNA, 20 bp, Homo sapiens
tgactgttttgtacatgtga

SEQ ID NO: 9000 - DNA, 22 bp, Homo sapiens
tttttccaattacctgctgaca

SEQ ID NO: 9001 - DNA, 20 bp, Homo sapiens
ttccagaaatacctgtctag

SEQ ID NO: 9002 - DNA, 20 bp, Homo sapiens
acttccaagctcagtctaaa

SEQ ID NO: 9003 - DNA, 20 bp, Homo sapiens
agccctcattaaagatgcca

SEQ ID NO: 9004 - DNA, 20 bp, Homo sapiens
caacacccagtcctattcca

SEQ ID NO: 9005 - DNA, 21 bp, Homo sapiens
gcagaccgcagaattttcaca

SEQ ID NO: 9006 - DNA, 24 bp, Homo sapiens
tggggtcatagcaggttctggtca

SEQ ID NO: 9007 - DNA, 18 bp, Homo sapiens
tggggtctcagggctcag

SEQ ID NO: 9008 - DNA, 21 bp, Homo sapiens
tgtaattgtgggtatgtgtgc

SEQ ID NO: 9009 - DNA, 23 bp, Homo sapiens
caaagagacaaagggactttttc

SEQ ID NO: 9010 - DNA, 19 bp, Homo sapiens
cgatattgctaactgatca

SEQ ID NO: 9011 - DNA, 18 bp, Homo sapiens
tcacaaacactcggcatg

SEQ ID NO: 9012 - DNA, 21 bp, Homo sapiens
tgtaaatatttttttaaccta

SEQ ID NO: 9013 - DNA, 21 bp, Homo sapiens
ttgtttgactccttaccaata

SEQ ID NO: 9014 - DNA, 17 bp, Homo sapiens
tttgagtgtttatagat

SEQ ID NO: 9015 - DNA, 20 bp, Homo sapiens
acttgagctgtgacgggttc

SEQ ID NO: 9016 - DNA, 23 bp, Homo sapiens
agagtgttaccctcttttcctca

SEQ ID NO: 9017 - DNA, 18 bp, Homo sapiens
ccatttctcttctgctgg

SEQ ID NO: 9018 - DNA, 20 bp, Homo sapiens
ttgcctgattttctctggca

SEQ ID NO: 9019 - DNA, 20 bp, Homo sapiens
gtctgctcggccaggacagc

SEQ ID NO: 9020 - DNA, 18 bp, Homo sapiens
accgcggacgtgctggcc

SEQ ID NO: 9021 - DNA, 19 bp, Homo sapiens
ctgctcccacacttgtgcc

SEQ ID NO: 9022 - DNA, 22 bp, Homo sapiens
gccatctcaggttggcggcaga

SEQ ID NO: 9023 - DNA, 21 bp, Homo sapiens
ggaggggactggtcccggtca

SEQ ID NO: 9024 - DNA, 22 bp, Homo sapiens
gggtccttccaacaccgctaca

SEQ ID NO: 9025 - DNA, 19 bp, Homo sapiens
cctggtcgtgcgccctatg

SEQ ID NO: 9026 - DNA, 17 bp, Homo sapiens
gcaaggccttaccagcc

SEQ ID NO: 9027 - DNA, 23 bp, Homo sapiens
gctgtaatgtgggttttgtttta

SEQ ID NO: 9028 - DNA, 17 bp, Homo sapiens
tacagacaacttcatct

SEQ ID NO: 9029 - DNA, 24 bp, Homo sapiens
ttctctaagtgccaaaaacagtgt

SEQ ID NO: 9030 - DNA, 21 bp, Homo sapiens
ggggatggtcagcggctgctg

SEQ ID NO: 9031 - DNA, 24 bp, Homo sapiens
tcagcggctgctgccgtctggctc

SEQ ID NO: 9032 - DNA, 23 bp, Homo sapiens
tgaatgagttctgtatgaaactg

SEQ ID NO: 9033 - DNA, 22 bp, Homo sapiens
tagttgtattattgttgtttca

SEQ ID NO: 9034 - DNA, 22 bp, Homo sapiens
tatgtctactgtaaacattgct

SEQ ID NO: 9035 - DNA, 19 bp, Homo sapiens
tgtgaccaaatgggcctca

SEQ ID NO: 9036 - DNA, 22 bp, Homo sapiens
aaacaatatatacagactatac

SEQ ID NO: 9037 - DNA, 18 bp, Homo sapiens
attccagaaccaaatctt

SEQ ID NO: 9038 - DNA, 21 bp, Homo sapiens
tggaataataatgtgggatta

SEQ ID NO: 9039 - DNA, 21 bp, Homo sapiens
ttaagagtactattttttcca

SEQ ID NO: 9040 - DNA, 18 bp, Homo sapiens
cctcaggtttgcctctaa

SEQ ID NO: 9041 - DNA, 21 bp, Homo sapiens
gcctaatctctctctttttca

SEQ ID NO: 9042 - DNA, 16 bp, Homo sapiens
tccagaaagaccccag

SEQ ID NO: 9043 - DNA, 24 bp, Homo sapiens
atttgggccctgtgctgcctgcct

SEQ ID NO: 9044 - DNA, 15 bp, Homo sapiens
cctatctcttcccac

SEQ ID NO: 9045 - DNA, 24 bp, Homo sapiens
cctcatagtatctgccttggtctt

SEQ ID NO: 9046 - DNA, 23 bp, Homo sapiens
cctgcttccccaccccctcctca

SEQ ID NO: 9047 - DNA, 23 bp, Homo sapiens
cctgtaccctcccctggtctaca

SEQ ID NO: 9048 - DNA, 20 bp, Homo sapiens
ccttaatggagaaacgggcc

SEQ ID NO: 9049 - DNA, 18 bp, Homo sapiens
tctagatagtgttagaga

SEQ ID NO: 9050 - DNA, 23 bp, Homo sapiens
atgtggaggccagggtaaggtga

SEQ ID NO: 9051 - DNA, 23 bp, Homo sapiens
gccactttttttgtacaggggta

SEQ ID NO: 9052 - DNA, 22 bp, Homo sapiens
tagcctttctaaaccaaagttc

SEQ ID NO: 9053 - DNA, 22 bp, Homo sapiens
gtgcccacctgtgcgcgccgcc

SEQ ID NO: 9054 - DNA, 24 bp, Homo sapiens
ctgtcgggcaagatagctccttca

SEQ ID NO: 9055 - DNA, 17 bp, Homo sapiens
tgttgtcctgtgtcatc

SEQ ID NO: 9056 - DNA, 17 bp, Homo sapiens
gcagaccatatccctat

SEQ ID NO: 9057 - DNA, 20 bp, Homo sapiens
tgttttccagcatggtatta

SEQ ID NO: 9058 - DNA, 20 bp, Homo sapiens
acagggtctgcccgctgcac

SEQ ID NO: 9059 - DNA, 21 bp, Homo sapiens
caaccctccctgctaacccct

SEQ ID NO: 9060 - DNA, 20 bp, Homo sapiens
cgtccccaacatgcatctca

SEQ ID NO: 9061 - DNA, 18 bp, Homo sapiens
cttccccgcccctgccca

SEQ ID NO: 9062 - DNA, 18 bp, Homo sapiens
gactggaagcagaaaatg

SEQ ID NO: 9063 - DNA, 22 bp, Homo sapiens
gccacctcctcccagcccccca

SEQ ID NO: 9064 - DNA, 22 bp, Homo sapiens
gcccccttgcctttcaaactgg

SEQ ID NO: 9065 - DNA, 24 bp, Homo sapiens
gcctgggctgccgacacctgggcc

SEQ ID NO: 9066 - DNA, 19 bp, Homo sapiens
ggcaagcccccttgccttt

SEQ ID NO: 9067 - DNA, 24 bp, Homo sapiens
tctcactctgggtgtcttggtctt

SEQ ID NO: 9068 - DNA, 21 bp, Homo sapiens
gcccccgctgccctctgccct

SEQ ID NO: 9069 - DNA, 20 bp, Homo sapiens
agtaagaggactactcagca

SEQ ID NO: 9070 - DNA, 23 bp, Homo sapiens
tgggtgggctctgatgcagaact

SEQ ID NO: 9071 - DNA, 23 bp, Homo sapiens
acccagcgcacccctccccccct

SEQ ID NO: 9072 - DNA, 18 bp, Homo sapiens
accgggagggcccggcga

SEQ ID NO: 9073 - DNA, 19 bp, Homo sapiens
agaacccagcgcacccctc

SEQ ID NO: 9074 - DNA, 22 bp, Homo sapiens
cctcttttccccttgccccctc

SEQ ID NO: 9075 - DNA, 17 bp, Homo sapiens
ggggaggaggccagcca

SEQ ID NO: 9076 - DNA, 17 bp, Homo sapiens
taggaaatgacccgaga

SEQ ID NO: 9077 - DNA, 22 bp, Homo sapiens
tgatgaagacagaaggctccgg

SEQ ID NO: 9078 - DNA, 20 bp, Homo sapiens
tttgcttgaagagaccccct

SEQ ID NO: 9079 - DNA, 20 bp, Homo sapiens
cacctgtgtcctccctgggc

SEQ ID NO: 9080 - DNA, 22 bp, Homo sapiens
ccagccccgccacaacctctcc

SEQ ID NO: 9081 - DNA, 21 bp, Homo sapiens
gcagtgtcttgttttgtttta

SEQ ID NO: 9082 - DNA, 18 bp, Homo sapiens
ccgcctcgcccccacccc

SEQ ID NO: 9083 - DNA, 21 bp, Homo sapiens
tcgcccccacccccacccacc

SEQ ID NO: 9084 - DNA, 20 bp, Homo sapiens
gtatgagggaactgtgtaga

SEQ ID NO: 9085 - DNA, 16 bp, Homo sapiens
tttaagctgcctgtac

SEQ ID NO: 9086 - DNA, 23 bp, Homo sapiens
ttttttgtatagttaaccactac

SEQ ID NO: 9087 - DNA, 21 bp, Homo sapiens
cccgccgccgcggccccccgg

SEQ ID NO: 9088 - DNA, 19 bp, Homo sapiens
cattcttagctgtaactta

SEQ ID NO: 9089 - DNA, 19 bp, Homo sapiens
ttccccaggtggcctggag

SEQ ID NO: 9090 - DNA, 19 bp, Homo sapiens
tgccttggtttttactgct

SEQ ID NO: 9091 - DNA, 19 bp, Homo sapiens
gcccctgacgggcacccca

SEQ ID NO: 9092 - DNA, 15 bp, Homo sapiens
gaaaaagggcgtccc

SEQ ID NO: 9093 - DNA, 21 bp, Homo sapiens
tccaagcacaaggaactcctg

SEQ ID NO: 9094 - DNA, 19 bp, Homo sapiens
tgaacctttttgcccccac

SEQ ID NO: 9095 - DNA, 28 bp, Homo sapiens
agctgaagcagggcagggcatcaactca

SEQ ID NO: 9096 - DNA, 21 bp, Homo sapiens
cacttatttattgttgccttt

SEQ ID NO: 9097 - DNA, 21 bp, Homo sapiens
cagaaatgggcagttctccca

SEQ ID NO: 9098 - DNA, 21 bp, Homo sapiens
gcctccacccgtcctccctca

SEQ ID NO: 9099 - DNA, 21 bp, Homo sapiens
gcggccagcagcccctgcccc

SEQ ID NO: 9100 - DNA, 20 bp, Homo sapiens
ggctggggcatggcaaatca

SEQ ID NO: 9101 - DNA, 26 bp, Homo sapiens
gggaagccgatggcggcggctgcggc

SEQ ID NO: 9102 - DNA, 23 bp, Homo sapiens
gggttcgcagcggcggccgcggc

SEQ ID NO: 9103 - DNA, 21 bp, Homo sapiens
ggtggctctggggtatgtgtg

SEQ ID NO: 9104 - DNA, 23 bp, Homo sapiens
gtgtgtgtgggtgtgtgcgcctg

SEQ ID NO: 9105 - DNA, 18 bp, Homo sapiens
tcctctccttcccacaaa

SEQ ID NO: 9106 - DNA, 22 bp, Homo sapiens
tcttgtttcactccaccatcac

SEQ ID NO: 9107 - DNA, 21 bp, Homo sapiens
aagttttaatagaacctgtaa

SEQ ID NO: 9108 - DNA, 22 bp, Homo sapiens
agctgtagatcttgatcttcca

SEQ ID NO: 9109 - DNA, 19 bp, Homo sapiens
cactgaccctccgcccttc

SEQ ID NO: 9110 - DNA, 18 bp, Homo sapiens
tgaggcttttttgtttta

SEQ ID NO: 9111 - DNA, 23 bp, Homo sapiens
taacagtgatcacattcattcca

SEQ ID NO: 9112 - DNA, 20 bp, Homo sapiens
agagatatttcccagttact

SEQ ID NO: 9113 - DNA, 19 bp, Homo sapiens
gtggctctttaattcctga

SEQ ID NO: 9114 - DNA, 20 bp, Homo sapiens
gttcaaattagtgcctcgga

SEQ ID NO: 9115 - DNA, 19 bp, Homo sapiens
tcagccctcctcattccta

SEQ ID NO: 9116 - DNA, 19 bp, Homo sapiens
ttccgtacggcttccggtg

SEQ ID NO: 9117 - DNA, 20 bp, Homo sapiens
agctgtcccccaggatccca

SEQ ID NO: 9118 - DNA, 22 bp, Homo sapiens
cagtaccaatcagtcagtgtca

SEQ ID NO: 9119 - DNA, 19 bp, Homo sapiens
ggcttcctctctttgtgat

SEQ ID NO: 9120 - DNA, 20 bp, Homo sapiens
gtacaaatgctctttgcctc

SEQ ID NO: 9121 - DNA, 21 bp, Homo sapiens
tttcctccctctctgatgcca

SEQ ID NO: 9122 - DNA, 17 bp, Homo sapiens
ctggcattgcacttttt

SEQ ID NO: 9123 - DNA, 23 bp, Homo sapiens
ctttgtggttccagatttttttt

SEQ ID NO: 9124 - DNA, 22 bp, Homo sapiens
tttgagcaatctgggcactttt

SEQ ID NO: 9125 - DNA, 18 bp, Homo sapiens
actgacacctttgcaggc

SEQ ID NO: 9126 - DNA, 17 bp, Homo sapiens
caacttttccctcctcc

SEQ ID NO: 9127 - DNA, 21 bp, Homo sapiens
ccttgcttggctgcttggcct

SEQ ID NO: 9128 - DNA, 22 bp, Homo sapiens
ccttgcttggctgcttggcctt

SEQ ID NO: 9129 - DNA, 17 bp, Homo sapiens
gcatgtgcttgtgtgtg

SEQ ID NO: 9130 - DNA, 23 bp, Homo sapiens
tgtgtaaacagtgttttggaata

SEQ ID NO: 9131 - DNA, 23 bp, Homo sapiens
gcctgggccagatgagcctgccc

SEQ ID NO: 9132 - DNA, 18 bp, Homo sapiens
cagcagcagcagcagcac

SEQ ID NO: 9133 - DNA, 19 bp, Homo sapiens
cagtcccttatgagcgtca

SEQ ID NO: 9134 - DNA, 19 bp, Homo sapiens
cttctctttcccccaccct

SEQ ID NO: 9135 - DNA, 20 bp, Homo sapiens
gcttcgtcttgtgtttgctg

SEQ ID NO: 9136 - DNA, 20 bp, Homo sapiens
gggaggaggggtaggactgc

SEQ ID NO: 9137 - DNA, 20 bp, Homo sapiens
ccgcccgctgccctacccgc

SEQ ID NO: 9138 - DNA, 20 bp, Homo sapiens
cttttttatatctctttggc

SEQ ID NO: 9139 - DNA, 20 bp, Homo sapiens
ctctccgcaccctctgtctc

SEQ ID NO: 9140 - DNA, 18 bp, Homo sapiens
gtgtgtattacttgtcta

SEQ ID NO: 9141 - DNA, 21 bp, Homo sapiens
tctctccccgtctccctccca

SEQ ID NO: 9142 - DNA, 18 bp, Homo sapiens
tgaaacttgtttacctta

SEQ ID NO: 9143 - DNA, 20 bp, Homo sapiens
tgtccccaggcatcatccca

SEQ ID NO: 9144 - DNA, 23 bp, Homo sapiens
tgtctcgccatcctcaagactca

SEQ ID NO: 9145 - DNA, 22 bp, Homo sapiens
atgaacctcgagaaagttctga

SEQ ID NO: 9146 - DNA, 20 bp, Homo sapiens
tggattaacagatggaattg

SEQ ID NO: 9147 - DNA, 21 bp, Homo sapiens
acctggtccacgtggattgtc

SEQ ID NO: 9148 - DNA, 20 bp, Homo sapiens
agctttcagaaggagttctc

SEQ ID NO: 9149 - DNA, 17 bp, Homo sapiens
tcaacctttctacctta

SEQ ID NO: 9150 - DNA, 21 bp, Homo sapiens
tcttgttccagctaggcaatg

SEQ ID NO: 9151 - DNA, 19 bp, Homo sapiens
tggtgtttttcacaaagta

SEQ ID NO: 9152 - DNA, 20 bp, Homo sapiens
atccctttaggatggaacta

SEQ ID NO: 9153 - DNA, 21 bp, Homo sapiens
acctgcagtagcggtgctgtc

SEQ ID NO: 9154 - DNA, 17 bp, Homo sapiens
cggccaaatgcgctcgt

SEQ ID NO: 9155 - DNA, 24 bp, Homo sapiens
cagttgaatttatggaatctacca

SEQ ID NO: 9156 - DNA, 24 bp, Homo sapiens
ccagagtttttatgtagcagggaa

SEQ ID NO: 9157 - DNA, 19 bp, Homo sapiens
ggtgcaaaagcagaaaata

SEQ ID NO: 9158 - DNA, 24 bp, Homo sapiens
ataagcatttaaaaacatatgaaa

SEQ ID NO: 9159 - DNA, 15 bp, Homo sapiens
cagtgaaatattgta

SEQ ID NO: 9160 - DNA, 17 bp, Homo sapiens
gtgtttttatttctgaa

SEQ ID NO: 9161 - DNA, 23 bp, Homo sapiens
tgcaccatttttgtattaacgta

SEQ ID NO: 9162 - DNA, 21 bp, Homo sapiens
ccctcccctcccctcccttcc

SEQ ID NO: 9163 - DNA, 22 bp, Homo sapiens
aaaatcaggactgaaatacatt

SEQ ID NO: 9164 - DNA, 22 bp, Homo sapiens
gcagttttaccggattttgtta

SEQ ID NO: 9165 - DNA, 20 bp, Homo sapiens
ttccatccgtaaaatatgta

SEQ ID NO: 9166 - DNA, 16 bp, Homo sapiens
aaaaactggcaacatt

SEQ ID NO: 9167 - DNA, 21 bp, Homo sapiens
aaacactgaaccagaccgatc

SEQ ID NO: 9168 - DNA, 18 bp, Homo sapiens
ccctagccctctccctct

SEQ ID NO: 9169 - DNA, 19 bp, Homo sapiens
gaatgggatcatgaaagta

SEQ ID NO: 9170 - DNA, 19 bp, Homo sapiens
gatcagaaaaatggagcaa

SEQ ID NO: 9171 - DNA, 25 bp, Homo sapiens
tccaacgtttggaagatcctgtgag

SEQ ID NO: 9172 - DNA, 19 bp, Homo sapiens
tggatgggttttatgagat

SEQ ID NO: 9173 - DNA, 19 bp, Homo sapiens
ttagggttggttcctttcc

SEQ ID NO: 9174 - DNA, 22 bp, Homo sapiens
ttccctcagtcccaaatccttc

SEQ ID NO: 9175 - DNA, 18 bp, Homo sapiens
ttgctgatggtctggtct

SEQ ID NO: 9176 - DNA, 21 bp, Homo sapiens
tttgctgtaagatgtctgttt

SEQ ID NO: 9177 - DNA, 21 bp, Homo sapiens
atcttggcttactgcaacctc

SEQ ID NO: 9178 - DNA, 21 bp, Homo sapiens
ccatggtgtcaatacatatca

SEQ ID NO: 9179 - DNA, 18 bp, Homo sapiens
ccctccaatctctctcca

SEQ ID NO: 9180 - DNA, 23 bp, Homo sapiens
cttaattttgttataaaatctca

SEQ ID NO: 9181 - DNA, 23 bp, Homo sapiens
gacccacggggtaacgggtctaa

SEQ ID NO: 9182 - DNA, 18 bp, Homo sapiens
tatcatgtagcttctgaa

SEQ ID NO: 9183 - DNA, 18 bp, Homo sapiens
tccgcctcctgggttcaa

SEQ ID NO: 9184 - DNA, 18 bp, Homo sapiens
tgccaccacacccagtga

SEQ ID NO: 9185 - DNA, 17 bp, Homo sapiens
ttttgggtatgtgggtt

SEQ ID NO: 9186 - DNA, 21 bp, Homo sapiens
taaatgttctgagtggagcta

SEQ ID NO: 9187 - DNA, 21 bp, Homo sapiens
tcttggctgtgtgtctgcgga

SEQ ID NO: 9188 - DNA, 17 bp, Homo sapiens
aactatggcctgtggat

SEQ ID NO: 9189 - DNA, 19 bp, Homo sapiens
tctttaattttacatttcc

SEQ ID NO: 9190 - DNA, 18 bp, Homo sapiens
aaaaagggctgtccatgt

SEQ ID NO: 9191 - DNA, 20 bp, Homo sapiens
aaacaacatgtgagcatggt

SEQ ID NO: 9192 - DNA, 20 bp, Homo sapiens
ccccacaggccccccgcagc

SEQ ID NO: 9193 - DNA, 21 bp, Homo sapiens
gacagaggaccattacaacta

SEQ ID NO: 9194 - DNA, 19 bp, Homo sapiens
tccccattcagacacttca

SEQ ID NO: 9195 - DNA, 19 bp, Homo sapiens
tgacagtgctctaggctgc

SEQ ID NO: 9196 - DNA, 18 bp, Homo sapiens
ccaaacacacaagctctc

SEQ ID NO: 9197 - DNA, 20 bp, Homo sapiens
ctggagtgtgtccttggcct

SEQ ID NO: 9198 - DNA, 18 bp, Homo sapiens
gactacaatgtctttatt

SEQ ID NO: 9199 - DNA, 19 bp, Homo sapiens
tttcttgcgctttgatttt

SEQ ID NO: 9200 - DNA, 22 bp, Homo sapiens
atctgtgaccatagcctagcta

SEQ ID NO: 9201 - DNA, 20 bp, Homo sapiens
atttcagtgttaatcagcta

SEQ ID NO: 9202 - DNA, 20 bp, Homo sapiens
caccactctgaggctaatta

SEQ ID NO: 9203 - DNA, 19 bp, Homo sapiens
ttacatcggactctatctg

SEQ ID NO: 9204 - DNA, 19 bp, Homo sapiens
gagacccaaccagacccca

SEQ ID NO: 9205 - DNA, 23 bp, Homo sapiens
aagcatgtaactaggtattgctt

SEQ ID NO: 9206 - DNA, 19 bp, Homo sapiens
ctgtgtgttaatcctctag

SEQ ID NO: 9207 - DNA, 21 bp, Homo sapiens
ttgatactctcatttaaactg

SEQ ID NO: 9208 - DNA, 21 bp, Homo sapiens
atcttggttcactgcaacctc

SEQ ID NO: 9209 - DNA, 20 bp, Homo sapiens
catctgcgtgtgtgcaggga

SEQ ID NO: 9210 - DNA, 21 bp, Homo sapiens
ccccttgcggctccctcgggc

SEQ ID NO: 9211 - DNA, 22 bp, Homo sapiens
cctccccacgaccccccttccc

SEQ ID NO: 9212 - DNA, 19 bp, Homo sapiens
cttgcatggcttgtgtggt

SEQ ID NO: 9213 - DNA, 24 bp, Homo sapiens
gcgacataaaatccagctgtgatg

SEQ ID NO: 9214 - DNA, 23 bp, Homo sapiens
tccggggcgctgacccaccatca

SEQ ID NO: 9215 - DNA, 19 bp, Homo sapiens
aagcacaaggaaggatggg

SEQ ID NO: 9216 - DNA, 19 bp, Homo sapiens
gactgctcttagtattaca

SEQ ID NO: 9217 - DNA, 23 bp, Homo sapiens
gcctgagctgtggcggaggatcc

SEQ ID NO: 9218 - DNA, 20 bp, Homo sapiens
gcgccacgaaagaaactgta

SEQ ID NO: 9219 - DNA, 17 bp, Homo sapiens
gtctagagtctgtgcac

SEQ ID NO: 9220 - DNA, 19 bp, Homo sapiens
gttagctgatgccagttga

SEQ ID NO: 9221 - DNA, 17 bp, Homo sapiens
catcacccgcccctgga

SEQ ID NO: 9222 - DNA, 18 bp, Homo sapiens
taatggggtctgtaaata

SEQ ID NO: 9223 - DNA, 22 bp, Homo sapiens
tgcagtacagtgtgtgtgggtg

SEQ ID NO: 9224 - DNA, 21 bp, Homo sapiens
ccagcccccacctctgcctcc

SEQ ID NO: 9225 - DNA, 18 bp, Homo sapiens
gtctcatcttccacccca

SEQ ID NO: 9226 - DNA, 17 bp, Homo sapiens
tcatcttccaccccaaa

SEQ ID NO: 9227 - DNA, 21 bp, Homo sapiens
tgaaattactacaaaatttga

SEQ ID NO: 9228 - DNA, 21 bp, Homo sapiens
aaagagacggactcctgttca

SEQ ID NO: 9229 - DNA, 20 bp, Homo sapiens
aagagacggactcctgttca

SEQ ID NO: 9230 - DNA, 19 bp, Homo sapiens
caggataaacccaatacat

SEQ ID NO: 9231 - DNA, 22 bp, Homo sapiens
ggagaaaaagatgggattgcca

SEQ ID NO: 9232 - DNA, 22 bp, Homo sapiens
atctggggaggccgcctggttt

SEQ ID NO: 9233 - DNA, 21 bp, Homo sapiens
caaccctctcctgtctgccct

SEQ ID NO: 9234 - DNA, 24 bp, Homo sapiens
gaaagggtggaaatcaaccctctc

SEQ ID NO: 9235 - DNA, 23 bp, Homo sapiens
acctgtcaactggagtgctctct

SEQ ID NO: 9236 - DNA, 19 bp, Homo sapiens
actggtagtgagaatatca

SEQ ID NO: 9237 - DNA, 23 bp, Homo sapiens
caccgtagggcatgctgatacca

SEQ ID NO: 9238 - DNA, 20 bp, Homo sapiens
ctaagtacagtggcactgtt

SEQ ID NO: 9239 - DNA, 23 bp, Homo sapiens
ctctttttatatcaaaagtctca

SEQ ID NO: 9240 - DNA, 18 bp, Homo sapiens
ctgtggcttgttttgttt

SEQ ID NO: 9241 - DNA, 17 bp, Homo sapiens
cttatctggtgttaaga

SEQ ID NO: 9242 - DNA, 21 bp, Homo sapiens
ctttttcattacacttgactt

SEQ ID NO: 9243 - DNA, 20 bp, Homo sapiens
ggcatgctgataccatccca

SEQ ID NO: 9244 - DNA, 23 bp, Homo sapiens
tcacacatgcagtggttctctga

SEQ ID NO: 9245 - DNA, 18 bp, Homo sapiens
tccaagaagctttcctca

SEQ ID NO: 9246 - DNA, 21 bp, Homo sapiens
aaaataagctcagtgatacct

SEQ ID NO: 9247 - DNA, 20 bp, Homo sapiens
acccggcccaacccagccca

SEQ ID NO: 9248 - DNA, 20 bp, Homo sapiens
cccagactcaaggagttggt

SEQ ID NO: 9249 - DNA, 18 bp, Homo sapiens
ccctgagttttacccaga

SEQ ID NO: 9250 - DNA, 20 bp, Homo sapiens
ctgtctaatttgcacctttg

SEQ ID NO: 9251 - DNA, 25 bp, Homo sapiens
tagtgtcaccaattccaccaagaca

SEQ ID NO: 9252 - DNA, 23 bp, Homo sapiens
tgtttcttcccatactgcataca

SEQ ID NO: 9253 - DNA, 18 bp, Homo sapiens
tttccactcaaaatatgt

SEQ ID NO: 9254 - DNA, 17 bp, Homo sapiens
agaaaatgcagttttca

SEQ ID NO: 9255 - DNA, 16 bp, Homo sapiens
cctaccatctcagtga

SEQ ID NO: 9256 - DNA, 16 bp, Homo sapiens
gtgcagatgtagcagg

SEQ ID NO: 9257 - DNA, 18 bp, Homo sapiens
ttataaattattttctca

SEQ ID NO: 9258 - DNA, 19 bp, Homo sapiens
gggggtgggtggcctgtgg

SEQ ID NO: 9259 - DNA, 24 bp, Homo sapiens
tggagggcatcctggatggaattg

SEQ ID NO: 9260 - DNA, 21 bp, Homo sapiens
ctgtggactgagacccacctt

SEQ ID NO: 9261 - DNA, 24 bp, Homo sapiens
ggaagaggaggctggttggtacca

SEQ ID NO: 9262 - DNA, 24 bp, Homo sapiens
ccagaaggggatcctcccgctccg

SEQ ID NO: 9263 - DNA, 22 bp, Homo sapiens
ccatattaccacagacatacta

SEQ ID NO: 9264 - DNA, 18 bp, Homo sapiens
cttggcggccgccggttc

SEQ ID NO: 9265 - DNA, 19 bp, Homo sapiens
ggaggaggaggtaccgcca

SEQ ID NO: 9266 - DNA, 24 bp, Homo sapiens
tcccaggtcgtggccgtcttgctc

SEQ ID NO: 9267 - DNA, 20 bp, Homo sapiens
ttccaaagtacactgtttca

SEQ ID NO: 9268 - DNA, 17 bp, Homo sapiens
tttgacctctgcagcaa

SEQ ID NO: 9269 - DNA, 16 bp, Homo sapiens
cctactggacgctgcc

SEQ ID NO: 9270 - DNA, 17 bp, Homo sapiens
gggccgcccgctccctt

SEQ ID NO: 9271 - DNA, 21 bp, Homo sapiens
tcacgccctcttgtttccttt

SEQ ID NO: 9272 - DNA, 24 bp, Homo sapiens
ccaggcggccgacctccccattcc

SEQ ID NO: 9273 - DNA, 21 bp, Homo sapiens
cttctctgcttcctccacgtc

SEQ ID NO: 9274 - DNA, 22 bp, Homo sapiens
tagggttcagtaggtctcagtc

SEQ ID NO: 9275 - DNA, 18 bp, Homo sapiens
acagactgccaaatggaa

SEQ ID NO: 9276 - DNA, 22 bp, Homo sapiens
caaccagggaccctctgcccct

SEQ ID NO: 9277 - DNA, 19 bp, Homo sapiens
attgacacaaagcattcca

SEQ ID NO: 9278 - DNA, 17 bp, Homo sapiens
gagctttactaaaagaa

SEQ ID NO: 9279 - DNA, 20 bp, Homo sapiens
tccgaaaactggtttctagt

SEQ ID NO: 9280 - DNA, 17 bp, Homo sapiens
tgtccatctctccatct

SEQ ID NO: 9281 - DNA, 18 bp, Homo sapiens
ttgatggacaaaatgaga

SEQ ID NO: 9282 - DNA, 19 bp, Homo sapiens
actacttactgatagacca

SEQ ID NO: 9283 - DNA, 21 bp, Homo sapiens
atagaccaaaaaactacacca

SEQ ID NO: 9284 - DNA, 18 bp, Homo sapiens
ccatggcacatgtatacc

SEQ ID NO: 9285 - DNA, 23 bp, Homo sapiens
ggacatttagggtcccccctgtg

SEQ ID NO: 9286 - DNA, 23 bp, Homo sapiens
acattaaaaatgtagctgactta

SEQ ID NO: 9287 - DNA, 18 bp, Homo sapiens
aattatccaactacatat

SEQ ID NO: 9288 - DNA, 26 bp, Homo sapiens
atggttctactcccaggatgaaatta

SEQ ID NO: 9289 - DNA, 20 bp, Homo sapiens
ccgtggatgtgcaagttgtg

SEQ ID NO: 9290 - DNA, 22 bp, Homo sapiens
cctgggagccttccccagtgta

SEQ ID NO: 9291 - DNA, 22 bp, Homo sapiens
cgggctccggctgggcccggcg

SEQ ID NO: 9292 - DNA, 20 bp, Homo sapiens
attagtgatttcagcaaatc

SEQ ID NO: 9293 - DNA, 17 bp, Homo sapiens
gaaactccagatatcaa

SEQ ID NO: 9294 - DNA, 19 bp, Homo sapiens
tgccttttaatataccaca

SEQ ID NO: 9295 - DNA, 19 bp, Homo sapiens
ttcagcaaatctcatgata

SEQ ID NO: 9296 - DNA, 16 bp, Homo sapiens
gagtccatttcccaca

SEQ ID NO: 9297 - DNA, 21 bp, Homo sapiens
ctctcgcacaccggggccctg

SEQ ID NO: 9298 - DNA, 24 bp, Homo sapiens
ggtgtggtgagaaggcaggttgtg

SEQ ID NO: 9299 - DNA, 19 bp, Homo sapiens
acagaagagtcttgttcca

SEQ ID NO: 9300 - DNA, 19 bp, Homo sapiens
agcgtttgctttcgcctgt

SEQ ID NO: 9301 - DNA, 18 bp, Homo sapiens
tcgatgtgatgttctttt

SEQ ID NO: 9302 - DNA, 17 bp, Homo sapiens
ctgggtcctgctggtct

SEQ ID NO: 9303 - DNA, 19 bp, Homo sapiens
ccgcggcggccgccggctc

SEQ ID NO: 9304 - DNA, 22 bp, Homo sapiens
atcatggagcgaataattttca

SEQ ID NO: 9305 - DNA, 21 bp, Homo sapiens
cccaaacggatccttccccag

SEQ ID NO: 9306 - DNA, 21 bp, Homo sapiens
cctctgcgttctgccttggtt

SEQ ID NO: 9307 - DNA, 19 bp, Homo sapiens
cttttcctccacagctgtg

SEQ ID NO: 9308 - DNA, 27 bp, Homo sapiens
tctcgacatttggtttgttttaatttt

SEQ ID NO: 9309 - DNA, 25 bp, Homo sapiens
ttccaaaataagctgttaatggtgt

SEQ ID NO: 9310 - DNA, 18 bp, Homo sapiens
agggcagcaggcctggtt

SEQ ID NO: 9311 - DNA, 21 bp, Homo sapiens
catccacatgccctcctcctt

SEQ ID NO: 9312 - DNA, 18 bp, Homo sapiens
gaggttgttaccattatg

SEQ ID NO: 9313 - DNA, 22 bp, Homo sapiens
acaggaagatgtcttttcttca

SEQ ID NO: 9314 - DNA, 19 bp, Homo sapiens
cttcctctgcctttgttca

SEQ ID NO: 9315 - DNA, 26 bp, Homo sapiens
cttgggcataggttccaagtattttt

SEQ ID NO: 9316 - DNA, 18 bp, Homo sapiens
tcagtcagcgagtgcttg

SEQ ID NO: 9317 - DNA, 18 bp, Homo sapiens
tgaactagttgccagtga

SEQ ID NO: 9318 - DNA, 16 bp, Homo sapiens
ttcttctgttatctca

SEQ ID NO: 9319 - DNA, 21 bp, Homo sapiens
aggcctcactcaagcctgaga

SEQ ID NO: 9320 - DNA, 21 bp, Homo sapiens
cagggctgctgtggcccagtc

SEQ ID NO: 9321 - DNA, 18 bp, Homo sapiens
cattcccaagccatggca

SEQ ID NO: 9322 - DNA, 16 bp, Homo sapiens
ccaagcctggccctta

SEQ ID NO: 9323 - DNA, 17 bp, Homo sapiens
cctccccacttcccccc

SEQ ID NO: 9324 - DNA, 20 bp, Homo sapiens
gacagccctgcctatcctct

SEQ ID NO: 9325 - DNA, 19 bp, Homo sapiens
ggaaagctgttccaacaca

SEQ ID NO: 9326 - DNA, 18 bp, Homo sapiens
ggaagcggcggcggtggc

SEQ ID NO: 9327 - DNA, 19 bp, Homo sapiens
acattttcaatagaggata

SEQ ID NO: 9328 - DNA, 17 bp, Homo sapiens
agaagaatcagcttgtg

SEQ ID NO: 9329 - DNA, 21 bp, Homo sapiens
cagggatatttctgctatgca

SEQ ID NO: 9330 - DNA, 21 bp, Homo sapiens
cctcactccaccttccttcca

SEQ ID NO: 9331 - DNA, 16 bp, Homo sapiens
ctatatcagcctatgc

SEQ ID NO: 9332 - DNA, 18 bp, Homo sapiens
ctcctttactatgttgaa

SEQ ID NO: 9333 - DNA, 23 bp, Homo sapiens
ctgagatacgcactcagctccat

SEQ ID NO: 9334 - DNA, 21 bp, Homo sapiens
tagttaatagaaatttccctt

SEQ ID NO: 9335 - DNA, 17 bp, Homo sapiens
tatattcccatccctct

SEQ ID NO: 9336 - DNA, 16 bp, Homo sapiens
cggggaggcttttcca

SEQ ID NO: 9337 - DNA, 22 bp, Homo sapiens
tccaagtccaccagtctctgaa

SEQ ID NO: 9338 - DNA, 22 bp, Homo sapiens
tttttctggtagctttagcttt

SEQ ID NO: 9339 - DNA, 17 bp, Homo sapiens
atgcatttatcacttcc

SEQ ID NO: 9340 - DNA, 23 bp, Homo sapiens
cctctatgaaatcaaatgtactg

SEQ ID NO: 9341 - DNA, 18 bp, Homo sapiens
gtaaataaaaataacctt

SEQ ID NO: 9342 - DNA, 23 bp, Homo sapiens
tacagcaattgtagtaactgaca

SEQ ID NO: 9343 - DNA, 19 bp, Homo sapiens
ttcacttgtgttggattta

SEQ ID NO: 9344 - DNA, 21 bp, Homo sapiens
aagagactttgtcacttattt

SEQ ID NO: 9345 - DNA, 21 bp, Homo sapiens
aattgagcactgtttactgtt

SEQ ID NO: 9346 - DNA, 18 bp, Homo sapiens
tctaacttggttatgaga

SEQ ID NO: 9347 - DNA, 18 bp, Homo sapiens
cttctccttagtccttca

SEQ ID NO: 9348 - DNA, 18 bp, Homo sapiens
gaagtagtctttggctta

SEQ ID NO: 9349 - DNA, 22 bp, Homo sapiens
tctaatgaactgttttaacctt

SEQ ID NO: 9350 - DNA, 18 bp, Homo sapiens
ttggccgttgtgagctct

SEQ ID NO: 9351 - DNA, 20 bp, Homo sapiens
aacacatgcagagtcacatc

SEQ ID NO: 9352 - DNA, 23 bp, Homo sapiens
tggcagtttgagaccgctaccct

SEQ ID NO: 9353 - DNA, 21 bp, Homo sapiens
cctagctgtgccccccacttt

SEQ ID NO: 9354 - DNA, 19 bp, Homo sapiens
aattctgtcagctatccaa

SEQ ID NO: 9355 - DNA, 17 bp, Homo sapiens
actgcttcaatctactt

SEQ ID NO: 9356 - DNA, 18 bp, Homo sapiens
ccacccactgctgcccca

SEQ ID NO: 9357 - DNA, 20 bp, Homo sapiens
ccagaccccgggctcgcctc

SEQ ID NO: 9358 - DNA, 19 bp, Homo sapiens
cccgaaatggggggcctgc

SEQ ID NO: 9359 - DNA, 17 bp, Homo sapiens
cttgccactcccacttt

SEQ ID NO: 9360 - DNA, 19 bp, Homo sapiens
gcttggtctggtctgtgca

SEQ ID NO: 9361 - DNA, 18 bp, Homo sapiens
gtgcagtgcattcagaca

SEQ ID NO: 9362 - DNA, 16 bp, Homo sapiens
tccctcggcacacttt

SEQ ID NO: 9363 - DNA, 21 bp, Homo sapiens
cactaataacattgctgtcaa

SEQ ID NO: 9364 - DNA, 19 bp, Homo sapiens
aaggaacccggtgtgcaca

SEQ ID NO: 9365 - DNA, 20 bp, Homo sapiens
acatctaactcaactgtgaa

SEQ ID NO: 9366 - DNA, 21 bp, Homo sapiens
accacaggcccttccccttcc

SEQ ID NO: 9367 - DNA, 23 bp, Homo sapiens
agaagttttaaacagggctttca

SEQ ID NO: 9368 - DNA, 20 bp, Homo sapiens
atgacacttccttgctttgg

SEQ ID NO: 9369 - DNA, 19 bp, Homo sapiens
caccttttgaagcagcaac

SEQ ID NO: 9370 - DNA, 21 bp, Homo sapiens
ccttggtggttgaacttggag

SEQ ID NO: 9371 - DNA, 18 bp, Homo sapiens
cctttttgcaccgtcacc

SEQ ID NO: 9372 - DNA, 20 bp, Homo sapiens
ctctagcctggggggcttgt

SEQ ID NO: 9373 - DNA, 18 bp, Homo sapiens
ggtcctcagccctgccac

SEQ ID NO: 9374 - DNA, 18 bp, Homo sapiens
tagattgtaacccctcca

SEQ ID NO: 9375 - DNA, 21 bp, Homo sapiens
gaattcaggtttacaagatga

SEQ ID NO: 9376 - DNA, 17 bp, Homo sapiens
taaacctggagtactcg

SEQ ID NO: 9377 - DNA, 23 bp, Homo sapiens
tatttcagaaaagaaattatcta

SEQ ID NO: 9378 - DNA, 18 bp, Homo sapiens
ctttttcaggacattgca

SEQ ID NO: 9379 - DNA, 20 bp, Homo sapiens
gatgttctagcatgtgatta

SEQ ID NO: 9380 - DNA, 17 bp, Homo sapiens
ttcataatgactttcca

SEQ ID NO: 9381 - DNA, 18 bp, Homo sapiens
ccagtttttctccatctc

SEQ ID NO: 9382 - DNA, 17 bp, Homo sapiens
gtttcgtctcccaccca

SEQ ID NO: 9383 - DNA, 16 bp, Homo sapiens
aaccaagatagatcca

SEQ ID NO: 9384 - DNA, 18 bp, Homo sapiens
gaattcacaccttaggtg

SEQ ID NO: 9385 - DNA, 20 bp, Homo sapiens
gccttgggagagattttgtc

SEQ ID NO: 9386 - DNA, 19 bp, Homo sapiens
aaatatctatctgctatta

SEQ ID NO: 9387 - DNA, 18 bp, Homo sapiens
acagatgaaaattacata

SEQ ID NO: 9388 - DNA, 19 bp, Homo sapiens
ctgcaagctctgcttccca

SEQ ID NO: 9389 - DNA, 21 bp, Homo sapiens
tctctttatctcccttgcctt

SEQ ID NO: 9390 - DNA, 18 bp, Homo sapiens
ttccagaatctggcccag

SEQ ID NO: 9391 - DNA, 21 bp, Homo sapiens
ccctgggctcgaacctgcgga

SEQ ID NO: 9392 - DNA, 23 bp, Homo sapiens
ggttggacttgccggcgtcaccg

SEQ ID NO: 9393 - DNA, 19 bp, Homo sapiens
gattcactggttctgtaac

SEQ ID NO: 9394 - DNA, 20 bp, Homo sapiens
gtgcctctcgggtggcgggt

SEQ ID NO: 9395 - DNA, 17 bp, Homo sapiens
gtggtctccttacatct

SEQ ID NO: 9396 - DNA, 20 bp, Homo sapiens
tgctttcaagatttgctttt

SEQ ID NO: 9397 - DNA, 19 bp, Homo sapiens
ctccccttccctctggctc

SEQ ID NO: 9398 - DNA, 20 bp, Homo sapiens
ataaatgtattagttcatct

SEQ ID NO: 9399 - DNA, 19 bp, Homo sapiens
tcttagctgaaatggccga

SEQ ID NO: 9400 - DNA, 28 bp, Homo sapiens
tgcctgtcataagaaaactcttagctga

SEQ ID NO: 9401 - DNA, 20 bp, Homo sapiens
atgaaaccttattttttcca

SEQ ID NO: 9402 - DNA, 22 bp, Homo sapiens
ccaactacaaccaagctctctg

SEQ ID NO: 9403 - DNA, 21 bp, Homo sapiens
ctacctccctgcaaccaacta

SEQ ID NO: 9404 - DNA, 23 bp, Homo sapiens
ggatgtgcttttctccaatatca

SEQ ID NO: 9405 - DNA, 20 bp, Homo sapiens
tctaaaagatcctttttaaa

SEQ ID NO: 9406 - DNA, 17 bp, Homo sapiens
tgaaggacacttcctgc

SEQ ID NO: 9407 - DNA, 19 bp, Homo sapiens
tgagcctggctggcacaga

SEQ ID NO: 9408 - DNA, 20 bp, Homo sapiens
gcctccctcagggtttcggg

SEQ ID NO: 9409 - DNA, 22 bp, Homo sapiens
gctctgaccaggagtttgggga

SEQ ID NO: 9410 - DNA, 18 bp, Homo sapiens
ccttattaatgatcagct

SEQ ID NO: 9411 - DNA, 18 bp, Homo sapiens
aattcttgaaggaaaatg

SEQ ID NO: 9412 - DNA, 22 bp, Homo sapiens
ccaccgggtgacatccgtccca

SEQ ID NO: 9413 - DNA, 24 bp, Homo sapiens
ccctggtgatggggttacgtgggg

SEQ ID NO: 9414 - DNA, 24 bp, Homo sapiens
gcgtcccgagacgccggcttcctc

SEQ ID NO: 9415 - DNA, 22 bp, Homo sapiens
atttcataaaaatccctcttcc

SEQ ID NO: 9416 - DNA, 21 bp, Homo sapiens
ccttttgggtttgccttaatt

SEQ ID NO: 9417 - DNA, 22 bp, Homo sapiens
tcttgttcatgttttgctaatg

SEQ ID NO: 9418 - DNA, 19 bp, Homo sapiens
ttcagtctgcagctattca

SEQ ID NO: 9419 - DNA, 20 bp, Homo sapiens
ttttaaaattgcagcagttg

SEQ ID NO: 9420 - DNA, 21 bp, Homo sapiens
agagcgtctccagccccatct

SEQ ID NO: 9421 - DNA, 18 bp, Homo sapiens
ccacgtgtgcacgcatga

SEQ ID NO: 9422 - DNA, 18 bp, Homo sapiens
ccccaccctccggcagct

SEQ ID NO: 9423 - DNA, 18 bp, Homo sapiens
cctcccctccccacagtg

SEQ ID NO: 9424 - DNA, 21 bp, Homo sapiens
gtggaggcagaggggatccgg

SEQ ID NO: 9425 - DNA, 17 bp, Homo sapiens
gtgtggccgcccgggtg

SEQ ID NO: 9426 - DNA, 18 bp, Homo sapiens
aggcccagcctggacaaa

SEQ ID NO: 9427 - DNA, 19 bp, Homo sapiens
caccatccaccttcccttc

SEQ ID NO: 9428 - DNA, 20 bp, Homo sapiens
caaggaaaaaaggtatatca

SEQ ID NO: 9429 - DNA, 18 bp, Homo sapiens
catcggctcgtaaactga

SEQ ID NO: 9430 - DNA, 19 bp, Homo sapiens
ggaaggacaagaatgtcat

SEQ ID NO: 9431 - DNA, 20 bp, Homo sapiens
tgaatggactaagatgaaat

SEQ ID NO: 9432 - DNA, 23 bp, Homo sapiens
tggagccataagatctgtatcta

SEQ ID NO: 9433 - DNA, 24 bp, Homo sapiens
agctagtctcttctcttctgtgat

SEQ ID NO: 9434 - DNA, 18 bp, Homo sapiens
gcagagggagttaagcca

SEQ ID NO: 9435 - DNA, 18 bp, Homo sapiens
taccagaggttggagaac

SEQ ID NO: 9436 - DNA, 22 bp, Homo sapiens
agcaaaataaacttggtttaca

SEQ ID NO: 9437 - DNA, 22 bp, Homo sapiens
cctcctcgcccgcccgcccgca

SEQ ID NO: 9438 - DNA, 24 bp, Homo sapiens
tttaaacccattttagtcactttt

SEQ ID NO: 9439 - DNA, 18 bp, Homo sapiens
atgggcattgctggactg

SEQ ID NO: 9440 - DNA, 21 bp, Homo sapiens
tgttgatctatgggaaatcta

SEQ ID NO: 9441 - DNA, 21 bp, Homo sapiens
tttcagtagctccttggtttt

SEQ ID NO: 9442 - DNA, 17 bp, Homo sapiens
aggtggccaatatgggg

SEQ ID NO: 9443 - DNA, 18 bp, Homo sapiens
atgtatatctgtggaata

SEQ ID NO: 9444 - DNA, 17 bp, Homo sapiens
cctttaaaaccctacct

SEQ ID NO: 9445 - DNA, 19 bp, Homo sapiens
gttaagaacacgtgtatta

SEQ ID NO: 9446 - DNA, 23 bp, Homo sapiens
ttttgtgcttccaaatcactttt

SEQ ID NO: 9447 - DNA, 17 bp, Homo sapiens
cccccccacccactttt

SEQ ID NO: 9448 - DNA, 24 bp, Homo sapiens
ggtgggtgggattgtggcgttgtg

SEQ ID NO: 9449 - DNA, 22 bp, Homo sapiens
tgggattgtggcgttgtggtct

SEQ ID NO: 9450 - DNA, 18 bp, Homo sapiens
ctctcctttctttatctc

SEQ ID NO: 9451 - DNA, 24 bp, Homo sapiens
ggatgccttaagactctcctttct

SEQ ID NO: 9452 - DNA, 18 bp, Homo sapiens
tgcaggagactcttgcag

SEQ ID NO: 9453 - DNA, 21 bp, Homo sapiens
atcttggctcactgcaacctc

SEQ ID NO: 9454 - DNA, 19 bp, Homo sapiens
cagttgggcaaaatcatct

SEQ ID NO: 9455 - DNA, 20 bp, Homo sapiens
cctctgcctcccgggttcaa

SEQ ID NO: 9456 - DNA, 18 bp, Homo sapiens
gcatcctagggtgctttt

SEQ ID NO: 9457 - DNA, 20 bp, Homo sapiens
gtcctgaacatgattgtgga

SEQ ID NO: 9458 - DNA, 16 bp, Homo sapiens
gtgcaattttatctca

SEQ ID NO: 9459 - DNA, 18 bp, Homo sapiens
tatgatggggttatgtca

SEQ ID NO: 9460 - DNA, 18 bp, Homo sapiens
tccgcctcctgggttcaa

SEQ ID NO: 9461 - DNA, 18 bp, Homo sapiens
tctcaggaattattttta

SEQ ID NO: 9462 - DNA, 18 bp, Homo sapiens
tcttgacctcatgatcca

SEQ ID NO: 9463 - DNA, 20 bp, Homo sapiens
tggccaggttggtcttgaac

SEQ ID NO: 9464 - DNA, 25 bp, Homo sapiens
ccttggtattgtaaagatctgggga

SEQ ID NO: 9465 - DNA, 19 bp, Homo sapiens
ctcaagaagaagcttttga

SEQ ID NO: 9466 - DNA, 19 bp, Homo sapiens
cccacgcttgccctacagc

SEQ ID NO: 9467 - DNA, 24 bp, Homo sapiens
cccttccaaaaacgattttttcca

SEQ ID NO: 9468 - DNA, 18 bp, Homo sapiens
tgccctacagcccttcca

SEQ ID NO: 9469 - DNA, 23 bp, Homo sapiens
tgttggctccacctccagcctcc

SEQ ID NO: 9470 - DNA, 25 bp, Homo sapiens
acagatgggattgtgacatatcgct

SEQ ID NO: 9471 - DNA, 20 bp, Homo sapiens
ccagaagggccacactccag

SEQ ID NO: 9472 - DNA, 25 bp, Homo sapiens
cctccccagaagggccacactccag

SEQ ID NO: 9473 - DNA, 17 bp, Homo sapiens
ctgttttccttgatggg

SEQ ID NO: 9474 - DNA, 17 bp, Homo sapiens
gaccctgtgtgaaatta

SEQ ID NO: 9475 - DNA, 21 bp, Homo sapiens
gtgccacgacaggtgggcttt

SEQ ID NO: 9476 - DNA, 23 bp, Homo sapiens
tgagtgcgccgagcatggggctg

SEQ ID NO: 9477 - DNA, 20 bp, Homo sapiens
cccagaaggaaatctctgac

SEQ ID NO: 9478 - DNA, 19 bp, Homo sapiens
aggaaatgcaattatgata

SEQ ID NO: 9479 - DNA, 18 bp, Homo sapiens
gtgtagaagacctagctg

SEQ ID NO: 9480 - DNA, 19 bp, Homo sapiens
taattcatagagtagagtg

SEQ ID NO: 9481 - DNA, 16 bp, Homo sapiens
acctccagatgccaaa

SEQ ID NO: 9482 - DNA, 19 bp, Homo sapiens
tgaatgagatgttttagga

SEQ ID NO: 9483 - DNA, 26 bp, Homo sapiens
tgaggatcaaatttcagcatgaaatt

SEQ ID NO: 9484 - DNA, 21 bp, Homo sapiens
ttgatggtataacataactca

SEQ ID NO: 9485 - DNA, 18 bp, Homo sapiens
ccctgatgatggccctgt

SEQ ID NO: 9486 - DNA, 16 bp, Homo sapiens
tgcaacctccaccccc

SEQ ID NO: 9487 - DNA, 20 bp, Homo sapiens
ccatggactgaaacttcaca

SEQ ID NO: 9488 - DNA, 17 bp, Homo sapiens
acacaagccttttcaca

SEQ ID NO: 9489 - DNA, 18 bp, Homo sapiens
ggtcagttgactctgata

SEQ ID NO: 9490 - DNA, 17 bp, Homo sapiens
tgcaattaatctttata

SEQ ID NO: 9491 - DNA, 24 bp, Homo sapiens
tttagttatccctgcattattttt

SEQ ID NO: 9492 - DNA, 23 bp, Homo sapiens
cacctgtggtcccagctgcctca

SEQ ID NO: 9493 - DNA, 19 bp, Homo sapiens
gagtggataatggaaactg

SEQ ID NO: 9494 - DNA, 21 bp, Homo sapiens
tctgtctttccctgtgtgtga

SEQ ID NO: 9495 - DNA, 22 bp, Homo sapiens
tgtaaaactcacacttgccaaa

SEQ ID NO: 9496 - DNA, 18 bp, Homo sapiens
accagagagaaaccctac

SEQ ID NO: 9497 - DNA, 19 bp, Homo sapiens
tggagagaaacttcacatg

SEQ ID NO: 9498 - DNA, 17 bp, Homo sapiens
tttggatgatccacaaa

SEQ ID NO: 9499 - DNA, 19 bp, Homo sapiens
ccaggttccttcttgcaca

SEQ ID NO: 9500 - DNA, 19 bp, Homo sapiens
ctgctggtttcccgaggga

SEQ ID NO: 9501 - DNA, 17 bp, Homo sapiens
ggccccctgaaatctca

SEQ ID NO: 9502 - DNA, 26 bp, Homo sapiens
tctgtccaggtgcccctcatcatcac

SEQ ID NO: 9503 - DNA, 18 bp, Homo sapiens
agacctggagtctatgct

SEQ ID NO: 9504 - DNA, 19 bp, Homo sapiens
tggtgctgcctcaacctga

SEQ ID NO: 9505 - DNA, 17 bp, Homo sapiens
ttccccccacatgggga

SEQ ID NO: 9506 - DNA, 20 bp, Homo sapiens
aacaattacagaatcatgat

SEQ ID NO: 9507 - DNA, 22 bp, Homo sapiens
atatcctaaagactgctcaaca

SEQ ID NO: 9508 - DNA, 18 bp, Homo sapiens
ggataactgcatagatcc

SEQ ID NO: 9509 - DNA, 21 bp, Homo sapiens
gtgttgaacctgggaccctga

SEQ ID NO: 9510 - DNA, 26 bp, Homo sapiens
taagtggagcacagggtatggggtta

SEQ ID NO: 9511 - DNA, 20 bp, Homo sapiens
tcttacccattccttttcca

SEQ ID NO: 9512 - DNA, 16 bp, Homo sapiens
tgggtgaaatgtctgc

SEQ ID NO: 9513 - DNA, 21 bp, Homo sapiens
gcaggtgccccctctgcctcc

SEQ ID NO: 9514 - DNA, 19 bp, Homo sapiens
tgtctgcagacggcggagg

SEQ ID NO: 9515 - DNA, 18 bp, Homo sapiens
ttaagaaatctgacccac

SEQ ID NO: 9516 - DNA, 18 bp, Homo sapiens
cctctgggtgacatcgga

SEQ ID NO: 9517 - DNA, 22 bp, Homo sapiens
ctttctctcttctcttggctca

SEQ ID NO: 9518 - DNA, 20 bp, Homo sapiens
gtggcttcaagctaagtttc

SEQ ID NO: 9519 - DNA, 20 bp, Homo sapiens
tcaggtatgggctgaatgca

SEQ ID NO: 9520 - DNA, 19 bp, Homo sapiens
tctggcaaacccttggccc

SEQ ID NO: 9521 - DNA, 18 bp, Homo sapiens
tgcttgaccctcttgctt

SEQ ID NO: 9522 - DNA, 19 bp, Homo sapiens
tggatgggacaggaagctg

SEQ ID NO: 9523 - DNA, 21 bp, Homo sapiens
cccatggttcatgtggagcca

SEQ ID NO: 9524 - DNA, 19 bp, Homo sapiens
cgcgcgccacagtcgctgc

SEQ ID NO: 9525 - DNA, 25 bp, Homo sapiens
ctctggtggccccgccgccctgcgg

SEQ ID NO: 9526 - DNA, 21 bp, Homo sapiens
gccctgcggggatcccggggg

SEQ ID NO: 9527 - DNA, 24 bp, Homo sapiens
gccgccctgcggggatcccggggg

SEQ ID NO: 9528 - DNA, 18 bp, Homo sapiens
gtctatctctccatccct

SEQ ID NO: 9529 - DNA, 20 bp, Homo sapiens
tccgctgcagctccaccaat

SEQ ID NO: 9530 - DNA, 17 bp, Homo sapiens
agaaactgattactgct

SEQ ID NO: 9531 - DNA, 16 bp, Homo sapiens
atttgctttttatcca

SEQ ID NO: 9532 - DNA, 20 bp, Homo sapiens
catgtagaatatgctcttta

SEQ ID NO: 9533 - DNA, 24 bp, Homo sapiens
cctcttcataccagtttaacactt

SEQ ID NO: 9534 - DNA, 23 bp, Homo sapiens
tcaccaatgagtacccgacccgt

SEQ ID NO: 9535 - DNA, 22 bp, Homo sapiens
caataaaaataaatctaaatca

SEQ ID NO: 9536 - DNA, 20 bp, Homo sapiens
cacatttgttgcaccaatta

SEQ ID NO: 9537 - DNA, 22 bp, Homo sapiens
ccactcctgaatgagacttaat

SEQ ID NO: 9538 - DNA, 18 bp, Homo sapiens
tttcttttgtgcagatca

SEQ ID NO: 9539 - DNA, 22 bp, Homo sapiens
acttttacattttggcatgaca

SEQ ID NO: 9540 - DNA, 23 bp, Homo sapiens
agtcaaacttacaaaaactgttg

SEQ ID NO: 9541 - DNA, 18 bp, Homo sapiens
tcctcttggtggcagata

SEQ ID NO: 9542 - DNA, 20 bp, Homo sapiens
tcttggtggcagatacctgc

SEQ ID NO: 9543 - DNA, 19 bp, Homo sapiens
cacttgcaacctacctgtt

SEQ ID NO: 9544 - DNA, 24 bp, Homo sapiens
gcggcggcgcgggccgtgcgcgag

SEQ ID NO: 9545 - DNA, 19 bp, Homo sapiens
taaaacatcattactataa

SEQ ID NO: 9546 - DNA, 25 bp, Homo sapiens
tacataattcactctgagtgtttta

SEQ ID NO: 9547 - DNA, 19 bp, Homo sapiens
ccaagaaacatatgttata

SEQ ID NO: 9548 - DNA, 18 bp, Homo sapiens
ttgcttgtcccaatacaa

SEQ ID NO: 9549 - DNA, 19 bp, Homo sapiens
attcaagtggattctaaat

SEQ ID NO: 9550 - DNA, 23 bp, Homo sapiens
caaaacagcatacctgctaagct

SEQ ID NO: 9551 - DNA, 22 bp, Homo sapiens
cagattcttggctgggtttagt

SEQ ID NO: 9552 - DNA, 23 bp, Homo sapiens
cttaagcccacctgggcactttt

SEQ ID NO: 9553 - DNA, 23 bp, Homo sapiens
ggagacgcagcggcggccgcagc

SEQ ID NO: 9554 - DNA, 16 bp, Homo sapiens
gtgcctaaatgtagta

SEQ ID NO: 9555 - DNA, 21 bp, Homo sapiens
tcactttccccatcacactca

SEQ ID NO: 9556 - DNA, 20 bp, Homo sapiens
tgaattttcaggaaccgtca

SEQ ID NO: 9557 - DNA, 20 bp, Homo sapiens
ttctctcctctcccatccca

SEQ ID NO: 9558 - DNA, 21 bp, Homo sapiens
aatggaacagtaagaacatca

SEQ ID NO: 9559 - DNA, 18 bp, Homo sapiens
aatggaagcaattgctca

SEQ ID NO: 9560 - DNA, 20 bp, Homo sapiens
accctccaagtctgtacctc

SEQ ID NO: 9561 - DNA, 22 bp, Homo sapiens
acctactaatagtttgttgatc

SEQ ID NO: 9562 - DNA, 18 bp, Homo sapiens
acctccacctccaccgcc

SEQ ID NO: 9563 - DNA, 17 bp, Homo sapiens
agtcccagtatacctca

SEQ ID NO: 9564 - DNA, 20 bp, Homo sapiens
ccaccgccacctccacctcc

SEQ ID NO: 9565 - DNA, 20 bp, Homo sapiens
ccacctccaccgccacctcc

SEQ ID NO: 9566 - DNA, 19 bp, Homo sapiens
ctctccctctccctctctc

SEQ ID NO: 9567 - DNA, 19 bp, Homo sapiens
ctctctctctctccctctc

SEQ ID NO: 9568 - DNA, 26 bp, Homo sapiens
gtagtttctcatgacggcttttgtca

SEQ ID NO: 9569 - DNA, 22 bp, Homo sapiens
gtgcccgaccctatcccggcgg

SEQ ID NO: 9570 - DNA, 20 bp, Homo sapiens
tatgtatttttctatgtttt

SEQ ID NO: 9571 - DNA, 20 bp, Homo sapiens
tcaccatctcttcattcaaa

SEQ ID NO: 9572 - DNA, 19 bp, Homo sapiens
tcctctcctcctcctcctc

SEQ ID NO: 9573 - DNA, 18 bp, Homo sapiens
ttcaagggacacaattca

SEQ ID NO: 9574 - DNA, 22 bp, Homo sapiens
tttcaggaaatctacttcctac

SEQ ID NO: 9575 - DNA, 19 bp, Homo sapiens
ccagccagaggtggagcca

SEQ ID NO: 9576 - DNA, 20 bp, Homo sapiens
cgaagccggacacggcttca

SEQ ID NO: 9577 - DNA, 21 bp, Homo sapiens
ctgtgtgccccactccagcct

SEQ ID NO: 9578 - DNA, 19 bp, Homo sapiens
tcgaacccactccggttcc

SEQ ID NO: 9579 - DNA, 22 bp, Homo sapiens
ttgctacgacagacttgcactg

SEQ ID NO: 9580 - DNA, 22 bp, Homo sapiens
tagcacgtgggggagctgcgga

SEQ ID NO: 9581 - DNA, 22 bp, Homo sapiens
ttgatgatatttaaccagtttt

SEQ ID NO: 9582 - DNA, 23 bp, Homo sapiens
ttgtaaccattttctatttgtgc

SEQ ID NO: 9583 - DNA, 22 bp, Homo sapiens
gaatcaacagatcaatgacata

SEQ ID NO: 9584 - DNA, 23 bp, Homo sapiens
tcccattttccttcaccgtgaca

SEQ ID NO: 9585 - DNA, 21 bp, Homo sapiens
cgagccggcctcgcccagcca

SEQ ID NO: 9586 - DNA, 23 bp, Homo sapiens
gcgcctcggccctcccgaccttt

SEQ ID NO: 9587 - DNA, 20 bp, Homo sapiens
aagccaggattctccggtct

SEQ ID NO: 9588 - DNA, 19 bp, Homo sapiens
cttcgctagctttagtctt

SEQ ID NO: 9589 - DNA, 21 bp, Homo sapiens
gcagcttcgtgcttttgtaca

SEQ ID NO: 9590 - DNA, 18 bp, Homo sapiens
ggctcctgtgctttttat

SEQ ID NO: 9591 - DNA, 19 bp, Homo sapiens
aaaagaatactttgtaata

SEQ ID NO: 9592 - DNA, 19 bp, Homo sapiens
agggaagctgcaggaccaa

SEQ ID NO: 9593 - DNA, 19 bp, Homo sapiens
cgcagaacaggagccgggg

SEQ ID NO: 9594 - DNA, 19 bp, Homo sapiens
ctatgtctgtcatacgcta

SEQ ID NO: 9595 - DNA, 18 bp, Homo sapiens
tctacggggccgcggcca

SEQ ID NO: 9596 - DNA, 19 bp, Homo sapiens
tgaccacccattgattgta

SEQ ID NO: 9597 - DNA, 23 bp, Homo sapiens
cccctccccacctttcccacccc

SEQ ID NO: 9598 - DNA, 24 bp, Homo sapiens
ctaataccctgaaaagaagtgatg

SEQ ID NO: 9599 - DNA, 23 bp, Homo sapiens
taatgttcacttgagtggaactg

SEQ ID NO: 9600 - DNA, 16 bp, Homo sapiens
tctctcctcccctgcc

SEQ ID NO: 9601 - DNA, 21 bp, Homo sapiens
aagacctggaacaagattctg

SEQ ID NO: 9602 - DNA, 16 bp, Homo sapiens
agacccccattcttca

SEQ ID NO: 9603 - DNA, 18 bp, Homo sapiens
tccactccagagttgggt

SEQ ID NO: 9604 - DNA, 17 bp, Homo sapiens
tcctgttctatcccttc

SEQ ID NO: 9605 - DNA, 19 bp, Homo sapiens
taggtctgccttcacttta

SEQ ID NO: 9606 - DNA, 21 bp, Homo sapiens
atgagactgcagcctgtgaca

SEQ ID NO: 9607 - DNA, 17 bp, Homo sapiens
cagcgacgcctgcccag

SEQ ID NO: 9608 - DNA, 22 bp, Homo sapiens
cctccaaacctggccaagccca

SEQ ID NO: 9609 - DNA, 22 bp, Homo sapiens
cctccaaacctggccaagccca

SEQ ID NO: 9610 - DNA, 23 bp, Homo sapiens
cctttttggtaccttgtaacctt

SEQ ID NO: 9611 - DNA, 18 bp, Homo sapiens
ctgaaatttcattgctcc

SEQ ID NO: 9612 - DNA, 20 bp, Homo sapiens
ctgtgtgtgcacctgctcac

SEQ ID NO: 9613 - DNA, 20 bp, Homo sapiens
gcccctggagttcagaagtc

SEQ ID NO: 9614 - DNA, 19 bp, Homo sapiens
gggcggggcggccgctgcc

SEQ ID NO: 9615 - DNA, 20 bp, Homo sapiens
ggtcaacaccagagatctca

SEQ ID NO: 9616 - DNA, 25 bp, Homo sapiens
tgggagggctttagcaatgagactg

SEQ ID NO: 9617 - DNA, 21 bp, Homo sapiens
acagagatcaggacgcctttg

SEQ ID NO: 9618 - DNA, 18 bp, Homo sapiens
agcgccttttcctccctt

SEQ ID NO: 9619 - DNA, 24 bp, Homo sapiens
ggcgtgagtcaccgcgcccggcca

SEQ ID NO: 9620 - DNA, 20 bp, Homo sapiens
catcctctcccccatgctta

SEQ ID NO: 9621 - DNA, 23 bp, Homo sapiens
ttctgtctctccttcttccccct

SEQ ID NO: 9622 - DNA, 18 bp, Homo sapiens
ccacaccggagcagtgct

SEQ ID NO: 9623 - DNA, 18 bp, Homo sapiens
gagtcagacaactgctgg

SEQ ID NO: 9624 - DNA, 19 bp, Homo sapiens
ttcaagttaaaactcccca

SEQ ID NO: 9625 - DNA, 19 bp, Homo sapiens
tttttctggttcacaacag

SEQ ID NO: 9626 - DNA, 21 bp, Homo sapiens
tgagtcctttatgaaattcat

SEQ ID NO: 9627 - DNA, 22 bp, Homo sapiens
acttgagtctattgccttgcct

SEQ ID NO: 9628 - DNA, 21 bp, Homo sapiens
tgataactccctctggagctt

SEQ ID NO: 9629 - DNA, 22 bp, Homo sapiens
gcctgcttttgacctttggctc

SEQ ID NO: 9630 - DNA, 19 bp, Homo sapiens
agattaggataagtaagct

SEQ ID NO: 9631 - DNA, 19 bp, Homo sapiens
ctgaaatgcattttcctct

SEQ ID NO: 9632 - DNA, 19 bp, Homo sapiens
cttttcagcacttaatttt

SEQ ID NO: 9633 - DNA, 19 bp, Homo sapiens
gcgcgaggggcggccggga

SEQ ID NO: 9634 - DNA, 24 bp, Homo sapiens
tctccagcggccatgttaaccagg

SEQ ID NO: 9635 - DNA, 24 bp, Homo sapiens
tctgcttttctcctctctgttcct

SEQ ID NO: 9636 - DNA, 24 bp, Homo sapiens
ccaaggcctgtggcccccacactg

SEQ ID NO: 9637 - DNA, 19 bp, Homo sapiens
gggagttcccatctagtca

SEQ ID NO: 9638 - DNA, 18 bp, Homo sapiens
gggcggggcggcgctgcc

SEQ ID NO: 9639 - DNA, 18 bp, Homo sapiens
actgttgattgtttgctt

SEQ ID NO: 9640 - DNA, 17 bp, Homo sapiens
ctgatggtctgtgagat

SEQ ID NO: 9641 - DNA, 19 bp, Homo sapiens
tgagctcagctgacaagca

SEQ ID NO: 9642 - DNA, 18 bp, Homo sapiens
tcaagacttcaacctgca

SEQ ID NO: 9643 - DNA, 23 bp, Homo sapiens
aacttttggtaggaaggaaaaca

SEQ ID NO: 9644 - DNA, 18 bp, Homo sapiens
cacttttaccatacttga

SEQ ID NO: 9645 - DNA, 19 bp, Homo sapiens
ccaagcatacaatttgagc

SEQ ID NO: 9646 - DNA, 20 bp, Homo sapiens
tgcaatctaaagatgcaata

SEQ ID NO: 9647 - DNA, 20 bp, Homo sapiens
ctgtgagcaggggaacgcga

SEQ ID NO: 9648 - DNA, 18 bp, Homo sapiens
cagctttccccagggtga

SEQ ID NO: 9649 - DNA, 18 bp, Homo sapiens
ccagcgtttgcctggtct

SEQ ID NO: 9650 - DNA, 22 bp, Homo sapiens
cccctcgtcattttctttccca

SEQ ID NO: 9651 - DNA, 21 bp, Homo sapiens
tttattcccccatcttcatcc

SEQ ID NO: 9652 - DNA, 19 bp, Homo sapiens
aatacagtgagaccctgtc

SEQ ID NO: 9653 - DNA, 25 bp, Homo sapiens
aaaataggaacacgtgctctacctc

SEQ ID NO: 9654 - DNA, 19 bp, Homo sapiens
aagctccacatcaataaac

SEQ ID NO: 9655 - DNA, 22 bp, Homo sapiens
acctcagtgacccgtctggccc

SEQ ID NO: 9656 - DNA, 17 bp, Homo sapiens
gcccgcggaagagcaga

SEQ ID NO: 9657 - DNA, 17 bp, Homo sapiens
aaacggagggtgttgca

SEQ ID NO: 9658 - DNA, 18 bp, Homo sapiens
taaacaatctctacatgt

SEQ ID NO: 9659 - DNA, 18 bp, Homo sapiens
tgggcatgttagaataca

SEQ ID NO: 9660 - DNA, 19 bp, Homo sapiens
accacttgagcctatatca

SEQ ID NO: 9661 - DNA, 17 bp, Homo sapiens
catctggtgccaaatga

SEQ ID NO: 9662 - DNA, 23 bp, Homo sapiens
gtttggattgcagcattctgctc

SEQ ID NO: 9663 - DNA, 18 bp, Homo sapiens
tctgatgatgcgctgtga

SEQ ID NO: 9664 - DNA, 23 bp, Homo sapiens
gcacggatggtgaggggctgaga

SEQ ID NO: 9665 - DNA, 22 bp, Homo sapiens
gccgcaggcggctgctgggccc

SEQ ID NO: 9666 - DNA, 22 bp, Homo sapiens
aaataatcaaagatagcattca

SEQ ID NO: 9667 - DNA, 22 bp, Homo sapiens
aaatgtaatcatcccaaagatc

SEQ ID NO: 9668 - DNA, 17 bp, Homo sapiens
aactgaaaactacctgg

SEQ ID NO: 9669 - DNA, 21 bp, Homo sapiens
ctaataaaggatcatgaggaa

SEQ ID NO: 9670 - DNA, 22 bp, Homo sapiens
ctttcttttgactacttgactg

SEQ ID NO: 9671 - DNA, 18 bp, Homo sapiens
tcaggttcaagttcttga

SEQ ID NO: 9672 - DNA, 20 bp, Homo sapiens
tgaatggggttgtgaaactg

SEQ ID NO: 9673 - DNA, 19 bp, Homo sapiens
tgctgtttatgtgtgacta

SEQ ID NO: 9674 - DNA, 25 bp, Homo sapiens
tgttaaaatgatggattcaacttct

SEQ ID NO: 9675 - DNA, 24 bp, Homo sapiens
ttctaaagtgtgtgtatgtttgtg

SEQ ID NO: 9676 - DNA, 21 bp, Homo sapiens
tttctttagatgccttgattt

SEQ ID NO: 9677 - DNA, 23 bp, Homo sapiens
agactgtgggtcaaatgtttcca

SEQ ID NO: 9678 - DNA, 19 bp, Homo sapiens
gtaatagatttccagctaa

SEQ ID NO: 9679 - DNA, 24 bp, Homo sapiens
gtcctatgatgctattatcataga

SEQ ID NO: 9680 - DNA, 19 bp, Homo sapiens
ttcccttggaccaccttca

SEQ ID NO: 9681 - DNA, 23 bp, Homo sapiens
ccttttcatatttcttttgactt

SEQ ID NO: 9682 - DNA, 25 bp, Homo sapiens
cttagttttggtttaagtcattttt

SEQ ID NO: 9683 - DNA, 24 bp, Homo sapiens
tttaagtcatttttgattgctttt

SEQ ID NO: 9684 - DNA, 24 bp, Homo sapiens
tttctgtgaaacttcatattgctg

SEQ ID NO: 9685 - DNA, 19 bp, Homo sapiens
agtgttcactgtagccacc

SEQ ID NO: 9686 - DNA, 24 bp, Homo sapiens
tccgcggtatggaggatttgagga

SEQ ID NO: 9687 - DNA, 19 bp, Homo sapiens
accacacaccccactgggc

SEQ ID NO: 9688 - DNA, 17 bp, Homo sapiens
ccgcccacccgccccca

SEQ ID NO: 9689 - DNA, 19 bp, Homo sapiens
gcatggccaagagccagct

SEQ ID NO: 9690 - DNA, 19 bp, Homo sapiens
aatctgttggagacatagg

SEQ ID NO: 9691 - DNA, 26 bp, Homo sapiens
agtttttgtgggcatatatatataca

SEQ ID NO: 9692 - DNA, 21 bp, Homo sapiens
aacagattccaagagaattga

SEQ ID NO: 9693 - DNA, 23 bp, Homo sapiens
tttttttataccagttttggaga

SEQ ID NO: 9694 - DNA, 19 bp, Homo sapiens
gaggatattcccccatccc

SEQ ID NO: 9695 - DNA, 20 bp, Homo sapiens
acattttgaggttttgtaaa

SEQ ID NO: 9696 - DNA, 20 bp, Homo sapiens
agctgctgctggagattcaa

SEQ ID NO: 9697 - DNA, 22 bp, Homo sapiens
agttgtgaatacattctttgct

SEQ ID NO: 9698 - DNA, 19 bp, Homo sapiens
ccgtggagatcgcttttct

SEQ ID NO: 9699 - DNA, 19 bp, Homo sapiens
ctttgaagcaaatacaatt

SEQ ID NO: 9700 - DNA, 22 bp, Homo sapiens
tgggatttcatggggtttggtt

SEQ ID NO: 9701 - DNA, 23 bp, Homo sapiens
cctggtcctgctgtcttggtttt

SEQ ID NO: 9702 - DNA, 18 bp, Homo sapiens
gcctacacctccacctcc

SEQ ID NO: 9703 - DNA, 18 bp, Homo sapiens
ggattacagctctgccca

SEQ ID NO: 9704 - DNA, 22 bp, Homo sapiens
accaatgatgagcctcatgcca

SEQ ID NO: 9705 - DNA, 21 bp, Homo sapiens
ccaagtcgctgccagacacca

SEQ ID NO: 9706 - DNA, 18 bp, Homo sapiens
cctcagtgcaggcacctc

SEQ ID NO: 9707 - DNA, 21 bp, Homo sapiens
ctgggggtcttcctccacctc

SEQ ID NO: 9708 - DNA, 23 bp, Homo sapiens
gcccctctgtctggccacccctc

SEQ ID NO: 9709 - DNA, 18 bp, Homo sapiens
tgagcctcatgccagtga

SEQ ID NO: 9710 - DNA, 17 bp, Homo sapiens
tgtaggaaaagacctca

SEQ ID NO: 9711 - DNA, 23 bp, Homo sapiens
gatgccacctggagccccaccca

SEQ ID NO: 9712 - DNA, 23 bp, Homo sapiens
tttcccatctttttgttaccata

SEQ ID NO: 9713 - DNA, 17 bp, Homo sapiens
actggtgggcactggac

SEQ ID NO: 9714 - DNA, 20 bp, Homo sapiens
agttttctgtcactggtggg

SEQ ID NO: 9715 - DNA, 18 bp, Homo sapiens
gcagcttcggggggtcct

SEQ ID NO: 9716 - DNA, 20 bp, Homo sapiens
gccgccccgggcaggtcccg

SEQ ID NO: 9717 - DNA, 21 bp, Homo sapiens
gggagagagctggtgattcca

SEQ ID NO: 9718 - DNA, 22 bp, Homo sapiens
tggagaggtcaggatggaacta

SEQ ID NO: 9719 - DNA, 20 bp, Homo sapiens
cccgctcccctgtcatttca

SEQ ID NO: 9720 - DNA, 19 bp, Homo sapiens
ccctggtcttcggccgggt

SEQ ID NO: 9721 - DNA, 23 bp, Homo sapiens
cgctcctgccccaccccacctcc

SEQ ID NO: 9722 - DNA, 21 bp, Homo sapiens
ctgccttgcttggcacccgct

SEQ ID NO: 9723 - DNA, 22 bp, Homo sapiens
gagcgccttccttgcccacctc

SEQ ID NO: 9724 - DNA, 23 bp, Homo sapiens
tccttttttcagcaaaatacttc

SEQ ID NO: 9725 - DNA, 18 bp, Homo sapiens
acaaaccattgcccggca

SEQ ID NO: 9726 - DNA, 17 bp, Homo sapiens
gcactggcccgtgctgc

SEQ ID NO: 9727 - DNA, 19 bp, Homo sapiens
cgccgcctgcgccgcgaga

SEQ ID NO: 9728 - DNA, 21 bp, Homo sapiens
gccacaaccttaaccaacacc

SEQ ID NO: 9729 - DNA, 21 bp, Homo sapiens
agcagtccctctttgacctca

SEQ ID NO: 9730 - DNA, 19 bp, Homo sapiens
catgtatatattcttctga

SEQ ID NO: 9731 - DNA, 18 bp, Homo sapiens
acattggagcctgcaata

SEQ ID NO: 9732 - DNA, 18 bp, Homo sapiens
ccggtaagtaaacagtca

SEQ ID NO: 9733 - DNA, 19 bp, Homo sapiens
ggccgggtgtagtggctca

SEQ ID NO: 9734 - DNA, 21 bp, Homo sapiens
tcctgatgatggtcattgggg

SEQ ID NO: 9735 - DNA, 18 bp, Homo sapiens
tgtcgccaagttggagtg

SEQ ID NO: 9736 - DNA, 17 bp, Homo sapiens
aaacaaaagccacaaac

SEQ ID NO: 9737 - DNA, 17 bp, Homo sapiens
aacaccacttaacagta

SEQ ID NO: 9738 - DNA, 21 bp, Homo sapiens
acttgttgaaaaactgatttg

SEQ ID NO: 9739 - DNA, 18 bp, Homo sapiens
agctggaaacttggacta

SEQ ID NO: 9740 - DNA, 21 bp, Homo sapiens
gagctttaataaaaaatctta

SEQ ID NO: 9741 - DNA, 21 bp, Homo sapiens
tctgctttgcctctggtggta

SEQ ID NO: 9742 - DNA, 21 bp, Homo sapiens
tgacttcctggcaccacaggg

SEQ ID NO: 9743 - DNA, 18 bp, Homo sapiens
tggaagaactgccctgct

SEQ ID NO: 9744 - DNA, 20 bp, Homo sapiens
tctcaaaacagtattagctt

SEQ ID NO: 9745 - DNA, 22 bp, Homo sapiens
ttctactggaagtttgcacttt

SEQ ID NO: 9746 - DNA, 22 bp, Homo sapiens
ttctactggaagtttgcacttt

SEQ ID NO: 9747 - DNA, 16 bp, Homo sapiens
aagacaaacctggtca

SEQ ID NO: 9748 - DNA, 23 bp, Homo sapiens
agaagtcttggagtgcattttca

SEQ ID NO: 9749 - DNA, 24 bp, Homo sapiens
atcctgctcttttggaaacgtatt

SEQ ID NO: 9750 - DNA, 25 bp, Homo sapiens
cttccgaatggaagaggtctgtgag

SEQ ID NO: 9751 - DNA, 19 bp, Homo sapiens
cttcctatttacataatgt

SEQ ID NO: 9752 - DNA, 21 bp, Homo sapiens
aaccaagccttggcaccgcca

SEQ ID NO: 9753 - DNA, 18 bp, Homo sapiens
ctgtaggctaattcctct

SEQ ID NO: 9754 - DNA, 20 bp, Homo sapiens
gaatagcccccttcgataca

SEQ ID NO: 9755 - DNA, 19 bp, Homo sapiens
gtctgtggctttgatcaga

SEQ ID NO: 9756 - DNA, 17 bp, Homo sapiens
gttccctgggcttctgg

SEQ ID NO: 9757 - DNA, 19 bp, Homo sapiens
atcacatttaaacactgtt

SEQ ID NO: 9758 - DNA, 19 bp, Homo sapiens
caaaattgcaaaagcctta

SEQ ID NO: 9759 - DNA, 24 bp, Homo sapiens
cagaagaattgaggatctgatgga

SEQ ID NO: 9760 - DNA, 19 bp, Homo sapiens
gcagccctactggaacaca

SEQ ID NO: 9761 - DNA, 24 bp, Homo sapiens
ggaacacagagtgcttctcccgca

SEQ ID NO: 9762 - DNA, 21 bp, Homo sapiens
gtccttccctgtaacattgga

SEQ ID NO: 9763 - DNA, 20 bp, Homo sapiens
catgtgcctacatagacaca

SEQ ID NO: 9764 - DNA, 23 bp, Homo sapiens
gaaaaaactgaaaaagatgctgc

SEQ ID NO: 9765 - DNA, 23 bp, Homo sapiens
gagaagtaggggaaagggaatca

SEQ ID NO: 9766 - DNA, 17 bp, Homo sapiens
gttttagttctgtgaac

SEQ ID NO: 9767 - DNA, 19 bp, Homo sapiens
ttcctgctgtttgctacca

SEQ ID NO: 9768 - DNA, 19 bp, Homo sapiens
tgtgcaaccactgcttctt

SEQ ID NO: 9769 - DNA, 18 bp, Homo sapiens
aagctatttcgccaggca

SEQ ID NO: 9770 - DNA, 18 bp, Homo sapiens
tgggtggatcacctgagg

SEQ ID NO: 9771 - DNA, 24 bp, Homo sapiens
aaattccagaaatctgcatataat

SEQ ID NO: 9772 - DNA, 18 bp, Homo sapiens
acaacctttaaaatgttc

SEQ ID NO: 9773 - DNA, 20 bp, Homo sapiens
accataaaggtcttcacata

SEQ ID NO: 9774 - DNA, 17 bp, Homo sapiens
caaaatctgtgcaggga

SEQ ID NO: 9775 - DNA, 23 bp, Homo sapiens
gaacacggctcactgccgcctca

SEQ ID NO: 9776 - DNA, 18 bp, Homo sapiens
tgatccttgaacaactca

SEQ ID NO: 9777 - DNA, 23 bp, Homo sapiens
tttattatcccaagttcctgctg

SEQ ID NO: 9778 - DNA, 18 bp, Homo sapiens
aaggacgaacttggatta

SEQ ID NO: 9779 - DNA, 23 bp, Homo sapiens
cattttattttcccaccttcaaa

SEQ ID NO: 9780 - DNA, 20 bp, Homo sapiens
gttgtgagccaccgctgcca

SEQ ID NO: 9781 - DNA, 18 bp, Homo sapiens
tctgtattaattcactga

SEQ ID NO: 9782 - DNA, 23 bp, Homo sapiens
ttgagctgatttaagttgttttt

SEQ ID NO: 9783 - DNA, 18 bp, Homo sapiens
ttgtttgttagcaggtgt

SEQ ID NO: 9784 - DNA, 22 bp, Homo sapiens
agaaatgactgtaaatatttca

SEQ ID NO: 9785 - DNA, 20 bp, Homo sapiens
agtttcactctgtgaggagt

SEQ ID NO: 9786 - DNA, 17 bp, Homo sapiens
ctattttgtgtccttga

SEQ ID NO: 9787 - DNA, 19 bp, Homo sapiens
ctcccagaagaccaaactg

SEQ ID NO: 9788 - DNA, 20 bp, Homo sapiens
gtccctctgagtgtgtcttg

SEQ ID NO: 9789 - DNA, 16 bp, Homo sapiens
agacatttctcctttc

SEQ ID NO: 9790 - DNA, 24 bp, Homo sapiens
tttccctcagccaggtcaccctca

SEQ ID NO: 9791 - DNA, 18 bp, Homo sapiens
aggctttttcatctacga

SEQ ID NO: 9792 - DNA, 17 bp, Homo sapiens
cgaccgctccccggcgg

SEQ ID NO: 9793 - DNA, 19 bp, Homo sapiens
ctgggctccacctgctcac

SEQ ID NO: 9794 - DNA, 19 bp, Homo sapiens
ggagaactgaagattgcca

SEQ ID NO: 9795 - DNA, 17 bp, Homo sapiens
tggaagacaccaacttc

SEQ ID NO: 9796 - DNA, 19 bp, Homo sapiens
ggccccgcccgtcccccct

SEQ ID NO: 9797 - DNA, 22 bp, Homo sapiens
ctgagatatgtacacagtcatt

SEQ ID NO: 9798 - DNA, 22 bp, Homo sapiens
ggggccgccgcgggccgtctgc

SEQ ID NO: 9799 - DNA, 15 bp, Homo sapiens
atgttgataattctg

SEQ ID NO: 9800 - DNA, 20 bp, Homo sapiens
cacataaaaagttcccctct

SEQ ID NO: 9801 - DNA, 26 bp, Homo sapiens
ggatgttggccaccaggtgcctttca

SEQ ID NO: 9802 - DNA, 18 bp, Homo sapiens
aagaaatatgggcatttt

SEQ ID NO: 9803 - DNA, 19 bp, Homo sapiens
tgtctacatggttaatgga

SEQ ID NO: 9804 - DNA, 21 bp, Homo sapiens
ctcgtgtgcgtgtagtctgtg

SEQ ID NO: 9805 - DNA, 18 bp, Homo sapiens
catctttgtacagagaca

SEQ ID NO: 9806 - DNA, 25 bp, Homo sapiens
agtctacaccctcccacggggtgga

SEQ ID NO: 9807 - DNA, 23 bp, Homo sapiens
atcctagacaagcctgaccgtgc

SEQ ID NO: 9808 - DNA, 23 bp, Homo sapiens
atcctgcaatccttctgccccaa

SEQ ID NO: 9809 - DNA, 19 bp, Homo sapiens
gatccctgtacacgtggtg

SEQ ID NO: 9810 - DNA, 19 bp, Homo sapiens
tgacaaacaaacagcccca

SEQ ID NO: 9811 - DNA, 20 bp, Homo sapiens
gagagagagaaaagagcctc

SEQ ID NO: 9812 - DNA, 21 bp, Homo sapiens
tcagccctccatctaatgtga

SEQ ID NO: 9813 - DNA, 21 bp, Homo sapiens
aaaaggtattatacatgtgat

SEQ ID NO: 9814 - DNA, 20 bp, Homo sapiens
aaaggtattatacatgtgat

SEQ ID NO: 9815 - DNA, 21 bp, Homo sapiens
ctccccttcctcttgtctgat

SEQ ID NO: 9816 - DNA, 22 bp, Homo sapiens
gcatagaaaccactagaaagtg

SEQ ID NO: 9817 - DNA, 20 bp, Homo sapiens
gcttaaaccacttaaacgaa

SEQ ID NO: 9818 - DNA, 17 bp, Homo sapiens
aaacgctttttattgct

SEQ ID NO: 9819 - DNA, 22 bp, Homo sapiens
gtctctctgtccccctcccctc

SEQ ID NO: 9820 - DNA, 19 bp, Homo sapiens
gtctgtggccgtccaggtg

SEQ ID NO: 9821 - DNA, 24 bp, Homo sapiens
tccagatgagaccaatgcacttca

SEQ ID NO: 9822 - DNA, 18 bp, Homo sapiens
gctgcgggctgggcccca

SEQ ID NO: 9823 - DNA, 20 bp, Homo sapiens
ccagcccctggtactccccc

SEQ ID NO: 9824 - DNA, 20 bp, Homo sapiens
cctttgttgctgtctggctt

SEQ ID NO: 9825 - DNA, 22 bp, Homo sapiens
tctggctttcccgaatcttttt

SEQ ID NO: 9826 - DNA, 19 bp, Homo sapiens
ctgaagcctcagtccttca

SEQ ID NO: 9827 - DNA, 19 bp, Homo sapiens
ctgaagcctcagtccttca

SEQ ID NO: 9828 - DNA, 19 bp, Homo sapiens
ccctcctgcccgcctgaga

SEQ ID NO: 9829 - DNA, 22 bp, Homo sapiens
tcctgactcacagggcctggaa

SEQ ID NO: 9830 - DNA, 16 bp, Homo sapiens
tctgctttagatgtgt

SEQ ID NO: 9831 - DNA, 20 bp, Homo sapiens
aacaacaatcatgcttatga

SEQ ID NO: 9832 - DNA, 17 bp, Homo sapiens
aaggctggaagctgcag

SEQ ID NO: 9833 - DNA, 19 bp, Homo sapiens
tcaatcgaaatatgctcta

SEQ ID NO: 9834 - DNA, 22 bp, Homo sapiens
aagtaactttgtcccagtccta

SEQ ID NO: 9835 - DNA, 20 bp, Homo sapiens
acatttagatatatttgtgt

SEQ ID NO: 9836 - DNA, 19 bp, Homo sapiens
cttttttttaattactgta

SEQ ID NO: 9837 - DNA, 21 bp, Homo sapiens
gaagcagaatgaaaccacatt

SEQ ID NO: 9838 - DNA, 18 bp, Homo sapiens
tacacatacatacacaca

SEQ ID NO: 9839 - DNA, 20 bp, Homo sapiens
tctgtggagtacattgaaga

SEQ ID NO: 9840 - DNA, 19 bp, Homo sapiens
ttctgtcactcaagacaca

SEQ ID NO: 9841 - DNA, 16 bp, Homo sapiens
cccttatccctctgga

SEQ ID NO: 9842 - DNA, 23 bp, Homo sapiens
gcgcggagctcgggcggccgtgg

SEQ ID NO: 9843 - DNA, 19 bp, Homo sapiens
taaccccatggactccttt

SEQ ID NO: 9844 - DNA, 20 bp, Homo sapiens
tcgggtaatattaaacagta

SEQ ID NO: 9845 - DNA, 17 bp, Homo sapiens
actctggagagactgtg

SEQ ID NO: 9846 - DNA, 22 bp, Homo sapiens
agaagttaactacagtgttttc

SEQ ID NO: 9847 - DNA, 24 bp, Homo sapiens
cctgagtaccagcaggtccctttt

SEQ ID NO: 9848 - DNA, 19 bp, Homo sapiens
ctgcattttcctacattga

SEQ ID NO: 9849 - DNA, 19 bp, Homo sapiens
cttttttgtggtgtctagc

SEQ ID NO: 9850 - DNA, 17 bp, Homo sapiens
gaggcggcggcggcggc

SEQ ID NO: 9851 - DNA, 23 bp, Homo sapiens
tcctggccccctgggcttgtgaa

SEQ ID NO: 9852 - DNA, 19 bp, Homo sapiens
tggcagaatcaaattgcta

SEQ ID NO: 9853 - DNA, 21 bp, Homo sapiens
tggccccctgggcttgtgaac

SEQ ID NO: 9854 - DNA, 19 bp, Homo sapiens
atacatataaaaagggatt

SEQ ID NO: 9855 - DNA, 22 bp, Homo sapiens
cctggggaactttaggttattt

SEQ ID NO: 9856 - DNA, 19 bp, Homo sapiens
ggtttattatttattcatc

SEQ ID NO: 9857 - DNA, 21 bp, Homo sapiens
atatgtctatcaaatacctct

SEQ ID NO: 9858 - DNA, 16 bp, Homo sapiens
ccacgcaacacttcct

SEQ ID NO: 9859 - DNA, 20 bp, Homo sapiens
ctgattctttgtttgcaata

SEQ ID NO: 9860 - DNA, 18 bp, Homo sapiens
tctgtagtaaaatgtgaa

SEQ ID NO: 9861 - DNA, 20 bp, Homo sapiens
tgcccaggtatgccttccag

SEQ ID NO: 9862 - DNA, 20 bp, Homo sapiens
tgttacagctcattgttgag

SEQ ID NO: 9863 - DNA, 19 bp, Homo sapiens
agcttgaacctagatctca

SEQ ID NO: 9864 - DNA, 19 bp, Homo sapiens
ccccgggaccccctggagc

SEQ ID NO: 9865 - DNA, 23 bp, Homo sapiens
gcttggatcagtaagtctggttc

SEQ ID NO: 9866 - DNA, 19 bp, Homo sapiens
aaagaaattaataggacca

SEQ ID NO: 9867 - DNA, 17 bp, Homo sapiens
aagaaattaataggacc

SEQ ID NO: 9868 - DNA, 20 bp, Homo sapiens
aaaagcaatcgcaggaggca

SEQ ID NO: 9869 - DNA, 19 bp, Homo sapiens
acactttggatactgtgaa

SEQ ID NO: 9870 - DNA, 20 bp, Homo sapiens
atgacgtggtaaaatgtgaa

SEQ ID NO: 9871 - DNA, 17 bp, Homo sapiens
cacaattctaggatgaa

SEQ ID NO: 9872 - DNA, 21 bp, Homo sapiens
ctctcatataccactactgga

SEQ ID NO: 9873 - DNA, 18 bp, Homo sapiens
gatttcatattatagact

SEQ ID NO: 9874 - DNA, 24 bp, Homo sapiens
tagatggtaaaaaatgtgaaattg

SEQ ID NO: 9875 - DNA, 21 bp, Homo sapiens
cgtaaaaaatacgaacggatc

SEQ ID NO: 9876 - DNA, 23 bp, Homo sapiens
taaaatgcatttctgatatgcaa

SEQ ID NO: 9877 - DNA, 19 bp, Homo sapiens
agcattttgaattactttt

SEQ ID NO: 9878 - DNA, 18 bp, Homo sapiens
attccccgccctctgaca

SEQ ID NO: 9879 - DNA, 24 bp, Homo sapiens
caagattgtgattagacacattta

SEQ ID NO: 9880 - DNA, 20 bp, Homo sapiens
caccaccctacacccccctc

SEQ ID NO: 9881 - DNA, 20 bp, Homo sapiens
cagagggtctctagggtctg

SEQ ID NO: 9882 - DNA, 15 bp, Homo sapiens
ccagtgcaaaggcta

SEQ ID NO: 9883 - DNA, 20 bp, Homo sapiens
ccatgtagacatgttgcaca

SEQ ID NO: 9884 - DNA, 21 bp, Homo sapiens
cccccgtcagattcccttcca

SEQ ID NO: 9885 - DNA, 18 bp, Homo sapiens
cccctccccccggcccca

SEQ ID NO: 9886 - DNA, 18 bp, Homo sapiens
ctcattttgattgttata

SEQ ID NO: 9887 - DNA, 21 bp, Homo sapiens
ctgtggtaactcattttgatt

SEQ ID NO: 9888 - DNA, 19 bp, Homo sapiens
ggaagtcttcctgtcacat

SEQ ID NO: 9889 - DNA, 19 bp, Homo sapiens
ggatcccagggcactgtca

SEQ ID NO: 9890 - DNA, 18 bp, Homo sapiens
gtggcttgtgttcaggga

SEQ ID NO: 9891 - DNA, 17 bp, Homo sapiens
tccagggtgactctcca

SEQ ID NO: 9892 - DNA, 22 bp, Homo sapiens
ttcacctgtggtaactcatttt

SEQ ID NO: 9893 - DNA, 18 bp, Homo sapiens
ttgagtgcactggcagga

SEQ ID NO: 9894 - DNA, 21 bp, Homo sapiens
tttttgttgcatgtatttgta

SEQ ID NO: 9895 - DNA, 20 bp, Homo sapiens
atggtctgaattgtatatgt

SEQ ID NO: 9896 - DNA, 22 bp, Homo sapiens
gttatcacatgtgaaagctttt

SEQ ID NO: 9897 - DNA, 20 bp, Homo sapiens
tctgctttacctcagtggta

SEQ ID NO: 9898 - DNA, 19 bp, Homo sapiens
ccacctccttgctacccca

SEQ ID NO: 9899 - DNA, 19 bp, Homo sapiens
aataaaattctattacagt

SEQ ID NO: 9900 - DNA, 20 bp, Homo sapiens
taccaaaacaaacaaacaga

SEQ ID NO: 9901 - DNA, 18 bp, Homo sapiens
tgtgttggcacatgcctg

SEQ ID NO: 9902 - DNA, 21 bp, Homo sapiens
gtgtgccaccacacttggcta

SEQ ID NO: 9903 - DNA, 21 bp, Homo sapiens
tcatccccagcctccacctcc

SEQ ID NO: 9904 - DNA, 19 bp, Homo sapiens
aaacagaaactgagtgtga

SEQ ID NO: 9905 - DNA, 25 bp, Homo sapiens
acaaaacaccacaaaacagacttca

SEQ ID NO: 9906 - DNA, 17 bp, Homo sapiens
acatgttattgcagtga

SEQ ID NO: 9907 - DNA, 21 bp, Homo sapiens
tggttttcttaaatacctaca

SEQ ID NO: 9908 - DNA, 20 bp, Homo sapiens
cgggcggggcggggccggcc

SEQ ID NO: 9909 - DNA, 19 bp, Homo sapiens
gacggcactgggtggggcc

SEQ ID NO: 9910 - DNA, 21 bp, Homo sapiens
tctggaagacagtgttgccca

SEQ ID NO: 9911 - DNA, 21 bp, Homo sapiens
tgccatccatgtttgtgctgt

SEQ ID NO: 9912 - DNA, 19 bp, Homo sapiens
aactcacagatggatacca

SEQ ID NO: 9913 - DNA, 20 bp, Homo sapiens
acccagtggtagctccacca

SEQ ID NO: 9914 - DNA, 19 bp, Homo sapiens
agatggataccaacacggt

SEQ ID NO: 9915 - DNA, 20 bp, Homo sapiens
cagccccagaggattccata

SEQ ID NO: 9916 - DNA, 21 bp, Homo sapiens
gcatcagctgtacctacaata

SEQ ID NO: 9917 - DNA, 18 bp, Homo sapiens
cactatgacactgagcaa

SEQ ID NO: 9918 - DNA, 20 bp, Homo sapiens
cagcaggaagccaggctgag

SEQ ID NO: 9919 - DNA, 20 bp, Homo sapiens
gatcctgaaaagtgttatga

SEQ ID NO: 9920 - DNA, 21 bp, Homo sapiens
gtgtgtcaccacgctcggcta

SEQ ID NO: 9921 - DNA, 18 bp, Homo sapiens
tcctgaaaagtgttatga

SEQ ID NO: 9922 - DNA, 22 bp, Homo sapiens
aatttggtttcagaatggctga

SEQ ID NO: 9923 - DNA, 23 bp, Homo sapiens
ggcacgatggctcaaacctgtaa

SEQ ID NO: 9924 - DNA, 24 bp, Homo sapiens
tgaagttatgggtgacttgaaata

SEQ ID NO: 9925 - DNA, 17 bp, Homo sapiens
gcagctcaacgtcctgc

SEQ ID NO: 9926 - DNA, 16 bp, Homo sapiens
ttccagaatttgtcca

SEQ ID NO: 9927 - DNA, 21 bp, Homo sapiens
agaaagaaaaaaatgggcatt

SEQ ID NO: 9928 - DNA, 18 bp, Homo sapiens
accgcgaccccggccgcc

SEQ ID NO: 9929 - DNA, 19 bp, Homo sapiens
gacctctgaaattgatgat

SEQ ID NO: 9930 - DNA, 21 bp, Homo sapiens
tttgtcagtgtgtttttttaa

SEQ ID NO: 9931 - DNA, 17 bp, Homo sapiens
agtgtgtgttcattgta

SEQ ID NO: 9932 - DNA, 21 bp, Homo sapiens
gcagaactaagctcagtatgt

SEQ ID NO: 9933 - DNA, 19 bp, Homo sapiens
aagcgattctcccacctca

SEQ ID NO: 9934 - DNA, 25 bp, Homo sapiens
atccatgaccaaattaaatatgaaa

SEQ ID NO: 9935 - DNA, 21 bp, Homo sapiens
atcttggctcagtgcaacctc

SEQ ID NO: 9936 - DNA, 18 bp, Homo sapiens
ccacaattgtcacatgac

SEQ ID NO: 9937 - DNA, 17 bp, Homo sapiens
gttgtcccctgcacttc

SEQ ID NO: 9938 - DNA, 17 bp, Homo sapiens
tcaagcgattctcgtgc

SEQ ID NO: 9939 - DNA, 23 bp, Homo sapiens
tcagaccttccctggtttacctt

SEQ ID NO: 9940 - DNA, 18 bp, Homo sapiens
tccgcctcctgggttcaa

SEQ ID NO: 9941 - DNA, 20 bp, Homo sapiens
tgtctgtggagttttaggag

SEQ ID NO: 9942 - DNA, 18 bp, Homo sapiens
ttgtaagatccatctaca

SEQ ID NO: 9943 - DNA, 16 bp, Homo sapiens
gccttcttttttctca

SEQ ID NO: 9944 - DNA, 20 bp, Homo sapiens
taatcagcagaattactttt

SEQ ID NO: 9945 - DNA, 22 bp, Homo sapiens
aaaccactctccacagcttttt

SEQ ID NO: 9946 - DNA, 21 bp, Homo sapiens
acttaactgagatccagcaaa

SEQ ID NO: 9947 - DNA, 22 bp, Homo sapiens
ccccacctaagtcgagacagta

SEQ ID NO: 9948 - DNA, 19 bp, Homo sapiens
aaaacatatgtgattctca

SEQ ID NO: 9949 - DNA, 15 bp, Homo sapiens
cagaatagctcttta

SEQ ID NO: 9950 - DNA, 21 bp, Homo sapiens
taagagttttaatgccagtgc

SEQ ID NO: 9951 - DNA, 23 bp, Homo sapiens
tgcatttcaagttaaatgtctta

SEQ ID NO: 9952 - DNA, 19 bp, Homo sapiens
tgtagtagatattactgaa

SEQ ID NO: 9953 - DNA, 20 bp, Homo sapiens
ttgaaatatattttgcatta

SEQ ID NO: 9954 - DNA, 18 bp, Homo sapiens
cctggccccacgcagctc

SEQ ID NO: 9955 - DNA, 21 bp, Homo sapiens
cgagcttccccgcaccggcca

SEQ ID NO: 9956 - DNA, 18 bp, Homo sapiens
agcgcaccccgctgactc

SEQ ID NO: 9957 - DNA, 19 bp, Homo sapiens
aaggaaccaagctgacaca

SEQ ID NO: 9958 - DNA, 19 bp, Homo sapiens
caccatttcggacaccccg

SEQ ID NO: 9959 - DNA, 24 bp, Homo sapiens
cccgttaataaaaaccaatgtagg

SEQ ID NO: 9960 - DNA, 22 bp, Homo sapiens
gcggctgcgagggactttgtca

SEQ ID NO: 9961 - DNA, 22 bp, Homo sapiens
caagactctttgggtccattca

SEQ ID NO: 9962 - DNA, 18 bp, Homo sapiens
ccagctgcagaccatgcc

SEQ ID NO: 9963 - DNA, 23 bp, Homo sapiens
gcccccagttaatactccagaga

SEQ ID NO: 9964 - DNA, 24 bp, Homo sapiens
ggagaccctggcggcggcggcggc

SEQ ID NO: 9965 - DNA, 20 bp, Homo sapiens
actactgatggtttatgaca

SEQ ID NO: 9966 - DNA, 22 bp, Homo sapiens
gattgcaaaacagttcttttaa

SEQ ID NO: 9967 - DNA, 18 bp, Homo sapiens
tagttttttgtttttgtt

SEQ ID NO: 9968 - DNA, 22 bp, Homo sapiens
tcatttgactggaaaaaaataa

SEQ ID NO: 9969 - DNA, 19 bp, Homo sapiens
tgaccacctggtgccagct

SEQ ID NO: 9970 - DNA, 17 bp, Homo sapiens
tttgcacagtgcactta

SEQ ID NO: 9971 - DNA, 18 bp, Homo sapiens
agcactgcctttacttca

SEQ ID NO: 9972 - DNA, 19 bp, Homo sapiens
cagcacaaggaatttccct

SEQ ID NO: 9973 - DNA, 19 bp, Homo sapiens
taaaaacaaaacaaacaaa

SEQ ID NO: 9974 - DNA, 22 bp, Homo sapiens
tgagatcaaagtggtggggtca

SEQ ID NO: 9975 - DNA, 20 bp, Homo sapiens
tttccaatatcctcatgaca

SEQ ID NO: 9976 - DNA, 22 bp, Homo sapiens
agcacttaagtgttagatctaa

SEQ ID NO: 9977 - DNA, 20 bp, Homo sapiens
tcagaacaaaacttctatta

SEQ ID NO: 9978 - DNA, 22 bp, Homo sapiens
tgagtacacctatgtgaaactg

SEQ ID NO: 9979 - DNA, 20 bp, Homo sapiens
ttgatgtatttctccatcct

SEQ ID NO: 9980 - DNA, 15 bp, Homo sapiens
tcctccagcatctca

SEQ ID NO: 9981 - DNA, 19 bp, Homo sapiens
cctggtggatgcctggttc

SEQ ID NO: 9982 - DNA, 17 bp, Homo sapiens
ctgccctggttgtgtgg

SEQ ID NO: 9983 - DNA, 23 bp, Homo sapiens
cttgagttttacaagttattttt

SEQ ID NO: 9984 - DNA, 19 bp, Homo sapiens
gctcagcgcttgtgctctg

SEQ ID NO: 9985 - DNA, 21 bp, Homo sapiens
tcctccaccattggccgtagc

SEQ ID NO: 9986 - DNA, 26 bp, Homo sapiens
tgaagaccagttctgaggtgaagctg

SEQ ID NO: 9987 - DNA, 19 bp, Homo sapiens
agcaaaacaagtgacatga

SEQ ID NO: 9988 - DNA, 20 bp, Homo sapiens
ccagcacatagcttgcctaa

SEQ ID NO: 9989 - DNA, 20 bp, Homo sapiens
cctcagctccccggcactgc

SEQ ID NO: 9990 - DNA, 21 bp, Homo sapiens
gcctgggccttggctgggcct

SEQ ID NO: 9991 - DNA, 23 bp, Homo sapiens
agaaaaaagaagacttttccaac

SEQ ID NO: 9992 - DNA, 18 bp, Homo sapiens
agaaaaatttgaagtctg

SEQ ID NO: 9993 - DNA, 16 bp, Homo sapiens
gcattaagatagggtg

SEQ ID NO: 9994 - DNA, 25 bp, Homo sapiens
gcttgctgtggtggttgcctagccc

SEQ ID NO: 9995 - DNA, 22 bp, Homo sapiens
ggtgcccaggatagatgtaata

SEQ ID NO: 9996 - DNA, 20 bp, Homo sapiens
gtcctgaattctacattatt

SEQ ID NO: 9997 - DNA, 19 bp, Homo sapiens
tctctgcaatgcctcaagg

SEQ ID NO: 9998 - DNA, 23 bp, Homo sapiens
tgacttttaccttttacagcgta

SEQ ID NO: 9999 - DNA, 19 bp, Homo sapiens
aacgttcaacgtacaaaca

SEQ ID NO: 10000 - DNA, 24 bp, Homo sapiens
aatggtgcagaaagagataccttt

SEQ ID NO: 10001 - DNA, 22 bp, Homo sapiens
acttttctaagtacttatacat

SEQ ID NO: 10002 - DNA, 22 bp, Homo sapiens
cgcgctgcctccggtgccgctg

SEQ ID NO: 10003 - DNA, 16 bp, Homo sapiens
ctttctttccatggca

SEQ ID NO: 10004 - DNA, 19 bp, Homo sapiens
ttgatgacttcttgtggca

SEQ ID NO: 10005 - DNA, 18 bp, Homo sapiens
aggacccagaagctcctc

SEQ ID NO: 10006 - DNA, 19 bp, Homo sapiens
cgggagttttgtaccactt

SEQ ID NO: 10007 - DNA, 20 bp, Homo sapiens
cacctcagcctctcaagtaa

SEQ ID NO: 10008 - DNA, 23 bp, Homo sapiens
cttctcaggttgcttcttacaca

SEQ ID NO: 10009 - DNA, 19 bp, Homo sapiens
tatcttggcctaaacctca

SEQ ID NO: 10010 - DNA, 20 bp, Homo sapiens
tggccaggctggtcttgaac

SEQ ID NO: 10011 - DNA, 20 bp, Homo sapiens
ctcaggagaagcccccacta

SEQ ID NO: 10012 - DNA, 18 bp, Homo sapiens
ggagcttggcatgggcta

SEQ ID NO: 10013 - DNA, 16 bp, Homo sapiens
acgtaactggctgcag

SEQ ID NO: 10014 - DNA, 18 bp, Homo sapiens
agtgactttctcgcaccc

SEQ ID NO: 10015 - DNA, 17 bp, Homo sapiens
ccaagtttattatgagg

SEQ ID NO: 10016 - DNA, 22 bp, Homo sapiens
tctttgttgttgtttttatttt

SEQ ID NO: 10017 - DNA, 18 bp, Homo sapiens
ttgggttcgggtcactgc

SEQ ID NO: 10018 - DNA, 22 bp, Homo sapiens
ccctgatggggcctgaccgcgg

SEQ ID NO: 10019 - DNA, 19 bp, Homo sapiens
cctcctcggcccgtcccca

SEQ ID NO: 10020 - DNA, 21 bp, Homo sapiens
gagggcaggttccaagccaca

SEQ ID NO: 10021 - DNA, 22 bp, Homo sapiens
gcctgggcccagcgagccccca

SEQ ID NO: 10022 - DNA, 19 bp, Homo sapiens
ggacagggtgaggctccca

SEQ ID NO: 10023 - DNA, 18 bp, Homo sapiens
catcacccgcctcacagg

SEQ ID NO: 10024 - DNA, 16 bp, Homo sapiens
ggcccgccctgcagtg

SEQ ID NO: 10025 - DNA, 22 bp, Homo sapiens
gtggacgagaacacgttctcca

SEQ ID NO: 10026 - DNA, 18 bp, Homo sapiens
tgccgatccggcctgcga

SEQ ID NO: 10027 - DNA, 25 bp, Homo sapiens
aaaatattcctctgatgtgaaatta

SEQ ID NO: 10028 - DNA, 18 bp, Homo sapiens
caaatatcctggtgcgat

SEQ ID NO: 10029 - DNA, 22 bp, Homo sapiens
gagccaagatcgcgccactgca

SEQ ID NO: 10030 - DNA, 20 bp, Homo sapiens
gtaacatatagtctactata

SEQ ID NO: 10031 - DNA, 26 bp, Homo sapiens
atccccagctagactagtgttggaga

SEQ ID NO: 10032 - DNA, 18 bp, Homo sapiens
aaataaggtagtactttt

SEQ ID NO: 10033 - DNA, 19 bp, Homo sapiens
ggtaattgtagggtaatac

SEQ ID NO: 10034 - DNA, 20 bp, Homo sapiens
tcttaaatagtgtaactata

SEQ ID NO: 10035 - DNA, 22 bp, Homo sapiens
tctttttaaatgctttatcttt

SEQ ID NO: 10036 - DNA, 21 bp, Homo sapiens
tcagtcctgccagcagccgca

SEQ ID NO: 10037 - DNA, 18 bp, Homo sapiens
ccagtctcacaggagtca

SEQ ID NO: 10038 - DNA, 24 bp, Homo sapiens
ggcttgtttcctgaacgttggccg

SEQ ID NO: 10039 - DNA, 23 bp, Homo sapiens
ttggccggcggaggacccgcgag

SEQ ID NO: 10040 - DNA, 16 bp, Homo sapiens
cacacccctctcccct

SEQ ID NO: 10041 - DNA, 17 bp, Homo sapiens
caggagaaactgcagcc

SEQ ID NO: 10042 - DNA, 19 bp, Homo sapiens
gaaaggcactccaacctca

SEQ ID NO: 10043 - DNA, 20 bp, Homo sapiens
gcccccatttctccatttct

SEQ ID NO: 10044 - DNA, 25 bp, Homo sapiens
tttgtgtgtctgcatctccatctta

SEQ ID NO: 10045 - DNA, 19 bp, Homo sapiens
cttgggcaggacctgtgag

SEQ ID NO: 10046 - DNA, 20 bp, Homo sapiens
gggcttcaggggctcctgtc

SEQ ID NO: 10047 - DNA, 20 bp, Homo sapiens
gggcttcaggggctcctgtc

SEQ ID NO: 10048 - DNA, 18 bp, Homo sapiens
tcagtcgtgtgtactgta

SEQ ID NO: 10049 - DNA, 20 bp, Homo sapiens
tcccagaacccacagtgggc

SEQ ID NO: 10050 - DNA, 21 bp, Homo sapiens
tcctgggccagggcctgatgg

SEQ ID NO: 10051 - DNA, 20 bp, Homo sapiens
acgagctctcgcccactcgc

SEQ ID NO: 10052 - DNA, 19 bp, Homo sapiens
caccactgtgacccccttc

SEQ ID NO: 10053 - DNA, 18 bp, Homo sapiens
ccatggtcactgcctcag

SEQ ID NO: 10054 - DNA, 22 bp, Homo sapiens
cccctccagggggactgctcca

SEQ ID NO: 10055 - DNA, 19 bp, Homo sapiens
ctgggggaccctctgaagc

SEQ ID NO: 10056 - DNA, 24 bp, Homo sapiens
gcatttctgcctcactttatgtca

SEQ ID NO: 10057 - DNA, 18 bp, Homo sapiens
tccagggggactgctcca

SEQ ID NO: 10058 - DNA, 20 bp, Homo sapiens
agtcactatcttgggtaaca

SEQ ID NO: 10059 - DNA, 17 bp, Homo sapiens
cagcaaatattaactta

SEQ ID NO: 10060 - DNA, 23 bp, Homo sapiens
tgagtggggttgggcataggctg

SEQ ID NO: 10061 - DNA, 17 bp, Homo sapiens
tgttctaagactgccta

SEQ ID NO: 10062 - DNA, 15 bp, Homo sapiens
catttcccctggtga

SEQ ID NO: 10063 - DNA, 17 bp, Homo sapiens
cttgagtagacaaaggc

SEQ ID NO: 10064 - DNA, 19 bp, Homo sapiens
tggagcaaggggagggtga

SEQ ID NO: 10065 - DNA, 20 bp, Homo sapiens
aaagttttaaaagtcctcca

SEQ ID NO: 10066 - DNA, 18 bp, Homo sapiens
aagaccaccctaccagcc

SEQ ID NO: 10067 - DNA, 18 bp, Homo sapiens
caggctcctgctgcccta

SEQ ID NO: 10068 - DNA, 19 bp, Homo sapiens
ctggcaacaaccacttcct

SEQ ID NO: 10069 - DNA, 21 bp, Homo sapiens
aaccatatgcatttcacctca

SEQ ID NO: 10070 - DNA, 22 bp, Homo sapiens
agaaatcacaacagcgctggaa

SEQ ID NO: 10071 - DNA, 18 bp, Homo sapiens
cctgggccgtatctgtct

SEQ ID NO: 10072 - DNA, 19 bp, Homo sapiens
aaggatctataccctcctg

SEQ ID NO: 10073 - DNA, 20 bp, Homo sapiens
agagagggtggataagctcc

SEQ ID NO: 10074 - DNA, 19 bp, Homo sapiens
cgagtgctcacctgcccca

SEQ ID NO: 10075 - DNA, 24 bp, Homo sapiens
gcaaaagctgtggctgccaggcct

SEQ ID NO: 10076 - DNA, 24 bp, Homo sapiens
gcttggggacccctccctgcccct

SEQ ID NO: 10077 - DNA, 23 bp, Homo sapiens
ttctgccctttcccacacctttg

SEQ ID NO: 10078 - DNA, 19 bp, Homo sapiens
aaacacagaagaaacgtga

SEQ ID NO: 10079 - DNA, 18 bp, Homo sapiens
acccaccgcaacctcatc

SEQ ID NO: 10080 - DNA, 22 bp, Homo sapiens
agggggatcccatctctacaca

SEQ ID NO: 10081 - DNA, 21 bp, Homo sapiens
gagaagaaagccatgtggcgg

SEQ ID NO: 10082 - DNA, 24 bp, Homo sapiens
gcaacctcatcccctcagcactaa

SEQ ID NO: 10083 - DNA, 17 bp, Homo sapiens
ggatcaaactctgcttc

SEQ ID NO: 10084 - DNA, 21 bp, Homo sapiens
gtgtgtgtgcacgcatggctg

SEQ ID NO: 10085 - DNA, 19 bp, Homo sapiens
tatgattgtaccactgcac

SEQ ID NO: 10086 - DNA, 22 bp, Homo sapiens
tttctgtcaatgtcaccaggga

SEQ ID NO: 10087 - DNA, 19 bp, Homo sapiens
cttaacggtcctctggtct

SEQ ID NO: 10088 - DNA, 22 bp, Homo sapiens
gggacgcggcggcggcggcggc

SEQ ID NO: 10089 - DNA, 19 bp, Homo sapiens
cagcatcacactgacactc

SEQ ID NO: 10090 - DNA, 21 bp, Homo sapiens
cagggatctttttctgcccct

SEQ ID NO: 10091 - DNA, 17 bp, Homo sapiens
ccccggcccccagcaca

SEQ ID NO: 10092 - DNA, 18 bp, Homo sapiens
cttcaggcccagcactgc

SEQ ID NO: 10093 - DNA, 16 bp, Homo sapiens
atgctgcagttaacac

SEQ ID NO: 10094 - DNA, 21 bp, Homo sapiens
ccagatgcccacctcatccaa

SEQ ID NO: 10095 - DNA, 18 bp, Homo sapiens
cctgcaacctccacctcc

SEQ ID NO: 10096 - DNA, 23 bp, Homo sapiens
ggtacttcgtagactctgcctca

SEQ ID NO: 10097 - DNA, 20 bp, Homo sapiens
tcgccaagcagtatctcctg

SEQ ID NO: 10098 - DNA, 20 bp, Homo sapiens
tgctgttagtaactgtgtga

SEQ ID NO: 10099 - DNA, 23 bp, Homo sapiens
tggagtacagtagtgcaatctca

SEQ ID NO: 10100 - DNA, 22 bp, Homo sapiens
tgttggcaacagttccatgtca

SEQ ID NO: 10101 - DNA, 19 bp, Homo sapiens
tttccttcaggctctgtga

SEQ ID NO: 10102 - DNA, 25 bp, Homo sapiens
ttttcattgtgtatttgcaccatca

SEQ ID NO: 10103 - DNA, 17 bp, Homo sapiens
caccagcgctcctcgca

SEQ ID NO: 10104 - DNA, 25 bp, Homo sapiens
gcctggaagtccacctgtctggtcc

SEQ ID NO: 10105 - DNA, 22 bp, Homo sapiens
gctgtggaataagttgtgtttg

SEQ ID NO: 10106 - DNA, 22 bp, Homo sapiens
ggccagccgcggcccttggccc

SEQ ID NO: 10107 - DNA, 19 bp, Homo sapiens
tctgatatacccaatgtgt

SEQ ID NO: 10108 - DNA, 19 bp, Homo sapiens
tcatttgagtacccaaata

SEQ ID NO: 10109 - DNA, 18 bp, Homo sapiens
actcatctcttaatttgc

SEQ ID NO: 10110 - DNA, 19 bp, Homo sapiens
ccccacaaaagataactca

SEQ ID NO: 10111 - DNA, 20 bp, Homo sapiens
attcacaggtcacccctctc

SEQ ID NO: 10112 - DNA, 21 bp, Homo sapiens
ctcagcagctccccagcacca

SEQ ID NO: 10113 - DNA, 18 bp, Homo sapiens
gcctcaaccacaattctt

SEQ ID NO: 10114 - DNA, 21 bp, Homo sapiens
tctaggggcctgctcctctaa

SEQ ID NO: 10115 - DNA, 19 bp, Homo sapiens
tctgagctcacgctggctc

SEQ ID NO: 10116 - DNA, 18 bp, Homo sapiens
atagaaaaagaattggtt

SEQ ID NO: 10117 - DNA, 21 bp, Homo sapiens
atgtatttataaagtttttcc

SEQ ID NO: 10118 - DNA, 22 bp, Homo sapiens
cttatctttgccttactgatca

SEQ ID NO: 10119 - DNA, 19 bp, Homo sapiens
agccacgctgtttacctca

SEQ ID NO: 10120 - DNA, 21 bp, Homo sapiens
ctttgtcgtggagatctggaa

SEQ ID NO: 10121 - DNA, 18 bp, Homo sapiens
cgctactgtcctgtcctc

SEQ ID NO: 10122 - DNA, 21 bp, Homo sapiens
tgcgggctgcctcacctcctc

SEQ ID NO: 10123 - DNA, 19 bp, Homo sapiens
acctccgactccctggttc

SEQ ID NO: 10124 - DNA, 22 bp, Homo sapiens
actggacaatgttacgctagaa

SEQ ID NO: 10125 - DNA, 18 bp, Homo sapiens
cagaacatatcatcactg

SEQ ID NO: 10126 - DNA, 19 bp, Homo sapiens
catcctcttctgtccctgg

SEQ ID NO: 10127 - DNA, 22 bp, Homo sapiens
cctcctcactcaggctgttgta

SEQ ID NO: 10128 - DNA, 18 bp, Homo sapiens
ctccatgtagataagagc

SEQ ID NO: 10129 - DNA, 22 bp, Homo sapiens
ctccccctcccttgtggtttca

SEQ ID NO: 10130 - DNA, 19 bp, Homo sapiens
ctgttttgtgatgccccca

SEQ ID NO: 10131 - DNA, 18 bp, Homo sapiens
gataaccagctaatccca

SEQ ID NO: 10132 - DNA, 19 bp, Homo sapiens
taatttcacaaccgttatc

SEQ ID NO: 10133 - DNA, 22 bp, Homo sapiens
tcctgataacaagactctgtgg

SEQ ID NO: 10134 - DNA, 19 bp, Homo sapiens
aggggccacactggaccat

SEQ ID NO: 10135 - DNA, 22 bp, Homo sapiens
ccctgctccagcccagttctca

SEQ ID NO: 10136 - DNA, 17 bp, Homo sapiens
acttcgccaactcgcca

SEQ ID NO: 10137 - DNA, 18 bp, Homo sapiens
agtcgtgcgccccccgcc

SEQ ID NO: 10138 - DNA, 18 bp, Homo sapiens
ctcccgctcctctgcctc

SEQ ID NO: 10139 - DNA, 19 bp, Homo sapiens
ctgccttgcccctacctca

SEQ ID NO: 10140 - DNA, 22 bp, Homo sapiens
gcccctctctccctctgcccct

SEQ ID NO: 10141 - DNA, 22 bp, Homo sapiens
gcttctctccccctctgtctct

SEQ ID NO: 10142 - DNA, 17 bp, Homo sapiens
acttcgccaactcgcca

SEQ ID NO: 10143 - DNA, 18 bp, Homo sapiens
agtcgtgcgccccccgcc

SEQ ID NO: 10144 - DNA, 18 bp, Homo sapiens
ctcccgctcctctgcctc

SEQ ID NO: 10145 - DNA, 19 bp, Homo sapiens
ctgccttgcccctacctca

SEQ ID NO: 10146 - DNA, 22 bp, Homo sapiens
gcccctctctccctctgcccct

SEQ ID NO: 10147 - DNA, 22 bp, Homo sapiens
gcttctctccccctctgtctct

SEQ ID NO: 10148 - DNA, 24 bp, Homo sapiens
ggcgcgcaaacttgagttactttt

SEQ ID NO: 10149 - DNA, 24 bp, Homo sapiens
acataattccagtcacagtttttg

SEQ ID NO: 10150 - DNA, 18 bp, Homo sapiens
cgacaacttcgcagccca

SEQ ID NO: 10151 - DNA, 23 bp, Homo sapiens
caccacagccatcgccactgcca

SEQ ID NO: 10152 - DNA, 19 bp, Homo sapiens
cctgcttcccaaactccca

SEQ ID NO: 10153 - DNA, 22 bp, Homo sapiens
ctgtggataacattgctagcga

SEQ ID NO: 10154 - DNA, 23 bp, Homo sapiens
caacaaagaggattagacagtaa

SEQ ID NO: 10155 - DNA, 20 bp, Homo sapiens
ctgctttactgtgtatctca

SEQ ID NO: 10156 - DNA, 19 bp, Homo sapiens
tctttttgatttttaaatc

SEQ ID NO: 10157 - DNA, 18 bp, Homo sapiens
tggtttttgttgcttttt

SEQ ID NO: 10158 - DNA, 20 bp, Homo sapiens
tttggagagtgggctgacat

SEQ ID NO: 10159 - DNA, 23 bp, Homo sapiens
caacaaagaggattagacagtaa

SEQ ID NO: 10160 - DNA, 19 bp, Homo sapiens
cctgaacaatgtcaacaag

SEQ ID NO: 10161 - DNA, 20 bp, Homo sapiens
ctgctttactgtgtatctca

SEQ ID NO: 10162 - DNA, 22 bp, Homo sapiens
gaaaacattcacaaaatgggta

SEQ ID NO: 10163 - DNA, 19 bp, Homo sapiens
tctttttgatttttaaatc

SEQ ID NO: 10164 - DNA, 18 bp, Homo sapiens
tggtttttgttgcttttt

SEQ ID NO: 10165 - DNA, 20 bp, Homo sapiens
tttggagagtgggctgacat

SEQ ID NO: 10166 - DNA, 23 bp, Homo sapiens
caacaaagaggattagacagtaa

SEQ ID NO: 10167 - DNA, 17 bp, Homo sapiens
caacagggaaatcagca

SEQ ID NO: 10168 - DNA, 20 bp, Homo sapiens
ctgctttactgtgtatctca

SEQ ID NO: 10169 - DNA, 19 bp, Homo sapiens
tctttttgatttttaaatc

SEQ ID NO: 10170 - DNA, 18 bp, Homo sapiens
tggtttttgttgcttttt

SEQ ID NO: 10171 - DNA, 20 bp, Homo sapiens
tttggagagtgggctgacat

SEQ ID NO: 10172 - DNA, 23 bp, Homo sapiens
caacaaagaggattagacagtaa

SEQ ID NO: 10173 - DNA, 17 bp, Homo sapiens
caacagggaaatcagca

SEQ ID NO: 10174 - DNA, 19 bp, Homo sapiens
cctgaacaatgtcaacaag

SEQ ID NO: 10175 - DNA, 20 bp, Homo sapiens
ctgctttactgtgtatctca

SEQ ID NO: 10176 - DNA, 22 bp, Homo sapiens
gaaaacattcacaaaatgggta

SEQ ID NO: 10177 - DNA, 19 bp, Homo sapiens
tctttttgatttttaaatc

SEQ ID NO: 10178 - DNA, 18 bp, Homo sapiens
tggtttttgttgcttttt

SEQ ID NO: 10179 - DNA, 20 bp, Homo sapiens
tttggagagtgggctgacat

SEQ ID NO: 10180 - DNA, 23 bp, Homo sapiens
caacaaagaggattagacagtaa

SEQ ID NO: 10181 - DNA, 20 bp, Homo sapiens
ctgctttactgtgtatctca

SEQ ID NO: 10182 - DNA, 19 bp, Homo sapiens
tctttttgatttttaaatc

SEQ ID NO: 10183 - DNA, 18 bp, Homo sapiens
tggtttttgttgcttttt

SEQ ID NO: 10184 - DNA, 20 bp, Homo sapiens
tttggagagtgggctgacat

SEQ ID NO: 10185 - DNA, 23 bp, Homo sapiens
caacaaagaggattagacagtaa

SEQ ID NO: 10186 - DNA, 20 bp, Homo sapiens
ctgctttactgtgtatctca

SEQ ID NO: 10187 - DNA, 19 bp, Homo sapiens
tctttttgatttttaaatc

SEQ ID NO: 10188 - DNA, 18 bp, Homo sapiens
tggtttttgttgcttttt

SEQ ID NO: 10189 - DNA, 20 bp, Homo sapiens
tttggagagtgggctgacat

SEQ ID NO: 10190 - DNA, 21 bp, Homo sapiens
aaaaacagatgccagtattct

SEQ ID NO: 10191 - DNA, 23 bp, Homo sapiens
caacaaagaggattagacagtaa

SEQ ID NO: 10192 - DNA, 21 bp, Homo sapiens
ctctggtgacacaacctgtgg

SEQ ID NO: 10193 - DNA, 20 bp, Homo sapiens
ctgctttactgtgtatctca

SEQ ID NO: 10194 - DNA, 20 bp, Homo sapiens
gcaagtcaagttactggtgg

SEQ ID NO: 10195 - DNA, 16 bp, Homo sapiens
ggactgaccactattg

SEQ ID NO: 10196 - DNA, 19 bp, Homo sapiens
gttgcccctgcgccaggga

SEQ ID NO: 10197 - DNA, 19 bp, Homo sapiens
tcctcaaaaacagatgcca

SEQ ID NO: 10198 - DNA, 19 bp, Homo sapiens
tctttttgatttttaaatc

SEQ ID NO: 10199 - DNA, 18 bp, Homo sapiens
tggtttttgttgcttttt

SEQ ID NO: 10200 - DNA, 20 bp, Homo sapiens
tgtcagacagaaaaaagagg

SEQ ID NO: 10201 - DNA, 20 bp, Homo sapiens
tttggagagtgggctgacat

SEQ ID NO: 10202 - DNA, 23 bp, Homo sapiens
caacaaagaggattagacagtaa

SEQ ID NO: 10203 - DNA, 20 bp, Homo sapiens
ctgctttactgtgtatctca

SEQ ID NO: 10204 - DNA, 19 bp, Homo sapiens
tctttttgatttttaaatc

SEQ ID NO: 10205 - DNA, 18 bp, Homo sapiens
tggtttttgttgcttttt

SEQ ID NO: 10206 - DNA, 20 bp, Homo sapiens
tttggagagtgggctgacat

SEQ ID NO: 10207 - DNA, 23 bp, Homo sapiens
caacaaagaggattagacagtaa

SEQ ID NO: 10208 - DNA, 20 bp, Homo sapiens
ctgctttactgtgtatctca

SEQ ID NO: 10209 - DNA, 19 bp, Homo sapiens
tctttttgatttttaaatc

SEQ ID NO: 10210 - DNA, 18 bp, Homo sapiens
tggtttttgttgcttttt

SEQ ID NO: 10211 - DNA, 20 bp, Homo sapiens
tttggagagtgggctgacat

SEQ ID NO: 10212 - DNA, 23 bp, Homo sapiens
caacaaagaggattagacagtaa

SEQ ID NO: 10213 - DNA, 20 bp, Homo sapiens
ctgctttactgtgtatctca

SEQ ID NO: 10214 - DNA, 19 bp, Homo sapiens
tctttttgatttttaaatc

SEQ ID NO: 10215 - DNA, 18 bp, Homo sapiens
tggtttttgttgcttttt

SEQ ID NO: 10216 - DNA, 20 bp, Homo sapiens
tttggagagtgggctgacat

SEQ ID NO: 10217 - DNA, 21 bp, Homo sapiens
aaaaacagatgccagtattct

SEQ ID NO: 10218 - DNA, 23 bp, Homo sapiens
caacaaagaggattagacagtaa

SEQ ID NO: 10219 - DNA, 21 bp, Homo sapiens
ctctggtgacacaacctgtgg

SEQ ID NO: 10220 - DNA, 20 bp, Homo sapiens
ctgctttactgtgtatctca

SEQ ID NO: 10221 - DNA, 20 bp, Homo sapiens
gcaagtcaagttactggtgg

SEQ ID NO: 10222 - DNA, 16 bp, Homo sapiens
ggactgaccactattg

SEQ ID NO: 10223 - DNA, 19 bp, Homo sapiens
gttgcccctgcgccaggga

SEQ ID NO: 10224 - DNA, 19 bp, Homo sapiens
tcctcaaaaacagatgcca

SEQ ID NO: 10225 - DNA, 19 bp, Homo sapiens
tctttttgatttttaaatc

SEQ ID NO: 10226 - DNA, 18 bp, Homo sapiens
tggtttttgttgcttttt

SEQ ID NO: 10227 - DNA, 20 bp, Homo sapiens
tgtcagacagaaaaaagagg

SEQ ID NO: 10228 - DNA, 20 bp, Homo sapiens
tttggagagtgggctgacat

SEQ ID NO: 10229 - DNA, 21 bp, Homo sapiens
aaaaacagatgccagtattct

SEQ ID NO: 10230 - DNA, 23 bp, Homo sapiens
caacaaagaggattagacagtaa

SEQ ID NO: 10231 - DNA, 21 bp, Homo sapiens
ctctggtgacacaacctgtgg

SEQ ID NO: 10232 - DNA, 20 bp, Homo sapiens
ctgctttactgtgtatctca

SEQ ID NO: 10233 - DNA, 20 bp, Homo sapiens
gcaagtcaagttactggtgg

SEQ ID NO: 10234 - DNA, 16 bp, Homo sapiens
ggactgaccactattg

SEQ ID NO: 10235 - DNA, 19 bp, Homo sapiens
gttgcccctgcgccaggga

SEQ ID NO: 10236 - DNA, 19 bp, Homo sapiens
tcctcaaaaacagatgcca

SEQ ID NO: 10237 - DNA, 19 bp, Homo sapiens
tctttttgatttttaaatc

SEQ ID NO: 10238 - DNA, 18 bp, Homo sapiens
tggtttttgttgcttttt

SEQ ID NO: 10239 - DNA, 20 bp, Homo sapiens
tgtcagacagaaaaaagagg

SEQ ID NO: 10240 - DNA, 20 bp, Homo sapiens
tttggagagtgggctgacat

SEQ ID NO: 10241 - DNA, 18 bp, Homo sapiens
acaggccgcctctgtggc

SEQ ID NO: 10242 - DNA, 19 bp, Homo sapiens
agggttgtgctttctagca

SEQ ID NO: 10243 - DNA, 17 bp, Homo sapiens
cctgaagccattggaga

SEQ ID NO: 10244 - DNA, 22 bp, Homo sapiens
gccccggtgtgtcccaggagtc

SEQ ID NO: 10245 - DNA, 21 bp, Homo sapiens
ggagtcctcattgaatcctca

SEQ ID NO: 10246 - DNA, 17 bp, Homo sapiens
tcaagatattcaggtgg

SEQ ID NO: 10247 - DNA, 19 bp, Homo sapiens
ggctctggcgcgccagccg

SEQ ID NO: 10248 - DNA, 18 bp, Homo sapiens
ctgtagccccctctgcca

SEQ ID NO: 10249 - DNA, 21 bp, Homo sapiens
cacctagagggcacgcagcgt

SEQ ID NO: 10250 - DNA, 18 bp, Homo sapiens
ctgtagccccctctgcca

SEQ ID NO: 10251 - DNA, 20 bp, Homo sapiens
gtccagcgccaacagcctct

SEQ ID NO: 10252 - DNA, 18 bp, Homo sapiens
ctgtagccccctctgcca

SEQ ID NO: 10253 - DNA, 17 bp, Homo sapiens
ctacatacaatcaatgt

SEQ ID NO: 10254 - DNA, 21 bp, Homo sapiens
tgcttggtttgcacatgttgt

SEQ ID NO: 10255 - DNA, 19 bp, Homo sapiens
ttccagagccctcgttcca

SEQ ID NO: 10256 - DNA, 18 bp, Homo sapiens
tcaagactttgctctcca

SEQ ID NO: 10257 - DNA, 19 bp, Homo sapiens
agctgggggctccttgcca

SEQ ID NO: 10258 - DNA, 16 bp, Homo sapiens
atgctgggctgcctgg

SEQ ID NO: 10259 - DNA, 18 bp, Homo sapiens
caacccctcctttcccct

SEQ ID NO: 10260 - DNA, 20 bp, Homo sapiens
cctcctttcccctgcccttg

SEQ ID NO: 10261 - DNA, 24 bp, Homo sapiens
ctagaatacagtctgggtcccaca

SEQ ID NO: 10262 - DNA, 20 bp, Homo sapiens
gcctcaggagtccttgggga

SEQ ID NO: 10263 - DNA, 22 bp, Homo sapiens
gtggttttcaaactgcttggca

SEQ ID NO: 10264 - DNA, 20 bp, Homo sapiens
tggatgggtgggcatggaac

SEQ ID NO: 10265 - DNA, 20 bp, Homo sapiens
ttgttccttcatcatccccc

SEQ ID NO: 10266 - DNA, 23 bp, Homo sapiens
tttgcatgggtgttacttgtctg

SEQ ID NO: 10267 - DNA, 18 bp, Homo sapiens
atgcaaagcagtgtgttg

SEQ ID NO: 10268 - DNA, 20 bp, Homo sapiens
aggaaccagtcagctggcca

SEQ ID NO: 10269 - DNA, 18 bp, Homo sapiens
ctacctgccatgcataca

SEQ ID NO: 10270 - DNA, 15 bp, Homo sapiens
gtgctatttcagcaa

SEQ ID NO: 10271 - DNA, 20 bp, Homo sapiens
tggccaggctggtcttgaac

SEQ ID NO: 10272 - DNA, 19 bp, Homo sapiens
aaacaacaacacaataaca

SEQ ID NO: 10273 - DNA, 21 bp, Homo sapiens
agtgcgagagaggcggtcgtg

SEQ ID NO: 10274 - DNA, 21 bp, Homo sapiens
ggttcatgtagagaaaagcac

SEQ ID NO: 10275 - DNA, 22 bp, Homo sapiens
acagccacagccagaggagcct

SEQ ID NO: 10276 - DNA, 20 bp, Homo sapiens
cagccacagccagaggagcc

SEQ ID NO: 10277 - DNA, 23 bp, Homo sapiens
acttgaacttgggcatctggctc

SEQ ID NO: 10278 - DNA, 19 bp, Homo sapiens
tctagttccctgcttgatg

SEQ ID NO: 10279 - DNA, 21 bp, Homo sapiens
tctgcctgaggtcccacccca

SEQ ID NO: 10280 - DNA, 19 bp, Homo sapiens
tgtttgatcttctcaaaca

SEQ ID NO: 10281 - DNA, 23 bp, Homo sapiens
aacacaagcatttcacttctcca

SEQ ID NO: 10282 - DNA, 22 bp, Homo sapiens
gacatacatcattctgtgatta

SEQ ID NO: 10283 - DNA, 25 bp, Homo sapiens
tagttttatcttaacactgaaactg

SEQ ID NO: 10284 - DNA, 17 bp, Homo sapiens
tcaagatgactgcttca

SEQ ID NO: 10285 - DNA, 26 bp, Homo sapiens
tgcttttaacattccgacatacatca

SEQ ID NO: 10286 - DNA, 18 bp, Homo sapiens
tggctcagtgtgagattg

SEQ ID NO: 10287 - DNA, 17 bp, Homo sapiens
cttcatacatcaccaca

SEQ ID NO: 10288 - DNA, 18 bp, Homo sapiens
ctggagaaaaatatctgt

SEQ ID NO: 10289 - DNA, 19 bp, Homo sapiens
tagaggcctttagttataa

SEQ ID NO: 10290 - DNA, 17 bp, Homo sapiens
aataaaagaatctgata

SEQ ID NO: 10291 - DNA, 20 bp, Homo sapiens
acaaaactattaagtatgtc

SEQ ID NO: 10292 - DNA, 22 bp, Homo sapiens
ccaaaagcaacattcgttctct

SEQ ID NO: 10293 - DNA, 19 bp, Homo sapiens
tcccccggcctccgcgcca

SEQ ID NO: 10294 - DNA, 20 bp, Homo sapiens
aggtaggtcagatccccctc

SEQ ID NO: 10295 - DNA, 19 bp, Homo sapiens
atagaacacaagggatata

SEQ ID NO: 10296 - DNA, 18 bp, Homo sapiens
ctctagagtttagtcctt

SEQ ID NO: 10297 - DNA, 19 bp, Homo sapiens
tgcagctcactgctgctgc

SEQ ID NO: 10298 - DNA, 23 bp, Homo sapiens
tggacagcttacctagtcttgta

SEQ ID NO: 10299 - DNA, 21 bp, Homo sapiens
gttctttataacaaaacaggg

SEQ ID NO: 10300 - DNA, 21 bp, Homo sapiens
cagcaactttttaattaaaca

SEQ ID NO: 10301 - DNA, 18 bp, Homo sapiens
cccggtctcagtcgtcat

SEQ ID NO: 10302 - DNA, 22 bp, Homo sapiens
gcctggctgggaagtctgggga

SEQ ID NO: 10303 - DNA, 21 bp, Homo sapiens
acccaattcaagcttatttta

SEQ ID NO: 10304 - DNA, 18 bp, Homo sapiens
ccacccacctctgcctcc

SEQ ID NO: 10305 - DNA, 19 bp, Homo sapiens
ctagccttccaagcatgaa

SEQ ID NO: 10306 - DNA, 20 bp, Homo sapiens
taatgttcatttattttcta

SEQ ID NO: 10307 - DNA, 18 bp, Homo sapiens
tccgcctcctgggttcaa

SEQ ID NO: 10308 - DNA, 19 bp, Homo sapiens
gccggagatctatttttta

SEQ ID NO: 10309 - DNA, 21 bp, Homo sapiens
gctcctcttcctttcctcctc

SEQ ID NO: 10310 - DNA, 19 bp, Homo sapiens
cctgagggaggacctgggg

SEQ ID NO: 10311 - DNA, 24 bp, Homo sapiens
cgcccctgcctgccatgtacctcc

SEQ ID NO: 10312 - DNA, 21 bp, Homo sapiens
gactgcaatgtgccgatctta

SEQ ID NO: 10313 - DNA, 17 bp, Homo sapiens
ttcctcttcggccctca

SEQ ID NO: 10314 - DNA, 21 bp, Homo sapiens
cacacccagcggccccccgca

SEQ ID NO: 10315 - DNA, 18 bp, Homo sapiens
catccccaccccacccca

SEQ ID NO: 10316 - DNA, 22 bp, Homo sapiens
cccgctgagtggggggtcgtgg

SEQ ID NO: 10317 - DNA, 19 bp, Homo sapiens
cagtaagcaaaattttcca

SEQ ID NO: 10318 - DNA, 22 bp, Homo sapiens
tgggcatttaatatgtaaagat

SEQ ID NO: 10319 - DNA, 19 bp, Homo sapiens
tttactttgatgtatcata

SEQ ID NO: 10320 - DNA, 23 bp, Homo sapiens
ggcagaaagctggagcccctgga

SEQ ID NO: 10321 - DNA, 21 bp, Homo sapiens
ttctgtcttgttcagccttga

SEQ ID NO: 10322 - DNA, 22 bp, Homo sapiens
tttcatgcgctgtttttgtttt

SEQ ID NO: 10323 - DNA, 23 bp, Homo sapiens
cagacgtgaaagccagaacctca

SEQ ID NO: 10324 - DNA, 22 bp, Homo sapiens
tatggattgccaagtcagcata

SEQ ID NO: 10325 - DNA, 18 bp, Homo sapiens
tctggcgtgagttgtgaa

SEQ ID NO: 10326 - DNA, 19 bp, Homo sapiens
tgataactaaaatccctct

SEQ ID NO: 10327 - DNA, 19 bp, Homo sapiens
aagttctgcatagcatcta

SEQ ID NO: 10328 - DNA, 18 bp, Homo sapiens
ctggtaatcacagtatta

SEQ ID NO: 10329 - DNA, 22 bp, Homo sapiens
cttttccctccttttttatctc

SEQ ID NO: 10330 - DNA, 25 bp, Homo sapiens
tacttttctccagggactttttgca

SEQ ID NO: 10331 - DNA, 21 bp, Homo sapiens
tgtgtttcaaacatttctgga

SEQ ID NO: 10332 - DNA, 19 bp, Homo sapiens
gctttatttttaacactaa

SEQ ID NO: 10333 - DNA, 24 bp, Homo sapiens
tcctgggttgcagggacttgagaa

SEQ ID NO: 10334 - DNA, 17 bp, Homo sapiens
actttgccgtctggttt

SEQ ID NO: 10335 - DNA, 17 bp, Homo sapiens
gatttgtaatgagtaca

SEQ ID NO: 10336 - DNA, 19 bp, Homo sapiens
tcctgaaactctttggaga

SEQ ID NO: 10337 - DNA, 23 bp, Homo sapiens
cagtgttctgctttttaatccta

SEQ ID NO: 10338 - DNA, 18 bp, Homo sapiens
gtctgttacagttgctag

SEQ ID NO: 10339 - DNA, 23 bp, Homo sapiens
tacctgcagtggcaccctgtaca

SEQ ID NO: 10340 - DNA, 19 bp, Homo sapiens
ttcagaagcagacatggca

SEQ ID NO: 10341 - DNA, 20 bp, Homo sapiens
aatatcaccaggcttcttct

SEQ ID NO: 10342 - DNA, 20 bp, Homo sapiens
atcaaacataccccaagtta

SEQ ID NO: 10343 - DNA, 24 bp, Homo sapiens
cccactctccttggcaccctgaca

SEQ ID NO: 10344 - DNA, 18 bp, Homo sapiens
ctctccttggcaccctga

SEQ ID NO: 10345 - DNA, 24 bp, Homo sapiens
ttgcacaatatcaccaggcttctt

SEQ ID NO: 10346 - DNA, 21 bp, Homo sapiens
cctaggccaggccgtgttgaa

SEQ ID NO: 10347 - DNA, 22 bp, Homo sapiens
agaacaatgggaaacttagcta

SEQ ID NO: 10348 - DNA, 17 bp, Homo sapiens
gggaagaggctgggagc

SEQ ID NO: 10349 - DNA, 21 bp, Homo sapiens
gtcttgaactcttgggctcaa

SEQ ID NO: 10350 - DNA, 21 bp, Homo sapiens
accttgtatataccctgcacc

SEQ ID NO: 10351 - DNA, 18 bp, Homo sapiens
cccagcgtccctgcctcc

SEQ ID NO: 10352 - DNA, 19 bp, Homo sapiens
agaaaatgggagctgtgct

SEQ ID NO: 10353 - DNA, 21 bp, Homo sapiens
agcgaggcacttgctaactct

SEQ ID NO: 10354 - DNA, 23 bp, Homo sapiens
aggcacttgctaactcttggcct

SEQ ID NO: 10355 - DNA, 20 bp, Homo sapiens
ctctggcccagaccctgtgg

SEQ ID NO: 10356 - DNA, 16 bp, Homo sapiens
tggcacagcaacatca

SEQ ID NO: 10357 - DNA, 19 bp, Homo sapiens
aagcaattctcttgcttca

SEQ ID NO: 10358 - DNA, 25 bp, Homo sapiens
acaatgaccaggttggactgtttaa

SEQ ID NO: 10359 - DNA, 19 bp, Homo sapiens
acacttattattttccttt

SEQ ID NO: 10360 - DNA, 18 bp, Homo sapiens
ataagttatggccatctt

SEQ ID NO: 10361 - DNA, 21 bp, Homo sapiens
ccaagcatgcaccaaacactg

SEQ ID NO: 10362 - DNA, 18 bp, Homo sapiens
ccacctttatttaaagtt

SEQ ID NO: 10363 - DNA, 23 bp, Homo sapiens
cctcaagcaatccgcctacctca

SEQ ID NO: 10364 - DNA, 24 bp, Homo sapiens
cctctaaaaggaaaccccatccca

SEQ ID NO: 10365 - DNA, 19 bp, Homo sapiens
ctccagcccccagcaacca

SEQ ID NO: 10366 - DNA, 19 bp, Homo sapiens
gccaaataaaattgtatta

SEQ ID NO: 10367 - DNA, 20 bp, Homo sapiens
tcatttttatggccaaataa

SEQ ID NO: 10368 - DNA, 18 bp, Homo sapiens
tgaggtaaacttcacata

SEQ ID NO: 10369 - DNA, 24 bp, Homo sapiens
tgcaacctcctcctcctggattca

SEQ ID NO: 10370 - DNA, 19 bp, Homo sapiens
cgtgcgcgaagagacctcg

SEQ ID NO: 10371 - DNA, 19 bp, Homo sapiens
gcccatttctccacactgg

SEQ ID NO: 10372 - DNA, 20 bp, Homo sapiens
gtggggagggggcttttgtt

SEQ ID NO: 10373 - DNA, 21 bp, Homo sapiens
cccacctccaacacctcctga

SEQ ID NO: 10374 - DNA, 21 bp, Homo sapiens
gctttcctgctccacctgaga

SEQ ID NO: 10375 - DNA, 19 bp, Homo sapiens
tgaacctggctttctcaca

SEQ ID NO: 10376 - DNA, 18 bp, Homo sapiens
aaatccaaaatagtcatg

SEQ ID NO: 10377 - DNA, 17 bp, Homo sapiens
caagtgttttgggtttt

SEQ ID NO: 10378 - DNA, 25 bp, Homo sapiens
ctgtacttcagttctcatcttgtaa

SEQ ID NO: 10379 - DNA, 22 bp, Homo sapiens
tcaaagaggccagtactttgcc

SEQ ID NO: 10380 - DNA, 18 bp, Homo sapiens
tccaggaggactgttcta

SEQ ID NO: 10381 - DNA, 19 bp, Homo sapiens
tgaaccgtcaatgtgaaat

SEQ ID NO: 10382 - DNA, 18 bp, Homo sapiens
cccagacactgaagtgca

SEQ ID NO: 10383 - DNA, 23 bp, Homo sapiens
gcaggttatgcaagtcgccaggc

SEQ ID NO: 10384 - DNA, 15 bp, Homo sapiens
gcataaaagttaaca

SEQ ID NO: 10385 - DNA, 22 bp, Homo sapiens
tagatcctctgatatacaatta

SEQ ID NO: 10386 - DNA, 19 bp, Homo sapiens
ataaaaatggaagctatta

SEQ ID NO: 10387 - DNA, 21 bp, Homo sapiens
ctctgacattgaggcctgggg

SEQ ID NO: 10388 - DNA, 22 bp, Homo sapiens
gtaaaggacatttgcttacctg

SEQ ID NO: 10389 - DNA, 18 bp, Homo sapiens
ttggacctgactcagcta

SEQ ID NO: 10390 - DNA, 23 bp, Homo sapiens
aaatcttaggctaccacattcta

SEQ ID NO: 10391 - DNA, 19 bp, Homo sapiens
acaccctagaacactccta

SEQ ID NO: 10392 - DNA, 18 bp, Homo sapiens
atgcttaacagatcatta

SEQ ID NO: 10393 - DNA, 19 bp, Homo sapiens
ctgtattggacagcactgc

SEQ ID NO: 10394 - DNA, 24 bp, Homo sapiens
tccaattcaagcctctcaactcaa

SEQ ID NO: 10395 - DNA, 18 bp, Homo sapiens
cttcccctgactgttcca

SEQ ID NO: 10396 - DNA, 24 bp, Homo sapiens
gagacaaggccagtgtatatgcaa

SEQ ID NO: 10397 - DNA, 20 bp, Homo sapiens
ggaggaggaaacttcacata

SEQ ID NO: 10398 - DNA, 21 bp, Homo sapiens
gtcccaccactgaagctgttg

SEQ ID NO: 10399 - DNA, 20 bp, Homo sapiens
cctggagaggtcgctttgtg

SEQ ID NO: 10400 - DNA, 21 bp, Homo sapiens
cctccaagaagaggcagccca

SEQ ID NO: 10401 - DNA, 19 bp, Homo sapiens
gaggctcccagtccccact

SEQ ID NO: 10402 - DNA, 22 bp, Homo sapiens
gcgccagccgggactcacccgc

SEQ ID NO: 10403 - DNA, 22 bp, Homo sapiens
aggattctattttgtttaatgg

SEQ ID NO: 10404 - DNA, 21 bp, Homo sapiens
cagaaatggcagaataaatct

SEQ ID NO: 10405 - DNA, 18 bp, Homo sapiens
accttggcttcctggccc

SEQ ID NO: 10406 - DNA, 21 bp, Homo sapiens
ccctcgccccaagactgggga

SEQ ID NO: 10407 - DNA, 22 bp, Homo sapiens
cctgcttcctggcccagtccca

SEQ ID NO: 10408 - DNA, 20 bp, Homo sapiens
cttgggccacacctgctcac

SEQ ID NO: 10409 - DNA, 20 bp, Homo sapiens
ttcatcagacagacacctcc

SEQ ID NO: 10410 - DNA, 18 bp, Homo sapiens
cacatggacaggctgcag

SEQ ID NO: 10411 - DNA, 18 bp, Homo sapiens
cccttgaaggtttgggga

SEQ ID NO: 10412 - DNA, 17 bp, Homo sapiens
cttttggcaaacagtgt

SEQ ID NO: 10413 - DNA, 19 bp, Homo sapiens
gccccctcagatggctttt

SEQ ID NO: 10414 - DNA, 23 bp, Homo sapiens
gtccatgtggcacctttgtgaga

SEQ ID NO: 10415 - DNA, 17 bp, Homo sapiens
gtcccactatgggtctc

SEQ ID NO: 10416 - DNA, 22 bp, Homo sapiens
gtggttttgggttttttttgtt

SEQ ID NO: 10417 - DNA, 20 bp, Homo sapiens
atagcgggtttcaccctcca

SEQ ID NO: 10418 - DNA, 19 bp, Homo sapiens
tctgtctctctcgggcctt

SEQ ID NO: 10419 - DNA, 21 bp, Homo sapiens
cggacggacacacctcatgga

SEQ ID NO: 10420 - DNA, 18 bp, Homo sapiens
tgttctgaccctctgtgc

SEQ ID NO: 10421 - DNA, 19 bp, Homo sapiens
gtaaaagtggatcctgcca

SEQ ID NO: 10422 - DNA, 22 bp, Homo sapiens
aaagacccaggtaaaagaccca

SEQ ID NO: 10423 - DNA, 17 bp, Homo sapiens
atgtccagaagcatttc

SEQ ID NO: 10424 - DNA, 19 bp, Homo sapiens
tttctgttgccttcgtttt

SEQ ID NO: 10425 - DNA, 19 bp, Homo sapiens
aaaaacatatacaaataaa

SEQ ID NO: 10426 - DNA, 25 bp, Homo sapiens
acttgggcccttcccttcttggttt

SEQ ID NO: 10427 - DNA, 22 bp, Homo sapiens
tttttacctctgtcttggcttt

SEQ ID NO: 10428 - DNA, 19 bp, Homo sapiens
gtatgatttttagtgtcag

SEQ ID NO: 10429 - DNA, 21 bp, Homo sapiens
gcccatggccgcgcgcgctcc

SEQ ID NO: 10430 - DNA, 22 bp, Homo sapiens
ctaaacgtacaacatcatagta

SEQ ID NO: 10431 - DNA, 19 bp, Homo sapiens
gtccttaaggcaacagtgc

SEQ ID NO: 10432 - DNA, 18 bp, Homo sapiens
tgtgtccgtatatttctg

SEQ ID NO: 10433 - DNA, 18 bp, Homo sapiens
ttgcaaaatgtcaattct

SEQ ID NO: 10434 - DNA, 17 bp, Homo sapiens
catgctggacatccctt

SEQ ID NO: 10435 - DNA, 21 bp, Homo sapiens
ccatggagaacacacaaccag

SEQ ID NO: 10436 - DNA, 18 bp, Homo sapiens
atctcccaagaggcttca

SEQ ID NO: 10437 - DNA, 21 bp, Homo sapiens
cctgctccctacagtgggctg

SEQ ID NO: 10438 - DNA, 19 bp, Homo sapiens
ctcccctgccccatctggt

SEQ ID NO: 10439 - DNA, 19 bp, Homo sapiens
cttgggagttgttgggttc

SEQ ID NO: 10440 - DNA, 21 bp, Homo sapiens
gccctggagtagggggccaga

SEQ ID NO: 10441 - DNA, 18 bp, Homo sapiens
gtacatcaaactgtatta

SEQ ID NO: 10442 - DNA, 19 bp, Homo sapiens
accaccatctgagacagga

SEQ ID NO: 10443 - DNA, 19 bp, Homo sapiens
caatcccagactgggaacc

SEQ ID NO: 10444 - DNA, 21 bp, Homo sapiens
gaaagggtagaggtcttttca

SEQ ID NO: 10445 - DNA, 17 bp, Homo sapiens
ggccaggacccacaggg

SEQ ID NO: 10446 - DNA, 21 bp, Homo sapiens
agaaaaaagcgaggaaatcag

SEQ ID NO: 10447 - DNA, 22 bp, Homo sapiens
atgtggagcaaagtgtcagtga

SEQ ID NO: 10448 - DNA, 19 bp, Homo sapiens
cctggattgaattgggccc

SEQ ID NO: 10449 - DNA, 16 bp, Homo sapiens
ctgagggctgcttggt

SEQ ID NO: 10450 - DNA, 20 bp, Homo sapiens
gggcacctggcagtgaggga

SEQ ID NO: 10451 - DNA, 21 bp, Homo sapiens
tctgtattggctactgttctt

SEQ ID NO: 10452 - DNA, 26 bp, Homo sapiens
atctgaatttggaattcttctggttt

SEQ ID NO: 10453 - DNA, 19 bp, Homo sapiens
caacagattgcctgctcct

SEQ ID NO: 10454 - DNA, 20 bp, Homo sapiens
tctaaattagagaggttaac

SEQ ID NO: 10455 - DNA, 25 bp, Homo sapiens
caaagttaaaggaccactgccctga

SEQ ID NO: 10456 - DNA, 19 bp, Homo sapiens
cctggtcttggcctgtgaa

SEQ ID NO: 10457 - DNA, 20 bp, Homo sapiens
ctggaagactgttgtggcct

SEQ ID NO: 10458 - DNA, 19 bp, Homo sapiens
cttggcagcagcctgtgaa

SEQ ID NO: 10459 - DNA, 21 bp, Homo sapiens
gcaaatcagggcttcccccta

SEQ ID NO: 10460 - DNA, 22 bp, Homo sapiens
tcatccctggccccctatcttg

SEQ ID NO: 10461 - DNA, 18 bp, Homo sapiens
tggtcttggcctgtgaat

SEQ ID NO: 10462 - DNA, 17 bp, Homo sapiens
ttggggtggttctgctt

SEQ ID NO: 10463 - DNA, 23 bp, Homo sapiens
aataatttgtgtcagcattttca

SEQ ID NO: 10464 - DNA, 22 bp, Homo sapiens
agaacatacttccactacatca

SEQ ID NO: 10465 - DNA, 15 bp, Homo sapiens
gaccagaacatactt

SEQ ID NO: 10466 - DNA, 26 bp, Homo sapiens
gccctcatgggacctgccctccctca

SEQ ID NO: 10467 - DNA, 23 bp, Homo sapiens
gcttttcctcagggtgtcctgag

SEQ ID NO: 10468 - DNA, 17 bp, Homo sapiens
ggaccagggtggagctg

SEQ ID NO: 10469 - DNA, 19 bp, Homo sapiens
ggagcaatctgacccttct

SEQ ID NO: 10470 - DNA, 21 bp, Homo sapiens
tccctcagccgtcagccatca

SEQ ID NO: 10471 - DNA, 20 bp, Homo sapiens
ctgagcgttgcgttcggttt

SEQ ID NO: 10472 - DNA, 23 bp, Homo sapiens
aaccagcagggagcacttggctc

SEQ ID NO: 10473 - DNA, 17 bp, Homo sapiens
aagtgctggccgttctt

SEQ ID NO: 10474 - DNA, 25 bp, Homo sapiens
acaccccttcacagcatacactgcc

SEQ ID NO: 10475 - DNA, 21 bp, Homo sapiens
acgcgttaaagggccatgaca

SEQ ID NO: 10476 - DNA, 19 bp, Homo sapiens
caggaatccgccgccgcta

SEQ ID NO: 10477 - DNA, 22 bp, Homo sapiens
cagtagggcccccagccagcgc

SEQ ID NO: 10478 - DNA, 21 bp, Homo sapiens
catacatagacaagcatcata

SEQ ID NO: 10479 - DNA, 19 bp, Homo sapiens
ccacggccccacctttccc

SEQ ID NO: 10480 - DNA, 19 bp, Homo sapiens
ctcccatctctgccatctg

SEQ ID NO: 10481 - DNA, 19 bp, Homo sapiens
ctggacaatttctctgtca

SEQ ID NO: 10482 - DNA, 15 bp, Homo sapiens
cttatagagctgcaa

SEQ ID NO: 10483 - DNA, 24 bp, Homo sapiens
gatatgattttcagcttggagctg

SEQ ID NO: 10484 - DNA, 22 bp, Homo sapiens
gtcggggccgccggtggagtct

SEQ ID NO: 10485 - DNA, 27 bp, Homo sapiens
tgagtacagccgcatcacctgtcaact

SEQ ID NO: 10486 - DNA, 21 bp, Homo sapiens
tggaagctgctctttacctca

SEQ ID NO: 10487 - DNA, 17 bp, Homo sapiens
tttgaaaagaagagaca

SEQ ID NO: 10488 - DNA, 18 bp, Homo sapiens
aaccctgaagataatcaa

SEQ ID NO: 10489 - DNA, 16 bp, Homo sapiens
cctccccaagcatgaa

SEQ ID NO: 10490 - DNA, 17 bp, Homo sapiens
gtcttcatcatcataca

SEQ ID NO: 10491 - DNA, 19 bp, Homo sapiens
tatctgcttagtattaaca

SEQ ID NO: 10492 - DNA, 23 bp, Homo sapiens
ttgggatatggtattattttaca

SEQ ID NO: 10493 - DNA, 19 bp, Homo sapiens
agaagtttctagccggcca

SEQ ID NO: 10494 - DNA, 16 bp, Homo sapiens
ccagaagtgccttcca

SEQ ID NO: 10495 - DNA, 19 bp, Homo sapiens
cccggtgggaggctgcgga

SEQ ID NO: 10496 - DNA, 18 bp, Homo sapiens
gccgtggctgccaggttc

SEQ ID NO: 10497 - DNA, 19 bp, Homo sapiens
ctcctgcttgcggactgct

SEQ ID NO: 10498 - DNA, 23 bp, Homo sapiens
ggctttgactcggactgcagcga

SEQ ID NO: 10499 - DNA, 18 bp, Homo sapiens
tgggatttggtgtctgct

SEQ ID NO: 10500 - DNA, 25 bp, Homo sapiens
acaatcgattgtggtgtcctttcaa

SEQ ID NO: 10501 - DNA, 23 bp, Homo sapiens
tttatgcttcttaaatcattttt

SEQ ID NO: 10502 - DNA, 18 bp, Homo sapiens
atgtgcccaaagctctga

SEQ ID NO: 10503 - DNA, 22 bp, Homo sapiens
cagggcgtttctaggcctggtc

SEQ ID NO: 10504 - DNA, 22 bp, Homo sapiens
cctaactttctgaattattttt

SEQ ID NO: 10505 - DNA, 22 bp, Homo sapiens
tgcccaaagctctgaatagtta

SEQ ID NO: 10506 - DNA, 21 bp, Homo sapiens
tttctttgcaacagcagtgtt

SEQ ID NO: 10507 - DNA, 17 bp, Homo sapiens
aggcagttccccggtga

SEQ ID NO: 10508 - DNA, 16 bp, Homo sapiens
ccccacccccgcagct

SEQ ID NO: 10509 - DNA, 18 bp, Homo sapiens
ccttcctcctccaggtac

SEQ ID NO: 10510 - DNA, 19 bp, Homo sapiens
tcaacatctaagcctgttg

SEQ ID NO: 10511 - DNA, 22 bp, Homo sapiens
cagaagtgcagcccctctcaca

SEQ ID NO: 10512 - DNA, 20 bp, Homo sapiens
tcccccagagcccctcatgc

SEQ ID NO: 10513 - DNA, 18 bp, Homo sapiens
aaccatgatgccttaaca

SEQ ID NO: 10514 - DNA, 23 bp, Homo sapiens
ccaggctctcagtgccaccaccc

SEQ ID NO: 10515 - DNA, 22 bp, Homo sapiens
ccccctcctcagccctccccca

SEQ ID NO: 10516 - DNA, 18 bp, Homo sapiens
tgtgctgcagctgcccac

SEQ ID NO: 10517 - DNA, 24 bp, Homo sapiens
ctttgacatttggggatctggtgg

SEQ ID NO: 10518 - DNA, 20 bp, Homo sapiens
gtgaactccacctccgtgga

SEQ ID NO: 10519 - DNA, 26 bp, Homo sapiens
tctagaattcactgagttttgtttca

SEQ ID NO: 10520 - DNA, 19 bp, Homo sapiens
catcccctccctcatcctc

SEQ ID NO: 10521 - DNA, 17 bp, Homo sapiens
accaaactacgacctca

SEQ ID NO: 10522 - DNA, 20 bp, Homo sapiens
actgcaagctcaggatttca

SEQ ID NO: 10523 - DNA, 21 bp, Homo sapiens
gcttctctgtcttttttcccc

SEQ ID NO: 10524 - DNA, 20 bp, Homo sapiens
gttcttccgtgtcccgatgt

SEQ ID NO: 10525 - DNA, 18 bp, Homo sapiens
tctgtcttttttccccct

SEQ ID NO: 10526 - DNA, 18 bp, Homo sapiens
tttggtacaaaaccactc

SEQ ID NO: 10527 - DNA, 18 bp, Homo sapiens
ggaggcggcggcggcggc

SEQ ID NO: 10528 - DNA, 22 bp, Homo sapiens
gaaaatcagaagtacagtttta

SEQ ID NO: 10529 - DNA, 21 bp, Homo sapiens
taagtgggtttttatgaactg

SEQ ID NO: 10530 - DNA, 18 bp, Homo sapiens
acaaatagaaacactgcc

SEQ ID NO: 10531 - DNA, 23 bp, Homo sapiens
gcgtctgcaccccggcagcgcga

SEQ ID NO: 10532 - DNA, 18 bp, Homo sapiens
gttgaaagaccgtttaca

SEQ ID NO: 10533 - DNA, 23 bp, Homo sapiens
tgtactggcttgaattttctgga

SEQ ID NO: 10534 - DNA, 19 bp, Homo sapiens
cttggagtgccttaatttt

SEQ ID NO: 10535 - DNA, 17 bp, Homo sapiens
gctctccagtggcactg

SEQ ID NO: 10536 - DNA, 17 bp, Homo sapiens
gttgactgctcgtgtgc

SEQ ID NO: 10537 - DNA, 18 bp, Homo sapiens
tccttctgcctcatggga

SEQ ID NO: 10538 - DNA, 22 bp, Homo sapiens
tgagtgggcttctctgggagct

SEQ ID NO: 10539 - DNA, 30 bp, Homo sapiens
tgcttgaattataaatgtggtgtttggcct

SEQ ID NO: 10540 - DNA, 18 bp, Homo sapiens
ttgtattaaatagcattg

SEQ ID NO: 10541 - DNA, 17 bp, Homo sapiens
gaaccactatgaagcta

SEQ ID NO: 10542 - DNA, 18 bp, Homo sapiens
caagaagatgaatggcgt

SEQ ID NO: 10543 - DNA, 19 bp, Homo sapiens
cgcccagcaccctgcctcc

SEQ ID NO: 10544 - DNA, 22 bp, Homo sapiens
ctgtgaggtttcccaatggtgt

SEQ ID NO: 10545 - DNA, 19 bp, Homo sapiens
gtatctttctatgctgctt

SEQ ID NO: 10546 - DNA, 22 bp, Homo sapiens
aggtcctagcagaaggcattga

SEQ ID NO: 10547 - DNA, 18 bp, Homo sapiens
catcaatgtccctgtccc

SEQ ID NO: 10548 - DNA, 17 bp, Homo sapiens
ccagagacacactggca

SEQ ID NO: 10549 - DNA, 25 bp, Homo sapiens
cctaggtggtctcataattccattt

SEQ ID NO: 10550 - DNA, 20 bp, Homo sapiens
ctttcccctaggtggtctca

SEQ ID NO: 10551 - DNA, 23 bp, Homo sapiens
taggtcctagcagaaggcattga

SEQ ID NO: 10552 - DNA, 24 bp, Homo sapiens
ggacaatccaaagcatggttcttc

SEQ ID NO: 10553 - DNA, 24 bp, Homo sapiens
ttcttcgggagcgagctgttctca

SEQ ID NO: 10554 - DNA, 19 bp, Homo sapiens
aaatctgatatattacaca

SEQ ID NO: 10555 - DNA, 18 bp, Homo sapiens
ctcgcctcccccattcca

SEQ ID NO: 10556 - DNA, 18 bp, Homo sapiens
gaaatctttctccctagc

SEQ ID NO: 10557 - DNA, 20 bp, Homo sapiens
gccgcggcacccctgaggcc

SEQ ID NO: 10558 - DNA, 18 bp, Homo sapiens
gcggcggcggacgtgcgc

SEQ ID NO: 10559 - DNA, 21 bp, Homo sapiens
agccaggtaccttctcacctg

SEQ ID NO: 10560 - DNA, 20 bp, Homo sapiens
gaaggtgctgataccttcaa

SEQ ID NO: 10561 - DNA, 19 bp, Homo sapiens
cgcgcggccccgcgctgct

SEQ ID NO: 10562 - DNA, 20 bp, Homo sapiens
cggggtctccctgtgttacc

SEQ ID NO: 10563 - DNA, 22 bp, Homo sapiens
ctcaagctatccttgcacctca

SEQ ID NO: 10564 - DNA, 23 bp, Homo sapiens
ctttttggaattgtcttgatttt

SEQ ID NO: 10565 - DNA, 19 bp, Homo sapiens
tcacccagcaccttgcaga

SEQ ID NO: 10566 - DNA, 18 bp, Homo sapiens
tgcccagctccccaactc

SEQ ID NO: 10567 - DNA, 18 bp, Homo sapiens
tttcaacttttgacaatc

SEQ ID NO: 10568 - DNA, 16 bp, Homo sapiens
gaggaaaaagaagcaa

SEQ ID NO: 10569 - DNA, 18 bp, Homo sapiens
gtttctaatatctagcaa

SEQ ID NO: 10570 - DNA, 16 bp, Homo sapiens
gttttggtttgtacag

SEQ ID NO: 10571 - DNA, 18 bp, Homo sapiens
accaagatcaagcagaga

SEQ ID NO: 10572 - DNA, 16 bp, Homo sapiens
cgcctctcccacctcc

SEQ ID NO: 10573 - DNA, 18 bp, Homo sapiens
tttgtttggttttctcgg

SEQ ID NO: 10574 - DNA, 19 bp, Homo sapiens
aatggaagccaacacatca

SEQ ID NO: 10575 - DNA, 20 bp, Homo sapiens
acatactttatttcttctta

SEQ ID NO: 10576 - DNA, 15 bp, Homo sapiens
gattttaacagctct

SEQ ID NO: 10577 - DNA, 17 bp, Homo sapiens
gctgaagacttttgtta

SEQ ID NO: 10578 - DNA, 18 bp, Homo sapiens
tctctactaaaaatacaa

SEQ ID NO: 10579 - DNA, 20 bp, Homo sapiens
tctcttcctgagccttaact

SEQ ID NO: 10580 - DNA, 17 bp, Homo sapiens
tgatgtgatctatgaag

SEQ ID NO: 10581 - DNA, 20 bp, Homo sapiens
tggggcccggagtgaggctg

SEQ ID NO: 10582 - DNA, 18 bp, Homo sapiens
tgggtggatcacttgagg

SEQ ID NO: 10583 - DNA, 24 bp, Homo sapiens
cttttgtcagctgagcagtttgtg

SEQ ID NO: 10584 - DNA, 20 bp, Homo sapiens
gcacagggaccccccaccca

SEQ ID NO: 10585 - DNA, 22 bp, Homo sapiens
ttttttcccctttgccttgatc

SEQ ID NO: 10586 - DNA, 23 bp, Homo sapiens
ccgttcagttctcctgggctcca

SEQ ID NO: 10587 - DNA, 18 bp, Homo sapiens
cgggagggaacatcctgc

SEQ ID NO: 10588 - DNA, 18 bp, Homo sapiens
ctgttgcaggcaaatgta

SEQ ID NO: 10589 - DNA, 18 bp, Homo sapiens
gccacagaagatgtcatg

SEQ ID NO: 10590 - DNA, 21 bp, Homo sapiens
tgaatgagacaaaagcagtgg

SEQ ID NO: 10591 - DNA, 18 bp, Homo sapiens
tcacctgctagtaggacg

SEQ ID NO: 10592 - DNA, 18 bp, Homo sapiens
agttctgttgaaatctca

SEQ ID NO: 10593 - DNA, 24 bp, Homo sapiens
gactattcaataccatactgaaga

SEQ ID NO: 10594 - DNA, 24 bp, Homo sapiens
tctaaatgtaggaaggcctgtgaa

SEQ ID NO: 10595 - DNA, 18 bp, Homo sapiens
tgaaactgtagtatcata

SEQ ID NO: 10596 - DNA, 18 bp, Homo sapiens
tgactattcaataccata

SEQ ID NO: 10597 - DNA, 22 bp, Homo sapiens
tttaagtgagtatttgttccaa

SEQ ID NO: 10598 - DNA, 19 bp, Homo sapiens
aagatattgatggccacta

SEQ ID NO: 10599 - DNA, 24 bp, Homo sapiens
aagcaagatattgatggccactaa

SEQ ID NO: 10600 - DNA, 17 bp, Homo sapiens
ttggatatacctagatt

SEQ ID NO: 10601 - DNA, 19 bp, Homo sapiens
gaagaagtgttgattgcca

SEQ ID NO: 10602 - DNA, 22 bp, Homo sapiens
tgctgtactgcaatatttggat

SEQ ID NO: 10603 - DNA, 21 bp, Homo sapiens
cacacccacacacatctatct

SEQ ID NO: 10604 - DNA, 19 bp, Homo sapiens
acatttagtaccctgcagg

SEQ ID NO: 10605 - DNA, 18 bp, Homo sapiens
accaagggccctcactca

SEQ ID NO: 10606 - DNA, 18 bp, Homo sapiens
cagtcacctcctgctcct

SEQ ID NO: 10607 - DNA, 21 bp, Homo sapiens
ccaggctccctgaccaccctg

SEQ ID NO: 10608 - DNA, 21 bp, Homo sapiens
ccttcccccgcctttcttccc

SEQ ID NO: 10609 - DNA, 17 bp, Homo sapiens
agcctaaagaaatctca

SEQ ID NO: 10610 - DNA, 22 bp, Homo sapiens
agtattactgatggtactgtta

SEQ ID NO: 10611 - DNA, 21 bp, Homo sapiens
gcagaaaactttggatgtgcc

SEQ ID NO: 10612 - DNA, 18 bp, Homo sapiens
tctggacacagacagatc

SEQ ID NO: 10613 - DNA, 19 bp, Homo sapiens
aggaaagaaaaataagcaa

SEQ ID NO: 10614 - DNA, 19 bp, Homo sapiens
catgtctgttactcacttt

SEQ ID NO: 10615 - DNA, 18 bp, Homo sapiens
gtgttaaaactgaaacac

SEQ ID NO: 10616 - DNA, 24 bp, Homo sapiens
ttttttggggggtcttggtttatg

SEQ ID NO: 10617 - DNA, 24 bp, Homo sapiens
atgaattgaacaatttaaccttga

SEQ ID NO: 10618 - DNA, 19 bp, Homo sapiens
ctctacaaaagcaaactct

SEQ ID NO: 10619 - DNA, 19 bp, Homo sapiens
aagcaattctcctgcctca

SEQ ID NO: 10620 - DNA, 20 bp, Homo sapiens
agtctcactctgttgcccag

SEQ ID NO: 10621 - DNA, 22 bp, Homo sapiens
atcttggctcactacaacctct

SEQ ID NO: 10622 - DNA, 19 bp, Homo sapiens
atgatcattgctgaactca

SEQ ID NO: 10623 - DNA, 19 bp, Homo sapiens
caaagctctctggcaccca

SEQ ID NO: 10624 - DNA, 20 bp, Homo sapiens
cctctgcctcccgggttcaa

SEQ ID NO: 10625 - DNA, 23 bp, Homo sapiens
ggaagccttcctggatttcacgc

SEQ ID NO: 10626 - DNA, 22 bp, Homo sapiens
tctcccagcttgctttagtttt

SEQ ID NO: 10627 - DNA, 21 bp, Homo sapiens
tggaagccttcctggatttca

SEQ ID NO: 10628 - DNA, 18 bp, Homo sapiens
tgtaccctcctcccctct

SEQ ID NO: 10629 - DNA, 17 bp, Homo sapiens
ttgcaaacatcagcctc

SEQ ID NO: 10630 - DNA, 23 bp, Homo sapiens
acttgaccttggccgctttgtcc

SEQ ID NO: 10631 - DNA, 18 bp, Homo sapiens
cacctgacctagcacaca

SEQ ID NO: 10632 - DNA, 20 bp, Homo sapiens
gatttaaaatggtgatgctt

SEQ ID NO: 10633 - DNA, 22 bp, Homo sapiens
gcccacgaccaaggggtcttca

SEQ ID NO: 10634 - DNA, 20 bp, Homo sapiens
gccgggcggccccctggctc

SEQ ID NO: 10635 - DNA, 19 bp, Homo sapiens
gcctttaacactaactgta

SEQ ID NO: 10636 - DNA, 21 bp, Homo sapiens
gctttgtcctaacagtccaca

SEQ ID NO: 10637 - DNA, 26 bp, Homo sapiens
tctgaagcgttattttgggtactttt

SEQ ID NO: 10638 - DNA, 20 bp, Homo sapiens
cctaggcgcggttcaggtca

SEQ ID NO: 10639 - DNA, 16 bp, Homo sapiens
ctccccaactccttcc

SEQ ID NO: 10640 - DNA, 20 bp, Homo sapiens
tggcccctccccaactcctt

SEQ ID NO: 10641 - DNA, 16 bp, Homo sapiens
agagccttggccctct

SEQ ID NO: 10642 - DNA, 18 bp, Homo sapiens
atcccaagtaaaaatttc

SEQ ID NO: 10643 - DNA, 22 bp, Homo sapiens
cagtaccagctttggtaatgtt

SEQ ID NO: 10644 - DNA, 18 bp, Homo sapiens
ccttttaacccagtgtac

SEQ ID NO: 10645 - DNA, 20 bp, Homo sapiens
gagagcaagttactgctgct

SEQ ID NO: 10646 - DNA, 22 bp, Homo sapiens
gccagaacagagaaccctgtta

SEQ ID NO: 10647 - DNA, 18 bp, Homo sapiens
gttgcactaactgctggt

SEQ ID NO: 10648 - DNA, 18 bp, Homo sapiens
tagccctaactccttaac

SEQ ID NO: 10649 - DNA, 23 bp, Homo sapiens
tctctttgtgggtttttcatctt

SEQ ID NO: 10650 - DNA, 22 bp, Homo sapiens
ttggagatcaaaatcctgcaga

SEQ ID NO: 10651 - DNA, 18 bp, Homo sapiens
atcctgaatgaacagtgg

SEQ ID NO: 10652 - DNA, 17 bp, Homo sapiens
cttcccctcctccttcc

SEQ ID NO: 10653 - DNA, 23 bp, Homo sapiens
gcctggatttgtatccttggctt

SEQ ID NO: 10654 - DNA, 21 bp, Homo sapiens
aacagtaacacacccctgctt

SEQ ID NO: 10655 - DNA, 21 bp, Homo sapiens
ctgcttgggaccctagctata

SEQ ID NO: 10656 - DNA, 20 bp, Homo sapiens
tctttaaacagttttcctta

SEQ ID NO: 10657 - DNA, 17 bp, Homo sapiens
ccgcactcccgccacca

SEQ ID NO: 10658 - DNA, 22 bp, Homo sapiens
gtgttttgtgaggtgaatgtct

SEQ ID NO: 10659 - DNA, 19 bp, Homo sapiens
tatgtttgtacacaacacc

SEQ ID NO: 10660 - DNA, 19 bp, Homo sapiens
ggctatgaacacgatatca

SEQ ID NO: 10661 - DNA, 18 bp, Homo sapiens
catcctccacgcaccccc

SEQ ID NO: 10662 - DNA, 19 bp, Homo sapiens
catgcattccccctactct

SEQ ID NO: 10663 - DNA, 15 bp, Homo sapiens
ccagccctcaccccc

SEQ ID NO: 10664 - DNA, 22 bp, Homo sapiens
cccacctatcgttggttcgcaa

SEQ ID NO: 10665 - DNA, 20 bp, Homo sapiens
gcaaagtgcaaagctttctt

SEQ ID NO: 10666 - DNA, 24 bp, Homo sapiens
gcctggacaggggctgccaggccc

SEQ ID NO: 10667 - DNA, 21 bp, Homo sapiens
gtcctgtgtaccgggcccgcc

SEQ ID NO: 10668 - DNA, 20 bp, Homo sapiens
tggccagagaggcccagggg

SEQ ID NO: 10669 - DNA, 20 bp, Homo sapiens
aatcatattacaagatttta

SEQ ID NO: 10670 - DNA, 19 bp, Homo sapiens
gagcctattacaagtctca

SEQ ID NO: 10671 - DNA, 21 bp, Homo sapiens
ggtggatggggaggatggttg

SEQ ID NO: 10672 - DNA, 24 bp, Homo sapiens
gtatctaccagtgtcattcaatta

SEQ ID NO: 10673 - DNA, 22 bp, Homo sapiens
ttgaacagatatttgtacacca

SEQ ID NO: 10674 - DNA, 22 bp, Homo sapiens
ctcacagcctgaagctcatcct

SEQ ID NO: 10675 - DNA, 19 bp, Homo sapiens
gcgacgaggacgcattcca

SEQ ID NO: 10676 - DNA, 19 bp, Homo sapiens
tcctgatggaattgttata

SEQ ID NO: 10677 - DNA, 21 bp, Homo sapiens
tctcttctgtgtttcgatttt

SEQ ID NO: 10678 - DNA, 20 bp, Homo sapiens
tgtattaggagaaaattacc

SEQ ID NO: 10679 - DNA, 21 bp, Homo sapiens
gctgtttcctccggcataaga

SEQ ID NO: 10680 - DNA, 18 bp, Homo sapiens
acatacctaccagtatta

SEQ ID NO: 10681 - DNA, 23 bp, Homo sapiens
accaatatatagtgggtacatca

SEQ ID NO: 10682 - DNA, 21 bp, Homo sapiens
tgctacctcctcagagtttca

SEQ ID NO: 10683 - DNA, 17 bp, Homo sapiens
atggacatttcatacct

SEQ ID NO: 10684 - DNA, 18 bp, Homo sapiens
cctgaaatgttgtgtaga

SEQ ID NO: 10685 - DNA, 18 bp, Homo sapiens
ctgtgatttttgttttta

SEQ ID NO: 10686 - DNA, 21 bp, Homo sapiens
tgagtggtcaccaggcttgca

SEQ ID NO: 10687 - DNA, 20 bp, Homo sapiens
aaaagcaaactaacaaagaa

SEQ ID NO: 10688 - DNA, 26 bp, Homo sapiens
ataactttctctttaagcctctgcta

SEQ ID NO: 10689 - DNA, 18 bp, Homo sapiens
atttattcagctacatca

SEQ ID NO: 10690 - DNA, 20 bp, Homo sapiens
caatcttgcctgccttctgg

SEQ ID NO: 10691 - DNA, 21 bp, Homo sapiens
caccccatcaggcacgtgtgc

SEQ ID NO: 10692 - DNA, 18 bp, Homo sapiens
cccacattactgaaacca

SEQ ID NO: 10693 - DNA, 19 bp, Homo sapiens
ccccttactcccctctgca

SEQ ID NO: 10694 - DNA, 23 bp, Homo sapiens
cccttttgtctctgggaccagac

SEQ ID NO: 10695 - DNA, 22 bp, Homo sapiens
cctctttagctctctttatctt

SEQ ID NO: 10696 - DNA, 22 bp, Homo sapiens
cctgatgtcctcaattgctgct

SEQ ID NO: 10697 - DNA, 20 bp, Homo sapiens
cctgcttcagcagcccctca

SEQ ID NO: 10698 - DNA, 18 bp, Homo sapiens
gcgcgccgccgccgtctg

SEQ ID NO: 10699 - DNA, 23 bp, Homo sapiens
gctctctttatctttctctctca

SEQ ID NO: 10700 - DNA, 23 bp, Homo sapiens
tgggtctcaggctgggctcagca

SEQ ID NO: 10701 - DNA, 17 bp, Homo sapiens
caggttataacctggta

SEQ ID NO: 10702 - DNA, 18 bp, Homo sapiens
ggttataacctggtacca

SEQ ID NO: 10703 - DNA, 22 bp, Homo sapiens
gacctcatctgtggagctgcca

SEQ ID NO: 10704 - DNA, 22 bp, Homo sapiens
acagcgatcccgggacggtcga

SEQ ID NO: 10705 - DNA, 19 bp, Homo sapiens
acaggtgggtaacccccac

SEQ ID NO: 10706 - DNA, 16 bp, Homo sapiens
cccacccaacccagct

SEQ ID NO: 10707 - DNA, 25 bp, Homo sapiens
cccttcttggaaggcagggctggac

SEQ ID NO: 10708 - DNA, 16 bp, Homo sapiens
cctcccagagcagcca

SEQ ID NO: 10709 - DNA, 19 bp, Homo sapiens
cctccccaggctttgtgag

SEQ ID NO: 10710 - DNA, 26 bp, Homo sapiens
ctggacagcagtgggaggtttgtgag

SEQ ID NO: 10711 - DNA, 19 bp, Homo sapiens
cttgggctggggcctggaa

SEQ ID NO: 10712 - DNA, 21 bp, Homo sapiens
gcagtcggaagggtttttgtt

SEQ ID NO: 10713 - DNA, 23 bp, Homo sapiens
tagttttgtagtttcttggcttt

SEQ ID NO: 10714 - DNA, 22 bp, Homo sapiens
gccaagtaaacagggtacctca

SEQ ID NO: 10715 - DNA, 27 bp, Homo sapiens
gtgccatgctgggccactggggacttt

SEQ ID NO: 10716 - DNA, 20 bp, Homo sapiens
tcccacatgaggccatctca

SEQ ID NO: 10717 - DNA, 21 bp, Homo sapiens
gagatgcagcagcttactcct

SEQ ID NO: 10718 - DNA, 20 bp, Homo sapiens
ttgggagaactgcaccgtta

SEQ ID NO: 10719 - DNA, 19 bp, Homo sapiens
cccctccccactcctctcc

SEQ ID NO: 10720 - DNA, 18 bp, Homo sapiens
cttggcagtgtttgtgag

SEQ ID NO: 10721 - DNA, 18 bp, Homo sapiens
caagaacaaggagcggac

SEQ ID NO: 10722 - DNA, 20 bp, Homo sapiens
gaagagggtgaggaagccat

SEQ ID NO: 10723 - DNA, 16 bp, Homo sapiens
aatctgtaacattact

SEQ ID NO: 10724 - DNA, 20 bp, Homo sapiens
gtggagcagccgatcgggga

SEQ ID NO: 10725 - DNA, 21 bp, Homo sapiens
tccaaacaccttgagctctct

SEQ ID NO: 10726 - DNA, 20 bp, Homo sapiens
aaacccagctcctgagtctc

SEQ ID NO: 10727 - DNA, 18 bp, Homo sapiens
aacccagctcccactctc

SEQ ID NO: 10728 - DNA, 17 bp, Homo sapiens
ctcagtgggctgcagtt

SEQ ID NO: 10729 - DNA, 21 bp, Homo sapiens
aagtgtgtgatttctctccca

SEQ ID NO: 10730 - DNA, 19 bp, Homo sapiens
acgtttgactggtgtgctg

SEQ ID NO: 10731 - DNA, 19 bp, Homo sapiens
agactaacagcagatctct

SEQ ID NO: 10732 - DNA, 17 bp, Homo sapiens
cagactccctcctgtga

SEQ ID NO: 10733 - DNA, 19 bp, Homo sapiens
cagtctagggatctggcca

SEQ ID NO: 10734 - DNA, 22 bp, Homo sapiens
ccaagttggaaaacactcttca

SEQ ID NO: 10735 - DNA, 19 bp, Homo sapiens
gaatttttctgtctttgga

SEQ ID NO: 10736 - DNA, 23 bp, Homo sapiens
aggaccgtgcagggatgccaagc

SEQ ID NO: 10737 - DNA, 19 bp, Homo sapiens
tccagcaggggatccccac

SEQ ID NO: 10738 - DNA, 20 bp, Homo sapiens
ccagggacaccgcctcccca

SEQ ID NO: 10739 - DNA, 21 bp, Homo sapiens
gagagtgtgactcccttgcca

SEQ ID NO: 10740 - DNA, 18 bp, Homo sapiens
gtccaccccggaatccca

SEQ ID NO: 10741 - DNA, 20 bp, Homo sapiens
acatttgaatgaactgtaaa

SEQ ID NO: 10742 - DNA, 21 bp, Homo sapiens
caggatttgcttctaggccca

SEQ ID NO: 10743 - DNA, 21 bp, Homo sapiens
gatccgagaacacacaagtga

SEQ ID NO: 10744 - DNA, 23 bp, Homo sapiens
cacacccactttgtccatttgca

SEQ ID NO: 10745 - DNA, 23 bp, Homo sapiens
ctgaaacctagtactgcccccca

SEQ ID NO: 10746 - DNA, 18 bp, Homo sapiens
gcactggggagtctttgt

SEQ ID NO: 10747 - DNA, 15 bp, Homo sapiens
ccttggccatgtgaa

SEQ ID NO: 10748 - DNA, 19 bp, Homo sapiens
ctagagctagcagttccca

SEQ ID NO: 10749 - DNA, 19 bp, Homo sapiens
ggggaggctcaaaccatta

SEQ ID NO: 10750 - DNA, 18 bp, Homo sapiens
tctgatgaggtttctggg

SEQ ID NO: 10751 - DNA, 17 bp, Homo sapiens
atctgaagaacagcccc

SEQ ID NO: 10752 - DNA, 21 bp, Homo sapiens
cctggcctctgcactgtgata

SEQ ID NO: 10753 - DNA, 17 bp, Homo sapiens
gcactaccaaggccgac

SEQ ID NO: 10754 - DNA, 26 bp, Homo sapiens
gcactaccaaggccgaccactagagg

SEQ ID NO: 10755 - DNA, 19 bp, Homo sapiens
gcagacagccctcctctca

SEQ ID NO: 10756 - DNA, 17 bp, Homo sapiens
gcctcggccgtctgccc

SEQ ID NO: 10757 - DNA, 19 bp, Homo sapiens
gctctggtctcccgcccca

SEQ ID NO: 10758 - DNA, 21 bp, Homo sapiens
tagggtttggggggcttggca

SEQ ID NO: 10759 - DNA, 23 bp, Homo sapiens
acaagggtattgatatgaaatta

SEQ ID NO: 10760 - DNA, 18 bp, Homo sapiens
aggtaaaaagttaacagg

SEQ ID NO: 10761 - DNA, 20 bp, Homo sapiens
caccaccgcgcgcccccgct

SEQ ID NO: 10762 - DNA, 21 bp, Homo sapiens
caccaccgcgcgcccccgctc

SEQ ID NO: 10763 - DNA, 22 bp, Homo sapiens
cctttcattttgctttaagttt

SEQ ID NO: 10764 - DNA, 18 bp, Homo sapiens
gtgtatgtgagtattctc

SEQ ID NO: 10765 - DNA, 21 bp, Homo sapiens
aacgcccccaaaatctgtttc

SEQ ID NO: 10766 - DNA, 17 bp, Homo sapiens
acttggcacggtattca

SEQ ID NO: 10767 - DNA, 22 bp, Homo sapiens
cagtattttatcgtccagaccc

SEQ ID NO: 10768 - DNA, 20 bp, Homo sapiens
tcaataccctaccacagatc

SEQ ID NO: 10769 - DNA, 22 bp, Homo sapiens
actagtaaacatatgttcctaa

SEQ ID NO: 10770 - DNA, 23 bp, Homo sapiens
atcaatggtttaacagttatcca

SEQ ID NO: 10771 - DNA, 20 bp, Homo sapiens
caatccaactgtactggcca

SEQ ID NO: 10772 - DNA, 19 bp, Homo sapiens
cacatgcacacatgtgcca

SEQ ID NO: 10773 - DNA, 18 bp, Homo sapiens
catcagtatagtgtttta

SEQ ID NO: 10774 - DNA, 20 bp, Homo sapiens
ctgcacccaccaacctgtca

SEQ ID NO: 10775 - DNA, 19 bp, Homo sapiens
gtctgtcacacatgcacac

SEQ ID NO: 10776 - DNA, 20 bp, Homo sapiens
tatgactctctgctatccca

SEQ ID NO: 10777 - DNA, 23 bp, Homo sapiens
tctgcattgagcatattttctta

SEQ ID NO: 10778 - DNA, 20 bp, Homo sapiens
cccgcccgggccccgccacc

SEQ ID NO: 10779 - DNA, 17 bp, Homo sapiens
cctcagctgacggggca

SEQ ID NO: 10780 - DNA, 16 bp, Homo sapiens
cagtaatcctaaacta

SEQ ID NO: 10781 - DNA, 20 bp, Homo sapiens
cgccgctgcccgcctcgaga

SEQ ID NO: 10782 - DNA, 19 bp, Homo sapiens
gaagggccgagcgtccgtt

SEQ ID NO: 10783 - DNA, 17 bp, Homo sapiens
gcactccagtcccatca

SEQ ID NO: 10784 - DNA, 20 bp, Homo sapiens
gggacgccaggcccgccccc

SEQ ID NO: 10785 - DNA, 22 bp, Homo sapiens
tccaataactctccccctttcc

SEQ ID NO: 10786 - DNA, 25 bp, Homo sapiens
agaatatggctacacttatacatca

SEQ ID NO: 10787 - DNA, 20 bp, Homo sapiens
agacaaatgccgtttccaca

SEQ ID NO: 10788 - DNA, 22 bp, Homo sapiens
ggagagtggcggcggcggcggc

SEQ ID NO: 10789 - DNA, 22 bp, Homo sapiens
gggtctccctttctgcctttcc

SEQ ID NO: 10790 - DNA, 18 bp, Homo sapiens
gggtggggaccgccgcca

SEQ ID NO: 10791 - DNA, 19 bp, Homo sapiens
ttctgtgaaaagggttgca

SEQ ID NO: 10792 - DNA, 21 bp, Homo sapiens
caacccaatcctctgtctcct

SEQ ID NO: 10793 - DNA, 19 bp, Homo sapiens
gcttctgttcctccgcgcc

SEQ ID NO: 10794 - DNA, 20 bp, Homo sapiens
aagatcggaacagctcctta

SEQ ID NO: 10795 - DNA, 19 bp, Homo sapiens
cgcgccgcctcgcgctctg

SEQ ID NO: 10796 - DNA, 17 bp, Homo sapiens
gggaactgacataggct

SEQ ID NO: 10797 - DNA, 24 bp, Homo sapiens
atctgagccctgcacgctgggcct

SEQ ID NO: 10798 - DNA, 18 bp, Homo sapiens
ccaagatgactgcttcag

SEQ ID NO: 10799 - DNA, 18 bp, Homo sapiens
ctgccctccccctcctct

SEQ ID NO: 10800 - DNA, 17 bp, Homo sapiens
gcagctgtcacacgcta

SEQ ID NO: 10801 - DNA, 18 bp, Homo sapiens
tgtcttcctccccggcgg

SEQ ID NO: 10802 - DNA, 18 bp, Homo sapiens
atcctcaacactattgta

SEQ ID NO: 10803 - DNA, 25 bp, Homo sapiens
cttaagtcttccttaaatgactttt

SEQ ID NO: 10804 - DNA, 24 bp, Homo sapiens
cttggcaaattttaaaacattttt

SEQ ID NO: 10805 - DNA, 22 bp, Homo sapiens
tgtttccttaaacatgaaactg

SEQ ID NO: 10806 - DNA, 21 bp, Homo sapiens
atgccacctcttcctgctccc

SEQ ID NO: 10807 - DNA, 20 bp, Homo sapiens
caaataacaaatgtgccatg

SEQ ID NO: 10808 - DNA, 19 bp, Homo sapiens
ccgtggaatggttttctta

SEQ ID NO: 10809 - DNA, 19 bp, Homo sapiens
cctcgccggcccctggtcc

SEQ ID NO: 10810 - DNA, 19 bp, Homo sapiens
cgcgccaccacacccagct

SEQ ID NO: 10811 - DNA, 18 bp, Homo sapiens
gaagggcacccccgcctc

SEQ ID NO: 10812 - DNA, 19 bp, Homo sapiens
gagcattggtgtgcattaa

SEQ ID NO: 10813 - DNA, 18 bp, Homo sapiens
tccacctcctgggttcaa

SEQ ID NO: 10814 - DNA, 20 bp, Homo sapiens
tgcaggagtgaggcatggtg

SEQ ID NO: 10815 - DNA, 17 bp, Homo sapiens
caacccctcctctctct

SEQ ID NO: 10816 - DNA, 22 bp, Homo sapiens
caacccctcctctctctgtccc

SEQ ID NO: 10817 - DNA, 17 bp, Homo sapiens
ccctccccactcctcct

SEQ ID NO: 10818 - DNA, 18 bp, Homo sapiens
gtaagcatggttcatctt

SEQ ID NO: 10819 - DNA, 18 bp, Homo sapiens
tccgccctccaggttcaa

SEQ ID NO: 10820 - DNA, 22 bp, Homo sapiens
tggagcagttaacatgtgactg

SEQ ID NO: 10821 - DNA, 23 bp, Homo sapiens
tggtgcagccaaccaacctggca

SEQ ID NO: 10822 - DNA, 18 bp, Homo sapiens
ttcaagtgattctcatgc

SEQ ID NO: 10823 - DNA, 23 bp, Homo sapiens
ttgtaaactgtggttgcctgcct

SEQ ID NO: 10824 - DNA, 20 bp, Homo sapiens
caaggggacatggagaaagc

SEQ ID NO: 10825 - DNA, 21 bp, Homo sapiens
ctgaagacctggaattcccca

SEQ ID NO: 10826 - DNA, 17 bp, Homo sapiens
cttccctgcttctgcct

SEQ ID NO: 10827 - DNA, 19 bp, Homo sapiens
ggtggatggagaggatatg

SEQ ID NO: 10828 - DNA, 21 bp, Homo sapiens
tggatggagaggatatggggc

SEQ ID NO: 10829 - DNA, 17 bp, Homo sapiens
gagcaatgccagtggcc

SEQ ID NO: 10830 - DNA, 27 bp, Homo sapiens
acctggatggggcaggccacctggctc

SEQ ID NO: 10831 - DNA, 18 bp, Homo sapiens
agtgctcaaggccagctt

SEQ ID NO: 10832 - DNA, 21 bp, Homo sapiens
ccttccccatcgttgccccca

SEQ ID NO: 10833 - DNA, 27 bp, Homo sapiens
tctttttgtagctggggctttgatgtt

SEQ ID NO: 10834 - DNA, 21 bp, Homo sapiens
ccgcgcagcgcgagcgcctca

SEQ ID NO: 10835 - DNA, 20 bp, Homo sapiens
aagagaacctcagcattgtg

SEQ ID NO: 10836 - DNA, 19 bp, Homo sapiens
tcagcattgtgcacgataa

SEQ ID NO: 10837 - DNA, 29 bp, Homo sapiens
gtctggactaaccctgtggttgcctgccc

SEQ ID NO: 10838 - DNA, 22 bp, Homo sapiens
ttcaaatggccatttttctcca

SEQ ID NO: 10839 - DNA, 20 bp, Homo sapiens
atgaaaaatacagtttgtca

SEQ ID NO: 10840 - DNA, 26 bp, Homo sapiens
gcgagagagctgctgccactgctgct

SEQ ID NO: 10841 - DNA, 15 bp, Homo sapiens
tgcaaagtcatgcaa

SEQ ID NO: 10842 - DNA, 18 bp, Homo sapiens
ttggaagttgcatggcat

SEQ ID NO: 10843 - DNA, 18 bp, Homo sapiens
ggggtcttgggcatttca

SEQ ID NO: 10844 - DNA, 21 bp, Homo sapiens
tgagtgggtctcccaagacta

SEQ ID NO: 10845 - DNA, 18 bp, Homo sapiens
ccatggacaaggcagcta

SEQ ID NO: 10846 - DNA, 20 bp, Homo sapiens
ggctcgggctaccagtccca

SEQ ID NO: 10847 - DNA, 22 bp, Homo sapiens
ggtgggtggggaggggcgcgcg

SEQ ID NO: 10848 - DNA, 19 bp, Homo sapiens
cagttttaaatcctttgcg

SEQ ID NO: 10849 - DNA, 17 bp, Homo sapiens
ggaactaaagtctgtga

SEQ ID NO: 10850 - DNA, 20 bp, Homo sapiens
gcggcgcagctgactgctgc

SEQ ID NO: 10851 - DNA, 22 bp, Homo sapiens
atgtatctgtacagtagctttc

SEQ ID NO: 10852 - DNA, 18 bp, Homo sapiens
attaccaccgactcggcc

SEQ ID NO: 10853 - DNA, 20 bp, Homo sapiens
ctgcctcaactgtctggttt

SEQ ID NO: 10854 - DNA, 20 bp, Homo sapiens
cttgtccggggggtttgagg

SEQ ID NO: 10855 - DNA, 19 bp, Homo sapiens
gattgttttagattctttc

SEQ ID NO: 10856 - DNA, 19 bp, Homo sapiens
tatcagtgccagcccaata

SEQ ID NO: 10857 - DNA, 21 bp, Homo sapiens
tctgatcgttctgaagcttgc

SEQ ID NO: 10858 - DNA, 26 bp, Homo sapiens
tgctgaagaaatccaacatcattcca

SEQ ID NO: 10859 - DNA, 19 bp, Homo sapiens
tggctgctttctctaacca

SEQ ID NO: 10860 - DNA, 18 bp, Homo sapiens
ttgttaatatccatcata

SEQ ID NO: 10861 - DNA, 17 bp, Homo sapiens
agagttcacaaaaagcc

SEQ ID NO: 10862 - DNA, 21 bp, Homo sapiens
ataagaactgtactcttctca

SEQ ID NO: 10863 - DNA, 20 bp, Homo sapiens
atttaaaacttgttgcccca

SEQ ID NO: 10864 - DNA, 18 bp, Homo sapiens
ctggacaccacctggcct

SEQ ID NO: 10865 - DNA, 20 bp, Homo sapiens
gactcttggatatgaaactg

SEQ ID NO: 10866 - DNA, 24 bp, Homo sapiens
acaggacgaatgcatattcaacac

SEQ ID NO: 10867 - DNA, 20 bp, Homo sapiens
gaacagctcatcttcaaagt

SEQ ID NO: 10868 - DNA, 19 bp, Homo sapiens
gcggaggaggggggggtac

SEQ ID NO: 10869 - DNA, 18 bp, Homo sapiens
gtggtggttcattccaca

SEQ ID NO: 10870 - DNA, 18 bp, Homo sapiens
tagaaaatgcaccaaata

SEQ ID NO: 10871 - DNA, 20 bp, Homo sapiens
tatgaattgctgtctagcct

SEQ ID NO: 10872 - DNA, 18 bp, Homo sapiens
aaaccaagccgtggcttc

SEQ ID NO: 10873 - DNA, 19 bp, Homo sapiens
aagaaataaaagcgttgca

SEQ ID NO: 10874 - DNA, 23 bp, Homo sapiens
ctgtggatttctacacccttgat

SEQ ID NO: 10875 - DNA, 16 bp, Homo sapiens
cccagaagtgtcccag

SEQ ID NO: 10876 - DNA, 17 bp, Homo sapiens
cccgcacgcaggcttcc

SEQ ID NO: 10877 - DNA, 24 bp, Homo sapiens
ggcccccgacccatcactgccaca

SEQ ID NO: 10878 - DNA, 23 bp, Homo sapiens
tttgatgcaaccaagttattttt

SEQ ID NO: 10879 - DNA, 19 bp, Homo sapiens
aaagtcaactcccctcccc

SEQ ID NO: 10880 - DNA, 19 bp, Homo sapiens
actttcatacatggatgaa

SEQ ID NO: 10881 - DNA, 17 bp, Homo sapiens
caaaaaacaaaaccact

SEQ ID NO: 10882 - DNA, 20 bp, Homo sapiens
caaaacatgttgaacatcca

SEQ ID NO: 10883 - DNA, 21 bp, Homo sapiens
cattaagaatttctgaatatg

SEQ ID NO: 10884 - DNA, 19 bp, Homo sapiens
ccattcgaaattcatgata

SEQ ID NO: 10885 - DNA, 19 bp, Homo sapiens
cctcttcgactgcctgttc

SEQ ID NO: 10886 - DNA, 22 bp, Homo sapiens
gagccaagatggcgccactgca

SEQ ID NO: 10887 - DNA, 20 bp, Homo sapiens
ggccccgggtattgacccca

SEQ ID NO: 10888 - DNA, 20 bp, Homo sapiens
ttgcttgtggtaaccattta

SEQ ID NO: 10889 - DNA, 18 bp, Homo sapiens
gcatgtcatgtattctca

SEQ ID NO: 10890 - DNA, 19 bp, Homo sapiens
tatcgtataaaaatctgct

SEQ ID NO: 10891 - DNA, 23 bp, Homo sapiens
tcaccattaaatataattggcta

SEQ ID NO: 10892 - DNA, 26 bp, Homo sapiens
tcttttcatagtcttctttgtatttt

SEQ ID NO: 10893 - DNA, 19 bp, Homo sapiens
aagcaattctcctgcctca

SEQ ID NO: 10894 - DNA, 18 bp, Homo sapiens
cctgcaacctccacctcc

SEQ ID NO: 10895 - DNA, 18 bp, Homo sapiens
tccacctcctgggttcaa

SEQ ID NO: 10896 - DNA, 18 bp, Homo sapiens
gcctgagaaaagagggta

SEQ ID NO: 10897 - DNA, 28 bp, Homo sapiens
ttgccgtggagtcgcgacctcttggccc

SEQ ID NO: 10898 - DNA, 16 bp, Homo sapiens
cccgcgccccggcccg

SEQ ID NO: 10899 - DNA, 20 bp, Homo sapiens
ttttttgggaattcaaggga

SEQ ID NO: 10900 - DNA, 21 bp, Homo sapiens
tcccactgcccccgcctctca

SEQ ID NO: 10901 - DNA, 19 bp, Homo sapiens
acagccaaattgcagaaga

SEQ ID NO: 10902 - DNA, 20 bp, Homo sapiens
acatttggctccactgtaaa

SEQ ID NO: 10903 - DNA, 19 bp, Homo sapiens
accactatcttttgttcta

SEQ ID NO: 10904 - DNA, 21 bp, Homo sapiens
ccagggcggccgggcgcccca

SEQ ID NO: 10905 - DNA, 20 bp, Homo sapiens
gattcaagtgcaatccatgt

SEQ ID NO: 10906 - DNA, 21 bp, Homo sapiens
gtagctggagagagagttctc

SEQ ID NO: 10907 - DNA, 21 bp, Homo sapiens
tcaaaagattaacaacactgc

SEQ ID NO: 10908 - DNA, 18 bp, Homo sapiens
atgcaacactgtgtccag

SEQ ID NO: 10909 - DNA, 20 bp, Homo sapiens
gcccagcatggacctggtga

SEQ ID NO: 10910 - DNA, 22 bp, Homo sapiens
ggtgttcactctcgccagctca

SEQ ID NO: 10911 - DNA, 21 bp, Homo sapiens
atgttaacaaagaataaataa

SEQ ID NO: 10912 - DNA, 17 bp, Homo sapiens
cagagccctcctgctca

SEQ ID NO: 10913 - DNA, 17 bp, Homo sapiens
cattttacacagtttta

SEQ ID NO: 10914 - DNA, 20 bp, Homo sapiens
taggacttctgtttcctggt

SEQ ID NO: 10915 - DNA, 20 bp, Homo sapiens
tttgcaagtttgccaccagt

SEQ ID NO: 10916 - DNA, 20 bp, Homo sapiens
atttgagcccagcttggctc

SEQ ID NO: 10917 - DNA, 19 bp, Homo sapiens
ccatcccactgggacattt

SEQ ID NO: 10918 - DNA, 19 bp, Homo sapiens
gcctgcctgtgtctgctga

SEQ ID NO: 10919 - DNA, 19 bp, Homo sapiens
atgtgatagagacatctct

SEQ ID NO: 10920 - DNA, 17 bp, Homo sapiens
ccttttccttctctgaa

SEQ ID NO: 10921 - DNA, 19 bp, Homo sapiens
aaagagagcactttcgaca

SEQ ID NO: 10922 - DNA, 20 bp, Homo sapiens
aggcacttctaactcacccc

SEQ ID NO: 10923 - DNA, 21 bp, Homo sapiens
ccacgcaagtaagcctgctgt

SEQ ID NO: 10924 - DNA, 19 bp, Homo sapiens
ctgcaagctctgcctccca

SEQ ID NO: 10925 - DNA, 21 bp, Homo sapiens
catgtaagctggggccgctca

SEQ ID NO: 10926 - DNA, 18 bp, Homo sapiens
ttctgtttcatatttttc

SEQ ID NO: 10927 - DNA, 17 bp, Homo sapiens
agattaatgggcattgt

SEQ ID NO: 10928 - DNA, 21 bp, Homo sapiens
cccagactttacgactacaca

SEQ ID NO: 10929 - DNA, 22 bp, Homo sapiens
gctatattcccattgctctgaa

SEQ ID NO: 10930 - DNA, 22 bp, Homo sapiens
cacttctctcctcagacttcaa

SEQ ID NO: 10931 - DNA, 18 bp, Homo sapiens
gccaatcaggactttcca

SEQ ID NO: 10932 - DNA, 18 bp, Homo sapiens
tttggcgctgacttggaa

SEQ ID NO: 10933 - DNA, 20 bp, Homo sapiens
aatatatttcacatccttct

SEQ ID NO: 10934 - DNA, 23 bp, Homo sapiens
cctcacccttgggctttgctgcc

SEQ ID NO: 10935 - DNA, 18 bp, Homo sapiens
ctgccccaatcctcccca

SEQ ID NO: 10936 - DNA, 21 bp, Homo sapiens
tccctgctcctaacccctgcc

SEQ ID NO: 10937 - DNA, 18 bp, Homo sapiens
tggtcatgttcgtggtgt

SEQ ID NO: 10938 - DNA, 19 bp, Homo sapiens
aaatcccaacatatatact

SEQ ID NO: 10939 - DNA, 22 bp, Homo sapiens
acaaagatcatatccatgtgta

SEQ ID NO: 10940 - DNA, 18 bp, Homo sapiens
cctgcaacctccacctcc

SEQ ID NO: 10941 - DNA, 18 bp, Homo sapiens
ccttgaataagtctccca

SEQ ID NO: 10942 - DNA, 22 bp, Homo sapiens
cttccattcattgtttacgctg

SEQ ID NO: 10943 - DNA, 23 bp, Homo sapiens
gacccaacttttctagtgtgcca

SEQ ID NO: 10944 - DNA, 26 bp, Homo sapiens
tccacggccactccgcctcttccctc

SEQ ID NO: 10945 - DNA, 22 bp, Homo sapiens
ccccatgctcccttctctgcca

SEQ ID NO: 10946 - DNA, 18 bp, Homo sapiens
cccccaaccccttcacca

SEQ ID NO: 10947 - DNA, 22 bp, Homo sapiens
gacggagcctctggcggctcgt

SEQ ID NO: 10948 - DNA, 19 bp, Homo sapiens
aaactcctgacctcaggtg

SEQ ID NO: 10949 - DNA, 18 bp, Homo sapiens
tccgcctcctgggttcaa

SEQ ID NO: 10950 - DNA, 17 bp, Homo sapiens
taggactacccaagtca

SEQ ID NO: 10951 - DNA, 18 bp, Homo sapiens
tggtcttaactttaggta

SEQ ID NO: 10952 - DNA, 15 bp, Homo sapiens
cagagcagagtctgg

SEQ ID NO: 10953 - DNA, 23 bp, Homo sapiens
cccaaggtcccctccacatccca

SEQ ID NO: 10954 - DNA, 18 bp, Homo sapiens
cctttggaaagccattga

SEQ ID NO: 10955 - DNA, 18 bp, Homo sapiens
gcctgctgagagccccca

SEQ ID NO: 10956 - DNA, 19 bp, Homo sapiens
gctccaggggcccttggga

SEQ ID NO: 10957 - DNA, 21 bp, Homo sapiens
agctggggcaaggggcagcca

SEQ ID NO: 10958 - DNA, 21 bp, Homo sapiens
atcttcatgtggacattgaga

SEQ ID NO: 10959 - DNA, 15 bp, Homo sapiens
gcacctgttgtgtgc

SEQ ID NO: 10960 - DNA, 21 bp, Homo sapiens
tgctgccaagttagctattgg

SEQ ID NO: 10961 - DNA, 22 bp, Homo sapiens
atttgagcctcatctctggctt

SEQ ID NO: 10962 - DNA, 20 bp, Homo sapiens
aaaatgccaagttgtcctga

SEQ ID NO: 10963 - DNA, 18 bp, Homo sapiens
aaagcagaaagtactgca

SEQ ID NO: 10964 - DNA, 19 bp, Homo sapiens
acggttgctcaacacatca

SEQ ID NO: 10965 - DNA, 19 bp, Homo sapiens
agcccgcgcgccgagcccc

SEQ ID NO: 10966 - DNA, 21 bp, Homo sapiens
ctggtgatgaccatgcacctt

SEQ ID NO: 10967 - DNA, 19 bp, Homo sapiens
gtgtcactgctggtgaact

SEQ ID NO: 10968 - DNA, 17 bp, Homo sapiens
tcaagtgattctcctgc

SEQ ID NO: 10969 - DNA, 21 bp, Homo sapiens
actggatccagagtttgccgt

SEQ ID NO: 10970 - DNA, 21 bp, Homo sapiens
tttcctgggaatccacacgtt

SEQ ID NO: 10971 - DNA, 19 bp, Homo sapiens
aggaaaattatgcccagtt

SEQ ID NO: 10972 - DNA, 23 bp, Homo sapiens
caaacactgtggttgtttggttc

SEQ ID NO: 10973 - DNA, 18 bp, Homo sapiens
cctgcttcaccgtcgtcc

SEQ ID NO: 10974 - DNA, 16 bp, Homo sapiens
cgggccagtgggcgag

SEQ ID NO: 10975 - DNA, 21 bp, Homo sapiens
gaaccctccgcaccgggtccc

SEQ ID NO: 10976 - DNA, 20 bp, Homo sapiens
gcgtctgcaccccctgcttc

SEQ ID NO: 10977 - DNA, 22 bp, Homo sapiens
tacgcttcgctaccaccagcgg

SEQ ID NO: 10978 - DNA, 17 bp, Homo sapiens
tcaaatgcaaatcttta

SEQ ID NO: 10979 - DNA, 19 bp, Homo sapiens
tctgttgacatagtaactc

SEQ ID NO: 10980 - DNA, 19 bp, Homo sapiens
tggacattaactggaactg

SEQ ID NO: 10981 - DNA, 23 bp, Homo sapiens
ttccttcttgcctgctctgtgga

SEQ ID NO: 10982 - DNA, 23 bp, Homo sapiens
atattctgctattgcagcaatta

SEQ ID NO: 10983 - DNA, 24 bp, Homo sapiens
atggttacactaaccaaaagacac

SEQ ID NO: 10984 - DNA, 19 bp, Homo sapiens
atgtgatgcttgatatttt

SEQ ID NO: 10985 - DNA, 21 bp, Homo sapiens
cacttggggagatttgccaca

SEQ ID NO: 10986 - DNA, 22 bp, Homo sapiens
ggaccctagcgacggtcgtggc

SEQ ID NO: 10987 - DNA, 17 bp, Homo sapiens
ttaaaacacctctgctt

SEQ ID NO: 10988 - DNA, 20 bp, Homo sapiens
ttctgctattgcagcaatta

SEQ ID NO: 10989 - DNA, 23 bp, Homo sapiens
tttagtataccggaattactttt

SEQ ID NO: 10990 - DNA, 19 bp, Homo sapiens
tttctgatgttgccttaat

SEQ ID NO: 10991 - DNA, 18 bp, Homo sapiens
ctgcaacaggcttgtgca

SEQ ID NO: 10992 - DNA, 23 bp, Homo sapiens
gagctgccctccttgtccaccca

SEQ ID NO: 10993 - DNA, 18 bp, Homo sapiens
ggcatttgactgaagatg

SEQ ID NO: 10994 - DNA, 20 bp, Homo sapiens
ggtcaccagcaccaacacca

SEQ ID NO: 10995 - DNA, 22 bp, Homo sapiens
tcctacccacacctctgccaga

SEQ ID NO: 10996 - DNA, 17 bp, Homo sapiens
ctgagcctgctgggccc

SEQ ID NO: 10997 - DNA, 20 bp, Homo sapiens
accgtcctcgatctgtacga

SEQ ID NO: 10998 - DNA, 18 bp, Homo sapiens
tttaagtaagttctttga

SEQ ID NO: 10999 - DNA, 22 bp, Homo sapiens
ccactacaggccccacacctgc

SEQ ID NO: 11000 - DNA, 22 bp, Homo sapiens
caagaggaccaaccgcagccca

SEQ ID NO: 11001 - DNA, 24 bp, Homo sapiens
ccctccccccgggaggcttgcgaa

SEQ ID NO: 11002 - DNA, 23 bp, Homo sapiens
gcaaagcagcctgagttattttt

SEQ ID NO: 11003 - DNA, 20 bp, Homo sapiens
gtgcgcgctgcgacacctcc

SEQ ID NO: 11004 - DNA, 17 bp, Homo sapiens
atgtggggaaacatttt

SEQ ID NO: 11005 - DNA, 23 bp, Homo sapiens
cctaccagggctttcttggcttt

SEQ ID NO: 11006 - DNA, 19 bp, Homo sapiens
ccttcgtgcctcatggaat

SEQ ID NO: 11007 - DNA, 27 bp, Homo sapiens
ctctgtgtgtgtatgtgtgtgtttata

SEQ ID NO: 11008 - DNA, 18 bp, Homo sapiens
cttcttcaatttctttca

SEQ ID NO: 11009 - DNA, 26 bp, Homo sapiens
tgaatgggtttctatatatgggtctg

SEQ ID NO: 11010 - DNA, 19 bp, Homo sapiens
gccccaccccaccatggta

SEQ ID NO: 11011 - DNA, 17 bp, Homo sapiens
tcatggctgatcagagc

SEQ ID NO: 11012 - DNA, 18 bp, Homo sapiens
gcgacgcgcccggcccgg

SEQ ID NO: 11013 - DNA, 18 bp, Homo sapiens
tgcccccaacacattcaa

SEQ ID NO: 11014 - DNA, 20 bp, Homo sapiens
tacgcgctctccctgtttag

SEQ ID NO: 11015 - DNA, 24 bp, Homo sapiens
tctttgttttcctttgctgttcct

SEQ ID NO: 11016 - DNA, 20 bp, Homo sapiens
gtatgtatttattacttgat

SEQ ID NO: 11017 - DNA, 23 bp, Homo sapiens
tttaaaagatgcacggaaagtta

SEQ ID NO: 11018 - DNA, 21 bp, Homo sapiens
gtggtaggagggtttttttta

SEQ ID NO: 11019 - DNA, 19 bp, Homo sapiens
tcctccctgctttctggtg

SEQ ID NO: 11020 - DNA, 21 bp, Homo sapiens
ccctcaaggaggactggtgga

SEQ ID NO: 11021 - DNA, 19 bp, Homo sapiens
ggtctagagcatggccagc

SEQ ID NO: 11022 - DNA, 18 bp, Homo sapiens
aagccaggtcttctctct

SEQ ID NO: 11023 - DNA, 16 bp, Homo sapiens
ccatggcctctgccag

SEQ ID NO: 11024 - DNA, 21 bp, Homo sapiens
atgagagaaacaggaaacaaa

SEQ ID NO: 11025 - DNA, 19 bp, Homo sapiens
aactcttcccctcctgctt

SEQ ID NO: 11026 - DNA, 18 bp, Homo sapiens
aggcacttgggaacttac

SEQ ID NO: 11027 - DNA, 19 bp, Homo sapiens
cagcttgcaaatacgtact

SEQ ID NO: 11028 - DNA, 20 bp, Homo sapiens
tcaaacatggttatttctgt

SEQ ID NO: 11029 - DNA, 18 bp, Homo sapiens
tgactttaactttagaca

SEQ ID NO: 11030 - DNA, 19 bp, Homo sapiens
tggttatttctgtcagtga

SEQ ID NO: 11031 - DNA, 26 bp, Homo sapiens
agttagaagtacttctgtctcactta

SEQ ID NO: 11032 - DNA, 21 bp, Homo sapiens
tacaagggcaaagacactaca

SEQ ID NO: 11033 - DNA, 19 bp, Homo sapiens
cttgatcacttgaagctca

SEQ ID NO: 11034 - DNA, 24 bp, Homo sapiens
gtatgtgtgggcttgcttagatta

SEQ ID NO: 11035 - DNA, 22 bp, Homo sapiens
tagtaaacacaaaagattgtta

SEQ ID NO: 11036 - DNA, 23 bp, Homo sapiens
tttgtaattcttgtgtcactttt

SEQ ID NO: 11037 - DNA, 20 bp, Homo sapiens
caccaccaccaccttccttc

SEQ ID NO: 11038 - DNA, 18 bp, Homo sapiens
cacacacaccagataata

SEQ ID NO: 11039 - DNA, 18 bp, Homo sapiens
tcaagactccaatagaca

SEQ ID NO: 11040 - DNA, 17 bp, Homo sapiens
tgacattacacaactca

SEQ ID NO: 11041 - DNA, 19 bp, Homo sapiens
tgatggattgatagtgaaa

SEQ ID NO: 11042 - DNA, 21 bp, Homo sapiens
agaagcgtccgtcctcgagcc

SEQ ID NO: 11043 - DNA, 18 bp, Homo sapiens
ctctcactaaagatgtta

SEQ ID NO: 11044 - DNA, 18 bp, Homo sapiens
taagtacacacaaacaaa

SEQ ID NO: 11045 - DNA, 20 bp, Homo sapiens
ctggggtgccattttgtttt

SEQ ID NO: 11046 - DNA, 20 bp, Homo sapiens
tctgaaatactctctggtgc

SEQ ID NO: 11047 - DNA, 18 bp, Homo sapiens
tccgcctcctgggttcaa

SEQ ID NO: 11048 - DNA, 18 bp, Homo sapiens
accactaattgtgtacat

SEQ ID NO: 11049 - DNA, 30 bp, Homo sapiens
atagatgaacatggtgttcaacctgtgctc

SEQ ID NO: 11050 - DNA, 21 bp, Homo sapiens
ctaagcaaacaagttggaatt

SEQ ID NO: 11051 - DNA, 18 bp, Homo sapiens
acaagaaattaccggaga

SEQ ID NO: 11052 - DNA, 22 bp, Homo sapiens
aacgaattgcatgcatgttgaa

SEQ ID NO: 11053 - DNA, 20 bp, Homo sapiens
aatgattgtgcaaaaagtca

SEQ ID NO: 11054 - DNA, 20 bp, Homo sapiens
ccagacaattctcccagtcc

SEQ ID NO: 11055 - DNA, 16 bp, Homo sapiens
ctatcatagcacagta

SEQ ID NO: 11056 - DNA, 18 bp, Homo sapiens
gtatgaacacaattgcta

SEQ ID NO: 11057 - DNA, 21 bp, Homo sapiens
tttgcttaaaacagagcccac

SEQ ID NO: 11058 - DNA, 18 bp, Homo sapiens
agtagcaccattatcccc

SEQ ID NO: 11059 - DNA, 20 bp, Homo sapiens
attgtgtcatcaagcattcc

SEQ ID NO: 11060 - DNA, 18 bp, Homo sapiens
cacagacgcttgttccag

SEQ ID NO: 11061 - DNA, 18 bp, Homo sapiens
caccaccatccccccatc

SEQ ID NO: 11062 - DNA, 23 bp, Homo sapiens
ccaccaaaagcctctcctgctga

SEQ ID NO: 11063 - DNA, 18 bp, Homo sapiens
ccccactctagacccccc

SEQ ID NO: 11064 - DNA, 16 bp, Homo sapiens
cgaggtcacggtgagt

SEQ ID NO: 11065 - DNA, 18 bp, Homo sapiens
ctgatcactgtccttgcc

SEQ ID NO: 11066 - DNA, 20 bp, Homo sapiens
gccacagtgaccgcctgccc

SEQ ID NO: 11067 - DNA, 21 bp, Homo sapiens
gcccaccacaagaggctgtga

SEQ ID NO: 11068 - DNA, 21 bp, Homo sapiens
tgcccaggctgccctgcccag

SEQ ID NO: 11069 - DNA, 19 bp, Homo sapiens
atcaggatttccgcattat

SEQ ID NO: 11070 - DNA, 19 bp, Homo sapiens
atctaatatatatattaca

SEQ ID NO: 11071 - DNA, 20 bp, Homo sapiens
gccaaatgaactaaacattg

SEQ ID NO: 11072 - DNA, 22 bp, Homo sapiens
taggaaatcacctggcttggtt

SEQ ID NO: 11073 - DNA, 20 bp, Homo sapiens
tccccggaccagccctcagt

SEQ ID NO: 11074 - DNA, 19 bp, Homo sapiens
ccaaaataaaaaccttcca

SEQ ID NO: 11075 - DNA, 21 bp, Homo sapiens
ccaggagctcaacctcatgta

SEQ ID NO: 11076 - DNA, 22 bp, Homo sapiens
gggaggcggcggcagctgcggc

SEQ ID NO: 11077 - DNA, 19 bp, Homo sapiens
taaaaaccttccaaacaaa

SEQ ID NO: 11078 - DNA, 25 bp, Homo sapiens
acaattctactgtaactacccatca

SEQ ID NO: 11079 - DNA, 17 bp, Homo sapiens
ctacctgagaccatgcc

SEQ ID NO: 11080 - DNA, 18 bp, Homo sapiens
ggaaaaaaaaaacagcaa

SEQ ID NO: 11081 - DNA, 18 bp, Homo sapiens
tcattggaatgttgcaca

SEQ ID NO: 11082 - DNA, 21 bp, Homo sapiens
aaatataggtctgcactgcaa

SEQ ID NO: 11083 - DNA, 15 bp, Homo sapiens
aacatgtaccattaa

SEQ ID NO: 11084 - DNA, 21 bp, Homo sapiens
agaagtctcctttctgtttca

SEQ ID NO: 11085 - DNA, 18 bp, Homo sapiens
agtttcactctgttgcag

SEQ ID NO: 11086 - DNA, 16 bp, Homo sapiens
atgttgtacatgagaa

SEQ ID NO: 11087 - DNA, 22 bp, Homo sapiens
ccttcccctccaccctccccca

SEQ ID NO: 11088 - DNA, 15 bp, Homo sapiens
gttcttttgttccgg

SEQ ID NO: 11089 - DNA, 18 bp, Homo sapiens
attagagatcgaagcctc

SEQ ID NO: 11090 - DNA, 18 bp, Homo sapiens
cctttctcctctcccctc

SEQ ID NO: 11091 - DNA, 18 bp, Homo sapiens
gtggaacccttgccccca

SEQ ID NO: 11092 - DNA, 16 bp, Homo sapiens
taggccacaacacccc

SEQ ID NO: 11093 - DNA, 21 bp, Homo sapiens
tcctatctccacatctctgaa

SEQ ID NO: 11094 - DNA, 20 bp, Homo sapiens
ctaatatcattttgtgactg

SEQ ID NO: 11095 - DNA, 21 bp, Homo sapiens
gcagttttgagaatcagtttt

SEQ ID NO: 11096 - DNA, 19 bp, Homo sapiens
tgtttctatctctaaatga

SEQ ID NO: 11097 - DNA, 24 bp, Homo sapiens
caacacagttttacattgccctga

SEQ ID NO: 11098 - DNA, 18 bp, Homo sapiens
ggaggcggtggctgtggc

SEQ ID NO: 11099 - DNA, 19 bp, Homo sapiens
aagcaattctcctgcctca

SEQ ID NO: 11100 - DNA, 18 bp, Homo sapiens
caaacacacgctgcaatt

SEQ ID NO: 11101 - DNA, 18 bp, Homo sapiens
gaatgtgatctgagacta

SEQ ID NO: 11102 - DNA, 23 bp, Homo sapiens
gtccagcttcagacccactcttt

SEQ ID NO: 11103 - DNA, 19 bp, Homo sapiens
tttataatttgcccttgaa

SEQ ID NO: 11104 - DNA, 22 bp, Homo sapiens
gagccaagactacgccactgca

SEQ ID NO: 11105 - DNA, 18 bp, Homo sapiens
ggaactacctgcctttca

SEQ ID NO: 11106 - DNA, 19 bp, Homo sapiens
gtaagctgagatcgctgca

SEQ ID NO: 11107 - DNA, 25 bp, Homo sapiens
tgtctaggagggatgaccccactca

SEQ ID NO: 11108 - DNA, 18 bp, Homo sapiens
tttcactttgcggagttg

SEQ ID NO: 11109 - DNA, 21 bp, Homo sapiens
tttgccttgtcaatgtattta

SEQ ID NO: 11110 - DNA, 19 bp, Homo sapiens
aaaagtaagatttcagtca

SEQ ID NO: 11111 - DNA, 20 bp, Homo sapiens
aggaaatagatggtgccccc

SEQ ID NO: 11112 - DNA, 21 bp, Homo sapiens
cacatgaccaatcatatggta

SEQ ID NO: 11113 - DNA, 18 bp, Homo sapiens
ccagaaatgctgcttcca

SEQ ID NO: 11114 - DNA, 20 bp, Homo sapiens
ccccgccgccgccccccagc

SEQ ID NO: 11115 - DNA, 22 bp, Homo sapiens
gcgctccagcagctgctgccgc

SEQ ID NO: 11116 - DNA, 18 bp, Homo sapiens
gctagggggtgtttctca

SEQ ID NO: 11117 - DNA, 20 bp, Homo sapiens
ggatcccagcacatcactgt

SEQ ID NO: 11118 - DNA, 17 bp, Homo sapiens
tggaccgtgtgaagcta

SEQ ID NO: 11119 - DNA, 23 bp, Homo sapiens
cgcctgtaatcccagccactcca

SEQ ID NO: 11120 - DNA, 20 bp, Homo sapiens
ctgcagtatttgagcaggga

SEQ ID NO: 11121 - DNA, 23 bp, Homo sapiens
tttgagcagggacagtcattttt

SEQ ID NO: 11122 - DNA, 18 bp, Homo sapiens
acccaaatgaaaatttca

SEQ ID NO: 11123 - DNA, 22 bp, Homo sapiens
cattggatttcatgccatccca

SEQ ID NO: 11124 - DNA, 18 bp, Homo sapiens
tcaggagacaacttgcac

SEQ ID NO: 11125 - DNA, 22 bp, Homo sapiens
tcttttcttctggtttaatttt

SEQ ID NO: 11126 - DNA, 22 bp, Homo sapiens
ttcaaaacaaatatttacttca

SEQ ID NO: 11127 - DNA, 18 bp, Homo sapiens
aagaagcccaccactagg

SEQ ID NO: 11128 - DNA, 20 bp, Homo sapiens
ccaaagtcactcctgttttg

SEQ ID NO: 11129 - DNA, 22 bp, Homo sapiens
gaaggaactacttcagtgcaca

SEQ ID NO: 11130 - DNA, 23 bp, Homo sapiens
tttaggatgttctggatgctttt

SEQ ID NO: 11131 - DNA, 19 bp, Homo sapiens
agcatcttgaaaagaaaaa

SEQ ID NO: 11132 - DNA, 19 bp, Homo sapiens
ccaagctaaatttgtattg

SEQ ID NO: 11133 - DNA, 19 bp, Homo sapiens
tcaaccattactcacactt

SEQ ID NO: 11134 - DNA, 20 bp, Homo sapiens
tgagtaatgccacaatggca

SEQ ID NO: 11135 - DNA, 17 bp, Homo sapiens
accgcgacggctgaggc

SEQ ID NO: 11136 - DNA, 22 bp, Homo sapiens
agccctgcccccgcgagcctcc

SEQ ID NO: 11137 - DNA, 24 bp, Homo sapiens
gttaccacctcgagacttgtctca

SEQ ID NO: 11138 - DNA, 19 bp, Homo sapiens
gaaatctctacacatttca

SEQ ID NO: 11139 - DNA, 17 bp, Homo sapiens
caccgccgccgagccgc

SEQ ID NO: 11140 - DNA, 17 bp, Homo sapiens
tgtcagaaaataccttt

SEQ ID NO: 11141 - DNA, 22 bp, Homo sapiens
attggaatctgcctcctaatga

SEQ ID NO: 11142 - DNA, 22 bp, Homo sapiens
cagaaaacaagtactatgtgat

SEQ ID NO: 11143 - DNA, 20 bp, Homo sapiens
ctgtgcttcatatttgtaca

SEQ ID NO: 11144 - DNA, 19 bp, Homo sapiens
tatgtgatgaaaacatttc

SEQ ID NO: 11145 - DNA, 19 bp, Homo sapiens
aagtgggccccaccctgcc

SEQ ID NO: 11146 - DNA, 21 bp, Homo sapiens
ccaaggggaagcagctcctca

SEQ ID NO: 11147 - DNA, 22 bp, Homo sapiens
cctgagaggcccccagatcact

SEQ ID NO: 11148 - DNA, 21 bp, Homo sapiens
cctggtgctgccgtgccccca

SEQ ID NO: 11149 - DNA, 25 bp, Homo sapiens
ctcagggaacagcagcagtgccata

SEQ ID NO: 11150 - DNA, 25 bp, Homo sapiens
ggccgtcccaaaagcggccgcttcc

SEQ ID NO: 11151 - DNA, 19 bp, Homo sapiens
gtgccttggccacaatgcg

SEQ ID NO: 11152 - DNA, 20 bp, Homo sapiens
taggattgaacagttcagtt

SEQ ID NO: 11153 - DNA, 19 bp, Homo sapiens
ttctacactgaaaatgtta

SEQ ID NO: 11154 - DNA, 19 bp, Homo sapiens
ggggatgggcccgcggctg

SEQ ID NO: 11155 - DNA, 22 bp, Homo sapiens
gtagaagtcaacttcatctgaa

SEQ ID NO: 11156 - DNA, 19 bp, Homo sapiens
taaaaacattaaaaataaa

SEQ ID NO: 11157 - DNA, 18 bp, Homo sapiens
attcccacatctacatca

SEQ ID NO: 11158 - DNA, 17 bp, Homo sapiens
ccaataaatttgtgtta

SEQ ID NO: 11159 - DNA, 18 bp, Homo sapiens
tgatggatctacttatgg

SEQ ID NO: 11160 - DNA, 21 bp, Homo sapiens
tgttgatgtacagtttctgaa

SEQ ID NO: 11161 - DNA, 18 bp, Homo sapiens
gtctacaaaatcatgata

SEQ ID NO: 11162 - DNA, 19 bp, Homo sapiens
tcttcctttccgtagcctc

SEQ ID NO: 11163 - DNA, 17 bp, Homo sapiens
tttagctcttcttttga

SEQ ID NO: 11164 - DNA, 28 bp, Homo sapiens
taaatggcatggctttgacatcaagctg

SEQ ID NO: 11165 - DNA, 19 bp, Homo sapiens
aacccatgatgaactgtga

SEQ ID NO: 11166 - DNA, 18 bp, Homo sapiens
aagaaagcagtccgatga

SEQ ID NO: 11167 - DNA, 19 bp, Homo sapiens
caaactgtgggagtgattg

SEQ ID NO: 11168 - DNA, 20 bp, Homo sapiens
cgtacagccaggcccgtgtg

SEQ ID NO: 11169 - DNA, 21 bp, Homo sapiens
ctttgtccctgccttggcttt

SEQ ID NO: 11170 - DNA, 20 bp, Homo sapiens
gcccaggtgcactgctcaca

SEQ ID NO: 11171 - DNA, 18 bp, Homo sapiens
ttgatacctttgcggtca

SEQ ID NO: 11172 - DNA, 18 bp, Homo sapiens
ttgcattgcaaagctctt

SEQ ID NO: 11173 - DNA, 21 bp, Homo sapiens
agcaactctaagactacagca

SEQ ID NO: 11174 - DNA, 25 bp, Homo sapiens
cccaaagtgcttccaaggcagaagc

SEQ ID NO: 11175 - DNA, 22 bp, Homo sapiens
ggcagtggagtcggaagggcac

SEQ ID NO: 11176 - DNA, 16 bp, Homo sapiens
ttgatgtgcctgtgaa

SEQ ID NO: 11177 - DNA, 18 bp, Homo sapiens
acttttccttccagcaaa

SEQ ID NO: 11178 - DNA, 21 bp, Homo sapiens
atttgaaatttttgtacaata

SEQ ID NO: 11179 - DNA, 16 bp, Homo sapiens
caggcctccactcccc

SEQ ID NO: 11180 - DNA, 17 bp, Homo sapiens
cttccttcccctcaggt

SEQ ID NO: 11181 - DNA, 17 bp, Homo sapiens
tcaagtgaatgaatggt

SEQ ID NO: 11182 - DNA, 21 bp, Homo sapiens
tttgggttcttgagttgtttt

SEQ ID NO: 11183 - DNA, 21 bp, Homo sapiens
ttttgggtcatgtctgttgta

SEQ ID NO: 11184 - DNA, 24 bp, Homo sapiens
atgaacccgggatgcagagcagct

SEQ ID NO: 11185 - DNA, 18 bp, Homo sapiens
cacctcagggattctgat

SEQ ID NO: 11186 - DNA, 18 bp, Homo sapiens
ccaagttcttccagcaaa

SEQ ID NO: 11187 - DNA, 22 bp, Homo sapiens
ctggcccatgtgacctttgcca

SEQ ID NO: 11188 - DNA, 22 bp, Homo sapiens
tctgagcacagtagcctggccc

SEQ ID NO: 11189 - DNA, 28 bp, Homo sapiens
atgggagcccctctcagctgtggggctg

SEQ ID NO: 11190 - DNA, 18 bp, Homo sapiens
cctggagggcactgagct

SEQ ID NO: 11191 - DNA, 19 bp, Homo sapiens
ggccctcagacctgccaca

SEQ ID NO: 11192 - DNA, 17 bp, Homo sapiens
tgccttgttccatatta

SEQ ID NO: 11193 - DNA, 18 bp, Homo sapiens
acagagtaacttcacata

SEQ ID NO: 11194 - DNA, 20 bp, Homo sapiens
agaaatgggtgtcactgctt

SEQ ID NO: 11195 - DNA, 19 bp, Homo sapiens
caacccccatgctgcctcc

SEQ ID NO: 11196 - DNA, 20 bp, Homo sapiens
cagaatgtaagattcattca

SEQ ID NO: 11197 - DNA, 22 bp, Homo sapiens
ctaatatcaacagtatatctca

SEQ ID NO: 11198 - DNA, 18 bp, Homo sapiens
gtgcagcttaatatgctg

SEQ ID NO: 11199 - DNA, 23 bp, Homo sapiens
ccaccccaccaggcaacccctga

SEQ ID NO: 11200 - DNA, 15 bp, Homo sapiens
accccaccttgcaga

SEQ ID NO: 11201 - DNA, 21 bp, Homo sapiens
tcaccaaagaagattctctta

SEQ ID NO: 11202 - DNA, 20 bp, Homo sapiens
ttctggcggcggtagatttg

SEQ ID NO: 11203 - DNA, 18 bp, Homo sapiens
tacaccatttttgagcag

SEQ ID NO: 11204 - DNA, 19 bp, Homo sapiens
ttttgataagtatctgcgg

SEQ ID NO: 11205 - DNA, 18 bp, Homo sapiens
actgaggtcaagatttca

SEQ ID NO: 11206 - DNA, 20 bp, Homo sapiens
caaactcttaatgctgtgtt

SEQ ID NO: 11207 - DNA, 20 bp, Homo sapiens
cagtcctggggagcttcaca

SEQ ID NO: 11208 - DNA, 18 bp, Homo sapiens
cccatggaggaattctga

SEQ ID NO: 11209 - DNA, 20 bp, Homo sapiens
cctttgcctcccaggtttaa

SEQ ID NO: 11210 - DNA, 23 bp, Homo sapiens
gacggggtttcaccacattcgtc

SEQ ID NO: 11211 - DNA, 19 bp, Homo sapiens
gagagggatgaagaggtga

SEQ ID NO: 11212 - DNA, 23 bp, Homo sapiens
gcaactgcccaggaaggactgtg

SEQ ID NO: 11213 - DNA, 19 bp, Homo sapiens
ggtttccctcccgatatca

SEQ ID NO: 11214 - DNA, 21 bp, Homo sapiens
acttgaataggtgcctgttct

SEQ ID NO: 11215 - DNA, 16 bp, Homo sapiens
atggagatctgttgtc

SEQ ID NO: 11216 - DNA, 16 bp, Homo sapiens
ctttctctcctctctc

SEQ ID NO: 11217 - DNA, 19 bp, Homo sapiens
ggccgggtatggtgactca

SEQ ID NO: 11218 - DNA, 21 bp, Homo sapiens
tcatttgtcaccatcttttcc

SEQ ID NO: 11219 - DNA, 21 bp, Homo sapiens
tgggtggaccacctgaggtta

SEQ ID NO: 11220 - DNA, 20 bp, Homo sapiens
ctggtggtgcagcagacatc

SEQ ID NO: 11221 - DNA, 27 bp, Homo sapiens
acaaagactcagctacttcttttctta

SEQ ID NO: 11222 - DNA, 20 bp, Homo sapiens
caaaatatatctctgctctt

SEQ ID NO: 11223 - DNA, 20 bp, Homo sapiens
tatgttgctggaacatttct

SEQ ID NO: 11224 - DNA, 19 bp, Homo sapiens
ctccccatcccgggcacac

SEQ ID NO: 11225 - DNA, 22 bp, Homo sapiens
gcttgcgggggccgcctgtcct

SEQ ID NO: 11226 - DNA, 21 bp, Homo sapiens
gcggaacggggagcctctgtc

SEQ ID NO: 11227 - DNA, 16 bp, Homo sapiens
acatcactgctgctcg

SEQ ID NO: 11228 - DNA, 16 bp, Homo sapiens
atccccaggcataaca

SEQ ID NO: 11229 - DNA, 22 bp, Homo sapiens
ccccacccactccctacagtcc

SEQ ID NO: 11230 - DNA, 20 bp, Homo sapiens
ctgcccccaatgccccgagg

SEQ ID NO: 11231 - DNA, 21 bp, Homo sapiens
tgggtgacagagcgtgagact

SEQ ID NO: 11232 - DNA, 24 bp, Homo sapiens
gcctgacagcagctggtttggtcc

SEQ ID NO: 11233 - DNA, 22 bp, Homo sapiens
tcccctacagtggttctctgga

SEQ ID NO: 11234 - DNA, 23 bp, Homo sapiens
tgaatggaggctgcaggaggctg

SEQ ID NO: 11235 - DNA, 21 bp, Homo sapiens
gagctgcgctgacagcagcca

SEQ ID NO: 11236 - DNA, 19 bp, Homo sapiens
gagaaagagaaatatatat

SEQ ID NO: 11237 - DNA, 17 bp, Homo sapiens
ttccacccttttggagc

SEQ ID NO: 11238 - DNA, 21 bp, Homo sapiens
caccctggacaagtgactgcc

SEQ ID NO: 11239 - DNA, 16 bp, Homo sapiens
tagacagtgctggaga

SEQ ID NO: 11240 - DNA, 23 bp, Homo sapiens
tgggtgtgcctggcctgggactg

SEQ ID NO: 11241 - DNA, 22 bp, Homo sapiens
acggtgtttgtgtccctgggta

SEQ ID NO: 11242 - DNA, 19 bp, Homo sapiens
agagaacattcctctgcag

SEQ ID NO: 11243 - DNA, 18 bp, Homo sapiens
gattgttctgtccagttt

SEQ ID NO: 11244 - DNA, 21 bp, Homo sapiens
ttagctacttttcagaattga

SEQ ID NO: 11245 - DNA, 18 bp, Homo sapiens
tggatcatatatattaca

SEQ ID NO: 11246 - DNA, 21 bp, Homo sapiens
aatgtccaccagacaccagcc

SEQ ID NO: 11247 - DNA, 20 bp, Homo sapiens
ccttttcttggttttaattt

SEQ ID NO: 11248 - DNA, 19 bp, Homo sapiens
gagagaacaacattcctct

SEQ ID NO: 11249 - DNA, 22 bp, Homo sapiens
gcttttcccccacatctctatg

SEQ ID NO: 11250 - DNA, 19 bp, Homo sapiens
gtaaagtaggaatgttgtg

SEQ ID NO: 11251 - DNA, 19 bp, Homo sapiens
gtacagaaaatatcactgt

SEQ ID NO: 11252 - DNA, 23 bp, Homo sapiens
acacagctatcaagtgctaagtt

SEQ ID NO: 11253 - DNA, 18 bp, Homo sapiens
caaaccaacatttggtga

SEQ ID NO: 11254 - DNA, 18 bp, Homo sapiens
tctggtgcaatctgtgaa

SEQ ID NO: 11255 - DNA, 20 bp, Homo sapiens
catcaaaaacaaaaacaatt

SEQ ID NO: 11256 - DNA, 18 bp, Homo sapiens
tgtgtgtgtgtatggttg

SEQ ID NO: 11257 - DNA, 21 bp, Homo sapiens
ctctttctcttctcaccctca

SEQ ID NO: 11258 - DNA, 18 bp, Homo sapiens
cctccccggaggctggac

SEQ ID NO: 11259 - DNA, 20 bp, Homo sapiens
gggttcctctcaatcctgca

SEQ ID NO: 11260 - DNA, 21 bp, Homo sapiens
tctccccatagccacagtgga

SEQ ID NO: 11261 - DNA, 19 bp, Homo sapiens
agtgtcaggcctttgcagt

SEQ ID NO: 11262 - DNA, 19 bp, Homo sapiens
cttctgatctagatttgaa

SEQ ID NO: 11263 - DNA, 22 bp, Homo sapiens
gcctctgggattttaccagtca

SEQ ID NO: 11264 - DNA, 15 bp, Homo sapiens
gctgccagggatccg

SEQ ID NO: 11265 - DNA, 17 bp, Homo sapiens
agaaggaagagtcagtg

SEQ ID NO: 11266 - DNA, 22 bp, Homo sapiens
tttgagtaatctcaaataatct

SEQ ID NO: 11267 - DNA, 21 bp, Homo sapiens
cttctgtctgttcttaatttt

SEQ ID NO: 11268 - DNA, 19 bp, Homo sapiens
aaagagcaccatgattcca

SEQ ID NO: 11269 - DNA, 23 bp, Homo sapiens
acagggtcataccccctccctct

SEQ ID NO: 11270 - DNA, 21 bp, Homo sapiens
ggcgggcaccccgcgagcgca

SEQ ID NO: 11271 - DNA, 23 bp, Homo sapiens
agaactttaataagcccttgaga

SEQ ID NO: 11272 - DNA, 20 bp, Homo sapiens
agtttaacacagcctgattc

SEQ ID NO: 11273 - DNA, 19 bp, Homo sapiens
atcgtaaacattcatgata

SEQ ID NO: 11274 - DNA, 18 bp, Homo sapiens
atgagccaagatcacacc

SEQ ID NO: 11275 - DNA, 22 bp, Homo sapiens
ccattaaaaaaacattttattt

SEQ ID NO: 11276 - DNA, 21 bp, Homo sapiens
cccgtctctactaaaaagaca

SEQ ID NO: 11277 - DNA, 24 bp, Homo sapiens
ctcaaaaaaaaaaaagtcatgtta

SEQ ID NO: 11278 - DNA, 22 bp, Homo sapiens
ctgttggtaaatcctctgctca

SEQ ID NO: 11279 - DNA, 23 bp, Homo sapiens
cttaagctagctcctttggcttt

SEQ ID NO: 11280 - DNA, 25 bp, Homo sapiens
ctttttcaactttttgctttgcttt

SEQ ID NO: 11281 - DNA, 22 bp, Homo sapiens
gagccaagatcacaccactgca

SEQ ID NO: 11282 - DNA, 21 bp, Homo sapiens
gcctggatacttacctggccc

SEQ ID NO: 11283 - DNA, 21 bp, Homo sapiens
gtttaacacagcctgattcaa

SEQ ID NO: 11284 - DNA, 22 bp, Homo sapiens
gttttcatactataaccaggta

SEQ ID NO: 11285 - DNA, 20 bp, Homo sapiens
tagggttatgggcagttgtt

SEQ ID NO: 11286 - DNA, 23 bp, Homo sapiens
tgagtatgagttatgtttagtca

SEQ ID NO: 11287 - DNA, 16 bp, Homo sapiens
tgtcatcagctgtgat

SEQ ID NO: 11288 - DNA, 16 bp, Homo sapiens
ttattaatttaggcct

SEQ ID NO: 11289 - DNA, 20 bp, Homo sapiens
gccaccgctccctcttccca

SEQ ID NO: 11290 - DNA, 18 bp, Homo sapiens
ctctaatttgcatgggca

SEQ ID NO: 11291 - DNA, 18 bp, Homo sapiens
tatgtgcattttgtagta

SEQ ID NO: 11292 - DNA, 18 bp, Homo sapiens
aaacagaaattacccagt

SEQ ID NO: 11293 - DNA, 22 bp, Homo sapiens
cctccccagtttgagggctgtt

SEQ ID NO: 11294 - DNA, 19 bp, Homo sapiens
gatgaactagattccctaa

SEQ ID NO: 11295 - DNA, 18 bp, Homo sapiens
tgggtggatcacctgagg

SEQ ID NO: 11296 - DNA, 27 bp, Homo sapiens
tttgggttttctgtacagattgttttt

SEQ ID NO: 11297 - DNA, 22 bp, Homo sapiens
ctccccatctgagccagcctgc

SEQ ID NO: 11298 - DNA, 19 bp, Homo sapiens
gggactgggaggctgtggc

SEQ ID NO: 11299 - DNA, 18 bp, Homo sapiens
caacgtcacccatctgta

SEQ ID NO: 11300 - DNA, 18 bp, Homo sapiens
ttccacccagtcccccca

SEQ ID NO: 11301 - DNA, 20 bp, Homo sapiens
agtatttcccaatcatgaaa

SEQ ID NO: 11302 - DNA, 18 bp, Homo sapiens
cctgcaacctccacctcc

SEQ ID NO: 11303 - DNA, 19 bp, Homo sapiens
ctgcaacctccacctccca

SEQ ID NO: 11304 - DNA, 17 bp, Homo sapiens
cttccaccgtcattttg

SEQ ID NO: 11305 - DNA, 22 bp, Homo sapiens
gagaaaggggaaatttttggtt

SEQ ID NO: 11306 - DNA, 18 bp, Homo sapiens
gcatctgcattttcccca

SEQ ID NO: 11307 - DNA, 20 bp, Homo sapiens
ggaccagcaataataccttg

SEQ ID NO: 11308 - DNA, 19 bp, Homo sapiens
ggtgctgttttacaacgtg

SEQ ID NO: 11309 - DNA, 18 bp, Homo sapiens
tccacctcccaggttcaa

SEQ ID NO: 11310 - DNA, 17 bp, Homo sapiens
tcttaaggaacacggtg

SEQ ID NO: 11311 - DNA, 20 bp, Homo sapiens
atctggagttttaaaaggct

SEQ ID NO: 11312 - DNA, 18 bp, Homo sapiens
ccagaaattctggcccag

SEQ ID NO: 11313 - DNA, 18 bp, Homo sapiens
tccgcctcccgggttcaa

SEQ ID NO: 11314 - DNA, 19 bp, Homo sapiens
acaaagtgccactacaaca

SEQ ID NO: 11315 - DNA, 24 bp, Homo sapiens
ccgttggtggtgggaggccagcgg

SEQ ID NO: 11316 - DNA, 22 bp, Homo sapiens
gtaaaggagtgtcccagttgct

SEQ ID NO: 11317 - DNA, 20 bp, Homo sapiens
gggcagcgaggcgctggccg

SEQ ID NO: 11318 - DNA, 21 bp, Homo sapiens
acctccccgggctgccggtgg

SEQ ID NO: 11319 - DNA, 20 bp, Homo sapiens
aagaaaagagatgccctgaa

SEQ ID NO: 11320 - DNA, 21 bp, Homo sapiens
atcttggctcactgcagcctc

SEQ ID NO: 11321 - DNA, 21 bp, Homo sapiens
gaaaccttttttccatggctc

SEQ ID NO: 11322 - DNA, 18 bp, Homo sapiens
tccacctcccgggttcaa

SEQ ID NO: 11323 - DNA, 15 bp, Homo sapiens
aagggtccatgtacc

SEQ ID NO: 11324 - DNA, 21 bp, Homo sapiens
acctgttttactactatggca

SEQ ID NO: 11325 - DNA, 22 bp, Homo sapiens
actttggctagttaaactcata

SEQ ID NO: 11326 - DNA, 18 bp, Homo sapiens
cctcaaattgtgcaacca

SEQ ID NO: 11327 - DNA, 20 bp, Homo sapiens
gatttaaaacatggcatctc

SEQ ID NO: 11328 - DNA, 22 bp, Homo sapiens
tctgggtaatttcatgtttatt

SEQ ID NO: 11329 - DNA, 21 bp, Homo sapiens
ttttaacatatgtgtttgaga

SEQ ID NO: 11330 - DNA, 22 bp, Homo sapiens
caaaatatctcagttggaccat

SEQ ID NO: 11331 - DNA, 18 bp, Homo sapiens
agaaaattctacctggct

SEQ ID NO: 11332 - DNA, 17 bp, Homo sapiens
catagtgccttgatttt

SEQ ID NO: 11333 - DNA, 19 bp, Homo sapiens
cctcccccaacccctctcc

SEQ ID NO: 11334 - DNA, 20 bp, Homo sapiens
tatgccttcactacaacatt

SEQ ID NO: 11335 - DNA, 27 bp, Homo sapiens
cttgagaattcatcttgagttatcttt

SEQ ID NO: 11336 - DNA, 19 bp, Homo sapiens
tctttttaagctctgtgag

SEQ ID NO: 11337 - DNA, 23 bp, Homo sapiens
accatcagacctggcctccaaga

SEQ ID NO: 11338 - DNA, 24 bp, Homo sapiens
cctggaagactcctcagttcttca

SEQ ID NO: 11339 - DNA, 18 bp, Homo sapiens
cctttgcctgaaacattg

SEQ ID NO: 11340 - DNA, 19 bp, Homo sapiens
catcagagaatgactatca

SEQ ID NO: 11341 - DNA, 17 bp, Homo sapiens
cgtcctctcctgtcacc

SEQ ID NO: 11342 - DNA, 22 bp, Homo sapiens
ttgctataaaaaaatttgtgat

SEQ ID NO: 11343 - DNA, 18 bp, Homo sapiens
agttggactcattgatgg

SEQ ID NO: 11344 - DNA, 17 bp, Homo sapiens
agtttcagtgttagata

SEQ ID NO: 11345 - DNA, 21 bp, Homo sapiens
gcattcgtactcatgctgtta

SEQ ID NO: 11346 - DNA, 16 bp, Homo sapiens
gagctacgtggagctg

SEQ ID NO: 11347 - DNA, 23 bp, Homo sapiens
ggaagagggggccatgagccggc

SEQ ID NO: 11348 - DNA, 20 bp, Homo sapiens
agcccttgaacatggcactg

SEQ ID NO: 11349 - DNA, 19 bp, Homo sapiens
ctatctctggcacctctga

SEQ ID NO: 11350 - DNA, 18 bp, Homo sapiens
gcgggggtgggtgtggtg

SEQ ID NO: 11351 - DNA, 24 bp, Homo sapiens
agacgtggacaccatctccactga

SEQ ID NO: 11352 - DNA, 19 bp, Homo sapiens
tgaagaatgattcagggta

SEQ ID NO: 11353 - DNA, 28 bp, Homo sapiens
atatagaaaatgaagagggacatcaagt

SEQ ID NO: 11354 - DNA, 16 bp, Homo sapiens
gggacatcaagtaaca

SEQ ID NO: 11355 - DNA, 19 bp, Homo sapiens
tcagaggtttcaaacattg

SEQ ID NO: 11356 - DNA, 19 bp, Homo sapiens
tgaagagggacatcaagta

SEQ ID NO: 11357 - DNA, 23 bp, Homo sapiens
gagaggcacactgtcagaggtga

SEQ ID NO: 11358 - DNA, 21 bp, Homo sapiens
acttgaattgtggaaaagctc

SEQ ID NO: 11359 - DNA, 24 bp, Homo sapiens
gcctgagcattgtttgtctggccc

SEQ ID NO: 11360 - DNA, 18 bp, Homo sapiens
tgcagcaacaaccaggct

SEQ ID NO: 11361 - DNA, 19 bp, Homo sapiens
aagtcaatttgtcagtagc

SEQ ID NO: 11362 - DNA, 21 bp, Homo sapiens
actgcaccttccctcatttca

SEQ ID NO: 11363 - DNA, 23 bp, Homo sapiens
ccctaccctgcacccacatccca

SEQ ID NO: 11364 - DNA, 19 bp, Homo sapiens
cttattcctcctcccctct

SEQ ID NO: 11365 - DNA, 17 bp, Homo sapiens
gtaaaagttctgtgaca

SEQ ID NO: 11366 - DNA, 17 bp, Homo sapiens
tgcaaattgagtttctt

SEQ ID NO: 11367 - DNA, 18 bp, Homo sapiens
aatgtaaaattcatagca

SEQ ID NO: 11368 - DNA, 18 bp, Homo sapiens
agctataatgtttccctc

SEQ ID NO: 11369 - DNA, 20 bp, Homo sapiens
attaaatttaatatactgca

SEQ ID NO: 11370 - DNA, 21 bp, Homo sapiens
tgagctataatgtttccctca

SEQ ID NO: 11371 - DNA, 20 bp, Homo sapiens
acctcaaatccacccatatg

SEQ ID NO: 11372 - DNA, 19 bp, Homo sapiens
ctaatccttctggcagatt

SEQ ID NO: 11373 - DNA, 22 bp, Homo sapiens
gacatctggaaacctctacata

SEQ ID NO: 11374 - DNA, 22 bp, Homo sapiens
gcgaccgcggcggcggcggcgg

SEQ ID NO: 11375 - DNA, 18 bp, Homo sapiens
tagttattatccagagga

SEQ ID NO: 11376 - DNA, 21 bp, Homo sapiens
tctggcagattcaaatcgttt

SEQ ID NO: 11377 - DNA, 22 bp, Homo sapiens
tggataaacaacattgagatta

SEQ ID NO: 11378 - DNA, 26 bp, Homo sapiens
tttccaatacgacactgaaatatgtg

SEQ ID NO: 11379 - DNA, 22 bp, Homo sapiens
ttttttcattgtttttaacttt

SEQ ID NO: 11380 - DNA, 18 bp, Homo sapiens
tttgattttccaagtggt

SEQ ID NO: 11381 - DNA, 21 bp, Homo sapiens
aaacctccttccctctgccca

SEQ ID NO: 11382 - DNA, 19 bp, Homo sapiens
agcatagtaactcctttca

SEQ ID NO: 11383 - DNA, 17 bp, Homo sapiens
catagctctctcctgct

SEQ ID NO: 11384 - DNA, 23 bp, Homo sapiens
cctgggggcgctcagattgcttt

SEQ ID NO: 11385 - DNA, 18 bp, Homo sapiens
gtccactgagtttccttc

SEQ ID NO: 11386 - DNA, 20 bp, Homo sapiens
agcaagttttcttccatgat

SEQ ID NO: 11387 - DNA, 21 bp, Homo sapiens
ggtggtggcggggggtcttgg

SEQ ID NO: 11388 - DNA, 19 bp, Homo sapiens
gtgggcccagggcggcctc

SEQ ID NO: 11389 - DNA, 22 bp, Homo sapiens
taaatactttagcaaaaacatt

SEQ ID NO: 11390 - DNA, 17 bp, Homo sapiens
tttgcaaactgatgtta

SEQ ID NO: 11391 - DNA, 21 bp, Homo sapiens
aaaaaaattacaaaccaagaa

SEQ ID NO: 11392 - DNA, 20 bp, Homo sapiens
gaatttttggataatttgga

SEQ ID NO: 11393 - DNA, 20 bp, Homo sapiens
gggtataatgacaacagcca

SEQ ID NO: 11394 - DNA, 21 bp, Homo sapiens
acctgggggaccccctggccc

SEQ ID NO: 11395 - DNA, 21 bp, Homo sapiens
cctctttaaccccctgacctt

SEQ ID NO: 11396 - DNA, 21 bp, Homo sapiens
ctcaaggggtttctggcacct

SEQ ID NO: 11397 - DNA, 21 bp, Homo sapiens
tcctgcttcccactcatctta

SEQ ID NO: 11398 - DNA, 21 bp, Homo sapiens
cctgagtggtctggcggtttt

SEQ ID NO: 11399 - DNA, 18 bp, Homo sapiens
ctgtcagactgtctgcct

SEQ ID NO: 11400 - DNA, 25 bp, Homo sapiens
gcttgagtttctccactcttggctc

SEQ ID NO: 11401 - DNA, 20 bp, Homo sapiens
tggtttgacctgatatactc

SEQ ID NO: 11402 - DNA, 16 bp, Homo sapiens
gcccagagcccggtgg

SEQ ID NO: 11403 - DNA, 18 bp, Homo sapiens
atggaggtgctgaacaca

SEQ ID NO: 11404 - DNA, 17 bp, Homo sapiens
catcacgttttttctga

SEQ ID NO: 11405 - DNA, 17 bp, Homo sapiens
gtgtagccatgtctaga

SEQ ID NO: 11406 - DNA, 20 bp, Homo sapiens
accttctagaccacatgata

SEQ ID NO: 11407 - DNA, 18 bp, Homo sapiens
catctttcgtctgcacta

SEQ ID NO: 11408 - DNA, 20 bp, Homo sapiens
gaggggggggcagcaagaga

SEQ ID NO: 11409 - DNA, 19 bp, Homo sapiens
tccctctcctttggtcaga

SEQ ID NO: 11410 - DNA, 17 bp, Homo sapiens
gcccgggtgcctgctcc

SEQ ID NO: 11411 - DNA, 23 bp, Homo sapiens
acaaagcatattaaatggcaata

SEQ ID NO: 11412 - DNA, 21 bp, Homo sapiens
atcccacctcatcccattttt

SEQ ID NO: 11413 - DNA, 17 bp, Homo sapiens
ttccaaattttaagctg

SEQ ID NO: 11414 - DNA, 19 bp, Homo sapiens
acctgcaacttatgtgcac

SEQ ID NO: 11415 - DNA, 18 bp, Homo sapiens
gccacacccaagatcacc

SEQ ID NO: 11416 - DNA, 18 bp, Homo sapiens
agaaaattcataacgtgt

SEQ ID NO: 11417 - DNA, 25 bp, Homo sapiens
tgaatgtgttttttaaatggaacta

SEQ ID NO: 11418 - DNA, 18 bp, Homo sapiens
aatttcggatttatttca

SEQ ID NO: 11419 - DNA, 21 bp, Homo sapiens
tccaatgtggttgtccggttt

SEQ ID NO: 11420 - DNA, 18 bp, Homo sapiens
atctgattccccaagggc

SEQ ID NO: 11421 - DNA, 19 bp, Homo sapiens
ggtcccccccgccccttcc

SEQ ID NO: 11422 - DNA, 18 bp, Homo sapiens
cctttttcctccctgtag

SEQ ID NO: 11423 - DNA, 21 bp, Homo sapiens
cttatttagtcttcatagatc

SEQ ID NO: 11424 - DNA, 19 bp, Homo sapiens
gaaatgagaaacttcctcc

SEQ ID NO: 11425 - DNA, 16 bp, Homo sapiens
gcaccccttctgcccc

SEQ ID NO: 11426 - DNA, 24 bp, Homo sapiens
taggcagtcccaagacacctttca

SEQ ID NO: 11427 - DNA, 23 bp, Homo sapiens
tctagacgcccccagacacctct

SEQ ID NO: 11428 - DNA, 20 bp, Homo sapiens
tctaggcagtcccaagacac

SEQ ID NO: 11429 - DNA, 20 bp, Homo sapiens
ggagaggcaggtgagaggga

SEQ ID NO: 11430 - DNA, 18 bp, Homo sapiens
ccttcggggggcccgtgg

SEQ ID NO: 11431 - DNA, 21 bp, Homo sapiens
gccaccccccaggggtctctg

SEQ ID NO: 11432 - DNA, 17 bp, Homo sapiens
gcctaggcgcccagcga

SEQ ID NO: 11433 - DNA, 23 bp, Homo sapiens
aaaactcagagagggtcttcgtt

SEQ ID NO: 11434 - DNA, 23 bp, Homo sapiens
cactttgaggaacaatccccttt

SEQ ID NO: 11435 - DNA, 18 bp, Homo sapiens
ccaccgccggcccgccca

SEQ ID NO: 11436 - DNA, 22 bp, Homo sapiens
ctgccccggcattgcatcttcc

SEQ ID NO: 11437 - DNA, 20 bp, Homo sapiens
agagctggcatatctggtca

SEQ ID NO: 11438 - DNA, 20 bp, Homo sapiens
agagtgagcaaccagctgga

SEQ ID NO: 11439 - DNA, 19 bp, Homo sapiens
atatctggtcagaactgca

SEQ ID NO: 11440 - DNA, 20 bp, Homo sapiens
gcgcccagggaggagtcagt

SEQ ID NO: 11441 - DNA, 20 bp, Homo sapiens
atggagtcccctctagggtt

SEQ ID NO: 11442 - DNA, 21 bp, Homo sapiens
gcccagaagactgcgttccag

SEQ ID NO: 11443 - DNA, 21 bp, Homo sapiens
ttgaaattatggttaacctca

SEQ ID NO: 11444 - DNA, 21 bp, Homo sapiens
ggtggacacttggcaccagct

SEQ ID NO: 11445 - DNA, 24 bp, Homo sapiens
gtgttctgtgaggttgttcggcta

SEQ ID NO: 11446 - DNA, 21 bp, Homo sapiens
aaatagtgaacttttctacgt

SEQ ID NO: 11447 - DNA, 23 bp, Homo sapiens
aagacagtttattagaaatagca

SEQ ID NO: 11448 - DNA, 24 bp, Homo sapiens
ccaacggtccaagggattacatct

SEQ ID NO: 11449 - DNA, 23 bp, Homo sapiens
cgtttcacaaaatcttttgtgaa

SEQ ID NO: 11450 - DNA, 24 bp, Homo sapiens
ctatgtatagctgtcgttagtctt

SEQ ID NO: 11451 - DNA, 21 bp, Homo sapiens
gccctctcatactatgaacat

SEQ ID NO: 11452 - DNA, 17 bp, Homo sapiens
tgactggatttccctca

SEQ ID NO: 11453 - DNA, 19 bp, Homo sapiens
tgagtctcagcaggagtta

SEQ ID NO: 11454 - DNA, 20 bp, Homo sapiens
tggacattgttgtgaaattg

SEQ ID NO: 11455 - DNA, 17 bp, Homo sapiens
tcagaataccaaaacaa

SEQ ID NO: 11456 - DNA, 17 bp, Homo sapiens
tccatccccctagctca

SEQ ID NO: 11457 - DNA, 22 bp, Homo sapiens
agctttgtacatcagcactgtt

SEQ ID NO: 11458 - DNA, 19 bp, Homo sapiens
acattcatcaccgcaaaga

SEQ ID NO: 11459 - DNA, 23 bp, Homo sapiens
gacatcctggatatgctgggaga

SEQ ID NO: 11460 - DNA, 22 bp, Homo sapiens
gaggcctgaaaaaagccacaca

SEQ ID NO: 11461 - DNA, 17 bp, Homo sapiens
ccactggagatgctggg

SEQ ID NO: 11462 - DNA, 18 bp, Homo sapiens
cctgataccatctgccag

SEQ ID NO: 11463 - DNA, 24 bp, Homo sapiens
cctcccgagggaaccttcttccca

SEQ ID NO: 11464 - DNA, 18 bp, Homo sapiens
tcaagtgattcttcttgc

SEQ ID NO: 11465 - DNA, 18 bp, Homo sapiens
tccgcctcccaggttcaa

SEQ ID NO: 11466 - DNA, 19 bp, Homo sapiens
tccatgttgggggtcctaa

SEQ ID NO: 11467 - DNA, 19 bp, Homo sapiens
tctgtctttcttggcccct

SEQ ID NO: 11468 - DNA, 22 bp, Homo sapiens
tgctgcttccgagaacctcggc

SEQ ID NO: 11469 - DNA, 22 bp, Homo sapiens
cgagccgagcgcagtctgccgg

SEQ ID NO: 11470 - DNA, 20 bp, Homo sapiens
ggccgggtgcccggcccctg

SEQ ID NO: 11471 - DNA, 20 bp, Homo sapiens
atgaatattattagacagta

SEQ ID NO: 11472 - DNA, 21 bp, Homo sapiens
atgtaatagaagcttttctta

SEQ ID NO: 11473 - DNA, 17 bp, Homo sapiens
tgttatttcttgctctg

SEQ ID NO: 11474 - DNA, 21 bp, Homo sapiens
tttcctgtgaacttgtgtctc

SEQ ID NO: 11475 - DNA, 17 bp, Homo sapiens
accaaaacaaataaaga

SEQ ID NO: 11476 - DNA, 21 bp, Homo sapiens
atcttggctcactgcaacctc

SEQ ID NO: 11477 - DNA, 18 bp, Homo sapiens
tccgcctcctgggttcaa

SEQ ID NO: 11478 - DNA, 20 bp, Homo sapiens
tggccagcgtggtcttgaac

SEQ ID NO: 11479 - DNA, 18 bp, Homo sapiens
ttaaaaatgatacttaga

SEQ ID NO: 11480 - DNA, 24 bp, Homo sapiens
ctttccccaagaattatcatggaa

SEQ ID NO: 11481 - DNA, 18 bp, Homo sapiens
tcatgctgcatctatatc

SEQ ID NO: 11482 - DNA, 20 bp, Homo sapiens
ttgtgaccagccagacctca

SEQ ID NO: 11483 - DNA, 21 bp, Homo sapiens
taggtgggcccaccacttgag

SEQ ID NO: 11484 - DNA, 21 bp, Homo sapiens
agaatttaaatactgtgctta

SEQ ID NO: 11485 - DNA, 18 bp, Homo sapiens
cctctccccagatacctc

SEQ ID NO: 11486 - DNA, 24 bp, Homo sapiens
ctctcaggaatgaagatttgtgaa

SEQ ID NO: 11487 - DNA, 19 bp, Homo sapiens
aaagcttctaaagcaggta

SEQ ID NO: 11488 - DNA, 19 bp, Homo sapiens
ccaaccactgtgccactga

SEQ ID NO: 11489 - DNA, 23 bp, Homo sapiens
ccgcggctagcgccgacaaccag

SEQ ID NO: 11490 - DNA, 20 bp, Homo sapiens
gcaagaggaacctctcgcca

SEQ ID NO: 11491 - DNA, 19 bp, Homo sapiens
gcagtgatgacttgctgtc

SEQ ID NO: 11492 - DNA, 27 bp, Homo sapiens
ggtgcctcagttttccttctgttaaaa

SEQ ID NO: 11493 - DNA, 21 bp, Homo sapiens
gtaataagatggctgtggcat

SEQ ID NO: 11494 - DNA, 15 bp, Homo sapiens
tagatggaatggaaa

SEQ ID NO: 11495 - DNA, 21 bp, Homo sapiens
tccacagtgttgtgccccttc

SEQ ID NO: 11496 - DNA, 26 bp, Homo sapiens
tccacagtgttgtgccccttcactca

SEQ ID NO: 11497 - DNA, 21 bp, Homo sapiens
ttcaagccccaccacatagca

SEQ ID NO: 11498 - DNA, 25 bp, Homo sapiens
ttcaagtgacacattaatgataaac

SEQ ID NO: 11499 - DNA, 18 bp, Homo sapiens
tttggctgagacctggga

SEQ ID NO: 11500 - DNA, 22 bp, Homo sapiens
accttggatcagtggtcacctc

SEQ ID NO: 11501 - DNA, 24 bp, Homo sapiens
agttttggaaacccctgccagtga

SEQ ID NO: 11502 - DNA, 18 bp, Homo sapiens
ccactataaatatgtaga

SEQ ID NO: 11503 - DNA, 23 bp, Homo sapiens
ggactaagtgggagaaattagaa

SEQ ID NO: 11504 - DNA, 20 bp, Homo sapiens
gttttggaactgcgataact

SEQ ID NO: 11505 - DNA, 18 bp, Homo sapiens
ttttttgtttagatacca

SEQ ID NO: 11506 - DNA, 21 bp, Homo sapiens
aaagaacatattttccgttca

SEQ ID NO: 11507 - DNA, 20 bp, Homo sapiens
aagaacatattttccgttca

SEQ ID NO: 11508 - DNA, 20 bp, Homo sapiens
aaggaccaggattgcactga

SEQ ID NO: 11509 - DNA, 19 bp, Homo sapiens
agtgtgcatatatactaca

SEQ ID NO: 11510 - DNA, 18 bp, Homo sapiens
cctcaaacacacaaacta

SEQ ID NO: 11511 - DNA, 24 bp, Homo sapiens
gcctgggctctagtttcctggttt

SEQ ID NO: 11512 - DNA, 20 bp, Homo sapiens
tatggaaatataggctatgt

SEQ ID NO: 11513 - DNA, 17 bp, Homo sapiens
tgtgcatatatactaca

SEQ ID NO: 11514 - DNA, 22 bp, Homo sapiens
ttttggccctacctgtaactta

SEQ ID NO: 11515 - DNA, 21 bp, Homo sapiens
acaggtaaacagaaatccttt

SEQ ID NO: 11516 - DNA, 15 bp, Homo sapiens
accagcagtgtttaa

SEQ ID NO: 11517 - DNA, 22 bp, Homo sapiens
ccaaatacattaacaagctctt

SEQ ID NO: 11518 - DNA, 21 bp, Homo sapiens
ctctggcccacacagatctgt

SEQ ID NO: 11519 - DNA, 18 bp, Homo sapiens
ttttgcttaaagatctca

SEQ ID NO: 11520 - DNA, 19 bp, Homo sapiens
acattggtcatcttcccta

SEQ ID NO: 11521 - DNA, 19 bp, Homo sapiens
ctgcaacctccgcctccca

SEQ ID NO: 11522 - DNA, 18 bp, Homo sapiens
tccgcctcccaggttcaa

SEQ ID NO: 11523 - DNA, 19 bp, Homo sapiens
acaacccaggtgacgatgc

SEQ ID NO: 11524 - DNA, 22 bp, Homo sapiens
gctcccagacggccttggactg

SEQ ID NO: 11525 - DNA, 17 bp, Homo sapiens
ggacacagccagcccct

SEQ ID NO: 11526 - DNA, 24 bp, Homo sapiens
tcctggtattgggaggtttctggg

SEQ ID NO: 11527 - DNA, 25 bp, Homo sapiens
tctgagatagtcacaacccaggtga

SEQ ID NO: 11528 - DNA, 23 bp, Homo sapiens
aaaatgaaaatatcttcacctct

SEQ ID NO: 11529 - DNA, 20 bp, Homo sapiens
acatcttgtcaacatgcatt

SEQ ID NO: 11530 - DNA, 23 bp, Homo sapiens
caaggaaagaactactagctaca

SEQ ID NO: 11531 - DNA, 17 bp, Homo sapiens
cctgtctcctactttga

SEQ ID NO: 11532 - DNA, 15 bp, Homo sapiens
taaggaatgatccaa

SEQ ID NO: 11533 - DNA, 19 bp, Homo sapiens
tcttttgacatccagcagt

SEQ ID NO: 11534 - DNA, 18 bp, Homo sapiens
cttgggtcgcgttggtgc

SEQ ID NO: 11535 - DNA, 18 bp, Homo sapiens
aaggaaagaatggcatag

SEQ ID NO: 11536 - DNA, 21 bp, Homo sapiens
gtaagtggatcacttgccaaa

SEQ ID NO: 11537 - DNA, 21 bp, Homo sapiens
tctcttcagctcccttagctt

SEQ ID NO: 11538 - DNA, 18 bp, Homo sapiens
tcttctttcctgttagtc

SEQ ID NO: 11539 - DNA, 18 bp, Homo sapiens
agaaaggacacccggtca

SEQ ID NO: 11540 - DNA, 17 bp, Homo sapiens
agccaagacccttctgc

SEQ ID NO: 11541 - DNA, 20 bp, Homo sapiens
ggagcggcggcggctgcagg

SEQ ID NO: 11542 - DNA, 21 bp, Homo sapiens
gtcctttaagatcaaaactca

SEQ ID NO: 11543 - DNA, 21 bp, Homo sapiens
tccccacggcctgtccgggaa

SEQ ID NO: 11544 - DNA, 18 bp, Homo sapiens
tgcaaagccaagaccctt

SEQ ID NO: 11545 - DNA, 19 bp, Homo sapiens
aaaccccggacctcaggtg

SEQ ID NO: 11546 - DNA, 23 bp, Homo sapiens
attagggttggatgcccatttct

SEQ ID NO: 11547 - DNA, 19 bp, Homo sapiens
cagcaccacagagtgcttg

SEQ ID NO: 11548 - DNA, 24 bp, Homo sapiens
cttgtgtcccctcctccccctcca

SEQ ID NO: 11549 - DNA, 19 bp, Homo sapiens
gagagaatgaggctcagtt

SEQ ID NO: 11550 - DNA, 21 bp, Homo sapiens
gctgtgggcatcttctgccca

SEQ ID NO: 11551 - DNA, 18 bp, Homo sapiens
ggacacatcttgccacca

SEQ ID NO: 11552 - DNA, 19 bp, Homo sapiens
tcccaggtcagtagaccaa

SEQ ID NO: 11553 - DNA, 20 bp, Homo sapiens
tctgggtagttctagaggat

SEQ ID NO: 11554 - DNA, 17 bp, Homo sapiens
tgcctcccacattcttc

SEQ ID NO: 11555 - DNA, 23 bp, Homo sapiens
tgctgtggaacacataagcccca

SEQ ID NO: 11556 - DNA, 19 bp, Homo sapiens
agtccatctccctcatctc

SEQ ID NO: 11557 - DNA, 22 bp, Homo sapiens
tcatctccattctcagtttctt

SEQ ID NO: 11558 - DNA, 18 bp, Homo sapiens
tgtgtttgtcatttctga

SEQ ID NO: 11559 - DNA, 23 bp, Homo sapiens
ttactgagaacacccaataccca

SEQ ID NO: 11560 - DNA, 21 bp, Homo sapiens
tttctcccgttgttttacctt

SEQ ID NO: 11561 - DNA, 15 bp, Homo sapiens
aatgaaagcgatgag

SEQ ID NO: 11562 - DNA, 21 bp, Homo sapiens
acttgggttgaggctgggttc

SEQ ID NO: 11563 - DNA, 20 bp, Homo sapiens
tcttgcattggaggtcccag

SEQ ID NO: 11564 - DNA, 19 bp, Homo sapiens
tgacctgttcttagagcaa

SEQ ID NO: 11565 - DNA, 18 bp, Homo sapiens
agcaattctcctgcctca

SEQ ID NO: 11566 - DNA, 20 bp, Homo sapiens
gccagacccctgggcacctc

SEQ ID NO: 11567 - DNA, 17 bp, Homo sapiens
gtggatggaaggggctg

SEQ ID NO: 11568 - DNA, 19 bp, Homo sapiens
tctgaaaactttgcctctg

SEQ ID NO: 11569 - DNA, 22 bp, Homo sapiens
tgagattataggcacctaccac

SEQ ID NO: 11570 - DNA, 18 bp, Homo sapiens
ttcaagtgattctcatgc

SEQ ID NO: 11571 - DNA, 22 bp, Homo sapiens
acttgttatggttgtttggacc

SEQ ID NO: 11572 - DNA, 20 bp, Homo sapiens
atcctgaggcaaagtagtga

SEQ ID NO: 11573 - DNA, 17 bp, Homo sapiens
tactggattgtgtttgt

SEQ ID NO: 11574 - DNA, 21 bp, Homo sapiens
cctgcagaccaacagcgggct

SEQ ID NO: 11575 - DNA, 18 bp, Homo sapiens
tcggggaccgtcttttga

SEQ ID NO: 11576 - DNA, 23 bp, Homo sapiens
tcttttgaagagtcagtccctcc

SEQ ID NO: 11577 - DNA, 20 bp, Homo sapiens
agatagatgttatagaaatg

SEQ ID NO: 11578 - DNA, 24 bp, Homo sapiens
atttgagttgcgaataaatgttcc

SEQ ID NO: 11579 - DNA, 24 bp, Homo sapiens
cacctatgtcatactgtctcctcc

SEQ ID NO: 11580 - DNA, 20 bp, Homo sapiens
gccattttgcagggactctg

SEQ ID NO: 11581 - DNA, 19 bp, Homo sapiens
gtaataaggtgtccagcag

SEQ ID NO: 11582 - DNA, 19 bp, Homo sapiens
ttcaaactcttgggctcaa

SEQ ID NO: 11583 - DNA, 19 bp, Homo sapiens
caaaacaaacaaagcaata

SEQ ID NO: 11584 - DNA, 26 bp, Homo sapiens
cctctttatccctcctgttttacttt

SEQ ID NO: 11585 - DNA, 19 bp, Homo sapiens
aaagatacacaaagatggg

SEQ ID NO: 11586 - DNA, 18 bp, Homo sapiens
agaacccagcaacaaacc

SEQ ID NO: 11587 - DNA, 19 bp, Homo sapiens
agaatagtggcttaccgct

SEQ ID NO: 11588 - DNA, 17 bp, Homo sapiens
agaggggctgggcccag

SEQ ID NO: 11589 - DNA, 22 bp, Homo sapiens
cctcctttttttggactttgta

SEQ ID NO: 11590 - DNA, 21 bp, Homo sapiens
cgttagtaaacttacttcata

SEQ ID NO: 11591 - DNA, 20 bp, Homo sapiens
ctgtgttcttgttttgttca

SEQ ID NO: 11592 - DNA, 19 bp, Homo sapiens
tggcccgtgcgtggggctg

SEQ ID NO: 11593 - DNA, 19 bp, Homo sapiens
ggccaaactgttcatccta

SEQ ID NO: 11594 - DNA, 21 bp, Homo sapiens
ggcccacatccctccacttct

SEQ ID NO: 11595 - DNA, 24 bp, Homo sapiens
tccagggaccatttgcccttccca

SEQ ID NO: 11596 - DNA, 18 bp, Homo sapiens
tttatgcccccaaattat

SEQ ID NO: 11597 - DNA, 21 bp, Homo sapiens
aaacacagaagaataggggga

SEQ ID NO: 11598 - DNA, 19 bp, Homo sapiens
acaagacagactccactca

SEQ ID NO: 11599 - DNA, 25 bp, Homo sapiens
atttgaagggtctggtgcctggcct

SEQ ID NO: 11600 - DNA, 20 bp, Homo sapiens
catacgtaaacaagagaggc

SEQ ID NO: 11601 - DNA, 16 bp, Homo sapiens
ctctgccaccgagttc

SEQ ID NO: 11602 - DNA, 20 bp, Homo sapiens
ttcaagaccagcctgaccaa

SEQ ID NO: 11603 - DNA, 20 bp, Homo sapiens
tgctgcgggtgttcttttgg

SEQ ID NO: 11604 - DNA, 16 bp, Homo sapiens
actgccttcttgcttt

SEQ ID NO: 11605 - DNA, 21 bp, Homo sapiens
ctccttataatagacacttca

SEQ ID NO: 11606 - DNA, 20 bp, Homo sapiens
ggagtctgtgacagccaccc

SEQ ID NO: 11607 - DNA, 24 bp, Homo sapiens
agtgagtgagttgggtgtattgtg

SEQ ID NO: 11608 - DNA, 18 bp, Homo sapiens
ccacaccgcggccgccca

SEQ ID NO: 11609 - DNA, 18 bp, Homo sapiens
tgcagtaggcggcccggg

SEQ ID NO: 11610 - DNA, 23 bp, Homo sapiens
gctctgaggtgcaacttcttcac

SEQ ID NO: 11611 - DNA, 22 bp, Homo sapiens
agagctggactcgctcatctgt

SEQ ID NO: 11612 - DNA, 21 bp, Homo sapiens
cttttcttaagatgctgtgag

SEQ ID NO: 11613 - DNA, 19 bp, Homo sapiens
gcacgtcactggcgggctc

SEQ ID NO: 11614 - DNA, 19 bp, Homo sapiens
gcagtccccagtctgacca

SEQ ID NO: 11615 - DNA, 21 bp, Homo sapiens
accacagtgccaccaagctca

SEQ ID NO: 11616 - DNA, 20 bp, Homo sapiens
gccccgggggagcctctgtc

SEQ ID NO: 11617 - DNA, 22 bp, Homo sapiens
ggaggaggaaaccggcggagca

SEQ ID NO: 11618 - DNA, 22 bp, Homo sapiens
ggccacgacgaccgccaccgcc

SEQ ID NO: 11619 - DNA, 19 bp, Homo sapiens
gtgaggagagggtggcatc

SEQ ID NO: 11620 - DNA, 18 bp, Homo sapiens
caagacactgcctaaggt

SEQ ID NO: 11621 - DNA, 20 bp, Homo sapiens
ctgggccctaggcctagccc

SEQ ID NO: 11622 - DNA, 18 bp, Homo sapiens
aacaaaaagaataaagct

SEQ ID NO: 11623 - DNA, 24 bp, Homo sapiens
ccaccattttcttctgcactccca

SEQ ID NO: 11624 - DNA, 16 bp, Homo sapiens
tctccctattagactg

SEQ ID NO: 11625 - DNA, 21 bp, Homo sapiens
tctgaacattcattgcacttt

SEQ ID NO: 11626 - DNA, 17 bp, Homo sapiens
acataggtgggtttatg

SEQ ID NO: 11627 - DNA, 20 bp, Homo sapiens
ccactctgtgcaccaaccta

SEQ ID NO: 11628 - DNA, 18 bp, Homo sapiens
agctacattaaaatctta

SEQ ID NO: 11629 - DNA, 21 bp, Homo sapiens
atcacttacaggtaccattta

SEQ ID NO: 11630 - DNA, 21 bp, Homo sapiens
ccttttcactgttatggcctt

SEQ ID NO: 11631 - DNA, 20 bp, Homo sapiens
gattgctttttttctttcag

SEQ ID NO: 11632 - DNA, 18 bp, Homo sapiens
tttattgcatacttgcac

SEQ ID NO: 11633 - DNA, 19 bp, Homo sapiens
ctgtgaccacctcattgct

SEQ ID NO: 11634 - DNA, 19 bp, Homo sapiens
tatctgtggcctatgaggc

SEQ ID NO: 11635 - DNA, 19 bp, Homo sapiens
acagctggtgccaaatagc

SEQ ID NO: 11636 - DNA, 17 bp, Homo sapiens
atgcacacggctggtca

SEQ ID NO: 11637 - DNA, 18 bp, Homo sapiens
ccacaaacggagcccctg

SEQ ID NO: 11638 - DNA, 19 bp, Homo sapiens
ccccactcctctaagacaa

SEQ ID NO: 11639 - DNA, 23 bp, Homo sapiens
ggagggggttaaggcgcaggcgg

SEQ ID NO: 11640 - DNA, 21 bp, Homo sapiens
tgtccacatccccagagccca

SEQ ID NO: 11641 - DNA, 21 bp, Homo sapiens
aacagattgccctaagcattg

SEQ ID NO: 11642 - DNA, 24 bp, Homo sapiens
acaaaagcaggtctgttttatgtc

SEQ ID NO: 11643 - DNA, 20 bp, Homo sapiens
gcattagaaactactgaaga

SEQ ID NO: 11644 - DNA, 22 bp, Homo sapiens
agggcttccctcatcttcctca

SEQ ID NO: 11645 - DNA, 20 bp, Homo sapiens
ccagaggaaagcccatctcc

SEQ ID NO: 11646 - DNA, 19 bp, Homo sapiens
gacactccagaggcccctg

SEQ ID NO: 11647 - DNA, 22 bp, Homo sapiens
gtgcctctgttggctgagctct

SEQ ID NO: 11648 - DNA, 24 bp, Homo sapiens
tgtttaaacactgaactctggtgt

SEQ ID NO: 11649 - DNA, 24 bp, Homo sapiens
atgcaacctcactatggtatgctg

SEQ ID NO: 11650 - DNA, 19 bp, Homo sapiens
cttgaccttttcgacgctt

SEQ ID NO: 11651 - DNA, 19 bp, Homo sapiens
cttttcgacgcttaacctt

SEQ ID NO: 11652 - DNA, 18 bp, Homo sapiens
gcacagggccatctgtca

SEQ ID NO: 11653 - DNA, 18 bp, Homo sapiens
gctgtctgtcaccagcta

SEQ ID NO: 11654 - DNA, 18 bp, Homo sapiens
tctccgggtgtggcctca

SEQ ID NO: 11655 - DNA, 18 bp, Homo sapiens
ttcttggtgactgtccca

SEQ ID NO: 11656 - DNA, 20 bp, Homo sapiens
aaggatgagtctacatttta

SEQ ID NO: 11657 - DNA, 21 bp, Homo sapiens
aggaagtatatgatctgactt

SEQ ID NO: 11658 - DNA, 24 bp, Homo sapiens
ctatttttcctactttgcttttga

SEQ ID NO: 11659 - DNA, 19 bp, Homo sapiens
ggaagctgcgaggattcca

SEQ ID NO: 11660 - DNA, 22 bp, Homo sapiens
gtacaaaatagctgacagtttt

SEQ ID NO: 11661 - DNA, 18 bp, Homo sapiens
aagggaaaaggggtttca

SEQ ID NO: 11662 - DNA, 17 bp, Homo sapiens
gacccaccaccacctcc

SEQ ID NO: 11663 - DNA, 19 bp, Homo sapiens
gagctcccttttccgtgga

SEQ ID NO: 11664 - DNA, 26 bp, Homo sapiens
tcccagagcgccccggggggctgcga

SEQ ID NO: 11665 - DNA, 20 bp, Homo sapiens
aaaaggtgtcttggtttgat

SEQ ID NO: 11666 - DNA, 19 bp, Homo sapiens
agaaagcacagtttgtgag

SEQ ID NO: 11667 - DNA, 23 bp, Homo sapiens
agatatttttgaccagttccttt

SEQ ID NO: 11668 - DNA, 18 bp, Homo sapiens
gttgtgtgattttttgcc

SEQ ID NO: 11669 - DNA, 21 bp, Homo sapiens
tctttttggaatcctgacctt

SEQ ID NO: 11670 - DNA, 16 bp, Homo sapiens
ttgctcaatgtaatat

SEQ ID NO: 11671 - DNA, 15 bp, Homo sapiens
ggcgacggcggcggc

SEQ ID NO: 11672 - DNA, 20 bp, Homo sapiens
ccacctgctgacctgctgtt

SEQ ID NO: 11673 - DNA, 19 bp, Homo sapiens
tcaagactcacatcccttt

SEQ ID NO: 11674 - DNA, 20 bp, Homo sapiens
ttctggcctgggaggtctgt

SEQ ID NO: 11675 - DNA, 21 bp, Homo sapiens
cagtgcacagggcttccctct

SEQ ID NO: 11676 - DNA, 19 bp, Homo sapiens
cctgcagcctgcctggctc

SEQ ID NO: 11677 - DNA, 21 bp, Homo sapiens
gatgtcttcagtgtgggactg

SEQ ID NO: 11678 - DNA, 16 bp, Homo sapiens
gcccacctccgccccc

SEQ ID NO: 11679 - DNA, 21 bp, Homo sapiens
tcatttttccacactgagcaa

SEQ ID NO: 11680 - DNA, 21 bp, Homo sapiens
tgacctaataaggccatgcaa

SEQ ID NO: 11681 - DNA, 20 bp, Homo sapiens
ttccttgcctccttctggtg

SEQ ID NO: 11682 - DNA, 16 bp, Homo sapiens
ccaattgattgactga

SEQ ID NO: 11683 - DNA, 19 bp, Homo sapiens
ccaccccaccccccacccc

SEQ ID NO: 11684 - DNA, 22 bp, Homo sapiens
cgtcctggtccgccagcacctc

SEQ ID NO: 11685 - DNA, 19 bp, Homo sapiens
tcaagagaaacgcacctgc

SEQ ID NO: 11686 - DNA, 18 bp, Homo sapiens
accacaccaggccacccc

SEQ ID NO: 11687 - DNA, 21 bp, Homo sapiens
cccatcgccccaccgcagcta

SEQ ID NO: 11688 - DNA, 18 bp, Homo sapiens
ccctgcccaccctccctc

SEQ ID NO: 11689 - DNA, 17 bp, Homo sapiens
ccggacacacctctgct

SEQ ID NO: 11690 - DNA, 21 bp, Homo sapiens
gcattcagtgcacctgcctca

SEQ ID NO: 11691 - DNA, 23 bp, Homo sapiens
gcctggcctccgatgcctggcct

SEQ ID NO: 11692 - DNA, 18 bp, Homo sapiens
gtggctatcaggagttct

SEQ ID NO: 11693 - DNA, 21 bp, Homo sapiens
tcctgtaatgttaaactcttt

SEQ ID NO: 11694 - DNA, 18 bp, Homo sapiens
tgcgttcgcctctggccc

SEQ ID NO: 11695 - DNA, 23 bp, Homo sapiens
acttgggtccaaattgttggctt

SEQ ID NO: 11696 - DNA, 19 bp, Homo sapiens
aataatggtacagatcttt

SEQ ID NO: 11697 - DNA, 20 bp, Homo sapiens
ccaaaagccataagcctgaa

SEQ ID NO: 11698 - DNA, 23 bp, Homo sapiens
tgcagcaacaaggaaatgacgca

SEQ ID NO: 11699 - DNA, 19 bp, Homo sapiens
tgccttggtttttactgct

SEQ ID NO: 11700 - DNA, 19 bp, Homo sapiens
aaaaagtgcctgtagatga

SEQ ID NO: 11701 - DNA, 18 bp, Homo sapiens
tacagcagcacgcattca

SEQ ID NO: 11702 - DNA, 21 bp, Homo sapiens
agagccggtcagattccccta

SEQ ID NO: 11703 - DNA, 17 bp, Homo sapiens
cgacccacctctgccca

SEQ ID NO: 11704 - DNA, 16 bp, Homo sapiens
aacttgaagattgtag

SEQ ID NO: 11705 - DNA, 22 bp, Homo sapiens
cccggcgtgctcggctcccaca

SEQ ID NO: 11706 - DNA, 20 bp, Homo sapiens
tcccagtggcccggcgtgct

SEQ ID NO: 11707 - DNA, 19 bp, Homo sapiens
cccccggctctgccgtgca

SEQ ID NO: 11708 - DNA, 23 bp, Homo sapiens
ggtgaagacccgtcgagctgcgg

SEQ ID NO: 11709 - DNA, 22 bp, Homo sapiens
ggcgacacggggagaacataca

SEQ ID NO: 11710 - DNA, 16 bp, Homo sapiens
tcggcccagctctgaa

SEQ ID NO: 11711 - DNA, 23 bp, Homo sapiens
ccagtgatgctaaaggttgtatt

SEQ ID NO: 11712 - DNA, 21 bp, Homo sapiens
tctaaaatagggacgtggcca

SEQ ID NO: 11713 - DNA, 18 bp, Homo sapiens
ctccatttgcacctttgg

SEQ ID NO: 11714 - DNA, 18 bp, Homo sapiens
ggccacagagcagtcatg

SEQ ID NO: 11715 - DNA, 19 bp, Homo sapiens
gggctttggcctctttgtc

SEQ ID NO: 11716 - DNA, 18 bp, Homo sapiens
tgcctgtgcaggatccgg

SEQ ID NO: 11717 - DNA, 18 bp, Homo sapiens
ttcttcatagactacttt

SEQ ID NO: 11718 - DNA, 20 bp, Homo sapiens
accacacactcaccactccc

SEQ ID NO: 11719 - DNA, 22 bp, Homo sapiens
aaagtgtctctgccttgagtca

SEQ ID NO: 11720 - DNA, 21 bp, Homo sapiens
acaaggaagaagcttgctggt

SEQ ID NO: 11721 - DNA, 22 bp, Homo sapiens
agaaagtatttgatttttgtct

SEQ ID NO: 11722 - DNA, 17 bp, Homo sapiens
agctgctctgaaatctc

SEQ ID NO: 11723 - DNA, 21 bp, Homo sapiens
ccctaaaaatccagactcttt

SEQ ID NO: 11724 - DNA, 22 bp, Homo sapiens
gactggttttgcaacgtttaca

SEQ ID NO: 11725 - DNA, 18 bp, Homo sapiens
ggtgcgaatgacagtagc

SEQ ID NO: 11726 - DNA, 22 bp, Homo sapiens
gtatatgtgaggatttttattg

SEQ ID NO: 11727 - DNA, 17 bp, Homo sapiens
tgggctcttccaacaag

SEQ ID NO: 11728 - DNA, 23 bp, Homo sapiens
atctcccccacctccccactttt

SEQ ID NO: 11729 - DNA, 22 bp, Homo sapiens
caccaccaccaccaccccttct

SEQ ID NO: 11730 - DNA, 20 bp, Homo sapiens
ccaccaccacctccaccgcc

SEQ ID NO: 11731 - DNA, 20 bp, Homo sapiens
ccaccgccaccaccacctcc

SEQ ID NO: 11732 - DNA, 20 bp, Homo sapiens
cctcccccaacctttctctc

SEQ ID NO: 11733 - DNA, 22 bp, Homo sapiens
tcctgctctcacacacaccaga

SEQ ID NO: 11734 - DNA, 22 bp, Homo sapiens
acccagagcacaggagctgcca

SEQ ID NO: 11735 - DNA, 17 bp, Homo sapiens
ccatcccctgatgccca

SEQ ID NO: 11736 - DNA, 21 bp, Homo sapiens
ccccaaggtccccccacagct

SEQ ID NO: 11737 - DNA, 19 bp, Homo sapiens
gctgtcctggcatttgtgg

SEQ ID NO: 11738 - DNA, 25 bp, Homo sapiens
aatcaagccatgtataaatgtgata

SEQ ID NO: 11739 - DNA, 19 bp, Homo sapiens
agtgccaaatgctctctca

SEQ ID NO: 11740 - DNA, 16 bp, Homo sapiens
attgacaacacagcct

SEQ ID NO: 11741 - DNA, 18 bp, Homo sapiens
cgcacgctgaagacggca

SEQ ID NO: 11742 - DNA, 30 bp, Homo sapiens
gtctctttgtacaggaactgcattgacttt

SEQ ID NO: 11743 - DNA, 18 bp, Homo sapiens
tcacttactattgttgct

SEQ ID NO: 11744 - DNA, 19 bp, Homo sapiens
cctgctccaatttccccac

SEQ ID NO: 11745 - DNA, 19 bp, Homo sapiens
cttccttctaccccaaggc

SEQ ID NO: 11746 - DNA, 30 bp, Homo sapiens
tagcaagaaatattttaatatagtgaaatg

SEQ ID NO: 11747 - DNA, 22 bp, Homo sapiens
tggaatttctagtatgagacta

SEQ ID NO: 11748 - DNA, 21 bp, Homo sapiens
atctgggcttatatctggcct

SEQ ID NO: 11749 - DNA, 20 bp, Homo sapiens
tctggctgtttgagattctc

SEQ ID NO: 11750 - DNA, 17 bp, Homo sapiens
aaccacagatagtacca

SEQ ID NO: 11751 - DNA, 16 bp, Homo sapiens
gctccccacattctct

SEQ ID NO: 11752 - DNA, 18 bp, Homo sapiens
ggcagttcaagctgttga

SEQ ID NO: 11753 - DNA, 19 bp, Homo sapiens
tgaacctagaggtgatgtg

SEQ ID NO: 11754 - DNA, 19 bp, Homo sapiens
aaggcatgaccagcaatga

SEQ ID NO: 11755 - DNA, 20 bp, Homo sapiens
atcctactgttactgatcac

SEQ ID NO: 11756 - DNA, 21 bp, Homo sapiens
tgaccattttcgctagacttc

SEQ ID NO: 11757 - DNA, 16 bp, Homo sapiens
ctctccttttatctca

SEQ ID NO: 11758 - DNA, 21 bp, Homo sapiens
cgcgccgcccgcgcgccgctg

SEQ ID NO: 11759 - DNA, 21 bp, Homo sapiens
aatagcgccctgtgcagctga

SEQ ID NO: 11760 - DNA, 18 bp, Homo sapiens
atgtctaatgtaacttct

SEQ ID NO: 11761 - DNA, 19 bp, Homo sapiens
tgcaaaatctgtgcttttt

SEQ ID NO: 11762 - DNA, 19 bp, Homo sapiens
tggactgatgctggaatta

SEQ ID NO: 11763 - DNA, 21 bp, Homo sapiens
aagaataaactgatgctatct

SEQ ID NO: 11764 - DNA, 22 bp, Homo sapiens
agaataaactgatgctatctca

SEQ ID NO: 11765 - DNA, 19 bp, Homo sapiens
aggagatcaaattacattt

SEQ ID NO: 11766 - DNA, 15 bp, Homo sapiens
gataaactgatgcta

SEQ ID NO: 11767 - DNA, 19 bp, Homo sapiens
tttgatggcccttgttgaa

SEQ ID NO: 11768 - DNA, 18 bp, Homo sapiens
caacccctgactgctcct

SEQ ID NO: 11769 - DNA, 22 bp, Homo sapiens
ccccacagtccttcccatttcc

SEQ ID NO: 11770 - DNA, 16 bp, Homo sapiens
ctgaacagttacttca

SEQ ID NO: 11771 - DNA, 17 bp, Homo sapiens
aggagggggcggggaca

SEQ ID NO: 11772 - DNA, 21 bp, Homo sapiens
cagaagaaatctggcctcgga

SEQ ID NO: 11773 - DNA, 20 bp, Homo sapiens
cccagaaaaaaaccacttgg

SEQ ID NO: 11774 - DNA, 17 bp, Homo sapiens
ctttctctcctgactca

SEQ ID NO: 11775 - DNA, 19 bp, Homo sapiens
gtgggctgaaaacatcctt

SEQ ID NO: 11776 - DNA, 21 bp, Homo sapiens
tgtggcttttcccaacacaat

SEQ ID NO: 11777 - DNA, 18 bp, Homo sapiens
catccgcgccgccgccgc

SEQ ID NO: 11778 - DNA, 24 bp, Homo sapiens
gtgcttctcatcaatgatatgtaa

SEQ ID NO: 11779 - DNA, 19 bp, Homo sapiens
gtgcttgcaaaatgtaata

SEQ ID NO: 11780 - DNA, 17 bp, Homo sapiens
tatttgaaaaggcttcc

SEQ ID NO: 11781 - DNA, 17 bp, Homo sapiens
tcctatccagccttttt

SEQ ID NO: 11782 - DNA, 19 bp, Homo sapiens
tttttctgatatatgcagt

SEQ ID NO: 11783 - DNA, 18 bp, Homo sapiens
aacagaagcaactcaaag

SEQ ID NO: 11784 - DNA, 19 bp, Homo sapiens
agacagtgctacagagcca

SEQ ID NO: 11785 - DNA, 21 bp, Homo sapiens
atgggtccccaaatgttccca

SEQ ID NO: 11786 - DNA, 21 bp, Homo sapiens
gcttgagttgtcacttggtcc

SEQ ID NO: 11787 - DNA, 22 bp, Homo sapiens
ggcgtccctgcagccccgggtg

SEQ ID NO: 11788 - DNA, 18 bp, Homo sapiens
tttgtattgatcactttt

SEQ ID NO: 11789 - DNA, 19 bp, Homo sapiens
accggtggttttctggttt

SEQ ID NO: 11790 - DNA, 20 bp, Homo sapiens
gccagccgcttcctgcctcc

SEQ ID NO: 11791 - DNA, 21 bp, Homo sapiens
cctttttgtggctaagttttg

SEQ ID NO: 11792 - DNA, 20 bp, Homo sapiens
gggagactgttgctcaacca

SEQ ID NO: 11793 - DNA, 24 bp, Homo sapiens
tcaaccatcaggaaacagttgtca

SEQ ID NO: 11794 - DNA, 24 bp, Homo sapiens
caccaccaccttttgcccccttct

SEQ ID NO: 11795 - DNA, 16 bp, Homo sapiens
gtggggagtcttgtca

SEQ ID NO: 11796 - DNA, 23 bp, Homo sapiens
taagatggtgttgggttaggtta

SEQ ID NO: 11797 - DNA, 19 bp, Homo sapiens
ttcttgcttctcatgatgc

SEQ ID NO: 11798 - DNA, 23 bp, Homo sapiens
atctgaatgattactgtctgtct

SEQ ID NO: 11799 - DNA, 19 bp, Homo sapiens
gtgattattacaccagtta

SEQ ID NO: 11800 - DNA, 19 bp, Homo sapiens
agtattgtggcatcagata

SEQ ID NO: 11801 - DNA, 18 bp, Homo sapiens
caccaaaggagacatatc

SEQ ID NO: 11802 - DNA, 21 bp, Homo sapiens
caagtgcagagttcagacttc

SEQ ID NO: 11803 - DNA, 17 bp, Homo sapiens
cactttcttcaaagcca

SEQ ID NO: 11804 - DNA, 23 bp, Homo sapiens
tcccccagatgcagggctgcagg

SEQ ID NO: 11805 - DNA, 18 bp, Homo sapiens
cagctgcaatcactagca

SEQ ID NO: 11806 - DNA, 23 bp, Homo sapiens
gctggccgcggccggtttggtct

SEQ ID NO: 11807 - DNA, 17 bp, Homo sapiens
ccatcatcatgtcctca

SEQ ID NO: 11808 - DNA, 19 bp, Homo sapiens
tcatgtatatgaacttctc

SEQ ID NO: 11809 - DNA, 22 bp, Homo sapiens
aaaacagctgcatctgttactt

SEQ ID NO: 11810 - DNA, 16 bp, Homo sapiens
cactgaccaagtgctg

SEQ ID NO: 11811 - DNA, 24 bp, Homo sapiens
tagatggaccccagcatttaagtg

SEQ ID NO: 11812 - DNA, 20 bp, Homo sapiens
tcccggcggaaagcctctgt

SEQ ID NO: 11813 - DNA, 18 bp, Homo sapiens
tgagccatgatttcccac

SEQ ID NO: 11814 - DNA, 21 bp, Homo sapiens
cccaacttagtttttcagtga

SEQ ID NO: 11815 - DNA, 19 bp, Homo sapiens
tcatttgacttctcaataa

SEQ ID NO: 11816 - DNA, 21 bp, Homo sapiens
aacacgattcgcaacgttctg

SEQ ID NO: 11817 - DNA, 18 bp, Homo sapiens
cctcctgtacttaaacac

SEQ ID NO: 11818 - DNA, 20 bp, Homo sapiens
gttaaataaacagtattaca

SEQ ID NO: 11819 - DNA, 20 bp, Homo sapiens
cagtctcagagcggagccca

SEQ ID NO: 11820 - DNA, 17 bp, Homo sapiens
cggcactccagcctggc

SEQ ID NO: 11821 - DNA, 19 bp, Homo sapiens
ctagtagaactggatccca

SEQ ID NO: 11822 - DNA, 21 bp, Homo sapiens
tggatggtgacattgaaacta

SEQ ID NO: 11823 - DNA, 19 bp, Homo sapiens
ccctctgattgataagaca

SEQ ID NO: 11824 - DNA, 26 bp, Homo sapiens
gcctgggtctggagccgtcctggcct

SEQ ID NO: 11825 - DNA, 18 bp, Homo sapiens
acatagtcccctcctatt

SEQ ID NO: 11826 - DNA, 23 bp, Homo sapiens
agcctccatacgaaagcactgtt

SEQ ID NO: 11827 - DNA, 16 bp, Homo sapiens
gattctaccacttttg

SEQ ID NO: 11828 - DNA, 18 bp, Homo sapiens
gtctggatgtgtttactg

SEQ ID NO: 11829 - DNA, 20 bp, Homo sapiens
aaggtggcaatgcttaaact

SEQ ID NO: 11830 - DNA, 21 bp, Homo sapiens
acctatgttattttgtgtaca

SEQ ID NO: 11831 - DNA, 19 bp, Homo sapiens
cccactcccctcgccaccg

SEQ ID NO: 11832 - DNA, 18 bp, Homo sapiens
ctggtcgtcgtcgccgct

SEQ ID NO: 11833 - DNA, 21 bp, Homo sapiens
cttttgttctgctttatcttt

SEQ ID NO: 11834 - DNA, 22 bp, Homo sapiens
gatttgatgtgactttttttgg

SEQ ID NO: 11835 - DNA, 20 bp, Homo sapiens
ctctcctgcagcccatctgg

SEQ ID NO: 11836 - DNA, 15 bp, Homo sapiens
cttcgccgccgcagc

SEQ ID NO: 11837 - DNA, 21 bp, Homo sapiens
gcttggctccccctcccccct

SEQ ID NO: 11838 - DNA, 21 bp, Homo sapiens
tagctgtagctcgggctgctt

SEQ ID NO: 11839 - DNA, 23 bp, Homo sapiens
gcactgaaggagaagatctgcca

SEQ ID NO: 11840 - DNA, 21 bp, Homo sapiens
caagtaaagcacaacattatg

SEQ ID NO: 11841 - DNA, 19 bp, Homo sapiens
tgtaattgcgtacaggcga

SEQ ID NO: 11842 - DNA, 19 bp, Homo sapiens
caagacacaaggcattcca

SEQ ID NO: 11843 - DNA, 22 bp, Homo sapiens
cattggcatcatcgtttctttt

SEQ ID NO: 11844 - DNA, 21 bp, Homo sapiens
ccacttccacctcttctctca

SEQ ID NO: 11845 - DNA, 17 bp, Homo sapiens
cctccttaagctgctgt

SEQ ID NO: 11846 - DNA, 16 bp, Homo sapiens
gggcccacggccacca

SEQ ID NO: 11847 - DNA, 22 bp, Homo sapiens
ccctactacactttgctagtga

SEQ ID NO: 11848 - DNA, 20 bp, Homo sapiens
cctctgcctcccgggttcaa

SEQ ID NO: 11849 - DNA, 18 bp, Homo sapiens
cctgcaacctccacctcc

SEQ ID NO: 11850 - DNA, 19 bp, Homo sapiens
ctggacagagctaaactct

SEQ ID NO: 11851 - DNA, 17 bp, Homo sapiens
tcaagcgattcttgtgc

SEQ ID NO: 11852 - DNA, 21 bp, Homo sapiens
cgtgcctccccaccaccactt

SEQ ID NO: 11853 - DNA, 23 bp, Homo sapiens
tttgatgattattggagccccag

SEQ ID NO: 11854 - DNA, 16 bp, Homo sapiens
acccagctctctctct

SEQ ID NO: 11855 - DNA, 20 bp, Homo sapiens
cctctgcctcccgggttcaa

SEQ ID NO: 11856 - DNA, 19 bp, Homo sapiens
ggctgacagatggtatgca

SEQ ID NO: 11857 - DNA, 21 bp, Homo sapiens
tcccactctcaatgctgtgac

SEQ ID NO: 11858 - DNA, 18 bp, Homo sapiens
ttctcctgcctgagcctt

SEQ ID NO: 11859 - DNA, 23 bp, Homo sapiens
ttgggccctcgcaccagcctgca

SEQ ID NO: 11860 - DNA, 24 bp, Homo sapiens
cctgggtaatgagaggtggctttt

SEQ ID NO: 11861 - DNA, 17 bp, Homo sapiens
gcctttttcccagcttc

SEQ ID NO: 11862 - DNA, 18 bp, Homo sapiens
attttgaagttatttttt

SEQ ID NO: 11863 - DNA, 24 bp, Homo sapiens
gctctcagctggaggcccctctct

SEQ ID NO: 11864 - DNA, 19 bp, Homo sapiens
ggtcatcatacatcccaca

SEQ ID NO: 11865 - DNA, 18 bp, Homo sapiens
cctgcaacctccacctcc

SEQ ID NO: 11866 - DNA, 18 bp, Homo sapiens
tccacctcctgggttcaa

SEQ ID NO: 11867 - DNA, 21 bp, Homo sapiens
tttttgtttaacaaggtaact

SEQ ID NO: 11868 - DNA, 20 bp, Homo sapiens
aacccagccctccactgcca

SEQ ID NO: 11869 - DNA, 17 bp, Homo sapiens
actggaatttactgaga

SEQ ID NO: 11870 - DNA, 18 bp, Homo sapiens
agaactggtcttctcaca

SEQ ID NO: 11871 - DNA, 18 bp, Homo sapiens
ccagcgagtttcccagga

SEQ ID NO: 11872 - DNA, 18 bp, Homo sapiens
ccaggacacctatgtcaa

SEQ ID NO: 11873 - DNA, 16 bp, Homo sapiens
ctcaggtctgctgcaa

SEQ ID NO: 11874 - DNA, 18 bp, Homo sapiens
ctcttgtaaaataaccca

SEQ ID NO: 11875 - DNA, 15 bp, Homo sapiens
gaacactagaagctc

SEQ ID NO: 11876 - DNA, 21 bp, Homo sapiens
gggcaggggtgaaactccagc

SEQ ID NO: 11877 - DNA, 18 bp, Homo sapiens
tggtcttgacttgtcata

SEQ ID NO: 11878 - DNA, 22 bp, Homo sapiens
atgtcatagaaatattgactca

SEQ ID NO: 11879 - DNA, 17 bp, Homo sapiens
cctgagcctccttattc

SEQ ID NO: 11880 - DNA, 18 bp, Homo sapiens
ctgcctcctcatttttca

SEQ ID NO: 11881 - DNA, 21 bp, Homo sapiens
tggacatttattgtgaaatta

SEQ ID NO: 11882 - DNA, 20 bp, Homo sapiens
gcccctctctcctcttcctc

SEQ ID NO: 11883 - DNA, 19 bp, Homo sapiens
attgaccctggacatcttt

SEQ ID NO: 11884 - DNA, 21 bp, Homo sapiens
ccagattataaggagaaccaa

SEQ ID NO: 11885 - DNA, 24 bp, Homo sapiens
taagtcgcaaaatttattaattta

SEQ ID NO: 11886 - DNA, 20 bp, Homo sapiens
acatgttgtacatttcacca

SEQ ID NO: 11887 - DNA, 21 bp, Homo sapiens
catggcctctgcaactgctca

SEQ ID NO: 11888 - DNA, 19 bp, Homo sapiens
cctgggggacccctggctc

SEQ ID NO: 11889 - DNA, 16 bp, Homo sapiens
gccgggtgctttcctg

SEQ ID NO: 11890 - DNA, 23 bp, Homo sapiens
taccagtctcctcccctactctg

SEQ ID NO: 11891 - DNA, 23 bp, Homo sapiens
tcttttcatatctctttgccctt

SEQ ID NO: 11892 - DNA, 19 bp, Homo sapiens
tggctgtacctgttcctcc

SEQ ID NO: 11893 - DNA, 18 bp, Homo sapiens
tggtggggagcacagaca

SEQ ID NO: 11894 - DNA, 23 bp, Homo sapiens
gaacgaagttcgcttcttccttc

SEQ ID NO: 11895 - DNA, 19 bp, Homo sapiens
ccacctccaacccaaccca

SEQ ID NO: 11896 - DNA, 18 bp, Homo sapiens
cccatctctcccacttcc

SEQ ID NO: 11897 - DNA, 18 bp, Homo sapiens
tctctgcctctcttcttc

SEQ ID NO: 11898 - DNA, 23 bp, Homo sapiens
tctgcctctcttcttcccctttg

SEQ ID NO: 11899 - DNA, 18 bp, Homo sapiens
aaactaaagagctgcaca

SEQ ID NO: 11900 - DNA, 21 bp, Homo sapiens
aggattacaggcccgtgccca

SEQ ID NO: 11901 - DNA, 20 bp, Homo sapiens
cctctgcctcttgggttcaa

SEQ ID NO: 11902 - DNA, 18 bp, Homo sapiens
ctttgtattaatttacca

SEQ ID NO: 11903 - DNA, 19 bp, Homo sapiens
gttgcagcactgcccatca

SEQ ID NO: 11904 - DNA, 22 bp, Homo sapiens
taaaaaggaacaagactgactg

SEQ ID NO: 11905 - DNA, 19 bp, Homo sapiens
acactgtggccaggcctta

SEQ ID NO: 11906 - DNA, 22 bp, Homo sapiens
cactgtgccccacaaaacttca

SEQ ID NO: 11907 - DNA, 22 bp, Homo sapiens
ccaccccccactcagtgcctcc

SEQ ID NO: 11908 - DNA, 20 bp, Homo sapiens
gcctgggccgtggcacagct

SEQ ID NO: 11909 - DNA, 18 bp, Homo sapiens
tccacatgctgcctggca

SEQ ID NO: 11910 - DNA, 20 bp, Homo sapiens
tggaagcccaactggggttg

SEQ ID NO: 11911 - DNA, 18 bp, Homo sapiens
caccattctcctgcctca

SEQ ID NO: 11912 - DNA, 21 bp, Homo sapiens
catgtttttaatggtaaactg

SEQ ID NO: 11913 - DNA, 19 bp, Homo sapiens
cccaagtattaaactctaa

SEQ ID NO: 11914 - DNA, 19 bp, Homo sapiens
ctgcaagctctgcctccca

SEQ ID NO: 11915 - DNA, 20 bp, Homo sapiens
gtggtttgagtgtctagcaa

SEQ ID NO: 11916 - DNA, 20 bp, Homo sapiens
tcagggacttgaatgcactt

SEQ ID NO: 11917 - DNA, 20 bp, Homo sapiens
aaataccattagaaaatact

SEQ ID NO: 11918 - DNA, 22 bp, Homo sapiens
tatattttatgacaagaatgtg

SEQ ID NO: 11919 - DNA, 19 bp, Homo sapiens
tccgatttttgccttcgaa

SEQ ID NO: 11920 - DNA, 20 bp, Homo sapiens
tgtggcgtaccttctccaca

SEQ ID NO: 11921 - DNA, 18 bp, Homo sapiens
aaatgcagcatctttgtg

SEQ ID NO: 11922 - DNA, 17 bp, Homo sapiens
agcaaataggcaaaaga

SEQ ID NO: 11923 - DNA, 22 bp, Homo sapiens
cacaagcctccaaggctcctta

SEQ ID NO: 11924 - DNA, 18 bp, Homo sapiens
gggataaagtcatcctct

SEQ ID NO: 11925 - DNA, 18 bp, Homo sapiens
cttctctgcctttatttt

SEQ ID NO: 11926 - DNA, 16 bp, Homo sapiens
aattcacttcagtcca

SEQ ID NO: 11927 - DNA, 23 bp, Homo sapiens
cagacgtggggagcctgacccca

SEQ ID NO: 11928 - DNA, 21 bp, Homo sapiens
ccagcaggcacctgtattgca

SEQ ID NO: 11929 - DNA, 23 bp, Homo sapiens
ccccgtgggggtgcctgtgccag

SEQ ID NO: 11930 - DNA, 22 bp, Homo sapiens
ccctgggggtgggaggctgtgg

SEQ ID NO: 11931 - DNA, 18 bp, Homo sapiens
cttggtagggtgctgcct

SEQ ID NO: 11932 - DNA, 21 bp, Homo sapiens
gcctggcacctactctttaga

SEQ ID NO: 11933 - DNA, 20 bp, Homo sapiens
tagcagaggtatgcttacca

SEQ ID NO: 11934 - DNA, 22 bp, Homo sapiens
ttttgccatggaggtctgggag

SEQ ID NO: 11935 - DNA, 20 bp, Homo sapiens
acgaggatttcctcatcgtc

SEQ ID NO: 11936 - DNA, 22 bp, Homo sapiens
tggaaggggaaccacagtttca

SEQ ID NO: 11937 - DNA, 22 bp, Homo sapiens
aaaatgaaagcaaaatatctta

SEQ ID NO: 11938 - DNA, 26 bp, Homo sapiens
aaagtcattatttttcctattcattt

SEQ ID NO: 11939 - DNA, 21 bp, Homo sapiens
aagaatcttgtgatgtctaca

SEQ ID NO: 11940 - DNA, 18 bp, Homo sapiens
atttttgtcatttccaaa

SEQ ID NO: 11941 - DNA, 19 bp, Homo sapiens
tgcaagtgcccgccctgcc

SEQ ID NO: 11942 - DNA, 23 bp, Homo sapiens
actttagcatgttgttgatcatg

SEQ ID NO: 11943 - DNA, 23 bp, Homo sapiens
gcagcaagctgagggtctttgtt

SEQ ID NO: 11944 - DNA, 21 bp, Homo sapiens
tgaccctggcagtgcactggt

SEQ ID NO: 11945 - DNA, 18 bp, Homo sapiens
ctagagcaccaccttaag

SEQ ID NO: 11946 - DNA, 20 bp, Homo sapiens
aaaaggtatcttggttatga

SEQ ID NO: 11947 - DNA, 22 bp, Homo sapiens
aaacagcgggaacttcattgca

SEQ ID NO: 11948 - DNA, 17 bp, Homo sapiens
aagtcattacaaatgtg

SEQ ID NO: 11949 - DNA, 19 bp, Homo sapiens
caaaactggtaagtttctt

SEQ ID NO: 11950 - DNA, 20 bp, Homo sapiens
ccagaaaacgctgtcctgtg

SEQ ID NO: 11951 - DNA, 19 bp, Homo sapiens
ccattgtgtccaactgtat

SEQ ID NO: 11952 - DNA, 21 bp, Homo sapiens
cctcttctccaatttgtaggt

SEQ ID NO: 11953 - DNA, 24 bp, Homo sapiens
ctgagatttctaccacacctttga

SEQ ID NO: 11954 - DNA, 19 bp, Homo sapiens
ggcttcatcttctccctgt

SEQ ID NO: 11955 - DNA, 26 bp, Homo sapiens
taggtgacgagttgacattgagattg

SEQ ID NO: 11956 - DNA, 20 bp, Homo sapiens
tcatcttctccctgtaactg

SEQ ID NO: 11957 - DNA, 19 bp, Homo sapiens
acatttatcacctctgatg

SEQ ID NO: 11958 - DNA, 19 bp, Homo sapiens
gaaaatgattcctggacat

SEQ ID NO: 11959 - DNA, 20 bp, Homo sapiens
tcaccaaaatttctacacca

SEQ ID NO: 11960 - DNA, 16 bp, Homo sapiens
tgaaacgttatgatga

SEQ ID NO: 11961 - DNA, 19 bp, Homo sapiens
ttctgctacttcactgtca

SEQ ID NO: 11962 - DNA, 22 bp, Homo sapiens
ataaaatatgtttctatttaga

SEQ ID NO: 11963 - DNA, 21 bp, Homo sapiens
taactttcaataaatgcaata

SEQ ID NO: 11964 - DNA, 23 bp, Homo sapiens
tcttttcatgtcatgttttgatt

SEQ ID NO: 11965 - DNA, 23 bp, Homo sapiens
agccatggttcacacatatgaca

SEQ ID NO: 11966 - DNA, 20 bp, Homo sapiens
ctctccttacacgcactgat

SEQ ID NO: 11967 - DNA, 22 bp, Homo sapiens
tcttgagagtccttcttgcaca

SEQ ID NO: 11968 - DNA, 19 bp, Homo sapiens
actgatccagatttgcagt

SEQ ID NO: 11969 - DNA, 21 bp, Homo sapiens
actggacagtagacatcatga

SEQ ID NO: 11970 - DNA, 25 bp, Homo sapiens
actgtttcaactaacacccatgcta

SEQ ID NO: 11971 - DNA, 19 bp, Homo sapiens
cataacagtttcttaacct

SEQ ID NO: 11972 - DNA, 22 bp, Homo sapiens
ccagactgcttcccgtccaagt

SEQ ID NO: 11973 - DNA, 18 bp, Homo sapiens
ctctccttccagtcctga

SEQ ID NO: 11974 - DNA, 20 bp, Homo sapiens
ctgagccagcatgctggctt

SEQ ID NO: 11975 - DNA, 18 bp, Homo sapiens
gggcccgcccgccccctc

SEQ ID NO: 11976 - DNA, 19 bp, Homo sapiens
acttcatcctgaagtttgc

SEQ ID NO: 11977 - DNA, 20 bp, Homo sapiens
tggccaggctggtcttgaac

SEQ ID NO: 11978 - DNA, 17 bp, Homo sapiens
cccagccgggcccggga

SEQ ID NO: 11979 - DNA, 22 bp, Homo sapiens
tctctccccatctctggtctca

SEQ ID NO: 11980 - DNA, 24 bp, Homo sapiens
tgcccccagaaaggggctgccctg

SEQ ID NO: 11981 - DNA, 19 bp, Homo sapiens
gcccgcacagctccgggtg

SEQ ID NO: 11982 - DNA, 19 bp, Homo sapiens
tcaaacatgcggtgccatg

SEQ ID NO: 11983 - DNA, 22 bp, Homo sapiens
ctgacaacagcgtgagatttca

SEQ ID NO: 11984 - DNA, 21 bp, Homo sapiens
accctgcagcccaggtcccca

SEQ ID NO: 11985 - DNA, 19 bp, Homo sapiens
ccatccttcctctgttcct

SEQ ID NO: 11986 - DNA, 15 bp, Homo sapiens
ctccctccctcctct

SEQ ID NO: 11987 - DNA, 17 bp, Homo sapiens
gctgcagtgggatctgg

SEQ ID NO: 11988 - DNA, 18 bp, Homo sapiens
gttccttctggccgggca

SEQ ID NO: 11989 - DNA, 20 bp, Homo sapiens
aagtcacctccaagtgtagc

SEQ ID NO: 11990 - DNA, 18 bp, Homo sapiens
ctattgccttgtgtgatt

SEQ ID NO: 11991 - DNA, 20 bp, Homo sapiens
ctttgatggtttctatctgc

SEQ ID NO: 11992 - DNA, 20 bp, Homo sapiens
gcccggtacagggcccggtg

SEQ ID NO: 11993 - DNA, 19 bp, Homo sapiens
gcctcaggcagagcccggt

SEQ ID NO: 11994 - DNA, 22 bp, Homo sapiens
tccagcccccagtgtcccatcc

SEQ ID NO: 11995 - DNA, 21 bp, Homo sapiens
tgggtgtgcaacttgaggctg

SEQ ID NO: 11996 - DNA, 18 bp, Homo sapiens
ttcgagccacgcatccaa

SEQ ID NO: 11997 - DNA, 22 bp, Homo sapiens
aagaacaataatgattccatca

SEQ ID NO: 11998 - DNA, 20 bp, Homo sapiens
atcattgttttccctcacag

SEQ ID NO: 11999 - DNA, 23 bp, Homo sapiens
taggattcaattcaatgtggaac

SEQ ID NO: 12000 - DNA, 19 bp, Homo sapiens
tctgctttttggctttgtg

SEQ ID NO: 12001 - DNA, 26 bp, Homo sapiens
caaggttgtgctatcaaggctcagca

SEQ ID NO: 12002 - DNA, 17 bp, Homo sapiens
taaaacaacacaatgca

SEQ ID NO: 12003 - DNA, 16 bp, Homo sapiens
atgatcctaccagttg

SEQ ID NO: 12004 - DNA, 22 bp, Homo sapiens
cttccaagcacccctctgccct

SEQ ID NO: 12005 - DNA, 22 bp, Homo sapiens
cttgtctttcaaggccaggttc

SEQ ID NO: 12006 - DNA, 25 bp, Homo sapiens
gtgtttcacatatgttgtgaatttt

SEQ ID NO: 12007 - DNA, 16 bp, Homo sapiens
atccagccagacccca

SEQ ID NO: 12008 - DNA, 24 bp, Homo sapiens
ccctcccccatgggctgtgtccta

SEQ ID NO: 12009 - DNA, 23 bp, Homo sapiens
gaggaggggaccaattctggaca

SEQ ID NO: 12010 - DNA, 17 bp, Homo sapiens
ggaattccctccccctc

SEQ ID NO: 12011 - DNA, 22 bp, Homo sapiens
actgaaagcaaatgctttgtga

SEQ ID NO: 12012 - DNA, 17 bp, Homo sapiens
atacataaatgcccagc

SEQ ID NO: 12013 - DNA, 19 bp, Homo sapiens
cgtccctgctgtgagctct

SEQ ID NO: 12014 - DNA, 23 bp, Homo sapiens
ctattatggaacccaatggacat

SEQ ID NO: 12015 - DNA, 19 bp, Homo sapiens
gctttgattccctctgata

SEQ ID NO: 12016 - DNA, 23 bp, Homo sapiens
caccccagcctggccacgcagcc

SEQ ID NO: 12017 - DNA, 19 bp, Homo sapiens
cctggccacgcagccagga

SEQ ID NO: 12018 - DNA, 21 bp, Homo sapiens
gcagccgtcacccctgcctcc

SEQ ID NO: 12019 - DNA, 25 bp, Homo sapiens
gcccttttcctccagcctaaactga

SEQ ID NO: 12020 - DNA, 20 bp, Homo sapiens
attttgtgaccactattgtg

SEQ ID NO: 12021 - DNA, 22 bp, Homo sapiens
ccgaaaccgagtccgggcccgt

SEQ ID NO: 12022 - DNA, 21 bp, Homo sapiens
aaggatgaactaaatatttta

SEQ ID NO: 12023 - DNA, 17 bp, Homo sapiens
aatcaagattcaaacag

SEQ ID NO: 12024 - DNA, 23 bp, Homo sapiens
ttgagacgtcagtgataaatgag

SEQ ID NO: 12025 - DNA, 20 bp, Homo sapiens
ttttttgcaactgtgctttt

SEQ ID NO: 12026 - DNA, 19 bp, Homo sapiens
aaactcctgacctcaggtg

SEQ ID NO: 12027 - DNA, 21 bp, Homo sapiens
atcttggctcaccataacctc

SEQ ID NO: 12028 - DNA, 18 bp, Homo sapiens
tccgcctcccaggttcaa

SEQ ID NO: 12029 - DNA, 17 bp, Homo sapiens
ttctcctgccttagcct

SEQ ID NO: 12030 - DNA, 19 bp, Homo sapiens
cagggcctgatctttacca

SEQ ID NO: 12031 - DNA, 20 bp, Homo sapiens
cagtcctggttgggatcaca

SEQ ID NO: 12032 - DNA, 18 bp, Homo sapiens
ctcaaggtcacacagtga

SEQ ID NO: 12033 - DNA, 21 bp, Homo sapiens
gcttggcccacagtctggctc

SEQ ID NO: 12034 - DNA, 20 bp, Homo sapiens
ggtctccaaattacagccca

SEQ ID NO: 12035 - DNA, 21 bp, Homo sapiens
tgttgacctgtcagatcaaca

SEQ ID NO: 12036 - DNA, 20 bp, Homo sapiens
cctctgcctcctgggttcaa

SEQ ID NO: 12037 - DNA, 18 bp, Homo sapiens
tcctgacctcatgatcca

SEQ ID NO: 12038 - DNA, 16 bp, Homo sapiens
tgtcactacagtatta

SEQ ID NO: 12039 - DNA, 26 bp, Homo sapiens
ttcccatccatctgtttactacaata

SEQ ID NO: 12040 - DNA, 20 bp, Homo sapiens
agttgttaaacaacatgcta

SEQ ID NO: 12041 - DNA, 23 bp, Homo sapiens
ggactttccagtgatgccactga

SEQ ID NO: 12042 - DNA, 18 bp, Homo sapiens
acacatcccagcccaatc

SEQ ID NO: 12043 - DNA, 17 bp, Homo sapiens
aggggtgacacagactc

SEQ ID NO: 12044 - DNA, 22 bp, Homo sapiens
atctgtcctcggcttctggcct

SEQ ID NO: 12045 - DNA, 27 bp, Homo sapiens
gcctgaactaccgtcctgcctaggcct

SEQ ID NO: 12046 - DNA, 17 bp, Homo sapiens
taggattttacttcttg

SEQ ID NO: 12047 - DNA, 22 bp, Homo sapiens
tttgccctgggaaaccccttct

SEQ ID NO: 12048 - DNA, 19 bp, Homo sapiens
taaaagagacacaaacaaa

SEQ ID NO: 12049 - DNA, 18 bp, Homo sapiens
gcagggggctggcaggtg

SEQ ID NO: 12050 - DNA, 19 bp, Homo sapiens
aaaagagtgaatgtggtat

SEQ ID NO: 12051 - DNA, 19 bp, Homo sapiens
cagtggctcttgggttcaa

SEQ ID NO: 12052 - DNA, 22 bp, Homo sapiens
gcttgggcttaggcttgggctc

SEQ ID NO: 12053 - DNA, 20 bp, Homo sapiens
ttcattttcactggatacat

SEQ ID NO: 12054 - DNA, 20 bp, Homo sapiens
gctctgggaggccggctgcg

SEQ ID NO: 12055 - DNA, 19 bp, Homo sapiens
agcctcatagtcaatccca

SEQ ID NO: 12056 - DNA, 20 bp, Homo sapiens
atgtacttaaaacatctgat

SEQ ID NO: 12057 - DNA, 26 bp, Homo sapiens
cctcatagtcaatcccagttgctttt

SEQ ID NO: 12058 - DNA, 26 bp, Homo sapiens
gtatgtgtgatactaaggtttgactg

SEQ ID NO: 12059 - DNA, 15 bp, Homo sapiens
tcatagtcaatccca

SEQ ID NO: 12060 - DNA, 21 bp, Homo sapiens
attttgtattattgttctcac

SEQ ID NO: 12061 - DNA, 25 bp, Homo sapiens
tccaaatgaacttgcacttgttata

SEQ ID NO: 12062 - DNA, 19 bp, Homo sapiens
tgtatatttttaaagaatg

SEQ ID NO: 12063 - DNA, 26 bp, Homo sapiens
acctgagctcccctgccctctggctt

SEQ ID NO: 12064 - DNA, 20 bp, Homo sapiens
caagatgagttgacacaacc

SEQ ID NO: 12065 - DNA, 17 bp, Homo sapiens
cagctgtgtgtccatca

SEQ ID NO: 12066 - DNA, 19 bp, Homo sapiens
ccgaatacgcactcttgaa

SEQ ID NO: 12067 - DNA, 23 bp, Homo sapiens
aaaagagtagaatagggtatgat

SEQ ID NO: 12068 - DNA, 21 bp, Homo sapiens
gggacttggcaacccgcctcc

SEQ ID NO: 12069 - DNA, 19 bp, Homo sapiens
gttgggtggagagagtatt

SEQ ID NO: 12070 - DNA, 18 bp, Homo sapiens
tgggcccggatggggctg

SEQ ID NO: 12071 - DNA, 20 bp, Homo sapiens
ctcctgctccttgctgtttt

SEQ ID NO: 12072 - DNA, 21 bp, Homo sapiens
gaagcctcagtggtggaattc

SEQ ID NO: 12073 - DNA, 25 bp, Homo sapiens
ttctgatgatttgggggcttgggag

SEQ ID NO: 12074 - DNA, 25 bp, Homo sapiens
catgcttggagcattgggtatctga

SEQ ID NO: 12075 - DNA, 23 bp, Homo sapiens
ctctgacggtggagaaccatgtg

SEQ ID NO: 12076 - DNA, 18 bp, Homo sapiens
gagcttcaaagcaacttt

SEQ ID NO: 12077 - DNA, 20 bp, Homo sapiens
gcttatccaaaattatctct

SEQ ID NO: 12078 - DNA, 21 bp, Homo sapiens
gtctagaaagaaaacattgga

SEQ ID NO: 12079 - DNA, 21 bp, Homo sapiens
ttcagaagatgattttactca

SEQ ID NO: 12080 - DNA, 22 bp, Homo sapiens
aatggcagccctccccgcccct

SEQ ID NO: 12081 - DNA, 22 bp, Homo sapiens
ccctcgctgcggggcctgtgga

SEQ ID NO: 12082 - DNA, 17 bp, Homo sapiens
gccccgccccagcccca

SEQ ID NO: 12083 - DNA, 15 bp, Homo sapiens
aagctgtggtttaca

SEQ ID NO: 12084 - DNA, 21 bp, Homo sapiens
acagcagcaccctttcctctc

SEQ ID NO: 12085 - DNA, 18 bp, Homo sapiens
ccccacaagccccctcca

SEQ ID NO: 12086 - DNA, 22 bp, Homo sapiens
ccttccccacaagccccctcca

SEQ ID NO: 12087 - DNA, 20 bp, Homo sapiens
cttgcggcctcgcggccggg

SEQ ID NO: 12088 - DNA, 19 bp, Homo sapiens
gcggccgggccggcctggg

SEQ ID NO: 12089 - DNA, 18 bp, Homo sapiens
agggaaaatcctaagaca

SEQ ID NO: 12090 - DNA, 21 bp, Homo sapiens
ggatggaaagacaaactgcac

SEQ ID NO: 12091 - DNA, 19 bp, Homo sapiens
caggtggggcatgtcctca

SEQ ID NO: 12092 - DNA, 21 bp, Homo sapiens
gtgtttctagagaacagttga

SEQ ID NO: 12093 - DNA, 17 bp, Homo sapiens
ggccgagtgtgtgtcct

SEQ ID NO: 12094 - DNA, 18 bp, Homo sapiens
cctggcagtggattgtgg

SEQ ID NO: 12095 - DNA, 23 bp, Homo sapiens
gaaaacctccatcttggctccca

SEQ ID NO: 12096 - DNA, 21 bp, Homo sapiens
gtgaacctgcctgtgaactct

SEQ ID NO: 12097 - DNA, 16 bp, Homo sapiens
atgatgcagcctctga

SEQ ID NO: 12098 - DNA, 18 bp, Homo sapiens
attacagaaacagtctgt

SEQ ID NO: 12099 - DNA, 17 bp, Homo sapiens
gcaagccgagagccagc

SEQ ID NO: 12100 - DNA, 23 bp, Homo sapiens
ggccagccccgcgccacaaaggg

SEQ ID NO: 12101 - DNA, 16 bp, Homo sapiens
ggccgccgccccctct

SEQ ID NO: 12102 - DNA, 23 bp, Homo sapiens
ggccgggcgggcgcacaccatcc

SEQ ID NO: 12103 - DNA, 18 bp, Homo sapiens
ggcgacggcggcggcggc

SEQ ID NO: 12104 - DNA, 25 bp, Homo sapiens
aagttgttaccaaatacacatttca

SEQ ID NO: 12105 - DNA, 21 bp, Homo sapiens
agagagaaaaagattgtatta

SEQ ID NO: 12106 - DNA, 20 bp, Homo sapiens
gaaaaagataagaaatacta

SEQ ID NO: 12107 - DNA, 17 bp, Homo sapiens
gaaacacttgcttgcca

SEQ ID NO: 12108 - DNA, 21 bp, Homo sapiens
tttcattgttccactggacgc

SEQ ID NO: 12109 - DNA, 24 bp, Homo sapiens
acagtgctggggtgagtaccccca

SEQ ID NO: 12110 - DNA, 18 bp, Homo sapiens
aagtttacattttgtttc

SEQ ID NO: 12111 - DNA, 18 bp, Homo sapiens
cacttttcctccatttga

SEQ ID NO: 12112 - DNA, 21 bp, Homo sapiens
ccgaaattattacccttctca

SEQ ID NO: 12113 - DNA, 18 bp, Homo sapiens
ggatcccacagcttactg

SEQ ID NO: 12114 - DNA, 25 bp, Homo sapiens
ttgaaatgttatttaaatatattca

SEQ ID NO: 12115 - DNA, 23 bp, Homo sapiens
aatactgtacataaaatgtcatt

SEQ ID NO: 12116 - DNA, 19 bp, Homo sapiens
tactgcagtgacctgccct

SEQ ID NO: 12117 - DNA, 17 bp, Homo sapiens
tcaagtgattctcgtac

SEQ ID NO: 12118 - DNA, 17 bp, Homo sapiens
tccgcctccaggttcaa

SEQ ID NO: 12119 - DNA, 18 bp, Homo sapiens
tggacctcagatcttgta

SEQ ID NO: 12120 - DNA, 22 bp, Homo sapiens
agataatagaccagcaattgca

SEQ ID NO: 12121 - DNA, 23 bp, Homo sapiens
gtgacagagccatgagccagcca

SEQ ID NO: 12122 - DNA, 20 bp, Homo sapiens
taaggaggactgggtttgtt

SEQ ID NO: 12123 - DNA, 20 bp, Homo sapiens
acttctgcttcctcatctca

SEQ ID NO: 12124 - DNA, 19 bp, Homo sapiens
cactctgaaaatgtgcagc

SEQ ID NO: 12125 - DNA, 18 bp, Homo sapiens
cttcctcaactccctcca

SEQ ID NO: 12126 - DNA, 19 bp, Homo sapiens
tgtgtgtgagtgtggctgg

SEQ ID NO: 12127 - DNA, 18 bp, Homo sapiens
gaaggcggcggccgcggc

SEQ ID NO: 12128 - DNA, 22 bp, Homo sapiens
atgcctcagtttctcccaccgc

SEQ ID NO: 12129 - DNA, 21 bp, Homo sapiens
tcctctcctccccttgccctc

SEQ ID NO: 12130 - DNA, 19 bp, Homo sapiens
tctccctcccctctcctct

SEQ ID NO: 12131 - DNA, 19 bp, Homo sapiens
ctccccttttttcttctca

SEQ ID NO: 12132 - DNA, 19 bp, Homo sapiens
gctctggcaaagcttttag

SEQ ID NO: 12133 - DNA, 23 bp, Homo sapiens
tttctttaagttggtttagcctt

SEQ ID NO: 12134 - DNA, 21 bp, Homo sapiens
ggtcctcgacgcctgccgaca

SEQ ID NO: 12135 - DNA, 19 bp, Homo sapiens
cctgactcctccttgcaaa

SEQ ID NO: 12136 - DNA, 18 bp, Homo sapiens
taagattatgtaacctag

SEQ ID NO: 12137 - DNA, 18 bp, Homo sapiens
ttaggatgactgttacag

SEQ ID NO: 12138 - DNA, 18 bp, Homo sapiens
ccgccagctgacaggaca

SEQ ID NO: 12139 - DNA, 20 bp, Homo sapiens
ctgataattgtatgtattgt

SEQ ID NO: 12140 - DNA, 20 bp, Homo sapiens
actcccagggactctgggga

SEQ ID NO: 12141 - DNA, 17 bp, Homo sapiens
cagattctggcatccca

SEQ ID NO: 12142 - DNA, 18 bp, Homo sapiens
gcccgcatcccaccctcc

SEQ ID NO: 12143 - DNA, 24 bp, Homo sapiens
tccccaccgtgacctgcctggcct

SEQ ID NO: 12144 - DNA, 21 bp, Homo sapiens
ttttggcggctgtagttgtgg

SEQ ID NO: 12145 - DNA, 19 bp, Homo sapiens
acacacatgagattcttca

SEQ ID NO: 12146 - DNA, 21 bp, Homo sapiens
ccccacccacagtgctgcact

SEQ ID NO: 12147 - DNA, 19 bp, Homo sapiens
ccccctgcccacctctcca

SEQ ID NO: 12148 - DNA, 25 bp, Homo sapiens
cgcccaccccctgcccacctctcca

SEQ ID NO: 12149 - DNA, 17 bp, Homo sapiens
ctgtgagccctacctta

SEQ ID NO: 12150 - DNA, 17 bp, Homo sapiens
cttacccctctgcccct

SEQ ID NO: 12151 - DNA, 23 bp, Homo sapiens
gctcacctctggtagccatagca

SEQ ID NO: 12152 - DNA, 21 bp, Homo sapiens
tctgggctgctaacctggcct

SEQ ID NO: 12153 - DNA, 20 bp, Homo sapiens
tgagggtggcgggcctgcgg

SEQ ID NO: 12154 - DNA, 18 bp, Homo sapiens
accctgggccactgcctg

SEQ ID NO: 12155 - DNA, 18 bp, Homo sapiens
agagacagaagccaacga

SEQ ID NO: 12156 - DNA, 23 bp, Homo sapiens
agcttccctcagctcttacctca

SEQ ID NO: 12157 - DNA, 19 bp, Homo sapiens
caaagccacctcatttcca

SEQ ID NO: 12158 - DNA, 21 bp, Homo sapiens
ccatccatggcccccagactg

SEQ ID NO: 12159 - DNA, 21 bp, Homo sapiens
tcatttccaaacatctcactc

SEQ ID NO: 12160 - DNA, 18 bp, Homo sapiens
ttccctcagctcttacct

SEQ ID NO: 12161 - DNA, 21 bp, Homo sapiens
cacctctaaccccctcccctc

SEQ ID NO: 12162 - DNA, 21 bp, Homo sapiens
tagacttgaggggctaccctg

SEQ ID NO: 12163 - DNA, 22 bp, Homo sapiens
cactgggtgattcacgtgtgcc

SEQ ID NO: 12164 - DNA, 19 bp, Homo sapiens
ctgcaacctccgcctccca

SEQ ID NO: 12165 - DNA, 18 bp, Homo sapiens
tccgcctcccaggttcaa

SEQ ID NO: 12166 - DNA, 22 bp, Homo sapiens
ttggaaaatacatctgttccag

SEQ ID NO: 12167 - DNA, 18 bp, Homo sapiens
agtatcgtctgcattcca

SEQ ID NO: 12168 - DNA, 20 bp, Homo sapiens
atatttacaaagctaaaata

SEQ ID NO: 12169 - DNA, 20 bp, Homo sapiens
gatattgtaacaatactgcc

SEQ ID NO: 12170 - DNA, 17 bp, Homo sapiens
gtgtgtgtgcacatttg

SEQ ID NO: 12171 - DNA, 15 bp, Homo sapiens
gttctgaatgcactt

SEQ ID NO: 12172 - DNA, 23 bp, Homo sapiens
taaatgacactattatgaagcta

SEQ ID NO: 12173 - DNA, 23 bp, Homo sapiens
ttccagatttcacacctacaata

SEQ ID NO: 12174 - DNA, 24 bp, Homo sapiens
gcgtctcggctgccgctagagttt

SEQ ID NO: 12175 - DNA, 21 bp, Homo sapiens
cccggacggagggccggcgag

SEQ ID NO: 12176 - DNA, 19 bp, Homo sapiens
ccggacggagggccggcga

SEQ ID NO: 12177 - DNA, 24 bp, Homo sapiens
ctttgttccgggagagtttgtgag

SEQ ID NO: 12178 - DNA, 22 bp, Homo sapiens
acatttaagattctcctgtgga

SEQ ID NO: 12179 - DNA, 18 bp, Homo sapiens
cagctagcacccttcata

SEQ ID NO: 12180 - DNA, 18 bp, Homo sapiens
ccccgccacctgtactca

SEQ ID NO: 12181 - DNA, 21 bp, Homo sapiens
cctctcctccccttgcgctcg

SEQ ID NO: 12182 - DNA, 18 bp, Homo sapiens
ctagaatcttctttgttc

SEQ ID NO: 12183 - DNA, 19 bp, Homo sapiens
ctctttctctctctctctc

SEQ ID NO: 12184 - DNA, 18 bp, Homo sapiens
gacatgaagacacaatct

SEQ ID NO: 12185 - DNA, 19 bp, Homo sapiens
gcagggcaggggggccttt

SEQ ID NO: 12186 - DNA, 22 bp, Homo sapiens
gcagtttttattgtctgtgtca

SEQ ID NO: 12187 - DNA, 21 bp, Homo sapiens
gcctgagggagcccctggctt

SEQ ID NO: 12188 - DNA, 21 bp, Homo sapiens
catgagccaccgcgcctggca

SEQ ID NO: 12189 - DNA, 15 bp, Homo sapiens
ctgtcccctgcctct

SEQ ID NO: 12190 - DNA, 19 bp, Homo sapiens
cttttcccaattcccttcc

SEQ ID NO: 12191 - DNA, 22 bp, Homo sapiens
gtagttttcttggtttgcgtta

SEQ ID NO: 12192 - DNA, 20 bp, Homo sapiens
tgggaagcagcaagccacca

SEQ ID NO: 12193 - DNA, 22 bp, Homo sapiens
agatttgaaaattgtataccaa

SEQ ID NO: 12194 - DNA, 18 bp, Homo sapiens
actggcggtcaagtgtgg

SEQ ID NO: 12195 - DNA, 18 bp, Homo sapiens
tggatgagcatggagctg

SEQ ID NO: 12196 - DNA, 20 bp, Homo sapiens
tggtgcaggtctccacctgc

SEQ ID NO: 12197 - DNA, 23 bp, Homo sapiens
acatcctgtgcctccatcagcta

SEQ ID NO: 12198 - DNA, 18 bp, Homo sapiens
ccaagcagagaagctctc

SEQ ID NO: 12199 - DNA, 22 bp, Homo sapiens
gaaccaggcttggaaccgtagg

SEQ ID NO: 12200 - DNA, 18 bp, Homo sapiens
ttggaggtgaacaagcaa

SEQ ID NO: 12201 - DNA, 21 bp, Homo sapiens
aaataccactgaagaggacac

SEQ ID NO: 12202 - DNA, 22 bp, Homo sapiens
caaagaattgtaatcctcccca

SEQ ID NO: 12203 - DNA, 25 bp, Homo sapiens
cccacgaccttggcccgagcccctc

SEQ ID NO: 12204 - DNA, 24 bp, Homo sapiens
tctttagctactccttttcctaca

SEQ ID NO: 12205 - DNA, 19 bp, Homo sapiens
aaacttctgacctcaggtg

SEQ ID NO: 12206 - DNA, 21 bp, Homo sapiens
agacagagattcagtttgtca

SEQ ID NO: 12207 - DNA, 27 bp, Homo sapiens
agagccaagattttaacctagatctcc

SEQ ID NO: 12208 - DNA, 20 bp, Homo sapiens
agtgaagtgagatgatgcat

SEQ ID NO: 12209 - DNA, 18 bp, Homo sapiens
cattattgctttgacctt

SEQ ID NO: 12210 - DNA, 17 bp, Homo sapiens
ccagaaagctatcaatg

SEQ ID NO: 12211 - DNA, 17 bp, Homo sapiens
gctaaggtccaagaaac

SEQ ID NO: 12212 - DNA, 21 bp, Homo sapiens
ggtgttaaaagaatcatggta

SEQ ID NO: 12213 - DNA, 17 bp, Homo sapiens
gtcttatctgccttttt

SEQ ID NO: 12214 - DNA, 20 bp, Homo sapiens
taccactgatttaccattgc

SEQ ID NO: 12215 - DNA, 18 bp, Homo sapiens
tccgcttcccaggttcaa

SEQ ID NO: 12216 - DNA, 21 bp, Homo sapiens
ttgaccaaaacatacatttga

SEQ ID NO: 12217 - DNA, 18 bp, Homo sapiens
ttgcaaaatgactgcttt

SEQ ID NO: 12218 - DNA, 21 bp, Homo sapiens
atctgagttattttttggtct

SEQ ID NO: 12219 - DNA, 24 bp, Homo sapiens
cctgggcggatctgagttattttt

SEQ ID NO: 12220 - DNA, 20 bp, Homo sapiens
gccgcggagtccggccccca

SEQ ID NO: 12221 - DNA, 17 bp, Homo sapiens
gggatggccggccagtg

SEQ ID NO: 12222 - DNA, 21 bp, Homo sapiens
aaatacctgcaaagtgctcta

SEQ ID NO: 12223 - DNA, 17 bp, Homo sapiens
cccccgcgactatctcc

SEQ ID NO: 12224 - DNA, 20 bp, Homo sapiens
agggcaagctggagttaata

SEQ ID NO: 12225 - DNA, 17 bp, Homo sapiens
cacaacttgttttccca

SEQ ID NO: 12226 - DNA, 19 bp, Homo sapiens
ctggacgatcgcctggctt

SEQ ID NO: 12227 - DNA, 19 bp, Homo sapiens
gtcagcctgcttctgcccc

SEQ ID NO: 12228 - DNA, 19 bp, Homo sapiens
tctcattatctccatgata

SEQ ID NO: 12229 - DNA, 17 bp, Homo sapiens
aacttggaagaagcttc

SEQ ID NO: 12230 - DNA, 25 bp, Homo sapiens
taccacacaatatttcatgattcaa

SEQ ID NO: 12231 - DNA, 16 bp, Homo sapiens
atctccaaggtgaggt

SEQ ID NO: 12232 - DNA, 18 bp, Homo sapiens
atcttgacctcttggctc

SEQ ID NO: 12233 - DNA, 18 bp, Homo sapiens
catcaccatttttcctga

SEQ ID NO: 12234 - DNA, 19 bp, Homo sapiens
acaaggtgggctgccctca

SEQ ID NO: 12235 - DNA, 19 bp, Homo sapiens
atgcctaagggagacattt

SEQ ID NO: 12236 - DNA, 20 bp, Homo sapiens
gccagtgtggtgcttggtcc

SEQ ID NO: 12237 - DNA, 20 bp, Homo sapiens
tccaaaccggaagaccgtgg

SEQ ID NO: 12238 - DNA, 17 bp, Homo sapiens
gccccctccctccctca

SEQ ID NO: 12239 - DNA, 18 bp, Homo sapiens
tccacctcccgggttcaa

SEQ ID NO: 12240 - DNA, 18 bp, Homo sapiens
ttcaagtgattctcatgc

SEQ ID NO: 12241 - DNA, 26 bp, Homo sapiens
cccaactcgatgggcacagccagcca

SEQ ID NO: 12242 - DNA, 20 bp, Homo sapiens
ccctccccttcactccctcc

SEQ ID NO: 12243 - DNA, 15 bp, Homo sapiens
cctgtgccctctgga

SEQ ID NO: 12244 - DNA, 24 bp, Homo sapiens
gtgcctcggcctccaaggggcttt

SEQ ID NO: 12245 - DNA, 18 bp, Homo sapiens
tctgtgtgtccttgtgtg

SEQ ID NO: 12246 - DNA, 19 bp, Homo sapiens
ttctgtctctctctgtcct

SEQ ID NO: 12247 - DNA, 21 bp, Homo sapiens
tggtgtctgtgtgtgaagctg

SEQ ID NO: 12248 - DNA, 21 bp, Homo sapiens
cggtgccaggttttctgggtg

SEQ ID NO: 12249 - DNA, 18 bp, Homo sapiens
gtgtagctatatctatat

SEQ ID NO: 12250 - DNA, 22 bp, Homo sapiens
cagaaaccaccaagactgttga

SEQ ID NO: 12251 - DNA, 25 bp, Homo sapiens
ccttcactctaatggactgttccag

SEQ ID NO: 12252 - DNA, 22 bp, Homo sapiens
cgcccctgtctggatcccctcc

SEQ ID NO: 12253 - DNA, 20 bp, Homo sapiens
aaaatggggcaggccacacc

SEQ ID NO: 12254 - DNA, 19 bp, Homo sapiens
ccccactgccccctgcagc

SEQ ID NO: 12255 - DNA, 25 bp, Homo sapiens
gaatgaagtcacctcgcccccctct

SEQ ID NO: 12256 - DNA, 19 bp, Homo sapiens
gccccttggcaccatcctg

SEQ ID NO: 12257 - DNA, 22 bp, Homo sapiens
ggacttggcatttaggattcca

SEQ ID NO: 12258 - DNA, 24 bp, Homo sapiens
aagagaggtgtggcgtggccctgg

SEQ ID NO: 12259 - DNA, 18 bp, Homo sapiens
tgaacagaggccatgccg

SEQ ID NO: 12260 - DNA, 24 bp, Homo sapiens
gcgccgctgcctctggcgggcttt

SEQ ID NO: 12261 - DNA, 21 bp, Homo sapiens
gggcaaggtgaagagcgcacc

SEQ ID NO: 12262 - DNA, 18 bp, Homo sapiens
ggttggtgggagttgcga

SEQ ID NO: 12263 - DNA, 19 bp, Homo sapiens
acggccccacccttatctc

SEQ ID NO: 12264 - DNA, 22 bp, Homo sapiens
agacccccactcctgcccgcca

SEQ ID NO: 12265 - DNA, 19 bp, Homo sapiens
caatatcaccccttaccac

SEQ ID NO: 12266 - DNA, 22 bp, Homo sapiens
cccttcaccccgaggactgggc

SEQ ID NO: 12267 - DNA, 26 bp, Homo sapiens
ggggtcacggcgacggcggcggcggc

SEQ ID NO: 12268 - DNA, 21 bp, Homo sapiens
gccagttcccacagcacccca

SEQ ID NO: 12269 - DNA, 17 bp, Homo sapiens
aaataccttttaagcta

SEQ ID NO: 12270 - DNA, 18 bp, Homo sapiens
cacctcccactgcccctc

SEQ ID NO: 12271 - DNA, 23 bp, Homo sapiens
ggaacctgccgagtgagcactga

SEQ ID NO: 12272 - DNA, 22 bp, Homo sapiens
ctaatactgagagatttggtca

SEQ ID NO: 12273 - DNA, 25 bp, Homo sapiens
gagactagcctcatgagacttggca

SEQ ID NO: 12274 - DNA, 20 bp, Homo sapiens
cttaataaaacaagcaggta

SEQ ID NO: 12275 - DNA, 18 bp, Homo sapiens
cctgctttctcgcggcca

SEQ ID NO: 12276 - DNA, 18 bp, Homo sapiens
cggcttccctgctttctc

SEQ ID NO: 12277 - DNA, 18 bp, Homo sapiens
atgtagactagcaaaata

SEQ ID NO: 12278 - DNA, 20 bp, Homo sapiens
aattttcaatgtttttttgg

SEQ ID NO: 12279 - DNA, 20 bp, Homo sapiens
acatgcttttaaatgtctca

SEQ ID NO: 12280 - DNA, 23 bp, Homo sapiens
agtgataatgggtcagtttctca

SEQ ID NO: 12281 - DNA, 24 bp, Homo sapiens
tacatgtgaaaacacaagtctttg

SEQ ID NO: 12282 - DNA, 16 bp, Homo sapiens
agcagttgaacctggg

SEQ ID NO: 12283 - DNA, 15 bp, Homo sapiens
tgcaacactaacttc

SEQ ID NO: 12284 - DNA, 20 bp, Homo sapiens
tgggaacaaacctcacttga

SEQ ID NO: 12285 - DNA, 22 bp, Homo sapiens
ttgaacctgggaacaaacctca

SEQ ID NO: 12286 - DNA, 18 bp, Homo sapiens
cccaaactgaggagcccg

SEQ ID NO: 12287 - DNA, 20 bp, Homo sapiens
ccccgcccaggccccccagc

SEQ ID NO: 12288 - DNA, 17 bp, Homo sapiens
ctgtgcctttacgatca

SEQ ID NO: 12289 - DNA, 23 bp, Homo sapiens
gaggttttctccctgcccgggaa

SEQ ID NO: 12290 - DNA, 16 bp, Homo sapiens
ggtaagtccattttcc

SEQ ID NO: 12291 - DNA, 21 bp, Homo sapiens
tgccaggaatctgcctacctg

SEQ ID NO: 12292 - DNA, 18 bp, Homo sapiens
agataattactgccttga

SEQ ID NO: 12293 - DNA, 21 bp, Homo sapiens
cagtacccaccaccttcttct

SEQ ID NO: 12294 - DNA, 18 bp, Homo sapiens
catatcccttccagatgg

SEQ ID NO: 12295 - DNA, 22 bp, Homo sapiens
ggctccatcccccgccccctct

SEQ ID NO: 12296 - DNA, 18 bp, Homo sapiens
taagaaacttatttctca

SEQ ID NO: 12297 - DNA, 23 bp, Homo sapiens
tatcccaagaatgcaagatttca

SEQ ID NO: 12298 - DNA, 18 bp, Homo sapiens
gaagagaaaagcatttca

SEQ ID NO: 12299 - DNA, 19 bp, Homo sapiens
gcgtagaaacgcctgccaa

SEQ ID NO: 12300 - DNA, 21 bp, Homo sapiens
aaactaaagccaatagcacca

SEQ ID NO: 12301 - DNA, 22 bp, Homo sapiens
atttaggaattctctttgatga

SEQ ID NO: 12302 - DNA, 20 bp, Homo sapiens
cctgaggaactttacactga

SEQ ID NO: 12303 - DNA, 20 bp, Homo sapiens
tgcctgggcacctattcaca

SEQ ID NO: 12304 - DNA, 19 bp, Homo sapiens
aagaaggagatgattcttt

SEQ ID NO: 12305 - DNA, 18 bp, Homo sapiens
agtgctctcaccacgagg

SEQ ID NO: 12306 - DNA, 22 bp, Homo sapiens
ccaggctctcaaccgtctccct

SEQ ID NO: 12307 - DNA, 21 bp, Homo sapiens
aaataaaacatggccttaaca

SEQ ID NO: 12308 - DNA, 19 bp, Homo sapiens
tttaggtgatctcaaatta

SEQ ID NO: 12309 - DNA, 20 bp, Homo sapiens
tgcatcatttttcatttgcc

SEQ ID NO: 12310 - DNA, 17 bp, Homo sapiens
ccagaaaacaagccctg

SEQ ID NO: 12311 - DNA, 20 bp, Homo sapiens
cctgccagcctcctacctca

SEQ ID NO: 12312 - DNA, 18 bp, Homo sapiens
tgccagcctcctacctca

SEQ ID NO: 12313 - DNA, 17 bp, Homo sapiens
ccgtggagcttgccgtc

SEQ ID NO: 12314 - DNA, 20 bp, Homo sapiens
aaatacagaaacctcagtga

SEQ ID NO: 12315 - DNA, 18 bp, Homo sapiens
atgcttgacagtgtgaaa

SEQ ID NO: 12316 - DNA, 20 bp, Homo sapiens
catacagtgcctttgagcaa

SEQ ID NO: 12317 - DNA, 18 bp, Homo sapiens
aagtgtggtgtttggttt

SEQ ID NO: 12318 - DNA, 18 bp, Homo sapiens
gcctcggccacttggttc

SEQ ID NO: 12319 - DNA, 17 bp, Homo sapiens
tctggacagaccacaac

SEQ ID NO: 12320 - DNA, 20 bp, Homo sapiens
ttactgtcatgtcatttacc

SEQ ID NO: 12321 - DNA, 21 bp, Homo sapiens
ttgatgagtgattgcctgtcc

SEQ ID NO: 12322 - DNA, 20 bp, Homo sapiens
cagcaatcaaattatggaca

SEQ ID NO: 12323 - DNA, 19 bp, Homo sapiens
gcatttgtgaatttaatag

SEQ ID NO: 12324 - DNA, 22 bp, Homo sapiens
tccaaaataacctaactgcagc

SEQ ID NO: 12325 - DNA, 22 bp, Homo sapiens
tcctacgttagaaaccattctt

SEQ ID NO: 12326 - DNA, 21 bp, Homo sapiens
tcttttatctgttgtagcttt

SEQ ID NO: 12327 - DNA, 19 bp, Homo sapiens
gtgaaaatcatatttgggc

SEQ ID NO: 12328 - DNA, 21 bp, Homo sapiens
tctgtttaatgaatttggaaa

SEQ ID NO: 12329 - DNA, 21 bp, Homo sapiens
acgagggttacccctttgctt

SEQ ID NO: 12330 - DNA, 20 bp, Homo sapiens
tcaccgcaacctccacctcc

SEQ ID NO: 12331 - DNA, 18 bp, Homo sapiens
tccacctcctgggttcaa

SEQ ID NO: 12332 - DNA, 23 bp, Homo sapiens
tccagctgtgcctctgctgccag

SEQ ID NO: 12333 - DNA, 18 bp, Homo sapiens
tctccccatctagccagg

SEQ ID NO: 12334 - DNA, 22 bp, Homo sapiens
agagcaagctcttaagttcaca

SEQ ID NO: 12335 - DNA, 23 bp, Homo sapiens
caaagagctcaccagcattttcc

SEQ ID NO: 12336 - DNA, 23 bp, Homo sapiens
ccacctggtgtcagcctcagtca

SEQ ID NO: 12337 - DNA, 17 bp, Homo sapiens
ctgccacctggtgtcag

SEQ ID NO: 12338 - DNA, 19 bp, Homo sapiens
gcacatcccaccagtgaaa

SEQ ID NO: 12339 - DNA, 17 bp, Homo sapiens
tgcttcctcatttgctt

SEQ ID NO: 12340 - DNA, 19 bp, Homo sapiens
ttcttcttttcttgatctt

SEQ ID NO: 12341 - DNA, 20 bp, Homo sapiens
actttgaattcctggattca

SEQ ID NO: 12342 - DNA, 23 bp, Homo sapiens
gcccgcggttccaccgctctgaa

SEQ ID NO: 12343 - DNA, 19 bp, Homo sapiens
aaggactcacctccttgag

SEQ ID NO: 12344 - DNA, 19 bp, Homo sapiens
cagacaaagcagaagctgc

SEQ ID NO: 12345 - DNA, 21 bp, Homo sapiens
tatctccatgagaaaattcat

SEQ ID NO: 12346 - DNA, 21 bp, Homo sapiens
acttcagaagcaatgggggca

SEQ ID NO: 12347 - DNA, 17 bp, Homo sapiens
cacccatgtcaacatct

SEQ ID NO: 12348 - DNA, 18 bp, Homo sapiens
cactgaacaaaggcttca

SEQ ID NO: 12349 - DNA, 24 bp, Homo sapiens
accagaccccaagtcccccacccc

SEQ ID NO: 12350 - DNA, 20 bp, Homo sapiens
ggacccccgcccacatcctc

SEQ ID NO: 12351 - DNA, 23 bp, Homo sapiens
ggttcctctaaccagaaccagct

SEQ ID NO: 12352 - DNA, 18 bp, Homo sapiens
acacacagaagaattggt

SEQ ID NO: 12353 - DNA, 18 bp, Homo sapiens
catctgtcatgtcgatga

SEQ ID NO: 12354 - DNA, 18 bp, Homo sapiens
tctatccagcaagatcct

SEQ ID NO: 12355 - DNA, 20 bp, Homo sapiens
tgctgaattacttgtgaaga

SEQ ID NO: 12356 - DNA, 16 bp, Homo sapiens
caagggtttgggtttt

SEQ ID NO: 12357 - DNA, 18 bp, Homo sapiens
tttagttcctcaacatat

SEQ ID NO: 12358 - DNA, 24 bp, Homo sapiens
acttgaatgggacttggctggcct

SEQ ID NO: 12359 - DNA, 25 bp, Homo sapiens
ccctggtcctgggcggggcctgtgg

SEQ ID NO: 12360 - DNA, 17 bp, Homo sapiens
gcgcagggaggggccgg

SEQ ID NO: 12361 - DNA, 23 bp, Homo sapiens
ggaggaggaggtggtgactggca

SEQ ID NO: 12362 - DNA, 18 bp, Homo sapiens
gaaaactattccaggact

SEQ ID NO: 12363 - DNA, 19 bp, Homo sapiens
tgtctatacattggtcacc

SEQ ID NO: 12364 - DNA, 19 bp, Homo sapiens
ctactgcccccccccctct

SEQ ID NO: 12365 - DNA, 18 bp, Homo sapiens
ctcctccaaaaccaggga

SEQ ID NO: 12366 - DNA, 21 bp, Homo sapiens
tagggtccctggttccagtta

SEQ ID NO: 12367 - DNA, 28 bp, Homo sapiens
taggtgtgattattttaatatgaaggtg

SEQ ID NO: 12368 - DNA, 18 bp, Homo sapiens
tctggaaaaatttcctcc

SEQ ID NO: 12369 - DNA, 19 bp, Homo sapiens
aaactggtcccctccacca

SEQ ID NO: 12370 - DNA, 16 bp, Homo sapiens
acacagactcctactc

SEQ ID NO: 12371 - DNA, 21 bp, Homo sapiens
gcaagggcggtcgggtcccga

SEQ ID NO: 12372 - DNA, 23 bp, Homo sapiens
tcacatgaggttactgtttcttt

SEQ ID NO: 12373 - DNA, 19 bp, Homo sapiens
tccacagcgcctccggtgt

SEQ ID NO: 12374 - DNA, 19 bp, Homo sapiens
gaatgcaccgagaggaatg

SEQ ID NO: 12375 - DNA, 21 bp, Homo sapiens
acaaaacaccttgtcaacctc

SEQ ID NO: 12376 - DNA, 18 bp, Homo sapiens
cagcacaccattgatgaa

SEQ ID NO: 12377 - DNA, 20 bp, Homo sapiens
taaacaaattagcaatcatt

SEQ ID NO: 12378 - DNA, 19 bp, Homo sapiens
aaaaggttacatagatatg

SEQ ID NO: 12379 - DNA, 22 bp, Homo sapiens
agcacagtgctcctccatatca

SEQ ID NO: 12380 - DNA, 19 bp, Homo sapiens
tgtatggacagtttttccg

SEQ ID NO: 12381 - DNA, 24 bp, Homo sapiens
acctgatcgagcgctgtctggctt

SEQ ID NO: 12382 - DNA, 20 bp, Homo sapiens
gctgtctggctttaacctga

SEQ ID NO: 12383 - DNA, 18 bp, Homo sapiens
atcttaatttggatttaa

SEQ ID NO: 12384 - DNA, 21 bp, Homo sapiens
ctgtaaaagaaaaaagaatca

SEQ ID NO: 12385 - DNA, 18 bp, Homo sapiens
atcagatcctgtttgata

SEQ ID NO: 12386 - DNA, 20 bp, Homo sapiens
atctgcaattgtgtggctca

SEQ ID NO: 12387 - DNA, 15 bp, Homo sapiens
ctttcatattggcac

SEQ ID NO: 12388 - DNA, 17 bp, Homo sapiens
gcctctgagggttctgg

SEQ ID NO: 12389 - DNA, 15 bp, Homo sapiens
tcccattgcagcctc

SEQ ID NO: 12390 - DNA, 18 bp, Homo sapiens
tggatacacatggagctg

SEQ ID NO: 12391 - DNA, 19 bp, Homo sapiens
aaaacccggtcttaactga

SEQ ID NO: 12392 - DNA, 19 bp, Homo sapiens
cgtaatgcaaaaacccggt

SEQ ID NO: 12393 - DNA, 22 bp, Homo sapiens
tgaatgaaccaatgtgtgattg

SEQ ID NO: 12394 - DNA, 21 bp, Homo sapiens
aacaaaccatagaggcattga

SEQ ID NO: 12395 - DNA, 21 bp, Homo sapiens
aattagggacaaatgatgtta

SEQ ID NO: 12396 - DNA, 20 bp, Homo sapiens
agaaaagttttacctggttg

SEQ ID NO: 12397 - DNA, 19 bp, Homo sapiens
agtactggattccagcatt

SEQ ID NO: 12398 - DNA, 19 bp, Homo sapiens
catagctccactctgctgc

SEQ ID NO: 12399 - DNA, 17 bp, Homo sapiens
cctttttggagttgctc

SEQ ID NO: 12400 - DNA, 18 bp, Homo sapiens
ctagctccactctgctgc

SEQ ID NO: 12401 - DNA, 17 bp, Homo sapiens
tagctccactctgctgc

SEQ ID NO: 12402 - DNA, 18 bp, Homo sapiens
agtgaacacacacaaggg

SEQ ID NO: 12403 - DNA, 23 bp, Homo sapiens
ctccagctcccactccctttcca

SEQ ID NO: 12404 - DNA, 16 bp, Homo sapiens
gctggcgcccatccta

SEQ ID NO: 12405 - DNA, 26 bp, Homo sapiens
gcttgggccctgcattggcctggcct

SEQ ID NO: 12406 - DNA, 22 bp, Homo sapiens
tcccactccctttccaacctca

SEQ ID NO: 12407 - DNA, 23 bp, Homo sapiens
ttgcccacacactttccatctct

SEQ ID NO: 12408 - DNA, 20 bp, Homo sapiens
ataataagtgcttattgttt

SEQ ID NO: 12409 - DNA, 22 bp, Homo sapiens
ccacattttcaatcctccttca

SEQ ID NO: 12410 - DNA, 22 bp, Homo sapiens
ccccatggcagaactctgctgg

SEQ ID NO: 12411 - DNA, 19 bp, Homo sapiens
ctctctttgaccatactga

SEQ ID NO: 12412 - DNA, 17 bp, Homo sapiens
ctctttgaccatactga

SEQ ID NO: 12413 - DNA, 21 bp, Homo sapiens
ggaaacagaatactttgcaca

SEQ ID NO: 12414 - DNA, 19 bp, Homo sapiens
gtatgcttatccttgactg

SEQ ID NO: 12415 - DNA, 21 bp, Homo sapiens
tctgtgtggactttagtccca

SEQ ID NO: 12416 - DNA, 18 bp, Homo sapiens
aaaaaaatcagggatata

SEQ ID NO: 12417 - DNA, 23 bp, Homo sapiens
ctgagcctcaccctatcagtcag

SEQ ID NO: 12418 - DNA, 20 bp, Homo sapiens
taagtgggcctcctggggat

SEQ ID NO: 12419 - DNA, 19 bp, Homo sapiens
acagtgcaccgctgtccca

SEQ ID NO: 12420 - DNA, 21 bp, Homo sapiens
atctttggcagctcttttctt

SEQ ID NO: 12421 - DNA, 18 bp, Homo sapiens
tcgtttcccattgctgta

SEQ ID NO: 12422 - DNA, 20 bp, Homo sapiens
aaaaatacctaactatggtt

SEQ ID NO: 12423 - DNA, 21 bp, Homo sapiens
agaagaggtcccaatccccca

SEQ ID NO: 12424 - DNA, 19 bp, Homo sapiens
gcggccagcaggcacctgg

SEQ ID NO: 12425 - DNA, 20 bp, Homo sapiens
gctggaagcccaggaagcac

SEQ ID NO: 12426 - DNA, 18 bp, Homo sapiens
ttccgccctaatggaggt

SEQ ID NO: 12427 - DNA, 21 bp, Homo sapiens
aaacacacaagaacaataaca

SEQ ID NO: 12428 - DNA, 22 bp, Homo sapiens
ccaatatatacatggttagcca

SEQ ID NO: 12429 - DNA, 19 bp, Homo sapiens
gattattgggatgaagcta

SEQ ID NO: 12430 - DNA, 19 bp, Homo sapiens
ggtatactcactattgtga

SEQ ID NO: 12431 - DNA, 18 bp, Homo sapiens
taagaaatggaaagactc

SEQ ID NO: 12432 - DNA, 19 bp, Homo sapiens
ttccagaatgcaggttcta

SEQ ID NO: 12433 - DNA, 18 bp, Homo sapiens
atctggtgatatgcaatt

SEQ ID NO: 12434 - DNA, 21 bp, Homo sapiens
attttctatactggtgttaga

SEQ ID NO: 12435 - DNA, 17 bp, Homo sapiens
tccattccccaagttca

SEQ ID NO: 12436 - DNA, 20 bp, Homo sapiens
ttctctggagaacttcctca

SEQ ID NO: 12437 - DNA, 17 bp, Homo sapiens
ttgttccgtctgtaaca

SEQ ID NO: 12438 - DNA, 17 bp, Homo sapiens
cagaattatgactcttc

SEQ ID NO: 12439 - DNA, 16 bp, Homo sapiens
gaatatgcttcccgca

SEQ ID NO: 12440 - DNA, 20 bp, Homo sapiens
tctggggaagactgtttggc

SEQ ID NO: 12441 - DNA, 22 bp, Homo sapiens
agctgtatcatcctctcacctg

SEQ ID NO: 12442 - DNA, 19 bp, Homo sapiens
agtggagttatgtcactga

SEQ ID NO: 12443 - DNA, 20 bp, Homo sapiens
cctctgcctcccaggttcaa

SEQ ID NO: 12444 - DNA, 18 bp, Homo sapiens
ggcttctgctgccatcct

SEQ ID NO: 12445 - DNA, 17 bp, Homo sapiens
tcaagcgattctcatgc

SEQ ID NO: 12446 - DNA, 16 bp, Homo sapiens
tcagaataatgagaca

SEQ ID NO: 12447 - DNA, 19 bp, Homo sapiens
gtttgacttttcataagca

SEQ ID NO: 12448 - DNA, 22 bp, Homo sapiens
agaaataagaccactgttttga

SEQ ID NO: 12449 - DNA, 20 bp, Homo sapiens
agtgaagctgaagataacct

SEQ ID NO: 12450 - DNA, 19 bp, Homo sapiens
cccctgcagccattgcagc

SEQ ID NO: 12451 - DNA, 24 bp, Homo sapiens
gaaaggatccttcagttacataca

SEQ ID NO: 12452 - DNA, 21 bp, Homo sapiens
tgcctgtggagtctctgctga

SEQ ID NO: 12453 - DNA, 21 bp, Homo sapiens
atcacggagttcagatgtgtt

SEQ ID NO: 12454 - DNA, 18 bp, Homo sapiens
gaaaaaagaggaaatact

SEQ ID NO: 12455 - DNA, 19 bp, Homo sapiens
gctttttgtccatgtgccg

SEQ ID NO: 12456 - DNA, 19 bp, Homo sapiens
tgcttgttagaactcagct

SEQ ID NO: 12457 - DNA, 20 bp, Homo sapiens
aacagtcatgccaactgtga

SEQ ID NO: 12458 - DNA, 20 bp, Homo sapiens
ccaaacagtcatgccaactg

SEQ ID NO: 12459 - DNA, 21 bp, Homo sapiens
gccgtagcggccgcctgaccc

SEQ ID NO: 12460 - DNA, 20 bp, Homo sapiens
tcggtgtgttgtttttttaa

SEQ ID NO: 12461 - DNA, 24 bp, Homo sapiens
tttgaagtcaatcttttcatcaga

SEQ ID NO: 12462 - DNA, 17 bp, Homo sapiens
gatgaatctctgtgaca

SEQ ID NO: 12463 - DNA, 21 bp, Homo sapiens
tgtgactgaagacatttctga

SEQ ID NO: 12464 - DNA, 25 bp, Homo sapiens
cttttttatttttttccttaatttt

SEQ ID NO: 12465 - DNA, 25 bp, Homo sapiens
ggaaagaaaacttgatgtgattgcc

SEQ ID NO: 12466 - DNA, 26 bp, Homo sapiens
taggtggaataatccaacataaattg

SEQ ID NO: 12467 - DNA, 21 bp, Homo sapiens
ccaccattccctgccagccca

SEQ ID NO: 12468 - DNA, 18 bp, Homo sapiens
cctgacgatatcctggaa

SEQ ID NO: 12469 - DNA, 23 bp, Homo sapiens
gcccaccccaccctggggccctg

SEQ ID NO: 12470 - DNA, 22 bp, Homo sapiens
gtgcccctaggttggtgggtct

SEQ ID NO: 12471 - DNA, 23 bp, Homo sapiens
taaaccacagcctcagaccagct

SEQ ID NO: 12472 - DNA, 23 bp, Homo sapiens
tgacgatatcctggaaggactga

SEQ ID NO: 12473 - DNA, 21 bp, Homo sapiens
tgcccagaaaagtgcccctag

SEQ ID NO: 12474 - DNA, 24 bp, Homo sapiens
ggttgttcttttttctttttttaa

SEQ ID NO: 12475 - DNA, 20 bp, Homo sapiens
tggaatgtatgtctggagta

SEQ ID NO: 12476 - DNA, 19 bp, Homo sapiens
tttgccttggtttgcaata

SEQ ID NO: 12477 - DNA, 18 bp, Homo sapiens
ctccctgactctgcttct

SEQ ID NO: 12478 - DNA, 24 bp, Homo sapiens
gctctggggcagtgaggaactaga

SEQ ID NO: 12479 - DNA, 18 bp, Homo sapiens
taaataaaaacataaacc

SEQ ID NO: 12480 - DNA, 19 bp, Homo sapiens
tttcttcaacaactattca

SEQ ID NO: 12481 - DNA, 19 bp, Homo sapiens
tcaccatcttttcccacaa

SEQ ID NO: 12482 - DNA, 18 bp, Homo sapiens
tctctcttatttagtctt

SEQ ID NO: 12483 - DNA, 21 bp, Homo sapiens
ttttgaatgttaaatgtcaaa

SEQ ID NO: 12484 - DNA, 21 bp, Homo sapiens
ccccttcacctgcagctatga

SEQ ID NO: 12485 - DNA, 20 bp, Homo sapiens
cctgaaggaagacctgcgga

SEQ ID NO: 12486 - DNA, 17 bp, Homo sapiens
gaggcctttccatagct

SEQ ID NO: 12487 - DNA, 17 bp, Homo sapiens
ttccagaaagaccccca

SEQ ID NO: 12488 - DNA, 23 bp, Homo sapiens
ggtttttgggaagggtgtgcgtg

SEQ ID NO: 12489 - DNA, 18 bp, Homo sapiens
agcaattcattggaacac

SEQ ID NO: 12490 - DNA, 18 bp, Homo sapiens
cctgctaaaagagatctt

SEQ ID NO: 12491 - DNA, 20 bp, Homo sapiens
ccctcatcggcccgcagctg

SEQ ID NO: 12492 - DNA, 18 bp, Homo sapiens
cactgccacacgcagctc

SEQ ID NO: 12493 - DNA, 18 bp, Homo sapiens
cagaacaagctgttctca

SEQ ID NO: 12494 - DNA, 18 bp, Homo sapiens
aaaacatttggattggta

SEQ ID NO: 12495 - DNA, 21 bp, Homo sapiens
aaggaaaccccagccccacca

SEQ ID NO: 12496 - DNA, 24 bp, Homo sapiens
caccccgagtcctgagctcacttt

SEQ ID NO: 12497 - DNA, 18 bp, Homo sapiens
ccaagcgctccggcggag

SEQ ID NO: 12498 - DNA, 20 bp, Homo sapiens
ccgcctcccacccccacccc

SEQ ID NO: 12499 - DNA, 19 bp, Homo sapiens
cttctctgaatgcatgtca

SEQ ID NO: 12500 - DNA, 18 bp, Homo sapiens
cttgggtctggctggctc

SEQ ID NO: 12501 - DNA, 21 bp, Homo sapiens
gcattacctcacccggcccca

SEQ ID NO: 12502 - DNA, 21 bp, Homo sapiens
gccaccgatggagggtcgtgg

SEQ ID NO: 12503 - DNA, 16 bp, Homo sapiens
tcagtgcccaggaccg

SEQ ID NO: 12504 - DNA, 22 bp, Homo sapiens
tgtgggagtgcgggtgggggtg

SEQ ID NO: 12505 - DNA, 19 bp, Homo sapiens
caggcctcccactcctccc

SEQ ID NO: 12506 - DNA, 19 bp, Homo sapiens
cccagccccctctccccct

SEQ ID NO: 12507 - DNA, 22 bp, Homo sapiens
tggagagaacactaagaggtga

SEQ ID NO: 12508 - DNA, 17 bp, Homo sapiens
cctgtttaaagatttca

SEQ ID NO: 12509 - DNA, 22 bp, Homo sapiens
gacttcatcttcaaaactgcca

SEQ ID NO: 12510 - DNA, 20 bp, Homo sapiens
gcaaaaacaccaccaatcac

SEQ ID NO: 12511 - DNA, 20 bp, Homo sapiens
ccccgcctctccctggcagc

SEQ ID NO: 12512 - DNA, 16 bp, Homo sapiens
cccgccaccgccacca

SEQ ID NO: 12513 - DNA, 18 bp, Homo sapiens
accggaaggtccaggtga

SEQ ID NO: 12514 - DNA, 19 bp, Homo sapiens
ctgcaagctccgcctccca

SEQ ID NO: 12515 - DNA, 19 bp, Homo sapiens
agcttttccagttaaattg

SEQ ID NO: 12516 - DNA, 17 bp, Homo sapiens
attatgtttaatcgcca

SEQ ID NO: 12517 - DNA, 19 bp, Homo sapiens
gctttgacacagcactgtt

SEQ ID NO: 12518 - DNA, 27 bp, Homo sapiens
ggaagtcctcaaggaaaagataccaaa

SEQ ID NO: 12519 - DNA, 17 bp, Homo sapiens
tcgagttattcaatgat

SEQ ID NO: 12520 - DNA, 19 bp, Homo sapiens
taacacccagagcatgata

SEQ ID NO: 12521 - DNA, 18 bp, Homo sapiens
agagagaaaacagcactt

SEQ ID NO: 12522 - DNA, 18 bp, Homo sapiens
caccaccggcaccctccc

SEQ ID NO: 12523 - DNA, 26 bp, Homo sapiens
ctttgagttacaggaaggtctccgaa

SEQ ID NO: 12524 - DNA, 17 bp, Homo sapiens
gactttaacataagcta

SEQ ID NO: 12525 - DNA, 27 bp, Homo sapiens
gtgtgtgtgagtgtgagtgtgcggctg

SEQ ID NO: 12526 - DNA, 19 bp, Homo sapiens
aaactcctgacctcaggtg

SEQ ID NO: 12527 - DNA, 21 bp, Homo sapiens
atcttggcttactgcaacctc

SEQ ID NO: 12528 - DNA, 22 bp, Homo sapiens
cactgactcagctctgaccttc

SEQ ID NO: 12529 - DNA, 21 bp, Homo sapiens
tcaacaacttctgctgcatta

SEQ ID NO: 12530 - DNA, 17 bp, Homo sapiens
tcaagtgattctcctgc

SEQ ID NO: 12531 - DNA, 18 bp, Homo sapiens
tccacctcctgggttcaa

SEQ ID NO: 12532 - DNA, 23 bp, Homo sapiens
agaggagcggccggagcgagaca

SEQ ID NO: 12533 - DNA, 19 bp, Homo sapiens
aggcagtaggcattcttta

SEQ ID NO: 12534 - DNA, 22 bp, Homo sapiens
gaggagcggccggagcgagaca

SEQ ID NO: 12535 - DNA, 17 bp, Homo sapiens
gcctttcacagcttctt

SEQ ID NO: 12536 - DNA, 16 bp, Homo sapiens
tgcgtgttgaatccca

SEQ ID NO: 12537 - DNA, 20 bp, Homo sapiens
actgcctatacccctcatca

SEQ ID NO: 12538 - DNA, 17 bp, Homo sapiens
caccacagccaccttct

SEQ ID NO: 12539 - DNA, 21 bp, Homo sapiens
cactgcctatacccctcatca

SEQ ID NO: 12540 - DNA, 23 bp, Homo sapiens
cccaccttctgccgccgccacca

SEQ ID NO: 12541 - DNA, 19 bp, Homo sapiens
ctgagcggccgcctgtcct

SEQ ID NO: 12542 - DNA, 20 bp, Homo sapiens
gagccccctgtccttcccac

SEQ ID NO: 12543 - DNA, 26 bp, Homo sapiens
cagcactagccaaacctcaccaactc

SEQ ID NO: 12544 - DNA, 23 bp, Homo sapiens
agatcattccactcagcctggga

SEQ ID NO: 12545 - DNA, 18 bp, Homo sapiens
aaaattaaagagactctc

SEQ ID NO: 12546 - DNA, 17 bp, Homo sapiens
aaacacactgaaatttc

SEQ ID NO: 12547 - DNA, 17 bp, Homo sapiens
ggaggcggcggcgcggc

SEQ ID NO: 12548 - DNA, 19 bp, Homo sapiens
cagaggaccagctccattc

SEQ ID NO: 12549 - DNA, 21 bp, Homo sapiens
ctatcaagaataaaccatgaa

SEQ ID NO: 12550 - DNA, 21 bp, Homo sapiens
ctatcaagagcaaactatgaa

SEQ ID NO: 12551 - DNA, 18 bp, Homo sapiens
ctgattgacaacagtgtt

SEQ ID NO: 12552 - DNA, 19 bp, Homo sapiens
tcaagtggataaaaagtgt

SEQ ID NO: 12553 - DNA, 23 bp, Homo sapiens
aaagcactgaactaagagtccca

SEQ ID NO: 12554 - DNA, 20 bp, Homo sapiens
cctctgtcaaccctcctgcc

SEQ ID NO: 12555 - DNA, 25 bp, Homo sapiens
ctcaagcagtgcgaaaagcagatta

SEQ ID NO: 12556 - DNA, 22 bp, Homo sapiens
accacacagtcacccctccctc

SEQ ID NO: 12557 - DNA, 22 bp, Homo sapiens
caccaccacacagtcacccctc

SEQ ID NO: 12558 - DNA, 20 bp, Homo sapiens
ccagcccctaagccccgtcc

SEQ ID NO: 12559 - DNA, 19 bp, Homo sapiens
ccccagctccccccgcagc

SEQ ID NO: 12560 - DNA, 18 bp, Homo sapiens
cccgcagccggctccgca

SEQ ID NO: 12561 - DNA, 20 bp, Homo sapiens
ctgtagtgaatgatgtgtca

SEQ ID NO: 12562 - DNA, 18 bp, Homo sapiens
ttaagtgattacactttt

SEQ ID NO: 12563 - DNA, 19 bp, Homo sapiens
aaactcctgacctcaggtg

SEQ ID NO: 12564 - DNA, 20 bp, Homo sapiens
cctctgcctcccaggttcaa

SEQ ID NO: 12565 - DNA, 19 bp, Homo sapiens
ctgcaacctctgcctccca

SEQ ID NO: 12566 - DNA, 18 bp, Homo sapiens
agggcagtcactgttgac

SEQ ID NO: 12567 - DNA, 20 bp, Homo sapiens
atcggggcgccgcgccggga

SEQ ID NO: 12568 - DNA, 19 bp, Homo sapiens
cacagatttttctttttca

SEQ ID NO: 12569 - DNA, 17 bp, Homo sapiens
gaaggcaacccccgctc

SEQ ID NO: 12570 - DNA, 18 bp, Homo sapiens
gcaaaagatctttccaaa

SEQ ID NO: 12571 - DNA, 16 bp, Homo sapiens
gtctagaaacatttct

SEQ ID NO: 12572 - DNA, 20 bp, Homo sapiens
tcctttaatttcaggtctca

SEQ ID NO: 12573 - DNA, 19 bp, Homo sapiens
tctttttcattgaaacttt

SEQ ID NO: 12574 - DNA, 16 bp, Homo sapiens
ttgcctagagcgctgc

SEQ ID NO: 12575 - DNA, 22 bp, Homo sapiens
ccagcccccaaagcagcccttc

SEQ ID NO: 12576 - DNA, 17 bp, Homo sapiens
ccccctctcaggagcca

SEQ ID NO: 12577 - DNA, 18 bp, Homo sapiens
cccctgcctttgggagca

SEQ ID NO: 12578 - DNA, 19 bp, Homo sapiens
gggcagggaggctttggca

SEQ ID NO: 12579 - DNA, 21 bp, Homo sapiens
tgggcaccaggcatgggactg

SEQ ID NO: 12580 - DNA, 24 bp, Homo sapiens
ttttgtcaggtgggagatttggaa

SEQ ID NO: 12581 - DNA, 23 bp, Homo sapiens
ggcatgaggtacaatgcctgcca

SEQ ID NO: 12582 - DNA, 20 bp, Homo sapiens
tgagcaaatggaacaatttt

SEQ ID NO: 12583 - DNA, 20 bp, Homo sapiens
acagcagcatttttatttca

SEQ ID NO: 12584 - DNA, 25 bp, Homo sapiens
ccttacccctggctgtttggacttt

SEQ ID NO: 12585 - DNA, 24 bp, Homo sapiens
gtcaatgctatttttgtttttaga

SEQ ID NO: 12586 - DNA, 19 bp, Homo sapiens
tgacatctttttaaagctt

SEQ ID NO: 12587 - DNA, 18 bp, Homo sapiens
ggataatactccatcata

SEQ ID NO: 12588 - DNA, 17 bp, Homo sapiens
tttttctacacctttga

SEQ ID NO: 12589 - DNA, 20 bp, Homo sapiens
gcagccggggatggccgtgt

SEQ ID NO: 12590 - DNA, 23 bp, Homo sapiens
ggaagaaacgccgctccctgcca

SEQ ID NO: 12591 - DNA, 16 bp, Homo sapiens
ggatctggaacctctc

SEQ ID NO: 12592 - DNA, 23 bp, Homo sapiens
gagaacttccaacaagcctcaaa

SEQ ID NO: 12593 - DNA, 23 bp, Homo sapiens
gcacaggcccgccctctgcctcc

SEQ ID NO: 12594 - DNA, 18 bp, Homo sapiens
ttattacaagatctttcc

SEQ ID NO: 12595 - DNA, 21 bp, Homo sapiens
acctgaaagtttttttggttt

SEQ ID NO: 12596 - DNA, 22 bp, Homo sapiens
agctgtcgctgccctgattcca

SEQ ID NO: 12597 - DNA, 17 bp, Homo sapiens
atcccagctacgtggga

SEQ ID NO: 12598 - DNA, 20 bp, Homo sapiens
cacctgtgcccccgcagctc

SEQ ID NO: 12599 - DNA, 17 bp, Homo sapiens
cctgcgctgacaagggc

SEQ ID NO: 12600 - DNA, 22 bp, Homo sapiens
cgggaggtcctcctccccctct

SEQ ID NO: 12601 - DNA, 20 bp, Homo sapiens
gcgtgtgaaatagtaagtca

SEQ ID NO: 12602 - DNA, 21 bp, Homo sapiens
tgtgggtgctgggtgtggctg

SEQ ID NO: 12603 - DNA, 17 bp, Homo sapiens
agtatcttttcatgaaa

SEQ ID NO: 12604 - DNA, 20 bp, Homo sapiens
cctctgcctcccgggttcaa

SEQ ID NO: 12605 - DNA, 21 bp, Homo sapiens
gaaaaaggaaaggccccttgt

SEQ ID NO: 12606 - DNA, 17 bp, Homo sapiens
cacaggactttgatgaa

SEQ ID NO: 12607 - DNA, 21 bp, Homo sapiens
cccacaaggaaccctcaggcc

SEQ ID NO: 12608 - DNA, 22 bp, Homo sapiens
tcaggggaccccactcccctca

SEQ ID NO: 12609 - DNA, 22 bp, Homo sapiens
aagacatcaaaggcaacatatg

SEQ ID NO: 12610 - DNA, 18 bp, Homo sapiens
atcaaaggcaacatatga

SEQ ID NO: 12611 - DNA, 19 bp, Homo sapiens
ggccgggtgcggtggctca

SEQ ID NO: 12612 - DNA, 20 bp, Homo sapiens
acacaggacttggtctgctg

SEQ ID NO: 12613 - DNA, 22 bp, Homo sapiens
acttggtctgctggcctggcct

SEQ ID NO: 12614 - DNA, 16 bp, Homo sapiens
cctcttgcgtctgtgc

SEQ ID NO: 12615 - DNA, 17 bp, Homo sapiens
tgttggacttctcttca

SEQ ID NO: 12616 - DNA, 27 bp, Homo sapiens
tagatgattacttgtgatgtgaaactg

SEQ ID NO: 12617 - DNA, 23 bp, Homo sapiens
agccccgccacgcagagcccaga

SEQ ID NO: 12618 - DNA, 24 bp, Homo sapiens
gcgctcccggccgctctcgcctcc

SEQ ID NO: 12619 - DNA, 18 bp, Homo sapiens
atgtagttcccatgtgcc

SEQ ID NO: 12620 - DNA, 19 bp, Homo sapiens
gaggatcagaccttctttc

SEQ ID NO: 12621 - DNA, 20 bp, Homo sapiens
aaacactgaagtgcttttca

SEQ ID NO: 12622 - DNA, 22 bp, Homo sapiens
acctgggttcacacagcttttt

SEQ ID NO: 12623 - DNA, 19 bp, Homo sapiens
ctgaccaaaggtctaggct

SEQ ID NO: 12624 - DNA, 24 bp, Homo sapiens
cctcttagaactggttttaacctt

SEQ ID NO: 12625 - DNA, 24 bp, Homo sapiens
gcgcctcggccgccgccgccgcct

SEQ ID NO: 12626 - DNA, 24 bp, Homo sapiens
gcttttcccccaaagtatcatgtg

SEQ ID NO: 12627 - DNA, 18 bp, Homo sapiens
ttgagattttttcagtga

SEQ ID NO: 12628 - DNA, 18 bp, Homo sapiens
aaccaatctgtatcatgt

SEQ ID NO: 12629 - DNA, 18 bp, Homo sapiens
actgatgtaattgtcatt

SEQ ID NO: 12630 - DNA, 17 bp, Homo sapiens
gaagtgaccaatgtaat

SEQ ID NO: 12631 - DNA, 15 bp, Homo sapiens
tgatttgttctttga

SEQ ID NO: 12632 - DNA, 22 bp, Homo sapiens
ttctaggtcattaacgtttttt

SEQ ID NO: 12633 - DNA, 21 bp, Homo sapiens
atctggtgtccagcatggatg

SEQ ID NO: 12634 - DNA, 20 bp, Homo sapiens
atgttggatctgtcattatc

SEQ ID NO: 12635 - DNA, 22 bp, Homo sapiens
cggcaccattggtctctgggta

SEQ ID NO: 12636 - DNA, 22 bp, Homo sapiens
ctgggtctacaaggactttcca

SEQ ID NO: 12637 - DNA, 15 bp, Homo sapiens
ggccttcttcccaca

SEQ ID NO: 12638 - DNA, 24 bp, Homo sapiens
caatctagcgggagagacaggata

SEQ ID NO: 12639 - DNA, 18 bp, Homo sapiens
tggacccttgtgttttga

SEQ ID NO: 12640 - DNA, 15 bp, Homo sapiens
ctctctcctctcctc

SEQ ID NO: 12641 - DNA, 20 bp, Homo sapiens
ggaaaggcagcagcggcggc

SEQ ID NO: 12642 - DNA, 21 bp, Homo sapiens
tctggagacaccagctccaca

SEQ ID NO: 12643 - DNA, 20 bp, Homo sapiens
tgaatgggctgggggtgggg

SEQ ID NO: 12644 - DNA, 22 bp, Homo sapiens
ctgagatatgtacacagtcatt

SEQ ID NO: 12645 - DNA, 17 bp, Homo sapiens
ctgcagttacggagctg

SEQ ID NO: 12646 - DNA, 22 bp, Homo sapiens
actgaaggacctgagctggcca

SEQ ID NO: 12647 - DNA, 15 bp, Homo sapiens
aggacctgagctggc

SEQ ID NO: 12648 - DNA, 20 bp, Homo sapiens
atctgagctgcagcctggct

SEQ ID NO: 12649 - DNA, 19 bp, Homo sapiens
ccaccccacctccactccc

SEQ ID NO: 12650 - DNA, 19 bp, Homo sapiens
ccacctccactcccacctc

SEQ ID NO: 12651 - DNA, 18 bp, Homo sapiens
cctgagctggccaggccc

SEQ ID NO: 12652 - DNA, 19 bp, Homo sapiens
cctgccccaccccacctcc

SEQ ID NO: 12653 - DNA, 17 bp, Homo sapiens
acttcttggaaaagcca

SEQ ID NO: 12654 - DNA, 18 bp, Homo sapiens
ccagagcaccaagtccag

SEQ ID NO: 12655 - DNA, 22 bp, Homo sapiens
gttatgacatatgtaatacaca

SEQ ID NO: 12656 - DNA, 20 bp, Homo sapiens
tccccagctcactctctgaa

SEQ ID NO: 12657 - DNA, 16 bp, Homo sapiens
acaatttacctgtcaa

SEQ ID NO: 12658 - DNA, 21 bp, Homo sapiens
agtcttttccctagttcctga

SEQ ID NO: 12659 - DNA, 18 bp, Homo sapiens
atgcatcatctcactttt

SEQ ID NO: 12660 - DNA, 19 bp, Homo sapiens
attcagttgacacgaggca

SEQ ID NO: 12661 - DNA, 24 bp, Homo sapiens
ccctgcaaatggatggcttgtgaa

SEQ ID NO: 12662 - DNA, 27 bp, Homo sapiens
ccttttccgcacagctgtgttgacttt

SEQ ID NO: 12663 - DNA, 20 bp, Homo sapiens
cgcgcacccgcccgcgccgc

SEQ ID NO: 12664 - DNA, 17 bp, Homo sapiens
ctgcagccacgtggcca

SEQ ID NO: 12665 - DNA, 19 bp, Homo sapiens
gagctatcgtttccgtgga

SEQ ID NO: 12666 - DNA, 17 bp, Homo sapiens
ggacacccagcgtgcaa

SEQ ID NO: 12667 - DNA, 18 bp, Homo sapiens
ggtccctgttttgcttta

SEQ ID NO: 12668 - DNA, 22 bp, Homo sapiens
gtccagggcagatggcagagga

SEQ ID NO: 12669 - DNA, 20 bp, Homo sapiens
tatgtggaaacagtgtttta

SEQ ID NO: 12670 - DNA, 22 bp, Homo sapiens
cagcattacagtaactaactct

SEQ ID NO: 12671 - DNA, 18 bp, Homo sapiens
gtgatgccacgtaactta

SEQ ID NO: 12672 - DNA, 18 bp, Homo sapiens
tattcagctcttgagcaa

SEQ ID NO: 12673 - DNA, 17 bp, Homo sapiens
tcaatcctcttctcttc

SEQ ID NO: 12674 - DNA, 19 bp, Homo sapiens
agcatccatcactcctgtg

SEQ ID NO: 12675 - DNA, 18 bp, Homo sapiens
caggaggagcagcacccg

SEQ ID NO: 12676 - DNA, 17 bp, Homo sapiens
gatgtggcctccgtcca

SEQ ID NO: 12677 - DNA, 23 bp, Homo sapiens
ggcctccgtccagcgcgctggcc

SEQ ID NO: 12678 - DNA, 16 bp, Homo sapiens
gggtccaggcctagca

SEQ ID NO: 12679 - DNA, 21 bp, Homo sapiens
tccttggccgagagaacctga

SEQ ID NO: 12680 - DNA, 21 bp, Homo sapiens
taattccaagtggcatgtatc

SEQ ID NO: 12681 - DNA, 23 bp, Homo sapiens
ccaaatgtggcaaaccaacccca

SEQ ID NO: 12682 - DNA, 19 bp, Homo sapiens
ggccaaatgtggcaaacca

SEQ ID NO: 12683 - DNA, 19 bp, Homo sapiens
agaatatatttaaatgcaa

SEQ ID NO: 12684 - DNA, 18 bp, Homo sapiens
cctgcaacctccacctcc

SEQ ID NO: 12685 - DNA, 19 bp, Homo sapiens
ctgcaacctccacctccca

SEQ ID NO: 12686 - DNA, 19 bp, Homo sapiens
gaactgccataaaatctca

SEQ ID NO: 12687 - DNA, 15 bp, Homo sapiens
gtttctgaagtctca

SEQ ID NO: 12688 - DNA, 18 bp, Homo sapiens
tccacctcccaggttcaa

SEQ ID NO: 12689 - DNA, 20 bp, Homo sapiens
tggccaggctggtcttgaac

SEQ ID NO: 12690 - DNA, 22 bp, Homo sapiens
tcctgcccggggggcctggtgg

SEQ ID NO: 12691 - DNA, 20 bp, Homo sapiens
tggccccgcctcctccttca

SEQ ID NO: 12692 - DNA, 20 bp, Homo sapiens
aagggaatactatctaacca

SEQ ID NO: 12693 - DNA, 22 bp, Homo sapiens
caattttctgacttgcttttct

SEQ ID NO: 12694 - DNA, 22 bp, Homo sapiens
cactgaattccaatttcatttc

SEQ ID NO: 12695 - DNA, 17 bp, Homo sapiens
ctaccttgtgcctctca

SEQ ID NO: 12696 - DNA, 19 bp, Homo sapiens
taacagtctgtgttttctc

SEQ ID NO: 12697 - DNA, 15 bp, Homo sapiens
agagggggcgggaca

SEQ ID NO: 12698 - DNA, 19 bp, Homo sapiens
agccacactcctggcatcc

SEQ ID NO: 12699 - DNA, 20 bp, Homo sapiens
catgaagtcactgattagtt

SEQ ID NO: 12700 - DNA, 18 bp, Homo sapiens
gtcccttgtttttgatca

SEQ ID NO: 12701 - DNA, 17 bp, Homo sapiens
tcgacttgaaccactcc

SEQ ID NO: 12702 - DNA, 18 bp, Homo sapiens
ggccatgccagccacgtc

SEQ ID NO: 12703 - DNA, 17 bp, Homo sapiens
tctgtgaggagctgtgg

SEQ ID NO: 12704 - DNA, 26 bp, Homo sapiens
ttcactaaaatcagtgactcacttcc

SEQ ID NO: 12705 - DNA, 18 bp, Homo sapiens
agtgcttgacctttttgt

SEQ ID NO: 12706 - DNA, 20 bp, Homo sapiens
cacctccaccacccctccct

SEQ ID NO: 12707 - DNA, 20 bp, Homo sapiens
cactgactcatggcacctcc

SEQ ID NO: 12708 - DNA, 18 bp, Homo sapiens
gagaaggagctggcgaga

SEQ ID NO: 12709 - DNA, 22 bp, Homo sapiens
taaatgtatccagatgaggttg

SEQ ID NO: 12710 - DNA, 17 bp, Homo sapiens
tcaagtgattctcctgc

SEQ ID NO: 12711 - DNA, 18 bp, Homo sapiens
tccctgtcccagccagca

SEQ ID NO: 12712 - DNA, 16 bp, Homo sapiens
tgcatgtgtccactta

SEQ ID NO: 12713 - DNA, 20 bp, Homo sapiens
ggagaggcggcggccgcggc

SEQ ID NO: 12714 - DNA, 24 bp, Homo sapiens
atctggggagacagcaggatcaca

SEQ ID NO: 12715 - DNA, 19 bp, Homo sapiens
atgccactttaagctttat

SEQ ID NO: 12716 - DNA, 21 bp, Homo sapiens
ttctttggtgcctgcagttta

SEQ ID NO: 12717 - DNA, 20 bp, Homo sapiens
tctgttatgtgtgtttgctg

SEQ ID NO: 12718 - DNA, 19 bp, Homo sapiens
ctgtgggctggaaatccca

SEQ ID NO: 12719 - DNA, 16 bp, Homo sapiens
tcaagactatatctaa

SEQ ID NO: 12720 - DNA, 18 bp, Homo sapiens
caggtgaaaggtggctgc

SEQ ID NO: 12721 - DNA, 23 bp, Homo sapiens
ctctggtgaccacttgcctgtgg

SEQ ID NO: 12722 - DNA, 18 bp, Homo sapiens
agttctcaaatcgttttt

SEQ ID NO: 12723 - DNA, 19 bp, Homo sapiens
ctcaaaaacatgaacaagt

SEQ ID NO: 12724 - DNA, 20 bp, Homo sapiens
tcatacatatatccattata

SEQ ID NO: 12725 - DNA, 18 bp, Homo sapiens
cactttctccagtgctca

SEQ ID NO: 12726 - DNA, 22 bp, Homo sapiens
ccctcactttctccagtgctca

SEQ ID NO: 12727 - DNA, 21 bp, Homo sapiens
taatagggtgtggaatgtcgt

SEQ ID NO: 12728 - DNA, 21 bp, Homo sapiens
caccctctatgagtcccattt

SEQ ID NO: 12729 - DNA, 24 bp, Homo sapiens
cctttaactttgcagaccttcctt

SEQ ID NO: 12730 - DNA, 18 bp, Homo sapiens
tctatgagtcccatttta

SEQ ID NO: 12731 - DNA, 16 bp, Homo sapiens
tggctcccctttgagc

SEQ ID NO: 12732 - DNA, 18 bp, Homo sapiens
ttccctgcctcaccctca

SEQ ID NO: 12733 - DNA, 19 bp, Homo sapiens
aaactcctgacctcaggtg

SEQ ID NO: 12734 - DNA, 19 bp, Homo sapiens
aagcaattctcctgcctca

SEQ ID NO: 12735 - DNA, 21 bp, Homo sapiens
ctacactttgaaagatatatt

SEQ ID NO: 12736 - DNA, 17 bp, Homo sapiens
gctaaatcccaaagggg

SEQ ID NO: 12737 - DNA, 17 bp, Homo sapiens
gaccttgaatttggatt

SEQ ID NO: 12738 - DNA, 19 bp, Homo sapiens
tgtaattatcctggattca

SEQ ID NO: 12739 - DNA, 24 bp, Homo sapiens
caacgggagcgagttggtcaccgc

SEQ ID NO: 12740 - DNA, 22 bp, Homo sapiens
gcgccaagactcaggggatcgg

SEQ ID NO: 12741 - DNA, 19 bp, Homo sapiens
tctgggaagacaagttgct

SEQ ID NO: 12742 - DNA, 18 bp, Homo sapiens
ttttcattgaagagttga

SEQ ID NO: 12743 - DNA, 19 bp, Homo sapiens
gagcgagggcgcttcgctc

SEQ ID NO: 12744 - DNA, 21 bp, Homo sapiens
gaccctgtgccctccttccca

SEQ ID NO: 12745 - DNA, 24 bp, Homo sapiens
tctgcctgacaaggccagcaccca

SEQ ID NO: 12746 - DNA, 21 bp, Homo sapiens
cctgggcctcggcgggtcact

SEQ ID NO: 12747 - DNA, 22 bp, Homo sapiens
aaaatgcaatcactgtgttgta

SEQ ID NO: 12748 - DNA, 25 bp, Homo sapiens
aactgggtattcttgaattgctttt

SEQ ID NO: 12749 - DNA, 17 bp, Homo sapiens
atcttccaaagcactat

SEQ ID NO: 12750 - DNA, 23 bp, Homo sapiens
cagctgttctagagtttcagtca

SEQ ID NO: 12751 - DNA, 23 bp, Homo sapiens
cagggtcggtgggggggttggtt

SEQ ID NO: 12752 - DNA, 17 bp, Homo sapiens
cattaacgactagatta

SEQ ID NO: 12753 - DNA, 22 bp, Homo sapiens
cctggcacagtgctttgatctt

SEQ ID NO: 12754 - DNA, 17 bp, Homo sapiens
gtccagcaagatacttt

SEQ ID NO: 12755 - DNA, 19 bp, Homo sapiens
tgctgttaatgtattgctg

SEQ ID NO: 12756 - DNA, 19 bp, Homo sapiens
acctcccccgcacacacac

SEQ ID NO: 12757 - DNA, 18 bp, Homo sapiens
agaaagagggtcagtgga

SEQ ID NO: 12758 - DNA, 22 bp, Homo sapiens
ccattcaccagattatttgatg

SEQ ID NO: 12759 - DNA, 20 bp, Homo sapiens
ctgatggaaatatttcctcc

SEQ ID NO: 12760 - DNA, 24 bp, Homo sapiens
gcttctctcagagtctccccctct

SEQ ID NO: 12761 - DNA, 17 bp, Homo sapiens
gccaggcgtgcgggaga

SEQ ID NO: 12762 - DNA, 15 bp, Homo sapiens
gtgccccatcctctg

SEQ ID NO: 12763 - DNA, 21 bp, Homo sapiens
tgagttagactatttcccaca

SEQ ID NO: 12764 - DNA, 22 bp, Homo sapiens
acagtgtcaggatcgcgggctt

SEQ ID NO: 12765 - DNA, 23 bp, Homo sapiens
ccaggacgcacagaagcgcctca

SEQ ID NO: 12766 - DNA, 19 bp, Homo sapiens
cctgaattctctttggctt

SEQ ID NO: 12767 - DNA, 18 bp, Homo sapiens
gagcgcctgaccttcctc

SEQ ID NO: 12768 - DNA, 18 bp, Homo sapiens
ccaggccaccctgcctcc

SEQ ID NO: 12769 - DNA, 20 bp, Homo sapiens
ccccacccagtaccgcatct

SEQ ID NO: 12770 - DNA, 21 bp, Homo sapiens
gatgccaccttccttgtcccc

SEQ ID NO: 12771 - DNA, 21 bp, Homo sapiens
gccccctcggggacgccccca

SEQ ID NO: 12772 - DNA, 20 bp, Homo sapiens
ccccacccagtaccgcatct

SEQ ID NO: 12773 - DNA, 17 bp, Homo sapiens
cggggtgaaacctccca

SEQ ID NO: 12774 - DNA, 21 bp, Homo sapiens
gccccctcggggacgccccca

SEQ ID NO: 12775 - DNA, 21 bp, Homo sapiens
cagggttgtggcgcagcagtc

SEQ ID NO: 12776 - DNA, 19 bp, Homo sapiens
cttcctgcgcgcgcgcctg

SEQ ID NO: 12777 - DNA, 20 bp, Homo sapiens
atcagcattataaaaagtgt

SEQ ID NO: 12778 - DNA, 24 bp, Homo sapiens
ctaactataaatcctatttgtgtg

SEQ ID NO: 12779 - DNA, 21 bp, Homo sapiens
gaagaaaaatgagacattttt

SEQ ID NO: 12780 - DNA, 26 bp, Homo sapiens
acgtagacttggttcaagtctcgtta

SEQ ID NO: 12781 - DNA, 18 bp, Homo sapiens
agcaaagtgtggtatcca

SEQ ID NO: 12782 - DNA, 23 bp, Homo sapiens
taagtgggcttccattccatgga

SEQ ID NO: 12783 - DNA, 18 bp, Homo sapiens
tgaagagagcatcagagt

SEQ ID NO: 12784 - DNA, 23 bp, Homo sapiens
tgagatcaggaccagcctggtca

SEQ ID NO: 12785 - DNA, 18 bp, Homo sapiens
tggatatttttctaccta

SEQ ID NO: 12786 - DNA, 21 bp, Homo sapiens
tgtgtcttttgaagagagcat

SEQ ID NO: 12787 - DNA, 19 bp, Homo sapiens
ccttcctgacctctggctc

SEQ ID NO: 12788 - DNA, 18 bp, Homo sapiens
gcaatacctctcgttcca

SEQ ID NO: 12789 - DNA, 19 bp, Homo sapiens
gcccagggagggctttcgt

SEQ ID NO: 12790 - DNA, 19 bp, Homo sapiens
acacttgtacccacaggtg

SEQ ID NO: 12791 - DNA, 24 bp, Homo sapiens
ccaggcatatgtttccccatctct

SEQ ID NO: 12792 - DNA, 20 bp, Homo sapiens
ccattttcatcctgagccca

SEQ ID NO: 12793 - DNA, 18 bp, Homo sapiens
ccctctgttctctcccct

SEQ ID NO: 12794 - DNA, 16 bp, Homo sapiens
ccctggcctcacttga

SEQ ID NO: 12795 - DNA, 18 bp, Homo sapiens
ctggaatgggagacctgt

SEQ ID NO: 12796 - DNA, 17 bp, Homo sapiens
ctggcctcacttgattc

SEQ ID NO: 12797 - DNA, 19 bp, Homo sapiens
cttgattcatctctggttt

SEQ ID NO: 12798 - DNA, 21 bp, Homo sapiens
gaaacagaaatgaccacgtga

SEQ ID NO: 12799 - DNA, 20 bp, Homo sapiens
gaggtctttcagctcattta

SEQ ID NO: 12800 - DNA, 20 bp, Homo sapiens
gcgatttgggggctcgggga

SEQ ID NO: 12801 - DNA, 20 bp, Homo sapiens
ggaaagaggcatcaaagcta

SEQ ID NO: 12802 - DNA, 21 bp, Homo sapiens
tcaaacctttctggcctgtta

SEQ ID NO: 12803 - DNA, 19 bp, Homo sapiens
tctgggagtccccatccca

SEQ ID NO: 12804 - DNA, 22 bp, Homo sapiens
tgggtggggttatgtgagggta

SEQ ID NO: 12805 - DNA, 18 bp, Homo sapiens
ttttcttacacaccccca

SEQ ID NO: 12806 - DNA, 18 bp, Homo sapiens
attttcagttttgcctgc

SEQ ID NO: 12807 - DNA, 19 bp, Homo sapiens
cacacctctgctggatgcc

SEQ ID NO: 12808 - DNA, 22 bp, Homo sapiens
ataccaagtatattgtgtctgc

SEQ ID NO: 12809 - DNA, 20 bp, Homo sapiens
atttgtcacaggccattgta

SEQ ID NO: 12810 - DNA, 19 bp, Homo sapiens
ctatatatgacatatgcta

SEQ ID NO: 12811 - DNA, 22 bp, Homo sapiens
tgagaaaatgttgggtccagtc

SEQ ID NO: 12812 - DNA, 18 bp, Homo sapiens
agaatgttctttcattaa

SEQ ID NO: 12813 - DNA, 19 bp, Homo sapiens
aaccggcatccgttttgga

SEQ ID NO: 12814 - DNA, 23 bp, Homo sapiens
cctggtaccactcagaacctcca

SEQ ID NO: 12815 - DNA, 17 bp, Homo sapiens
ggaacggcctgtaccgt

SEQ ID NO: 12816 - DNA, 19 bp, Homo sapiens
tccagcacgagcacccact

SEQ ID NO: 12817 - DNA, 22 bp, Homo sapiens
tgctgccttacacagtgcattt

SEQ ID NO: 12818 - DNA, 21 bp, Homo sapiens
acctggaccagactctggccc

SEQ ID NO: 12819 - DNA, 17 bp, Homo sapiens
attccttcatcctctga

SEQ ID NO: 12820 - DNA, 15 bp, Homo sapiens
gcgggccggcctggg

SEQ ID NO: 12821 - DNA, 21 bp, Homo sapiens
ggctcttcttccttcatctca

SEQ ID NO: 12822 - DNA, 20 bp, Homo sapiens
gttccagaactgatgtcaga

SEQ ID NO: 12823 - DNA, 21 bp, Homo sapiens
tccgcctcgtcgagcgctgct

SEQ ID NO: 12824 - DNA, 19 bp, Homo sapiens
tttccgagacggacacttt

SEQ ID NO: 12825 - DNA, 21 bp, Homo sapiens
aagttaatagaaagttggcca

SEQ ID NO: 12826 - DNA, 24 bp, Homo sapiens
gagggccgggccaggagaatctcc

SEQ ID NO: 12827 - DNA, 19 bp, Homo sapiens
gcaggcttactgagctgtc

SEQ ID NO: 12828 - DNA, 19 bp, Homo sapiens
gcctgaattgctttctgct

SEQ ID NO: 12829 - DNA, 19 bp, Homo sapiens
ggaaaaccattctaaaaca

SEQ ID NO: 12830 - DNA, 20 bp, Homo sapiens
gggagcaagaggtgtgcaca

SEQ ID NO: 12831 - DNA, 19 bp, Homo sapiens
ttcctttttgcagcaatta

SEQ ID NO: 12832 - DNA, 21 bp, Homo sapiens
ccatcagcaaagacgagcctc

SEQ ID NO: 12833 - DNA, 20 bp, Homo sapiens
gagaggaagtttgttcacca

SEQ ID NO: 12834 - DNA, 19 bp, Homo sapiens
ggtgttggctggacccctc

SEQ ID NO: 12835 - DNA, 18 bp, Homo sapiens
cccgcccaccctgccgga

SEQ ID NO: 12836 - DNA, 21 bp, Homo sapiens
tccacggccccgccccgccct

SEQ ID NO: 12837 - DNA, 24 bp, Homo sapiens
gaagtccccaagacaatctcgcca

SEQ ID NO: 12838 - DNA, 24 bp, Homo sapiens
tgcacagggtgctcctgccacctc

SEQ ID NO: 12839 - DNA, 20 bp, Homo sapiens
ttcaagatttcaatatccaa

SEQ ID NO: 12840 - DNA, 24 bp, Homo sapiens
ttttcaagatttcaatatccaaca

SEQ ID NO: 12841 - DNA, 22 bp, Homo sapiens
aaaagaaaacttgtgttcaatc

SEQ ID NO: 12842 - DNA, 16 bp, Homo sapiens
ctctccttcactctga

SEQ ID NO: 12843 - DNA, 21 bp, Homo sapiens
ctctttctctctttccatctc

SEQ ID NO: 12844 - DNA, 18 bp, Homo sapiens
gactccgagaagctctcg

SEQ ID NO: 12845 - DNA, 21 bp, Homo sapiens
gatggcttaagcctgtgtata

SEQ ID NO: 12846 - DNA, 21 bp, Homo sapiens
gcctcgctggctgcttcgctc

SEQ ID NO: 12847 - DNA, 24 bp, Homo sapiens
ggttgttcctttttctttttttaa

SEQ ID NO: 12848 - DNA, 19 bp, Homo sapiens
tggaggccaccaagctgct

SEQ ID NO: 12849 - DNA, 19 bp, Homo sapiens
ttgtcacttctgctgtaca

SEQ ID NO: 12850 - DNA, 18 bp, Homo sapiens
ttttcccatcaccagaaa

SEQ ID NO: 12851 - DNA, 18 bp, Homo sapiens
agccctcaggattcctga

SEQ ID NO: 12852 - DNA, 23 bp, Homo sapiens
gcctgggttgtggccgccctagc

SEQ ID NO: 12853 - DNA, 19 bp, Homo sapiens
acattttctcaattgtaaa

SEQ ID NO: 12854 - DNA, 18 bp, Homo sapiens
cagttcagacaaatgtaa

SEQ ID NO: 12855 - DNA, 23 bp, Homo sapiens
cccaagcacttcaaaggaactgg

SEQ ID NO: 12856 - DNA, 17 bp, Homo sapiens
gaaaacaaacaaacaaa

SEQ ID NO: 12857 - DNA, 25 bp, Homo sapiens
gcctgtccagccggccgcctgtccc

SEQ ID NO: 12858 - DNA, 19 bp, Homo sapiens
ccaagggaagctcctctga

SEQ ID NO: 12859 - DNA, 21 bp, Homo sapiens
ccagctgagaatgccccctcc

SEQ ID NO: 12860 - DNA, 17 bp, Homo sapiens
ctctagagcaaggccca

SEQ ID NO: 12861 - DNA, 17 bp, Homo sapiens
ctctccttgccaaatct

SEQ ID NO: 12862 - DNA, 22 bp, Homo sapiens
gcagagagttcccatctcatct

SEQ ID NO: 12863 - DNA, 24 bp, Homo sapiens
taaaaacacccacatatgcttttc

SEQ ID NO: 12864 - DNA, 21 bp, Homo sapiens
tttgtttgctattctgtgtgt

SEQ ID NO: 12865 - DNA, 22 bp, Homo sapiens
tgcatatgtattttgtatttgc

SEQ ID NO: 12866 - DNA, 18 bp, Homo sapiens
cagacttccttttacttc

SEQ ID NO: 12867 - DNA, 18 bp, Homo sapiens
ctgtaaaaccttgtctta

SEQ ID NO: 12868 - DNA, 17 bp, Homo sapiens
gtcctgtagctatttta

SEQ ID NO: 12869 - DNA, 21 bp, Homo sapiens
ggactcccgcccgctcccgct

SEQ ID NO: 12870 - DNA, 21 bp, Homo sapiens
gcgctcccgccggcgagttct

SEQ ID NO: 12871 - DNA, 23 bp, Homo sapiens
cagccaggggtccagagctagcc

SEQ ID NO: 12872 - DNA, 22 bp, Homo sapiens
ctctttctctcctgcagtcccg

SEQ ID NO: 12873 - DNA, 21 bp, Homo sapiens
ctgcctgccccacctgcctca

SEQ ID NO: 12874 - DNA, 21 bp, Homo sapiens
ccctcccctcaccttccccca

SEQ ID NO: 12875 - DNA, 21 bp, Homo sapiens
ctgcccggcaccccctcccca

SEQ ID NO: 12876 - DNA, 18 bp, Homo sapiens
tcctccggaccccacctt

SEQ ID NO: 12877 - DNA, 20 bp, Homo sapiens
ttgcctagcctctccctctc

SEQ ID NO: 12878 - DNA, 18 bp, Homo sapiens
aagataaaatgatgttat

SEQ ID NO: 12879 - DNA, 24 bp, Homo sapiens
atctatgtttataatactactact

SEQ ID NO: 12880 - DNA, 23 bp, Homo sapiens
atgaggccggatgaaacttctca

SEQ ID NO: 12881 - DNA, 20 bp, Homo sapiens
cagaagaaaatttgccaatc

SEQ ID NO: 12882 - DNA, 21 bp, Homo sapiens
ctcccactccataccccgcca

SEQ ID NO: 12883 - DNA, 21 bp, Homo sapiens
cttctcatgtatattacccaa

SEQ ID NO: 12884 - DNA, 16 bp, Homo sapiens
gatacttacatgttcc

SEQ ID NO: 12885 - DNA, 20 bp, Homo sapiens
gtcagctgctgttgaacttt

SEQ ID NO: 12886 - DNA, 18 bp, Homo sapiens
tggtcctatttttgtgaa

SEQ ID NO: 12887 - DNA, 21 bp, Homo sapiens
tgtccttaaaatgtggtctgc

SEQ ID NO: 12888 - DNA, 21 bp, Homo sapiens
aaacagatgatgagaatttct

SEQ ID NO: 12889 - DNA, 20 bp, Homo sapiens
aagttcaagtgattctcctg

SEQ ID NO: 12890 - DNA, 21 bp, Homo sapiens
caagggcctaccctgatgcca

SEQ ID NO: 12891 - DNA, 25 bp, Homo sapiens
ctggctcacccacctgctaatagca

SEQ ID NO: 12892 - DNA, 21 bp, Homo sapiens
gatttacagtccaggcagcaa

SEQ ID NO: 12893 - DNA, 17 bp, Homo sapiens
tcaagtgattctcctgc

SEQ ID NO: 12894 - DNA, 19 bp, Homo sapiens
tgagctgtcagttcccaca

SEQ ID NO: 12895 - DNA, 21 bp, Homo sapiens
tgctgtggaggccaagacccc

SEQ ID NO: 12896 - DNA, 22 bp, Homo sapiens
acccgagcaggggttttaagga

SEQ ID NO: 12897 - DNA, 23 bp, Homo sapiens
agtgttcatcctgaaatgtctca

SEQ ID NO: 12898 - DNA, 22 bp, Homo sapiens
caaccctacacgcacgaactga

SEQ ID NO: 12899 - DNA, 20 bp, Homo sapiens
cttctatcagaaccaattct

SEQ ID NO: 12900 - DNA, 25 bp, Homo sapiens
gccgcgaccgccgcggctgcagcct

SEQ ID NO: 12901 - DNA, 23 bp, Homo sapiens
tcctggtagaacctttcaacaaa

SEQ ID NO: 12902 - DNA, 19 bp, Homo sapiens
tttcaaaataagcttttcc

SEQ ID NO: 12903 - DNA, 21 bp, Homo sapiens
tttcctccacccattctctga

SEQ ID NO: 12904 - DNA, 19 bp, Homo sapiens
ggtgggttggggtgttgtg

SEQ ID NO: 12905 - DNA, 20 bp, Homo sapiens
tggtcaggctggtcttgaac

SEQ ID NO: 12906 - DNA, 19 bp, Homo sapiens
acttagagactgattagac

SEQ ID NO: 12907 - DNA, 22 bp, Homo sapiens
aattcattcctcctcttcctct

SEQ ID NO: 12908 - DNA, 22 bp, Homo sapiens
aggtgaattacccagcttgcct

SEQ ID NO: 12909 - DNA, 21 bp, Homo sapiens
ctagttgtcactgcctggctt

SEQ ID NO: 12910 - DNA, 19 bp, Homo sapiens
cttccaccgtctgcgcgcc

SEQ ID NO: 12911 - DNA, 18 bp, Homo sapiens
gaatatcccccttcctct

SEQ ID NO: 12912 - DNA, 23 bp, Homo sapiens
taaatggaaaaatatatggacta

SEQ ID NO: 12913 - DNA, 16 bp, Homo sapiens
cccaccctctgctcct

SEQ ID NO: 12914 - DNA, 18 bp, Homo sapiens
ggcttctgaggactccca

SEQ ID NO: 12915 - DNA, 19 bp, Homo sapiens
tgtccaggggcccagagag

SEQ ID NO: 12916 - DNA, 20 bp, Homo sapiens
ccaggtatctcccctcctct

SEQ ID NO: 12917 - DNA, 16 bp, Homo sapiens
gccaacccccctgcag

SEQ ID NO: 12918 - DNA, 20 bp, Homo sapiens
tcacagacatggaagggacc

SEQ ID NO: 12919 - DNA, 20 bp, Homo sapiens
tgtgctggcagatagggttg

SEQ ID NO: 12920 - DNA, 22 bp, Homo sapiens
aggtagtcctggtactccttta

SEQ ID NO: 12921 - DNA, 19 bp, Homo sapiens
catcctcctctggataact

SEQ ID NO: 12922 - DNA, 18 bp, Homo sapiens
gaggttcgggtccggccg

SEQ ID NO: 12923 - DNA, 20 bp, Homo sapiens
tagatggacttctcagaact

SEQ ID NO: 12924 - DNA, 20 bp, Homo sapiens
tgttgccttactttttaata

SEQ ID NO: 12925 - DNA, 17 bp, Homo sapiens
ttacagcagcactgtat

SEQ ID NO: 12926 - DNA, 21 bp, Homo sapiens
aaacctgcctccaagatttca

SEQ ID NO: 12927 - DNA, 21 bp, Homo sapiens
aatgctattgaaattactgaa

SEQ ID NO: 12928 - DNA, 16 bp, Homo sapiens
cacaattttcaggttt

SEQ ID NO: 12929 - DNA, 21 bp, Homo sapiens
tggcgaaccatctcaatgtaa

SEQ ID NO: 12930 - DNA, 20 bp, Homo sapiens
gcacgaggaagcggttggga

SEQ ID NO: 12931 - DNA, 18 bp, Homo sapiens
ggcctggctatggaacta

SEQ ID NO: 12932 - DNA, 20 bp, Homo sapiens
tcataataggtgacagtgtt

SEQ ID NO: 12933 - DNA, 16 bp, Homo sapiens
tcgatttttcttaagc

SEQ ID NO: 12934 - DNA, 20 bp, Homo sapiens
gacgggactcccggttctcc

SEQ ID NO: 12935 - DNA, 20 bp, Homo sapiens
aaaaacaacaaacaaacaaa

SEQ ID NO: 12936 - DNA, 19 bp, Homo sapiens
agtaactacagtggcatta

SEQ ID NO: 12937 - DNA, 20 bp, Homo sapiens
gaaaatgtcaagctgattta

SEQ ID NO: 12938 - DNA, 18 bp, Homo sapiens
tgctgctccagtaactac

SEQ ID NO: 12939 - DNA, 21 bp, Homo sapiens
aagcaagaaatattttctctc

SEQ ID NO: 12940 - DNA, 22 bp, Homo sapiens
cttctcgtttgagtactactaa

SEQ ID NO: 12941 - DNA, 18 bp, Homo sapiens
gaaaaaaaagtaaagcaa

SEQ ID NO: 12942 - DNA, 19 bp, Homo sapiens
tggcaccatttcctaaagt

SEQ ID NO: 12943 - DNA, 23 bp, Homo sapiens
ccagcccctagctacatctctcc

SEQ ID NO: 12944 - DNA, 22 bp, Homo sapiens
cctccccctgtaacctcttccc

SEQ ID NO: 12945 - DNA, 21 bp, Homo sapiens
gagcaaagctaggcctgatta

SEQ ID NO: 12946 - DNA, 18 bp, Homo sapiens
ggaggcgccggctgtggc

SEQ ID NO: 12947 - DNA, 16 bp, Homo sapiens
aacactggtgatttca

SEQ ID NO: 12948 - DNA, 18 bp, Homo sapiens
gttaaagatttgctttat

SEQ ID NO: 12949 - DNA, 18 bp, Homo sapiens
cagctggtaaggtcttca

SEQ ID NO: 12950 - DNA, 22 bp, Homo sapiens
cctttcttcccttgcacgctcg

SEQ ID NO: 12951 - DNA, 19 bp, Homo sapiens
cttctctgtgttctgcctc

SEQ ID NO: 12952 - DNA, 21 bp, Homo sapiens
gtcccattccaccccacccca

SEQ ID NO: 12953 - DNA, 17 bp, Homo sapiens
tgcttagtggcactgac

SEQ ID NO: 12954 - DNA, 21 bp, Homo sapiens
aactccatcagaactcgcaat

SEQ ID NO: 12955 - DNA, 17 bp, Homo sapiens
actccatcagaactcgc

SEQ ID NO: 12956 - DNA, 21 bp, Homo sapiens
gttctttaaatgcgttcctca

SEQ ID NO: 12957 - DNA, 18 bp, Homo sapiens
acttgggagctgactgtg

SEQ ID NO: 12958 - DNA, 17 bp, Homo sapiens
tttaattaaggggtagg

SEQ ID NO: 12959 - DNA, 16 bp, Homo sapiens
aaaccttttgttctgt

SEQ ID NO: 12960 - DNA, 17 bp, Homo sapiens
agactatttgccatgac

SEQ ID NO: 12961 - DNA, 23 bp, Homo sapiens
atggttatagttctaatatggag

SEQ ID NO: 12962 - DNA, 20 bp, Homo sapiens
cacagtaatttcccttttta

SEQ ID NO: 12963 - DNA, 18 bp, Homo sapiens
ctttagggttagtcctca

SEQ ID NO: 12964 - DNA, 20 bp, Homo sapiens
ctttctccccctctgccttt

SEQ ID NO: 12965 - DNA, 20 bp, Homo sapiens
gaagaatctaaaagataaca

SEQ ID NO: 12966 - DNA, 24 bp, Homo sapiens
gagtcctgactcagaacaccaact

SEQ ID NO: 12967 - DNA, 22 bp, Homo sapiens
ggctctccccacccattcccct

SEQ ID NO: 12968 - DNA, 24 bp, Homo sapiens
taagtggggaatgcaacgtgaggc

SEQ ID NO: 12969 - DNA, 21 bp, Homo sapiens
tctctttgtggtcatgtgatt

SEQ ID NO: 12970 - DNA, 19 bp, Homo sapiens
ttttctttccagccagtta

SEQ ID NO: 12971 - DNA, 18 bp, Homo sapiens
accgccaccgcctggtcc

SEQ ID NO: 12972 - DNA, 21 bp, Homo sapiens
acatttagataatttatagta

SEQ ID NO: 12973 - DNA, 19 bp, Homo sapiens
atccaagctatgcatttca

SEQ ID NO: 12974 - DNA, 22 bp, Homo sapiens
atgcatttcatatagctttttc

SEQ ID NO: 12975 - DNA, 19 bp, Homo sapiens
aggagacaggaagcctcaa

SEQ ID NO: 12976 - DNA, 22 bp, Homo sapiens
ctaaaagcatggccctgctgcc

SEQ ID NO: 12977 - DNA, 16 bp, Homo sapiens
gagcttccagagctct

SEQ ID NO: 12978 - DNA, 26 bp, Homo sapiens
catggtgctatcctctgaacccctca

SEQ ID NO: 12979 - DNA, 23 bp, Homo sapiens
ctttggacttggaaggtgtgcgg

SEQ ID NO: 12980 - DNA, 17 bp, Homo sapiens
tcccccagcatctctca

SEQ ID NO: 12981 - DNA, 19 bp, Homo sapiens
cccacggcccctacaggct

SEQ ID NO: 12982 - DNA, 17 bp, Homo sapiens
cgtgacaggtttccaca

SEQ ID NO: 12983 - DNA, 21 bp, Homo sapiens
aaaatcagttaactatactcc

SEQ ID NO: 12984 - DNA, 19 bp, Homo sapiens
ccagcctggtggcccagct

SEQ ID NO: 12985 - DNA, 21 bp, Homo sapiens
ccggactgaccaaatcaccca

SEQ ID NO: 12986 - DNA, 20 bp, Homo sapiens
cactcttagaattcccattt

SEQ ID NO: 12987 - DNA, 22 bp, Homo sapiens
ctctggtgcactccatctgtaa

SEQ ID NO: 12988 - DNA, 19 bp, Homo sapiens
gtactattattccatacta

SEQ ID NO: 12989 - DNA, 18 bp, Homo sapiens
tccatctgtttcttgcca

SEQ ID NO: 12990 - DNA, 21 bp, Homo sapiens
tccccactgtacactgtggta

SEQ ID NO: 12991 - DNA, 20 bp, Homo sapiens
ttagaaatttaaaatagcat

SEQ ID NO: 12992 - DNA, 21 bp, Homo sapiens
ttcgagtctgtttatccgttg

SEQ ID NO: 12993 - DNA, 21 bp, Homo sapiens
tttccaaaattaacctttaaa

SEQ ID NO: 12994 - DNA, 22 bp, Homo sapiens
aggcacaattccaccttccttt

SEQ ID NO: 12995 - DNA, 24 bp, Homo sapiens
aatggttaaacacaaaaggctgat

SEQ ID NO: 12996 - DNA, 18 bp, Homo sapiens
actgtgaaactttctgaa

SEQ ID NO: 12997 - DNA, 16 bp, Homo sapiens
ctgctcacactccaga

SEQ ID NO: 12998 - DNA, 19 bp, Homo sapiens
ctgcttcgctgcagggata

SEQ ID NO: 12999 - DNA, 24 bp, Homo sapiens
ggaaacatctttcatagccacatt

SEQ ID NO: 13000 - DNA, 19 bp, Homo sapiens
ggcttctcccggttcattt

SEQ ID NO: 13001 - DNA, 26 bp, Homo sapiens
tcagtgcataattccaagtggctttt

SEQ ID NO: 13002 - DNA, 23 bp, Homo sapiens
ggtggcgaagcagcagccgcggc

SEQ ID NO: 13003 - DNA, 22 bp, Homo sapiens
gcacctccacgccactgcctcc

SEQ ID NO: 13004 - DNA, 22 bp, Homo sapiens
gggcggccagggacccaaagca

SEQ ID NO: 13005 - DNA, 19 bp, Homo sapiens
tagcatttaaaagtttaaa

SEQ ID NO: 13006 - DNA, 18 bp, Homo sapiens
tgtattgtaaattggcat

SEQ ID NO: 13007 - DNA, 19 bp, Homo sapiens
tttttcatatactggcctt

SEQ ID NO: 13008 - DNA, 17 bp, Homo sapiens
gatattttctaccctca

SEQ ID NO: 13009 - DNA, 22 bp, Homo sapiens
gctcctctgtcctgcctaccct

SEQ ID NO: 13010 - DNA, 17 bp, Homo sapiens
ggaccgggcagtgtcac

SEQ ID NO: 13011 - DNA, 22 bp, Homo sapiens
acagaaagatcatttgaaacca

SEQ ID NO: 13012 - DNA, 20 bp, Homo sapiens
taactgccatatatgtaata

SEQ ID NO: 13013 - DNA, 21 bp, Homo sapiens
gtcggagtcgaatgcatttgt

SEQ ID NO: 13014 - DNA, 24 bp, Homo sapiens
tgcaggaactgcatgctgcaggtg

SEQ ID NO: 13015 - DNA, 20 bp, Homo sapiens
ggaacacaaaactctttgta

SEQ ID NO: 13016 - DNA, 20 bp, Homo sapiens
taacaaggaatgtttcttat

SEQ ID NO: 13017 - DNA, 21 bp, Homo sapiens
gtatttcaaatatctaagcaa

SEQ ID NO: 13018 - DNA, 28 bp, Homo sapiens
tgaatgttagatgcttagtgtgaagttg

SEQ ID NO: 13019 - DNA, 20 bp, Homo sapiens
tgagtgggcttcggagtgaa

SEQ ID NO: 13020 - DNA, 24 bp, Homo sapiens
ccacttccccatctccccaagtag

SEQ ID NO: 13021 - DNA, 26 bp, Homo sapiens
agagaaggctatgtaaacaaaccaca

SEQ ID NO: 13022 - DNA, 22 bp, Homo sapiens
attcctcctccaattggtttaa

SEQ ID NO: 13023 - DNA, 24 bp, Homo sapiens
cctgggagtagctagtttgctttt

SEQ ID NO: 13024 - DNA, 21 bp, Homo sapiens
gacacagacgttaggcatttc

SEQ ID NO: 13025 - DNA, 17 bp, Homo sapiens
gttcaaagactgtgaac

SEQ ID NO: 13026 - DNA, 18 bp, Homo sapiens
tgactctcacctgtacta

SEQ ID NO: 13027 - DNA, 22 bp, Homo sapiens
actaacttctaagatgatttca

SEQ ID NO: 13028 - DNA, 22 bp, Homo sapiens
gcaggtagcttcttttttctca

SEQ ID NO: 13029 - DNA, 19 bp, Homo sapiens
gtagttaccatacagatta

SEQ ID NO: 13030 - DNA, 21 bp, Homo sapiens
tgtttgttccccgggacttca

SEQ ID NO: 13031 - DNA, 23 bp, Homo sapiens
ctgaggattttaacattgtgata

SEQ ID NO: 13032 - DNA, 22 bp, Homo sapiens
tactttatcatgttttcatgat

SEQ ID NO: 13033 - DNA, 21 bp, Homo sapiens
tgaattttggcatgatgactg

SEQ ID NO: 13034 - DNA, 20 bp, Homo sapiens
cgccggccggccagcaccca

SEQ ID NO: 13035 - DNA, 17 bp, Homo sapiens
tctgtgggaaatggaga

SEQ ID NO: 13036 - DNA, 18 bp, Homo sapiens
cagggttgctgaccctta

SEQ ID NO: 13037 - DNA, 21 bp, Homo sapiens
ctctttctctgtacagtctca

SEQ ID NO: 13038 - DNA, 21 bp, Homo sapiens
gcctgttctcagcagtagaga

SEQ ID NO: 13039 - DNA, 18 bp, Homo sapiens
gggccagatgccctgcca

SEQ ID NO: 13040 - DNA, 21 bp, Homo sapiens
acgtgggaatcacaccctcca

SEQ ID NO: 13041 - DNA, 19 bp, Homo sapiens
cagacctcccacagctcca

SEQ ID NO: 13042 - DNA, 25 bp, Homo sapiens
acatctagctttgacaatcatagta

SEQ ID NO: 13043 - DNA, 20 bp, Homo sapiens
cctttttctttttctcccct

SEQ ID NO: 13044 - DNA, 26 bp, Homo sapiens
gggacatgtaccacggcggccaaagc

SEQ ID NO: 13045 - DNA, 25 bp, Homo sapiens
tactattggtgtgttggtgaatttt

SEQ ID NO: 13046 - DNA, 20 bp, Homo sapiens
tgagctcttttttccccccc

SEQ ID NO: 13047 - DNA, 25 bp, Homo sapiens
tgggggggtgtcaaagaacttgaca

SEQ ID NO: 13048 - DNA, 21 bp, Homo sapiens
gtcctgaactgatttttgtga

SEQ ID NO: 13049 - DNA, 24 bp, Homo sapiens
aaacaaaacaaaacagaaaaatca

SEQ ID NO: 13050 - DNA, 19 bp, Homo sapiens
ctaaaaataccacagatgg

SEQ ID NO: 13051 - DNA, 24 bp, Homo sapiens
gctgaaatggctgttggcagttct

SEQ ID NO: 13052 - DNA, 20 bp, Homo sapiens
agtttgaacgtcagtgtcac

SEQ ID NO: 13053 - DNA, 23 bp, Homo sapiens
cagcatctggaagactttcctct

SEQ ID NO: 13054 - DNA, 21 bp, Homo sapiens
ttcctggttgcactctgtaga

SEQ ID NO: 13055 - DNA, 19 bp, Homo sapiens
ttccttgggaacctaggga

SEQ ID NO: 13056 - DNA, 18 bp, Homo sapiens
actgcttctctgctctga

SEQ ID NO: 13057 - DNA, 17 bp, Homo sapiens
ccgctccctcaggagtc

SEQ ID NO: 13058 - DNA, 23 bp, Homo sapiens
aaagagacttcctcttggcgttc

SEQ ID NO: 13059 - DNA, 22 bp, Homo sapiens
aagagacttcctcttggcgttc

SEQ ID NO: 13060 - DNA, 17 bp, Homo sapiens
aggaaacacagattctt

SEQ ID NO: 13061 - DNA, 18 bp, Homo sapiens
ccttctctttactctcca

SEQ ID NO: 13062 - DNA, 18 bp, Homo sapiens
ggcttttgccccactttg

SEQ ID NO: 13063 - DNA, 18 bp, Homo sapiens
tccgcctcttgggttcaa

SEQ ID NO: 13064 - DNA, 23 bp, Homo sapiens
ttgtcttccccatgttcatagct

SEQ ID NO: 13065 - DNA, 23 bp, Homo sapiens
agggcgggaatcagacctactcc

SEQ ID NO: 13066 - DNA, 18 bp, Homo sapiens
attgtctaaatgaggcct

SEQ ID NO: 13067 - DNA, 23 bp, Homo sapiens
cctctgggcttgaccagttccca

SEQ ID NO: 13068 - DNA, 20 bp, Homo sapiens
tgggccctgccaaggcgaca

SEQ ID NO: 13069 - DNA, 19 bp, Homo sapiens
tgggagtctccctgcctca

SEQ ID NO: 13070 - DNA, 21 bp, Homo sapiens
tgtagcagcctcctggacttc

SEQ ID NO: 13071 - DNA, 26 bp, Homo sapiens
aaacagatattgtaccatgtacctaa

SEQ ID NO: 13072 - DNA, 25 bp, Homo sapiens
ccccgcccggtccgcccccgcggct

SEQ ID NO: 13073 - DNA, 17 bp, Homo sapiens
gcgcgccgcggcgctgt

SEQ ID NO: 13074 - DNA, 23 bp, Homo sapiens
gcgtctggccagccgcgagctct

SEQ ID NO: 13075 - DNA, 21 bp, Homo sapiens
tgctgttaatgtatactactg

SEQ ID NO: 13076 - DNA, 19 bp, Homo sapiens
ttttcatgcttccaggtaa

SEQ ID NO: 13077 - DNA, 22 bp, Homo sapiens
aaggactaacatttttaagtta

SEQ ID NO: 13078 - DNA, 22 bp, Homo sapiens
ataagtggatacaaccactcta

SEQ ID NO: 13079 - DNA, 17 bp, Homo sapiens
atgcaagatgctctgat

SEQ ID NO: 13080 - DNA, 22 bp, Homo sapiens
caatgcaagatgctctgatagc

SEQ ID NO: 13081 - DNA, 22 bp, Homo sapiens
ctaagatggtaactgtgtgatt

SEQ ID NO: 13082 - DNA, 16 bp, Homo sapiens
gcaagatgctctgata

SEQ ID NO: 13083 - DNA, 19 bp, Homo sapiens
gtgataaaacaacatggta

SEQ ID NO: 13084 - DNA, 17 bp, Homo sapiens
tgatgaggtaataatca

SEQ ID NO: 13085 - DNA, 18 bp, Homo sapiens
ttctcctgcctcagcctt

SEQ ID NO: 13086 - DNA, 19 bp, Homo sapiens
gcccctgactctaagctga

SEQ ID NO: 13087 - DNA, 21 bp, Homo sapiens
atcctgccctgcagtcacatg

SEQ ID NO: 13088 - DNA, 20 bp, Homo sapiens
ccacagccccgctgtggtcc

SEQ ID NO: 13089 - DNA, 17 bp, Homo sapiens
tccagaaatgctcccca

SEQ ID NO: 13090 - DNA, 17 bp, Homo sapiens
gcgtctgcgacgggaga

SEQ ID NO: 13091 - DNA, 19 bp, Homo sapiens
gccagcgccttccactcca

SEQ ID NO: 13092 - DNA, 21 bp, Homo sapiens
tttcattgttttgccttcaaa

SEQ ID NO: 13093 - DNA, 18 bp, Homo sapiens
tttgacttgacttgcgaa

SEQ ID NO: 13094 - DNA, 23 bp, Homo sapiens
ggaagaggaggctgagagggtca

SEQ ID NO: 13095 - DNA, 21 bp, Homo sapiens
aatacagatatatacaaatat

SEQ ID NO: 13096 - DNA, 18 bp, Homo sapiens
accaaaacgggttaatca

SEQ ID NO: 13097 - DNA, 18 bp, Homo sapiens
atctcgtgcatgaagctg

SEQ ID NO: 13098 - DNA, 23 bp, Homo sapiens
atgtcattgatataatttcccta

SEQ ID NO: 13099 - DNA, 18 bp, Homo sapiens
cactttggaatcacccca

SEQ ID NO: 13100 - DNA, 20 bp, Homo sapiens
gccaataatacaaacccgtt

SEQ ID NO: 13101 - DNA, 21 bp, Homo sapiens
gcccatggaggaggctcttga

SEQ ID NO: 13102 - DNA, 17 bp, Homo sapiens
tttctgttcactcacac

SEQ ID NO: 13103 - DNA, 21 bp, Homo sapiens
atggcttggcaggaactctgg

SEQ ID NO: 13104 - DNA, 20 bp, Homo sapiens
cagcctactatatctacata

SEQ ID NO: 13105 - DNA, 17 bp, Homo sapiens
ccagatggctgccccag

SEQ ID NO: 13106 - DNA, 21 bp, Homo sapiens
cgacaggcaaaagagattttg

SEQ ID NO: 13107 - DNA, 19 bp, Homo sapiens
tacaatcatgtgcaacttt

SEQ ID NO: 13108 - DNA, 19 bp, Homo sapiens
tctgggtcagcttggcacc

SEQ ID NO: 13109 - DNA, 21 bp, Homo sapiens
tctgtcaatctctttgcacct

SEQ ID NO: 13110 - DNA, 21 bp, Homo sapiens
acacatgatggccaagtgcca

SEQ ID NO: 13111 - DNA, 17 bp, Homo sapiens
ctccctggggctgttca

SEQ ID NO: 13112 - DNA, 16 bp, Homo sapiens
ttgcaagtgttcacct

SEQ ID NO: 13113 - DNA, 20 bp, Homo sapiens
accctgaagaaatcctggga

SEQ ID NO: 13114 - DNA, 21 bp, Homo sapiens
ggaaacgtgaaaggctgtggc

SEQ ID NO: 13115 - DNA, 22 bp, Homo sapiens
ccaacctcccactcccacctcc

SEQ ID NO: 13116 - DNA, 21 bp, Homo sapiens
ccccacccagccccctgcagc

SEQ ID NO: 13117 - DNA, 18 bp, Homo sapiens
gagacagagacacagcca

SEQ ID NO: 13118 - DNA, 21 bp, Homo sapiens
gatgaggcttgcggctgtggc

SEQ ID NO: 13119 - DNA, 26 bp, Homo sapiens
tcctgctggcctggaagactctgtgg

SEQ ID NO: 13120 - DNA, 17 bp, Homo sapiens
ttctgtcactggtctca

SEQ ID NO: 13121 - DNA, 21 bp, Homo sapiens
agtaagtttctccgaatccct

SEQ ID NO: 13122 - DNA, 17 bp, Homo sapiens
tctaaaacaatggagta

SEQ ID NO: 13123 - DNA, 18 bp, Homo sapiens
tgcaaatacatgcattta

SEQ ID NO: 13124 - DNA, 16 bp, Homo sapiens
tgccattctcctgcct

SEQ ID NO: 13125 - DNA, 20 bp, Homo sapiens
cagtattttgtcctagcagc

SEQ ID NO: 13126 - DNA, 17 bp, Homo sapiens
cccctccttattctcca

SEQ ID NO: 13127 - DNA, 18 bp, Homo sapiens
ctgagtgaactgctaata

SEQ ID NO: 13128 - DNA, 19 bp, Homo sapiens
actgtccgaattgacatca

SEQ ID NO: 13129 - DNA, 21 bp, Homo sapiens
caattccaccccccaccaacc

SEQ ID NO: 13130 - DNA, 22 bp, Homo sapiens
caccccccaccaacccccttct

SEQ ID NO: 13131 - DNA, 25 bp, Homo sapiens
ccacttacttagatatctgcagata

SEQ ID NO: 13132 - DNA, 17 bp, Homo sapiens
ccatctgcttctaacgc

SEQ ID NO: 13133 - DNA, 18 bp, Homo sapiens
tctaacgccttcatggta

SEQ ID NO: 13134 - DNA, 18 bp, Homo sapiens
ctcagggaaagcatttaa

SEQ ID NO: 13135 - DNA, 19 bp, Homo sapiens
gacattcaataaagttgag

SEQ ID NO: 13136 - DNA, 25 bp, Homo sapiens
atatccctactgacagtaactacct

SEQ ID NO: 13137 - DNA, 18 bp, Homo sapiens
cagatgtaaagttttcta

SEQ ID NO: 13138 - DNA, 21 bp, Homo sapiens
gttagatttactggaaatgta

SEQ ID NO: 13139 - DNA, 20 bp, Homo sapiens
tggtaaaagatatttagcaa

SEQ ID NO: 13140 - DNA, 17 bp, Homo sapiens
ttgatgtagattttact

SEQ ID NO: 13141 - DNA, 23 bp, Homo sapiens
cctccttagcattttcttttgta

SEQ ID NO: 13142 - DNA, 18 bp, Homo sapiens
gcagagccctcctgctca

SEQ ID NO: 13143 - DNA, 19 bp, Homo sapiens
tggccagctctgcatttga

SEQ ID NO: 13144 - DNA, 18 bp, Homo sapiens
ccagatgttttaccagtc

SEQ ID NO: 13145 - DNA, 20 bp, Homo sapiens
ccctatatagtcacactttg

SEQ ID NO: 13146 - DNA, 18 bp, Homo sapiens
gccctggcccaaagccag

SEQ ID NO: 13147 - DNA, 23 bp, Homo sapiens
aaacccagtccaaacaacgcctc

SEQ ID NO: 13148 - DNA, 19 bp, Homo sapiens
caagccggctacggtatca

SEQ ID NO: 13149 - DNA, 16 bp, Homo sapiens
cactcacctacactga

SEQ ID NO: 13150 - DNA, 22 bp, Homo sapiens
ccccccccttttccttctttcc

SEQ ID NO: 13151 - DNA, 19 bp, Homo sapiens
ccttctttccccctatcct

SEQ ID NO: 13152 - DNA, 30 bp, Homo sapiens
tagagagcaacccaaccaaaacaaatcaca

SEQ ID NO: 13153 - DNA, 18 bp, Homo sapiens
tgagccttggatccctca

SEQ ID NO: 13154 - DNA, 19 bp, Homo sapiens
accgcgacgggcgggcggc

SEQ ID NO: 13155 - DNA, 19 bp, Homo sapiens
aaattttgactgtcagcta

SEQ ID NO: 13156 - DNA, 19 bp, Homo sapiens
cccgcgccgccggccccgc

SEQ ID NO: 13157 - DNA, 20 bp, Homo sapiens
ctgttatgccctgtttgcaa

SEQ ID NO: 13158 - DNA, 18 bp, Homo sapiens
gccctccgccccgcccca

SEQ ID NO: 13159 - DNA, 23 bp, Homo sapiens
gccctgtttgcaaaaacaattta

SEQ ID NO: 13160 - DNA, 21 bp, Homo sapiens
ttctccagtgttaaaactttt

SEQ ID NO: 13161 - DNA, 19 bp, Homo sapiens
aagcagttctcccacctca

SEQ ID NO: 13162 - DNA, 15 bp, Homo sapiens
aatgtattagtgaat

SEQ ID NO: 13163 - DNA, 19 bp, Homo sapiens
cttgagttctgcctcgctt

SEQ ID NO: 13164 - DNA, 19 bp, Homo sapiens
tctctgtagaaaaccgcac

SEQ ID NO: 13165 - DNA, 23 bp, Homo sapiens
tctctttcagagcatttagcctt

SEQ ID NO: 13166 - DNA, 19 bp, Homo sapiens
tgttggtgttaatttctga

SEQ ID NO: 13167 - DNA, 21 bp, Homo sapiens
ttctcaatccacccttttcca

SEQ ID NO: 13168 - DNA, 19 bp, Homo sapiens
cagaggaccctgaccctcg

SEQ ID NO: 13169 - DNA, 17 bp, Homo sapiens
cccaaccctggatccca

SEQ ID NO: 13170 - DNA, 18 bp, Homo sapiens
ctgggcagagtcccctgc

SEQ ID NO: 13171 - DNA, 20 bp, Homo sapiens
gcaaaaaagtaaaatgctgc

SEQ ID NO: 13172 - DNA, 19 bp, Homo sapiens
tggtcagcatagccgccca

SEQ ID NO: 13173 - DNA, 19 bp, Homo sapiens
aaaaaaacaagacgggccg

SEQ ID NO: 13174 - DNA, 19 bp, Homo sapiens
ccgccctcctcactgctga

SEQ ID NO: 13175 - DNA, 19 bp, Homo sapiens
tgggtggatcacttgaggc

SEQ ID NO: 13176 - DNA, 23 bp, Homo sapiens
atgtcaccaacaggatgatgtca

SEQ ID NO: 13177 - DNA, 21 bp, Homo sapiens
ccagatgctaaagtgattcaa

SEQ ID NO: 13178 - DNA, 22 bp, Homo sapiens
gagccaagatcgtaccactgca

SEQ ID NO: 13179 - DNA, 21 bp, Homo sapiens
gctacaatatacagttcaggc

SEQ ID NO: 13180 - DNA, 21 bp, Homo sapiens
atttgaccagattgtttggct

SEQ ID NO: 13181 - DNA, 22 bp, Homo sapiens
acaagtcttgaatcagtcctca

SEQ ID NO: 13182 - DNA, 21 bp, Homo sapiens
atgaacccaggccactagtct

SEQ ID NO: 13183 - DNA, 21 bp, Homo sapiens
cagaatttacctcatctcaca

SEQ ID NO: 13184 - DNA, 17 bp, Homo sapiens
ccagaggatgcagggaa

SEQ ID NO: 13185 - DNA, 19 bp, Homo sapiens
ccgcccccgccaaacctca

SEQ ID NO: 13186 - DNA, 20 bp, Homo sapiens
ctcagcccggtaagctgcag

SEQ ID NO: 13187 - DNA, 18 bp, Homo sapiens
ctgggtgggggtctgtgg

SEQ ID NO: 13188 - DNA, 18 bp, Homo sapiens
gcagctctgctcaactgc

SEQ ID NO: 13189 - DNA, 21 bp, Homo sapiens
gttggacgtgtccgtctgtcc

SEQ ID NO: 13190 - DNA, 19 bp, Homo sapiens
gttttctgccacaccccca

SEQ ID NO: 13191 - DNA, 19 bp, Homo sapiens
tcaactgcgtcttctctca

SEQ ID NO: 13192 - DNA, 21 bp, Homo sapiens
tctgctgatgggaaggcagag

SEQ ID NO: 13193 - DNA, 22 bp, Homo sapiens
ttgatgcacagaatttacctca

SEQ ID NO: 13194 - DNA, 19 bp, Homo sapiens
aagcaattctcctgcctca

SEQ ID NO: 13195 - DNA, 25 bp, Homo sapiens
acttgggctgcacagatcctgggcc

SEQ ID NO: 13196 - DNA, 17 bp, Homo sapiens
aaaggaagctagctgct

SEQ ID NO: 13197 - DNA, 16 bp, Homo sapiens
cgcttaaatcatgtga

SEQ ID NO: 13198 - DNA, 18 bp, Homo sapiens
gtcaccagattcattaca

SEQ ID NO: 13199 - DNA, 22 bp, Homo sapiens
caccccctcacccccttctttt

SEQ ID NO: 13200 - DNA, 22 bp, Homo sapiens
cagggttggtgggggtcagtca

SEQ ID NO: 13201 - DNA, 21 bp, Homo sapiens
ccacctcagtgcccacagcca

SEQ ID NO: 13202 - DNA, 18 bp, Homo sapiens
tcattttctttttgatct

SEQ ID NO: 13203 - DNA, 19 bp, Homo sapiens
ttctacctgaggaggctgc

SEQ ID NO: 13204 - DNA, 22 bp, Homo sapiens
ttctgatgagaaaggcctgagg

SEQ ID NO: 13205 - DNA, 22 bp, Homo sapiens
ttttgtttgggggctttgtgga

SEQ ID NO: 13206 - DNA, 19 bp, Homo sapiens
agattaggataagtaagct

SEQ ID NO: 13207 - DNA, 19 bp, Homo sapiens
ctgaaatgcattttcctct

SEQ ID NO: 13208 - DNA, 19 bp, Homo sapiens
cttttcagcacttaatttt

SEQ ID NO: 13209 - DNA, 19 bp, Homo sapiens
gcgcgaggggcggccggga

SEQ ID NO: 13210 - DNA, 24 bp, Homo sapiens
tctgcttttctcctctctgttcct

SEQ ID NO: 13211 - DNA, 24 bp, Homo sapiens
gagggcagggattgtgtctggtta

SEQ ID NO: 13212 - DNA, 21 bp, Homo sapiens
tgctgtccccctgcagactgc

SEQ ID NO: 13213 - DNA, 19 bp, Homo sapiens
ttggctcagaagtcacctc

SEQ ID NO: 13214 - DNA, 16 bp, Homo sapiens
ctgaactgctctggct

SEQ ID NO: 13215 - DNA, 18 bp, Homo sapiens
gaggtccgatctggaaca

SEQ ID NO: 13216 - DNA, 20 bp, Homo sapiens
gcctttgttcccaagaccca

SEQ ID NO: 13217 - DNA, 19 bp, Homo sapiens
gttgcacatttgtttttaa

SEQ ID NO: 13218 - DNA, 16 bp, Homo sapiens
tcatttctgtcaaact

SEQ ID NO: 13219 - DNA, 26 bp, Homo sapiens
tgaatgtagattttactgtgaagcta

SEQ ID NO: 13220 - DNA, 19 bp, Homo sapiens
actgagtcccctcacctga

SEQ ID NO: 13221 - DNA, 19 bp, Homo sapiens
ccacctctttttccattcc

SEQ ID NO: 13222 - DNA, 22 bp, Homo sapiens
cggaggaagcacctctgcctcc

SEQ ID NO: 13223 - DNA, 19 bp, Homo sapiens
gacactgccctgcttcctc

SEQ ID NO: 13224 - DNA, 16 bp, Homo sapiens
accttcctggactgca

SEQ ID NO: 13225 - DNA, 18 bp, Homo sapiens
attacatttcagctctca

SEQ ID NO: 13226 - DNA, 19 bp, Homo sapiens
cttcaaatcagacattaca

SEQ ID NO: 13227 - DNA, 25 bp, Homo sapiens
ctttttcacttaagtgctttagttt

SEQ ID NO: 13228 - DNA, 19 bp, Homo sapiens
gccagaccaaagcaccttc

SEQ ID NO: 13229 - DNA, 22 bp, Homo sapiens
gctgtaaagatgtaagttgtgt

SEQ ID NO: 13230 - DNA, 23 bp, Homo sapiens
tcttaggatttaggattgctgta

SEQ ID NO: 13231 - DNA, 19 bp, Homo sapiens
ttgcctaatgtagtttatg

SEQ ID NO: 13232 - DNA, 17 bp, Homo sapiens
ttgggcaggtctttgaa

SEQ ID NO: 13233 - DNA, 18 bp, Homo sapiens
tttaagtatttgatgatc

SEQ ID NO: 13234 - DNA, 22 bp, Homo sapiens
atttgaattgaggctttggcct

SEQ ID NO: 13235 - DNA, 20 bp, Homo sapiens
ctggaagccccctctgcctc

SEQ ID NO: 13236 - DNA, 21 bp, Homo sapiens
ctggaagccccctctgcctcc

SEQ ID NO: 13237 - DNA, 21 bp, Homo sapiens
aaacaatcttaactatgcaca

SEQ ID NO: 13238 - DNA, 19 bp, Homo sapiens
atgcattttgagcatttca

SEQ ID NO: 13239 - DNA, 22 bp, Homo sapiens
caaacaatcttaactatgcaca

SEQ ID NO: 13240 - DNA, 16 bp, Homo sapiens
cccagggcagctgcca

SEQ ID NO: 13241 - DNA, 22 bp, Homo sapiens
ggaaatgagacctggtggaata

SEQ ID NO: 13242 - DNA, 23 bp, Homo sapiens
tcctggaaatgagacctggtgga

SEQ ID NO: 13243 - DNA, 21 bp, Homo sapiens
cactgtcataaccagtgctct

SEQ ID NO: 13244 - DNA, 20 bp, Homo sapiens
cagagtctacacagacgcct

SEQ ID NO: 13245 - DNA, 19 bp, Homo sapiens
gcctaaaatcttaggtcat

SEQ ID NO: 13246 - DNA, 21 bp, Homo sapiens
ggggtcctctgggattagtta

SEQ ID NO: 13247 - DNA, 24 bp, Homo sapiens
agcctggccaacatggcaaaacca

SEQ ID NO: 13248 - DNA, 19 bp, Homo sapiens
attttcggcaaccgctgct

SEQ ID NO: 13249 - DNA, 21 bp, Homo sapiens
catggcaaaaccatctctact

SEQ ID NO: 13250 - DNA, 18 bp, Homo sapiens
ccttccattttccttcca

SEQ ID NO: 13251 - DNA, 23 bp, Homo sapiens
gcagttttgccaggtgtttgtta

SEQ ID NO: 13252 - DNA, 23 bp, Homo sapiens
acccagagtggcccaagactccc

SEQ ID NO: 13253 - DNA, 22 bp, Homo sapiens
catcattagcatgaaccaccca

SEQ ID NO: 13254 - DNA, 18 bp, Homo sapiens
ccaagtcatcctcccacc

SEQ ID NO: 13255 - DNA, 23 bp, Homo sapiens
aaggtatactaaataatatatca

SEQ ID NO: 13256 - DNA, 20 bp, Homo sapiens
aggctcccactgctactact

SEQ ID NO: 13257 - DNA, 16 bp, Homo sapiens
gcccagaaggcaccag

SEQ ID NO: 13258 - DNA, 18 bp, Homo sapiens
cggggcccatgcccgtgc

SEQ ID NO: 13259 - DNA, 18 bp, Homo sapiens
gcccggtgcctctcagga

SEQ ID NO: 13260 - DNA, 24 bp, Homo sapiens
gcttctctgtgggtacgtgcccct

SEQ ID NO: 13261 - DNA, 18 bp, Homo sapiens
gctttgcccgcctggccc

SEQ ID NO: 13262 - DNA, 26 bp, Homo sapiens
gtgccatagttttattaactccatta

SEQ ID NO: 13263 - DNA, 23 bp, Homo sapiens
tgttgccttgccacgtcctgtca

SEQ ID NO: 13264 - DNA, 19 bp, Homo sapiens
agatcaccagcccggcctg

SEQ ID NO: 13265 - DNA, 16 bp, Homo sapiens
gccccttcccatctct

SEQ ID NO: 13266 - DNA, 22 bp, Homo sapiens
actggaagagtagaatatcata

SEQ ID NO: 13267 - DNA, 19 bp, Homo sapiens
cactctcaccaagtcacca

SEQ ID NO: 13268 - DNA, 20 bp, Homo sapiens
catgctgggcatcctaggcc

SEQ ID NO: 13269 - DNA, 21 bp, Homo sapiens
ctctctcctcactctgcctct

SEQ ID NO: 13270 - DNA, 22 bp, Homo sapiens
gcttgggaaccacccctggcct

SEQ ID NO: 13271 - DNA, 18 bp, Homo sapiens
taacagtctgctcccctc

SEQ ID NO: 13272 - DNA, 22 bp, Homo sapiens
tatcatatagggaagaaacctt

SEQ ID NO: 13273 - DNA, 18 bp, Homo sapiens
tcatgattttccgttaca

SEQ ID NO: 13274 - DNA, 18 bp, Homo sapiens
aacatgtagggcaagagg

SEQ ID NO: 13275 - DNA, 19 bp, Homo sapiens
aagaggagatgtgatcagg

SEQ ID NO: 13276 - DNA, 19 bp, Homo sapiens
ggccccgccttttccccca

SEQ ID NO: 13277 - DNA, 20 bp, Homo sapiens
tgtccctcagcaacatccca

SEQ ID NO: 13278 - DNA, 19 bp, Homo sapiens
tagcaatacaaactagttg

SEQ ID NO: 13279 - DNA, 19 bp, Homo sapiens
agacagctgctcagagcca

SEQ ID NO: 13280 - DNA, 23 bp, Homo sapiens
atctgagccagcaccgccggctt

SEQ ID NO: 13281 - DNA, 20 bp, Homo sapiens
ttgagtctatttttgtacaa

SEQ ID NO: 13282 - DNA, 23 bp, Homo sapiens
atctgggttaattcatttggttc

SEQ ID NO: 13283 - DNA, 19 bp, Homo sapiens
atgttaccttttcatcccc

SEQ ID NO: 13284 - DNA, 18 bp, Homo sapiens
cgctcttttcaatctctt

SEQ ID NO: 13285 - DNA, 16 bp, Homo sapiens
ctcagagaccaataaa

SEQ ID NO: 13286 - DNA, 17 bp, Homo sapiens
tccgaaaacttccattg

SEQ ID NO: 13287 - DNA, 21 bp, Homo sapiens
tctgaaaacccaaggccaggt

SEQ ID NO: 13288 - DNA, 20 bp, Homo sapiens
tcttttcaatctcttaatct

SEQ ID NO: 13289 - DNA, 23 bp, Homo sapiens
aaaactgtattaaaatgcattga

SEQ ID NO: 13290 - DNA, 17 bp, Homo sapiens
tgtattaaaatgcattg

SEQ ID NO: 13291 - DNA, 23 bp, Homo sapiens
agaaaggaaatcccagctttccc

SEQ ID NO: 13292 - DNA, 20 bp, Homo sapiens
tgaggaatgaaaggaaccca

SEQ ID NO: 13293 - DNA, 19 bp, Homo sapiens
agctgaccgggctcacttg

SEQ ID NO: 13294 - DNA, 21 bp, Homo sapiens
ccatgctcttgttctgttcct

SEQ ID NO: 13295 - DNA, 19 bp, Homo sapiens
ctctaaagaccatgttgga

SEQ ID NO: 13296 - DNA, 21 bp, Homo sapiens
gtcccttttagtttgatcaga

SEQ ID NO: 13297 - DNA, 23 bp, Homo sapiens
tcaaaacacttccagtctggaga

SEQ ID NO: 13298 - DNA, 18 bp, Homo sapiens
cctcctgggatctgtggg

SEQ ID NO: 13299 - DNA, 22 bp, Homo sapiens
ccaagagtaaccctcccatccc

SEQ ID NO: 13300 - DNA, 18 bp, Homo sapiens
gagtaaccctcccatccc

SEQ ID NO: 13301 - DNA, 20 bp, Homo sapiens
aaaacaggaacccaccaaac

SEQ ID NO: 13302 - DNA, 21 bp, Homo sapiens
acacacaaaccagcctcaact

SEQ ID NO: 13303 - DNA, 20 bp, Homo sapiens
ccagggcgttaaattcacag

SEQ ID NO: 13304 - DNA, 23 bp, Homo sapiens
ccctcccctccccttcttctcca

SEQ ID NO: 13305 - DNA, 19 bp, Homo sapiens
gctagtcacacctatttga

SEQ ID NO: 13306 - DNA, 17 bp, Homo sapiens
ggaaaacaggaacccac

SEQ ID NO: 13307 - DNA, 19 bp, Homo sapiens
aaacaaacaaaacaaagaa

SEQ ID NO: 13308 - DNA, 17 bp, Homo sapiens
acaaaaattagccaagt

SEQ ID NO: 13309 - DNA, 21 bp, Homo sapiens
agcctttcgtgtttttccaca

SEQ ID NO: 13310 - DNA, 23 bp, Homo sapiens
cacaaaccctccatccacttccc

SEQ ID NO: 13311 - DNA, 20 bp, Homo sapiens
cttcccatttcctctgccct

SEQ ID NO: 13312 - DNA, 21 bp, Homo sapiens
gcctggatcgctcgacctggc

SEQ ID NO: 13313 - DNA, 25 bp, Homo sapiens
gcgacacatctgatcagctgtggtg

SEQ ID NO: 13314 - DNA, 18 bp, Homo sapiens
gtttaagcttctctgtac

SEQ ID NO: 13315 - DNA, 19 bp, Homo sapiens
tctttttgacttccaactg

SEQ ID NO: 13316 - DNA, 17 bp, Homo sapiens
ttttcagaaccacgtca

SEQ ID NO: 13317 - DNA, 19 bp, Homo sapiens
aagggtttggtctaagctg

SEQ ID NO: 13318 - DNA, 24 bp, Homo sapiens
atcaaacacaggtgcactcagctg

SEQ ID NO: 13319 - DNA, 20 bp, Homo sapiens
cagctgggagtgtccatcat

SEQ ID NO: 13320 - DNA, 19 bp, Homo sapiens
tcaaacacaggtgcactca

SEQ ID NO: 13321 - DNA, 22 bp, Homo sapiens
tcgtaccagcaagtagactagg

SEQ ID NO: 13322 - DNA, 18 bp, Homo sapiens
tggtccttgggagctctg

SEQ ID NO: 13323 - DNA, 19 bp, Homo sapiens
cttccctctacctccccca

SEQ ID NO: 13324 - DNA, 24 bp, Homo sapiens
ttttttgcccacctgccttgattt

SEQ ID NO: 13325 - DNA, 18 bp, Homo sapiens
gccccgtgccgccgccgc

SEQ ID NO: 13326 - DNA, 24 bp, Homo sapiens
gccttccggccgaccgcccggctt

SEQ ID NO: 13327 - DNA, 21 bp, Homo sapiens
atccactttgtacataagtta

SEQ ID NO: 13328 - DNA, 21 bp, Homo sapiens
ggcttctgtatgtagtatttt

SEQ ID NO: 13329 - DNA, 23 bp, Homo sapiens
tgaagaatctttcagtcatagta

SEQ ID NO: 13330 - DNA, 19 bp, Homo sapiens
ttctgaagtaaaggcttgt

SEQ ID NO: 13331 - DNA, 20 bp, Homo sapiens
ggctccctgctctcatttta

SEQ ID NO: 13332 - DNA, 18 bp, Homo sapiens
gtgtagttgaaacagtca

SEQ ID NO: 13333 - DNA, 20 bp, Homo sapiens
tacccacacacatacacaca

SEQ ID NO: 13334 - DNA, 20 bp, Homo sapiens
ttgattgggactggggctga

SEQ ID NO: 13335 - DNA, 17 bp, Homo sapiens
tgatttcaaacactttt

SEQ ID NO: 13336 - DNA, 18 bp, Homo sapiens
atttttttccactaccca

SEQ ID NO: 13337 - DNA, 21 bp, Homo sapiens
ctgaattgagttactttgata

SEQ ID NO: 13338 - DNA, 17 bp, Homo sapiens
gcagtgattaaccaaga

SEQ ID NO: 13339 - DNA, 20 bp, Homo sapiens
gccaaactgaataaaactgt

SEQ ID NO: 13340 - DNA, 21 bp, Homo sapiens
gccttaggagcaaatgtagta

SEQ ID NO: 13341 - DNA, 20 bp, Homo sapiens
tcttatgtactcatgcatgg

SEQ ID NO: 13342 - DNA, 25 bp, Homo sapiens
gggaacgtggtgcggcggcggcggc

SEQ ID NO: 13343 - DNA, 20 bp, Homo sapiens
tcagcagcggcaacaagtgc

SEQ ID NO: 13344 - DNA, 22 bp, Homo sapiens
ttggtttcctggtggtatcata

SEQ ID NO: 13345 - DNA, 18 bp, Homo sapiens
agggtccgggcccggccg

SEQ ID NO: 13346 - DNA, 22 bp, Homo sapiens
cttcttctcgggtcttggtcct

SEQ ID NO: 13347 - DNA, 20 bp, Homo sapiens
acattttgtaattttcctca

SEQ ID NO: 13348 - DNA, 18 bp, Homo sapiens
atcaatattaacacttga

SEQ ID NO: 13349 - DNA, 19 bp, Homo sapiens
ggccactttacgcaactca

SEQ ID NO: 13350 - DNA, 19 bp, Homo sapiens
tcaacttttagcctgctca

SEQ ID NO: 13351 - DNA, 19 bp, Homo sapiens
agagtgctgcctctatcca

SEQ ID NO: 13352 - DNA, 16 bp, Homo sapiens
atcctggtatcattgc

SEQ ID NO: 13353 - DNA, 19 bp, Homo sapiens
cctgagtcgggaggcctgc

SEQ ID NO: 13354 - DNA, 23 bp, Homo sapiens
ggtgggtggaggggtttgcagtg

SEQ ID NO: 13355 - DNA, 20 bp, Homo sapiens
ccacgccgacccctcccctc

SEQ ID NO: 13356 - DNA, 21 bp, Homo sapiens
cccgcttttaccctccccacc

SEQ ID NO: 13357 - DNA, 18 bp, Homo sapiens
acactcctccttgcgcac

SEQ ID NO: 13358 - DNA, 23 bp, Homo sapiens
tctcttctctctcttttaatttt

SEQ ID NO: 13359 - DNA, 19 bp, Homo sapiens
gggcggggcgaaccctgcc

SEQ ID NO: 13360 - DNA, 26 bp, Homo sapiens
aaaacaacagatggggggtttgtgga

SEQ ID NO: 13361 - DNA, 24 bp, Homo sapiens
caatcttgacttgtttttgcagta

SEQ ID NO: 13362 - DNA, 17 bp, Homo sapiens
cttccccttccctttcc

SEQ ID NO: 13363 - DNA, 19 bp, Homo sapiens
gtttgcttttgccactttc

SEQ ID NO: 13364 - DNA, 20 bp, Homo sapiens
tgataaagatcatcagtttt

SEQ ID NO: 13365 - DNA, 24 bp, Homo sapiens
gaaagaacagagattaccctttca

SEQ ID NO: 13366 - DNA, 16 bp, Homo sapiens
gaatgtatttggaata

SEQ ID NO: 13367 - DNA, 24 bp, Homo sapiens
tcctgttctgtaagatcagatgtt

SEQ ID NO: 13368 - DNA, 21 bp, Homo sapiens
ttggtatggttggagtgtagg

SEQ ID NO: 13369 - DNA, 20 bp, Homo sapiens
cagaaaagacaaacatttca

SEQ ID NO: 13370 - DNA, 18 bp, Homo sapiens
gccagggaagccaacccc

SEQ ID NO: 13371 - DNA, 18 bp, Homo sapiens
tagtctcgagtttttttt

SEQ ID NO: 13372 - DNA, 19 bp, Homo sapiens
aataaaatcctatgaaatc

SEQ ID NO: 13373 - DNA, 19 bp, Homo sapiens
ccccgccctgggctgcagc

SEQ ID NO: 13374 - DNA, 24 bp, Homo sapiens
taccccatccagaacattcttgga

SEQ ID NO: 13375 - DNA, 19 bp, Homo sapiens
tgcccagagcgtgtcccag

SEQ ID NO: 13376 - DNA, 21 bp, Homo sapiens
tggaggcggcggtggcactga

SEQ ID NO: 13377 - DNA, 21 bp, Homo sapiens
tgggagcctctgggctcggca

SEQ ID NO: 13378 - DNA, 18 bp, Homo sapiens
tctttttcactttacttt

SEQ ID NO: 13379 - DNA, 19 bp, Homo sapiens
acagctgactgatcagact

SEQ ID NO: 13380 - DNA, 20 bp, Homo sapiens
cctaagtctccttttcttca

SEQ ID NO: 13381 - DNA, 20 bp, Homo sapiens
attttccagatacttgcttt

SEQ ID NO: 13382 - DNA, 21 bp, Homo sapiens
ctttgtactttctttaatctt

SEQ ID NO: 13383 - DNA, 18 bp, Homo sapiens
tcattacttcatgtgtca

SEQ ID NO: 13384 - DNA, 20 bp, Homo sapiens
agaagatatgaatctctgag

SEQ ID NO: 13385 - DNA, 22 bp, Homo sapiens
ggcatttggcaattcttagaga

SEQ ID NO: 13386 - DNA, 23 bp, Homo sapiens
tcacagaatactaaagcacctca

SEQ ID NO: 13387 - DNA, 16 bp, Homo sapiens
tcccaaaatgtcagaa

SEQ ID NO: 13388 - DNA, 23 bp, Homo sapiens
tccggttgtcacaattggaggga

SEQ ID NO: 13389 - DNA, 21 bp, Homo sapiens
aaagtgctaataataatctca

SEQ ID NO: 13390 - DNA, 19 bp, Homo sapiens
aaataaaagttctacttca

SEQ ID NO: 13391 - DNA, 26 bp, Homo sapiens
caaggttgtgacgttcgagcttagtt

SEQ ID NO: 13392 - DNA, 19 bp, Homo sapiens
cccactcgtgataagtcaa

SEQ ID NO: 13393 - DNA, 17 bp, Homo sapiens
cctgattttaattgtga

SEQ ID NO: 13394 - DNA, 16 bp, Homo sapiens
taaatccaaagtcccc

SEQ ID NO: 13395 - DNA, 28 bp, Homo sapiens
tatgaccctgattttaattgtgaaatta

SEQ ID NO: 13396 - DNA, 21 bp, Homo sapiens
tcaggattctaatagctacat

SEQ ID NO: 13397 - DNA, 18 bp, Homo sapiens
ttcctagagaactgtcca

SEQ ID NO: 13398 - DNA, 22 bp, Homo sapiens
ttcctattttatactcatggaa

SEQ ID NO: 13399 - DNA, 21 bp, Homo sapiens
ttgcccactcgtgataagtca

SEQ ID NO: 13400 - DNA, 21 bp, Homo sapiens
aacaaaaacagcagtttgtga

SEQ ID NO: 13401 - DNA, 16 bp, Homo sapiens
agcctgtaaacggtgc

SEQ ID NO: 13402 - DNA, 18 bp, Homo sapiens
caatttggaaggcattga

SEQ ID NO: 13403 - DNA, 20 bp, Homo sapiens
tctcatagggttgtgtgatt

SEQ ID NO: 13404 - DNA, 17 bp, Homo sapiens
taagatcaggaggccca

SEQ ID NO: 13405 - DNA, 16 bp, Homo sapiens
agaagtaaacaggtca

SEQ ID NO: 13406 - DNA, 21 bp, Homo sapiens
ctgttcaaaggcattatctgt

SEQ ID NO: 13407 - DNA, 18 bp, Homo sapiens
tgtgaaacaactacatta

SEQ ID NO: 13408 - DNA, 25 bp, Homo sapiens
tttcagcaaattttaaaacattttt

SEQ ID NO: 13409 - DNA, 18 bp, Homo sapiens
gaataattgaagtccctt

SEQ ID NO: 13410 - DNA, 21 bp, Homo sapiens
tccagctaagagggcccatct

SEQ ID NO: 13411 - DNA, 16 bp, Homo sapiens
tctcacctctttccta

SEQ ID NO: 13412 - DNA, 25 bp, Homo sapiens
tgtaattgagaaaatgttcaccaaa

SEQ ID NO: 13413 - DNA, 26 bp, Homo sapiens
aaaattataccattggcatgaagctg

SEQ ID NO: 13414 - DNA, 23 bp, Homo sapiens
actatgactgtatgattatttta

SEQ ID NO: 13415 - DNA, 17 bp, Homo sapiens
tagaacagatggcacta

SEQ ID NO: 13416 - DNA, 22 bp, Homo sapiens
tcttggtgtatagttctgtgaa

SEQ ID NO: 13417 - DNA, 17 bp, Homo sapiens
aatatgtcttaactatt

SEQ ID NO: 13418 - DNA, 22 bp, Homo sapiens
atcttggctcactgcaacctct

SEQ ID NO: 13419 - DNA, 20 bp, Homo sapiens
cctctgcctcctgggttcaa

SEQ ID NO: 13420 - DNA, 20 bp, Homo sapiens
ctcagatagtactgaaccct

SEQ ID NO: 13421 - DNA, 21 bp, Homo sapiens
tacctaacttctagtgtagta

SEQ ID NO: 13422 - DNA, 20 bp, Homo sapiens
tagaatttctatatctagtc

SEQ ID NO: 13423 - DNA, 23 bp, Homo sapiens
tagagttggcagttaatgctgaa

SEQ ID NO: 13424 - DNA, 18 bp, Homo sapiens
tctcactctgtcattgtt

SEQ ID NO: 13425 - DNA, 20 bp, Homo sapiens
tggccaggctggtcttgaac

SEQ ID NO: 13426 - DNA, 19 bp, Homo sapiens
tgtgtagagtttttgatta

SEQ ID NO: 13427 - DNA, 18 bp, Homo sapiens
aaagttggggggtgggaa

SEQ ID NO: 13428 - DNA, 28 bp, Homo sapiens
atttgatactataatagaatgagacata

SEQ ID NO: 13429 - DNA, 18 bp, Homo sapiens
gcgcgcggcggccgtggc

SEQ ID NO: 13430 - DNA, 19 bp, Homo sapiens
acagcactccaggccagct

SEQ ID NO: 13431 - DNA, 26 bp, Homo sapiens
cttgggtaagtacgcaacttactttt

SEQ ID NO: 13432 - DNA, 19 bp, Homo sapiens
aggtcttatagattcctga

SEQ ID NO: 13433 - DNA, 19 bp, Homo sapiens
tgaggaatacagtgagcag

SEQ ID NO: 13434 - DNA, 19 bp, Homo sapiens
agggacctggactccccct

SEQ ID NO: 13435 - DNA, 23 bp, Homo sapiens
gtgcctctttggctgggggttct

SEQ ID NO: 13436 - DNA, 20 bp, Homo sapiens
gtgttttccagtcccatccc

SEQ ID NO: 13437 - DNA, 22 bp, Homo sapiens
tgggtgttctcagcatgaagct

SEQ ID NO: 13438 - DNA, 25 bp, Homo sapiens
cccgaggtgcggagcgacctgcgga

SEQ ID NO: 13439 - DNA, 17 bp, Homo sapiens
accaaaacaaatggaga

SEQ ID NO: 13440 - DNA, 20 bp, Homo sapiens
agtattaccaatgctgttgt

SEQ ID NO: 13441 - DNA, 19 bp, Homo sapiens
ctcccctttggtaatgctt

SEQ ID NO: 13442 - DNA, 27 bp, Homo sapiens
gcaggatggtgatgggggtttttgtta

SEQ ID NO: 13443 - DNA, 16 bp, Homo sapiens
tagcaaattgtgctgc

SEQ ID NO: 13444 - DNA, 16 bp, Homo sapiens
tagcaaattgtgctgc

SEQ ID NO: 13445 - DNA, 19 bp, Homo sapiens
tgctgttaactactactga

SEQ ID NO: 13446 - DNA, 20 bp, Homo sapiens
catcaagtctccacgtgttt

SEQ ID NO: 13447 - DNA, 20 bp, Homo sapiens
ccccgcccctccccctacag

SEQ ID NO: 13448 - DNA, 21 bp, Homo sapiens
ccttcagccgccgccgcagct

SEQ ID NO: 13449 - DNA, 19 bp, Homo sapiens
cgcccctgcccagcacctc

SEQ ID NO: 13450 - DNA, 20 bp, Homo sapiens
cgcccctgcccagcacctcc

SEQ ID NO: 13451 - DNA, 23 bp, Homo sapiens
ctccgggcagagaccaccgcgcc

SEQ ID NO: 13452 - DNA, 19 bp, Homo sapiens
gcccctttctcttgctgtt

SEQ ID NO: 13453 - DNA, 23 bp, Homo sapiens
atggaaaccaggggacttacctt

SEQ ID NO: 13454 - DNA, 24 bp, Homo sapiens
cagacaggttaacagaagctactg

SEQ ID NO: 13455 - DNA, 19 bp, Homo sapiens
gcaaaatgaaaattttgcc

SEQ ID NO: 13456 - DNA, 21 bp, Homo sapiens
gcaaaatgaaaattttgcctt

SEQ ID NO: 13457 - DNA, 23 bp, Homo sapiens
tactgcagtggaaagagcactga

SEQ ID NO: 13458 - DNA, 26 bp, Homo sapiens
tctgggtttctctcaagtttgttttt

SEQ ID NO: 13459 - DNA, 18 bp, Homo sapiens
tggacagaatttcccaca

SEQ ID NO: 13460 - DNA, 15 bp, Homo sapiens
agagagagaagtacc

SEQ ID NO: 13461 - DNA, 20 bp, Homo sapiens
cagccttttctaataggcta

SEQ ID NO: 13462 - DNA, 21 bp, Homo sapiens
ggtttatttatgttgtagcaa

SEQ ID NO: 13463 - DNA, 20 bp, Homo sapiens
taaaagctcggcattgtaat

SEQ ID NO: 13464 - DNA, 18 bp, Homo sapiens
tattttcactttgtgtca

SEQ ID NO: 13465 - DNA, 21 bp, Homo sapiens
tcatgaatttagttagactaa

SEQ ID NO: 13466 - DNA, 20 bp, Homo sapiens
acaaccttcggccgccccac

SEQ ID NO: 13467 - DNA, 19 bp, Homo sapiens
agccactctgactcagcca

SEQ ID NO: 13468 - DNA, 20 bp, Homo sapiens
caccatcatcacatccccca

SEQ ID NO: 13469 - DNA, 24 bp, Homo sapiens
ccttagccttgggaggtctgggaa

SEQ ID NO: 13470 - DNA, 18 bp, Homo sapiens
ctgccccacctctcccca

SEQ ID NO: 13471 - DNA, 22 bp, Homo sapiens
gggacaggaaaccacttccttt

SEQ ID NO: 13472 - DNA, 18 bp, Homo sapiens
tccgcctcctgggttcaa

SEQ ID NO: 13473 - DNA, 20 bp, Homo sapiens
tgaccctgaggtcaacacag

SEQ ID NO: 13474 - DNA, 22 bp, Homo sapiens
tttagtaatctgccttagcctt

SEQ ID NO: 13475 - DNA, 22 bp, Homo sapiens
aggggtacacactttttgctta

SEQ ID NO: 13476 - DNA, 23 bp, Homo sapiens
cccagttccgtccaagttgctgc

SEQ ID NO: 13477 - DNA, 18 bp, Homo sapiens
cggagagagattccatct

SEQ ID NO: 13478 - DNA, 20 bp, Homo sapiens
ctataattgtctctgagtaa

SEQ ID NO: 13479 - DNA, 19 bp, Homo sapiens
gctgtatatttatctttca

SEQ ID NO: 13480 - DNA, 18 bp, Homo sapiens
tcaaatgtatgcctgtta

SEQ ID NO: 13481 - DNA, 19 bp, Homo sapiens
tctttttcagagcttctca

SEQ ID NO: 13482 - DNA, 18 bp, Homo sapiens
tggtacatatataccaca

SEQ ID NO: 13483 - DNA, 20 bp, Homo sapiens
cgcctgcttcacacccctca

SEQ ID NO: 13484 - DNA, 17 bp, Homo sapiens
gcccacccagggcccgg

SEQ ID NO: 13485 - DNA, 21 bp, Homo sapiens
agtagctgagaaaactaagtc

SEQ ID NO: 13486 - DNA, 19 bp, Homo sapiens
tttttgattgcagtttata

SEQ ID NO: 13487 - DNA, 21 bp, Homo sapiens
aaacacttgtccaaggtctca

SEQ ID NO: 13488 - DNA, 19 bp, Homo sapiens
caagccccgcctctcctct

SEQ ID NO: 13489 - DNA, 21 bp, Homo sapiens
ctgtgcgtccaagtggagtca

SEQ ID NO: 13490 - DNA, 18 bp, Homo sapiens
gtggagtcaggttttcta

SEQ ID NO: 13491 - DNA, 19 bp, Homo sapiens
tgcaaattcagtgttaact

SEQ ID NO: 13492 - DNA, 20 bp, Homo sapiens
tgtttgcaaattcagtgtta

SEQ ID NO: 13493 - DNA, 20 bp, Homo sapiens
actgcagtggccacttctga

SEQ ID NO: 13494 - DNA, 17 bp, Homo sapiens
aggttctccagatctct

SEQ ID NO: 13495 - DNA, 24 bp, Homo sapiens
caaagctggcatcctcctatgtca

SEQ ID NO: 13496 - DNA, 17 bp, Homo sapiens
cactggcactttcagca

SEQ ID NO: 13497 - DNA, 19 bp, Homo sapiens
cagatctcttaagactgta

SEQ ID NO: 13498 - DNA, 19 bp, Homo sapiens
ccacatccacttccacccc

SEQ ID NO: 13499 - DNA, 21 bp, Homo sapiens
ggatggtgactgcgccatggc

SEQ ID NO: 13500 - DNA, 18 bp, Homo sapiens
ggatgttaacatgggatt

SEQ ID NO: 13501 - DNA, 18 bp, Homo sapiens
agaagccctggccagtga

SEQ ID NO: 13502 - DNA, 26 bp, Homo sapiens
cctgcagactgaagactctggactca

SEQ ID NO: 13503 - DNA, 21 bp, Homo sapiens
ggcctgggccagagtcaggga

SEQ ID NO: 13504 - DNA, 17 bp, Homo sapiens
tgattggaacaccagga

SEQ ID NO: 13505 - DNA, 19 bp, Homo sapiens
cctgctccacttgtcaggg

SEQ ID NO: 13506 - DNA, 22 bp, Homo sapiens
aagtccacccttggttcctaac

SEQ ID NO: 13507 - DNA, 19 bp, Homo sapiens
gtgccattaacaaatgtat

SEQ ID NO: 13508 - DNA, 28 bp, Homo sapiens
accacataccctcacttcccccttccct

SEQ ID NO: 13509 - DNA, 23 bp, Homo sapiens
cctctttctccttactgacttca

SEQ ID NO: 13510 - DNA, 20 bp, Homo sapiens
cttcccccttccctacctct

SEQ ID NO: 13511 - DNA, 22 bp, Homo sapiens
acaccagttcttggtgacgcca

SEQ ID NO: 13512 - DNA, 20 bp, Homo sapiens
atcaggcgtctacactgtca

SEQ ID NO: 13513 - DNA, 17 bp, Homo sapiens
atgtttggctgggcatc

SEQ ID NO: 13514 - DNA, 23 bp, Homo sapiens
gcccttcctccagcgccctgcgg

SEQ ID NO: 13515 - DNA, 18 bp, Homo sapiens
agctatcccatcttcagg

SEQ ID NO: 13516 - DNA, 19 bp, Homo sapiens
attggggagcttgcccttt

SEQ ID NO: 13517 - DNA, 24 bp, Homo sapiens
gtttctgctgcagatagtggtgtt

SEQ ID NO: 13518 - DNA, 20 bp, Homo sapiens
acctggggcagataaaatgc

SEQ ID NO: 13519 - DNA, 24 bp, Homo sapiens
agtgagtgggagagtacctgtgtg

SEQ ID NO: 13520 - DNA, 16 bp, Homo sapiens
agtggccatcatcctc

SEQ ID NO: 13521 - DNA, 19 bp, Homo sapiens
ccattaggtcggttcctgc

SEQ ID NO: 13522 - DNA, 20 bp, Homo sapiens
cgggaggggaggcattgaca

SEQ ID NO: 13523 - DNA, 24 bp, Homo sapiens
ttacaatgtgaataatggcactga

SEQ ID NO: 13524 - DNA, 19 bp, Homo sapiens
acaaaagtcacagtctgag

SEQ ID NO: 13525 - DNA, 17 bp, Homo sapiens
caattcaatccatgaca

SEQ ID NO: 13526 - DNA, 18 bp, Homo sapiens
tcacctgtgtcctccctg

SEQ ID NO: 13527 - DNA, 24 bp, Homo sapiens
tggagcacctctgagatggaattg

SEQ ID NO: 13528 - DNA, 21 bp, Homo sapiens
ctctagtggaagacctttgga

SEQ ID NO: 13529 - DNA, 24 bp, Homo sapiens
ctttttgggtgaaatggatttatg

SEQ ID NO: 13530 - DNA, 17 bp, Homo sapiens
gctgttccttttcacct

SEQ ID NO: 13531 - DNA, 20 bp, Homo sapiens
tatttcagctgttccttttc

SEQ ID NO: 13532 - DNA, 23 bp, Homo sapiens
tgccaaccgtgcttgtactgcta

SEQ ID NO: 13533 - DNA, 18 bp, Homo sapiens
aaagaagctatgaagata

SEQ ID NO: 13534 - DNA, 24 bp, Homo sapiens
gagaaatactgagcaagtctttca

SEQ ID NO: 13535 - DNA, 22 bp, Homo sapiens
gcttatatttatcgcttggctc

SEQ ID NO: 13536 - DNA, 25 bp, Homo sapiens
tttccatactaaaccagtttgttaa

SEQ ID NO: 13537 - DNA, 18 bp, Homo sapiens
agtgagtggagagccagc

SEQ ID NO: 13538 - DNA, 20 bp, Homo sapiens
gtccgtgcaccgatgcacac

SEQ ID NO: 13539 - DNA, 22 bp, Homo sapiens
tctcttttgagttttatacctt

SEQ ID NO: 13540 - DNA, 20 bp, Homo sapiens
tatgcttatttggaaagtca

SEQ ID NO: 13541 - DNA, 17 bp, Homo sapiens
tctagttgttttaatct

SEQ ID NO: 13542 - DNA, 21 bp, Homo sapiens
aaacaatgtataggtacacag

SEQ ID NO: 13543 - DNA, 16 bp, Homo sapiens
aaccctcctgtgtcct

SEQ ID NO: 13544 - DNA, 18 bp, Homo sapiens
acagaacccttttcctga

SEQ ID NO: 13545 - DNA, 24 bp, Homo sapiens
agaagaaagagaaaccttcacttt

SEQ ID NO: 13546 - DNA, 19 bp, Homo sapiens
atcaaatgtatatgctttt

SEQ ID NO: 13547 - DNA, 18 bp, Homo sapiens
ccacttttgactaggtaa

SEQ ID NO: 13548 - DNA, 19 bp, Homo sapiens
ccagccaacagtaacactt

SEQ ID NO: 13549 - DNA, 19 bp, Homo sapiens
gctgtctctctgacaccag

SEQ ID NO: 13550 - DNA, 22 bp, Homo sapiens
gtcatatactctgcatcactgt

SEQ ID NO: 13551 - DNA, 17 bp, Homo sapiens
gtgaataaagttgtgtg

SEQ ID NO: 13552 - DNA, 23 bp, Homo sapiens
tatgccccaaagcttgctctttt

SEQ ID NO: 13553 - DNA, 20 bp, Homo sapiens
tcactgcactcctttgtcat

SEQ ID NO: 13554 - DNA, 16 bp, Homo sapiens
tcctgtgtcctctgaa

SEQ ID NO: 13555 - DNA, 17 bp, Homo sapiens
tggttaaaacaccatga

SEQ ID NO: 13556 - DNA, 21 bp, Homo sapiens
cgccaaggactttccacatca

SEQ ID NO: 13557 - DNA, 19 bp, Homo sapiens
gaggaggagggcgacgcca

SEQ ID NO: 13558 - DNA, 20 bp, Homo sapiens
aacctcttcagcactagcca

SEQ ID NO: 13559 - DNA, 19 bp, Homo sapiens
atcttaaatgtgtaagtca

SEQ ID NO: 13560 - DNA, 23 bp, Homo sapiens
ctatttttgagaaaaccctcaca

SEQ ID NO: 13561 - DNA, 18 bp, Homo sapiens
ctttccactctctttcca

SEQ ID NO: 13562 - DNA, 26 bp, Homo sapiens
ttctgccccttttatgacacctttga

SEQ ID NO: 13563 - DNA, 19 bp, Homo sapiens
ttgttttatctccctttcc

SEQ ID NO: 13564 - DNA, 20 bp, Homo sapiens
agccacactcgcacctcctg

SEQ ID NO: 13565 - DNA, 19 bp, Homo sapiens
ccaggaaaccattaagccc

SEQ ID NO: 13566 - DNA, 24 bp, Homo sapiens
cctgcactcatgccacctgccagg

SEQ ID NO: 13567 - DNA, 19 bp, Homo sapiens
gccctggggctggggggct

SEQ ID NO: 13568 - DNA, 19 bp, Homo sapiens
tcaaacacccctaactcag

SEQ ID NO: 13569 - DNA, 18 bp, Homo sapiens
tcagtcctcccttgactt

SEQ ID NO: 13570 - DNA, 18 bp, Homo sapiens
agaaaaaaaaaattgtat

SEQ ID NO: 13571 - DNA, 21 bp, Homo sapiens
agattttgtagggacccatta

SEQ ID NO: 13572 - DNA, 23 bp, Homo sapiens
aggattttacagccttctgatga

SEQ ID NO: 13573 - DNA, 19 bp, Homo sapiens
ccaattttaatgacactaa

SEQ ID NO: 13574 - DNA, 18 bp, Homo sapiens
gggaaccatcagcaccaa

SEQ ID NO: 13575 - DNA, 22 bp, Homo sapiens
taagattgtggagtctgagtta

SEQ ID NO: 13576 - DNA, 15 bp, Homo sapiens
taattcaatggcaat

SEQ ID NO: 13577 - DNA, 17 bp, Homo sapiens
tcagactgaaatcctaa

SEQ ID NO: 13578 - DNA, 19 bp, Homo sapiens
tgatgtaattctctcactt

SEQ ID NO: 13579 - DNA, 17 bp, Homo sapiens
aaggggctggaatctca

SEQ ID NO: 13580 - DNA, 19 bp, Homo sapiens
acacacaaaacaaacaaac

SEQ ID NO: 13581 - DNA, 26 bp, Homo sapiens
acttggaaacttgattgttgtggttc

SEQ ID NO: 13582 - DNA, 19 bp, Homo sapiens
cccgccgttccctgcgctt

SEQ ID NO: 13583 - DNA, 20 bp, Homo sapiens
tctgactgtccctgccaatg

SEQ ID NO: 13584 - DNA, 20 bp, Homo sapiens
tttggtacccccaaaccccc

SEQ ID NO: 13585 - DNA, 20 bp, Homo sapiens
gctattgtgagttttttcaa

SEQ ID NO: 13586 - DNA, 17 bp, Homo sapiens
tatgggaaaacattcca

SEQ ID NO: 13587 - DNA, 17 bp, Homo sapiens
gaactgctttccaactc

SEQ ID NO: 13588 - DNA, 21 bp, Homo sapiens
gtgtgtgtggtggggcttggc

SEQ ID NO: 13589 - DNA, 18 bp, Homo sapiens
aaggcttgatgtgtataa

SEQ ID NO: 13590 - DNA, 19 bp, Homo sapiens
accaagcataagagaagaa

SEQ ID NO: 13591 - DNA, 19 bp, Homo sapiens
gcctgccctccaagcccca

SEQ ID NO: 13592 - DNA, 17 bp, Homo sapiens
agaaatattgtaccgca

SEQ ID NO: 13593 - DNA, 20 bp, Homo sapiens
tttagagtaaaaaataagca

SEQ ID NO: 13594 - DNA, 22 bp, Homo sapiens
ttttgttataaatttataactt

SEQ ID NO: 13595 - DNA, 20 bp, Homo sapiens
acagaagtgttcacagtgta

SEQ ID NO: 13596 - DNA, 20 bp, Homo sapiens
attcgcatcttctctatcca

SEQ ID NO: 13597 - DNA, 19 bp, Homo sapiens
ggtgccctgaatggaacta

SEQ ID NO: 13598 - DNA, 18 bp, Homo sapiens
tggcttaggatggaatta

SEQ ID NO: 13599 - DNA, 17 bp, Homo sapiens
aagaaaagtacccggca

SEQ ID NO: 13600 - DNA, 19 bp, Homo sapiens
caaatgaactgtcctgaca

SEQ ID NO: 13601 - DNA, 18 bp, Homo sapiens
ctttttctgtgctttgac

SEQ ID NO: 13602 - DNA, 19 bp, Homo sapiens
gaactcttggccttacgaa

SEQ ID NO: 13603 - DNA, 17 bp, Homo sapiens
gctcggagtttcgggga

SEQ ID NO: 13604 - DNA, 17 bp, Homo sapiens
agagtccatgtccatct

SEQ ID NO: 13605 - DNA, 19 bp, Homo sapiens
agccttttttgggcagtca

SEQ ID NO: 13606 - DNA, 20 bp, Homo sapiens
cagtccctcagcttcaccca

SEQ ID NO: 13607 - DNA, 21 bp, Homo sapiens
ttctcctggacaaacctttcc

SEQ ID NO: 13608 - DNA, 19 bp, Homo sapiens
agaaaagaagtcttaagat

SEQ ID NO: 13609 - DNA, 20 bp, Homo sapiens
agaagtcttaagatatttca

SEQ ID NO: 13610 - DNA, 21 bp, Homo sapiens
ctgagagacagacacaacagt

SEQ ID NO: 13611 - DNA, 21 bp, Homo sapiens
gacctcggcctctccatgtga

SEQ ID NO: 13612 - DNA, 24 bp, Homo sapiens
aacaatccgtggctgctcattctt

SEQ ID NO: 13613 - DNA, 19 bp, Homo sapiens
cctccccctacctccttcc

SEQ ID NO: 13614 - DNA, 23 bp, Homo sapiens
gtggtttggggagggacttcgtt

SEQ ID NO: 13615 - DNA, 16 bp, Homo sapiens
aatccaatgctcacct

SEQ ID NO: 13616 - DNA, 25 bp, Homo sapiens
gccacggaggcagggtctctgggga

SEQ ID NO: 13617 - DNA, 20 bp, Homo sapiens
ggcctgctcctcctgcaggg

SEQ ID NO: 13618 - DNA, 17 bp, Homo sapiens
tgcttgtgtctccctcg

SEQ ID NO: 13619 - DNA, 18 bp, Homo sapiens
tgtaattgctttgtgtgc

SEQ ID NO: 13620 - DNA, 18 bp, Homo sapiens
aagtggaaagctacactg

SEQ ID NO: 13621 - DNA, 17 bp, Homo sapiens
agaaaagacaaaggtta

SEQ ID NO: 13622 - DNA, 21 bp, Homo sapiens
atccctttgagaggtggctca

SEQ ID NO: 13623 - DNA, 25 bp, Homo sapiens
ccctgggtcccaggagggtctggag

SEQ ID NO: 13624 - DNA, 24 bp, Homo sapiens
ccctggtgctcagagcacctgtgg

SEQ ID NO: 13625 - DNA, 22 bp, Homo sapiens
cctactgtcctaagctgctttt

SEQ ID NO: 13626 - DNA, 19 bp, Homo sapiens
cttcccagacctgcttcca

SEQ ID NO: 13627 - DNA, 21 bp, Homo sapiens
cttctttatgatgttcacttt

SEQ ID NO: 13628 - DNA, 21 bp, Homo sapiens
gcgccgccgtgctcatgctgc

SEQ ID NO: 13629 - DNA, 23 bp, Homo sapiens
ggaatcttcaccccacttcctct

SEQ ID NO: 13630 - DNA, 15 bp, Homo sapiens
ggtccctgccttttt

SEQ ID NO: 13631 - DNA, 21 bp, Homo sapiens
tgcttggaagtggcctcccca

SEQ ID NO: 13632 - DNA, 18 bp, Homo sapiens
tgacgagacccatgtgtg

SEQ ID NO: 13633 - DNA, 22 bp, Homo sapiens
aaataaccaacaacctcttcca

SEQ ID NO: 13634 - DNA, 22 bp, Homo sapiens
aagaataaaaacgacctctttg

SEQ ID NO: 13635 - DNA, 18 bp, Homo sapiens
acaacccacctggaactt

SEQ ID NO: 13636 - DNA, 21 bp, Homo sapiens
ccatggcttagcagaacccca

SEQ ID NO: 13637 - DNA, 19 bp, Homo sapiens
cctgggctgctcctgtccc

SEQ ID NO: 13638 - DNA, 17 bp, Homo sapiens
cgggaagaagccagcaa

SEQ ID NO: 13639 - DNA, 18 bp, Homo sapiens
gtggctcctgccacaccc

SEQ ID NO: 13640 - DNA, 18 bp, Homo sapiens
tccaggctggccttccag

SEQ ID NO: 13641 - DNA, 23 bp, Homo sapiens
tggctcctgccacacccacaggg

SEQ ID NO: 13642 - DNA, 21 bp, Homo sapiens
tggcttcagccccttgagcag

SEQ ID NO: 13643 - DNA, 27 bp, Homo sapiens
gggaatatacaaagtgaagccacattg

SEQ ID NO: 13644 - DNA, 23 bp, Homo sapiens
caaaggaccaggcttgccttttc

SEQ ID NO: 13645 - DNA, 20 bp, Homo sapiens
caatgacttcatttttttct

SEQ ID NO: 13646 - DNA, 23 bp, Homo sapiens
gaaaagagtctcaggttattttt

SEQ ID NO: 13647 - DNA, 21 bp, Homo sapiens
agagctagtgtaagctgttga

SEQ ID NO: 13648 - DNA, 16 bp, Homo sapiens
tttaataaccagctca

SEQ ID NO: 13649 - DNA, 19 bp, Homo sapiens
aatactccttcttccttca

SEQ ID NO: 13650 - DNA, 18 bp, Homo sapiens
ccgtagcctcacagccag

SEQ ID NO: 13651 - DNA, 24 bp, Homo sapiens
gccagaagcccgttggcgagctct

SEQ ID NO: 13652 - DNA, 17 bp, Homo sapiens
ggcacctgcaaaccacc

SEQ ID NO: 13653 - DNA, 21 bp, Homo sapiens
acaacagaggagataatctcc

SEQ ID NO: 13654 - DNA, 26 bp, Homo sapiens
cctgatggaattccaacatgagatta

SEQ ID NO: 13655 - DNA, 21 bp, Homo sapiens
actctcctctctccttctgca

SEQ ID NO: 13656 - DNA, 21 bp, Homo sapiens
agtatggtcgggtgtcagata

SEQ ID NO: 13657 - DNA, 24 bp, Homo sapiens
atagctgtgattcaccccacccca

SEQ ID NO: 13658 - DNA, 21 bp, Homo sapiens
cagtgttttgtttccagctca

SEQ ID NO: 13659 - DNA, 23 bp, Homo sapiens
ctctgatgctctgaggcttctgg

SEQ ID NO: 13660 - DNA, 18 bp, Homo sapiens
ctgagcagctcctggctc

SEQ ID NO: 13661 - DNA, 18 bp, Homo sapiens
gaaaggacccgtgcatct

SEQ ID NO: 13662 - DNA, 23 bp, Homo sapiens
gcctggtgggtgttccctggccc

SEQ ID NO: 13663 - DNA, 19 bp, Homo sapiens
gctcactttgtacccctca

SEQ ID NO: 13664 - DNA, 17 bp, Homo sapiens
ggcatgcctcccttcca

SEQ ID NO: 13665 - DNA, 20 bp, Homo sapiens
gtgaacctactggtggactc

SEQ ID NO: 13666 - DNA, 22 bp, Homo sapiens
tggcctggtgcatccacagagg

SEQ ID NO: 13667 - DNA, 18 bp, Homo sapiens
tggctccggtgggaactg

SEQ ID NO: 13668 - DNA, 19 bp, Homo sapiens
aacccagctggcaccctct

SEQ ID NO: 13669 - DNA, 19 bp, Homo sapiens
cgatggcgatgatgcctct

SEQ ID NO: 13670 - DNA, 25 bp, Homo sapiens
gctttctttaaaaaagggtctgtga

SEQ ID NO: 13671 - DNA, 23 bp, Homo sapiens
ggcaagaaaagctgtagctcgcc

SEQ ID NO: 13672 - DNA, 18 bp, Homo sapiens
tgtcggtctaaaagagga

SEQ ID NO: 13673 - DNA, 21 bp, Homo sapiens
tttttttgatgaagccgagca

SEQ ID NO: 13674 - DNA, 22 bp, Homo sapiens
atttgtttagcttgcttggctt

SEQ ID NO: 13675 - DNA, 17 bp, Homo sapiens
gaaaaaggaagacccgt

SEQ ID NO: 13676 - DNA, 17 bp, Homo sapiens
gagtgtagcgggcatcg

SEQ ID NO: 13677 - DNA, 22 bp, Homo sapiens
tctccatcgagctgtttggttc

SEQ ID NO: 13678 - DNA, 19 bp, Homo sapiens
tgtgttggtttctttctga

SEQ ID NO: 13679 - DNA, 16 bp, Homo sapiens
ttttttccttagcctt

SEQ ID NO: 13680 - DNA, 21 bp, Homo sapiens
ctggaacaatgttgcttggct

SEQ ID NO: 13681 - DNA, 18 bp, Homo sapiens
gagctaagcgtgaagctg

SEQ ID NO: 13682 - DNA, 17 bp, Homo sapiens
acctgcccttagtgatg

SEQ ID NO: 13683 - DNA, 17 bp, Homo sapiens
aggatattccctgctgc

SEQ ID NO: 13684 - DNA, 19 bp, Homo sapiens
catatccctggactcttga

SEQ ID NO: 13685 - DNA, 17 bp, Homo sapiens
tttgccttgttgcaaca

SEQ ID NO: 13686 - DNA, 22 bp, Homo sapiens
aaagaatgatggttcaaggcca

SEQ ID NO: 13687 - DNA, 19 bp, Homo sapiens
agcagtagtcacaaagcca

SEQ ID NO: 13688 - DNA, 16 bp, Homo sapiens
gctttggagaaagacc

SEQ ID NO: 13689 - DNA, 18 bp, Homo sapiens
tccattctcctggagctg

SEQ ID NO: 13690 - DNA, 22 bp, Homo sapiens
tgtaggtaagcaagctactgta

SEQ ID NO: 13691 - DNA, 23 bp, Homo sapiens
tttggtgttctccggatcctttt

SEQ ID NO: 13692 - DNA, 23 bp, Homo sapiens
aagccaattctctgggtgtccca

SEQ ID NO: 13693 - DNA, 18 bp, Homo sapiens
aggataaaccatacttcc

SEQ ID NO: 13694 - DNA, 17 bp, Homo sapiens
cagctggtggatgcatc

SEQ ID NO: 13695 - DNA, 18 bp, Homo sapiens
aagaagtgacttttctga

SEQ ID NO: 13696 - DNA, 25 bp, Homo sapiens
aatccagcgatgctgcagctgtaaa

SEQ ID NO: 13697 - DNA, 23 bp, Homo sapiens
aatgattatcattagaagctaac

SEQ ID NO: 13698 - DNA, 17 bp, Homo sapiens
agaaaatggctgtgctg

SEQ ID NO: 13699 - DNA, 17 bp, Homo sapiens
atctgaaggtcatctcc

SEQ ID NO: 13700 - DNA, 18 bp, Homo sapiens
caaagaagtgacttttct

SEQ ID NO: 13701 - DNA, 20 bp, Homo sapiens
gggagcggccccgctccccc

SEQ ID NO: 13702 - DNA, 19 bp, Homo sapiens
tgagggcagaggctgtggc

SEQ ID NO: 13703 - DNA, 18 bp, Homo sapiens
tcacttgtcttccacttt

SEQ ID NO: 13704 - DNA, 22 bp, Homo sapiens
tctctccggaggtcaccaagga

SEQ ID NO: 13705 - DNA, 23 bp, Homo sapiens
tctttaatggctgtcttgccctt

SEQ ID NO: 13706 - DNA, 18 bp, Homo sapiens
ttttcatgcccagttaac

SEQ ID NO: 13707 - DNA, 26 bp, Homo sapiens
ccttgatttgtgtttgtcttggcctt

SEQ ID NO: 13708 - DNA, 20 bp, Homo sapiens
aaaataaaaatgaacaggta

SEQ ID NO: 13709 - DNA, 19 bp, Homo sapiens
agctcctcccacctcagca

SEQ ID NO: 13710 - DNA, 17 bp, Homo sapiens
cacacgtagtggcttaa

SEQ ID NO: 13711 - DNA, 22 bp, Homo sapiens
gctagctcctcccacctcagca

SEQ ID NO: 13712 - DNA, 23 bp, Homo sapiens
tgaggaaggctcaactggggctg

SEQ ID NO: 13713 - DNA, 22 bp, Homo sapiens
ccgcctccgcgcgcctatgaga

SEQ ID NO: 13714 - DNA, 17 bp, Homo sapiens
tggaaggtttttgttca

SEQ ID NO: 13715 - DNA, 16 bp, Homo sapiens
aatgaagccttcttcc

SEQ ID NO: 13716 - DNA, 18 bp, Homo sapiens
acacagacacacacacac

SEQ ID NO: 13717 - DNA, 19 bp, Homo sapiens
ttgttggtggttttttcaa

SEQ ID NO: 13718 - DNA, 17 bp, Homo sapiens
aactgaacttcagagca

SEQ ID NO: 13719 - DNA, 22 bp, Homo sapiens
cagatcctcaataaacatttca

SEQ ID NO: 13720 - DNA, 19 bp, Homo sapiens
gtgatgacattccctgcta

SEQ ID NO: 13721 - DNA, 20 bp, Homo sapiens
tctgctgatatctgcaggga

SEQ ID NO: 13722 - DNA, 18 bp, Homo sapiens
ttgcaattgcttccctca

SEQ ID NO: 13723 - DNA, 19 bp, Homo sapiens
aacctgatcatcccaccca

SEQ ID NO: 13724 - DNA, 21 bp, Homo sapiens
taaaaccagaaaagtgtttag

SEQ ID NO: 13725 - DNA, 19 bp, Homo sapiens
gaggttcctttgttctacc

SEQ ID NO: 13726 - DNA, 23 bp, Homo sapiens
tctttggtcatttttctgctcct

SEQ ID NO: 13727 - DNA, 19 bp, Homo sapiens
tctttttcatctatttgca

SEQ ID NO: 13728 - DNA, 20 bp, Homo sapiens
agaagggccgggctcggtca

SEQ ID NO: 13729 - DNA, 17 bp, Homo sapiens
cttgagatcagccctcc

SEQ ID NO: 13730 - DNA, 18 bp, Homo sapiens
gcccacccactcgcgtct

SEQ ID NO: 13731 - DNA, 21 bp, Homo sapiens
ccacttgcccaaactgccaaa

SEQ ID NO: 13732 - DNA, 21 bp, Homo sapiens
ccctccccgcgcccctcccca

SEQ ID NO: 13733 - DNA, 18 bp, Homo sapiens
cctggcgaggacgctgcc

SEQ ID NO: 13734 - DNA, 18 bp, Homo sapiens
tggacctgatgtgaaatt

SEQ ID NO: 13735 - DNA, 18 bp, Homo sapiens
ttctcaccgactctccac

SEQ ID NO: 13736 - DNA, 18 bp, Homo sapiens
cactgccacacgcagctc

SEQ ID NO: 13737 - DNA, 31 bp, Homo sapiens
cgctcctccgccccgctcctcctcctcctct

SEQ ID NO: 13738 - DNA, 22 bp, Homo sapiens
gctcctcctcctcctcttcctc

SEQ ID NO: 13739 - DNA, 19 bp, Homo sapiens
ccgccctccccccacctcc

SEQ ID NO: 13740 - DNA, 20 bp, Homo sapiens
gcctgggccgcggtgaggcc

SEQ ID NO: 13741 - DNA, 18 bp, Homo sapiens
ccacgctcatcttgcaaa

SEQ ID NO: 13742 - DNA, 20 bp, Homo sapiens
agcagctcactacgatatca

SEQ ID NO: 13743 - DNA, 19 bp, Homo sapiens
atagaatatacatgtaaca

SEQ ID NO: 13744 - DNA, 18 bp, Homo sapiens
gccttggcatttgtgcag

SEQ ID NO: 13745 - DNA, 20 bp, Homo sapiens
gccttcaagggttctggagg

SEQ ID NO: 13746 - DNA, 24 bp, Homo sapiens
agcgctggtgatccacccgcgcgc

SEQ ID NO: 13747 - DNA, 22 bp, Homo sapiens
aggagagagaaaaataatggca

SEQ ID NO: 13748 - DNA, 20 bp, Homo sapiens
gccacctccgagtcctgggg

SEQ ID NO: 13749 - DNA, 18 bp, Homo sapiens
gccccgcccgcccccctt

SEQ ID NO: 13750 - DNA, 22 bp, Homo sapiens
tgctcctgaccagagccacctc

SEQ ID NO: 13751 - DNA, 19 bp, Homo sapiens
agcccggccacgccgcccc

SEQ ID NO: 13752 - DNA, 20 bp, Homo sapiens
atgccttgatagttagccct

SEQ ID NO: 13753 - DNA, 21 bp, Homo sapiens
cacaacagggcagttgtgata

SEQ ID NO: 13754 - DNA, 24 bp, Homo sapiens
cttgtctttttttttttattttta

SEQ ID NO: 13755 - DNA, 20 bp, Homo sapiens
cctaaagatcaagctacaca

SEQ ID NO: 13756 - DNA, 23 bp, Homo sapiens
tgctgttcaaagaaattacagtt

SEQ ID NO: 13757 - DNA, 19 bp, Homo sapiens
gctccttcaatcccatttt

SEQ ID NO: 13758 - DNA, 18 bp, Homo sapiens
acagacatacatttctca

SEQ ID NO: 13759 - DNA, 22 bp, Homo sapiens
caaatatggggaaaaaactgtg

SEQ ID NO: 13760 - DNA, 23 bp, Homo sapiens
caagtatggctcctccatatctc

SEQ ID NO: 13761 - DNA, 18 bp, Homo sapiens
cagacaagctgcatttca

SEQ ID NO: 13762 - DNA, 18 bp, Homo sapiens
cagtgccgacagctctcc

SEQ ID NO: 13763 - DNA, 19 bp, Homo sapiens
ccacagtgccgacagctct

SEQ ID NO: 13764 - DNA, 20 bp, Homo sapiens
tcccgccagccagccccgac

SEQ ID NO: 13765 - DNA, 20 bp, Homo sapiens
tgcaggggtagcctgaggtg

SEQ ID NO: 13766 - DNA, 23 bp, Homo sapiens
tttaagggcccaggatcgttttt

SEQ ID NO: 13767 - DNA, 16 bp, Homo sapiens
aaccttgcttcctgct

SEQ ID NO: 13768 - DNA, 22 bp, Homo sapiens
aatattgtataaattgttttca

SEQ ID NO: 13769 - DNA, 21 bp, Homo sapiens
gaatccaccttccactattgt

SEQ ID NO: 13770 - DNA, 21 bp, Homo sapiens
gtataaattgttttcatactt

SEQ ID NO: 13771 - DNA, 20 bp, Homo sapiens
tcccagcttggaaattctgc

SEQ ID NO: 13772 - DNA, 19 bp, Homo sapiens
ttccagaaagtgatcacag

SEQ ID NO: 13773 - DNA, 21 bp, Homo sapiens
gcccagctctctcaggattca

SEQ ID NO: 13774 - DNA, 18 bp, Homo sapiens
ggctggtgtttgtagttg

SEQ ID NO: 13775 - DNA, 19 bp, Homo sapiens
tccaatctggtaatggtgt

SEQ ID NO: 13776 - DNA, 20 bp, Homo sapiens
agaagaaatatttttcacct

SEQ ID NO: 13777 - DNA, 19 bp, Homo sapiens
agggggtcccccaccctct

SEQ ID NO: 13778 - DNA, 20 bp, Homo sapiens
caagacatcaccctctcctc

SEQ ID NO: 13779 - DNA, 18 bp, Homo sapiens
cctgtcctcttcccagtt

SEQ ID NO: 13780 - DNA, 20 bp, Homo sapiens
cggaaggcggctggtgcaca

SEQ ID NO: 13781 - DNA, 21 bp, Homo sapiens
ctcccccgccctgctggcctc

SEQ ID NO: 13782 - DNA, 16 bp, Homo sapiens
ggctaattctaagcac

SEQ ID NO: 13783 - DNA, 21 bp, Homo sapiens
tcctctctcccccttgttatt

SEQ ID NO: 13784 - DNA, 16 bp, Homo sapiens
gaaccaatatgaactg

SEQ ID NO: 13785 - DNA, 19 bp, Homo sapiens
accaccaactcctcctcct

SEQ ID NO: 13786 - DNA, 17 bp, Homo sapiens
ccgctacagtttgaaga

SEQ ID NO: 13787 - DNA, 22 bp, Homo sapiens
tccttttttcccccttgttcct

SEQ ID NO: 13788 - DNA, 20 bp, Homo sapiens
tgtaaacattttctctctca

SEQ ID NO: 13789 - DNA, 18 bp, Homo sapiens
acaacatccgcctcctgg

SEQ ID NO: 13790 - DNA, 18 bp, Homo sapiens
atatagaatttgataata

SEQ ID NO: 13791 - DNA, 20 bp, Homo sapiens
attagtaatattgagcgctc

SEQ ID NO: 13792 - DNA, 19 bp, Homo sapiens
gaatctgccatccacatca

SEQ ID NO: 13793 - DNA, 22 bp, Homo sapiens
gacggcattagtttttccctta

SEQ ID NO: 13794 - DNA, 19 bp, Homo sapiens
gggggtgctgggcctggcg

SEQ ID NO: 13795 - DNA, 22 bp, Homo sapiens
aaactgaagccaagccacatca

SEQ ID NO: 13796 - DNA, 19 bp, Homo sapiens
agctattacaaatataaca

SEQ ID NO: 13797 - DNA, 20 bp, Homo sapiens
atagatgtttttttttattc

SEQ ID NO: 13798 - DNA, 20 bp, Homo sapiens
atatattttctaccattcca

SEQ ID NO: 13799 - DNA, 21 bp, Homo sapiens
tttctagatggctttaatttt

SEQ ID NO: 13800 - DNA, 19 bp, Homo sapiens
atctgttaaactgatgaca

SEQ ID NO: 13801 - DNA, 21 bp, Homo sapiens
gacttaggtgggtagcaatgc

SEQ ID NO: 13802 - DNA, 18 bp, Homo sapiens
tctgccctggtttgtgtg

SEQ ID NO: 13803 - DNA, 19 bp, Homo sapiens
tgatgacagacataactca

SEQ ID NO: 13804 - DNA, 19 bp, Homo sapiens
tgtaatacgctgtacagta

SEQ ID NO: 13805 - DNA, 18 bp, Homo sapiens
ggaggtcgacgactccgt

SEQ ID NO: 13806 - DNA, 28 bp, Homo sapiens
tgggagcaactgtaaataacttgccctg

SEQ ID NO: 13807 - DNA, 26 bp, Homo sapiens
aaagactggatccaaacccatcttcc

SEQ ID NO: 13808 - DNA, 20 bp, Homo sapiens
tcacaccaccccccatgcca

SEQ ID NO: 13809 - DNA, 22 bp, Homo sapiens
tccccttgcaaaccatcccagc

SEQ ID NO: 13810 - DNA, 26 bp, Homo sapiens
tgaggtctctgtggcaggcctggtca

SEQ ID NO: 13811 - DNA, 18 bp, Homo sapiens
tggcctttggcatgagat

SEQ ID NO: 13812 - DNA, 17 bp, Homo sapiens
attatttcaagccgcca

SEQ ID NO: 13813 - DNA, 17 bp, Homo sapiens
ctggcagccaggcaatc

SEQ ID NO: 13814 - DNA, 18 bp, Homo sapiens
aagagaggttatagagta

SEQ ID NO: 13815 - DNA, 22 bp, Homo sapiens
acataggtatatatatgccatg

SEQ ID NO: 13816 - DNA, 18 bp, Homo sapiens
actgttccctctgctcct

SEQ ID NO: 13817 - DNA, 20 bp, Homo sapiens
ggcacatgacaactttgcca

SEQ ID NO: 13818 - DNA, 17 bp, Homo sapiens
aaacactgaaccattct

SEQ ID NO: 13819 - DNA, 18 bp, Homo sapiens
agggcaatctgtctttaa

SEQ ID NO: 13820 - DNA, 23 bp, Homo sapiens
tccaaaagtttctctaggtccca

SEQ ID NO: 13821 - DNA, 22 bp, Homo sapiens
ggctgaaacttagtgattgcca

SEQ ID NO: 13822 - DNA, 19 bp, Homo sapiens
gttgaagatttatggacag

SEQ ID NO: 13823 - DNA, 22 bp, Homo sapiens
gccctaacccttggctccagga

SEQ ID NO: 13824 - DNA, 20 bp, Homo sapiens
gggccccccgcccctccctc

SEQ ID NO: 13825 - DNA, 16 bp, Homo sapiens
tcattactgtctcctg

SEQ ID NO: 13826 - DNA, 19 bp, Homo sapiens
tgtagctatatctgcccct

SEQ ID NO: 13827 - DNA, 20 bp, Homo sapiens
ggtctggcccgcctgccaca

SEQ ID NO: 13828 - DNA, 16 bp, Homo sapiens
aatgtgtgttgtgagc

SEQ ID NO: 13829 - DNA, 18 bp, Homo sapiens
cacactctcattcacaca

SEQ ID NO: 13830 - DNA, 17 bp, Homo sapiens
ctcctttgtccctctga

SEQ ID NO: 13831 - DNA, 22 bp, Homo sapiens
tcctggtgaagcatggcttcgg

SEQ ID NO: 13832 - DNA, 16 bp, Homo sapiens
tggtcatttcaatcca

SEQ ID NO: 13833 - DNA, 15 bp, Homo sapiens
caaattcagtatcct

SEQ ID NO: 13834 - DNA, 20 bp, Homo sapiens
gtaactgccatattatataa

SEQ ID NO: 13835 - DNA, 18 bp, Homo sapiens
gtcctgtacatcattctc

SEQ ID NO: 13836 - DNA, 19 bp, Homo sapiens
tgaactatacttgaaggac

SEQ ID NO: 13837 - DNA, 22 bp, Homo sapiens
ttccatgttctacttcagctaa

SEQ ID NO: 13838 - DNA, 17 bp, Homo sapiens
taggtactgtaatctac

SEQ ID NO: 13839 - DNA, 22 bp, Homo sapiens
tttgcgccggagtgcctgtgaa

SEQ ID NO: 13840 - DNA, 19 bp, Homo sapiens
gcctctgtccctctggtca

SEQ ID NO: 13841 - DNA, 19 bp, Homo sapiens
ggagtcggggataaacatc

SEQ ID NO: 13842 - DNA, 15 bp, Homo sapiens
tttcttccttttata

SEQ ID NO: 13843 - DNA, 17 bp, Homo sapiens
accgccacagcactcaa

SEQ ID NO: 13844 - DNA, 23 bp, Homo sapiens
ccgctccctcactcgaacacaca

SEQ ID NO: 13845 - DNA, 20 bp, Homo sapiens
gctcctgctcctcctccgct

SEQ ID NO: 13846 - DNA, 19 bp, Homo sapiens
aagcgattctctcacctca

SEQ ID NO: 13847 - DNA, 18 bp, Homo sapiens
aatttttgtatttttaga

SEQ ID NO: 13848 - DNA, 18 bp, Homo sapiens
cctgcaacctccacctcc

SEQ ID NO: 13849 - DNA, 20 bp, Homo sapiens
tggccaggctggtcttgaac

SEQ ID NO: 13850 - DNA, 18 bp, Homo sapiens
aaaacttcagattgttca

SEQ ID NO: 13851 - DNA, 20 bp, Homo sapiens
ggacattgagatcacttgtc

SEQ ID NO: 13852 - DNA, 23 bp, Homo sapiens
gttttactttaccttcactaaca

SEQ ID NO: 13853 - DNA, 21 bp, Homo sapiens
tctgcgcgcccttccaacgaa

SEQ ID NO: 13854 - DNA, 18 bp, Homo sapiens
acctttgattcctggctt

SEQ ID NO: 13855 - DNA, 18 bp, Homo sapiens
actgttggacaaatgata

SEQ ID NO: 13856 - DNA, 22 bp, Homo sapiens
ctaaaagaattacagggatgtt

SEQ ID NO: 13857 - DNA, 19 bp, Homo sapiens
agtcccaccataagagcta

SEQ ID NO: 13858 - DNA, 20 bp, Homo sapiens
ccagtcaaaaagaaagtgag

SEQ ID NO: 13859 - DNA, 18 bp, Homo sapiens
ctttcagacttaaactga

SEQ ID NO: 13860 - DNA, 22 bp, Homo sapiens
tgaggctttcagacttaaactg

SEQ ID NO: 13861 - DNA, 20 bp, Homo sapiens
tgaggtttgaggtcctggtc

SEQ ID NO: 13862 - DNA, 19 bp, Homo sapiens
tgtgagtgtgtttccagaa

SEQ ID NO: 13863 - DNA, 16 bp, Homo sapiens
acaggtaccatgttcc

SEQ ID NO: 13864 - DNA, 17 bp, Homo sapiens
ccgagaccagcaccccg

SEQ ID NO: 13865 - DNA, 21 bp, Homo sapiens
gtcattgttttactgccctca

SEQ ID NO: 13866 - DNA, 20 bp, Homo sapiens
gtggtacccagttttaggaa

SEQ ID NO: 13867 - DNA, 23 bp, Homo sapiens
aacaattagaacacaacaggcca

SEQ ID NO: 13868 - DNA, 18 bp, Homo sapiens
tatgttgctgtgttgtta

SEQ ID NO: 13869 - DNA, 25 bp, Homo sapiens
aggaagaggatcaccttccaagaca

SEQ ID NO: 13870 - DNA, 18 bp, Homo sapiens
tgctatcaaaccacttct

SEQ ID NO: 13871 - DNA, 19 bp, Homo sapiens
caaataccaacatccatcc

SEQ ID NO: 13872 - DNA, 21 bp, Homo sapiens
caccctcagagattctgatta

SEQ ID NO: 13873 - DNA, 18 bp, Homo sapiens
cacagtgaaaattctcgg

SEQ ID NO: 13874 - DNA, 18 bp, Homo sapiens
acttcccttcgtttgcat

SEQ ID NO: 13875 - DNA, 19 bp, Homo sapiens
aggaaagagaggaaacatc

SEQ ID NO: 13876 - DNA, 19 bp, Homo sapiens
aaagcccatgttctgtgag

SEQ ID NO: 13877 - DNA, 19 bp, Homo sapiens
ggccaagatagaatctgta

SEQ ID NO: 13878 - DNA, 18 bp, Homo sapiens
acctcagggctgcattca

SEQ ID NO: 13879 - DNA, 21 bp, Homo sapiens
agcaacagtttgtctccagtc

SEQ ID NO: 13880 - DNA, 19 bp, Homo sapiens
cacttgtgccatcttcttt

SEQ ID NO: 13881 - DNA, 21 bp, Homo sapiens
gcaaaaacacatcctgagaca

SEQ ID NO: 13882 - DNA, 15 bp, Homo sapiens
gcctggggtttcggg

SEQ ID NO: 13883 - DNA, 24 bp, Homo sapiens
caagccccccttgacatcctctca

SEQ ID NO: 13884 - DNA, 24 bp, Homo sapiens
tctactggattagccctactcttt

SEQ ID NO: 13885 - DNA, 19 bp, Homo sapiens
caaaatacaactcctcagc

SEQ ID NO: 13886 - DNA, 18 bp, Homo sapiens
cagaattgttggtcctca

SEQ ID NO: 13887 - DNA, 18 bp, Homo sapiens
cttcagacaattccaaat

SEQ ID NO: 13888 - DNA, 22 bp, Homo sapiens
tgaagaattctgcttcagagta

SEQ ID NO: 13889 - DNA, 18 bp, Homo sapiens
atgactccagaggacctc

SEQ ID NO: 13890 - DNA, 22 bp, Homo sapiens
caactctcccaaaatggctcag

SEQ ID NO: 13891 - DNA, 17 bp, Homo sapiens
cctgatccggtctgtgg

SEQ ID NO: 13892 - DNA, 19 bp, Homo sapiens
gccacagccacacgtgtga

SEQ ID NO: 13893 - DNA, 19 bp, Homo sapiens
gcccaatcacagacaagca

SEQ ID NO: 13894 - DNA, 20 bp, Homo sapiens
ttggcccctggaggtgagct

SEQ ID NO: 13895 - DNA, 18 bp, Homo sapiens
ttttccagagcctgttag

SEQ ID NO: 13896 - DNA, 22 bp, Homo sapiens
cccggctaagccagaagagcca

SEQ ID NO: 13897 - DNA, 19 bp, Homo sapiens
cacttcctgccccatttgg

SEQ ID NO: 13898 - DNA, 23 bp, Homo sapiens
ccctggcccagaggtctggcgga

SEQ ID NO: 13899 - DNA, 23 bp, Homo sapiens
cctgaacctcttaacttaataaa

SEQ ID NO: 13900 - DNA, 18 bp, Homo sapiens
ctggtccccctctgtctc

SEQ ID NO: 13901 - DNA, 17 bp, Homo sapiens
gcgcggcggcgggcggc

SEQ ID NO: 13902 - DNA, 20 bp, Homo sapiens
caagaacagttttgagccat

SEQ ID NO: 13903 - DNA, 19 bp, Homo sapiens
ccgccagccgccttcccca

SEQ ID NO: 13904 - DNA, 22 bp, Homo sapiens
ctggggacgctgttttctttta

SEQ ID NO: 13905 - DNA, 17 bp, Homo sapiens
aaatacttcatcactaa

SEQ ID NO: 13906 - DNA, 20 bp, Homo sapiens
aagaatttcctttgctgggc

SEQ ID NO: 13907 - DNA, 18 bp, Homo sapiens
aatccattaccatgtaca

SEQ ID NO: 13908 - DNA, 23 bp, Homo sapiens
cttccatagcttattaacactaa

SEQ ID NO: 13909 - DNA, 21 bp, Homo sapiens
tactaatgaattgaactgtga

SEQ ID NO: 13910 - DNA, 21 bp, Homo sapiens
tccatagcttattaacactaa

SEQ ID NO: 13911 - DNA, 18 bp, Homo sapiens
aaaagaagaatcaatttt

SEQ ID NO: 13912 - DNA, 17 bp, Homo sapiens
acaatccataacatcca

SEQ ID NO: 13913 - DNA, 23 bp, Homo sapiens
gtgctgtgacttcggtgaatttt

SEQ ID NO: 13914 - DNA, 22 bp, Homo sapiens
tgtagatttgttaaatgtgtgt

SEQ ID NO: 13915 - DNA, 19 bp, Homo sapiens
tgttgggatatggaatgaa

SEQ ID NO: 13916 - DNA, 21 bp, Homo sapiens
ttcaaacatctgaggcatgat

SEQ ID NO: 13917 - DNA, 23 bp, Homo sapiens
aaagtaggtctgcagctatttca

SEQ ID NO: 13918 - DNA, 18 bp, Homo sapiens
ctgtctttcacctttcca

SEQ ID NO: 13919 - DNA, 25 bp, Homo sapiens
tttctatcatgtccaacacattcaa

SEQ ID NO: 13920 - DNA, 24 bp, Homo sapiens
atcatggggaacagatgtgttcca

SEQ ID NO: 13921 - DNA, 18 bp, Homo sapiens
tccacctcctgggttcaa

SEQ ID NO: 13922 - DNA, 18 bp, Homo sapiens
tcttgacctcatgatcca

SEQ ID NO: 13923 - DNA, 19 bp, Homo sapiens
tcagttgtgtatttgttca

SEQ ID NO: 13924 - DNA, 19 bp, Homo sapiens
ccaagcccagcccacctcc

SEQ ID NO: 13925 - DNA, 18 bp, Homo sapiens
gctgagccattctcctca

SEQ ID NO: 13926 - DNA, 20 bp, Homo sapiens
tcactgagcagggactgtca

SEQ ID NO: 13927 - DNA, 22 bp, Homo sapiens
tcctgggcaaggaacttaaact

SEQ ID NO: 13928 - DNA, 24 bp, Homo sapiens
taagttgtaactgagattgcaata

SEQ ID NO: 13929 - DNA, 19 bp, Homo sapiens
tgcattaagagaaagcaat

SEQ ID NO: 13930 - DNA, 26 bp, Homo sapiens
ttaaaggcctggttctaagtcctttt

SEQ ID NO: 13931 - DNA, 19 bp, Homo sapiens
gcaggtctctcagcactga

SEQ ID NO: 13932 - DNA, 18 bp, Homo sapiens
actgacattacatagcta

SEQ ID NO: 13933 - DNA, 22 bp, Homo sapiens
gagccaagatggcaccactgca

SEQ ID NO: 13934 - DNA, 22 bp, Homo sapiens
tttgtgtgtgtgtgtgtttgtg

SEQ ID NO: 13935 - DNA, 20 bp, Homo sapiens
atgagagaagactgtgacaa

SEQ ID NO: 13936 - DNA, 19 bp, Homo sapiens
ccacaattccaggcaatgg

SEQ ID NO: 13937 - DNA, 22 bp, Homo sapiens
gagttgtaaccattttctggta

SEQ ID NO: 13938 - DNA, 21 bp, Homo sapiens
tgatgtggaatatactaaagc

SEQ ID NO: 13939 - DNA, 22 bp, Homo sapiens
ttgtaaccattttctggtatca

SEQ ID NO: 13940 - DNA, 22 bp, Homo sapiens
ttgtaattctccccacccttga

SEQ ID NO: 13941 - DNA, 18 bp, Homo sapiens
atgattgtgctactgcac

SEQ ID NO: 13942 - DNA, 24 bp, Homo sapiens
cagaaaacctccacggccttttca

SEQ ID NO: 13943 - DNA, 22 bp, Homo sapiens
tctactttgtattcttgtgagg

SEQ ID NO: 13944 - DNA, 19 bp, Homo sapiens
acctctgactccctggttc

SEQ ID NO: 13945 - DNA, 27 bp, Homo sapiens
ccatcccctcttctacctcctgcaacc

SEQ ID NO: 13946 - DNA, 19 bp, Homo sapiens
ccttccccaccccctcccc

SEQ ID NO: 13947 - DNA, 16 bp, Homo sapiens
actttcaagatccaaa

SEQ ID NO: 13948 - DNA, 17 bp, Homo sapiens
caaaaacaagatgacca

SEQ ID NO: 13949 - DNA, 22 bp, Homo sapiens
caggattaaactaggtttggtt

SEQ ID NO: 13950 - DNA, 25 bp, Homo sapiens
ccaagagcaaatccacattcctctt

SEQ ID NO: 13951 - DNA, 19 bp, Homo sapiens
ggatggcgacaagggcagc

SEQ ID NO: 13952 - DNA, 18 bp, Homo sapiens
ggcttctatattgcattt

SEQ ID NO: 13953 - DNA, 18 bp, Homo sapiens
ggtgctatttctctgtaa

SEQ ID NO: 13954 - DNA, 18 bp, Homo sapiens
tctgtgtgtgtagttttg

SEQ ID NO: 13955 - DNA, 21 bp, Homo sapiens
gttgaagcaactgtttgtctt

SEQ ID NO: 13956 - DNA, 17 bp, Homo sapiens
tggccctaaacatgtaa

SEQ ID NO: 13957 - DNA, 17 bp, Homo sapiens
aggcagttccccggtga

SEQ ID NO: 13958 - DNA, 16 bp, Homo sapiens
ccccacccccgcagct

SEQ ID NO: 13959 - DNA, 18 bp, Homo sapiens
ccttcctcctccaggtac

SEQ ID NO: 13960 - DNA, 19 bp, Homo sapiens
tcaacatctaagcctgttg

SEQ ID NO: 13961 - DNA, 21 bp, Homo sapiens
caggacccccacaccacccca

SEQ ID NO: 13962 - DNA, 20 bp, Homo sapiens
catgaaacccccacccccac

SEQ ID NO: 13963 - DNA, 18 bp, Homo sapiens
agattatatatttccctc

SEQ ID NO: 13964 - DNA, 18 bp, Homo sapiens
atccagtgtcatgcttac

SEQ ID NO: 13965 - DNA, 20 bp, Homo sapiens
atgtgcctgtttaaagcact

SEQ ID NO: 13966 - DNA, 20 bp, Homo sapiens
gacattacattctgtactta

SEQ ID NO: 13967 - DNA, 25 bp, Homo sapiens
gagctactttcatctaaacctgtaa

SEQ ID NO: 13968 - DNA, 23 bp, Homo sapiens
aaaatgtcttgcaatgtgctgta

SEQ ID NO: 13969 - DNA, 17 bp, Homo sapiens
atacatgttattagttg

SEQ ID NO: 13970 - DNA, 22 bp, Homo sapiens
cccgtctctactaaaaatacca

SEQ ID NO: 13971 - DNA, 18 bp, Homo sapiens
gaacagaagcttaatgtt

SEQ ID NO: 13972 - DNA, 18 bp, Homo sapiens
gtgatagcagttgtcatt

SEQ ID NO: 13973 - DNA, 16 bp, Homo sapiens
taatgtggagtgacta

SEQ ID NO: 13974 - DNA, 20 bp, Homo sapiens
ttctttacttttctttggtg

SEQ ID NO: 13975 - DNA, 24 bp, Homo sapiens
aaaatgaagtgtcaaaaaatctca

SEQ ID NO: 13976 - DNA, 21 bp, Homo sapiens
gcagaattcaactttttaaac

SEQ ID NO: 13977 - DNA, 23 bp, Homo sapiens
tgcccctgaaaagtttttgctga

SEQ ID NO: 13978 - DNA, 22 bp, Homo sapiens
tgcttatggtaaaatttgcctg

SEQ ID NO: 13979 - DNA, 24 bp, Homo sapiens
catgacctctgtattctctagtta

SEQ ID NO: 13980 - DNA, 21 bp, Homo sapiens
gtcccaccgctgcccctactg

SEQ ID NO: 13981 - DNA, 22 bp, Homo sapiens
tcaaaatcattgcagagtatta

SEQ ID NO: 13982 - DNA, 20 bp, Homo sapiens
atattaatcatatgttttgt

SEQ ID NO: 13983 - DNA, 20 bp, Homo sapiens
ttgcctgaaaatatttgtga

SEQ ID NO: 13984 - DNA, 20 bp, Homo sapiens
acgtcagagaacttaaactg

SEQ ID NO: 13985 - DNA, 22 bp, Homo sapiens
actcaccacaagggtccgcggc

SEQ ID NO: 13986 - DNA, 19 bp, Homo sapiens
cagtgagaccaagaaccca

SEQ ID NO: 13987 - DNA, 20 bp, Homo sapiens
gaaactccgaacacatccga

SEQ ID NO: 13988 - DNA, 21 bp, Homo sapiens
tttctcagcttctttggcctt

SEQ ID NO: 13989 - DNA, 17 bp, Homo sapiens
agctctgcaccatcctc

SEQ ID NO: 13990 - DNA, 22 bp, Homo sapiens
caaagctttaggcatgattcca

SEQ ID NO: 13991 - DNA, 24 bp, Homo sapiens
gctgtttttgggggtgcctggaga

SEQ ID NO: 13992 - DNA, 24 bp, Homo sapiens
aaaagacttcaagtaaatataaga

SEQ ID NO: 13993 - DNA, 19 bp, Homo sapiens
catttcctctcaaacctta

SEQ ID NO: 13994 - DNA, 23 bp, Homo sapiens
gatgtggaaatatcttcagccaa

SEQ ID NO: 13995 - DNA, 17 bp, Homo sapiens
gctagatgacaatctca

SEQ ID NO: 13996 - DNA, 20 bp, Homo sapiens
gtgaaggtagcaatacttca

SEQ ID NO: 13997 - DNA, 23 bp, Homo sapiens
gtagttggcaagatgaaatgcca

SEQ ID NO: 13998 - DNA, 16 bp, Homo sapiens
cctgtttattgtggga

SEQ ID NO: 13999 - DNA, 20 bp, Homo sapiens
ttgccccccctttccatctc

SEQ ID NO: 14000 - DNA, 18 bp, Homo sapiens
ggctcatttccccgatga

SEQ ID NO: 14001 - DNA, 23 bp, Homo sapiens
cccacaaaagcaagcattgattt

SEQ ID NO: 14002 - DNA, 23 bp, Homo sapiens
gaattccatcttggcttccctaa

SEQ ID NO: 14003 - DNA, 19 bp, Homo sapiens
gatccaaaacagcctctct

SEQ ID NO: 14004 - DNA, 18 bp, Homo sapiens
tcctctgctcaggttcag

SEQ ID NO: 14005 - DNA, 23 bp, Homo sapiens
gcggttttatcttcccccttgtc

SEQ ID NO: 14006 - DNA, 19 bp, Homo sapiens
aggcctccccagcaatgtg

SEQ ID NO: 14007 - DNA, 21 bp, Homo sapiens
atcttggctcactgcaacctc

SEQ ID NO: 14008 - DNA, 18 bp, Homo sapiens
cctgcaacctccacctcc

SEQ ID NO: 14009 - DNA, 19 bp, Homo sapiens
ctgcaacctccacctccca

SEQ ID NO: 14010 - DNA, 23 bp, Homo sapiens
ctgtaagtttcctgaggcctccc

SEQ ID NO: 14011 - DNA, 24 bp, Homo sapiens
ggcgtgggccgccgcacccggcca

SEQ ID NO: 14012 - DNA, 18 bp, Homo sapiens
tccacctcccaggttcaa

SEQ ID NO: 14013 - DNA, 22 bp, Homo sapiens
atccacaggtaacaccatgatg

SEQ ID NO: 14014 - DNA, 19 bp, Homo sapiens
ctgaccacagagcgctgct

SEQ ID NO: 14015 - DNA, 18 bp, Homo sapiens
agccgagaacccagggcc

SEQ ID NO: 14016 - DNA, 18 bp, Homo sapiens
cacctgaaccacgagcca

SEQ ID NO: 14017 - DNA, 22 bp, Homo sapiens
cgaggttgaagggtcttggtca

SEQ ID NO: 14018 - DNA, 18 bp, Homo sapiens
ggccacctgaaccacgag

SEQ ID NO: 14019 - DNA, 18 bp, Homo sapiens
tcatcgacaacgaaaagc

SEQ ID NO: 14020 - DNA, 19 bp, Homo sapiens
catggtgtcaggcacctgt

SEQ ID NO: 14021 - DNA, 18 bp, Homo sapiens
ccccacccccccccccgc

SEQ ID NO: 14022 - DNA, 20 bp, Homo sapiens
ctgttatgagctgaccccca

SEQ ID NO: 14023 - DNA, 21 bp, Homo sapiens
gtctttctattattgtagaga

SEQ ID NO: 14024 - DNA, 16 bp, Homo sapiens
tgatcaccacaactca

SEQ ID NO: 14025 - DNA, 16 bp, Homo sapiens
tgatcaccacaactca

SEQ ID NO: 14026 - DNA, 21 bp, Homo sapiens
ttttgggagcattgagcctgc

SEQ ID NO: 14027 - DNA, 22 bp, Homo sapiens
acaatccctcactgctgcctca

SEQ ID NO: 14028 - DNA, 19 bp, Homo sapiens
cccagagggcctcccccag

SEQ ID NO: 14029 - DNA, 19 bp, Homo sapiens
gacggggtttcactctgtc

SEQ ID NO: 14030 - DNA, 23 bp, Homo sapiens
tccaagggacaggcagttcttct

SEQ ID NO: 14031 - DNA, 21 bp, Homo sapiens
aactgccacagatagctgcca

SEQ ID NO: 14032 - DNA, 27 bp, Homo sapiens
ccctatcattatttcaccaagccaata

SEQ ID NO: 14033 - DNA, 18 bp, Homo sapiens
gctccaagaggctcctga

SEQ ID NO: 14034 - DNA, 18 bp, Homo sapiens
ggaacccagcaacacgct

SEQ ID NO: 14035 - DNA, 17 bp, Homo sapiens
tcaccaagccaatacca

SEQ ID NO: 14036 - DNA, 19 bp, Homo sapiens
tcgtggaagtggccgtgca

SEQ ID NO: 14037 - DNA, 21 bp, Homo sapiens
tctgggacttcccggtggagt

SEQ ID NO: 14038 - DNA, 19 bp, Homo sapiens
ccctgggccagggtctgtg

SEQ ID NO: 14039 - DNA, 19 bp, Homo sapiens
tcaataaagatttcaagat

SEQ ID NO: 14040 - DNA, 17 bp, Homo sapiens
ccggcccctcccacccc

SEQ ID NO: 14041 - DNA, 23 bp, Homo sapiens
gcccctcccacccccctgcctct

SEQ ID NO: 14042 - DNA, 18 bp, Homo sapiens
acaggtggctgttggtct

SEQ ID NO: 14043 - DNA, 24 bp, Homo sapiens
ctctggctacctagggacctgtgg

SEQ ID NO: 14044 - DNA, 20 bp, Homo sapiens
ctgctgggcgtgaacaccct

SEQ ID NO: 14045 - DNA, 18 bp, Homo sapiens
aaggggggaggggtcccg

SEQ ID NO: 14046 - DNA, 15 bp, Homo sapiens
acagtttctgttgaa

SEQ ID NO: 14047 - DNA, 17 bp, Homo sapiens
tcttcttttttttctca

SEQ ID NO: 14048 - DNA, 17 bp, Homo sapiens
aaacagatcaggaagca

SEQ ID NO: 14049 - DNA, 18 bp, Homo sapiens
aaacctcacatttgtgaa

SEQ ID NO: 14050 - DNA, 18 bp, Homo sapiens
ataaaatatgttctttag

SEQ ID NO: 14051 - DNA, 22 bp, Homo sapiens
cagaaacctccatcaaacctca

SEQ ID NO: 14052 - DNA, 22 bp, Homo sapiens
catttgtgaactcaaacgatgt

SEQ ID NO: 14053 - DNA, 18 bp, Homo sapiens
tgatatttttcatgctcc

SEQ ID NO: 14054 - DNA, 18 bp, Homo sapiens
aaggcttgatgtgtataa

SEQ ID NO: 14055 - DNA, 21 bp, Homo sapiens
accagaagggaggccctggaa

SEQ ID NO: 14056 - DNA, 25 bp, Homo sapiens
taaagatacaaaatggtattgttta

SEQ ID NO: 14057 - DNA, 18 bp, Homo sapiens
acatatatatacacacac

SEQ ID NO: 14058 - DNA, 19 bp, Homo sapiens
atcgtgtctgcttataata

SEQ ID NO: 14059 - DNA, 17 bp, Homo sapiens
caagaaaccttgggcca

SEQ ID NO: 14060 - DNA, 19 bp, Homo sapiens
ctgactcatggatctggta

SEQ ID NO: 14061 - DNA, 16 bp, Homo sapiens
ggatcgtgtctgctta

SEQ ID NO: 14062 - DNA, 18 bp, Homo sapiens
ggtgcagcctacatggca

SEQ ID NO: 14063 - DNA, 19 bp, Homo sapiens
gtatacagttattttctca

SEQ ID NO: 14064 - DNA, 18 bp, Homo sapiens
ttcaagaaaccttgggcc

SEQ ID NO: 14065 - DNA, 19 bp, Homo sapiens
tttaggatcgtgtctgctt

SEQ ID NO: 14066 - DNA, 19 bp, Homo sapiens
aacatttaaaaagatgaca

SEQ ID NO: 14067 - DNA, 21 bp, Homo sapiens
cggggcggtgcccccaccgca

SEQ ID NO: 14068 - DNA, 21 bp, Homo sapiens
tttttcagattgttttgattt

SEQ ID NO: 14069 - DNA, 23 bp, Homo sapiens
gcgcgaaacatggcggggcagga

SEQ ID NO: 14070 - DNA, 21 bp, Homo sapiens
aaaacaaaaacccaaccaaac

SEQ ID NO: 14071 - DNA, 22 bp, Homo sapiens
aactgacaaattaaggaggtta

SEQ ID NO: 14072 - DNA, 21 bp, Homo sapiens
gcctgggcaacaggtaagact

SEQ ID NO: 14073 - DNA, 19 bp, Homo sapiens
gttcaagaaaagtacttca

SEQ ID NO: 14074 - DNA, 16 bp, Homo sapiens
actgcaattattcagt

SEQ ID NO: 14075 - DNA, 25 bp, Homo sapiens
cttttttatagcctatttctttaat

SEQ ID NO: 14076 - DNA, 25 bp, Homo sapiens
gaacccaaggctcaaatttactgtc

SEQ ID NO: 14077 - DNA, 19 bp, Homo sapiens
tagggtgtagacctccagt

SEQ ID NO: 14078 - DNA, 22 bp, Homo sapiens
catccacccttctccatgctca

SEQ ID NO: 14079 - DNA, 21 bp, Homo sapiens
ctggagcaaggcactctcaaa

SEQ ID NO: 14080 - DNA, 23 bp, Homo sapiens
tttctttgttcagctttagtttt

SEQ ID NO: 14081 - DNA, 23 bp, Homo sapiens
gtgtctcggaaatggttggcttt

SEQ ID NO: 14082 - DNA, 20 bp, Homo sapiens
tgaggcacttgggcttggtt

SEQ ID NO: 14083 - DNA, 21 bp, Homo sapiens
acacgacgtctgtgtggagcc

SEQ ID NO: 14084 - DNA, 22 bp, Homo sapiens
agcaaaccttcccagcagccct

SEQ ID NO: 14085 - DNA, 22 bp, Homo sapiens
agctgccacttcttttgcctca

SEQ ID NO: 14086 - DNA, 21 bp, Homo sapiens
gactggagggtgagtccctca

SEQ ID NO: 14087 - DNA, 17 bp, Homo sapiens
gcaggggtgaggcggtg

SEQ ID NO: 14088 - DNA, 21 bp, Homo sapiens
gtccagagccccagcagggag

SEQ ID NO: 14089 - DNA, 21 bp, Homo sapiens
tacctaggacaccagctgcca

SEQ ID NO: 14090 - DNA, 21 bp, Homo sapiens
aagactggtgctgttcattca

SEQ ID NO: 14091 - DNA, 18 bp, Homo sapiens
aggagaatcaattcttca

SEQ ID NO: 14092 - DNA, 18 bp, Homo sapiens
tgatggagacattctgaa

SEQ ID NO: 14093 - DNA, 24 bp, Homo sapiens
ttttttcatactactgttaacttt

SEQ ID NO: 14094 - DNA, 21 bp, Homo sapiens
ccttcccggccatttctgtcc

SEQ ID NO: 14095 - DNA, 18 bp, Homo sapiens
agcctcaggtggcagatg

SEQ ID NO: 14096 - DNA, 19 bp, Homo sapiens
cctggaaggcagatgagct

SEQ ID NO: 14097 - DNA, 17 bp, Homo sapiens
gcttacatcccattttg

SEQ ID NO: 14098 - DNA, 19 bp, Homo sapiens
gtctactgttttaatgaga

SEQ ID NO: 14099 - DNA, 21 bp, Homo sapiens
tagaaccttaggtagaactcc

SEQ ID NO: 14100 - DNA, 20 bp, Homo sapiens
aggtgcccgccaccacacca

SEQ ID NO: 14101 - DNA, 25 bp, Homo sapiens
gattgtataatgtgattttttttag

SEQ ID NO: 14102 - DNA, 22 bp, Homo sapiens
ggtgctatttaaggtgtgcaat

SEQ ID NO: 14103 - DNA, 19 bp, Homo sapiens
tagttaaaagtttttgtca

SEQ ID NO: 14104 - DNA, 17 bp, Homo sapiens
tcaagtgattctcctgc

SEQ ID NO: 14105 - DNA, 20 bp, Homo sapiens
tggccaggctggtcttgaac

SEQ ID NO: 14106 - DNA, 21 bp, Homo sapiens
acccgtgccacgcgctctgca

SEQ ID NO: 14107 - DNA, 20 bp, Homo sapiens
cacctgcacaccgtccctct

SEQ ID NO: 14108 - DNA, 19 bp, Homo sapiens
cgccctcctccctccgcta

SEQ ID NO: 14109 - DNA, 17 bp, Homo sapiens
ctgcacacccctgcaca

SEQ ID NO: 14110 - DNA, 19 bp, Homo sapiens
aaacactgattttaaaatc

SEQ ID NO: 14111 - DNA, 20 bp, Homo sapiens
aagtgactgagaatctagca

SEQ ID NO: 14112 - DNA, 18 bp, Homo sapiens
ccatgtgtgttgatcaga

SEQ ID NO: 14113 - DNA, 21 bp, Homo sapiens
ttaaaaatgaccaaaacatgt

SEQ ID NO: 14114 - DNA, 26 bp, Homo sapiens
aaagacacgattcctcagaccagtga

SEQ ID NO: 14115 - DNA, 20 bp, Homo sapiens
cagagactataaagatttca

SEQ ID NO: 14116 - DNA, 18 bp, Homo sapiens
ccttagatctcccttcca

SEQ ID NO: 14117 - DNA, 21 bp, Homo sapiens
ccttcccttcacttctgtcca

SEQ ID NO: 14118 - DNA, 16 bp, Homo sapiens
ttcagagaccgttcca

SEQ ID NO: 14119 - DNA, 21 bp, Homo sapiens
ttccagagaccaccttcccag

SEQ ID NO: 14120 - DNA, 19 bp, Homo sapiens
ttctcctgctctgcagctt

SEQ ID NO: 14121 - DNA, 21 bp, Homo sapiens
caaggctgtgaacaaacatac

SEQ ID NO: 14122 - DNA, 23 bp, Homo sapiens
catgggccatttaaagtgtttca

SEQ ID NO: 14123 - DNA, 16 bp, Homo sapiens
ccagcgaacccacttt

SEQ ID NO: 14124 - DNA, 24 bp, Homo sapiens
gagaaataggggagtgggggccca

SEQ ID NO: 14125 - DNA, 21 bp, Homo sapiens
gaccctgggtagactcccaca

SEQ ID NO: 14126 - DNA, 21 bp, Homo sapiens
gcctgggctggtgtcaggccc

SEQ ID NO: 14127 - DNA, 19 bp, Homo sapiens
tgtgttggccatttctgga

SEQ ID NO: 14128 - DNA, 17 bp, Homo sapiens
ttctttgagccttagcc

SEQ ID NO: 14129 - DNA, 20 bp, Homo sapiens
ttgagactttcccacatgat

SEQ ID NO: 14130 - DNA, 16 bp, Homo sapiens
gagcccctgtccccac

SEQ ID NO: 14131 - DNA, 17 bp, Homo sapiens
agccccctggatggcag

SEQ ID NO: 14132 - DNA, 18 bp, Homo sapiens
gccacgctgaaccagccg

SEQ ID NO: 14133 - DNA, 20 bp, Homo sapiens
aaaagatatatatgtgtgac

SEQ ID NO: 14134 - DNA, 18 bp, Homo sapiens
ttatgtggaaaaccctca

SEQ ID NO: 14135 - DNA, 21 bp, Homo sapiens
aagaaaggagggaaaaaccat

SEQ ID NO: 14136 - DNA, 20 bp, Homo sapiens
aaggctggtgccagtagtta

SEQ ID NO: 14137 - DNA, 23 bp, Homo sapiens
cttccattgaggagcccaggctg

SEQ ID NO: 14138 - DNA, 21 bp, Homo sapiens
tggctttgcaccaaatcctcc

SEQ ID NO: 14139 - DNA, 17 bp, Homo sapiens
agtgtgttttaactagc

SEQ ID NO: 14140 - DNA, 20 bp, Homo sapiens
ctgtatattgtttactttat

SEQ ID NO: 14141 - DNA, 23 bp, Homo sapiens
gcagtttaggacctgctgtcata

SEQ ID NO: 14142 - DNA, 26 bp, Homo sapiens
gcgttggaagagttgttgggggtttt

SEQ ID NO: 14143 - DNA, 18 bp, Homo sapiens
ccagctgaccacccctcc

SEQ ID NO: 14144 - DNA, 16 bp, Homo sapiens
ctctctctctctctca

SEQ ID NO: 14145 - DNA, 21 bp, Homo sapiens
ctctttctctctctctctctc

SEQ ID NO: 14146 - DNA, 19 bp, Homo sapiens
tgaccacccctcccagctc

SEQ ID NO: 14147 - DNA, 21 bp, Homo sapiens
tggaacccccaagtgaggctg

SEQ ID NO: 14148 - DNA, 20 bp, Homo sapiens
aaaaagttacagaaatacta

SEQ ID NO: 14149 - DNA, 22 bp, Homo sapiens
aaacagttgtgaaccaagatct

SEQ ID NO: 14150 - DNA, 18 bp, Homo sapiens
taatatcattcactagct

SEQ ID NO: 14151 - DNA, 18 bp, Homo sapiens
tcttgctctatctctcaa

SEQ ID NO: 14152 - DNA, 20 bp, Homo sapiens
aaaaagttacagaaatacta

SEQ ID NO: 14153 - DNA, 22 bp, Homo sapiens
aaacagttgtgaaccaagatct

SEQ ID NO: 14154 - DNA, 18 bp, Homo sapiens
taatatcattcactagct

SEQ ID NO: 14155 - DNA, 18 bp, Homo sapiens
tcttgctctatctctcaa

SEQ ID NO: 14156 - DNA, 20 bp, Homo sapiens
aaaaagttacagaaatacta

SEQ ID NO: 14157 - DNA, 22 bp, Homo sapiens
aaacagttgtgaaccaagatct

SEQ ID NO: 14158 - DNA, 20 bp, Homo sapiens
gcctctgccttggggagtta

SEQ ID NO: 14159 - DNA, 18 bp, Homo sapiens
taatatcattcactagct

SEQ ID NO: 14160 - DNA, 18 bp, Homo sapiens
tcttgctctatctctcaa

SEQ ID NO: 14161 - DNA, 17 bp, Homo sapiens
atgaatatttcatatct

SEQ ID NO: 14162 - DNA, 21 bp, Homo sapiens
ccctagcccccccagtgtgca

SEQ ID NO: 14163 - DNA, 20 bp, Homo sapiens
cctgttgctgaaaccataca

SEQ ID NO: 14164 - DNA, 22 bp, Homo sapiens
cggcactccagcctgggtgaca

SEQ ID NO: 14165 - DNA, 16 bp, Homo sapiens
tcaagaaccggtttcc

SEQ ID NO: 14166 - DNA, 22 bp, Homo sapiens
ttgtacaaaatacgttttgtaa

SEQ ID NO: 14167 - DNA, 17 bp, Homo sapiens
atgaatatttcatatct

SEQ ID NO: 14168 - DNA, 21 bp, Homo sapiens
ccctagcccccccagtgtgca

SEQ ID NO: 14169 - DNA, 20 bp, Homo sapiens
cctgttgctgaaaccataca

SEQ ID NO: 14170 - DNA, 22 bp, Homo sapiens
cggcactccagcctgggtgaca

SEQ ID NO: 14171 - DNA, 16 bp, Homo sapiens
tcaagaaccggtttcc

SEQ ID NO: 14172 - DNA, 22 bp, Homo sapiens
ttgtacaaaatacgttttgtaa

SEQ ID NO: 14173 - DNA, 17 bp, Homo sapiens
atgaatatttcatatct

SEQ ID NO: 14174 - DNA, 21 bp, Homo sapiens
ccctagcccccccagtgtgca

SEQ ID NO: 14175 - DNA, 20 bp, Homo sapiens
cctgttgctgaaaccataca

SEQ ID NO: 14176 - DNA, 22 bp, Homo sapiens
cggcactccagcctgggtgaca

SEQ ID NO: 14177 - DNA, 16 bp, Homo sapiens
tcaagaaccggtttcc

SEQ ID NO: 14178 - DNA, 22 bp, Homo sapiens
ttgtacaaaatacgttttgtaa

SEQ ID NO: 14179 - DNA, 17 bp, Homo sapiens
atgaatatttcatatct

SEQ ID NO: 14180 - DNA, 21 bp, Homo sapiens
ccctagcccccccagtgtgca

SEQ ID NO: 14181 - DNA, 20 bp, Homo sapiens
cctgttgctgaaaccataca

SEQ ID NO: 14182 - DNA, 22 bp, Homo sapiens
cggcactccagcctgggtgaca

SEQ ID NO: 14183 - DNA, 21 bp, Homo sapiens
gtaaagctgcttgtgaatttt

SEQ ID NO: 14184 - DNA, 16 bp, Homo sapiens
tcaagaaccggtttcc

SEQ ID NO: 14185 - DNA, 22 bp, Homo sapiens
ttgtacaaaatacgttttgtaa

SEQ ID NO: 14186 - DNA, 17 bp, Homo sapiens
atgaatatttcatatct

SEQ ID NO: 14187 - DNA, 21 bp, Homo sapiens
ccctagcccccccagtgtgca

SEQ ID NO: 14188 - DNA, 20 bp, Homo sapiens
cctgttgctgaaaccataca

SEQ ID NO: 14189 - DNA, 22 bp, Homo sapiens
cggcactccagcctgggtgaca

SEQ ID NO: 14190 - DNA, 16 bp, Homo sapiens
tcaagaaccggtttcc

SEQ ID NO: 14191 - DNA, 22 bp, Homo sapiens
ttgtacaaaatacgttttgtaa

SEQ ID NO: 14192 - DNA, 17 bp, Homo sapiens
atgaatatttcatatct

SEQ ID NO: 14193 - DNA, 21 bp, Homo sapiens
ccctagcccccccagtgtgca

SEQ ID NO: 14194 - DNA, 20 bp, Homo sapiens
cctgttgctgaaaccataca

SEQ ID NO: 14195 - DNA, 22 bp, Homo sapiens
cggcactccagcctgggtgaca

SEQ ID NO: 14196 - DNA, 16 bp, Homo sapiens
tcaagaaccggtttcc

SEQ ID NO: 14197 - DNA, 22 bp, Homo sapiens
ttgtacaaaatacgttttgtaa

SEQ ID NO: 14198 - DNA, 17 bp, Homo sapiens
atgaatatttcatatct

SEQ ID NO: 14199 - DNA, 21 bp, Homo sapiens
ccctagcccccccagtgtgca

SEQ ID NO: 14200 - DNA, 20 bp, Homo sapiens
cctgttgctgaaaccataca

SEQ ID NO: 14201 - DNA, 22 bp, Homo sapiens
cggcactccagcctgggtgaca

SEQ ID NO: 14202 - DNA, 21 bp, Homo sapiens
gatcccccacagccactactg

SEQ ID NO: 14203 - DNA, 20 bp, Homo sapiens
gggtgaaggagctttcatca

SEQ ID NO: 14204 - DNA, 16 bp, Homo sapiens
tcaagaaccggtttcc

SEQ ID NO: 14205 - DNA, 22 bp, Homo sapiens
ttgtacaaaatacgttttgtaa

SEQ ID NO: 14206 - DNA, 17 bp, Homo sapiens
atgaatatttcatatct

SEQ ID NO: 14207 - DNA, 21 bp, Homo sapiens
ccctagcccccccagtgtgca

SEQ ID NO: 14208 - DNA, 20 bp, Homo sapiens
cctgttgctgaaaccataca

SEQ ID NO: 14209 - DNA, 22 bp, Homo sapiens
cggcactccagcctgggtgaca

SEQ ID NO: 14210 - DNA, 16 bp, Homo sapiens
tcaagaaccggtttcc

SEQ ID NO: 14211 - DNA, 22 bp, Homo sapiens
ttgtacaaaatacgttttgtaa

SEQ ID NO: 14212 - DNA, 17 bp, Homo sapiens
atgaatatttcatatct

SEQ ID NO: 14213 - DNA, 21 bp, Homo sapiens
ccctagcccccccagtgtgca

SEQ ID NO: 14214 - DNA, 20 bp, Homo sapiens
cctgttgctgaaaccataca

SEQ ID NO: 14215 - DNA, 22 bp, Homo sapiens
cggcactccagcctgggtgaca

SEQ ID NO: 14216 - DNA, 16 bp, Homo sapiens
tcaagaaccggtttcc

SEQ ID NO: 14217 - DNA, 22 bp, Homo sapiens
ttgtacaaaatacgttttgtaa

SEQ ID NO: 14218 - DNA, 17 bp, Homo sapiens
atgaatatttcatatct

SEQ ID NO: 14219 - DNA, 21 bp, Homo sapiens
ccctagcccccccagtgtgca

SEQ ID NO: 14220 - DNA, 20 bp, Homo sapiens
cctgttgctgaaaccataca

SEQ ID NO: 14221 - DNA, 22 bp, Homo sapiens
cggcactccagcctgggtgaca

SEQ ID NO: 14222 - DNA, 16 bp, Homo sapiens
tcaagaaccggtttcc

SEQ ID NO: 14223 - DNA, 22 bp, Homo sapiens
ttgtacaaaatacgttttgtaa

SEQ ID NO: 14224 - DNA, 19 bp, Homo sapiens
acagctggtgccaaatagc

SEQ ID NO: 14225 - DNA, 17 bp, Homo sapiens
atgcacacggctggtca

SEQ ID NO: 14226 - DNA, 18 bp, Homo sapiens
ccacaaacggagcccctg

SEQ ID NO: 14227 - DNA, 19 bp, Homo sapiens
ccccactcctctaagacaa

SEQ ID NO: 14228 - DNA, 21 bp, Homo sapiens
tgtccacatccccagagccca

SEQ ID NO: 14229 - DNA, 21 bp, Homo sapiens
cgggtgcggagccgccggtgg

SEQ ID NO: 14230 - DNA, 18 bp, Homo sapiens
agaaacatcagttactct

SEQ ID NO: 14231 - DNA, 22 bp, Homo sapiens
gaatttttttcatcttctctgg

SEQ ID NO: 14232 - DNA, 23 bp, Homo sapiens
actcattaccgtctgtgattgcc

SEQ ID NO: 14233 - DNA, 19 bp, Homo sapiens
atttctcatcaattctcta

SEQ ID NO: 14234 - DNA, 19 bp, Homo sapiens
ccacagcaaatgagatgta

SEQ ID NO: 14235 - DNA, 18 bp, Homo sapiens
tggatgtttcttctttga

SEQ ID NO: 14236 - DNA, 17 bp, Homo sapiens
ttgggctgggtctgctt

SEQ ID NO: 14237 - DNA, 22 bp, Homo sapiens
ctctgaagaggaagcctgtgag

SEQ ID NO: 14238 - DNA, 22 bp, Homo sapiens
tccagcggcgcgctgctagtga

SEQ ID NO: 14239 - DNA, 19 bp, Homo sapiens
accacacaccccactgggc

SEQ ID NO: 14240 - DNA, 17 bp, Homo sapiens
ccgcccacccgccccca

SEQ ID NO: 14241 - DNA, 20 bp, Homo sapiens
ctggtggtgcagcagacatc

SEQ ID NO: 14242 - DNA, 19 bp, Homo sapiens
actcatcttttatattctg

SEQ ID NO: 14243 - DNA, 20 bp, Homo sapiens
ctggtggtgcagcagacatc

SEQ ID NO: 14244 - DNA, 24 bp, Homo sapiens
tagatgggaagtccatggagacta

SEQ ID NO: 14245 - DNA, 20 bp, Homo sapiens
cagttgggccatatggtgct

SEQ ID NO: 14246 - DNA, 19 bp, Homo sapiens
catccctgtcctcatgacc

SEQ ID NO: 14247 - DNA, 23 bp, Homo sapiens
ctggcacttactggtccttacca

SEQ ID NO: 14248 - DNA, 22 bp, Homo sapiens
atttgagcactttttatacaca

SEQ ID NO: 14249 - DNA, 19 bp, Homo sapiens
cctgttgactgctgggccc

SEQ ID NO: 14250 - DNA, 20 bp, Homo sapiens
gaaggctttgatttagagta

SEQ ID NO: 14251 - DNA, 21 bp, Homo sapiens
ggcctgcccatgagtcagggg

SEQ ID NO: 14252 - DNA, 26 bp, Homo sapiens
tgcacttagaatgatgtaatattcca

SEQ ID NO: 14253 - DNA, 21 bp, Homo sapiens
tgggcccgattctgatatgag

SEQ ID NO: 14254 - DNA, 18 bp, Homo sapiens
actgtaccatgcctgtca

SEQ ID NO: 14255 - DNA, 23 bp, Homo sapiens
agagtgaggaagaagcagaatga

SEQ ID NO: 14256 - DNA, 22 bp, Homo sapiens
agcttcatgttgaaagaaccta

SEQ ID NO: 14257 - DNA, 18 bp, Homo sapiens
attgcacaatatagatct

SEQ ID NO: 14258 - DNA, 18 bp, Homo sapiens
cctgtgattattgtatga

SEQ ID NO: 14259 - DNA, 16 bp, Homo sapiens
cttgtgtagcattgca

SEQ ID NO: 14260 - DNA, 17 bp, Homo sapiens
ttcctgcactcattctc

SEQ ID NO: 14261 - DNA, 19 bp, Homo sapiens
aaccagaccactcaggtgg

SEQ ID NO: 14262 - DNA, 22 bp, Homo sapiens
acagtgtgctccagatggtgct

SEQ ID NO: 14263 - DNA, 23 bp, Homo sapiens
actaagtaaattcatgcactttt

SEQ ID NO: 14264 - DNA, 19 bp, Homo sapiens
ccctaccagcagctgtgca

SEQ ID NO: 14265 - DNA, 22 bp, Homo sapiens
cgccaatgcacccccaacctcc

SEQ ID NO: 14266 - DNA, 17 bp, Homo sapiens
gagtgagctggtgacca

SEQ ID NO: 14267 - DNA, 19 bp, Homo sapiens
aaccagaccactcaggtgg

SEQ ID NO: 14268 - DNA, 22 bp, Homo sapiens
acagtgtgctccagatggtgct

SEQ ID NO: 14269 - DNA, 23 bp, Homo sapiens
actaagtaaattcatgcactttt

SEQ ID NO: 14270 - DNA, 17 bp, Homo sapiens
cccacctgtgttcctca

SEQ ID NO: 14271 - DNA, 19 bp, Homo sapiens
ccctaccagcagctgtgca

SEQ ID NO: 14272 - DNA, 22 bp, Homo sapiens
cgccaatgcacccccaacctcc

SEQ ID NO: 14273 - DNA, 17 bp, Homo sapiens
gagtgagctggtgacca

SEQ ID NO: 14274 - DNA, 19 bp, Homo sapiens
gggcgcaccagtgcctgga

SEQ ID NO: 14275 - DNA, 18 bp, Homo sapiens
tgtgaccgcgccttctca

SEQ ID NO: 14276 - DNA, 22 bp, Homo sapiens
ttctgcttttaatgcacttttt

SEQ ID NO: 14277 - DNA, 25 bp, Homo sapiens
taaatggaagggagacatgaaattg

SEQ ID NO: 14278 - DNA, 18 bp, Homo sapiens
aactttctaaggcagcta

SEQ ID NO: 14279 - DNA, 19 bp, Homo sapiens
aagcaattctcctgcctca

SEQ ID NO: 14280 - DNA, 24 bp, Homo sapiens
agtgcttcctgtcccggcctgaga

SEQ ID NO: 14281 - DNA, 21 bp, Homo sapiens
cctcaaaacaagcccttccca

SEQ ID NO: 14282 - DNA, 21 bp, Homo sapiens
ccttggcgcgtggctcgtgga

SEQ ID NO: 14283 - DNA, 18 bp, Homo sapiens
ctctactcttagcactga

SEQ ID NO: 14284 - DNA, 15 bp, Homo sapiens
cttctgtcccatttt

SEQ ID NO: 14285 - DNA, 18 bp, Homo sapiens
gccccttgctctcaggag

SEQ ID NO: 14286 - DNA, 27 bp, Homo sapiens
gtctgagggttccggttgtcttggcct

SEQ ID NO: 14287 - DNA, 23 bp, Homo sapiens
cttaacatgtacctgtcaatgtt

SEQ ID NO: 14288 - DNA, 19 bp, Homo sapiens
gtgtaaaaaaatatattga

SEQ ID NO: 14289 - DNA, 20 bp, Homo sapiens
tttcaataccttttagattt

SEQ ID NO: 14290 - DNA, 21 bp, Homo sapiens
aagaatcaagatcttccctct

SEQ ID NO: 14291 - DNA, 19 bp, Homo sapiens
cagtgagagtgcaacccca

SEQ ID NO: 14292 - DNA, 17 bp, Homo sapiens
ctattccaacagttgtt

SEQ ID NO: 14293 - DNA, 20 bp, Homo sapiens
ttttggaagcacataacttg

SEQ ID NO: 14294 - DNA, 18 bp, Homo sapiens
tgagagctctgtcagtga

SEQ ID NO: 14295 - DNA, 20 bp, Homo sapiens
ggagtctcatctgtctttcc

SEQ ID NO: 14296 - DNA, 20 bp, Homo sapiens
agatggatgtcgcacacgcc

SEQ ID NO: 14297 - DNA, 21 bp, Homo sapiens
ctgcaggtttccatacactga

SEQ ID NO: 14298 - DNA, 18 bp, Homo sapiens
tctgtggttcatattact

SEQ ID NO: 14299 - DNA, 18 bp, Homo sapiens
agcaagatggacaaggtg

SEQ ID NO: 14300 - DNA, 18 bp, Homo sapiens
caggaaagaagcttttaa

SEQ ID NO: 14301 - DNA, 18 bp, Homo sapiens
tcctggtaactgttccag

SEQ ID NO: 14302 - DNA, 25 bp, Homo sapiens
tttcttgggaagctgttttggtcct

SEQ ID NO: 14303 - DNA, 21 bp, Homo sapiens
atttggactgttgttctgctt

SEQ ID NO: 14304 - DNA, 20 bp, Homo sapiens
ctaatgaatcattgattgac

SEQ ID NO: 14305 - DNA, 18 bp, Homo sapiens
gcttaaaacatttgccaa

SEQ ID NO: 14306 - DNA, 23 bp, Homo sapiens
tacctgaagtgagtctttgggta

SEQ ID NO: 14307 - DNA, 21 bp, Homo sapiens
tcactggattttaccaagtaa

SEQ ID NO: 14308 - DNA, 19 bp, Homo sapiens
agagaacattcctctgcag

SEQ ID NO: 14309 - DNA, 18 bp, Homo sapiens
gattgttctgtccagttt

SEQ ID NO: 14310 - DNA, 21 bp, Homo sapiens
ttagctacttttcagaattga

SEQ ID NO: 14311 - DNA, 19 bp, Homo sapiens
ctatggtggaaatttgtgg

SEQ ID NO: 14312 - DNA, 20 bp, Homo sapiens
gctgaaaccccatctccact

SEQ ID NO: 14313 - DNA, 20 bp, Homo sapiens
tgggtaacagagtgagactg

SEQ ID NO: 14314 - DNA, 16 bp, Homo sapiens
tgtgctgagaacaccc

SEQ ID NO: 14315 - DNA, 17 bp, Homo sapiens
ccctggcggcggggacc

SEQ ID NO: 14316 - DNA, 20 bp, Homo sapiens
agcctgggcaacatagtgag

SEQ ID NO: 14317 - DNA, 21 bp, Homo sapiens
gcttctgggagacctcgggga

SEQ ID NO: 14318 - DNA, 25 bp, Homo sapiens
ttctgagcttctttgcagcctttga

SEQ ID NO: 14319 - DNA, 21 bp, Homo sapiens
agtctcttctcactacagtgt

SEQ ID NO: 14320 - DNA, 20 bp, Homo sapiens
atgtctatgcccgtcacata

SEQ ID NO: 14321 - DNA, 19 bp, Homo sapiens
ggccgggtgcagtggctta

SEQ ID NO: 14322 - DNA, 20 bp, Homo sapiens
cctagacaaccaagaccgct

SEQ ID NO: 14323 - DNA, 18 bp, Homo sapiens
cctgcaacctccacctcc

SEQ ID NO: 14324 - DNA, 23 bp, Homo sapiens
gagaagcagatttggagagatca

SEQ ID NO: 14325 - DNA, 22 bp, Homo sapiens
gcacctgaattctttttcttca

SEQ ID NO: 14326 - DNA, 23 bp, Homo sapiens
tctggtagcacctgaattctttt

SEQ ID NO: 14327 - DNA, 18 bp, Homo sapiens
tgcctggcaaggtccttc

SEQ ID NO: 14328 - DNA, 18 bp, Homo sapiens
ttccttgctctctggtgt

SEQ ID NO: 14329 - DNA, 22 bp, Homo sapiens
ttctattggtcagacattgatg

SEQ ID NO: 14330 - DNA, 18 bp, Homo sapiens
atcctgaagtgtgggtgg

SEQ ID NO: 14331 - DNA, 23 bp, Homo sapiens
atgttcggactggaaacatttct

SEQ ID NO: 14332 - DNA, 20 bp, Homo sapiens
cctgttctcaacaacaggga

SEQ ID NO: 14333 - DNA, 21 bp, Homo sapiens
ctctttctctctctctctctc

SEQ ID NO: 14334 - DNA, 20 bp, Homo sapiens
gaattctccatatattcact

SEQ ID NO: 14335 - DNA, 19 bp, Homo sapiens
gagccctcctattttcaca

SEQ ID NO: 14336 - DNA, 26 bp, Homo sapiens
gtgtgtatttcaaatttgtttgacta

SEQ ID NO: 14337 - DNA, 16 bp, Homo sapiens
tccatatattcactaa

SEQ ID NO: 14338 - DNA, 21 bp, Homo sapiens
tctggaattacaagatttcta

SEQ ID NO: 14339 - DNA, 20 bp, Homo sapiens
tcttgtttgggggatcttgg

SEQ ID NO: 14340 - DNA, 18 bp, Homo sapiens
tgcccaggtgacctgttc

SEQ ID NO: 14341 - DNA, 19 bp, Homo sapiens
acatggcatttgggaaagc

SEQ ID NO: 14342 - DNA, 20 bp, Homo sapiens
accagagagggaggccactg

SEQ ID NO: 14343 - DNA, 23 bp, Homo sapiens
atcaggcgccttcctggcctgat

SEQ ID NO: 14344 - DNA, 18 bp, Homo sapiens
cacacgtgtcacagccag

SEQ ID NO: 14345 - DNA, 21 bp, Homo sapiens
cctagccttcaagttgctttt

SEQ ID NO: 14346 - DNA, 23 bp, Homo sapiens
cctcagcctagttgctttaatct

SEQ ID NO: 14347 - DNA, 20 bp, Homo sapiens
gctgtggttagtatcttgtt

SEQ ID NO: 14348 - DNA, 20 bp, Homo sapiens
gtgccaggaccaccccacct

SEQ ID NO: 14349 - DNA, 17 bp, Homo sapiens
tccttctgagactctca

SEQ ID NO: 14350 - DNA, 21 bp, Homo sapiens
tctggggatgtgcccttccca

SEQ ID NO: 14351 - DNA, 18 bp, Homo sapiens
tgctggtgtgtgcaggga

SEQ ID NO: 14352 - DNA, 21 bp, Homo sapiens
tgcttttcagccatgaaacta

SEQ ID NO: 14353 - DNA, 23 bp, Homo sapiens
tgggtgggctttggcaggtggct

SEQ ID NO: 14354 - DNA, 18 bp, Homo sapiens
tgtcctctggggatgtgc

SEQ ID NO: 14355 - DNA, 17 bp, Homo sapiens
ccacactgatgattctc

SEQ ID NO: 14356 - DNA, 20 bp, Homo sapiens
ccctggtggttccgctgtgg

SEQ ID NO: 14357 - DNA, 18 bp, Homo sapiens
ctccgtcctcctctggcc

SEQ ID NO: 14358 - DNA, 18 bp, Homo sapiens
ctgcagagccccgctgtc

SEQ ID NO: 14359 - DNA, 22 bp, Homo sapiens
gcacccctggccctcccagcca

SEQ ID NO: 14360 - DNA, 21 bp, Homo sapiens
gcaggtgggcgctcgcgtctc

SEQ ID NO: 14361 - DNA, 18 bp, Homo sapiens
gccacaaacaggctcata

SEQ ID NO: 14362 - DNA, 19 bp, Homo sapiens
gcccccggccccggcccca

SEQ ID NO: 14363 - DNA, 17 bp, Homo sapiens
ggcagcacctgctctga

SEQ ID NO: 14364 - DNA, 18 bp, Homo sapiens
ggccccttggattcctgg

SEQ ID NO: 14365 - DNA, 21 bp, Homo sapiens
ggtggttccgctgtggggctg

SEQ ID NO: 14366 - DNA, 20 bp, Homo sapiens
catatgtatatacaggctga

SEQ ID NO: 14367 - DNA, 21 bp, Homo sapiens
ctggtcctccccaccacccca

SEQ ID NO: 14368 - DNA, 25 bp, Homo sapiens
gtattagtaaacttgagttactttt

SEQ ID NO: 14369 - DNA, 20 bp, Homo sapiens
tcttttccattttactttgc

SEQ ID NO: 14370 - DNA, 21 bp, Homo sapiens
tgttttgaaatgtttgccaaa

SEQ ID NO: 14371 - DNA, 18 bp, Homo sapiens
aagagtagcaatactgca

SEQ ID NO: 14372 - DNA, 21 bp, Homo sapiens
ggaggagcttagtaagtggtg

SEQ ID NO: 14373 - DNA, 17 bp, Homo sapiens
atgagactttaatgcaa

SEQ ID NO: 14374 - DNA, 21 bp, Homo sapiens
atttatagtctcaaaattcct

SEQ ID NO: 14375 - DNA, 16 bp, Homo sapiens
gaagaaaccactattt

SEQ ID NO: 14376 - DNA, 18 bp, Homo sapiens
cccccaagccactatcca

SEQ ID NO: 14377 - DNA, 20 bp, Homo sapiens
cttctttataaacttgactt

SEQ ID NO: 14378 - DNA, 17 bp, Homo sapiens
ctttttccattgtttaa

SEQ ID NO: 14379 - DNA, 21 bp, Homo sapiens
gaacatttggggttttaaact

SEQ ID NO: 14380 - DNA, 22 bp, Homo sapiens
gatttgttttatccactttttt

SEQ ID NO: 14381 - DNA, 20 bp, Homo sapiens
acctagagaaagccagcaaa

SEQ ID NO: 14382 - DNA, 20 bp, Homo sapiens
acccgatatgtcattatgca

SEQ ID NO: 14383 - DNA, 20 bp, Homo sapiens
acgttggccagttttcctca

SEQ ID NO: 14384 - DNA, 17 bp, Homo sapiens
actaggtattcttgctc

SEQ ID NO: 14385 - DNA, 22 bp, Homo sapiens
acttggacaacctgactggctt

SEQ ID NO: 14386 - DNA, 18 bp, Homo sapiens
ccctggcccttcaagata

SEQ ID NO: 14387 - DNA, 24 bp, Homo sapiens
ctatgcatacatatatacacacat

SEQ ID NO: 14388 - DNA, 18 bp, Homo sapiens
ctctccttcaattgctga

SEQ ID NO: 14389 - DNA, 19 bp, Homo sapiens
cttatcaaagagattttaa

SEQ ID NO: 14390 - DNA, 22 bp, Homo sapiens
gaggctgaagtcaccctgggaa

SEQ ID NO: 14391 - DNA, 19 bp, Homo sapiens
gattctcttatttccggga

SEQ ID NO: 14392 - DNA, 20 bp, Homo sapiens
tgagatgttgatgtgaactg

SEQ ID NO: 14393 - DNA, 18 bp, Homo sapiens
ccaccaaccaccacctcc

SEQ ID NO: 14394 - DNA, 19 bp, Homo sapiens
ccttgcattaaaccagtga

SEQ ID NO: 14395 - DNA, 17 bp, Homo sapiens
tccactggtggctcaga

SEQ ID NO: 14396 - DNA, 22 bp, Homo sapiens
agcagttttcttacctttgcct

SEQ ID NO: 14397 - DNA, 19 bp, Homo sapiens
ttcttaaggagctttaagc

SEQ ID NO: 14398 - DNA, 17 bp, Homo sapiens
ttctttcaatcttctca

SEQ ID NO: 14399 - DNA, 22 bp, Homo sapiens
agaaggtaacaactatgttgaa

SEQ ID NO: 14400 - DNA, 19 bp, Homo sapiens
ctgcaaactccgcctccca

SEQ ID NO: 14401 - DNA, 23 bp, Homo sapiens
tgcccggccctaaaatgaaatta

SEQ ID NO: 14402 - DNA, 18 bp, Homo sapiens
tctgtattgtactaacca

SEQ ID NO: 14403 - DNA, 21 bp, Homo sapiens
atcttggctcactgcaacctc

SEQ ID NO: 14404 - DNA, 17 bp, Homo sapiens
caggcccccaccttctc

SEQ ID NO: 14405 - DNA, 19 bp, Homo sapiens
ccttctcggcttctggttt

SEQ ID NO: 14406 - DNA, 17 bp, Homo sapiens
ctcttccattttgcaca

SEQ ID NO: 14407 - DNA, 22 bp, Homo sapiens
gcttgaaaaccgtccgaaggca

SEQ ID NO: 14408 - DNA, 20 bp, Homo sapiens
gcttggaccgaggcctggtc

SEQ ID NO: 14409 - DNA, 19 bp, Homo sapiens
gtgtacacacacttgattg

SEQ ID NO: 14410 - DNA, 17 bp, Homo sapiens
tccagggtttgcaggga

SEQ ID NO: 14411 - DNA, 20 bp, Homo sapiens
tttcacttgtgtctgctcct

SEQ ID NO: 14412 - DNA, 23 bp, Homo sapiens
tttctccccatatcccaaggcga

SEQ ID NO: 14413 - DNA, 21 bp, Homo sapiens
actaacctggagacagtaaca

SEQ ID NO: 14414 - DNA, 17 bp, Homo sapiens
agacatctcctcacccc

SEQ ID NO: 14415 - DNA, 19 bp, Homo sapiens
agacttgggggcaggcgcc

SEQ ID NO: 14416 - DNA, 25 bp, Homo sapiens
agagattcccctggaccacacctcc

SEQ ID NO: 14417 - DNA, 18 bp, Homo sapiens
agtgaatgggaaagggtg

SEQ ID NO: 14418 - DNA, 20 bp, Homo sapiens
cctgaaaaatgactgtccca

SEQ ID NO: 14419 - DNA, 23 bp, Homo sapiens
cggatctcccctgaccgctctcc

SEQ ID NO: 14420 - DNA, 21 bp, Homo sapiens
tcctgaaaaatgactgtccca

SEQ ID NO: 14421 - DNA, 24 bp, Homo sapiens
tgggacctgctaagtgtggaatta

SEQ ID NO: 14422 - DNA, 18 bp, Homo sapiens
ttcctctggagctttgca

SEQ ID NO: 14423 - DNA, 20 bp, Homo sapiens
ccagatgccttctagattca

SEQ ID NO: 14424 - DNA, 21 bp, Homo sapiens
gatgtgatcttggaacttcca

SEQ ID NO: 14425 - DNA, 21 bp, Homo sapiens
taggctcagctcatgatgaca

SEQ ID NO: 14426 - DNA, 22 bp, Homo sapiens
ttgtaccatgagtaaaacttca

SEQ ID NO: 14427 - DNA, 17 bp, Homo sapiens
accctctccccactttt

SEQ ID NO: 14428 - DNA, 22 bp, Homo sapiens
tgggacctgctcttaacctcaa

SEQ ID NO: 14429 - DNA, 20 bp, Homo sapiens
aaatatgtataattatgatg

SEQ ID NO: 14430 - DNA, 19 bp, Homo sapiens
agaagcttcaaattcctca

SEQ ID NO: 14431 - DNA, 20 bp, Homo sapiens
aagtgcaatgacttgattta

SEQ ID NO: 14432 - DNA, 17 bp, Homo sapiens
actaagcttctgtctta

SEQ ID NO: 14433 - DNA, 17 bp, Homo sapiens
cacatataaaatatgta

SEQ ID NO: 14434 - DNA, 21 bp, Homo sapiens
ggccttgttttgctgtagcaa

SEQ ID NO: 14435 - DNA, 24 bp, Homo sapiens
ttttttgtttgtgaccactaagct

SEQ ID NO: 14436 - DNA, 18 bp, Homo sapiens
aagcaagatgaaatgtca

SEQ ID NO: 14437 - DNA, 18 bp, Homo sapiens
ctgtaatcttttgttttg

SEQ ID NO: 14438 - DNA, 19 bp, Homo sapiens
actcttcatggaaagcaac

SEQ ID NO: 14439 - DNA, 25 bp, Homo sapiens
gccccgaactgtggtcgccaggccc

SEQ ID NO: 14440 - DNA, 19 bp, Homo sapiens
ggccgggtgcggtggctca

SEQ ID NO: 14441 - DNA, 18 bp, Homo sapiens
tctctactaaaaatgcaa

SEQ ID NO: 14442 - DNA, 21 bp, Homo sapiens
gttacagcagcagcagctcca

SEQ ID NO: 14443 - DNA, 20 bp, Homo sapiens
acctgagtcaaaattgtcat

SEQ ID NO: 14444 - DNA, 21 bp, Homo sapiens
agcccattttgccaagatgtc

SEQ ID NO: 14445 - DNA, 21 bp, Homo sapiens
cactgtcagccctcactgtca

SEQ ID NO: 14446 - DNA, 21 bp, Homo sapiens
gccaccccttggcactgtgga

SEQ ID NO: 14447 - DNA, 23 bp, Homo sapiens
gctctccaaattttgctttagta

SEQ ID NO: 14448 - DNA, 23 bp, Homo sapiens
gcgcgaagcggagtggaccggga

SEQ ID NO: 14449 - DNA, 25 bp, Homo sapiens
ggaaacgagcccttgacgctgtggc

SEQ ID NO: 14450 - DNA, 21 bp, Homo sapiens
gagttctctgtagttcctcca

SEQ ID NO: 14451 - DNA, 19 bp, Homo sapiens
gaaacaaagaactcctgga

SEQ ID NO: 14452 - DNA, 20 bp, Homo sapiens
gttcttttttgctccaagtg

SEQ ID NO: 14453 - DNA, 17 bp, Homo sapiens
aaagtgactgtactgca

SEQ ID NO: 14454 - DNA, 20 bp, Homo sapiens
tcgatgtgattttttttcaa

SEQ ID NO: 14455 - DNA, 18 bp, Homo sapiens
gaattttttttaatgtgg

SEQ ID NO: 14456 - DNA, 22 bp, Homo sapiens
taagttcataatcatatttttc

SEQ ID NO: 14457 - DNA, 19 bp, Homo sapiens
tgacagtacataatcagtt

SEQ ID NO: 14458 - DNA, 20 bp, Homo sapiens
ttacacatacacctgttata

SEQ ID NO: 14459 - DNA, 22 bp, Homo sapiens
gctcctcgcggcctccgcgtct

SEQ ID NO: 14460 - DNA, 23 bp, Homo sapiens
agaatgttggtaatgccatgtca

SEQ ID NO: 14461 - DNA, 18 bp, Homo sapiens
gatacaggcatatgtcat

SEQ ID NO: 14462 - DNA, 19 bp, Homo sapiens
cacagacgcggacagcgcc

SEQ ID NO: 14463 - DNA, 23 bp, Homo sapiens
cagagttcagcaaggagctgctg

SEQ ID NO: 14464 - DNA, 20 bp, Homo sapiens
taacagatacgggcagctag

SEQ ID NO: 14465 - DNA, 19 bp, Homo sapiens
tgaccattgtgcacatgcg

SEQ ID NO: 14466 - DNA, 21 bp, Homo sapiens
gtcacctttctaaagcttttt

SEQ ID NO: 14467 - DNA, 23 bp, Homo sapiens
tatttgattctgatctgaaacta

SEQ ID NO: 14468 - DNA, 18 bp, Homo sapiens
acctggctgccttcttca

SEQ ID NO: 14469 - DNA, 21 bp, Homo sapiens
cgcgcgggcaggcacctgtgc

SEQ ID NO: 14470 - DNA, 19 bp, Homo sapiens
cttcatcaaccttctctca

SEQ ID NO: 14471 - DNA, 19 bp, Homo sapiens
cttcatcaaccttctctca

SEQ ID NO: 14472 - DNA, 19 bp, Homo sapiens
gccgccctcgagcgcccca

SEQ ID NO: 14473 - DNA, 17 bp, Homo sapiens
gtggcctcctggactca

SEQ ID NO: 14474 - DNA, 19 bp, Homo sapiens
acctgggaagtgttgtttg

SEQ ID NO: 14475 - DNA, 20 bp, Homo sapiens
tcagccctggtggccctgca

SEQ ID NO: 14476 - DNA, 20 bp, Homo sapiens
aaggtcacccatcaccgcca

SEQ ID NO: 14477 - DNA, 19 bp, Homo sapiens
ccctttattgtctaactga

SEQ ID NO: 14478 - DNA, 15 bp, Homo sapiens
gcaacatttcaggga

SEQ ID NO: 14479 - DNA, 20 bp, Homo sapiens
tgcccgggacgcccgcacca

SEQ ID NO: 14480 - DNA, 17 bp, Homo sapiens
tggccttaaccagagct

SEQ ID NO: 14481 - DNA, 20 bp, Homo sapiens
acagctgcagttaggaaggg

SEQ ID NO: 14482 - DNA, 22 bp, Homo sapiens
atcttggctcactgcaacctct

SEQ ID NO: 14483 - DNA, 22 bp, Homo sapiens
cctctcccaggtcactgtctca

SEQ ID NO: 14484 - DNA, 20 bp, Homo sapiens
cctctgcctcctgggttcaa

SEQ ID NO: 14485 - DNA, 22 bp, Homo sapiens
gaagaaccattttaactccatc

SEQ ID NO: 14486 - DNA, 20 bp, Homo sapiens
gcaactgctttgcaatgaca

SEQ ID NO: 14487 - DNA, 19 bp, Homo sapiens
tctccagaatgccagccag

SEQ ID NO: 14488 - DNA, 19 bp, Homo sapiens
tctgctttggctttgccgg

SEQ ID NO: 14489 - DNA, 17 bp, Homo sapiens
tgaggacagctaatcca

SEQ ID NO: 14490 - DNA, 21 bp, Homo sapiens
tggtgaggtgaccacagctgc

SEQ ID NO: 14491 - DNA, 21 bp, Homo sapiens
ttcaagtgattctcctgccac

SEQ ID NO: 14492 - DNA, 21 bp, Homo sapiens
gacaccttttgttgccttctt

SEQ ID NO: 14493 - DNA, 21 bp, Homo sapiens
gatgtactgatggatcctcca

SEQ ID NO: 14494 - DNA, 21 bp, Homo sapiens
gctgtggacagagctccctca

SEQ ID NO: 14495 - DNA, 18 bp, Homo sapiens
tctgaagccacctggttc

SEQ ID NO: 14496 - DNA, 23 bp, Homo sapiens
tgggtgacttgactgtgagactg

SEQ ID NO: 14497 - DNA, 17 bp, Homo sapiens
ttttttaatttgaggta

SEQ ID NO: 14498 - DNA, 18 bp, Homo sapiens
acaaaagctggttaggtt

SEQ ID NO: 14499 - DNA, 18 bp, Homo sapiens
accttacccttattcctc

SEQ ID NO: 14500 - DNA, 18 bp, Homo sapiens
atgcctgatgagtttata

SEQ ID NO: 14501 - DNA, 18 bp, Homo sapiens
cagcagcagcagcagcac

SEQ ID NO: 14502 - DNA, 18 bp, Homo sapiens
cttattcctctctgtcca

SEQ ID NO: 14503 - DNA, 19 bp, Homo sapiens
cttggtgtagtagcaataa

SEQ ID NO: 14504 - DNA, 25 bp, Homo sapiens
tcaacctcatgtcccccacccctca

SEQ ID NO: 14505 - DNA, 24 bp, Homo sapiens
tctctttacctggggcctggcttt

SEQ ID NO: 14506 - DNA, 22 bp, Homo sapiens
tctgcactgtcctgcactcttt

SEQ ID NO: 14507 - DNA, 19 bp, Homo sapiens
tgctatgcaaaacaatcta

SEQ ID NO: 14508 - DNA, 23 bp, Homo sapiens
ccctccccaggggcctcctttcc

SEQ ID NO: 14509 - DNA, 22 bp, Homo sapiens
ctacggaaccagattctggtga

SEQ ID NO: 14510 - DNA, 19 bp, Homo sapiens
tttgtagaaaaggtttcct

SEQ ID NO: 14511 - DNA, 20 bp, Homo sapiens
aaggcatcagtccccctgtg

SEQ ID NO: 14512 - DNA, 21 bp, Homo sapiens
atgtggagactgatggccagg

SEQ ID NO: 14513 - DNA, 18 bp, Homo sapiens
gctgcagccccttgctct

SEQ ID NO: 14514 - DNA, 19 bp, Homo sapiens
tccaggcctctagttccag

SEQ ID NO: 14515 - DNA, 19 bp, Homo sapiens
ttcccccaccagctgcagc

SEQ ID NO: 14516 - DNA, 17 bp, Homo sapiens
aacaaagaagactatgt

SEQ ID NO: 14517 - DNA, 23 bp, Homo sapiens
taagggttctgagcatgaagctg

SEQ ID NO: 14518 - DNA, 24 bp, Homo sapiens
taatcatgttggctggtctggtca

SEQ ID NO: 14519 - DNA, 19 bp, Homo sapiens
tctccgcttatgcttctgg

SEQ ID NO: 14520 - DNA, 17 bp, Homo sapiens
tgtaaaagaccatgcaa

SEQ ID NO: 14521 - DNA, 23 bp, Homo sapiens
ttttgcatcagctgtttaacttt

SEQ ID NO: 14522 - DNA, 24 bp, Homo sapiens
acttcttaggagacatgcactttt

SEQ ID NO: 14523 - DNA, 23 bp, Homo sapiens
gagaaagtaatgattcctaaagc

SEQ ID NO: 14524 - DNA, 19 bp, Homo sapiens
aattccagatttctttgtc

SEQ ID NO: 14525 - DNA, 17 bp, Homo sapiens
agagtgggaagaggtga

SEQ ID NO: 14526 - DNA, 17 bp, Homo sapiens
caagaacaaaactccat

SEQ ID NO: 14527 - DNA, 19 bp, Homo sapiens
ctccttcttatctgtgata

SEQ ID NO: 14528 - DNA, 16 bp, Homo sapiens
cgcgttcaccactttt

SEQ ID NO: 14529 - DNA, 17 bp, Homo sapiens
gcgcgacatcggcgaac

SEQ ID NO: 14530 - DNA, 18 bp, Homo sapiens
agttttcctgtttcccac

SEQ ID NO: 14531 - DNA, 17 bp, Homo sapiens
cattggccgacatcaca

SEQ ID NO: 14532 - DNA, 19 bp, Homo sapiens
cctgaggcacccacttggg

SEQ ID NO: 14533 - DNA, 18 bp, Homo sapiens
cctggcaagtcacctgca

SEQ ID NO: 14534 - DNA, 18 bp, Homo sapiens
ctgcaccgtctacccttc

SEQ ID NO: 14535 - DNA, 18 bp, Homo sapiens
cttaggcgttttgacctt

SEQ ID NO: 14536 - DNA, 17 bp, Homo sapiens
taatggagccctacctc

SEQ ID NO: 14537 - DNA, 17 bp, Homo sapiens
tcaggaaaactgttcca

SEQ ID NO: 14538 - DNA, 18 bp, Homo sapiens
agctcgtaccttctcacc

SEQ ID NO: 14539 - DNA, 22 bp, Homo sapiens
ctggctcatactgcccccacca

SEQ ID NO: 14540 - DNA, 23 bp, Homo sapiens
tgctgtggcaccccatcgcccca

SEQ ID NO: 14541 - DNA, 18 bp, Homo sapiens
ctagagatcaactttctc

SEQ ID NO: 14542 - DNA, 18 bp, Homo sapiens
tagagatcaactttctca

SEQ ID NO: 14543 - DNA, 22 bp, Homo sapiens
tctgttacgctaaacttttgat

SEQ ID NO: 14544 - DNA, 24 bp, Homo sapiens
tctttttatattgtacatagtctt

SEQ ID NO: 14545 - DNA, 19 bp, Homo sapiens
catctgttggttacaagat

SEQ ID NO: 14546 - DNA, 21 bp, Homo sapiens
tctgctgaagctcctaatgga

SEQ ID NO: 14547 - DNA, 18 bp, Homo sapiens
aatggaaatgttttctaa

SEQ ID NO: 14548 - DNA, 20 bp, Homo sapiens
aggaatattagaggaaactt

SEQ ID NO: 14549 - DNA, 21 bp, Homo sapiens
gagcacacaacaaatgtcaga

SEQ ID NO: 14550 - DNA, 24 bp, Homo sapiens
agaaagtgtgaatgcggagtagga

SEQ ID NO: 14551 - DNA, 19 bp, Homo sapiens
ccaagaccctatctgttca

SEQ ID NO: 14552 - DNA, 24 bp, Homo sapiens
tacgaaggatccccaagcccttca

SEQ ID NO: 14553 - DNA, 20 bp, Homo sapiens
tgacctttccctgggcttca

SEQ ID NO: 14554 - DNA, 20 bp, Homo sapiens
atacttctgttttctcttgc

SEQ ID NO: 14555 - DNA, 22 bp, Homo sapiens
tactggctctttcctgctctgg

SEQ ID NO: 14556 - DNA, 21 bp, Homo sapiens
ttctttattcaattttactga

SEQ ID NO: 14557 - DNA, 22 bp, Homo sapiens
gagagcaggggacacggtgcta

SEQ ID NO: 14558 - DNA, 18 bp, Homo sapiens
ggccaggtcttcatcctg

SEQ ID NO: 14559 - DNA, 19 bp, Homo sapiens
gtcctgaaaaccctgtgga

SEQ ID NO: 14560 - DNA, 17 bp, Homo sapiens
ctgctgcagttaccatg

SEQ ID NO: 14561 - DNA, 17 bp, Homo sapiens
gcccctaaattttgcac

SEQ ID NO: 14562 - DNA, 16 bp, Homo sapiens
gctgcttttgctctga

SEQ ID NO: 14563 - DNA, 23 bp, Homo sapiens
tattatttcaaataaatggaaaa

SEQ ID NO: 14564 - DNA, 22 bp, Homo sapiens
tcgtgtgaccataagatactga

SEQ ID NO: 14565 - DNA, 24 bp, Homo sapiens
gacattttaataccatgccagaga

SEQ ID NO: 14566 - DNA, 17 bp, Homo sapiens
ttcttgcaatagtaact

SEQ ID NO: 14567 - DNA, 18 bp, Homo sapiens
acacagaatacaacctca

SEQ ID NO: 14568 - DNA, 26 bp, Homo sapiens
agaacaacaaaagcacttttccatct

SEQ ID NO: 14569 - DNA, 21 bp, Homo sapiens
atcaaacaggcctgggtatct

SEQ ID NO: 14570 - DNA, 18 bp, Homo sapiens
ctcgacaccgagtcctag

SEQ ID NO: 14571 - DNA, 28 bp, Homo sapiens
gcctgggtatctgaggcttgcttggctt

SEQ ID NO: 14572 - DNA, 17 bp, Homo sapiens
aatgagatggcatgtga

SEQ ID NO: 14573 - DNA, 19 bp, Homo sapiens
cagctttgtggcctttgca

SEQ ID NO: 14574 - DNA, 17 bp, Homo sapiens
cctcccccactccattc

SEQ ID NO: 14575 - DNA, 23 bp, Homo sapiens
gcgctgtttgctgcgcgggcttt

SEQ ID NO: 14576 - DNA, 19 bp, Homo sapiens
ggtgcttctgaattcctga

SEQ ID NO: 14577 - DNA, 19 bp, Homo sapiens
gtagccttgacactgatgg

SEQ ID NO: 14578 - DNA, 20 bp, Homo sapiens
tatatgatattgggttgata

SEQ ID NO: 14579 - DNA, 15 bp, Homo sapiens
tgaggagaaaagcaa

SEQ ID NO: 14580 - DNA, 23 bp, Homo sapiens
tgcaaattctgtttccaacttga

SEQ ID NO: 14581 - DNA, 20 bp, Homo sapiens
ttttatcatattttagggtg

SEQ ID NO: 14582 - DNA, 19 bp, Homo sapiens
aaagtgctgctgattccca

SEQ ID NO: 14583 - DNA, 18 bp, Homo sapiens
caggaccaccaagcccct

SEQ ID NO: 14584 - DNA, 18 bp, Homo sapiens
ggcttctccctcccgttt

SEQ ID NO: 14585 - DNA, 17 bp, Homo sapiens
tcaccaagctgtctctc

SEQ ID NO: 14586 - DNA, 19 bp, Homo sapiens
catgcacaagaagcactca

SEQ ID NO: 14587 - DNA, 17 bp, Homo sapiens
cccacccccatagttgt

SEQ ID NO: 14588 - DNA, 20 bp, Homo sapiens
ccccaaacttccaaatccca

SEQ ID NO: 14589 - DNA, 19 bp, Homo sapiens
ttgagcacgagacactttt

SEQ ID NO: 14590 - DNA, 23 bp, Homo sapiens
ccacaggccccgcccctcctccc

SEQ ID NO: 14591 - DNA, 20 bp, Homo sapiens
tgaatgagattgaggcgtgg

SEQ ID NO: 14592 - DNA, 23 bp, Homo sapiens
ttctggcggttgtgggcttcgga

SEQ ID NO: 14593 - DNA, 23 bp, Homo sapiens
ctgggttcaggtgattctcctga

SEQ ID NO: 14594 - DNA, 20 bp, Homo sapiens
accaaggattgtggcaacca

SEQ ID NO: 14595 - DNA, 21 bp, Homo sapiens
agaataaatttcggctgtttt

SEQ ID NO: 14596 - DNA, 18 bp, Homo sapiens
atgaagtcctgtcactca

SEQ ID NO: 14597 - DNA, 23 bp, Homo sapiens
cctagaagcagagactctgtgag

SEQ ID NO: 14598 - DNA, 23 bp, Homo sapiens
cctttaatcctgccactgtcata

SEQ ID NO: 14599 - DNA, 23 bp, Homo sapiens
cgtctgacttagtgggcacctga

SEQ ID NO: 14600 - DNA, 18 bp, Homo sapiens
ctcaggtcctggcaagtt

SEQ ID NO: 14601 - DNA, 20 bp, Homo sapiens
gatctcagcaaagccactga

SEQ ID NO: 14602 - DNA, 20 bp, Homo sapiens
gatctcagcaaagccactga

SEQ ID NO: 14603 - DNA, 21 bp, Homo sapiens
ggaaacagatctcagcaaagc

SEQ ID NO: 14604 - DNA, 21 bp, Homo sapiens
ggtgagtggaggagacccatg

SEQ ID NO: 14605 - DNA, 24 bp, Homo sapiens
aaataaataacataaatcgttgaa

SEQ ID NO: 14606 - DNA, 18 bp, Homo sapiens
actggatatatcactatg

SEQ ID NO: 14607 - DNA, 21 bp, Homo sapiens
caccgtaaccactgcacatca

SEQ ID NO: 14608 - DNA, 22 bp, Homo sapiens
ctgtgcaaataaactcctttta

SEQ ID NO: 14609 - DNA, 17 bp, Homo sapiens
gtggggcagcggctgtg

SEQ ID NO: 14610 - DNA, 19 bp, Homo sapiens
tagtgaaacttatctgatg

SEQ ID NO: 14611 - DNA, 20 bp, Homo sapiens
tatttagcaatatttgatga

SEQ ID NO: 14612 - DNA, 20 bp, Homo sapiens
tgcacatcacctccatctct

SEQ ID NO: 14613 - DNA, 21 bp, Homo sapiens
ccaccttccacccccaactcc

SEQ ID NO: 14614 - DNA, 24 bp, Homo sapiens
ccttccacccccaactcccttcca

SEQ ID NO: 14615 - DNA, 20 bp, Homo sapiens
gctccaggggctgccaggga

SEQ ID NO: 14616 - DNA, 23 bp, Homo sapiens
tcctgtatctgtaaacacttttt

SEQ ID NO: 14617 - DNA, 19 bp, Homo sapiens
cagagacgccacaacttca

SEQ ID NO: 14618 - DNA, 21 bp, Homo sapiens
ccttggtggtcctcatgtgga

SEQ ID NO: 14619 - DNA, 18 bp, Homo sapiens
gacctgatatgggatccc

SEQ ID NO: 14620 - DNA, 15 bp, Homo sapiens
gcccgtcaggggcca

SEQ ID NO: 14621 - DNA, 19 bp, Homo sapiens
ggccggacgcagtagctta

SEQ ID NO: 14622 - DNA, 22 bp, Homo sapiens
gtagttgtagggtactttgtca

SEQ ID NO: 14623 - DNA, 17 bp, Homo sapiens
gtgctggcttttctgga

SEQ ID NO: 14624 - DNA, 26 bp, Homo sapiens
gtgtctttttgcttttggtgaacttt

SEQ ID NO: 14625 - DNA, 18 bp, Homo sapiens
tccagaaaggtaatggtg

SEQ ID NO: 14626 - DNA, 20 bp, Homo sapiens
tcctcttattcttccacaaa

SEQ ID NO: 14627 - DNA, 17 bp, Homo sapiens
tgtcccaaggcataact

SEQ ID NO: 14628 - DNA, 18 bp, Homo sapiens
tgtctgatttttacaatg

SEQ ID NO: 14629 - DNA, 18 bp, Homo sapiens
tgttgagtgttctttgga

SEQ ID NO: 14630 - DNA, 21 bp, Homo sapiens
acactgccgtcgcttttgctg

SEQ ID NO: 14631 - DNA, 20 bp, Homo sapiens
tctggggcgctctccggtgt

SEQ ID NO: 14632 - DNA, 22 bp, Homo sapiens
agccaaagcagggagcctttct

SEQ ID NO: 14633 - DNA, 19 bp, Homo sapiens
agtccagttttcaatatga

SEQ ID NO: 14634 - DNA, 18 bp, Homo sapiens
attgcatgctgctcagac

SEQ ID NO: 14635 - DNA, 20 bp, Homo sapiens
cacacagacctgtttccttt

SEQ ID NO: 14636 - DNA, 21 bp, Homo sapiens
caccacaatcaactattgaca

SEQ ID NO: 14637 - DNA, 22 bp, Homo sapiens
cctgttcatctctttcatgccc

SEQ ID NO: 14638 - DNA, 19 bp, Homo sapiens
gcaatgaccaaatatttca

SEQ ID NO: 14639 - DNA, 18 bp, Homo sapiens
gtaatcatataaggccat

SEQ ID NO: 14640 - DNA, 18 bp, Homo sapiens
tagtttctgtacaactga

SEQ ID NO: 14641 - DNA, 23 bp, Homo sapiens
tcatctgtataattgccaaatga

SEQ ID NO: 14642 - DNA, 25 bp, Homo sapiens
tccaatgctttttgacatctttata

SEQ ID NO: 14643 - DNA, 21 bp, Homo sapiens
tccttgcccacactatggaat

SEQ ID NO: 14644 - DNA, 20 bp, Homo sapiens
tgatacaacctgtgacatca

SEQ ID NO: 14645 - DNA, 18 bp, Homo sapiens
tttaaaactgcttttcca

SEQ ID NO: 14646 - DNA, 19 bp, Homo sapiens
actaaggacacaagaatca

SEQ ID NO: 14647 - DNA, 20 bp, Homo sapiens
ccactacctcctccaacaaa

SEQ ID NO: 14648 - DNA, 19 bp, Homo sapiens
ccctccacccactacctcc

SEQ ID NO: 14649 - DNA, 20 bp, Homo sapiens
cctttggtatcatcatgaaa

SEQ ID NO: 14650 - DNA, 18 bp, Homo sapiens
ctccagagctggcccttc

SEQ ID NO: 14651 - DNA, 21 bp, Homo sapiens
cttagggaggttggtgtcaga

SEQ ID NO: 14652 - DNA, 19 bp, Homo sapiens
gctctgagccagattccac

SEQ ID NO: 14653 - DNA, 18 bp, Homo sapiens
ggaggagggcagggcttg

SEQ ID NO: 14654 - DNA, 22 bp, Homo sapiens
gggacagctaccactgtcctct

SEQ ID NO: 14655 - DNA, 24 bp, Homo sapiens
tggatgggggtgatgcagggactg

SEQ ID NO: 14656 - DNA, 18 bp, Homo sapiens
aagtagagcaaagagcca

SEQ ID NO: 14657 - DNA, 24 bp, Homo sapiens
ctgttatttgctgattttgtttta

SEQ ID NO: 14658 - DNA, 19 bp, Homo sapiens
ggtggacattatttcccca

SEQ ID NO: 14659 - DNA, 21 bp, Homo sapiens
tctttaaacaattctgtgagc

SEQ ID NO: 14660 - DNA, 20 bp, Homo sapiens
acgtggctaccaaatgccta

SEQ ID NO: 14661 - DNA, 19 bp, Homo sapiens
caaagatcaaggaatgtca

SEQ ID NO: 14662 - DNA, 17 bp, Homo sapiens
ccgtggaagcacactct

SEQ ID NO: 14663 - DNA, 20 bp, Homo sapiens
ggaccaataaacagcctcct

SEQ ID NO: 14664 - DNA, 17 bp, Homo sapiens
gtcatctctggtgtcag

SEQ ID NO: 14665 - DNA, 24 bp, Homo sapiens
gtcattgcgtgtgtgtggtttgtg

SEQ ID NO: 14666 - DNA, 17 bp, Homo sapiens
tgggtattatgcagtgc

SEQ ID NO: 14667 - DNA, 18 bp, Homo sapiens
tgtaccaatttcttttaa

SEQ ID NO: 14668 - DNA, 18 bp, Homo sapiens
ttcaaatgtaaattgttc

SEQ ID NO: 14669 - DNA, 20 bp, Homo sapiens
ttgcgtgtgtgtggtttgtg

SEQ ID NO: 14670 - DNA, 18 bp, Homo sapiens
tcttggttgcacatgtta

SEQ ID NO: 14671 - DNA, 19 bp, Homo sapiens
cttaagcaggctgatcgct

SEQ ID NO: 14672 - DNA, 19 bp, Homo sapiens
gggacccggcggcggcggc

SEQ ID NO: 14673 - DNA, 17 bp, Homo sapiens
tcatgggcaacagaggc

SEQ ID NO: 14674 - DNA, 18 bp, Homo sapiens
agaaactttggaacaaaa

SEQ ID NO: 14675 - DNA, 17 bp, Homo sapiens
atgcctttcatagttta

SEQ ID NO: 14676 - DNA, 19 bp, Homo sapiens
gaacaggagtttgctgcca

SEQ ID NO: 14677 - DNA, 16 bp, Homo sapiens
gacagccgctgcttcc

SEQ ID NO: 14678 - DNA, 26 bp, Homo sapiens
atcgcatgtcctacaatctgctctta

SEQ ID NO: 14679 - DNA, 19 bp, Homo sapiens
caaatttgcactctgctcc

SEQ ID NO: 14680 - DNA, 26 bp, Homo sapiens
cacttccattggtctccaggccccaa

SEQ ID NO: 14681 - DNA, 22 bp, Homo sapiens
gattcaacaggaaaccgatctt

SEQ ID NO: 14682 - DNA, 16 bp, Homo sapiens
gcagaggactgggcca

SEQ ID NO: 14683 - DNA, 23 bp, Homo sapiens
ctttttaattgaagatgtcttga

SEQ ID NO: 14684 - DNA, 16 bp, Homo sapiens
ggagccagccagcgtg

SEQ ID NO: 14685 - DNA, 17 bp, Homo sapiens
atcccacccatgttgta

SEQ ID NO: 14686 - DNA, 22 bp, Homo sapiens
ccattaaaaaaccattctctta

SEQ ID NO: 14687 - DNA, 19 bp, Homo sapiens
ctgccccacccccacctcc

SEQ ID NO: 14688 - DNA, 17 bp, Homo sapiens
gcctcagggcctggtga

SEQ ID NO: 14689 - DNA, 23 bp, Homo sapiens
tctcctattatctattatcactg

SEQ ID NO: 14690 - DNA, 21 bp, Homo sapiens
tctggacagacagaaccatct

SEQ ID NO: 14691 - DNA, 19 bp, Homo sapiens
atcccacctacagactacc

SEQ ID NO: 14692 - DNA, 21 bp, Homo sapiens
ctccgagtgtcctcccctgcc

SEQ ID NO: 14693 - DNA, 20 bp, Homo sapiens
ttccaggaatagcgctccag

SEQ ID NO: 14694 - DNA, 22 bp, Homo sapiens
tttcaaaattgcagcagtccca

SEQ ID NO: 14695 - DNA, 19 bp, Homo sapiens
aggcccctgggctccttca

SEQ ID NO: 14696 - DNA, 21 bp, Homo sapiens
agggaagagaatgaggaccac

SEQ ID NO: 14697 - DNA, 19 bp, Homo sapiens
cttccagaggtttcagctt

SEQ ID NO: 14698 - DNA, 23 bp, Homo sapiens
gattgctttgtggtgattctcag

SEQ ID NO: 14699 - DNA, 16 bp, Homo sapiens
ccctggccagcaccca

SEQ ID NO: 14700 - DNA, 22 bp, Homo sapiens
caggattcaaagctaggtttgg

SEQ ID NO: 14701 - DNA, 18 bp, Homo sapiens
cctgggggtgcctggcct

SEQ ID NO: 14702 - DNA, 19 bp, Homo sapiens
gtgggtgggaagactagtg

SEQ ID NO: 14703 - DNA, 19 bp, Homo sapiens
aagtgatgccctcctgcca

SEQ ID NO: 14704 - DNA, 24 bp, Homo sapiens
ccttacgcttgtgggggtctgcgg

SEQ ID NO: 14705 - DNA, 16 bp, Homo sapiens
ctagacgctgctagga

SEQ ID NO: 14706 - DNA, 19 bp, Homo sapiens
caaaatataaaatgtaaca

SEQ ID NO: 14707 - DNA, 20 bp, Homo sapiens
ctggtctttcttgacagggt

SEQ ID NO: 14708 - DNA, 20 bp, Homo sapiens
ctttgcagacgtttcactcc

SEQ ID NO: 14709 - DNA, 20 bp, Homo sapiens
gcaaaaagtacctcttctta

SEQ ID NO: 14710 - DNA, 18 bp, Homo sapiens
agccgcagcctctgccgc

SEQ ID NO: 14711 - DNA, 18 bp, Homo sapiens
cctcgggcaccagcctgc

SEQ ID NO: 14712 - DNA, 18 bp, Homo sapiens
cctgccctccccaccccc

SEQ ID NO: 14713 - DNA, 24 bp, Homo sapiens
cctggcaccaggctcacccaccca

SEQ ID NO: 14714 - DNA, 22 bp, Homo sapiens
gcctctgccgcagcgcccccgc

SEQ ID NO: 14715 - DNA, 22 bp, Homo sapiens
gcctggaccccattgtctgtct

SEQ ID NO: 14716 - DNA, 19 bp, Homo sapiens
gggtggtgctggcccagtt

SEQ ID NO: 14717 - DNA, 18 bp, Homo sapiens
gtaaaagtacatgccatg

SEQ ID NO: 14718 - DNA, 22 bp, Homo sapiens
cgtcagggtcgccagcgcctca

SEQ ID NO: 14719 - DNA, 20 bp, Homo sapiens
tttgtgtgtgtgtagtttat

SEQ ID NO: 14720 - DNA, 18 bp, Homo sapiens
agatgttctttcacccga

SEQ ID NO: 14721 - DNA, 20 bp, Homo sapiens
gcggccgcgtcgacgtgaca

SEQ ID NO: 14722 - DNA, 19 bp, Homo sapiens
acagccatctaactcatta

SEQ ID NO: 14723 - DNA, 19 bp, Homo sapiens
catctaactcattacctta

SEQ ID NO: 14724 - DNA, 23 bp, Homo sapiens
gaatgtccgtgatgcctacctca

SEQ ID NO: 14725 - DNA, 18 bp, Homo sapiens
gacttaattatgagactg

SEQ ID NO: 14726 - DNA, 19 bp, Homo sapiens
tatttcatatattctctcc

SEQ ID NO: 14727 - DNA, 18 bp, Homo sapiens
tctgctcttgtttgtgtg

SEQ ID NO: 14728 - DNA, 20 bp, Homo sapiens
acaaacacagagctgcccag

SEQ ID NO: 14729 - DNA, 25 bp, Homo sapiens
acctgaacgcaccaccctctggcct

SEQ ID NO: 14730 - DNA, 16 bp, Homo sapiens
agaaaaataatctggt

SEQ ID NO: 14731 - DNA, 21 bp, Homo sapiens
cagaagaaaaataatctggtc

SEQ ID NO: 14732 - DNA, 19 bp, Homo sapiens
taacagtctgcacagtttc

SEQ ID NO: 14733 - DNA, 22 bp, Homo sapiens
ccagagaccatccagctcatca

SEQ ID NO: 14734 - DNA, 20 bp, Homo sapiens
tttgttttatttcactgatt

SEQ ID NO: 14735 - DNA, 19 bp, Homo sapiens
ccacggcctctgcctcccc

SEQ ID NO: 14736 - DNA, 18 bp, Homo sapiens
agtgttacaactgagttg

SEQ ID NO: 14737 - DNA, 23 bp, Homo sapiens
attgaagataggtttagcagtaa

SEQ ID NO: 14738 - DNA, 23 bp, Homo sapiens
agcgcgaccctgcaggtgctgga

SEQ ID NO: 14739 - DNA, 22 bp, Homo sapiens
agtgggtggggaaggttgttgt

SEQ ID NO: 14740 - DNA, 25 bp, Homo sapiens
ctgcacccagccaggtccctgggga

SEQ ID NO: 14741 - DNA, 17 bp, Homo sapiens
ctgccttgcttcctcca

SEQ ID NO: 14742 - DNA, 19 bp, Homo sapiens
tggtttcggcgtgatgttg

SEQ ID NO: 14743 - DNA, 17 bp, Homo sapiens
agacgacgatatcagcg

SEQ ID NO: 14744 - DNA, 23 bp, Homo sapiens
cttctgacgagccacacgtttgc

SEQ ID NO: 14745 - DNA, 22 bp, Homo sapiens
acagacacagccgccagcccaa

SEQ ID NO: 14746 - DNA, 19 bp, Homo sapiens
ccacagacccagtcctcca

SEQ ID NO: 14747 - DNA, 23 bp, Homo sapiens
gccaccccttgagggtggccagg

SEQ ID NO: 14748 - DNA, 16 bp, Homo sapiens
tctgtggagagtggag

SEQ ID NO: 14749 - DNA, 22 bp, Homo sapiens
aaaaacattccaagccaattgg

SEQ ID NO: 14750 - DNA, 19 bp, Homo sapiens
agtttgcttagttacaaca

SEQ ID NO: 14751 - DNA, 21 bp, Homo sapiens
caacctctagagattgaggta

SEQ ID NO: 14752 - DNA, 23 bp, Homo sapiens
ctctttctccccccaaacccctc

SEQ ID NO: 14753 - DNA, 18 bp, Homo sapiens
tctctctctctctgtctc

SEQ ID NO: 14754 - DNA, 19 bp, Homo sapiens
tgcgtctatatgatactca

SEQ ID NO: 14755 - DNA, 20 bp, Homo sapiens
ttcctctttcatacattcca

SEQ ID NO: 14756 - DNA, 21 bp, Homo sapiens
ttgtttgatttccctctgcag

SEQ ID NO: 14757 - DNA, 18 bp, Homo sapiens
ttttcttgtaacatgata

SEQ ID NO: 14758 - DNA, 19 bp, Homo sapiens
accgggcgcaccatctttc

SEQ ID NO: 14759 - DNA, 19 bp, Homo sapiens
ctgctgcttaggtcctttt

SEQ ID NO: 14760 - DNA, 20 bp, Homo sapiens
tcatgctacccaccacctca

SEQ ID NO: 14761 - DNA, 22 bp, Homo sapiens
atttgggttgtctgtcttgtct

SEQ ID NO: 14762 - DNA, 23 bp, Homo sapiens
cctaggcaccactgagttgtttt

SEQ ID NO: 14763 - DNA, 17 bp, Homo sapiens
gttttcccaacgtgaca

SEQ ID NO: 14764 - DNA, 21 bp, Homo sapiens
attatattgttgaagccttca

SEQ ID NO: 14765 - DNA, 18 bp, Homo sapiens
ttcaatatatatacctgg

SEQ ID NO: 14766 - DNA, 20 bp, Homo sapiens
acctcacccagatatcatcc

SEQ ID NO: 14767 - DNA, 17 bp, Homo sapiens
aggccacctgtcactca

SEQ ID NO: 14768 - DNA, 19 bp, Homo sapiens
ccctctaccctgttcctca

SEQ ID NO: 14769 - DNA, 18 bp, Homo sapiens
cctgaaccagcctggctt

SEQ ID NO: 14770 - DNA, 22 bp, Homo sapiens
ctgcacagtctggccatgtgac

SEQ ID NO: 14771 - DNA, 24 bp, Homo sapiens
gcaggtggaggccatgcctgtctt

SEQ ID NO: 14772 - DNA, 22 bp, Homo sapiens
gcttggtctgaccccttggcct

SEQ ID NO: 14773 - DNA, 20 bp, Homo sapiens
tctcccaccaagaggccacc

SEQ ID NO: 14774 - DNA, 19 bp, Homo sapiens
tgttcctcagcatggagct

SEQ ID NO: 14775 - DNA, 19 bp, Homo sapiens
tttcccctgttttcccaca

SEQ ID NO: 14776 - DNA, 21 bp, Homo sapiens
ctccccaagggtgccggcact

SEQ ID NO: 14777 - DNA, 23 bp, Homo sapiens
gcaccagcagccgcctccatgcc

SEQ ID NO: 14778 - DNA, 24 bp, Homo sapiens
gccccacgtcaaaggtcaagtgag

SEQ ID NO: 14779 - DNA, 18 bp, Homo sapiens
cctagataactctacacg

SEQ ID NO: 14780 - DNA, 19 bp, Homo sapiens
gcaccactctgctgcccca

SEQ ID NO: 14781 - DNA, 20 bp, Homo sapiens
gcagcgcacctgccacccct

SEQ ID NO: 14782 - DNA, 21 bp, Homo sapiens
tctttttagttccatgatctt

SEQ ID NO: 14783 - DNA, 16 bp, Homo sapiens
acctcatcagagaagc

SEQ ID NO: 14784 - DNA, 18 bp, Homo sapiens
agggtcccagcttagtta

SEQ ID NO: 14785 - DNA, 19 bp, Homo sapiens
cctgatgagtacatgtgga

SEQ ID NO: 14786 - DNA, 19 bp, Homo sapiens
ggaagggaataatctttta

SEQ ID NO: 14787 - DNA, 23 bp, Homo sapiens
atctgagcctatcgccctggcct

SEQ ID NO: 14788 - DNA, 17 bp, Homo sapiens
ggcagttagccagccca

SEQ ID NO: 14789 - DNA, 24 bp, Homo sapiens
ctgtaaaaatgtattatcttgtaa

SEQ ID NO: 14790 - DNA, 18 bp, Homo sapiens
gccacctgggagttctgg

SEQ ID NO: 14791 - DNA, 19 bp, Homo sapiens
atactgtgtttagtacact

SEQ ID NO: 14792 - DNA, 19 bp, Homo sapiens
aggatgctgtggctgttct

SEQ ID NO: 14793 - DNA, 21 bp, Homo sapiens
agtgagtctcaaattgttttt

SEQ ID NO: 14794 - DNA, 20 bp, Homo sapiens
atctttactcaagaatttca

SEQ ID NO: 14795 - DNA, 25 bp, Homo sapiens
ctccaggaagagttaagcactgctt

SEQ ID NO: 14796 - DNA, 27 bp, Homo sapiens
ctttttagttacagatgttttgacttt

SEQ ID NO: 14797 - DNA, 21 bp, Homo sapiens
tactttatatgcattatgatg

SEQ ID NO: 14798 - DNA, 16 bp, Homo sapiens
tgatggacatgtgaaa

SEQ ID NO: 14799 - DNA, 20 bp, Homo sapiens
ccaggggctgttatatacat

SEQ ID NO: 14800 - DNA, 19 bp, Homo sapiens
ggtttatatgattaaatta

SEQ ID NO: 14801 - DNA, 22 bp, Homo sapiens
gtcccagattatttctgtaaga

SEQ ID NO: 14802 - DNA, 17 bp, Homo sapiens
caccacaatgactgtct

SEQ ID NO: 14803 - DNA, 17 bp, Homo sapiens
taagctggaacagtcca

SEQ ID NO: 14804 - DNA, 19 bp, Homo sapiens
accccgagacaaaaatgct

SEQ ID NO: 14805 - DNA, 19 bp, Homo sapiens
ctcccgcccccaaacccca

SEQ ID NO: 14806 - DNA, 16 bp, Homo sapiens
tcctttaagaggcggg

SEQ ID NO: 14807 - DNA, 19 bp, Homo sapiens
tgttaggaaaattaaccaa

SEQ ID NO: 14808 - DNA, 25 bp, Homo sapiens
agtgttaagtagcaggtgtgttgtg

SEQ ID NO: 14809 - DNA, 18 bp, Homo sapiens
tctcgcacgctgcccctg

SEQ ID NO: 14810 - DNA, 21 bp, Homo sapiens
tggatggatcttctctgaact

SEQ ID NO: 14811 - DNA, 18 bp, Homo sapiens
ttcgtgattccacgtcta

SEQ ID NO: 14812 - DNA, 24 bp, Homo sapiens
cccaggcagctgccaagcactccc

SEQ ID NO: 14813 - DNA, 23 bp, Homo sapiens
ctggactgaggggagtgtgccca

SEQ ID NO: 14814 - DNA, 22 bp, Homo sapiens
gaaccaagatcacgccactgca

SEQ ID NO: 14815 - DNA, 20 bp, Homo sapiens
atttctggtgtgtgcagaca

SEQ ID NO: 14816 - DNA, 21 bp, Homo sapiens
ctgacagcccaaactgtcaga

SEQ ID NO: 14817 - DNA, 20 bp, Homo sapiens
atttactcctctttatcaca

SEQ ID NO: 14818 - DNA, 22 bp, Homo sapiens
caaagttatattgtgatactca

SEQ ID NO: 14819 - DNA, 21 bp, Homo sapiens
cgaggctgtggagcggcgtga

SEQ ID NO: 14820 - DNA, 20 bp, Homo sapiens
tggcacctagaatgaagtta

SEQ ID NO: 14821 - DNA, 18 bp, Homo sapiens
gagaatgtgatttttggc

SEQ ID NO: 14822 - DNA, 22 bp, Homo sapiens
atggaagatggtacattctgga

SEQ ID NO: 14823 - DNA, 17 bp, Homo sapiens
gcaccacgcccacgtcc

SEQ ID NO: 14824 - DNA, 24 bp, Homo sapiens
tccagatatgggttaaattcctca

SEQ ID NO: 14825 - DNA, 23 bp, Homo sapiens
ttaaagcatatttaagttatttt

SEQ ID NO: 14826 - DNA, 19 bp, Homo sapiens
gcccactgaggggacagcc

SEQ ID NO: 14827 - DNA, 25 bp, Homo sapiens
gcccgccaagagggggcctctgcta

SEQ ID NO: 14828 - DNA, 17 bp, Homo sapiens
ggagaggatagagaggt

SEQ ID NO: 14829 - DNA, 19 bp, Homo sapiens
gggcggggtggggcctcca

SEQ ID NO: 14830 - DNA, 18 bp, Homo sapiens
tctgggcagggacctcgg

SEQ ID NO: 14831 - DNA, 23 bp, Homo sapiens
gtcacttgacattactgctccca

SEQ ID NO: 14832 - DNA, 21 bp, Homo sapiens
tccagaccctgaccctccctc

SEQ ID NO: 14833 - DNA, 20 bp, Homo sapiens
tgcttaagtaagaatcaggc

SEQ ID NO: 14834 - DNA, 21 bp, Homo sapiens
agtttgacaccttgataccca

SEQ ID NO: 14835 - DNA, 17 bp, Homo sapiens
tctctggaaaactatca

SEQ ID NO: 14836 - DNA, 20 bp, Homo sapiens
aagacttgtcaaatatatca

SEQ ID NO: 14837 - DNA, 21 bp, Homo sapiens
gaagaaaatccatttccatga

SEQ ID NO: 14838 - DNA, 25 bp, Homo sapiens
ttttttcaaacaagtttttgacctt

SEQ ID NO: 14839 - DNA, 21 bp, Homo sapiens
aacagatttacatcccagaca

SEQ ID NO: 14840 - DNA, 19 bp, Homo sapiens
accaggcagccactgtgca

SEQ ID NO: 14841 - DNA, 18 bp, Homo sapiens
agctattgctccatgaca

SEQ ID NO: 14842 - DNA, 21 bp, Homo sapiens
atttgaacccaggtctcgtct

SEQ ID NO: 14843 - DNA, 21 bp, Homo sapiens
gacacagagtattttaaaaga

SEQ ID NO: 14844 - DNA, 20 bp, Homo sapiens
ggctgctggctgtctggctt

SEQ ID NO: 14845 - DNA, 17 bp, Homo sapiens
tcaagtgattcttctgc

SEQ ID NO: 14846 - DNA, 20 bp, Homo sapiens
tctttttggactttaatctt

SEQ ID NO: 14847 - DNA, 20 bp, Homo sapiens
tggccaggctggtcttgaac

SEQ ID NO: 14848 - DNA, 19 bp, Homo sapiens
ttccagaagctgccctcag

SEQ ID NO: 14849 - DNA, 18 bp, Homo sapiens
gctaagactgtcataaaa

SEQ ID NO: 14850 - DNA, 16 bp, Homo sapiens
tgaagagatttcaaag

SEQ ID NO: 14851 - DNA, 20 bp, Homo sapiens
ttactttcattattatttgc

SEQ ID NO: 14852 - DNA, 19 bp, Homo sapiens
ttgaaatatttttatcaga

SEQ ID NO: 14853 - DNA, 20 bp, Homo sapiens
catttgggtgggtgccaaat

SEQ ID NO: 14854 - DNA, 23 bp, Homo sapiens
cctttgctagttgtttgggcttt

SEQ ID NO: 14855 - DNA, 18 bp, Homo sapiens
cttattcagccttatcca

SEQ ID NO: 14856 - DNA, 21 bp, Homo sapiens
gaaatgcacttgcctatgata

SEQ ID NO: 14857 - DNA, 17 bp, Homo sapiens
gctttttagaataatgc

SEQ ID NO: 14858 - DNA, 19 bp, Homo sapiens
tcctcagggatcacactgc

SEQ ID NO: 14859 - DNA, 23 bp, Homo sapiens
tttaagcagcttgaatggttttt

SEQ ID NO: 14860 - DNA, 20 bp, Homo sapiens
aacaccttggcttgttattg

SEQ ID NO: 14861 - DNA, 21 bp, Homo sapiens
aacctgttgaagattatttca

SEQ ID NO: 14862 - DNA, 20 bp, Homo sapiens
aacaccttggcttgttattg

SEQ ID NO: 14863 - DNA, 21 bp, Homo sapiens
aacctgttgaagattatttca

SEQ ID NO: 14864 - DNA, 22 bp, Homo sapiens
gcctgctgagaagaagaaacca

SEQ ID NO: 14865 - DNA, 18 bp, Homo sapiens
gtcaggagagtgatgtga

SEQ ID NO: 14866 - DNA, 19 bp, Homo sapiens
aagcaattctcctgcctca

SEQ ID NO: 14867 - DNA, 18 bp, Homo sapiens
gcattttcccttgctgta

SEQ ID NO: 14868 - DNA, 20 bp, Homo sapiens
gtctcccagtcttgtcccgg

SEQ ID NO: 14869 - DNA, 18 bp, Homo sapiens
tcagactcctgggttcaa

SEQ ID NO: 14870 - DNA, 20 bp, Homo sapiens
tcgctgcctcctgggttcaa

SEQ ID NO: 14871 - DNA, 19 bp, Homo sapiens
tcttgtttcttacatatca

SEQ ID NO: 14872 - DNA, 24 bp, Homo sapiens
ttttggaattaaaagccactgact

SEQ ID NO: 14873 - DNA, 24 bp, Homo sapiens
aaatggaaaaaagatactcacaca

SEQ ID NO: 14874 - DNA, 19 bp, Homo sapiens
aagacatttagaaatatgt

SEQ ID NO: 14875 - DNA, 20 bp, Homo sapiens
aagatcccatacctactaca

SEQ ID NO: 14876 - DNA, 24 bp, Homo sapiens
aagggctatagatcacatacgtta

SEQ ID NO: 14877 - DNA, 23 bp, Homo sapiens
acctataacaaggagacattaca

SEQ ID NO: 14878 - DNA, 16 bp, Homo sapiens
cagtcttggctgcaca

SEQ ID NO: 14879 - DNA, 18 bp, Homo sapiens
catgacttaccattccag

SEQ ID NO: 14880 - DNA, 17 bp, Homo sapiens
catgatatttagaccaa

SEQ ID NO: 14881 - DNA, 17 bp, Homo sapiens
cttgatgctgcctggcc

SEQ ID NO: 14882 - DNA, 21 bp, Homo sapiens
ggcaaggtgaaggcattgcca

SEQ ID NO: 14883 - DNA, 18 bp, Homo sapiens
gggaaaagagtctgtgaa

SEQ ID NO: 14884 - DNA, 22 bp, Homo sapiens
gttcaaatcatatatcaggttg

SEQ ID NO: 14885 - DNA, 20 bp, Homo sapiens
tctcttgctgtcattatgat

SEQ ID NO: 14886 - DNA, 21 bp, Homo sapiens
tcttgttcttggtcttgtcaa

SEQ ID NO: 14887 - DNA, 20 bp, Homo sapiens
tgaagagattgaacctagta

SEQ ID NO: 14888 - DNA, 21 bp, Homo sapiens
tttctctaacctataacaagg

SEQ ID NO: 14889 - DNA, 22 bp, Homo sapiens
tttctttatagtaagagcttta

SEQ ID NO: 14890 - DNA, 19 bp, Homo sapiens
tttgttacagcctcacctg

SEQ ID NO: 14891 - DNA, 23 bp, Homo sapiens
atgtcaccctgatctgtcatgcc

SEQ ID NO: 14892 - DNA, 19 bp, Homo sapiens
caagaacaagcaaatgcca

SEQ ID NO: 14893 - DNA, 21 bp, Homo sapiens
ctgtcatgccccaccgccacc

SEQ ID NO: 14894 - DNA, 24 bp, Homo sapiens
ggggacggcggcggcggcggcggc

SEQ ID NO: 14895 - DNA, 18 bp, Homo sapiens
tttcctcccaccccctca

SEQ ID NO: 14896 - DNA, 22 bp, Homo sapiens
cctcctcgccatcctactcctc

SEQ ID NO: 14897 - DNA, 21 bp, Homo sapiens
cctcctcgtcatcctccccct

SEQ ID NO: 14898 - DNA, 19 bp, Homo sapiens
atcagttcgcagggcttaa

SEQ ID NO: 14899 - DNA, 21 bp, Homo sapiens
ccaagtatataaagctccctg

SEQ ID NO: 14900 - DNA, 20 bp, Homo sapiens
ctgaaagtaaagttgtatgt

SEQ ID NO: 14901 - DNA, 19 bp, Homo sapiens
cttcctcacttcctctcca

SEQ ID NO: 14902 - DNA, 19 bp, Homo sapiens
gtggttaaaacatagcttt

SEQ ID NO: 14903 - DNA, 24 bp, Homo sapiens
tcatttccaccagcagttccctta

SEQ ID NO: 14904 - DNA, 18 bp, Homo sapiens
tgtttcagaaaacataat

SEQ ID NO: 14905 - DNA, 19 bp, Homo sapiens
tttgctggatttactaaca

SEQ ID NO: 14906 - DNA, 21 bp, Homo sapiens
gacagggctccagggcttgtc

SEQ ID NO: 14907 - DNA, 19 bp, Homo sapiens
accagaagagaaaatactg

SEQ ID NO: 14908 - DNA, 18 bp, Homo sapiens
ccgcaggggctcttggga

SEQ ID NO: 14909 - DNA, 22 bp, Homo sapiens
ctcttcccgtgcccctaccaga

SEQ ID NO: 14910 - DNA, 19 bp, Homo sapiens
acacccgtgtagatgggta

SEQ ID NO: 14911 - DNA, 26 bp, Homo sapiens
gacatttgccttaggaacttaactct

SEQ ID NO: 14912 - DNA, 19 bp, Homo sapiens
gtctctccctgtcctagct

SEQ ID NO: 14913 - DNA, 16 bp, Homo sapiens
gttatcaactgcaatg

SEQ ID NO: 14914 - DNA, 21 bp, Homo sapiens
gttgaaggaatttcctggttt

SEQ ID NO: 14915 - DNA, 20 bp, Homo sapiens
acaacagaaaggaaatccta

SEQ ID NO: 14916 - DNA, 20 bp, Homo sapiens
agatcagcagagccacccta

SEQ ID NO: 14917 - DNA, 25 bp, Homo sapiens
agccaagggagccaaacacactaga

SEQ ID NO: 14918 - DNA, 21 bp, Homo sapiens
ctagatcagctgaaactctaa

SEQ ID NO: 14919 - DNA, 19 bp, Homo sapiens
ctgaactaaggcttggcct

SEQ ID NO: 14920 - DNA, 21 bp, Homo sapiens
gaaaatttagcaagccactga

SEQ ID NO: 14921 - DNA, 18 bp, Homo sapiens
gtagtaatacctatctca

SEQ ID NO: 14922 - DNA, 18 bp, Homo sapiens
gttgagatcttcatccaa

SEQ ID NO: 14923 - DNA, 24 bp, Homo sapiens
tcatattttttattacaacactaa

SEQ ID NO: 14924 - DNA, 21 bp, Homo sapiens
tgcgaacactgaactctacgc

SEQ ID NO: 14925 - DNA, 19 bp, Homo sapiens
cttgtaatctgttccttac

SEQ ID NO: 14926 - DNA, 18 bp, Homo sapiens
ggtatttcaaagctcttt

SEQ ID NO: 14927 - DNA, 17 bp, Homo sapiens
gttttattacaatgtaa

SEQ ID NO: 14928 - DNA, 18 bp, Homo sapiens
tgaactgaaattgtgcca

SEQ ID NO: 14929 - DNA, 20 bp, Homo sapiens
tgtcttgagaaagaaatcac

SEQ ID NO: 14930 - DNA, 17 bp, Homo sapiens
gcctgtttcttctctga

SEQ ID NO: 14931 - DNA, 20 bp, Homo sapiens
aaagactattaagagcaata

SEQ ID NO: 14932 - DNA, 24 bp, Homo sapiens
tcttggtgatggagtgtgcgtgtg

SEQ ID NO: 14933 - DNA, 21 bp, Homo sapiens
tctttttaaaatgctgttttg

SEQ ID NO: 14934 - DNA, 21 bp, Homo sapiens
tttgttacagctatgcactgt

SEQ ID NO: 14935 - DNA, 17 bp, Homo sapiens
ccgggcccacattctcc

SEQ ID NO: 14936 - DNA, 19 bp, Homo sapiens
tgtctcgctcgctccgccc

SEQ ID NO: 14937 - DNA, 24 bp, Homo sapiens
ccaggctcaggcaggcctggccca

SEQ ID NO: 14938 - DNA, 18 bp, Homo sapiens
ggatcccagagcgttgta

SEQ ID NO: 14939 - DNA, 20 bp, Homo sapiens
tctgtgggtcatcctttccc

SEQ ID NO: 14940 - DNA, 20 bp, Homo sapiens
ttcaagaccagcctgaccaa

SEQ ID NO: 14941 - DNA, 21 bp, Homo sapiens
tttcaagcagtgcttgttgtg

SEQ ID NO: 14942 - DNA, 19 bp, Homo sapiens
ccttgtccagtggagccca

SEQ ID NO: 14943 - DNA, 20 bp, Homo sapiens
agcccccagatggtattgca

SEQ ID NO: 14944 - DNA, 19 bp, Homo sapiens
cctacttcccagttaactc

SEQ ID NO: 14945 - DNA, 17 bp, Homo sapiens
cctgctggaagctgcca

SEQ ID NO: 14946 - DNA, 20 bp, Homo sapiens
ggtatttgtcatgtgccaac

SEQ ID NO: 14947 - DNA, 19 bp, Homo sapiens
tggagcccgctgcaggcca

SEQ ID NO: 14948 - DNA, 20 bp, Homo sapiens
ctgtcaatggaattacagct

SEQ ID NO: 14949 - DNA, 18 bp, Homo sapiens
gcagctgccgtgggcttt

SEQ ID NO: 14950 - DNA, 18 bp, Homo sapiens
cagtactttgtccagatt

SEQ ID NO: 14951 - DNA, 21 bp, Homo sapiens
cccgtggcatggcgtggctca

SEQ ID NO: 14952 - DNA, 21 bp, Homo sapiens
gcttgggaaccgtttgagcct

SEQ ID NO: 14953 - DNA, 19 bp, Homo sapiens
gtcatctaaagtccagtga

SEQ ID NO: 14954 - DNA, 19 bp, Homo sapiens
tggcccccaaggtcagagc

SEQ ID NO: 14955 - DNA, 20 bp, Homo sapiens
tcttttgttgctttaatttt

SEQ ID NO: 14956 - DNA, 23 bp, Homo sapiens
cttcattggtaacctggaccaca

SEQ ID NO: 14957 - DNA, 21 bp, Homo sapiens
ttcattggtaacctggaccac

SEQ ID NO: 14958 - DNA, 25 bp, Homo sapiens
gttctttttgctgccatcttcctca

SEQ ID NO: 14959 - DNA, 19 bp, Homo sapiens
tccttgcgccacgtgcttc

SEQ ID NO: 14960 - DNA, 22 bp, Homo sapiens
cccctcgagtgggggactgtac

SEQ ID NO: 14961 - DNA, 23 bp, Homo sapiens
gcttgggctgcccagccctgtcc

SEQ ID NO: 14962 - DNA, 19 bp, Homo sapiens
ggcagcgagtgaaggacgc

SEQ ID NO: 14963 - DNA, 16 bp, Homo sapiens
cttgagaccagaggct

SEQ ID NO: 14964 - DNA, 23 bp, Homo sapiens
acccacagctcccttctcatctc

SEQ ID NO: 14965 - DNA, 19 bp, Homo sapiens
ttgttgatccagcatttga

SEQ ID NO: 14966 - DNA, 25 bp, Homo sapiens
agccgtgggctctaacgcggggctg

SEQ ID NO: 14967 - DNA, 18 bp, Homo sapiens
gcaatatgtatttgagtt

SEQ ID NO: 14968 - DNA, 19 bp, Homo sapiens
tgtagaccagactgcctct

SEQ ID NO: 14969 - DNA, 22 bp, Homo sapiens
ttaagagtatttaacctttcca

SEQ ID NO: 14970 - DNA, 22 bp, Homo sapiens
tctgagtttctgcaggtcattt

SEQ ID NO: 14971 - DNA, 20 bp, Homo sapiens
cccagcacgcgctccgcgcc

SEQ ID NO: 14972 - DNA, 24 bp, Homo sapiens
gctggtttgagggccaccactgca

SEQ ID NO: 14973 - DNA, 23 bp, Homo sapiens
tgagaggagagaaatacacgtct

SEQ ID NO: 14974 - DNA, 20 bp, Homo sapiens
gaggctgcgctgcccgggag

SEQ ID NO: 14975 - DNA, 22 bp, Homo sapiens
gcagacaccacagggtggcatc

SEQ ID NO: 14976 - DNA, 18 bp, Homo sapiens
gcctgccgagggctgcgc

SEQ ID NO: 14977 - DNA, 21 bp, Homo sapiens
accagagaactattactaggc

SEQ ID NO: 14978 - DNA, 24 bp, Homo sapiens
gcgcttttgtctccggtgagtttt

SEQ ID NO: 14979 - DNA, 18 bp, Homo sapiens
tgggtggatcacctgagg

SEQ ID NO: 14980 - DNA, 22 bp, Homo sapiens
cctggcacacagcagggaccca

SEQ ID NO: 14981 - DNA, 24 bp, Homo sapiens
gccaggcgggctgcaggcacctca

SEQ ID NO: 14982 - DNA, 20 bp, Homo sapiens
acctgatgccctcctaccca

SEQ ID NO: 14983 - DNA, 21 bp, Homo sapiens
ccccatagtcccgcctgcagc

SEQ ID NO: 14984 - DNA, 22 bp, Homo sapiens
ccgggctagcactgacgtgtct

SEQ ID NO: 14985 - DNA, 21 bp, Homo sapiens
gcgcctcggaaggggagctct

SEQ ID NO: 14986 - DNA, 21 bp, Homo sapiens
tcttgagacctgatgccctcc

SEQ ID NO: 14987 - DNA, 21 bp, Homo sapiens
gaatcgataacatttcaagaa

SEQ ID NO: 14988 - DNA, 22 bp, Homo sapiens
cacggaaggacacacgctgaag

SEQ ID NO: 14989 - DNA, 18 bp, Homo sapiens
gagtggagcacgtgagac

SEQ ID NO: 14990 - DNA, 23 bp, Homo sapiens
acttttagaatgtagcaaccact

SEQ ID NO: 14991 - DNA, 19 bp, Homo sapiens
gtgtgggacttttagaatg

SEQ ID NO: 14992 - DNA, 21 bp, Homo sapiens
tgttgggaaaggcttcttgaa

SEQ ID NO: 14993 - DNA, 19 bp, Homo sapiens
atggaatgccccaagtatt

SEQ ID NO: 14994 - DNA, 20 bp, Homo sapiens
gccaactgagtagcaaatca

SEQ ID NO: 14995 - DNA, 24 bp, Homo sapiens
agtgggtgggaggggtcaggtgtg

SEQ ID NO: 14996 - DNA, 19 bp, Homo sapiens
gaacagaaacagtgttatt

SEQ ID NO: 14997 - DNA, 19 bp, Homo sapiens
gaaggcccccgctccctct

SEQ ID NO: 14998 - DNA, 20 bp, Homo sapiens
aacagagggtattatttgtt

SEQ ID NO: 14999 - DNA, 19 bp, Homo sapiens
agtaatattagcaaatctc

SEQ ID NO: 15000 - DNA, 18 bp, Homo sapiens
atatagcacgttgtgcaa

SEQ ID NO: 15001 - DNA, 18 bp, Homo sapiens
cttgtgccctcactatgc

SEQ ID NO: 15002 - DNA, 19 bp, Homo sapiens
gaaactactgaggagctta

SEQ ID NO: 15003 - DNA, 18 bp, Homo sapiens
tcacattggtttgtctcc

SEQ ID NO: 15004 - DNA, 21 bp, Homo sapiens
tgagatcgtggaccatcagtt

SEQ ID NO: 15005 - DNA, 21 bp, Homo sapiens
aactccatcaggcaaaattta

SEQ ID NO: 15006 - DNA, 22 bp, Homo sapiens
gaaacagaaattgacctccggt

SEQ ID NO: 15007 - DNA, 19 bp, Homo sapiens
tccagactattgaagtatg

SEQ ID NO: 15008 - DNA, 21 bp, Homo sapiens
agttaccctttattctgtgat

SEQ ID NO: 15009 - DNA, 24 bp, Homo sapiens
ggtgggtgcggaggggcgtgtgtg

SEQ ID NO: 15010 - DNA, 25 bp, Homo sapiens
gtggctgtgaagggaagtctttgtt

SEQ ID NO: 15011 - DNA, 20 bp, Homo sapiens
ggcctcctttgttcccattt

SEQ ID NO: 15012 - DNA, 17 bp, Homo sapiens
tcctcggcaggacccca

SEQ ID NO: 15013 - DNA, 19 bp, Homo sapiens
tctgcctcttgcaccttga

SEQ ID NO: 15014 - DNA, 19 bp, Homo sapiens
tgtgaccactggggcctca

SEQ ID NO: 15015 - DNA, 24 bp, Homo sapiens
actgaggtccccaaaccccacccc

SEQ ID NO: 15016 - DNA, 25 bp, Homo sapiens
caccccaagtgaccccccgcagctc

SEQ ID NO: 15017 - DNA, 23 bp, Homo sapiens
ccatcctctgaaccccaatcccc

SEQ ID NO: 15018 - DNA, 22 bp, Homo sapiens
ccccaagtgaccccccgcagct

SEQ ID NO: 15019 - DNA, 22 bp, Homo sapiens
cctctggccacccgctgtccca

SEQ ID NO: 15020 - DNA, 15 bp, Homo sapiens
aacactgaatttctc

SEQ ID NO: 15021 - DNA, 20 bp, Homo sapiens
acccacctcaccccggctca

SEQ ID NO: 15022 - DNA, 17 bp, Homo sapiens
agagtcttttatctggt

SEQ ID NO: 15023 - DNA, 17 bp, Homo sapiens
agtcagtagggacattg

SEQ ID NO: 15024 - DNA, 24 bp, Homo sapiens
cctggaagtctgtaagttgttttt

SEQ ID NO: 15025 - DNA, 20 bp, Homo sapiens
gaggagaaatgagattgcca

SEQ ID NO: 15026 - DNA, 21 bp, Homo sapiens
tcatggaagaggctcctctga

SEQ ID NO: 15027 - DNA, 22 bp, Homo sapiens
tgtggatgggtgcctgtgggtg

SEQ ID NO: 15028 - DNA, 19 bp, Homo sapiens
agggcctttatttccaact

SEQ ID NO: 15029 - DNA, 19 bp, Homo sapiens
catctgtcaatgtgatgat

SEQ ID NO: 15030 - DNA, 18 bp, Homo sapiens
gaatcagtgtaagccact

SEQ ID NO: 15031 - DNA, 21 bp, Homo sapiens
tgaatggaatgcatgcgactg

SEQ ID NO: 15032 - DNA, 18 bp, Homo sapiens
aatgcaactactctacat

SEQ ID NO: 15033 - DNA, 17 bp, Homo sapiens
gaaaatggccagatttt

SEQ ID NO: 15034 - DNA, 18 bp, Homo sapiens
accccgagctgccctctt

SEQ ID NO: 15035 - DNA, 16 bp, Homo sapiens
agtcatgcccattctc

SEQ ID NO: 15036 - DNA, 18 bp, Homo sapiens
caacccttcccctgtcct

SEQ ID NO: 15037 - DNA, 22 bp, Homo sapiens
cccacccccacatttgcacacc

SEQ ID NO: 15038 - DNA, 22 bp, Homo sapiens
taggtagtctacccttaccttg

SEQ ID NO: 15039 - DNA, 18 bp, Homo sapiens
tgacacacgccctcctca

SEQ ID NO: 15040 - DNA, 19 bp, Homo sapiens
agttttaagtggcaactca

SEQ ID NO: 15041 - DNA, 19 bp, Homo sapiens
ctttaaagccttgcaggaa

SEQ ID NO: 15042 - DNA, 26 bp, Homo sapiens
gcagtgcctggggccctgtttctggg

SEQ ID NO: 15043 - DNA, 17 bp, Homo sapiens
tgttgggaccatttttg

SEQ ID NO: 15044 - DNA, 21 bp, Homo sapiens
ctctctctctctttctctctc

SEQ ID NO: 15045 - DNA, 18 bp, Homo sapiens
ttgacgggacttcatctt

SEQ ID NO: 15046 - DNA, 22 bp, Homo sapiens
aatgactatacagactttagtc

SEQ ID NO: 15047 - DNA, 20 bp, Homo sapiens
gaaaatgtttaagtctttga

SEQ ID NO: 15048 - DNA, 19 bp, Homo sapiens
gcatggcgctcagacattt

SEQ ID NO: 15049 - DNA, 18 bp, Homo sapiens
tctttttagttcttaacc

SEQ ID NO: 15050 - DNA, 22 bp, Homo sapiens
ttgatacagcgtcgccaaaact

SEQ ID NO: 15051 - DNA, 18 bp, Homo sapiens
agcagctgaaggagcctc

SEQ ID NO: 15052 - DNA, 20 bp, Homo sapiens
ccccagctgacaggctgttg

SEQ ID NO: 15053 - DNA, 27 bp, Homo sapiens
gagccctgcctgttccctgtccatcca

SEQ ID NO: 15054 - DNA, 19 bp, Homo sapiens
gctggagccctcctacccg

SEQ ID NO: 15055 - DNA, 17 bp, Homo sapiens
ggccctcagaactctca

SEQ ID NO: 15056 - DNA, 15 bp, Homo sapiens
tcagtgctgatgcca

SEQ ID NO: 15057 - DNA, 19 bp, Homo sapiens
tctgggcgacctctggccc

SEQ ID NO: 15058 - DNA, 21 bp, Homo sapiens
agacttggagagacccgtctg

SEQ ID NO: 15059 - DNA, 17 bp, Homo sapiens
catcctcttccttccca

SEQ ID NO: 15060 - DNA, 19 bp, Homo sapiens
acctgggccctcccaccca

SEQ ID NO: 15061 - DNA, 18 bp, Homo sapiens
caagacccccctctcttc

SEQ ID NO: 15062 - DNA, 22 bp, Homo sapiens
cctcccccgcttcctcccttcc

SEQ ID NO: 15063 - DNA, 20 bp, Homo sapiens
gacccctcccccgcttcctc

SEQ ID NO: 15064 - DNA, 16 bp, Homo sapiens
gctcccaaaaccgctg

SEQ ID NO: 15065 - DNA, 19 bp, Homo sapiens
tggaatgtaacgcgatctc

SEQ ID NO: 15066 - DNA, 20 bp, Homo sapiens
accaaaacagatggtagaga

SEQ ID NO: 15067 - DNA, 23 bp, Homo sapiens
atggcagcatgaattccaactca

SEQ ID NO: 15068 - DNA, 19 bp, Homo sapiens
tcacacccgcttccccctc

SEQ ID NO: 15069 - DNA, 19 bp, Homo sapiens
tgagatccagcacaactca

SEQ ID NO: 15070 - DNA, 18 bp, Homo sapiens
actctttccctctattta

SEQ ID NO: 15071 - DNA, 23 bp, Homo sapiens
ccctccccaacggctgccttccc

SEQ ID NO: 15072 - DNA, 20 bp, Homo sapiens
aagttcccggggcttcctcc

SEQ ID NO: 15073 - DNA, 18 bp, Homo sapiens
atgaagagaatcttatta

SEQ ID NO: 15074 - DNA, 22 bp, Homo sapiens
tttgtcccaggctttctggtgt

SEQ ID NO: 15075 - DNA, 21 bp, Homo sapiens
gaacaacagcagtgttattgt

SEQ ID NO: 15076 - DNA, 18 bp, Homo sapiens
gctacccagcacatgcca

SEQ ID NO: 15077 - DNA, 19 bp, Homo sapiens
acctctgactccctggttc

SEQ ID NO: 15078 - DNA, 27 bp, Homo sapiens
ccatcccctcttctacctcctgcaacc

SEQ ID NO: 15079 - DNA, 22 bp, Homo sapiens
ccttccccaccccctcccccca

SEQ ID NO: 15080 - DNA, 22 bp, Homo sapiens
tcaaagacgagggtcacgcacg

SEQ ID NO: 15081 - DNA, 22 bp, Homo sapiens
cagacagagccctctagctgct

SEQ ID NO: 15082 - DNA, 18 bp, Homo sapiens
aaaacaaacagaacccaa

SEQ ID NO: 15083 - DNA, 20 bp, Homo sapiens
aaaacaaacagaacccaaac

SEQ ID NO: 15084 - DNA, 20 bp, Homo sapiens
caagaaaaaggcagtgcctc

SEQ ID NO: 15085 - DNA, 24 bp, Homo sapiens
gggataacccttccttcgatacca

SEQ ID NO: 15086 - DNA, 18 bp, Homo sapiens
cagcttcgggagcgcgct

SEQ ID NO: 15087 - DNA, 20 bp, Homo sapiens
ccacagccacctccaccccc

SEQ ID NO: 15088 - DNA, 19 bp, Homo sapiens
ccactgggccccattctcc

SEQ ID NO: 15089 - DNA, 20 bp, Homo sapiens
ccccgtagccactctctgcc

SEQ ID NO: 15090 - DNA, 20 bp, Homo sapiens
ccctggggaagaggccttgg

SEQ ID NO: 15091 - DNA, 18 bp, Homo sapiens
cgaggctgcctctgggtg

SEQ ID NO: 15092 - DNA, 19 bp, Homo sapiens
ggaacattcccacataata

SEQ ID NO: 15093 - DNA, 16 bp, Homo sapiens
gcgtgcgcagcccggg

SEQ ID NO: 15094 - DNA, 20 bp, Homo sapiens
aaacatttgccaaactaaat

SEQ ID NO: 15095 - DNA, 19 bp, Homo sapiens
aacatttgccaaactaaat

SEQ ID NO: 15096 - DNA, 19 bp, Homo sapiens
ctttttatatatgttttaa

SEQ ID NO: 15097 - DNA, 19 bp, Homo sapiens
tggttgtactacagtatac

SEQ ID NO: 15098 - DNA, 18 bp, Homo sapiens
atcattcagatcatcccc

SEQ ID NO: 15099 - DNA, 20 bp, Homo sapiens
tggtttgtttttacaaaata

SEQ ID NO: 15100 - DNA, 23 bp, Homo sapiens
tactgcatgcatcacttctgcat

SEQ ID NO: 15101 - DNA, 22 bp, Homo sapiens
gcctggacggctctgctggtct

SEQ ID NO: 15102 - DNA, 21 bp, Homo sapiens
gttggggaaggctcctggccc

SEQ ID NO: 15103 - DNA, 18 bp, Homo sapiens
tctcctgcctggacggct

SEQ ID NO: 15104 - DNA, 22 bp, Homo sapiens
gcctggacagctctgctggtct

SEQ ID NO: 15105 - DNA, 23 bp, Homo sapiens
acctgggttctgtcccctggctc

SEQ ID NO: 15106 - DNA, 20 bp, Homo sapiens
agctgggaacttggtgttgc

SEQ ID NO: 15107 - DNA, 16 bp, Homo sapiens
cctttgtctggagtca

SEQ ID NO: 15108 - DNA, 19 bp, Homo sapiens
ggatgtatcctccagccaa

SEQ ID NO: 15109 - DNA, 18 bp, Homo sapiens
tgggggcggtggggaggt

SEQ ID NO: 15110 - DNA, 21 bp, Homo sapiens
ttctggccaatcaaggcttgc

SEQ ID NO: 15111 - DNA, 19 bp, Homo sapiens
acttctctttattctgcat

SEQ ID NO: 15112 - DNA, 18 bp, Homo sapiens
agccttgtgtggcagata

SEQ ID NO: 15113 - DNA, 18 bp, Homo sapiens
gatctagcctttccagta

SEQ ID NO: 15114 - DNA, 19 bp, Homo sapiens
gtcatacttttccaccgaa

SEQ ID NO: 15115 - DNA, 22 bp, Homo sapiens
tcagctttacagaactgtatta

SEQ ID NO: 15116 - DNA, 20 bp, Homo sapiens
aggaagaaaccacaccatca

SEQ ID NO: 15117 - DNA, 18 bp, Homo sapiens
caacccaccccctgccct

SEQ ID NO: 15118 - DNA, 20 bp, Homo sapiens
ccttccccacctccttccca

SEQ ID NO: 15119 - DNA, 20 bp, Homo sapiens
gagctgaggcatccaagaaa

SEQ ID NO: 15120 - DNA, 24 bp, Homo sapiens
ggtggatgggggagtgaaattgtg

SEQ ID NO: 15121 - DNA, 26 bp, Homo sapiens
gtgtgtgtgaccctgtattgtttgat

SEQ ID NO: 15122 - DNA, 23 bp, Homo sapiens
tgggtggtcccagcctggagctg

SEQ ID NO: 15123 - DNA, 18 bp, Homo sapiens
aatggaagtaatacatca

SEQ ID NO: 15124 - DNA, 21 bp, Homo sapiens
gatagctatacagtctgtaca

SEQ ID NO: 15125 - DNA, 24 bp, Homo sapiens
taaatgggtcaataaatggaagta

SEQ ID NO: 15126 - DNA, 18 bp, Homo sapiens
tttccaaacttgacctca

SEQ ID NO: 15127 - DNA, 19 bp, Homo sapiens
caggtcaccaattttctca

SEQ ID NO: 15128 - DNA, 19 bp, Homo sapiens
catctgacaccatgtagaa

SEQ ID NO: 15129 - DNA, 22 bp, Homo sapiens
ctcctcaagccgtaatgttgaa

SEQ ID NO: 15130 - DNA, 21 bp, Homo sapiens
gatgtagatgcagatattcta

SEQ ID NO: 15131 - DNA, 16 bp, Homo sapiens
gtacatctgttgagca

SEQ ID NO: 15132 - DNA, 20 bp, Homo sapiens
gttgagtacccgcttggttt

SEQ ID NO: 15133 - DNA, 20 bp, Homo sapiens
cccccaacctccaccccacc

SEQ ID NO: 15134 - DNA, 22 bp, Homo sapiens
gccactctgaggctggcggcct

SEQ ID NO: 15135 - DNA, 20 bp, Homo sapiens
gagccctcggcgggctgcga

SEQ ID NO: 15136 - DNA, 20 bp, Homo sapiens
gagccctcggcgggctgcga

SEQ ID NO: 15137 - DNA, 21 bp, Homo sapiens
ccgcgcagcgcgagcgcctca

SEQ ID NO: 15138 - DNA, 21 bp, Homo sapiens
ccgcgcagcgcgagcgcctca

SEQ ID NO: 15139 - DNA, 21 bp, Homo sapiens
aactagaaaagtggcccagaa

SEQ ID NO: 15140 - DNA, 22 bp, Homo sapiens
gaaaagtggcccagaaacagca

SEQ ID NO: 15141 - DNA, 21 bp, Homo sapiens
ccgcgcagcgcgagcgcctca

SEQ ID NO: 15142 - DNA, 18 bp, Homo sapiens
cgcttagacaatgccccg

SEQ ID NO: 15143 - DNA, 21 bp, Homo sapiens
acctccccgggctgccggtgg

SEQ ID NO: 15144 - DNA, 21 bp, Homo sapiens
acctccccgggctgccggtgg

SEQ ID NO: 15145 - DNA, 21 bp, Homo sapiens
acctccccgggctgccggtgg

SEQ ID NO: 15146 - DNA, 21 bp, Homo sapiens
acctccccgggctgccggtgg

SEQ ID NO: 15147 - DNA, 21 bp, Homo sapiens
acctccccgggctgccggtgg

SEQ ID NO: 15148 - DNA, 19 bp, Homo sapiens
acagccaaattgcagaaga

SEQ ID NO: 15149 - DNA, 20 bp, Homo sapiens
acatttggctccactgtaaa

SEQ ID NO: 15150 - DNA, 19 bp, Homo sapiens
accactatcttttgttcta

SEQ ID NO: 15151 - DNA, 21 bp, Homo sapiens
ccagggcggccgggcgcccca

SEQ ID NO: 15152 - DNA, 20 bp, Homo sapiens
gattcaagtgcaatccatgt

SEQ ID NO: 15153 - DNA, 21 bp, Homo sapiens
gtagctggagagagagttctc

SEQ ID NO: 15154 - DNA, 21 bp, Homo sapiens
tcaaaagattaacaacactgc

SEQ ID NO: 15155 - DNA, 19 bp, Homo sapiens
acagccaaattgcagaaga

SEQ ID NO: 15156 - DNA, 20 bp, Homo sapiens
acatttggctccactgtaaa

SEQ ID NO: 15157 - DNA, 19 bp, Homo sapiens
accactatcttttgttcta

SEQ ID NO: 15158 - DNA, 21 bp, Homo sapiens
ccagggcggccgggcgcccca

SEQ ID NO: 15159 - DNA, 20 bp, Homo sapiens
gattcaagtgcaatccatgt

SEQ ID NO: 15160 - DNA, 21 bp, Homo sapiens
gtagctggagagagagttctc

SEQ ID NO: 15161 - DNA, 21 bp, Homo sapiens
tcaaaagattaacaacactgc

SEQ ID NO: 15162 - DNA, 21 bp, Homo sapiens
acttggatcttcccttggtcc

SEQ ID NO: 15163 - DNA, 22 bp, Homo sapiens
agaattgtagttcttagtccca

SEQ ID NO: 15164 - DNA, 17 bp, Homo sapiens
agagggagacagagatg

SEQ ID NO: 15165 - DNA, 24 bp, Homo sapiens
agttctctttcttagtccctaatc

SEQ ID NO: 15166 - DNA, 20 bp, Homo sapiens
cagcacagccttgatttcct

SEQ ID NO: 15167 - DNA, 21 bp, Homo sapiens
ccttcccccttacctccccca

SEQ ID NO: 15168 - DNA, 19 bp, Homo sapiens
gaaagaaacccacagaagg

SEQ ID NO: 15169 - DNA, 20 bp, Homo sapiens
gaatctggacatttgttcca

SEQ ID NO: 15170 - DNA, 18 bp, Homo sapiens
gagcaaaacattgggcca

SEQ ID NO: 15171 - DNA, 18 bp, Homo sapiens
ggcttaagtaccaatctc

SEQ ID NO: 15172 - DNA, 20 bp, Homo sapiens
tcaagacttctccaggccca

SEQ ID NO: 15173 - DNA, 23 bp, Homo sapiens
tctccttgatttttggtagtatc

SEQ ID NO: 15174 - DNA, 19 bp, Homo sapiens
tgcattgagaaggaactga

SEQ ID NO: 15175 - DNA, 19 bp, Homo sapiens
ttatcaccacccccctttt

SEQ ID NO: 15176 - DNA, 17 bp, Homo sapiens
ttctcccgttaaccagg

SEQ ID NO: 15177 - DNA, 20 bp, Homo sapiens
gagccctcggcgggctgcga

SEQ ID NO: 15178 - DNA, 19 bp, Homo sapiens
acctgggccccactggaca

SEQ ID NO: 15179 - DNA, 21 bp, Homo sapiens
tcagctatgactcagtcccct

SEQ ID NO: 15180 - DNA, 19 bp, Homo sapiens
acctgggccccactggaca

SEQ ID NO: 15181 - DNA, 21 bp, Homo sapiens
tcagctatgactcagtcccct

SEQ ID NO: 15182 - DNA, 21 bp, Homo sapiens
aggagaaagcaaaatacatca

SEQ ID NO: 15183 - DNA, 25 bp, Homo sapiens
gaaactccatcttcaaaacaaaaca

SEQ ID NO: 15184 - DNA, 17 bp, Homo sapiens
gaacaggggctggtatt

SEQ ID NO: 15185 - DNA, 17 bp, Homo sapiens
gagataattgcttgcca

SEQ ID NO: 15186 - DNA, 23 bp, Homo sapiens
tgggattatgtgcctcccattca

SEQ ID NO: 15187 - DNA, 19 bp, Homo sapiens
tgggtggatcacttgaggc

SEQ ID NO: 15188 - DNA, 18 bp, Homo sapiens
ctggacaccacctggcct

SEQ ID NO: 15189 - DNA, 20 bp, Homo sapiens
gactcttggatatgaaactg

SEQ ID NO: 15190 - DNA, 20 bp, Homo sapiens
atgaaaccttattttttcca

SEQ ID NO: 15191 - DNA, 22 bp, Homo sapiens
ccaactacaaccaagctctctg

SEQ ID NO: 15192 - DNA, 21 bp, Homo sapiens
ctacctccctgcaaccaacta

SEQ ID NO: 15193 - DNA, 23 bp, Homo sapiens
ggatgtgcttttctccaatatca

SEQ ID NO: 15194 - DNA, 20 bp, Homo sapiens
tctaaaagatcctttttaaa

SEQ ID NO: 15195 - DNA, 17 bp, Homo sapiens
tgaaggacacttcctgc

SEQ ID NO: 15196 - DNA, 19 bp, Homo sapiens
tgagcctggctggcacaga

SEQ ID NO: 15197 - DNA, 19 bp, Homo sapiens
acaaatgttacactagaca

SEQ ID NO: 15198 - DNA, 21 bp, Homo sapiens
atggctgtactggatatccca

SEQ ID NO: 15199 - DNA, 18 bp, Homo sapiens
ccagtatttccccttctc

SEQ ID NO: 15200 - DNA, 24 bp, Homo sapiens
ctggttcctccctgccccttgcca

SEQ ID NO: 15201 - DNA, 19 bp, Homo sapiens
agggcaagatcccatccca

SEQ ID NO: 15202 - DNA, 24 bp, Homo sapiens
ggcagaaggtgaccagccagctca

SEQ ID NO: 15203 - DNA, 20 bp, Homo sapiens
ggctaccaggaggctaagaa

SEQ ID NO: 15204 - DNA, 20 bp, Homo sapiens
gtgagccctgaaagctctgg

SEQ ID NO: 15205 - DNA, 20 bp, Homo sapiens
gtttcatgttgaacacagct

SEQ ID NO: 15206 - DNA, 19 bp, Homo sapiens
aagcaattctcctgcctca

SEQ ID NO: 15207 - DNA, 21 bp, Homo sapiens
acactctacctttagtgcaag

SEQ ID NO: 15208 - DNA, 21 bp, Homo sapiens
actacatgttatgtttcctga

SEQ ID NO: 15209 - DNA, 22 bp, Homo sapiens
atgtcatttgtctcccgcccta

SEQ ID NO: 15210 - DNA, 18 bp, Homo sapiens
ctcttacactagaatcct

SEQ ID NO: 15211 - DNA, 19 bp, Homo sapiens
gaattcacttgttctgtca

SEQ ID NO: 15212 - DNA, 18 bp, Homo sapiens
tcaaggctccacctcaga

SEQ ID NO: 15213 - DNA, 18 bp, Homo sapiens
tggatggagactgtgaac

SEQ ID NO: 15214 - DNA, 19 bp, Homo sapiens
tgtctatcagcacaactca

SEQ ID NO: 15215 - DNA, 21 bp, Homo sapiens
ttctgtttcaacaatcattac

SEQ ID NO: 15216 - DNA, 17 bp, Homo sapiens
tttgatacttgacagtg

SEQ ID NO: 15217 - DNA, 20 bp, Homo sapiens
tttttgttatgtggtttata

SEQ ID NO: 15218 - DNA, 16 bp, Homo sapiens
acacttagtgagaagg

SEQ ID NO: 15219 - DNA, 16 bp, Homo sapiens
catgtcatcttttcca

SEQ ID NO: 15220 - DNA, 19 bp, Homo sapiens
gaatttttgtaaactctgg

SEQ ID NO: 15221 - DNA, 20 bp, Homo sapiens
ggaatagtctcttctcttca

SEQ ID NO: 15222 - DNA, 19 bp, Homo sapiens
tatgattgtgccactgcac

SEQ ID NO: 15223 - DNA, 18 bp, Homo sapiens
tgggtggatcacctgagg

SEQ ID NO: 15224 - DNA, 21 bp, Homo sapiens
cacctaagtctatattcactg

SEQ ID NO: 15225 - DNA, 22 bp, Homo sapiens
cgaatccactctcatgtctttt

SEQ ID NO: 15226 - DNA, 20 bp, Homo sapiens
gctctacatcttatcagtca

SEQ ID NO: 15227 - DNA, 22 bp, Homo sapiens
gctgcaatgtagtcttgtgtgt

SEQ ID NO: 15228 - DNA, 18 bp, Homo sapiens
ggttataacagaaaactg

SEQ ID NO: 15229 - DNA, 25 bp, Homo sapiens
gtgctctgtaccactggtgagtgct

SEQ ID NO: 15230 - DNA, 23 bp, Homo sapiens
tacctgctgttacttattcagat

SEQ ID NO: 15231 - DNA, 18 bp, Homo sapiens
tagagctacaggtgttca

SEQ ID NO: 15232 - DNA, 18 bp, Homo sapiens
tgaagatcatataccaaa

SEQ ID NO: 15233 - DNA, 20 bp, Homo sapiens
acaggaacccagccagagtt

SEQ ID NO: 15234 - DNA, 21 bp, Homo sapiens
cagctggttgggggcaccatc

SEQ ID NO: 15235 - DNA, 17 bp, Homo sapiens
tgcctccctgcacttca

SEQ ID NO: 15236 - DNA, 17 bp, Homo sapiens
agttcagtaataagcta

SEQ ID NO: 15237 - DNA, 19 bp, Homo sapiens
tgggtcaagcagcgcccca

SEQ ID NO: 15238 - DNA, 24 bp, Homo sapiens
acattagtggatatactcatagta

SEQ ID NO: 15239 - DNA, 19 bp, Homo sapiens
agtgcctaaccctgcttgt

SEQ ID NO: 15240 - DNA, 21 bp, Homo sapiens
atcaacactactaacattaca

SEQ ID NO: 15241 - DNA, 21 bp, Homo sapiens
cattaagagtgtcttatgaga

SEQ ID NO: 15242 - DNA, 18 bp, Homo sapiens
ggatttttgttgtttttg

SEQ ID NO: 15243 - DNA, 17 bp, Homo sapiens
tactgcctaccttagct

SEQ ID NO: 15244 - DNA, 18 bp, Homo sapiens
tagccatgatagatgatg

SEQ ID NO: 15245 - DNA, 22 bp, Homo sapiens
tctgagttgtttgtttggactt

SEQ ID NO: 15246 - DNA, 17 bp, Homo sapiens
ttaaagtaaatctctta

SEQ ID NO: 15247 - DNA, 18 bp, Homo sapiens
atgaccctgaaatgactg

SEQ ID NO: 15248 - DNA, 19 bp, Homo sapiens
cgtgtgtgtggctaaatta

SEQ ID NO: 15249 - DNA, 21 bp, Homo sapiens
ctttgctgggaagactgtgag

SEQ ID NO: 15250 - DNA, 21 bp, Homo sapiens
tcattttgattttacaaataa

SEQ ID NO: 15251 - DNA, 17 bp, Homo sapiens
agtagcttaattacccc

SEQ ID NO: 15252 - DNA, 24 bp, Homo sapiens
tctagtttccctagagtcattttt

SEQ ID NO: 15253 - DNA, 18 bp, Homo sapiens
tttccaggcatagcaatg

SEQ ID NO: 15254 - DNA, 19 bp, Homo sapiens
tttggcaatttataattta

SEQ ID NO: 15255 - DNA, 21 bp, Homo sapiens
acctgagcctggggctggctc

SEQ ID NO: 15256 - DNA, 17 bp, Homo sapiens
aggccagcacccaccat

SEQ ID NO: 15257 - DNA, 18 bp, Homo sapiens
gtgcccccgcgtgcctgc

SEQ ID NO: 15258 - DNA, 19 bp, Homo sapiens
tccaagtggggcagctctc

SEQ ID NO: 15259 - DNA, 20 bp, Homo sapiens
tccccaccccaacagagcca

SEQ ID NO: 15260 - DNA, 23 bp, Homo sapiens
ccctgagtagtgaggatctgcgg

SEQ ID NO: 15261 - DNA, 16 bp, Homo sapiens
tccgtggagagctgtg

SEQ ID NO: 15262 - DNA, 22 bp, Homo sapiens
gcggtttttttggtttgttgtt

SEQ ID NO: 15263 - DNA, 22 bp, Homo sapiens
ggtatcctaggtaagagcccct

SEQ ID NO: 15264 - DNA, 19 bp, Homo sapiens
aaagcatatatactaccta

SEQ ID NO: 15265 - DNA, 21 bp, Homo sapiens
agcaagtttcgaagtcacagt

SEQ ID NO: 15266 - DNA, 20 bp, Homo sapiens
caaggagtgaagcgcccacc

SEQ ID NO: 15267 - DNA, 21 bp, Homo sapiens
tgagattttctcagccagtga

SEQ ID NO: 15268 - DNA, 21 bp, Homo sapiens
aagagtagctctatttgtcca

SEQ ID NO: 15269 - DNA, 23 bp, Homo sapiens
gtgttattacctgcaggatatta

SEQ ID NO: 15270 - DNA, 23 bp, Homo sapiens
tgaggcaggaagcacactggagc

SEQ ID NO: 15271 - DNA, 17 bp, Homo sapiens
ggagacgaaggacgcat

SEQ ID NO: 15272 - DNA, 23 bp, Homo sapiens
caaggtcattacagctgcagtca

SEQ ID NO: 15273 - DNA, 22 bp, Homo sapiens
gctctggcctgggagctggcga

SEQ ID NO: 15274 - DNA, 18 bp, Homo sapiens
cagcactttgggaagcca

SEQ ID NO: 15275 - DNA, 18 bp, Homo sapiens
gtgcacactaccttccca

SEQ ID NO: 15276 - DNA, 17 bp, Homo sapiens
tcacttgtaccccacta

SEQ ID NO: 15277 - DNA, 18 bp, Homo sapiens
tctgtgctccccactcca

SEQ ID NO: 15278 - DNA, 20 bp, Homo sapiens
acaggatgcaaccacaacac

SEQ ID NO: 15279 - DNA, 25 bp, Homo sapiens
cgtctccaaagccaggattctgagg

SEQ ID NO: 15280 - DNA, 16 bp, Homo sapiens
gaatggagagcatgga

SEQ ID NO: 15281 - DNA, 22 bp, Homo sapiens
gacggtgatgacccagcagcaa

SEQ ID NO: 15282 - DNA, 19 bp, Homo sapiens
gactgccagaaaaccacca

SEQ ID NO: 15283 - DNA, 20 bp, Homo sapiens
gccaaggaacccaaggactg

SEQ ID NO: 15284 - DNA, 20 bp, Homo sapiens
ttctgaggaaagtcctgtgg

SEQ ID NO: 15285 - DNA, 17 bp, Homo sapiens
acaaaaacatttgccaa

SEQ ID NO: 15286 - DNA, 24 bp, Homo sapiens
agacccctgaatatttatatcagt

SEQ ID NO: 15287 - DNA, 19 bp, Homo sapiens
agtgatcccagcatcattt

SEQ ID NO: 15288 - DNA, 17 bp, Homo sapiens
ccttatgaagcactgct

SEQ ID NO: 15289 - DNA, 23 bp, Homo sapiens
ccttgaaaaattggaagatctgt

SEQ ID NO: 15290 - DNA, 18 bp, Homo sapiens
ctgatctatgtgtttgag

SEQ ID NO: 15291 - DNA, 24 bp, Homo sapiens
gttttggatgaccttccaaactta

SEQ ID NO: 15292 - DNA, 17 bp, Homo sapiens
tcaagtgattctcttgc

SEQ ID NO: 15293 - DNA, 18 bp, Homo sapiens
tccgtctcccaggttcaa

SEQ ID NO: 15294 - DNA, 18 bp, Homo sapiens
tctgtgtacctgcagcat

SEQ ID NO: 15295 - DNA, 17 bp, Homo sapiens
tgcaattattctttata

SEQ ID NO: 15296 - DNA, 22 bp, Homo sapiens
tttccctatgtataaccagtga

SEQ ID NO: 15297 - DNA, 22 bp, Homo sapiens
agggcagagcaaggacaacccc

SEQ ID NO: 15298 - DNA, 19 bp, Homo sapiens
atgggaccaggtggccata

SEQ ID NO: 15299 - DNA, 19 bp, Homo sapiens
ccctgtgtgcaccaaccta

SEQ ID NO: 15300 - DNA, 17 bp, Homo sapiens
tcaagtgattctcctgc

SEQ ID NO: 15301 - DNA, 19 bp, Homo sapiens
tcatactgtactctcccca

SEQ ID NO: 15302 - DNA, 18 bp, Homo sapiens
tttctcattgctgctcta

SEQ ID NO: 15303 - DNA, 22 bp, Homo sapiens
ccatgtcatgtatctcattata

SEQ ID NO: 15304 - DNA, 22 bp, Homo sapiens
gcacgtgtccagggacactgca

SEQ ID NO: 15305 - DNA, 20 bp, Homo sapiens
tttttccaccaagcgagata

SEQ ID NO: 15306 - DNA, 18 bp, Homo sapiens
agaaactccccttgtacc

SEQ ID NO: 15307 - DNA, 20 bp, Homo sapiens
cctaaaaagctgagctgtaa

SEQ ID NO: 15308 - DNA, 20 bp, Homo sapiens
ggaggaggaggctgggatcc

SEQ ID NO: 15309 - DNA, 22 bp, Homo sapiens
taacagtcttattctcattctt

SEQ ID NO: 15310 - DNA, 24 bp, Homo sapiens
tttcttcctgccgttcttagcttt

SEQ ID NO: 15311 - DNA, 23 bp, Homo sapiens
ctaaatataacttaaaaagtgaa

SEQ ID NO: 15312 - DNA, 22 bp, Homo sapiens
taaagactgcaattgaagataa

SEQ ID NO: 15313 - DNA, 18 bp, Homo sapiens
aaggctatctggctttaa

SEQ ID NO: 15314 - DNA, 19 bp, Homo sapiens
atgaatgccatcaatgtaa

SEQ ID NO: 15315 - DNA, 18 bp, Homo sapiens
gtcattcatactactgct

SEQ ID NO: 15316 - DNA, 21 bp, Homo sapiens
cagggttccctgggcccagtc

SEQ ID NO: 15317 - DNA, 21 bp, Homo sapiens
ccaaacagatatctaaacact

SEQ ID NO: 15318 - DNA, 26 bp, Homo sapiens
cctggtctggtctcagaatcactttt

SEQ ID NO: 15319 - DNA, 21 bp, Homo sapiens
gcttgatattcctcctctacc

SEQ ID NO: 15320 - DNA, 17 bp, Homo sapiens
ggcctgtttggctccga

SEQ ID NO: 15321 - DNA, 20 bp, Homo sapiens
ttcttccacccctttctggt

SEQ ID NO: 15322 - DNA, 22 bp, Homo sapiens
aaacccaaaacaaaacaaaaca

SEQ ID NO: 15323 - DNA, 19 bp, Homo sapiens
atcattgaaaagcgccctg

SEQ ID NO: 15324 - DNA, 18 bp, Homo sapiens
atttccttccgattacct

SEQ ID NO: 15325 - DNA, 19 bp, Homo sapiens
agctactcctggtccctca

SEQ ID NO: 15326 - DNA, 22 bp, Homo sapiens
gctatttgtgtttagtgtcaga

SEQ ID NO: 15327 - DNA, 28 bp, Homo sapiens
ttaagagtaatatatttaattttatcca

SEQ ID NO: 15328 - DNA, 20 bp, Homo sapiens
caacgcacatccgcctgtat

SEQ ID NO: 15329 - DNA, 20 bp, Homo sapiens
cccccaacccacagatacca

SEQ ID NO: 15330 - DNA, 20 bp, Homo sapiens
ttttgttacaggtacttcaa

SEQ ID NO: 15331 - DNA, 18 bp, Homo sapiens
agtgaaaaggataaatgg

SEQ ID NO: 15332 - DNA, 18 bp, Homo sapiens
cacttacaggaagactga

SEQ ID NO: 15333 - DNA, 20 bp, Homo sapiens
cctctgcctcctgggttcaa

SEQ ID NO: 15334 - DNA, 17 bp, Homo sapiens
gcgattcccctgcctca

SEQ ID NO: 15335 - DNA, 19 bp, Homo sapiens
ttcaagaccagatattcaa

SEQ ID NO: 15336 - DNA, 15 bp, Homo sapiens
ttcttctttttctca

SEQ ID NO: 15337 - DNA, 19 bp, Homo sapiens
catgctttggaaaagttta

SEQ ID NO: 15338 - DNA, 18 bp, Homo sapiens
tttggaggtactcccagt

SEQ ID NO: 15339 - DNA, 18 bp, Homo sapiens
gggggtggggttgaaata

SEQ ID NO: 15340 - DNA, 21 bp, Homo sapiens
taattccagagtactgtcctc

SEQ ID NO: 15341 - DNA, 29 bp, Homo sapiens
taggtctcccactttctaggatcattttt

SEQ ID NO: 15342 - DNA, 20 bp, Homo sapiens
tctgtgactggtgccataga

SEQ ID NO: 15343 - DNA, 22 bp, Homo sapiens
aaatccatatacacacgtagaa

SEQ ID NO: 15344 - DNA, 18 bp, Homo sapiens
aatgtgatattaaagact

SEQ ID NO: 15345 - DNA, 21 bp, Homo sapiens
atctagagtgttttacaaaat

SEQ ID NO: 15346 - DNA, 22 bp, Homo sapiens
aaaactattactaggctgataa

SEQ ID NO: 15347 - DNA, 17 bp, Homo sapiens
caagctactggatgcac

SEQ ID NO: 15348 - DNA, 16 bp, Homo sapiens
ccagccctgcctgtac

SEQ ID NO: 15349 - DNA, 17 bp, Homo sapiens
ccgtggaaataatgttt

SEQ ID NO: 15350 - DNA, 23 bp, Homo sapiens
cgagctgtggttaggcttggtta

SEQ ID NO: 15351 - DNA, 23 bp, Homo sapiens
ctaaagcagtactggactggcca

SEQ ID NO: 15352 - DNA, 21 bp, Homo sapiens
ctctttctctctctctctctc

SEQ ID NO: 15353 - DNA, 20 bp, Homo sapiens
ctgtacatacacatgcacac

SEQ ID NO: 15354 - DNA, 18 bp, Homo sapiens
gactatttgacaaccaca

SEQ ID NO: 15355 - DNA, 17 bp, Homo sapiens
ggaaaagagtatgccca

SEQ ID NO: 15356 - DNA, 19 bp, Homo sapiens
ggcagcaaagatgtctgtt

SEQ ID NO: 15357 - DNA, 19 bp, Homo sapiens
ggtcttgagacctgtgaac

SEQ ID NO: 15358 - DNA, 16 bp, Homo sapiens
tagtgttggtgtcttg

SEQ ID NO: 15359 - DNA, 19 bp, Homo sapiens
tcaatttagtcttctctca

SEQ ID NO: 15360 - DNA, 20 bp, Homo sapiens
tctagaatttgaaagggttt

SEQ ID NO: 15361 - DNA, 20 bp, Homo sapiens
tttttgggcaaaactactca

SEQ ID NO: 15362 - DNA, 15 bp, Homo sapiens
aaaaatgacatgtgt

SEQ ID NO: 15363 - DNA, 19 bp, Homo sapiens
agagatctattgtacttca

SEQ ID NO: 15364 - DNA, 21 bp, Homo sapiens
cactttcagtcaggtgtgcca

SEQ ID NO: 15365 - DNA, 21 bp, Homo sapiens
cttcttacataatatttatca

SEQ ID NO: 15366 - DNA, 22 bp, Homo sapiens
tccccaagtaaggtttttacca

SEQ ID NO: 15367 - DNA, 23 bp, Homo sapiens
tttaaattgttaatgtggtaagt

SEQ ID NO: 15368 - DNA, 20 bp, Homo sapiens
caacatctatctctgctgcc

SEQ ID NO: 15369 - DNA, 18 bp, Homo sapiens
ttggtgtgcgttcagaga

SEQ ID NO: 15370 - DNA, 18 bp, Homo sapiens
tatggactcaaaactctc

SEQ ID NO: 15371 - DNA, 24 bp, Homo sapiens
agaaaatttctgttcttgcacgtt

SEQ ID NO: 15372 - DNA, 24 bp, Homo sapiens
cctgcatccttctcccattcccca

SEQ ID NO: 15373 - DNA, 20 bp, Homo sapiens
cttcttgctctcctctcctc

SEQ ID NO: 15374 - DNA, 17 bp, Homo sapiens
gagaaggatagagaggt

SEQ ID NO: 15375 - DNA, 19 bp, Homo sapiens
gagtcctgatctggaactg

SEQ ID NO: 15376 - DNA, 19 bp, Homo sapiens
catcattgaaaaacatgga

SEQ ID NO: 15377 - DNA, 19 bp, Homo sapiens
ctgccatgccctgctctga

SEQ ID NO: 15378 - DNA, 23 bp, Homo sapiens
taaatgacattaacttgaaatta

SEQ ID NO: 15379 - DNA, 21 bp, Homo sapiens
agctctttctctatttactga

SEQ ID NO: 15380 - DNA, 22 bp, Homo sapiens
taaatggacctctgtacggctg

SEQ ID NO: 15381 - DNA, 21 bp, Homo sapiens
tctgctgggtgccttgacctt

SEQ ID NO: 15382 - DNA, 23 bp, Homo sapiens
ttgctatggtctgaatatttgtg

SEQ ID NO: 15383 - DNA, 21 bp, Homo sapiens
ctgctatgttttgttatgcag

SEQ ID NO: 15384 - DNA, 16 bp, Homo sapiens
aggctggtttacagtc

SEQ ID NO: 15385 - DNA, 22 bp, Homo sapiens
atcttggctcactgcaacctct

SEQ ID NO: 15386 - DNA, 20 bp, Homo sapiens
cctctgtctcccaggttcag

SEQ ID NO: 15387 - DNA, 18 bp, Homo sapiens
cctgcaacctccacctcc

SEQ ID NO: 15388 - DNA, 18 bp, Homo sapiens
ctgtcccaccctacctgc

SEQ ID NO: 15389 - DNA, 25 bp, Homo sapiens
cttctaatgaaaacttggtcatctt

SEQ ID NO: 15390 - DNA, 18 bp, Homo sapiens
tcctgacctcatgatcca

SEQ ID NO: 15391 - DNA, 21 bp, Homo sapiens
tttcacttatgtaccattttt

SEQ ID NO: 15392 - DNA, 17 bp, Homo sapiens
acattttcatctcccca

SEQ ID NO: 15393 - DNA, 21 bp, Homo sapiens
actttagaaaattgttgacat

SEQ ID NO: 15394 - DNA, 22 bp, Homo sapiens
cccatcactttgggaggccaga

SEQ ID NO: 15395 - DNA, 21 bp, Homo sapiens
tggatggatcacctgagcctg

SEQ ID NO: 15396 - DNA, 17 bp, Homo sapiens
aaaaacaaacaaacaaa

SEQ ID NO: 15397 - DNA, 22 bp, Homo sapiens
gagccaagatcacgccactgca

SEQ ID NO: 15398 - DNA, 20 bp, Homo sapiens
ttcaagaccagcctgaccaa

SEQ ID NO: 15399 - DNA, 19 bp, Homo sapiens
tattaagaaattatccagt

SEQ ID NO: 15400 - DNA, 23 bp, Homo sapiens
aaggaatgacctgaaacattttt

SEQ ID NO: 15401 - DNA, 18 bp, Homo sapiens
atgccgtaatgtcattat

SEQ ID NO: 15402 - DNA, 16 bp, Homo sapiens
gtgacagtagttgtca

SEQ ID NO: 15403 - DNA, 22 bp, Homo sapiens
gcacccgccctgtgacgctcca

SEQ ID NO: 15404 - DNA, 25 bp, Homo sapiens
aaatgcaatgtgctgccctgagatc

SEQ ID NO: 15405 - DNA, 18 bp, Homo sapiens
cccgggatctccatctct

SEQ ID NO: 15406 - DNA, 20 bp, Homo sapiens
ctgtgcttttgcaccattga

SEQ ID NO: 15407 - DNA, 21 bp, Homo sapiens
ggacacgtgggagtcctccca

SEQ ID NO: 15408 - DNA, 23 bp, Homo sapiens
tgagaagcagcactaggcctgtt

SEQ ID NO: 15409 - DNA, 22 bp, Homo sapiens
gagccaagatcgtgtcactgca

SEQ ID NO: 15410 - DNA, 20 bp, Homo sapiens
gcctacctcatagcttcaca

SEQ ID NO: 15411 - DNA, 21 bp, Homo sapiens
gcctctgagctccaggggtca

SEQ ID NO: 15412 - DNA, 20 bp, Homo sapiens
accctgcttcatactcttga

SEQ ID NO: 15413 - DNA, 20 bp, Homo sapiens
aggtattacttctgcactta

SEQ ID NO: 15414 - DNA, 21 bp, Homo sapiens
atctggggttcctgactgata

SEQ ID NO: 15415 - DNA, 19 bp, Homo sapiens
atgcctccaaacaacactg

SEQ ID NO: 15416 - DNA, 19 bp, Homo sapiens
atggacacccttaatttta

SEQ ID NO: 15417 - DNA, 20 bp, Homo sapiens
cacattataccctgctctta

SEQ ID NO: 15418 - DNA, 21 bp, Homo sapiens
ccgcccaagctctcagtgcct

SEQ ID NO: 15419 - DNA, 24 bp, Homo sapiens
gcaaagagaacctattatttgcca

SEQ ID NO: 15420 - DNA, 18 bp, Homo sapiens
ggaaacatcttctgtgta

SEQ ID NO: 15421 - DNA, 16 bp, Homo sapiens
tctctggtagtttttc

SEQ ID NO: 15422 - DNA, 17 bp, Homo sapiens
tctttcttctaaaacgg

SEQ ID NO: 15423 - DNA, 18 bp, Homo sapiens
tgtgacacaatcctaata

SEQ ID NO: 15424 - DNA, 22 bp, Homo sapiens
ggttgtgaatgatttcttttga

SEQ ID NO: 15425 - DNA, 21 bp, Homo sapiens
atatctcaaacaccagcatca

SEQ ID NO: 15426 - DNA, 23 bp, Homo sapiens
catccccggacacctggtctaca

SEQ ID NO: 15427 - DNA, 16 bp, Homo sapiens
tccccccaccacctca

SEQ ID NO: 15428 - DNA, 24 bp, Homo sapiens
tgctgttccagatatgactactga

SEQ ID NO: 15429 - DNA, 22 bp, Homo sapiens
agaaactatagctgaggactaa

SEQ ID NO: 15430 - DNA, 21 bp, Homo sapiens
atggaaaagtgttgcctgcca

SEQ ID NO: 15431 - DNA, 15 bp, Homo sapiens
gctctatttttcagc

SEQ ID NO: 15432 - DNA, 21 bp, Homo sapiens
taacagtccttggaccattct

SEQ ID NO: 15433 - DNA, 24 bp, Homo sapiens
atctccatgaatcctagttaggga

SEQ ID NO: 15434 - DNA, 18 bp, Homo sapiens
ctagctctctgtcttgat

SEQ ID NO: 15435 - DNA, 21 bp, Homo sapiens
acctggcacagtgcctggcct

SEQ ID NO: 15436 - DNA, 22 bp, Homo sapiens
atttgaaagctgtgtaactcca

SEQ ID NO: 15437 - DNA, 20 bp, Homo sapiens
aagtctgatctgtataccca

SEQ ID NO: 15438 - DNA, 16 bp, Homo sapiens
agctcctcttcccaca

SEQ ID NO: 15439 - DNA, 18 bp, Homo sapiens
gtaaaagatgggtgtgaa

SEQ ID NO: 15440 - DNA, 16 bp, Homo sapiens
tcttcccacagccagg

SEQ ID NO: 15441 - DNA, 21 bp, Homo sapiens
atgttccatagattatgtcat

SEQ ID NO: 15442 - DNA, 18 bp, Homo sapiens
atgtttcccagcagttta

SEQ ID NO: 15443 - DNA, 18 bp, Homo sapiens
cagccatgtctctgcgta

SEQ ID NO: 15444 - DNA, 19 bp, Homo sapiens
ggtctagaataggttggca

SEQ ID NO: 15445 - DNA, 22 bp, Homo sapiens
tctgaattgtgattcccagttc

SEQ ID NO: 15446 - DNA, 20 bp, Homo sapiens
tggcaaactagtctgtgagc

SEQ ID NO: 15447 - DNA, 19 bp, Homo sapiens
aagcaattctcccacctca

SEQ ID NO: 15448 - DNA, 19 bp, Homo sapiens
aagcgattctcctacctca

SEQ ID NO: 15449 - DNA, 17 bp, Homo sapiens
atcctaccttcccccac

SEQ ID NO: 15450 - DNA, 19 bp, Homo sapiens
cattcagcaaaagccctga

SEQ ID NO: 15451 - DNA, 21 bp, Homo sapiens
cctggcacacagcaaacactc

SEQ ID NO: 15452 - DNA, 21 bp, Homo sapiens
ctctttctctctttctttctc

SEQ ID NO: 15453 - DNA, 19 bp, Homo sapiens
gaaatcaacatctttgaaa

SEQ ID NO: 15454 - DNA, 18 bp, Homo sapiens
gtataagggttgtacaga

SEQ ID NO: 15455 - DNA, 18 bp, Homo sapiens
tcctgacctcatgatcca

SEQ ID NO: 15456 - DNA, 22 bp, Homo sapiens
tggcagccccagtgtgcaacta

SEQ ID NO: 15457 - DNA, 20 bp, Homo sapiens
tgtccccaaggctggagtgc

SEQ ID NO: 15458 - DNA, 21 bp, Homo sapiens
aggacacattaggattggtca

SEQ ID NO: 15459 - DNA, 21 bp, Homo sapiens
tgctttgatccactaatgcta

SEQ ID NO: 15460 - DNA, 16 bp, Homo sapiens
acccgtattgtggaca

SEQ ID NO: 15461 - DNA, 17 bp, Homo sapiens
gaggtctaggcttggtc

SEQ ID NO: 15462 - DNA, 15 bp, Homo sapiens
catactgagataggg

SEQ ID NO: 15463 - DNA, 20 bp, Homo sapiens
cgtttttgcctaacacccca

SEQ ID NO: 15464 - DNA, 23 bp, Homo sapiens
caagcagtgattagtttcagtca

SEQ ID NO: 15465 - DNA, 19 bp, Homo sapiens
acaacctttcccagactcc

SEQ ID NO: 15466 - DNA, 19 bp, Homo sapiens
atcactctcctccatagca

SEQ ID NO: 15467 - DNA, 17 bp, Homo sapiens
ccttctcttattctcca

SEQ ID NO: 15468 - DNA, 18 bp, Homo sapiens
gggctcctgggcccagtc

SEQ ID NO: 15469 - DNA, 23 bp, Homo sapiens
tccttaaccgtggactcttcctt

SEQ ID NO: 15470 - DNA, 18 bp, Homo sapiens
tgggtctctggattcctg

SEQ ID NO: 15471 - DNA, 19 bp, Homo sapiens
cccactgaggcccctactg

SEQ ID NO: 15472 - DNA, 20 bp, Homo sapiens
ggaggaggaagcccatagac

SEQ ID NO: 15473 - DNA, 23 bp, Homo sapiens
tccttaaccgtggactcttcctt

SEQ ID NO: 15474 - DNA, 18 bp, Homo sapiens
tgggtctctggattcctg

SEQ ID NO: 15475 - DNA, 19 bp, Homo sapiens
tgcattcttacattagtta

SEQ ID NO: 15476 - DNA, 19 bp, Homo sapiens
cccctccccaaccccctca

SEQ ID NO: 15477 - DNA, 20 bp, Homo sapiens
agaaaagaagtggtttatca

SEQ ID NO: 15478 - DNA, 19 bp, Homo sapiens
ccagtggcagatcccctgt

SEQ ID NO: 15479 - DNA, 19 bp, Homo sapiens
tcattctgtcattgctgct

SEQ ID NO: 15480 - DNA, 19 bp, Homo sapiens
ttcccccactatgcatatc

SEQ ID NO: 15481 - DNA, 22 bp, Homo sapiens
gcctgtgggcgatttcctccgg

SEQ ID NO: 15482 - DNA, 21 bp, Homo sapiens
ggaagtggcggcggcggcggc

SEQ ID NO: 15483 - DNA, 19 bp, Homo sapiens
aagaaacagaagtttagca

SEQ ID NO: 15484 - DNA, 16 bp, Homo sapiens
attcacctgcctttcc

SEQ ID NO: 15485 - DNA, 22 bp, Homo sapiens
cagaagtttagcaagggtcatg

SEQ ID NO: 15486 - DNA, 21 bp, Homo sapiens
cccagggtgggagacctggaa

SEQ ID NO: 15487 - DNA, 20 bp, Homo sapiens
gggggcggcagggaggcggc

SEQ ID NO: 15488 - DNA, 20 bp, Homo sapiens
gggtcatgaagaatactgca

SEQ ID NO: 15489 - DNA, 18 bp, Homo sapiens
tctacccggaggagcgct

SEQ ID NO: 15490 - DNA, 21 bp, Homo sapiens
tctccctggaccacttccggt

SEQ ID NO: 15491 - DNA, 20 bp, Homo sapiens
ttcttacctcccagctacct

SEQ ID NO: 15492 - DNA, 19 bp, Homo sapiens
acagctgctacccccaaga

SEQ ID NO: 15493 - DNA, 21 bp, Homo sapiens
atgaaattaaaatattaaata

SEQ ID NO: 15494 - DNA, 16 bp, Homo sapiens
ctctgggaacagctgc

SEQ ID NO: 15495 - DNA, 20 bp, Homo sapiens
gcgttcagggcctgacggtt

SEQ ID NO: 15496 - DNA, 19 bp, Homo sapiens
cccacccacttctgcactt

SEQ ID NO: 15497 - DNA, 20 bp, Homo sapiens
gcccaccccacccacttctg

SEQ ID NO: 15498 - DNA, 23 bp, Homo sapiens
aaccagagtcaagatttgaaata

SEQ ID NO: 15499 - DNA, 19 bp, Homo sapiens
agaaaggcagcccatttta

SEQ ID NO: 15500 - DNA, 17 bp, Homo sapiens
ggaatagatccgattca

SEQ ID NO: 15501 - DNA, 18 bp, Homo sapiens
tcgccttgtttccatggg

SEQ ID NO: 15502 - DNA, 19 bp, Homo sapiens
tgaagccagccaatgtgtt

SEQ ID NO: 15503 - DNA, 18 bp, Homo sapiens
aaacacacgaagcataat

SEQ ID NO: 15504 - DNA, 24 bp, Homo sapiens
agaactatcttatgggatatttta

SEQ ID NO: 15505 - DNA, 18 bp, Homo sapiens
caaagaaggctaatgtca

SEQ ID NO: 15506 - DNA, 20 bp, Homo sapiens
tgaggctttggcagaaatta

SEQ ID NO: 15507 - DNA, 21 bp, Homo sapiens
tggatgtataacatgaagctg

SEQ ID NO: 15508 - DNA, 20 bp, Homo sapiens
aagagataagtgcatcatga

SEQ ID NO: 15509 - DNA, 23 bp, Homo sapiens
gagatgcatgctttgttctgtgc

SEQ ID NO: 15510 - DNA, 20 bp, Homo sapiens
tgtgttggtcgctctctgaa

SEQ ID NO: 15511 - DNA, 18 bp, Homo sapiens
ttttgttctgcattgact

SEQ ID NO: 15512 - DNA, 20 bp, Homo sapiens
ccgtcaccccacacaggctg

SEQ ID NO: 15513 - DNA, 17 bp, Homo sapiens
cctcctgccaattctct

SEQ ID NO: 15514 - DNA, 16 bp, Homo sapiens
ctccccatgcccaggg

SEQ ID NO: 15515 - DNA, 22 bp, Homo sapiens
gacacaaaggtcttggttctcc

SEQ ID NO: 15516 - DNA, 16 bp, Homo sapiens
gggccagcaccgctga

SEQ ID NO: 15517 - DNA, 23 bp, Homo sapiens
gtatatatattgcattcgtgctg

SEQ ID NO: 15518 - DNA, 23 bp, Homo sapiens
tgaggtcactgtggggcacggtt

SEQ ID NO: 15519 - DNA, 19 bp, Homo sapiens
tgtatatatattgcattcg

SEQ ID NO: 15520 - DNA, 20 bp, Homo sapiens
ttaccaaaaaacaactgtca

SEQ ID NO: 15521 - DNA, 16 bp, Homo sapiens
acacagtatcattcca

SEQ ID NO: 15522 - DNA, 23 bp, Homo sapiens
gaagaaattgccctggcactttt

SEQ ID NO: 15523 - DNA, 25 bp, Homo sapiens
aaattccaaaactgctcatatgatg

SEQ ID NO: 15524 - DNA, 18 bp, Homo sapiens
aaatactgtgtctaaaga

SEQ ID NO: 15525 - DNA, 23 bp, Homo sapiens
agaaatttcagtggtctatcatt

SEQ ID NO: 15526 - DNA, 24 bp, Homo sapiens
cactgaccaaccaaccaaactcca

SEQ ID NO: 15527 - DNA, 16 bp, Homo sapiens
gatgtagggtctgctt

SEQ ID NO: 15528 - DNA, 21 bp, Homo sapiens
tagacttggggatggacagct

SEQ ID NO: 15529 - DNA, 18 bp, Homo sapiens
tgaactgaaattgtgcca

SEQ ID NO: 15530 - DNA, 24 bp, Homo sapiens
gccctgggagcagaggtggagcga

SEQ ID NO: 15531 - DNA, 17 bp, Homo sapiens
aataggaccgccccctc

SEQ ID NO: 15532 - DNA, 19 bp, Homo sapiens
ccacctggtactgttccag

SEQ ID NO: 15533 - DNA, 20 bp, Homo sapiens
ccagtatgttttacagatta

SEQ ID NO: 15534 - DNA, 20 bp, Homo sapiens
gtgcacctgcagtggtttaa

SEQ ID NO: 15535 - DNA, 19 bp, Homo sapiens
agaatacaagtagcattgc

SEQ ID NO: 15536 - DNA, 21 bp, Homo sapiens
caagatcacaggagccactgc

SEQ ID NO: 15537 - DNA, 19 bp, Homo sapiens
cagatgaatatttaactca

SEQ ID NO: 15538 - DNA, 17 bp, Homo sapiens
ctctactaaacatgcaa

SEQ ID NO: 15539 - DNA, 20 bp, Homo sapiens
gtctcggaaacacagagcca

SEQ ID NO: 15540 - DNA, 20 bp, Homo sapiens
gaggaacatatgcctgagaa

SEQ ID NO: 15541 - DNA, 17 bp, Homo sapiens
tctcaccagtatttgct

SEQ ID NO: 15542 - DNA, 22 bp, Homo sapiens
agatggagttataactgtcata

SEQ ID NO: 15543 - DNA, 19 bp, Homo sapiens
acagaaaaatctatgactc

SEQ ID NO: 15544 - DNA, 19 bp, Homo sapiens
aggatttcagggcccagca

SEQ ID NO: 15545 - DNA, 24 bp, Homo sapiens
caccactgccaccacccctctttt

SEQ ID NO: 15546 - DNA, 15 bp, Homo sapiens
cattcatccaacttc

SEQ ID NO: 15547 - DNA, 22 bp, Homo sapiens
cccaccccggctgctcttgaca

SEQ ID NO: 15548 - DNA, 19 bp, Homo sapiens
ctccttgtcattgacctta

SEQ ID NO: 15549 - DNA, 24 bp, Homo sapiens
ttctagaataaagaattttccctc

SEQ ID NO: 15550 - DNA, 18 bp, Homo sapiens
aaaccctttttttgcttc

SEQ ID NO: 15551 - DNA, 18 bp, Homo sapiens
agtccagtgcctggaact

SEQ ID NO: 15552 - DNA, 17 bp, Homo sapiens
ctctccttttctatctg

SEQ ID NO: 15553 - DNA, 24 bp, Homo sapiens
cttattttttaagaattattctta

SEQ ID NO: 15554 - DNA, 18 bp, Homo sapiens
gatttttctgaatacgca

SEQ ID NO: 15555 - DNA, 23 bp, Homo sapiens
tagggaagatctgtatggaatta

SEQ ID NO: 15556 - DNA, 19 bp, Homo sapiens
tgcaggggtgggggcgggt

SEQ ID NO: 15557 - DNA, 16 bp, Homo sapiens
aaaggcaaactttgta

SEQ ID NO: 15558 - DNA, 20 bp, Homo sapiens
cgccggccggccagcaccca

SEQ ID NO: 15559 - DNA, 21 bp, Homo sapiens
gtgagcacacagagcagcatc

SEQ ID NO: 15560 - DNA, 17 bp, Homo sapiens
agcctgggtggcagatg

SEQ ID NO: 15561 - DNA, 18 bp, Homo sapiens
aggtgtggcttctggcct

SEQ ID NO: 15562 - DNA, 18 bp, Homo sapiens
ctcccctgaaatgctttt

SEQ ID NO: 15563 - DNA, 18 bp, Homo sapiens
cttttccctgctgcctct

SEQ ID NO: 15564 - DNA, 19 bp, Homo sapiens
tctgacctggggtctgggg

SEQ ID NO: 15565 - DNA, 26 bp, Homo sapiens
ttttttcagatactgtgcttgatttt

SEQ ID NO: 15566 - DNA, 20 bp, Homo sapiens
caccaccaccaccaccactc

SEQ ID NO: 15567 - DNA, 18 bp, Homo sapiens
cctcccaatccaagtagc

SEQ ID NO: 15568 - DNA, 22 bp, Homo sapiens
gatgagagaattcatccagaca

SEQ ID NO: 15569 - DNA, 19 bp, Homo sapiens
gcgcacgaactaccattca

SEQ ID NO: 15570 - DNA, 21 bp, Homo sapiens
tcaccaccatcatcacctccg

SEQ ID NO: 15571 - DNA, 20 bp, Homo sapiens
tcacccagcagccagagccg

SEQ ID NO: 15572 - DNA, 19 bp, Homo sapiens
accggggccccgctggcca

SEQ ID NO: 15573 - DNA, 20 bp, Homo sapiens
actcatctcttgctgacggt

SEQ ID NO: 15574 - DNA, 19 bp, Homo sapiens
ccccacccttgcccccagc

SEQ ID NO: 15575 - DNA, 19 bp, Homo sapiens
cctggactgcctctcgcct

SEQ ID NO: 15576 - DNA, 22 bp, Homo sapiens
gagggcctggacccagatctcc

SEQ ID NO: 15577 - DNA, 18 bp, Homo sapiens
tcccatgcacttgcccaa

SEQ ID NO: 15578 - DNA, 27 bp, Homo sapiens
tggagggtcagccccaacagggagctg

SEQ ID NO: 15579 - DNA, 17 bp, Homo sapiens
tggtcctaagaatggga

SEQ ID NO: 15580 - DNA, 18 bp, Homo sapiens
tgtcggaccttcacttca

SEQ ID NO: 15581 - DNA, 21 bp, Homo sapiens
ttgagacgttcatttaatgaa

SEQ ID NO: 15582 - DNA, 21 bp, Homo sapiens
acgctcaaccccaagtccttt

SEQ ID NO: 15583 - DNA, 24 bp, Homo sapiens
acttggaccgcttcagcctgggct

SEQ ID NO: 15584 - DNA, 23 bp, Homo sapiens
aggtgtccctcccctgctagtca

SEQ ID NO: 15585 - DNA, 22 bp, Homo sapiens
cctgctgagacctaggttgcca

SEQ ID NO: 15586 - DNA, 23 bp, Homo sapiens
gccacccagctggacacgggaga

SEQ ID NO: 15587 - DNA, 18 bp, Homo sapiens
gttcttccccctccatgt

SEQ ID NO: 15588 - DNA, 19 bp, Homo sapiens
tcatcatactggcactgtt

SEQ ID NO: 15589 - DNA, 25 bp, Homo sapiens
acaaaagacaatgtgctttatgtta

SEQ ID NO: 15590 - DNA, 19 bp, Homo sapiens
attcaggtggataaatagt

SEQ ID NO: 15591 - DNA, 23 bp, Homo sapiens
ctatgaatgaaaaaaatatttta

SEQ ID NO: 15592 - DNA, 18 bp, Homo sapiens
tcacttgtgtcaccagct

SEQ ID NO: 15593 - DNA, 23 bp, Homo sapiens
tgctttctactatatctttcagc

SEQ ID NO: 15594 - DNA, 18 bp, Homo sapiens
agtgggtggaagtccggt

SEQ ID NO: 15595 - DNA, 18 bp, Homo sapiens
tctttttctgggactttg

SEQ ID NO: 15596 - DNA, 19 bp, Homo sapiens
tgggtgggtggcatctcct

SEQ ID NO: 15597 - DNA, 21 bp, Homo sapiens
ctttaattcttttgttccaaa

SEQ ID NO: 15598 - DNA, 18 bp, Homo sapiens
acccccagcacacacaca

SEQ ID NO: 15599 - DNA, 20 bp, Homo sapiens
cacacctcctagaccacgcc

SEQ ID NO: 15600 - DNA, 23 bp, Homo sapiens
ccacttagaccacgcccacctcc

SEQ ID NO: 15601 - DNA, 23 bp, Homo sapiens
ccacttagaccacgcccacctcc

SEQ ID NO: 15602 - DNA, 19 bp, Homo sapiens
ccccacccactgcctgagc

SEQ ID NO: 15603 - DNA, 18 bp, Homo sapiens
ccccagctgcgcctgaca

SEQ ID NO: 15604 - DNA, 19 bp, Homo sapiens
cctaaggaaccttagtgat

SEQ ID NO: 15605 - DNA, 21 bp, Homo sapiens
cgcccctgctgccccaccacc

SEQ ID NO: 15606 - DNA, 24 bp, Homo sapiens
gaaggccagatgagaaaggtctcc

SEQ ID NO: 15607 - DNA, 25 bp, Homo sapiens
gcccacctcctgaccgcgttcctca

SEQ ID NO: 15608 - DNA, 20 bp, Homo sapiens
acttctaaggtcacgtttac

SEQ ID NO: 15609 - DNA, 22 bp, Homo sapiens
caaccaaaaatctattgtggta

SEQ ID NO: 15610 - DNA, 16 bp, Homo sapiens
ccagccaccttgtaaa

SEQ ID NO: 15611 - DNA, 22 bp, Homo sapiens
gtgtcaaatgttaaatgaaata

SEQ ID NO: 15612 - DNA, 22 bp, Homo sapiens
tcttgttgtctcttcctcttca

SEQ ID NO: 15613 - DNA, 21 bp, Homo sapiens
tttctttgtagttgttctgat

SEQ ID NO: 15614 - DNA, 19 bp, Homo sapiens
ctccgtccggcctcatttc

SEQ ID NO: 15615 - DNA, 19 bp, Homo sapiens
gtgtgggcattgttggtta

SEQ ID NO: 15616 - DNA, 22 bp, Homo sapiens
ccaagaagtgtttggataacca

SEQ ID NO: 15617 - DNA, 20 bp, Homo sapiens
ctgttgcaagagtgaatgta

SEQ ID NO: 15618 - DNA, 18 bp, Homo sapiens
ggcacattgttgcagcaa

SEQ ID NO: 15619 - DNA, 19 bp, Homo sapiens
tgggtttgcagcatgaact

SEQ ID NO: 15620 - DNA, 22 bp, Homo sapiens
gcatcttacagattttacttca

SEQ ID NO: 15621 - DNA, 18 bp, Homo sapiens
tgggtggatcacctgagg

SEQ ID NO: 15622 - DNA, 22 bp, Homo sapiens
agctcagctgttgaggacaccc

SEQ ID NO: 15623 - DNA, 22 bp, Homo sapiens
agtgaccccaatcctataccca

SEQ ID NO: 15624 - DNA, 20 bp, Homo sapiens
caggggcagaaaacactaca

SEQ ID NO: 15625 - DNA, 22 bp, Homo sapiens
ccccactccaactccttctcca

SEQ ID NO: 15626 - DNA, 19 bp, Homo sapiens
ggaagccagaagcatccca

SEQ ID NO: 15627 - DNA, 17 bp, Homo sapiens
tccttctccaccaccca

SEQ ID NO: 15628 - DNA, 20 bp, Homo sapiens
caaactaattctgattgtgt

SEQ ID NO: 15629 - DNA, 20 bp, Homo sapiens
caaccagcgataggccacat

SEQ ID NO: 15630 - DNA, 20 bp, Homo sapiens
gtagctttgttttcctttgt

SEQ ID NO: 15631 - DNA, 18 bp, Homo sapiens
aaaaattacaccagagag

SEQ ID NO: 15632 - DNA, 20 bp, Homo sapiens
aacttctgtcttttaagcca

SEQ ID NO: 15633 - DNA, 17 bp, Homo sapiens
catcatcacggggtgaa

SEQ ID NO: 15634 - DNA, 17 bp, Homo sapiens
gaggtctgggcccagcg

SEQ ID NO: 15635 - DNA, 21 bp, Homo sapiens
ggagaccctgggagctgtggc

SEQ ID NO: 15636 - DNA, 20 bp, Homo sapiens
gtcctgagcactttgcaaga

SEQ ID NO: 15637 - DNA, 23 bp, Homo sapiens
gttcaagagaacccacccagaga

SEQ ID NO: 15638 - DNA, 19 bp, Homo sapiens
taccacagaatatcactgt

SEQ ID NO: 15639 - DNA, 18 bp, Homo sapiens
aaagctttttcagttcct

SEQ ID NO: 15640 - DNA, 18 bp, Homo sapiens
accttgactgccaggccc

SEQ ID NO: 15641 - DNA, 17 bp, Homo sapiens
atgaccctgagatcgtg

SEQ ID NO: 15642 - DNA, 18 bp, Homo sapiens
tgacctcaagctcagcta

SEQ ID NO: 15643 - DNA, 19 bp, Homo sapiens
tgcagctgctgcagcaggg

SEQ ID NO: 15644 - DNA, 24 bp, Homo sapiens
aaaatatctcttcagatgaaactg

SEQ ID NO: 15645 - DNA, 18 bp, Homo sapiens
gtaatcatatctacatgc

SEQ ID NO: 15646 - DNA, 23 bp, Homo sapiens
tatagaaagtgaatatgcagtta

SEQ ID NO: 15647 - DNA, 19 bp, Homo sapiens
atgtatcacgtgtgctttg

SEQ ID NO: 15648 - DNA, 20 bp, Homo sapiens
ccaatacaaaagcccactga

SEQ ID NO: 15649 - DNA, 22 bp, Homo sapiens
caagcacaaggcctgccctaca

SEQ ID NO: 15650 - DNA, 18 bp, Homo sapiens
ttccaggacctggcccag

SEQ ID NO: 15651 - DNA, 19 bp, Homo sapiens
ttgcctgctgcctgcatcc

SEQ ID NO: 15652 - DNA, 18 bp, Homo sapiens
aatcaatcactgaacctg

SEQ ID NO: 15653 - DNA, 24 bp, Homo sapiens
acctgagctgttttctgttggccc

SEQ ID NO: 15654 - DNA, 18 bp, Homo sapiens
caggctggaatgatctca

SEQ ID NO: 15655 - DNA, 18 bp, Homo sapiens
cctggcgatcttctgggg

SEQ ID NO: 15656 - DNA, 19 bp, Homo sapiens
cggctaccacctgttccag

SEQ ID NO: 15657 - DNA, 19 bp, Homo sapiens
ggcgccaccaaccagcctc

SEQ ID NO: 15658 - DNA, 21 bp, Homo sapiens
tgcctggaaaacctgtcccag

SEQ ID NO: 15659 - DNA, 22 bp, Homo sapiens
gggcatttgggataccaagata

SEQ ID NO: 15660 - DNA, 21 bp, Homo sapiens
tggtgaaaccccatctccact

SEQ ID NO: 15661 - DNA, 21 bp, Homo sapiens
ctgtttaatggtgatgcctcg

SEQ ID NO: 15662 - DNA, 22 bp, Homo sapiens
tgaatgggaaatcatgcaacta

SEQ ID NO: 15663 - DNA, 15 bp, Homo sapiens
ggagcagggctgtga

SEQ ID NO: 15664 - DNA, 18 bp, Homo sapiens
accgcggccgccgggcct

SEQ ID NO: 15665 - DNA, 16 bp, Homo sapiens
caccgcggggccgacg

SEQ ID NO: 15666 - DNA, 20 bp, Homo sapiens
ccaccggcctaaagacgacg

SEQ ID NO: 15667 - DNA, 16 bp, Homo sapiens
gcaaagaacaatgtac

SEQ ID NO: 15668 - DNA, 18 bp, Homo sapiens
caacacatgctcactgcc

SEQ ID NO: 15669 - DNA, 23 bp, Homo sapiens
ccctcctcaattggaggctggac

SEQ ID NO: 15670 - DNA, 20 bp, Homo sapiens
gccagttcacccacagatca

SEQ ID NO: 15671 - DNA, 18 bp, Homo sapiens
gcccttcatggcagggac

SEQ ID NO: 15672 - DNA, 15 bp, Homo sapiens
tggccttctgtgaat

SEQ ID NO: 15673 - DNA, 21 bp, Homo sapiens
caaaaggaccctgccttggtg

SEQ ID NO: 15674 - DNA, 22 bp, Homo sapiens
cctaccaagaaaaacagtctca

SEQ ID NO: 15675 - DNA, 18 bp, Homo sapiens
cttgatgatggcggtgga

SEQ ID NO: 15676 - DNA, 19 bp, Homo sapiens
ttgcagagatccagcccct

SEQ ID NO: 15677 - DNA, 22 bp, Homo sapiens
acagacccaaccaccagcaata

SEQ ID NO: 15678 - DNA, 22 bp, Homo sapiens
gattggtcttgatattgagata

SEQ ID NO: 15679 - DNA, 18 bp, Homo sapiens
aaaaagggggggaaatac

SEQ ID NO: 15680 - DNA, 20 bp, Homo sapiens
tggtcaggctggtcttgaac

SEQ ID NO: 15681 - DNA, 21 bp, Homo sapiens
ttttttgtgggccagtttgta

SEQ ID NO: 15682 - DNA, 20 bp, Homo sapiens
aattaataaacattttaata

SEQ ID NO: 15683 - DNA, 21 bp, Homo sapiens
acctgaggtggctgaggctca

SEQ ID NO: 15684 - DNA, 20 bp, Homo sapiens
cgttaccgggtccagactga

SEQ ID NO: 15685 - DNA, 19 bp, Homo sapiens
gcaactgatgtcctgcgtg

SEQ ID NO: 15686 - DNA, 16 bp, Homo sapiens
gcagcccccgcagctc

SEQ ID NO: 15687 - DNA, 18 bp, Homo sapiens
aggtggcctgcccgggaa

SEQ ID NO: 15688 - DNA, 19 bp, Homo sapiens
cctgaatcttaccaacaaa

SEQ ID NO: 15689 - DNA, 18 bp, Homo sapiens
tgaatggatctcaccaga

SEQ ID NO: 15690 - DNA, 22 bp, Homo sapiens
tgcccaagcatatatcgtctct

SEQ ID NO: 15691 - DNA, 18 bp, Homo sapiens
agtttccacattagcact

SEQ ID NO: 15692 - DNA, 22 bp, Homo sapiens
cccatggctcccaaaccatgcc

SEQ ID NO: 15693 - DNA, 21 bp, Homo sapiens
tcttgatgaaaatgttgcaca

SEQ ID NO: 15694 - DNA, 21 bp, Homo sapiens
ttctgtctctctgagcctctg

SEQ ID NO: 15695 - DNA, 16 bp, Homo sapiens
ttgcaaaacccgcctc

SEQ ID NO: 15696 - DNA, 23 bp, Homo sapiens
cgcgcgacactgcgtgcccgcgc

SEQ ID NO: 15697 - DNA, 21 bp, Homo sapiens
cagggagagaccctaccccca

SEQ ID NO: 15698 - DNA, 20 bp, Homo sapiens
gtaacatccatcctgctaca

SEQ ID NO: 15699 - DNA, 18 bp, Homo sapiens
tacagtgtttgtgggatg

SEQ ID NO: 15700 - DNA, 18 bp, Homo sapiens
tgagcttcccaatcaata

SEQ ID NO: 15701 - DNA, 21 bp, Homo sapiens
ttccttggaaccatctctgaa

SEQ ID NO: 15702 - DNA, 23 bp, Homo sapiens
agaccccagccagacccccgcca

SEQ ID NO: 15703 - DNA, 20 bp, Homo sapiens
gctctcctcaccacacagca

SEQ ID NO: 15704 - DNA, 21 bp, Homo sapiens
ggcagaactaagccaggcata

SEQ ID NO: 15705 - DNA, 19 bp, Homo sapiens
gggttttgatcttttgtca

SEQ ID NO: 15706 - DNA, 18 bp, Homo sapiens
gtagttttaagcttgttt

SEQ ID NO: 15707 - DNA, 19 bp, Homo sapiens
ttctacatacaaaacacag

SEQ ID NO: 15708 - DNA, 22 bp, Homo sapiens
gccgccccctgcagtccggaga

SEQ ID NO: 15709 - DNA, 17 bp, Homo sapiens
acatcttcattctccca

SEQ ID NO: 15710 - DNA, 19 bp, Homo sapiens
attctgatgatgagtctct

SEQ ID NO: 15711 - DNA, 18 bp, Homo sapiens
cttccggcgtgtccccaa

SEQ ID NO: 15712 - DNA, 17 bp, Homo sapiens
tataatacttagcttta

SEQ ID NO: 15713 - DNA, 22 bp, Homo sapiens
ttctgccacttgtgcgctgctt

SEQ ID NO: 15714 - DNA, 21 bp, Homo sapiens
tttgagtgtccaaaatagcca

SEQ ID NO: 15715 - DNA, 19 bp, Homo sapiens
ctctccttgcctttgtctt

SEQ ID NO: 15716 - DNA, 20 bp, Homo sapiens
ctgctggtcagagcaccaag

SEQ ID NO: 15717 - DNA, 19 bp, Homo sapiens
actttgatatcatattcct

SEQ ID NO: 15718 - DNA, 21 bp, Homo sapiens
tggcagtcccaaatgaaatta

SEQ ID NO: 15719 - DNA, 18 bp, Homo sapiens
atcttcacccccacctcc

SEQ ID NO: 15720 - DNA, 24 bp, Homo sapiens
acactttcagagccttcccaccca

SEQ ID NO: 15721 - DNA, 18 bp, Homo sapiens
gcatttttcatattcttc

SEQ ID NO: 15722 - DNA, 22 bp, Homo sapiens
ggcaagaagaggctgcctacca

SEQ ID NO: 15723 - DNA, 22 bp, Homo sapiens
tagaatttgtttttgttgtttt

SEQ ID NO: 15724 - DNA, 23 bp, Homo sapiens
tctttttatgatgattttacctt

SEQ ID NO: 15725 - DNA, 18 bp, Homo sapiens
caagtggtcattgttaca

SEQ ID NO: 15726 - DNA, 21 bp, Homo sapiens
gataagaaacatgtcatcata

SEQ ID NO: 15727 - DNA, 22 bp, Homo sapiens
taatggggcagatatgcattaa

SEQ ID NO: 15728 - DNA, 17 bp, Homo sapiens
aaaaacaaacaaacaaa

SEQ ID NO: 15729 - DNA, 18 bp, Homo sapiens
aaacagaagttacaaatg

SEQ ID NO: 15730 - DNA, 17 bp, Homo sapiens
atagaaagtgcttaaac

SEQ ID NO: 15731 - DNA, 27 bp, Homo sapiens
caacatcagcctggccaacatgatgaa

SEQ ID NO: 15732 - DNA, 19 bp, Homo sapiens
gaaatatgtaataatgata

SEQ ID NO: 15733 - DNA, 19 bp, Homo sapiens
tgatagaaagtgcttaaac

SEQ ID NO: 15734 - DNA, 20 bp, Homo sapiens
aataggcatttaatgaaaca

SEQ ID NO: 15735 - DNA, 21 bp, Homo sapiens
accagtgaccctgaaaactga

SEQ ID NO: 15736 - DNA, 25 bp, Homo sapiens
atttcagtgaagtcattttgcttca

SEQ ID NO: 15737 - DNA, 19 bp, Homo sapiens
cagtttattacatttacat

SEQ ID NO: 15738 - DNA, 17 bp, Homo sapiens
ctgaaaactgagggtgc

SEQ ID NO: 15739 - DNA, 17 bp, Homo sapiens
aacaggattaactgtga

SEQ ID NO: 15740 - DNA, 18 bp, Homo sapiens
cgcaacttcctagcgtga

SEQ ID NO: 15741 - DNA, 18 bp, Homo sapiens
gttgctgaaaaatatttg

SEQ ID NO: 15742 - DNA, 22 bp, Homo sapiens
tgttaagggaaatccaaattcc

SEQ ID NO: 15743 - DNA, 21 bp, Homo sapiens
ttgtaacagcaacttgtcaaa

SEQ ID NO: 15744 - DNA, 18 bp, Homo sapiens
cctgaggctgcctggcct

SEQ ID NO: 15745 - DNA, 19 bp, Homo sapiens
gcgttgggggtcccggggg

SEQ ID NO: 15746 - DNA, 22 bp, Homo sapiens
ggttgttctgtcttttttttaa

SEQ ID NO: 15747 - DNA, 24 bp, Homo sapiens
ttttgatgcctcagggtctctgaa

SEQ ID NO: 15748 - DNA, 17 bp, Homo sapiens
gaagaaatgaagggaca

SEQ ID NO: 15749 - DNA, 18 bp, Homo sapiens
gtaacacttatttacata

SEQ ID NO: 15750 - DNA, 19 bp, Homo sapiens
cttctctgcttttaatctt

SEQ ID NO: 15751 - DNA, 21 bp, Homo sapiens
gactggggctaggtttggtta

SEQ ID NO: 15752 - DNA, 20 bp, Homo sapiens
tgctcccacgtcctgcactg

SEQ ID NO: 15753 - DNA, 18 bp, Homo sapiens
ctactatagtaaactctt

SEQ ID NO: 15754 - DNA, 20 bp, Homo sapiens
taaatgaaagtggcatcaca

SEQ ID NO: 15755 - DNA, 19 bp, Homo sapiens
tgcaaatctctccctctct

SEQ ID NO: 15756 - DNA, 19 bp, Homo sapiens
aaggctggcgcccgtaatc

SEQ ID NO: 15757 - DNA, 21 bp, Homo sapiens
gatgggtttttaatgatacta

SEQ ID NO: 15758 - DNA, 18 bp, Homo sapiens
tccatttcctactggagg

SEQ ID NO: 15759 - DNA, 19 bp, Homo sapiens
tggtcattttgttcaagga

SEQ ID NO: 15760 - DNA, 23 bp, Homo sapiens
gacattcacagcagctctgtgga

SEQ ID NO: 15761 - DNA, 18 bp, Homo sapiens
taaccatgagagatgcca

SEQ ID NO: 15762 - DNA, 19 bp, Homo sapiens
tctgtgtgactgtctgctt

SEQ ID NO: 15763 - DNA, 19 bp, Homo sapiens
accaggcagccactgtgca

SEQ ID NO: 15764 - DNA, 18 bp, Homo sapiens
agctattgctccatgaca

SEQ ID NO: 15765 - DNA, 21 bp, Homo sapiens
atttgaacccaggtctcgtct

SEQ ID NO: 15766 - DNA, 21 bp, Homo sapiens
ctgataaaacagattgtgata

SEQ ID NO: 15767 - DNA, 21 bp, Homo sapiens
gacacagagtattttaaaaga

SEQ ID NO: 15768 - DNA, 20 bp, Homo sapiens
ggctgctggctgtctggctt

SEQ ID NO: 15769 - DNA, 17 bp, Homo sapiens
tcaagtgattcttctgc

SEQ ID NO: 15770 - DNA, 20 bp, Homo sapiens
tctttttggactttaatctt

SEQ ID NO: 15771 - DNA, 20 bp, Homo sapiens
tggccaggctggtcttgaac

SEQ ID NO: 15772 - DNA, 19 bp, Homo sapiens
ttccagaagctgccctcag

SEQ ID NO: 15773 - DNA, 21 bp, Homo sapiens
agtggaaattactgatgagta

SEQ ID NO: 15774 - DNA, 18 bp, Homo sapiens
cacagtggaaattactga

SEQ ID NO: 15775 - DNA, 22 bp, Homo sapiens
gttagagtttaacaaaatactc

SEQ ID NO: 15776 - DNA, 20 bp, Homo sapiens
tttcggttttctgccagcca

SEQ ID NO: 15777 - DNA, 20 bp, Homo sapiens
acccgcccccgcctgcctca

SEQ ID NO: 15778 - DNA, 16 bp, Homo sapiens
gcccccgcctgcctca

SEQ ID NO: 15779 - DNA, 17 bp, Homo sapiens
catacagaagcagggtg

SEQ ID NO: 15780 - DNA, 20 bp, Homo sapiens
ccattacaacagctccagga

SEQ ID NO: 15781 - DNA, 21 bp, Homo sapiens
gcccccagtgactcttggttt

SEQ ID NO: 15782 - DNA, 17 bp, Homo sapiens
gcctgggcagggcccgg

SEQ ID NO: 15783 - DNA, 19 bp, Homo sapiens
gtcctcaggagcccccagg

SEQ ID NO: 15784 - DNA, 17 bp, Homo sapiens
aatattattgcttgcta

SEQ ID NO: 15785 - DNA, 22 bp, Homo sapiens
ggcagaatccaaatactgggtt

SEQ ID NO: 15786 - DNA, 25 bp, Homo sapiens
caaggccgaagggtgacaaaataca

SEQ ID NO: 15787 - DNA, 20 bp, Homo sapiens
ctgcggggtctgcctggcct

SEQ ID NO: 15788 - DNA, 22 bp, Homo sapiens
actaacctaaaagaaaatgaca

SEQ ID NO: 15789 - DNA, 26 bp, Homo sapiens
ataatttagtaggggcttattgtctc

SEQ ID NO: 15790 - DNA, 18 bp, Homo sapiens
atatgcacatagcactgt

SEQ ID NO: 15791 - DNA, 23 bp, Homo sapiens
gccttttgtttcctgtgcaaaca

SEQ ID NO: 15792 - DNA, 23 bp, Homo sapiens
ttgtggatatttggctgttttta

SEQ ID NO: 15793 - DNA, 19 bp, Homo sapiens
gggaaatactgaggaccaa

SEQ ID NO: 15794 - DNA, 17 bp, Homo sapiens
gtaatgtggcactgagc

SEQ ID NO: 15795 - DNA, 19 bp, Homo sapiens
attaagtgcagtttatatt

SEQ ID NO: 15796 - DNA, 15 bp, Homo sapiens
gtggtggagtgaagt

SEQ ID NO: 15797 - DNA, 21 bp, Homo sapiens
gtgtcttggttaactaattct

SEQ ID NO: 15798 - DNA, 26 bp, Homo sapiens
ttcaccagaactattttaatatatca

SEQ ID NO: 15799 - DNA, 20 bp, Homo sapiens
cagctctaccaggagatcca

SEQ ID NO: 15800 - DNA, 22 bp, Homo sapiens
aggaagtagttgcctttggtca

SEQ ID NO: 15801 - DNA, 19 bp, Homo sapiens
ttggattttatttataatt

SEQ ID NO: 15802 - DNA, 19 bp, Homo sapiens
ccatttacaaatgtacctt

SEQ ID NO: 15803 - DNA, 19 bp, Homo sapiens
gaccccattgagttactgt

SEQ ID NO: 15804 - DNA, 25 bp, Homo sapiens
tttggggtgtgtgtgtgtgtttgtg

SEQ ID NO: 15805 - DNA, 18 bp, Homo sapiens
acagctcagcaacaacca

SEQ ID NO: 15806 - DNA, 23 bp, Homo sapiens
accactgctggcacaagcagtga

SEQ ID NO: 15807 - DNA, 17 bp, Homo sapiens
ctggcgatcttttgata

SEQ ID NO: 15808 - DNA, 17 bp, Homo sapiens
gcagtgactgtttggca

SEQ ID NO: 15809 - DNA, 17 bp, Homo sapiens
ttcacagtattttgctt

SEQ ID NO: 15810 - DNA, 19 bp, Homo sapiens
agatgaatgccgagtgctt

SEQ ID NO: 15811 - DNA, 21 bp, Homo sapiens
agattagatctctaaatgcag

SEQ ID NO: 15812 - DNA, 21 bp, Homo sapiens
cattttgtcctgcacacacgt

SEQ ID NO: 15813 - DNA, 19 bp, Homo sapiens
gcctcagccagcaatgcaa

SEQ ID NO: 15814 - DNA, 21 bp, Homo sapiens
tcctgaaaagaccttgcagta

SEQ ID NO: 15815 - DNA, 22 bp, Homo sapiens
tttctgatcactctcagactgt

SEQ ID NO: 15816 - DNA, 18 bp, Homo sapiens
gcgagtgacaatgtgaca

SEQ ID NO: 15817 - DNA, 18 bp, Homo sapiens
tccgcctcctgggttcaa

SEQ ID NO: 15818 - DNA, 15 bp, Homo sapiens
tgcggctgtgcctgg

SEQ ID NO: 15819 - DNA, 21 bp, Homo sapiens
aagccccagacccccttctct

SEQ ID NO: 15820 - DNA, 17 bp, Homo sapiens
cggggggcatgctggcc

SEQ ID NO: 15821 - DNA, 23 bp, Homo sapiens
tgtgggggtggtggtgctgcagg

SEQ ID NO: 15822 - DNA, 23 bp, Homo sapiens
ccagagcactgttggaagtctgg

SEQ ID NO: 15823 - DNA, 23 bp, Homo sapiens
cgaggctacgagctgcccgatgg

SEQ ID NO: 15824 - DNA, 21 bp, Homo sapiens
tttcacttgtcattctacttt

SEQ ID NO: 15825 - DNA, 18 bp, Homo sapiens
aagagacccgttcagagt

SEQ ID NO: 15826 - DNA, 20 bp, Homo sapiens
gctcatgggcaagaaactct

SEQ ID NO: 15827 - DNA, 18 bp, Homo sapiens
tgggtggatcacctgaag

SEQ ID NO: 15828 - DNA, 17 bp, Homo sapiens
caggaatagtggtttaa

SEQ ID NO: 15829 - DNA, 21 bp, Homo sapiens
ccttattttccacctccccca

SEQ ID NO: 15830 - DNA, 19 bp, Homo sapiens
ctgcaacctccgcctccca

SEQ ID NO: 15831 - DNA, 18 bp, Homo sapiens
tccgcctcccaggttcaa

SEQ ID NO: 15832 - DNA, 23 bp, Homo sapiens
ggagatctggcgatgactgtggc

SEQ ID NO: 15833 - DNA, 24 bp, Homo sapiens
tgtagggatccctcctgcacatca

SEQ ID NO: 15834 - DNA, 20 bp, Homo sapiens
ttctggccttccccacccca

SEQ ID NO: 15835 - DNA, 17 bp, Homo sapiens
gtgctggcttttttgaa

SEQ ID NO: 15836 - DNA, 18 bp, Homo sapiens
gttcaacaccaccttata

SEQ ID NO: 15837 - DNA, 17 bp, Homo sapiens
ctttctctgctcagctc

SEQ ID NO: 15838 - DNA, 17 bp, Homo sapiens
ccagggcaccgttctag

SEQ ID NO: 15839 - DNA, 20 bp, Homo sapiens
gttcaagaaaattaaatggt

SEQ ID NO: 15840 - DNA, 21 bp, Homo sapiens
taagatctattaagcttgaca

SEQ ID NO: 15841 - DNA, 20 bp, Homo sapiens
tagaaccttttcttatctca

SEQ ID NO: 15842 - DNA, 18 bp, Homo sapiens
gccttacgtggtatcaca

SEQ ID NO: 15843 - DNA, 21 bp, Homo sapiens
ccctctgagtaggaagtgtga

SEQ ID NO: 15844 - DNA, 20 bp, Homo sapiens
tgttcctcagtatggggctg

SEQ ID NO: 15845 - DNA, 21 bp, Homo sapiens
ccagtggggcccccgcagctc

SEQ ID NO: 15846 - DNA, 18 bp, Homo sapiens
ctcactttgaaaagtatg

SEQ ID NO: 15847 - DNA, 16 bp, Homo sapiens
cttctattccatttta

SEQ ID NO: 15848 - DNA, 23 bp, Homo sapiens
ctttttacactgtatgcggtttg

SEQ ID NO: 15849 - DNA, 23 bp, Homo sapiens
ctttttgggtctcaagatttatg

SEQ ID NO: 15850 - DNA, 22 bp, Homo sapiens
gcgccagcggagctccggctcc

SEQ ID NO: 15851 - DNA, 22 bp, Homo sapiens
cagctaggctacacccatcatg

SEQ ID NO: 15852 - DNA, 21 bp, Homo sapiens
ccctcttccttcctggtgtac

SEQ ID NO: 15853 - DNA, 21 bp, Homo sapiens
tcaggaacttgacacagtgtt

SEQ ID NO: 15854 - DNA, 19 bp, Homo sapiens
tcccagagaccatctatca

SEQ ID NO: 15855 - DNA, 21 bp, Homo sapiens
tgaccatccatagaatatgtg

SEQ ID NO: 15856 - DNA, 19 bp, Homo sapiens
tgcggctgtaccaggaaga

SEQ ID NO: 15857 - DNA, 25 bp, Homo sapiens
ataatgtacaggtcatttgtgtaga

SEQ ID NO: 15858 - DNA, 20 bp, Homo sapiens
tcaaaagggatgttgctggt

SEQ ID NO: 15859 - DNA, 15 bp, Homo sapiens
attgtatcttaatca

SEQ ID NO: 15860 - DNA, 18 bp, Homo sapiens
ctgtggtatggccattga

SEQ ID NO: 15861 - DNA, 23 bp, Homo sapiens
tgaggttgtgattggtgacattc

SEQ ID NO: 15862 - DNA, 21 bp, Homo sapiens
tgcccaaggcaactcaccctc

SEQ ID NO: 15863 - DNA, 24 bp, Homo sapiens
tttcttattgggttgtcttgcttt

SEQ ID NO: 15864 - DNA, 20 bp, Homo sapiens
caagtcctgcgatgctaagt

SEQ ID NO: 15865 - DNA, 23 bp, Homo sapiens
cataacacaggagacctgctccc

SEQ ID NO: 15866 - DNA, 22 bp, Homo sapiens
ccagggcgtcctccagctcagc

SEQ ID NO: 15867 - DNA, 19 bp, Homo sapiens
gaatgttctcagtgtccta

SEQ ID NO: 15868 - DNA, 19 bp, Homo sapiens
ggagcactctgagatctca

SEQ ID NO: 15869 - DNA, 18 bp, Homo sapiens
gggttaaaatgccgacca

SEQ ID NO: 15870 - DNA, 21 bp, Homo sapiens
taaaatgctggaaaactgtaa

SEQ ID NO: 15871 - DNA, 20 bp, Homo sapiens
tccgtctcgctcatcatcac

SEQ ID NO: 15872 - DNA, 18 bp, Homo sapiens
tctggcctctcaccccca

SEQ ID NO: 15873 - DNA, 22 bp, Homo sapiens
acagtggagacgtctgctctga

SEQ ID NO: 15874 - DNA, 23 bp, Homo sapiens
agctacagagcaccaaccagcag

SEQ ID NO: 15875 - DNA, 18 bp, Homo sapiens
cagttttatgctgccttt

SEQ ID NO: 15876 - DNA, 21 bp, Homo sapiens
ccttgttgaaccgctgctaaa

SEQ ID NO: 15877 - DNA, 17 bp, Homo sapiens
gctggtacctttacctc

SEQ ID NO: 15878 - DNA, 16 bp, Homo sapiens
ggatgtagacattgcc

SEQ ID NO: 15879 - DNA, 22 bp, Homo sapiens
gtcccactgctgattattgaga

SEQ ID NO: 15880 - DNA, 24 bp, Homo sapiens
taagttccaaaagaagatgtaata

SEQ ID NO: 15881 - DNA, 18 bp, Homo sapiens
tcccactgctgattattg

SEQ ID NO: 15882 - DNA, 20 bp, Homo sapiens
cgcctgcaccaacagcctca

SEQ ID NO: 15883 - DNA, 17 bp, Homo sapiens
ctctccttcgccttctg

SEQ ID NO: 15884 - DNA, 22 bp, Homo sapiens
gacggggtttcaccatactggc

SEQ ID NO: 15885 - DNA, 19 bp, Homo sapiens
gcacctctgccttcttcct

SEQ ID NO: 15886 - DNA, 22 bp, Homo sapiens
gccccacacaccacagccagga

SEQ ID NO: 15887 - DNA, 22 bp, Homo sapiens
gcccctcacaccacagccagga

SEQ ID NO: 15888 - DNA, 22 bp, Homo sapiens
gcccctcacaccacagccagga

SEQ ID NO: 15889 - DNA, 22 bp, Homo sapiens
gcccctcacaccacagccagga

SEQ ID NO: 15890 - DNA, 22 bp, Homo sapiens
gcccctctcaccacagccagga

SEQ ID NO: 15891 - DNA, 22 bp, Homo sapiens
gcccctctcaccacagccagga

SEQ ID NO: 15892 - DNA, 19 bp, Homo sapiens
gccctggtctaatccagga

SEQ ID NO: 15893 - DNA, 22 bp, Homo sapiens
gcccttcacaccacagccagga

SEQ ID NO: 15894 - DNA, 25 bp, Homo sapiens
gcgcatgtaggctgccggtggcttt

SEQ ID NO: 15895 - DNA, 18 bp, Homo sapiens
tccatctcccgggttcaa

SEQ ID NO: 15896 - DNA, 18 bp, Homo sapiens
tctgaaagcatctgtgga

SEQ ID NO: 15897 - DNA, 24 bp, Homo sapiens
tttccagaccatcccctctcacca

SEQ ID NO: 15898 - DNA, 20 bp, Homo sapiens
cctgaaggactgcgtggtgg

SEQ ID NO: 15899 - DNA, 19 bp, Homo sapiens
aagcaattctcctgcctca

SEQ ID NO: 15900 - DNA, 19 bp, Homo sapiens
aagcaattctccttcttca

SEQ ID NO: 15901 - DNA, 19 bp, Homo sapiens
aagcaattctccttcttca

SEQ ID NO: 15902 - DNA, 23 bp, Homo sapiens
acttcaagcaattctcctgcctc

SEQ ID NO: 15903 - DNA, 21 bp, Homo sapiens
agtctcactctgttgccaggc

SEQ ID NO: 15904 - DNA, 19 bp, Homo sapiens
atattgccagatgtcctct

SEQ ID NO: 15905 - DNA, 21 bp, Homo sapiens
atcttggctcactgcaacctc

SEQ ID NO: 15906 - DNA, 21 bp, Homo sapiens
atcttggctcactgcaacctc

SEQ ID NO: 15907 - DNA, 18 bp, Homo sapiens
cctgcaacctccacctcc

SEQ ID NO: 15908 - DNA, 18 bp, Homo sapiens
cctgcaacctccacctcc

SEQ ID NO: 15909 - DNA, 18 bp, Homo sapiens
cgcagtaaactgttgata

SEQ ID NO: 15910 - DNA, 19 bp, Homo sapiens
ctgcaacctccgcctccca

SEQ ID NO: 15911 - DNA, 18 bp, Homo sapiens
tccacctcccgggttcaa

SEQ ID NO: 15912 - DNA, 18 bp, Homo sapiens
tccacctcctgggttcaa

SEQ ID NO: 15913 - DNA, 18 bp, Homo sapiens
tccgcctcccaggttcag

SEQ ID NO: 15914 - DNA, 19 bp, Homo sapiens
tccttgtgaacagtgttat

SEQ ID NO: 15915 - DNA, 20 bp, Homo sapiens
tggtcaggctggtcttgaac

SEQ ID NO: 15916 - DNA, 20 bp, Homo sapiens
tggtcaggctggtcttgaac

SEQ ID NO: 15917 - DNA, 20 bp, Homo sapiens
tgtatccttgtgtgaaattg

SEQ ID NO: 15918 - DNA, 19 bp, Homo sapiens
cacagtaaaagaattcctt

SEQ ID NO: 15919 - DNA, 16 bp, Homo sapiens
cctcacccaggagtca

SEQ ID NO: 15920 - DNA, 22 bp, Homo sapiens
ctggcttacaataaatgcccaa

SEQ ID NO: 15921 - DNA, 24 bp, Homo sapiens
cttctctgtgaaacactctacctt

SEQ ID NO: 15922 - DNA, 23 bp, Homo sapiens
gtttctgctgacttgcctggctt

SEQ ID NO: 15923 - DNA, 19 bp, Homo sapiens
tttggtgatgctgtgcgag

SEQ ID NO: 15924 - DNA, 21 bp, Homo sapiens
gattgttttgctactttttca

SEQ ID NO: 15925 - DNA, 24 bp, Homo sapiens
tctttaaatgaacaagtaaccaca

SEQ ID NO: 15926 - DNA, 20 bp, Homo sapiens
tttctgtttcacgttccttc

SEQ ID NO: 15927 - DNA, 25 bp, Homo sapiens
accagacgtctgtgctgcctggttt

SEQ ID NO: 15928 - DNA, 20 bp, Homo sapiens
cagtgggaccagtgttgcca

SEQ ID NO: 15929 - DNA, 20 bp, Homo sapiens
cccatctctccttctcactg

SEQ ID NO: 15930 - DNA, 22 bp, Homo sapiens
ctcctcctcctcctcctcctct

SEQ ID NO: 15931 - DNA, 21 bp, Homo sapiens
gacaggaacaaggacaactcc

SEQ ID NO: 15932 - DNA, 21 bp, Homo sapiens
taattccatcagactgctgtc

SEQ ID NO: 15933 - DNA, 18 bp, Homo sapiens
tctggttactgcctggcc

SEQ ID NO: 15934 - DNA, 18 bp, Homo sapiens
aagagtagctttttttca

SEQ ID NO: 15935 - DNA, 17 bp, Homo sapiens
cttccccgcccctctcc

SEQ ID NO: 15936 - DNA, 20 bp, Homo sapiens
tctttttatatatttagcct

SEQ ID NO: 15937 - DNA, 23 bp, Homo sapiens
acaaaaattattgagcaacccta

SEQ ID NO: 15938 - DNA, 22 bp, Homo sapiens
gtgccaaaaacctgtggatttt

SEQ ID NO: 15939 - DNA, 24 bp, Homo sapiens
gtggttttctcgagtctttggtca

SEQ ID NO: 15940 - DNA, 18 bp, Homo sapiens
atcctaaaatacattggt

SEQ ID NO: 15941 - DNA, 21 bp, Homo sapiens
actcttgttcaagactagcta

SEQ ID NO: 15942 - DNA, 21 bp, Homo sapiens
cagggcgtccgctaggctcgg

SEQ ID NO: 15943 - DNA, 16 bp, Homo sapiens
tctttctacagtatga

SEQ ID NO: 15944 - DNA, 19 bp, Homo sapiens
atcatctaagaccatctct

SEQ ID NO: 15945 - DNA, 19 bp, Homo sapiens
atgtggagcaaacttgagg

SEQ ID NO: 15946 - DNA, 20 bp, Homo sapiens
ccacctctgtggccacctca

SEQ ID NO: 15947 - DNA, 26 bp, Homo sapiens
ccagattcaagtgatcctcccatctc

SEQ ID NO: 15948 - DNA, 19 bp, Homo sapiens
ccttccacttcccacttcc

SEQ ID NO: 15949 - DNA, 18 bp, Homo sapiens
ctggtgtcctgaaagggg

SEQ ID NO: 15950 - DNA, 22 bp, Homo sapiens
gagccaagatcatgctactgca

SEQ ID NO: 15951 - DNA, 20 bp, Homo sapiens
gtaagcagcaaacccctgga

SEQ ID NO: 15952 - DNA, 19 bp, Homo sapiens
gtgtgtgtgagcacctgac

SEQ ID NO: 15953 - DNA, 21 bp, Homo sapiens
tcaccaaccccttccacttcc

SEQ ID NO: 15954 - DNA, 22 bp, Homo sapiens
tcatacactgaagcaaattcag

SEQ ID NO: 15955 - DNA, 18 bp, Homo sapiens
acttgataggctatgcat

SEQ ID NO: 15956 - DNA, 24 bp, Homo sapiens
gtgttttcttgagtgtcacttgat

SEQ ID NO: 15957 - DNA, 18 bp, Homo sapiens
ctgtccctgctctgcctc

SEQ ID NO: 15958 - DNA, 22 bp, Homo sapiens
cttcttcggcaaaccttgcttt

SEQ ID NO: 15959 - DNA, 19 bp, Homo sapiens
accctggcaggggacccca

SEQ ID NO: 15960 - DNA, 16 bp, Homo sapiens
actggcacacgcaggc

SEQ ID NO: 15961 - DNA, 19 bp, Homo sapiens
ccctcaaccggctccatca

SEQ ID NO: 15962 - DNA, 18 bp, Homo sapiens
cctgcaacctccacctcc

SEQ ID NO: 15963 - DNA, 18 bp, Homo sapiens
cgccccgtcggcagctct

SEQ ID NO: 15964 - DNA, 19 bp, Homo sapiens
cgcgccaccacgcccagct

SEQ ID NO: 15965 - DNA, 22 bp, Homo sapiens
gaataaagccaaggcttcttcc

SEQ ID NO: 15966 - DNA, 25 bp, Homo sapiens
cctctttgcctgtgggtttaacttt

SEQ ID NO: 15967 - DNA, 20 bp, Homo sapiens
gatgcccattctacttttga

SEQ ID NO: 15968 - DNA, 27 bp, Homo sapiens
gcgggccgagcggggcggcctttgtta

SEQ ID NO: 15969 - DNA, 22 bp, Homo sapiens
gcttctgctgaccgctgggccc

SEQ ID NO: 15970 - DNA, 23 bp, Homo sapiens
aagtatttatgaactgtgataaa

SEQ ID NO: 15971 - DNA, 21 bp, Homo sapiens
acttggaaatgcctctggctt

SEQ ID NO: 15972 - DNA, 17 bp, Homo sapiens
ctcccttcctctcctct

SEQ ID NO: 15973 - DNA, 25 bp, Homo sapiens
ccccagacctccagaaatgacgtca

SEQ ID NO: 15974 - DNA, 24 bp, Homo sapiens
cttcttgcaactctccttaatttt

SEQ ID NO: 15975 - DNA, 17 bp, Homo sapiens
tccagaaatgacgtcag

SEQ ID NO: 15976 - DNA, 21 bp, Homo sapiens
acaaaagttagccttagagtt

SEQ ID NO: 15977 - DNA, 19 bp, Homo sapiens
acatcattgtttctatgac

SEQ ID NO: 15978 - DNA, 20 bp, Homo sapiens
agaagcccagtggggagctc

SEQ ID NO: 15979 - DNA, 17 bp, Homo sapiens
gatgaaaccagtcttcc

SEQ ID NO: 15980 - DNA, 20 bp, Homo sapiens
gattcattctcccttgagct

SEQ ID NO: 15981 - DNA, 17 bp, Homo sapiens
gcactcgtctttgcctt

SEQ ID NO: 15982 - DNA, 20 bp, Homo sapiens
gcaggccgggcctgctgtca

SEQ ID NO: 15983 - DNA, 17 bp, Homo sapiens
aagccatctcccagggc

SEQ ID NO: 15984 - DNA, 21 bp, Homo sapiens
atccaactgccccttgagtcc

SEQ ID NO: 15985 - DNA, 19 bp, Homo sapiens
cagaaaaagaagtgccttt

SEQ ID NO: 15986 - DNA, 17 bp, Homo sapiens
cagcatggcattgagaa

SEQ ID NO: 15987 - DNA, 19 bp, Homo sapiens
gattcccagcatggcattg

SEQ ID NO: 15988 - DNA, 21 bp, Homo sapiens
gccccatgagtagccaggata

SEQ ID NO: 15989 - DNA, 21 bp, Homo sapiens
ggtggatgggaagaaaattgt

SEQ ID NO: 15990 - DNA, 26 bp, Homo sapiens
gtgtctcatataccctatcctggtgg

SEQ ID NO: 15991 - DNA, 21 bp, Homo sapiens
tggggatgcctaacatgaagc

SEQ ID NO: 15992 - DNA, 22 bp, Homo sapiens
cgcctgccccccccgccaatcc

SEQ ID NO: 15993 - DNA, 19 bp, Homo sapiens
gtatcccccagccccagga

SEQ ID NO: 15994 - DNA, 19 bp, Homo sapiens
accaatggattacatgcca

SEQ ID NO: 15995 - DNA, 21 bp, Homo sapiens
agtggatggggtttctgttgt

SEQ ID NO: 15996 - DNA, 19 bp, Homo sapiens
cctaccccaccacacccca

SEQ ID NO: 15997 - DNA, 25 bp, Homo sapiens
gcccctgtccctcgccatacactga

SEQ ID NO: 15998 - DNA, 18 bp, Homo sapiens
tgccaggagccaacctgg

SEQ ID NO: 15999 - DNA, 18 bp, Homo sapiens
tttgtcgaaggcctgtgg

SEQ ID NO: 16000 - DNA, 20 bp, Homo sapiens
ttcacctgtgtcctcgccgc

SEQ ID NO: 16001 - DNA, 21 bp, Homo sapiens
attgcaccaaagtacatttga

SEQ ID NO: 16002 - DNA, 19 bp, Homo sapiens
ccagatgctaaatcattcc

SEQ ID NO: 16003 - DNA, 19 bp, Homo sapiens
taagccccaagagacattt

SEQ ID NO: 16004 - DNA, 18 bp, Homo sapiens
tatatgaaagctgtgata

SEQ ID NO: 16005 - DNA, 17 bp, Homo sapiens
aaagttgaaagtggcaa

SEQ ID NO: 16006 - DNA, 19 bp, Homo sapiens
accaagtattgcttggctt

SEQ ID NO: 16007 - DNA, 18 bp, Homo sapiens
cagtcctggtcggccaca

SEQ ID NO: 16008 - DNA, 19 bp, Homo sapiens
gccaaactcttgaagcacc

SEQ ID NO: 16009 - DNA, 24 bp, Homo sapiens
tcaccactagcccaccctgcccgt

SEQ ID NO: 16010 - DNA, 23 bp, Homo sapiens
cacaacagtgactatatcactca

SEQ ID NO: 16011 - DNA, 18 bp, Homo sapiens
cacacagtatgctctctg

SEQ ID NO: 16012 - DNA, 21 bp, Homo sapiens
taggtgggcccaccacttgag

SEQ ID NO: 16013 - DNA, 21 bp, Homo sapiens
aacaggaagccacttgcaagc

SEQ ID NO: 16014 - DNA, 18 bp, Homo sapiens
actcactctcttttgcca

SEQ ID NO: 16015 - DNA, 21 bp, Homo sapiens
agttatagaaagctgtctaca

SEQ ID NO: 16016 - DNA, 21 bp, Homo sapiens
caagaaacatgcattttggca

SEQ ID NO: 16017 - DNA, 19 bp, Homo sapiens
caggcacagagctgcagtt

SEQ ID NO: 16018 - DNA, 19 bp, Homo sapiens
cctagaggctgcttggccc

SEQ ID NO: 16019 - DNA, 20 bp, Homo sapiens
tcgtgacatcacacacttca

SEQ ID NO: 16020 - DNA, 18 bp, Homo sapiens
tgtattttgaccaaataa

SEQ ID NO: 16021 - DNA, 21 bp, Homo sapiens
aaattcagaaaattcacctga

SEQ ID NO: 16022 - DNA, 18 bp, Homo sapiens
atgatcatttagcattca

SEQ ID NO: 16023 - DNA, 19 bp, Homo sapiens
gaaagctgctttcacgtca

SEQ ID NO: 16024 - DNA, 21 bp, Homo sapiens
taatgaaagcactaagtttgg

SEQ ID NO: 16025 - DNA, 18 bp, Homo sapiens
acccatctgttcctcgtc

SEQ ID NO: 16026 - DNA, 23 bp, Homo sapiens
accgagtgatgcccctctcccct

SEQ ID NO: 16027 - DNA, 20 bp, Homo sapiens
cagacccccctgaccaagct

SEQ ID NO: 16028 - DNA, 19 bp, Homo sapiens
ccatcccattcccacctcc

SEQ ID NO: 16029 - DNA, 22 bp, Homo sapiens
cccgctgtggcagcggctggag

SEQ ID NO: 16030 - DNA, 23 bp, Homo sapiens
cggggtgggagctgggcctggcg

SEQ ID NO: 16031 - DNA, 15 bp, Homo sapiens
ctctctccctgcctc

SEQ ID NO: 16032 - DNA, 20 bp, Homo sapiens
ctctctctcttctgcttctc

SEQ ID NO: 16033 - DNA, 20 bp, Homo sapiens
tccatgctgggggaccgtgg

SEQ ID NO: 16034 - DNA, 22 bp, Homo sapiens
tgagtgggccctggggacactg

SEQ ID NO: 16035 - DNA, 19 bp, Homo sapiens
tgggacttgggtggagctg

SEQ ID NO: 16036 - DNA, 24 bp, Homo sapiens
tgtgcagcctggaaaccatcgctg

SEQ ID NO: 16037 - DNA, 18 bp, Homo sapiens
ttcagcagcatgatgcca

SEQ ID NO: 16038 - DNA, 22 bp, Homo sapiens
ttttcttttgttaaaaatcaaa

SEQ ID NO: 16039 - DNA, 19 bp, Homo sapiens
ctgcctggctggcacctca

SEQ ID NO: 16040 - DNA, 23 bp, Homo sapiens
gagaccgtgtggccatgatgtgg

SEQ ID NO: 16041 - DNA, 18 bp, Homo sapiens
ggagcagtcactattgta

SEQ ID NO: 16042 - DNA, 18 bp, Homo sapiens
taatcccagtagctgtta

SEQ ID NO: 16043 - DNA, 18 bp, Homo sapiens
taggtgggtttcaggagc

SEQ ID NO: 16044 - DNA, 18 bp, Homo sapiens
acaaaggatcttaaacca

SEQ ID NO: 16045 - DNA, 21 bp, Homo sapiens
ccagcagcctcccacctgtga

SEQ ID NO: 16046 - DNA, 22 bp, Homo sapiens
gccccttccctgagccacccca

SEQ ID NO: 16047 - DNA, 20 bp, Homo sapiens
tcgagtattaatactactgc

SEQ ID NO: 16048 - DNA, 23 bp, Homo sapiens
ttgagacactggaaaaaaagata

SEQ ID NO: 16049 - DNA, 18 bp, Homo sapiens
agagcccaaataagcatc

SEQ ID NO: 16050 - DNA, 21 bp, Homo sapiens
cactgaggtcatggtgactca

SEQ ID NO: 16051 - DNA, 24 bp, Homo sapiens
ctctgatttcattgaggatcttgg

SEQ ID NO: 16052 - DNA, 17 bp, Homo sapiens
gcttgggaagaaactcc

SEQ ID NO: 16053 - DNA, 20 bp, Homo sapiens
tgaggtcatggtgactcagt

SEQ ID NO: 16054 - DNA, 20 bp, Homo sapiens
catatataacgtgttattgc

SEQ ID NO: 16055 - DNA, 21 bp, Homo sapiens
catctcaatttacactagcca

SEQ ID NO: 16056 - DNA, 24 bp, Homo sapiens
ccaaaatgccatttttaacgccga

SEQ ID NO: 16057 - DNA, 18 bp, Homo sapiens
gagttgcctgggctacaa

SEQ ID NO: 16058 - DNA, 19 bp, Homo sapiens
gttttgtataaaacaatag

SEQ ID NO: 16059 - DNA, 23 bp, Homo sapiens
aagagaactgtcaggagcccaga

SEQ ID NO: 16060 - DNA, 18 bp, Homo sapiens
atagatgccatctgtgtg

SEQ ID NO: 16061 - DNA, 22 bp, Homo sapiens
ccccgccccgcccccaacaact

SEQ ID NO: 16062 - DNA, 17 bp, Homo sapiens
ggagcccagaaccaacc

SEQ ID NO: 16063 - DNA, 25 bp, Homo sapiens
ttcaaaacaaaatgttacaacaata

SEQ ID NO: 16064 - DNA, 19 bp, Homo sapiens
aactttaaaaaggatcagg

SEQ ID NO: 16065 - DNA, 17 bp, Homo sapiens
acaaaagtttcctgagt

SEQ ID NO: 16066 - DNA, 24 bp, Homo sapiens
accccgggcggtccacccgcctca

SEQ ID NO: 16067 - DNA, 19 bp, Homo sapiens
agggtttgtgtatccattc

SEQ ID NO: 16068 - DNA, 18 bp, Homo sapiens
gatccagaggagacaaag

SEQ ID NO: 16069 - DNA, 21 bp, Homo sapiens
gcccagaaataaaaccttaac

SEQ ID NO: 16070 - DNA, 19 bp, Homo sapiens
gtaggaaataaacttgata

SEQ ID NO: 16071 - DNA, 18 bp, Homo sapiens
tctctgctaaaaatacaa

SEQ ID NO: 16072 - DNA, 18 bp, Homo sapiens
tgatatctattctgtgac

SEQ ID NO: 16073 - DNA, 18 bp, Homo sapiens
tgggtggatcacttgagg

SEQ ID NO: 16074 - DNA, 21 bp, Homo sapiens
ccaccactccctgggcaccca

SEQ ID NO: 16075 - DNA, 21 bp, Homo sapiens
agccaccaaccccagccagtg

SEQ ID NO: 16076 - DNA, 19 bp, Homo sapiens
aggtcagctgggtctagca

SEQ ID NO: 16077 - DNA, 23 bp, Homo sapiens
atacacccacactctggcaccac

SEQ ID NO: 16078 - DNA, 22 bp, Homo sapiens
cagacaccattgcccacactat

SEQ ID NO: 16079 - DNA, 23 bp, Homo sapiens
cagcctcaactctgagaagccca

SEQ ID NO: 16080 - DNA, 18 bp, Homo sapiens
cctggagggctctgggga

SEQ ID NO: 16081 - DNA, 15 bp, Homo sapiens
cctggccccaccagc

SEQ ID NO: 16082 - DNA, 19 bp, Homo sapiens
cctggctcctcacatccca

SEQ ID NO: 16083 - DNA, 20 bp, Homo sapiens
ctgaccagcccaaatctgcc

SEQ ID NO: 16084 - DNA, 19 bp, Homo sapiens
gaacatcagcaactgacca

SEQ ID NO: 16085 - DNA, 21 bp, Homo sapiens
gacagtggaaaaaagagacca

SEQ ID NO: 16086 - DNA, 18 bp, Homo sapiens
gcgaaccccactctgcca

SEQ ID NO: 16087 - DNA, 23 bp, Homo sapiens
gcttgggctccaggcactggctt

SEQ ID NO: 16088 - DNA, 16 bp, Homo sapiens
ggccttccctgcccct

SEQ ID NO: 16089 - DNA, 18 bp, Homo sapiens
gtgtccctccctcctgtg

SEQ ID NO: 16090 - DNA, 22 bp, Homo sapiens
tctgcctggcaggccaacctca

SEQ ID NO: 16091 - DNA, 19 bp, Homo sapiens
tgcacagacaccattgccc

SEQ ID NO: 16092 - DNA, 19 bp, Homo sapiens
ttatttcagggcccttttc

SEQ ID NO: 16093 - DNA, 20 bp, Homo sapiens
agatggagaagagaccatca

SEQ ID NO: 16094 - DNA, 21 bp, Homo sapiens
cacaactgccactgctcacca

SEQ ID NO: 16095 - DNA, 20 bp, Homo sapiens
cccagaaactcacttctcag

SEQ ID NO: 16096 - DNA, 21 bp, Homo sapiens
cccagaaactcacttctcagt

SEQ ID NO: 16097 - DNA, 23 bp, Homo sapiens
taaatgaaagtaggatgaagcta

SEQ ID NO: 16098 - DNA, 22 bp, Homo sapiens
tccttctgaccacacacagaca

SEQ ID NO: 16099 - DNA, 20 bp, Homo sapiens
tgccactgctcaccaggaca

SEQ ID NO: 16100 - DNA, 18 bp, Homo sapiens
tgctcaacccaagcttct

SEQ ID NO: 16101 - DNA, 20 bp, Homo sapiens
ttttcttgtaactcatgaca

SEQ ID NO: 16102 - DNA, 18 bp, Homo sapiens
agtgccccttctgcctca

SEQ ID NO: 16103 - DNA, 17 bp, Homo sapiens
ccaaagaccaaacactg

SEQ ID NO: 16104 - DNA, 21 bp, Homo sapiens
acttaataaatacaatatgct

SEQ ID NO: 16105 - DNA, 20 bp, Homo sapiens
ggtttgttacttggactaac

SEQ ID NO: 16106 - DNA, 22 bp, Homo sapiens
aaaacaaaacaaaccctaacta

SEQ ID NO: 16107 - DNA, 19 bp, Homo sapiens
ccccacctccccgcaagct

SEQ ID NO: 16108 - DNA, 19 bp, Homo sapiens
ccctggtggtgggggctgt

SEQ ID NO: 16109 - DNA, 19 bp, Homo sapiens
gggcacatcacccacctca

SEQ ID NO: 16110 - DNA, 18 bp, Homo sapiens
gcaagagcactctgggtt

SEQ ID NO: 16111 - DNA, 20 bp, Homo sapiens
tacgtatgaacactataaac

SEQ ID NO: 16112 - DNA, 22 bp, Homo sapiens
atagacatctcaccagcactga

SEQ ID NO: 16113 - DNA, 19 bp, Homo sapiens
ccaggcactcacgcctctt

SEQ ID NO: 16114 - DNA, 18 bp, Homo sapiens
ctagagcctggtcctcca

SEQ ID NO: 16115 - DNA, 21 bp, Homo sapiens
gcctgggctcgcggccggccc

SEQ ID NO: 16116 - DNA, 20 bp, Homo sapiens
ggccagtctcggcagtcgag

SEQ ID NO: 16117 - DNA, 23 bp, Homo sapiens
gtcggtctctgagaaagcacctg

SEQ ID NO: 16118 - DNA, 21 bp, Homo sapiens
tccagcagctcaatgctgttt

SEQ ID NO: 16119 - DNA, 18 bp, Homo sapiens
tgtccccagtcctggtca

SEQ ID NO: 16120 - DNA, 19 bp, Homo sapiens
ttttgtctgcctcccctca

SEQ ID NO: 16121 - DNA, 22 bp, Homo sapiens
atcaactgaagagtccatttaa

SEQ ID NO: 16122 - DNA, 19 bp, Homo sapiens
ctccccatgttatgttgaa

SEQ ID NO: 16123 - DNA, 16 bp, Homo sapiens
gtgggtggtgagacca

SEQ ID NO: 16124 - DNA, 20 bp, Homo sapiens
cctctgcctcctgggttcaa

SEQ ID NO: 16125 - DNA, 23 bp, Homo sapiens
tctaaagaatcttgggttatttt

SEQ ID NO: 16126 - DNA, 22 bp, Homo sapiens
tggccaggctggtcttgtgaac

SEQ ID NO: 16127 - DNA, 18 bp, Homo sapiens
aaaagacttttttttaaa

SEQ ID NO: 16128 - DNA, 21 bp, Homo sapiens
gagttgtagataaaatgtcat

SEQ ID NO: 16129 - DNA, 23 bp, Homo sapiens
cccctcccgccccagggcagggc

SEQ ID NO: 16130 - DNA, 21 bp, Homo sapiens
cctcctttcccctgggctgcg

SEQ ID NO: 16131 - DNA, 23 bp, Homo sapiens
cgaggcagggccgcccctccagt

SEQ ID NO: 16132 - DNA, 17 bp, Homo sapiens
gctgctgcttatgtggt

SEQ ID NO: 16133 - DNA, 19 bp, Homo sapiens
aaactcctgacctcaggtg

SEQ ID NO: 16134 - DNA, 20 bp, Homo sapiens
aaatgtaataaaatttgaga

SEQ ID NO: 16135 - DNA, 18 bp, Homo sapiens
attagttaaaattcctca

SEQ ID NO: 16136 - DNA, 20 bp, Homo sapiens
cctctgcctcctgggttcaa

SEQ ID NO: 16137 - DNA, 19 bp, Homo sapiens
cgtttagaaacaaaaccct

SEQ ID NO: 16138 - DNA, 18 bp, Homo sapiens
ctcacactaaacatttta

SEQ ID NO: 16139 - DNA, 21 bp, Homo sapiens
gccgacccccaatctctttaa

SEQ ID NO: 16140 - DNA, 18 bp, Homo sapiens
gtttagaaacaaaaccct

SEQ ID NO: 16141 - DNA, 20 bp, Homo sapiens
tcagtctgcttattttccaa

SEQ ID NO: 16142 - DNA, 22 bp, Homo sapiens
cactgactcattgaaaatgtta

SEQ ID NO: 16143 - DNA, 19 bp, Homo sapiens
cgtgttttatgttaagtca

SEQ ID NO: 16144 - DNA, 21 bp, Homo sapiens
aaaaggtagaacttggatgat

SEQ ID NO: 16145 - DNA, 20 bp, Homo sapiens
catagacaactagagcagct

SEQ ID NO: 16146 - DNA, 20 bp, Homo sapiens
ccacagccatagacaactag

SEQ ID NO: 16147 - DNA, 20 bp, Homo sapiens
ccatatgtgtataattaaca

SEQ ID NO: 16148 - DNA, 21 bp, Homo sapiens
caaggccctctaggcctggca

SEQ ID NO: 16149 - DNA, 16 bp, Homo sapiens
catgtgtgtgcggccc

SEQ ID NO: 16150 - DNA, 18 bp, Homo sapiens
tggcccagtgtgatgctg

SEQ ID NO: 16151 - DNA, 23 bp, Homo sapiens
aaagtctcatttttaaatctccc

SEQ ID NO: 16152 - DNA, 20 bp, Homo sapiens
aataggaggacatcaatgta

SEQ ID NO: 16153 - DNA, 20 bp, Homo sapiens
aatcataatttcaactagat

SEQ ID NO: 16154 - DNA, 18 bp, Homo sapiens
gacccaggcttcattaca

SEQ ID NO: 16155 - DNA, 19 bp, Homo sapiens
ggagaagggatatgttgtg

SEQ ID NO: 16156 - DNA, 21 bp, Homo sapiens
taaatctccctggcatgaggt

SEQ ID NO: 16157 - DNA, 20 bp, Homo sapiens
tcagtgttaagtgcacttgt

SEQ ID NO: 16158 - DNA, 22 bp, Homo sapiens
aactcctgcaattcacggcatc

SEQ ID NO: 16159 - DNA, 16 bp, Homo sapiens
ccagagatcactgcag

SEQ ID NO: 16160 - DNA, 23 bp, Homo sapiens
ccctaccactgcgaggcctgcgg

SEQ ID NO: 16161 - DNA, 17 bp, Homo sapiens
ctgtcctgtatgtatcc

SEQ ID NO: 16162 - DNA, 22 bp, Homo sapiens
gagccaagatcgtgccactgca

SEQ ID NO: 16163 - DNA, 19 bp, Homo sapiens
gcacgtgtgagctgggcca

SEQ ID NO: 16164 - DNA, 22 bp, Homo sapiens
gcctgaacccccagcctgggct

SEQ ID NO: 16165 - DNA, 19 bp, Homo sapiens
ggaggaggaggatacgcca

SEQ ID NO: 16166 - DNA, 20 bp, Homo sapiens
tcctggcggcttccctgcgg

SEQ ID NO: 16167 - DNA, 21 bp, Homo sapiens
tgaggttgcatgggcttggtt

SEQ ID NO: 16168 - DNA, 18 bp, Homo sapiens
tgatgaggtatcaggtgg

SEQ ID NO: 16169 - DNA, 21 bp, Homo sapiens
tgcagtgagccaagatcgtgc

SEQ ID NO: 16170 - DNA, 19 bp, Homo sapiens
aatttgctaaatattttaa

SEQ ID NO: 16171 - DNA, 19 bp, Homo sapiens
acacctgtagacgttcgcc

SEQ ID NO: 16172 - DNA, 22 bp, Homo sapiens
atactgtttctccaaacactta

SEQ ID NO: 16173 - DNA, 19 bp, Homo sapiens
atatgtgctgtctattata

SEQ ID NO: 16174 - DNA, 18 bp, Homo sapiens
cagacgtgcctctgtgta

SEQ ID NO: 16175 - DNA, 16 bp, Homo sapiens
ccagatggatctgtta

SEQ ID NO: 16176 - DNA, 23 bp, Homo sapiens
gactggaaaggaatggaaaatat

SEQ ID NO: 16177 - DNA, 20 bp, Homo sapiens
ggcaatgtctatttcaggga

SEQ ID NO: 16178 - DNA, 17 bp, Homo sapiens
ggtatagacaaccagct

SEQ ID NO: 16179 - DNA, 19 bp, Homo sapiens
taaggactgcactatagtt

SEQ ID NO: 16180 - DNA, 18 bp, Homo sapiens
tggaaactctccagttca

SEQ ID NO: 16181 - DNA, 17 bp, Homo sapiens
ttgtacttagcaaatac

SEQ ID NO: 16182 - DNA, 20 bp, Homo sapiens
gggaagcgcggggccgcggc

SEQ ID NO: 16183 - DNA, 19 bp, Homo sapiens
taaagataattaaaaatga

SEQ ID NO: 16184 - DNA, 19 bp, Homo sapiens
cccgctaatgtttccatca

SEQ ID NO: 16185 - DNA, 18 bp, Homo sapiens
gtttccatcatgtgtaca

SEQ ID NO: 16186 - DNA, 17 bp, Homo sapiens
gaacaaaaaatgcccaa

SEQ ID NO: 16187 - DNA, 18 bp, Homo sapiens
accaaaaagaggctgggc

SEQ ID NO: 16188 - DNA, 23 bp, Homo sapiens
gaaaccacgtgaaacctacattg

SEQ ID NO: 16189 - DNA, 17 bp, Homo sapiens
ttgctatgttcataatt

SEQ ID NO: 16190 - DNA, 24 bp, Homo sapiens
ttgtaataaaccaagctgtacaat

SEQ ID NO: 16191 - DNA, 24 bp, Homo sapiens
ttttaaggctatatgtagtgtatg

SEQ ID NO: 16192 - DNA, 24 bp, Homo sapiens
acctgggctgtgggcttctgggtc

SEQ ID NO: 16193 - DNA, 19 bp, Homo sapiens
caccacacaccttccttct

SEQ ID NO: 16194 - DNA, 19 bp, Homo sapiens
cactttcattttcaattga

SEQ ID NO: 16195 - DNA, 22 bp, Homo sapiens
tgcccaggtagcccctccccag

SEQ ID NO: 16196 - DNA, 21 bp, Homo sapiens
caagctgggctgggtctagtc

SEQ ID NO: 16197 - DNA, 19 bp, Homo sapiens
cccaccattcactgtgaca

SEQ ID NO: 16198 - DNA, 20 bp, Homo sapiens
cgtgcctgccccactgtgac

SEQ ID NO: 16199 - DNA, 21 bp, Homo sapiens
aagagactttcttctgtgtca

SEQ ID NO: 16200 - DNA, 20 bp, Homo sapiens
accagagggagtcacaggca

SEQ ID NO: 16201 - DNA, 20 bp, Homo sapiens
acctaggagcccaggacccc

SEQ ID NO: 16202 - DNA, 24 bp, Homo sapiens
agagagaacaaatggctgtgggta

SEQ ID NO: 16203 - DNA, 21 bp, Homo sapiens
aggccgggctgggctcagcca

SEQ ID NO: 16204 - DNA, 22 bp, Homo sapiens
atctgttaagatccagatctct

SEQ ID NO: 16205 - DNA, 23 bp, Homo sapiens
ccctggtgaacctagcgctgtgg

SEQ ID NO: 16206 - DNA, 20 bp, Homo sapiens
ccttttctccatgcattgct

SEQ ID NO: 16207 - DNA, 19 bp, Homo sapiens
cttttccccatcctcaagg

SEQ ID NO: 16208 - DNA, 18 bp, Homo sapiens
gcccacatcccacttcct

SEQ ID NO: 16209 - DNA, 21 bp, Homo sapiens
gccctggggtaggggctgtga

SEQ ID NO: 16210 - DNA, 26 bp, Homo sapiens
gccttgcatatggttctgaccagtca

SEQ ID NO: 16211 - DNA, 17 bp, Homo sapiens
tccggccccacacagct

SEQ ID NO: 16212 - DNA, 20 bp, Homo sapiens
ttgatgtgtttgtttggctt

SEQ ID NO: 16213 - DNA, 19 bp, Homo sapiens
attggtctggtgcagcata

SEQ ID NO: 16214 - DNA, 18 bp, Homo sapiens
tcctggggattctgggga

SEQ ID NO: 16215 - DNA, 23 bp, Homo sapiens
tccttccttcccctagtgtctgg

SEQ ID NO: 16216 - DNA, 23 bp, Homo sapiens
tgagtgggaatgcgttgggactg

SEQ ID NO: 16217 - DNA, 22 bp, Homo sapiens
cagtgttgctcccatctcttct

SEQ ID NO: 16218 - DNA, 21 bp, Homo sapiens
ccagatctggcttctttccca

SEQ ID NO: 16219 - DNA, 26 bp, Homo sapiens
ccagcctcatcaccgtgctcttctca

SEQ ID NO: 16220 - DNA, 24 bp, Homo sapiens
ccctccacccacccccacgacccc

SEQ ID NO: 16221 - DNA, 20 bp, Homo sapiens
gaaaaagaggaagccattgg

SEQ ID NO: 16222 - DNA, 19 bp, Homo sapiens
gggaggagccagtttgcca

SEQ ID NO: 16223 - DNA, 18 bp, Homo sapiens
tccttccctgtcagtgtt

SEQ ID NO: 16224 - DNA, 22 bp, Homo sapiens
ttttgctacaatttgtaactta

SEQ ID NO: 16225 - DNA, 20 bp, Homo sapiens
agccaagaccagcaggtccc

SEQ ID NO: 16226 - DNA, 19 bp, Homo sapiens
ccatcaccaagactggcca

SEQ ID NO: 16227 - DNA, 20 bp, Homo sapiens
cgcgcgcccgcccgcgccgc

SEQ ID NO: 16228 - DNA, 20 bp, Homo sapiens
aacctgcctgacttcctgct

SEQ ID NO: 16229 - DNA, 21 bp, Homo sapiens
agaacatttttctttccctca

SEQ ID NO: 16230 - DNA, 19 bp, Homo sapiens
agattcatactttactgta

SEQ ID NO: 16231 - DNA, 18 bp, Homo sapiens
cagcctcagcaacaaaca

SEQ ID NO: 16232 - DNA, 21 bp, Homo sapiens
ccatttctttcctctattcag

SEQ ID NO: 16233 - DNA, 23 bp, Homo sapiens
cttcacaattttaagccactttt

SEQ ID NO: 16234 - DNA, 19 bp, Homo sapiens
gaaaatcagatttttttta

SEQ ID NO: 16235 - DNA, 18 bp, Homo sapiens
tctctgctaaaaatacaa

SEQ ID NO: 16236 - DNA, 24 bp, Homo sapiens
tgcatggccatgtgtttgtaggtg

SEQ ID NO: 16237 - DNA, 20 bp, Homo sapiens
ttacagctttgccgggaagt

SEQ ID NO: 16238 - DNA, 24 bp, Homo sapiens
gtgtgtgtgagtggagagtgagtg

SEQ ID NO: 16239 - DNA, 30 bp, Homo sapiens
atagttacagggggtttttttgttgttttt

SEQ ID NO: 16240 - DNA, 25 bp, Homo sapiens
atttgaacaatgtactccctggcct

SEQ ID NO: 16241 - DNA, 20 bp, Homo sapiens
caaagatcctgcgtgcagtg

SEQ ID NO: 16242 - DNA, 18 bp, Homo sapiens
ccacccacctccgcctcc

SEQ ID NO: 16243 - DNA, 22 bp, Homo sapiens
gctgtctcaggccttccttaga

SEQ ID NO: 16244 - DNA, 23 bp, Homo sapiens
tcagccccaggtagcagaactca

SEQ ID NO: 16245 - DNA, 19 bp, Homo sapiens
agtgtgaaaaaagcacctt

SEQ ID NO: 16246 - DNA, 26 bp, Homo sapiens
atacttctttaaggttgcttttgctg

SEQ ID NO: 16247 - DNA, 16 bp, Homo sapiens
gtcagtgcacatccta

SEQ ID NO: 16248 - DNA, 21 bp, Homo sapiens
aaaacttcttgctgaatggta

SEQ ID NO: 16249 - DNA, 19 bp, Homo sapiens
caggaaatgccttacttca

SEQ ID NO: 16250 - DNA, 23 bp, Homo sapiens
atgtatcatactatagtcttgaa

SEQ ID NO: 16251 - DNA, 21 bp, Homo sapiens
gcaggactgagggtttttgca

SEQ ID NO: 16252 - DNA, 22 bp, Homo sapiens
tgtgtaggttgcaattgaacat

SEQ ID NO: 16253 - DNA, 21 bp, Homo sapiens
cccaccaggtccctcccacaa

SEQ ID NO: 16254 - DNA, 19 bp, Homo sapiens
gatgctcaagcactcaaac

SEQ ID NO: 16255 - DNA, 18 bp, Homo sapiens
tgctgttctttagtgaaa

SEQ ID NO: 16256 - DNA, 19 bp, Homo sapiens
tgggtggattgcttgaaac

SEQ ID NO: 16257 - DNA, 20 bp, Homo sapiens
aaaaggtacctgtacttatg

SEQ ID NO: 16258 - DNA, 21 bp, Homo sapiens
agatctttctgtgacaggtaa

SEQ ID NO: 16259 - DNA, 20 bp, Homo sapiens
tatagacagaaataataagc

SEQ ID NO: 16260 - DNA, 22 bp, Homo sapiens
tgcatagtgatttttgaatttg

SEQ ID NO: 16261 - DNA, 18 bp, Homo sapiens
tgggtggatcacctgagg

SEQ ID NO: 16262 - DNA, 18 bp, Homo sapiens
atgcagtttcagcagcaa

SEQ ID NO: 16263 - DNA, 21 bp, Homo sapiens
cacttcattctccccgtctga

SEQ ID NO: 16264 - DNA, 19 bp, Homo sapiens
gcagttcacatcgatttcc

SEQ ID NO: 16265 - DNA, 23 bp, Homo sapiens
gttagagtcgtggaaaaatccct

SEQ ID NO: 16266 - DNA, 23 bp, Homo sapiens
tcatccagcagctccccccacca

SEQ ID NO: 16267 - DNA, 21 bp, Homo sapiens
tctgctggacagtggactgtt

SEQ ID NO: 16268 - DNA, 20 bp, Homo sapiens
tgggacctaacttgaagtta

SEQ ID NO: 16269 - DNA, 20 bp, Homo sapiens
acacggtgcaccaatctaca

SEQ ID NO: 16270 - DNA, 24 bp, Homo sapiens
atctggacttgcccttgtctgttc

SEQ ID NO: 16271 - DNA, 16 bp, Homo sapiens
tggacaacctggctgg

SEQ ID NO: 16272 - DNA, 22 bp, Homo sapiens
ccctcctttccaacttccttcc

SEQ ID NO: 16273 - DNA, 19 bp, Homo sapiens
cctcctcttcacccccagg

SEQ ID NO: 16274 - DNA, 18 bp, Homo sapiens
tctctgccccctccctct

SEQ ID NO: 16275 - DNA, 18 bp, Homo sapiens
ttcctgcccctctctgcc

SEQ ID NO: 16276 - DNA, 21 bp, Homo sapiens
acagctgagacctcctactca

SEQ ID NO: 16277 - DNA, 18 bp, Homo sapiens
atttttaaaaattagcca

SEQ ID NO: 16278 - DNA, 16 bp, Homo sapiens
ctttcagataaaatgt

SEQ ID NO: 16279 - DNA, 22 bp, Homo sapiens
ggaattgaacaggctgcttgca

SEQ ID NO: 16280 - DNA, 20 bp, Homo sapiens
acctcttttggcatgagcta

SEQ ID NO: 16281 - DNA, 21 bp, Homo sapiens
gcagggaagagaaactttgcc

SEQ ID NO: 16282 - DNA, 20 bp, Homo sapiens
tagctcatgaagacaatcac

SEQ ID NO: 16283 - DNA, 21 bp, Homo sapiens
actctctattattgtgttgct

SEQ ID NO: 16284 - DNA, 18 bp, Homo sapiens
cagtgtttcaatccagcc

SEQ ID NO: 16285 - DNA, 21 bp, Homo sapiens
gtgtgtgactcagcttggctg

SEQ ID NO: 16286 - DNA, 20 bp, Homo sapiens
taataaaaacttgaatccaa

SEQ ID NO: 16287 - DNA, 21 bp, Homo sapiens
atctgccaaggttgcttgccc

SEQ ID NO: 16288 - DNA, 22 bp, Homo sapiens
atgctccaacagccattgccta

SEQ ID NO: 16289 - DNA, 20 bp, Homo sapiens
caacccggcccctctgtccc

SEQ ID NO: 16290 - DNA, 23 bp, Homo sapiens
caaggcaggaggtacaccagctg

SEQ ID NO: 16291 - DNA, 23 bp, Homo sapiens
cccagccttccaaggtgaggcca

SEQ ID NO: 16292 - DNA, 20 bp, Homo sapiens
cctgctcctgaagcctctgt

SEQ ID NO: 16293 - DNA, 19 bp, Homo sapiens
ctcctgttctggcctgaga

SEQ ID NO: 16294 - DNA, 19 bp, Homo sapiens
cttaaacctctctgcctct

SEQ ID NO: 16295 - DNA, 22 bp, Homo sapiens
gcaagagctgatgaggtcctga

SEQ ID NO: 16296 - DNA, 18 bp, Homo sapiens
gccacaagcgcaggggta

SEQ ID NO: 16297 - DNA, 22 bp, Homo sapiens
gcccctctgtccccttggctct

SEQ ID NO: 16298 - DNA, 21 bp, Homo sapiens
gcttcaggcccctctgctcct

SEQ ID NO: 16299 - DNA, 21 bp, Homo sapiens
gcttgagttgcccataggccc

SEQ ID NO: 16300 - DNA, 18 bp, Homo sapiens
ggagccccctctgccaca

SEQ ID NO: 16301 - DNA, 20 bp, Homo sapiens
tcctgccctcagcctctgaa

SEQ ID NO: 16302 - DNA, 19 bp, Homo sapiens
tcctggtcctgctccagga

SEQ ID NO: 16303 - DNA, 17 bp, Homo sapiens
tggggccaaggcctacc

SEQ ID NO: 16304 - DNA, 22 bp, Homo sapiens
aatgtgggaaagttttcagcca

SEQ ID NO: 16305 - DNA, 21 bp, Homo sapiens
accagaaatacatattatgaa

SEQ ID NO: 16306 - DNA, 15 bp, Homo sapiens
aggtgctggaacagg

SEQ ID NO: 16307 - DNA, 19 bp, Homo sapiens
attgacagataatgactga

SEQ ID NO: 16308 - DNA, 19 bp, Homo sapiens
ccccagaaaacttgtctct

SEQ ID NO: 16309 - DNA, 23 bp, Homo sapiens
cctcttttccccctagaagaacc

SEQ ID NO: 16310 - DNA, 19 bp, Homo sapiens
ctgcaacctccgcctccca

SEQ ID NO: 16311 - DNA, 16 bp, Homo sapiens
gctgtctcttctcacc

SEQ ID NO: 16312 - DNA, 18 bp, Homo sapiens
tccgcctcccaggttcaa

SEQ ID NO: 16313 - DNA, 16 bp, Homo sapiens
tgcagtaagtgtagta

SEQ ID NO: 16314 - DNA, 21 bp, Homo sapiens
tggaaacttgtatagacagag

SEQ ID NO: 16315 - DNA, 21 bp, Homo sapiens
aagtctcgagatgccagtgaa

SEQ ID NO: 16316 - DNA, 21 bp, Homo sapiens
agcaacaggattccctcagta

SEQ ID NO: 16317 - DNA, 19 bp, Homo sapiens
cataacagcccctttctca

SEQ ID NO: 16318 - DNA, 21 bp, Homo sapiens
gccaggtgcagcaggatccct

SEQ ID NO: 16319 - DNA, 15 bp, Homo sapiens
ccagggacaaaccct

SEQ ID NO: 16320 - DNA, 16 bp, Homo sapiens
cccacctacatttcct

SEQ ID NO: 16321 - DNA, 23 bp, Homo sapiens
tcctgaactctgggatcctgcgg

SEQ ID NO: 16322 - DNA, 15 bp, Homo sapiens
tctccctctgccttt

SEQ ID NO: 16323 - DNA, 21 bp, Homo sapiens
tttggggtcccagagcctgct

SEQ ID NO: 16324 - DNA, 18 bp, Homo sapiens
aagaaaagggaaagccat

SEQ ID NO: 16325 - DNA, 16 bp, Homo sapiens
agttgctaagcactta

SEQ ID NO: 16326 - DNA, 19 bp, Homo sapiens
ctttgacaggcggtttgtg

SEQ ID NO: 16327 - DNA, 19 bp, Homo sapiens
tcaattctgaaccaccacc

SEQ ID NO: 16328 - DNA, 18 bp, Homo sapiens
tcacttgagcatgtaata

SEQ ID NO: 16329 - DNA, 20 bp, Homo sapiens
tgggtgtttatatgaaacta

SEQ ID NO: 16330 - DNA, 21 bp, Homo sapiens
tttctttgatgttttaacttt

SEQ ID NO: 16331 - DNA, 18 bp, Homo sapiens
atttaggctttgatgaga

SEQ ID NO: 16332 - DNA, 19 bp, Homo sapiens
ccaagcccacccttccaca

SEQ ID NO: 16333 - DNA, 18 bp, Homo sapiens
ccaggtttttagatccca

SEQ ID NO: 16334 - DNA, 19 bp, Homo sapiens
cctgggaactgtttggtcc

SEQ ID NO: 16335 - DNA, 21 bp, Homo sapiens
ctatcccatcgaaattcccca

SEQ ID NO: 16336 - DNA, 20 bp, Homo sapiens
gcttccctgtcccttccctc

SEQ ID NO: 16337 - DNA, 20 bp, Homo sapiens
ggaactgttcagaaatctca

SEQ ID NO: 16338 - DNA, 20 bp, Homo sapiens
gtatgtgtcaagaattactc

SEQ ID NO: 16339 - DNA, 26 bp, Homo sapiens
gtttgagctttgtcattgcttgtctc

SEQ ID NO: 16340 - DNA, 21 bp, Homo sapiens
tccagtgatggtcccaccttt

SEQ ID NO: 16341 - DNA, 21 bp, Homo sapiens
ttcccatcctctctctgtgga

SEQ ID NO: 16342 - DNA, 18 bp, Homo sapiens
ttctcctgcctctagcct

SEQ ID NO: 16343 - DNA, 20 bp, Homo sapiens
ttgtttgttagtttgcctgg

SEQ ID NO: 16344 - DNA, 18 bp, Homo sapiens
cctgccctcctagctcca

SEQ ID NO: 16345 - DNA, 22 bp, Homo sapiens
ctggcgaccactgcccattcca

SEQ ID NO: 16346 - DNA, 18 bp, Homo sapiens
cttgaagaacaaggctga

SEQ ID NO: 16347 - DNA, 23 bp, Homo sapiens
gcccctcccccaacaagatctct

SEQ ID NO: 16348 - DNA, 19 bp, Homo sapiens
gtcccctgccccggcctca

SEQ ID NO: 16349 - DNA, 19 bp, Homo sapiens
tctgagccggaggcccttg

SEQ ID NO: 16350 - DNA, 19 bp, Homo sapiens
aagcaattctcctgcctca

SEQ ID NO: 16351 - DNA, 18 bp, Homo sapiens
accgtgaccatgctgcca

SEQ ID NO: 16352 - DNA, 19 bp, Homo sapiens
ccgtgggagccctgcctct

SEQ ID NO: 16353 - DNA, 19 bp, Homo sapiens
cctgaccccaacacctgca

SEQ ID NO: 16354 - DNA, 18 bp, Homo sapiens
cctgcaacctccacctcc

SEQ ID NO: 16355 - DNA, 18 bp, Homo sapiens
cgtgagccactgccccca

SEQ ID NO: 16356 - DNA, 19 bp, Homo sapiens
ctgacagagaaggtctcct

SEQ ID NO: 16357 - DNA, 22 bp, Homo sapiens
ctgggattacaggcacctgcca

SEQ ID NO: 16358 - DNA, 18 bp, Homo sapiens
ggaaagggacggaatcaa

SEQ ID NO: 16359 - DNA, 18 bp, Homo sapiens
ggctgcgcccgctccctc

SEQ ID NO: 16360 - DNA, 17 bp, Homo sapiens
tcaagtgattctcctgc

SEQ ID NO: 16361 - DNA, 18 bp, Homo sapiens
tccacctcccgggttcaa

SEQ ID NO: 16362 - DNA, 21 bp, Homo sapiens
tccagctaggcccgtgtggtt

SEQ ID NO: 16363 - DNA, 20 bp, Homo sapiens
tctcttgggaacgctggaga

SEQ ID NO: 16364 - DNA, 20 bp, Homo sapiens
tggccaggctggtcttgaac

SEQ ID NO: 16365 - DNA, 18 bp, Homo sapiens
ttctcctgcctcagcctt

SEQ ID NO: 16366 - DNA, 19 bp, Homo sapiens
ttgggccccttccccacca

SEQ ID NO: 16367 - DNA, 20 bp, Homo sapiens
aataaatgaagcctgaaaca

SEQ ID NO: 16368 - DNA, 18 bp, Homo sapiens
tgtagtcctgtcatttaa

SEQ ID NO: 16369 - DNA, 21 bp, Homo sapiens
ttaaatgaactaattactttt

SEQ ID NO: 16370 - DNA, 18 bp, Homo sapiens
aatgaaaagccttccttc

SEQ ID NO: 16371 - DNA, 16 bp, Homo sapiens
cagacttgttgctgtc

SEQ ID NO: 16372 - DNA, 30 bp, Homo sapiens
catgagccctcagaccacttgcttcccaca

SEQ ID NO: 16373 - DNA, 21 bp, Homo sapiens
cccgccttcccatctgtcaga

SEQ ID NO: 16374 - DNA, 27 bp, Homo sapiens
ccttggccgaggatggaagatttggag

SEQ ID NO: 16375 - DNA, 19 bp, Homo sapiens
cttggcatatgtttggtct

SEQ ID NO: 16376 - DNA, 16 bp, Homo sapiens
ctttcctctctgcgag

SEQ ID NO: 16377 - DNA, 24 bp, Homo sapiens
gctcccctctcgtctcctcccctc

SEQ ID NO: 16378 - DNA, 23 bp, Homo sapiens
tagggcattccagcaagaggctg

SEQ ID NO: 16379 - DNA, 20 bp, Homo sapiens
tccatttgcaaacagatctt

SEQ ID NO: 16380 - DNA, 25 bp, Homo sapiens
tcttagaagatagatgcagcagtaa

SEQ ID NO: 16381 - DNA, 22 bp, Homo sapiens
ttccaaagcaatttcttaacca

SEQ ID NO: 16382 - DNA, 17 bp, Homo sapiens
ctcactactgtcttcct

SEQ ID NO: 16383 - DNA, 19 bp, Homo sapiens
ctcttttcttcttagcctt

SEQ ID NO: 16384 - DNA, 22 bp, Homo sapiens
gttaccactccgaccggactca

SEQ ID NO: 16385 - DNA, 18 bp, Homo sapiens
taatttagctttgtgtca

SEQ ID NO: 16386 - DNA, 19 bp, Homo sapiens
tcttacctgctttaatttt

SEQ ID NO: 16387 - DNA, 21 bp, Homo sapiens
acttgattcaacgtttggttc

SEQ ID NO: 16388 - DNA, 19 bp, Homo sapiens
agaagagaacagtactctc

SEQ ID NO: 16389 - DNA, 21 bp, Homo sapiens
agatcaccataagcgtccctg

SEQ ID NO: 16390 - DNA, 23 bp, Homo sapiens
agctggggtagaggcactgccca

SEQ ID NO: 16391 - DNA, 17 bp, Homo sapiens
atgtgctgctcgtgagc

SEQ ID NO: 16392 - DNA, 20 bp, Homo sapiens
caagggagcgatactaaggc

SEQ ID NO: 16393 - DNA, 21 bp, Homo sapiens
gaaaatcagaggagccactga

SEQ ID NO: 16394 - DNA, 24 bp, Homo sapiens
gataggagacaggagatcaccata

SEQ ID NO: 16395 - DNA, 22 bp, Homo sapiens
gcttggacctgggtgcctggct

SEQ ID NO: 16396 - DNA, 19 bp, Homo sapiens
gtggtcttaacgtagactg

SEQ ID NO: 16397 - DNA, 24 bp, Homo sapiens
tggatggacttcaacttggagttg

SEQ ID NO: 16398 - DNA, 20 bp, Homo sapiens
tggccaggctggtcttgaac

SEQ ID NO: 16399 - DNA, 18 bp, Homo sapiens
tggtcttgcagttttgaa

SEQ ID NO: 16400 - DNA, 16 bp, Homo sapiens
tttagacacaaacctc

SEQ ID NO: 16401 - DNA, 21 bp, Homo sapiens
tttcccaattgttttagcctt

SEQ ID NO: 16402 - DNA, 19 bp, Homo sapiens
acctttttcccccccattt

SEQ ID NO: 16403 - DNA, 20 bp, Homo sapiens
agtgctaggaaataactcac

SEQ ID NO: 16404 - DNA, 20 bp, Homo sapiens
cagaagaaaaactgtaatcc

SEQ ID NO: 16405 - DNA, 19 bp, Homo sapiens
caggaagaatttttacagt

SEQ ID NO: 16406 - DNA, 20 bp, Homo sapiens
agtggttaggggatgttgtg

SEQ ID NO: 16407 - DNA, 19 bp, Homo sapiens
atctgtgaagagtctcagc

SEQ ID NO: 16408 - DNA, 17 bp, Homo sapiens
gactgactcctgcagca

SEQ ID NO: 16409 - DNA, 23 bp, Homo sapiens
gctgtttgtctccaggtgtcaga

SEQ ID NO: 16410 - DNA, 19 bp, Homo sapiens
ggtgtcatcctgttcctcc

SEQ ID NO: 16411 - DNA, 23 bp, Homo sapiens
tctgtgtgccctgcccatcacca

SEQ ID NO: 16412 - DNA, 20 bp, Homo sapiens
agaccacatccacccaggga

SEQ ID NO: 16413 - DNA, 18 bp, Homo sapiens
agcatccacttgtctgtg

SEQ ID NO: 16414 - DNA, 15 bp, Homo sapiens
caagccaagcatcca

SEQ ID NO: 16415 - DNA, 18 bp, Homo sapiens
cacaaacatttgctctta

SEQ ID NO: 16416 - DNA, 20 bp, Homo sapiens
ctccgggagcgggagctgga

SEQ ID NO: 16417 - DNA, 21 bp, Homo sapiens
ctgattggttgccgtggtctt

SEQ ID NO: 16418 - DNA, 18 bp, Homo sapiens
ttttttgtgggttgcttt

SEQ ID NO: 16419 - DNA, 20 bp, Homo sapiens
agaaaatgaagcattggtca

SEQ ID NO: 16420 - DNA, 18 bp, Homo sapiens
caatttagaatcactttt

SEQ ID NO: 16421 - DNA, 22 bp, Homo sapiens
ccaccatgccaataaggctctc

SEQ ID NO: 16422 - DNA, 18 bp, Homo sapiens
ccctatgacaacactttg

SEQ ID NO: 16423 - DNA, 18 bp, Homo sapiens
ctctccctcatggtttca

SEQ ID NO: 16424 - DNA, 20 bp, Homo sapiens
gagaacattccacatgccaa

SEQ ID NO: 16425 - DNA, 18 bp, Homo sapiens
gctgtatatacctgtcaa

SEQ ID NO: 16426 - DNA, 20 bp, Homo sapiens
ggatggcgaggcagccgggc

SEQ ID NO: 16427 - DNA, 19 bp, Homo sapiens
aaactcctgacctcaggtg

SEQ ID NO: 16428 - DNA, 22 bp, Homo sapiens
acctgggctgtggctctctgtc

SEQ ID NO: 16429 - DNA, 21 bp, Homo sapiens
catggcagcaggatgcaggga

SEQ ID NO: 16430 - DNA, 22 bp, Homo sapiens
cttgagccctcagcctgtgata

SEQ ID NO: 16431 - DNA, 20 bp, Homo sapiens
gaattgctgccgtctggcct

SEQ ID NO: 16432 - DNA, 19 bp, Homo sapiens
gcatgcctcagtttcctca

SEQ ID NO: 16433 - DNA, 23 bp, Homo sapiens
taggggcctcttggcagaggctg

SEQ ID NO: 16434 - DNA, 19 bp, Homo sapiens
tgccactaacactgtgatg

SEQ ID NO: 16435 - DNA, 19 bp, Homo sapiens
tgtcagtacattttgtgcc

SEQ ID NO: 16436 - DNA, 18 bp, Homo sapiens
agagtcttataacacctc

SEQ ID NO: 16437 - DNA, 18 bp, Homo sapiens
aggagttcacaatgatgc

SEQ ID NO: 16438 - DNA, 20 bp, Homo sapiens
atgcccagatgctgcctcag

SEQ ID NO: 16439 - DNA, 17 bp, Homo sapiens
caactttccctccctcc

SEQ ID NO: 16440 - DNA, 18 bp, Homo sapiens
cactttcttcatagactc

SEQ ID NO: 16441 - DNA, 19 bp, Homo sapiens
cagccctcctaatacctca

SEQ ID NO: 16442 - DNA, 21 bp, Homo sapiens
ccatgagggtaaagttgtgtg

SEQ ID NO: 16443 - DNA, 17 bp, Homo sapiens
cccactgctgccctctg

SEQ ID NO: 16444 - DNA, 21 bp, Homo sapiens
cccagaccagcagtcacccca

SEQ ID NO: 16445 - DNA, 18 bp, Homo sapiens
ctccaggcacccacctgc

SEQ ID NO: 16446 - DNA, 21 bp, Homo sapiens
ctctgggaaccccaccccact

SEQ ID NO: 16447 - DNA, 18 bp, Homo sapiens
ctgaaatgtctccacgtc

SEQ ID NO: 16448 - DNA, 19 bp, Homo sapiens
gaaggagctctgccagtgg

SEQ ID NO: 16449 - DNA, 18 bp, Homo sapiens
gctcaaccaactccttta

SEQ ID NO: 16450 - DNA, 20 bp, Homo sapiens
gctccaagaaaggccaccca

SEQ ID NO: 16451 - DNA, 24 bp, Homo sapiens
gcttccctgcctcctcctaccttt

SEQ ID NO: 16452 - DNA, 19 bp, Homo sapiens
ggctcttgggatgcagcaa

SEQ ID NO: 16453 - DNA, 19 bp, Homo sapiens
gtgatacccagaccagcag

SEQ ID NO: 16454 - DNA, 20 bp, Homo sapiens
tccagccctcctaatacctc

SEQ ID NO: 16455 - DNA, 18 bp, Homo sapiens
tctgaaaagccactctgg

SEQ ID NO: 16456 - DNA, 15 bp, Homo sapiens
tgcagcatctttcct

SEQ ID NO: 16457 - DNA, 19 bp, Homo sapiens
tgcccagatgctgcctcag

SEQ ID NO: 16458 - DNA, 16 bp, Homo sapiens
tggggcttgggaattc

SEQ ID NO: 16459 - DNA, 23 bp, Homo sapiens
atgcccaggcgattgcgtcccag

SEQ ID NO: 16460 - DNA, 19 bp, Homo sapiens
ctttagactacagttccca

SEQ ID NO: 16461 - DNA, 20 bp, Homo sapiens
gttctttactttttgtttgg

SEQ ID NO: 16462 - DNA, 20 bp, Homo sapiens
aacagtaaattattgtgctt

SEQ ID NO: 16463 - DNA, 20 bp, Homo sapiens
acagtgaaaaaatttaaagc

SEQ ID NO: 16464 - DNA, 20 bp, Homo sapiens
aggggtacatcgtcaacata

SEQ ID NO: 16465 - DNA, 19 bp, Homo sapiens
caatgtagaaagaatgtga

SEQ ID NO: 16466 - DNA, 19 bp, Homo sapiens
caccttccagactacgctc

SEQ ID NO: 16467 - DNA, 21 bp, Homo sapiens
cattttgtatctccgcactca

SEQ ID NO: 16468 - DNA, 25 bp, Homo sapiens
ccacgggtgcaggccttttccctca

SEQ ID NO: 16469 - DNA, 19 bp, Homo sapiens
cccttccccactcccatcc

SEQ ID NO: 16470 - DNA, 19 bp, Homo sapiens
ccgcactcatcctgttata

SEQ ID NO: 16471 - DNA, 19 bp, Homo sapiens
ccttccccactcccatccc

SEQ ID NO: 16472 - DNA, 21 bp, Homo sapiens
gcttctctcatcctcccctct

SEQ ID NO: 16473 - DNA, 23 bp, Homo sapiens
ggatgtgagagtaacgtaccgta

SEQ ID NO: 16474 - DNA, 22 bp, Homo sapiens
gtttccagttgtctaacgggtt

SEQ ID NO: 16475 - DNA, 24 bp, Homo sapiens
ttttacagaatataaacaacagta

SEQ ID NO: 16476 - DNA, 21 bp, Homo sapiens
agtggctttgatttgggatta

SEQ ID NO: 16477 - DNA, 18 bp, Homo sapiens
ttaattcctatttcaata

SEQ ID NO: 16478 - DNA, 17 bp, Homo sapiens
aaaacaaaaaccccaaa

SEQ ID NO: 16479 - DNA, 19 bp, Homo sapiens
aaggaggtataacctttcc

SEQ ID NO: 16480 - DNA, 20 bp, Homo sapiens
aaggctgggcttcaaaatca

SEQ ID NO: 16481 - DNA, 20 bp, Homo sapiens
aatttttaagaaaagcatca

SEQ ID NO: 16482 - DNA, 19 bp, Homo sapiens
acttgtcaaggctgtttta

SEQ ID NO: 16483 - DNA, 27 bp, Homo sapiens
catggtttttgaggagggcttttgtca

SEQ ID NO: 16484 - DNA, 18 bp, Homo sapiens
ccaaacttggttctctga

SEQ ID NO: 16485 - DNA, 18 bp, Homo sapiens
ccacctttgtggtaaaca

SEQ ID NO: 16486 - DNA, 22 bp, Homo sapiens
cctccccccaattcccccccca

SEQ ID NO: 16487 - DNA, 16 bp, Homo sapiens
cggcccgggatgcact

SEQ ID NO: 16488 - DNA, 18 bp, Homo sapiens
cttccaaagccagagcca

SEQ ID NO: 16489 - DNA, 19 bp, Homo sapiens
ctttatgaaagacatcaca

SEQ ID NO: 16490 - DNA, 19 bp, Homo sapiens
ctttgtggtaaacaatgaa

SEQ ID NO: 16491 - DNA, 22 bp, Homo sapiens
gcacccttgcttgcctttttca

SEQ ID NO: 16492 - DNA, 19 bp, Homo sapiens
gccccctccgcccgcctcc

SEQ ID NO: 16493 - DNA, 20 bp, Homo sapiens
gttaccttcctgtaactgcc

SEQ ID NO: 16494 - DNA, 17 bp, Homo sapiens
tactcaaagtctaacaa

SEQ ID NO: 16495 - DNA, 18 bp, Homo sapiens
agaattatttgcaatttg

SEQ ID NO: 16496 - DNA, 17 bp, Homo sapiens
atcatggtgattttatc

SEQ ID NO: 16497 - DNA, 18 bp, Homo sapiens
cctgggcagggtctgtgg

SEQ ID NO: 16498 - DNA, 19 bp, Homo sapiens
ctctcctgaccccatctgg

SEQ ID NO: 16499 - DNA, 22 bp, Homo sapiens
gcaaccagcctgagtcgcggtg

SEQ ID NO: 16500 - DNA, 22 bp, Homo sapiens
tgcccatggtgggagcgtggtc

SEQ ID NO: 16501 - DNA, 18 bp, Homo sapiens
tgtgagctgtttttggaa

SEQ ID NO: 16502 - DNA, 19 bp, Homo sapiens
acttctctcccacttctgc

SEQ ID NO: 16503 - DNA, 17 bp, Homo sapiens
agcttctggtaaatcca

SEQ ID NO: 16504 - DNA, 18 bp, Homo sapiens
aggcagggatgctgtgtt

SEQ ID NO: 16505 - DNA, 22 bp, Homo sapiens
ataagagtccccacctctactc

SEQ ID NO: 16506 - DNA, 18 bp, Homo sapiens
ctcagatcctccttctac

SEQ ID NO: 16507 - DNA, 18 bp, Homo sapiens
tgagcatagggggacagc

SEQ ID NO: 16508 - DNA, 24 bp, Homo sapiens
accacagaatgccccctccctgct

SEQ ID NO: 16509 - DNA, 16 bp, Homo sapiens
gaaccctcttcctgca

SEQ ID NO: 16510 - DNA, 23 bp, Homo sapiens
gctcttggctgtcacctgcccca

SEQ ID NO: 16511 - DNA, 18 bp, Homo sapiens
ggccaaccacagaatgcc

SEQ ID NO: 16512 - DNA, 20 bp, Homo sapiens
ggggctggggtccgcctgcc

SEQ ID NO: 16513 - DNA, 17 bp, Homo sapiens
tctttcttctcttggca

SEQ ID NO: 16514 - DNA, 18 bp, Homo sapiens
tggggcctggcatggaac

SEQ ID NO: 16515 - DNA, 18 bp, Homo sapiens
cactcattgtccatgatg

SEQ ID NO: 16516 - DNA, 17 bp, Homo sapiens
ccaaattctgttctctg

SEQ ID NO: 16517 - DNA, 19 bp, Homo sapiens
gtgctgttgcacagtgaaa

SEQ ID NO: 16518 - DNA, 20 bp, Homo sapiens
tacctgctagtcttgtgtca

SEQ ID NO: 16519 - DNA, 21 bp, Homo sapiens
tcctgcttggaagacttgggg

SEQ ID NO: 16520 - DNA, 23 bp, Homo sapiens
tttagtcaattttggatcgcttt

SEQ ID NO: 16521 - DNA, 23 bp, Homo sapiens
aatgtgggatttggagtcagaca

SEQ ID NO: 16522 - DNA, 24 bp, Homo sapiens
acctgggctcattcttcttggctc

SEQ ID NO: 16523 - DNA, 21 bp, Homo sapiens
gccagaatcctctcagagtca

SEQ ID NO: 16524 - DNA, 21 bp, Homo sapiens
gccagacgaggtcctcacagg

SEQ ID NO: 16525 - DNA, 21 bp, Homo sapiens
gcccaccccagccaccactga

SEQ ID NO: 16526 - DNA, 20 bp, Homo sapiens
ggattctcaccgtggggctg

SEQ ID NO: 16527 - DNA, 19 bp, Homo sapiens
tgatgaaggggatacgctg

SEQ ID NO: 16528 - DNA, 21 bp, Homo sapiens
tgccatcgcctccatcagcca

SEQ ID NO: 16529 - DNA, 17 bp, Homo sapiens
cactttccctccatttg

SEQ ID NO: 16530 - DNA, 19 bp, Homo sapiens
catgtgctaatgttgcaca

SEQ ID NO: 16531 - DNA, 18 bp, Homo sapiens
ggtgtcacttggctctga

SEQ ID NO: 16532 - DNA, 21 bp, Homo sapiens
gtaaatatgtgaggtgtgctg

SEQ ID NO: 16533 - DNA, 24 bp, Homo sapiens
gtatgagctgggtgtcacttggct

SEQ ID NO: 16534 - DNA, 20 bp, Homo sapiens
gtctagtttctgcctctgat

SEQ ID NO: 16535 - DNA, 22 bp, Homo sapiens
tgggacctcttattctcaaata

SEQ ID NO: 16536 - DNA, 17 bp, Homo sapiens
ttgaacaaatcacattt

SEQ ID NO: 16537 - DNA, 21 bp, Homo sapiens
agaaaggacagaatctctccc

SEQ ID NO: 16538 - DNA, 18 bp, Homo sapiens
agctgctctaaaatctca

SEQ ID NO: 16539 - DNA, 21 bp, Homo sapiens
caggaggcagctctccccaca

SEQ ID NO: 16540 - DNA, 28 bp, Homo sapiens
cagtaatgtacaggattccttgtgtaga

SEQ ID NO: 16541 - DNA, 21 bp, Homo sapiens
catgctggtggccttctgaat

SEQ ID NO: 16542 - DNA, 22 bp, Homo sapiens
ccacagagtagtgaatctctca

SEQ ID NO: 16543 - DNA, 19 bp, Homo sapiens
gctgagcatgcttgtgcag

SEQ ID NO: 16544 - DNA, 22 bp, Homo sapiens
ggaagaaagggacccctctcca

SEQ ID NO: 16545 - DNA, 20 bp, Homo sapiens
tacagcctggcaaaagttaa

SEQ ID NO: 16546 - DNA, 24 bp, Homo sapiens
tcaataatataagacctggtgtta

SEQ ID NO: 16547 - DNA, 22 bp, Homo sapiens
tgaaacgggcagagatgatgaa

SEQ ID NO: 16548 - DNA, 21 bp, Homo sapiens
ttcccaccttactaaattacc

SEQ ID NO: 16549 - DNA, 19 bp, Homo sapiens
atgcctcgctccttcctgc

SEQ ID NO: 16550 - DNA, 18 bp, Homo sapiens
cctcccagcatctgtgag

SEQ ID NO: 16551 - DNA, 18 bp, Homo sapiens
cctgccacccagcccctc

SEQ ID NO: 16552 - DNA, 20 bp, Homo sapiens
ctttggtggagaatttctta

SEQ ID NO: 16553 - DNA, 22 bp, Homo sapiens
gctccacctggggggactggga

SEQ ID NO: 16554 - DNA, 18 bp, Homo sapiens
gtgagtgcagcgtgtgtg

SEQ ID NO: 16555 - DNA, 19 bp, Homo sapiens
accaaaacaaaattaatga

SEQ ID NO: 16556 - DNA, 20 bp, Homo sapiens
ccaatcattaagccctgtga

SEQ ID NO: 16557 - DNA, 19 bp, Homo sapiens
ctttggcgacgggaaactt

SEQ ID NO: 16558 - DNA, 17 bp, Homo sapiens
gaagaggaggcctggac

SEQ ID NO: 16559 - DNA, 22 bp, Homo sapiens
gacatttaactggaatccagga

SEQ ID NO: 16560 - DNA, 23 bp, Homo sapiens
tctttcacattgcttttgacttt

SEQ ID NO: 16561 - DNA, 20 bp, Homo sapiens
tggccaggctggtcttgaac

SEQ ID NO: 16562 - DNA, 19 bp, Homo sapiens
tttgacaaaaatgagctct

SEQ ID NO: 16563 - DNA, 17 bp, Homo sapiens
acggaaaccctacccct

SEQ ID NO: 16564 - DNA, 19 bp, Homo sapiens
caacccagcccttgggctg

SEQ ID NO: 16565 - DNA, 19 bp, Homo sapiens
cacaaactcacctccctct

SEQ ID NO: 16566 - DNA, 24 bp, Homo sapiens
cctaccccttccatgctcatctca

SEQ ID NO: 16567 - DNA, 24 bp, Homo sapiens
gcttggacatgcccgcttgtgccc

SEQ ID NO: 16568 - DNA, 16 bp, Homo sapiens
gtgactgcgtacctgt

SEQ ID NO: 16569 - DNA, 17 bp, Homo sapiens
tgctccatcggctgtga

SEQ ID NO: 16570 - DNA, 22 bp, Homo sapiens
acggcctttgtcagccatggca

SEQ ID NO: 16571 - DNA, 18 bp, Homo sapiens
agacatactgtttgccta

SEQ ID NO: 16572 - DNA, 18 bp, Homo sapiens
caacctgccctctggtcc

SEQ ID NO: 16573 - DNA, 21 bp, Homo sapiens
cctcccttccccttccctgcc

SEQ ID NO: 16574 - DNA, 20 bp, Homo sapiens
gacgctccgaactcgaggca

SEQ ID NO: 16575 - DNA, 18 bp, Homo sapiens
gatcgtcctgtccatcca

SEQ ID NO: 16576 - DNA, 16 bp, Homo sapiens
ggaccagagtgtgaag

SEQ ID NO: 16577 - DNA, 17 bp, Homo sapiens
ggcttggcgcggcggcc

SEQ ID NO: 16578 - DNA, 20 bp, Homo sapiens
gggctcgcattgttcccgca

SEQ ID NO: 16579 - DNA, 20 bp, Homo sapiens
ggttgctttgaagtctcttt

SEQ ID NO: 16580 - DNA, 20 bp, Homo sapiens
gtggagggggctgtgttgtg

SEQ ID NO: 16581 - DNA, 19 bp, Homo sapiens
tcagctgcagggcactgtg

SEQ ID NO: 16582 - DNA, 18 bp, Homo sapiens
ttttattgaggccgggca

SEQ ID NO: 16583 - DNA, 25 bp, Homo sapiens
acctgggcctcctgactcctggccc

SEQ ID NO: 16584 - DNA, 26 bp, Homo sapiens
aggacctttgtgctcactttggccca

SEQ ID NO: 16585 - DNA, 23 bp, Homo sapiens
gcctggatgtgtctgcttgactt

SEQ ID NO: 16586 - DNA, 21 bp, Homo sapiens
aagttatccattggggagctc

SEQ ID NO: 16587 - DNA, 19 bp, Homo sapiens
ccaaaaaggctgtgagatg

SEQ ID NO: 16588 - DNA, 17 bp, Homo sapiens
ccctaccaagtttggca

SEQ ID NO: 16589 - DNA, 22 bp, Homo sapiens
cttgagattttacctagaggct

SEQ ID NO: 16590 - DNA, 20 bp, Homo sapiens
gccaccttttaacttgtttg

SEQ ID NO: 16591 - DNA, 21 bp, Homo sapiens
gcgttcccactttcttactct

SEQ ID NO: 16592 - DNA, 19 bp, Homo sapiens
tctgcggccaagcagtgtt

SEQ ID NO: 16593 - DNA, 21 bp, Homo sapiens
tggcagctcctactgctgctt

SEQ ID NO: 16594 - DNA, 20 bp, Homo sapiens
tttctttatggttgctgttc

SEQ ID NO: 16595 - DNA, 19 bp, Homo sapiens
aactgttgagttgatcaca

SEQ ID NO: 16596 - DNA, 21 bp, Homo sapiens
aactgttgagttgatcacata

SEQ ID NO: 16597 - DNA, 17 bp, Homo sapiens
aatcgcaccttatctga

SEQ ID NO: 16598 - DNA, 19 bp, Homo sapiens
accacttacagctttctca

SEQ ID NO: 16599 - DNA, 21 bp, Homo sapiens
agttttctttctttccttgtc

SEQ ID NO: 16600 - DNA, 20 bp, Homo sapiens
atgtttgaggacctgcaata

SEQ ID NO: 16601 - DNA, 21 bp, Homo sapiens
ccaaagatcaaacacagcatt

SEQ ID NO: 16602 - DNA, 19 bp, Homo sapiens
cggtggaatgacgtggcca

SEQ ID NO: 16603 - DNA, 15 bp, Homo sapiens
ctcctttatcttgca

SEQ ID NO: 16604 - DNA, 22 bp, Homo sapiens
ggaacatggggaccaacaaagc

SEQ ID NO: 16605 - DNA, 19 bp, Homo sapiens
tctgagatctggtgtcaga

SEQ ID NO: 16606 - DNA, 18 bp, Homo sapiens
ttggcaaatcgcacctta

SEQ ID NO: 16607 - DNA, 23 bp, Homo sapiens
tttgatttttcaagagacaagaa

SEQ ID NO: 16608 - DNA, 24 bp, Homo sapiens
aaaattgaccctgggatgagatta

SEQ ID NO: 16609 - DNA, 18 bp, Homo sapiens
tcctgtgttagctctgtg

SEQ ID NO: 16610 - DNA, 20 bp, Homo sapiens
tcctgtgttagctctgtgaa

SEQ ID NO: 16611 - DNA, 26 bp, Homo sapiens
tttaagaaataatcctaattgttttt

SEQ ID NO: 16612 - DNA, 25 bp, Homo sapiens
agactgctttctaatagtgaaacta

SEQ ID NO: 16613 - DNA, 24 bp, Homo sapiens
agatgacagaattgacttgccata

SEQ ID NO: 16614 - DNA, 25 bp, Homo sapiens
aggtggtgcattctcattttcctca

SEQ ID NO: 16615 - DNA, 19 bp, Homo sapiens
atgattacctaaccagtta

SEQ ID NO: 16616 - DNA, 19 bp, Homo sapiens
caaaatctttaaagtaaca

SEQ ID NO: 16617 - DNA, 17 bp, Homo sapiens
cattctacagtgtttta

SEQ ID NO: 16618 - DNA, 21 bp, Homo sapiens
cctctcattggatgactattc

SEQ ID NO: 16619 - DNA, 22 bp, Homo sapiens
ctctacatgaagatttcacttt

SEQ ID NO: 16620 - DNA, 22 bp, Homo sapiens
gcacattaaggagcaactggga

SEQ ID NO: 16621 - DNA, 19 bp, Homo sapiens
tagatacatttagaaatgt

SEQ ID NO: 16622 - DNA, 21 bp, Homo sapiens
tatacaaacctcattcttcat

SEQ ID NO: 16623 - DNA, 16 bp, Homo sapiens
ttctttagggtcttcc

SEQ ID NO: 16624 - DNA, 25 bp, Homo sapiens
agccaaggcctgctgaccgcgccga

SEQ ID NO: 16625 - DNA, 20 bp, Homo sapiens
cctcacgccgccgccaccgc

SEQ ID NO: 16626 - DNA, 18 bp, Homo sapiens
cctcttcgccctcccact

SEQ ID NO: 16627 - DNA, 18 bp, Homo sapiens
tgacctataatctttgaa

SEQ ID NO: 16628 - DNA, 17 bp, Homo sapiens
tgagccttcctatcaca

SEQ ID NO: 16629 - DNA, 17 bp, Homo sapiens
actacttcattttctca

SEQ ID NO: 16630 - DNA, 19 bp, Homo sapiens
ctccaaaaacagcaggcca

SEQ ID NO: 16631 - DNA, 15 bp, Homo sapiens
ggaggaggcgttgcc

SEQ ID NO: 16632 - DNA, 19 bp, Homo sapiens
taaagatttgaacctgtaa

SEQ ID NO: 16633 - DNA, 18 bp, Homo sapiens
tcatattgatgaaatcgt

SEQ ID NO: 16634 - DNA, 23 bp, Homo sapiens
gcagaacttgtaagcctaaactg

SEQ ID NO: 16635 - DNA, 20 bp, Homo sapiens
tgcgcagctcgctgccgtgc

SEQ ID NO: 16636 - DNA, 20 bp, Homo sapiens
aagtggagagaatctggcaa

SEQ ID NO: 16637 - DNA, 21 bp, Homo sapiens
gcctgagcagccggctggtcc

SEQ ID NO: 16638 - DNA, 21 bp, Homo sapiens
caatcctgatcaagacaccaa

SEQ ID NO: 16639 - DNA, 18 bp, Homo sapiens
ctagaaaattactttccc

SEQ ID NO: 16640 - DNA, 17 bp, Homo sapiens
acccaggagctgcaata

SEQ ID NO: 16641 - DNA, 21 bp, Homo sapiens
actgttcagaaatgactgtgt

SEQ ID NO: 16642 - DNA, 18 bp, Homo sapiens
atacattggcagctgcta

SEQ ID NO: 16643 - DNA, 20 bp, Homo sapiens
atccatgtcacctttcccac

SEQ ID NO: 16644 - DNA, 22 bp, Homo sapiens
caggtggtccccagatctcttc

SEQ ID NO: 16645 - DNA, 18 bp, Homo sapiens
cattcagcctttgccaaa

SEQ ID NO: 16646 - DNA, 18 bp, Homo sapiens
gattttgggatgaaactg

SEQ ID NO: 16647 - DNA, 20 bp, Homo sapiens
gcccccccaccccaaccccg

SEQ ID NO: 16648 - DNA, 19 bp, Homo sapiens
gcccgcatgcgtgcctgct

SEQ ID NO: 16649 - DNA, 16 bp, Homo sapiens
ggccagaagctccagg

SEQ ID NO: 16650 - DNA, 18 bp, Homo sapiens
gtcagatttttgcaccaa

SEQ ID NO: 16651 - DNA, 21 bp, Homo sapiens
tcacactagtgttggtccctt

SEQ ID NO: 16652 - DNA, 19 bp, Homo sapiens
tgtgggcctttttgtttta

SEQ ID NO: 16653 - DNA, 17 bp, Homo sapiens
tttccctaatgtatcca

SEQ ID NO: 16654 - DNA, 23 bp, Homo sapiens
cagacacacacgtacgcacactg

SEQ ID NO: 16655 - DNA, 17 bp, Homo sapiens
gggggcagtgattgcca

SEQ ID NO: 16656 - DNA, 22 bp, Homo sapiens
gtgggctgaccaggacctctga

SEQ ID NO: 16657 - DNA, 17 bp, Homo sapiens
caagaacaaaaccacca

SEQ ID NO: 16658 - DNA, 18 bp, Homo sapiens
cacacatgcacgcacaca

SEQ ID NO: 16659 - DNA, 19 bp, Homo sapiens
gagaatacaaaaagcatgc

SEQ ID NO: 16660 - DNA, 22 bp, Homo sapiens
gctctgaggaaccaggtcccac

SEQ ID NO: 16661 - DNA, 20 bp, Homo sapiens
gcttgaatgccaccttctga

SEQ ID NO: 16662 - DNA, 16 bp, Homo sapiens
ggaaaacagaggccac

SEQ ID NO: 16663 - DNA, 23 bp, Homo sapiens
ttttttgtttttgttttaacttt

SEQ ID NO: 16664 - DNA, 17 bp, Homo sapiens
aaaactatagtcctata

SEQ ID NO: 16665 - DNA, 21 bp, Homo sapiens
agaatctcactatcagagcca

SEQ ID NO: 16666 - DNA, 21 bp, Homo sapiens
atctgacctgtcccctggccc

SEQ ID NO: 16667 - DNA, 21 bp, Homo sapiens
cgcaccctcaccccaccatca

SEQ ID NO: 16668 - DNA, 18 bp, Homo sapiens
ctttttacttctcagtgc

SEQ ID NO: 16669 - DNA, 16 bp, Homo sapiens
tactgctgtatcatgc

SEQ ID NO: 16670 - DNA, 22 bp, Homo sapiens
tcttttcacctgtctcagtctt

SEQ ID NO: 16671 - DNA, 20 bp, Homo sapiens
tggcacttttgatatgagac

SEQ ID NO: 16672 - DNA, 22 bp, Homo sapiens
accaccaccacctgtgtaacca

SEQ ID NO: 16673 - DNA, 20 bp, Homo sapiens
caaatgtagattttaccaga

SEQ ID NO: 16674 - DNA, 23 bp, Homo sapiens
cacctgtgtaaccaccaccgcca

SEQ ID NO: 16675 - DNA, 22 bp, Homo sapiens
ggaaaacagatgagcaacccac

SEQ ID NO: 16676 - DNA, 19 bp, Homo sapiens
tgtgtaaccaccaccgcca

SEQ ID NO: 16677 - DNA, 19 bp, Homo sapiens
aaggcttggagcaaactga

SEQ ID NO: 16678 - DNA, 22 bp, Homo sapiens
agccactgtgcccggcctcctg

SEQ ID NO: 16679 - DNA, 17 bp, Homo sapiens
atagggaacatgggcca

SEQ ID NO: 16680 - DNA, 22 bp, Homo sapiens
atccttcagttttagcactggc

SEQ ID NO: 16681 - DNA, 16 bp, Homo sapiens
attccctcatgtaata

SEQ ID NO: 16682 - DNA, 22 bp, Homo sapiens
attccgtctgctccaacacaca

SEQ ID NO: 16683 - DNA, 17 bp, Homo sapiens
ccatggaaacactagtc

SEQ ID NO: 16684 - DNA, 21 bp, Homo sapiens
gattcaaaaccaggatcttta

SEQ ID NO: 16685 - DNA, 23 bp, Homo sapiens
tggaagaagataaattactctca

SEQ ID NO: 16686 - DNA, 18 bp, Homo sapiens
ttcaagtgattctcctgc

SEQ ID NO: 16687 - DNA, 23 bp, Homo sapiens
acagggaagaaactcctccggtc

SEQ ID NO: 16688 - DNA, 22 bp, Homo sapiens
accatcgccatcatcatcacca

SEQ ID NO: 16689 - DNA, 22 bp, Homo sapiens
acggagtctgcccaggactgca

SEQ ID NO: 16690 - DNA, 20 bp, Homo sapiens
caccatcatcatcttcctcc

SEQ ID NO: 16691 - DNA, 17 bp, Homo sapiens
catcatcatcaccacca

SEQ ID NO: 16692 - DNA, 21 bp, Homo sapiens
gcggagtcagatgtttctggg

SEQ ID NO: 16693 - DNA, 18 bp, Homo sapiens
aacgcaataatgatgaga

SEQ ID NO: 16694 - DNA, 20 bp, Homo sapiens
atagggctgtacaaatatag

SEQ ID NO: 16695 - DNA, 19 bp, Homo sapiens
cacttgtaggacttccttt

SEQ ID NO: 16696 - DNA, 15 bp, Homo sapiens
gcacaggacaacttt

SEQ ID NO: 16697 - DNA, 18 bp, Homo sapiens
tgggaagacatctggcaa

SEQ ID NO: 16698 - DNA, 19 bp, Homo sapiens
aacagaagttgattttgtt

SEQ ID NO: 16699 - DNA, 15 bp, Homo sapiens
agcatggcaacatca

SEQ ID NO: 16700 - DNA, 21 bp, Homo sapiens
agtaagatgcacgcatttcca

SEQ ID NO: 16701 - DNA, 19 bp, Homo sapiens
caaggggagatggtgctaa

SEQ ID NO: 16702 - DNA, 20 bp, Homo sapiens
caggtgattaaaaagcttta

SEQ ID NO: 16703 - DNA, 18 bp, Homo sapiens
ctactccttggtcctcca

SEQ ID NO: 16704 - DNA, 17 bp, Homo sapiens
taaacagggcttgagca

SEQ ID NO: 16705 - DNA, 17 bp, Homo sapiens
ttccagaaaatcttcca

SEQ ID NO: 16706 - DNA, 18 bp, Homo sapiens
aattcacaaaacttccaa

SEQ ID NO: 16707 - DNA, 18 bp, Homo sapiens
catgtggctagtggctgc

SEQ ID NO: 16708 - DNA, 17 bp, Homo sapiens
ccaaaagaaatgtcgtg

SEQ ID NO: 16709 - DNA, 17 bp, Homo sapiens
cttagtggcttctgaag

SEQ ID NO: 16710 - DNA, 19 bp, Homo sapiens
gacggggtctcactgtatc

SEQ ID NO: 16711 - DNA, 20 bp, Homo sapiens
gcttgcccagtgcttcttga

SEQ ID NO: 16712 - DNA, 21 bp, Homo sapiens
tatattggacagcatgggcca

SEQ ID NO: 16713 - DNA, 17 bp, Homo sapiens
tgcagactagttaaatc

SEQ ID NO: 16714 - DNA, 22 bp, Homo sapiens
ttaaaattaaaatccagttcct

SEQ ID NO: 16715 - DNA, 23 bp, Homo sapiens
ttagagtaatagagaattcttca

SEQ ID NO: 16716 - DNA, 18 bp, Homo sapiens
ttataatgccctccatcc

SEQ ID NO: 16717 - DNA, 18 bp, Homo sapiens
ctataccatccaccctca

SEQ ID NO: 16718 - DNA, 21 bp, Homo sapiens
catgacggagaatgccctcca

SEQ ID NO: 16719 - DNA, 22 bp, Homo sapiens
cctaaatacttgctttgatttt

SEQ ID NO: 16720 - DNA, 19 bp, Homo sapiens
gaatacatttcccctccct

SEQ ID NO: 16721 - DNA, 18 bp, Homo sapiens
gacacggcctcgcagcaa

SEQ ID NO: 16722 - DNA, 21 bp, Homo sapiens
gcacggatgggggtgatgcca

SEQ ID NO: 16723 - DNA, 20 bp, Homo sapiens
tactcaccaccatttcctga

SEQ ID NO: 16724 - DNA, 19 bp, Homo sapiens
tcgtgctccccaaatcacc

SEQ ID NO: 16725 - DNA, 24 bp, Homo sapiens
tgcgacctcggcctcctggattca

SEQ ID NO: 16726 - DNA, 21 bp, Homo sapiens
tgggattgtaggagtgtgcca

SEQ ID NO: 16727 - DNA, 19 bp, Homo sapiens
aagaaattgggactttttt

SEQ ID NO: 16728 - DNA, 17 bp, Homo sapiens
acatatgtcaactgtaa

SEQ ID NO: 16729 - DNA, 19 bp, Homo sapiens
aggatacttgggctggtca

SEQ ID NO: 16730 - DNA, 23 bp, Homo sapiens
caaaacctgaagatgtccgtgaa

SEQ ID NO: 16731 - DNA, 24 bp, Homo sapiens
gacctaggctttcaaaagattcca

SEQ ID NO: 16732 - DNA, 21 bp, Homo sapiens
gcagcttcaagagaagaattt

SEQ ID NO: 16733 - DNA, 24 bp, Homo sapiens
gtttggatcaaattttgctggttc

SEQ ID NO: 16734 - DNA, 18 bp, Homo sapiens
ttttgctggttctttgga

SEQ ID NO: 16735 - DNA, 21 bp, Homo sapiens
ccatcatagcctggtcctcca

SEQ ID NO: 16736 - DNA, 18 bp, Homo sapiens
tctgggatttttctctga

SEQ ID NO: 16737 - DNA, 22 bp, Homo sapiens
tggagaagggatggcaccaccc

SEQ ID NO: 16738 - DNA, 18 bp, Homo sapiens
tttgtgtggcagtttgta

SEQ ID NO: 16739 - DNA, 20 bp, Homo sapiens
aaacagaaaaatctaccggt

SEQ ID NO: 16740 - DNA, 23 bp, Homo sapiens
cagaaaaaaagttacatgtcgat

SEQ ID NO: 16741 - DNA, 18 bp, Homo sapiens
gccttttttttcatctca

SEQ ID NO: 16742 - DNA, 17 bp, Homo sapiens
ggaagacctgaaagcca

SEQ ID NO: 16743 - DNA, 17 bp, Homo sapiens
ggcttctgttggcattt

SEQ ID NO: 16744 - DNA, 19 bp, Homo sapiens
tcaccatagcacttgtaaa

SEQ ID NO: 16745 - DNA, 20 bp, Homo sapiens
accccagcccccagctctga

SEQ ID NO: 16746 - DNA, 23 bp, Homo sapiens
agccctgggaccagcagccacca

SEQ ID NO: 16747 - DNA, 16 bp, Homo sapiens
atggcagtggaggtga

SEQ ID NO: 16748 - DNA, 18 bp, Homo sapiens
atggctatcatttggttg

SEQ ID NO: 16749 - DNA, 18 bp, Homo sapiens
caaccctcaccctcctcc

SEQ ID NO: 16750 - DNA, 18 bp, Homo sapiens
cacccctgggcagcttca

SEQ ID NO: 16751 - DNA, 19 bp, Homo sapiens
cccctcttcacctccctca

SEQ ID NO: 16752 - DNA, 19 bp, Homo sapiens
ccctccagaccactgtctc

SEQ ID NO: 16753 - DNA, 23 bp, Homo sapiens
tcgccgccttatcaagcgctttt

SEQ ID NO: 16754 - DNA, 17 bp, Homo sapiens
tctaattacttgtgtga

SEQ ID NO: 16755 - DNA, 22 bp, Homo sapiens
tggagtttataaactggacaac

SEQ ID NO: 16756 - DNA, 21 bp, Homo sapiens
tgtgatgatggagccacgcaa

SEQ ID NO: 16757 - DNA, 18 bp, Homo sapiens
aaggaccccttgaatcca

SEQ ID NO: 16758 - DNA, 18 bp, Homo sapiens
atttgatccttataatca

SEQ ID NO: 16759 - DNA, 24 bp, Homo sapiens
caaactctcttcagggccgcctca

SEQ ID NO: 16760 - DNA, 19 bp, Homo sapiens
ccacccacaaagcagtact

SEQ ID NO: 16761 - DNA, 19 bp, Homo sapiens
cctaaacaatatcctgttg

SEQ ID NO: 16762 - DNA, 21 bp, Homo sapiens
ctggcctctctgatccttcca

SEQ ID NO: 16763 - DNA, 17 bp, Homo sapiens
tctgtggaggtacggag

SEQ ID NO: 16764 - DNA, 19 bp, Homo sapiens
tgggaaatcaaacatcaca

SEQ ID NO: 16765 - DNA, 20 bp, Homo sapiens
tgtgttgacaaggtatttct

SEQ ID NO: 16766 - DNA, 18 bp, Homo sapiens
ttctattcccaggactaa

SEQ ID NO: 16767 - DNA, 18 bp, Homo sapiens
ttgcatgtagcaagcttt

SEQ ID NO: 16768 - DNA, 22 bp, Homo sapiens
aagactaccagtatggagttca

SEQ ID NO: 16769 - DNA, 24 bp, Homo sapiens
agcttctatggttcatagtctttg

SEQ ID NO: 16770 - DNA, 18 bp, Homo sapiens
atgcatcacatcactttt

SEQ ID NO: 16771 - DNA, 22 bp, Homo sapiens
ccgagggcggaggcgacactct

SEQ ID NO: 16772 - DNA, 20 bp, Homo sapiens
tcagtgggcagggttgcaca

SEQ ID NO: 16773 - DNA, 19 bp, Homo sapiens
cagcggcagctgctcggca

SEQ ID NO: 16774 - DNA, 18 bp, Homo sapiens
gggcggagcgcgctggcc

SEQ ID NO: 16775 - DNA, 19 bp, Homo sapiens
tgttcaattttgtagggtg

SEQ ID NO: 16776 - DNA, 17 bp, Homo sapiens
ccacttgatgcacaaat

SEQ ID NO: 16777 - DNA, 18 bp, Homo sapiens
tcctaaaattttccaaca

SEQ ID NO: 16778 - DNA, 20 bp, Homo sapiens
tgttaaaacagggtcaatcc

SEQ ID NO: 16779 - DNA, 18 bp, Homo sapiens
atctgaccgcaccaaggt

SEQ ID NO: 16780 - DNA, 19 bp, Homo sapiens
gccatgcgttgtttggtct

SEQ ID NO: 16781 - DNA, 18 bp, Homo sapiens
aaatgtgaaaaaaataca

SEQ ID NO: 16782 - DNA, 24 bp, Homo sapiens
catttttttttttcaaaaatgtga

SEQ ID NO: 16783 - DNA, 22 bp, Homo sapiens
cttctctgtcagggttgctcct

SEQ ID NO: 16784 - DNA, 21 bp, Homo sapiens
ggacaaggcctctggttctcc

SEQ ID NO: 16785 - DNA, 23 bp, Homo sapiens
ggttgctcctgtggcttttttaa

SEQ ID NO: 16786 - DNA, 24 bp, Homo sapiens
tttgatcatatcttggatcctttt

SEQ ID NO: 16787 - DNA, 23 bp, Homo sapiens
acgaattataattatggtttaca

SEQ ID NO: 16788 - DNA, 16 bp, Homo sapiens
aggtaagatgaaacag

SEQ ID NO: 16789 - DNA, 21 bp, Homo sapiens
cgaggctgtaatgtgccatga

SEQ ID NO: 16790 - DNA, 24 bp, Homo sapiens
ctattagaaatgactccctttcaa

SEQ ID NO: 16791 - DNA, 21 bp, Homo sapiens
gaattataattatggtttaca

SEQ ID NO: 16792 - DNA, 26 bp, Homo sapiens
gccacttatttttgaagatgctgagg

SEQ ID NO: 16793 - DNA, 18 bp, Homo sapiens
ccctttggcactattgtg

SEQ ID NO: 16794 - DNA, 17 bp, Homo sapiens
ctcgtttaaagctgcag

SEQ ID NO: 16795 - DNA, 18 bp, Homo sapiens
gtgtcagcatgtttctgg

SEQ ID NO: 16796 - DNA, 24 bp, Homo sapiens
gtgtttcttattttggccagttct

SEQ ID NO: 16797 - DNA, 17 bp, Homo sapiens
gtttgttattggcactg

SEQ ID NO: 16798 - DNA, 20 bp, Homo sapiens
tctgctgatactccttggag

SEQ ID NO: 16799 - DNA, 23 bp, Homo sapiens
cgccggccggggaagaggcgcgg

SEQ ID NO: 16800 - DNA, 20 bp, Homo sapiens
gaattatcctatggaatgat

SEQ ID NO: 16801 - DNA, 18 bp, Homo sapiens
ttcagaataactttccag

SEQ ID NO: 16802 - DNA, 23 bp, Homo sapiens
ctaggagcaaagaggggggcagc

SEQ ID NO: 16803 - DNA, 18 bp, Homo sapiens
actaaaaggagcccatct

SEQ ID NO: 16804 - DNA, 22 bp, Homo sapiens
ccctccccatcctcctcttccc

SEQ ID NO: 16805 - DNA, 16 bp, Homo sapiens
ctcccctcctctcctc

SEQ ID NO: 16806 - DNA, 24 bp, Homo sapiens
ctgctttaccctcataattctcaa

SEQ ID NO: 16807 - DNA, 20 bp, Homo sapiens
gaggccatcccaagccgaga

SEQ ID NO: 16808 - DNA, 17 bp, Homo sapiens
ggcgaactcatctctac

SEQ ID NO: 16809 - DNA, 18 bp, Homo sapiens
gggcttcaggagttctga

SEQ ID NO: 16810 - DNA, 22 bp, Homo sapiens
tctccccaccctcccctcctct

SEQ ID NO: 16811 - DNA, 22 bp, Homo sapiens
cacctctaccaatccatcttca

SEQ ID NO: 16812 - DNA, 23 bp, Homo sapiens
cttacagattccaggtccctttt

SEQ ID NO: 16813 - DNA, 22 bp, Homo sapiens
ggacttagtttcatctattgta

SEQ ID NO: 16814 - DNA, 18 bp, Homo sapiens
tccgcctcccgggttcaa

SEQ ID NO: 16815 - DNA, 18 bp, Homo sapiens
tctaactctcccaacaaa

SEQ ID NO: 16816 - DNA, 20 bp, Homo sapiens
aaacagactagagaagccac

SEQ ID NO: 16817 - DNA, 23 bp, Homo sapiens
actgggctacatggaaaatgaca

SEQ ID NO: 16818 - DNA, 18 bp, Homo sapiens
atcatatcaaatatgcca

SEQ ID NO: 16819 - DNA, 21 bp, Homo sapiens
cccaggagtgatttctcttta

SEQ ID NO: 16820 - DNA, 15 bp, Homo sapiens
gatcctgaaacagtg

SEQ ID NO: 16821 - DNA, 24 bp, Homo sapiens
agcctctctagttttagtttactg

SEQ ID NO: 16822 - DNA, 22 bp, Homo sapiens
ccattttcttggtatgtactca

SEQ ID NO: 16823 - DNA, 22 bp, Homo sapiens
gcactgcccctggtgggattca

SEQ ID NO: 16824 - DNA, 23 bp, Homo sapiens
tctgcttttctgatctgtgagta

SEQ ID NO: 16825 - DNA, 23 bp, Homo sapiens
tggtccctccccagctgaagtta

SEQ ID NO: 16826 - DNA, 18 bp, Homo sapiens
tggtcctaaattttatga

SEQ ID NO: 16827 - DNA, 18 bp, Homo sapiens
tgtcaagcccttaagcaa

SEQ ID NO: 16828 - DNA, 19 bp, Homo sapiens
gacaagctgtgttgaaata

SEQ ID NO: 16829 - DNA, 21 bp, Homo sapiens
ggaacaaactgttgaaatcca

SEQ ID NO: 16830 - DNA, 19 bp, Homo sapiens
gtggacctcgtgctcatca

SEQ ID NO: 16831 - DNA, 19 bp, Homo sapiens
aaccccatgtcctcctcct

SEQ ID NO: 16832 - DNA, 17 bp, Homo sapiens
caaaaacatgtgttgta

SEQ ID NO: 16833 - DNA, 17 bp, Homo sapiens
cagaaggaagaggatct

SEQ ID NO: 16834 - DNA, 22 bp, Homo sapiens
gacagcagcccgccccggcctc

SEQ ID NO: 16835 - DNA, 21 bp, Homo sapiens
gactgttactgtgtctgtgta

SEQ ID NO: 16836 - DNA, 18 bp, Homo sapiens
gtggacgctgaccgcccg

SEQ ID NO: 16837 - DNA, 18 bp, Homo sapiens
gtgtctcggttacacagc

SEQ ID NO: 16838 - DNA, 17 bp, Homo sapiens
taagggaatccgggatc

SEQ ID NO: 16839 - DNA, 16 bp, Homo sapiens
aactctcccttctcct

SEQ ID NO: 16840 - DNA, 21 bp, Homo sapiens
caccacacccggccccccttc

SEQ ID NO: 16841 - DNA, 20 bp, Homo sapiens
cctctgcctcccgggttcaa

SEQ ID NO: 16842 - DNA, 22 bp, Homo sapiens
gcccccatcccaccctacccca

SEQ ID NO: 16843 - DNA, 19 bp, Homo sapiens
ggaacttaacttggggcta

SEQ ID NO: 16844 - DNA, 17 bp, Homo sapiens
taccccaccctacccca

SEQ ID NO: 16845 - DNA, 21 bp, Homo sapiens
tggggttgcaggtgtgcacca

SEQ ID NO: 16846 - DNA, 16 bp, Homo sapiens
tttctcaagctcctca

SEQ ID NO: 16847 - DNA, 18 bp, Homo sapiens
aacatccagaggtgagac

SEQ ID NO: 16848 - DNA, 19 bp, Homo sapiens
aagtttgtaaaattcctta

SEQ ID NO: 16849 - DNA, 21 bp, Homo sapiens
aggaagtaatgggaaggggtt

SEQ ID NO: 16850 - DNA, 18 bp, Homo sapiens
cccgcaacctccgcctcc

SEQ ID NO: 16851 - DNA, 19 bp, Homo sapiens
cctttcttctcacacgtcg

SEQ ID NO: 16852 - DNA, 18 bp, Homo sapiens
tccgcctcccgggttcaa

SEQ ID NO: 16853 - DNA, 22 bp, Homo sapiens
agaaacagaaggacagcatttc

SEQ ID NO: 16854 - DNA, 23 bp, Homo sapiens
ccagctgcagtctcccagcctcc

SEQ ID NO: 16855 - DNA, 18 bp, Homo sapiens
cgctcattgctcttcaga

SEQ ID NO: 16856 - DNA, 19 bp, Homo sapiens
ctgtaggatttcaaattac

SEQ ID NO: 16857 - DNA, 18 bp, Homo sapiens
gactgctgtaggatttca

SEQ ID NO: 16858 - DNA, 19 bp, Homo sapiens
tgcccatctgctgtcccag

SEQ ID NO: 16859 - DNA, 18 bp, Homo sapiens
tgccccatctccatccct

SEQ ID NO: 16860 - DNA, 18 bp, Homo sapiens
tggagttagtgtggaact

SEQ ID NO: 16861 - DNA, 24 bp, Homo sapiens
tcctgaaagatggaattatgacga

SEQ ID NO: 16862 - DNA, 20 bp, Homo sapiens
agtgggtggagaggaagcat

SEQ ID NO: 16863 - DNA, 18 bp, Homo sapiens
atttccttagatgttacc

SEQ ID NO: 16864 - DNA, 19 bp, Homo sapiens
caggcctccctgccccctc

SEQ ID NO: 16865 - DNA, 21 bp, Homo sapiens
ccaccgccgccacctcgcccg

SEQ ID NO: 16866 - DNA, 20 bp, Homo sapiens
ctggtttgcccacctccgat

SEQ ID NO: 16867 - DNA, 20 bp, Homo sapiens
ggtctggctgcgtggagctg

SEQ ID NO: 16868 - DNA, 21 bp, Homo sapiens
tccccctcctgcgctgcgagc

SEQ ID NO: 16869 - DNA, 21 bp, Homo sapiens
cataaattatcttttcttctg

SEQ ID NO: 16870 - DNA, 20 bp, Homo sapiens
ctgtgctgatggcttggctt

SEQ ID NO: 16871 - DNA, 21 bp, Homo sapiens
ttcaagtgattctgaaggcac

SEQ ID NO: 16872 - DNA, 23 bp, Homo sapiens
accacacaacacaccacacccca

SEQ ID NO: 16873 - DNA, 21 bp, Homo sapiens
accacaccacaccacaccaca

SEQ ID NO: 16874 - DNA, 21 bp, Homo sapiens
accacaccacaccacacctca

SEQ ID NO: 16875 - DNA, 18 bp, Homo sapiens
acccacgcacatgcacac

SEQ ID NO: 16876 - DNA, 19 bp, Homo sapiens
caacacacctcacctcaca

SEQ ID NO: 16877 - DNA, 19 bp, Homo sapiens
ccagggccagatggagcca

SEQ ID NO: 16878 - DNA, 17 bp, Homo sapiens
ctggcccaggcccagtc

SEQ ID NO: 16879 - DNA, 18 bp, Homo sapiens
ggctgcccgcctcctgga

SEQ ID NO: 16880 - DNA, 22 bp, Homo sapiens
attattctttaatgggataata

SEQ ID NO: 16881 - DNA, 23 bp, Homo sapiens
gacaatgtacagcattctggcca

SEQ ID NO: 16882 - DNA, 18 bp, Homo sapiens
gagagaagacatattgac

SEQ ID NO: 16883 - DNA, 20 bp, Homo sapiens
tcagtattggagaaatgctt

SEQ ID NO: 16884 - DNA, 19 bp, Homo sapiens
ctccccattttgtaacact

SEQ ID NO: 16885 - DNA, 20 bp, Homo sapiens
gcctcagtttccccatttta

SEQ ID NO: 16886 - DNA, 22 bp, Homo sapiens
tcccagttttgagatgaagctg

SEQ ID NO: 16887 - DNA, 18 bp, Homo sapiens
ttcaccttcgtcatgctg

SEQ ID NO: 16888 - DNA, 23 bp, Homo sapiens
cccacggaaggacatgctgtcca

SEQ ID NO: 16889 - DNA, 20 bp, Homo sapiens
cctggctgggagtcctgtgg

SEQ ID NO: 16890 - DNA, 17 bp, Homo sapiens
cgtgttagtctgaggta

SEQ ID NO: 16891 - DNA, 19 bp, Homo sapiens
ctgcaagctccatctccca

SEQ ID NO: 16892 - DNA, 25 bp, Homo sapiens
gaaacgcactgcagagattctgaga

SEQ ID NO: 16893 - DNA, 22 bp, Homo sapiens
gccgcggcgtcctcgacaacct

SEQ ID NO: 16894 - DNA, 16 bp, Homo sapiens
gctgccgtactccagg

SEQ ID NO: 16895 - DNA, 17 bp, Homo sapiens
tattgccttttctagtg

SEQ ID NO: 16896 - DNA, 18 bp, Homo sapiens
tccagaggctgcacccag

SEQ ID NO: 16897 - DNA, 20 bp, Homo sapiens
tcctgtgtctgtcctccgga

SEQ ID NO: 16898 - DNA, 18 bp, Homo sapiens
tggggacacctgttccag

SEQ ID NO: 16899 - DNA, 23 bp, Homo sapiens
atctgggctcacctccctggttc

SEQ ID NO: 16900 - DNA, 16 bp, Homo sapiens
atgcccagcctgttcc

SEQ ID NO: 16901 - DNA, 20 bp, Homo sapiens
cctttggtacaccttgcaaa

SEQ ID NO: 16902 - DNA, 23 bp, Homo sapiens
ccttttcctgccgccttggtctt

SEQ ID NO: 16903 - DNA, 22 bp, Homo sapiens
tctgaaaaccagactccggggc

SEQ ID NO: 16904 - DNA, 23 bp, Homo sapiens
agttggtacagctctgttcttcc

SEQ ID NO: 16905 - DNA, 22 bp, Homo sapiens
ggaagaactggtgccccctcca

SEQ ID NO: 16906 - DNA, 18 bp, Homo sapiens
agatccttttaagaatgc

SEQ ID NO: 16907 - DNA, 20 bp, Homo sapiens
agcttctggaaggccatgtt

SEQ ID NO: 16908 - DNA, 21 bp, Homo sapiens
caaccagtgtcttctgcccct

SEQ ID NO: 16909 - DNA, 22 bp, Homo sapiens
cactaataggaatgccattcaa

SEQ ID NO: 16910 - DNA, 19 bp, Homo sapiens
catcagataatacttttct

SEQ ID NO: 16911 - DNA, 18 bp, Homo sapiens
ccaacggaaaacaataca

SEQ ID NO: 16912 - DNA, 23 bp, Homo sapiens
ctgatcctttcaaaccaaccaaa

SEQ ID NO: 16913 - DNA, 20 bp, Homo sapiens
taaagactagaaacaaagaa

SEQ ID NO: 16914 - DNA, 19 bp, Homo sapiens
taagggaaaaaacttttaa

SEQ ID NO: 16915 - DNA, 19 bp, Homo sapiens
tgacctgttctatgttgaa

SEQ ID NO: 16916 - DNA, 19 bp, Homo sapiens
tggatacctacttagtgct

SEQ ID NO: 16917 - DNA, 24 bp, Homo sapiens
ttgttggaaaactcatgcatccca

SEQ ID NO: 16918 - DNA, 16 bp, Homo sapiens
ccaggcattgctctgc

SEQ ID NO: 16919 - DNA, 21 bp, Homo sapiens
ctggggcactgacctttgcca

SEQ ID NO: 16920 - DNA, 22 bp, Homo sapiens
ggacggccccaggcattgctct

SEQ ID NO: 16921 - DNA, 18 bp, Homo sapiens
actgcataacaggcacca

SEQ ID NO: 16922 - DNA, 20 bp, Homo sapiens
atcagactatctgtatatat

SEQ ID NO: 16923 - DNA, 20 bp, Homo sapiens
cctctgcctcccaggttcaa

SEQ ID NO: 16924 - DNA, 19 bp, Homo sapiens
ctgcaacctctgcctccca

SEQ ID NO: 16925 - DNA, 25 bp, Homo sapiens
cttaactatgactagacatgttata

SEQ ID NO: 16926 - DNA, 23 bp, Homo sapiens
gacgtcaccaaacaaggttgcat

SEQ ID NO: 16927 - DNA, 19 bp, Homo sapiens
tctctcctcatccttttgc

SEQ ID NO: 16928 - DNA, 27 bp, Homo sapiens
atgggtatataccccaaagtggaattg

SEQ ID NO: 16929 - DNA, 19 bp, Homo sapiens
cttaacttcatcctcaagg

SEQ ID NO: 16930 - DNA, 20 bp, Homo sapiens
tgtgtttctgcatttctgga

SEQ ID NO: 16931 - DNA, 21 bp, Homo sapiens
aaaaaaggcacaaaaataggt

SEQ ID NO: 16932 - DNA, 19 bp, Homo sapiens
accaaggattttcaagaca

SEQ ID NO: 16933 - DNA, 21 bp, Homo sapiens
atagctgtgttcctgatccca

SEQ ID NO: 16934 - DNA, 23 bp, Homo sapiens
ctccccactcccggcagcacttt

SEQ ID NO: 16935 - DNA, 19 bp, Homo sapiens
ctgagccttcgttcttcag

SEQ ID NO: 16936 - DNA, 17 bp, Homo sapiens
gcagatttcttcttgat

SEQ ID NO: 16937 - DNA, 20 bp, Homo sapiens
tccccactgaagaggtctgt

SEQ ID NO: 16938 - DNA, 17 bp, Homo sapiens
tgtgaatgaggcccacc

SEQ ID NO: 16939 - DNA, 17 bp, Homo sapiens
cactcttgttgcgatcg

SEQ ID NO: 16940 - DNA, 18 bp, Homo sapiens
ccatccatcttctgtgat

SEQ ID NO: 16941 - DNA, 18 bp, Homo sapiens
ctcatggtatggaaaacc

SEQ ID NO: 16942 - DNA, 18 bp, Homo sapiens
gcccacccatggctcggt

SEQ ID NO: 16943 - DNA, 23 bp, Homo sapiens
tcttgttgcgatcgctaacctca

SEQ ID NO: 16944 - DNA, 21 bp, Homo sapiens
aaggattcagaaagaacctta

SEQ ID NO: 16945 - DNA, 16 bp, Homo sapiens
accaccagctctcctt

SEQ ID NO: 16946 - DNA, 20 bp, Homo sapiens
agtctcactctgttgcccag

SEQ ID NO: 16947 - DNA, 21 bp, Homo sapiens
atcttggctcactgcaacctc

SEQ ID NO: 16948 - DNA, 20 bp, Homo sapiens
ccttttgccaaaagcagtcc

SEQ ID NO: 16949 - DNA, 22 bp, Homo sapiens
gattggaagtggccagcagcaa

SEQ ID NO: 16950 - DNA, 23 bp, Homo sapiens
tagatgaatactgggattggctc

SEQ ID NO: 16951 - DNA, 18 bp, Homo sapiens
tccgtctcccaggttcaa

SEQ ID NO: 16952 - DNA, 20 bp, Homo sapiens
tttccacctctgcctttaag

SEQ ID NO: 16953 - DNA, 22 bp, Homo sapiens
aacaaaatgcactaagaaacgt

SEQ ID NO: 16954 - DNA, 23 bp, Homo sapiens
acaccacagttctgaatagtgat

SEQ ID NO: 16955 - DNA, 20 bp, Homo sapiens
cagctgttgtgatctgtgta

SEQ ID NO: 16956 - DNA, 21 bp, Homo sapiens
ccgtgaccttgcagttgtgta

SEQ ID NO: 16957 - DNA, 16 bp, Homo sapiens
ccttcacacacacaac

SEQ ID NO: 16958 - DNA, 22 bp, Homo sapiens
gaatgagcttgagccttcctcc

SEQ ID NO: 16959 - DNA, 15 bp, Homo sapiens
gggacgtgtctgctt

SEQ ID NO: 16960 - DNA, 23 bp, Homo sapiens
tggagaggagagggcaaaggcga

SEQ ID NO: 16961 - DNA, 18 bp, Homo sapiens
tgtgaagtgagtgggtga

SEQ ID NO: 16962 - DNA, 21 bp, Homo sapiens
ccccaacgccgccgccaccgc

SEQ ID NO: 16963 - DNA, 21 bp, Homo sapiens
ggcggggctcgcgcaacctcc

SEQ ID NO: 16964 - DNA, 20 bp, Homo sapiens
ggctccaacagctcctccgc

SEQ ID NO: 16965 - DNA, 22 bp, Homo sapiens
aagcttatcaaaagtttgtgga

SEQ ID NO: 16966 - DNA, 18 bp, Homo sapiens
acttagtgtgttccttca

SEQ ID NO: 16967 - DNA, 23 bp, Homo sapiens
gactgtcccctttagagatccca

SEQ ID NO: 16968 - DNA, 19 bp, Homo sapiens
gaggactgccccccggcgc

SEQ ID NO: 16969 - DNA, 22 bp, Homo sapiens
gcactttgttaatctccagaga

SEQ ID NO: 16970 - DNA, 15 bp, Homo sapiens
gctggcaatgtgaca

SEQ ID NO: 16971 - DNA, 16 bp, Homo sapiens
tccagaaaagattcag

SEQ ID NO: 16972 - DNA, 21 bp, Homo sapiens
tgccccccggcgcctgcccag

SEQ ID NO: 16973 - DNA, 23 bp, Homo sapiens
aagcactgagaaattctttctca

SEQ ID NO: 16974 - DNA, 18 bp, Homo sapiens
agagctaaacaccagtgc

SEQ ID NO: 16975 - DNA, 21 bp, Homo sapiens
cagaaggcacaaacccagtgc

SEQ ID NO: 16976 - DNA, 18 bp, Homo sapiens
ccatggcacactcagcag

SEQ ID NO: 16977 - DNA, 19 bp, Homo sapiens
cctctggtgtgcttggctt

SEQ ID NO: 16978 - DNA, 19 bp, Homo sapiens
ctgttctgcttgtatccca

SEQ ID NO: 16979 - DNA, 18 bp, Homo sapiens
cttgaagcgcagaaggca

SEQ ID NO: 16980 - DNA, 21 bp, Homo sapiens
ctttggggactacattgctga

SEQ ID NO: 16981 - DNA, 18 bp, Homo sapiens
gcttttattgctcccaca

SEQ ID NO: 16982 - DNA, 20 bp, Homo sapiens
gggaatactggggtcagtta

SEQ ID NO: 16983 - DNA, 23 bp, Homo sapiens
ggtaccccaggaggcatgatgtg

SEQ ID NO: 16984 - DNA, 20 bp, Homo sapiens
taaccccttgtcagttgtca

SEQ ID NO: 16985 - DNA, 20 bp, Homo sapiens
tatgggtaaagagacatgaa

SEQ ID NO: 16986 - DNA, 25 bp, Homo sapiens
tccatggggtcccggtgttgttttt

SEQ ID NO: 16987 - DNA, 20 bp, Homo sapiens
tcctagaatttggataaacc

SEQ ID NO: 16988 - DNA, 21 bp, Homo sapiens
tctgcttgtatcccagtgata

SEQ ID NO: 16989 - DNA, 22 bp, Homo sapiens
tgagtgggctccgcactggctg

SEQ ID NO: 16990 - DNA, 21 bp, Homo sapiens
tggaagtgtttaatgtgaggc

SEQ ID NO: 16991 - DNA, 21 bp, Homo sapiens
tggctcatgtttccatgtgcc

SEQ ID NO: 16992 - DNA, 19 bp, Homo sapiens
ggccaggatgtccattcta

SEQ ID NO: 16993 - DNA, 24 bp, Homo sapiens
tatccaggcagagaagctcctgga

SEQ ID NO: 16994 - DNA, 20 bp, Homo sapiens
tgagcctgagtctttccaca

SEQ ID NO: 16995 - DNA, 19 bp, Homo sapiens
aacctggaatctctcatct

SEQ ID NO: 16996 - DNA, 20 bp, Homo sapiens
cttgtattacagatgttaca

SEQ ID NO: 16997 - DNA, 21 bp, Homo sapiens
ggctatgtaagagttagcagc

SEQ ID NO: 16998 - DNA, 18 bp, Homo sapiens
gtcagtggtgctatgctg

SEQ ID NO: 16999 - DNA, 24 bp, Homo sapiens
taagtggactttgcttttggggct

SEQ ID NO: 17000 - DNA, 20 bp, Homo sapiens
tgtgctgctgcatttctgag

SEQ ID NO: 17001 - DNA, 21 bp, Homo sapiens
actactactggtaaaatgcag

SEQ ID NO: 17002 - DNA, 19 bp, Homo sapiens
caaaaataaatgcgaacat

SEQ ID NO: 17003 - DNA, 17 bp, Homo sapiens
cagcacataaggctccc

SEQ ID NO: 17004 - DNA, 19 bp, Homo sapiens
catatttaagcaaacatca

SEQ ID NO: 17005 - DNA, 24 bp, Homo sapiens
catgcattcttccggctcctctga

SEQ ID NO: 17006 - DNA, 17 bp, Homo sapiens
ccccccaatctcttcca

SEQ ID NO: 17007 - DNA, 22 bp, Homo sapiens
gaacatgttttaaaaagataca

SEQ ID NO: 17008 - DNA, 21 bp, Homo sapiens
ggccacaggcaggtccagtca

SEQ ID NO: 17009 - DNA, 18 bp, Homo sapiens
ttgcaaaatgcacttttt

SEQ ID NO: 17010 - DNA, 20 bp, Homo sapiens
cctgccctccttgcagccca

SEQ ID NO: 17011 - DNA, 18 bp, Homo sapiens
ctcattattgtgtccttt

SEQ ID NO: 17012 - DNA, 18 bp, Homo sapiens
tactcctgtatcattgct

SEQ ID NO: 17013 - DNA, 20 bp, Homo sapiens
tgtgtagatctgttttggaa

SEQ ID NO: 17014 - DNA, 18 bp, Homo sapiens
ttgagcagttcctaaaga

SEQ ID NO: 17015 - DNA, 16 bp, Homo sapiens
aaccatgtccaaaacc

SEQ ID NO: 17016 - DNA, 18 bp, Homo sapiens
cctgcaacctccacctcc

SEQ ID NO: 17017 - DNA, 19 bp, Homo sapiens
tatgcaaagacgcttaaac

SEQ ID NO: 17018 - DNA, 23 bp, Homo sapiens
tgcccttgccacttccccaaaca

SEQ ID NO: 17019 - DNA, 19 bp, Homo sapiens
tttctcccccctgtgactg

SEQ ID NO: 17020 - DNA, 17 bp, Homo sapiens
gaacaaattccagccgg

SEQ ID NO: 17021 - DNA, 22 bp, Homo sapiens
aggcctagacgcaggatcttta

SEQ ID NO: 17022 - DNA, 25 bp, Homo sapiens
gacacacccacaccgtagaacatat

SEQ ID NO: 17023 - DNA, 19 bp, Homo sapiens
aagcaattctcctgcctca

SEQ ID NO: 17024 - DNA, 19 bp, Homo sapiens
acactcatcacaattaatg

SEQ ID NO: 17025 - DNA, 21 bp, Homo sapiens
atcttggctctctccaatctc

SEQ ID NO: 17026 - DNA, 19 bp, Homo sapiens
atgtatctcattctcctca

SEQ ID NO: 17027 - DNA, 20 bp, Homo sapiens
ctgcctggttttcctaccca

SEQ ID NO: 17028 - DNA, 24 bp, Homo sapiens
tccagtaacatttttatgtactca

SEQ ID NO: 17029 - DNA, 19 bp, Homo sapiens
ttttacacacaccatttta

SEQ ID NO: 17030 - DNA, 23 bp, Homo sapiens
cctctccgcccactctttgctca

SEQ ID NO: 17031 - DNA, 27 bp, Homo sapiens
gcctgggttttattcttggcctggccc

SEQ ID NO: 17032 - DNA, 24 bp, Homo sapiens
aatctgttgtttctgccaaaggta

SEQ ID NO: 17033 - DNA, 18 bp, Homo sapiens
agacggtacataatccta

SEQ ID NO: 17034 - DNA, 19 bp, Homo sapiens
attaccagttagcttttaa

SEQ ID NO: 17035 - DNA, 20 bp, Homo sapiens
cccagcttagccactgtaag

SEQ ID NO: 17036 - DNA, 17 bp, Homo sapiens
gcgcatgcacgcacaca

SEQ ID NO: 17037 - DNA, 18 bp, Homo sapiens
tgcccccaacccagctta

SEQ ID NO: 17038 - DNA, 23 bp, Homo sapiens
aatcagcacatcacttagttcaa

SEQ ID NO: 17039 - DNA, 18 bp, Homo sapiens
taccttcagatgttcact

SEQ ID NO: 17040 - DNA, 20 bp, Homo sapiens
accttttgtaaagttgtcat

SEQ ID NO: 17041 - DNA, 21 bp, Homo sapiens
gcagtgagtaaaaaagaaaca

SEQ ID NO: 17042 - DNA, 20 bp, Homo sapiens
ttcttaatatgaacatggta

SEQ ID NO: 17043 - DNA, 18 bp, Homo sapiens
aaggtagcggcctaagct

SEQ ID NO: 17044 - DNA, 17 bp, Homo sapiens
agccgcagccaaatagc

SEQ ID NO: 17045 - DNA, 21 bp, Homo sapiens
aggaaatggaaccatttcaca

SEQ ID NO: 17046 - DNA, 21 bp, Homo sapiens
cacacctctttaagctgactc

SEQ ID NO: 17047 - DNA, 18 bp, Homo sapiens
cagcactttgggaagcca

SEQ ID NO: 17048 - DNA, 22 bp, Homo sapiens
ggcctgtgccactggtgccagc

SEQ ID NO: 17049 - DNA, 17 bp, Homo sapiens
tgacagagccagactcc

SEQ ID NO: 17050 - DNA, 22 bp, Homo sapiens
tgcccagggtgaatcaatggaa

SEQ ID NO: 17051 - DNA, 19 bp, Homo sapiens
ttccagatgtctgctccag

SEQ ID NO: 17052 - DNA, 22 bp, Homo sapiens
cttctagtgtacccatcatcca

SEQ ID NO: 17053 - DNA, 17 bp, Homo sapiens
acaaagcccccatgtca

SEQ ID NO: 17054 - DNA, 17 bp, Homo sapiens
agtataacactaagaaa

SEQ ID NO: 17055 - DNA, 20 bp, Homo sapiens
catgtcatttagactaacca

SEQ ID NO: 17056 - DNA, 20 bp, Homo sapiens
gcagtttccatgtctttttt

SEQ ID NO: 17057 - DNA, 20 bp, Homo sapiens
gcccccatgtcatttagact

SEQ ID NO: 17058 - DNA, 19 bp, Homo sapiens
gttttcttaaatcactttt

SEQ ID NO: 17059 - DNA, 18 bp, Homo sapiens
tctttgcctgttttaact

SEQ ID NO: 17060 - DNA, 23 bp, Homo sapiens
tctttttagcagctttcagcttt

SEQ ID NO: 17061 - DNA, 19 bp, Homo sapiens
tttatatgcctaatgttac

SEQ ID NO: 17062 - DNA, 19 bp, Homo sapiens
aaaagataagatgctccca

SEQ ID NO: 17063 - DNA, 17 bp, Homo sapiens
caaacctttttgactca

SEQ ID NO: 17064 - DNA, 20 bp, Homo sapiens
ccttgacttgagacttgtgg

SEQ ID NO: 17065 - DNA, 22 bp, Homo sapiens
gcctgaatcagaacgctggctt

SEQ ID NO: 17066 - DNA, 17 bp, Homo sapiens
tcaagtgattctcctgc

SEQ ID NO: 17067 - DNA, 18 bp, Homo sapiens
tccaactcttgggttcaa

SEQ ID NO: 17068 - DNA, 19 bp, Homo sapiens
tgatgacttttataagttt

SEQ ID NO: 17069 - DNA, 23 bp, Homo sapiens
tgggttcaagcaaccctgcctca

SEQ ID NO: 17070 - DNA, 19 bp, Homo sapiens
tttctttatagtctgaact

SEQ ID NO: 17071 - DNA, 20 bp, Homo sapiens
aggcgcccgccaccacacca

SEQ ID NO: 17072 - DNA, 22 bp, Homo sapiens
caagattctgaagacttagtta

SEQ ID NO: 17073 - DNA, 17 bp, Homo sapiens
tggtttcccaaccaata

SEQ ID NO: 17074 - DNA, 20 bp, Homo sapiens
tgttagagataatttctgaa

SEQ ID NO: 17075 - DNA, 19 bp, Homo sapiens
ttccatgatgttcttttaa

SEQ ID NO: 17076 - DNA, 23 bp, Homo sapiens
tttaagaaataaggtggaactcc

SEQ ID NO: 17077 - DNA, 20 bp, Homo sapiens
tatgtataccaacactgcca

SEQ ID NO: 17078 - DNA, 18 bp, Homo sapiens
tgcttttcatctggacaa

SEQ ID NO: 17079 - DNA, 18 bp, Homo sapiens
ttgtgttgtcttagcttt

SEQ ID NO: 17080 - DNA, 18 bp, Homo sapiens
atgttaccctgccacacc

SEQ ID NO: 17081 - DNA, 24 bp, Homo sapiens
caatgatgaatcacttagtgtgaa

SEQ ID NO: 17082 - DNA, 17 bp, Homo sapiens
tcttccggagtctagag

SEQ ID NO: 17083 - DNA, 23 bp, Homo sapiens
cagacccgtgcccaatctcctct

SEQ ID NO: 17084 - DNA, 18 bp, Homo sapiens
ccagcccctccacccccc

SEQ ID NO: 17085 - DNA, 16 bp, Homo sapiens
gcgaggagtccctgca

SEQ ID NO: 17086 - DNA, 16 bp, Homo sapiens
taagcccctgcatttg

SEQ ID NO: 17087 - DNA, 22 bp, Homo sapiens
agggctcacaatttggcttttt

SEQ ID NO: 17088 - DNA, 19 bp, Homo sapiens
aacaccagttaacatagta

SEQ ID NO: 17089 - DNA, 24 bp, Homo sapiens
caacaacaccacgaaacatctgtg

SEQ ID NO: 17090 - DNA, 19 bp, Homo sapiens
ccaagaggccagtcctcca

SEQ ID NO: 17091 - DNA, 23 bp, Homo sapiens
ctccaaaatattaaaataaccca

SEQ ID NO: 17092 - DNA, 20 bp, Homo sapiens
ttttataccaattattagtc

SEQ ID NO: 17093 - DNA, 17 bp, Homo sapiens
aaacactgagagtatct

SEQ ID NO: 17094 - DNA, 17 bp, Homo sapiens
aaacctcaaagtctggt

SEQ ID NO: 17095 - DNA, 22 bp, Homo sapiens
agctattgaggcttagctttat

SEQ ID NO: 17096 - DNA, 18 bp, Homo sapiens
ataatgcacagtacacta

SEQ ID NO: 17097 - DNA, 18 bp, Homo sapiens
ctcaaagtctggtgtaga

SEQ ID NO: 17098 - DNA, 19 bp, Homo sapiens
gaagtctaatacatgatac

SEQ ID NO: 17099 - DNA, 18 bp, Homo sapiens
gcagccctccgcccgggt

SEQ ID NO: 17100 - DNA, 17 bp, Homo sapiens
tataggcatatacctca

SEQ ID NO: 17101 - DNA, 24 bp, Homo sapiens
tctttttatggggaaattgatttt

SEQ ID NO: 17102 - DNA, 17 bp, Homo sapiens
tgatctcaagtcctttt

SEQ ID NO: 17103 - DNA, 21 bp, Homo sapiens
tgtaatctgatgcatgaatca

SEQ ID NO: 17104 - DNA, 21 bp, Homo sapiens
atttgatgctgttgtctgtct

SEQ ID NO: 17105 - DNA, 19 bp, Homo sapiens
cacatgcacacaaatggac

SEQ ID NO: 17106 - DNA, 21 bp, Homo sapiens
catttagctatctgcctcttt

SEQ ID NO: 17107 - DNA, 19 bp, Homo sapiens
gagctggattagctgttga

SEQ ID NO: 17108 - DNA, 18 bp, Homo sapiens
tattacctcgtgcattgt

SEQ ID NO: 17109 - DNA, 19 bp, Homo sapiens
tctgctgatatgcatttat

SEQ ID NO: 17110 - DNA, 19 bp, Homo sapiens
tgctgttgactgtgctatt

SEQ ID NO: 17111 - DNA, 22 bp, Homo sapiens
tgtctctctctcaccctagctt

SEQ ID NO: 17112 - DNA, 19 bp, Homo sapiens
ttcaagacttcaaatacaa

SEQ ID NO: 17113 - DNA, 20 bp, Homo sapiens
tttacatgcctgatggcacc

SEQ ID NO: 17114 - DNA, 19 bp, Homo sapiens
aaacaaaggcagcagacta

SEQ ID NO: 17115 - DNA, 19 bp, Homo sapiens
aacagcagaccagcctggc

SEQ ID NO: 17116 - DNA, 21 bp, Homo sapiens
agtgaataatttcttaccaaa

SEQ ID NO: 17117 - DNA, 22 bp, Homo sapiens
atggtgttgaaaaataactgtt

SEQ ID NO: 17118 - DNA, 22 bp, Homo sapiens
atttagttatatttgatatttt

SEQ ID NO: 17119 - DNA, 21 bp, Homo sapiens
cagtgagaagtgcaacatcca

SEQ ID NO: 17120 - DNA, 22 bp, Homo sapiens
ctgtgagtttcaaagggagtca

SEQ ID NO: 17121 - DNA, 20 bp, Homo sapiens
gaatactacagttttgtcca

SEQ ID NO: 17122 - DNA, 19 bp, Homo sapiens
aggcctctgcatattctca

SEQ ID NO: 17123 - DNA, 21 bp, Homo sapiens
aggtaccatcgcctcctgcca

SEQ ID NO: 17124 - DNA, 19 bp, Homo sapiens
cctccatggagaaaacagc

SEQ ID NO: 17125 - DNA, 22 bp, Homo sapiens
cgccaggtaccatcgcctcctg

SEQ ID NO: 17126 - DNA, 19 bp, Homo sapiens
gcaaaatgaagcccttacc

SEQ ID NO: 17127 - DNA, 19 bp, Homo sapiens
gcagcaacatctgtgagcc

SEQ ID NO: 17128 - DNA, 17 bp, Homo sapiens
gccacccctatccctct

SEQ ID NO: 17129 - DNA, 21 bp, Homo sapiens
gcctggaatgttttctggctc

SEQ ID NO: 17130 - DNA, 25 bp, Homo sapiens
gttgcaatgatggctgggccagtca

SEQ ID NO: 17131 - DNA, 22 bp, Homo sapiens
taggatttttaaatgctggtga

SEQ ID NO: 17132 - DNA, 17 bp, Homo sapiens
tgcagtgcagccactga

SEQ ID NO: 17133 - DNA, 16 bp, Homo sapiens
tggtcagtcccttgcc

SEQ ID NO: 17134 - DNA, 24 bp, Homo sapiens
attaaagttagaaacgactacaga

SEQ ID NO: 17135 - DNA, 23 bp, Homo sapiens
cctctctcggcaccagttgacct

SEQ ID NO: 17136 - DNA, 21 bp, Homo sapiens
cctggatgggtactttattaa

SEQ ID NO: 17137 - DNA, 22 bp, Homo sapiens
ctgcatacttatacctggatgg

SEQ ID NO: 17138 - DNA, 22 bp, Homo sapiens
taataaaaagattaaagtgtca

SEQ ID NO: 17139 - DNA, 23 bp, Homo sapiens
tatcccctttaaaggagacatta

SEQ ID NO: 17140 - DNA, 17 bp, Homo sapiens
tgtagcaccaaaattct

SEQ ID NO: 17141 - DNA, 21 bp, Homo sapiens
tttctttgtggctcatgcttt

SEQ ID NO: 17142 - DNA, 19 bp, Homo sapiens
aaaatctagaaaccatcgg

SEQ ID NO: 17143 - DNA, 19 bp, Homo sapiens
aggcaattctcctgcctca

SEQ ID NO: 17144 - DNA, 18 bp, Homo sapiens
taataaaagtgaaattac

SEQ ID NO: 17145 - DNA, 20 bp, Homo sapiens
tgaagcctagacattcagag

SEQ ID NO: 17146 - DNA, 21 bp, Homo sapiens
agatcttttagtattatgtaa

SEQ ID NO: 17147 - DNA, 16 bp, Homo sapiens
ccttgtccagaaaacc

SEQ ID NO: 17148 - DNA, 25 bp, Homo sapiens
gactgcatgtttacttaatcaggtt

SEQ ID NO: 17149 - DNA, 20 bp, Homo sapiens
taaaacgttcccacaatgca

SEQ ID NO: 17150 - DNA, 19 bp, Homo sapiens
ttgtttgttgttgtggtgt

SEQ ID NO: 17151 - DNA, 21 bp, Homo sapiens
tttgtttgtttttttctatgt

SEQ ID NO: 17152 - DNA, 17 bp, Homo sapiens
cacatctattgtttcct

SEQ ID NO: 17153 - DNA, 23 bp, Homo sapiens
cagagacgtgggtacaaaccctg

SEQ ID NO: 17154 - DNA, 23 bp, Homo sapiens
cgggcgcaggcggccccacggga

SEQ ID NO: 17155 - DNA, 19 bp, Homo sapiens
aggacccttgtcctggtgg

SEQ ID NO: 17156 - DNA, 23 bp, Homo sapiens
cctggaccacgttgcccaagtca

SEQ ID NO: 17157 - DNA, 21 bp, Homo sapiens
ctcctggaccacgttgcccaa

SEQ ID NO: 17158 - DNA, 17 bp, Homo sapiens
gcgcggcgggctcgcgc

SEQ ID NO: 17159 - DNA, 20 bp, Homo sapiens
ggcttctgtgttatgtattt

SEQ ID NO: 17160 - DNA, 21 bp, Homo sapiens
gggctggaaggcggctgcggc

SEQ ID NO: 17161 - DNA, 21 bp, Homo sapiens
aaaatgcccagtaactttaca

SEQ ID NO: 17162 - DNA, 26 bp, Homo sapiens
aatttgtgatcagtagtctctctgga

SEQ ID NO: 17163 - DNA, 18 bp, Homo sapiens
attaagaaaatgcccagt

SEQ ID NO: 17164 - DNA, 19 bp, Homo sapiens
cactcgacatcccattcgg

SEQ ID NO: 17165 - DNA, 19 bp, Homo sapiens
gaattcacacgtagacgac

SEQ ID NO: 17166 - DNA, 17 bp, Homo sapiens
gaccccgattatcacag

SEQ ID NO: 17167 - DNA, 19 bp, Homo sapiens
ggagccctaataaatttca

SEQ ID NO: 17168 - DNA, 18 bp, Homo sapiens
ttcgttgtgcctttgaaa

SEQ ID NO: 17169 - DNA, 22 bp, Homo sapiens
tttatccatacttagcaaccaa

SEQ ID NO: 17170 - DNA, 21 bp, Homo sapiens
aagtgaaatgaatctgtcatt

SEQ ID NO: 17171 - DNA, 22 bp, Homo sapiens
agtctcactctgttacccaggc

SEQ ID NO: 17172 - DNA, 23 bp, Homo sapiens
agtggttttcttacataggactc

SEQ ID NO: 17173 - DNA, 21 bp, Homo sapiens
ctttttcccctccttaatttt

SEQ ID NO: 17174 - DNA, 22 bp, Homo sapiens
aagatgcagtctctgctgatca

SEQ ID NO: 17175 - DNA, 19 bp, Homo sapiens
aagtgacaacttagggagc

SEQ ID NO: 17176 - DNA, 22 bp, Homo sapiens
agtaagattctcctgtatttca

SEQ ID NO: 17177 - DNA, 20 bp, Homo sapiens
agtgaatggggacactcgtg

SEQ ID NO: 17178 - DNA, 17 bp, Homo sapiens
caacagcatcatctgca

SEQ ID NO: 17179 - DNA, 20 bp, Homo sapiens
ccactctatttttttaggtt

SEQ ID NO: 17180 - DNA, 22 bp, Homo sapiens
ctctcctgtgagatttcacttt

SEQ ID NO: 17181 - DNA, 18 bp, Homo sapiens
gaggagtgcatggcgaga

SEQ ID NO: 17182 - DNA, 19 bp, Homo sapiens
gccaggcggccgcttggcc

SEQ ID NO: 17183 - DNA, 20 bp, Homo sapiens
gcgtctgcactgatgaccgt

SEQ ID NO: 17184 - DNA, 23 bp, Homo sapiens
gcgttcctggacaaacagcctca

SEQ ID NO: 17185 - DNA, 18 bp, Homo sapiens
ggtcctactgctgtgagc

SEQ ID NO: 17186 - DNA, 17 bp, Homo sapiens
tcgacttcattttgcca

SEQ ID NO: 17187 - DNA, 19 bp, Homo sapiens
tctgcacctaaacccatac

SEQ ID NO: 17188 - DNA, 21 bp, Homo sapiens
tgaccgtctgagcccagctca

SEQ ID NO: 17189 - DNA, 20 bp, Homo sapiens
tgccccgttgcctatcacag

SEQ ID NO: 17190 - DNA, 19 bp, Homo sapiens
tgtcccgcgggcgagttct

SEQ ID NO: 17191 - DNA, 23 bp, Homo sapiens
aactcgttatctaaagcatcaga

SEQ ID NO: 17192 - DNA, 22 bp, Homo sapiens
aggtcaccatcagtgaacgcaa

SEQ ID NO: 17193 - DNA, 20 bp, Homo sapiens
atttgggagacagtcacgtc

SEQ ID NO: 17194 - DNA, 21 bp, Homo sapiens
caccctcctccacctcccaaa

SEQ ID NO: 17195 - DNA, 18 bp, Homo sapiens
ccaccctcctccacctcc

SEQ ID NO: 17196 - DNA, 20 bp, Homo sapiens
cctctgcctcccaggttcaa

SEQ ID NO: 17197 - DNA, 21 bp, Homo sapiens
gtcattggtttgatttttgga

SEQ ID NO: 17198 - DNA, 18 bp, Homo sapiens
tgtgcagatatttatgaa

SEQ ID NO: 17199 - DNA, 18 bp, Homo sapiens
gccagggagggaaccctg

SEQ ID NO: 17200 - DNA, 21 bp, Homo sapiens
aaggaataagaagttacctac

SEQ ID NO: 17201 - DNA, 22 bp, Homo sapiens
cctcccctggcttttcctacca

SEQ ID NO: 17202 - DNA, 17 bp, Homo sapiens
cactgtgtcaagttaca

SEQ ID NO: 17203 - DNA, 18 bp, Homo sapiens
catcagaattcataatca

SEQ ID NO: 17204 - DNA, 21 bp, Homo sapiens
cttaaaattgtataaggctga

SEQ ID NO: 17205 - DNA, 22 bp, Homo sapiens
tgcattagagcactttgcaatt

SEQ ID NO: 17206 - DNA, 21 bp, Homo sapiens
ctacactctagtaaacatttt

SEQ ID NO: 17207 - DNA, 20 bp, Homo sapiens
gaaatgcagcgcagatcctt

SEQ ID NO: 17208 - DNA, 23 bp, Homo sapiens
gcctgagccaccgcgcccggccc

SEQ ID NO: 17209 - DNA, 18 bp, Homo sapiens
gtatatcaccattgggta

SEQ ID NO: 17210 - DNA, 20 bp, Homo sapiens
tggccaggctggtcttgaac

SEQ ID NO: 17211 - DNA, 25 bp, Homo sapiens
tttcattattttgcactggatccac

SEQ ID NO: 17212 - DNA, 24 bp, Homo sapiens
agaaatatatcccttgctcccttt

SEQ ID NO: 17213 - DNA, 16 bp, Homo sapiens
cactgctagtgtacag

SEQ ID NO: 17214 - DNA, 16 bp, Homo sapiens
tctttgtgacacttca

SEQ ID NO: 17215 - DNA, 26 bp, Homo sapiens
tttttttatagttgtagttttgattt

SEQ ID NO: 17216 - DNA, 21 bp, Homo sapiens
acccaaaggcctttcatctca

SEQ ID NO: 17217 - DNA, 19 bp, Homo sapiens
atctactcttatactgaca

SEQ ID NO: 17218 - DNA, 21 bp, Homo sapiens
attggaaggaaatactactca

SEQ ID NO: 17219 - DNA, 19 bp, Homo sapiens
cactttcactttacacttg

SEQ ID NO: 17220 - DNA, 19 bp, Homo sapiens
ggatgctggcatctgtgta

SEQ ID NO: 17221 - DNA, 19 bp, Homo sapiens
tcagccatttactctccca

SEQ ID NO: 17222 - DNA, 21 bp, Homo sapiens
tttctgtttcccatatctcac

SEQ ID NO: 17223 - DNA, 23 bp, Homo sapiens
aagaataaagactcgaggcttct

SEQ ID NO: 17224 - DNA, 19 bp, Homo sapiens
aagtgccaggaacaatgaa

SEQ ID NO: 17225 - DNA, 17 bp, Homo sapiens
tggcctgtgtgaagctg

SEQ ID NO: 17226 - DNA, 23 bp, Homo sapiens
ccaaacagatgcagaagaaccca

SEQ ID NO: 17227 - DNA, 22 bp, Homo sapiens
tacagtgggggtaaaagtcaca

SEQ ID NO: 17228 - DNA, 18 bp, Homo sapiens
gttcccagaaacccagtg

SEQ ID NO: 17229 - DNA, 18 bp, Homo sapiens
ggtaaatacttggaccat

SEQ ID NO: 17230 - DNA, 16 bp, Homo sapiens
taccactctgattata

SEQ ID NO: 17231 - DNA, 19 bp, Homo sapiens
tataaatacgtttgcctca

SEQ ID NO: 17232 - DNA, 18 bp, Homo sapiens
cagctggggttctaggga

SEQ ID NO: 17233 - DNA, 23 bp, Homo sapiens
agaacacacctgtggctatctta

SEQ ID NO: 17234 - DNA, 22 bp, Homo sapiens
aggagggggaagcagcaggaca

SEQ ID NO: 17235 - DNA, 20 bp, Homo sapiens
gccttggggccttacctacc

SEQ ID NO: 17236 - DNA, 21 bp, Homo sapiens
gggaacagtgctggctgtggc

SEQ ID NO: 17237 - DNA, 21 bp, Homo sapiens
tggggttgtggtgactccagt

SEQ ID NO: 17238 - DNA, 21 bp, Homo sapiens
aaaagatatagcaaatgaaga

SEQ ID NO: 17239 - DNA, 19 bp, Homo sapiens
agggttttacttccttgtt

SEQ ID NO: 17240 - DNA, 19 bp, Homo sapiens
gttctcaaaatattaactc

SEQ ID NO: 17241 - DNA, 21 bp, Homo sapiens
tgagtggattttatataggat

SEQ ID NO: 17242 - DNA, 19 bp, Homo sapiens
acaatcaccgtgctgcagc

SEQ ID NO: 17243 - DNA, 21 bp, Homo sapiens
ccaaaagaaaaaaaaatctca

SEQ ID NO: 17244 - DNA, 25 bp, Homo sapiens
cctcccccacagcctcttttctcca

SEQ ID NO: 17245 - DNA, 22 bp, Homo sapiens
cctctcccttccctctgtctca

SEQ ID NO: 17246 - DNA, 21 bp, Homo sapiens
cgccctcaatgctggctgctg

SEQ ID NO: 17247 - DNA, 18 bp, Homo sapiens
ggaagctgaaacctctga

SEQ ID NO: 17248 - DNA, 18 bp, Homo sapiens
tccctgcccagtcatgca

SEQ ID NO: 17249 - DNA, 24 bp, Homo sapiens
ctttccccaaaatttccacagaaa

SEQ ID NO: 17250 - DNA, 24 bp, Homo sapiens
aaacttcagttctatttctataga

SEQ ID NO: 17251 - DNA, 17 bp, Homo sapiens
acgtaatcccgtctgaa

SEQ ID NO: 17252 - DNA, 21 bp, Homo sapiens
tcacatgaaaagttatcagat

SEQ ID NO: 17253 - DNA, 21 bp, Homo sapiens
cagtgactccaagtggaacta

SEQ ID NO: 17254 - DNA, 23 bp, Homo sapiens
ctttttcagttagtcctaacttt

SEQ ID NO: 17255 - DNA, 23 bp, Homo sapiens
tttagatacctgagtgcactttt

SEQ ID NO: 17256 - DNA, 19 bp, Homo sapiens
cccgcccctcccgccgcca

SEQ ID NO: 17257 - DNA, 18 bp, Homo sapiens
gctcggaacccaccccag

SEQ ID NO: 17258 - DNA, 21 bp, Homo sapiens
tcccgggcccgcgcgctccca

SEQ ID NO: 17259 - DNA, 19 bp, Homo sapiens
agtctccccaaatcagtga

SEQ ID NO: 17260 - DNA, 23 bp, Homo sapiens
gcgagattgaagggcttttgtta

SEQ ID NO: 17261 - DNA, 19 bp, Homo sapiens
gggaaatactaggaactaa

SEQ ID NO: 17262 - DNA, 19 bp, Homo sapiens
aagcaattctcctgcctca

SEQ ID NO: 17263 - DNA, 17 bp, Homo sapiens
ctaactgttgtgtgatt

SEQ ID NO: 17264 - DNA, 25 bp, Homo sapiens
gctgcaagcagtttatataaagata

SEQ ID NO: 17265 - DNA, 15 bp, Homo sapiens
gttacctttctgtgc

SEQ ID NO: 17266 - DNA, 18 bp, Homo sapiens
tccgcctcccgggttcaa

SEQ ID NO: 17267 - DNA, 18 bp, Homo sapiens
ttgggcattgcttggctc

SEQ ID NO: 17268 - DNA, 21 bp, Homo sapiens
ttttgctgcaagcagtttata

SEQ ID NO: 17269 - DNA, 19 bp, Homo sapiens
actagaagaacctcagtga

SEQ ID NO: 17270 - DNA, 21 bp, Homo sapiens
ccaggcacagagctgcctgct

SEQ ID NO: 17271 - DNA, 28 bp, Homo sapiens
ccttgggagcagtgggggtgtctgtgga

SEQ ID NO: 17272 - DNA, 25 bp, Homo sapiens
ggccgggcatggtggctcatgccta

SEQ ID NO: 17273 - DNA, 18 bp, Homo sapiens
gggggctggtgattccca

SEQ ID NO: 17274 - DNA, 18 bp, Homo sapiens
tgggtggatcacttgagg

SEQ ID NO: 17275 - DNA, 19 bp, Homo sapiens
agctaaacaacagatgcca

SEQ ID NO: 17276 - DNA, 22 bp, Homo sapiens
cctgttttgttttggattattt

SEQ ID NO: 17277 - DNA, 17 bp, Homo sapiens
gtccttttcagtattta

SEQ ID NO: 17278 - DNA, 23 bp, Homo sapiens
gtcgacttattttatacatagca

SEQ ID NO: 17279 - DNA, 20 bp, Homo sapiens
ccgcgcgccgccgccactgc

SEQ ID NO: 17280 - DNA, 19 bp, Homo sapiens
cctgacaaacttccatcaa

SEQ ID NO: 17281 - DNA, 19 bp, Homo sapiens
cgcgcgccgccgccactgc

SEQ ID NO: 17282 - DNA, 17 bp, Homo sapiens
agaaaattcatctgtgc

SEQ ID NO: 17283 - DNA, 19 bp, Homo sapiens
cgcggaggtgcggcgggga

SEQ ID NO: 17284 - DNA, 23 bp, Homo sapiens
taaccagagcttagcaaatggga

SEQ ID NO: 17285 - DNA, 25 bp, Homo sapiens
tctaaagtaactggcccagtctcca

SEQ ID NO: 17286 - DNA, 21 bp, Homo sapiens
tctcttcgctggcttaacttt

SEQ ID NO: 17287 - DNA, 17 bp, Homo sapiens
ttatgattgttactgca

SEQ ID NO: 17288 - DNA, 19 bp, Homo sapiens
acctaacagggacttccca

SEQ ID NO: 17289 - DNA, 18 bp, Homo sapiens
aggcccttctgtagcctc

SEQ ID NO: 17290 - DNA, 19 bp, Homo sapiens
atcctggtttcccagatct

SEQ ID NO: 17291 - DNA, 20 bp, Homo sapiens
cacctcccagagacggccac

SEQ ID NO: 17292 - DNA, 23 bp, Homo sapiens
ccctggccctgagactctgtgag

SEQ ID NO: 17293 - DNA, 21 bp, Homo sapiens
ccctgggtggagatttccgaa

SEQ ID NO: 17294 - DNA, 22 bp, Homo sapiens
ccgaaaagtagtcttctctgag

SEQ ID NO: 17295 - DNA, 18 bp, Homo sapiens
cctgctgagctgcagcca

SEQ ID NO: 17296 - DNA, 18 bp, Homo sapiens
ctctgtgagggggctgga

SEQ ID NO: 17297 - DNA, 23 bp, Homo sapiens
acaaacctagatggtatacccta

SEQ ID NO: 17298 - DNA, 20 bp, Homo sapiens
caaatcaacatgactgtgtt

SEQ ID NO: 17299 - DNA, 24 bp, Homo sapiens
ctgactacttcccttgctaatcac

SEQ ID NO: 17300 - DNA, 19 bp, Homo sapiens
cttgagtagtctttggtcc

SEQ ID NO: 17301 - DNA, 22 bp, Homo sapiens
gagccaagatcgcgccactgca

SEQ ID NO: 17302 - DNA, 20 bp, Homo sapiens
taagatataaaatggtacac

SEQ ID NO: 17303 - DNA, 19 bp, Homo sapiens
tccaaagatagtatttcca

SEQ ID NO: 17304 - DNA, 21 bp, Homo sapiens
tgaaagaacacttctaagcct

SEQ ID NO: 17305 - DNA, 17 bp, Homo sapiens
tgactgccagcagtgga

SEQ ID NO: 17306 - DNA, 22 bp, Homo sapiens
gctcccactgccccctgagatg

SEQ ID NO: 17307 - DNA, 21 bp, Homo sapiens
ggagacagcatgctggctgtg

SEQ ID NO: 17308 - DNA, 20 bp, Homo sapiens
ggcccaaacctgagattcca

SEQ ID NO: 17309 - DNA, 20 bp, Homo sapiens
tctgtttcattgactctttt

SEQ ID NO: 17310 - DNA, 20 bp, Homo sapiens
cctccttccccctttgactt

SEQ ID NO: 17311 - DNA, 19 bp, Homo sapiens
cctgagcaggggcttgggg

SEQ ID NO: 17312 - DNA, 21 bp, Homo sapiens
gcaggcactgtgttttcctca

SEQ ID NO: 17313 - DNA, 20 bp, Homo sapiens
gcctgaggagctgcctgcct

SEQ ID NO: 17314 - DNA, 19 bp, Homo sapiens
gccttcggaggctcaggga

SEQ ID NO: 17315 - DNA, 20 bp, Homo sapiens
accctgcttgtttctgcagc

SEQ ID NO: 17316 - DNA, 18 bp, Homo sapiens
actgtcagtggagatact

SEQ ID NO: 17317 - DNA, 19 bp, Homo sapiens
ccaatgaaaacggccgcct

SEQ ID NO: 17318 - DNA, 20 bp, Homo sapiens
cggagagaacaaagcccatt

SEQ ID NO: 17319 - DNA, 18 bp, Homo sapiens
tcctgacctcatgatcca

SEQ ID NO: 17320 - DNA, 21 bp, Homo sapiens
tgtatttgctgaaagagagca

SEQ ID NO: 17321 - DNA, 22 bp, Homo sapiens
tttaagtgatgacaagttccaa

SEQ ID NO: 17322 - DNA, 18 bp, Homo sapiens
tttgtatgttaggacttt

SEQ ID NO: 17323 - DNA, 20 bp, Homo sapiens
atggtgaaaccccatcgcta

SEQ ID NO: 17324 - DNA, 21 bp, Homo sapiens
cagggtcgtgggaagcttggt

SEQ ID NO: 17325 - DNA, 19 bp, Homo sapiens
catatcccttctgtatcct

SEQ ID NO: 17326 - DNA, 17 bp, Homo sapiens
ccccaacattcctatag

SEQ ID NO: 17327 - DNA, 21 bp, Homo sapiens
gagttagccttgcatatccct

SEQ ID NO: 17328 - DNA, 19 bp, Homo sapiens
ggactgctcaatcactatt

SEQ ID NO: 17329 - DNA, 22 bp, Homo sapiens
ttctgctcacacaattgcactc

SEQ ID NO: 17330 - DNA, 21 bp, Homo sapiens
gcaactttttttgccttggtg

SEQ ID NO: 17331 - DNA, 21 bp, Homo sapiens
ggaaaggacaagaaaaaacta

SEQ ID NO: 17332 - DNA, 21 bp, Homo sapiens
gtaacctatgataacataata

SEQ ID NO: 17333 - DNA, 25 bp, Homo sapiens
gtgtgtgtgagtgtgtgtgtgtctg

SEQ ID NO: 17334 - DNA, 19 bp, Homo sapiens
taggtaacctatgataaca

SEQ ID NO: 17335 - DNA, 23 bp, Homo sapiens
tgataacataataatgtggacgc

SEQ ID NO: 17336 - DNA, 18 bp, Homo sapiens
atgtaatgagataccttt

SEQ ID NO: 17337 - DNA, 23 bp, Homo sapiens
ccgccgccacccagagtgtggtc

SEQ ID NO: 17338 - DNA, 26 bp, Homo sapiens
ctaacgctcactgtcagtgcccatgt

SEQ ID NO: 17339 - DNA, 22 bp, Homo sapiens
gcagctccagcccatcttgctg

SEQ ID NO: 17340 - DNA, 22 bp, Homo sapiens
gttttaatcactcttgccatta

SEQ ID NO: 17341 - DNA, 19 bp, Homo sapiens
tgagtatttccaggacaac

SEQ ID NO: 17342 - DNA, 18 bp, Homo sapiens
ccccaccccgcctgccgc

SEQ ID NO: 17343 - DNA, 19 bp, Homo sapiens
cccgccgcctgctgcccgg

SEQ ID NO: 17344 - DNA, 15 bp, Homo sapiens
actaatattacctcc

SEQ ID NO: 17345 - DNA, 20 bp, Homo sapiens
atataatttatcatttgtac

SEQ ID NO: 17346 - DNA, 19 bp, Homo sapiens
cctgatccacctacctgct

SEQ ID NO: 17347 - DNA, 18 bp, Homo sapiens
cgcatgttgcacctgtgc

SEQ ID NO: 17348 - DNA, 20 bp, Homo sapiens
gacagccccctgccccatct

SEQ ID NO: 17349 - DNA, 17 bp, Homo sapiens
gttttaactctaagaaa

SEQ ID NO: 17350 - DNA, 21 bp, Homo sapiens
tataccaacatcctgaaagtt

SEQ ID NO: 17351 - DNA, 17 bp, Homo sapiens
ctccctccctctgccct

SEQ ID NO: 17352 - DNA, 16 bp, Homo sapiens
gataggaaaccagtga

SEQ ID NO: 17353 - DNA, 22 bp, Homo sapiens
tcaacacaattttattcactaa

SEQ ID NO: 17354 - DNA, 21 bp, Homo sapiens
ttccttttgagaagcactgaa

SEQ ID NO: 17355 - DNA, 24 bp, Homo sapiens
agggagagtggctcgggctcagtc

SEQ ID NO: 17356 - DNA, 21 bp, Homo sapiens
ccatgactacatcacagccag

SEQ ID NO: 17357 - DNA, 18 bp, Homo sapiens
ctggaattacactttttt

SEQ ID NO: 17358 - DNA, 21 bp, Homo sapiens
gcggaagtagcacagtttcca

SEQ ID NO: 17359 - DNA, 16 bp, Homo sapiens
cagaacgattgatgaa

SEQ ID NO: 17360 - DNA, 21 bp, Homo sapiens
caacacttgatggtacagtaa

SEQ ID NO: 17361 - DNA, 18 bp, Homo sapiens
tcaataaagacctcttga

SEQ ID NO: 17362 - DNA, 20 bp, Homo sapiens
agcgccccagcgcctcatct

SEQ ID NO: 17363 - DNA, 18 bp, Homo sapiens
ccctccccactcccccta

SEQ ID NO: 17364 - DNA, 22 bp, Homo sapiens
gccacctccttcccggccgccc

SEQ ID NO: 17365 - DNA, 20 bp, Homo sapiens
tcctgttgtctgtcacactt

SEQ ID NO: 17366 - DNA, 18 bp, Homo sapiens
tgcttgttctaacaatat

SEQ ID NO: 17367 - DNA, 19 bp, Homo sapiens
ctgcaagctccacctccca

SEQ ID NO: 17368 - DNA, 21 bp, Homo sapiens
gcgcttcggtacagcacgggt

SEQ ID NO: 17369 - DNA, 16 bp, Homo sapiens
gtgaagacaggctgtg

SEQ ID NO: 17370 - DNA, 21 bp, Homo sapiens
ttctcctgctgccaccgtctt

SEQ ID NO: 17371 - DNA, 18 bp, Homo sapiens
aacagatttgccggcatt

SEQ ID NO: 17372 - DNA, 26 bp, Homo sapiens
cagggcaccccaggacacccaggata

SEQ ID NO: 17373 - DNA, 21 bp, Homo sapiens
ctgcagcagttgcactctttt

SEQ ID NO: 17374 - DNA, 21 bp, Homo sapiens
gcctttcctccattttctgtg

SEQ ID NO: 17375 - DNA, 22 bp, Homo sapiens
ggaaaagtagagaaagaaatgc

SEQ ID NO: 17376 - DNA, 18 bp, Homo sapiens
ggagctttctaaatctca

SEQ ID NO: 17377 - DNA, 18 bp, Homo sapiens
tgagctcttctatagctc

SEQ ID NO: 17378 - DNA, 20 bp, Homo sapiens
tgtagggagatatgtaggtg

SEQ ID NO: 17379 - DNA, 19 bp, Homo sapiens
tttttcttttttcatttca

SEQ ID NO: 17380 - DNA, 19 bp, Homo sapiens
aaactcctgacctcaggtg

SEQ ID NO: 17381 - DNA, 22 bp, Homo sapiens
ctgggattacaggcacctgcca

SEQ ID NO: 17382 - DNA, 18 bp, Homo sapiens
tccacctcctgggttcaa

SEQ ID NO: 17383 - DNA, 25 bp, Homo sapiens
ttagagttagttttagggcactttt

SEQ ID NO: 17384 - DNA, 22 bp, Homo sapiens
aaaggatgggtcccaccctccc

SEQ ID NO: 17385 - DNA, 21 bp, Homo sapiens
gatgctgctcaacatgggcta

SEQ ID NO: 17386 - DNA, 22 bp, Homo sapiens
cctgaagttcttggattacttt

SEQ ID NO: 17387 - DNA, 23 bp, Homo sapiens
ccttgcacatacattggttttga

SEQ ID NO: 17388 - DNA, 19 bp, Homo sapiens
cttaacatttcatgtagta

SEQ ID NO: 17389 - DNA, 18 bp, Homo sapiens
tattaatctactgtatca

SEQ ID NO: 17390 - DNA, 20 bp, Homo sapiens
tgtagcaaatttgtttaatc

SEQ ID NO: 17391 - DNA, 25 bp, Homo sapiens
aaaccacagataataacaaacctta

SEQ ID NO: 17392 - DNA, 18 bp, Homo sapiens
gaaattacactgtgctca

SEQ ID NO: 17393 - DNA, 19 bp, Homo sapiens
gaacctgctggtgcaagct

SEQ ID NO: 17394 - DNA, 27 bp, Homo sapiens
gcctgggctgtagcaagctgtctgccc

SEQ ID NO: 17395 - DNA, 18 bp, Homo sapiens
gtctgcccttgggttcaa

SEQ ID NO: 17396 - DNA, 19 bp, Homo sapiens
aggaacctgagcctggctg

SEQ ID NO: 17397 - DNA, 17 bp, Homo sapiens
atcctcttccttcacag

SEQ ID NO: 17398 - DNA, 22 bp, Homo sapiens
cactaccagagttctctagcaa

SEQ ID NO: 17399 - DNA, 19 bp, Homo sapiens
cttgccagctgacgtcaca

SEQ ID NO: 17400 - DNA, 21 bp, Homo sapiens
gcctctgtcccaattctgagt

SEQ ID NO: 17401 - DNA, 22 bp, Homo sapiens
gtagagacaggatttcaccatg

SEQ ID NO: 17402 - DNA, 19 bp, Homo sapiens
gtgaactcacacatgtgta

SEQ ID NO: 17403 - DNA, 16 bp, Homo sapiens
gttgcgtagtcttgaa

SEQ ID NO: 17404 - DNA, 21 bp, Homo sapiens
tcatcatcatcatctctgcta

SEQ ID NO: 17405 - DNA, 26 bp, Homo sapiens
tgggtgggtttctacctttgaaactg

SEQ ID NO: 17406 - DNA, 22 bp, Homo sapiens
ttttgggacaatgcctctgtcc

SEQ ID NO: 17407 - DNA, 20 bp, Homo sapiens
caagatctccacgaatatca

SEQ ID NO: 17408 - DNA, 18 bp, Homo sapiens
agaaaatgttgtgctgta

SEQ ID NO: 17409 - DNA, 20 bp, Homo sapiens
agatcccaaatcttatgtaa

SEQ ID NO: 17410 - DNA, 23 bp, Homo sapiens
cacttttaaaaaataccatttga

SEQ ID NO: 17411 - DNA, 18 bp, Homo sapiens
gagtccttcctctcccct

SEQ ID NO: 17412 - DNA, 18 bp, Homo sapiens
gatcccaaatcttatgta

SEQ ID NO: 17413 - DNA, 20 bp, Homo sapiens
gcatattccaattcactttt

SEQ ID NO: 17414 - DNA, 18 bp, Homo sapiens
tccagtcatgactgtcca

SEQ ID NO: 17415 - DNA, 23 bp, Homo sapiens
accatttttacatccatgaaaat

SEQ ID NO: 17416 - DNA, 20 bp, Homo sapiens
gaagtttaaactctgctcac

SEQ ID NO: 17417 - DNA, 18 bp, Homo sapiens
tcccccaagaggatgcgg

SEQ ID NO: 17418 - DNA, 22 bp, Homo sapiens
accctgctagctttgcccttga

SEQ ID NO: 17419 - DNA, 18 bp, Homo sapiens
acttcatcccaacttgct

SEQ ID NO: 17420 - DNA, 16 bp, Homo sapiens
ctgctttggatgtggt

SEQ ID NO: 17421 - DNA, 21 bp, Homo sapiens
ggacggtgagacggccgcggc

SEQ ID NO: 17422 - DNA, 17 bp, Homo sapiens
agaaagtttacatacat

SEQ ID NO: 17423 - DNA, 20 bp, Homo sapiens
agtttcacttttcatcagca

SEQ ID NO: 17424 - DNA, 24 bp, Homo sapiens
caccaccgccgccgcctccatctt

SEQ ID NO: 17425 - DNA, 21 bp, Homo sapiens
caccttaccatcatcatgcca

SEQ ID NO: 17426 - DNA, 17 bp, Homo sapiens
cagtgggagaaagttca

SEQ ID NO: 17427 - DNA, 20 bp, Homo sapiens
catcatctttcacatgttca

SEQ ID NO: 17428 - DNA, 16 bp, Homo sapiens
cattgaccctgctgca

SEQ ID NO: 17429 - DNA, 18 bp, Homo sapiens
ccatgctacattttcatc

SEQ ID NO: 17430 - DNA, 19 bp, Homo sapiens
gcacacagtattcccagtg

SEQ ID NO: 17431 - DNA, 19 bp, Homo sapiens
taccactgaaccccattgc

SEQ ID NO: 17432 - DNA, 17 bp, Homo sapiens
tgcatctgggcatttca

SEQ ID NO: 17433 - DNA, 23 bp, Homo sapiens
tggaaagacctgggcagaaatgg

SEQ ID NO: 17434 - DNA, 17 bp, Homo sapiens
ttaccatcatcatgcca

SEQ ID NO: 17435 - DNA, 19 bp, Homo sapiens
ttcaaactccatttccatg

SEQ ID NO: 17436 - DNA, 20 bp, Homo sapiens
acccctaaaatcttacccac

SEQ ID NO: 17437 - DNA, 21 bp, Homo sapiens
ctcctgtgagcctcaatttta

SEQ ID NO: 17438 - DNA, 22 bp, Homo sapiens
gacatcactcatcttcctcaca

SEQ ID NO: 17439 - DNA, 18 bp, Homo sapiens
tgattgagccaccacact

SEQ ID NO: 17440 - DNA, 19 bp, Homo sapiens
tgcctctccttatccttca

SEQ ID NO: 17441 - DNA, 26 bp, Homo sapiens
caggctcccctccttcctattagcta

SEQ ID NO: 17442 - DNA, 19 bp, Homo sapiens
ccgtgtgtctgtgcagtgc

SEQ ID NO: 17443 - DNA, 22 bp, Homo sapiens
gggtattaaggtcagcctctca

SEQ ID NO: 17444 - DNA, 16 bp, Homo sapiens
ggttagatctgtgaac

SEQ ID NO: 17445 - DNA, 18 bp, Homo sapiens
tccgcctcccgggttcaa

SEQ ID NO: 17446 - DNA, 17 bp, Homo sapiens
tgacagagccagactcc

SEQ ID NO: 17447 - DNA, 18 bp, Homo sapiens
tgctcccacccttgcctg

SEQ ID NO: 17448 - DNA, 27 bp, Homo sapiens
cctgggacagtggctgctcttgacttt

SEQ ID NO: 17449 - DNA, 20 bp, Homo sapiens
tcttttctaggagtgtctca

SEQ ID NO: 17450 - DNA, 19 bp, Homo sapiens
aatggctctccctccccct

SEQ ID NO: 17451 - DNA, 20 bp, Homo sapiens
acccagagggtaaggattcc

SEQ ID NO: 17452 - DNA, 18 bp, Homo sapiens
actttaacatgcatccaa

SEQ ID NO: 17453 - DNA, 20 bp, Homo sapiens
caactagctgacaaagcttc

SEQ ID NO: 17454 - DNA, 20 bp, Homo sapiens
cagatcaggggctctgggga

SEQ ID NO: 17455 - DNA, 20 bp, Homo sapiens
ccagatccagacctaggcct

SEQ ID NO: 17456 - DNA, 16 bp, Homo sapiens
ccccagtccactggca

SEQ ID NO: 17457 - DNA, 21 bp, Homo sapiens
ccgttcctagtggggcttgct

SEQ ID NO: 17458 - DNA, 21 bp, Homo sapiens
ctctctcaggacctctcctct

SEQ ID NO: 17459 - DNA, 21 bp, Homo sapiens
gcagcctagacagaacctgca

SEQ ID NO: 17460 - DNA, 19 bp, Homo sapiens
gcctttcctccaaagcctg

SEQ ID NO: 17461 - DNA, 18 bp, Homo sapiens
ggaaggcagcctcagaca

SEQ ID NO: 17462 - DNA, 24 bp, Homo sapiens
ggcaagagcctccacgcccggcca

SEQ ID NO: 17463 - DNA, 19 bp, Homo sapiens
tcttacctccctccctcct

SEQ ID NO: 17464 - DNA, 18 bp, Homo sapiens
tgccagccctcgtgctgc

SEQ ID NO: 17465 - DNA, 20 bp, Homo sapiens
cactgtccccaccctccttc

SEQ ID NO: 17466 - DNA, 22 bp, Homo sapiens
cagggcacgtgctcacagccct

SEQ ID NO: 17467 - DNA, 21 bp, Homo sapiens
ccacgggctccctgctccccc

SEQ ID NO: 17468 - DNA, 16 bp, Homo sapiens
ctgcgcggcctcgtca

SEQ ID NO: 17469 - DNA, 18 bp, Homo sapiens
ggagcgcccggccccctc

SEQ ID NO: 17470 - DNA, 20 bp, Homo sapiens
ggcttgctgtgtctcactgt

SEQ ID NO: 17471 - DNA, 21 bp, Homo sapiens
acctgtctcacaagaacttca

SEQ ID NO: 17472 - DNA, 19 bp, Homo sapiens
actcaaggccatgaactca

SEQ ID NO: 17473 - DNA, 21 bp, Homo sapiens
atcttggctcactgcaacctc

SEQ ID NO: 17474 - DNA, 21 bp, Homo sapiens
caagattgtgctcttctatca

SEQ ID NO: 17475 - DNA, 18 bp, Homo sapiens
cagtggtgtaattttatt

SEQ ID NO: 17476 - DNA, 18 bp, Homo sapiens
tccgactcccaggttcaa

SEQ ID NO: 17477 - DNA, 20 bp, Homo sapiens
gcaagctcaccgcctgaaca

SEQ ID NO: 17478 - DNA, 20 bp, Homo sapiens
gcgaggtcagacatccacca

SEQ ID NO: 17479 - DNA, 19 bp, Homo sapiens
ggaacggccgtcctcttcc

SEQ ID NO: 17480 - DNA, 17 bp, Homo sapiens
ggaactccattccacct

SEQ ID NO: 17481 - DNA, 18 bp, Homo sapiens
tcagcctcaggcatccaa

SEQ ID NO: 17482 - DNA, 17 bp, Homo sapiens
tccaaaataaaaaccca

SEQ ID NO: 17483 - DNA, 18 bp, Homo sapiens
tgagatccaccaacatct

SEQ ID NO: 17484 - DNA, 19 bp, Homo sapiens
cagcaacagcagcagtacc

SEQ ID NO: 17485 - DNA, 18 bp, Homo sapiens
ggaaaaaaaaacaagcaa

SEQ ID NO: 17486 - DNA, 20 bp, Homo sapiens
ggagaggcggcggcggcggc

SEQ ID NO: 17487 - DNA, 19 bp, Homo sapiens
gttcaagaaactagtctgt

SEQ ID NO: 17488 - DNA, 21 bp, Homo sapiens
tgagtgcttagaatggggcta

SEQ ID NO: 17489 - DNA, 22 bp, Homo sapiens
ttgagcagtgggtgacacaaca

SEQ ID NO: 17490 - DNA, 18 bp, Homo sapiens
cctgcaacctccacctcc

SEQ ID NO: 17491 - DNA, 19 bp, Homo sapiens
ctgcaacctccacctccca

SEQ ID NO: 17492 - DNA, 20 bp, Homo sapiens
gacccgcccttgtcggcctc

SEQ ID NO: 17493 - DNA, 18 bp, Homo sapiens
tccacctcccaggttcaa

SEQ ID NO: 17494 - DNA, 23 bp, Homo sapiens
ctttcaaagcacacagtcaaaca

SEQ ID NO: 17495 - DNA, 22 bp, Homo sapiens
accttcaccagcaaacctcctg

SEQ ID NO: 17496 - DNA, 16 bp, Homo sapiens
agggctttgttcctgg

SEQ ID NO: 17497 - DNA, 19 bp, Homo sapiens
gcccccatgtccctcccca

SEQ ID NO: 17498 - DNA, 20 bp, Homo sapiens
gcctctgtcctgccgagcca

SEQ ID NO: 17499 - DNA, 16 bp, Homo sapiens
ggcgccacactccggg

SEQ ID NO: 17500 - DNA, 19 bp, Homo sapiens
tgtccccaaaacctgtgct

SEQ ID NO: 17501 - DNA, 18 bp, Homo sapiens
agacatacattcatcccc

SEQ ID NO: 17502 - DNA, 20 bp, Homo sapiens
gctttttcctctagcactaa

SEQ ID NO: 17503 - DNA, 19 bp, Homo sapiens
gtatgaggttatgttgagg

SEQ ID NO: 17504 - DNA, 15 bp, Homo sapiens
tctctcatgtaacca

SEQ ID NO: 17505 - DNA, 19 bp, Homo sapiens
atgtcactgcttcattgcc

SEQ ID NO: 17506 - DNA, 23 bp, Homo sapiens
cctgggaagttgaggtcactttt

SEQ ID NO: 17507 - DNA, 18 bp, Homo sapiens
gggatgggcagcagcggc

SEQ ID NO: 17508 - DNA, 22 bp, Homo sapiens
gtgaccaccaagacatatatgt

SEQ ID NO: 17509 - DNA, 27 bp, Homo sapiens
tgaagtgcagattgtaacatggagcta

SEQ ID NO: 17510 - DNA, 24 bp, Homo sapiens
tgtttcctggtggacagccgggta

SEQ ID NO: 17511 - DNA, 20 bp, Homo sapiens
ttcataatcagattatgcta

SEQ ID NO: 17512 - DNA, 18 bp, Homo sapiens
aattcattagtttgtcat

SEQ ID NO: 17513 - DNA, 20 bp, Homo sapiens
ccaagaaattcaccatgaaa

SEQ ID NO: 17514 - DNA, 19 bp, Homo sapiens
ctctcctgtagcgttagct

SEQ ID NO: 17515 - DNA, 19 bp, Homo sapiens
ctgcaacctccgcctccca

SEQ ID NO: 17516 - DNA, 24 bp, Homo sapiens
gaagaaagacaaggaaacccctga

SEQ ID NO: 17517 - DNA, 22 bp, Homo sapiens
gacggggtttcaccatactggc

SEQ ID NO: 17518 - DNA, 17 bp, Homo sapiens
gccgccgccgctggcca

SEQ ID NO: 17519 - DNA, 18 bp, Homo sapiens
tccgcctcccaggttcaa

SEQ ID NO: 17520 - DNA, 23 bp, Homo sapiens
tctcagtaatgggagatcttgag

SEQ ID NO: 17521 - DNA, 19 bp, Homo sapiens
cccagcgccctctacctcc

SEQ ID NO: 17522 - DNA, 19 bp, Homo sapiens
ccccacctccctgcagctt

SEQ ID NO: 17523 - DNA, 21 bp, Homo sapiens
ccctgccagggggtttgagga

SEQ ID NO: 17524 - DNA, 21 bp, Homo sapiens
ctcttgagagccccacccctg

SEQ ID NO: 17525 - DNA, 17 bp, Homo sapiens
gccagggggtttgagga

SEQ ID NO: 17526 - DNA, 22 bp, Homo sapiens
gggcggcctgcagaccctgcca

SEQ ID NO: 17527 - DNA, 20 bp, Homo sapiens
ccatgtgatcattgatcaga

SEQ ID NO: 17528 - DNA, 23 bp, Homo sapiens
ctcaccaaatgaagctttttcta

SEQ ID NO: 17529 - DNA, 18 bp, Homo sapiens
gtccttagattttgatca

SEQ ID NO: 17530 - DNA, 18 bp, Homo sapiens
gttttgccattgcagcaa

SEQ ID NO: 17531 - DNA, 18 bp, Homo sapiens
tgttgggaaggtaatttt

SEQ ID NO: 17532 - DNA, 22 bp, Homo sapiens
cccagcacgtggccccagacca

SEQ ID NO: 17533 - DNA, 17 bp, Homo sapiens
ctccccaggagcaggga

SEQ ID NO: 17534 - DNA, 20 bp, Homo sapiens
gattgtgttcctccccagga

SEQ ID NO: 17535 - DNA, 20 bp, Homo sapiens
gcatagctggccacagtgct

SEQ ID NO: 17536 - DNA, 19 bp, Homo sapiens
agtgtcaaagttgtgtgtt

SEQ ID NO: 17537 - DNA, 20 bp, Homo sapiens
cacacatagcccttttcatg

SEQ ID NO: 17538 - DNA, 21 bp, Homo sapiens
cagcccttctctaaccaccct

SEQ ID NO: 17539 - DNA, 18 bp, Homo sapiens
ctggaacactacagtgtt

SEQ ID NO: 17540 - DNA, 19 bp, Homo sapiens
cttttcatggatagacctt

SEQ ID NO: 17541 - DNA, 20 bp, Homo sapiens
gaaggggggaaccaagcacc

SEQ ID NO: 17542 - DNA, 19 bp, Homo sapiens
ggtttcccatgttgcagca

SEQ ID NO: 17543 - DNA, 16 bp, Homo sapiens
tgccttgtcattatta

SEQ ID NO: 17544 - DNA, 23 bp, Homo sapiens
tggagtggacttctgttcaggga

SEQ ID NO: 17545 - DNA, 22 bp, Homo sapiens
aaggtaccagatgtaagagtca

SEQ ID NO: 17546 - DNA, 18 bp, Homo sapiens
agacctgtgcgtcagcta

SEQ ID NO: 17547 - DNA, 22 bp, Homo sapiens
gaaaaactattgatttcccatg

SEQ ID NO: 17548 - DNA, 18 bp, Homo sapiens
gagtatttgccaacagtc

SEQ ID NO: 17549 - DNA, 16 bp, Homo sapiens
gttaggagaaatctga

SEQ ID NO: 17550 - DNA, 19 bp, Homo sapiens
tacttataaaaatagtgtg

SEQ ID NO: 17551 - DNA, 21 bp, Homo sapiens
aatgaagtcatcccttctccc

SEQ ID NO: 17552 - DNA, 18 bp, Homo sapiens
caccattctcctgcctca

SEQ ID NO: 17553 - DNA, 19 bp, Homo sapiens
cagcaacgccagactatat

SEQ ID NO: 17554 - DNA, 18 bp, Homo sapiens
cagtggtgcaatctcact

SEQ ID NO: 17555 - DNA, 19 bp, Homo sapiens
ccattaaaaattgcactta

SEQ ID NO: 17556 - DNA, 18 bp, Homo sapiens
cgcaaaggctttacttct

SEQ ID NO: 17557 - DNA, 19 bp, Homo sapiens
ctgcaagctctgcctccca

SEQ ID NO: 17558 - DNA, 23 bp, Homo sapiens
gagaaggccctgaaatcacattg

SEQ ID NO: 17559 - DNA, 20 bp, Homo sapiens
tagacagatacagtggagat

SEQ ID NO: 17560 - DNA, 22 bp, Homo sapiens
agaaatctcaaactgtactgta

SEQ ID NO: 17561 - DNA, 19 bp, Homo sapiens
caggacagtttatgaaata

SEQ ID NO: 17562 - DNA, 18 bp, Homo sapiens
ggagttaaatgtcctgca

SEQ ID NO: 17563 - DNA, 19 bp, Homo sapiens
ggagttaaatgtcctgcaa

SEQ ID NO: 17564 - DNA, 19 bp, Homo sapiens
ttaggtggtcagtcctttt

SEQ ID NO: 17565 - DNA, 18 bp, Homo sapiens
atgccacctcgtttaacc

SEQ ID NO: 17566 - DNA, 19 bp, Homo sapiens
caccgagaaccaccagcca

SEQ ID NO: 17567 - DNA, 22 bp, Homo sapiens
ctaatatttgttgtaaaagtga

SEQ ID NO: 17568 - DNA, 20 bp, Homo sapiens
ctatatcccttcttacctga

SEQ ID NO: 17569 - DNA, 20 bp, Homo sapiens
ctcattgtggccttgttgaa

SEQ ID NO: 17570 - DNA, 18 bp, Homo sapiens
gaactcattcatgaggaa

SEQ ID NO: 17571 - DNA, 17 bp, Homo sapiens
gctaggtcgcggcagca

SEQ ID NO: 17572 - DNA, 16 bp, Homo sapiens
gttgtggaaactgcac

SEQ ID NO: 17573 - DNA, 17 bp, Homo sapiens
tccagaaaccacgtcca

SEQ ID NO: 17574 - DNA, 17 bp, Homo sapiens
tgataaaactaatggca

SEQ ID NO: 17575 - DNA, 21 bp, Homo sapiens
atctgggtctctgtgtggtct

SEQ ID NO: 17576 - DNA, 16 bp, Homo sapiens
gcttttgtgtccctga

SEQ ID NO: 17577 - DNA, 19 bp, Homo sapiens
tctactctcaatccagtta

SEQ ID NO: 17578 - DNA, 20 bp, Homo sapiens
agccatggtcttggcactgt

SEQ ID NO: 17579 - DNA, 22 bp, Homo sapiens
cttctttgtgtttctttgcctt

SEQ ID NO: 17580 - DNA, 22 bp, Homo sapiens
ggactggggacaacagtattaa

SEQ ID NO: 17581 - DNA, 20 bp, Homo sapiens
aaggcgccaacagagtagtc

SEQ ID NO: 17582 - DNA, 18 bp, Homo sapiens
ctttcctccccactggag

SEQ ID NO: 17583 - DNA, 25 bp, Homo sapiens
ttttggtttctaggaaggtctttgg

SEQ ID NO: 17584 - DNA, 19 bp, Homo sapiens
aagcaattctcctgcctca

SEQ ID NO: 17585 - DNA, 19 bp, Homo sapiens
catgccagcacttgaactg

SEQ ID NO: 17586 - DNA, 21 bp, Homo sapiens
cctaccgagaggattatgcaa

SEQ ID NO: 17587 - DNA, 19 bp, Homo sapiens
cctccagaccctgctaacc

SEQ ID NO: 17588 - DNA, 23 bp, Homo sapiens
gcttggatcatgctcgtctgccc

SEQ ID NO: 17589 - DNA, 17 bp, Homo sapiens
ggctgttccctctccaa

SEQ ID NO: 17590 - DNA, 19 bp, Homo sapiens
tactagtggtggcagtggc

SEQ ID NO: 17591 - DNA, 21 bp, Homo sapiens
tcaggaggtgggaggccgtgg

SEQ ID NO: 17592 - DNA, 22 bp, Homo sapiens
tgagtggactctgtgctcactg

SEQ ID NO: 17593 - DNA, 20 bp, Homo sapiens
tggccaggctggtcttgaac

SEQ ID NO: 17594 - DNA, 19 bp, Homo sapiens
aagtatagataacatttca

SEQ ID NO: 17595 - DNA, 19 bp, Homo sapiens
aataggcagcactctgaaa

SEQ ID NO: 17596 - DNA, 19 bp, Homo sapiens
agccctaaagcagatttaa

SEQ ID NO: 17597 - DNA, 20 bp, Homo sapiens
agggttttaaactttataat

SEQ ID NO: 17598 - DNA, 20 bp, Homo sapiens
atgtcatgtttgacattttt

SEQ ID NO: 17599 - DNA, 19 bp, Homo sapiens
atgtcctaacatggagtta

SEQ ID NO: 17600 - DNA, 22 bp, Homo sapiens
cctaggtcacaagacccaggga

SEQ ID NO: 17601 - DNA, 17 bp, Homo sapiens
gttttacatctgtgaac

SEQ ID NO: 17602 - DNA, 20 bp, Homo sapiens
tactgagtacctactaggta

SEQ ID NO: 17603 - DNA, 22 bp, Homo sapiens
tcgtagctacatacgtaccaca

SEQ ID NO: 17604 - DNA, 23 bp, Homo sapiens
tgaatctttggtgtattgaaata

SEQ ID NO: 17605 - DNA, 21 bp, Homo sapiens
agacagagacttgacttgatc

SEQ ID NO: 17606 - DNA, 19 bp, Homo sapiens
tcactcaacaggtatagta

SEQ ID NO: 17607 - DNA, 22 bp, Homo sapiens
agaaagagcttacccctttccc

SEQ ID NO: 17608 - DNA, 20 bp, Homo sapiens
agcttacccctttcccccgg

SEQ ID NO: 17609 - DNA, 18 bp, Homo sapiens
ccttctttatcaacagct

SEQ ID NO: 17610 - DNA, 24 bp, Homo sapiens
ccttgatctgtatatacttgtgag

SEQ ID NO: 17611 - DNA, 18 bp, Homo sapiens
gtatgaattgtttctaac

SEQ ID NO: 17612 - DNA, 19 bp, Homo sapiens
ccccactgtcctcaaccct

SEQ ID NO: 17613 - DNA, 16 bp, Homo sapiens
tctgtcttcctgcctt

SEQ ID NO: 17614 - DNA, 18 bp, Homo sapiens
tcccaaactaccaacaag

SEQ ID NO: 17615 - DNA, 19 bp, Homo sapiens
tccccggactcatgaattc

SEQ ID NO: 17616 - DNA, 21 bp, Homo sapiens
tagcccaaaacagttgccaaa

SEQ ID NO: 17617 - DNA, 17 bp, Homo sapiens
tcttccgtgtctgatgt

SEQ ID NO: 17618 - DNA, 25 bp, Homo sapiens
tgcctcttactatacgactgtagtg

SEQ ID NO: 17619 - DNA, 22 bp, Homo sapiens
tgtctttggctagagcttagtt

SEQ ID NO: 17620 - DNA, 23 bp, Homo sapiens
accaatatggcccatgtgtcaga

SEQ ID NO: 17621 - DNA, 23 bp, Homo sapiens
acccacctccgtcgcccacctca

SEQ ID NO: 17622 - DNA, 19 bp, Homo sapiens
atgaggcagcttcatgtgc

SEQ ID NO: 17623 - DNA, 19 bp, Homo sapiens
catgtgctcagtctgcagg

SEQ ID NO: 17624 - DNA, 22 bp, Homo sapiens
gagaggcagggcctgcttgtca

SEQ ID NO: 17625 - DNA, 24 bp, Homo sapiens
gctagcatcagcaccactatagca

SEQ ID NO: 17626 - DNA, 26 bp, Homo sapiens
gtatatatagtggtattgttttatta

SEQ ID NO: 17627 - DNA, 19 bp, Homo sapiens
taaagttaaaatctccgca

SEQ ID NO: 17628 - DNA, 21 bp, Homo sapiens
tttgtttgctaaaggatgggg

SEQ ID NO: 17629 - DNA, 23 bp, Homo sapiens
ttttttggtgcagtggtcttgtg

SEQ ID NO: 17630 - DNA, 24 bp, Homo sapiens
tccagatttctgtttctgtcctaa

SEQ ID NO: 17631 - DNA, 21 bp, Homo sapiens
ttttatgagctttttggcttt

SEQ ID NO: 17632 - DNA, 17 bp, Homo sapiens
gtcttaatggtgctcac

SEQ ID NO: 17633 - DNA, 22 bp, Homo sapiens
agtaggaaccagatagagatga

SEQ ID NO: 17634 - DNA, 28 bp, Homo sapiens
gataattccagaatgcctgtatatgatg

SEQ ID NO: 17635 - DNA, 19 bp, Homo sapiens
tgagtggagacctatcaga

SEQ ID NO: 17636 - DNA, 25 bp, Homo sapiens
aagtttttaatggaaagttgagcca

SEQ ID NO: 17637 - DNA, 21 bp, Homo sapiens
cagagccccacgcaggttcac

SEQ ID NO: 17638 - DNA, 18 bp, Homo sapiens
ccagaccctggcaccctc

SEQ ID NO: 17639 - DNA, 22 bp, Homo sapiens
ccgacgacctcaactctgccca

SEQ ID NO: 17640 - DNA, 21 bp, Homo sapiens
ggcagaatccacttcccaaac

SEQ ID NO: 17641 - DNA, 19 bp, Homo sapiens
ctcggcctcctctgcgtct

SEQ ID NO: 17642 - DNA, 19 bp, Homo sapiens
ggcgcacggcagctgcagc

SEQ ID NO: 17643 - DNA, 24 bp, Homo sapiens
ccttgttatttgggagactttgag

SEQ ID NO: 17644 - DNA, 22 bp, Homo sapiens
ctgtggcgaccttgctttggtt

SEQ ID NO: 17645 - DNA, 17 bp, Homo sapiens
gactggcccagtctcca

SEQ ID NO: 17646 - DNA, 19 bp, Homo sapiens
atctagtttacctagcaaa

SEQ ID NO: 17647 - DNA, 21 bp, Homo sapiens
ggtttattttatctgcctttt

SEQ ID NO: 17648 - DNA, 18 bp, Homo sapiens
tctgccttaggcacttct

SEQ ID NO: 17649 - DNA, 19 bp, Homo sapiens
caagtgttaatgcccatgc

SEQ ID NO: 17650 - DNA, 16 bp, Homo sapiens
cagacggttggcatac

SEQ ID NO: 17651 - DNA, 21 bp, Homo sapiens
cctctgaactgttttgatttt

SEQ ID NO: 17652 - DNA, 24 bp, Homo sapiens
aagatgtgtttaactgtgaggcta

SEQ ID NO: 17653 - DNA, 23 bp, Homo sapiens
acaaatgtcatcaaatatgttga

SEQ ID NO: 17654 - DNA, 21 bp, Homo sapiens
accatcagatgcagttcccta

SEQ ID NO: 17655 - DNA, 18 bp, Homo sapiens
acttgaacattttgcttg

SEQ ID NO: 17656 - DNA, 19 bp, Homo sapiens
caccatcagatgcagttcc

SEQ ID NO: 17657 - DNA, 16 bp, Homo sapiens
gatttttgcctctgga

SEQ ID NO: 17658 - DNA, 23 bp, Homo sapiens
acatcctggctgacaactgtgaa

SEQ ID NO: 17659 - DNA, 20 bp, Homo sapiens
atttgcaaggctgtacaatg

SEQ ID NO: 17660 - DNA, 18 bp, Homo sapiens
cacaatgtgacccaactt

SEQ ID NO: 17661 - DNA, 20 bp, Homo sapiens
ctgccctctcccatctttga

SEQ ID NO: 17662 - DNA, 20 bp, Homo sapiens
tgcatttgatgagtgctgga

SEQ ID NO: 17663 - DNA, 17 bp, Homo sapiens
ttcccctgaatctctaa

SEQ ID NO: 17664 - DNA, 19 bp, Homo sapiens
taacttaattctcttcgtt

SEQ ID NO: 17665 - DNA, 21 bp, Homo sapiens
accaaaatagtcctaatcagt

SEQ ID NO: 17666 - DNA, 18 bp, Homo sapiens
ccccacttgtgagtgcaa

SEQ ID NO: 17667 - DNA, 20 bp, Homo sapiens
cgtactctcagctgcctctc

SEQ ID NO: 17668 - DNA, 22 bp, Homo sapiens
accccacccaggctgcttccca

SEQ ID NO: 17669 - DNA, 19 bp, Homo sapiens
catctattcatttatgaga

SEQ ID NO: 17670 - DNA, 22 bp, Homo sapiens
ccaggctgcttcccaggcctca

SEQ ID NO: 17671 - DNA, 21 bp, Homo sapiens
ctgcctcagctccgtgcaggg

SEQ ID NO: 17672 - DNA, 23 bp, Homo sapiens
tcaggcctcttgggatcgcctca

SEQ ID NO: 17673 - DNA, 23 bp, Homo sapiens
actactatccataaatgcaatga

SEQ ID NO: 17674 - DNA, 19 bp, Homo sapiens
tgggactgagcctgtgaat

SEQ ID NO: 17675 - DNA, 19 bp, Homo sapiens
cacccaccagagactgcca

SEQ ID NO: 17676 - DNA, 19 bp, Homo sapiens
ccaattccacatttctgaa

SEQ ID NO: 17677 - DNA, 18 bp, Homo sapiens
ctgatatcatattcctcc

SEQ ID NO: 17678 - DNA, 19 bp, Homo sapiens
gagtgagactccatctcca

SEQ ID NO: 17679 - DNA, 25 bp, Homo sapiens
gcttctccctgtcttcctctcctct

SEQ ID NO: 17680 - DNA, 18 bp, Homo sapiens
tccgcctcctgggttcaa

SEQ ID NO: 17681 - DNA, 19 bp, Homo sapiens
tgggtggatcgcctgagat

SEQ ID NO: 17682 - DNA, 19 bp, Homo sapiens
agaagagatattttcggtt

SEQ ID NO: 17683 - DNA, 20 bp, Homo sapiens
tctgaagacaatggacccac

SEQ ID NO: 17684 - DNA, 18 bp, Homo sapiens
tctacgggaaatgggtca

SEQ ID NO: 17685 - DNA, 21 bp, Homo sapiens
tggatgcattggctgaaattg

SEQ ID NO: 17686 - DNA, 18 bp, Homo sapiens
ccaagaccaaatccctca

SEQ ID NO: 17687 - DNA, 20 bp, Homo sapiens
gaaacagagatttccaattg

SEQ ID NO: 17688 - DNA, 20 bp, Homo sapiens
gacgacttgtcctgccacca

SEQ ID NO: 17689 - DNA, 23 bp, Homo sapiens
tcttttcccatatccttggcttt

SEQ ID NO: 17690 - DNA, 19 bp, Homo sapiens
tgagttacctcttcccaca

SEQ ID NO: 17691 - DNA, 19 bp, Homo sapiens
tgcccaagaccaaatccct

SEQ ID NO: 17692 - DNA, 22 bp, Homo sapiens
accagagatcttgatctctctc

SEQ ID NO: 17693 - DNA, 19 bp, Homo sapiens
caacacatctccactacca

SEQ ID NO: 17694 - DNA, 18 bp, Homo sapiens
catcaaagaagcttttga

SEQ ID NO: 17695 - DNA, 21 bp, Homo sapiens
gccaaacttactgatatcctc

SEQ ID NO: 17696 - DNA, 22 bp, Homo sapiens
ttaataacccacaaaagattca

SEQ ID NO: 17697 - DNA, 17 bp, Homo sapiens
ttgtaagaggatatcta

SEQ ID NO: 17698 - DNA, 22 bp, Homo sapiens
aaatctttcctgcatgaagcta

SEQ ID NO: 17699 - DNA, 19 bp, Homo sapiens
agtttgaatgaaatgttat

SEQ ID NO: 17700 - DNA, 21 bp, Homo sapiens
catggaaacttgtgctcaaac

SEQ ID NO: 17701 - DNA, 18 bp, Homo sapiens
gcctgattaacaggcact

SEQ ID NO: 17702 - DNA, 17 bp, Homo sapiens
ggaagtacaggaaccag

SEQ ID NO: 17703 - DNA, 18 bp, Homo sapiens
tgaaataacactttcaca

SEQ ID NO: 17704 - DNA, 15 bp, Homo sapiens
tgatgtagttcactt

SEQ ID NO: 17705 - DNA, 24 bp, Homo sapiens
tgggcttacccttgacaggaactg

SEQ ID NO: 17706 - DNA, 19 bp, Homo sapiens
tttccaggatcatgctgtt

SEQ ID NO: 17707 - DNA, 23 bp, Homo sapiens
cccctccccacctcgcttcttcc

SEQ ID NO: 17708 - DNA, 24 bp, Homo sapiens
ccctccccacctcgcttcttccca

SEQ ID NO: 17709 - DNA, 22 bp, Homo sapiens
tagcactgggacacagatcctt

SEQ ID NO: 17710 - DNA, 20 bp, Homo sapiens
tatgtatttatagtgtttta

SEQ ID NO: 17711 - DNA, 22 bp, Homo sapiens
tcaaaaacacagctatcataga

SEQ ID NO: 17712 - DNA, 20 bp, Homo sapiens
ctggctgtggcccccattcc

SEQ ID NO: 17713 - DNA, 25 bp, Homo sapiens
gtgtgtgtgagcgtgtgtgtgagtg

SEQ ID NO: 17714 - DNA, 21 bp, Homo sapiens
tcctggcgatgccctggtgga

SEQ ID NO: 17715 - DNA, 22 bp, Homo sapiens
gagccggtactcacctccgccc

SEQ ID NO: 17716 - DNA, 20 bp, Homo sapiens
actggcatgggctaaccact

SEQ ID NO: 17717 - DNA, 17 bp, Homo sapiens
ggtgaaaacagcactcc

SEQ ID NO: 17718 - DNA, 18 bp, Homo sapiens
tcttttctgggctgtatt

SEQ ID NO: 17719 - DNA, 23 bp, Homo sapiens
ccgctaagctgcttctcacccca

SEQ ID NO: 17720 - DNA, 20 bp, Homo sapiens
gcctggagcacctgctccag

SEQ ID NO: 17721 - DNA, 23 bp, Homo sapiens
aaccagagtgactgatatatata

SEQ ID NO: 17722 - DNA, 18 bp, Homo sapiens
aattgaatctagagtctt

SEQ ID NO: 17723 - DNA, 20 bp, Homo sapiens
tgaaaaactttgtcttgtca

SEQ ID NO: 17724 - DNA, 16 bp, Homo sapiens
tttacccctctaatta

SEQ ID NO: 17725 - DNA, 20 bp, Homo sapiens
ttttaacaaaagcctccaga

SEQ ID NO: 17726 - DNA, 21 bp, Homo sapiens
aatactagatgtttattatta

SEQ ID NO: 17727 - DNA, 19 bp, Homo sapiens
cacaccaaacctgctccca

SEQ ID NO: 17728 - DNA, 20 bp, Homo sapiens
ccaccataaatgttacaata

SEQ ID NO: 17729 - DNA, 19 bp, Homo sapiens
ggccaaaatactgcctgta

SEQ ID NO: 17730 - DNA, 17 bp, Homo sapiens
gctcactgtcttccaca

SEQ ID NO: 17731 - DNA, 18 bp, Homo sapiens
ggaggctgatgcctgcca

SEQ ID NO: 17732 - DNA, 18 bp, Homo sapiens
ggaggctgatgcctgcca

SEQ ID NO: 17733 - DNA, 19 bp, Homo sapiens
tcatcacccagtctggaga

SEQ ID NO: 17734 - DNA, 18 bp, Homo sapiens
tgctacttccccatcttt

SEQ ID NO: 17735 - DNA, 20 bp, Homo sapiens
ttcccccagtagcgcttttt

SEQ ID NO: 17736 - DNA, 20 bp, Homo sapiens
aaggtgtgaatgtaatgtga

SEQ ID NO: 17737 - DNA, 20 bp, Homo sapiens
agttctttacctcaacctga

SEQ ID NO: 17738 - DNA, 18 bp, Homo sapiens
cggacttcaggcggatct

SEQ ID NO: 17739 - DNA, 22 bp, Homo sapiens
gtagcttaattagtattttgtt

SEQ ID NO: 17740 - DNA, 18 bp, Homo sapiens
aaaacattataggctggg

SEQ ID NO: 17741 - DNA, 20 bp, Homo sapiens
aacaggagtaatgtttcgtt

SEQ ID NO: 17742 - DNA, 19 bp, Homo sapiens
aagaaaacttagggtctca

SEQ ID NO: 17743 - DNA, 22 bp, Homo sapiens
cctgctttagagctgtgtgttg

SEQ ID NO: 17744 - DNA, 28 bp, Homo sapiens
cgatttgtaataaaactgagttgtacaa

SEQ ID NO: 17745 - DNA, 26 bp, Homo sapiens
gagggagtttgtattaggtctggtca

SEQ ID NO: 17746 - DNA, 22 bp, Homo sapiens
ggatagtttatgagtaatcttt

SEQ ID NO: 17747 - DNA, 22 bp, Homo sapiens
tccatgggtggaaacttgtgag

SEQ ID NO: 17748 - DNA, 19 bp, Homo sapiens
tcgtgtagttgtctggttt

SEQ ID NO: 17749 - DNA, 21 bp, Homo sapiens
ttcttattgcactggtttata

SEQ ID NO: 17750 - DNA, 19 bp, Homo sapiens
ttcttctctttttgtctca

SEQ ID NO: 17751 - DNA, 17 bp, Homo sapiens
tttaaacactctgacca

SEQ ID NO: 17752 - DNA, 20 bp, Homo sapiens
ttgtggtttattggaaccta

SEQ ID NO: 17753 - DNA, 21 bp, Homo sapiens
gggcgggacggcggccgccgc

SEQ ID NO: 17754 - DNA, 20 bp, Homo sapiens
atttgagctgtttactgtct

SEQ ID NO: 17755 - DNA, 23 bp, Homo sapiens
cctttaatccaatatagttgata

SEQ ID NO: 17756 - DNA, 24 bp, Homo sapiens
cagacagaacacaaaaggtttctg

SEQ ID NO: 17757 - DNA, 20 bp, Homo sapiens
caggaaaggctaggttcagt

SEQ ID NO: 17758 - DNA, 19 bp, Homo sapiens
gtgttttttgttgtttttg

SEQ ID NO: 17759 - DNA, 18 bp, Homo sapiens
ttcttcagaaaacctcca

SEQ ID NO: 17760 - DNA, 16 bp, Homo sapiens
ccattccttctgtgat

SEQ ID NO: 17761 - DNA, 23 bp, Homo sapiens
agctaagcagctgctgggactca

SEQ ID NO: 17762 - DNA, 18 bp, Homo sapiens
tgcctgtggagtgctgag

SEQ ID NO: 17763 - DNA, 17 bp, Homo sapiens
tgtgtacgccgccagct

SEQ ID NO: 17764 - DNA, 16 bp, Homo sapiens
gtaccctgttctcttt

SEQ ID NO: 17765 - DNA, 23 bp, Homo sapiens
gcccctgccgcggtgcctggcct

SEQ ID NO: 17766 - DNA, 25 bp, Homo sapiens
ctgtaaaatttgtctcatcttttaa

SEQ ID NO: 17767 - DNA, 20 bp, Homo sapiens
cttccttctccactaaccca

SEQ ID NO: 17768 - DNA, 18 bp, Homo sapiens
ggacatgttaaaattcca

SEQ ID NO: 17769 - DNA, 20 bp, Homo sapiens
ttatgtatttgaattcctga

SEQ ID NO: 17770 - DNA, 22 bp, Homo sapiens
aaccagaaaggtttctgcccag

SEQ ID NO: 17771 - DNA, 20 bp, Homo sapiens
caaagaggctgtacccatcc

SEQ ID NO: 17772 - DNA, 15 bp, Homo sapiens
gggccccttcccaca

SEQ ID NO: 17773 - DNA, 18 bp, Homo sapiens
tgaatgagaaggaattga

SEQ ID NO: 17774 - DNA, 19 bp, Homo sapiens
ccccacccatccccacagc

SEQ ID NO: 17775 - DNA, 23 bp, Homo sapiens
tctggatccttccctgccggctc

SEQ ID NO: 17776 - DNA, 17 bp, Homo sapiens
aaaaacaaacaaacaaa

SEQ ID NO: 17777 - DNA, 19 bp, Homo sapiens
accaaactgattcatgtac

SEQ ID NO: 17778 - DNA, 21 bp, Homo sapiens
agaacacatacacatatccat

SEQ ID NO: 17779 - DNA, 19 bp, Homo sapiens
agggacatcaacaaagctg

SEQ ID NO: 17780 - DNA, 20 bp, Homo sapiens
cctgcgcctcctgggttcaa

SEQ ID NO: 17781 - DNA, 19 bp, Homo sapiens
gaaataaagtgactcctca

SEQ ID NO: 17782 - DNA, 17 bp, Homo sapiens
tcaagtgattcttctgc

SEQ ID NO: 17783 - DNA, 17 bp, Homo sapiens
tttacattttcttaaca

SEQ ID NO: 17784 - DNA, 18 bp, Homo sapiens
accctgagatagagattc

SEQ ID NO: 17785 - DNA, 22 bp, Homo sapiens
caccccacatggcccacagctc

SEQ ID NO: 17786 - DNA, 17 bp, Homo sapiens
ccatgtcacccagaaag

SEQ ID NO: 17787 - DNA, 16 bp, Homo sapiens
cctttgggggacccca

SEQ ID NO: 17788 - DNA, 23 bp, Homo sapiens
gaaaatccaatcccaagtcccca

SEQ ID NO: 17789 - DNA, 19 bp, Homo sapiens
gaccaccaaggacagctca

SEQ ID NO: 17790 - DNA, 23 bp, Homo sapiens
gccccattctaggactctgggga

SEQ ID NO: 17791 - DNA, 22 bp, Homo sapiens
tattaacagatactcccataat

SEQ ID NO: 17792 - DNA, 20 bp, Homo sapiens
gaaatgtcccccatctccct

SEQ ID NO: 17793 - DNA, 20 bp, Homo sapiens
ggtggaacccaatgtttaca

SEQ ID NO: 17794 - DNA, 19 bp, Homo sapiens
tcctcgccagctgctgatc

SEQ ID NO: 17795 - DNA, 20 bp, Homo sapiens
tcctggtgatgggagtcagc

SEQ ID NO: 17796 - DNA, 18 bp, Homo sapiens
cctccttgagctccgcca

SEQ ID NO: 17797 - DNA, 21 bp, Homo sapiens
atattctatgcctaatactca

SEQ ID NO: 17798 - DNA, 23 bp, Homo sapiens
ggaccctccctgcccaccccctc

SEQ ID NO: 17799 - DNA, 21 bp, Homo sapiens
tccctgcttacttagacctca

SEQ ID NO: 17800 - DNA, 18 bp, Homo sapiens
ggcatgatcagcacatca

SEQ ID NO: 17801 - DNA, 20 bp, Homo sapiens
tggcccctgacgtggacctg

SEQ ID NO: 17802 - DNA, 17 bp, Homo sapiens
caacaccggaacaagcc

SEQ ID NO: 17803 - DNA, 18 bp, Homo sapiens
gaggcagaaacaccagcc

SEQ ID NO: 17804 - DNA, 19 bp, Homo sapiens
ttttttgttttcccccact

SEQ ID NO: 17805 - DNA, 21 bp, Homo sapiens
gttttcaagaaaattgagcca

SEQ ID NO: 17806 - DNA, 16 bp, Homo sapiens
atgtgctcggccccca

SEQ ID NO: 17807 - DNA, 22 bp, Homo sapiens
ctgcacactcacatatgtggca

SEQ ID NO: 17808 - DNA, 23 bp, Homo sapiens
gcctgggccgccccgccgggttc

SEQ ID NO: 17809 - DNA, 20 bp, Homo sapiens
acccacacgcagtctttgca

SEQ ID NO: 17810 - DNA, 21 bp, Homo sapiens
cgttagggatacctcatgaca

SEQ ID NO: 17811 - DNA, 21 bp, Homo sapiens
tctgacagccacagcactaca

SEQ ID NO: 17812 - DNA, 22 bp, Homo sapiens
aaggctggtattccttgagtca

SEQ ID NO: 17813 - DNA, 20 bp, Homo sapiens
agaccttttagttatgagta

SEQ ID NO: 17814 - DNA, 20 bp, Homo sapiens
caacttctgtccagatgaca

SEQ ID NO: 17815 - DNA, 22 bp, Homo sapiens
cacttccctccccaggccccaa

SEQ ID NO: 17816 - DNA, 17 bp, Homo sapiens
tcctgcttcccacccca

SEQ ID NO: 17817 - DNA, 20 bp, Homo sapiens
tcctgtgcttgccttctgaa

SEQ ID NO: 17818 - DNA, 21 bp, Homo sapiens
tctatttttgctaccagatga

SEQ ID NO: 17819 - DNA, 23 bp, Homo sapiens
tctttaagtctatattttcctca

SEQ ID NO: 17820 - DNA, 21 bp, Homo sapiens
ttgtaaaagtttagcaaaata

SEQ ID NO: 17821 - DNA, 20 bp, Homo sapiens
tttcttaaatgctgttttag

SEQ ID NO: 17822 - DNA, 23 bp, Homo sapiens
tttgggccacccaaaatgttttt

SEQ ID NO: 17823 - DNA, 25 bp, Homo sapiens
ggggattcgtggcgacggcggcggc

SEQ ID NO: 17824 - DNA, 21 bp, Homo sapiens
cagaaggtggaattctagtga

SEQ ID NO: 17825 - DNA, 18 bp, Homo sapiens
ccttggcatgctgttcca

SEQ ID NO: 17826 - DNA, 17 bp, Homo sapiens
gttgtgaaacatactca

SEQ ID NO: 17827 - DNA, 22 bp, Homo sapiens
tcattaacttacttgctgcctt

SEQ ID NO: 17828 - DNA, 20 bp, Homo sapiens
tctcgatggaattgtgtgat

SEQ ID NO: 17829 - DNA, 24 bp, Homo sapiens
aagtctcagcccagttcaattcag

SEQ ID NO: 17830 - DNA, 17 bp, Homo sapiens
aggcagcacagaggtga

SEQ ID NO: 17831 - DNA, 17 bp, Homo sapiens
atagccaaggctagcga

SEQ ID NO: 17832 - DNA, 20 bp, Homo sapiens
caaatgataaggatgccaca

SEQ ID NO: 17833 - DNA, 21 bp, Homo sapiens
ccaataaaaatgagccctatg

SEQ ID NO: 17834 - DNA, 18 bp, Homo sapiens
gaacggaacagcatcaca

SEQ ID NO: 17835 - DNA, 18 bp, Homo sapiens
gctttttcctgatcttca

SEQ ID NO: 17836 - DNA, 20 bp, Homo sapiens
ggaattgactgaacttccca

SEQ ID NO: 17837 - DNA, 20 bp, Homo sapiens
gtaacctattttacatagta

SEQ ID NO: 17838 - DNA, 19 bp, Homo sapiens
taagccaaaaatctgtact

SEQ ID NO: 17839 - DNA, 16 bp, Homo sapiens
ttccagagggatatcc

SEQ ID NO: 17840 - DNA, 18 bp, Homo sapiens
tttttaattgcctgtaga

SEQ ID NO: 17841 - DNA, 21 bp, Homo sapiens
agtgacttcacacacacctca

SEQ ID NO: 17842 - DNA, 18 bp, Homo sapiens
atgttattaaaaaatgtg

SEQ ID NO: 17843 - DNA, 18 bp, Homo sapiens
cttgtggagccatcgcga

SEQ ID NO: 17844 - DNA, 17 bp, Homo sapiens
ttaggaagcttttgtta

SEQ ID NO: 17845 - DNA, 19 bp, Homo sapiens
caacagccccttctgcccc

SEQ ID NO: 17846 - DNA, 21 bp, Homo sapiens
gcacagaaatgctgcagagta

SEQ ID NO: 17847 - DNA, 22 bp, Homo sapiens
tattggataaggaccaatgaca

SEQ ID NO: 17848 - DNA, 22 bp, Homo sapiens
ctctcctctcatgcagtttatg

SEQ ID NO: 17849 - DNA, 19 bp, Homo sapiens
tatattctgattcctaaca

SEQ ID NO: 17850 - DNA, 21 bp, Homo sapiens
tgttttctttgcttctcaaca

SEQ ID NO: 17851 - DNA, 20 bp, Homo sapiens
aaggctggcctcctcataag

SEQ ID NO: 17852 - DNA, 20 bp, Homo sapiens
agtaaacctctccaccaagg

SEQ ID NO: 17853 - DNA, 22 bp, Homo sapiens
gcctggaggagtttcctggcct

SEQ ID NO: 17854 - DNA, 19 bp, Homo sapiens
tgcctacaccatgttccag

SEQ ID NO: 17855 - DNA, 22 bp, Homo sapiens
ttttcttcagaagacccatgtg

SEQ ID NO: 17856 - DNA, 19 bp, Homo sapiens
tctgtttcatgtgcccatc

SEQ ID NO: 17857 - DNA, 20 bp, Homo sapiens
tgggaaagatttgctaggta

SEQ ID NO: 17858 - DNA, 19 bp, Homo sapiens
aaaccaaagccccctttct

SEQ ID NO: 17859 - DNA, 16 bp, Homo sapiens
aacatggggggccaga

SEQ ID NO: 17860 - DNA, 20 bp, Homo sapiens
actggtgcagctgctggcca

SEQ ID NO: 17861 - DNA, 16 bp, Homo sapiens
agcaaacaaaatcatg

SEQ ID NO: 17862 - DNA, 21 bp, Homo sapiens
cacatcgctgccttgttcctc

SEQ ID NO: 17863 - DNA, 21 bp, Homo sapiens
cacgaaagggtaccaagccca

SEQ ID NO: 17864 - DNA, 19 bp, Homo sapiens
ctgaccaccacttatcgga

SEQ ID NO: 17865 - DNA, 19 bp, Homo sapiens
gacccaataagctaccaaa

SEQ ID NO: 17866 - DNA, 18 bp, Homo sapiens
gagggtgggaggcctcgg

SEQ ID NO: 17867 - DNA, 20 bp, Homo sapiens
ggaacccggaactgaccccc

SEQ ID NO: 17868 - DNA, 23 bp, Homo sapiens
ggcagcaaacaaaatcatgcaca

SEQ ID NO: 17869 - DNA, 22 bp, Homo sapiens
tcccaggttccaagccctgggc

SEQ ID NO: 17870 - DNA, 20 bp, Homo sapiens
tgggtggatcctaggtgcat

SEQ ID NO: 17871 - DNA, 20 bp, Homo sapiens
cctctgcttcctaggttcaa

SEQ ID NO: 17872 - DNA, 18 bp, Homo sapiens
gctgagcagttcacttca

SEQ ID NO: 17873 - DNA, 17 bp, Homo sapiens
tcaagtgattctcctgc

SEQ ID NO: 17874 - DNA, 21 bp, Homo sapiens
tgggattgtaagagtatgcca

SEQ ID NO: 17875 - DNA, 18 bp, Homo sapiens
accattatctcctattcc

SEQ ID NO: 17876 - DNA, 22 bp, Homo sapiens
gtagagacaggatttcaccatg

SEQ ID NO: 17877 - DNA, 17 bp, Homo sapiens
tcaagtgattctcctgc

SEQ ID NO: 17878 - DNA, 20 bp, Homo sapiens
tggccaggctggtcttgaac

SEQ ID NO: 17879 - DNA, 18 bp, Homo sapiens
attgacagcacatatacc

SEQ ID NO: 17880 - DNA, 22 bp, Homo sapiens
acttgaaaggttgcctggactc

SEQ ID NO: 17881 - DNA, 24 bp, Homo sapiens
acagccaaatgggggaagaggtga

SEQ ID NO: 17882 - DNA, 23 bp, Homo sapiens
caggattatgggagccccagcca

SEQ ID NO: 17883 - DNA, 24 bp, Homo sapiens
ccacttagtttctttttcattcct

SEQ ID NO: 17884 - DNA, 22 bp, Homo sapiens
ctctaggtgtttccactccacc

SEQ ID NO: 17885 - DNA, 18 bp, Homo sapiens
tgtccacctcataagtca

SEQ ID NO: 17886 - DNA, 19 bp, Homo sapiens
acattttgtatcttgtaaa

SEQ ID NO: 17887 - DNA, 19 bp, Homo sapiens
ccgcggcaaggacatgcct

SEQ ID NO: 17888 - DNA, 21 bp, Homo sapiens
tagatggactttttggtaaat

SEQ ID NO: 17889 - DNA, 19 bp, Homo sapiens
tattgcattatatcattgc

SEQ ID NO: 17890 - DNA, 23 bp, Homo sapiens
tgaatggattttaaaaaataatt

SEQ ID NO: 17891 - DNA, 17 bp, Homo sapiens
tttaatgtagtaactca

SEQ ID NO: 17892 - DNA, 22 bp, Homo sapiens
accattcacacctaaagactga

SEQ ID NO: 17893 - DNA, 18 bp, Homo sapiens
tctaaactagacatctta

SEQ ID NO: 17894 - DNA, 16 bp, Homo sapiens
tggttcctttgtgaac

SEQ ID NO: 17895 - DNA, 23 bp, Homo sapiens
cttgtgcagtaacagtgcacaca

SEQ ID NO: 17896 - DNA, 15 bp, Homo sapiens
cctttaagaggcgga

SEQ ID NO: 17897 - DNA, 22 bp, Homo sapiens
gatgttaaatggtggacgagta

SEQ ID NO: 17898 - DNA, 18 bp, Homo sapiens
agcagtgaacttccctct

SEQ ID NO: 17899 - DNA, 16 bp, Homo sapiens
cctgaagaggacctgc

SEQ ID NO: 17900 - DNA, 24 bp, Homo sapiens
agggcatcttccaggtggggaaac

SEQ ID NO: 17901 - DNA, 22 bp, Homo sapiens
tgaagagagcgtcaggccatca

SEQ ID NO: 17902 - DNA, 21 bp, Homo sapiens
tgttcctcaccctccatctct

SEQ ID NO: 17903 - DNA, 21 bp, Homo sapiens
actgacaggatttactagtta

SEQ ID NO: 17904 - DNA, 18 bp, Homo sapiens
agaagcaaaaaaggctgc

SEQ ID NO: 17905 - DNA, 22 bp, Homo sapiens
catagacagttccagcatcaca

SEQ ID NO: 17906 - DNA, 20 bp, Homo sapiens
ctcgaggaacaaggttgcac

SEQ ID NO: 17907 - DNA, 19 bp, Homo sapiens
tctgggagaaacagagcca

SEQ ID NO: 17908 - DNA, 19 bp, Homo sapiens
ctcgacccggcactgggta

SEQ ID NO: 17909 - DNA, 19 bp, Homo sapiens
tcacggaggctctttgtca

SEQ ID NO: 17910 - DNA, 25 bp, Homo sapiens
aaacaaaaggctgcagcacatgtta

SEQ ID NO: 17911 - DNA, 18 bp, Homo sapiens
aagccctgaccccaggga

SEQ ID NO: 17912 - DNA, 16 bp, Homo sapiens
cacccggctttgggga

SEQ ID NO: 17913 - DNA, 20 bp, Homo sapiens
ccaaaagcagctccaacaga

SEQ ID NO: 17914 - DNA, 20 bp, Homo sapiens
ccaccccaccaccctaatct

SEQ ID NO: 17915 - DNA, 19 bp, Homo sapiens
cccccaacctacccccacc

SEQ ID NO: 17916 - DNA, 15 bp, Homo sapiens
ctcagggagctgcaa

SEQ ID NO: 17917 - DNA, 24 bp, Homo sapiens
ctggatatgcccacccctgccaaa

SEQ ID NO: 17918 - DNA, 16 bp, Homo sapiens
gcccagagctctccag

SEQ ID NO: 17919 - DNA, 17 bp, Homo sapiens
gccgaataggctactgc

SEQ ID NO: 17920 - DNA, 21 bp, Homo sapiens
gggaaggaggctgctcaccca

SEQ ID NO: 17921 - DNA, 22 bp, Homo sapiens
gtcccagactgattacatgaga

SEQ ID NO: 17922 - DNA, 26 bp, Homo sapiens
tgaatgggagggcgggcctggagctg

SEQ ID NO: 17923 - DNA, 22 bp, Homo sapiens
aacatgaatttccagccgatga

SEQ ID NO: 17924 - DNA, 18 bp, Homo sapiens
aatccaaacaatacctca

SEQ ID NO: 17925 - DNA, 22 bp, Homo sapiens
ccaatgcaaactcaaatggtgc

SEQ ID NO: 17926 - DNA, 20 bp, Homo sapiens
tccagttgggcagcagggaa

SEQ ID NO: 17927 - DNA, 20 bp, Homo sapiens
ccttccccgtcccctcctcc

SEQ ID NO: 17928 - DNA, 16 bp, Homo sapiens
ctctttcctcctcctc

SEQ ID NO: 17929 - DNA, 22 bp, Homo sapiens
taaacctaaattcaaatctcct

SEQ ID NO: 17930 - DNA, 17 bp, Homo sapiens
atcaaagttactccaga

SEQ ID NO: 17931 - DNA, 25 bp, Homo sapiens
gcctgaacccgttcttctctggttc

SEQ ID NO: 17932 - DNA, 21 bp, Homo sapiens
ctcacctccccaggctcacct

SEQ ID NO: 17933 - DNA, 18 bp, Homo sapiens
gacccctacccccacccc

SEQ ID NO: 17934 - DNA, 22 bp, Homo sapiens
ttgaacccccatgcaatgagct

SEQ ID NO: 17935 - DNA, 19 bp, Homo sapiens
ccctgcaggggatctgtgg

SEQ ID NO: 17936 - DNA, 20 bp, Homo sapiens
ccctgcaggggatctgtggg

SEQ ID NO: 17937 - DNA, 18 bp, Homo sapiens
agtcattaatctaaggaa

SEQ ID NO: 17938 - DNA, 16 bp, Homo sapiens
ccagttcccttcttta

SEQ ID NO: 17939 - DNA, 17 bp, Homo sapiens
gcctatttcctcaggag

SEQ ID NO: 17940 - DNA, 22 bp, Homo sapiens
taggtggggcaggctggggctg

SEQ ID NO: 17941 - DNA, 26 bp, Homo sapiens
tctctttggtttaggtttttgacctt

SEQ ID NO: 17942 - DNA, 17 bp, Homo sapiens
ggaggagggggccgtgc

SEQ ID NO: 17943 - DNA, 22 bp, Homo sapiens
tccggccccgcctctgccctca

SEQ ID NO: 17944 - DNA, 22 bp, Homo sapiens
accgactttccccaagagaaaa

SEQ ID NO: 17945 - DNA, 22 bp, Homo sapiens
cgggattccaagggctcggtta

SEQ ID NO: 17946 - DNA, 24 bp, Homo sapiens
gcacacaagctctgcgccaatcac

SEQ ID NO: 17947 - DNA, 19 bp, Homo sapiens
ggaccctaagatgaagctg

SEQ ID NO: 17948 - DNA, 19 bp, Homo sapiens
gcgcccagcgtgcacggga

SEQ ID NO: 17949 - DNA, 19 bp, Homo sapiens
tggctctttttccttctca

SEQ ID NO: 17950 - DNA, 22 bp, Homo sapiens
aaacctgaatggtcgctacctc

SEQ ID NO: 17951 - DNA, 16 bp, Homo sapiens
cctgtgatctctgcca

SEQ ID NO: 17952 - DNA, 17 bp, Homo sapiens
cctgactgtgctctgtg

SEQ ID NO: 17953 - DNA, 16 bp, Homo sapiens
cctgtgatctctgcca

SEQ ID NO: 17954 - DNA, 21 bp, Homo sapiens
tcctcccacggcttgtggctg

SEQ ID NO: 17955 - DNA, 21 bp, Homo sapiens
tggaccgtgagtgtggggctg

SEQ ID NO: 17956 - DNA, 24 bp, Homo sapiens
cagcaccctcagatgatttccctc

SEQ ID NO: 17957 - DNA, 17 bp, Homo sapiens
cagccatcctcccatcc

SEQ ID NO: 17958 - DNA, 23 bp, Homo sapiens
cggtcttgattaggtttcagtca

SEQ ID NO: 17959 - DNA, 20 bp, Homo sapiens
ctgaactgtggctactgtgc

SEQ ID NO: 17960 - DNA, 19 bp, Homo sapiens
gccagctgcctcttcttta

SEQ ID NO: 17961 - DNA, 19 bp, Homo sapiens
gcccccatgcccctctgag

SEQ ID NO: 17962 - DNA, 19 bp, Homo sapiens
tatgtgtcccttgataaca

SEQ ID NO: 17963 - DNA, 24 bp, Homo sapiens
cagcaccctcagatgatttccctc

SEQ ID NO: 17964 - DNA, 17 bp, Homo sapiens
cagccatcctcccatcc

SEQ ID NO: 17965 - DNA, 23 bp, Homo sapiens
cggtcttgattaggtttcagtca

SEQ ID NO: 17966 - DNA, 20 bp, Homo sapiens
ctgaactgtggctactgtgc

SEQ ID NO: 17967 - DNA, 19 bp, Homo sapiens
gccagctgcctcttcttta

SEQ ID NO: 17968 - DNA, 19 bp, Homo sapiens
gcccccatgcccctctgag

SEQ ID NO: 17969 - DNA, 19 bp, Homo sapiens
tatgtgtcccttgataaca

SEQ ID NO: 17970 - DNA, 16 bp, Homo sapiens
gattctaccacttttg

SEQ ID NO: 17971 - DNA, 18 bp, Homo sapiens
gtctggatgtgtttactg

SEQ ID NO: 17972 - DNA, 31 bp, Homo sapiens; identical to SEQ ID NO: 8202

SEQ ID NO: 17973 - DNA, 31 bp, Homo sapiens; identical to SEQ ID NO: 8202

SEQ ID NO: 17974 - DNA, 31 bp, Homo sapiens; identical to SEQ ID NO: 8202

SEQ ID NO: 17975 - DNA, 18 bp, Homo sapiens
ccctctccctccacctcc

SEQ ID NO: 17976 - DNA, 22 bp, Homo sapiens
cctccctgccaccaggcactgc

SEQ ID NO: 17977 - DNA, 19 bp, Homo sapiens
cgcacggtacccgtgctgc

SEQ ID NO: 17978 - DNA, 18 bp, Homo sapiens
ctgttttgccttcaccca

SEQ ID NO: 17979 - DNA, 21 bp, Homo sapiens
gcacaagccacggcggactct

SEQ ID NO: 17980 - DNA, 22 bp, Homo sapiens
gctacttttgctgttttatttt

SEQ ID NO: 17981 - DNA, 19 bp, Homo sapiens
gcttgaaaagccgcggaac

SEQ ID NO: 17982 - DNA, 21 bp, Homo sapiens
atctctccggcctcctggttc

SEQ ID NO: 17983 - DNA, 18 bp, Homo sapiens
cctcctggttcccacaac

SEQ ID NO: 17984 - DNA, 18 bp, Homo sapiens
cctgcaacctccacctcc

SEQ ID NO: 17985 - DNA, 19 bp, Homo sapiens
ctgcaacctccacctccca

SEQ ID NO: 17986 - DNA, 18 bp, Homo sapiens
tccacctcccaggttcag

SEQ ID NO: 17987 - DNA, 21 bp, Homo sapiens
caagaagaaagtgctaagctg

SEQ ID NO: 17988 - DNA, 21 bp, Homo sapiens
caccacccctctacctcttca

SEQ ID NO: 17989 - DNA, 19 bp, Homo sapiens
gccccagaatggaacctca

SEQ ID NO: 17990 - DNA, 18 bp, Homo sapiens
ggcccgcgccccgagccc

SEQ ID NO: 17991 - DNA, 23 bp, Homo sapiens
ggggatggaggccaggccgtggc

SEQ ID NO: 17992 - DNA, 18 bp, Homo sapiens
tcccccagttcgcagtgc

SEQ ID NO: 17993 - DNA, 21 bp, Homo sapiens
tggaattccagtctgaggtta

SEQ ID NO: 17994 - DNA, 18 bp, Homo sapiens
cattacatctggatgtac

SEQ ID NO: 17995 - DNA, 18 bp, Homo sapiens
gggcatctcctgctactt

SEQ ID NO: 17996 - DNA, 24 bp, Homo sapiens
tctggtatggaatttgaaacccca

SEQ ID NO: 17997 - DNA, 22 bp, Homo sapiens
tgatgtgctctggtatggaatt

SEQ ID NO: 17998 - DNA, 21 bp, Homo sapiens
tgggtgacaagagtgaaactg

SEQ ID NO: 17999 - DNA, 19 bp, Homo sapiens
tgtgctctggtatggaatt

SEQ ID NO: 18000 - DNA, 19 bp, Homo sapiens
cctgaggcacccacttggg

SEQ ID NO: 18001 - DNA, 18 bp, Homo sapiens
ctgcaccgtctacccttc

SEQ ID NO: 18002 - DNA, 17 bp, Homo sapiens
ctgtattgaactttgct

SEQ ID NO: 18003 - DNA, 18 bp, Homo sapiens
cttaggcgttttgacctt

SEQ ID NO: 18004 - DNA, 25 bp, Homo sapiens
gaactggctcctcgtcatgggactg

SEQ ID NO: 18005 - DNA, 19 bp, Homo sapiens
gagatccaaagagaagggc

SEQ ID NO: 18006 - DNA, 17 bp, Homo sapiens
taatggagccctacctc

SEQ ID NO: 18007 - DNA, 20 bp, Homo sapiens
tgctgttagttattttattg

SEQ ID NO: 18008 - DNA, 21 bp, Homo sapiens
ttttagcagtagtttgttgta

SEQ ID NO: 18009 - DNA, 18 bp, Homo sapiens
accagaaaatccactggg

SEQ ID NO: 18010 - DNA, 17 bp, Homo sapiens
actatctaaatttgctg

SEQ ID NO: 18011 - DNA, 16 bp, Homo sapiens
agaaaatccactgggg

SEQ ID NO: 18012 - DNA, 19 bp, Homo sapiens
aggaaaaaaaaatgaacag

SEQ ID NO: 18013 - DNA, 19 bp, Homo sapiens
ccacgtgtgtaatgttata

SEQ ID NO: 18014 - DNA, 19 bp, Homo sapiens
cctaacatctttaaatcgc

SEQ ID NO: 18015 - DNA, 18 bp, Homo sapiens
gagtgaatgattgtcatt

SEQ ID NO: 18016 - DNA, 18 bp, Homo sapiens
ggaagctatgtgaaatta

SEQ ID NO: 18017 - DNA, 22 bp, Homo sapiens
ggttcttctgaaattgcagcag

SEQ ID NO: 18018 - DNA, 23 bp, Homo sapiens
ttagaaattattattagtagcat

SEQ ID NO: 18019 - DNA, 20 bp, Homo sapiens
accagacaaaatcagctttc

SEQ ID NO: 18020 - DNA, 25 bp, Homo sapiens
ctccttcggccgccgccgccactgc

SEQ ID NO: 18021 - DNA, 17 bp, Homo sapiens
gcagcctatggcccagg

SEQ ID NO: 18022 - DNA, 19 bp, Homo sapiens
tacaagaacacagttttta

SEQ ID NO: 18023 - DNA, 23 bp, Homo sapiens
tacatacaagaacacagttttta

SEQ ID NO: 18024 - DNA, 19 bp, Homo sapiens
actcacaggtcacctcgca

SEQ ID NO: 18025 - DNA, 18 bp, Homo sapiens
cagacagataataacatt

SEQ ID NO: 18026 - DNA, 20 bp, Homo sapiens
cctcctcgccggcaccctca

SEQ ID NO: 18027 - DNA, 18 bp, Homo sapiens
ctcggctgcagcctggca

SEQ ID NO: 18028 - DNA, 21 bp, Homo sapiens
ttcaaacatttagcaagcatg

SEQ ID NO: 18029 - DNA, 23 bp, Homo sapiens
gcttgagttcaacatttgtttgg

SEQ ID NO: 18030 - DNA, 20 bp, Homo sapiens
ttttttcatagaccctaact

SEQ ID NO: 18031 - DNA, 19 bp, Homo sapiens
ccttaaaacacacatggga

SEQ ID NO: 18032 - DNA, 19 bp, Homo sapiens
ccttaaaacacacatggga

SEQ ID NO: 18033 - DNA, 23 bp, Homo sapiens
ggttgcttggggggcgttggccg

SEQ ID NO: 18034 - DNA, 24 bp, Homo sapiens
tgtcctcagagcaccacacactga

SEQ ID NO: 18035 - DNA, 19 bp, Homo sapiens
ttctgccttggggacctgc

SEQ ID NO: 18036 - DNA, 20 bp, Homo sapiens
ccactgccccatctccctct

SEQ ID NO: 18037 - DNA, 21 bp, Homo sapiens
ccccacccccgcccccagctt

SEQ ID NO: 18038 - DNA, 22 bp, Homo sapiens
cccctgcagggctcaggggtca

SEQ ID NO: 18039 - DNA, 21 bp, Homo sapiens
tccttctttcccttggacgcc

SEQ ID NO: 18040 - DNA, 21 bp, Homo sapiens
tctagatgcaacttttgttcc

SEQ ID NO: 18041 - DNA, 21 bp, Homo sapiens
tgagaccacctggcgtgaggt

SEQ ID NO: 18042 - DNA, 17 bp, Homo sapiens
ctgataatccccgggga

SEQ ID NO: 18043 - DNA, 16 bp, Homo sapiens
gagtttgctgaaaaca

SEQ ID NO: 18044 - DNA, 21 bp, Homo sapiens
ctatatcacaaaaacctgcca

SEQ ID NO: 18045 - DNA, 20 bp, Homo sapiens
gccgcggccgcaccaaggcc

SEQ ID NO: 18046 - DNA, 20 bp, Homo sapiens
aagtttactctggttcctaa

SEQ ID NO: 18047 - DNA, 18 bp, Homo sapiens
gttcttttacttcagtgt

SEQ ID NO: 18048 - DNA, 18 bp, Homo sapiens
aggtacggcggcgaagtg

SEQ ID NO: 18049 - DNA, 22 bp, Homo sapiens
cctgaagttcttggattacttt

SEQ ID NO: 18050 - DNA, 19 bp, Homo sapiens
ggcgatgaacaaatgtaat

SEQ ID NO: 18051 - DNA, 18 bp, Homo sapiens
tattaatctactgtatca

SEQ ID NO: 18052 - DNA, 23 bp, Homo sapiens
tcaaaccaatttcaaattatttt

SEQ ID NO: 18053 - DNA, 27 bp, Homo sapiens
taagaataatatttactgtgtcagtgc

SEQ ID NO: 18054 - DNA, 21 bp, Homo sapiens
actgcagtgtcccggagcctg

SEQ ID NO: 18055 - DNA, 19 bp, Homo sapiens
gccctcctgcctagactga

SEQ ID NO: 18056 - DNA, 19 bp, Homo sapiens
gttccctgctgaagcccct

SEQ ID NO: 18057 - DNA, 17 bp, Homo sapiens
aagagattgagcaagtg

SEQ ID NO: 18058 - DNA, 23 bp, Homo sapiens
cactaaataaagagattgagcaa

SEQ ID NO: 18059 - DNA, 19 bp, Homo sapiens
cataaatatcttcctacca

SEQ ID NO: 18060 - DNA, 20 bp, Homo sapiens
ttgttcttttgttgtttttg

SEQ ID NO: 18061 - DNA, 20 bp, Homo sapiens
gcaaatatcttgagaacttc

SEQ ID NO: 18062 - DNA, 17 bp, Homo sapiens
cagcaacctctgcctcc

SEQ ID NO: 18063 - DNA, 21 bp, Homo sapiens
ctccttctctttgatgattca

SEQ ID NO: 18064 - DNA, 22 bp, Homo sapiens
ctcttgactattgggagtagtg

SEQ ID NO: 18065 - DNA, 20 bp, Homo sapiens
tggtcaggctggtcttgaac

SEQ ID NO: 18066 - DNA, 17 bp, Homo sapiens
ttctcctgcttcagcct

SEQ ID NO: 18067 - DNA, 18 bp, Homo sapiens
ccgccgcctcctcattca

SEQ ID NO: 18068 - DNA, 16 bp, Homo sapiens
atcccctggactttca

SEQ ID NO: 18069 - DNA, 22 bp, Homo sapiens
tctgtggtttcatcattccttc

SEQ ID NO: 18070 - DNA, 22 bp, Homo sapiens
ggacgaccacacgccgcttcct

SEQ ID NO: 18071 - DNA, 20 bp, Homo sapiens
aggtaatataaaaacaggta

SEQ ID NO: 18072 - DNA, 19 bp, Homo sapiens
atttatagccaaggatcct

SEQ ID NO: 18073 - DNA, 16 bp, Homo sapiens
ctgcagtatttttcgt

SEQ ID NO: 18074 - DNA, 23 bp, Homo sapiens
tgataagtaattacactggacct

SEQ ID NO: 18075 - DNA, 17 bp, Homo sapiens
tttctagatcccattca

SEQ ID NO: 18076 - DNA, 21 bp, Homo sapiens
tttctttgacttccttaactt

SEQ ID NO: 18077 - DNA, 22 bp, Homo sapiens
cttcccttaaaactttgggctg

SEQ ID NO: 18078 - DNA, 23 bp, Homo sapiens
tgccattttcagcaattacggct

SEQ ID NO: 18079 - DNA, 17 bp, Homo sapiens
tgctgcagaaccacatc

SEQ ID NO: 18080 - DNA, 21 bp, Homo sapiens
ccatatgaagctagaaaatgc

SEQ ID NO: 18081 - DNA, 17 bp, Homo sapiens
aaaaacaaacaaacaaa

SEQ ID NO: 18082 - DNA, 19 bp, Homo sapiens
aataggcaattttaaaaca

SEQ ID NO: 18083 - DNA, 19 bp, Homo sapiens
atttcagacataccagtta

SEQ ID NO: 18084 - DNA, 19 bp, Homo sapiens
ctccccgaccttgctgact

SEQ ID NO: 18085 - DNA, 20 bp, Homo sapiens
gtccaagactggggcccacc

SEQ ID NO: 18086 - DNA, 18 bp, Homo sapiens
gttactgaaagcaaatca

SEQ ID NO: 18087 - DNA, 17 bp, Homo sapiens
ctgttctggttctttga

SEQ ID NO: 18088 - DNA, 19 bp, Homo sapiens
caccaacttttacctagcc

SEQ ID NO: 18089 - DNA, 21 bp, Homo sapiens
cactgggcaataaactttcca

SEQ ID NO: 18090 - DNA, 19 bp, Homo sapiens
cctaacctgtttcttgcca

SEQ ID NO: 18091 - DNA, 17 bp, Homo sapiens
cggcgcttcggcccggg

SEQ ID NO: 18092 - DNA, 21 bp, Homo sapiens
atgagtattactagttactca

SEQ ID NO: 18093 - DNA, 18 bp, Homo sapiens
cctatattgccctttgaa

SEQ ID NO: 18094 - DNA, 24 bp, Homo sapiens
ggtataatctaagaattgtttaca

SEQ ID NO: 18095 - DNA, 21 bp, Homo sapiens
tttcctatattgccctttgaa

SEQ ID NO: 18096 - DNA, 20 bp, Homo sapiens
gccctgtatttctccatctc

SEQ ID NO: 18097 - DNA, 19 bp, Homo sapiens
tccttgggctatattttct

SEQ ID NO: 18098 - DNA, 18 bp, Homo sapiens
tgcccaagactcacctcc

SEQ ID NO: 18099 - DNA, 21 bp, Homo sapiens
ttgaatctgcacttatcccca

SEQ ID NO: 18100 - DNA, 21 bp, Homo sapiens
atttttaaaatcagccagctc

SEQ ID NO: 18101 - DNA, 19 bp, Homo sapiens
tccctgtccctagcaacca

SEQ ID NO: 18102 - DNA, 21 bp, Homo sapiens
tcctgaactttggttcataaa

SEQ ID NO: 18103 - DNA, 24 bp, Homo sapiens
tctgtctagttccaaaacattttt

SEQ ID NO: 18104 - DNA, 20 bp, Homo sapiens
tgaaaccctgtagccattaa

SEQ ID NO: 18105 - DNA, 18 bp, Homo sapiens
aacacatacatttatgca

SEQ ID NO: 18106 - DNA, 24 bp, Homo sapiens
aacccagcctcattcagatacaga

SEQ ID NO: 18107 - DNA, 18 bp, Homo sapiens
caaatacttagcaccata

SEQ ID NO: 18108 - DNA, 24 bp, Homo sapiens
cggcggtgatccgagcgagcggcc

SEQ ID NO: 18109 - DNA, 20 bp, Homo sapiens
cagtctttatgcaaatgaaa

SEQ ID NO: 18110 - DNA, 18 bp, Homo sapiens
taaaaacaaacaaacaaa

SEQ ID NO: 18111 - DNA, 17 bp, Homo sapiens
ttgcttctgttactgcc

SEQ ID NO: 18112 - DNA, 18 bp, Homo sapiens
ccaggcagctgcgccccc

SEQ ID NO: 18113 - DNA, 19 bp, Homo sapiens
tgaacgaacacatgatgga

SEQ ID NO: 18114 - DNA, 19 bp, Homo sapiens
aactgaatgaagccatatt

SEQ ID NO: 18115 - DNA, 24 bp, Homo sapiens
aattcttgatgagcaataatgata

SEQ ID NO: 18116 - DNA, 21 bp, Homo sapiens
ctctgcaacacttgcagaaca

SEQ ID NO: 18117 - DNA, 19 bp, Homo sapiens
gttgtacttaagtgtgtaa

SEQ ID NO: 18118 - DNA, 19 bp, Homo sapiens
tcaaatgaaaattctttat

SEQ ID NO: 18119 - DNA, 20 bp, Homo sapiens
ttcattattaccagcagtta

SEQ ID NO: 18120 - DNA, 22 bp, Homo sapiens
aagtgaaataacatttcagcta

SEQ ID NO: 18121 - DNA, 17 bp, Homo sapiens
attttacatttgcctaa

SEQ ID NO: 18122 - DNA, 19 bp, Homo sapiens
ccagaacagagcagagcca

SEQ ID NO: 18123 - DNA, 20 bp, Homo sapiens
cttgcctttattttacagtg

SEQ ID NO: 18124 - DNA, 22 bp, Homo sapiens
aatagatgccgattctgaaaca

SEQ ID NO: 18125 - DNA, 20 bp, Homo sapiens
gtgatattggaaatagccta

SEQ ID NO: 18126 - DNA, 19 bp, Homo sapiens
ttccagaaaaatcttccag

SEQ ID NO: 18127 - DNA, 21 bp, Homo sapiens
gggaacagtggcggcttcggc

SEQ ID NO: 18128 - DNA, 22 bp, Homo sapiens
tgacaaacatggagaaacctca

SEQ ID NO: 18129 - DNA, 24 bp, Homo sapiens
acctgtgggatcgttgcctggttt

SEQ ID NO: 18130 - DNA, 21 bp, Homo sapiens
cacccttcctattctttttca

SEQ ID NO: 18131 - DNA, 21 bp, Homo sapiens
cccagaacttcctccccacaa

SEQ ID NO: 18132 - DNA, 20 bp, Homo sapiens
tctttttcattcttcttgca

SEQ ID NO: 18133 - DNA, 22 bp, Homo sapiens
caagatttttatatgttcagtt

SEQ ID NO: 18134 - DNA, 18 bp, Homo sapiens
tgcatgtctgctctgata

SEQ ID NO: 18135 - DNA, 21 bp, Homo sapiens
ttcttctcgtctcccacccca

SEQ ID NO: 18136 - DNA, 22 bp, Homo sapiens
gcactatgtgcatttgctgtca

SEQ ID NO: 18137 - DNA, 18 bp, Homo sapiens
tggtcctgtgttgctttt

SEQ ID NO: 18138 - DNA, 18 bp, Homo sapiens
tcttgagacctttattgt

SEQ ID NO: 18139 - DNA, 24 bp, Homo sapiens
aaataacttttgataatgtttact

SEQ ID NO: 18140 - DNA, 18 bp, Homo sapiens
gcaagaatagtatctgct

SEQ ID NO: 18141 - DNA, 23 bp, Homo sapiens
gttctttacaggagtttaaaacg

SEQ ID NO: 18142 - DNA, 20 bp, Homo sapiens
tagggaaacatttcaacagc

SEQ ID NO: 18143 - DNA, 21 bp, Homo sapiens
tcaagtgtattttctgtaaca

SEQ ID NO: 18144 - DNA, 20 bp, Homo sapiens
tgattgcactattttgtttt

SEQ ID NO: 18145 - DNA, 20 bp, Homo sapiens
ataatgaatgctgcatatta

SEQ ID NO: 18146 - DNA, 19 bp, Homo sapiens
caccatcatcaaacactca

SEQ ID NO: 18147 - DNA, 20 bp, Homo sapiens
gaagttgcccttaaccacta

SEQ ID NO: 18148 - DNA, 21 bp, Homo sapiens
gatttatttttttcccagtgc

SEQ ID NO: 18149 - DNA, 19 bp, Homo sapiens
atgtcttcaacataccaaa

SEQ ID NO: 18150 - DNA, 20 bp, Homo sapiens
aaatccatctgctcatgaag

SEQ ID NO: 18151 - DNA, 22 bp, Homo sapiens
aggagctgaccaggagcacact

SEQ ID NO: 18152 - DNA, 23 bp, Homo sapiens
ccaatagttacttttctggtcct

SEQ ID NO: 18153 - DNA, 20 bp, Homo sapiens
gaaaggaatgagtgtgtgac

SEQ ID NO: 18154 - DNA, 19 bp, Homo sapiens
taactgtgttggatgagtg

SEQ ID NO: 18155 - DNA, 18 bp, Homo sapiens
aacccatctcacctgaca

SEQ ID NO: 18156 - DNA, 17 bp, Homo sapiens
actacaatgattctgaa

SEQ ID NO: 18157 - DNA, 18 bp, Homo sapiens
agcaccgggtggcagatg

SEQ ID NO: 18158 - DNA, 22 bp, Homo sapiens
atgtagagcaagttgaaaatgg

SEQ ID NO: 18159 - DNA, 18 bp, Homo sapiens
gccatgaaactttgcctt

SEQ ID NO: 18160 - DNA, 19 bp, Homo sapiens
aaaacattctatctactga

SEQ ID NO: 18161 - DNA, 27 bp, Homo sapiens
aaccccataattagatccattaattta

SEQ ID NO: 18162 - DNA, 18 bp, Homo sapiens
aagagaccacccatatca

SEQ ID NO: 18163 - DNA, 21 bp, Homo sapiens
atgccaaggaccttttgctgc

SEQ ID NO: 18164 - DNA, 19 bp, Homo sapiens
gtaagttttataaggtctg

SEQ ID NO: 18165 - DNA, 21 bp, Homo sapiens
tagaggattagtaagatctct

SEQ ID NO: 18166 - DNA, 22 bp, Homo sapiens
tctaactgtatatttgtatgat

SEQ ID NO: 18167 - DNA, 22 bp, Homo sapiens
ccaagactgggactattcccca

SEQ ID NO: 18168 - DNA, 20 bp, Homo sapiens
ccagcccgagcggagccgga

SEQ ID NO: 18169 - DNA, 20 bp, Homo sapiens
agcctaagagctaaggcagt

SEQ ID NO: 18170 - DNA, 18 bp, Homo sapiens
gatcctgaaacatgcggg

SEQ ID NO: 18171 - DNA, 19 bp, Homo sapiens
gtggtctttcttgttttta

SEQ ID NO: 18172 - DNA, 17 bp, Homo sapiens
tcctgaaacatgcggga

SEQ ID NO: 18173 - DNA, 18 bp, Homo sapiens
caaatccaagattcttta

SEQ ID NO: 18174 - DNA, 22 bp, Homo sapiens
gtgtctggaattggtgggttct

SEQ ID NO: 18175 - DNA, 21 bp, Homo sapiens
tccttgggagtcgctgtgata

SEQ ID NO: 18176 - DNA, 21 bp, Homo sapiens
tgtctctcctcacactccagc

SEQ ID NO: 18177 - DNA, 17 bp, Homo sapiens
aataaggatccttttta

SEQ ID NO: 18178 - DNA, 18 bp, Homo sapiens
ggaagttaaaatatctct

SEQ ID NO: 18179 - DNA, 22 bp, Homo sapiens
gttagataaaatggtaaaatgt

SEQ ID NO: 18180 - DNA, 20 bp, Homo sapiens
aattacactgtactacccaa

SEQ ID NO: 18181 - DNA, 21 bp, Homo sapiens
gtctcagaccatcttgtgaga

SEQ ID NO: 18182 - DNA, 20 bp, Homo sapiens
ttgttttattatagcaatta

SEQ ID NO: 18183 - DNA, 24 bp, Homo sapiens
aaaacgggttcaaaccccacttct

SEQ ID NO: 18184 - DNA, 20 bp, Homo sapiens
gcttattgttatctgtgata

SEQ ID NO: 18185 - DNA, 19 bp, Homo sapiens
ggacttcttatttactgta

SEQ ID NO: 18186 - DNA, 21 bp, Homo sapiens
aaagaacttcatcattgtaca

SEQ ID NO: 18187 - DNA, 19 bp, Homo sapiens
cagtagttccgattttttc

SEQ ID NO: 18188 - DNA, 18 bp, Homo sapiens
gtgttaggtattatttga

SEQ ID NO: 18189 - DNA, 19 bp, Homo sapiens
tgctgttagttgtgcatta

SEQ ID NO: 18190 - DNA, 17 bp, Homo sapiens
acttggtggcatcagca

SEQ ID NO: 18191 - DNA, 19 bp, Homo sapiens
cgcgcggcgcctgagcgcg

SEQ ID NO: 18192 - DNA, 19 bp, Homo sapiens
ctctgctccctcttcctct

SEQ ID NO: 18193 - DNA, 27 bp, Homo sapiens
tcaaacccccaccttccagttccctca

SEQ ID NO: 18194 - DNA, 20 bp, Homo sapiens
tcctctagctgagagtgggc

SEQ ID NO: 18195 - DNA, 16 bp, Homo sapiens
ccgtgccggctggcca

SEQ ID NO: 18196 - DNA, 19 bp, Homo sapiens
accgtcctcactgcgccac

SEQ ID NO: 18197 - DNA, 24 bp, Homo sapiens
tcctgcttcccacgctgccatctc

SEQ ID NO: 18198 - DNA, 19 bp, Homo sapiens
tgaccttcctgcttcccac

SEQ ID NO: 18199 - DNA, 16 bp, Homo sapiens
tgagtgccaggtgcat

SEQ ID NO: 18200 - DNA, 23 bp, Homo sapiens
tgtccagggcagggtcctgggaa

SEQ ID NO: 18201 - DNA, 18 bp, Homo sapiens
ttagggattaccatttcc

SEQ ID NO: 18202 - DNA, 18 bp, Homo sapiens
ggaaaactcagattccaa

SEQ ID NO: 18203 - DNA, 19 bp, Homo sapiens
caagcattagcaatattaa

SEQ ID NO: 18204 - DNA, 19 bp, Homo sapiens
gatggaaacttttcttacc

SEQ ID NO: 18205 - DNA, 20 bp, Homo sapiens
tacatatagttactgtgaca

SEQ ID NO: 18206 - DNA, 20 bp, Homo sapiens
tcattttctgattctcatca

SEQ ID NO: 18207 - DNA, 20 bp, Homo sapiens
aaggagtgggaaataccctt

SEQ ID NO: 18208 - DNA, 23 bp, Homo sapiens
aagtctaattttggttcctaaca

SEQ ID NO: 18209 - DNA, 23 bp, Homo sapiens
ccaaaacacttgaatgtgcctca

SEQ ID NO: 18210 - DNA, 18 bp, Homo sapiens
gcaggaggaacaacatca

SEQ ID NO: 18211 - DNA, 26 bp, Homo sapiens
tgagtgggtgcctgtggttggagctg

SEQ ID NO: 18212 - DNA, 20 bp, Homo sapiens
tggttccaagcatggaacta

SEQ ID NO: 18213 - DNA, 19 bp, Homo sapiens
aagcaattctcctgcctca

SEQ ID NO: 18214 - DNA, 18 bp, Homo sapiens
aatcatgtgcttcataga

SEQ ID NO: 18215 - DNA, 21 bp, Homo sapiens
aggcacccaccacatctggct

SEQ ID NO: 18216 - DNA, 22 bp, Homo sapiens
atcttggctcactgcaacctct

SEQ ID NO: 18217 - DNA, 19 bp, Homo sapiens
ctgcaacctccgcctccca

SEQ ID NO: 18218 - DNA, 18 bp, Homo sapiens
tccgcctcccaggttcaa

SEQ ID NO: 18219 - DNA, 18 bp, Homo sapiens
tctacctcctgggttcaa

SEQ ID NO: 18220 - DNA, 25 bp, Homo sapiens
agagccgccctatcagattatctta

SEQ ID NO: 18221 - DNA, 22 bp, Homo sapiens
acaaaagataattggaaacatg

SEQ ID NO: 18222 - DNA, 26 bp, Homo sapiens
tacctcatcctctccacagtgtgaga

SEQ ID NO: 18223 - DNA, 19 bp, Homo sapiens
tcctctccacagtgtgaga

SEQ ID NO: 18224 - DNA, 24 bp, Homo sapiens
tgggcatttgtttgaaattagata

SEQ ID NO: 18225 - DNA, 21 bp, Homo sapiens
acttgtatggagaactcacca

SEQ ID NO: 18226 - DNA, 21 bp, Homo sapiens
ggaattatttctgacacatga

SEQ ID NO: 18227 - DNA, 19 bp, Homo sapiens
aaatagtgagtagtatggt

SEQ ID NO: 18228 - DNA, 16 bp, Homo sapiens
atgtatcaaggagcgt

SEQ ID NO: 18229 - DNA, 25 bp, Homo sapiens
ggaaacaaaagtgaataccatattg

SEQ ID NO: 18230 - DNA, 21 bp, Homo sapiens
acccagagaggccaagatccc

SEQ ID NO: 18231 - DNA, 18 bp, Homo sapiens
ctgtctcctctccatccc

SEQ ID NO: 18232 - DNA, 15 bp, Homo sapiens
ggctcccctgctcct

SEQ ID NO: 18233 - DNA, 21 bp, Homo sapiens
gtccacccctcctcaacatcg

SEQ ID NO: 18234 - DNA, 21 bp, Homo sapiens
tgcccaggcacgccatttcca

SEQ ID NO: 18235 - DNA, 22 bp, Homo sapiens
aaggggggaccagaattcccca

SEQ ID NO: 18236 - DNA, 20 bp, Homo sapiens
atgacataactacacagtta

SEQ ID NO: 18237 - DNA, 19 bp, Homo sapiens
ccatctccacttcctcccc

SEQ ID NO: 18238 - DNA, 22 bp, Homo sapiens
cttcctccccctcgagtgtaca

SEQ ID NO: 18239 - DNA, 18 bp, Homo sapiens
gacattttctagctactt

SEQ ID NO: 18240 - DNA, 18 bp, Homo sapiens
ttgttcaatcactatgaa

SEQ ID NO: 18241 - DNA, 25 bp, Homo sapiens
ctacagcctgacccatgggcaccgt

SEQ ID NO: 18242 - DNA, 18 bp, Homo sapiens
acattatattggaatgaa

SEQ ID NO: 18243 - DNA, 21 bp, Homo sapiens
atgcatctgccattttcctca

SEQ ID NO: 18244 - DNA, 18 bp, Homo sapiens
tagtctctgcatacctca

SEQ ID NO: 18245 - DNA, 21 bp, Homo sapiens
tgcaaattctgtaatttcact

SEQ ID NO: 18246 - DNA, 21 bp, Homo sapiens
ttgatcacttttcaacttcca

SEQ ID NO: 18247 - DNA, 19 bp, Homo sapiens
atttcagatatacagactg

SEQ ID NO: 18248 - DNA, 25 bp, Homo sapiens
ggatttcacttgtcaacttacccca

SEQ ID NO: 18249 - DNA, 20 bp, Homo sapiens
actaaaattgaaaaatccac

SEQ ID NO: 18250 - DNA, 23 bp, Homo sapiens
agagggtgaggttcagcacatca

SEQ ID NO: 18251 - DNA, 22 bp, Homo sapiens
ccacctcttaacatctctttca

SEQ ID NO: 18252 - DNA, 18 bp, Homo sapiens
ccagtactgcagatctca

SEQ ID NO: 18253 - DNA, 22 bp, Homo sapiens
ctggccttcccccaccacagca

SEQ ID NO: 18254 - DNA, 23 bp, Homo sapiens
gacagggtatcacacatttctca

SEQ ID NO: 18255 - DNA, 18 bp, Homo sapiens
gcagactcagctgcaatt

SEQ ID NO: 18256 - DNA, 18 bp, Homo sapiens
gcccgtatctttctcttc

SEQ ID NO: 18257 - DNA, 26 bp, Homo sapiens
gctcctcattgctcccatctgcctct

SEQ ID NO: 18258 - DNA, 19 bp, Homo sapiens
tccctgcctgcagcctgca

SEQ ID NO: 18259 - DNA, 21 bp, Homo sapiens
tctctttcactttggttttgc

SEQ ID NO: 18260 - DNA, 19 bp, Homo sapiens
tgaatgggtctcaaagact

SEQ ID NO: 18261 - DNA, 16 bp, Homo sapiens
ggcgccctgccttggc

SEQ ID NO: 18262 - DNA, 21 bp, Homo sapiens
ggagagtgacggcggcccggc

SEQ ID NO: 18263 - DNA, 17 bp, Homo sapiens
atccacttcttcaagct

SEQ ID NO: 18264 - DNA, 18 bp, Homo sapiens
caaaatggcagtgtctta

SEQ ID NO: 18265 - DNA, 20 bp, Homo sapiens
ccctcaggcgtccatctgat

SEQ ID NO: 18266 - DNA, 20 bp, Homo sapiens
cctatggaatccagttctga

SEQ ID NO: 18267 - DNA, 22 bp, Homo sapiens
ccttgattttaagccctgtgaa

SEQ ID NO: 18268 - DNA, 21 bp, Homo sapiens
cctttttatccccatagcttt

SEQ ID NO: 18269 - DNA, 16 bp, Homo sapiens
ctcccaggtagcactg

SEQ ID NO: 18270 - DNA, 24 bp, Homo sapiens
gcccagaaaaatgtgcagcttgac

SEQ ID NO: 18271 - DNA, 22 bp, Homo sapiens
tcagggaaagccaggcccacct

SEQ ID NO: 18272 - DNA, 22 bp, Homo sapiens
tcccagaatctgcccctcacca

SEQ ID NO: 18273 - DNA, 18 bp, Homo sapiens
tccccaccaccaccagca

SEQ ID NO: 18274 - DNA, 22 bp, Homo sapiens
ttctggaggggagggtctggag

SEQ ID NO: 18275 - DNA, 18 bp, Homo sapiens
ttgggcagatgacttcac

SEQ ID NO: 18276 - DNA, 20 bp, Homo sapiens
atctcacttctgagaacgaa

SEQ ID NO: 18277 - DNA, 20 bp, Homo sapiens
ccccacctcttccctgccgc

SEQ ID NO: 18278 - DNA, 19 bp, Homo sapiens
gtggctgtcccggacccca

SEQ ID NO: 18279 - DNA, 18 bp, Homo sapiens
tcggatcccgagcgcggg

SEQ ID NO: 18280 - DNA, 17 bp, Homo sapiens
ccctctgtctactccct

SEQ ID NO: 18281 - DNA, 16 bp, Homo sapiens
tgtgaacttcactttg

SEQ ID NO: 18282 - DNA, 18 bp, Homo sapiens
accaggtccccactgagg

SEQ ID NO: 18283 - DNA, 19 bp, Homo sapiens
ccagctgactgagccccct

SEQ ID NO: 18284 - DNA, 24 bp, Homo sapiens
gctaaatctagtgggttctgagga

SEQ ID NO: 18285 - DNA, 21 bp, Homo sapiens
cgagatcatgcgcgggtttgg

SEQ ID NO: 18286 - DNA, 18 bp, Homo sapiens
aaaacatgtatatacatt

SEQ ID NO: 18287 - DNA, 17 bp, Homo sapiens
ccccacctccccctgca

SEQ ID NO: 18288 - DNA, 21 bp, Homo sapiens
ccatcctcgtcacttgggacc

SEQ ID NO: 18289 - DNA, 21 bp, Homo sapiens
cccagggaagcctcccagcgg

SEQ ID NO: 18290 - DNA, 23 bp, Homo sapiens
gctctccctccagggctgctgag

SEQ ID NO: 18291 - DNA, 20 bp, Homo sapiens
atgaaagtaatatgaacaca

SEQ ID NO: 18292 - DNA, 17 bp, Homo sapiens
actttgacttctggtct

SEQ ID NO: 18293 - DNA, 20 bp, Homo sapiens
ccaggattgctgccgcattc

SEQ ID NO: 18294 - DNA, 21 bp, Homo sapiens
cccacctggagggtttgggag

SEQ ID NO: 18295 - DNA, 20 bp, Homo sapiens
tgttaaagctgctcgattcc

SEQ ID NO: 18296 - DNA, 19 bp, Homo sapiens
aaacagatttagggattga

SEQ ID NO: 18297 - DNA, 17 bp, Homo sapiens
acagatttagggattga

SEQ ID NO: 18298 - DNA, 22 bp, Homo sapiens
cggggttttgcagagctcagtt

SEQ ID NO: 18299 - DNA, 17 bp, Homo sapiens
tgcccgctaacacagca

SEQ ID NO: 18300 - DNA, 19 bp, Homo sapiens
aggaaaaaaactgtgcaag

SEQ ID NO: 18301 - DNA, 19 bp, Homo sapiens
agtagacattcagatccag

SEQ ID NO: 18302 - DNA, 19 bp, Homo sapiens
tcgccttcacccccacccc

SEQ ID NO: 18303 - DNA, 23 bp, Homo sapiens
tggatgggattatgtggaaacta

SEQ ID NO: 18304 - DNA, 17 bp, Homo sapiens
aaacaatacagcattaa

SEQ ID NO: 18305 - DNA, 18 bp, Homo sapiens
aatgcacaaagctgtagt

SEQ ID NO: 18306 - DNA, 16 bp, Homo sapiens
agcccatgatacctta

SEQ ID NO: 18307 - DNA, 21 bp, Homo sapiens
atctttcagccacagaatcta

SEQ ID NO: 18308 - DNA, 22 bp, Homo sapiens
atgttgggggaaaattaactca

SEQ ID NO: 18309 - DNA, 19 bp, Homo sapiens
caccagaactaatttgcta

SEQ ID NO: 18310 - DNA, 18 bp, Homo sapiens
cattcagcaagctcctga

SEQ ID NO: 18311 - DNA, 17 bp, Homo sapiens
ctcttactaaaatgtta

SEQ ID NO: 18312 - DNA, 18 bp, Homo sapiens
gggaaacattctgtgaca

SEQ ID NO: 18313 - DNA, 21 bp, Homo sapiens
tgaccttaataccccaagctt

SEQ ID NO: 18314 - DNA, 24 bp, Homo sapiens
tgcaacctctgcctcctggattca

SEQ ID NO: 18315 - DNA, 23 bp, Homo sapiens
tggagtgcagtagtgcgatctca

SEQ ID NO: 18316 - DNA, 20 bp, Homo sapiens
tggatgggctccattaaaac

SEQ ID NO: 18317 - DNA, 17 bp, Homo sapiens
tgtttgaaacaatacag

SEQ ID NO: 18318 - DNA, 17 bp, Homo sapiens
ttcgctgacgccgggca

SEQ ID NO: 18319 - DNA, 19 bp, Homo sapiens
acaaatgtaaaaaacgtgg

SEQ ID NO: 18320 - DNA, 17 bp, Homo sapiens
agaaaatataagccttt

SEQ ID NO: 18321 - DNA, 22 bp, Homo sapiens
cagagtaatatatagggtttac

SEQ ID NO: 18322 - DNA, 22 bp, Homo sapiens
gcccagggtcactgggaactct

SEQ ID NO: 18323 - DNA, 23 bp, Homo sapiens
gcctgagtctctcctgcctgcct

SEQ ID NO: 18324 - DNA, 18 bp, Homo sapiens
tcatactggagagaaact

SEQ ID NO: 18325 - DNA, 21 bp, Homo sapiens
tctcctgcctgccttatcctt

SEQ ID NO: 18326 - DNA, 24 bp, Homo sapiens
tttgtagatgtataattacattca

SEQ ID NO: 18327 - DNA, 19 bp, Homo sapiens
aacactttttggactttgt

SEQ ID NO: 18328 - DNA, 20 bp, Homo sapiens
atgtcctcagcgacatttct

SEQ ID NO: 18329 - DNA, 18 bp, Homo sapiens
ctatgtttgtatattttt

SEQ ID NO: 18330 - DNA, 19 bp, Homo sapiens
ctcccgctgctttcatttt

SEQ ID NO: 18331 - DNA, 25 bp, Homo sapiens
gaggcctaagtggcaacatggcata

SEQ ID NO: 18332 - DNA, 23 bp, Homo sapiens
tagatggaaaagtgtagggactg

SEQ ID NO: 18333 - DNA, 19 bp, Homo sapiens
aagcaattctcctgcctca

SEQ ID NO: 18334 - DNA, 18 bp, Homo sapiens
aatcatgtgcttcataga

SEQ ID NO: 18335 - DNA, 21 bp, Homo sapiens
aggcacccaccacatctggct

SEQ ID NO: 18336 - DNA, 22 bp, Homo sapiens
atcttggctcactgcaacctct

SEQ ID NO: 18337 - DNA, 19 bp, Homo sapiens
ctgcaacctccgcctccca

SEQ ID NO: 18338 - DNA, 18 bp, Homo sapiens
tccgcctcccaggttcaa

SEQ ID NO: 18339 - DNA, 18 bp, Homo sapiens
tctacctcctgggttcaa

SEQ ID NO: 18340 - DNA, 23 bp, Homo sapiens
ctttttgaaagggagagaattga

SEQ ID NO: 18341 - DNA, 23 bp, Homo sapiens
ttaaacttgcctaatacctttct

SEQ ID NO: 18342 - DNA, 22 bp, Homo sapiens
acttgacgaggctctttggttt

SEQ ID NO: 18343 - DNA, 18 bp, Homo sapiens
tgaagaagaagcttgatg

SEQ ID NO: 18344 - DNA, 26 bp, Homo sapiens
aataattcatttctgggctaatttca

SEQ ID NO: 18345 - DNA, 23 bp, Homo sapiens
cacgtgagctgatcgtggctgca

SEQ ID NO: 18346 - DNA, 18 bp, Homo sapiens
ttgagccattcctaaaga

SEQ ID NO: 18347 - DNA, 22 bp, Homo sapiens
tgggtgggtactagggagactg

SEQ ID NO: 18348 - DNA, 18 bp, Homo sapiens
acacagacacgtaatacc

SEQ ID NO: 18349 - DNA, 23 bp, Homo sapiens
accatcacatttggaaagtgatc

SEQ ID NO: 18350 - DNA, 24 bp, Homo sapiens
agcccccatgttctctgcactgtt

SEQ ID NO: 18351 - DNA, 21 bp, Homo sapiens
atgtttcaataaaccttttga

SEQ ID NO: 18352 - DNA, 19 bp, Homo sapiens
cctcaatccccgcaaacta

SEQ ID NO: 18353 - DNA, 18 bp, Homo sapiens
agaggagatgaattatgg

SEQ ID NO: 18354 - DNA, 18 bp, Homo sapiens
ctgaacctctcaggatca

SEQ ID NO: 18355 - DNA, 18 bp, Homo sapiens
agcccctcctcacacata

SEQ ID NO: 18356 - DNA, 21 bp, Homo sapiens
agctgtggtcctctgattcca

SEQ ID NO: 18357 - DNA, 20 bp, Homo sapiens
catacatatgcacgcacaca

SEQ ID NO: 18358 - DNA, 20 bp, Homo sapiens
cgcacatgcacacatacaca

SEQ ID NO: 18359 - DNA, 20 bp, Homo sapiens
gcctctgcccttcaggagca

SEQ ID NO: 18360 - DNA, 19 bp, Homo sapiens
gggtggggcgttactgcca

SEQ ID NO: 18361 - DNA, 19 bp, Homo sapiens
tggagatgggagacagagg

SEQ ID NO: 18362 - DNA, 18 bp, Homo sapiens
atcctacccattgccact

SEQ ID NO: 18363 - DNA, 21 bp, Homo sapiens
gagaaatacctttagaggtga

SEQ ID NO: 18364 - DNA, 18 bp, Homo sapiens
tgaatatcatgaactctc

SEQ ID NO: 18365 - DNA, 18 bp, Homo sapiens
actgtattcctgctctga

SEQ ID NO: 18366 - DNA, 15 bp, Homo sapiens
atgacagaccagtta

SEQ ID NO: 18367 - DNA, 22 bp, Homo sapiens
attacgttttcattttttctga

SEQ ID NO: 18368 - DNA, 19 bp, Homo sapiens
cccactctctctcatctct

SEQ ID NO: 18369 - DNA, 30 bp, Homo sapiens
cgtatgtgtgggtgtgtgtgtatttgggtg

SEQ ID NO: 18370 - DNA, 18 bp, Homo sapiens
ctaggataaatcactttt

SEQ ID NO: 18371 - DNA, 16 bp, Homo sapiens
tataaagattgtgcag

SEQ ID NO: 18372 - DNA, 18 bp, Homo sapiens
tatacacatgtgtagtgt

SEQ ID NO: 18373 - DNA, 20 bp, Homo sapiens
tccaaagatgttctagatct

SEQ ID NO: 18374 - DNA, 19 bp, Homo sapiens
tctaactatcaaattgtgt

SEQ ID NO: 18375 - DNA, 19 bp, Homo sapiens
tctcttccccctcccccct

SEQ ID NO: 18376 - DNA, 19 bp, Homo sapiens
tgaatgagacctctgatag

SEQ ID NO: 18377 - DNA, 20 bp, Homo sapiens
gtgccaggagtcaaggcctg

SEQ ID NO: 18378 - DNA, 18 bp, Homo sapiens
cctttaacccgtgattcc

SEQ ID NO: 18379 - DNA, 19 bp, Homo sapiens
ggatgtgataaaaacatcc

SEQ ID NO: 18380 - DNA, 17 bp, Homo sapiens
caaactagtccagttta

SEQ ID NO: 18381 - DNA, 20 bp, Homo sapiens
gcactcaccttccgatttta

SEQ ID NO: 18382 - DNA, 18 bp, Homo sapiens
tgccaccaatttgtatta

SEQ ID NO: 18383 - DNA, 16 bp, Homo sapiens
tgtttgcctggataaa

SEQ ID NO: 18384 - DNA, 18 bp, Homo sapiens
ttgctcccactggtttaa

SEQ ID NO: 18385 - DNA, 23 bp, Homo sapiens
acacagggctaagacttgaacca

SEQ ID NO: 18386 - DNA, 21 bp, Homo sapiens
catacttactccggttgggtg

SEQ ID NO: 18387 - DNA, 19 bp, Homo sapiens
catgctcctgcatactcct

SEQ ID NO: 18388 - DNA, 22 bp, Homo sapiens
tgcccaagcccttcctcccctc

SEQ ID NO: 18389 - DNA, 23 bp, Homo sapiens
agcagtccatttctaccaaggca

SEQ ID NO: 18390 - DNA, 19 bp, Homo sapiens
agctgagcagcttttctcc

SEQ ID NO: 18391 - DNA, 20 bp, Homo sapiens
ccagtggaggagttcatgga

SEQ ID NO: 18392 - DNA, 18 bp, Homo sapiens
tgcccaaaactgtcatcc

SEQ ID NO: 18393 - DNA, 18 bp, Homo sapiens
tgttaaaatgagcattga

SEQ ID NO: 18394 - DNA, 20 bp, Homo sapiens
acttcatcatcttgataagt

SEQ ID NO: 18395 - DNA, 20 bp, Homo sapiens
cctttttaagacttttgacc

SEQ ID NO: 18396 - DNA, 18 bp, Homo sapiens
gctgaataacagctcttt

SEQ ID NO: 18397 - DNA, 18 bp, Homo sapiens
taggaaagctatttcaac

SEQ ID NO: 18398 - DNA, 21 bp, Homo sapiens
ttgaccatagtgttttccagt

SEQ ID NO: 18399 - DNA, 21 bp, Homo sapiens
tgtaacaagctcatagggtat

SEQ ID NO: 18400 - DNA, 19 bp, Homo sapiens
gcaaaatgagcttgggttt

SEQ ID NO: 18401 - DNA, 22 bp, Homo sapiens
ggtaaacccttaaatcttgcca

SEQ ID NO: 18402 - DNA, 23 bp, Homo sapiens
tgctgctcactgagaacccagct

SEQ ID NO: 18403 - DNA, 20 bp, Homo sapiens
cacaactagaaagtgtcacc

SEQ ID NO: 18404 - DNA, 23 bp, Homo sapiens
gcagaatctaaagaaagcattga

SEQ ID NO: 18405 - DNA, 20 bp, Homo sapiens
cccttcctccccccgtgtca

SEQ ID NO: 18406 - DNA, 18 bp, Homo sapiens
ggaagcggcggcggcggc

SEQ ID NO: 18407 - DNA, 22 bp, Homo sapiens
tcataatcatttctgctgtgca

SEQ ID NO: 18408 - DNA, 19 bp, Homo sapiens
tctctctctcttactctta

SEQ ID NO: 18409 - DNA, 24 bp, Homo sapiens
agtaagtggttcttatgtgttttg

SEQ ID NO: 18410 - DNA, 20 bp, Homo sapiens
tgtgccaaatgattcggata

SEQ ID NO: 18411 - DNA, 19 bp, Homo sapiens
ttctcctgctctgcagctt

SEQ ID NO: 18412 - DNA, 20 bp, Homo sapiens
aactaacaactgacaaatca

SEQ ID NO: 18413 - DNA, 17 bp, Homo sapiens
acatggctgggttcatg

SEQ ID NO: 18414 - DNA, 16 bp, Homo sapiens
agtatcacagcattaa

SEQ ID NO: 18415 - DNA, 16 bp, Homo sapiens
agtatcacagcattaa

SEQ ID NO: 18416 - DNA, 19 bp, Homo sapiens
gcagaggaatgttattgta

SEQ ID NO: 18417 - DNA, 18 bp, Homo sapiens
tcccaattgctgtttcag

SEQ ID NO: 18418 - DNA, 21 bp, Homo sapiens
ttaaaatggcagtctacatca

SEQ ID NO: 18419 - DNA, 18 bp, Homo sapiens
aaatagtgaataaggtgc

SEQ ID NO: 18420 - DNA, 15 bp, Homo sapiens
gagctgcctgccaaa

SEQ ID NO: 18421 - DNA, 21 bp, Homo sapiens
tgttgaccctcaaagggcata

SEQ ID NO: 18422 - DNA, 23 bp, Homo sapiens
acttgaatctgataggccggcct

SEQ ID NO: 18423 - DNA, 18 bp, Homo sapiens
ccaaaaaagacatgtcac

SEQ ID NO: 18424 - DNA, 25 bp, Homo sapiens
gctttggaaattattgcctctgata

SEQ ID NO: 18425 - DNA, 16 bp, Homo sapiens
ttgatgggacatgaag

SEQ ID NO: 18426 - DNA, 22 bp, Homo sapiens
aatctttcataactacatctca

SEQ ID NO: 18427 - DNA, 21 bp, Homo sapiens
gctttagtctgacataatcta

SEQ ID NO: 18428 - DNA, 19 bp, Homo sapiens
tcattgcactttggtcaga

SEQ ID NO: 18429 - DNA, 23 bp, Homo sapiens
aacacaatggagtactaagatgg

SEQ ID NO: 18430 - DNA, 19 bp, Homo sapiens
caacaaacatgttactatt

SEQ ID NO: 18431 - DNA, 19 bp, Homo sapiens
catctaagcatcatctgat

SEQ ID NO: 18432 - DNA, 18 bp, Homo sapiens
ggtattattcatgtgtca

SEQ ID NO: 18433 - DNA, 23 bp, Homo sapiens
gtatatatgagccttcttgttta

SEQ ID NO: 18434 - DNA, 20 bp, Homo sapiens
tgaaaatgtgacttagagta

SEQ ID NO: 18435 - DNA, 20 bp, Homo sapiens
ccttcccccggccctcctcc

SEQ ID NO: 18436 - DNA, 22 bp, Homo sapiens
tcacactacagtcatttctttt

SEQ ID NO: 18437 - DNA, 19 bp, Homo sapiens
tctatatataatatgacgc

SEQ ID NO: 18438 - DNA, 18 bp, Homo sapiens
accctccatctacccctt

SEQ ID NO: 18439 - DNA, 21 bp, Homo sapiens
agcatttcccaccctccatct

SEQ ID NO: 18440 - DNA, 19 bp, Homo sapiens
ccaggcactttgcatcaca

SEQ ID NO: 18441 - DNA, 22 bp, Homo sapiens
ccagggtattctttttccatcc

SEQ ID NO: 18442 - DNA, 19 bp, Homo sapiens
ccgaaccgcgctttctgaa

SEQ ID NO: 18443 - DNA, 18 bp, Homo sapiens
gcaggcagagggcctttg

SEQ ID NO: 18444 - DNA, 20 bp, Homo sapiens
gttggtttggtccctggttt

SEQ ID NO: 18445 - DNA, 18 bp, Homo sapiens
aaaaacaaaacaaacaaa

SEQ ID NO: 18446 - DNA, 21 bp, Homo sapiens
agaaaagataatttatcctca

SEQ ID NO: 18447 - DNA, 21 bp, Homo sapiens
ctttcttcccatccttaactg

SEQ ID NO: 18448 - DNA, 19 bp, Homo sapiens
gtagttttggggaactttt

SEQ ID NO: 18449 - DNA, 27 bp, Homo sapiens
tagttacagtgggttttattgtttttg

SEQ ID NO: 18450 - DNA, 16 bp, Homo sapiens
tatgcttaaatagatc

SEQ ID NO: 18451 - DNA, 19 bp, Homo sapiens
ccccgccctccgccgcagc

SEQ ID NO: 18452 - DNA, 25 bp, Homo sapiens
gccgtcctcgcctccctctgcctct

SEQ ID NO: 18453 - DNA, 21 bp, Homo sapiens
atctcgggtcaccacaacctc

SEQ ID NO: 18454 - DNA, 19 bp, Homo sapiens
cagcctcccgagtagctca

SEQ ID NO: 18455 - DNA, 18 bp, Homo sapiens
cccacaacctccgcctcc

SEQ ID NO: 18456 - DNA, 22 bp, Homo sapiens
actttctggagtaatcaggtgg

SEQ ID NO: 18457 - DNA, 19 bp, Homo sapiens
caggcctgggctgtgcagc

SEQ ID NO: 18458 - DNA, 19 bp, Homo sapiens
gcggaagtagcttgcctca

SEQ ID NO: 18459 - DNA, 22 bp, Homo sapiens
caaaattcattaaatttggctg

SEQ ID NO: 18460 - DNA, 21 bp, Homo sapiens
acacacttattccatcagcta

SEQ ID NO: 18461 - DNA, 24 bp, Homo sapiens
atttgaattgttgtggttttgttt

SEQ ID NO: 18462 - DNA, 19 bp, Homo sapiens
cagacatacccatttggat

SEQ ID NO: 18463 - DNA, 26 bp, Homo sapiens
cagacatacccatttggatgacccca

SEQ ID NO: 18464 - DNA, 17 bp, Homo sapiens
catctcctcaaggctcc

SEQ ID NO: 18465 - DNA, 23 bp, Homo sapiens
ccttgagaggacatacttttcca

SEQ ID NO: 18466 - DNA, 19 bp, Homo sapiens
tgaatacaagtttacctca

SEQ ID NO: 18467 - DNA, 17 bp, Homo sapiens
tgctaacgaacagctca

SEQ ID NO: 18468 - DNA, 20 bp, Homo sapiens
tggaaggccaaatgaagctg

SEQ ID NO: 18469 - DNA, 18 bp, Homo sapiens
aaagtttggaagcactga

SEQ ID NO: 18470 - DNA, 17 bp, Homo sapiens
agtgtttatctttctct

SEQ ID NO: 18471 - DNA, 19 bp, Homo sapiens
tggttccatggagttctga

SEQ ID NO: 18472 - DNA, 17 bp, Homo sapiens
acaaggggaggggtcaa

SEQ ID NO: 18473 - DNA, 19 bp, Homo sapiens
actggaggctgcctggctc

SEQ ID NO: 18474 - DNA, 20 bp, Homo sapiens
gagatgcattggtagcaact

SEQ ID NO: 18475 - DNA, 22 bp, Homo sapiens
tcatcatcaccaccatctccca

SEQ ID NO: 18476 - DNA, 20 bp, Homo sapiens
tcatgacataccagatgcca

SEQ ID NO: 18477 - DNA, 22 bp, Homo sapiens
ttctgaaattgggtcctcctcc

SEQ ID NO: 18478 - DNA, 19 bp, Homo sapiens
aagcaattctcctgcctca

SEQ ID NO: 18479 - DNA, 17 bp, Homo sapiens
aggtctctccctccctc

SEQ ID NO: 18480 - DNA, 22 bp, Homo sapiens
atcttggctcaccacaacctct

SEQ ID NO: 18481 - DNA, 20 bp, Homo sapiens
cctctgcctcctgggttcaa

SEQ ID NO: 18482 - DNA, 20 bp, Homo sapiens
taggtgggtctcaaagatga

SEQ ID NO: 18483 - DNA, 19 bp, Homo sapiens
tctggcctggataatctca

SEQ ID NO: 18484 - DNA, 21 bp, Homo sapiens
aatctgcttcaagaaatctca

SEQ ID NO: 18485 - DNA, 18 bp, Homo sapiens
acggtacatttctattac

SEQ ID NO: 18486 - DNA, 19 bp, Homo sapiens
atcacatagaaactccatt

SEQ ID NO: 18487 - DNA, 17 bp, Homo sapiens
ccgacgccgccgcctca

SEQ ID NO: 18488 - DNA, 18 bp, Homo sapiens
ctccattaatcatctgat

SEQ ID NO: 18489 - DNA, 18 bp, Homo sapiens
gcccaggagcccgtccag

SEQ ID NO: 18490 - DNA, 19 bp, Homo sapiens
gtattaagaattatatgaa

SEQ ID NO: 18491 - DNA, 18 bp, Homo sapiens
taaaaatacctaaagtgc

SEQ ID NO: 18492 - DNA, 21 bp, Homo sapiens
taattccagccttttgttttc

SEQ ID NO: 18493 - DNA, 24 bp, Homo sapiens
ttagagcacgttttggtcattttt

SEQ ID NO: 18494 - DNA, 17 bp, Homo sapiens
tttcacctgtggattcg

SEQ ID NO: 18495 - DNA, 23 bp, Homo sapiens
aagcaggtatcccagcatgaaat

SEQ ID NO: 18496 - DNA, 23 bp, Homo sapiens
taatacaacagagcactttttga

SEQ ID NO: 18497 - DNA, 18 bp, Homo sapiens
tgcaatattttagtaata

SEQ ID NO: 18498 - DNA, 20 bp, Homo sapiens
tgagggcaaccaagttgtta

SEQ ID NO: 18499 - DNA, 19 bp, Homo sapiens
ttctaacattgcttactta

SEQ ID NO: 18500 - DNA, 20 bp, Homo sapiens
ttgtaaatattcctgtattc

SEQ ID NO: 18501 - DNA, 21 bp, Homo sapiens
tatagaaaagtggaatcgagt

SEQ ID NO: 18502 - DNA, 22 bp, Homo sapiens
agtgggtggggagggtggttta

SEQ ID NO: 18503 - DNA, 21 bp, Homo sapiens
agagcagtcacaacagagtga

SEQ ID NO: 18504 - DNA, 25 bp, Homo sapiens
cgcagaactaccaggtggcaaagta

SEQ ID NO: 18505 - DNA, 18 bp, Homo sapiens
gttaatccctttgtctgt

SEQ ID NO: 18506 - DNA, 22 bp, Homo sapiens
tgaccaagactgagccagctta

SEQ ID NO: 18507 - DNA, 21 bp, Homo sapiens
tggggagacaaatctcagaac

SEQ ID NO: 18508 - DNA, 21 bp, Homo sapiens
ccagggagcccgagcggccgc

SEQ ID NO: 18509 - DNA, 18 bp, Homo sapiens
cgggggggatttttcgtc

SEQ ID NO: 18510 - DNA, 17 bp, Homo sapiens
ctccccccaaccaggga

SEQ ID NO: 18511 - DNA, 22 bp, Homo sapiens
cttggcacttaagtgcactttt

SEQ ID NO: 18512 - DNA, 19 bp, Homo sapiens
gcccttcttccccatctct

SEQ ID NO: 18513 - DNA, 17 bp, Homo sapiens
tgaactgcttttcctca

SEQ ID NO: 18514 - DNA, 18 bp, Homo sapiens
tttcacttgtattgactt

SEQ ID NO: 18515 - DNA, 23 bp, Homo sapiens
acacagctatcaagtgctaagtt

SEQ ID NO: 18516 - DNA, 18 bp, Homo sapiens
caaaccaacatttggtga

SEQ ID NO: 18517 - DNA, 18 bp, Homo sapiens
tctggtgcaatctgtgaa

SEQ ID NO: 18518 - DNA, 20 bp, Homo sapiens
taacaccatactttggcata

SEQ ID NO: 18519 - DNA, 18 bp, Homo sapiens
ttaatacataacacggta

SEQ ID NO: 18520 - DNA, 19 bp, Homo sapiens
ccgccactgctgccagcga

SEQ ID NO: 18521 - DNA, 22 bp, Homo sapiens
tcctgatgtgacggactgtgaa

SEQ ID NO: 18522 - DNA, 22 bp, Homo sapiens
tctggcaccactgccctggtcc

SEQ ID NO: 18523 - DNA, 21 bp, Homo sapiens
catgttctatttaagttctga

SEQ ID NO: 18524 - DNA, 21 bp, Homo sapiens
ccagagcacatgctgacctga

SEQ ID NO: 18525 - DNA, 16 bp, Homo sapiens
ccttttctcccctctc

SEQ ID NO: 18526 - DNA, 23 bp, Homo sapiens
gaactggctggcaggttctgcac

SEQ ID NO: 18527 - DNA, 21 bp, Homo sapiens
tggaagagccgtatgtactca

SEQ ID NO: 18528 - DNA, 17 bp, Homo sapiens
caaatgtaaggccatga

SEQ ID NO: 18529 - DNA, 17 bp, Homo sapiens
ccaatgggcaatagccc

SEQ ID NO: 18530 - DNA, 15 bp, Homo sapiens
ctttctttccagtca

SEQ ID NO: 18531 - DNA, 22 bp, Homo sapiens
gaagaaaaataaaagccaatga

SEQ ID NO: 18532 - DNA, 19 bp, Homo sapiens
tatttcaaaaattgtcaaa

SEQ ID NO: 18533 - DNA, 21 bp, Homo sapiens
ttctgattgttaagactttcc

SEQ ID NO: 18534 - DNA, 19 bp, Homo sapiens
caaagaacggcactttttc

SEQ ID NO: 18535 - DNA, 20 bp, Homo sapiens
cctttttacatttttgacct

SEQ ID NO: 18536 - DNA, 21 bp, Homo sapiens
cgaggttatgtacttcctgtt

SEQ ID NO: 18537 - DNA, 21 bp, Homo sapiens
cttttcctccccatcctggag

SEQ ID NO: 18538 - DNA, 23 bp, Homo sapiens
tcttgccgctggcccagtcacta

SEQ ID NO: 18539 - DNA, 18 bp, Homo sapiens
acccaacgtctcatcttc

SEQ ID NO: 18540 - DNA, 21 bp, Homo sapiens
gccctggggctgggggctgga

SEQ ID NO: 18541 - DNA, 17 bp, Homo sapiens
gggacggcgtggctgtg

SEQ ID NO: 18542 - DNA, 19 bp, Homo sapiens
gggccgttgttgcctctcc

SEQ ID NO: 18543 - DNA, 19 bp, Homo sapiens
aagcaattctcccgcctca

SEQ ID NO: 18544 - DNA, 18 bp, Homo sapiens
cccgcaacctccgcctcc

SEQ ID NO: 18545 - DNA, 23 bp, Homo sapiens
gtttgagctgtggcagaagcacc

SEQ ID NO: 18546 - DNA, 22 bp, Homo sapiens
ttcccagaaccaaagaatgtga

SEQ ID NO: 18547 - DNA, 19 bp, Homo sapiens
taaatggacttattgaagc

SEQ ID NO: 18548 - DNA, 19 bp, Homo sapiens
ctggcttcccccttcctct

SEQ ID NO: 18549 - DNA, 20 bp, Homo sapiens
atttggcttcaaaaatctga

SEQ ID NO: 18550 - DNA, 23 bp, Homo sapiens
gcgcggagaactcagcgctgaga

SEQ ID NO: 18551 - DNA, 19 bp, Homo sapiens
aagtgatgccctcctgcca

SEQ ID NO: 18552 - DNA, 24 bp, Homo sapiens
ccttacgcttgtgggggtctgcgg

SEQ ID NO: 18553 - DNA, 16 bp, Homo sapiens
ctagacgctgctagga

SEQ ID NO: 18554 - DNA, 20 bp, Homo sapiens
atggtgaaaccccatcgcta

SEQ ID NO: 18555 - DNA, 23 bp, Homo sapiens
cagagtctgcaggggacagccct

SEQ ID NO: 18556 - DNA, 21 bp, Homo sapiens
gcccctggcctgtgtccccca

SEQ ID NO: 18557 - DNA, 25 bp, Homo sapiens
agaccctggtgggggaatgacatca

SEQ ID NO: 18558 - DNA, 23 bp, Homo sapiens
cctggtaacataaaagcagttca

SEQ ID NO: 18559 - DNA, 20 bp, Homo sapiens
ctttattaaaatcttcctca

SEQ ID NO: 18560 - DNA, 20 bp, Homo sapiens
gaggagggagagggtgacga

SEQ ID NO: 18561 - DNA, 19 bp, Homo sapiens
gcattcccacttttcctca

SEQ ID NO: 18562 - DNA, 17 bp, Homo sapiens
ttacactttttgctgct

SEQ ID NO: 18563 - DNA, 23 bp, Homo sapiens
tttagcatcttcaaatttctttt

SEQ ID NO: 18564 - DNA, 20 bp, Homo sapiens
cttctcaaaaagcactgcac

SEQ ID NO: 18565 - DNA, 21 bp, Homo sapiens
gagcggaaccctgacttctca

SEQ ID NO: 18566 - DNA, 23 bp, Homo sapiens
aactacgagccacgagtttgcag

SEQ ID NO: 18567 - DNA, 18 bp, Homo sapiens
aggctggaccagaccccc

SEQ ID NO: 18568 - DNA, 15 bp, Homo sapiens
ccacacccatgtgta

SEQ ID NO: 18569 - DNA, 19 bp, Homo sapiens
accctgccctcaacccttg

SEQ ID NO: 18570 - DNA, 18 bp, Homo sapiens
cagccaccctctgcccct

SEQ ID NO: 18571 - DNA, 24 bp, Homo sapiens
gcctgggccactcctccctggcct

SEQ ID NO: 18572 - DNA, 28 bp, Homo sapiens
gcttctcccccagccaccctctgcccct

SEQ ID NO: 18573 - DNA, 20 bp, Homo sapiens
tcacctgccagttatgtggc

SEQ ID NO: 18574 - DNA, 24 bp, Homo sapiens
tgagacctggcctcaaagggctga

SEQ ID NO: 18575 - DNA, 20 bp, Homo sapiens
tgtgcagtgttgctaccagc

SEQ ID NO: 18576 - DNA, 19 bp, Homo sapiens
gcaatgtgttcccatttta

SEQ ID NO: 18577 - DNA, 24 bp, Homo sapiens
aaatctcaagccaaactcaaagaa

SEQ ID NO: 18578 - DNA, 23 bp, Homo sapiens
cctgcttcccgacaccagcctca

SEQ ID NO: 18579 - DNA, 22 bp, Homo sapiens
cccatggcttgatgtgaagaca

SEQ ID NO: 18580 - DNA, 17 bp, Homo sapiens
caccgacacgtatttta

SEQ ID NO: 18581 - DNA, 20 bp, Homo sapiens
gccacccctcagatgttttg

SEQ ID NO: 18582 - DNA, 22 bp, Homo sapiens
gaaattgtgttaggtttggtta

SEQ ID NO: 18583 - DNA, 22 bp, Homo sapiens
ttcggaggaaaatttcaggctg

SEQ ID NO: 18584 - DNA, 16 bp, Homo sapiens
attaacttcgctccca

SEQ ID NO: 18585 - DNA, 21 bp, Homo sapiens
ctctctctctctttctctctc

SEQ ID NO: 18586 - DNA, 21 bp, Homo sapiens
ctctttctctctctctctctc

SEQ ID NO: 18587 - DNA, 23 bp, Homo sapiens
aaacacttgccagaaactaaatt

SEQ ID NO: 18588 - DNA, 22 bp, Homo sapiens
aacacttgccagaaactaaatt

SEQ ID NO: 18589 - DNA, 23 bp, Homo sapiens
caccgcccaccacccctcctgct

SEQ ID NO: 18590 - DNA, 20 bp, Homo sapiens
agaaatatatccccatctcc

SEQ ID NO: 18591 - DNA, 22 bp, Homo sapiens
tctgataattgtctcccctcca

SEQ ID NO: 18592 - DNA, 19 bp, Homo sapiens
ttagctctctttcttctca

SEQ ID NO: 18593 - DNA, 20 bp, Homo sapiens
atttgggagacagtcacgtc

SEQ ID NO: 18594 - DNA, 22 bp, Homo sapiens
gcttttctcctccccgcgcctc

SEQ ID NO: 18595 - DNA, 18 bp, Homo sapiens
ttttacatgtacatttta

SEQ ID NO: 18596 - DNA, 21 bp, Homo sapiens
accctctaggggctttgggga

SEQ ID NO: 18597 - DNA, 18 bp, Homo sapiens
caaccttcctccctactc

SEQ ID NO: 18598 - DNA, 20 bp, Homo sapiens
ccctctaggggctttgggga

SEQ ID NO: 18599 - DNA, 22 bp, Homo sapiens
gcacaaccttcctccctactca

SEQ ID NO: 18600 - DNA, 18 bp, Homo sapiens
tgaaaccagctagtgtgt

SEQ ID NO: 18601 - DNA, 22 bp, Homo sapiens
tggcctgtccccacatccagca

SEQ ID NO: 18602 - DNA, 17 bp, Homo sapiens
cccactgcttccttctg

SEQ ID NO: 18603 - DNA, 22 bp, Homo sapiens
cctgagttaaaaagtgattttt

SEQ ID NO: 18604 - DNA, 23 bp, Homo sapiens
gcctggtaaagttgtttgtgtct

SEQ ID NO: 18605 - DNA, 18 bp, Homo sapiens
tccgcctcccaggttcaa

SEQ ID NO: 18606 - DNA, 20 bp, Homo sapiens
tggtcaggctggtcttgaac

SEQ ID NO: 18607 - DNA, 17 bp, Homo sapiens
acacaaaggttaaatta

SEQ ID NO: 18608 - DNA, 21 bp, Homo sapiens
gaagatttggaagaagctatt

SEQ ID NO: 18609 - DNA, 24 bp, Homo sapiens
gtttggatctgcacagtttggttt

SEQ ID NO: 18610 - DNA, 24 bp, Homo sapiens
ttatcaagcttcaaaaagcttttt

SEQ ID NO: 18611 - DNA, 16 bp, Homo sapiens
agctagacccgcttca

SEQ ID NO: 18612 - DNA, 20 bp, Homo sapiens
ccctccccacctttctctcc

SEQ ID NO: 18613 - DNA, 21 bp, Homo sapiens
aatttatctctaaaaaatggc

SEQ ID NO: 18614 - DNA, 22 bp, Homo sapiens
atagtgaaaccccatctccaaa

SEQ ID NO: 18615 - DNA, 21 bp, Homo sapiens
atcctattcacatcactgttg

SEQ ID NO: 18616 - DNA, 18 bp, Homo sapiens
cagaagccaggtgagccc

SEQ ID NO: 18617 - DNA, 24 bp, Homo sapiens
gcagacaccccacctgtgccccta

SEQ ID NO: 18618 - DNA, 25 bp, Homo sapiens
tgataagattttggctgtttggttt

SEQ ID NO: 18619 - DNA, 20 bp, Homo sapiens
atctcacttctgagaacgaa

SEQ ID NO: 18620 - DNA, 16 bp, Homo sapiens
ggaaactgaacgatta

SEQ ID NO: 18621 - DNA, 19 bp, Homo sapiens
gtggctgtcccggacccca

SEQ ID NO: 18622 - DNA, 18 bp, Homo sapiens
tcggatcccgagcgcggg

SEQ ID NO: 18623 - DNA, 20 bp, Homo sapiens
acaaagttcattgatgtcga

SEQ ID NO: 18624 - DNA, 18 bp, Homo sapiens
acaataacaatggcatta

SEQ ID NO: 18625 - DNA, 18 bp, Homo sapiens
tgttacctgttctcactg

SEQ ID NO: 18626 - DNA, 19 bp, Homo sapiens
agcgggatcaagaatttca

SEQ ID NO: 18627 - DNA, 22 bp, Homo sapiens
cagggcgcagtggctcacccct

SEQ ID NO: 18628 - DNA, 22 bp, Homo sapiens
gaaccaagatcacaccactgca

SEQ ID NO: 18629 - DNA, 20 bp, Homo sapiens
ggcttctgtggctttcattt

SEQ ID NO: 18630 - DNA, 20 bp, Homo sapiens
aacatctgcattattctgaa

SEQ ID NO: 18631 - DNA, 20 bp, Homo sapiens
atgacacagaactatataca

SEQ ID NO: 18632 - DNA, 18 bp, Homo sapiens
gaataacactctgctgta

SEQ ID NO: 18633 - DNA, 22 bp, Homo sapiens
agatgcatgcctctttggctct

SEQ ID NO: 18634 - DNA, 18 bp, Homo sapiens
ataattttcccaatgtca

SEQ ID NO: 18635 - DNA, 17 bp, Homo sapiens
cactgccatctgaacaa

SEQ ID NO: 18636 - DNA, 19 bp, Homo sapiens
caggaagcctaggctcggt

SEQ ID NO: 18637 - DNA, 21 bp, Homo sapiens
caggcttcccgacccacaggc

SEQ ID NO: 18638 - DNA, 17 bp, Homo sapiens
ccagagcctggccctcc

SEQ ID NO: 18639 - DNA, 17 bp, Homo sapiens
gcacgtcccgcaggcta

SEQ ID NO: 18640 - DNA, 20 bp, Homo sapiens
ttgtcccccagaacatgacc

SEQ ID NO: 18641 - DNA, 18 bp, Homo sapiens
gttctttctctttcctgt

SEQ ID NO: 18642 - DNA, 18 bp, Homo sapiens
actgtgggaatgaccatg

SEQ ID NO: 18643 - DNA, 21 bp, Homo sapiens
atcttggctcactccaacctc

SEQ ID NO: 18644 - DNA, 21 bp, Homo sapiens
cattccatgggctccttgcca

SEQ ID NO: 18645 - DNA, 21 bp, Homo sapiens
cccggatgacctttccagact

SEQ ID NO: 18646 - DNA, 20 bp, Homo sapiens
cctctgcctcccgggttcaa

SEQ ID NO: 18647 - DNA, 20 bp, Homo sapiens
ctcttgcctcccaggttcaa

SEQ ID NO: 18648 - DNA, 18 bp, Homo sapiens
ggaggaggaagatggcca

SEQ ID NO: 18649 - DNA, 21 bp, Homo sapiens
gggaatgaccatggtcatggc

SEQ ID NO: 18650 - DNA, 17 bp, Homo sapiens
tcaagtgattctcctgc

SEQ ID NO: 18651 - DNA, 18 bp, Homo sapiens
tccgcctcctgggttcaa

SEQ ID NO: 18652 - DNA, 25 bp, Homo sapiens
agccctcagattcatcgctaccccg

SEQ ID NO: 18653 - DNA, 20 bp, Homo sapiens
cttcctccgcctccgcctct

SEQ ID NO: 18654 - DNA, 23 bp, Homo sapiens
gcctctctctcctcctcctcctc

SEQ ID NO: 18655 - DNA, 21 bp, Homo sapiens
gacagtgaaagtaccatcata

SEQ ID NO: 18656 - DNA, 19 bp, Homo sapiens
gcacttgtgctttagcttt

SEQ ID NO: 18657 - DNA, 22 bp, Homo sapiens
tcatacataagtcatttagtaa

SEQ ID NO: 18658 - DNA, 18 bp, Homo sapiens
ggcagtttacctctgatg

SEQ ID NO: 18659 - DNA, 17 bp, Homo sapiens
agtgtgttttaactagc

SEQ ID NO: 18660 - DNA, 20 bp, Homo sapiens
ctgtatattgtttactttat

SEQ ID NO: 18661 - DNA, 23 bp, Homo sapiens
gcagtttaggacctgctgtcata

SEQ ID NO: 18662 - DNA, 26 bp, Homo sapiens
gcgttggaagagttgttgggggtttt

SEQ ID NO: 18663 - DNA, 20 bp, Homo sapiens
gcccacccacactcactcca

SEQ ID NO: 18664 - DNA, 17 bp, Homo sapiens
tctttctctcctccctc

SEQ ID NO: 18665 - DNA, 22 bp, Homo sapiens
aaattactaatgcaccacgtca

SEQ ID NO: 18666 - DNA, 28 bp, Homo sapiens
atctgggccaagaatgattgctaggtcc

SEQ ID NO: 18667 - DNA, 18 bp, Homo sapiens
ttgtcggaggggaaaagg

SEQ ID NO: 18668 - DNA, 19 bp, Homo sapiens
aaacactgtagggaacctc

SEQ ID NO: 18669 - DNA, 22 bp, Homo sapiens
acaaaacactgtagggaacctc

SEQ ID NO: 18670 - DNA, 20 bp, Homo sapiens
aggtgtccaaaattccatac

SEQ ID NO: 18671 - DNA, 23 bp, Homo sapiens
cagacaatataagacacactata

SEQ ID NO: 18672 - DNA, 23 bp, Homo sapiens
taaatggagtcagtgtggaattg

SEQ ID NO: 18673 - DNA, 21 bp, Homo sapiens
taccaccattcttcataattc

SEQ ID NO: 18674 - DNA, 21 bp, Homo sapiens
tgattttctgttaatattcca

SEQ ID NO: 18675 - DNA, 17 bp, Homo sapiens
tttggggcagcatttgc

SEQ ID NO: 18676 - DNA, 17 bp, Homo sapiens
acagatggctgcgcacc

SEQ ID NO: 18677 - DNA, 18 bp, Homo sapiens
accccgagaaccagttca

SEQ ID NO: 18678 - DNA, 17 bp, Homo sapiens
ccaccatagggcatgat

SEQ ID NO: 18679 - DNA, 20 bp, Homo sapiens
ctcagtctcctctgtcctct

SEQ ID NO: 18680 - DNA, 22 bp, Homo sapiens
ggagccgctctctgcagagcca

SEQ ID NO: 18681 - DNA, 18 bp, Homo sapiens
ttagttcaagaacacatt

SEQ ID NO: 18682 - DNA, 20 bp, Homo sapiens
ctggctgtggcccccattcc

SEQ ID NO: 18683 - DNA, 25 bp, Homo sapiens
gtgtgtgtgagcgtgtgtgtgagtg

SEQ ID NO: 18684 - DNA, 21 bp, Homo sapiens
tcctggcgatgccctggtgga

SEQ ID NO: 18685 - DNA, 19 bp, Homo sapiens
acgtacctgtgtcttatct

SEQ ID NO: 18686 - DNA, 19 bp, Homo sapiens
cttctctggcctctggttt

SEQ ID NO: 18687 - DNA, 22 bp, Homo sapiens
gaaacccccttttttagctttt

SEQ ID NO: 18688 - DNA, 19 bp, Homo sapiens
gagccgcggcgcctcgttc

SEQ ID NO: 18689 - DNA, 20 bp, Homo sapiens
gggaaggcagcggcggcggc

SEQ ID NO: 18690 - DNA, 18 bp, Homo sapiens
gtctggcatgactaatgt

SEQ ID NO: 18691 - DNA, 19 bp, Homo sapiens
tccacagacacacctaagc

SEQ ID NO: 18692 - DNA, 18 bp, Homo sapiens
cttctgtgatagatgttt

SEQ ID NO: 18693 - DNA, 19 bp, Homo sapiens
tcccatttcaattcagtta

SEQ ID NO: 18694 - DNA, 18 bp, Homo sapiens
tgaagacctattcagagt

SEQ ID NO: 18695 - DNA, 23 bp, Homo sapiens
accacagactgtcctctccacct

SEQ ID NO: 18696 - DNA, 23 bp, Homo sapiens
ctctgatggtgctcagatttgtg

SEQ ID NO: 18697 - DNA, 18 bp, Homo sapiens
ctgccctttttgtgtggt

SEQ ID NO: 18698 - DNA, 22 bp, Homo sapiens
gcaaaatattatgcctaaagta

SEQ ID NO: 18699 - DNA, 16 bp, Homo sapiens
gcactattacatagta

SEQ ID NO: 18700 - DNA, 22 bp, Homo sapiens
ccccaccccctccccactagct

SEQ ID NO: 18701 - DNA, 22 bp, Homo sapiens
cccctccccactagctcgatct

SEQ ID NO: 18702 - DNA, 23 bp, Homo sapiens
cctccactttagctgttttgact

SEQ ID NO: 18703 - DNA, 19 bp, Homo sapiens
gaattgaacctgacatttt

SEQ ID NO: 18704 - DNA, 17 bp, Homo sapiens
gccctctagagaatcca

SEQ ID NO: 18705 - DNA, 24 bp, Homo sapiens
gccctgggagctggaggaaccgcg

SEQ ID NO: 18706 - DNA, 19 bp, Homo sapiens
tcttgagtagagttgcaca

SEQ ID NO: 18707 - DNA, 21 bp, Homo sapiens
caaccctccatcctaggctct

SEQ ID NO: 18708 - DNA, 18 bp, Homo sapiens
ccaaactctggcacctca

SEQ ID NO: 18709 - DNA, 19 bp, Homo sapiens
ggatggaagacagggattg

SEQ ID NO: 18710 - DNA, 18 bp, Homo sapiens
tctggaaggggcttggaa

SEQ ID NO: 18711 - DNA, 19 bp, Homo sapiens
tgcccagggtccccatcct

SEQ ID NO: 18712 - DNA, 19 bp, Homo sapiens
agtcccacagccttcctcc

SEQ ID NO: 18713 - DNA, 23 bp, Homo sapiens
agggatcggcagggaccacttcc

SEQ ID NO: 18714 - DNA, 22 bp, Homo sapiens
cccagacccaagcctgacccca

SEQ ID NO: 18715 - DNA, 23 bp, Homo sapiens
ccctggccccggcccttccctca

SEQ ID NO: 18716 - DNA, 19 bp, Homo sapiens
cttccctcacttccatcca

SEQ ID NO: 18717 - DNA, 16 bp, Homo sapiens
tgtagggtccggcgtg

SEQ ID NO: 18718 - DNA, 24 bp, Homo sapiens
catcaacctcaagcccgtttagca

SEQ ID NO: 18719 - DNA, 24 bp, Homo sapiens
cctatggaaatcattcacatctga

SEQ ID NO: 18720 - DNA, 25 bp, Homo sapiens
ctttttagaagctggctttaacttt

SEQ ID NO: 18721 - DNA, 17 bp, Homo sapiens
gcactgtatgcatactt

SEQ ID NO: 18722 - DNA, 20 bp, Homo sapiens
tgatcaattttcctcatgac

SEQ ID NO: 18723 - DNA, 19 bp, Homo sapiens
aaaaagctcaaggaaatac

SEQ ID NO: 18724 - DNA, 18 bp, Homo sapiens
agggaaaacaaaatactt

SEQ ID NO: 18725 - DNA, 17 bp, Homo sapiens
agtgcttgacctcctgt

SEQ ID NO: 18726 - DNA, 18 bp, Homo sapiens
tgaaattaccagatattc

SEQ ID NO: 18727 - DNA, 20 bp, Homo sapiens
tggccttgtcaacatacaga

SEQ ID NO: 18728 - DNA, 24 bp, Homo sapiens
caagaacaagcagagcccgggcca

SEQ ID NO: 18729 - DNA, 21 bp, Homo sapiens
gttctttttttctttaaggaa

SEQ ID NO: 18730 - DNA, 22 bp, Homo sapiens
tcaaataagcagtatttaatca

SEQ ID NO: 18731 - DNA, 16 bp, Homo sapiens
aggagaaaggataaca

SEQ ID NO: 18732 - DNA, 18 bp, Homo sapiens
aggtaaaagcctgaaaca

SEQ ID NO: 18733 - DNA, 17 bp, Homo sapiens
caagtgcgtgtctactt

SEQ ID NO: 18734 - DNA, 18 bp, Homo sapiens
cagagcctcagcatccaa

SEQ ID NO: 18735 - DNA, 26 bp, Homo sapiens
cagtggtgcaatcatagctcattgaa

SEQ ID NO: 18736 - DNA, 22 bp, Homo sapiens
cctttttatactaggtctggtt

SEQ ID NO: 18737 - DNA, 21 bp, Homo sapiens
ggaaacagaaatttagaatgg

SEQ ID NO: 18738 - DNA, 21 bp, Homo sapiens
tgatggattttcatttcttcg

SEQ ID NO: 18739 - DNA, 19 bp, Homo sapiens
ttcagatcctttaatgtgg

SEQ ID NO: 18740 - DNA, 18 bp, Homo sapiens
acaaaagcagctgtgaca

SEQ ID NO: 18741 - DNA, 20 bp, Homo sapiens
ggagggtacttggcattaca

SEQ ID NO: 18742 - DNA, 19 bp, Homo sapiens
cttacagaaagataccctc

SEQ ID NO: 18743 - DNA, 17 bp, Homo sapiens
tgcaaaattagcttttt

SEQ ID NO: 18744 - DNA, 22 bp, Homo sapiens
cctctttggttttcttagcttt

SEQ ID NO: 18745 - DNA, 20 bp, Homo sapiens
tctccactaagcctgtgtaa

SEQ ID NO: 18746 - DNA, 17 bp, Homo sapiens
gtgttgccaccatgcac

SEQ ID NO: 18747 - DNA, 18 bp, Homo sapiens
atgccgcctgtgtgccgt

SEQ ID NO: 18748 - DNA, 23 bp, Homo sapiens
catccagcagctcctcatcccca

SEQ ID NO: 18749 - DNA, 22 bp, Homo sapiens
acacttggcccttggttacgtc

SEQ ID NO: 18750 - DNA, 23 bp, Homo sapiens
agtgcccaccccacatcactaca

SEQ ID NO: 18751 - DNA, 16 bp, Homo sapiens
cgtggaggatttggaa

SEQ ID NO: 18752 - DNA, 19 bp, Homo sapiens
actgccatccatctccaga

SEQ ID NO: 18753 - DNA, 19 bp, Homo sapiens
agcaggcagcattgatgaa

SEQ ID NO: 18754 - DNA, 24 bp, Homo sapiens
agtaggtgggactacagatgtgtg

SEQ ID NO: 18755 - DNA, 22 bp, Homo sapiens
caagatcatttcacctcactcc

SEQ ID NO: 18756 - DNA, 19 bp, Homo sapiens
cacattttgatcattgcta

SEQ ID NO: 18757 - DNA, 22 bp, Homo sapiens
gagccaagatcatttcacctca

SEQ ID NO: 18758 - DNA, 21 bp, Homo sapiens
gcccctggcaaccaccatcct

SEQ ID NO: 18759 - DNA, 18 bp, Homo sapiens
tgaccaaaaatcagtttt

SEQ ID NO: 18760 - DNA, 20 bp, Homo sapiens
ttattttaaaaatcagctct

SEQ ID NO: 18761 - DNA, 23 bp, Homo sapiens
accacaggccgctgtaccccctt

SEQ ID NO: 18762 - DNA, 25 bp, Homo sapiens
cccactgcagtcggccttgcctcct

SEQ ID NO: 18763 - DNA, 21 bp, Homo sapiens
ctcctcctcctcctctacctc

SEQ ID NO: 18764 - DNA, 17 bp, Homo sapiens
ctgctgggcgttccctt

SEQ ID NO: 18765 - DNA, 18 bp, Homo sapiens
tgaccagcctggcccacc

SEQ ID NO: 18766 - DNA, 17 bp, Homo sapiens
cccaccagaagaagcac

SEQ ID NO: 18767 - DNA, 17 bp, Homo sapiens
acatacaatagtgtgaa

SEQ ID NO: 18768 - DNA, 19 bp, Homo sapiens
attgctttttgtataccaa

SEQ ID NO: 18769 - DNA, 23 bp, Homo sapiens
cgtatggatgctagtgcctttaa

SEQ ID NO: 18770 - DNA, 22 bp, Homo sapiens
ggtataaaaccagatgtttaca

SEQ ID NO: 18771 - DNA, 20 bp, Homo sapiens
aactgcattaaccgatctga

SEQ ID NO: 18772 - DNA, 20 bp, Homo sapiens
atctttgatggctacttttt

SEQ ID NO: 18773 - DNA, 22 bp, Homo sapiens
cttaattttcattttcctcatt

SEQ ID NO: 18774 - DNA, 19 bp, Homo sapiens
tctctttatagttaggctt

SEQ ID NO: 18775 - DNA, 23 bp, Homo sapiens
aagaggataaaacaacgctccat

SEQ ID NO: 18776 - DNA, 21 bp, Homo sapiens
accaaaggagcaaagaggata

SEQ ID NO: 18777 - DNA, 18 bp, Homo sapiens
accttctaattgagacta

SEQ ID NO: 18778 - DNA, 19 bp, Homo sapiens
gaactgatctggcttgtca

SEQ ID NO: 18779 - DNA, 22 bp, Homo sapiens
tattggtcacccagtgatcata

SEQ ID NO: 18780 - DNA, 22 bp, Homo sapiens
ttggccttaaagctagccagct

SEQ ID NO: 18781 - DNA, 18 bp, Homo sapiens
aagctaagcctcaagata

SEQ ID NO: 18782 - DNA, 19 bp, Homo sapiens
aaggtgcagggggcaaagg

SEQ ID NO: 18783 - DNA, 18 bp, Homo sapiens
caaaggatcacctggtat

SEQ ID NO: 18784 - DNA, 18 bp, Homo sapiens
cctggcagtggattgtgg

SEQ ID NO: 18785 - DNA, 23 bp, Homo sapiens
gaaaacctccatcttggctccca

SEQ ID NO: 18786 - DNA, 18 bp, Homo sapiens
gcctgaggcagtcacaga

SEQ ID NO: 18787 - DNA, 21 bp, Homo sapiens
gtgaacctgcctgtgaactct

SEQ ID NO: 18788 - DNA, 22 bp, Homo sapiens
aaaagacctagcccaacttccc

SEQ ID NO: 18789 - DNA, 21 bp, Homo sapiens
aggagtctcactgggctggtt

SEQ ID NO: 18790 - DNA, 18 bp, Homo sapiens
cttcccctcctctctcca

SEQ ID NO: 18791 - DNA, 23 bp, Homo sapiens
ggagtgattttgacatgggggtg

SEQ ID NO: 18792 - DNA, 16 bp, Homo sapiens
tcttcctctcttcctc

SEQ ID NO: 18793 - DNA, 21 bp, Homo sapiens
aaactgccccccgagcttctt

SEQ ID NO: 18794 - DNA, 20 bp, Homo sapiens
cagcccctgcagtcatctca

SEQ ID NO: 18795 - DNA, 22 bp, Homo sapiens
cccagaggacgttcctcaagga

SEQ ID NO: 18796 - DNA, 22 bp, Homo sapiens
ccccaaactgccccccgagctt

SEQ ID NO: 18797 - DNA, 16 bp, Homo sapiens
cctgagggcctgcgga

SEQ ID NO: 18798 - DNA, 22 bp, Homo sapiens
cctggaccgctactgcccccca

SEQ ID NO: 18799 - DNA, 24 bp, Homo sapiens
cctttccacacgccgctgccccag

SEQ ID NO: 18800 - DNA, 21 bp, Homo sapiens
ctacaaggacaagaggctcaa

SEQ ID NO: 18801 - DNA, 23 bp, Homo sapiens
ctcctcatgcccctctgtcctct

SEQ ID NO: 18802 - DNA, 17 bp, Homo sapiens
ctgccactgggcccaca

SEQ ID NO: 18803 - DNA, 25 bp, Homo sapiens
gctccctgcccctcctcatgcccct

SEQ ID NO: 18804 - DNA, 19 bp, Homo sapiens
ggaccgggcaggtgtccac

SEQ ID NO: 18805 - DNA, 24 bp, Homo sapiens
attagctcctcctttttccttcca

SEQ ID NO: 18806 - DNA, 22 bp, Homo sapiens
ctttttccttggctttagcctt

SEQ ID NO: 18807 - DNA, 22 bp, Homo sapiens
gacggcaggcagcagctgtggc

SEQ ID NO: 18808 - DNA, 17 bp, Homo sapiens
gaggaaagcatgagcag

SEQ ID NO: 18809 - DNA, 22 bp, Homo sapiens
gcagagagcccagtgccggcca

SEQ ID NO: 18810 - DNA, 21 bp, Homo sapiens
taaaggtcatgtctcctagct

SEQ ID NO: 18811 - DNA, 24 bp, Homo sapiens
tcttggtgaagacagggttcgtgg

SEQ ID NO: 18812 - DNA, 22 bp, Homo sapiens
gacggcaggcagcagctgtggc

SEQ ID NO: 18813 - DNA, 17 bp, Homo sapiens
gaggaaagcatgagcag

SEQ ID NO: 18814 - DNA, 22 bp, Homo sapiens
gcagagagcccagtgccggcca

SEQ ID NO: 18815 - DNA, 21 bp, Homo sapiens
taaaggtcatgtctcctagct

SEQ ID NO: 18816 - DNA, 24 bp, Homo sapiens
tcttggtgaagacagggttcgtgg

SEQ ID NO: 18817 - DNA, 22 bp, Homo sapiens
acataattttttaaaaagtttt

SEQ ID NO: 18818 - DNA, 24 bp, Homo sapiens
gagaatttttatttctcaatacct

SEQ ID NO: 18819 - DNA, 19 bp, Homo sapiens
tggctttgaattttaagca

SEQ ID NO: 18820 - DNA, 23 bp, Homo sapiens
acaagtaatgtaaaagctagtat

SEQ ID NO: 18821 - DNA, 17 bp, Homo sapiens
gaaaccggtgtctgtca

SEQ ID NO: 18822 - DNA, 26 bp, Homo sapiens
tccatgatgaccatcctcatagctca

SEQ ID NO: 18823 - DNA, 23 bp, Homo sapiens
tctttttgtagttgaattgtctt

SEQ ID NO: 18824 - DNA, 20 bp, Homo sapiens
tgagcgtgaccccctggctc

SEQ ID NO: 18825 - DNA, 20 bp, Homo sapiens
actgcctatacccctcatca

SEQ ID NO: 18826 - DNA, 17 bp, Homo sapiens
caccacagccaccttct

SEQ ID NO: 18827 - DNA, 21 bp, Homo sapiens
cactgcctatacccctcatca

SEQ ID NO: 18828 - DNA, 23 bp, Homo sapiens
cccaccttctgccgccgccacca

SEQ ID NO: 18829 - DNA, 19 bp, Homo sapiens
ctgagcggccgcctgtcct

SEQ ID NO: 18830 - DNA, 20 bp, Homo sapiens
gagccccctgtccttcccac

SEQ ID NO: 18831 - DNA, 20 bp, Homo sapiens
actgcctatacccctcatca

SEQ ID NO: 18832 - DNA, 17 bp, Homo sapiens
caccacagccaccttct

SEQ ID NO: 18833 - DNA, 21 bp, Homo sapiens
cactgcctatacccctcatca

SEQ ID NO: 18834 - DNA, 23 bp, Homo sapiens
cccaccttctgccgccgccacca

SEQ ID NO: 18835 - DNA, 19 bp, Homo sapiens
ctgagcggccgcctgtcct

SEQ ID NO: 18836 - DNA, 20 bp, Homo sapiens
gagccccctgtccttcccac

SEQ ID NO: 18837 - DNA, 20 bp, Homo sapiens
actgcctatacccctcatca

SEQ ID NO: 18838 - DNA, 17 bp, Homo sapiens
caccacagccaccttct

SEQ ID NO: 18839 - DNA, 21 bp, Homo sapiens
cactgcctatacccctcatca

SEQ ID NO: 18840 - DNA, 23 bp, Homo sapiens
cccaccttctgccgccgccacca

SEQ ID NO: 18841 - DNA, 19 bp, Homo sapiens
ctgagcggccgcctgtcct

SEQ ID NO: 18842 - DNA, 20 bp, Homo sapiens
gagccccctgtccttcccac

SEQ ID NO: 18843 - DNA, 18 bp, Homo sapiens
tccagaaggctgtcccgg

SEQ ID NO: 18844 - DNA, 23 bp, Homo sapiens
acttttaaaaaggccttctctca

SEQ ID NO: 18845 - DNA, 18 bp, Homo sapiens
aggccaaggacaaacgcc

SEQ ID NO: 18846 - DNA, 18 bp, Homo sapiens
cagtttgttgcagtgcca

SEQ ID NO: 18847 - DNA, 18 bp, Homo sapiens
ggcagcggcaggagcgca

SEQ ID NO: 18848 - DNA, 23 bp, Homo sapiens
tggagagcccacatatgggattg

SEQ ID NO: 18849 - DNA, 18 bp, Homo sapiens
agccgggtagggcagata

SEQ ID NO: 18850 - DNA, 17 bp, Homo sapiens
ctttctctctccttctc

SEQ ID NO: 18851 - DNA, 22 bp, Homo sapiens
ttctgtctttctccctctcctt

SEQ ID NO: 18852 - DNA, 27 bp, Homo sapiens
acaaaactcaggccagagccacagctg

SEQ ID NO: 18853 - DNA, 23 bp, Homo sapiens
gtaatgaaagagcgaatgactga

SEQ ID NO: 18854 - DNA, 22 bp, Homo sapiens
tctggctgcagtaagctccctg

SEQ ID NO: 18855 - DNA, 16 bp, Homo sapiens
gccattgcctgtctct

SEQ ID NO: 18856 - DNA, 18 bp, Homo sapiens
gctccaatttgccagcca

SEQ ID NO: 18857 - DNA, 21 bp, Homo sapiens
acagacctccctacagctgta

SEQ ID NO: 18858 - DNA, 22 bp, Homo sapiens
acttgggggatctccttggcct

SEQ ID NO: 18859 - DNA, 22 bp, Homo sapiens
agaaggtacttactcttgtacc

SEQ ID NO: 18860 - DNA, 18 bp, Homo sapiens
atgcctcaaagccttgct

SEQ ID NO: 18861 - DNA, 23 bp, Homo sapiens
cagctgttctagagcgggaatta

SEQ ID NO: 18862 - DNA, 20 bp, Homo sapiens
ctatttggaaatccctaaca

SEQ ID NO: 18863 - DNA, 22 bp, Homo sapiens
cttatttgtcttctacacccca

SEQ ID NO: 18864 - DNA, 18 bp, Homo sapiens
tccgcctcccgggttcaa

SEQ ID NO: 18865 - DNA, 18 bp, Homo sapiens
tgtctgtggaaaatggga

SEQ ID NO: 18866 - DNA, 22 bp, Homo sapiens
atggaaaaccatggattctgaa

SEQ ID NO: 18867 - DNA, 25 bp, Homo sapiens
ggttttggatccaaggacctgtgga

SEQ ID NO: 18868 - DNA, 20 bp, Homo sapiens
taattttggatttttcctta

SEQ ID NO: 18869 - DNA, 22 bp, Homo sapiens
tgtgttatccaaagaacattgg

SEQ ID NO: 18870 - DNA, 21 bp, Homo sapiens
aatacagtatttctttgttat

SEQ ID NO: 18871 - DNA, 24 bp, Homo sapiens
cccttcttcctgcccccacacccc

SEQ ID NO: 18872 - DNA, 21 bp, Homo sapiens
gtccctgatgccgcttcccga

SEQ ID NO: 18873 - DNA, 21 bp, Homo sapiens
cagagtctgcacctgccgcct

SEQ ID NO: 18874 - DNA, 18 bp, Homo sapiens
gccctggacatggaacta

SEQ ID NO: 18875 - DNA, 21 bp, Homo sapiens
tccagatccagatccttgtgc

SEQ ID NO: 18876 - DNA, 18 bp, Homo sapiens
agaatggcaagtaagtta

SEQ ID NO: 18877 - DNA, 18 bp, Homo sapiens
gagcttgtgatgaaatct

SEQ ID NO: 18878 - DNA, 17 bp, Homo sapiens
gaggaagtttgtttttt

SEQ ID NO: 18879 - DNA, 20 bp, Homo sapiens
tacttttctccaatacctgc

SEQ ID NO: 18880 - DNA, 19 bp, Homo sapiens
tgatcctgtaatcatggta

SEQ ID NO: 18881 - DNA, 18 bp, Homo sapiens
aagttcatgtcactgtct

SEQ ID NO: 18882 - DNA, 25 bp, Homo sapiens
cctgggtggtctcatccattccttt

SEQ ID NO: 18883 - DNA, 18 bp, Homo sapiens
gagctcacaggaatctca

SEQ ID NO: 18884 - DNA, 17 bp, Homo sapiens
tccactcccgggttcaa

SEQ ID NO: 18885 - DNA, 23 bp, Homo sapiens
tccttctttccccttttgtcttg

SEQ ID NO: 18886 - DNA, 20 bp, Homo sapiens
tgcctgagctatgacaacag

SEQ ID NO: 18887 - DNA, 24 bp, Homo sapiens
tttgcttacaacgcagtgcgttta

SEQ ID NO: 18888 - DNA, 17 bp, Homo sapiens
gcaccccagtctaacac

SEQ ID NO: 18889 - DNA, 18 bp, Homo sapiens
tctccattttgggacatt

SEQ ID NO: 18890 - DNA, 24 bp, Homo sapiens
catgtttgaaaggtgaatttctga

SEQ ID NO: 18891 - DNA, 18 bp, Homo sapiens
tatatattagctgtactc

SEQ ID NO: 18892 - DNA, 18 bp, Homo sapiens
ttgctttgtgctcattga

SEQ ID NO: 18893 - DNA, 20 bp, Homo sapiens
aaggatgaacctcagggcac

SEQ ID NO: 18894 - DNA, 18 bp, Homo sapiens
agattgagggcccgggag

SEQ ID NO: 18895 - DNA, 18 bp, Homo sapiens
ccagtgggaggctgtgga

SEQ ID NO: 18896 - DNA, 20 bp, Homo sapiens
tgcaatgggctgcccaggct

SEQ ID NO: 18897 - DNA, 21 bp, Homo sapiens
accatggtggtggtttggctt

SEQ ID NO: 18898 - DNA, 18 bp, Homo sapiens
cggacagccccttgaaca

SEQ ID NO: 18899 - DNA, 18 bp, Homo sapiens
tacaaaaacagatggcat

SEQ ID NO: 18900 - DNA, 21 bp, Homo sapiens
tagtcccccaaataagtaata

SEQ ID NO: 18901 - DNA, 24 bp, Homo sapiens
agacagccagagggaaagcgaccc

SEQ ID NO: 18902 - DNA, 23 bp, Homo sapiens
ccaggacattcccctctgttcct

SEQ ID NO: 18903 - DNA, 19 bp, Homo sapiens
cctctgttcctctgttcct

SEQ ID NO: 18904 - DNA, 19 bp, Homo sapiens
ctgcaacctccgcctccca

SEQ ID NO: 18905 - DNA, 21 bp, Homo sapiens
ggacagccctggacccactcc

SEQ ID NO: 18906 - DNA, 15 bp, Homo sapiens
gtctagtctgtgaat

SEQ ID NO: 18907 - DNA, 17 bp, Homo sapiens
tcaagtgattctcctgc

SEQ ID NO: 18908 - DNA, 18 bp, Homo sapiens
tccgcctcccaggttcaa

SEQ ID NO: 18909 - DNA, 19 bp, Homo sapiens
tgtctagtctgtgaatttt

SEQ ID NO: 18910 - DNA, 19 bp, Homo sapiens
gaatttttctgtctttgga

SEQ ID NO: 18911 - DNA, 19 bp, Homo sapiens
aaatcccaacatatatact

SEQ ID NO: 18912 - DNA, 22 bp, Homo sapiens
acaaagatcatatccatgtgta

SEQ ID NO: 18913 - DNA, 18 bp, Homo sapiens
ccttgaataagtctccca

SEQ ID NO: 18914 - DNA, 22 bp, Homo sapiens
cttccattcattgtttacgctg

SEQ ID NO: 18915 - DNA, 23 bp, Homo sapiens
gacccaacttttctagtgtgcca

SEQ ID NO: 18916 - DNA, 26 bp, Homo sapiens
tccacggccactccgcctcttccctc

SEQ ID NO: 18917 - DNA, 19 bp, Homo sapiens
aaatcccaacatatatact

SEQ ID NO: 18918 - DNA, 22 bp, Homo sapiens
acaaagatcatatccatgtgta

SEQ ID NO: 18919 - DNA, 18 bp, Homo sapiens
ccttgaataagtctccca

SEQ ID NO: 18920 - DNA, 22 bp, Homo sapiens
cttccattcattgtttacgctg

SEQ ID NO: 18921 - DNA, 23 bp, Homo sapiens
gacccaacttttctagtgtgcca

SEQ ID NO: 18922 - DNA, 26 bp, Homo sapiens
tccacggccactccgcctcttccctc

SEQ ID NO: 18923 - DNA, 19 bp, Homo sapiens
aaatcccaacatatatact

SEQ ID NO: 18924 - DNA, 22 bp, Homo sapiens
acaaagatcatatccatgtgta

SEQ ID NO: 18925 - DNA, 18 bp, Homo sapiens
ccttgaataagtctccca

SEQ ID NO: 18926 - DNA, 22 bp, Homo sapiens
cttccattcattgtttacgctg

SEQ ID NO: 18927 - DNA, 23 bp, Homo sapiens
gacccaacttttctagtgtgcca

SEQ ID NO: 18928 - DNA, 26 bp, Homo sapiens
tccacggccactccgcctcttccctc

SEQ ID NO: 18929 - DNA, 17 bp, Homo sapiens
caccacaatgactgtct

SEQ ID NO: 18930 - DNA, 17 bp, Homo sapiens
taagctggaacagtcca

SEQ ID NO: 18931 - DNA, 22 bp, Homo sapiens
acccaactgtctcgatgcaatg

SEQ ID NO: 18932 - DNA, 21 bp, Homo sapiens
tctgaaatgaagatgggcttc

SEQ ID NO: 18933 - DNA, 20 bp, Homo sapiens
gcaaatggaggccaacctca

SEQ ID NO: 18934 - DNA, 21 bp, Homo sapiens
ttctgacggcagggctgtgag

SEQ ID NO: 18935 - DNA, 18 bp, Homo sapiens
accctggaccacattcgg

SEQ ID NO: 18936 - DNA, 21 bp, Homo sapiens
ttctgacggcagggctgtgag

SEQ ID NO: 18937 - DNA, 20 bp, Homo sapiens
ttgtttaatgctcagggcag

SEQ ID NO: 18938 - DNA, 20 bp, Homo sapiens
gcaaatggaggccaacctca

SEQ ID NO: 18939 - DNA, 21 bp, Homo sapiens
ttctgacggcagggctgtgag

SEQ ID NO: 18940 - DNA, 18 bp, Homo sapiens
accctggaccacattcgg

SEQ ID NO: 18941 - DNA, 21 bp, Homo sapiens
ttctgacggcagggctgtgag

SEQ ID NO: 18942 - DNA, 20 bp, Homo sapiens
ttgtttaatgctcagggcag

SEQ ID NO: 18943 - DNA, 18 bp, Homo sapiens
accctggaccacattcgg

SEQ ID NO: 18944 - DNA, 21 bp, Homo sapiens
ttctgacggcagggctgtgag

SEQ ID NO: 18945 - DNA, 20 bp, Homo sapiens
ttgtttaatgctcagggcag

SEQ ID NO: 18946 - DNA, 20 bp, Homo sapiens
gcaaatggaggccaacctca

SEQ ID NO: 18947 - DNA, 21 bp, Homo sapiens
ttctgacggcagggctgtgag

SEQ ID NO: 18948 - DNA, 18 bp, Homo sapiens
accctggaccacattcgg

SEQ ID NO: 18949 - DNA, 21 bp, Homo sapiens
ttctgacggcagggctgtgag

SEQ ID NO: 18950 - DNA, 20 bp, Homo sapiens
ttgtttaatgctcagggcag

SEQ ID NO: 18951 - DNA, 18 bp, Homo sapiens
aatttgacttttgttcca

SEQ ID NO: 18952 - DNA, 19 bp, Homo sapiens
aggtcaagtgattctcctg

SEQ ID NO: 18953 - DNA, 18 bp, Homo sapiens
cccccaaatcctgttcca

SEQ ID NO: 18954 - DNA, 20 bp, Homo sapiens
atttctctatttctgtgacg

SEQ ID NO: 18955 - DNA, 19 bp, Homo sapiens
cccccatgcccccacccca

SEQ ID NO: 18956 - DNA, 20 bp, Homo sapiens
tcatgaccctcgtctctgca

SEQ ID NO: 18957 - DNA, 17 bp, Homo sapiens
cgccccccatgctgctg

SEQ ID NO: 18958 - DNA, 22 bp, Homo sapiens
ggactttaagaatgactgagaa

SEQ ID NO: 18959 - DNA, 19 bp, Homo sapiens
tgtcttgagggaggacttt

SEQ ID NO: 18960 - DNA, 20 bp, Homo sapiens
cagagatgacatggagatcc

SEQ ID NO: 18961 - DNA, 19 bp, Homo sapiens
ccacaatttgttcactttt

SEQ ID NO: 18962 - DNA, 19 bp, Homo sapiens
ctctttctctctctctctc

SEQ ID NO: 18963 - DNA, 16 bp, Homo sapiens
accaaaatagagcaga

SEQ ID NO: 18964 - DNA, 23 bp, Homo sapiens
cagaatggacactctacaaccct

SEQ ID NO: 18965 - DNA, 27 bp, Homo sapiens
cctaggaaccttcccacaattgttttt

SEQ ID NO: 18966 - DNA, 23 bp, Homo sapiens
gcttgagccaccgtgccaggcct

SEQ ID NO: 18967 - DNA, 18 bp, Homo sapiens
tctccatcactcattcca

SEQ ID NO: 18968 - DNA, 24 bp, Homo sapiens
tgtaacctctgcctcctggattca

SEQ ID NO: 18969 - DNA, 17 bp, Homo sapiens
ggccgggtacaccagcc

SEQ ID NO: 18970 - DNA, 20 bp, Homo sapiens
cccactctggacccaggaca

SEQ ID NO: 18971 - DNA, 21 bp, Homo sapiens
aggcacttgcctctgcacttt

SEQ ID NO: 18972 - DNA, 22 bp, Homo sapiens
aaaatcagcttgtcttgttcca

SEQ ID NO: 18973 - DNA, 23 bp, Homo sapiens
aggagggagctcgtggcgaggca

SEQ ID NO: 18974 - DNA, 19 bp, Homo sapiens
aggtcgtgcagccagtggc

SEQ ID NO: 18975 - DNA, 21 bp, Homo sapiens
ccattcaccatctctaacatt

SEQ ID NO: 18976 - DNA, 20 bp, Homo sapiens
cgcacattagtgcatacgtg

SEQ ID NO: 18977 - DNA, 20 bp, Homo sapiens
gctgtccttgttctgttttg

SEQ ID NO: 18978 - DNA, 26 bp, Homo sapiens
tcctgaagaaattgggatacttgtgg

SEQ ID NO: 18979 - DNA, 23 bp, Homo sapiens
tctcgaggaggttccttaacctt

SEQ ID NO: 18980 - DNA, 20 bp, Homo sapiens
tctgagtgattttaatttgt

SEQ ID NO: 18981 - DNA, 20 bp, Homo sapiens
tgttttatgtatttctggtg

SEQ ID NO: 18982 - DNA, 17 bp, Homo sapiens
ggcaattactggcctca

SEQ ID NO: 18983 - DNA, 17 bp, Homo sapiens
atattgctgtgtccctc

SEQ ID NO: 18984 - DNA, 18 bp, Homo sapiens
caaggcacaccacagctg

SEQ ID NO: 18985 - DNA, 19 bp, Homo sapiens
cacggtttggatgtgcagc

SEQ ID NO: 18986 - DNA, 21 bp, Homo sapiens
cgaatgacagttgagtatgtc

SEQ ID NO: 18987 - DNA, 24 bp, Homo sapiens
gcttgaactgtttgttcttggtgc

SEQ ID NO: 18988 - DNA, 17 bp, Homo sapiens
ggcttctgagtccattt

SEQ ID NO: 18989 - DNA, 23 bp, Homo sapiens
tctttgacagtttccttggtttt

SEQ ID NO: 18990 - DNA, 19 bp, Homo sapiens
gaaataaaagtttacctca

SEQ ID NO: 18991 - DNA, 24 bp, Homo sapiens
gcctgggtcctaccctgtctggtc

SEQ ID NO: 18992 - DNA, 20 bp, Homo sapiens
tcctgttcggaggtctatgg

SEQ ID NO: 18993 - DNA, 22 bp, Homo sapiens
ttcttaacattgctgcatggta

SEQ ID NO: 18994 - DNA, 24 bp, Homo sapiens
acttgggttaaaacgtttggacct

SEQ ID NO: 18995 - DNA, 18 bp, Homo sapiens
cccttcctcctcctccag

SEQ ID NO: 18996 - DNA, 20 bp, Homo sapiens
caaggatcgggcggaagctg

SEQ ID NO: 18997 - DNA, 18 bp, Homo sapiens
cagcctgcacagcggtgc

SEQ ID NO: 18998 - DNA, 16 bp, Homo sapiens
ccagtgtagcacggaa

SEQ ID NO: 18999 - DNA, 22 bp, Homo sapiens
ccatcctcttccaacccacgcc

SEQ ID NO: 19000 - DNA, 25 bp, Homo sapiens
ccccaaggaaaccaatttccttcta

SEQ ID NO: 19001 - DNA, 19 bp, Homo sapiens
cccggaaaaactgacactg

SEQ ID NO: 19002 - DNA, 19 bp, Homo sapiens
ccgtggcacactcctgtcc

SEQ ID NO: 19003 - DNA, 24 bp, Homo sapiens
cgcagcataccatgtagcccgtgc

SEQ ID NO: 19004 - DNA, 22 bp, Homo sapiens
ctccttagctcccctctcctct

SEQ ID NO: 19005 - DNA, 20 bp, Homo sapiens
gcacacagttgaccggtgtg

SEQ ID NO: 19006 - DNA, 19 bp, Homo sapiens
gctgagggagggccttctc

SEQ ID NO: 19007 - DNA, 18 bp, Homo sapiens
gtaccgtgtaggggagcc

SEQ ID NO: 19008 - DNA, 21 bp, Homo sapiens
tcatttatttccactgtctta

SEQ ID NO: 19009 - DNA, 21 bp, Homo sapiens
tgcctctcagtttctccatct

SEQ ID NO: 19010 - DNA, 21 bp, Homo sapiens
ccccacgaaaccccctaaagc

SEQ ID NO: 19011 - DNA, 15 bp, Homo sapiens
cttcctctattatgc

SEQ ID NO: 19012 - DNA, 19 bp, Homo sapiens
cttgaactaagattggctt

SEQ ID NO: 19013 - DNA, 18 bp, Homo sapiens
gaggataaacaggacaat

SEQ ID NO: 19014 - DNA, 19 bp, Homo sapiens
gccctttgatttaacctga

SEQ ID NO: 19015 - DNA, 22 bp, Homo sapiens
tcacttagaataccaacagtca

SEQ ID NO: 19016 - DNA, 16 bp, Homo sapiens
ttccagaaaatgttcc

SEQ ID NO: 19017 - DNA, 19 bp, Homo sapiens
ttttgtgatgtttatttaa

SEQ ID NO: 19018 - DNA, 20 bp, Homo sapiens
agacttgggacaactgcctg

SEQ ID NO: 19019 - DNA, 21 bp, Homo sapiens
aggacaatgatggctattcta

SEQ ID NO: 19020 - DNA, 24 bp, Homo sapiens
ctctaactctacccacacccacct

SEQ ID NO: 19021 - DNA, 20 bp, Homo sapiens
taggactacttttctagtca

SEQ ID NO: 19022 - DNA, 24 bp, Homo sapiens
tccagactagagcctccttaccta

SEQ ID NO: 19023 - DNA, 21 bp, Homo sapiens
agagatatttttagtatatga

SEQ ID NO: 19024 - DNA, 19 bp, Homo sapiens
ccaaaggagcctgcactgg

SEQ ID NO: 19025 - DNA, 22 bp, Homo sapiens
cctcaatggctgctttgaactt

SEQ ID NO: 19026 - DNA, 24 bp, Homo sapiens
cttttctctacttccaaatcacaa

SEQ ID NO: 19027 - DNA, 19 bp, Homo sapiens
gccaaattaactctctgga

SEQ ID NO: 19028 - DNA, 23 bp, Homo sapiens
ggaaaagagcccctttgatccac

SEQ ID NO: 19029 - DNA, 21 bp, Homo sapiens
ttccaaatcacaatttcttac

SEQ ID NO: 19030 - DNA, 22 bp, Homo sapiens
aacgtagtcatatcatcgcgct

SEQ ID NO: 19031 - DNA, 22 bp, Homo sapiens
cgagagtgaaactccgtcccca

SEQ ID NO: 19032 - DNA, 22 bp, Homo sapiens
ccaccctctccctggtgtggcc

SEQ ID NO: 19033 - DNA, 19 bp, Homo sapiens
ctgggctgtgtgtggcgcc

SEQ ID NO: 19034 - DNA, 18 bp, Homo sapiens
gccaggcctacccaggga

SEQ ID NO: 19035 - DNA, 17 bp, Homo sapiens
gcccctccctccctgtc

SEQ ID NO: 19036 - DNA, 24 bp, Homo sapiens
gttcctccggggccaccttcctca

SEQ ID NO: 19037 - DNA, 23 bp, Homo sapiens
tggcctctctgaccgtgaggctg

SEQ ID NO: 19038 - DNA, 22 bp, Homo sapiens
caccaccaccaccacctacttc

SEQ ID NO: 19039 - DNA, 20 bp, Homo sapiens
cagcagcagcagcaccacca

SEQ ID NO: 19040 - DNA, 21 bp, Homo sapiens
cccctcaagagttctcaccag

SEQ ID NO: 19041 - DNA, 17 bp, Homo sapiens
ttcagcaacacctgtta

SEQ ID NO: 19042 - DNA, 19 bp, Homo sapiens
agaacatttactggcccca

SEQ ID NO: 19043 - DNA, 21 bp, Homo sapiens
cttcctgtcacccgcctggca

SEQ ID NO: 19044 - DNA, 19 bp, Homo sapiens
tactggccccaactgtggc

SEQ ID NO: 19045 - DNA, 20 bp, Homo sapiens
tcacaaacatgtatatgcca

SEQ ID NO: 19046 - DNA, 19 bp, Homo sapiens
tggaaaatgcatttaaata

SEQ ID NO: 19047 - DNA, 21 bp, Homo sapiens
tttcagttggcagaacattta

SEQ ID NO: 19048 - DNA, 20 bp, Homo sapiens
tccagaaaaagggtgtccag

SEQ ID NO: 19049 - DNA, 17 bp, Homo sapiens
aacaggcggagcctggc

SEQ ID NO: 19050 - DNA, 19 bp, Homo sapiens
agcctttgaggtggtcaga

SEQ ID NO: 19051 - DNA, 25 bp, Homo sapiens
cctcagctgtccagccctgctgcct

SEQ ID NO: 19052 - DNA, 19 bp, Homo sapiens
gactctgtccccttgagct

SEQ ID NO: 19053 - DNA, 23 bp, Homo sapiens
gcagaggagggaactgctccttc

SEQ ID NO: 19054 - DNA, 16 bp, Homo sapiens
gttcagtcctgtgaac

SEQ ID NO: 19055 - DNA, 19 bp, Homo sapiens
tcattaggctcctgctgtc

SEQ ID NO: 19056 - DNA, 23 bp, Homo sapiens
tggatggggccaaggtggagctg

SEQ ID NO: 19057 - DNA, 23 bp, Homo sapiens
tggctctgtccaaagtgagattg

SEQ ID NO: 19058 - DNA, 19 bp, Homo sapiens
tttaagccccatgttgtac

SEQ ID NO: 19059 - DNA, 17 bp, Homo sapiens
ccttcctcccctttctc

SEQ ID NO: 19060 - DNA, 25 bp, Homo sapiens
aaaaccaaatggatcttgttccgca

SEQ ID NO: 19061 - DNA, 19 bp, Homo sapiens
aagcaattctcccacctca

SEQ ID NO: 19062 - DNA, 26 bp, Homo sapiens
ccacagacgctcagccaatgcttgaa

SEQ ID NO: 19063 - DNA, 17 bp, Homo sapiens
cccacgcagcccctgtt

SEQ ID NO: 19064 - DNA, 22 bp, Homo sapiens
ccttggcgctcagatttgagag

SEQ ID NO: 19065 - DNA, 18 bp, Homo sapiens
gcagcccctgttctgctg

SEQ ID NO: 19066 - DNA, 17 bp, Homo sapiens
gtgacaaattctagcaa

SEQ ID NO: 19067 - DNA, 18 bp, Homo sapiens
tctggtgggacccgtgaa

SEQ ID NO: 19068 - DNA, 18 bp, Homo sapiens
catcaaatccctatctca

SEQ ID NO: 19069 - DNA, 20 bp, Homo sapiens
ctaggtccttagttattttt

SEQ ID NO: 19070 - DNA, 16 bp, Homo sapiens
ctgcctactaacatca

SEQ ID NO: 19071 - DNA, 18 bp, Homo sapiens
tgaatgcagacttcattt

SEQ ID NO: 19072 - DNA, 17 bp, Homo sapiens
tgctgttttatttgtgg

SEQ ID NO: 19073 - DNA, 23 bp, Homo sapiens
ttttttccatgctgttttaactt

SEQ ID NO: 19074 - DNA, 21 bp, Homo sapiens
agagcaaattggccatggcca

SEQ ID NO: 19075 - DNA, 18 bp, Homo sapiens
tgaaatcctttttacctc

SEQ ID NO: 19076 - DNA, 20 bp, Homo sapiens
agaaataacagtgctgtttt

SEQ ID NO: 19077 - DNA, 19 bp, Homo sapiens
catgagtattcattatctc

SEQ ID NO: 19078 - DNA, 20 bp, Homo sapiens
gccccctcctttcttgctgc

SEQ ID NO: 19079 - DNA, 18 bp, Homo sapiens
gcccctacccccacctcc

SEQ ID NO: 19080 - DNA, 16 bp, Homo sapiens
ggacagccccgtcccc

SEQ ID NO: 19081 - DNA, 18 bp, Homo sapiens
ttctgtacatagttccca

SEQ ID NO: 19082 - DNA, 19 bp, Homo sapiens
ttgagtgacattgacctca

SEQ ID NO: 19083 - DNA, 19 bp, Homo sapiens
acaggccagaaaccagcag

SEQ ID NO: 19084 - DNA, 20 bp, Homo sapiens
agcagccacaggagatgtca

SEQ ID NO: 19085 - DNA, 20 bp, Homo sapiens
agtgtccagtgcccatctct

SEQ ID NO: 19086 - DNA, 20 bp, Homo sapiens
atggcaatgcattctcaagc

SEQ ID NO: 19087 - DNA, 21 bp, Homo sapiens
caggacccgccccaccctgcg

SEQ ID NO: 19088 - DNA, 20 bp, Homo sapiens
caggtccccaaatgatctta

SEQ ID NO: 19089 - DNA, 20 bp, Homo sapiens
cccgccccaccctgcggttc

SEQ ID NO: 19090 - DNA, 20 bp, Homo sapiens
gaggaggctctgcatgtcca

SEQ ID NO: 19091 - DNA, 21 bp, Homo sapiens
gcagcaaagctgtatctgcta

SEQ ID NO: 19092 - DNA, 19 bp, Homo sapiens
gctgcagtgtggttttgtt

SEQ ID NO: 19093 - DNA, 20 bp, Homo sapiens
gctgtctccccagcgtgtcc

SEQ ID NO: 19094 - DNA, 23 bp, Homo sapiens
tcccgtggctcggattctctgag

SEQ ID NO: 19095 - DNA, 24 bp, Homo sapiens
tgagctgtgggcggggcctagtca

SEQ ID NO: 19096 - DNA, 24 bp, Homo sapiens
tgagctgtgggcggggcctagtca

SEQ ID NO: 19097 - DNA, 24 bp, Homo sapiens
tgagctgtgggcggggcctagtca

SEQ ID NO: 19098 - DNA, 21 bp, Homo sapiens
tgagtgacctgactgagacta

SEQ ID NO: 19099 - DNA, 17 bp, Homo sapiens
tgtggatggggcctagc

SEQ ID NO: 19100 - DNA, 17 bp, Homo sapiens
aatggtaccttgtctga

SEQ ID NO: 19101 - DNA, 18 bp, Homo sapiens
gcaattttgtaatttcag

SEQ ID NO: 19102 - DNA, 21 bp, Homo sapiens
taggtgggcttttagaaacta

SEQ ID NO: 19103 - DNA, 19 bp, Homo sapiens
tcgatgtgacttttttcag

SEQ ID NO: 19104 - DNA, 26 bp, Homo sapiens
cttataaaggtcccaggatcactttt

SEQ ID NO: 19105 - DNA, 21 bp, Homo sapiens
cagggttccctgggcccagtc

SEQ ID NO: 19106 - DNA, 26 bp, Homo sapiens
cctggtctggtctcagaatcactttt

SEQ ID NO: 19107 - DNA, 23 bp, Homo sapiens
gctctgggagtgtgaaactggga

SEQ ID NO: 19108 - DNA, 17 bp, Homo sapiens
ggcctgtttggctccga

SEQ ID NO: 19109 - DNA, 16 bp, Homo sapiens
actaatttttgccttg

SEQ ID NO: 19110 - DNA, 20 bp, Homo sapiens
ccagacccactcctgcctcc

SEQ ID NO: 19111 - DNA, 18 bp, Homo sapiens
tccgcctcccgggttcaa

SEQ ID NO: 19112 - DNA, 18 bp, Homo sapiens
tgctatttcaaagcaata

SEQ ID NO: 19113 - DNA, 21 bp, Homo sapiens
tggttttcctgtttgtccctc

SEQ ID NO: 19114 - DNA, 20 bp, Homo sapiens
tgttttccctttctacattt

SEQ ID NO: 19115 - DNA, 22 bp, Homo sapiens
agcgagagaggcaccttgttct

SEQ ID NO: 19116 - DNA, 20 bp, Homo sapiens
cccttcccttccagcccaca

SEQ ID NO: 19117 - DNA, 20 bp, Homo sapiens
ttcaagaccagcctgaccaa

SEQ ID NO: 19118 - DNA, 20 bp, Homo sapiens
atggcgaaaccccatcgcta

SEQ ID NO: 19119 - DNA, 23 bp, Homo sapiens
tgtctctcccattctccgagctt

SEQ ID NO: 19120 - DNA, 20 bp, Homo sapiens
ttcaagaccagcctgaccaa

SEQ ID NO: 19121 - DNA, 22 bp, Homo sapiens
gagccaagatcacgccactgca

SEQ ID NO: 19122 - DNA, 19 bp, Homo sapiens
tccacctggaccgtggcca

SEQ ID NO: 19123 - DNA, 21 bp, Homo sapiens
cgcctgcccccatcccctcca

SEQ ID NO: 19124 - DNA, 18 bp, Homo sapiens
cttctctgcccacctgct

SEQ ID NO: 19125 - DNA, 20 bp, Homo sapiens
tgtcctcagaactagacatc

SEQ ID NO: 19126 - DNA, 21 bp, Homo sapiens
ctcaaccaatttggcacccca

SEQ ID NO: 19127 - DNA, 19 bp, Homo sapiens
ttcaggtggtcttctacca

SEQ ID NO: 19128 - DNA, 21 bp, Homo sapiens
agcatccaccagattctatgg

SEQ ID NO: 19129 - DNA, 18 bp, Homo sapiens
atctggcatttctggctc

SEQ ID NO: 19130 - DNA, 21 bp, Homo sapiens
cactcaatcctaagctcctca

SEQ ID NO: 19131 - DNA, 21 bp, Homo sapiens
cctccaagagcctcattttca

SEQ ID NO: 19132 - DNA, 20 bp, Homo sapiens
cctctgcctcccgggttcaa

SEQ ID NO: 19133 - DNA, 20 bp, Homo sapiens
cggatctcagctggatccct

SEQ ID NO: 19134 - DNA, 23 bp, Homo sapiens
ggactgtcccctcgcttgctcca

SEQ ID NO: 19135 - DNA, 23 bp, Homo sapiens
ggtaggtggggaggggccacgcg

SEQ ID NO: 19136 - DNA, 18 bp, Homo sapiens
gtagatggagaagttgtt

SEQ ID NO: 19137 - DNA, 17 bp, Homo sapiens
tcaagtgattctcctgc

SEQ ID NO: 19138 - DNA, 19 bp, Homo sapiens
tggcctcggggtgggattg

SEQ ID NO: 19139 - DNA, 19 bp, Homo sapiens
tcaaacagagttgcaatca

SEQ ID NO: 19140 - DNA, 27 bp, Homo sapiens
cctaagactcttttcaggttcattttt

SEQ ID NO: 19141 - DNA, 16 bp, Homo sapiens
ctatatctacatatgc

SEQ ID NO: 19142 - DNA, 24 bp, Homo sapiens
tcatttaattcaaatgccaaatag

SEQ ID NO: 19143 - DNA, 19 bp, Homo sapiens
aggcaattctcccacctca

SEQ ID NO: 19144 - DNA, 18 bp, Homo sapiens
gatttcactttcatgaca

SEQ ID NO: 19145 - DNA, 22 bp, Homo sapiens
tgtaattgtgactcatgtgtca

SEQ ID NO: 19146 - DNA, 20 bp, Homo sapiens
gactcaacaacaatatcaca

SEQ ID NO: 19147 - DNA, 21 bp, Homo sapiens
tggagtcacagtattcttgga

SEQ ID NO: 19148 - DNA, 21 bp, Homo sapiens
acaaggaatcagattccccgt

SEQ ID NO: 19149 - DNA, 18 bp, Homo sapiens
atcttagagaactataca

SEQ ID NO: 19150 - DNA, 22 bp, Homo sapiens
tgagtaatcttgtaagcattaa

SEQ ID NO: 19151 - DNA, 19 bp, Homo sapiens
atttgagtgaatggcagga

SEQ ID NO: 19152 - DNA, 22 bp, Homo sapiens
ctattattaaaagcagcacaga

SEQ ID NO: 19153 - DNA, 22 bp, Homo sapiens
ccaaacagggattcagaaacca

SEQ ID NO: 19154 - DNA, 17 bp, Homo sapiens
ctggctgcacccgccca

SEQ ID NO: 19155 - DNA, 22 bp, Homo sapiens
gagggaactttggggattgcca

SEQ ID NO: 19156 - DNA, 21 bp, Homo sapiens
aggtacagctgggcccagcca

SEQ ID NO: 19157 - DNA, 19 bp, Homo sapiens
tcaacaacaccagcctgac

SEQ ID NO: 19158 - DNA, 19 bp, Homo sapiens
tgcccagatgtatacccag

SEQ ID NO: 19159 - DNA, 15 bp, Homo sapiens
tggaatttctcttca

SEQ ID NO: 19160 - DNA, 18 bp, Homo sapiens
ttgttggtcaaagtattg

SEQ ID NO: 19161 - DNA, 18 bp, Homo sapiens
tcctcagcactcattcta

SEQ ID NO: 19162 - DNA, 23 bp, Homo sapiens
agtccctcatccagaagatgcca

SEQ ID NO: 19163 - DNA, 21 bp, Homo sapiens
atcagaaaaatttgaacacag

SEQ ID NO: 19164 - DNA, 21 bp, Homo sapiens
catgtgcttggcactcaagga

SEQ ID NO: 19165 - DNA, 21 bp, Homo sapiens
actggggagaaatactatgaa

SEQ ID NO: 19166 - DNA, 24 bp, Homo sapiens
agtgattctcctgcctcaccctca

SEQ ID NO: 19167 - DNA, 23 bp, Homo sapiens
atttcatattgctcaaacacaca

SEQ ID NO: 19168 - DNA, 24 bp, Homo sapiens
attttgtttatggccagtttctca

SEQ ID NO: 19169 - DNA, 22 bp, Homo sapiens
catagccatcacgagcatgtca

SEQ ID NO: 19170 - DNA, 23 bp, Homo sapiens
ccacactttgaggattctcttca

SEQ ID NO: 19171 - DNA, 17 bp, Homo sapiens
ccagatttcatattgct

SEQ ID NO: 19172 - DNA, 20 bp, Homo sapiens
ctagtgagagctctcttcct

SEQ ID NO: 19173 - DNA, 23 bp, Homo sapiens
cttgagcagttttccagttttct

SEQ ID NO: 19174 - DNA, 21 bp, Homo sapiens
ggccaggtgttgcttgccctc

SEQ ID NO: 19175 - DNA, 18 bp, Homo sapiens
ggggagaaatactatgaa

SEQ ID NO: 19176 - DNA, 20 bp, Homo sapiens
tcaccgcaacctccacctcc

SEQ ID NO: 19177 - DNA, 21 bp, Homo sapiens
tccaaggttctcttctgttcc

SEQ ID NO: 19178 - DNA, 21 bp, Homo sapiens
tcctaccagagagaaaccttt

SEQ ID NO: 19179 - DNA, 22 bp, Homo sapiens
tctaccttccgtaaaatgctag

SEQ ID NO: 19180 - DNA, 18 bp, Homo sapiens
ggaggcggcggcggcggc

SEQ ID NO: 19181 - DNA, 17 bp, Homo sapiens
gggcattataacgagat

SEQ ID NO: 19182 - DNA, 15 bp, Homo sapiens
tgggcccgggagttt

SEQ ID NO: 19183 - DNA, 18 bp, Homo sapiens
acgcctccattgctgctt

SEQ ID NO: 19184 - DNA, 24 bp, Homo sapiens
caggatttccgtttgggtctagtt

SEQ ID NO: 19185 - DNA, 18 bp, Homo sapiens
cctcatgaaaagcagtcc

SEQ ID NO: 19186 - DNA, 19 bp, Homo sapiens
ggacggccggcccgccccc

SEQ ID NO: 19187 - DNA, 16 bp, Homo sapiens
aacatcaaattctgaa

SEQ ID NO: 19188 - DNA, 19 bp, Homo sapiens
aagtgatgtttctggctta

SEQ ID NO: 19189 - DNA, 22 bp, Homo sapiens
acagaatatttgaatctttgta

SEQ ID NO: 19190 - DNA, 18 bp, Homo sapiens
acttaattttggatttaa

SEQ ID NO: 19191 - DNA, 18 bp, Homo sapiens
cagaaacatcaaattctg

SEQ ID NO: 19192 - DNA, 17 bp, Homo sapiens
gttcagaaaacataatc

SEQ ID NO: 19193 - DNA, 18 bp, Homo sapiens
acctcagtgctgcactca

SEQ ID NO: 19194 - DNA, 18 bp, Homo sapiens
actactatttgtcacctc

SEQ ID NO: 19195 - DNA, 20 bp, Homo sapiens
agaggcagagtttgcttgcc

SEQ ID NO: 19196 - DNA, 20 bp, Homo sapiens
aggaaggtggaaaaccaaga

SEQ ID NO: 19197 - DNA, 16 bp, Homo sapiens
agggcactttgcagct

SEQ ID NO: 19198 - DNA, 25 bp, Homo sapiens
cctttcttattataagctgttccag

SEQ ID NO: 19199 - DNA, 19 bp, Homo sapiens
ctttgggagcagggcctgc

SEQ ID NO: 19200 - DNA, 23 bp, Homo sapiens
gatgtctgtgatgacagtggcca

SEQ ID NO: 19201 - DNA, 23 bp, Homo sapiens
gcaagaagatcccagtgcttgcc

SEQ ID NO: 19202 - DNA, 31 bp, Homo sapiens
gcctgggtttgaaaaattccaacttattttt

SEQ ID NO: 19203 - DNA, 19 bp, Homo sapiens
gccttctgagcctcacatc

SEQ ID NO: 19204 - DNA, 18 bp, Homo sapiens
aactgtcaggtcaaaata

SEQ ID NO: 19205 - DNA, 22 bp, Homo sapiens
tctttttcaatgaagctttgca

SEQ ID NO: 19206 - DNA, 23 bp, Homo sapiens
ttgtactttttttatatacttca

SEQ ID NO: 19207 - DNA, 18 bp, Homo sapiens
actcacaatttgtgctca

SEQ ID NO: 19208 - DNA, 19 bp, Homo sapiens
catcacagtattctgtgat

SEQ ID NO: 19209 - DNA, 19 bp, Homo sapiens
ttctgtgatgtctttttaa

SEQ ID NO: 19210 - DNA, 21 bp, Homo sapiens
tcagtctttgcatgctgctca

SEQ ID NO: 19211 - DNA, 23 bp, Homo sapiens
tcataggccccacctccacgtcc

SEQ ID NO: 19212 - DNA, 24 bp, Homo sapiens
acttggcaagggaccccctggttc

SEQ ID NO: 19213 - DNA, 18 bp, Homo sapiens
ccaacaaggcaagccaaa

SEQ ID NO: 19214 - DNA, 21 bp, Homo sapiens
gactttggcttttgtaaatca

SEQ ID NO: 19215 - DNA, 23 bp, Homo sapiens
taagattgctctaaggcccagca

SEQ ID NO: 19216 - DNA, 16 bp, Homo sapiens
tctgccttgagactgc

SEQ ID NO: 19217 - DNA, 23 bp, Homo sapiens
tttagttgactttttagttatag

SEQ ID NO: 19218 - DNA, 20 bp, Homo sapiens
gccctcagggccagccagga

SEQ ID NO: 19219 - DNA, 18 bp, Homo sapiens
gaaaacatcagggagatg

SEQ ID NO: 19220 - DNA, 19 bp, Homo sapiens
gagcagagaatctacatta

SEQ ID NO: 19221 - DNA, 18 bp, Homo sapiens
actccagcacggggtgaa

SEQ ID NO: 19222 - DNA, 19 bp, Homo sapiens
caaccctcggctctctcct

SEQ ID NO: 19223 - DNA, 21 bp, Homo sapiens
cagacagaaaccgaaagctct

SEQ ID NO: 19224 - DNA, 21 bp, Homo sapiens
ctcatcttttcttcttacaca

SEQ ID NO: 19225 - DNA, 22 bp, Homo sapiens
tctattaataatggtagtatta

SEQ ID NO: 19226 - DNA, 21 bp, Homo sapiens
agtctggtctcctgtgtttca

SEQ ID NO: 19227 - DNA, 22 bp, Homo sapiens
atcttggctcactgcaatctct

SEQ ID NO: 19228 - DNA, 19 bp, Homo sapiens
catcatcattcatgttttt

SEQ ID NO: 19229 - DNA, 20 bp, Homo sapiens
cattgtttacaggtgtgaaa

SEQ ID NO: 19230 - DNA, 23 bp, Homo sapiens
cctgggtaatttttttttttttt

SEQ ID NO: 19231 - DNA, 20 bp, Homo sapiens
tcaagactctgaaatatgta

SEQ ID NO: 19232 - DNA, 20 bp, Homo sapiens
tctctgcctctcgggttcaa

SEQ ID NO: 19233 - DNA, 16 bp, Homo sapiens
tgtgaagcaaaggtca

SEQ ID NO: 19234 - DNA, 17 bp, Homo sapiens
acacctgggaattatga

SEQ ID NO: 19235 - DNA, 19 bp, Homo sapiens
gatagtagatatgagacta

SEQ ID NO: 19236 - DNA, 18 bp, Homo sapiens
ggcttacactaagctttt

SEQ ID NO: 19237 - DNA, 22 bp, Homo sapiens
tgattgcaccactgcactctaa

SEQ ID NO: 19238 - DNA, 19 bp, Homo sapiens
tggtgaaaccccatctcca

SEQ ID NO: 19239 - DNA, 23 bp, Homo sapiens
agagcatcttccaagactccagc

SEQ ID NO: 19240 - DNA, 23 bp, Homo sapiens
ttgtggtggggtatcttcagtta

SEQ ID NO: 19241 - DNA, 24 bp, Homo sapiens
atcatagaaggtgagaatgtgttt

SEQ ID NO: 19242 - DNA, 21 bp, Homo sapiens
gtggattatgaacaaatgaaa

SEQ ID NO: 19243 - DNA, 23 bp, Homo sapiens
ctttgagtgctgggtacctgtgg

SEQ ID NO: 19244 - DNA, 22 bp, Homo sapiens
tggccccctctgacataaactg

SEQ ID NO: 19245 - DNA, 21 bp, Homo sapiens
tccactggctgaatgatcagg

SEQ ID NO: 19246 - DNA, 18 bp, Homo sapiens
tgagtctcagcagccgcc

SEQ ID NO: 19247 - DNA, 21 bp, Homo sapiens
cgtttccatggtaaccctgag

SEQ ID NO: 19248 - DNA, 25 bp, Homo sapiens
caggattaggaatttgggtttgtca

SEQ ID NO: 19249 - DNA, 20 bp, Homo sapiens
cttctatcccagattaccta

SEQ ID NO: 19250 - DNA, 22 bp, Homo sapiens
tccagtccttccatgcccttct

SEQ ID NO: 19251 - DNA, 22 bp, Homo sapiens
catggagttgtccagtgactca

SEQ ID NO: 19252 - DNA, 19 bp, Homo sapiens
ctctccttgcctccctgat

SEQ ID NO: 19253 - DNA, 18 bp, Homo sapiens
ctgtataaagacagtaga

SEQ ID NO: 19254 - DNA, 21 bp, Homo sapiens
cttaagcatgaagtgactttt

SEQ ID NO: 19255 - DNA, 18 bp, Homo sapiens
gccgaccacagtataaga

SEQ ID NO: 19256 - DNA, 15 bp, Homo sapiens
ggagcagatcttgtg

SEQ ID NO: 19257 - DNA, 18 bp, Homo sapiens
gagcaacagaagctatta

SEQ ID NO: 19258 - DNA, 17 bp, Homo sapiens
gccccccagccaggata

SEQ ID NO: 19259 - DNA, 20 bp, Homo sapiens
agctttctggtcaaatctca

SEQ ID NO: 19260 - DNA, 20 bp, Homo sapiens
acagcaagcagcatgcagca

SEQ ID NO: 19261 - DNA, 23 bp, Homo sapiens
ctctgttaaggaagcttcatttt

SEQ ID NO: 19262 - DNA, 21 bp, Homo sapiens
ctctttctctctctctcctca

SEQ ID NO: 19263 - DNA, 24 bp, Homo sapiens
gcagcaggcttaggatttttgtca

SEQ ID NO: 19264 - DNA, 20 bp, Homo sapiens
gcccctcttcccctacccct

SEQ ID NO: 19265 - DNA, 21 bp, Homo sapiens
ggttctgaagccacagactca

SEQ ID NO: 19266 - DNA, 17 bp, Homo sapiens
gtgggcacagctcccca

SEQ ID NO: 19267 - DNA, 21 bp, Homo sapiens
catctgtcactttatgtagat

SEQ ID NO: 19268 - DNA, 22 bp, Homo sapiens
cctcatcactctgactctgcct

SEQ ID NO: 19269 - DNA, 19 bp, Homo sapiens
ctgcatccaagtcaactca

SEQ ID NO: 19270 - DNA, 20 bp, Homo sapiens
ggtaagtggggggattctcg

SEQ ID NO: 19271 - DNA, 21 bp, Homo sapiens
tccagttgtcaccctgcccag

SEQ ID NO: 19272 - DNA, 24 bp, Homo sapiens
tcccccaggtttctgatgccatca

SEQ ID NO: 19273 - DNA, 20 bp, Homo sapiens
gataaaaaccccttgctatt

SEQ ID NO: 19274 - DNA, 19 bp, Homo sapiens
tcacttgtgccaggcatac

SEQ ID NO: 19275 - DNA, 18 bp, Homo sapiens
aggaaactgaaagcccca

SEQ ID NO: 19276 - DNA, 22 bp, Homo sapiens
cctctgggaagcctagttccca

SEQ ID NO: 19277 - DNA, 20 bp, Homo sapiens
tgggaagcctagttcccaca

SEQ ID NO: 19278 - DNA, 20 bp, Homo sapiens
acaggggaaaaggaattagt

SEQ ID NO: 19279 - DNA, 18 bp, Homo sapiens
agagcaagtaacatatta

SEQ ID NO: 19280 - DNA, 16 bp, Homo sapiens
attataacattcttcc

SEQ ID NO: 19281 - DNA, 21 bp, Homo sapiens
cccccgccccagcctaccttc

SEQ ID NO: 19282 - DNA, 19 bp, Homo sapiens
tgtttttctcccttttcca

SEQ ID NO: 19283 - DNA, 20 bp, Homo sapiens
acctaagccatcatcaacca

SEQ ID NO: 19284 - DNA, 21 bp, Homo sapiens
ctctttctcttggtcaactca

SEQ ID NO: 19285 - DNA, 21 bp, Homo sapiens
tgcaggggtggtcctttggtg

SEQ ID NO: 19286 - DNA, 21 bp, Homo sapiens
tggcggttctttcctatctca

SEQ ID NO: 19287 - DNA, 19 bp, Homo sapiens
ccagacccccggggaccca

SEQ ID NO: 19288 - DNA, 21 bp, Homo sapiens
gctacttgttttctcacttga

SEQ ID NO: 19289 - DNA, 19 bp, Homo sapiens
gggttgagctctgtgcagt

SEQ ID NO: 19290 - DNA, 17 bp, Homo sapiens
ttgtaccaattttagtc

SEQ ID NO: 19291 - DNA, 20 bp, Homo sapiens
tgccatcctaggcatcattc

SEQ ID NO: 19292 - DNA, 24 bp, Homo sapiens
atgccacttttgcctcctgccctg

SEQ ID NO: 19293 - DNA, 19 bp, Homo sapiens
cgaccttgaactgtgctca

SEQ ID NO: 19294 - DNA, 20 bp, Homo sapiens
gttgatgggtttctgtgaaa

SEQ ID NO: 19295 - DNA, 22 bp, Homo sapiens
agagcattgtagtcagcagtaa

SEQ ID NO: 19296 - DNA, 21 bp, Homo sapiens
agccaagattgcgccactgca

SEQ ID NO: 19297 - DNA, 23 bp, Homo sapiens
ccatgggggtcccatttgtgacc

SEQ ID NO: 19298 - DNA, 18 bp, Homo sapiens
actgtcgctgatgtgata

SEQ ID NO: 19299 - DNA, 20 bp, Homo sapiens
ctcctcattgtgtgaccagg

SEQ ID NO: 19300 - DNA, 21 bp, Homo sapiens
tcgtgcactgctcgagacaca

SEQ ID NO: 19301 - DNA, 23 bp, Homo sapiens
tgcgcgtatgtgcgcacatatgt

SEQ ID NO: 19302 - DNA, 17 bp, Homo sapiens
ccatgaaattccagtga

SEQ ID NO: 19303 - DNA, 18 bp, Homo sapiens
cccacggtctccatctca

SEQ ID NO: 19304 - DNA, 22 bp, Homo sapiens
tgcactcgagtaattagcaaag

SEQ ID NO: 19305 - DNA, 22 bp, Homo sapiens
aacaaaaagatgctctgtgtaa

SEQ ID NO: 19306 - DNA, 22 bp, Homo sapiens
agttatatcctttggctcagct

SEQ ID NO: 19307 - DNA, 22 bp, Homo sapiens
atggcaccttttaactaaccca

SEQ ID NO: 19308 - DNA, 19 bp, Homo sapiens
ccaaaacaataatcaaaga

SEQ ID NO: 19309 - DNA, 22 bp, Homo sapiens
cccttccccactcttcagcccc

SEQ ID NO: 19310 - DNA, 18 bp, Homo sapiens
gctgtattatagccttat

SEQ ID NO: 19311 - DNA, 20 bp, Homo sapiens
aaaccaattcacccagctgg

SEQ ID NO: 19312 - DNA, 21 bp, Homo sapiens
accaattcacccagctgggca

SEQ ID NO: 19313 - DNA, 23 bp, Homo sapiens
ccttttagtactgttttgagttt

SEQ ID NO: 19314 - DNA, 23 bp, Homo sapiens
ctagagggactgacttttgtcca

SEQ ID NO: 19315 - DNA, 20 bp, Homo sapiens
acttttctggccctactgca

SEQ ID NO: 19316 - DNA, 20 bp, Homo sapiens
gcatctcagcctcctaccca

SEQ ID NO: 19317 - DNA, 24 bp, Homo sapiens
agctcctggctgttcctcacctga

SEQ ID NO: 19318 - DNA, 17 bp, Homo sapiens
tgacatctccttccttc

SEQ ID NO: 19319 - DNA, 19 bp, Homo sapiens
acatgtgtctgtctggcct

SEQ ID NO: 19320 - DNA, 19 bp, Homo sapiens
attttttattctattgata

SEQ ID NO: 19321 - DNA, 18 bp, Homo sapiens
cttgccatctgtcagtgt

SEQ ID NO: 19322 - DNA, 15 bp, Homo sapiens
gtcagatccttgcca

SEQ ID NO: 19323 - DNA, 16 bp, Homo sapiens
tctgttgattgccaac

SEQ ID NO: 19324 - DNA, 15 bp, Homo sapiens
tgaggaaatgggcaa

SEQ ID NO: 19325 - DNA, 19 bp, Homo sapiens
aatcaaaaggagaataata

SEQ ID NO: 19326 - DNA, 21 bp, Homo sapiens
acaaaaacattttcttcttct

SEQ ID NO: 19327 - DNA, 16 bp, Homo sapiens
attgaatctgctctca

SEQ ID NO: 19328 - DNA, 24 bp, Homo sapiens
ctctcattgatgtgctggtttatg

SEQ ID NO: 19329 - DNA, 25 bp, Homo sapiens
tccaactatcaatagtcaggttcaa

SEQ ID NO: 19330 - DNA, 23 bp, Homo sapiens
cctggagggcctggatttctttt

SEQ ID NO: 19331 - DNA, 23 bp, Homo sapiens
cgtgtgggcttcagtgtgaggct

SEQ ID NO: 19332 - DNA, 18 bp, Homo sapiens
tattacctttttctggtt

SEQ ID NO: 19333 - DNA, 21 bp, Homo sapiens
atgtgactttgtagatattcc

SEQ ID NO: 19334 - DNA, 17 bp, Homo sapiens
cccccaaccacccacca

SEQ ID NO: 19335 - DNA, 17 bp, Homo sapiens
gtagcaggcagttccca

SEQ ID NO: 19336 - DNA, 20 bp, Homo sapiens
tactgacaccccactggcta

SEQ ID NO: 19337 - DNA, 17 bp, Homo sapiens
tcttcaccactgatctc

SEQ ID NO: 19338 - DNA, 22 bp, Homo sapiens
tttcttcattcagcttagcctt

SEQ ID NO: 19339 - DNA, 26 bp, Homo sapiens
ttttaaggagaaaaaaaaatgagtaa

SEQ ID NO: 19340 - DNA, 18 bp, Homo sapiens
acctatttcactgcctca

SEQ ID NO: 19341 - DNA, 19 bp, Homo sapiens
gcgtacaccagacccttca

SEQ ID NO: 19342 - DNA, 18 bp, Homo sapiens
ggtaatagaaccacattg

SEQ ID NO: 19343 - DNA, 21 bp, Homo sapiens
cagccctccacctctcgggga

SEQ ID NO: 19344 - DNA, 21 bp, Homo sapiens
ccaagcagaaaccggacctca

SEQ ID NO: 19345 - DNA, 18 bp, Homo sapiens
cctcctcctcttcctcag

SEQ ID NO: 19346 - DNA, 22 bp, Homo sapiens
ctcttaactgtacgtgtagttt

SEQ ID NO: 19347 - DNA, 18 bp, Homo sapiens
gcccagaggatgatccag

SEQ ID NO: 19348 - DNA, 18 bp, Homo sapiens
gcccagaggatgatccag

SEQ ID NO: 19349 - DNA, 26 bp, Homo sapiens
gcctgagccagggcttggcttggcct

SEQ ID NO: 19350 - DNA, 18 bp, Homo sapiens
tcattaaaatgatgacat

SEQ ID NO: 19351 - DNA, 20 bp, Homo sapiens
tccactgcgagttgaccaat

SEQ ID NO: 19352 - DNA, 21 bp, Homo sapiens
tgaaggtgagggttcagagta

SEQ ID NO: 19353 - DNA, 20 bp, Homo sapiens
tgcctgccgaccagcggaga

SEQ ID NO: 19354 - DNA, 23 bp, Homo sapiens
tgctcccagaggccgggcaactg

SEQ ID NO: 19355 - DNA, 18 bp, Homo sapiens
ggcttctgctctcattca

SEQ ID NO: 19356 - DNA, 20 bp, Homo sapiens
tgcacagttctacactgtca

SEQ ID NO: 19357 - DNA, 19 bp, Homo sapiens
agatgggtgctggtcctca

SEQ ID NO: 19358 - DNA, 18 bp, Homo sapiens
cagctacgctctgtgaca

SEQ ID NO: 19359 - DNA, 19 bp, Homo sapiens
cagtaacatcaagtgctca

SEQ ID NO: 19360 - DNA, 24 bp, Homo sapiens
ccttgggctgagaggacctgggaa

SEQ ID NO: 19361 - DNA, 23 bp, Homo sapiens
tgagaggacctgggaagcccctc

SEQ ID NO: 19362 - DNA, 20 bp, Homo sapiens
atccctaggaattgcctatc

SEQ ID NO: 19363 - DNA, 19 bp, Homo sapiens
tatctaaaatattaccatt

SEQ ID NO: 19364 - DNA, 18 bp, Homo sapiens
ttatgactgttttggttc

SEQ ID NO: 19365 - DNA, 18 bp, Homo sapiens
caggtgccactgtcagct

SEQ ID NO: 19366 - DNA, 19 bp, Homo sapiens
gtcacctagttatacaaac

SEQ ID NO: 19367 - DNA, 16 bp, Homo sapiens
atcgaggctgcggtga

SEQ ID NO: 19368 - DNA, 19 bp, Homo sapiens
ccccgccgctcaccggcgc

SEQ ID NO: 19369 - DNA, 19 bp, Homo sapiens
ggccgggtgcggtggctca

SEQ ID NO: 19370 - DNA, 18 bp, Homo sapiens
atgagatcactgacattc

SEQ ID NO: 19371 - DNA, 19 bp, Homo sapiens
tgagatcactgacattcca

SEQ ID NO: 19372 - DNA, 18 bp, Homo sapiens
aatgcagtatgggactat

SEQ ID NO: 19373 - DNA, 20 bp, Homo sapiens
agaaaatgtgaatttttcgt

SEQ ID NO: 19374 - DNA, 21 bp, Homo sapiens
agtgggtggaaagggcatttg

SEQ ID NO: 19375 - DNA, 21 bp, Homo sapiens
agttccgagcttgaagtcact

SEQ ID NO: 19376 - DNA, 21 bp, Homo sapiens
gtatgtatgttatacttgatt

SEQ ID NO: 19377 - DNA, 21 bp, Homo sapiens
taacttcaaaatctcctttat

SEQ ID NO: 19378 - DNA, 22 bp, Homo sapiens
cccagaggcccagctccccagt

SEQ ID NO: 19379 - DNA, 21 bp, Homo sapiens
gcaaccagctgctgcctgtgg

SEQ ID NO: 19380 - DNA, 22 bp, Homo sapiens
tacgacttggctttctgaaacg

SEQ ID NO: 19381 - DNA, 22 bp, Homo sapiens
acctgggtctgggacctggctc

SEQ ID NO: 19382 - DNA, 23 bp, Homo sapiens
ctgagccttgtgacttgagcaga

SEQ ID NO: 19383 - DNA, 18 bp, Homo sapiens
ggtgcagccctgcctggc

SEQ ID NO: 19384 - DNA, 21 bp, Homo sapiens
tgaggctgcccctcctaccac

SEQ ID NO: 19385 - DNA, 21 bp, Homo sapiens
gttgaatactgttctttggca

SEQ ID NO: 19386 - DNA, 18 bp, Homo sapiens
acaaaagtagaccaaagt

SEQ ID NO: 19387 - DNA, 22 bp, Homo sapiens
agcctaggttatacagatgcca

SEQ ID NO: 19388 - DNA, 24 bp, Homo sapiens
tattacctcagatacctgttgtca

SEQ ID NO: 19389 - DNA, 18 bp, Homo sapiens
tgcaagattttcataatt

SEQ ID NO: 19390 - DNA, 20 bp, Homo sapiens
tttgagttcataaatcattt

SEQ ID NO: 19391 - DNA, 22 bp, Homo sapiens
acaccctcaagtctctttgcca

SEQ ID NO: 19392 - DNA, 18 bp, Homo sapiens
agctgagcagctggagcc

SEQ ID NO: 19393 - DNA, 24 bp, Homo sapiens
cctctttgtagcagatatgatttt

SEQ ID NO: 19394 - DNA, 17 bp, Homo sapiens
ttactgtcaccttcact

SEQ ID NO: 19395 - DNA, 18 bp, Homo sapiens
aaaaacaaaacaaacaaa

SEQ ID NO: 19396 - DNA, 18 bp, Homo sapiens
gaacagatcagttgttgt

SEQ ID NO: 19397 - DNA, 23 bp, Homo sapiens
agcagtcttcttgcctcagcctc

SEQ ID NO: 19398 - DNA, 20 bp, Homo sapiens
cctctgcctcctgggttcaa

SEQ ID NO: 19399 - DNA, 20 bp, Homo sapiens
aatatcttagtttgctacca

SEQ ID NO: 19400 - DNA, 23 bp, Homo sapiens
taccagcatccagcatgaagttg

SEQ ID NO: 19401 - DNA, 21 bp, Homo sapiens
tgtgggggtgggatgtgagtg

SEQ ID NO: 19402 - DNA, 19 bp, Homo sapiens
agtattatatccatgctgt

SEQ ID NO: 19403 - DNA, 21 bp, Homo sapiens
atcttggctcactgcaacctc

SEQ ID NO: 19404 - DNA, 17 bp, Homo sapiens
ctgtctcagttgtcaga

SEQ ID NO: 19405 - DNA, 18 bp, Homo sapiens
tccgcctcttgggttcaa

SEQ ID NO: 19406 - DNA, 18 bp, Homo sapiens
tggccttgactcactttt

SEQ ID NO: 19407 - DNA, 19 bp, Homo sapiens
ttaaaaatggagcctttca

SEQ ID NO: 19408 - DNA, 18 bp, Homo sapiens
acccaggccgggctgcca

SEQ ID NO: 19409 - DNA, 19 bp, Homo sapiens
gagccttcctcttcccgca

SEQ ID NO: 19410 - DNA, 20 bp, Homo sapiens
ggagaggcggcggcggcggc

SEQ ID NO: 19411 - DNA, 20 bp, Homo sapiens
ttcctcttcccgcagcacgc

SEQ ID NO: 19412 - DNA, 19 bp, Homo sapiens
caaggcccacattctcctt

SEQ ID NO: 19413 - DNA, 20 bp, Homo sapiens
gagcgcctccagggccccgc

SEQ ID NO: 19414 - DNA, 19 bp, Homo sapiens
aaaaatgaaatatctggtt

SEQ ID NO: 19415 - DNA, 22 bp, Homo sapiens
cagtgttttgtctgtccgcgcc

SEQ ID NO: 19416 - DNA, 24 bp, Homo sapiens
tgagaagttgcttcttttacatca

SEQ ID NO: 19417 - DNA, 24 bp, Homo sapiens
tggatgggggttggcaggaagctg

SEQ ID NO: 19418 - DNA, 23 bp, Homo sapiens
caggaagtcaatcatctgtgaca

SEQ ID NO: 19419 - DNA, 22 bp, Homo sapiens
gtacccgttcttatcctagtgg

SEQ ID NO: 19420 - DNA, 23 bp, Homo sapiens
aaggcatcttcctcctctctgtg

SEQ ID NO: 19421 - DNA, 21 bp, Homo sapiens
gcacaggcaccagctacctca

SEQ ID NO: 19422 - DNA, 21 bp, Homo sapiens
aagagaggcccaggctactgg

SEQ ID NO: 19423 - DNA, 21 bp, Homo sapiens
ccctgctgcggagaccgcgga

SEQ ID NO: 19424 - DNA, 20 bp, Homo sapiens
actccatcagaacagctcca

SEQ ID NO: 19425 - DNA, 17 bp, Homo sapiens
ctggcctcagcatatca

SEQ ID NO: 19426 - DNA, 19 bp, Homo sapiens
ctgaaattggaacaccctt

SEQ ID NO: 19427 - DNA, 18 bp, Homo sapiens
tattgcaatgacaccatt

SEQ ID NO: 19428 - DNA, 25 bp, Homo sapiens
ttatggtatattttaagtgactttt

SEQ ID NO: 19429 - DNA, 22 bp, Homo sapiens
ccagactcgccaggaaaggcta

SEQ ID NO: 19430 - DNA, 21 bp, Homo sapiens
gcgcggagcacccggcgccga

SEQ ID NO: 19431 - DNA, 22 bp, Homo sapiens
accacactgcccctctcctcct

SEQ ID NO: 19432 - DNA, 24 bp, Homo sapiens
acttggattttctttatttggctt

SEQ ID NO: 19433 - DNA, 21 bp, Homo sapiens
gccaccctgctgtccttgaga

SEQ ID NO: 19434 - DNA, 20 bp, Homo sapiens
atgtggacgtgggtgggtga

SEQ ID NO: 19435 - DNA, 19 bp, Homo sapiens
catgctgggcctttccagt

SEQ ID NO: 19436 - DNA, 16 bp, Homo sapiens
ctctcctcctctcctc

SEQ ID NO: 19437 - DNA, 20 bp, Homo sapiens
ggtggaaaggggcatgtgtg

SEQ ID NO: 19438 - DNA, 19 bp, Homo sapiens
agaatggggccccagccgg

SEQ ID NO: 19439 - DNA, 24 bp, Homo sapiens
aggccctgtggagacaatccctca

SEQ ID NO: 19440 - DNA, 20 bp, Homo sapiens
aactcccgggacacccagga

SEQ ID NO: 19441 - DNA, 18 bp, Homo sapiens
gctccattaagtactcca

SEQ ID NO: 19442 - DNA, 22 bp, Homo sapiens
taacgacaacaaaccggtcaca

SEQ ID NO: 19443 - DNA, 20 bp, Homo sapiens
ttggcagaaattgtgttctt

SEQ ID NO: 19444 - DNA, 16 bp, Homo sapiens
ccaccttcccatctca

SEQ ID NO: 19445 - DNA, 20 bp, Homo sapiens
actaaaattaatacagctct

SEQ ID NO: 19446 - DNA, 19 bp, Homo sapiens
gtttaggtggtcctgaatc

SEQ ID NO: 19447 - DNA, 17 bp, Homo sapiens
gctgggccgcctggccc

SEQ ID NO: 19448 - DNA, 19 bp, Homo sapiens
gtgagctggagctgggcca

SEQ ID NO: 19449 - DNA, 20 bp, Homo sapiens
aaaatagacaagtgatacct

SEQ ID NO: 19450 - DNA, 23 bp, Homo sapiens
accaacttcacagggtgttcaga

SEQ ID NO: 19451 - DNA, 21 bp, Homo sapiens
agcctccttcctccccgggga

SEQ ID NO: 19452 - DNA, 27 bp, Homo sapiens
gtctgagcagagacattgatttggttt

SEQ ID NO: 19453 - DNA, 19 bp, Homo sapiens
tcctttaaaaaccgatcgg

SEQ ID NO: 19454 - DNA, 19 bp, Homo sapiens
tgcactccagcgtgggcta

SEQ ID NO: 19455 - DNA, 19 bp, Homo sapiens
tgggagaaaatgtctgcaa

SEQ ID NO: 19456 - DNA, 16 bp, Homo sapiens
atttgtggatagactg

SEQ ID NO: 19457 - DNA, 18 bp, Homo sapiens
ctagatgatctctaaagg

SEQ ID NO: 19458 - DNA, 19 bp, Homo sapiens
gtgagactgtagtgtcagg

SEQ ID NO: 19459 - DNA, 20 bp, Homo sapiens
tgaagagactatgctgagtg

SEQ ID NO: 19460 - DNA, 17 bp, Homo sapiens
ggagagaaaatgtacct

SEQ ID NO: 19461 - DNA, 19 bp, Homo sapiens
cccgcgcggcgcctggccc

SEQ ID NO: 19462 - DNA, 22 bp, Homo sapiens
accacgtcctacaactctgaca

SEQ ID NO: 19463 - DNA, 16 bp, Homo sapiens
acgcgcttcctctctt

SEQ ID NO: 19464 - DNA, 17 bp, Homo sapiens
cgcgcttcctctcttga

SEQ ID NO: 19465 - DNA, 17 bp, Homo sapiens
ctggtcctttgcagcca

SEQ ID NO: 19466 - DNA, 17 bp, Homo sapiens
acaattttgcagagata

SEQ ID NO: 19467 - DNA, 23 bp, Homo sapiens
ccagcggaaggagctgtgccccg

SEQ ID NO: 19468 - DNA, 20 bp, Homo sapiens
cccactcagcactctgccag

SEQ ID NO: 19469 - DNA, 21 bp, Homo sapiens
ccccactcagcactctgccag

SEQ ID NO: 19470 - DNA, 18 bp, Homo sapiens
cttgggctgacctgaccc

SEQ ID NO: 19471 - DNA, 18 bp, Homo sapiens
gggatggacggcttcggc

SEQ ID NO: 19472 - DNA, 22 bp, Homo sapiens
agacacagtggatattttgggc

SEQ ID NO: 19473 - DNA, 19 bp, Homo sapiens
cagggatctcgaaattctg

SEQ ID NO: 19474 - DNA, 18 bp, Homo sapiens
gacagagctggggtctca

SEQ ID NO: 19475 - DNA, 21 bp, Homo sapiens
aaactatctcaatactggctg

SEQ ID NO: 19476 - DNA, 17 bp, Homo sapiens
aatgagattttgtggtg

SEQ ID NO: 19477 - DNA, 20 bp, Homo sapiens
atcgccgcctccccgcctca

SEQ ID NO: 19478 - DNA, 21 bp, Homo sapiens
cagggcttccagatcactttt

SEQ ID NO: 19479 - DNA, 18 bp, Homo sapiens
cccgaattgaacactttt

SEQ ID NO: 19480 - DNA, 21 bp, Homo sapiens
gaggtcattgtttttggctta

SEQ ID NO: 19481 - DNA, 18 bp, Homo sapiens
gcaggagggagggttttt

SEQ ID NO: 19482 - DNA, 19 bp, Homo sapiens
gcctgaccatgaagcaaca

SEQ ID NO: 19483 - DNA, 18 bp, Homo sapiens
tatgtatgattttggcta

SEQ ID NO: 19484 - DNA, 17 bp, Homo sapiens
ttttcttgttcacagta

SEQ ID NO: 19485 - DNA, 22 bp, Homo sapiens
ccagcagcgaaaaagctggcca

SEQ ID NO: 19486 - DNA, 18 bp, Homo sapiens
ctgagtacagatattaca

SEQ ID NO: 19487 - DNA, 23 bp, Homo sapiens
tctaggtggtcttttccttattt

SEQ ID NO: 19488 - DNA, 22 bp, Homo sapiens
tggcatggtttggcttctgata

SEQ ID NO: 19489 - DNA, 18 bp, Homo sapiens
ctgtccacacatgcacac

SEQ ID NO: 19490 - DNA, 16 bp, Homo sapiens
tctggcctcccagatc

SEQ ID NO: 19491 - DNA, 21 bp, Homo sapiens
tgaccatgcctgaaccagtca

SEQ ID NO: 19492 - DNA, 23 bp, Homo sapiens
ttctgcccctgatcgcttggttt

SEQ ID NO: 19493 - DNA, 19 bp, Homo sapiens
aacaaagtgcagacattca

SEQ ID NO: 19494 - DNA, 19 bp, Homo sapiens
cgtgttggcgggcatctgt

SEQ ID NO: 19495 - DNA, 22 bp, Homo sapiens
aagggctataacatacatgtca

SEQ ID NO: 19496 - DNA, 20 bp, Homo sapiens
ctctaacaactggcatgcaa

SEQ ID NO: 19497 - DNA, 17 bp, Homo sapiens
gaagagttttaagtagc

SEQ ID NO: 19498 - DNA, 16 bp, Homo sapiens
ttatgccaacaagatg

SEQ ID NO: 19499 - DNA, 18 bp, Homo sapiens
ttgattctattcaatcca

SEQ ID NO: 19500 - DNA, 23 bp, Homo sapiens
cacccttcggagccccgctttca

SEQ ID NO: 19501 - DNA, 16 bp, Homo sapiens
agccggggccttctca

SEQ ID NO: 19502 - DNA, 18 bp, Homo sapiens
cctctgggaggcctgagg

SEQ ID NO: 19503 - DNA, 22 bp, Homo sapiens
gtggcccctctgggaggcctga

SEQ ID NO: 19504 - DNA, 19 bp, Homo sapiens
tcaatcctggtagcaacac

SEQ ID NO: 19505 - DNA, 23 bp, Homo sapiens
cgtttccattctgccttctcaga

SEQ ID NO: 19506 - DNA, 20 bp, Homo sapiens
gggtttccatccccgctgcc

SEQ ID NO: 19507 - DNA, 22 bp, Homo sapiens
tgcagctcggcctccgcgccgc

SEQ ID NO: 19508 - DNA, 23 bp, Homo sapiens
tcagagataaacaagaacaaata

SEQ ID NO: 19509 - DNA, 19 bp, Homo sapiens
ccacagaacatgcctgcca

SEQ ID NO: 19510 - DNA, 20 bp, Homo sapiens
cctctgcctcctgggttcaa

SEQ ID NO: 19511 - DNA, 20 bp, Homo sapiens
cgcccccaggccacctgctc

SEQ ID NO: 19512 - DNA, 21 bp, Homo sapiens
ctcctcaggactgcagcactg

SEQ ID NO: 19513 - DNA, 22 bp, Homo sapiens
gaaggtcatccaagtttcctcc

SEQ ID NO: 19514 - DNA, 22 bp, Homo sapiens
gcccccaggccacctgctccgg

SEQ ID NO: 19515 - DNA, 22 bp, Homo sapiens
gttccgcacgatccggaaccca

SEQ ID NO: 19516 - DNA, 21 bp, Homo sapiens
ccaaatctttgtgtttgccta

SEQ ID NO: 19517 - DNA, 21 bp, Homo sapiens
ctatcatcgatacatactgtt

SEQ ID NO: 19518 - DNA, 19 bp, Homo sapiens
ctgcccttggcatcatcca

SEQ ID NO: 19519 - DNA, 19 bp, Homo sapiens
gctttggctgtctggactt

SEQ ID NO: 19520 - DNA, 26 bp, Homo sapiens
tctcacgctttggctgtctggacttt

SEQ ID NO: 19521 - DNA, 19 bp, Homo sapiens
ttccagaacctgccaccag

SEQ ID NO: 19522 - DNA, 19 bp, Homo sapiens
cactaccacagtttttaca

SEQ ID NO: 19523 - DNA, 23 bp, Homo sapiens
ccctgacggcccattgtccgcgg

SEQ ID NO: 19524 - DNA, 21 bp, Homo sapiens
tctcacaaagctgccttgact

SEQ ID NO: 19525 - DNA, 21 bp, Homo sapiens
tgacttgagacacccaagagg

SEQ ID NO: 19526 - DNA, 20 bp, Homo sapiens
actctggacctgcctgcctc

SEQ ID NO: 19527 - DNA, 19 bp, Homo sapiens
ccctttaatacagaaccct

SEQ ID NO: 19528 - DNA, 21 bp, Homo sapiens
ctgctgataagaggagggagt

SEQ ID NO: 19529 - DNA, 17 bp, Homo sapiens
ggtgttcattttcccca

SEQ ID NO: 19530 - DNA, 25 bp, Homo sapiens
tagggtcctgtccggcttggggctg

SEQ ID NO: 19531 - DNA, 18 bp, Homo sapiens
tgcctagcagccgctgac

SEQ ID NO: 19532 - DNA, 20 bp, Homo sapiens
agacaaataccactacctgt

SEQ ID NO: 19533 - DNA, 18 bp, Homo sapiens
cgcccacgagctccacca

SEQ ID NO: 19534 - DNA, 16 bp, Homo sapiens
ctgtctgaactacaca

SEQ ID NO: 19535 - DNA, 19 bp, Homo sapiens
gaaaacagagcttcccgtg

SEQ ID NO: 19536 - DNA, 21 bp, Homo sapiens
acctgcaatgattactgtgca

SEQ ID NO: 19537 - DNA, 18 bp, Homo sapiens
ataaattacgactctcaa

SEQ ID NO: 19538 - DNA, 19 bp, Homo sapiens
gtggtcttcttgccttcat

SEQ ID NO: 19539 - DNA, 18 bp, Homo sapiens
tacaaaattccatctcag

SEQ ID NO: 19540 - DNA, 17 bp, Homo sapiens
ctgtattgttccatagc

SEQ ID NO: 19541 - DNA, 19 bp, Homo sapiens
gcctaaatagtattttata

SEQ ID NO: 19542 - DNA, 22 bp, Homo sapiens
acctgagccgcccgcctcgtcc

SEQ ID NO: 19543 - DNA, 24 bp, Homo sapiens
gaatcatttttagattgtgacata

SEQ ID NO: 19544 - DNA, 22 bp, Homo sapiens
ggcaacgagcgaaactacatct

SEQ ID NO: 19545 - DNA, 19 bp, Homo sapiens
gcattagaagagggtcttt

SEQ ID NO: 19546 - DNA, 19 bp, Homo sapiens
tttttgatctgggagatga

SEQ ID NO: 19547 - DNA, 19 bp, Homo sapiens
caagaacaaaactgctcca

SEQ ID NO: 19548 - DNA, 22 bp, Homo sapiens
gcaaaattcaagaacaaaactg

SEQ ID NO: 19549 - DNA, 23 bp, Homo sapiens
agccacggggacgcgggattcaa

SEQ ID NO: 19550 - DNA, 18 bp, Homo sapiens
ctgccctcctctgcacct

SEQ ID NO: 19551 - DNA, 20 bp, Homo sapiens
gcccaggctcaggcccatga

SEQ ID NO: 19552 - DNA, 18 bp, Homo sapiens
cgggacgctcacattcca

SEQ ID NO: 19553 - DNA, 18 bp, Homo sapiens
gccgctccggggggcctc

SEQ ID NO: 19554 - DNA, 18 bp, Homo sapiens
cttaggataacagcagta

SEQ ID NO: 19555 - DNA, 21 bp, Homo sapiens
gaaggggaagagcgtgttgtg

SEQ ID NO: 19556 - DNA, 16 bp, Homo sapiens
tcttttcttgacttag

SEQ ID NO: 19557 - DNA, 21 bp, Homo sapiens
atctgaggggtggcctggcct

SEQ ID NO: 19558 - DNA, 21 bp, Homo sapiens
cactgcctcactgcacctgcc

SEQ ID NO: 19559 - DNA, 20 bp, Homo sapiens
cccccacaagtcactgcctc

SEQ ID NO: 19560 - DNA, 18 bp, Homo sapiens
cccgagacccctctgaga

SEQ ID NO: 19561 - DNA, 19 bp, Homo sapiens
cggggtctgcagggctcag

SEQ ID NO: 19562 - DNA, 18 bp, Homo sapiens
gaggctcctccccaccac

SEQ ID NO: 19563 - DNA, 26 bp, Homo sapiens
ggaaccagcacaaagtgttggcatcg

SEQ ID NO: 19564 - DNA, 22 bp, Homo sapiens
tcacccaacctctcccacctcc

SEQ ID NO: 19565 - DNA, 23 bp, Homo sapiens
ttctgactgagctcccccattcc

SEQ ID NO: 19566 - DNA, 20 bp, Homo sapiens
tggccccggcccagttccca

SEQ ID NO: 19567 - DNA, 18 bp, Homo sapiens
tgtttcctagaaaaccca

SEQ ID NO: 19568 - DNA, 21 bp, Homo sapiens
acaggcatgtctttgacccca

SEQ ID NO: 19569 - DNA, 18 bp, Homo sapiens
gcaagagtaggggcctga

SEQ ID NO: 19570 - DNA, 20 bp, Homo sapiens
gaagagtcctcccatcccct

SEQ ID NO: 19571 - DNA, 24 bp, Homo sapiens
gcgcccgtggccgctgccgcctcc

SEQ ID NO: 19572 - DNA, 20 bp, Homo sapiens
aaagagactttctctttcat

SEQ ID NO: 19573 - DNA, 19 bp, Homo sapiens
aagagactttctctttcat

SEQ ID NO: 19574 - DNA, 18 bp, Homo sapiens
caaggagaaaaaaaccac

SEQ ID NO: 19575 - DNA, 25 bp, Homo sapiens
gcttctgaactcttcctctgcctct

SEQ ID NO: 19576 - DNA, 17 bp, Homo sapiens
gtgaactctacccatgt

SEQ ID NO: 19577 - DNA, 21 bp, Homo sapiens
ttgccttacttaacgcttttt

SEQ ID NO: 19578 - DNA, 20 bp, Homo sapiens
agcagaagtaggccttgctc

SEQ ID NO: 19579 - DNA, 20 bp, Homo sapiens
tgacctcacagaccagctca

SEQ ID NO: 19580 - DNA, 17 bp, Homo sapiens
caacttcatcatctaca

SEQ ID NO: 19581 - DNA, 17 bp, Homo sapiens
cacagatactgtttcct

SEQ ID NO: 19582 - DNA, 18 bp, Homo sapiens
gctgtcattgatgctcta

SEQ ID NO: 19583 - DNA, 19 bp, Homo sapiens
taatagggggaaaatgtca

SEQ ID NO: 19584 - DNA, 23 bp, Homo sapiens
tactgatttcagtactgagatta

SEQ ID NO: 19585 - DNA, 23 bp, Homo sapiens
taggattggcaatggttcgttta

SEQ ID NO: 19586 - DNA, 20 bp, Homo sapiens
ttaccacagatactgtttcc

SEQ ID NO: 19587 - DNA, 17 bp, Homo sapiens
ttttgacaaagctgaca

SEQ ID NO: 19588 - DNA, 18 bp, Homo sapiens
acttgaattgcgatgtgt

SEQ ID NO: 19589 - DNA, 20 bp, Homo sapiens
tactgacacatttttcctga

SEQ ID NO: 19590 - DNA, 19 bp, Homo sapiens
aagcaattctcctgcctca

SEQ ID NO: 19591 - DNA, 23 bp, Homo sapiens
acctggattccattggctggttt

SEQ ID NO: 19592 - DNA, 23 bp, Homo sapiens
ggcaacatggtgaaactgtctct

SEQ ID NO: 19593 - DNA, 18 bp, Homo sapiens
ttctcctgcctcaacctt

SEQ ID NO: 19594 - DNA, 20 bp, Homo sapiens
gtgttttggagcgcctctca

SEQ ID NO: 19595 - DNA, 23 bp, Homo sapiens
taatctcaagaagaatggtgata

SEQ ID NO: 19596 - DNA, 19 bp, Homo sapiens
tgggtggatcacttgaggc

SEQ ID NO: 19597 - DNA, 24 bp, Homo sapiens
ttctgcctctgtggaaaactactt

SEQ ID NO: 19598 - DNA, 22 bp, Homo sapiens
agctgtattgtattttacctca

SEQ ID NO: 19599 - DNA, 21 bp, Homo sapiens
gtaaaatgtctttttgacatg

SEQ ID NO: 19600 - DNA, 24 bp, Homo sapiens
tgagttgagacctgtatggaattg

SEQ ID NO: 19601 - DNA, 20 bp, Homo sapiens
cgccttagtgcttcagaccc

SEQ ID NO: 19602 - DNA, 19 bp, Homo sapiens
ctgaggatgattgttagct

SEQ ID NO: 19603 - DNA, 19 bp, Homo sapiens
aagtactgtgtatttcaca

SEQ ID NO: 19604 - DNA, 23 bp, Homo sapiens
acacctgtctaggtgaagactca

SEQ ID NO: 19605 - DNA, 21 bp, Homo sapiens
accccaaagaaaatgacttca

SEQ ID NO: 19606 - DNA, 19 bp, Homo sapiens
attactgcccttttcctga

SEQ ID NO: 19607 - DNA, 18 bp, Homo sapiens
cagcactttgggaagcca

SEQ ID NO: 19608 - DNA, 20 bp, Homo sapiens
ctcttcacctcctctgccct

SEQ ID NO: 19609 - DNA, 22 bp, Homo sapiens
ggctttcaacatgttcagtgga

SEQ ID NO: 19610 - DNA, 19 bp, Homo sapiens
atcccggagcctctgggga

SEQ ID NO: 19611 - DNA, 18 bp, Homo sapiens
caaagcaggaccagcagg

SEQ ID NO: 19612 - DNA, 18 bp, Homo sapiens
catagaacagataccttt

SEQ ID NO: 19613 - DNA, 24 bp, Homo sapiens
cgtatcaacagtggatttgctggt

SEQ ID NO: 19614 - DNA, 24 bp, Homo sapiens
gcctggtgaagtgacccttggcct

SEQ ID NO: 19615 - DNA, 19 bp, Homo sapiens
tggtcttgtaattgtgaac

SEQ ID NO: 19616 - DNA, 19 bp, Homo sapiens
cactgcctgtccccgtccc

SEQ ID NO: 19617 - DNA, 20 bp, Homo sapiens
catccaccacccttcttaca

SEQ ID NO: 19618 - DNA, 21 bp, Homo sapiens
gattcatcagggcaggaagca

SEQ ID NO: 19619 - DNA, 15 bp, Homo sapiens
tgcagtgagccagcc

SEQ ID NO: 19620 - DNA, 22 bp, Homo sapiens
tctctttgtggttcctggtcct

SEQ ID NO: 19621 - DNA, 21 bp, Homo sapiens
aagtgaacacactctatgtca

SEQ ID NO: 19622 - DNA, 19 bp, Homo sapiens
accatgaaataccatgata

SEQ ID NO: 19623 - DNA, 16 bp, Homo sapiens
aaaacttcagatttca

SEQ ID NO: 19624 - DNA, 16 bp, Homo sapiens
aacaaaagacagccag

SEQ ID NO: 19625 - DNA, 19 bp, Homo sapiens
aagaggaaactacacctta

SEQ ID NO: 19626 - DNA, 21 bp, Homo sapiens
cctgaaaacattattatttga

SEQ ID NO: 19627 - DNA, 23 bp, Homo sapiens
gcctgaatttggattgcctgctc

SEQ ID NO: 19628 - DNA, 22 bp, Homo sapiens
aaggattaaaactgagatttga

SEQ ID NO: 19629 - DNA, 22 bp, Homo sapiens
gaaaaactaaaagagtgcccca

SEQ ID NO: 19630 - DNA, 23 bp, Homo sapiens
caaatatcaacttgtaatactca

SEQ ID NO: 19631 - DNA, 18 bp, Homo sapiens
cagcattcaagattatga

SEQ ID NO: 19632 - DNA, 17 bp, Homo sapiens
gtcaggctgaacgcagc

SEQ ID NO: 19633 - DNA, 19 bp, Homo sapiens
aagaaaatccaaagcattg

SEQ ID NO: 19634 - DNA, 21 bp, Homo sapiens
ccatcctccctactcatgact

SEQ ID NO: 19635 - DNA, 18 bp, Homo sapiens
ggccgaggcggctgcggc

SEQ ID NO: 19636 - DNA, 23 bp, Homo sapiens
actctagaagaatctgtacatca

SEQ ID NO: 19637 - DNA, 18 bp, Homo sapiens
tatggtgtttacagtgta

SEQ ID NO: 19638 - DNA, 15 bp, Homo sapiens
cgtaaggaattgtga

SEQ ID NO: 19639 - DNA, 18 bp, Homo sapiens
aaacacatgttgactttt

SEQ ID NO: 19640 - DNA, 20 bp, Homo sapiens
gcaagtaaagagcaacggga

SEQ ID NO: 19641 - DNA, 19 bp, Homo sapiens
tactaattcaagctgtgac

SEQ ID NO: 19642 - DNA, 22 bp, Homo sapiens
tctcagaattttaatttttaga

SEQ ID NO: 19643 - DNA, 19 bp, Homo sapiens
ctacaataacattgtatca

SEQ ID NO: 19644 - DNA, 22 bp, Homo sapiens
ctttgaatagaagacttctgga

SEQ ID NO: 19645 - DNA, 22 bp, Homo sapiens
gagccaagattgtgccactgca

SEQ ID NO: 19646 - DNA, 19 bp, Homo sapiens
agatgggtgctggtcctca

SEQ ID NO: 19647 - DNA, 17 bp, Homo sapiens
cagaaactctgctccag

SEQ ID NO: 19648 - DNA, 18 bp, Homo sapiens
cagctacgctctgtgaca

SEQ ID NO: 19649 - DNA, 19 bp, Homo sapiens
cagtaacatcaagtgctca

SEQ ID NO: 19650 - DNA, 19 bp, Homo sapiens
cctcccacgagatctggag

SEQ ID NO: 19651 - DNA, 24 bp, Homo sapiens
ccttgggctgagaggacctgggaa

SEQ ID NO: 19652 - DNA, 21 bp, Homo sapiens
gtgcctatttcatcctggtgg

SEQ ID NO: 19653 - DNA, 23 bp, Homo sapiens
tgagaggacctgggaagcccctc

SEQ ID NO: 19654 - DNA, 18 bp, Homo sapiens
actttgaacctcagatca

SEQ ID NO: 19655 - DNA, 17 bp, Homo sapiens
tagctgctggaatcaca

SEQ ID NO: 19656 - DNA, 18 bp, Homo sapiens
ctctcctttgcacttgat

SEQ ID NO: 19657 - DNA, 21 bp, Homo sapiens
gtgttttgatatgtctagcaa

SEQ ID NO: 19658 - DNA, 18 bp, Homo sapiens
tggctttttaatatgctt

SEQ ID NO: 19659 - DNA, 23 bp, Homo sapiens
cacggagggtgcgcctgccgcca

SEQ ID NO: 19660 - DNA, 21 bp, Homo sapiens
cagcggcccagccttgctgcc

SEQ ID NO: 19661 - DNA, 20 bp, Homo sapiens
ccccgcctcaccccacatgc

SEQ ID NO: 19662 - DNA, 21 bp, Homo sapiens
ctaggcccgtcccactcacct

SEQ ID NO: 19663 - DNA, 20 bp, Homo sapiens
tgagtgctcacagccgcctc

SEQ ID NO: 19664 - DNA, 19 bp, Homo sapiens
ccattgataacagaaaatg

SEQ ID NO: 19665 - DNA, 18 bp, Homo sapiens
gatcctgggacacatggg

SEQ ID NO: 19666 - DNA, 18 bp, Homo sapiens
ggcttctgtggttgtcca

SEQ ID NO: 19667 - DNA, 20 bp, Homo sapiens
ttgcaaaatgagagtttctt

SEQ ID NO: 19668 - DNA, 20 bp, Homo sapiens
tcagccctccacctccggcg

SEQ ID NO: 19669 - DNA, 19 bp, Homo sapiens
atttattttcatgttatgc

SEQ ID NO: 19670 - DNA, 22 bp, Homo sapiens
gagccaagatagtgccactgca

SEQ ID NO: 19671 - DNA, 23 bp, Homo sapiens
gtttgaactgtgctattttgttc

SEQ ID NO: 19672 - DNA, 17 bp, Homo sapiens
tgttgtatgcctattga

SEQ ID NO: 19673 - DNA, 18 bp, Homo sapiens
aagagtaaatccaagtca

SEQ ID NO: 19674 - DNA, 18 bp, Homo sapiens
cagcttcaaatgctgctt

SEQ ID NO: 19675 - DNA, 19 bp, Homo sapiens
tgccttctcctccatttct

SEQ ID NO: 19676 - DNA, 20 bp, Homo sapiens
tgggtgcaacaatggcaatg

SEQ ID NO: 19677 - DNA, 21 bp, Homo sapiens
aactccacctcccgggttcac

SEQ ID NO: 19678 - DNA, 18 bp, Homo sapiens
atatcttcatccttctca

SEQ ID NO: 19679 - DNA, 18 bp, Homo sapiens
tcctgacctcatgatcca

SEQ ID NO: 19680 - DNA, 21 bp, Homo sapiens
tgtcaaactttttttgtacaa

SEQ ID NO: 19681 - DNA, 22 bp, Homo sapiens
gagccaagatcgcgccactgca

SEQ ID NO: 19682 - DNA, 20 bp, Homo sapiens
agtctcactctgtcgcccag

SEQ ID NO: 19683 - DNA, 25 bp, Homo sapiens
atttggattttggtatctttggttt

SEQ ID NO: 19684 - DNA, 22 bp, Homo sapiens
ctgggattacaggcacctgcca

SEQ ID NO: 19685 - DNA, 17 bp, Homo sapiens
ggctttaaataggcttc

SEQ ID NO: 19686 - DNA, 18 bp, Homo sapiens
tcctgacctcatgatcca

SEQ ID NO: 19687 - DNA, 20 bp, Homo sapiens
tggccaggctggtcttgaac

SEQ ID NO: 19688 - DNA, 20 bp, Homo sapiens
tttgcattgactgtttaatc

SEQ ID NO: 19689 - DNA, 26 bp, Homo sapiens
ttttgggaaagggaaaaatgtctgtt

SEQ ID NO: 19690 - DNA, 19 bp, Homo sapiens
acggcagcatcttatctca

SEQ ID NO: 19691 - DNA, 22 bp, Homo sapiens
ccaaaccatgctccccatgaca

SEQ ID NO: 19692 - DNA, 22 bp, Homo sapiens
gagccaagatcgcgccactgca

SEQ ID NO: 19693 - DNA, 23 bp, Homo sapiens
ttctggcctgcacgcagtgtgtg

SEQ ID NO: 19694 - DNA, 22 bp, Homo sapiens
agctgggtttttgctgttttta

SEQ ID NO: 19695 - DNA, 18 bp, Homo sapiens
caaccctccagggctact

SEQ ID NO: 19696 - DNA, 21 bp, Homo sapiens
ccagccccttgccaaccctcc

SEQ ID NO: 19697 - DNA, 21 bp, Homo sapiens
ggccagagtgatggcaccatc

SEQ ID NO: 19698 - DNA, 23 bp, Homo sapiens
tatctacaacccaataacagaca

SEQ ID NO: 19699 - DNA, 17 bp, Homo sapiens
tgaagtatccagcgctc

SEQ ID NO: 19700 - DNA, 18 bp, Homo sapiens
tgtccacgtgccgcctca

SEQ ID NO: 19701 - DNA, 23 bp, Homo sapiens
ttactgcgcctcaccactcccgt

SEQ ID NO: 19702 - DNA, 22 bp, Homo sapiens
agctgtattgtattttacctca

SEQ ID NO: 19703 - DNA, 21 bp, Homo sapiens
gtaaaatgtctttttgacatg

SEQ ID NO: 19704 - DNA, 24 bp, Homo sapiens
tgagttgagacctgtatggaattg

SEQ ID NO: 19705 - DNA, 18 bp, Homo sapiens
aagatataatggaggatg

SEQ ID NO: 19706 - DNA, 23 bp, Homo sapiens
agcaattttggcttaatggcaca

SEQ ID NO: 19707 - DNA, 18 bp, Homo sapiens
ctgtccatccattcctcc

SEQ ID NO: 19708 - DNA, 17 bp, Homo sapiens
gggagagactgacctca

SEQ ID NO: 19709 - DNA, 18 bp, Homo sapiens
acaggacccacctccatc

SEQ ID NO: 19710 - DNA, 20 bp, Homo sapiens
caggagcaaattgcaccaca

SEQ ID NO: 19711 - DNA, 18 bp, Homo sapiens
gggacaggacccacctcc

SEQ ID NO: 19712 - DNA, 19 bp, Homo sapiens
cgaatcatcacgcatccca

SEQ ID NO: 19713 - DNA, 22 bp, Homo sapiens
gaatgtgttcaaatacatctca

SEQ ID NO: 19714 - DNA, 18 bp, Homo sapiens
aaacactgaacagttatc

SEQ ID NO: 19715 - DNA, 24 bp, Homo sapiens
atcaaatgtatttgccttacttcc

SEQ ID NO: 19716 - DNA, 18 bp, Homo sapiens
ccccacgaactagatgcc

SEQ ID NO: 19717 - DNA, 22 bp, Homo sapiens
tccaactatacggtcagccctc

SEQ ID NO: 19718 - DNA, 19 bp, Homo sapiens
tggattcaaccaacatgga

SEQ ID NO: 19719 - DNA, 20 bp, Homo sapiens
cccctccccacccctttcct

SEQ ID NO: 19720 - DNA, 23 bp, Homo sapiens
ccctccccacccctttccttcta

SEQ ID NO: 19721 - DNA, 19 bp, Homo sapiens
cacagaattaggctgtgtt

SEQ ID NO: 19722 - DNA, 20 bp, Homo sapiens
catgcaactccaccttagaa

SEQ ID NO: 19723 - DNA, 18 bp, Homo sapiens
cctgggaaccccagactc

SEQ ID NO: 19724 - DNA, 21 bp, Homo sapiens
gctgtgatggttctgttttta

SEQ ID NO: 19725 - DNA, 19 bp, Homo sapiens
cgccacgcgccgccacgag

SEQ ID NO: 19726 - DNA, 19 bp, Homo sapiens
aaaagtttatttgtggtat

SEQ ID NO: 19727 - DNA, 21 bp, Homo sapiens
tggacgctggcgcggtggccg

SEQ ID NO: 19728 - DNA, 16 bp, Homo sapiens
actcatcttggcatta

SEQ ID NO: 19729 - DNA, 21 bp, Homo sapiens
ggaccaatggaagactgagaa

SEQ ID NO: 19730 - DNA, 19 bp, Homo sapiens
ggctatactgacaaactca

SEQ ID NO: 19731 - DNA, 19 bp, Homo sapiens
acagatgcatatttcctca

SEQ ID NO: 19732 - DNA, 22 bp, Homo sapiens
cttcattttcacatgttactca

SEQ ID NO: 19733 - DNA, 21 bp, Homo sapiens
tcacactacaacattctcttt

SEQ ID NO: 19734 - DNA, 17 bp, Homo sapiens
aaaaacattattcctct

SEQ ID NO: 19735 - DNA, 18 bp, Homo sapiens
cctatctctcccatctct

SEQ ID NO: 19736 - DNA, 18 bp, Homo sapiens
tttgataaagactttacc

SEQ ID NO: 19737 - DNA, 23 bp, Homo sapiens
accatcttccctctggggggatt

SEQ ID NO: 19738 - DNA, 16 bp, Homo sapiens
cttccgattccgccac

SEQ ID NO: 19739 - DNA, 17 bp, Homo sapiens
aggataaatgaatgatg

SEQ ID NO: 19740 - DNA, 18 bp, Homo sapiens
atgacaaatatgccagtt

SEQ ID NO: 19741 - DNA, 19 bp, Homo sapiens
cacctggtggctcattttt

SEQ ID NO: 19742 - DNA, 21 bp, Homo sapiens
ctgcctttgcctcagctttat

SEQ ID NO: 19743 - DNA, 19 bp, Homo sapiens
gcagatgctgctgctgtca

SEQ ID NO: 19744 - DNA, 21 bp, Homo sapiens
atggaaaaactttgtatggta

SEQ ID NO: 19745 - DNA, 15 bp, Homo sapiens
gatacaggtaaggaa

SEQ ID NO: 19746 - DNA, 18 bp, Homo sapiens
tgctacatcataatgctg

SEQ ID NO: 19747 - DNA, 21 bp, Homo sapiens
aaaccaatgaaaacaagaggg

SEQ ID NO: 19748 - DNA, 19 bp, Homo sapiens
caatgacaccagctggtca

SEQ ID NO: 19749 - DNA, 19 bp, Homo sapiens
cactaagaattgtgatttg

SEQ ID NO: 19750 - DNA, 22 bp, Homo sapiens
ttttgatggcggagaggggtgg

SEQ ID NO: 19751 - DNA, 16 bp, Homo sapiens
aaacagacccacattg

SEQ ID NO: 19752 - DNA, 16 bp, Homo sapiens
cacattggaacagtga

SEQ ID NO: 19753 - DNA, 19 bp, Homo sapiens
ctcagtataaggcatccta

SEQ ID NO: 19754 - DNA, 20 bp, Homo sapiens
taatttcagtaactgttttc

SEQ ID NO: 19755 - DNA, 24 bp, Homo sapiens
tcaacctgcacttcttacaaccaa

SEQ ID NO: 19756 - DNA, 18 bp, Homo sapiens
agcaccatttttttcttc

SEQ ID NO: 19757 - DNA, 21 bp, Homo sapiens
agttttctttcttcacagtca

SEQ ID NO: 19758 - DNA, 24 bp, Homo sapiens
attaaaattcatatatactgcagg

SEQ ID NO: 19759 - DNA, 20 bp, Homo sapiens
tgccgtctcctcatcctgca

SEQ ID NO: 19760 - DNA, 18 bp, Homo sapiens
atttccttgaaatttcac

SEQ ID NO: 19761 - DNA, 21 bp, Homo sapiens
cagcagggcatagggcacgca

SEQ ID NO: 19762 - DNA, 21 bp, Homo sapiens
gcttttctgcaaagtctgtgg

SEQ ID NO: 19763 - DNA, 18 bp, Homo sapiens
tcaaatagtctatacctg

SEQ ID NO: 19764 - DNA, 19 bp, Homo sapiens
ttgagactattatcaaaga

SEQ ID NO: 19765 - DNA, 20 bp, Homo sapiens
aggggtaatattgtgagctg

SEQ ID NO: 19766 - DNA, 19 bp, Homo sapiens
accttcccccgcccgcgga

SEQ ID NO: 19767 - DNA, 19 bp, Homo sapiens
ctgcctgggacggcctacc

SEQ ID NO: 19768 - DNA, 24 bp, Homo sapiens
cgagcgctccccagatctgggcca

SEQ ID NO: 19769 - DNA, 24 bp, Homo sapiens
gctcaatcagatcctggtgtcaga

SEQ ID NO: 19770 - DNA, 23 bp, Homo sapiens
cttagtgctctgaatttactttt

SEQ ID NO: 19771 - DNA, 19 bp, Homo sapiens
gattttaatcaccattaca

SEQ ID NO: 19772 - DNA, 21 bp, Homo sapiens
atcttggctcactgcaacctc

SEQ ID NO: 19773 - DNA, 19 bp, Homo sapiens
ctgcagcagtgactctcaa

SEQ ID NO: 19774 - DNA, 18 bp, Homo sapiens
tccgcctcccgggttcaa

SEQ ID NO: 19775 - DNA, 24 bp, Homo sapiens
gaagcaccaggcggtcagcagctg

SEQ ID NO: 19776 - DNA, 23 bp, Homo sapiens
ggtccttaaagcatttgctgcca

SEQ ID NO: 19777 - DNA, 20 bp, Homo sapiens
tcctgaagcagatcaacaaa

SEQ ID NO: 19778 - DNA, 19 bp, Homo sapiens
ataactttgtcctgtcctc

SEQ ID NO: 19779 - DNA, 20 bp, Homo sapiens
atcgtctttccgtcctctga

SEQ ID NO: 19780 - DNA, 23 bp, Homo sapiens
cctttctatccctatgtatttaa

SEQ ID NO: 19781 - DNA, 18 bp, Homo sapiens
ggcggcggcggccgtggc

SEQ ID NO: 19782 - DNA, 19 bp, Homo sapiens
aatcttcaacagacattca

SEQ ID NO: 19783 - DNA, 21 bp, Homo sapiens
acaggttcatctttgacttca

SEQ ID NO: 19784 - DNA, 16 bp, Homo sapiens
agttaccaaactagtc

SEQ ID NO: 19785 - DNA, 19 bp, Homo sapiens
cctcttccatactcttccg

SEQ ID NO: 19786 - DNA, 23 bp, Homo sapiens
tctgcttgcttcaaattactttt

SEQ ID NO: 19787 - DNA, 17 bp, Homo sapiens
tttgtttgtgtgtttgt

SEQ ID NO: 19788 - DNA, 18 bp, Homo sapiens
atcccagttatccctgga

SEQ ID NO: 19789 - DNA, 19 bp, Homo sapiens
tgatactaaacaactctct

SEQ ID NO: 19790 - DNA, 20 bp, Homo sapiens
ctcaactcccctgtagttta

SEQ ID NO: 19791 - DNA, 22 bp, Homo sapiens
ctgagacaacatactctgtcca

SEQ ID NO: 19792 - DNA, 18 bp, Homo sapiens
cttctccgcctcagccct

SEQ ID NO: 19793 - DNA, 23 bp, Homo sapiens
ttctgctgaacacccactgttcc

SEQ ID NO: 19794 - DNA, 23 bp, Homo sapiens
aaaatgttgcgaaaacatgggta

SEQ ID NO: 19795 - DNA, 20 bp, Homo sapiens
atgacgaagccattaccagt

SEQ ID NO: 19796 - DNA, 19 bp, Homo sapiens
aatgtccagcagagttacc

SEQ ID NO: 19797 - DNA, 20 bp, Homo sapiens
ctttcctctccttttcctca

SEQ ID NO: 19798 - DNA, 17 bp, Homo sapiens
tcattgtagtggcctaa

SEQ ID NO: 19799 - DNA, 20 bp, Homo sapiens
tggtgtctggcatgaaatta

SEQ ID NO: 19800 - DNA, 19 bp, Homo sapiens
atgcatgcccattgccttc

SEQ ID NO: 19801 - DNA, 18 bp, Homo sapiens
gttgctgatggacagtga

SEQ ID NO: 19802 - DNA, 22 bp, Homo sapiens
tgtgcagtatgaaatcgtattg

SEQ ID NO: 19803 - DNA, 25 bp, Homo sapiens
tttttttgtagtgctatttaatttt

SEQ ID NO: 19804 - DNA, 22 bp, Homo sapiens
cgggactggccctgcccagcca

SEQ ID NO: 19805 - DNA, 25 bp, Homo sapiens
gcctggatctgttttgttttggttt

SEQ ID NO: 19806 - DNA, 24 bp, Homo sapiens
ggcatgagccgccacacccggcca

SEQ ID NO: 19807 - DNA, 17 bp, Homo sapiens
agaaacaggttaggaca

SEQ ID NO: 19808 - DNA, 22 bp, Homo sapiens
cctgggtgatttttgtattttt

SEQ ID NO: 19809 - DNA, 18 bp, Homo sapiens
tccgtctcctgggttcaa

SEQ ID NO: 19810 - DNA, 17 bp, Homo sapiens
agagacagacagaggga

SEQ ID NO: 19811 - DNA, 21 bp, Homo sapiens
tccaaagagaaaagtaattca

SEQ ID NO: 19812 - DNA, 17 bp, Homo sapiens
agaacctctgggatctc

SEQ ID NO: 19813 - DNA, 21 bp, Homo sapiens
gaggataagctaacgatgctg

SEQ ID NO: 19814 - DNA, 21 bp, Homo sapiens
aaaaaaatccaaaacaaagaa

SEQ ID NO: 19815 - DNA, 24 bp, Homo sapiens
agggaaacaatgtgttcaaggcta

SEQ ID NO: 19816 - DNA, 23 bp, Homo sapiens
ctgtgaatacaggaacatagtca

SEQ ID NO: 19817 - DNA, 20 bp, Homo sapiens
gctcttgctggaggccttac

SEQ ID NO: 19818 - DNA, 19 bp, Homo sapiens
cccaccctcccacacctcc

SEQ ID NO: 19819 - DNA, 25 bp, Homo sapiens
ttctgctagctcatagcactcttcg

SEQ ID NO: 19820 - DNA, 18 bp, Homo sapiens
aacccagccccgggtccc

SEQ ID NO: 19821 - DNA, 19 bp, Homo sapiens
acattttgaaataatgtaa

SEQ ID NO: 19822 - DNA, 16 bp, Homo sapiens
accactcatcatcata

SEQ ID NO: 19823 - DNA, 22 bp, Homo sapiens
attcattttgtttgtttgatat

SEQ ID NO: 19824 - DNA, 17 bp, Homo sapiens
ctacagaatactggaca

SEQ ID NO: 19825 - DNA, 23 bp, Homo sapiens
gcttctctgccaacagctcctct

SEQ ID NO: 19826 - DNA, 21 bp, Homo sapiens
cacttggcacaaaacctggca

SEQ ID NO: 19827 - DNA, 16 bp, Homo sapiens
ggaactcacaaagcta

SEQ ID NO: 19828 - DNA, 22 bp, Homo sapiens
cagctgctcctggagtttgagc

SEQ ID NO: 19829 - DNA, 21 bp, Homo sapiens
aaccacgagagatgactgcag

SEQ ID NO: 19830 - DNA, 17 bp, Homo sapiens
aaagtaatgctgtgctg

SEQ ID NO: 19831 - DNA, 17 bp, Homo sapiens
gcttttcccccatttgt

SEQ ID NO: 19832 - DNA, 18 bp, Homo sapiens
tctttattagaatacttg

SEQ ID NO: 19833 - DNA, 20 bp, Homo sapiens
ttcaagcctcaagcttccaa

SEQ ID NO: 19834 - DNA, 18 bp, Homo sapiens
ccgcgacccgcttggctc

SEQ ID NO: 19835 - DNA, 18 bp, Homo sapiens
cgtccccgaccccacccg

SEQ ID NO: 19836 - DNA, 20 bp, Homo sapiens
gaggcggaagaacccccctg

SEQ ID NO: 19837 - DNA, 19 bp, Homo sapiens
ctgcaagctccacctccca

SEQ ID NO: 19838 - DNA, 18 bp, Homo sapiens
ggctgcccatataagtca

SEQ ID NO: 19839 - DNA, 20 bp, Homo sapiens
caataggagaaatgatacac

SEQ ID NO: 19840 - DNA, 17 bp, Homo sapiens
agccatcctggctgagg

SEQ ID NO: 19841 - DNA, 21 bp, Homo sapiens
acaagtgatacatccaatgca

SEQ ID NO: 19842 - DNA, 23 bp, Homo sapiens
atttgatttggtcagcctggctt

SEQ ID NO: 19843 - DNA, 17 bp, Homo sapiens
caattaaatcttgcctt

SEQ ID NO: 19844 - DNA, 16 bp, Homo sapiens
tgtaccatgcaatact

SEQ ID NO: 19845 - DNA, 15 bp, Homo sapiens
aagaacagaatacca

SEQ ID NO: 19846 - DNA, 19 bp, Homo sapiens
agcaagcgttgaaaactca

SEQ ID NO: 19847 - DNA, 18 bp, Homo sapiens
agctcgattagaagaatc

SEQ ID NO: 19848 - DNA, 20 bp, Homo sapiens
accctggcagccttccttga

SEQ ID NO: 19849 - DNA, 16 bp, Homo sapiens
catgagtgtgtggtca

SEQ ID NO: 19850 - DNA, 18 bp, Homo sapiens
cttccagaagcaacccag

SEQ ID NO: 19851 - DNA, 18 bp, Homo sapiens
tgtcaaggagaatctcca

SEQ ID NO: 19852 - DNA, 19 bp, Homo sapiens
gcgccgactcgctgcccag

SEQ ID NO: 19853 - DNA, 19 bp, Homo sapiens
ttccccgtgaaaccagaga

SEQ ID NO: 19854 - DNA, 24 bp, Homo sapiens
agaaatctgaaagcacctctgaca

SEQ ID NO: 19855 - DNA, 20 bp, Homo sapiens
agaggttgagtttgctgcca

SEQ ID NO: 19856 - DNA, 20 bp, Homo sapiens
gcacctctgacattcctttt

SEQ ID NO: 19857 - DNA, 16 bp, Homo sapiens
tctgaaagcacctctg

SEQ ID NO: 19858 - DNA, 20 bp, Homo sapiens
tctggccagttgtctggttt

SEQ ID NO: 19859 - DNA, 23 bp, Homo sapiens
tggatgctgttgtcatggagctg

SEQ ID NO: 19860 - DNA, 23 bp, Homo sapiens
aagtacaagtggttaatgtacca

SEQ ID NO: 19861 - DNA, 17 bp, Homo sapiens
agtaaagaatcatttca

SEQ ID NO: 19862 - DNA, 21 bp, Homo sapiens
aggaaatgtaactttggtttt

SEQ ID NO: 19863 - DNA, 22 bp, Homo sapiens
gttgatacaaataaaagttttt

SEQ ID NO: 19864 - DNA, 20 bp, Homo sapiens
tctagaattcaggatgttcc

SEQ ID NO: 19865 - DNA, 24 bp, Homo sapiens
cagggtcatggtctgaactactca

SEQ ID NO: 19866 - DNA, 15 bp, Homo sapiens
gagaacaaaggctga

SEQ ID NO: 19867 - DNA, 20 bp, Homo sapiens
tcctagaatccccatgactc

SEQ ID NO: 19868 - DNA, 20 bp, Homo sapiens
taggtgggcagatcatgagg

SEQ ID NO: 19869 - DNA, 24 bp, Homo sapiens
tgaggtcatggttgcaatgagtca

SEQ ID NO: 19870 - DNA, 18 bp, Homo sapiens
tgggtggatcacctgagg

SEQ ID NO: 19871 - DNA, 20 bp, Homo sapiens
catgtatgtgccacttctga

SEQ ID NO: 19872 - DNA, 18 bp, Homo sapiens
agagacttcttcccttca

SEQ ID NO: 19873 - DNA, 20 bp, Homo sapiens
caccctcccatcccagctga

SEQ ID NO: 19874 - DNA, 18 bp, Homo sapiens
cgggaggtttaggctcag

SEQ ID NO: 19875 - DNA, 17 bp, Homo sapiens
ttagaataactgttcca

SEQ ID NO: 19876 - DNA, 21 bp, Homo sapiens
ctgcattgaatacctgtttct

SEQ ID NO: 19877 - DNA, 23 bp, Homo sapiens
ttccatcttcctttgtatacttg

SEQ ID NO: 19878 - DNA, 21 bp, Homo sapiens
tgtaggaaatgccttgtgata

SEQ ID NO: 19879 - DNA, 19 bp, Homo sapiens
aggctgtttttgagtatga

SEQ ID NO: 19880 - DNA, 24 bp, Homo sapiens
ccatcctccatggcacagccctcc

SEQ ID NO: 19881 - DNA, 19 bp, Homo sapiens
ccggggaatgaccacccag

SEQ ID NO: 19882 - DNA, 28 bp, Homo sapiens
tctgaaaccaagaccttcccattcctcc

SEQ ID NO: 19883 - DNA, 21 bp, Homo sapiens
tggagttttaagcagaggtga

SEQ ID NO: 19884 - DNA, 23 bp, Homo sapiens
atattttagatataaacatcata

SEQ ID NO: 19885 - DNA, 26 bp, Homo sapiens
tttctagtggctactgttttagtttt

SEQ ID NO: 19886 - DNA, 20 bp, Homo sapiens
atatttagttcatcatttga

SEQ ID NO: 19887 - DNA, 19 bp, Homo sapiens
gtttgtgtccttgctctga

SEQ ID NO: 19888 - DNA, 21 bp, Homo sapiens
cacagtaacctcatttttgaa

SEQ ID NO: 19889 - DNA, 21 bp, Homo sapiens
acactgcgccaagagctcctc

SEQ ID NO: 19890 - DNA, 22 bp, Homo sapiens
caacaaaagcaacaggatgtca

SEQ ID NO: 19891 - DNA, 22 bp, Homo sapiens
cagacattattttaagctgcta

SEQ ID NO: 19892 - DNA, 19 bp, Homo sapiens
ccaagcactatgcaattga

SEQ ID NO: 19893 - DNA, 17 bp, Homo sapiens
ccacagataccatgata

SEQ ID NO: 19894 - DNA, 25 bp, Homo sapiens
gcaccaagaagttactgttacctca

SEQ ID NO: 19895 - DNA, 18 bp, Homo sapiens
tggatggatcaagtgaag

SEQ ID NO: 19896 - DNA, 18 bp, Homo sapiens
tggctcttatcatcatct

SEQ ID NO: 19897 - DNA, 20 bp, Homo sapiens
aacaaaaatcaaatgcctat

SEQ ID NO: 19898 - DNA, 19 bp, Homo sapiens
catgggtccactgttaaaa

SEQ ID NO: 19899 - DNA, 18 bp, Homo sapiens
ccctagaaaaacaactct

SEQ ID NO: 19900 - DNA, 19 bp, Homo sapiens
tacctcatccgtaggtgtg

SEQ ID NO: 19901 - DNA, 21 bp, Homo sapiens
tcattttcttttcaagcctca

SEQ ID NO: 19902 - DNA, 18 bp, Homo sapiens
agcataaatctcttctgt

SEQ ID NO: 19903 - DNA, 21 bp, Homo sapiens
aacttgtctcatctccacaca

SEQ ID NO: 19904 - DNA, 20 bp, Homo sapiens
cttagagagtgtcctctcat

SEQ ID NO: 19905 - DNA, 21 bp, Homo sapiens
gcattagtacattaaatttgg

SEQ ID NO: 19906 - DNA, 18 bp, Homo sapiens
ggtgtctagtagttctga

SEQ ID NO: 19907 - DNA, 24 bp, Homo sapiens
taaagccttccccatgtgaagctg

SEQ ID NO: 19908 - DNA, 20 bp, Homo sapiens
tgtgtccggtttatttctga

SEQ ID NO: 19909 - DNA, 17 bp, Homo sapiens
ttgtccagcctgaccaa

SEQ ID NO: 19910 - DNA, 21 bp, Homo sapiens
ctcagagggcacagctgcagg

SEQ ID NO: 19911 - DNA, 21 bp, Homo sapiens
gcacttgtgtgtcaccagcct

SEQ ID NO: 19912 - DNA, 18 bp, Homo sapiens
tgttttggggaggagttt

SEQ ID NO: 19913 - DNA, 21 bp, Homo sapiens
agaaaattttactgtgctgtg

SEQ ID NO: 19914 - DNA, 18 bp, Homo sapiens
gtgataaatataccagtt

SEQ ID NO: 19915 - DNA, 19 bp, Homo sapiens
aagcaattctcctgcctca

SEQ ID NO: 19916 - DNA, 22 bp, Homo sapiens
atcttggctcactgcaacctct

SEQ ID NO: 19917 - DNA, 20 bp, Homo sapiens
cctctgcctcccaggttcaa

SEQ ID NO: 19918 - DNA, 21 bp, Homo sapiens
cctggccaatcagattgtttt

SEQ ID NO: 19919 - DNA, 19 bp, Homo sapiens
ctgcaacctctgcctccca

SEQ ID NO: 19920 - DNA, 19 bp, Homo sapiens
gagccaccacacccagcga

SEQ ID NO: 19921 - DNA, 19 bp, Homo sapiens
taattccataattattttt

SEQ ID NO: 19922 - DNA, 21 bp, Homo sapiens
tcttcagagctaatcctctaa

SEQ ID NO: 19923 - DNA, 18 bp, Homo sapiens
tggcccagagtggagcta

SEQ ID NO: 19924 - DNA, 20 bp, Homo sapiens
cttaggtggttttattcatt

SEQ ID NO: 19925 - DNA, 24 bp, Homo sapiens
tgggttgtttccagtttggggctg

SEQ ID NO: 19926 - DNA, 19 bp, Homo sapiens
caaggatcttaactgtgtt

SEQ ID NO: 19927 - DNA, 18 bp, Homo sapiens
cttgaattacattagcac

SEQ ID NO: 19928 - DNA, 21 bp, Homo sapiens
gacactccagcatgctagtga

SEQ ID NO: 19929 - DNA, 19 bp, Homo sapiens
ggacttggcgaccatttca

SEQ ID NO: 19930 - DNA, 20 bp, Homo sapiens
tttattatctcctgatatgc

SEQ ID NO: 19931 - DNA, 18 bp, Homo sapiens
ggccgggtgcagtggctc

SEQ ID NO: 19932 - DNA, 18 bp, Homo sapiens
tgagtggatcacctgagg

SEQ ID NO: 19933 - DNA, 23 bp, Homo sapiens
atctctccagagccatattttct

SEQ ID NO: 19934 - DNA, 19 bp, Homo sapiens
ccttttcagttttgttttg

SEQ ID NO: 19935 - DNA, 20 bp, Homo sapiens
tggtgttctgaaatagccta

SEQ ID NO: 19936 - DNA, 21 bp, Homo sapiens
cccaaatgaaaaagttggtga

SEQ ID NO: 19937 - DNA, 24 bp, Homo sapiens
ggcgcccgccaccacgcccggcca

SEQ ID NO: 19938 - DNA, 20 bp, Homo sapiens
cccagagccaagtgcaccga

SEQ ID NO: 19939 - DNA, 28 bp, Homo sapiens
cctgaaagaggcaagactacaatgggct

SEQ ID NO: 19940 - DNA, 18 bp, Homo sapiens
gactgaatatacttcaca

SEQ ID NO: 19941 - DNA, 19 bp, Homo sapiens
tgtttgttaggagatgtct

SEQ ID NO: 19942 - DNA, 23 bp, Homo sapiens
aaagctataggaacaaagcacat

SEQ ID NO: 19943 - DNA, 16 bp, Homo sapiens
aagagggatcagagtg

SEQ ID NO: 19944 - DNA, 21 bp, Homo sapiens
aagatcataccttacctacca

SEQ ID NO: 19945 - DNA, 24 bp, Homo sapiens
agggctggaccacttgataacttc

SEQ ID NO: 19946 - DNA, 22 bp, Homo sapiens
tacacatgggtagagcctgcaa

SEQ ID NO: 19947 - DNA, 21 bp, Homo sapiens
tgagtggatctcctgccaggc

SEQ ID NO: 19948 - DNA, 23 bp, Homo sapiens
aacgtttttttatttttgtgctt

SEQ ID NO: 19949 - DNA, 19 bp, Homo sapiens
acttggagttgtcgacctt

SEQ ID NO: 19950 - DNA, 17 bp, Homo sapiens
tgctattcctcctgtcc

SEQ ID NO: 19951 - DNA, 22 bp, Homo sapiens
ttcaaagtcttccattttactt

SEQ ID NO: 19952 - DNA, 19 bp, Homo sapiens
tttccagaatagtaactca

SEQ ID NO: 19953 - DNA, 24 bp, Homo sapiens
gcccctgttcttcgctcaggagca

SEQ ID NO: 19954 - DNA, 17 bp, Homo sapiens
tgctgagaaccattcct

SEQ ID NO: 19955 - DNA, 20 bp, Homo sapiens
aatacgcttttggaaatgaa

SEQ ID NO: 19956 - DNA, 21 bp, Homo sapiens
aggaggaggcaagaggcgaga

SEQ ID NO: 19957 - DNA, 21 bp, Homo sapiens
cacagccaccacctctctcct

SEQ ID NO: 19958 - DNA, 20 bp, Homo sapiens
ctcctgaagacaatgttgaa

SEQ ID NO: 19959 - DNA, 19 bp, Homo sapiens
gaaatcatcaatattccca

SEQ ID NO: 19960 - DNA, 23 bp, Homo sapiens
tccagatgtcaacatatattata

SEQ ID NO: 19961 - DNA, 23 bp, Homo sapiens
tggaaaagctaaccatgaaattg

SEQ ID NO: 19962 - DNA, 20 bp, Homo sapiens
ttcaagaccagcctgaccaa

SEQ ID NO: 19963 - DNA, 19 bp, Homo sapiens
gcttttcctctacaggcct

SEQ ID NO: 19964 - DNA, 19 bp, Homo sapiens
tcagcaggatgctgaggaa

SEQ ID NO: 19965 - DNA, 19 bp, Homo sapiens
agtaaaatgttgatttctc

SEQ ID NO: 19966 - DNA, 23 bp, Homo sapiens
tcacaccacattacttggccttt

SEQ ID NO: 19967 - DNA, 18 bp, Homo sapiens
aatatcaaatattctgaa

SEQ ID NO: 19968 - DNA, 23 bp, Homo sapiens
ggaatagcccttaacatgaaatt

SEQ ID NO: 19969 - DNA, 19 bp, Homo sapiens
tgcaaaacattggttttct

SEQ ID NO: 19970 - DNA, 21 bp, Homo sapiens
ttcagatattgtcagctttga

SEQ ID NO: 19971 - DNA, 17 bp, Homo sapiens
atgcccttgctttggct

SEQ ID NO: 19972 - DNA, 19 bp, Homo sapiens
caggaacacacacatcctc

SEQ ID NO: 19973 - DNA, 19 bp, Homo sapiens
cgtgccaaagcacttacca

SEQ ID NO: 19974 - DNA, 23 bp, Homo sapiens
gaccctgtcattaattccatgtg

SEQ ID NO: 19975 - DNA, 18 bp, Homo sapiens
tcatacagagctgcagtt

SEQ ID NO: 19976 - DNA, 20 bp, Homo sapiens
ctgggcggctgtctggacct

SEQ ID NO: 19977 - DNA, 19 bp, Homo sapiens
aaacacttgggtttggtga

SEQ ID NO: 19978 - DNA, 19 bp, Homo sapiens
atgaaatgtgaagtttgtc

SEQ ID NO: 19979 - DNA, 21 bp, Homo sapiens
ctgtctttcttatatgaccct

SEQ ID NO: 19980 - DNA, 18 bp, Homo sapiens
gagcttccactgctgttt

SEQ ID NO: 19981 - DNA, 20 bp, Homo sapiens
gtaactgggtgattgccatt

SEQ ID NO: 19982 - DNA, 21 bp, Homo sapiens
tcacaccattacgtttctttt

SEQ ID NO: 19983 - DNA, 20 bp, Homo sapiens
tctattaactcagaggctca

SEQ ID NO: 19984 - DNA, 20 bp, Homo sapiens
ttactagaaagaccattaca

SEQ ID NO: 19985 - DNA, 16 bp, Homo sapiens
tgcctgtgtagggata

SEQ ID NO: 19986 - DNA, 22 bp, Homo sapiens
gagccaagatcactccactgca

SEQ ID NO: 19987 - DNA, 18 bp, Homo sapiens
aaatagtgactcccttga

SEQ ID NO: 19988 - DNA, 26 bp, Homo sapiens
attaacatggtaagccttagcagcaa

SEQ ID NO: 19989 - DNA, 22 bp, Homo sapiens
cttttctccacatacagtgcag

SEQ ID NO: 19990 - DNA, 19 bp, Homo sapiens
tgatccaaggccttgtgag

SEQ ID NO: 19991 - DNA, 18 bp, Homo sapiens
tgccagtatctgctctaa

SEQ ID NO: 19992 - DNA, 20 bp, Homo sapiens
ttgtttgtatttcttcaggt

SEQ ID NO: 19993 - DNA, 20 bp, Homo sapiens
acagcttcccgagtcattca

SEQ ID NO: 19994 - DNA, 25 bp, Homo sapiens
ccatcccaggtcaccacctggctga

SEQ ID NO: 19995 - DNA, 18 bp, Homo sapiens
cccaaaaacaacccctcc

SEQ ID NO: 19996 - DNA, 17 bp, Homo sapiens
cctccaacttgacatca

SEQ ID NO: 19997 - DNA, 19 bp, Homo sapiens
gcctctggcccaggagtta

SEQ ID NO: 19998 - DNA, 17 bp, Homo sapiens
ttggttcctcacaaagc

SEQ ID NO: 19999 - DNA, 17 bp, Homo sapiens
ttggttcctcacaaagc

SEQ ID NO: 20000 - DNA, 22 bp, Homo sapiens
cctgttttgttgagttgctgct

SEQ ID NO: 20001 - DNA, 22 bp, Homo sapiens
cttccctgccagcccacctgcc

SEQ ID NO: 20002 - DNA, 18 bp, Homo sapiens
tctgatgagcattcggta

SEQ ID NO: 20003 - DNA, 23 bp, Homo sapiens
caagaagaggtgtagagtttgca

SEQ ID NO: 20004 - DNA, 22 bp, Homo sapiens
gtcctaaaagtcttttgtgaga

SEQ ID NO: 20005 - DNA, 18 bp, Homo sapiens
taggtggatcgcctgagg

SEQ ID NO: 20006 - DNA, 21 bp, Homo sapiens
aatatattctctcatccctct

SEQ ID NO: 20007 - DNA, 23 bp, Homo sapiens
atctgcataatgttcactgccaa

SEQ ID NO: 20008 - DNA, 19 bp, Homo sapiens
catcatttttgtttccttt

SEQ ID NO: 20009 - DNA, 21 bp, Homo sapiens
tctttctggccaaatctctaa

SEQ ID NO: 20010 - DNA, 22 bp, Homo sapiens
tgaacccacacacacccaatga

SEQ ID NO: 20011 - DNA, 19 bp, Homo sapiens
tgaatgagataaaaagtga

SEQ ID NO: 20012 - DNA, 21 bp, Homo sapiens
tgtctctcactgatttagctt

SEQ ID NO: 20013 - DNA, 24 bp, Homo sapiens
caagaaagtagtgagagtttgcca

SEQ ID NO: 20014 - DNA, 19 bp, Homo sapiens
agtaacaggggcagttcct

SEQ ID NO: 20015 - DNA, 16 bp, Homo sapiens
caggggcagttcctga

SEQ ID NO: 20016 - DNA, 21 bp, Homo sapiens
gaatatcaagtatttctctgg

SEQ ID NO: 20017 - DNA, 20 bp, Homo sapiens
tatttctctggctcttgaca

SEQ ID NO: 20018 - DNA, 21 bp, Homo sapiens
acaaaaacaaaatctacctta

SEQ ID NO: 20019 - DNA, 22 bp, Homo sapiens
ccctaactcacctccccacagc

SEQ ID NO: 20020 - DNA, 19 bp, Homo sapiens
ggccatttccagccagctc

SEQ ID NO: 20021 - DNA, 20 bp, Homo sapiens
tgagcatggttctaacacct

SEQ ID NO: 20022 - DNA, 21 bp, Homo sapiens
atgaaatgaaaggttgcatat

SEQ ID NO: 20023 - DNA, 18 bp, Homo sapiens
caatcgttttttacttca

SEQ ID NO: 20024 - DNA, 16 bp, Homo sapiens
actctagacctgcctg

SEQ ID NO: 20025 - DNA, 16 bp, Homo sapiens
atgatacagagatgtc

SEQ ID NO: 20026 - DNA, 20 bp, Homo sapiens
ctagaattattgtccgttcc

SEQ ID NO: 20027 - DNA, 18 bp, Homo sapiens
ctgtgtgtgattttgttt

SEQ ID NO: 20028 - DNA, 22 bp, Homo sapiens
gtgtctatacattgctttccgc

SEQ ID NO: 20029 - DNA, 21 bp, Homo sapiens
tttcctgtgcattaacctctg

SEQ ID NO: 20030 - DNA, 18 bp, Homo sapiens
aatttttagatctctgga

SEQ ID NO: 20031 - DNA, 20 bp, Homo sapiens
caggcttcatggattcttga

SEQ ID NO: 20032 - DNA, 22 bp, Homo sapiens
ccttccccaggctctgcttcca

SEQ ID NO: 20033 - DNA, 17 bp, Homo sapiens
ctcaaaaacgtgagcgt

SEQ ID NO: 20034 - DNA, 22 bp, Homo sapiens
gtggtacccgtagtgcccagca

SEQ ID NO: 20035 - DNA, 17 bp, Homo sapiens
gttgcgtattggaaatt

SEQ ID NO: 20036 - DNA, 21 bp, Homo sapiens
tggattcttgacatgtaattg

SEQ ID NO: 20037 - DNA, 20 bp, Homo sapiens
aattattcgatgacatgatg

SEQ ID NO: 20038 - DNA, 21 bp, Homo sapiens
gcgggtcggccgttctgcccc

SEQ ID NO: 20039 - DNA, 22 bp, Homo sapiens
aggccacatctatggtaattaa

SEQ ID NO: 20040 - DNA, 21 bp, Homo sapiens
atttggaaatgtccttggctt

SEQ ID NO: 20041 - DNA, 16 bp, Homo sapiens
gtacaggcacctgcca

SEQ ID NO: 20042 - DNA, 22 bp, Homo sapiens
gtgctgctgacaggtgaactct

SEQ ID NO: 20043 - DNA, 18 bp, Homo sapiens
tccgcctcctgggttcaa

SEQ ID NO: 20044 - DNA, 20 bp, Homo sapiens
aggtagaacttgagaactca

SEQ ID NO: 20045 - DNA, 20 bp, Homo sapiens
gaattcgttctacaacatga

SEQ ID NO: 20046 - DNA, 18 bp, Homo sapiens
gactgctgaatcatcata

SEQ ID NO: 20047 - DNA, 22 bp, Homo sapiens
ggcttttcttgagcccatttta

SEQ ID NO: 20048 - DNA, 24 bp, Homo sapiens
caccacacccagctctctttcttg

SEQ ID NO: 20049 - DNA, 22 bp, Homo sapiens
gcttagagagaataagcttctt

SEQ ID NO: 20050 - DNA, 24 bp, Homo sapiens
ccaacagtgattgaggatttgtgg

SEQ ID NO: 20051 - DNA, 17 bp, Homo sapiens
ctttcttcatagcttct

SEQ ID NO: 20052 - DNA, 26 bp, Homo sapiens
gaaagtggtaatcctgaatctctttt

SEQ ID NO: 20053 - DNA, 18 bp, Homo sapiens
gttcccaagtggtagata

SEQ ID NO: 20054 - DNA, 21 bp, Homo sapiens
tacaaaagttttgagctcttc

SEQ ID NO: 20055 - DNA, 24 bp, Homo sapiens
tccaagactggatgctggatctca

SEQ ID NO: 20056 - DNA, 18 bp, Homo sapiens
aggagctttggccatata

SEQ ID NO: 20057 - DNA, 16 bp, Homo sapiens
ctcattggttatgagg

SEQ ID NO: 20058 - DNA, 21 bp, Homo sapiens
gctggatccaatagtgacctg

SEQ ID NO: 20059 - DNA, 23 bp, Homo sapiens
tccattgctgtatatttgcctaa

SEQ ID NO: 20060 - DNA, 19 bp, Homo sapiens
ttctagttccattgctgta

SEQ ID NO: 20061 - DNA, 21 bp, Homo sapiens
tttcttctatgccttaggctt

SEQ ID NO: 20062 - DNA, 19 bp, Homo sapiens
actcatcagtgtggtaatc

SEQ ID NO: 20063 - DNA, 20 bp, Homo sapiens
aactgctttttatctgagaa

SEQ ID NO: 20064 - DNA, 18 bp, Homo sapiens
acaataaacctttcctga

SEQ ID NO: 20065 - DNA, 19 bp, Homo sapiens
ccagggcctagccctgaca

SEQ ID NO: 20066 - DNA, 30 bp, Homo sapiens
gtcttggctgggtctggaggtgtctgtgga

SEQ ID NO: 20067 - DNA, 21 bp, Homo sapiens
tccgctgtgtcccgagcacac

SEQ ID NO: 20068 - DNA, 19 bp, Homo sapiens
agaagtgaacaaggagtca

SEQ ID NO: 20069 - DNA, 19 bp, Homo sapiens
aggctggagaagtgaacaa

SEQ ID NO: 20070 - DNA, 25 bp, Homo sapiens
gcagaaagaaccacaaactccatct

SEQ ID NO: 20071 - DNA, 20 bp, Homo sapiens
ttttcccaattcaacttcat

SEQ ID NO: 20072 - DNA, 22 bp, Homo sapiens
acacggtgctcagtgggtgcca

SEQ ID NO: 20073 - DNA, 21 bp, Homo sapiens
atgaagttacaggctagcaca

SEQ ID NO: 20074 - DNA, 18 bp, Homo sapiens
tccaactcttgggctcaa

SEQ ID NO: 20075 - DNA, 24 bp, Homo sapiens
ccagattctcaagcagatgcccaa

SEQ ID NO: 20076 - DNA, 17 bp, Homo sapiens
cccacctgccctgcact

SEQ ID NO: 20077 - DNA, 20 bp, Homo sapiens
ccctccctgcctcggctctg

SEQ ID NO: 20078 - DNA, 16 bp, Homo sapiens
gcagccctcctgcccc

SEQ ID NO: 20079 - DNA, 20 bp, Homo sapiens
gctctgccgccccagcctca

SEQ ID NO: 20080 - DNA, 20 bp, Homo sapiens
gggaggtccccacagagcca

SEQ ID NO: 20081 - DNA, 23 bp, Homo sapiens
tcaccaagtcacctccctccttg

SEQ ID NO: 20082 - DNA, 20 bp, Homo sapiens
tggtcttctcctgggctcca

SEQ ID NO: 20083 - DNA, 19 bp, Homo sapiens
ttctccccatgcttctagg

SEQ ID NO: 20084 - DNA, 18 bp, Homo sapiens
aagaatcccttcctcttg

SEQ ID NO: 20085 - DNA, 21 bp, Homo sapiens
cctccccccacccccatctcc

SEQ ID NO: 20086 - DNA, 17 bp, Homo sapiens
cgccaagtagccggtgg

SEQ ID NO: 20087 - DNA, 20 bp, Homo sapiens
cggcgccaagtagccggtgg

SEQ ID NO: 20088 - DNA, 19 bp, Homo sapiens
gaacatatcatactgaaca

SEQ ID NO: 20089 - DNA, 24 bp, Homo sapiens
tctagagagtaggacttttattcc

SEQ ID NO: 20090 - DNA, 18 bp, Homo sapiens
caaatcagagctcacagt

SEQ ID NO: 20091 - DNA, 19 bp, Homo sapiens
cagagtctgcatggcactc

SEQ ID NO: 20092 - DNA, 23 bp, Homo sapiens
ctgttcattctgctcgtatccca

SEQ ID NO: 20093 - DNA, 17 bp, Homo sapiens
gcctcctccctaaccca

SEQ ID NO: 20094 - DNA, 19 bp, Homo sapiens
gctccctggaggtttttaa

SEQ ID NO: 20095 - DNA, 27 bp, Homo sapiens
gcttgaagaaccttgactgcttggtcc

SEQ ID NO: 20096 - DNA, 17 bp, Homo sapiens
tgcatgccaagctgcct

SEQ ID NO: 20097 - DNA, 23 bp, Homo sapiens
ttctctgatgtgcacaaacacaa

SEQ ID NO: 20098 - DNA, 18 bp, Homo sapiens
aaaagcaactgcaggaca

SEQ ID NO: 20099 - DNA, 18 bp, Homo sapiens
accaccttcctgcccaca

SEQ ID NO: 20100 - DNA, 19 bp, Homo sapiens
agagggtggagtccacatc

SEQ ID NO: 20101 - DNA, 20 bp, Homo sapiens
cgtccccgcgcccagccctc

SEQ ID NO: 20102 - DNA, 19 bp, Homo sapiens
gtccccgcgcccagccctc

SEQ ID NO: 20103 - DNA, 21 bp, Homo sapiens
tgaacaagagtccagccaacc

SEQ ID NO: 20104 - DNA, 21 bp, Homo sapiens
aatgactagagggagccaaga

SEQ ID NO: 20105 - DNA, 18 bp, Homo sapiens
agatccaatcaaacctca

SEQ ID NO: 20106 - DNA, 21 bp, Homo sapiens
tgactagagggagccaagagg

SEQ ID NO: 20107 - DNA, 25 bp, Homo sapiens
ccagcacaaagggcccaggaagcca

SEQ ID NO: 20108 - DNA, 24 bp, Homo sapiens
ccctcacctccccgaggactggat

SEQ ID NO: 20109 - DNA, 22 bp, Homo sapiens
ccgtcccaccaccaagttcacc

SEQ ID NO: 20110 - DNA, 16 bp, Homo sapiens
ctggcgctcacgctgc

SEQ ID NO: 20111 - DNA, 19 bp, Homo sapiens
agaagtaaacaggcacctt

SEQ ID NO: 20112 - DNA, 23 bp, Homo sapiens
atctggctgctggtgtttggctt

SEQ ID NO: 20113 - DNA, 20 bp, Homo sapiens
cttcgttcctcctctgcttc

SEQ ID NO: 20114 - DNA, 25 bp, Homo sapiens
gaaaaactgtgccatggacattttt

SEQ ID NO: 20115 - DNA, 19 bp, Homo sapiens
aaaccagccaatcaataac

SEQ ID NO: 20116 - DNA, 24 bp, Homo sapiens
aatcaaattgcactgatctatgta

SEQ ID NO: 20117 - DNA, 21 bp, Homo sapiens
agatggagaaagatgatcata

SEQ ID NO: 20118 - DNA, 19 bp, Homo sapiens
atactcagaaaaattggtt

SEQ ID NO: 20119 - DNA, 19 bp, Homo sapiens
caccacctggttttgtaaa

SEQ ID NO: 20120 - DNA, 23 bp, Homo sapiens
tgagttcactgaatatgaaattg

SEQ ID NO: 20121 - DNA, 18 bp, Homo sapiens
aagatcaccacgcattga

SEQ ID NO: 20122 - DNA, 18 bp, Homo sapiens
acttaatcttttacatca

SEQ ID NO: 20123 - DNA, 17 bp, Homo sapiens
atctatgacttctacat

SEQ ID NO: 20124 - DNA, 21 bp, Homo sapiens
atttcatttttagattaaact

SEQ ID NO: 20125 - DNA, 20 bp, Homo sapiens
caagatcaccacgcattgaa

SEQ ID NO: 20126 - DNA, 21 bp, Homo sapiens
ccctataaatctggtcagcaa

SEQ ID NO: 20127 - DNA, 23 bp, Homo sapiens
gcacattttccacaatacattgc

SEQ ID NO: 20128 - DNA, 22 bp, Homo sapiens
tacgtgttcctgaatgaagctg

SEQ ID NO: 20129 - DNA, 17 bp, Homo sapiens
atgagtgcagtgtcaga

SEQ ID NO: 20130 - DNA, 21 bp, Homo sapiens
tgtcctggatgtggcagggaa

SEQ ID NO: 20131 - DNA, 23 bp, Homo sapiens
accaaactgtcaccatctttgca

SEQ ID NO: 20132 - DNA, 20 bp, Homo sapiens
accatgactagtaaatgtaa

SEQ ID NO: 20133 - DNA, 19 bp, Homo sapiens
cactttgattcccatttgg

SEQ ID NO: 20134 - DNA, 18 bp, Homo sapiens
cggcactccagcctgggc

SEQ ID NO: 20135 - DNA, 20 bp, Homo sapiens
ctccaggcaggaagcagtgc

SEQ ID NO: 20136 - DNA, 21 bp, Homo sapiens
ctgtatcgtagccgtccacaa

SEQ ID NO: 20137 - DNA, 19 bp, Homo sapiens
gtagtaatattctatcata

SEQ ID NO: 20138 - DNA, 24 bp, Homo sapiens
tacccaactgtcaccatctttgca

SEQ ID NO: 20139 - DNA, 16 bp, Homo sapiens
tattaccttgtgttca

SEQ ID NO: 20140 - DNA, 17 bp, Homo sapiens
ttctgccgtgactgttc

SEQ ID NO: 20141 - DNA, 20 bp, Homo sapiens
cagaggccttaaaattctgg

SEQ ID NO: 20142 - DNA, 23 bp, Homo sapiens
ggtccgctccctctagccagctc

SEQ ID NO: 20143 - DNA, 16 bp, Homo sapiens
tggaagacttgccaaa

SEQ ID NO: 20144 - DNA, 19 bp, Homo sapiens
actaagtgctctgctctga

SEQ ID NO: 20145 - DNA, 22 bp, Homo sapiens
ataatcaattgtgctgatatta

SEQ ID NO: 20146 - DNA, 18 bp, Homo sapiens
tcctccagaagtctgtga

SEQ ID NO: 20147 - DNA, 22 bp, Homo sapiens
ccagggctggaggcaggtccca

SEQ ID NO: 20148 - DNA, 21 bp, Homo sapiens
cgcgccgctccctcatgctgc

SEQ ID NO: 20149 - DNA, 18 bp, Homo sapiens
tggcttccgcctgtgcta

SEQ ID NO: 20150 - DNA, 22 bp, Homo sapiens
tttcaactgttgtcttgctctt

SEQ ID NO: 20151 - DNA, 19 bp, Homo sapiens
cctcatggaggacttggag

SEQ ID NO: 20152 - DNA, 19 bp, Homo sapiens
cctggatggcgttgggtct

SEQ ID NO: 20153 - DNA, 20 bp, Homo sapiens
cctgtctcaaaaaacaaatc

SEQ ID NO: 20154 - DNA, 20 bp, Homo sapiens
cttcactgttgtcttacttt

SEQ ID NO: 20155 - DNA, 22 bp, Homo sapiens
gagccaagatcctgccactgca

SEQ ID NO: 20156 - DNA, 23 bp, Homo sapiens
tcagaaaaaatagatttctttca

SEQ ID NO: 20157 - DNA, 16 bp, Homo sapiens
ttcaaaaccttctgga

SEQ ID NO: 20158 - DNA, 21 bp, Homo sapiens
agaggaacaaggacacagaca

SEQ ID NO: 20159 - DNA, 21 bp, Homo sapiens
atgcctcctgtctcaacactg

SEQ ID NO: 20160 - DNA, 20 bp, Homo sapiens
ctcccagctctcttgcactg

SEQ ID NO: 20161 - DNA, 20 bp, Homo sapiens
gcagccctatggtgaccgcc

SEQ ID NO: 20162 - DNA, 20 bp, Homo sapiens
gggcctccagcctgggactg

SEQ ID NO: 20163 - DNA, 19 bp, Homo sapiens
ggggttggcagcctcagtt

SEQ ID NO: 20164 - DNA, 21 bp, Homo sapiens
tcccagctctcttgcactgca

SEQ ID NO: 20165 - DNA, 22 bp, Homo sapiens
atttgagtgggttggttggccc

SEQ ID NO: 20166 - DNA, 17 bp, Homo sapiens
tctgctgagcgccttct

SEQ ID NO: 20167 - DNA, 17 bp, Homo sapiens
tctgcataattctactt

SEQ ID NO: 20168 - DNA, 17 bp, Homo sapiens
tgggaaatgtctagtaa

SEQ ID NO: 20169 - DNA, 18 bp, Homo sapiens
cagtcctggcagtgccgt

SEQ ID NO: 20170 - DNA, 19 bp, Homo sapiens
ccccaccatgaacctgtca

SEQ ID NO: 20171 - DNA, 23 bp, Homo sapiens
ctgtgtgggctgggctggtcaga

SEQ ID NO: 20172 - DNA, 19 bp, Homo sapiens
gattcagaccttgtccaca

SEQ ID NO: 20173 - DNA, 16 bp, Homo sapiens
gctccatttcatgagt

SEQ ID NO: 20174 - DNA, 19 bp, Homo sapiens
gtacattctcattgttgtc

SEQ ID NO: 20175 - DNA, 19 bp, Homo sapiens
gttaaacaccagcctgaca

SEQ ID NO: 20176 - DNA, 21 bp, Homo sapiens
aaccaggttgatctgccacag

SEQ ID NO: 20177 - DNA, 20 bp, Homo sapiens
actgctgtcttccctacctc

SEQ ID NO: 20178 - DNA, 21 bp, Homo sapiens
cactgctgtcttccctacctc

SEQ ID NO: 20179 - DNA, 17 bp, Homo sapiens
catgaccgatgcaggga

SEQ ID NO: 20180 - DNA, 22 bp, Homo sapiens
gcctggagtctgtgcctggtcc

SEQ ID NO: 20181 - DNA, 19 bp, Homo sapiens
gtcaccatagagcctgcaa

SEQ ID NO: 20182 - DNA, 26 bp, Homo sapiens
cgagatctgcggtctggggtctggtt

SEQ ID NO: 20183 - DNA, 18 bp, Homo sapiens
tcacctcacccttttcca

SEQ ID NO: 20184 - DNA, 20 bp, Homo sapiens
tcctaaataaaaagtaaaca

SEQ ID NO: 20185 - DNA, 22 bp, Homo sapiens
ttaaaaatgagccaagtgtggt

SEQ ID NO: 20186 - DNA, 20 bp, Homo sapiens
aacatatccagtacaattta

SEQ ID NO: 20187 - DNA, 19 bp, Homo sapiens
aggtgcctcagccatccca

SEQ ID NO: 20188 - DNA, 21 bp, Homo sapiens
tcccaggtgattctgtaagtt

SEQ ID NO: 20189 - DNA, 18 bp, Homo sapiens
caaatcagagctcacagt

SEQ ID NO: 20190 - DNA, 19 bp, Homo sapiens
cagagtctgcatggcactc

SEQ ID NO: 20191 - DNA, 23 bp, Homo sapiens
ctgttcattctgctcgtatccca

SEQ ID NO: 20192 - DNA, 17 bp, Homo sapiens
gcctcctccctaaccca

SEQ ID NO: 20193 - DNA, 19 bp, Homo sapiens
gctccctggaggtttttaa

SEQ ID NO: 20194 - DNA, 27 bp, Homo sapiens
gcttgaagaaccttgactgcttggtcc

SEQ ID NO: 20195 - DNA, 17 bp, Homo sapiens
tgcatgccaagctgcct

SEQ ID NO: 20196 - DNA, 23 bp, Homo sapiens
ttctctgatgtgcacaaacacaa

SEQ ID NO: 20197 - DNA, 18 bp, Homo sapiens
cagagaacagggctcccc

SEQ ID NO: 20198 - DNA, 19 bp, Homo sapiens
cgccaatagcaccctgaga

SEQ ID NO: 20199 - DNA, 19 bp, Homo sapiens
ctgcaagctctgcctccca

SEQ ID NO: 20200 - DNA, 22 bp, Homo sapiens
gtagagacagggtctcaccatg

SEQ ID NO: 20201 - DNA, 19 bp, Homo sapiens
tacattatatcattacctg

SEQ ID NO: 20202 - DNA, 19 bp, Homo sapiens
gacataccgaggaccaact

SEQ ID NO: 20203 - DNA, 22 bp, Homo sapiens
agtctcctttcagtatttggca

SEQ ID NO: 20204 - DNA, 19 bp, Homo sapiens
gcacgaagcaggcctgtta

SEQ ID NO: 20205 - DNA, 22 bp, Homo sapiens
gcctgagcttgtgggtctgttc

SEQ ID NO: 20206 - DNA, 20 bp, Homo sapiens
tggaaataggaaggaccaca

SEQ ID NO: 20207 - DNA, 17 bp, Homo sapiens
ctgaactgacctctgaa

SEQ ID NO: 20208 - DNA, 22 bp, Homo sapiens
ctgccgagtccggtcggtgacc

SEQ ID NO: 20209 - DNA, 21 bp, Homo sapiens
actttaaacatttcctaactc

SEQ ID NO: 20210 - DNA, 21 bp, Homo sapiens
agcaagaatgacctcctgcag

SEQ ID NO: 20211 - DNA, 17 bp, Homo sapiens
aggacagcactgctgct

SEQ ID NO: 20212 - DNA, 20 bp, Homo sapiens
atgtagatagcgcttttgaa

SEQ ID NO: 20213 - DNA, 21 bp, Homo sapiens
attctaccttcatcctaccca

SEQ ID NO: 20214 - DNA, 19 bp, Homo sapiens
cccaggagtaatttctcag

SEQ ID NO: 20215 - DNA, 16 bp, Homo sapiens
ccgggatcatggtgtt

SEQ ID NO: 20216 - DNA, 18 bp, Homo sapiens
tagttgaacttgacagca

SEQ ID NO: 20217 - DNA, 20 bp, Homo sapiens
acattcatatagtctctgtg

SEQ ID NO: 20218 - DNA, 19 bp, Homo sapiens
cagtacagttatttgtcaa

SEQ ID NO: 20219 - DNA, 21 bp, Homo sapiens
agcctctgacatgctctttga

SEQ ID NO: 20220 - DNA, 18 bp, Homo sapiens
catctgtcagtaatgaga

SEQ ID NO: 20221 - DNA, 19 bp, Homo sapiens
ggctctgacgaaacactga

SEQ ID NO: 20222 - DNA, 17 bp, Homo sapiens
gtatttctgtgttgtca

SEQ ID NO: 20223 - DNA, 17 bp, Homo sapiens
tcctcagagcaggtcga

SEQ ID NO: 20224 - DNA, 22 bp, Homo sapiens
tttaagtaactgagtcattttt

SEQ ID NO: 20225 - DNA, 17 bp, Homo sapiens
aaccttgcatgtcatca

SEQ ID NO: 20226 - DNA, 22 bp, Homo sapiens
aatgtggcaagtttttcagaca

SEQ ID NO: 20227 - DNA, 23 bp, Homo sapiens
tttgtgacaaggatttcgggtgt

SEQ ID NO: 20228 - DNA, 22 bp, Homo sapiens
ccactgctccttctaacatttt

SEQ ID NO: 20229 - DNA, 17 bp, Homo sapiens
ccgtctcccgggttcaa

SEQ ID NO: 20230 - DNA, 20 bp, Homo sapiens
cctaagcgtcctttacatta

SEQ ID NO: 20231 - DNA, 18 bp, Homo sapiens
gctatgcttctgctctga

SEQ ID NO: 20232 - DNA, 19 bp, Homo sapiens
gtggacagcagccaccctt

SEQ ID NO: 20233 - DNA, 21 bp, Homo sapiens
tgatgcacacaccaagtggta

SEQ ID NO: 20234 - DNA, 23 bp, Homo sapiens
ttctaacgttttttcatcatagt

SEQ ID NO: 20235 - DNA, 19 bp, Homo sapiens
aagataggaccaaatatgt

SEQ ID NO: 20236 - DNA, 19 bp, Homo sapiens
aagtaatgattaaagcttg

SEQ ID NO: 20237 - DNA, 22 bp, Homo sapiens
caaaatgcatatatggttttga

SEQ ID NO: 20238 - DNA, 21 bp, Homo sapiens
tgggcataatagtttacctca

SEQ ID NO: 20239 - DNA, 21 bp, Homo sapiens
tttatttttattggttcctga

SEQ ID NO: 20240 - DNA, 19 bp, Homo sapiens
gaaaggtacaaatagaggt

SEQ ID NO: 20241 - DNA, 17 bp, Homo sapiens
tgggctgactggggctg

SEQ ID NO: 20242 - DNA, 22 bp, Homo sapiens
taggattatgcctagtttgtca

SEQ ID NO: 20243 - DNA, 22 bp, Homo sapiens
aacgtgtgtgtcagttggacca

SEQ ID NO: 20244 - DNA, 17 bp, Homo sapiens
ccagggaaaacctcgga

SEQ ID NO: 20245 - DNA, 19 bp, Homo sapiens
ggccacagtgataccatcc

SEQ ID NO: 20246 - DNA, 21 bp, Homo sapiens
ggccacagtgataccatccca

SEQ ID NO: 20247 - DNA, 18 bp, Homo sapiens
tcagccctggtggcggca

SEQ ID NO: 20248 - DNA, 18 bp, Homo sapiens
tccctgtgtgactcagtt

SEQ ID NO: 20249 - DNA, 20 bp, Homo sapiens
agccttcagcagattccgtc

SEQ ID NO: 20250 - DNA, 17 bp, Homo sapiens
tgctgctctctaccaga

SEQ ID NO: 20251 - DNA, 20 bp, Homo sapiens
aaactgcccatcatgtgcac

SEQ ID NO: 20252 - DNA, 17 bp, Homo sapiens
agtcccaccctcaccat

SEQ ID NO: 20253 - DNA, 21 bp, Homo sapiens
atcttggctcactgcaacctc

SEQ ID NO: 20254 - DNA, 25 bp, Homo sapiens
cctgatcttgctatcaattgctgct

SEQ ID NO: 20255 - DNA, 22 bp, Homo sapiens
gaaaccaccctcgccaccaaga

SEQ ID NO: 20256 - DNA, 23 bp, Homo sapiens
gcacaagcaatacgcttgcctta

SEQ ID NO: 20257 - DNA, 21 bp, Homo sapiens
gtcatagaagaggatcttaga

SEQ ID NO: 20258 - DNA, 20 bp, Homo sapiens
tgacccccagcatgggattg

SEQ ID NO: 20259 - DNA, 18 bp, Homo sapiens
cgaccacgctgcctgtgg

SEQ ID NO: 20260 - DNA, 22 bp, Homo sapiens
gcctggcagagctgcctgtctt

SEQ ID NO: 20261 - DNA, 20 bp, Homo sapiens
gcctgtcttgtgtctgctga

SEQ ID NO: 20262 - DNA, 19 bp, Homo sapiens
aatgctcagacgacacaca

SEQ ID NO: 20263 - DNA, 20 bp, Homo sapiens
ctccccttcaggcccccgga

SEQ ID NO: 20264 - DNA, 23 bp, Homo sapiens
ctgacatgtgtatagtaatctca

SEQ ID NO: 20265 - DNA, 18 bp, Homo sapiens
tcagaccctctagttgca

SEQ ID NO: 20266 - DNA, 19 bp, Homo sapiens
ttgcactccagcccgggtt

SEQ ID NO: 20267 - DNA, 17 bp, Homo sapiens
aatagttaacccttcta

SEQ ID NO: 20268 - DNA, 21 bp, Homo sapiens
ccatctagactccatctcaaa

SEQ ID NO: 20269 - DNA, 22 bp, Homo sapiens
cccgtgggctccggcgtgaggc

SEQ ID NO: 20270 - DNA, 19 bp, Homo sapiens
gcagctgtcgggacgtgac

SEQ ID NO: 20271 - DNA, 20 bp, Homo sapiens
tcctgaacttctcccattaa

SEQ ID NO: 20272 - DNA, 23 bp, Homo sapiens
tgtaggaaataaaagtgatgata

SEQ ID NO: 20273 - DNA, 18 bp, Homo sapiens
aagaataaggtctggtta

SEQ ID NO: 20274 - DNA, 19 bp, Homo sapiens
aagcaattctcctacctca

SEQ ID NO: 20275 - DNA, 17 bp, Homo sapiens
acagagtatggctgttg

SEQ ID NO: 20276 - DNA, 18 bp, Homo sapiens
gctttcgtctgtcatcag

SEQ ID NO: 20277 - DNA, 20 bp, Homo sapiens
ggaacaactccattttatct

SEQ ID NO: 20278 - DNA, 19 bp, Homo sapiens
tgaagagattcgtctagag

SEQ ID NO: 20279 - DNA, 19 bp, Homo sapiens
ttcgcatatgtctatgaaa

SEQ ID NO: 20280 - DNA, 23 bp, Homo sapiens
ctttcttctcaagattcatgact

SEQ ID NO: 20281 - DNA, 19 bp, Homo sapiens
gagaggtactatgtgggtg

SEQ ID NO: 20282 - DNA, 20 bp, Homo sapiens
gtcagaagatctagaacagc

SEQ ID NO: 20283 - DNA, 20 bp, Homo sapiens
cttgaggctcatcttgcaca

SEQ ID NO: 20284 - DNA, 21 bp, Homo sapiens
caaccctgatttcctgcttct

SEQ ID NO: 20285 - DNA, 23 bp, Homo sapiens
caaaggactttttattcccttcc

SEQ ID NO: 20286 - DNA, 16 bp, Homo sapiens
caggtgagagctctgc

SEQ ID NO: 20287 - DNA, 19 bp, Homo sapiens
ggtttttgcctccagatga

SEQ ID NO: 20288 - DNA, 21 bp, Homo sapiens
tcaaaagtcagtgctaatgtt

SEQ ID NO: 20289 - DNA, 18 bp, Homo sapiens
tctacctcctgggttcaa

SEQ ID NO: 20290 - DNA, 18 bp, Homo sapiens
agtaaaaccattcaatca

SEQ ID NO: 20291 - DNA, 19 bp, Homo sapiens
gccctactgcctaaacact

SEQ ID NO: 20292 - DNA, 20 bp, Homo sapiens
cccagaaaaatgtacatgac

SEQ ID NO: 20293 - DNA, 22 bp, Homo sapiens
ttgagagaaacaaaaacactga

SEQ ID NO: 20294 - DNA, 20 bp, Homo sapiens
acacagagtaataatcaaac

SEQ ID NO: 20295 - DNA, 19 bp, Homo sapiens
ctgtaattctgttgtgtgt

SEQ ID NO: 20296 - DNA, 26 bp, Homo sapiens
cttatgttagtctctaaattattttt

SEQ ID NO: 20297 - DNA, 18 bp, Homo sapiens
gcttataaagcattttca

SEQ ID NO: 20298 - DNA, 27 bp, Homo sapiens
acatcatagttgataaattgatgttat

SEQ ID NO: 20299 - DNA, 18 bp, Homo sapiens
actggtggcacacgtggc

SEQ ID NO: 20300 - DNA, 24 bp, Homo sapiens
caagcatcaccaatgaacatttca

SEQ ID NO: 20301 - DNA, 22 bp, Homo sapiens
ccttgttaacaagcatcaccaa

SEQ ID NO: 20302 - DNA, 19 bp, Homo sapiens
gtatttgaaacataacttt

SEQ ID NO: 20303 - DNA, 19 bp, Homo sapiens
gtgcctaaacattacattg

SEQ ID NO: 20304 - DNA, 19 bp, Homo sapiens
tgttttctgtattgtttaa

SEQ ID NO: 20305 - DNA, 25 bp, Homo sapiens
tttcccgggtgagcccctctctgaa

SEQ ID NO: 20306 - DNA, 20 bp, Homo sapiens
ccttagccaaacaggaagaa

SEQ ID NO: 20307 - DNA, 19 bp, Homo sapiens
ctcaaaacacctattccag

SEQ ID NO: 20308 - DNA, 18 bp, Homo sapiens
tgagaccacgccactcta

SEQ ID NO: 20309 - DNA, 20 bp, Homo sapiens
ctggctgcgagtccatccga

SEQ ID NO: 20310 - DNA, 19 bp, Homo sapiens
tcggtggtatatgactcac

SEQ ID NO: 20311 - DNA, 18 bp, Homo sapiens
accaaaacaatatttaga

SEQ ID NO: 20312 - DNA, 21 bp, Homo sapiens
aagggaagccttggggcctca

SEQ ID NO: 20313 - DNA, 18 bp, Homo sapiens
attttgccactactcagt

SEQ ID NO: 20314 - DNA, 19 bp, Homo sapiens
tcaagaagggagacctgtt

SEQ ID NO: 20315 - DNA, 18 bp, Homo sapiens
tggattttaatgctgctt

SEQ ID NO: 20316 - DNA, 20 bp, Homo sapiens
ttaatgctgcttttccagta

SEQ ID NO: 20317 - DNA, 22 bp, Homo sapiens
cacagagaccagccatcttgca

SEQ ID NO: 20318 - DNA, 18 bp, Homo sapiens
cttcctattaaaatctca

SEQ ID NO: 20319 - DNA, 17 bp, Homo sapiens
caacctcacctccctca

SEQ ID NO: 20320 - DNA, 26 bp, Homo sapiens
cacacttctgcccccactgcattgaa

SEQ ID NO: 20321 - DNA, 22 bp, Homo sapiens
aagtctcagcaatagaattgaa

SEQ ID NO: 20322 - DNA, 17 bp, Homo sapiens
cgaaactaagcatcata

SEQ ID NO: 20323 - DNA, 20 bp, Homo sapiens
ggaaatagatggcttaaagt

SEQ ID NO: 20324 - DNA, 20 bp, Homo sapiens
ttcacctaggtacactgtca

SEQ ID NO: 20325 - DNA, 18 bp, Homo sapiens
accaagacctcatctaca

SEQ ID NO: 20326 - DNA, 22 bp, Homo sapiens
ctggtatctgacttttgctcca

SEQ ID NO: 20327 - DNA, 19 bp, Homo sapiens
gcacctctatacctcagct

SEQ ID NO: 20328 - DNA, 24 bp, Homo sapiens
tcaaaccaagacctcatctacata

SEQ ID NO: 20329 - DNA, 22 bp, Homo sapiens
ctctcctcaccacaacttatta

SEQ ID NO: 20330 - DNA, 18 bp, Homo sapiens
ctgatcctcttgatggag

SEQ ID NO: 20331 - DNA, 28 bp, Homo sapiens
gattgtttcaaaattggtgtttatttaa

SEQ ID NO: 20332 - DNA, 22 bp, Homo sapiens
ttaggaaatgtgcataccactc

SEQ ID NO: 20333 - DNA, 21 bp, Homo sapiens
aacacgaaagtctgaatcctg

SEQ ID NO: 20334 - DNA, 18 bp, Homo sapiens
aaggggctgggcctggtc

SEQ ID NO: 20335 - DNA, 17 bp, Homo sapiens
cacagatactgtttcct

SEQ ID NO: 20336 - DNA, 19 bp, Homo sapiens
taatagggggaaaatgtca

SEQ ID NO: 20337 - DNA, 20 bp, Homo sapiens
ttaccacagatactgtttcc

SEQ ID NO: 20338 - DNA, 25 bp, Homo sapiens
tttcttaaacatagctgctttaatt

SEQ ID NO: 20339 - DNA, 19 bp, Homo sapiens
gaggaacctgggcccatca

SEQ ID NO: 20340 - DNA, 22 bp, Homo sapiens
ccttcccccctcttctctctcc

SEQ ID NO: 20341 - DNA, 19 bp, Homo sapiens
gaggacctgggacccctga

SEQ ID NO: 20342 - DNA, 19 bp, Homo sapiens
agccttcttggattgccca

SEQ ID NO: 20343 - DNA, 20 bp, Homo sapiens
ctcatcacctccaacaatct

SEQ ID NO: 20344 - DNA, 20 bp, Homo sapiens
ctttgagtttgctattttct

SEQ ID NO: 20345 - DNA, 19 bp, Homo sapiens
ttctgtctcctcatcacct

SEQ ID NO: 20346 - DNA, 22 bp, Homo sapiens
ttgttaaatagccattgctttt

SEQ ID NO: 20347 - DNA, 20 bp, Homo sapiens
agtgaggcagaaataccttg

SEQ ID NO: 20348 - DNA, 22 bp, Homo sapiens
gcagcaagcacctgcctcagct

SEQ ID NO: 20349 - DNA, 19 bp, Homo sapiens
gtctatcggacagcggaga

SEQ ID NO: 20350 - DNA, 21 bp, Homo sapiens
acagagagcagagcacactcg

SEQ ID NO: 20351 - DNA, 18 bp, Homo sapiens
cagaacactcctgagaca

SEQ ID NO: 20352 - DNA, 20 bp, Homo sapiens
gcccttcaaagatgctgcca

SEQ ID NO: 20353 - DNA, 22 bp, Homo sapiens
tggaagtcccctggcatggtca

SEQ ID NO: 20354 - DNA, 19 bp, Homo sapiens
acaaaagcagatgatgtac

SEQ ID NO: 20355 - DNA, 20 bp, Homo sapiens
cagaagatgctacaaaacct

SEQ ID NO: 20356 - DNA, 22 bp, Homo sapiens
catggctgggaattgcctacca

SEQ ID NO: 20357 - DNA, 20 bp, Homo sapiens
ggtagatgggaggacatttc

SEQ ID NO: 20358 - DNA, 22 bp, Homo sapiens
gtgcctctcattagtggacttt

SEQ ID NO: 20359 - DNA, 20 bp, Homo sapiens
gttgggatggtgcttctgag

SEQ ID NO: 20360 - DNA, 23 bp, Homo sapiens
atgcatgccctgtggcaccctct

SEQ ID NO: 20361 - DNA, 21 bp, Homo sapiens
caccccagagtcctcatttga

SEQ ID NO: 20362 - DNA, 21 bp, Homo sapiens
tctgaaatgcatgccctgtgg

SEQ ID NO: 20363 - DNA, 20 bp, Homo sapiens
actgaatttagcactatgaa

SEQ ID NO: 20364 - DNA, 18 bp, Homo sapiens
cacactaatgcttccttt

SEQ ID NO: 20365 - DNA, 22 bp, Homo sapiens
tctgcagaagttgtttagtctt

SEQ ID NO: 20366 - DNA, 18 bp, Homo sapiens
tgttgatctcccacaatt

SEQ ID NO: 20367 - DNA, 24 bp, Homo sapiens
caagacattaactagagctcagtt

SEQ ID NO: 20368 - DNA, 20 bp, Homo sapiens
caagtgatccgcctgtctca

SEQ ID NO: 20369 - DNA, 27 bp, Homo sapiens
taaaaggcagctattagtgtgggactg

SEQ ID NO: 20370 - DNA, 17 bp, Homo sapiens
tcagatgattattccag

SEQ ID NO: 20371 - DNA, 18 bp, Homo sapiens
tcatgactcagtacagtg

SEQ ID NO: 20372 - DNA, 24 bp, Homo sapiens
ttcatcttttgtgatttcttttaa

SEQ ID NO: 20373 - DNA, 23 bp, Homo sapiens
aaacactgttgtcattttttcca

SEQ ID NO: 20374 - DNA, 16 bp, Homo sapiens
aaattgcatcactttt

SEQ ID NO: 20375 - DNA, 17 bp, Homo sapiens
aactagagtgtacaaaa

SEQ ID NO: 20376 - DNA, 21 bp, Homo sapiens
ggccacagccaaccagaatga

SEQ ID NO: 20377 - DNA, 20 bp, Homo sapiens
gtaaaatccagattgttttt

SEQ ID NO: 20378 - DNA, 28 bp, Homo sapiens
tacttttcagttagatatacttctgcat

SEQ ID NO: 20379 - DNA, 26 bp, Homo sapiens
tttcttcacctactagccttagtttt

SEQ ID NO: 20380 - DNA, 19 bp, Homo sapiens
aagtagagaaatctggcaa

SEQ ID NO: 20381 - DNA, 20 bp, Homo sapiens
agactccatcttttcaccca

SEQ ID NO: 20382 - DNA, 17 bp, Homo sapiens
atgcttcattttcacat

SEQ ID NO: 20383 - DNA, 18 bp, Homo sapiens
cagagatacacctttgta

SEQ ID NO: 20384 - DNA, 24 bp, Homo sapiens
gaagaaaggcccaagagcgagaca

SEQ ID NO: 20385 - DNA, 22 bp, Homo sapiens
gcaccttttgctcttgctgcta

SEQ ID NO: 20386 - DNA, 20 bp, Homo sapiens
ggtttcaacaagtcaggtga

SEQ ID NO: 20387 - DNA, 19 bp, Homo sapiens
tggaagagtttgacagaga

SEQ ID NO: 20388 - DNA, 28 bp, Homo sapiens
tgtggctggatgtcccacaacactataa

SEQ ID NO: 20389 - DNA, 15 bp, Homo sapiens
ttgctttaccagtta

SEQ ID NO: 20390 - DNA, 25 bp, Homo sapiens
aacacgcttatcaatgttatcgtgc

SEQ ID NO: 20391 - DNA, 16 bp, Homo sapiens
aacataattttggtga

SEQ ID NO: 20392 - DNA, 20 bp, Homo sapiens
aataggaaaatgaaattcag

SEQ ID NO: 20393 - DNA, 24 bp, Homo sapiens
ataaagtggtacagactcattaca

SEQ ID NO: 20394 - DNA, 17 bp, Homo sapiens
attacaacaagtttctc

SEQ ID NO: 20395 - DNA, 22 bp, Homo sapiens
caaataaagtggtacagactca

SEQ ID NO: 20396 - DNA, 22 bp, Homo sapiens
ttcaaacattatcatttaatgt

SEQ ID NO: 20397 - DNA, 19 bp, Homo sapiens
cactctcttggaaccacca

SEQ ID NO: 20398 - DNA, 17 bp, Homo sapiens
catggttcccaccatgt

SEQ ID NO: 20399 - DNA, 21 bp, Homo sapiens
gcaccatttaaagccactgga

SEQ ID NO: 20400 - DNA, 17 bp, Homo sapiens
gctactttatccattga

SEQ ID NO: 20401 - DNA, 19 bp, Homo sapiens
tccagcctgccattccatc

SEQ ID NO: 20402 - DNA, 19 bp, Homo sapiens
tttatactcaaaagagata

SEQ ID NO: 20403 - DNA, 24 bp, Homo sapiens
cctgacagtatttttgaattattt

SEQ ID NO: 20404 - DNA, 21 bp, Homo sapiens
tctgtattaattattgctttt

SEQ ID NO: 20405 - DNA, 15 bp, Homo sapiens
tcatcacccagagca

SEQ ID NO: 20406 - DNA, 16 bp, Homo sapiens
aagaaaagatgaccca

SEQ ID NO: 20407 - DNA, 20 bp, Homo sapiens
acttgaaataaaacctgaag

SEQ ID NO: 20408 - DNA, 17 bp, Homo sapiens
ctgaagaccttatctcc

SEQ ID NO: 20409 - DNA, 19 bp, Homo sapiens
ctgaagaccttatctccca

SEQ ID NO: 20410 - DNA, 19 bp, Homo sapiens
gagagtgaaccttggctta

SEQ ID NO: 20411 - DNA, 19 bp, Homo sapiens
gctccacacaccgtactga

SEQ ID NO: 20412 - DNA, 22 bp, Homo sapiens
aggaatctggactccccatccc

SEQ ID NO: 20413 - DNA, 19 bp, Homo sapiens
agtccatgtcctctcacca

SEQ ID NO: 20414 - DNA, 21 bp, Homo sapiens
atatgccccaccacgaaactc

SEQ ID NO: 20415 - DNA, 19 bp, Homo sapiens
cttccctatctccttacca

SEQ ID NO: 20416 - DNA, 22 bp, Homo sapiens
cctccttaactgcgtctgctca

SEQ ID NO: 20417 - DNA, 21 bp, Homo sapiens
caagggacttgggttcagtta

SEQ ID NO: 20418 - DNA, 21 bp, Homo sapiens
gacatttgctatattgacgct

SEQ ID NO: 20419 - DNA, 21 bp, Homo sapiens
gcaagtgatccgcctgcctca

SEQ ID NO: 20420 - DNA, 22 bp, Homo sapiens
ggaaaaagaagctaaaatacta

SEQ ID NO: 20421 - DNA, 20 bp, Homo sapiens
agtaccatttcttgtgttgt

SEQ ID NO: 20422 - DNA, 21 bp, Homo sapiens
gtatatgtgtggtgtttgatt

SEQ ID NO: 20423 - DNA, 21 bp, Homo sapiens
acaaatttcggggccatacca

SEQ ID NO: 20424 - DNA, 17 bp, Homo sapiens
agagttgaaccccttcc

SEQ ID NO: 20425 - DNA, 22 bp, Homo sapiens
agcacaaacaagcaagctcctt

SEQ ID NO: 20426 - DNA, 20 bp, Homo sapiens
cctgatgccctgagttgttt

SEQ ID NO: 20427 - DNA, 23 bp, Homo sapiens
gcccccatgacccaatcagctcc

SEQ ID NO: 20428 - DNA, 18 bp, Homo sapiens
tgatggtaagacaccaac

SEQ ID NO: 20429 - DNA, 17 bp, Homo sapiens
ttctgaaagcagagcca

SEQ ID NO: 20430 - DNA, 19 bp, Homo sapiens
ttgaaccccttccttctgc

SEQ ID NO: 20431 - DNA, 18 bp, Homo sapiens
tctgctggggagcctctt

SEQ ID NO: 20432 - DNA, 18 bp, Homo sapiens
tttcagaagcataataaa

SEQ ID NO: 20433 - DNA, 24 bp, Homo sapiens
ccttaaaccaccaatttatttcca

SEQ ID NO: 20434 - DNA, 19 bp, Homo sapiens
gtaaagaagctggcaaaga

SEQ ID NO: 20435 - DNA, 17 bp, Homo sapiens
ttcctgtgccccttctc

SEQ ID NO: 20436 - DNA, 22 bp, Homo sapiens
acacaggtgtccattcagatga

SEQ ID NO: 20437 - DNA, 18 bp, Homo sapiens
cattccccaaagcaatca

SEQ ID NO: 20438 - DNA, 19 bp, Homo sapiens
gccaaaggggttaaacact

SEQ ID NO: 20439 - DNA, 21 bp, Homo sapiens
tgcagagtgtaatcagcaccc

SEQ ID NO: 20440 - DNA, 18 bp, Homo sapiens
ttgttacatcctgctgaa

SEQ ID NO: 20441 - DNA, 20 bp, Homo sapiens
accatgaggaaataatcaga

SEQ ID NO: 20442 - DNA, 16 bp, Homo sapiens
ctggctgcccaccatc

SEQ ID NO: 20443 - DNA, 19 bp, Homo sapiens
ggaactgaatgaaatctca

SEQ ID NO: 20444 - DNA, 20 bp, Homo sapiens
gtttacttgtctgcctcttt

SEQ ID NO: 20445 - DNA, 18 bp, Homo sapiens
agaaaattcatattgtgt

SEQ ID NO: 20446 - DNA, 24 bp, Homo sapiens
cctaatgagcacctggtgggaata

SEQ ID NO: 20447 - DNA, 23 bp, Homo sapiens
ggcgtgagccaccgcgcccggcc

SEQ ID NO: 20448 - DNA, 18 bp, Homo sapiens
tagatggattttatatga

SEQ ID NO: 20449 - DNA, 20 bp, Homo sapiens
tggtcaggctggtcttgaac

SEQ ID NO: 20450 - DNA, 26 bp, Homo sapiens
cctccacagacatggccttagtacct

SEQ ID NO: 20451 - DNA, 17 bp, Homo sapiens
gcagcctggggtcctga

SEQ ID NO: 20452 - DNA, 19 bp, Homo sapiens
gtgaccatcagtgacctgt

SEQ ID NO: 20453 - DNA, 21 bp, Homo sapiens
tctccggaaagagtcctggtg

SEQ ID NO: 20454 - DNA, 22 bp, Homo sapiens
gcgcgatttcccgccgagcccg

SEQ ID NO: 20455 - DNA, 19 bp, Homo sapiens
ggtgaatcatcccggcaga

SEQ ID NO: 20456 - DNA, 17 bp, Homo sapiens
attggtggaggagagta

SEQ ID NO: 20457 - DNA, 21 bp, Homo sapiens
cctccccctccccctcctcca

SEQ ID NO: 20458 - DNA, 18 bp, Homo sapiens
ctccttctcctccccctc

SEQ ID NO: 20459 - DNA, 19 bp, Homo sapiens
ctgcttttcatgcatatta

SEQ ID NO: 20460 - DNA, 19 bp, Homo sapiens
cttcaatccttacttctgc

SEQ ID NO: 20461 - DNA, 17 bp, Homo sapiens
ggccctaaattgttttt

SEQ ID NO: 20462 - DNA, 24 bp, Homo sapiens
tagcattgctggacacaaagtgta

SEQ ID NO: 20463 - DNA, 22 bp, Homo sapiens
tcaggggacccagttcccctca

SEQ ID NO: 20464 - DNA, 24 bp, Homo sapiens
ttgggtgatgtgtgcaaaactgca

SEQ ID NO: 20465 - DNA, 22 bp, Homo sapiens
ccctgggagcagaggcccttct

SEQ ID NO: 20466 - DNA, 24 bp, Homo sapiens
gccattattggaaatttctaagga

SEQ ID NO: 20467 - DNA, 21 bp, Homo sapiens
tcacctccagcccatacatca

SEQ ID NO: 20468 - DNA, 31 bp, Homo sapiens
tgcttgaaccttcccagcgcttgtctggctt

SEQ ID NO: 20469 - DNA, 23 bp, Homo sapiens
atctgagctctagtgtctgactt

SEQ ID NO: 20470 - DNA, 17 bp, Homo sapiens
atgtctgggacctctga

SEQ ID NO: 20471 - DNA, 20 bp, Homo sapiens
cccatttctaaatgtacact

SEQ ID NO: 20472 - DNA, 24 bp, Homo sapiens
gatgcaaagagccagaatattcta

SEQ ID NO: 20473 - DNA, 19 bp, Homo sapiens
tagttgtatataaatatta

SEQ ID NO: 20474 - DNA, 19 bp, Homo sapiens
tatatgatacatgtaaatg

SEQ ID NO: 20475 - DNA, 22 bp, Homo sapiens
ttttaacacataaatgagggga

SEQ ID NO: 20476 - DNA, 21 bp, Homo sapiens
ttttgtttaaacacactgcct

SEQ ID NO: 20477 - DNA, 19 bp, Homo sapiens
agcttctaattttcaatca

SEQ ID NO: 20478 - DNA, 23 bp, Homo sapiens
cttttctggtttataactactaa

SEQ ID NO: 20479 - DNA, 23 bp, Homo sapiens
gttcttggaatcaattcctctaa

SEQ ID NO: 20480 - DNA, 21 bp, Homo sapiens
tgagccctacatgtggggttg

SEQ ID NO: 20481 - DNA, 21 bp, Homo sapiens
ggaaggaacatctcccttcca

SEQ ID NO: 20482 - DNA, 21 bp, Homo sapiens
tccttggtcccaatcttctca

SEQ ID NO: 20483 - DNA, 23 bp, Homo sapiens
tgggaacaatgttcgagagaaca

SEQ ID NO: 20484 - DNA, 21 bp, Homo sapiens
ttgccaagcctcctccatctc

SEQ ID NO: 20485 - DNA, 22 bp, Homo sapiens
tttgatgtaagagttcagtttg

SEQ ID NO: 20486 - DNA, 20 bp, Homo sapiens
ataccaataaaaggtacctc

SEQ ID NO: 20487 - DNA, 17 bp, Homo sapiens
gaaatttttattgcttt

SEQ ID NO: 20488 - DNA, 18 bp, Homo sapiens
gtaagtggggtctttgtg

SEQ ID NO: 20489 - DNA, 20 bp, Homo sapiens
gtagtaagtggggtctttgt

SEQ ID NO: 20490 - DNA, 19 bp, Homo sapiens
tcttttccagggctttgta

SEQ ID NO: 20491 - DNA, 23 bp, Homo sapiens
ttacagacaaaatgaagactatc

SEQ ID NO: 20492 - DNA, 21 bp, Homo sapiens
cccagtacttggaggaactgg

SEQ ID NO: 20493 - DNA, 19 bp, Homo sapiens
tgaatgaggactgcaatga

SEQ ID NO: 20494 - DNA, 23 bp, Homo sapiens
aaagaacccgttagtattgttta

SEQ ID NO: 20495 - DNA, 18 bp, Homo sapiens
caataaaatggcttttaa

SEQ ID NO: 20496 - DNA, 20 bp, Homo sapiens
ggcttttaattatttgttat

SEQ ID NO: 20497 - DNA, 21 bp, Homo sapiens
tcagcgatgcttatttctagc

SEQ ID NO: 20498 - DNA, 20 bp, Homo sapiens
aaacacagaattgaaggtgg

SEQ ID NO: 20499 - DNA, 18 bp, Homo sapiens
gcaccatcagacacctga

SEQ ID NO: 20500 - DNA, 20 bp, Homo sapiens
agaaacaaccctccccccca

SEQ ID NO: 20501 - DNA, 21 bp, Homo sapiens
ataatccctctgattccacta

SEQ ID NO: 20502 - DNA, 16 bp, Homo sapiens
cctcccccccattttt

SEQ ID NO: 20503 - DNA, 26 bp, Homo sapiens
gcagagagaaggagcaaaccttttca

SEQ ID NO: 20504 - DNA, 22 bp, Homo sapiens
tagatgggaattgcagaagctg

SEQ ID NO: 20505 - DNA, 24 bp, Homo sapiens
tagcttttcttcttggttatatca

SEQ ID NO: 20506 - DNA, 22 bp, Homo sapiens
tgcatgattttgtatatatggt

SEQ ID NO: 20507 - DNA, 24 bp, Homo sapiens
aaaaggcaggaaagtaggtatgat

SEQ ID NO: 20508 - DNA, 19 bp, Homo sapiens
attcctgtggttcatccca

SEQ ID NO: 20509 - DNA, 18 bp, Homo sapiens
cagcttttcctacactga

SEQ ID NO: 20510 - DNA, 19 bp, Homo sapiens
tcaccacccacaaaagatc

SEQ ID NO: 20511 - DNA, 17 bp, Homo sapiens
tctccccaaagtacttg

SEQ ID NO: 20512 - DNA, 18 bp, Homo sapiens
tgtatggaaaagctgcac

SEQ ID NO: 20513 - DNA, 19 bp, Homo sapiens
ccaacagacaatgccaatt

SEQ ID NO: 20514 - DNA, 18 bp, Homo sapiens
tcactgagattccagtga

SEQ ID NO: 20515 - DNA, 22 bp, Homo sapiens
tctaagcatttacccttttgat

SEQ ID NO: 20516 - DNA, 21 bp, Homo sapiens
ctgggaaccagctttcagtga

SEQ ID NO: 20517 - DNA, 22 bp, Homo sapiens
ttctgaaataaaagacatctcc

SEQ ID NO: 20518 - DNA, 17 bp, Homo sapiens
cccagggctgctgctca

SEQ ID NO: 20519 - DNA, 24 bp, Homo sapiens
cctcttagaactggttttaacctt

SEQ ID NO: 20520 - DNA, 24 bp, Homo sapiens
gcgcctcggccgccgccgccgcct

SEQ ID NO: 20521 - DNA, 24 bp, Homo sapiens
gcttttcccccaaagtatcatgtg

SEQ ID NO: 20522 - DNA, 20 bp, Homo sapiens
gtgaccgaaagaacccggtg

SEQ ID NO: 20523 - DNA, 20 bp, Homo sapiens
tccagaaaaacggatcacag

SEQ ID NO: 20524 - DNA, 22 bp, Homo sapiens
tgctgctcatcctgggcaagct

SEQ ID NO: 20525 - DNA, 18 bp, Homo sapiens
ttgagattttttcagtga

SEQ ID NO: 20526 - DNA, 18 bp, Homo sapiens
aaggacatttgaaatttc

SEQ ID NO: 20527 - DNA, 19 bp, Homo sapiens
agacgccgaaacccagtga

SEQ ID NO: 20528 - DNA, 21 bp, Homo sapiens
cctggccatcttgttgctgct

SEQ ID NO: 20529 - DNA, 24 bp, Homo sapiens
cttgtgattggggaggtttgtgga

SEQ ID NO: 20530 - DNA, 20 bp, Homo sapiens
ttttgttggttgcactaact

SEQ ID NO: 20531 - DNA, 16 bp, Homo sapiens
ctgaactgactggccc

SEQ ID NO: 20532 - DNA, 16 bp, Homo sapiens
ctttgagcagtttgtg

SEQ ID NO: 20533 - DNA, 20 bp, Homo sapiens
accacaatcagaattatatc

SEQ ID NO: 20534 - DNA, 20 bp, Homo sapiens
cccactccccactgtcactg

SEQ ID NO: 20535 - DNA, 17 bp, Homo sapiens
gtggtattggcaggata

SEQ ID NO: 20536 - DNA, 20 bp, Homo sapiens
tggccccaacacccataagg

SEQ ID NO: 20537 - DNA, 19 bp, Homo sapiens
ttcaggtattagtcagctt

SEQ ID NO: 20538 - DNA, 24 bp, Homo sapiens
gtttgcgtaccggtcgcctggtcc

SEQ ID NO: 20539 - DNA, 19 bp, Homo sapiens
gaggccccggtcttcctcc

SEQ ID NO: 20540 - DNA, 21 bp, Homo sapiens
cactaacttctggactttcca

SEQ ID NO: 20541 - DNA, 22 bp, Homo sapiens
accagtttcagaatactgtgaa

SEQ ID NO: 20542 - DNA, 22 bp, Homo sapiens
atatcaataacatggcacaaca

SEQ ID NO: 20543 - DNA, 21 bp, Homo sapiens
tggtgttcgggtatgaggctg

SEQ ID NO: 20544 - DNA, 15 bp, Homo sapiens
agcatccatcttctg

SEQ ID NO: 20545 - DNA, 19 bp, Homo sapiens
cttctggagagtctgtgag

SEQ ID NO: 20546 - DNA, 25 bp, Homo sapiens
ctttgacttctggagagtctgtgag

SEQ ID NO: 20547 - DNA, 20 bp, Homo sapiens
tagccccgggaccgtgttgc

SEQ ID NO: 20548 - DNA, 18 bp, Homo sapiens
gcacttgtaactgctgcc

SEQ ID NO: 20549 - DNA, 25 bp, Homo sapiens
gcagactgttaaattgtggtttata

SEQ ID NO: 20550 - DNA, 21 bp, Homo sapiens
gggggcggcgggggacatcgg

SEQ ID NO: 20551 - DNA, 24 bp, Homo sapiens
gtatacataggcattactttatta

SEQ ID NO: 20552 - DNA, 22 bp, Homo sapiens
tatagaaagtaaactgtggtca

SEQ ID NO: 20553 - DNA, 26 bp, Homo sapiens
atggataactatttctaatatgaaat

SEQ ID NO: 20554 - DNA, 22 bp, Homo sapiens
tctttggtttttgctttaattt

SEQ ID NO: 20555 - DNA, 19 bp, Homo sapiens
aagagacttaagatcattt

SEQ ID NO: 20556 - DNA, 21 bp, Homo sapiens
aggaacaggttagaagagcca

SEQ ID NO: 20557 - DNA, 20 bp, Homo sapiens
ctgtgtccacccctgcctct

SEQ ID NO: 20558 - DNA, 18 bp, Homo sapiens
gattccaatgcggagctg

SEQ ID NO: 20559 - DNA, 21 bp, Homo sapiens
gctcctgtccaagcatctgag

SEQ ID NO: 20560 - DNA, 20 bp, Homo sapiens
tagccaactccatctagata

SEQ ID NO: 20561 - DNA, 21 bp, Homo sapiens
tcagtcctgatttgtctgcca

SEQ ID NO: 20562 - DNA, 20 bp, Homo sapiens
tccttcctcaatcaatacag

SEQ ID NO: 20563 - DNA, 23 bp, Homo sapiens
tccttctcggcccgcgccgcagc

SEQ ID NO: 20564 - DNA, 24 bp, Homo sapiens
tctgtaggagtcttaggttttttt

SEQ ID NO: 20565 - DNA, 18 bp, Homo sapiens
acttctcttcacttctgc

SEQ ID NO: 20566 - DNA, 18 bp, Homo sapiens
agcctttttgccaggcca

SEQ ID NO: 20567 - DNA, 20 bp, Homo sapiens
tctttgaattctttaagcaa

SEQ ID NO: 20568 - DNA, 23 bp, Homo sapiens
atttgggtttctggctatggctt

SEQ ID NO: 20569 - DNA, 19 bp, Homo sapiens
ctggctacatagataagta

SEQ ID NO: 20570 - DNA, 27 bp, Homo sapiens
taagatgagaactaaaatgccgttgaa

SEQ ID NO: 20571 - DNA, 18 bp, Homo sapiens
tgaacatttgggtaatga

SEQ ID NO: 20572 - DNA, 23 bp, Homo sapiens
ttaggaaacacgacacaaacgct

SEQ ID NO: 20573 - DNA, 24 bp, Homo sapiens
gcattagtgtggcatttcagtgga

SEQ ID NO: 20574 - DNA, 20 bp, Homo sapiens
ggttgtaagaaaggctccca

SEQ ID NO: 20575 - DNA, 18 bp, Homo sapiens
ttcaatactctttaaaag

SEQ ID NO: 20576 - DNA, 24 bp, Homo sapiens
cagctcagtggctgagcccagtca

SEQ ID NO: 20577 - DNA, 23 bp, Homo sapiens
ttctgctggacacaacctctttt

SEQ ID NO: 20578 - DNA, 24 bp, Homo sapiens
agtctttggccacctctgatctca

SEQ ID NO: 20579 - DNA, 21 bp, Homo sapiens
atacctctcaatgtgtttgct

SEQ ID NO: 20580 - DNA, 19 bp, Homo sapiens
catgtgtacccaccacctt

SEQ ID NO: 20581 - DNA, 18 bp, Homo sapiens
gcctcatgtgtgaaatta

SEQ ID NO: 20582 - DNA, 22 bp, Homo sapiens
tcaatataaggcaagaaaaaat

SEQ ID NO: 20583 - DNA, 15 bp, Homo sapiens
aacccgaattcctca

SEQ ID NO: 20584 - DNA, 17 bp, Homo sapiens
acaaaccagtaccatgg

SEQ ID NO: 20585 - DNA, 18 bp, Homo sapiens
atttccattcattactta

SEQ ID NO: 20586 - DNA, 19 bp, Homo sapiens
tccctgactgcaggtagcc

SEQ ID NO: 20587 - DNA, 15 bp, Homo sapiens
cttggtgtctggctt

SEQ ID NO: 20588 - DNA, 18 bp, Homo sapiens
gctattttgtatccttga

SEQ ID NO: 20589 - DNA, 22 bp, Homo sapiens
tcaaagttaacacctatactca

SEQ ID NO: 20590 - DNA, 24 bp, Homo sapiens
tctcccttgggtgtataccaggga

SEQ ID NO: 20591 - DNA, 18 bp, Homo sapiens
acatgctaaatttctgaa

SEQ ID NO: 20592 - DNA, 22 bp, Homo sapiens
aggttatgtcctaataactatt

SEQ ID NO: 20593 - DNA, 26 bp, Homo sapiens
cctttttacaatttgattttaacttt

SEQ ID NO: 20594 - DNA, 18 bp, Homo sapiens
gaacagagggtatcattg

SEQ ID NO: 20595 - DNA, 17 bp, Homo sapiens
tctgagcaatccctttc

SEQ ID NO: 20596 - DNA, 21 bp, Homo sapiens
catgctgggccatacagctca

SEQ ID NO: 20597 - DNA, 19 bp, Homo sapiens
ctggcacaatcctaggata

SEQ ID NO: 20598 - DNA, 21 bp, Homo sapiens
aatgtcacagagactagttca

SEQ ID NO: 20599 - DNA, 22 bp, Homo sapiens
agagctcaaatgattacacatc

SEQ ID NO: 20600 - DNA, 18 bp, Homo sapiens
atatattttcatctctga

SEQ ID NO: 20601 - DNA, 20 bp, Homo sapiens
atgtcacagagactagttca

SEQ ID NO: 20602 - DNA, 20 bp, Homo sapiens
gactgtgcttcatccatcca

SEQ ID NO: 20603 - DNA, 19 bp, Homo sapiens
atggtgttaatgtgtgcct

SEQ ID NO: 20604 - DNA, 19 bp, Homo sapiens
aagtggatacataagatta

SEQ ID NO: 20605 - DNA, 17 bp, Homo sapiens
agtcacatcatatatgc

SEQ ID NO: 20606 - DNA, 20 bp, Homo sapiens
caccaacgtagaagcttttt

SEQ ID NO: 20607 - DNA, 21 bp, Homo sapiens
ccatcaccatccagcccagca

SEQ ID NO: 20608 - DNA, 18 bp, Homo sapiens
gtcattgagaaacaccct

SEQ ID NO: 20609 - DNA, 19 bp, Homo sapiens
ttctggcctctgcccccca

SEQ ID NO: 20610 - DNA, 20 bp, Homo sapiens
ttggttatcagtttgcagat

SEQ ID NO: 20611 - DNA, 19 bp, Homo sapiens
tgtttaaggtttctgacac

SEQ ID NO: 20612 - DNA, 19 bp, Homo sapiens
ttgcatacaatctgaaact

SEQ ID NO: 20613 - DNA, 21 bp, Homo sapiens
gcaggcttgcagtgagccatg

SEQ ID NO: 20614 - DNA, 24 bp, Homo sapiens
aaaatcctactggatatgaaactg

SEQ ID NO: 20615 - DNA, 20 bp, Homo sapiens
atgtggaacaaatggagtga

SEQ ID NO: 20616 - DNA, 20 bp, Homo sapiens
cccccaaccccagcagacac

SEQ ID NO: 20617 - DNA, 20 bp, Homo sapiens
tgaactcaccaatgtggaac

SEQ ID NO: 20618 - DNA, 15 bp, Homo sapiens
tattattgcacttca

SEQ ID NO: 20619 - DNA, 19 bp, Homo sapiens
aaactcctgacctcaggtg

SEQ ID NO: 20620 - DNA, 22 bp, Homo sapiens
cccacattacactaatcattga

SEQ ID NO: 20621 - DNA, 20 bp, Homo sapiens
cctctgcctcccgggttcaa

SEQ ID NO: 20622 - DNA, 17 bp, Homo sapiens
tcaagtgattctcctgc

SEQ ID NO: 20623 - DNA, 19 bp, Homo sapiens
ttgcaaagggccaaatttc

SEQ ID NO: 20624 - DNA, 23 bp, Homo sapiens
atctgtggtagtttgatactaca

SEQ ID NO: 20625 - DNA, 18 bp, Homo sapiens
ctaaccctttctacctta

SEQ ID NO: 20626 - DNA, 21 bp, Homo sapiens
gcattttaaatcaaacatttc

SEQ ID NO: 20627 - DNA, 19 bp, Homo sapiens
tcagttattatagatgaca

SEQ ID NO: 20628 - DNA, 19 bp, Homo sapiens
tttcaatacctttcagatc

SEQ ID NO: 20629 - DNA, 17 bp, Homo sapiens
acggagaagtgtcttct

SEQ ID NO: 20630 - DNA, 22 bp, Homo sapiens
agcctgggcaaaaagagccaga

SEQ ID NO: 20631 - DNA, 21 bp, Homo sapiens
gctgatctgtattttcattaa

SEQ ID NO: 20632 - DNA, 23 bp, Homo sapiens
taaatggacacgataggaaacta

SEQ ID NO: 20633 - DNA, 21 bp, Homo sapiens
cttctcactattgccttggcc

SEQ ID NO: 20634 - DNA, 20 bp, Homo sapiens
gctacttcggcaagacatct

SEQ ID NO: 20635 - DNA, 18 bp, Homo sapiens
ctaaaatgaagaagcttc

SEQ ID NO: 20636 - DNA, 19 bp, Homo sapiens
cttcctgtgccttggcctt

SEQ ID NO: 20637 - DNA, 22 bp, Homo sapiens
accagcttcgagttactttccc

SEQ ID NO: 20638 - DNA, 21 bp, Homo sapiens
cttttggggttgttttgcttt

SEQ ID NO: 20639 - DNA, 18 bp, Homo sapiens
ctttttgttcctctgata

SEQ ID NO: 20640 - DNA, 18 bp, Homo sapiens
gttggccgactgcacttg

SEQ ID NO: 20641 - DNA, 25 bp, Homo sapiens
ttcccagtcacatccattttgtgga

SEQ ID NO: 20642 - DNA, 25 bp, Homo sapiens
agaaaagtgacaagggcagagatga

SEQ ID NO: 20643 - DNA, 18 bp, Homo sapiens
aatgactgtggaataata

SEQ ID NO: 20644 - DNA, 21 bp, Homo sapiens
cacattttattgttttccttt

SEQ ID NO: 20645 - DNA, 22 bp, Homo sapiens
gagccaagattatgccactgca

SEQ ID NO: 20646 - DNA, 18 bp, Homo sapiens
tgggtggatcacctgagg

SEQ ID NO: 20647 - DNA, 17 bp, Homo sapiens
agggccagactacctct

SEQ ID NO: 20648 - DNA, 21 bp, Homo sapiens
ccaagagatcctcccacctcg

SEQ ID NO: 20649 - DNA, 19 bp, Homo sapiens
tgaacttcagcatgagctg

SEQ ID NO: 20650 - DNA, 18 bp, Homo sapiens
gcttagcacaatgatgaa

SEQ ID NO: 20651 - DNA, 21 bp, Homo sapiens
tggaaatgatcaaccagctca

SEQ ID NO: 20652 - DNA, 23 bp, Homo sapiens
gtgccctcacgccgccgggctct

SEQ ID NO: 20653 - DNA, 20 bp, Homo sapiens
catctggacaccatgttgta

SEQ ID NO: 20654 - DNA, 19 bp, Homo sapiens
tatagattaggaacaatgc

SEQ ID NO: 20655 - DNA, 19 bp, Homo sapiens
tgcctgggcgcctactcca

SEQ ID NO: 20656 - DNA, 19 bp, Homo sapiens
actgctgttaagcaatgtt

SEQ ID NO: 20657 - DNA, 18 bp, Homo sapiens
attttgaaaactgttatc

SEQ ID NO: 20658 - DNA, 17 bp, Homo sapiens
agtcccacatcatctca

SEQ ID NO: 20659 - DNA, 17 bp, Homo sapiens
gaaatatggatagcagc

SEQ ID NO: 20660 - DNA, 21 bp, Homo sapiens
ctattagtaaccttagtgata

SEQ ID NO: 20661 - DNA, 18 bp, Homo sapiens
tttcacatccaagtgcac

SEQ ID NO: 20662 - DNA, 17 bp, Homo sapiens
ttgatttctttatcgtg

SEQ ID NO: 20663 - DNA, 21 bp, Homo sapiens
aatgctgtcaagttttcctcc

SEQ ID NO: 20664 - DNA, 19 bp, Homo sapiens
atttgtaaactgctactga

SEQ ID NO: 20665 - DNA, 20 bp, Homo sapiens
gcagaattgattttgccttg

SEQ ID NO: 20666 - DNA, 24 bp, Homo sapiens
tctggttttcctgaacttattttt

SEQ ID NO: 20667 - DNA, 26 bp, Homo sapiens
tcatttattgtaaataacacttttcc

SEQ ID NO: 20668 - DNA, 18 bp, Homo sapiens
tgattcagtaaccagttt

SEQ ID NO: 20669 - DNA, 17 bp, Homo sapiens
aaaaactccttaactta

SEQ ID NO: 20670 - DNA, 20 bp, Homo sapiens
ggtgctatattaattcaata

SEQ ID NO: 20671 - DNA, 19 bp, Homo sapiens
tcaacaatatcatcattca

SEQ ID NO: 20672 - DNA, 22 bp, Homo sapiens
ttcctctgttaattcatggaat

SEQ ID NO: 20673 - DNA, 20 bp, Homo sapiens
ggccgcctgcgcgctggccg

SEQ ID NO: 20674 - DNA, 19 bp, Homo sapiens
aagaaaatcttggcatttt

SEQ ID NO: 20675 - DNA, 20 bp, Homo sapiens
ggacagggagagaaaatacc

SEQ ID NO: 20676 - DNA, 20 bp, Homo sapiens
tccagaaatgtatacttcca

SEQ ID NO: 20677 - DNA, 22 bp, Homo sapiens
tccaggggtcatgctcttccca

SEQ ID NO: 20678 - DNA, 20 bp, Homo sapiens
tgaagagactgaggtgcaga

SEQ ID NO: 20679 - DNA, 22 bp, Homo sapiens
tctcttcacccttcctggcctt

SEQ ID NO: 20680 - DNA, 28 bp, Homo sapiens
gccagggtcaatcaggatccccatttga

SEQ ID NO: 20681 - DNA, 20 bp, Homo sapiens
gcccatttcccattatacat

SEQ ID NO: 20682 - DNA, 19 bp, Homo sapiens
ttgaaatattttatcatta

SEQ ID NO: 20683 - DNA, 22 bp, Homo sapiens
tttcccattatacataacaata

SEQ ID NO: 20684 - DNA, 21 bp, Homo sapiens
accctttaatccaacttttga

SEQ ID NO: 20685 - DNA, 23 bp, Homo sapiens
tgtttcttttttaactaatgcta

SEQ ID NO: 20686 - DNA, 20 bp, Homo sapiens
ttcttttttaactaatgcta

SEQ ID NO: 20687 - DNA, 18 bp, Homo sapiens
caaatgctgtttatgata

SEQ ID NO: 20688 - DNA, 17 bp, Homo sapiens
tttaaattctcatctta

SEQ ID NO: 20689 - DNA, 17 bp, Homo sapiens
agagaaaaaaaagatcc

SEQ ID NO: 20690 - DNA, 18 bp, Homo sapiens
atgtgatataaaagctgt

SEQ ID NO: 20691 - DNA, 19 bp, Homo sapiens
ccactgatcataccactgc

SEQ ID NO: 20692 - DNA, 19 bp, Homo sapiens
cctgggccatattgtgaga

SEQ ID NO: 20693 - DNA, 20 bp, Homo sapiens
cgaggctgctgtgagccgtg

SEQ ID NO: 20694 - DNA, 20 bp, Homo sapiens
agctccacaaatgtgagcta

SEQ ID NO: 20695 - DNA, 18 bp, Homo sapiens
ggaggggaatctgtgaac

SEQ ID NO: 20696 - DNA, 19 bp, Homo sapiens
ggattatcaatgtgaactg

SEQ ID NO: 20697 - DNA, 18 bp, Homo sapiens
tgggtggatcacttgagg

SEQ ID NO: 20698 - DNA, 24 bp, Homo sapiens
cccgttgttggaggatttgatgag

SEQ ID NO: 20699 - DNA, 23 bp, Homo sapiens
ccctgatgatggcctacactgtg

SEQ ID NO: 20700 - DNA, 15 bp, Homo sapiens
tttctgataggcagt

SEQ ID NO: 20701 - DNA, 17 bp, Homo sapiens
catccagcagccaagac

SEQ ID NO: 20702 - DNA, 19 bp, Homo sapiens
ccattacaaaatgtaatgg

SEQ ID NO: 20703 - DNA, 19 bp, Homo sapiens
ccattacaaaatgtaatgg

SEQ ID NO: 20704 - DNA, 19 bp, Homo sapiens
tttgtccagttctcactta

SEQ ID NO: 20705 - DNA, 17 bp, Homo sapiens
tcgttcctctgcatatc

SEQ ID NO: 20706 - DNA, 23 bp, Homo sapiens
tttaggaaattgcacataccttc

SEQ ID NO: 20707 - DNA, 23 bp, Homo sapiens
acttgggctaagccgtctgggtc

SEQ ID NO: 20708 - DNA, 27 bp, Homo sapiens
cctccaggctccactcaccagacctca

SEQ ID NO: 20709 - DNA, 18 bp, Homo sapiens
tctgtttcacgttcgttg

SEQ ID NO: 20710 - DNA, 17 bp, Homo sapiens
atctgttaccacaatta

SEQ ID NO: 20711 - DNA, 19 bp, Homo sapiens
gggttactttaaaaatctg

SEQ ID NO: 20712 - DNA, 20 bp, Homo sapiens
tgctttttcttttacataat

SEQ ID NO: 20713 - DNA, 22 bp, Homo sapiens
tttgagtagtgaggttactttt

SEQ ID NO: 20714 - DNA, 20 bp, Homo sapiens
aagcgccttttcctgcagct

SEQ ID NO: 20715 - DNA, 22 bp, Homo sapiens
accagagagcagcccacgggca

SEQ ID NO: 20716 - DNA, 18 bp, Homo sapiens
acctcggctgctaggccc

SEQ ID NO: 20717 - DNA, 17 bp, Homo sapiens
ccacggccccactgtcc

SEQ ID NO: 20718 - DNA, 20 bp, Homo sapiens
gcgtaggggccgttgcccgc

SEQ ID NO: 20719 - DNA, 20 bp, Homo sapiens
gggcagatgctaggtcagtt

SEQ ID NO: 20720 - DNA, 21 bp, Homo sapiens
gtggcaaaggggtaggctcta

SEQ ID NO: 20721 - DNA, 20 bp, Homo sapiens
tttcttagttatgcatctca

SEQ ID NO: 20722 - DNA, 19 bp, Homo sapiens
agacccactaatttgcaca

SEQ ID NO: 20723 - DNA, 18 bp, Homo sapiens
ggagctttttaaatctca

SEQ ID NO: 20724 - DNA, 18 bp, Homo sapiens
tgagctcttcattagctc

SEQ ID NO: 20725 - DNA, 21 bp, Homo sapiens
gcataaaaataaaatttcata

SEQ ID NO: 20726 - DNA, 26 bp, Homo sapiens
acttgagctgggaaatcctttggcct

SEQ ID NO: 20727 - DNA, 18 bp, Homo sapiens
atcagctcaccagttcaa

SEQ ID NO: 20728 - DNA, 24 bp, Homo sapiens
cctgggagtaataaagttactttt

SEQ ID NO: 20729 - DNA, 17 bp, Homo sapiens
tacaatgaagatttacc

SEQ ID NO: 20730 - DNA, 20 bp, Homo sapiens
tcctgggagactccaacaaa

SEQ ID NO: 20731 - DNA, 21 bp, Homo sapiens
gcaggcgttcccatgatgcca

SEQ ID NO: 20732 - DNA, 20 bp, Homo sapiens
actcagtaacacagtgcagt

SEQ ID NO: 20733 - DNA, 20 bp, Homo sapiens
actcagtaacacagtgcagt

SEQ ID NO: 20734 - DNA, 22 bp, Homo sapiens
caaccttctcaggacaagccca

SEQ ID NO: 20735 - DNA, 15 bp, Homo sapiens
ccgtggaacctgttt

SEQ ID NO: 20736 - DNA, 19 bp, Homo sapiens
ctgcaacctctacctccca

SEQ ID NO: 20737 - DNA, 18 bp, Homo sapiens
ctgctgggctgcttcttt

SEQ ID NO: 20738 - DNA, 18 bp, Homo sapiens
gagctggtaaaatgtgaa

SEQ ID NO: 20739 - DNA, 18 bp, Homo sapiens
gcttgttcctggacttca

SEQ ID NO: 20740 - DNA, 18 bp, Homo sapiens
tctacctcccaggttcaa

SEQ ID NO: 20741 - DNA, 18 bp, Homo sapiens
tgtatttgaaaattctgc

SEQ ID NO: 20742 - DNA, 18 bp, Homo sapiens
tttgggcaggtgagtcat

SEQ ID NO: 20743 - DNA, 26 bp, Homo sapiens
cgggcggggcggggcgggccgggcca

SEQ ID NO: 20744 - DNA, 17 bp, Homo sapiens
cagtggtgtctctcacc

SEQ ID NO: 20745 - DNA, 21 bp, Homo sapiens
cttgtgcagctgcaaccacca

SEQ ID NO: 20746 - DNA, 22 bp, Homo sapiens
tgcactaggcttttgttactgt

SEQ ID NO: 20747 - DNA, 20 bp, Homo sapiens
ttgctatttctacattctcc

SEQ ID NO: 20748 - DNA, 20 bp, Homo sapiens
gtgggaagggagccttctca

SEQ ID NO: 20749 - DNA, 18 bp, Homo sapiens
aagacctgggattttgtc

SEQ ID NO: 20750 - DNA, 17 bp, Homo sapiens
tgagccttcccgtccgc

SEQ ID NO: 20751 - DNA, 21 bp, Homo sapiens
catcctctttgccccctcagg

SEQ ID NO: 20752 - DNA, 20 bp, Homo sapiens
ggacagtaatgacggctgtg

SEQ ID NO: 20753 - DNA, 19 bp, Homo sapiens
ccacccctggtctgttctg

SEQ ID NO: 20754 - DNA, 19 bp, Homo sapiens
gatggggctgcaagtgcta

SEQ ID NO: 20755 - DNA, 22 bp, Homo sapiens
acaaatccttttaacatgcatt

SEQ ID NO: 20756 - DNA, 22 bp, Homo sapiens
ctcccacatatactaaaattct

SEQ ID NO: 20757 - DNA, 18 bp, Homo sapiens
gatgtcctgatgtgaaac

SEQ ID NO: 20758 - DNA, 22 bp, Homo sapiens
taagggaagggcaaaaggctca

SEQ ID NO: 20759 - DNA, 27 bp, Homo sapiens
tcattagaagctcctaccctcatctca

SEQ ID NO: 20760 - DNA, 19 bp, Homo sapiens
tgtgttggcttttgttcag

SEQ ID NO: 20761 - DNA, 21 bp, Homo sapiens
tgtgttggcttttgttcagaa

SEQ ID NO: 20762 - DNA, 23 bp, Homo sapiens
tattttttcaagtaaaattttca

SEQ ID NO: 20763 - DNA, 19 bp, Homo sapiens
gtgtttcgtgtctaccata

SEQ ID NO: 20764 - DNA, 18 bp, Homo sapiens
aataagggcttgcttgcc

SEQ ID NO: 20765 - DNA, 16 bp, Homo sapiens
cctttgtcagaagtca

SEQ ID NO: 20766 - DNA, 18 bp, Homo sapiens
gcaaacctaaataccacc

SEQ ID NO: 20767 - DNA, 29 bp, Homo sapiens
ggtacctcaaagcaacagtgtatatgcaa

SEQ ID NO: 20768 - DNA, 18 bp, Homo sapiens
tgggtggatcatttgagg

SEQ ID NO: 20769 - DNA, 20 bp, Homo sapiens
aaagtaaaaggaaacagtac

SEQ ID NO: 20770 - DNA, 18 bp, Homo sapiens
atagttagccttgatttt

SEQ ID NO: 20771 - DNA, 20 bp, Homo sapiens
atgtgaactcaaatattgca

SEQ ID NO: 20772 - DNA, 20 bp, Homo sapiens
atgtgaactcaacacttcca

SEQ ID NO: 20773 - DNA, 24 bp, Homo sapiens
cctctttgatttttgtttggcctt

SEQ ID NO: 20774 - DNA, 17 bp, Homo sapiens
tattcagctggatccaa

SEQ ID NO: 20775 - DNA, 21 bp, Homo sapiens
cctcatgtctgtaacatgtga

SEQ ID NO: 20776 - DNA, 17 bp, Homo sapiens
ctcagagtgcactgcag

SEQ ID NO: 20777 - DNA, 18 bp, Homo sapiens
ctttgatggccacactgt

SEQ ID NO: 20778 - DNA, 22 bp, Homo sapiens
ctttgttggggagacttctgga

SEQ ID NO: 20779 - DNA, 16 bp, Homo sapiens
tattagtctttctaac

SEQ ID NO: 20780 - DNA, 22 bp, Homo sapiens
tctagggtctatcctagtgata

SEQ ID NO: 20781 - DNA, 18 bp, Homo sapiens
aactagagaggtgcaaaa

SEQ ID NO: 20782 - DNA, 18 bp, Homo sapiens
cagcttcagcagcaacaa

SEQ ID NO: 20783 - DNA, 20 bp, Homo sapiens
cttccatgtgaactttaggc

SEQ ID NO: 20784 - DNA, 22 bp, Homo sapiens
gaagaagtggagttttttggtt

SEQ ID NO: 20785 - DNA, 24 bp, Homo sapiens
ttattacatatcaggttttcctga

SEQ ID NO: 20786 - DNA, 19 bp, Homo sapiens
gcccttccccgccctccct

SEQ ID NO: 20787 - DNA, 17 bp, Homo sapiens
ttgcaacctcaagcttc

SEQ ID NO: 20788 - DNA, 18 bp, Homo sapiens
cctaatcccctcactttt

SEQ ID NO: 20789 - DNA, 20 bp, Homo sapiens
ctgtttaacaatttttcctc

SEQ ID NO: 20790 - DNA, 22 bp, Homo sapiens
taaggtgatcactggctcagtc

SEQ ID NO: 20791 - DNA, 20 bp, Homo sapiens
agtgttcaaagaagttcttg

SEQ ID NO: 20792 - DNA, 18 bp, Homo sapiens
agaggtgtgacaggctct

SEQ ID NO: 20793 - DNA, 19 bp, Homo sapiens
ctgtggacacacaaggtga

SEQ ID NO: 20794 - DNA, 19 bp, Homo sapiens
ctgtggacacacaaggtga

SEQ ID NO: 20795 - DNA, 20 bp, Homo sapiens
tcagctttcccctagcatgg

SEQ ID NO: 20796 - DNA, 18 bp, Homo sapiens
tgcccgtgtgcctgtccc

SEQ ID NO: 20797 - DNA, 18 bp, Homo sapiens
ttccagaaacttctgcag

SEQ ID NO: 20798 - DNA, 20 bp, Homo sapiens
aaacagaaccagccacctca

SEQ ID NO: 20799 - DNA, 20 bp, Homo sapiens
cctttgcctcctaggttcaa

SEQ ID NO: 20800 - DNA, 22 bp, Homo sapiens
tgcaattgtgtggcagcttgct

SEQ ID NO: 20801 - DNA, 19 bp, Homo sapiens
tgcactccagcagaggcta

SEQ ID NO: 20802 - DNA, 22 bp, Homo sapiens
agacccccacccagtggccgcc

SEQ ID NO: 20803 - DNA, 20 bp, Homo sapiens
agtgcgtgagaaaccagcac

SEQ ID NO: 20804 - DNA, 21 bp, Homo sapiens
cagcttccttgatcggactca

SEQ ID NO: 20805 - DNA, 20 bp, Homo sapiens
ccagcacccccttccgccgc

SEQ ID NO: 20806 - DNA, 18 bp, Homo sapiens
ccagtggccgccaggtcc

SEQ ID NO: 20807 - DNA, 18 bp, Homo sapiens
gggcggggctgacctgcc

SEQ ID NO: 20808 - DNA, 19 bp, Homo sapiens
gggcgggggcgctctgcca

SEQ ID NO: 20809 - DNA, 21 bp, Homo sapiens
aaactacagaaccacatccca

SEQ ID NO: 20810 - DNA, 22 bp, Homo sapiens
atcttggctcactgcaacctct

SEQ ID NO: 20811 - DNA, 21 bp, Homo sapiens
atggcacatgcttccactcca

SEQ ID NO: 20812 - DNA, 20 bp, Homo sapiens
cacacctggctgttttcttt

SEQ ID NO: 20813 - DNA, 21 bp, Homo sapiens
cagtgctctgtcagcagcctg

SEQ ID NO: 20814 - DNA, 20 bp, Homo sapiens
cctctgcctcccgggttcaa

SEQ ID NO: 20815 - DNA, 22 bp, Homo sapiens
ctttgggaacaaactcttcctt

SEQ ID NO: 20816 - DNA, 25 bp, Homo sapiens
tgcaacctccgcctcctggattcca

SEQ ID NO: 20817 - DNA, 19 bp, Homo sapiens
atctctcactcacagtgac

SEQ ID NO: 20818 - DNA, 20 bp, Homo sapiens
ttactttcgctctctaatca

SEQ ID NO: 20819 - DNA, 22 bp, Homo sapiens
ataccaataaaaagaaaaccct

SEQ ID NO: 20820 - DNA, 17 bp, Homo sapiens
cttaagacaacttgcac

SEQ ID NO: 20821 - DNA, 21 bp, Homo sapiens
aggtcgtgtaagagccatgcg

SEQ ID NO: 20822 - DNA, 22 bp, Homo sapiens
tggtgacacttgtaaactgtca

SEQ ID NO: 20823 - DNA, 20 bp, Homo sapiens
acggcggcggcgcgccggcc

SEQ ID NO: 20824 - DNA, 17 bp, Homo sapiens
cgcggagctccggctgg

SEQ ID NO: 20825 - DNA, 16 bp, Homo sapiens
gaccggcgccgcggga

SEQ ID NO: 20826 - DNA, 19 bp, Homo sapiens
taaaaacaaaacaaacaaa

SEQ ID NO: 20827 - DNA, 22 bp, Homo sapiens
agttggggaggggtctgttgtg

SEQ ID NO: 20828 - DNA, 23 bp, Homo sapiens
cccgcctctaccccgcctccatt

SEQ ID NO: 20829 - DNA, 22 bp, Homo sapiens
agaatagaagattggctcatca

SEQ ID NO: 20830 - DNA, 16 bp, Homo sapiens
agattctattttcatg

SEQ ID NO: 20831 - DNA, 15 bp, Homo sapiens
agtaagccagagtga

SEQ ID NO: 20832 - DNA, 21 bp, Homo sapiens
tgtctctgttttatccagtgg

SEQ ID NO: 20833 - DNA, 22 bp, Homo sapiens
ggaattactaatttgtcattaa

SEQ ID NO: 20834 - DNA, 21 bp, Homo sapiens
atggaagaaataacagtatgt

SEQ ID NO: 20835 - DNA, 19 bp, Homo sapiens
atggtcatggtagactgat

SEQ ID NO: 20836 - DNA, 21 bp, Homo sapiens
ggtaagtggaaaaatatcatg

SEQ ID NO: 20837 - DNA, 19 bp, Homo sapiens
cagtaagcaaaattttcca

SEQ ID NO: 20838 - DNA, 22 bp, Homo sapiens
tgggcatttaatatgtaaagat

SEQ ID NO: 20839 - DNA, 19 bp, Homo sapiens
tttactttgatgtatcata

SEQ ID NO: 20840 - DNA, 21 bp, Homo sapiens
aatcttactaacacctatgat

SEQ ID NO: 20841 - DNA, 18 bp, Homo sapiens
atggaaacaagccactta

SEQ ID NO: 20842 - DNA, 18 bp, Homo sapiens
attttatttatggtccag

SEQ ID NO: 20843 - DNA, 24 bp, Homo sapiens
cagaatgctttgaaattctaatgg

SEQ ID NO: 20844 - DNA, 20 bp, Homo sapiens
cccgacacctcacctttcgc

SEQ ID NO: 20845 - DNA, 17 bp, Homo sapiens
cctcacctttcgctgtt

SEQ ID NO: 20846 - DNA, 21 bp, Homo sapiens
ctctttctctctctctctctc

SEQ ID NO: 20847 - DNA, 18 bp, Homo sapiens
taaggataaaacacgtca

SEQ ID NO: 20848 - DNA, 22 bp, Homo sapiens
tatcggccacctgccaatcaca

SEQ ID NO: 20849 - DNA, 16 bp, Homo sapiens
tctctctctcttttct

SEQ ID NO: 20850 - DNA, 21 bp, Homo sapiens
aatcttactaacacctatgat

SEQ ID NO: 20851 - DNA, 18 bp, Homo sapiens
atggaaacaagccactta

SEQ ID NO: 20852 - DNA, 18 bp, Homo sapiens
attttatttatggtccag

SEQ ID NO: 20853 - DNA, 24 bp, Homo sapiens
cagaatgctttgaaattctaatgg

SEQ ID NO: 20854 - DNA, 20 bp, Homo sapiens
cccgacacctcacctttcgc

SEQ ID NO: 20855 - DNA, 17 bp, Homo sapiens
cctcacctttcgctgtt

SEQ ID NO: 20856 - DNA, 21 bp, Homo sapiens
ctctttctctctctctctctc

SEQ ID NO: 20857 - DNA, 18 bp, Homo sapiens
taaggataaaacacgtca

SEQ ID NO: 20858 - DNA, 22 bp, Homo sapiens
tatcggccacctgccaatcaca

SEQ ID NO: 20859 - DNA, 16 bp, Homo sapiens
tctctctctcttttct

SEQ ID NO: 20860 - DNA, 21 bp, Homo sapiens
aatcttactaacacctatgat

SEQ ID NO: 20861 - DNA, 18 bp, Homo sapiens
atggaaacaagccactta

SEQ ID NO: 20862 - DNA, 18 bp, Homo sapiens
attttatttatggtccag

SEQ ID NO: 20863 - DNA, 24 bp, Homo sapiens
cagaatgctttgaaattctaatgg

SEQ ID NO: 20864 - DNA, 20 bp, Homo sapiens
cccgacacctcacctttcgc

SEQ ID NO: 20865 - DNA, 17 bp, Homo sapiens
cctcacctttcgctgtt

SEQ ID NO: 20866 - DNA, 21 bp, Homo sapiens
ctctttctctctctctctctc

SEQ ID NO: 20867 - DNA, 18 bp, Homo sapiens
taaggataaaacacgtca

SEQ ID NO: 20868 - DNA, 22 bp, Homo sapiens
tatcggccacctgccaatcaca

SEQ ID NO: 20869 - DNA, 16 bp, Homo sapiens
tctctctctcttttct

SEQ ID NO: 20870 - DNA, 21 bp, Homo sapiens
aatcttactaacacctatgat

SEQ ID NO: 20871 - DNA, 18 bp, Homo sapiens
atggaaacaagccactta

SEQ ID NO: 20872 - DNA, 18 bp, Homo sapiens
attttatttatggtccag

SEQ ID NO: 20873 - DNA, 24 bp, Homo sapiens
cagaatgctttgaaattctaatgg

SEQ ID NO: 20874 - DNA, 20 bp, Homo sapiens
cccgacacctcacctttcgc

SEQ ID NO: 20875 - DNA, 17 bp, Homo sapiens
cctcacctttcgctgtt

SEQ ID NO: 20876 - DNA, 21 bp, Homo sapiens
ctctttctctctctctctctc

SEQ ID NO: 20877 - DNA, 18 bp, Homo sapiens
taaggataaaacacgtca

SEQ ID NO: 20878 - DNA, 22 bp, Homo sapiens
tatcggccacctgccaatcaca

SEQ ID NO: 20879 - DNA, 16 bp, Homo sapiens
tctctctctcttttct

SEQ ID NO: 20880 - DNA, 21 bp, Homo sapiens
aatcttactaacacctatgat

SEQ ID NO: 20881 - DNA, 18 bp, Homo sapiens
atggaaacaagccactta

SEQ ID NO: 20882 - DNA, 18 bp, Homo sapiens
attttatttatggtccag

SEQ ID NO: 20883 - DNA, 24 bp, Homo sapiens
cagaatgctttgaaattctaatgg

SEQ ID NO: 20884 - DNA, 20 bp, Homo sapiens
cccgacacctcacctttcgc

SEQ ID NO: 20885 - DNA, 17 bp, Homo sapiens
cctcacctttcgctgtt

SEQ ID NO: 20886 - DNA, 21 bp, Homo sapiens
ctctttctctctctctctctc

SEQ ID NO: 20887 - DNA, 21 bp, Homo sapiens
ctgaaactgaagaatctggta

SEQ ID NO: 20888 - DNA, 18 bp, Homo sapiens
taaggataaaacacgtca

SEQ ID NO: 20889 - DNA, 22 bp, Homo sapiens
tatcggccacctgccaatcaca

SEQ ID NO: 20890 - DNA, 16 bp, Homo sapiens
tctctctctcttttct

SEQ ID NO: 20891 - DNA, 21 bp, Homo sapiens
aatcttactaacacctatgat

SEQ ID NO: 20892 - DNA, 18 bp, Homo sapiens
atggaaacaagccactta

SEQ ID NO: 20893 - DNA, 18 bp, Homo sapiens
attttatttatggtccag

SEQ ID NO: 20894 - DNA, 24 bp, Homo sapiens
cagaatgctttgaaattctaatgg

SEQ ID NO: 20895 - DNA, 20 bp, Homo sapiens
cccgacacctcacctttcgc

SEQ ID NO: 20896 - DNA, 17 bp, Homo sapiens
cctcacctttcgctgtt

SEQ ID NO: 20897 - DNA, 21 bp, Homo sapiens
ctctttctctctctctctctc

SEQ ID NO: 20898 - DNA, 18 bp, Homo sapiens
taaggataaaacacgtca

SEQ ID NO: 20899 - DNA, 22 bp, Homo sapiens
tatcggccacctgccaatcaca

SEQ ID NO: 20900 - DNA, 16 bp, Homo sapiens
tctctctctcttttct

SEQ ID NO: 20901 - DNA, 21 bp, Homo sapiens
aatcttactaacacctatgat

SEQ ID NO: 20902 - DNA, 18 bp, Homo sapiens
atggaaacaagccactta

SEQ ID NO: 20903 - DNA, 18 bp, Homo sapiens
attttatttatggtccag

SEQ ID NO: 20904 - DNA, 24 bp, Homo sapiens
cagaatgctttgaaattctaatgg

SEQ ID NO: 20905 - DNA, 20 bp, Homo sapiens
cccgacacctcacctttcgc

SEQ ID NO: 20906 - DNA, 17 bp, Homo sapiens
cctcacctttcgctgtt

SEQ ID NO: 20907 - DNA, 21 bp, Homo sapiens
ctctttctctctctctctctc

SEQ ID NO: 20908 - DNA, 18 bp, Homo sapiens
taaggataaaacacgtca

SEQ ID NO: 20909 - DNA, 22 bp, Homo sapiens
tatcggccacctgccaatcaca

SEQ ID NO: 20910 - DNA, 16 bp, Homo sapiens
tctctctctcttttct

SEQ ID NO: 20911 - DNA, 21 bp, Homo sapiens
aatcttactaacacctatgat

SEQ ID NO: 20912 - DNA, 18 bp, Homo sapiens
atggaaacaagccactta

SEQ ID NO: 20913 - DNA, 18 bp, Homo sapiens
attttatttatggtccag

SEQ ID NO: 20914 - DNA, 24 bp, Homo sapiens
cagaatgctttgaaattctaatgg

SEQ ID NO: 20915 - DNA, 20 bp, Homo sapiens
cccgacacctcacctttcgc

SEQ ID NO: 20916 - DNA, 17 bp, Homo sapiens
cctcacctttcgctgtt

SEQ ID NO: 20917 - DNA, 21 bp, Homo sapiens
ctctttctctctctctctctc

SEQ ID NO: 20918 - DNA, 18 bp, Homo sapiens
taaggataaaacacgtca

SEQ ID NO: 20919 - DNA, 22 bp, Homo sapiens
tatcggccacctgccaatcaca

SEQ ID NO: 20920 - DNA, 16 bp, Homo sapiens
tctctctctcttttct

SEQ ID NO: 20921 - DNA, 21 bp, Homo sapiens
aatcttactaacacctatgat

SEQ ID NO: 20922 - DNA, 18 bp, Homo sapiens
atggaaacaagccactta

SEQ ID NO: 20923 - DNA, 18 bp, Homo sapiens
attttatttatggtccag

SEQ ID NO: 20924 - DNA, 24 bp, Homo sapiens
cagaatgctttgaaattctaatgg

SEQ ID NO: 20925 - DNA, 20 bp, Homo sapiens
cccgacacctcacctttcgc

SEQ ID NO: 20926 - DNA, 17 bp, Homo sapiens
cctcacctttcgctgtt

SEQ ID NO: 20927 - DNA, 21 bp, Homo sapiens
ctctttctctctctctctctc

SEQ ID NO: 20928 - DNA, 18 bp, Homo sapiens
taaggataaaacacgtca

SEQ ID NO: 20929 - DNA, 22 bp, Homo sapiens
tatcggccacctgccaatcaca

SEQ ID NO: 20930 - DNA, 16 bp, Homo sapiens
tctctctctcttttct

SEQ ID NO: 20931 - DNA, 21 bp, Homo sapiens
aatcttactaacacctatgat

SEQ ID NO: 20932 - DNA, 18 bp, Homo sapiens
atggaaacaagccactta

SEQ ID NO: 20933 - DNA, 18 bp, Homo sapiens
attttatttatggtccag

SEQ ID NO: 20934 - DNA, 24 bp, Homo sapiens
cagaatgctttgaaattctaatgg

SEQ ID NO: 20935 - DNA, 20 bp, Homo sapiens
cccgacacctcacctttcgc

SEQ ID NO: 20936 - DNA, 17 bp, Homo sapiens
cctcacctttcgctgtt

SEQ ID NO: 20937 - DNA, 21 bp, Homo sapiens
ctctttctctctctctctctc

SEQ ID NO: 20938 - DNA, 18 bp, Homo sapiens
taaggataaaacacgtca

SEQ ID NO: 20939 - DNA, 22 bp, Homo sapiens
tatcggccacctgccaatcaca

SEQ ID NO: 20940 - DNA, 16 bp, Homo sapiens
tctctctctcttttct

SEQ ID NO: 20941 - DNA, 21 bp, Homo sapiens
aatcttactaacacctatgat

SEQ ID NO: 20942 - DNA, 18 bp, Homo sapiens
atggaaacaagccactta

SEQ ID NO: 20943 - DNA, 18 bp, Homo sapiens
attttatttatggtccag

SEQ ID NO: 20944 - DNA, 24 bp, Homo sapiens
cagaatgctttgaaattctaatgg

SEQ ID NO: 20945 - DNA, 20 bp, Homo sapiens
cccgacacctcacctttcgc

SEQ ID NO: 20946 - DNA, 17 bp, Homo sapiens
cctcacctttcgctgtt

SEQ ID NO: 20947 - DNA, 21 bp, Homo sapiens
ctctttctctctctctctctc

SEQ ID NO: 20948 - DNA, 18 bp, Homo sapiens
taaggataaaacacgtca

SEQ ID NO: 20949 - DNA, 22 bp, Homo sapiens
tatcggccacctgccaatcaca

SEQ ID NO: 20950 - DNA, 16 bp, Homo sapiens
tctctctctcttttct

SEQ ID NO: 20951 - DNA, 21 bp, Homo sapiens
aatcttactaacacctatgat

SEQ ID NO: 20952 - DNA, 18 bp, Homo sapiens
atggaaacaagccactta

SEQ ID NO: 20953 - DNA, 18 bp, Homo sapiens
attttatttatggtccag

SEQ ID NO: 20954 - DNA, 24 bp, Homo sapiens
cagaatgctttgaaattctaatgg

SEQ ID NO: 20955 - DNA, 20 bp, Homo sapiens
cccgacacctcacctttcgc

SEQ ID NO: 20956 - DNA, 17 bp, Homo sapiens
cctcacctttcgctgtt

SEQ ID NO: 20957 - DNA, 21 bp, Homo sapiens
ctctttctctctctctctctc

SEQ ID NO: 20958 - DNA, 18 bp, Homo sapiens
taaggataaaacacgtca

SEQ ID NO: 20959 - DNA, 22 bp, Homo sapiens
tatcggccacctgccaatcaca

SEQ ID NO: 20960 - DNA, 16 bp, Homo sapiens
tctctctctcttttct

SEQ ID NO: 20961 - DNA, 21 bp, Homo sapiens
aatcttactaacacctatgat

SEQ ID NO: 20962 - DNA, 18 bp, Homo sapiens
atggaaacaagccactta

SEQ ID NO: 20963 - DNA, 18 bp, Homo sapiens
attttatttatggtccag

SEQ ID NO: 20964 - DNA, 24 bp, Homo sapiens
cagaatgctttgaaattctaatgg

SEQ ID NO: 20965 - DNA, 20 bp, Homo sapiens
cccgacacctcacctttcgc

SEQ ID NO: 20966 - DNA, 17 bp, Homo sapiens
cctcacctttcgctgtt

SEQ ID NO: 20967 - DNA, 21 bp, Homo sapiens
ctctttctctctctctctctc

SEQ ID NO: 20968 - DNA, 18 bp, Homo sapiens
taaggataaaacacgtca

SEQ ID NO: 20969 - DNA, 22 bp, Homo sapiens
tatcggccacctgccaatcaca

SEQ ID NO: 20970 - DNA, 16 bp, Homo sapiens
tctctctctcttttct

SEQ ID NO: 20971 - DNA, 21 bp, Homo sapiens
aatcttactaacacctatgat

SEQ ID NO: 20972 - DNA, 18 bp, Homo sapiens
atggaaacaagccactta

SEQ ID NO: 20973 - DNA, 18 bp, Homo sapiens
attttatttatggtccag

SEQ ID NO: 20974 - DNA, 24 bp, Homo sapiens
cagaatgctttgaaattctaatgg

SEQ ID NO: 20975 - DNA, 20 bp, Homo sapiens
cccgacacctcacctttcgc

SEQ ID NO: 20976 - DNA, 17 bp, Homo sapiens
cctcacctttcgctgtt

SEQ ID NO: 20977 - DNA, 21 bp, Homo sapiens
ctctttctctctctctctctc

SEQ ID NO: 20978 - DNA, 18 bp, Homo sapiens
taaggataaaacacgtca

SEQ ID NO: 20979 - DNA, 22 bp, Homo sapiens
tatcggccacctgccaatcaca

SEQ ID NO: 20980 - DNA, 16 bp, Homo sapiens
tctctctctcttttct

SEQ ID NO: 20981 - DNA, 19 bp, Homo sapiens
ctgaagcctcagtccttca

SEQ ID NO: 20982 - DNA, 19 bp, Homo sapiens
ctgaagcctcagtccttca

SEQ ID NO: 20983 - DNA, 18 bp, Homo sapiens
ccgcggaatatcggctta

SEQ ID NO: 20984 - DNA, 19 bp, Homo sapiens
ctgaagcctcagtccttca

SEQ ID NO: 20985 - DNA, 19 bp, Homo sapiens
ctgaagcctcagtccttca

SEQ ID NO: 20986 - DNA, 19 bp, Homo sapiens
ctgaagcctcagtccttca

SEQ ID NO: 20987 - DNA, 19 bp, Homo sapiens
ctgaagcctcagtccttca

SEQ ID NO: 20988 - DNA, 19 bp, Homo sapiens
ctgaagcctcagtccttca

SEQ ID NO: 20989 - DNA, 19 bp, Homo sapiens
ctgaagcctcagtccttca

SEQ ID NO: 20990 - DNA, 19 bp, Homo sapiens
ctgaagcctcagtccttca

SEQ ID NO: 20991 - DNA, 19 bp, Homo sapiens
ctgaagcctcagtccttca

SEQ ID NO: 20992 - DNA, 19 bp, Homo sapiens
ctgaagcctcagtccttca

SEQ ID NO: 20993 - DNA, 19 bp, Homo sapiens
ctgaagcctcagtccttca

SEQ ID NO: 20994 - DNA, 19 bp, Homo sapiens
ctgaagcctcagtccttca

SEQ ID NO: 20995 - DNA, 19 bp, Homo sapiens
ctgaagcctcagtccttca

SEQ ID NO: 20996 - DNA, 19 bp, Homo sapiens
ctgaagcctcagtccttca

SEQ ID NO: 20997 - DNA, 19 bp, Homo sapiens
ctgaagcctcagtccttca

SEQ ID NO: 20998 - DNA, 19 bp, Homo sapiens
ctgaagcctcagtccttca

SEQ ID NO: 20999 - DNA, 19 bp, Homo sapiens
ctgaagcctcagtccttca

SEQ ID NO: 21000 - DNA, 19 bp, Homo sapiens
ccagcccacctccgcctcc

SEQ ID NO: 21001 - DNA, 19 bp, Homo sapiens
ccagcccacctccgcctcc

SEQ ID NO: 21002 - DNA, 16 bp, Homo sapiens
taactaataagtgaca

SEQ ID NO: 21003 - DNA, 26 bp, Homo sapiens
tttatgtcaaacaattatgcttaata

SEQ ID NO: 21004 - DNA, 23 bp, Homo sapiens
tttgagatattttaaattgcttt

SEQ ID NO: 21005 - DNA, 20 bp, Homo sapiens
catcttaaaaaaaaatctca

SEQ ID NO: 21006 - DNA, 22 bp, Homo sapiens
cctgcttttctgggtcaatttt

SEQ ID NO: 21007 - DNA, 16 bp, Homo sapiens
taactaataagtgaca

SEQ ID NO: 21008 - DNA, 26 bp, Homo sapiens
tcatagatgatcattaaatttttaga

SEQ ID NO: 21009 - DNA, 26 bp, Homo sapiens
tttatgtcaaacaattatgcttaata

SEQ ID NO: 21010 - DNA, 23 bp, Homo sapiens
tttgagatattttaaattgcttt

SEQ ID NO: 21011 - DNA, 17 bp, Homo sapiens
gcaggctcggctctgtc

SEQ ID NO: 21012 - DNA, 19 bp, Homo sapiens
ggtctgggcactgcagcag

SEQ ID NO: 21013 - DNA, 19 bp, Homo sapiens
aagcgattctctcacttca

SEQ ID NO: 21014 - DNA, 18 bp, Homo sapiens
cagtggtgcaatctcact

SEQ ID NO: 21015 - DNA, 23 bp, Homo sapiens
tcatgacttttttatgtgtacca

SEQ ID NO: 21016 - DNA, 18 bp, Homo sapiens
tccgccttccaggttcaa

SEQ ID NO: 21017 - DNA, 19 bp, Homo sapiens
tgggtgacgagtgaaactg

SEQ ID NO: 21018 - DNA, 28 bp, Homo sapiens
taaaacatgcttaagaaaaatgcactga

SEQ ID NO: 21019 - DNA, 18 bp, Homo sapiens
tcataccaaggcctcata

SEQ ID NO: 21020 - DNA, 16 bp, Homo sapiens
tgaagatttctggctt

SEQ ID NO: 21021 - DNA, 22 bp, Homo sapiens
gcctgggccgtatctccggctc

SEQ ID NO: 21022 - DNA, 18 bp, Homo sapiens
tgctgttgtccaactatt

SEQ ID NO: 21023 - DNA, 21 bp, Homo sapiens
atcttggctcactgcaacctc

SEQ ID NO: 21024 - DNA, 23 bp, Homo sapiens
atttggattttactggttggtcc

SEQ ID NO: 21025 - DNA, 18 bp, Homo sapiens
caaacattgtaaaatgtg

SEQ ID NO: 21026 - DNA, 18 bp, Homo sapiens
cctgcaacctccacctcc

SEQ ID NO: 21027 - DNA, 21 bp, Homo sapiens
cgcccaccaccccacctggct

SEQ ID NO: 21028 - DNA, 19 bp, Homo sapiens
ctgcaacctccgcctccca

SEQ ID NO: 21029 - DNA, 17 bp, Homo sapiens
tccacctccaggttcaa

SEQ ID NO: 21030 - DNA, 20 bp, Homo sapiens
tggccaggctggtcttgaac

SEQ ID NO: 21031 - DNA, 17 bp, Homo sapiens
tacccttaacccatgaa

SEQ ID NO: 21032 - DNA, 21 bp, Homo sapiens
aggccttgaagacatgattcc

SEQ ID NO: 21033 - DNA, 16 bp, Homo sapiens
tggagaggtggaaaga

SEQ ID NO: 21034 - DNA, 21 bp, Homo sapiens
ttgatatgactaattcaggga

SEQ ID NO: 21035 - DNA, 16 bp, Homo sapiens
ccagaggcttttccag

SEQ ID NO: 21036 - DNA, 18 bp, Homo sapiens
tatctgccctttgaaata

SEQ ID NO: 21037 - DNA, 19 bp, Homo sapiens
atctgtgaaatatactaca

SEQ ID NO: 21038 - DNA, 17 bp, Homo sapiens
cagattaaactctcagc

SEQ ID NO: 21039 - DNA, 19 bp, Homo sapiens
cctaataagatttattatc

SEQ ID NO: 21040 - DNA, 17 bp, Homo sapiens
gtcaatcaaatatgcca

SEQ ID NO: 21041 - DNA, 19 bp, Homo sapiens
tctggatgacatctgtgaa

SEQ ID NO: 21042 - DNA, 19 bp, Homo sapiens
atggtaccagcctgtcaca

SEQ ID NO: 21043 - DNA, 18 bp, Homo sapiens
ccttgtaagttctgggga

SEQ ID NO: 21044 - DNA, 19 bp, Homo sapiens
tgagacttgactgaggctg

SEQ ID NO: 21045 - DNA, 20 bp, Homo sapiens
attgtgaccaatgaacttta

SEQ ID NO: 21046 - DNA, 17 bp, Homo sapiens
taaaaaatagtggtgag

SEQ ID NO: 21047 - DNA, 18 bp, Homo sapiens
tgtgaccaatgaacttta

SEQ ID NO: 21048 - DNA, 20 bp, Homo sapiens
acttgtttacatccaacaaa

SEQ ID NO: 21049 - DNA, 20 bp, Homo sapiens
gccttagaacgcctttccag

SEQ ID NO: 21050 - DNA, 23 bp, Homo sapiens
gttcaaaatcaagtgcctaggga

SEQ ID NO: 21051 - DNA, 17 bp, Homo sapiens
tccttttcacccatgga

SEQ ID NO: 21052 - DNA, 18 bp, Homo sapiens
tgaaatagaaccatggaa

SEQ ID NO: 21053 - DNA, 23 bp, Homo sapiens
aaattagtggttaaggttatcta

SEQ ID NO: 21054 - DNA, 20 bp, Homo sapiens
cactttcactgtggatttgg

SEQ ID NO: 21055 - DNA, 19 bp, Homo sapiens
actttggtcccttgacata

SEQ ID NO: 21056 - DNA, 16 bp, Homo sapiens
cgggtaacggctcctg

SEQ ID NO: 21057 - DNA, 17 bp, Homo sapiens
gcagacagacatcctct

SEQ ID NO: 21058 - DNA, 20 bp, Homo sapiens
agaaaagagcacaggctgca

SEQ ID NO: 21059 - DNA, 18 bp, Homo sapiens
agtatgggtttggccata

SEQ ID NO: 21060 - DNA, 19 bp, Homo sapiens
gacgtttgtctgtgcgatt

SEQ ID NO: 21061 - DNA, 25 bp, Homo sapiens
agccccgccaccaactagggcgaga

SEQ ID NO: 21062 - DNA, 23 bp, Homo sapiens
ctcccaagaccgtgcttgcccaa

SEQ ID NO: 21063 - DNA, 18 bp, Homo sapiens
ggccctggacacccagtg

SEQ ID NO: 21064 - DNA, 19 bp, Homo sapiens
tgttgggaaagtcgttgaa

SEQ ID NO: 21065 - DNA, 15 bp, Homo sapiens
ctgaccaagcccggg

SEQ ID NO: 21066 - DNA, 19 bp, Homo sapiens
gatcctgaagatcgtgtga

SEQ ID NO: 21067 - DNA, 24 bp, Homo sapiens
tcattttctttgtataactatgca

SEQ ID NO: 21068 - DNA, 25 bp, Homo sapiens
tccagcacgtcgtggcctctggtcc

SEQ ID NO: 21069 - DNA, 19 bp, Homo sapiens
ggaacagaaacaagcactt

SEQ ID NO: 21070 - DNA, 15 bp, Homo sapiens
cctgagcatgttgaa

SEQ ID NO: 21071 - DNA, 21 bp, Homo sapiens
agctgacactgatagattgat

SEQ ID NO: 21072 - DNA, 24 bp, Homo sapiens
tctgagtaagggaggagcactttt

SEQ ID NO: 21073 - DNA, 18 bp, Homo sapiens
tccctttgcaaaatgtga

SEQ ID NO: 21074 - DNA, 19 bp, Homo sapiens
tgcggggtgcggtttgtag

SEQ ID NO: 21075 - DNA, 21 bp, Homo sapiens
tggaaagtactttatccagaa

SEQ ID NO: 21076 - DNA, 18 bp, Homo sapiens
tgtcaatttcggctgtga

SEQ ID NO: 21077 - DNA, 23 bp, Homo sapiens
catcaacctcaactgtgtgtgca

SEQ ID NO: 21078 - DNA, 21 bp, Homo sapiens
cggcggtggcggagccggagc

SEQ ID NO: 21079 - DNA, 18 bp, Homo sapiens
gcattaatcttgcagttt

SEQ ID NO: 21080 - DNA, 22 bp, Homo sapiens
gctgcttctgttttttcattaa

SEQ ID NO: 21081 - DNA, 19 bp, Homo sapiens
acccttcccacagactcct

SEQ ID NO: 21082 - DNA, 20 bp, Homo sapiens
cccctgtcctgtttctcacc

SEQ ID NO: 21083 - DNA, 18 bp, Homo sapiens
ctgtgatagcatgtttca

SEQ ID NO: 21084 - DNA, 24 bp, Homo sapiens
cttccgtcaagttgtcttattttt

SEQ ID NO: 21085 - DNA, 18 bp, Homo sapiens
ggaagagagcacacagat

SEQ ID NO: 21086 - DNA, 20 bp, Homo sapiens
tgacatctctttcgtctcct

SEQ ID NO: 21087 - DNA, 18 bp, Homo sapiens
tgcccgtttgcctgttcc

SEQ ID NO: 21088 - DNA, 18 bp, Homo sapiens
tgctgagaatgtctctca

SEQ ID NO: 21089 - DNA, 21 bp, Homo sapiens
tggatgggctccccacgactg

SEQ ID NO: 21090 - DNA, 23 bp, Homo sapiens
agccacactcagaggcctcactg

SEQ ID NO: 21091 - DNA, 26 bp, Homo sapiens
ccatcgattgggggtggtttttgtca

SEQ ID NO: 21092 - DNA, 18 bp, Homo sapiens
ctccccctcctctcctct

SEQ ID NO: 21093 - DNA, 24 bp, Homo sapiens
ctttttcacaagcgctttattttt

SEQ ID NO: 21094 - DNA, 16 bp, Homo sapiens
gttctggaaaatgctc

SEQ ID NO: 21095 - DNA, 26 bp, Homo sapiens
accctgtcttaaagaccctgacctca

SEQ ID NO: 21096 - DNA, 17 bp, Homo sapiens
acggtgttagaactctc

SEQ ID NO: 21097 - DNA, 19 bp, Homo sapiens
atggaggacaatcctgata

SEQ ID NO: 21098 - DNA, 18 bp, Homo sapiens
cactgacaatttgatgag

SEQ ID NO: 21099 - DNA, 21 bp, Homo sapiens
cctaggcaggagcaatcactt

SEQ ID NO: 21100 - DNA, 20 bp, Homo sapiens
ctcctgcccctttgtttttt

SEQ ID NO: 21101 - DNA, 18 bp, Homo sapiens
cttccttatgttcctgaa

SEQ ID NO: 21102 - DNA, 22 bp, Homo sapiens
gagccaagattgtgccaccaca

SEQ ID NO: 21103 - DNA, 22 bp, Homo sapiens
gagccaagattgtgccactgca

SEQ ID NO: 21104 - DNA, 24 bp, Homo sapiens
gccacgttgaagtaaaaacaaaca

SEQ ID NO: 21105 - DNA, 24 bp, Homo sapiens
gctttttggttgctgttgagtttt

SEQ ID NO: 21106 - DNA, 21 bp, Homo sapiens
tcatatagtgggatcatgcaa

SEQ ID NO: 21107 - DNA, 22 bp, Homo sapiens
tgtatcgtcttcagactcctca

SEQ ID NO: 21108 - DNA, 19 bp, Homo sapiens
acagagaaccactactttg

SEQ ID NO: 21109 - DNA, 22 bp, Homo sapiens
tgaaaccaaagctagcatttca

SEQ ID NO: 21110 - DNA, 23 bp, Homo sapiens
tggccctcacttagcttgtgaac

SEQ ID NO: 21111 - DNA, 22 bp, Homo sapiens
agtctcactctgctgcctaggc

SEQ ID NO: 21112 - DNA, 17 bp, Homo sapiens
aaaatttgtatgctgta

SEQ ID NO: 21113 - DNA, 21 bp, Homo sapiens
aactggattggggtgtgcaca

SEQ ID NO: 21114 - DNA, 21 bp, Homo sapiens
atggttcgtgccttcattcca

SEQ ID NO: 21115 - DNA, 21 bp, Homo sapiens
tccaaacactggaaagctctc

SEQ ID NO: 21116 - DNA, 20 bp, Homo sapiens
tctccatgtgccttagcctt

SEQ ID NO: 21117 - DNA, 24 bp, Homo sapiens
caactttccatttctcatggtcaa

SEQ ID NO: 21118 - DNA, 21 bp, Homo sapiens
taaatatgtaaaaaatattta

SEQ ID NO: 21119 - DNA, 27 bp, Homo sapiens
tttctttcagtgtggctgctttggctt

SEQ ID NO: 21120 - DNA, 19 bp, Homo sapiens
gagggggctgggcctatca

SEQ ID NO: 21121 - DNA, 19 bp, Homo sapiens
gccacccccaccacgagtg

SEQ ID NO: 21122 - DNA, 20 bp, Homo sapiens
tggccaggctggtcttgaac

SEQ ID NO: 21123 - DNA, 20 bp, Homo sapiens
cattaacttgaacagggata

SEQ ID NO: 21124 - DNA, 21 bp, Homo sapiens
ttctccagacaaacttcctta

SEQ ID NO: 21125 - DNA, 21 bp, Homo sapiens
gaaaggataaatatgcctttc

SEQ ID NO: 21126 - DNA, 18 bp, Homo sapiens
agttcctactgcacaagt

SEQ ID NO: 21127 - DNA, 20 bp, Homo sapiens
cgtgtaaaacacagttccta

SEQ ID NO: 21128 - DNA, 19 bp, Homo sapiens
tcagtgttgttttaatttt

SEQ ID NO: 21129 - DNA, 20 bp, Homo sapiens
gggctgagccatcccgcgtg

SEQ ID NO: 21130 - DNA, 18 bp, Homo sapiens
aatgcaatctgtataata

SEQ ID NO: 21131 - DNA, 16 bp, Homo sapiens
ttgcatccaagcttct

SEQ ID NO: 21132 - DNA, 17 bp, Homo sapiens
caaggctgggtctagcg

SEQ ID NO: 21133 - DNA, 25 bp, Homo sapiens
catggaaagaaaataattatgaatg

SEQ ID NO: 21134 - DNA, 19 bp, Homo sapiens
gcaccatcctcgtactgtt

SEQ ID NO: 21135 - DNA, 31 bp, Homo sapiens
tacctgggctgtggtgtgtgggtcttggcct

SEQ ID NO: 21136 - DNA, 19 bp, Homo sapiens
tcccaacctcaccatggaa

SEQ ID NO: 21137 - DNA, 25 bp, Homo sapiens
aatggttggccccacgaagccacga

SEQ ID NO: 21138 - DNA, 23 bp, Homo sapiens
ccccgcccctgagaccctgcagc

SEQ ID NO: 21139 - DNA, 23 bp, Homo sapiens
ctggaagcaaagagggttgctca

SEQ ID NO: 21140 - DNA, 19 bp, Homo sapiens
tattttttacttttctaat

SEQ ID NO: 21141 - DNA, 18 bp, Homo sapiens
ttcaagcggcaggacgca

SEQ ID NO: 21142 - DNA, 19 bp, Homo sapiens
cagctaagccttcatcata

SEQ ID NO: 21143 - DNA, 18 bp, Homo sapiens
gaactaagagagcattgg

SEQ ID NO: 21144 - DNA, 17 bp, Homo sapiens
gcggctctcaacgtgac

SEQ ID NO: 21145 - DNA, 16 bp, Homo sapiens
tactggctcagactgt

SEQ ID NO: 21146 - DNA, 20 bp, Homo sapiens
tgggtggggttatgaaattg

SEQ ID NO: 21147 - DNA, 23 bp, Homo sapiens
ttcaggaacaaccagaggtatca

SEQ ID NO: 21148 - DNA, 25 bp, Homo sapiens
gccaaagtactggactgcctggttc

SEQ ID NO: 21149 - DNA, 19 bp, Homo sapiens
aaccccccgaagccattga

SEQ ID NO: 21150 - DNA, 18 bp, Homo sapiens
ggttctttgggcaacaga

SEQ ID NO: 21151 - DNA, 24 bp, Homo sapiens
gtttgaacacttttgttgtggttc

SEQ ID NO: 21152 - DNA, 26 bp, Homo sapiens
tcaccaaaaccccctttcccatcttg

SEQ ID NO: 21153 - DNA, 15 bp, Homo sapiens
tttcccatcttgcac

SEQ ID NO: 21154 - DNA, 22 bp, Homo sapiens
caaatatatggtaggactgtta

SEQ ID NO: 21155 - DNA, 22 bp, Homo sapiens
tacctaatctctttgtgcctca

SEQ ID NO: 21156 - DNA, 20 bp, Homo sapiens
aaaatgtatctgtgttacga

SEQ ID NO: 21157 - DNA, 22 bp, Homo sapiens
aatccatgatttatactcagaa

SEQ ID NO: 21158 - DNA, 21 bp, Homo sapiens
atctgggcctaatgttggctt

SEQ ID NO: 21159 - DNA, 19 bp, Homo sapiens
gctttgtgacatgaagcta

SEQ ID NO: 21160 - DNA, 20 bp, Homo sapiens
tcatctatggacttgccaaa

SEQ ID NO: 21161 - DNA, 20 bp, Homo sapiens
acaatgttttcttgattaca

SEQ ID NO: 21162 - DNA, 20 bp, Homo sapiens
attatgtgactgggactcca

SEQ ID NO: 21163 - DNA, 22 bp, Homo sapiens
caatgttttcttgattacatct

SEQ ID NO: 21164 - DNA, 19 bp, Homo sapiens
tccagaagatagacttcag

SEQ ID NO: 21165 - DNA, 24 bp, Homo sapiens
tctgcagcattcttgaatattttt

SEQ ID NO: 21166 - DNA, 18 bp, Homo sapiens
aaaacagacaaacaagaa

SEQ ID NO: 21167 - DNA, 27 bp, Homo sapiens
gtcaagatgactgctctatatcacttg

SEQ ID NO: 21168 - DNA, 18 bp, Homo sapiens
tatgcaaaagctgctgta

SEQ ID NO: 21169 - DNA, 17 bp, Homo sapiens
ctcgtcaaacatctgat

SEQ ID NO: 21170 - DNA, 22 bp, Homo sapiens
tgtggtttattttgtcatcaga

SEQ ID NO: 21171 - DNA, 21 bp, Homo sapiens
agtgctccgaagctgtgtgct

SEQ ID NO: 21172 - DNA, 24 bp, Homo sapiens
atcctaccactctcaccccacttt

SEQ ID NO: 21173 - DNA, 20 bp, Homo sapiens
gccctgccattggcggctct

SEQ ID NO: 21174 - DNA, 19 bp, Homo sapiens
tggcccaggcgtggggcta

SEQ ID NO: 21175 - DNA, 19 bp, Homo sapiens
acaaaatataacaagtttt

SEQ ID NO: 21176 - DNA, 24 bp, Homo sapiens
catgaattagctagcattagcata

SEQ ID NO: 21177 - DNA, 20 bp, Homo sapiens
caccaccaaccaccttcttc

SEQ ID NO: 21178 - DNA, 18 bp, Homo sapiens
caccaccacagcccctct

SEQ ID NO: 21179 - DNA, 22 bp, Homo sapiens
ccaccccctgccccactgctga

SEQ ID NO: 21180 - DNA, 18 bp, Homo sapiens
ccatttatccaaaccact

SEQ ID NO: 21181 - DNA, 16 bp, Homo sapiens
ccctcaaccgttctca

SEQ ID NO: 21182 - DNA, 19 bp, Homo sapiens
cctgtatggagaccttgga

SEQ ID NO: 21183 - DNA, 19 bp, Homo sapiens
cctttccctccttccctca

SEQ ID NO: 21184 - DNA, 20 bp, Homo sapiens
ggcagggagttcaggacaac

SEQ ID NO: 21185 - DNA, 24 bp, Homo sapiens
tgaccacacctccgttttctccgt

SEQ ID NO: 21186 - DNA, 18 bp, Homo sapiens
ttccagaaatgactttag

SEQ ID NO: 21187 - DNA, 18 bp, Homo sapiens
atttaccacccttccaga

SEQ ID NO: 21188 - DNA, 23 bp, Homo sapiens
ggagagcgcgcggcggcggcggc

SEQ ID NO: 21189 - DNA, 24 bp, Homo sapiens
ggccactcgcagcggcgctggccg

SEQ ID NO: 21190 - DNA, 23 bp, Homo sapiens
gggacggccccgagcgcgccctc

SEQ ID NO: 21191 - DNA, 18 bp, Homo sapiens
aaaaaggtcatgaaacac

SEQ ID NO: 21192 - DNA, 22 bp, Homo sapiens
atggtgttcaggccactatggc

SEQ ID NO: 21193 - DNA, 23 bp, Homo sapiens
caagcatggatctccatatttca

SEQ ID NO: 21194 - DNA, 18 bp, Homo sapiens
caatatagaaaaaaaaac

SEQ ID NO: 21195 - DNA, 19 bp, Homo sapiens
ctcgaaaactcatgttgaa

SEQ ID NO: 21196 - DNA, 20 bp, Homo sapiens
gtatttccacagagcatgca

SEQ ID NO: 21197 - DNA, 22 bp, Homo sapiens
taaaacttcaaatatctcacca

SEQ ID NO: 21198 - DNA, 19 bp, Homo sapiens
tattgatacaaactgtgac

SEQ ID NO: 21199 - DNA, 19 bp, Homo sapiens
agctcctcccaccccaaca

SEQ ID NO: 21200 - DNA, 20 bp, Homo sapiens
ccatggacatccccaacaac

SEQ ID NO: 21201 - DNA, 19 bp, Homo sapiens
ctcctcgatgcccagtgaa

SEQ ID NO: 21202 - DNA, 18 bp, Homo sapiens
gtcaaagggcagctgaga

SEQ ID NO: 21203 - DNA, 18 bp, Homo sapiens
gtcctccctccttgctgc

SEQ ID NO: 21204 - DNA, 21 bp, Homo sapiens
acatgcttgtaatcccagcta

SEQ ID NO: 21205 - DNA, 19 bp, Homo sapiens
ctgcaacctccgcctccca

SEQ ID NO: 21206 - DNA, 18 bp, Homo sapiens
tccgcctcccaggttcaa

SEQ ID NO: 21207 - DNA, 24 bp, Homo sapiens
tatctgtagaaaaccacagcctca

SEQ ID NO: 21208 - DNA, 17 bp, Homo sapiens
aacagctaagtacctag

SEQ ID NO: 21209 - DNA, 22 bp, Homo sapiens
cctctttgtccagccttgattt

SEQ ID NO: 21210 - DNA, 16 bp, Homo sapiens
gaccaactcatgaagt

SEQ ID NO: 21211 - DNA, 16 bp, Homo sapiens
tattaccctgtgttgt

SEQ ID NO: 21212 - DNA, 22 bp, Homo sapiens
ctctaacacatatgcagtttta

SEQ ID NO: 21213 - DNA, 22 bp, Homo sapiens
ctgtaggacagtttatcagtca

SEQ ID NO: 21214 - DNA, 26 bp, Homo sapiens
cagtgagtcaagatctcaccactgaa

SEQ ID NO: 21215 - DNA, 18 bp, Homo sapiens
ccgccgcctccccgctga

SEQ ID NO: 21216 - DNA, 17 bp, Homo sapiens
ctaacagtcttgtgtga

SEQ ID NO: 21217 - DNA, 21 bp, Homo sapiens
gagaggtgttatacagggcga

SEQ ID NO: 21218 - DNA, 18 bp, Homo sapiens
tcttctcaccgaactttg

SEQ ID NO: 21219 - DNA, 22 bp, Homo sapiens
aaggctggctgtgctggagtca

SEQ ID NO: 21220 - DNA, 18 bp, Homo sapiens
atatctttgatcccctga

SEQ ID NO: 21221 - DNA, 24 bp, Homo sapiens
catcttcctcctcccgacatcgca

SEQ ID NO: 21222 - DNA, 17 bp, Homo sapiens
cccgtgccgcccacagc

SEQ ID NO: 21223 - DNA, 22 bp, Homo sapiens
acccataattgagattgccata

SEQ ID NO: 21224 - DNA, 22 bp, Homo sapiens
gaacactagcatacctgcatga

SEQ ID NO: 21225 - DNA, 21 bp, Homo sapiens
tggctctagaatgtctaggaa

SEQ ID NO: 21226 - DNA, 22 bp, Homo sapiens
tttgagtaattttgggcaagct

SEQ ID NO: 21227 - DNA, 23 bp, Homo sapiens
cttgggtattatagatcactttt

SEQ ID NO: 21228 - DNA, 20 bp, Homo sapiens
gcttctgtgaggaccttttg

SEQ ID NO: 21229 - DNA, 23 bp, Homo sapiens
tatctccaacttcctaaaggctt

SEQ ID NO: 21230 - DNA, 20 bp, Homo sapiens
ttgttgtaattatggcactg

SEQ ID NO: 21231 - DNA, 21 bp, Homo sapiens
gccatacgtggttgtctgctt

SEQ ID NO: 21232 - DNA, 19 bp, Homo sapiens
gggcgccacagcacccacc

SEQ ID NO: 21233 - DNA, 19 bp, Homo sapiens
agtagaggcatgaacacac

SEQ ID NO: 21234 - DNA, 21 bp, Homo sapiens
cacggatgcacagagatatgc

SEQ ID NO: 21235 - DNA, 17 bp, Homo sapiens
cccccaaactctccccc

SEQ ID NO: 21236 - DNA, 19 bp, Homo sapiens
gagagagacagagacagag

SEQ ID NO: 21237 - DNA, 21 bp, Homo sapiens
gatatgcacacacatggatga

SEQ ID NO: 21238 - DNA, 18 bp, Homo sapiens
gctgagcctccttacctc

SEQ ID NO: 21239 - DNA, 25 bp, Homo sapiens
ggctgcgtctcctccgcacacctgt

SEQ ID NO: 21240 - DNA, 19 bp, Homo sapiens
tgaacacacatggatgcac

SEQ ID NO: 21241 - DNA, 20 bp, Homo sapiens
cagctctgtgagtctggcca

SEQ ID NO: 21242 - DNA, 22 bp, Homo sapiens
caccccaccatccagttttgcc

SEQ ID NO: 21243 - DNA, 20 bp, Homo sapiens
cttgggcaatctatactttt

SEQ ID NO: 21244 - DNA, 16 bp, Homo sapiens
gctctgggaaggaggc

SEQ ID NO: 21245 - DNA, 23 bp, Homo sapiens
tccagttttgcccagatgtgcta

SEQ ID NO: 21246 - DNA, 24 bp, Homo sapiens
tcccccagctctatccatctgcca

SEQ ID NO: 21247 - DNA, 25 bp, Homo sapiens
acctgcatgcacacacaccacctca

SEQ ID NO: 21248 - DNA, 23 bp, Homo sapiens
cccctcactatcagagactgggc

SEQ ID NO: 21249 - DNA, 16 bp, Homo sapiens
aagtggacttggccat

SEQ ID NO: 21250 - DNA, 18 bp, Homo sapiens
ctacagagacaattcctc

SEQ ID NO: 21251 - DNA, 20 bp, Homo sapiens
tccatatcctaatgattcaa

SEQ ID NO: 21252 - DNA, 20 bp, Homo sapiens
ccctgctagagcagccgcgc

SEQ ID NO: 21253 - DNA, 17 bp, Homo sapiens
tgggtataaactgttga

SEQ ID NO: 21254 - DNA, 22 bp, Homo sapiens
caggacaacccaacagcaccag

SEQ ID NO: 21255 - DNA, 20 bp, Homo sapiens
gcctgccaggcagacgctgc

SEQ ID NO: 21256 - DNA, 20 bp, Homo sapiens
ccatggatacgcttgtgatc

SEQ ID NO: 21257 - DNA, 22 bp, Homo sapiens
gtttctccattaatagtaactc

SEQ ID NO: 21258 - DNA, 18 bp, Homo sapiens
cttccccaccccttacca

SEQ ID NO: 21259 - DNA, 16 bp, Homo sapiens
gtccatcatgtgtcca

SEQ ID NO: 21260 - DNA, 20 bp, Homo sapiens
cgggagggagggcattggca

SEQ ID NO: 21261 - DNA, 21 bp, Homo sapiens
ccctctgttctccagcaaaca

SEQ ID NO: 21262 - DNA, 21 bp, Homo sapiens
cctttttatttctgtggcttt

SEQ ID NO: 21263 - DNA, 18 bp, Homo sapiens
ctatcttcccctccacct

SEQ ID NO: 21264 - DNA, 21 bp, Homo sapiens
tccaaaaaactcaggaatcaa

SEQ ID NO: 21265 - DNA, 23 bp, Homo sapiens
acagactgctctccaatccctga

SEQ ID NO: 21266 - DNA, 17 bp, Homo sapiens
ccatatttattcactga

SEQ ID NO: 21267 - DNA, 26 bp, Homo sapiens
cccggacctgtaccccctccccccaa

SEQ ID NO: 21268 - DNA, 24 bp, Homo sapiens
ccttctggctccagcttccctcca

SEQ ID NO: 21269 - DNA, 17 bp, Homo sapiens
gacacccccaccttccc

SEQ ID NO: 21270 - DNA, 24 bp, Homo sapiens
gtgcctctgccttatccctggtgg

SEQ ID NO: 21271 - DNA, 21 bp, Homo sapiens
tgtgttgtaattggtccctcc

SEQ ID NO: 21272 - DNA, 24 bp, Homo sapiens
ttttttcataaatgttataatttt

SEQ ID NO: 21273 - DNA, 20 bp, Homo sapiens
acagctgcaacgtggggtga

SEQ ID NO: 21274 - DNA, 17 bp, Homo sapiens
caccaccttgaacacct

SEQ ID NO: 21275 - DNA, 20 bp, Homo sapiens
cctttcggggatccgaggga

SEQ ID NO: 21276 - DNA, 24 bp, Homo sapiens
gccgcctttcggggatccgaggga

SEQ ID NO: 21277 - DNA, 21 bp, Homo sapiens
ggggatccgagggactgtggc

SEQ ID NO: 21278 - DNA, 21 bp, Homo sapiens
tcacacgggtatccagagcaa

SEQ ID NO: 21279 - DNA, 24 bp, Homo sapiens
tgagtgggccccagagcccagctg

SEQ ID NO: 21280 - DNA, 18 bp, Homo sapiens
agtcaaccagcagtatta

SEQ ID NO: 21281 - DNA, 20 bp, Homo sapiens
agagctggcatatctggtca

SEQ ID NO: 21282 - DNA, 20 bp, Homo sapiens
agagtgagcaaccagctgga

SEQ ID NO: 21283 - DNA, 19 bp, Homo sapiens
atatctggtcagaactgca

SEQ ID NO: 21284 - DNA, 20 bp, Homo sapiens
gcgcccagggaggagtcagt

SEQ ID NO: 21285 - DNA, 20 bp, Homo sapiens
agagctggcatatctggtca

SEQ ID NO: 21286 - DNA, 20 bp, Homo sapiens
agagtgagcaaccagctgga

SEQ ID NO: 21287 - DNA, 19 bp, Homo sapiens
atatctggtcagaactgca

SEQ ID NO: 21288 - DNA, 20 bp, Homo sapiens
gcgcccagggaggagtcagt

SEQ ID NO: 21289 - DNA, 18 bp, Homo sapiens
attcccaactgagtgtta

SEQ ID NO: 21290 - DNA, 18 bp, Homo sapiens
attcccaactgagtgtta

SEQ ID NO: 21291 - DNA, 18 bp, Homo sapiens
ccccaggctatgccatca

SEQ ID NO: 21292 - DNA, 23 bp, Homo sapiens
gcctccctcgctccctgctcctc

SEQ ID NO: 21293 - DNA, 20 bp, Homo sapiens
gcgcaacggctcctttgcca

SEQ ID NO: 21294 - DNA, 22 bp, Homo sapiens
gttctggcccctgtcatcctca

SEQ ID NO: 21295 - DNA, 21 bp, Homo sapiens
tgcactcttcaggaaaacgtg

SEQ ID NO: 21296 - DNA, 17 bp, Homo sapiens
ccacatcctcttcccca

SEQ ID NO: 21297 - DNA, 19 bp, Homo sapiens
ggcaggaactaaaacctca

SEQ ID NO: 21298 - DNA, 23 bp, Homo sapiens
ttctggtgaggtgggtttgggag

SEQ ID NO: 21299 - DNA, 21 bp, Homo sapiens
aaacttcttacaaatgaccag

SEQ ID NO: 21300 - DNA, 19 bp, Homo sapiens
accccagcccccagcctca

SEQ ID NO: 21301 - DNA, 20 bp, Homo sapiens
ctcaagcaacagagctgcag

SEQ ID NO: 21302 - DNA, 24 bp, Homo sapiens
gtgcctggctttgctgtggattct

SEQ ID NO: 21303 - DNA, 19 bp, Homo sapiens
aagcagaacattccatcca

SEQ ID NO: 21304 - DNA, 19 bp, Homo sapiens
atgcagaagacttacctta

SEQ ID NO: 21305 - DNA, 25 bp, Homo sapiens
ccactattcataaagtattaaccaa

SEQ ID NO: 21306 - DNA, 19 bp, Homo sapiens
ccaggatctgacaatgagc

SEQ ID NO: 21307 - DNA, 16 bp, Homo sapiens
cctggactatcagtaa

SEQ ID NO: 21308 - DNA, 17 bp, Homo sapiens
cctggtggatttgtggg

SEQ ID NO: 21309 - DNA, 18 bp, Homo sapiens
gccatcacaccacgagga

SEQ ID NO: 21310 - DNA, 20 bp, Homo sapiens
gggtgcaccagggccttgtt

SEQ ID NO: 21311 - DNA, 18 bp, Homo sapiens
gtttctctcacccaggtg

SEQ ID NO: 21312 - DNA, 19 bp, Homo sapiens
ccaatggggcggagcctga

SEQ ID NO: 21313 - DNA, 21 bp, Homo sapiens
gccctggccccgtctcaggat

SEQ ID NO: 21314 - DNA, 19 bp, Homo sapiens
tcagtcctgacgcttgcca

SEQ ID NO: 21315 - DNA, 21 bp, Homo sapiens
cccttctgttgtagactggac

SEQ ID NO: 21316 - DNA, 18 bp, Homo sapiens
cctggcaaggcctggtga

SEQ ID NO: 21317 - DNA, 23 bp, Homo sapiens
gcttgagctactgtgcccggccc

SEQ ID NO: 21318 - DNA, 18 bp, Homo sapiens
gttgctgccattgctgct

SEQ ID NO: 21319 - DNA, 23 bp, Homo sapiens
tggagtgcagtagcgcgatctca

SEQ ID NO: 21320 - DNA, 22 bp, Homo sapiens
ttgttaatgtcagagtgacact

SEQ ID NO: 21321 - DNA, 20 bp, Homo sapiens
tgaagaggcatttcagagtg

SEQ ID NO: 21322 - DNA, 21 bp, Homo sapiens
tggattgactgttgttccttc

SEQ ID NO: 21323 - DNA, 18 bp, Homo sapiens
ttacagacacagacctgc

SEQ ID NO: 21324 - DNA, 20 bp, Homo sapiens
agcattttgctgctacctta

SEQ ID NO: 21325 - DNA, 20 bp, Homo sapiens
ggacagggagagaaaatacc

SEQ ID NO: 21326 - DNA, 23 bp, Homo sapiens
ttttggtctgtgatgcttggtct

SEQ ID NO: 21327 - DNA, 18 bp, Homo sapiens
agcattcggttcttctgt

SEQ ID NO: 21328 - DNA, 20 bp, Homo sapiens
ctgttggaaattccagggta

SEQ ID NO: 21329 - DNA, 16 bp, Homo sapiens
ggcccgcccgcccctc

SEQ ID NO: 21330 - DNA, 16 bp, Homo sapiens
ggttcttctgtcaatc

SEQ ID NO: 21331 - DNA, 18 bp, Homo sapiens
ctcctgctgtagtccttt

SEQ ID NO: 21332 - DNA, 19 bp, Homo sapiens
gcctgctgagagagggtcg

SEQ ID NO: 21333 - DNA, 20 bp, Homo sapiens
tctccagccgaagctgcagg

SEQ ID NO: 21334 - DNA, 22 bp, Homo sapiens
tgccttggcctcggcgggcttt

SEQ ID NO: 21335 - DNA, 19 bp, Homo sapiens
ctggcgggctcctttgata

SEQ ID NO: 21336 - DNA, 22 bp, Homo sapiens
gccttcttctgctgcctggttt

SEQ ID NO: 21337 - DNA, 17 bp, Homo sapiens
aagtcatcaagtaaaca

SEQ ID NO: 21338 - DNA, 20 bp, Homo sapiens
aggaaagagagttacacctt

SEQ ID NO: 21339 - DNA, 23 bp, Homo sapiens
caccacagcatctgcccctgcta

SEQ ID NO: 21340 - DNA, 21 bp, Homo sapiens
gtagctttaatgatttttgtt

SEQ ID NO: 21341 - DNA, 23 bp, Homo sapiens
gttcagcatgtttgcacttgtta

SEQ ID NO: 21342 - DNA, 22 bp, Homo sapiens
acgtattcccattgcaggtgtt

SEQ ID NO: 21343 - DNA, 22 bp, Homo sapiens
ctcaacatcaaatgctctgatg

SEQ ID NO: 21344 - DNA, 20 bp, Homo sapiens
aaagaatgactgttttggtt

SEQ ID NO: 21345 - DNA, 21 bp, Homo sapiens
agccaaggagcagcatatagt

SEQ ID NO: 21346 - DNA, 24 bp, Homo sapiens
agccccacaatgttaaattctgta

SEQ ID NO: 21347 - DNA, 20 bp, Homo sapiens
cccacaatgttaaattctgt

SEQ ID NO: 21348 - DNA, 18 bp, Homo sapiens
gacacttaatatgaaatt

SEQ ID NO: 21349 - DNA, 18 bp, Homo sapiens
tctggaaaaagactccga

SEQ ID NO: 21350 - DNA, 18 bp, Homo sapiens
acatttagatacttcata

SEQ ID NO: 21351 - DNA, 22 bp, Homo sapiens
agaagctgctgtgaggagctca

SEQ ID NO: 21352 - DNA, 25 bp, Homo sapiens
cttcagtgttagttttcttaatttt

SEQ ID NO: 21353 - DNA, 25 bp, Homo sapiens
tctgtagcttttccaggtttttttt

SEQ ID NO: 21354 - DNA, 20 bp, Homo sapiens
atgtcattgtaatgatttca

SEQ ID NO: 21355 - DNA, 20 bp, Homo sapiens
catttttatcaaatgtgtga

SEQ ID NO: 21356 - DNA, 19 bp, Homo sapiens
ccggcgtctgctgccatga

SEQ ID NO: 21357 - DNA, 21 bp, Homo sapiens
ctgtagaagggggacatgcca

SEQ ID NO: 21358 - DNA, 20 bp, Homo sapiens
gccatttagggggacgctgc

SEQ ID NO: 21359 - DNA, 22 bp, Homo sapiens
gcctgagctgtctgtctcgttt

SEQ ID NO: 21360 - DNA, 20 bp, Homo sapiens
gtgtgaacgatacttggcta

SEQ ID NO: 21361 - DNA, 18 bp, Homo sapiens
tacaaagaaatttccctc

SEQ ID NO: 21362 - DNA, 16 bp, Homo sapiens
cttgttctacctatca

SEQ ID NO: 21363 - DNA, 26 bp, Homo sapiens
taaatgagatcattaacgtgaaacta

SEQ ID NO: 21364 - DNA, 21 bp, Homo sapiens
cctagcgactgacaacaggct

SEQ ID NO: 21365 - DNA, 18 bp, Homo sapiens
gcgtggagagccttcgcg

SEQ ID NO: 21366 - DNA, 19 bp, Homo sapiens
tttttgcctagcgactgac

SEQ ID NO: 21367 - DNA, 17 bp, Homo sapiens
ttcagttgaataacttg

SEQ ID NO: 21368 - DNA, 18 bp, Homo sapiens
cacaaaaatggtctttct

SEQ ID NO: 21369 - DNA, 18 bp, Homo sapiens
cctgcaacctccacctcc

SEQ ID NO: 21370 - DNA, 21 bp, Homo sapiens
cgacagaaagaagtctcttct

SEQ ID NO: 21371 - DNA, 20 bp, Homo sapiens
gcacaatgcatcccatccca

SEQ ID NO: 21372 - DNA, 21 bp, Homo sapiens
gttctttgtaaataaaacagg

SEQ ID NO: 21373 - DNA, 18 bp, Homo sapiens
tacaacctgatggcatta

SEQ ID NO: 21374 - DNA, 17 bp, Homo sapiens
tcaagtgattcttgtgc

SEQ ID NO: 21375 - DNA, 18 bp, Homo sapiens
tccacctcctgggttcaa

SEQ ID NO: 21376 - DNA, 20 bp, Homo sapiens
tctaggagtctcttgatgag

SEQ ID NO: 21377 - DNA, 18 bp, Homo sapiens
gtgggcaaaagaagatct

SEQ ID NO: 21378 - DNA, 18 bp, Homo sapiens
tctgtccggagttgtgta

SEQ ID NO: 21379 - DNA, 20 bp, Homo sapiens
aaaacaaccaagacaaagaa

SEQ ID NO: 21380 - DNA, 18 bp, Homo sapiens
accatgtaataaatgaac

SEQ ID NO: 21381 - DNA, 22 bp, Homo sapiens
agagctgcagccagctctgccc

SEQ ID NO: 21382 - DNA, 26 bp, Homo sapiens
cgaaccagaagcactgagattaacct

SEQ ID NO: 21383 - DNA, 21 bp, Homo sapiens
taaatggatttaggaagactg

SEQ ID NO: 21384 - DNA, 16 bp, Homo sapiens
aacccaagactgcctg

SEQ ID NO: 21385 - DNA, 18 bp, Homo sapiens
tttccactatcctaactg

SEQ ID NO: 21386 - DNA, 22 bp, Homo sapiens
aagaaattgcaaggactttttt

SEQ ID NO: 21387 - DNA, 20 bp, Homo sapiens
aggtcccaggtcttccctct

SEQ ID NO: 21388 - DNA, 19 bp, Homo sapiens
ccatgctaagtctaacact

SEQ ID NO: 21389 - DNA, 21 bp, Homo sapiens
ccccaccctctgcccttcagc

SEQ ID NO: 21390 - DNA, 19 bp, Homo sapiens
cttgacagcccaggtccct

SEQ ID NO: 21391 - DNA, 18 bp, Homo sapiens
ggacttgcctgcctcctc

SEQ ID NO: 21392 - DNA, 20 bp, Homo sapiens
ttgatatttgcacagggata

SEQ ID NO: 21393 - DNA, 19 bp, Homo sapiens
aagaaaaaaaggacagaca

SEQ ID NO: 21394 - DNA, 18 bp, Homo sapiens
acattgtatatatatcac

SEQ ID NO: 21395 - DNA, 23 bp, Homo sapiens
acttgccgcggactgcctgggct

SEQ ID NO: 21396 - DNA, 16 bp, Homo sapiens
ccccaagcctcattca

SEQ ID NO: 21397 - DNA, 15 bp, Homo sapiens
tcctggatcttccca

SEQ ID NO: 21398 - DNA, 18 bp, Homo sapiens
ccaaaaggtcacattcag

SEQ ID NO: 21399 - DNA, 23 bp, Homo sapiens
cctttttgtgcctttcttgacct

SEQ ID NO: 21400 - DNA, 19 bp, Homo sapiens
tcacctatgcctgaaagca

SEQ ID NO: 21401 - DNA, 18 bp, Homo sapiens
acatgtgatgtctggtct

SEQ ID NO: 21402 - DNA, 21 bp, Homo sapiens
agcagttgagcaaacaccaac

SEQ ID NO: 21403 - DNA, 22 bp, Homo sapiens
aggctgggcgcatcccaagaca

SEQ ID NO: 21404 - DNA, 21 bp, Homo sapiens
agttttgaagttctagccact

SEQ ID NO: 21405 - DNA, 21 bp, Homo sapiens
caagctaagagagcttgcaaa

SEQ ID NO: 21406 - DNA, 19 bp, Homo sapiens
gctcgatgacttgtctctg

SEQ ID NO: 21407 - DNA, 21 bp, Homo sapiens
gggctttctctagccttgtca

SEQ ID NO: 21408 - DNA, 16 bp, Homo sapiens
tttcccaaaaatgaaa

SEQ ID NO: 21409 - DNA, 19 bp, Homo sapiens
aaaaaattacccaggcact

SEQ ID NO: 21410 - DNA, 18 bp, Homo sapiens
aaataccatgtttgaaga

SEQ ID NO: 21411 - DNA, 25 bp, Homo sapiens
aataaccaaagcaaatgtttccttc

SEQ ID NO: 21412 - DNA, 17 bp, Homo sapiens
cacacattaaattcagt

SEQ ID NO: 21413 - DNA, 21 bp, Homo sapiens
cttacatattgttttggcttt

SEQ ID NO: 21414 - DNA, 22 bp, Homo sapiens
gagccaagatcgcgccactgca

SEQ ID NO: 21415 - DNA, 19 bp, Homo sapiens
gcgcctacgggctgcggtg

SEQ ID NO: 21416 - DNA, 22 bp, Homo sapiens
gctttccaagggaggtctagga

SEQ ID NO: 21417 - DNA, 23 bp, Homo sapiens
tccagtttcagatcatgctgcca

SEQ ID NO: 21418 - DNA, 18 bp, Homo sapiens
tctgattccaggcactct

SEQ ID NO: 21419 - DNA, 20 bp, Homo sapiens
tgggatatttatgctcagtt

SEQ ID NO: 21420 - DNA, 21 bp, Homo sapiens
tggggcagccctcagacttca

SEQ ID NO: 21421 - DNA, 23 bp, Homo sapiens
tgtcttttatacaatttttagct

SEQ ID NO: 21422 - DNA, 17 bp, Homo sapiens
atgggttctcaactgta

SEQ ID NO: 21423 - DNA, 19 bp, Homo sapiens
cattgatcatcccttctca

SEQ ID NO: 21424 - DNA, 20 bp, Homo sapiens
ccattgatcatcccttctca

SEQ ID NO: 21425 - DNA, 20 bp, Homo sapiens
ctgctgtacccagaaatcta

SEQ ID NO: 21426 - DNA, 19 bp, Homo sapiens
cttgctcccaagtcctttt

SEQ ID NO: 21427 - DNA, 22 bp, Homo sapiens
tctgggttcttccttttggttc

SEQ ID NO: 21428 - DNA, 18 bp, Homo sapiens
tgcaaaactccaggcttc

SEQ ID NO: 21429 - DNA, 18 bp, Homo sapiens
tgggtgcagcaggagctg

SEQ ID NO: 21430 - DNA, 20 bp, Homo sapiens
ctgataccacgaaccagtga

SEQ ID NO: 21431 - DNA, 21 bp, Homo sapiens
atcaatatgtaaatatgtgat

SEQ ID NO: 21432 - DNA, 21 bp, Homo sapiens
atgaagttgtttgtatacata

SEQ ID NO: 21433 - DNA, 21 bp, Homo sapiens
tgtgtcaagaaatcttggcaa

SEQ ID NO: 21434 - DNA, 19 bp, Homo sapiens
ttccagagcacgtctccag

SEQ ID NO: 21435 - DNA, 20 bp, Homo sapiens
tcttgattggagcttccggt

SEQ ID NO: 21436 - DNA, 20 bp, Homo sapiens
aggcagcaggcaccaagctg

SEQ ID NO: 21437 - DNA, 20 bp, Homo sapiens
aaagtggctctgactttccc

SEQ ID NO: 21438 - DNA, 21 bp, Homo sapiens
accattcccattcgttctatt

SEQ ID NO: 21439 - DNA, 17 bp, Homo sapiens
acctgggacgttggccg

SEQ ID NO: 21440 - DNA, 21 bp, Homo sapiens
actccattttgatctgtacta

SEQ ID NO: 21441 - DNA, 22 bp, Homo sapiens
caagatcatgccactccactcc

SEQ ID NO: 21442 - DNA, 22 bp, Homo sapiens
cagggccacctgggatcagtca

SEQ ID NO: 21443 - DNA, 18 bp, Homo sapiens
catttctcaagaatcctc

SEQ ID NO: 21444 - DNA, 20 bp, Homo sapiens
ccattcgttctattctgaga

SEQ ID NO: 21445 - DNA, 22 bp, Homo sapiens
gagccaagatcatgccactcca

SEQ ID NO: 21446 - DNA, 20 bp, Homo sapiens
ggcacactcaatggcaaaca

SEQ ID NO: 21447 - DNA, 17 bp, Homo sapiens
ggcttcccagccgctca

SEQ ID NO: 21448 - DNA, 23 bp, Homo sapiens
tggaatgtctcggtgtaaagctg

SEQ ID NO: 21449 - DNA, 18 bp, Homo sapiens
tgggtggatcacttgagg

SEQ ID NO: 21450 - DNA, 16 bp, Homo sapiens
cccaagaactactcca

SEQ ID NO: 21451 - DNA, 23 bp, Homo sapiens
ctcgtaccacccctgttacccca

SEQ ID NO: 21452 - DNA, 22 bp, Homo sapiens
ctggtcaatgcatcctacacca

SEQ ID NO: 21453 - DNA, 16 bp, Homo sapiens
gaggatggtcaggtgg

SEQ ID NO: 21454 - DNA, 18 bp, Homo sapiens
gtggatcatctctagcaa

SEQ ID NO: 21455 - DNA, 24 bp, Homo sapiens
tttgtgggaatctgttcctcacca

SEQ ID NO: 21456 - DNA, 17 bp, Homo sapiens
gacttgttaccaccgca

SEQ ID NO: 21457 - DNA, 20 bp, Homo sapiens
actattcttggagtcctttg

SEQ ID NO: 21458 - DNA, 21 bp, Homo sapiens
atggacgccataaattctgaa

SEQ ID NO: 21459 - DNA, 19 bp, Homo sapiens
cccaccctggcccactcca

SEQ ID NO: 21460 - DNA, 20 bp, Homo sapiens
ggcccagggagttctgctca

SEQ ID NO: 21461 - DNA, 19 bp, Homo sapiens
tatttctgacctttttcca

SEQ ID NO: 21462 - DNA, 17 bp, Homo sapiens
tcactttgttagcgttg

SEQ ID NO: 21463 - DNA, 20 bp, Homo sapiens
tgcgatcactgacttctcta

SEQ ID NO: 21464 - DNA, 20 bp, Homo sapiens
tggatgggagtgtggggctg

SEQ ID NO: 21465 - DNA, 25 bp, Homo sapiens
ttttgaggaagagggaaagtgacaa

SEQ ID NO: 21466 - DNA, 22 bp, Homo sapiens
caggctatgtattatctccttt

SEQ ID NO: 21467 - DNA, 21 bp, Homo sapiens
gtgaaagtttggtcagtctca

SEQ ID NO: 21468 - DNA, 22 bp, Homo sapiens
tattaacagttaatcccataac

SEQ ID NO: 21469 - DNA, 20 bp, Homo sapiens
tgaccctggcttgtgctagt

SEQ ID NO: 21470 - DNA, 23 bp, Homo sapiens
tgagtctttaggccagtatgcta

SEQ ID NO: 21471 - DNA, 24 bp, Homo sapiens
aacagagcagccgggaagctccaa

SEQ ID NO: 21472 - DNA, 24 bp, Homo sapiens
accgctcaactacatggaaactga

SEQ ID NO: 21473 - DNA, 21 bp, Homo sapiens
atgttgagaatccacatatga

SEQ ID NO: 21474 - DNA, 21 bp, Homo sapiens
cctaatatttgtaactacaca

SEQ ID NO: 21475 - DNA, 24 bp, Homo sapiens
ctgcatgaactaatgagcaaaata

SEQ ID NO: 21476 - DNA, 17 bp, Homo sapiens
ctttttcattccccttt

SEQ ID NO: 21477 - DNA, 22 bp, Homo sapiens
ctttttcattcccctttacctt

SEQ ID NO: 21478 - DNA, 18 bp, Homo sapiens
gaccatcgagactaggaa

SEQ ID NO: 21479 - DNA, 15 bp, Homo sapiens
ggtggatatacatca

SEQ ID NO: 21480 - DNA, 16 bp, Homo sapiens
tccagatcatctccca

SEQ ID NO: 21481 - DNA, 23 bp, Homo sapiens
tgagatcaaactgcaaggtggca

SEQ ID NO: 21482 - DNA, 21 bp, Homo sapiens
ccaggcacccctctttttact

SEQ ID NO: 21483 - DNA, 19 bp, Homo sapiens
cccagccccgccctcccca

SEQ ID NO: 21484 - DNA, 20 bp, Homo sapiens
cccccaacctctggctccca

SEQ ID NO: 21485 - DNA, 20 bp, Homo sapiens
taaggtcgtgataaagtgtt

SEQ ID NO: 21486 - DNA, 19 bp, Homo sapiens
ttagaaccaccgcccctct

SEQ ID NO: 21487 - DNA, 22 bp, Homo sapiens
tttttactcaaaggcactgact

SEQ ID NO: 21488 - DNA, 20 bp, Homo sapiens
aaaataacactacagtttcc

SEQ ID NO: 21489 - DNA, 18 bp, Homo sapiens
aataggcaaaaggaaaca

SEQ ID NO: 21490 - DNA, 16 bp, Homo sapiens
ccaacacctcttgaca

SEQ ID NO: 21491 - DNA, 18 bp, Homo sapiens
ccgcacccctctcccttt

SEQ ID NO: 21492 - DNA, 21 bp, Homo sapiens
ttggtagtgttggcgctcctg

SEQ ID NO: 21493 - DNA, 20 bp, Homo sapiens
accacacacttgcacacccc

SEQ ID NO: 21494 - DNA, 20 bp, Homo sapiens
aatgaagccagctcttcctc

SEQ ID NO: 21495 - DNA, 18 bp, Homo sapiens
actctaaaactaatttgt

SEQ ID NO: 21496 - DNA, 18 bp, Homo sapiens
cacagatgctggtcctca

SEQ ID NO: 21497 - DNA, 19 bp, Homo sapiens
ggagaaggggcattttgtg

SEQ ID NO: 21498 - DNA, 20 bp, Homo sapiens
tattctgcacattcattcca

SEQ ID NO: 21499 - DNA, 23 bp, Homo sapiens
tcaaaaatgaagccagctcttcc

SEQ ID NO: 21500 - DNA, 24 bp, Homo sapiens
ttttatggcagttgttttaagttt

SEQ ID NO: 21501 - DNA, 21 bp, Homo sapiens
gcttcacactgctctgcctct

SEQ ID NO: 21502 - DNA, 19 bp, Homo sapiens
gaaaaggtggtgattgcca

SEQ ID NO: 21503 - DNA, 19 bp, Homo sapiens
gattcagccaagaacagct

SEQ ID NO: 21504 - DNA, 21 bp, Homo sapiens
atgtggagcagtgtacagtga

SEQ ID NO: 21505 - DNA, 19 bp, Homo sapiens
acaaaacagagcaagagtt

SEQ ID NO: 21506 - DNA, 18 bp, Homo sapiens
tgtgttggcacatgcctg

SEQ ID NO: 21507 - DNA, 19 bp, Homo sapiens
aatcgcctccatttgagaa

SEQ ID NO: 21508 - DNA, 19 bp, Homo sapiens
actcatcttaagcccgagc

SEQ ID NO: 21509 - DNA, 16 bp, Homo sapiens
atcttaagcccgagca

SEQ ID NO: 21510 - DNA, 15 bp, Homo sapiens
caaccaaaaatgtct

SEQ ID NO: 21511 - DNA, 19 bp, Homo sapiens
gctcctgcctgctctgaga

SEQ ID NO: 21512 - DNA, 21 bp, Homo sapiens
ggaaacatcctgttttattat

SEQ ID NO: 21513 - DNA, 17 bp, Homo sapiens
ggctgaagagtctgctt

SEQ ID NO: 21514 - DNA, 19 bp, Homo sapiens
gttgctctaaaatacctca

SEQ ID NO: 21515 - DNA, 25 bp, Homo sapiens
taaatggggtaggtgggtgagatta

SEQ ID NO: 21516 - DNA, 17 bp, Homo sapiens
tccctgcccttctcctc

SEQ ID NO: 21517 - DNA, 20 bp, Homo sapiens
ttttggctgttagacctgtg

SEQ ID NO: 21518 - DNA, 21 bp, Homo sapiens
aaaagaaacaaaatcttgcca

SEQ ID NO: 21519 - DNA, 17 bp, Homo sapiens
aacactgggaccactgt

SEQ ID NO: 21520 - DNA, 20 bp, Homo sapiens
aagaattcagcaatgttatc

SEQ ID NO: 21521 - DNA, 22 bp, Homo sapiens
acagcctcatcattccactttt

SEQ ID NO: 21522 - DNA, 16 bp, Homo sapiens
atccttatttgccttt

SEQ ID NO: 21523 - DNA, 21 bp, Homo sapiens
cctaaatttaaaagcagtcca

SEQ ID NO: 21524 - DNA, 21 bp, Homo sapiens
cctcccccaaaggcgctttcc

SEQ ID NO: 21525 - DNA, 18 bp, Homo sapiens
cctttgtctctggaatca

SEQ ID NO: 21526 - DNA, 19 bp, Homo sapiens
cgtggctctgttttgtcag

SEQ ID NO: 21527 - DNA, 21 bp, Homo sapiens
ctaaaatttggactcttgtct

SEQ ID NO: 21528 - DNA, 19 bp, Homo sapiens
ctctactctctctgcccct

SEQ ID NO: 21529 - DNA, 20 bp, Homo sapiens
gataccatgttctatgcctt

SEQ ID NO: 21530 - DNA, 20 bp, Homo sapiens
ggaaacagcttggctgtggt

SEQ ID NO: 21531 - DNA, 19 bp, Homo sapiens
gggacacagggccaagctt

SEQ ID NO: 21532 - DNA, 19 bp, Homo sapiens
ggtaaagaagaaactgcac

SEQ ID NO: 21533 - DNA, 20 bp, Homo sapiens
gtgtgcctgtatcatttggc

SEQ ID NO: 21534 - DNA, 16 bp, Homo sapiens
tccagaaagaattcag

SEQ ID NO: 21535 - DNA, 22 bp, Homo sapiens
tcccattctaaaagtgtggaca

SEQ ID NO: 21536 - DNA, 19 bp, Homo sapiens
tgaagttgtaagagttgtc

SEQ ID NO: 21537 - DNA, 20 bp, Homo sapiens
tggccaggctggtcttgaac

SEQ ID NO: 21538 - DNA, 21 bp, Homo sapiens
tttgagatataaagaccctga

SEQ ID NO: 21539 - DNA, 17 bp, Homo sapiens
ttttcactatgcattca

SEQ ID NO: 21540 - DNA, 20 bp, Homo sapiens
acagcgagggcccagctcct

SEQ ID NO: 21541 - DNA, 18 bp, Homo sapiens
ggcactcaagctgggcca

SEQ ID NO: 21542 - DNA, 22 bp, Homo sapiens
atcgtttgtttatgaaatgcca

SEQ ID NO: 21543 - DNA, 19 bp, Homo sapiens
cctggcagggacctgagag

SEQ ID NO: 21544 - DNA, 19 bp, Homo sapiens
gtaggtggttcgtgctgtg

SEQ ID NO: 21545 - DNA, 16 bp, Homo sapiens
gtcctccaccatgcac

SEQ ID NO: 21546 - DNA, 17 bp, Homo sapiens
gtgagcacacccgtgtg

SEQ ID NO: 21547 - DNA, 18 bp, Homo sapiens
gtgtttgattggctttcg

SEQ ID NO: 21548 - DNA, 20 bp, Homo sapiens
cacagcaagactccgtctaa

SEQ ID NO: 21549 - DNA, 19 bp, Homo sapiens
cctaggtgctgcctggccc

SEQ ID NO: 21550 - DNA, 27 bp, Homo sapiens
cggcgcgcgcacaccccagtgctgctg

SEQ ID NO: 21551 - DNA, 19 bp, Homo sapiens
ctctccctcttcaggtctc

SEQ ID NO: 21552 - DNA, 20 bp, Homo sapiens
ctctccctcttcaggtctca

SEQ ID NO: 21553 - DNA, 19 bp, Homo sapiens
gccacctccctctccctct

SEQ ID NO: 21554 - DNA, 19 bp, Homo sapiens
ggcccctgtgtcatagtca

SEQ ID NO: 21555 - DNA, 17 bp, Homo sapiens
tgatctgctccagatga

SEQ ID NO: 21556 - DNA, 21 bp, Homo sapiens
tgcacatttcccaggactgcc

SEQ ID NO: 21557 - DNA, 20 bp, Homo sapiens
ctaaaggttccctctccacc

SEQ ID NO: 21558 - DNA, 21 bp, Homo sapiens
acctgtgggagcgcctggccc

SEQ ID NO: 21559 - DNA, 22 bp, Homo sapiens
cccagcacagccacctgccaga

SEQ ID NO: 21560 - DNA, 18 bp, Homo sapiens
ccctccccgtccctgtcc

SEQ ID NO: 21561 - DNA, 21 bp, Homo sapiens
cctcatcatccacccgctgcc

SEQ ID NO: 21562 - DNA, 25 bp, Homo sapiens
cctctgggcagcctgctttggcctt

SEQ ID NO: 21563 - DNA, 19 bp, Homo sapiens
ctccagcccctttgcctct

SEQ ID NO: 21564 - DNA, 17 bp, Homo sapiens
gacagggagggggacct

SEQ ID NO: 21565 - DNA, 19 bp, Homo sapiens
gccactgccaagcttcctg

SEQ ID NO: 21566 - DNA, 18 bp, Homo sapiens
ggagcatagaagccacat

SEQ ID NO: 21567 - DNA, 22 bp, Homo sapiens
tctgcctctgggcagcctgctt

SEQ ID NO: 21568 - DNA, 24 bp, Homo sapiens
tgagtgggccctgcccggggagct

SEQ ID NO: 21569 - DNA, 17 bp, Homo sapiens
tccccaaccacatttga

SEQ ID NO: 21570 - DNA, 18 bp, Homo sapiens
ttgtctttcagagttgtt

SEQ ID NO: 21571 - DNA, 22 bp, Homo sapiens
atttgcatcatgccgactggag

SEQ ID NO: 21572 - DNA, 25 bp, Homo sapiens
cttcttccacgtcctcctcctcctc

SEQ ID NO: 21573 - DNA, 17 bp, Homo sapiens
tgtttgcagccactgct

SEQ ID NO: 21574 - DNA, 17 bp, Homo sapiens
aagtgatagtgacccag

SEQ ID NO: 21575 - DNA, 21 bp, Homo sapiens
cccctccccactccctgatcc

SEQ ID NO: 21576 - DNA, 20 bp, Homo sapiens
gctcgaaggggggctttcgt

SEQ ID NO: 21577 - DNA, 24 bp, Homo sapiens
gcttctagagctctctctgcccct

SEQ ID NO: 21578 - DNA, 18 bp, Homo sapiens
ggacccatcaggacccca

SEQ ID NO: 21579 - DNA, 22 bp, Homo sapiens
taagtaatagtgaccctttcac

SEQ ID NO: 21580 - DNA, 18 bp, Homo sapiens
ggctaaagccgcaggtga

SEQ ID NO: 21581 - DNA, 20 bp, Homo sapiens
tcctgagttgaggcttgcgg

SEQ ID NO: 21582 - DNA, 22 bp, Homo sapiens
cctacaaatgatttcagatcat

SEQ ID NO: 21583 - DNA, 23 bp, Homo sapiens
taaatggatttttaagtgaaatt

SEQ ID NO: 21584 - DNA, 22 bp, Homo sapiens
cctacaaatgatttcagatcat

SEQ ID NO: 21585 - DNA, 23 bp, Homo sapiens
taaatggatttttaagtgaaatt

SEQ ID NO: 21586 - DNA, 18 bp, Homo sapiens
aacggggagtagcagtag

SEQ ID NO: 21587 - DNA, 22 bp, Homo sapiens
cctacaaatgatttcagatcat

SEQ ID NO: 21588 - DNA, 23 bp, Homo sapiens
taaatggatttttaagtgaaatt

SEQ ID NO: 21589 - DNA, 22 bp, Homo sapiens
cctacaaatgatttcagatcat

SEQ ID NO: 21590 - DNA, 21 bp, Homo sapiens
cctgaggcaggtaaatggggc

SEQ ID NO: 21591 - DNA, 23 bp, Homo sapiens
taaatggatttttaagtgaaatt

SEQ ID NO: 21592 - DNA, 21 bp, Homo sapiens
taagaaccttctattcacatc

SEQ ID NO: 21593 - DNA, 19 bp, Homo sapiens
aaacacttatttctgtgaa

SEQ ID NO: 21594 - DNA, 18 bp, Homo sapiens
acaaaagttaagaagcca

SEQ ID NO: 21595 - DNA, 16 bp, Homo sapiens
acacttatttctgtga

SEQ ID NO: 21596 - DNA, 22 bp, Homo sapiens
ctcatcactatttactaaagca

SEQ ID NO: 21597 - DNA, 22 bp, Homo sapiens
tcatttccattcaagtcatcca

SEQ ID NO: 21598 - DNA, 20 bp, Homo sapiens
ctataccctttagcaaaata

SEQ ID NO: 21599 - DNA, 25 bp, Homo sapiens
ctgtctactaagagacatcattcca

SEQ ID NO: 21600 - DNA, 23 bp, Homo sapiens
gatgagagaagggagagaataaa

SEQ ID NO: 21601 - DNA, 16 bp, Homo sapiens
gtctctccatatttag

SEQ ID NO: 21602 - DNA, 16 bp, Homo sapiens
aacttggggtccatca

SEQ ID NO: 21603 - DNA, 20 bp, Homo sapiens
agaaaagaaaagcaaccaca

SEQ ID NO: 21604 - DNA, 19 bp, Homo sapiens
agtattgtacaaccaacac

SEQ ID NO: 21605 - DNA, 17 bp, Homo sapiens
cacctgaggccaccagg

SEQ ID NO: 21606 - DNA, 19 bp, Homo sapiens
catctgcttcccccaaggc

SEQ ID NO: 21607 - DNA, 18 bp, Homo sapiens
ccagctgaccactggccc

SEQ ID NO: 21608 - DNA, 18 bp, Homo sapiens
gcagtcttcaatcgatca

SEQ ID NO: 21609 - DNA, 19 bp, Homo sapiens
ggcgggtggatcacttgaa

SEQ ID NO: 21610 - DNA, 18 bp, Homo sapiens
gtggtcttttcaaatgtc

SEQ ID NO: 21611 - DNA, 19 bp, Homo sapiens
tgccttcccttccatctct

SEQ ID NO: 21612 - DNA, 21 bp, Homo sapiens
ttcaggttaaaaaaaaagttt

SEQ ID NO: 21613 - DNA, 22 bp, Homo sapiens
ttctttgggtcccctgatgcca

SEQ ID NO: 21614 - DNA, 20 bp, Homo sapiens
ttgcccagctgaccactggc

SEQ ID NO: 21615 - DNA, 21 bp, Homo sapiens
acattgggaatataagacaat

SEQ ID NO: 21616 - DNA, 18 bp, Homo sapiens
agtgaattacccagagtg

SEQ ID NO: 21617 - DNA, 17 bp, Homo sapiens
tctacacaggttgccaa

SEQ ID NO: 21618 - DNA, 19 bp, Homo sapiens
tgtcaaacaagagagatga

SEQ ID NO: 21619 - DNA, 19 bp, Homo sapiens
aacccagtaaacatataca

SEQ ID NO: 21620 - DNA, 20 bp, Homo sapiens
aataggagttcatcctgaaa

SEQ ID NO: 21621 - DNA, 20 bp, Homo sapiens
cacctttgtatctcatttga

SEQ ID NO: 21622 - DNA, 20 bp, Homo sapiens
tttgttggcataaaataacc

SEQ ID NO: 21623 - DNA, 27 bp, Homo sapiens
gcctggattgtctgattttaggtcact

SEQ ID NO: 21624 - DNA, 22 bp, Homo sapiens
aaaataagaagatgcactttct

SEQ ID NO: 21625 - DNA, 19 bp, Homo sapiens
ataactccagagaagcagc

SEQ ID NO: 21626 - DNA, 24 bp, Homo sapiens
catagtcacagacaaaagcataca

SEQ ID NO: 21627 - DNA, 23 bp, Homo sapiens
ccaaaaaaaaaattaacattgta

SEQ ID NO: 21628 - DNA, 18 bp, Homo sapiens
gcagcttcagactgtttt

SEQ ID NO: 21629 - DNA, 19 bp, Homo sapiens
ggaacagtttcctttttta

SEQ ID NO: 21630 - DNA, 22 bp, Homo sapiens
atgtgaaaccacagatatttca

SEQ ID NO: 21631 - DNA, 18 bp, Homo sapiens
gggaaacaggctgaccac

SEQ ID NO: 21632 - DNA, 22 bp, Homo sapiens
cccttccagggcctctgctcca

SEQ ID NO: 21633 - DNA, 19 bp, Homo sapiens
ttccagggcctctgctcca

SEQ ID NO: 21634 - DNA, 24 bp, Homo sapiens
acaccactgggagggttgtgtagg

SEQ ID NO: 21635 - DNA, 22 bp, Homo sapiens
atgccagaatttggagatttga

SEQ ID NO: 21636 - DNA, 18 bp, Homo sapiens
caccactacccttgtaaa

SEQ ID NO: 21637 - DNA, 28 bp, Homo sapiens
ccaaagctctgagttccattttacagct

SEQ ID NO: 21638 - DNA, 16 bp, Homo sapiens
cctaccaatttcctcc

SEQ ID NO: 21639 - DNA, 24 bp, Homo sapiens
gagatatagcaactaacgacgcta

SEQ ID NO: 21640 - DNA, 24 bp, Homo sapiens
gctcccctgtcctcttcaatccct

SEQ ID NO: 21641 - DNA, 18 bp, Homo sapiens
gctctgagttccatttta

SEQ ID NO: 21642 - DNA, 24 bp, Homo sapiens
gcttctccagctcccctgtcctct

SEQ ID NO: 21643 - DNA, 21 bp, Homo sapiens
actctcagggttggcaaccct

SEQ ID NO: 21644 - DNA, 20 bp, Homo sapiens
ccgcagggatgccttgcctt

SEQ ID NO: 21645 - DNA, 21 bp, Homo sapiens
gcccactcacttgccattcca

SEQ ID NO: 21646 - DNA, 22 bp, Homo sapiens
tgcccagggacccccatcccgg

SEQ ID NO: 21647 - DNA, 24 bp, Homo sapiens
acagcaaacagattttattaccta

SEQ ID NO: 21648 - DNA, 17 bp, Homo sapiens
catttttatcagggccc

SEQ ID NO: 21649 - DNA, 22 bp, Homo sapiens
ctggaattacaggcacctgcca

SEQ ID NO: 21650 - DNA, 23 bp, Homo sapiens
ctgtaagttcctcctctgcccct

SEQ ID NO: 21651 - DNA, 22 bp, Homo sapiens
gggatggcgccagggcggtggc

SEQ ID NO: 21652 - DNA, 17 bp, Homo sapiens
tcaagtgattctcctgc

SEQ ID NO: 21653 - DNA, 18 bp, Homo sapiens
tccgcctcctgggttcaa

SEQ ID NO: 21654 - DNA, 19 bp, Homo sapiens
gaccccctgggccaggtga

SEQ ID NO: 21655 - DNA, 23 bp, Homo sapiens
gcaactctggtgaaaccttttca

SEQ ID NO: 21656 - DNA, 24 bp, Homo sapiens
ggacagaaaaggggcagacacacc

SEQ ID NO: 21657 - DNA, 19 bp, Homo sapiens
ttctccccatagcacgagg

SEQ ID NO: 21658 - DNA, 20 bp, Homo sapiens
gcgaggccaagagagacccc

SEQ ID NO: 21659 - DNA, 18 bp, Homo sapiens
cttttggactttgtatta

SEQ ID NO: 21660 - DNA, 20 bp, Homo sapiens
ggccacatgcaaccatgtga

SEQ ID NO: 21661 - DNA, 18 bp, Homo sapiens
gttttggtaaatctctta

SEQ ID NO: 21662 - DNA, 21 bp, Homo sapiens
tttctcagttgtttttgcttt

SEQ ID NO: 21663 - DNA, 20 bp, Homo sapiens
tctactgatgtttattagag

SEQ ID NO: 21664 - DNA, 21 bp, Homo sapiens
gaaacacagaagcaattttaa

SEQ ID NO: 21665 - DNA, 18 bp, Homo sapiens
aacagtccacgtgttctc

SEQ ID NO: 21666 - DNA, 22 bp, Homo sapiens
aattggcacactctcttccaca

SEQ ID NO: 21667 - DNA, 26 bp, Homo sapiens
tgagtgtatacccagtaatgggattg

SEQ ID NO: 21668 - DNA, 16 bp, Homo sapiens
agctatgatcatccca

SEQ ID NO: 21669 - DNA, 24 bp, Homo sapiens
aggcacctgccaactacttgcttt

SEQ ID NO: 21670 - DNA, 20 bp, Homo sapiens
caccgcatcaccaccccttc

SEQ ID NO: 21671 - DNA, 18 bp, Homo sapiens
cactaaagctaaccattc

SEQ ID NO: 21672 - DNA, 15 bp, Homo sapiens
cccctgcatatgaca

SEQ ID NO: 21673 - DNA, 20 bp, Homo sapiens
gaagttctgcaaacctcccc

SEQ ID NO: 21674 - DNA, 18 bp, Homo sapiens
tctttaggacattagtcc

SEQ ID NO: 21675 - DNA, 21 bp, Homo sapiens
ccacgtctcccctgcacccca

SEQ ID NO: 21676 - DNA, 16 bp, Homo sapiens
tgagcccagtacaaca

SEQ ID NO: 21677 - DNA, 25 bp, Homo sapiens
aaggagactccaccctggggtccca

SEQ ID NO: 21678 - DNA, 20 bp, Homo sapiens
acatcaccctcacgctgcgg

SEQ ID NO: 21679 - DNA, 18 bp, Homo sapiens
tgcagatttcttgctgct

SEQ ID NO: 21680 - DNA, 18 bp, Homo sapiens
tccaactcccaggttcaa

SEQ ID NO: 21681 - DNA, 20 bp, Homo sapiens
tgactgttccacatgtagta

SEQ ID NO: 21682 - DNA, 21 bp, Homo sapiens
cttttttgttgtcttttgacc

SEQ ID NO: 21683 - DNA, 22 bp, Homo sapiens
tgaaccttgagtccccctgctt

SEQ ID NO: 21684 - DNA, 20 bp, Homo sapiens
tgcactttaaagtgagatta

SEQ ID NO: 21685 - DNA, 17 bp, Homo sapiens
ttgcatcccactcccct

SEQ ID NO: 21686 - DNA, 22 bp, Homo sapiens
accattgtaataaaagctgtta

SEQ ID NO: 21687 - DNA, 18 bp, Homo sapiens
tttgtttgaactttctgg

SEQ ID NO: 21688 - DNA, 21 bp, Homo sapiens
atacactaaattcacatcacc

SEQ ID NO: 21689 - DNA, 22 bp, Homo sapiens
atcttggctcactgcaacctct

SEQ ID NO: 21690 - DNA, 21 bp, Homo sapiens
ccatactatattaaacacatt

SEQ ID NO: 21691 - DNA, 22 bp, Homo sapiens
cctcttcatgaccctgagtctt

SEQ ID NO: 21692 - DNA, 22 bp, Homo sapiens
gcttctcagaccggcaacatca

SEQ ID NO: 21693 - DNA, 19 bp, Homo sapiens
gtaacatttatttacataa

SEQ ID NO: 21694 - DNA, 18 bp, Homo sapiens
tcctgacctcatgatcca

SEQ ID NO: 21695 - DNA, 20 bp, Homo sapiens
agaaagagttaactgtgctg

SEQ ID NO: 21696 - DNA, 21 bp, Homo sapiens
cagcccacactctgccacctc

SEQ ID NO: 21697 - DNA, 22 bp, Homo sapiens
cccatcatgggaggcttttgga

SEQ ID NO: 21698 - DNA, 20 bp, Homo sapiens
cggcccagaaaccagagcca

SEQ ID NO: 21699 - DNA, 19 bp, Homo sapiens
gcccaaggcagcgaggctt

SEQ ID NO: 21700 - DNA, 23 bp, Homo sapiens
tctgtctcatagcacatgtgaca

SEQ ID NO: 21701 - DNA, 20 bp, Homo sapiens
tggacaacagccacaagggg

SEQ ID NO: 21702 - DNA, 22 bp, Homo sapiens
agagcaaaggaaaaacacatca

SEQ ID NO: 21703 - DNA, 18 bp, Homo sapiens
taggtggatcacttgagg

SEQ ID NO: 21704 - DNA, 17 bp, Homo sapiens
tgtttatggatgtctca

SEQ ID NO: 21705 - DNA, 21 bp, Homo sapiens
agaacaaaggcagctacgtca

SEQ ID NO: 21706 - DNA, 20 bp, Homo sapiens
cggagcggccgaagctcagc

SEQ ID NO: 21707 - DNA, 18 bp, Homo sapiens
cggggtgctgatctgcct

SEQ ID NO: 21708 - DNA, 17 bp, Homo sapiens
gagaacatttaagccac

SEQ ID NO: 21709 - DNA, 20 bp, Homo sapiens
gagatatctgaaaccaggta

SEQ ID NO: 21710 - DNA, 20 bp, Homo sapiens
gcagccagttgtggtttaca

SEQ ID NO: 21711 - DNA, 24 bp, Homo sapiens
gtaagattttaaacatttgtaata

SEQ ID NO: 21712 - DNA, 18 bp, Homo sapiens
tatgaactgttttatatc

SEQ ID NO: 21713 - DNA, 19 bp, Homo sapiens
tgctacctctatatcattc

SEQ ID NO: 21714 - DNA, 21 bp, Homo sapiens
tggggggtttttgttttttta

SEQ ID NO: 21715 - DNA, 17 bp, Homo sapiens
gagaacatttaagccac

SEQ ID NO: 21716 - DNA, 20 bp, Homo sapiens
gagatatctgaaaccaggta

SEQ ID NO: 21717 - DNA, 20 bp, Homo sapiens
gcagccagttgtggtttaca

SEQ ID NO: 21718 - DNA, 24 bp, Homo sapiens
gtaagattttaaacatttgtaata

SEQ ID NO: 21719 - DNA, 18 bp, Homo sapiens
tatgaactgttttatatc

SEQ ID NO: 21720 - DNA, 19 bp, Homo sapiens
tgctacctctatatcattc

SEQ ID NO: 21721 - DNA, 21 bp, Homo sapiens
tggggggtttttgttttttta

SEQ ID NO: 21722 - DNA, 19 bp, Homo sapiens
attaagacatttttcctga

SEQ ID NO: 21723 - DNA, 24 bp, Homo sapiens
cactccatactcaaatatgcttca

SEQ ID NO: 21724 - DNA, 20 bp, Homo sapiens
ctgatagataatcccattgc

SEQ ID NO: 21725 - DNA, 26 bp, Homo sapiens
tattatttgggtatttggagataata

SEQ ID NO: 21726 - DNA, 23 bp, Homo sapiens
ttttcatgctcagaatttcaggt

SEQ ID NO: 21727 - DNA, 18 bp, Homo sapiens
aacaataaatactatgca

SEQ ID NO: 21728 - DNA, 17 bp, Homo sapiens
aatgctgcagtctgcac

SEQ ID NO: 21729 - DNA, 23 bp, Homo sapiens
ccctccccaacccacatacctcc

SEQ ID NO: 21730 - DNA, 24 bp, Homo sapiens
ccctccccaacccacatacctcca

SEQ ID NO: 21731 - DNA, 22 bp, Homo sapiens
ccctggccgcggggcctgtgag

SEQ ID NO: 21732 - DNA, 21 bp, Homo sapiens
accaagagagcaaaccagaga

SEQ ID NO: 21733 - DNA, 21 bp, Homo sapiens
accaagagagcaaaccagaga

SEQ ID NO: 21734 - DNA, 21 bp, Homo sapiens
accaagagagcaaaccagaga

SEQ ID NO: 21735 - DNA, 18 bp, Homo sapiens
atgaggtttttcatacct

SEQ ID NO: 21736 - DNA, 18 bp, Homo sapiens
ccttgcccttccaacaaa

SEQ ID NO: 21737 - DNA, 22 bp, Homo sapiens
cctttgcccttgccttgccctt

SEQ ID NO: 21738 - DNA, 26 bp, Homo sapiens
ctatgcaaatgcatgcaaatactcca

SEQ ID NO: 21739 - DNA, 19 bp, Homo sapiens
ggcccttgagaagctgata

SEQ ID NO: 21740 - DNA, 21 bp, Homo sapiens
ttttggggtggggtctgggga

SEQ ID NO: 21741 - DNA, 24 bp, Homo sapiens
acagggttcccggtcagtccggct

SEQ ID NO: 21742 - DNA, 23 bp, Homo sapiens
accaggcccaccctcgtctctgc

SEQ ID NO: 21743 - DNA, 20 bp, Homo sapiens
atgtgggtgatggtggatga

SEQ ID NO: 21744 - DNA, 17 bp, Homo sapiens
ccagcaccaggcccacc

SEQ ID NO: 21745 - DNA, 24 bp, Homo sapiens
ccccaccgtgtgccccctgccagc

SEQ ID NO: 21746 - DNA, 18 bp, Homo sapiens
cgccaggtccagcaccca

SEQ ID NO: 21747 - DNA, 21 bp, Homo sapiens
gccccccctccccatagccag

SEQ ID NO: 21748 - DNA, 19 bp, Homo sapiens
gcctggggcctccacgtca

SEQ ID NO: 21749 - DNA, 21 bp, Homo sapiens
tccacggcccaggtctcctca

SEQ ID NO: 21750 - DNA, 23 bp, Homo sapiens
tctgcctgggtgagcccaccccg

SEQ ID NO: 21751 - DNA, 22 bp, Homo sapiens
cccgcgtcacccacctgccaga

SEQ ID NO: 21752 - DNA, 22 bp, Homo sapiens
ttgcctgagacccctcctctct

SEQ ID NO: 21753 - DNA, 20 bp, Homo sapiens
acttatatttaaaacttgcc

SEQ ID NO: 21754 - DNA, 21 bp, Homo sapiens
ccctggtggtggatcctggaa

SEQ ID NO: 21755 - DNA, 17 bp, Homo sapiens
ctggggcaggtcacttt

SEQ ID NO: 21756 - DNA, 21 bp, Homo sapiens
aacagatttacatcccagaca

SEQ ID NO: 21757 - DNA, 19 bp, Homo sapiens
accaggcagccactgtgca

SEQ ID NO: 21758 - DNA, 18 bp, Homo sapiens
agctattgctccatgaca

SEQ ID NO: 21759 - DNA, 21 bp, Homo sapiens
atttgaacccaggtctcgtct

SEQ ID NO: 21760 - DNA, 21 bp, Homo sapiens
ctgataaaacagattgtgata

SEQ ID NO: 21761 - DNA, 21 bp, Homo sapiens
gacacagagtattttaaaaga

SEQ ID NO: 21762 - DNA, 17 bp, Homo sapiens
tcaagtgattcttctgc

SEQ ID NO: 21763 - DNA, 20 bp, Homo sapiens
tctttttggactttaatctt

SEQ ID NO: 21764 - DNA, 20 bp, Homo sapiens
tggccaggctggtcttgaac

SEQ ID NO: 21765 - DNA, 19 bp, Homo sapiens
accaggcagccactgtgca

SEQ ID NO: 21766 - DNA, 18 bp, Homo sapiens
agctattgctccatgaca

SEQ ID NO: 21767 - DNA, 23 bp, Homo sapiens
attacaagtaattcttttcctga

SEQ ID NO: 21768 - DNA, 21 bp, Homo sapiens
atttgaacccaggtctcgtct

SEQ ID NO: 21769 - DNA, 21 bp, Homo sapiens
ccaggcaggcatttttacagc

SEQ ID NO: 21770 - DNA, 21 bp, Homo sapiens
gacacagagtattttaaaaga

SEQ ID NO: 21771 - DNA, 17 bp, Homo sapiens
tcaagtgattcttctgc

SEQ ID NO: 21772 - DNA, 20 bp, Homo sapiens
tctttttggactttaatctt

SEQ ID NO: 21773 - DNA, 20 bp, Homo sapiens
tggccaggctggtcttgaac

SEQ ID NO: 21774 - DNA, 23 bp, Homo sapiens
attacaagtaattcttttcctga

SEQ ID NO: 21775 - DNA, 21 bp, Homo sapiens
ccaggcaggcatttttacagc

SEQ ID NO: 21776 - DNA, 17 bp, Homo sapiens
gggcagttagtccttcc

SEQ ID NO: 21777 - DNA, 23 bp, Homo sapiens
tctggaatctggattttattcca

SEQ ID NO: 21778 - DNA, 17 bp, Homo sapiens
gggcagttagtccttcc

SEQ ID NO: 21779 - DNA, 23 bp, Homo sapiens
tctggaatctggattttattcca

SEQ ID NO: 21780 - DNA, 18 bp, Homo sapiens
acgtaaatgcagaagtta

SEQ ID NO: 21781 - DNA, 25 bp, Homo sapiens
acagacgagtgcctcctttacgtta

SEQ ID NO: 21782 - DNA, 18 bp, Homo sapiens
acgtaaatgcagaagtta

SEQ ID NO: 21783 - DNA, 18 bp, Homo sapiens
atcctttcccttacccac

SEQ ID NO: 21784 - DNA, 21 bp, Homo sapiens
gcaggtgcctctcagaggcca

SEQ ID NO: 21785 - DNA, 19 bp, Homo sapiens
ggcaggcaggtgcctctca

SEQ ID NO: 21786 - DNA, 23 bp, Homo sapiens
ggtactgagcagccactacccct

SEQ ID NO: 21787 - DNA, 21 bp, Homo sapiens
gtgaccaccaacattctgtgt

SEQ ID NO: 21788 - DNA, 18 bp, Homo sapiens
tggtgtttggctcttata

SEQ ID NO: 21789 - DNA, 18 bp, Homo sapiens
ttcccttacccaccttca

SEQ ID NO: 21790 - DNA, 20 bp, Homo sapiens
cagccacagccagagggccc

SEQ ID NO: 21791 - DNA, 23 bp, Homo sapiens
ccagaatggccccactctgttcc

SEQ ID NO: 21792 - DNA, 23 bp, Homo sapiens
ccttccacaggaggtcctgtgag

SEQ ID NO: 21793 - DNA, 22 bp, Homo sapiens
gatcccaaaaggattttggtgg

SEQ ID NO: 21794 - DNA, 20 bp, Homo sapiens
gcattaaatgaagccttacc

SEQ ID NO: 21795 - DNA, 21 bp, Homo sapiens
tctcgctgtctccctctgtgc

SEQ ID NO: 21796 - DNA, 18 bp, Homo sapiens
ttatcacttttaagcata

SEQ ID NO: 21797 - DNA, 17 bp, Homo sapiens
cccaggcgtggaagcat

SEQ ID NO: 21798 - DNA, 21 bp, Homo sapiens
tgtcccctccaggtgaagctg

SEQ ID NO: 21799 - DNA, 23 bp, Homo sapiens
aaagattttcaaacaagcataca

SEQ ID NO: 21800 - DNA, 17 bp, Homo sapiens
cctgtcatattaccaac

SEQ ID NO: 21801 - DNA, 20 bp, Homo sapiens
gctacagggaatattttgta

SEQ ID NO: 21802 - DNA, 24 bp, Homo sapiens
gtgttttggtttggggggaatttt

SEQ ID NO: 21803 - DNA, 21 bp, Homo sapiens
tcctgtcttgaagattttgag

SEQ ID NO: 21804 - DNA, 20 bp, Homo sapiens
tgtacatagtctgtacaata

SEQ ID NO: 21805 - DNA, 20 bp, Homo sapiens
agtctcactctgttgcccag

SEQ ID NO: 21806 - DNA, 18 bp, Homo sapiens
caccattctcctgcctca

SEQ ID NO: 21807 - DNA, 18 bp, Homo sapiens
tgactagaaagaaacagg

SEQ ID NO: 21808 - DNA, 22 bp, Homo sapiens
cagctgtttcaaacaggtgcca

SEQ ID NO: 21809 - DNA, 21 bp, Homo sapiens
aaatttggaccgttatttata

SEQ ID NO: 21810 - DNA, 20 bp, Homo sapiens
acttagtaaaataataggta

SEQ ID NO: 21811 - DNA, 23 bp, Homo sapiens
gctcttggacacattttgtatta

SEQ ID NO: 21812 - DNA, 18 bp, Homo sapiens
ggacagggtgaaaatgct

SEQ ID NO: 21813 - DNA, 23 bp, Homo sapiens
agcatggtaacgatggtgtcaca

SEQ ID NO: 21814 - DNA, 20 bp, Homo sapiens
agtctcactctgtcgcccag

SEQ ID NO: 21815 - DNA, 20 bp, Homo sapiens
atctatttttctcccatgat

SEQ ID NO: 21816 - DNA, 19 bp, Homo sapiens
cctctgcctccaggttcaa

SEQ ID NO: 21817 - DNA, 19 bp, Homo sapiens
ggtctaaatgtgtatgtca

SEQ ID NO: 21818 - DNA, 20 bp, Homo sapiens
tggccaggctggtcttgaac

SEQ ID NO: 21819 - DNA, 20 bp, Homo sapiens
ttaaacagttttgtaaaata

SEQ ID NO: 21820 - DNA, 20 bp, Homo sapiens
tgtgactctagcatgagact

SEQ ID NO: 21821 - DNA, 23 bp, Homo sapiens
aacaaaaaattttacctgtgcaa

SEQ ID NO: 21822 - DNA, 20 bp, Homo sapiens
acagagaagaaaataacttg

SEQ ID NO: 21823 - DNA, 19 bp, Homo sapiens
tgtgttggggggtactttt

SEQ ID NO: 21824 - DNA, 18 bp, Homo sapiens
tgttttttaacaatatta

SEQ ID NO: 21825 - DNA, 21 bp, Homo sapiens
agatgcctcagtgctacacca

SEQ ID NO: 21826 - DNA, 18 bp, Homo sapiens
caccagggtcgctccatc

SEQ ID NO: 21827 - DNA, 19 bp, Homo sapiens
gcctcagtgctacaccaca

SEQ ID NO: 21828 - DNA, 18 bp, Homo sapiens
cagaaccccataggcaag

SEQ ID NO: 21829 - DNA, 22 bp, Homo sapiens
cccccccccacttcacccccta

SEQ ID NO: 21830 - DNA, 20 bp, Homo sapiens
gacatctgtatctcctgtgg

SEQ ID NO: 21831 - DNA, 24 bp, Homo sapiens
tgagaaaagaattgggttctgtca

SEQ ID NO: 21832 - DNA, 23 bp, Homo sapiens
caggaatgtcacacacgatgaaa

SEQ ID NO: 21833 - DNA, 21 bp, Homo sapiens
tcctaaagtgtcaacgttttt

SEQ ID NO: 21834 - DNA, 19 bp, Homo sapiens
acttaataaagtaataatc

SEQ ID NO: 21835 - DNA, 22 bp, Homo sapiens
tggatggataaaaatggaatta

SEQ ID NO: 21836 - DNA, 20 bp, Homo sapiens
tttttctgacagtatagtgt

SEQ ID NO: 21837 - DNA, 20 bp, Homo sapiens
aagcagccaccttggaccat

SEQ ID NO: 21838 - DNA, 17 bp, Homo sapiens
agaaaccccagccatga

SEQ ID NO: 21839 - DNA, 19 bp, Homo sapiens
tgttctagacatctgtcta

SEQ ID NO: 21840 - DNA, 19 bp, Homo sapiens
ttgggattttgtttggttt

SEQ ID NO: 21841 - DNA, 19 bp, Homo sapiens
acaggaggaaatagactta

SEQ ID NO: 21842 - DNA, 21 bp, Homo sapiens
accctttcttctccccatttt

SEQ ID NO: 21843 - DNA, 22 bp, Homo sapiens
ccccattttcatactcttccca

SEQ ID NO: 21844 - DNA, 21 bp, Homo sapiens
cctttcttctccccattttca

SEQ ID NO: 21845 - DNA, 19 bp, Homo sapiens
ccttttctccccactcctc

SEQ ID NO: 21846 - DNA, 18 bp, Homo sapiens
ctgggagccaggccacct

SEQ ID NO: 21847 - DNA, 20 bp, Homo sapiens
gagatgcccaagtttgtcag

SEQ ID NO: 21848 - DNA, 27 bp, Homo sapiens
tcaaagaaggacgaatagcaccctacc

SEQ ID NO: 21849 - DNA, 22 bp, Homo sapiens
tggacaatttgggtggcagtgt

SEQ ID NO: 21850 - DNA, 20 bp, Homo sapiens
atggtgaaaccccatgtcta

SEQ ID NO: 21851 - DNA, 21 bp, Homo sapiens
ttattttgacttgcactgcca

SEQ ID NO: 21852 - DNA, 23 bp, Homo sapiens
atctgggcccagattgtctggtt

SEQ ID NO: 21853 - DNA, 17 bp, Homo sapiens
cccatggctcctcgcca

SEQ ID NO: 21854 - DNA, 17 bp, Homo sapiens
ctgggtacagtacctcc

SEQ ID NO: 21855 - DNA, 16 bp, Homo sapiens
gacgcgctttgtcctt

SEQ ID NO: 21856 - DNA, 18 bp, Homo sapiens
gatgaaacagacatccca

SEQ ID NO: 21857 - DNA, 22 bp, Homo sapiens
cacacttaaattacgttcctcc

SEQ ID NO: 21858 - DNA, 19 bp, Homo sapiens
ttaaaaattataaagatgt

SEQ ID NO: 21859 - DNA, 20 bp, Homo sapiens
atcttagaataaagaacgag

SEQ ID NO: 21860 - DNA, 18 bp, Homo sapiens
caaactaactaactgtgt

SEQ ID NO: 21861 - DNA, 18 bp, Homo sapiens
gcaaaccttctacctcct

SEQ ID NO: 21862 - DNA, 21 bp, Homo sapiens
taaataatgctggaatactca

SEQ ID NO: 21863 - DNA, 17 bp, Homo sapiens
ttttgatgcaggtctgc

SEQ ID NO: 21864 - DNA, 20 bp, Homo sapiens
gcgcggcgcgagcggccggg

SEQ ID NO: 21865 - DNA, 20 bp, Homo sapiens
aagtgccgacacctccctca

SEQ ID NO: 21866 - DNA, 25 bp, Homo sapiens
ataccctatgttattgtgctccctg

SEQ ID NO: 21867 - DNA, 19 bp, Homo sapiens
cgcggagcccggctaggga

SEQ ID NO: 21868 - DNA, 21 bp, Homo sapiens
gacatttatttctcctttgga

SEQ ID NO: 21869 - DNA, 19 bp, Homo sapiens
ttatagtggaaggatggtc

SEQ ID NO: 21870 - DNA, 20 bp, Homo sapiens
ttgtgctccctggattcctg

SEQ ID NO: 21871 - DNA, 21 bp, Homo sapiens
cacaccaggcgacaggcacca

SEQ ID NO: 21872 - DNA, 24 bp, Homo sapiens
ccacccatggagactggaacctca

SEQ ID NO: 21873 - DNA, 17 bp, Homo sapiens
ccagcatctgtcttttc

SEQ ID NO: 21874 - DNA, 21 bp, Homo sapiens
cccagtgcccatggttcctca

SEQ ID NO: 21875 - DNA, 21 bp, Homo sapiens
cccctccccactccagaggcc

SEQ ID NO: 21876 - DNA, 23 bp, Homo sapiens
cctcctctctggcagggatctca

SEQ ID NO: 21877 - DNA, 20 bp, Homo sapiens
cgcgcggcacggagccaggc

SEQ ID NO: 21878 - DNA, 25 bp, Homo sapiens
gcgcggagcccggtggcggcgagga

SEQ ID NO: 21879 - DNA, 17 bp, Homo sapiens
aaagagacaagcacaca

SEQ ID NO: 21880 - DNA, 21 bp, Homo sapiens
ccagcccccaccccgcccccc

SEQ ID NO: 21881 - DNA, 21 bp, Homo sapiens
aaatgtcaagaagaacatcca

SEQ ID NO: 21882 - DNA, 18 bp, Homo sapiens
atgtttaacggtgccaac

SEQ ID NO: 21883 - DNA, 19 bp, Homo sapiens
cgaggacagtcttgaaata

SEQ ID NO: 21884 - DNA, 19 bp, Homo sapiens
gccgttctgtgcttttccg

SEQ ID NO: 21885 - DNA, 22 bp, Homo sapiens
ctctggagctgggatttgggag

SEQ ID NO: 21886 - DNA, 23 bp, Homo sapiens
atagtggatcctggatggaactg

SEQ ID NO: 21887 - DNA, 20 bp, Homo sapiens
caggtggatacagaacttcc

SEQ ID NO: 21888 - DNA, 21 bp, Homo sapiens
gatagttgtatacaaatgagc

SEQ ID NO: 21889 - DNA, 18 bp, Homo sapiens
tgaaatagctttacagtg

SEQ ID NO: 21890 - DNA, 17 bp, Homo sapiens
cacaataattcccaact

SEQ ID NO: 21891 - DNA, 22 bp, Homo sapiens
gtaaaatgtgaccgtttgacat

SEQ ID NO: 21892 - DNA, 20 bp, Homo sapiens
gtatgccacaggtgaacttt

SEQ ID NO: 21893 - DNA, 18 bp, Homo sapiens
taaaggactaaatttgtt

SEQ ID NO: 21894 - DNA, 18 bp, Homo sapiens
taaatctctttactatgt

SEQ ID NO: 21895 - DNA, 19 bp, Homo sapiens
tagcggggacaaaaaatca

SEQ ID NO: 21896 - DNA, 22 bp, Homo sapiens
ttctacttcttgttccaagatg

SEQ ID NO: 21897 - DNA, 17 bp, Homo sapiens
actgttctaacaatcta

SEQ ID NO: 21898 - DNA, 21 bp, Homo sapiens
ctcagatgtgttcttgtagga

SEQ ID NO: 21899 - DNA, 18 bp, Homo sapiens
tcttgtaggaagatctgt

SEQ ID NO: 21900 - DNA, 15 bp, Homo sapiens
tttgctgttgcacaa

SEQ ID NO: 21901 - DNA, 24 bp, Homo sapiens
aagattggtaaataaatacattga

SEQ ID NO: 21902 - DNA, 21 bp, Homo sapiens
aagtttacatttcaatttcta

SEQ ID NO: 21903 - DNA, 21 bp, Homo sapiens
acacaaaactcaggaattggt

SEQ ID NO: 21904 - DNA, 22 bp, Homo sapiens
caaggtgtttataggcttgtca

SEQ ID NO: 21905 - DNA, 24 bp, Homo sapiens
cagtgcttgtactaggcttagtta

SEQ ID NO: 21906 - DNA, 17 bp, Homo sapiens
cgtgtaataagttgagt

SEQ ID NO: 21907 - DNA, 17 bp, Homo sapiens
ctaaaagcatgcatcta

SEQ ID NO: 21908 - DNA, 25 bp, Homo sapiens
gctgataatttatgttttttcatta

SEQ ID NO: 21909 - DNA, 18 bp, Homo sapiens
taatcgtttatgccatga

SEQ ID NO: 21910 - DNA, 16 bp, Homo sapiens
ttcaagcactaccact

SEQ ID NO: 21911 - DNA, 24 bp, Homo sapiens
atctgggttattggtgtttgttcc

SEQ ID NO: 21912 - DNA, 22 bp, Homo sapiens
ctattattactttgtagtagaa

SEQ ID NO: 21913 - DNA, 16 bp, Homo sapiens
aaatctctgcaagtga

SEQ ID NO: 21914 - DNA, 17 bp, Homo sapiens
gcctcgactcctggccc

SEQ ID NO: 21915 - DNA, 25 bp, Homo sapiens
ggggatgcgccgcggcggcggcggc

SEQ ID NO: 21916 - DNA, 27 bp, Homo sapiens
gtgggttgtataagggtagcttttgtt

SEQ ID NO: 21917 - DNA, 16 bp, Homo sapiens
tggactatataactta

SEQ ID NO: 21918 - DNA, 21 bp, Homo sapiens
ctgtcctcccccacctgctga

SEQ ID NO: 21919 - DNA, 19 bp, Homo sapiens
gccgcctccggagcttcgg

SEQ ID NO: 21920 - DNA, 18 bp, Homo sapiens
tcaaagctgcatatctca

SEQ ID NO: 21921 - DNA, 21 bp, Homo sapiens
acttcatcctctcctacctgg

SEQ ID NO: 21922 - DNA, 19 bp, Homo sapiens
ccaaggcccccctccctct

SEQ ID NO: 21923 - DNA, 23 bp, Homo sapiens
tcattggttcctctttctgttcc

SEQ ID NO: 21924 - DNA, 19 bp, Homo sapiens
tctcctacctggctctttt

SEQ ID NO: 21925 - DNA, 18 bp, Homo sapiens
tttctgttcccccattga

SEQ ID NO: 21926 - DNA, 20 bp, Homo sapiens
tttctgttcccccattgact

SEQ ID NO: 21927 - DNA, 24 bp, Homo sapiens
tagatttgacttcaactccgtaaa

SEQ ID NO: 21928 - DNA, 23 bp, Homo sapiens
ctcaaaagtattgtggcacctca

SEQ ID NO: 21929 - DNA, 24 bp, Homo sapiens
cttttaaactgcagttttaacttt

SEQ ID NO: 21930 - DNA, 23 bp, Homo sapiens
gatttgtgttaagtgactgagaa

SEQ ID NO: 21931 - DNA, 23 bp, Homo sapiens
tgaagttgtaagaaaagcttcca

SEQ ID NO: 21932 - DNA, 20 bp, Homo sapiens
aaagtccctgacatgaagct

SEQ ID NO: 21933 - DNA, 19 bp, Homo sapiens
ccagaacatccagagtctg

SEQ ID NO: 21934 - DNA, 22 bp, Homo sapiens
cctcgctgttgtgtgtgtgata

SEQ ID NO: 21935 - DNA, 21 bp, Homo sapiens
ctaattccaccctctgcccct

SEQ ID NO: 21936 - DNA, 17 bp, Homo sapiens
ctgagatgaaactccct

SEQ ID NO: 21937 - DNA, 22 bp, Homo sapiens
gagaagtggccgaagaggctca

SEQ ID NO: 21938 - DNA, 19 bp, Homo sapiens
gatccccgaggtggagctg

SEQ ID NO: 21939 - DNA, 20 bp, Homo sapiens
gcctcagtttccccatctct

SEQ ID NO: 21940 - DNA, 23 bp, Homo sapiens
gcctcccactgtcccaccgcctc

SEQ ID NO: 21941 - DNA, 20 bp, Homo sapiens
ggtctcagcccccaaggctg

SEQ ID NO: 21942 - DNA, 15 bp, Homo sapiens
tgagatgaagcttcc

SEQ ID NO: 21943 - DNA, 20 bp, Homo sapiens
accgttgggctgcttggttc

SEQ ID NO: 21944 - DNA, 20 bp, Homo sapiens
agcctcccaaaattctggga

SEQ ID NO: 21945 - DNA, 20 bp, Homo sapiens
atgctcaccaccaccaataa

SEQ ID NO: 21946 - DNA, 19 bp, Homo sapiens
ggctaacaactcaatctca

SEQ ID NO: 21947 - DNA, 16 bp, Homo sapiens
ggctgcttggttctga

SEQ ID NO: 21948 - DNA, 21 bp, Homo sapiens
taccactgattgcaattttgc

SEQ ID NO: 21949 - DNA, 22 bp, Homo sapiens
ccttttgcatctccttgacttt

SEQ ID NO: 21950 - DNA, 20 bp, Homo sapiens
ggaaccttgaaaactacctg

SEQ ID NO: 21951 - DNA, 20 bp, Homo sapiens
ccagcaccagtgcccttctc

SEQ ID NO: 21952 - DNA, 26 bp, Homo sapiens
gctctgaaggtcaaaagcctcatttt

SEQ ID NO: 21953 - DNA, 21 bp, Homo sapiens
tctctaacaacgtgactacct

SEQ ID NO: 21954 - DNA, 19 bp, Homo sapiens
tctgcatccttctctaaca

SEQ ID NO: 21955 - DNA, 19 bp, Homo sapiens
tctgggaagtgcctggttt

SEQ ID NO: 21956 - DNA, 21 bp, Homo sapiens
tggagcttcctaagttgcttt

SEQ ID NO: 21957 - DNA, 24 bp, Homo sapiens
ttctcctgctcccagatactcttt

SEQ ID NO: 21958 - DNA, 18 bp, Homo sapiens
acgtgccactcaatacaa

SEQ ID NO: 21959 - DNA, 18 bp, Homo sapiens
acgtaaatgcagaagtta

SEQ ID NO: 21960 - DNA, 23 bp, Homo sapiens
ggtactgagcagccactacccct

SEQ ID NO: 21961 - DNA, 21 bp, Homo sapiens
gtgaccaccaacattctgtgt

SEQ ID NO: 21962 - DNA, 18 bp, Homo sapiens
tggtgtttggctcttata

SEQ ID NO: 21963 - DNA, 19 bp, Homo sapiens
aatccattgatcagaagaa

SEQ ID NO: 21964 - DNA, 19 bp, Homo sapiens
accagaaaccacacattca

SEQ ID NO: 21965 - DNA, 22 bp, Homo sapiens
atgctcagatgaacaacatatt

SEQ ID NO: 21966 - DNA, 21 bp, Homo sapiens
cagaagaacttcacctgcaga

SEQ ID NO: 21967 - DNA, 20 bp, Homo sapiens
gaagctacctggatatttcc

SEQ ID NO: 21968 - DNA, 18 bp, Homo sapiens
ggctgagaatctttgcca

SEQ ID NO: 21969 - DNA, 19 bp, Homo sapiens
taatagatgttacttttga

SEQ ID NO: 21970 - DNA, 18 bp, Homo sapiens
tctccaggaatctgtgag

SEQ ID NO: 21971 - DNA, 21 bp, Homo sapiens
atatttttacatatattccca

SEQ ID NO: 21972 - DNA, 23 bp, Homo sapiens
gcccatggacaatctccacctca

SEQ ID NO: 21973 - DNA, 19 bp, Homo sapiens
catgccagcacttgaactg

SEQ ID NO: 21974 - DNA, 21 bp, Homo sapiens
cctaccgagaggattatgcaa

SEQ ID NO: 21975 - DNA, 19 bp, Homo sapiens
cctccagaccctgctaacc

SEQ ID NO: 21976 - DNA, 23 bp, Homo sapiens
gcttggatcatgctcgtctgccc

SEQ ID NO: 21977 - DNA, 17 bp, Homo sapiens
ggctgttccctctccaa

SEQ ID NO: 21978 - DNA, 21 bp, Homo sapiens
tcaggaggtgggaggccgtgg

SEQ ID NO: 21979 - DNA, 22 bp, Homo sapiens
tgagtggactctgtgctcactg

SEQ ID NO: 21980 - DNA, 22 bp, Homo sapiens
aaaccatacactggatgaccta

SEQ ID NO: 21981 - DNA, 20 bp, Homo sapiens
agaaaagaaaaccacccaca

SEQ ID NO: 21982 - DNA, 21 bp, Homo sapiens
cctagtcgattatttaagcat

SEQ ID NO: 21983 - DNA, 23 bp, Homo sapiens
tgttgataaggcactgcctctta

SEQ ID NO: 21984 - DNA, 20 bp, Homo sapiens
ttccacacattaatggcatg

SEQ ID NO: 21985 - DNA, 19 bp, Homo sapiens
acgtgctttcctattctca

SEQ ID NO: 21986 - DNA, 23 bp, Homo sapiens
aggactgggcgtctccaagccca

SEQ ID NO: 21987 - DNA, 22 bp, Homo sapiens
atttcagaaaataaaaatttca

SEQ ID NO: 21988 - DNA, 18 bp, Homo sapiens
atttgtgttgctgctgta

SEQ ID NO: 21989 - DNA, 24 bp, Homo sapiens
caagagacccgcaagaaacttgca

SEQ ID NO: 21990 - DNA, 21 bp, Homo sapiens
caccctactcaccgctctcct

SEQ ID NO: 21991 - DNA, 18 bp, Homo sapiens
cccaccttcgctggaaca

SEQ ID NO: 21992 - DNA, 19 bp, Homo sapiens
cttgatggccggcctcgaa

SEQ ID NO: 21993 - DNA, 19 bp, Homo sapiens
gagtgggccggggaggctg

SEQ ID NO: 21994 - DNA, 16 bp, Homo sapiens
gcggctacacattcca

SEQ ID NO: 21995 - DNA, 18 bp, Homo sapiens
ggggtcatgggttttgtt

SEQ ID NO: 21996 - DNA, 19 bp, Homo sapiens
tgtctatttcctgcacttc

SEQ ID NO: 21997 - DNA, 18 bp, Homo sapiens
acagggagagcagcagcc

SEQ ID NO: 21998 - DNA, 19 bp, Homo sapiens
tctgagccgcgagggcgcc

SEQ ID NO: 21999 - DNA, 18 bp, Homo sapiens
tgcggctgctccggacct

SEQ ID NO: 22000 - DNA, 21 bp, Homo sapiens
tttcaagtcatgttgtgtttg

SEQ ID NO: 22001 - DNA, 19 bp, Homo sapiens
aaaactaaccaacctcaac

SEQ ID NO: 22002 - DNA, 19 bp, Homo sapiens
aagtattgtcagttacctc

SEQ ID NO: 22003 - DNA, 19 bp, Homo sapiens
gtagcagtcactgacagta

SEQ ID NO: 22004 - DNA, 21 bp, Homo sapiens
caagcacagagcctggcccca

SEQ ID NO: 22005 - DNA, 21 bp, Homo sapiens
caggacgaaaaagaggcatac

SEQ ID NO: 22006 - DNA, 24 bp, Homo sapiens
ccatcctccctccacctcaagacc

SEQ ID NO: 22007 - DNA, 19 bp, Homo sapiens
ccattgctcttagtcccaa

SEQ ID NO: 22008 - DNA, 24 bp, Homo sapiens
gcttctctccttgccccccgccct

SEQ ID NO: 22009 - DNA, 25 bp, Homo sapiens
gtggcagatgtcttccctgggctgc

SEQ ID NO: 22010 - DNA, 18 bp, Homo sapiens
tctctttgtggtttcttg

SEQ ID NO: 22011 - DNA, 22 bp, Homo sapiens
cctccccccggccacccttccc

SEQ ID NO: 22012 - DNA, 20 bp, Homo sapiens
gcgtcctccccccggccacc

SEQ ID NO: 22013 - DNA, 18 bp, Homo sapiens
tggtgtagaatgattcca

SEQ ID NO: 22014 - DNA, 21 bp, Homo sapiens
gcatcaaatgaaaacttcata

SEQ ID NO: 22015 - DNA, 18 bp, Homo sapiens
taaaaatgcagaagctat

SEQ ID NO: 22016 - DNA, 21 bp, Homo sapiens
gtcccaccgctgcccctactg

SEQ ID NO: 22017 - DNA, 16 bp, Homo sapiens
gagaccagcgtggtca

SEQ ID NO: 22018 - DNA, 21 bp, Homo sapiens
gattgttccagtttcttttga

SEQ ID NO: 22019 - DNA, 21 bp, Homo sapiens
ccttccccttcccttccttcc

SEQ ID NO: 22020 - DNA, 17 bp, Homo sapiens
tcaatagcttaaactca

SEQ ID NO: 22021 - DNA, 18 bp, Homo sapiens
tgcttgttgcaatgtggt

SEQ ID NO: 22022 - DNA, 24 bp, Homo sapiens
acaaagaagaaagcagcactgtca

SEQ ID NO: 22023 - DNA, 16 bp, Homo sapiens
acatttaactacctgt

SEQ ID NO: 22024 - DNA, 18 bp, Homo sapiens
actatactaagaacatat

SEQ ID NO: 22025 - DNA, 21 bp, Homo sapiens
cagccacaagacatccacata

SEQ ID NO: 22026 - DNA, 21 bp, Homo sapiens
catgtacttttaaagcaggga

SEQ ID NO: 22027 - DNA, 23 bp, Homo sapiens
cttcaaacatgttgctttgcttt

SEQ ID NO: 22028 - DNA, 20 bp, Homo sapiens
ctttgtacatttaattgata

SEQ ID NO: 22029 - DNA, 17 bp, Homo sapiens
ggtttggatgttgcagc

SEQ ID NO: 22030 - DNA, 23 bp, Homo sapiens
gtaaaggatatttttgctctgtt

SEQ ID NO: 22031 - DNA, 20 bp, Homo sapiens
gtcaaaagactataaatgct

SEQ ID NO: 22032 - DNA, 19 bp, Homo sapiens
tcaaaaatgcaaaatgtga

SEQ ID NO: 22033 - DNA, 23 bp, Homo sapiens
acacagtgggtcgcaggatctga

SEQ ID NO: 22034 - DNA, 19 bp, Homo sapiens
agggtgactcaagtcaaca

SEQ ID NO: 22035 - DNA, 21 bp, Homo sapiens
ggacagggagagcaagaggtc

SEQ ID NO: 22036 - DNA, 22 bp, Homo sapiens
atcttggctcactgcaatctct

SEQ ID NO: 22037 - DNA, 22 bp, Homo sapiens
tagaaatacaattgatgttgaa

SEQ ID NO: 22038 - DNA, 23 bp, Homo sapiens
tctttttgagatttgttttggct

SEQ ID NO: 22039 - DNA, 21 bp, Homo sapiens
tgggcaccttgattgagattg

SEQ ID NO: 22040 - DNA, 21 bp, Homo sapiens
tgtatctgtaatcacagcatt

SEQ ID NO: 22041 - DNA, 22 bp, Homo sapiens
tttcccatcccaagatcacaat

SEQ ID NO: 22042 - DNA, 18 bp, Homo sapiens
taaacaatctctacatgt

SEQ ID NO: 22043 - DNA, 17 bp, Homo sapiens
cagaaggagcgtggccc

SEQ ID NO: 22044 - DNA, 17 bp, Homo sapiens
cccagccaacaccctga

SEQ ID NO: 22045 - DNA, 20 bp, Homo sapiens
gcccactgaaagcctggtga

SEQ ID NO: 22046 - DNA, 18 bp, Homo sapiens
ccagagctctctattctg

SEQ ID NO: 22047 - DNA, 20 bp, Homo sapiens
catcctcgagcaactgctgt

SEQ ID NO: 22048 - DNA, 24 bp, Homo sapiens
ccaccctctgccacccagtcctcc

SEQ ID NO: 22049 - DNA, 21 bp, Homo sapiens
tcaccgaagccactttctaca

SEQ ID NO: 22050 - DNA, 20 bp, Homo sapiens
tggacaactgcatggagctg

SEQ ID NO: 22051 - DNA, 21 bp, Homo sapiens
tggagctcttggctggggctg

SEQ ID NO: 22052 - DNA, 25 bp, Homo sapiens
ttccccacacatgcctatttctgaa

SEQ ID NO: 22053 - DNA, 19 bp, Homo sapiens
agttacttgtgttcattga

SEQ ID NO: 22054 - DNA, 20 bp, Homo sapiens
atgcaatttgacttggcata

SEQ ID NO: 22055 - DNA, 17 bp, Homo sapiens
cataatacccttttcca

SEQ ID NO: 22056 - DNA, 21 bp, Homo sapiens
catgcactcttcatgtaatca

SEQ ID NO: 22057 - DNA, 20 bp, Homo sapiens
ccacagaaatctctcaccca

SEQ ID NO: 22058 - DNA, 19 bp, Homo sapiens
ccatcagcaacatcattcc

SEQ ID NO: 22059 - DNA, 16 bp, Homo sapiens
gccatcagcaacatca

SEQ ID NO: 22060 - DNA, 18 bp, Homo sapiens
gtccagcactacaactta

SEQ ID NO: 22061 - DNA, 17 bp, Homo sapiens
gttcaggtgtataggga

SEQ ID NO: 22062 - DNA, 20 bp, Homo sapiens
taaagctaccatgttaatac

SEQ ID NO: 22063 - DNA, 17 bp, Homo sapiens
ttgtcaaatacagcatt

SEQ ID NO: 22064 - DNA, 20 bp, Homo sapiens
ttttaccatatggaataggg

SEQ ID NO: 22065 - DNA, 20 bp, Homo sapiens
accaaccatatgaagtaggc

SEQ ID NO: 22066 - DNA, 18 bp, Homo sapiens
atctgcatctccagatga

SEQ ID NO: 22067 - DNA, 16 bp, Homo sapiens
cacattttcggacgtc

SEQ ID NO: 22068 - DNA, 20 bp, Homo sapiens
caggtatcactgcactttaa

SEQ ID NO: 22069 - DNA, 18 bp, Homo sapiens
ctagcacttactgagcac

SEQ ID NO: 22070 - DNA, 21 bp, Homo sapiens
tgccaggaatcagtgacattc

SEQ ID NO: 22071 - DNA, 19 bp, Homo sapiens
ccttggttgtcttaatttt

SEQ ID NO: 22072 - DNA, 15 bp, Homo sapiens
tccctaccttttcca

SEQ ID NO: 22073 - DNA, 18 bp, Homo sapiens
ttgtctggctgctggcca

SEQ ID NO: 22074 - DNA, 22 bp, Homo sapiens
ggacacccgaggcctcctggga

SEQ ID NO: 22075 - DNA, 26 bp, Homo sapiens
aaatttgttctttgatattggaatta

SEQ ID NO: 22076 - DNA, 22 bp, Homo sapiens
agggtagaagtaagacatatca

SEQ ID NO: 22077 - DNA, 17 bp, Homo sapiens
cccgcggggacgccgcc

SEQ ID NO: 22078 - DNA, 21 bp, Homo sapiens
aaaatatctctaaaataggta

SEQ ID NO: 22079 - DNA, 19 bp, Homo sapiens
accgtctgtgtttgagcaa

SEQ ID NO: 22080 - DNA, 18 bp, Homo sapiens
actcttcttcattagctt

SEQ ID NO: 22081 - DNA, 19 bp, Homo sapiens
aggagaaaatcatgttgaa

SEQ ID NO: 22082 - DNA, 18 bp, Homo sapiens
atgatacttaaccagtta

SEQ ID NO: 22083 - DNA, 21 bp, Homo sapiens
tagcatacttaaaatatctct

SEQ ID NO: 22084 - DNA, 19 bp, Homo sapiens
tgctatttcacttgagcaa

SEQ ID NO: 22085 - DNA, 22 bp, Homo sapiens
actctaaaactctggtattata

SEQ ID NO: 22086 - DNA, 21 bp, Homo sapiens
aagagaggcccaggctactgg

SEQ ID NO: 22087 - DNA, 20 bp, Homo sapiens
cagactccccagggcttcaa

SEQ ID NO: 22088 - DNA, 21 bp, Homo sapiens
ccctgctgcggagaccgcgga

SEQ ID NO: 22089 - DNA, 23 bp, Homo sapiens
cctgagggcacccggttgctgct

SEQ ID NO: 22090 - DNA, 19 bp, Homo sapiens
ctgactttcttttttgata

SEQ ID NO: 22091 - DNA, 19 bp, Homo sapiens
tatttgtaaaatgacaatc

SEQ ID NO: 22092 - DNA, 19 bp, Homo sapiens
aaggtcctaaatctcccca

SEQ ID NO: 22093 - DNA, 17 bp, Homo sapiens
cctcctgccctcaggag

SEQ ID NO: 22094 - DNA, 20 bp, Homo sapiens
gcccccacgggtgccccccc

SEQ ID NO: 22095 - DNA, 19 bp, Homo sapiens
tggaatccggcgtgggctg

SEQ ID NO: 22096 - DNA, 18 bp, Homo sapiens
agttccacaatctcttct

SEQ ID NO: 22097 - DNA, 22 bp, Homo sapiens
ttggggttttgaatgtttgctt

SEQ ID NO: 22098 - DNA, 22 bp, Homo sapiens
aacagttcagtgcattgttgtt

SEQ ID NO: 22099 - DNA, 15 bp, Homo sapiens
agttagttctcatct

SEQ ID NO: 22100 - DNA, 20 bp, Homo sapiens
cgtttcatcaatttgaagaa

SEQ ID NO: 22101 - DNA, 18 bp, Homo sapiens
ggaagatggaatacatca

SEQ ID NO: 22102 - DNA, 17 bp, Homo sapiens
gtattacttaagattgt

SEQ ID NO: 22103 - DNA, 22 bp, Homo sapiens
ttatacatattaccttgttata

SEQ ID NO: 22104 - DNA, 21 bp, Homo sapiens
aagtcaagactgcatgttgaa

SEQ ID NO: 22105 - DNA, 19 bp, Homo sapiens
gcgcctgggatgccgggga

SEQ ID NO: 22106 - DNA, 18 bp, Homo sapiens
gtcccaggtacccggtgg

SEQ ID NO: 22107 - DNA, 18 bp, Homo sapiens
tgcggctgctccgggctg

SEQ ID NO: 22108 - DNA, 17 bp, Homo sapiens
agctctcttcttactca

SEQ ID NO: 22109 - DNA, 21 bp, Homo sapiens
cttaggatatttgagtcactt

SEQ ID NO: 22110 - DNA, 21 bp, Homo sapiens
tctctgcaatgcttctgtagc

SEQ ID NO: 22111 - DNA, 19 bp, Homo sapiens
atcttagcttctttaatca

SEQ ID NO: 22112 - DNA, 21 bp, Homo sapiens
cctctttagggctttggtttt

SEQ ID NO: 22113 - DNA, 25 bp, Homo sapiens
gagactggaatgcgtcagcctgaga

SEQ ID NO: 22114 - DNA, 20 bp, Homo sapiens
tattacatacatgctttgaa

SEQ ID NO: 22115 - DNA, 16 bp, Homo sapiens
tgccatcgctgtgatg

SEQ ID NO: 22116 - DNA, 20 bp, Homo sapiens
ggagcttccatcctggttct

SEQ ID NO: 22117 - DNA, 19 bp, Homo sapiens
gttcttccaaagtgcccgg

SEQ ID NO: 22118 - DNA, 22 bp, Homo sapiens
caaggaaagagagaaaacaaca

SEQ ID NO: 22119 - DNA, 20 bp, Homo sapiens
cagagtgaaagcgtaaggtt

SEQ ID NO: 22120 - DNA, 23 bp, Homo sapiens
tgcatctggcgatcagactctga

SEQ ID NO: 22121 - DNA, 18 bp, Homo sapiens
acttaccaaaacatatca

SEQ ID NO: 22122 - DNA, 22 bp, Homo sapiens
agtccatctttcaagcacttta

SEQ ID NO: 22123 - DNA, 21 bp, Homo sapiens
gcagcaatgcaaattatgaca

SEQ ID NO: 22124 - DNA, 16 bp, Homo sapiens
gctacttgaaggctga

SEQ ID NO: 22125 - DNA, 17 bp, Homo sapiens
gtataccctctattaca

SEQ ID NO: 22126 - DNA, 24 bp, Homo sapiens
tgtttgatgggaaagaccactaca

SEQ ID NO: 22127 - DNA, 20 bp, Homo sapiens
catgaagtattgtttccttt

SEQ ID NO: 22128 - DNA, 16 bp, Homo sapiens
aggtcaacattgacca

SEQ ID NO: 22129 - DNA, 19 bp, Homo sapiens
cattggaggagtggtttaa

SEQ ID NO: 22130 - DNA, 24 bp, Homo sapiens
cctagaagttcttgattcattttt

SEQ ID NO: 22131 - DNA, 17 bp, Homo sapiens
tcactgatatatgtaga

SEQ ID NO: 22132 - DNA, 21 bp, Homo sapiens
tggggtctcctgggttcagcg

SEQ ID NO: 22133 - DNA, 19 bp, Homo sapiens
cacttctgattttccttca

SEQ ID NO: 22134 - DNA, 25 bp, Homo sapiens
ccaaaatatagttgttgttgatttt

SEQ ID NO: 22135 - DNA, 19 bp, Homo sapiens
ctgttttgttttcatctca

SEQ ID NO: 22136 - DNA, 19 bp, Homo sapiens
ctttggcctgcagtttgta

SEQ ID NO: 22137 - DNA, 18 bp, Homo sapiens
tgttgggatctgtttgga

SEQ ID NO: 22138 - DNA, 23 bp, Homo sapiens
cagagatgacaaactggcatcct

SEQ ID NO: 22139 - DNA, 22 bp, Homo sapiens
tatccctgtgccaaaggctcca

SEQ ID NO: 22140 - DNA, 23 bp, Homo sapiens
cccgaagaatgtaacaagaagca

SEQ ID NO: 22141 - DNA, 23 bp, Homo sapiens
gacagcagccccgccccggcctc

SEQ ID NO: 22142 - DNA, 19 bp, Homo sapiens
gattcaaattgtatttaca

SEQ ID NO: 22143 - DNA, 21 bp, Homo sapiens
tttaggcattagagtcatttt

SEQ ID NO: 22144 - DNA, 16 bp, Homo sapiens
ccacacagctgcctca

SEQ ID NO: 22145 - DNA, 23 bp, Homo sapiens
cgtgcctggaaccacctcgtcca

SEQ ID NO: 22146 - DNA, 18 bp, Homo sapiens
ctgcccatgcctgcccca

SEQ ID NO: 22147 - DNA, 24 bp, Homo sapiens
gctcctccacccagtgcttctgcc

SEQ ID NO: 22148 - DNA, 19 bp, Homo sapiens
ggattatgaacaaacctca

SEQ ID NO: 22149 - DNA, 19 bp, Homo sapiens
agccagggcaggggtggct

SEQ ID NO: 22150 - DNA, 24 bp, Homo sapiens
tagaaagagctcagtgttgggctg

SEQ ID NO: 22151 - DNA, 20 bp, Homo sapiens
tcaatgtgaagagcttagaa

SEQ ID NO: 22152 - DNA, 24 bp, Homo sapiens
aatggagacctccctaccaagtga

SEQ ID NO: 22153 - DNA, 21 bp, Homo sapiens
agtgtctggagtttcattcca

SEQ ID NO: 22154 - DNA, 18 bp, Homo sapiens
ccagaacccatcccaata

SEQ ID NO: 22155 - DNA, 24 bp, Homo sapiens
ctgagcttacactaattggtcaga

SEQ ID NO: 22156 - DNA, 18 bp, Homo sapiens
tcagaaaggcattgtgaa

SEQ ID NO: 22157 - DNA, 18 bp, Homo sapiens
tgactagaaacatcaagg

SEQ ID NO: 22158 - DNA, 23 bp, Homo sapiens
acctgggttgcagaactgagcct

SEQ ID NO: 22159 - DNA, 19 bp, Homo sapiens
agtgaaaggtaaaatctca

SEQ ID NO: 22160 - DNA, 20 bp, Homo sapiens
attgccttccatgttgttta

SEQ ID NO: 22161 - DNA, 17 bp, Homo sapiens
cattgacctcagcagca

SEQ ID NO: 22162 - DNA, 20 bp, Homo sapiens
tcatttgcagaagttagtaa

SEQ ID NO: 22163 - DNA, 20 bp, Homo sapiens
cactcttacccaagactctg

SEQ ID NO: 22164 - DNA, 18 bp, Homo sapiens
catgcagccatgcaggga

SEQ ID NO: 22165 - DNA, 18 bp, Homo sapiens
cctgaactgcctctgctt

SEQ ID NO: 22166 - DNA, 16 bp, Homo sapiens
ctgctttgggtgcggt

SEQ ID NO: 22167 - DNA, 18 bp, Homo sapiens
gccctttccgtggcttct

SEQ ID NO: 22168 - DNA, 19 bp, Homo sapiens
tttagggcacactgttata

SEQ ID NO: 22169 - DNA, 23 bp, Homo sapiens
ctctccggggagctaaccaggga

SEQ ID NO: 22170 - DNA, 18 bp, Homo sapiens
cctgcccccctcgtctca

SEQ ID NO: 22171 - DNA, 19 bp, Homo sapiens
gacccccgcccccacctcc

SEQ ID NO: 22172 - DNA, 20 bp, Homo sapiens
aggccccacagtgcagcttc

SEQ ID NO: 22173 - DNA, 16 bp, Homo sapiens
cctttgggggatctgt

SEQ ID NO: 22174 - DNA, 19 bp, Homo sapiens
gcaatgacctcagacttct

SEQ ID NO: 22175 - DNA, 22 bp, Homo sapiens
ctccgtccagaaatgcctctca

SEQ ID NO: 22176 - DNA, 21 bp, Homo sapiens
tacgacttcatttggcttcga

SEQ ID NO: 22177 - DNA, 19 bp, Homo sapiens
tctctttatagctgtgact

SEQ ID NO: 22178 - DNA, 22 bp, Homo sapiens
tgaagtcttcacatctaccact

SEQ ID NO: 22179 - DNA, 23 bp, Homo sapiens
acaaaagattaatctttaaacca

SEQ ID NO: 22180 - DNA, 22 bp, Homo sapiens
acccatgcacactcatgcacac

SEQ ID NO: 22181 - DNA, 25 bp, Homo sapiens
ctacccaggtattacacaagccaaa

SEQ ID NO: 22182 - DNA, 18 bp, Homo sapiens
cttaatgcacagtgcatt

SEQ ID NO: 22183 - DNA, 24 bp, Homo sapiens
gaaagaagttttatgcgtgtgaca

SEQ ID NO: 22184 - DNA, 22 bp, Homo sapiens
gggcggggcgtgtagccagcca

SEQ ID NO: 22185 - DNA, 21 bp, Homo sapiens
tgcagggtcgggcttgcggtg

SEQ ID NO: 22186 - DNA, 20 bp, Homo sapiens
agcaccaggaaaatcaacag

SEQ ID NO: 22187 - DNA, 16 bp, Homo sapiens
tctgcgcattgatgaa

SEQ ID NO: 22188 - DNA, 21 bp, Homo sapiens
acctgaattggtctttggttt

SEQ ID NO: 22189 - DNA, 18 bp, Homo sapiens
catagctgaccaagctgc

SEQ ID NO: 22190 - DNA, 22 bp, Homo sapiens
gattttgtcattttttacatca

SEQ ID NO: 22191 - DNA, 21 bp, Homo sapiens
ggggagccgcggcggcgtggc

SEQ ID NO: 22192 - DNA, 24 bp, Homo sapiens
tgacaaaaatatggtgtcataata

SEQ ID NO: 22193 - DNA, 19 bp, Homo sapiens
cacagccttgatgatctca

SEQ ID NO: 22194 - DNA, 19 bp, Homo sapiens
ggatttattaatgtgggat

SEQ ID NO: 22195 - DNA, 24 bp, Homo sapiens
cttcacgtggttgtaaacagcaga

SEQ ID NO: 22196 - DNA, 21 bp, Homo sapiens
gggatggctgctcagctgctg

SEQ ID NO: 22197 - DNA, 22 bp, Homo sapiens
gtaacaaaagaccttagactgg

SEQ ID NO: 22198 - DNA, 21 bp, Homo sapiens
tccctgcagtgcacgctggca

SEQ ID NO: 22199 - DNA, 23 bp, Homo sapiens
ggaggagggggccgcagtcggga

SEQ ID NO: 22200 - DNA, 16 bp, Homo sapiens
gtccttttgaaacatc

SEQ ID NO: 22201 - DNA, 21 bp, Homo sapiens
ctccatccctccttctgcctc

SEQ ID NO: 22202 - DNA, 23 bp, Homo sapiens
ccttagttgctggctttgacctt

SEQ ID NO: 22203 - DNA, 16 bp, Homo sapiens
aatatggatcatctct

SEQ ID NO: 22204 - DNA, 22 bp, Homo sapiens
ctcgattaaaaatgttaagcta

SEQ ID NO: 22205 - DNA, 17 bp, Homo sapiens
tcaagtgattctcctgc

SEQ ID NO: 22206 - DNA, 21 bp, Homo sapiens
tgatgattcacacctgtacta

SEQ ID NO: 22207 - DNA, 19 bp, Homo sapiens
tgtactgtatgtagtcatg

SEQ ID NO: 22208 - DNA, 20 bp, Homo sapiens
aatccctcctcctctgctct

SEQ ID NO: 22209 - DNA, 19 bp, Homo sapiens
cccatctcaccctctctca

SEQ ID NO: 22210 - DNA, 18 bp, Homo sapiens
ccccggcgccctccctca

SEQ ID NO: 22211 - DNA, 18 bp, Homo sapiens
gacccacagagcaccctc

SEQ ID NO: 22212 - DNA, 25 bp, Homo sapiens
ggaggagggggccacgtgtgagaga

SEQ ID NO: 22213 - DNA, 19 bp, Homo sapiens
ccccagggagagctgacca

SEQ ID NO: 22214 - DNA, 22 bp, Homo sapiens
ccccctttcctgccctccccca

SEQ ID NO: 22215 - DNA, 21 bp, Homo sapiens
gccccagccccgcgcaggcca

SEQ ID NO: 22216 - DNA, 20 bp, Homo sapiens
aaactacagaagcttggtga

SEQ ID NO: 22217 - DNA, 18 bp, Homo sapiens
aaagaatgaactgctcct

SEQ ID NO: 22218 - DNA, 23 bp, Homo sapiens
tgagtgcgttttgtccttcacgt

SEQ ID NO: 22219 - DNA, 18 bp, Homo sapiens
tgctgtttgaactgttga

SEQ ID NO: 22220 - DNA, 21 bp, Homo sapiens
ctattcaatttctgagtaata

SEQ ID NO: 22221 - DNA, 17 bp, Homo sapiens
ctcctatcattttctga

SEQ ID NO: 22222 - DNA, 26 bp, Homo sapiens
tctgtattgacaagactgttgttttt

SEQ ID NO: 22223 - DNA, 20 bp, Homo sapiens
tgaatagtgtgtttattgta

SEQ ID NO: 22224 - DNA, 23 bp, Homo sapiens
tgctattctttttgcttaaatac

SEQ ID NO: 22225 - DNA, 18 bp, Homo sapiens
gttgaaggaagcttctct

SEQ ID NO: 22226 - DNA, 21 bp, Homo sapiens
aagaaaggagaaagccattgg

SEQ ID NO: 22227 - DNA, 21 bp, Homo sapiens
aaggccagattttacctacca

SEQ ID NO: 22228 - DNA, 19 bp, Homo sapiens
catcgatcgtatcactgct

SEQ ID NO: 22229 - DNA, 25 bp, Homo sapiens
ctggggctttttctgatttattttt

SEQ ID NO: 22230 - DNA, 24 bp, Homo sapiens
ctttgtacatatacgtaatttata

SEQ ID NO: 22231 - DNA, 17 bp, Homo sapiens
tcctttaggacatgaga

SEQ ID NO: 22232 - DNA, 18 bp, Homo sapiens
tctggggctttttctgat

SEQ ID NO: 22233 - DNA, 21 bp, Homo sapiens
cccgccctcaccccagccatc

SEQ ID NO: 22234 - DNA, 17 bp, Homo sapiens
aactgcctgacgttgca

SEQ ID NO: 22235 - DNA, 20 bp, Homo sapiens
ctgcctcttctgtcattgtt

SEQ ID NO: 22236 - DNA, 20 bp, Homo sapiens
cgcgcggcgccccgcggagc

SEQ ID NO: 22237 - DNA, 22 bp, Homo sapiens
cctccccccggccctcccttcc

SEQ ID NO: 22238 - DNA, 18 bp, Homo sapiens
ggaggcggcggcggcggc

SEQ ID NO: 22239 - DNA, 21 bp, Homo sapiens
acatttacaggaggccccgga

SEQ ID NO: 22240 - DNA, 21 bp, Homo sapiens
ccccacccacctcctgcggct

SEQ ID NO: 22241 - DNA, 21 bp, Homo sapiens
ctggaccatcgctgcctgcca

SEQ ID NO: 22242 - DNA, 21 bp, Homo sapiens
atgcctccggtgcaacagctg

SEQ ID NO: 22243 - DNA, 19 bp, Homo sapiens
actcttcatggaaagcaac

SEQ ID NO: 22244 - DNA, 15 bp, Homo sapiens
caggtttagaagctt

SEQ ID NO: 22245 - DNA, 20 bp, Homo sapiens
ccagggctcacccagattca

SEQ ID NO: 22246 - DNA, 21 bp, Homo sapiens
ccccaccgtgccgctgcagct

SEQ ID NO: 22247 - DNA, 18 bp, Homo sapiens
gagcgatgctggtggtca

SEQ ID NO: 22248 - DNA, 24 bp, Homo sapiens
atattttcagagaaagttacctaa

SEQ ID NO: 22249 - DNA, 21 bp, Homo sapiens
ccacccccatgaccaccacca

SEQ ID NO: 22250 - DNA, 24 bp, Homo sapiens
cctaactattaagatcactgtgta

SEQ ID NO: 22251 - DNA, 23 bp, Homo sapiens
ggttcttggagggtatgtcagtg

SEQ ID NO: 22252 - DNA, 24 bp, Homo sapiens
tataaattgggatttaagactgta

SEQ ID NO: 22253 - DNA, 26 bp, Homo sapiens
tctgcaacattcacaccattgcttcc

SEQ ID NO: 22254 - DNA, 19 bp, Homo sapiens
atatattattatttgattg

SEQ ID NO: 22255 - DNA, 21 bp, Homo sapiens
gcagctgcttcgcagcgcaac

SEQ ID NO: 22256 - DNA, 24 bp, Homo sapiens
tcagaggtggcgtaaatctggcca

SEQ ID NO: 22257 - DNA, 19 bp, Homo sapiens
aggcacttgccaccacgcc

SEQ ID NO: 22258 - DNA, 20 bp, Homo sapiens
cctctgcctcctgggttcaa

SEQ ID NO: 22259 - DNA, 18 bp, Homo sapiens
cctggaactccttggctc

SEQ ID NO: 22260 - DNA, 23 bp, Homo sapiens
cctgggtgtcaataattattttt

SEQ ID NO: 22261 - DNA, 20 bp, Homo sapiens
gccaccacacctggataatt

SEQ ID NO: 22262 - DNA, 17 bp, Homo sapiens
tcaagcgattcttgtgc

SEQ ID NO: 22263 - DNA, 20 bp, Homo sapiens
tccagattttatattcctaa

SEQ ID NO: 22264 - DNA, 25 bp, Homo sapiens
tccagattttatattcctaatccca

SEQ ID NO: 22265 - DNA, 22 bp, Homo sapiens
tttctatgttccatgcataata

SEQ ID NO: 22266 - DNA, 18 bp, Homo sapiens
tttgtccctagcaccttt

SEQ ID NO: 22267 - DNA, 17 bp, Homo sapiens
acattcctgtaatccca

SEQ ID NO: 22268 - DNA, 20 bp, Homo sapiens
actcatctttcagaagtttg

SEQ ID NO: 22269 - DNA, 20 bp, Homo sapiens
gattagagatttcactgata

SEQ ID NO: 22270 - DNA, 20 bp, Homo sapiens
gcgcccagcggacaccggca

SEQ ID NO: 22271 - DNA, 18 bp, Homo sapiens
gctcgccattgtgtttgc

SEQ ID NO: 22272 - DNA, 20 bp, Homo sapiens
ctggcctcgtccgcggccca

SEQ ID NO: 22273 - DNA, 22 bp, Homo sapiens
cacttccacactatttatttgg

SEQ ID NO: 22274 - DNA, 19 bp, Homo sapiens
ctgggcggcgcttcggctc

SEQ ID NO: 22275 - DNA, 19 bp, Homo sapiens
gcactgaagtattacataa

SEQ ID NO: 22276 - DNA, 19 bp, Homo sapiens
gggacgggcccggtgcggc

SEQ ID NO: 22277 - DNA, 25 bp, Homo sapiens
tttccagaatgtctgtttctcacta

SEQ ID NO: 22278 - DNA, 17 bp, Homo sapiens
aagtaactgaaccattc

SEQ ID NO: 22279 - DNA, 19 bp, Homo sapiens
attattatctattatctca

SEQ ID NO: 22280 - DNA, 20 bp, Homo sapiens
gtttgttatttatcctagtg

SEQ ID NO: 22281 - DNA, 18 bp, Homo sapiens
tgggtggatcacctgagg

SEQ ID NO: 22282 - DNA, 20 bp, Homo sapiens
ttcccaagtgtaagactctg

SEQ ID NO: 22283 - DNA, 19 bp, Homo sapiens
cctgttagaagtctgtgag

SEQ ID NO: 22284 - DNA, 19 bp, Homo sapiens
cctgttagaagtctgtgag

SEQ ID NO: 22285 - DNA, 20 bp, Homo sapiens
cctgttagaagtctgtgagc

SEQ ID NO: 22286 - DNA, 21 bp, Homo sapiens
gtgtgtgtttttcatttgatt

SEQ ID NO: 22287 - DNA, 23 bp, Homo sapiens
tgaagagaatcctgatatgaaac

SEQ ID NO: 22288 - DNA, 19 bp, Homo sapiens
accaagacatgaaaagctg

SEQ ID NO: 22289 - DNA, 20 bp, Homo sapiens
accagcttcctcaccaggca

SEQ ID NO: 22290 - DNA, 18 bp, Homo sapiens
accccttgcctctgtggc

SEQ ID NO: 22291 - DNA, 20 bp, Homo sapiens
atgtcattttattcccctcc

SEQ ID NO: 22292 - DNA, 18 bp, Homo sapiens
cccccagacatactttca

SEQ ID NO: 22293 - DNA, 21 bp, Homo sapiens
ggcagctgggcccacttcata

SEQ ID NO: 22294 - DNA, 23 bp, Homo sapiens
tccccctgacctgggcacaggca

SEQ ID NO: 22295 - DNA, 24 bp, Homo sapiens
cccttccccccctttttaaatgta

SEQ ID NO: 22296 - DNA, 21 bp, Homo sapiens
ccttccccttttcccctttcc

SEQ ID NO: 22297 - DNA, 20 bp, Homo sapiens
ggatcctggccatgaggttg

SEQ ID NO: 22298 - DNA, 19 bp, Homo sapiens
ggccaggttacttaagcac

SEQ ID NO: 22299 - DNA, 21 bp, Homo sapiens
tccccttttcccctttcccct

SEQ ID NO: 22300 - DNA, 17 bp, Homo sapiens
tttttgggtacagctgt

SEQ ID NO: 22301 - DNA, 16 bp, Homo sapiens
cggcttcacccttcgt

SEQ ID NO: 22302 - DNA, 21 bp, Homo sapiens
ctcttctgtcccctcccctct

SEQ ID NO: 22303 - DNA, 20 bp, Homo sapiens
gcccatttgggggcttctaa

SEQ ID NO: 22304 - DNA, 21 bp, Homo sapiens
gcttgtaaggccctctggttt

SEQ ID NO: 22305 - DNA, 20 bp, Homo sapiens
gggggagacggggtgattgc

SEQ ID NO: 22306 - DNA, 22 bp, Homo sapiens
ttttgaacaatgagggtttgtg

SEQ ID NO: 22307 - DNA, 18 bp, Homo sapiens
tttttcatgttttgcttt

SEQ ID NO: 22308 - DNA, 25 bp, Homo sapiens
acctggatattctgactcctggccc

SEQ ID NO: 22309 - DNA, 22 bp, Homo sapiens
cttattttcagctttacagaca

SEQ ID NO: 22310 - DNA, 22 bp, Homo sapiens
gagccaagattgtgccactgca

SEQ ID NO: 22311 - DNA, 17 bp, Homo sapiens
gcctgggcaataagcaa

SEQ ID NO: 22312 - DNA, 16 bp, Homo sapiens
ttgaaactggaaggca

SEQ ID NO: 22313 - DNA, 21 bp, Homo sapiens
caaataaagactgattcttta

SEQ ID NO: 22314 - DNA, 19 bp, Homo sapiens
gtgcagaattgataccaga

SEQ ID NO: 22315 - DNA, 24 bp, Homo sapiens
ttaggtaggagtgatgccacttta

SEQ ID NO: 22316 - DNA, 18 bp, Homo sapiens
agaaaacaaaactggcaa

SEQ ID NO: 22317 - DNA, 19 bp, Homo sapiens
atgtacttatggtaagcta

SEQ ID NO: 22318 - DNA, 21 bp, Homo sapiens
cagagttggggcattgaggaa

SEQ ID NO: 22319 - DNA, 21 bp, Homo sapiens
ctctttctctccctcctcctc

SEQ ID NO: 22320 - DNA, 22 bp, Homo sapiens
gaattcagtgaatattcattaa

SEQ ID NO: 22321 - DNA, 19 bp, Homo sapiens
ggaatgagcctgctgtggc

SEQ ID NO: 22322 - DNA, 19 bp, Homo sapiens
cggacccactctctgcctt

SEQ ID NO: 22323 - DNA, 17 bp, Homo sapiens
actgtttacatgtgata

SEQ ID NO: 22324 - DNA, 20 bp, Homo sapiens
agcaagtttcctaaggtaca

SEQ ID NO: 22325 - DNA, 17 bp, Homo sapiens
actgtttacatgtgata

SEQ ID NO: 22326 - DNA, 20 bp, Homo sapiens
agcaagtttcctaaggtaca

SEQ ID NO: 22327 - DNA, 25 bp, Homo sapiens
ctgcatctttacctatatccattta

SEQ ID NO: 22328 - DNA, 21 bp, Homo sapiens
acagcagcacgatttgtgaca

SEQ ID NO: 22329 - DNA, 18 bp, Homo sapiens
caaacaccatgtaacctg

SEQ ID NO: 22330 - DNA, 18 bp, Homo sapiens
caccccagctcctcactc

SEQ ID NO: 22331 - DNA, 20 bp, Homo sapiens
cgctgaccactccctcctcc

SEQ ID NO: 22332 - DNA, 22 bp, Homo sapiens
gcttctgtctccccctgcccct

SEQ ID NO: 22333 - DNA, 21 bp, Homo sapiens
tcctgccagaaggcctctgag

SEQ ID NO: 22334 - DNA, 24 bp, Homo sapiens
ttctgtctccccctgccccttcga

SEQ ID NO: 22335 - DNA, 19 bp, Homo sapiens
aagtgagcatctgggcatt

SEQ ID NO: 22336 - DNA, 19 bp, Homo sapiens
cagcagccgcctgccctga

SEQ ID NO: 22337 - DNA, 21 bp, Homo sapiens
cctaaactgactggacggctg

SEQ ID NO: 22338 - DNA, 21 bp, Homo sapiens
ctttttcatttccttaagttt

SEQ ID NO: 22339 - DNA, 19 bp, Homo sapiens
gtggtttgactctccttag

SEQ ID NO: 22340 - DNA, 19 bp, Homo sapiens
aagtgagcatctgggcatt

SEQ ID NO: 22341 - DNA, 19 bp, Homo sapiens
cagcagccgcctgccctga

SEQ ID NO: 22342 - DNA, 21 bp, Homo sapiens
cctaaactgactggacggctg

SEQ ID NO: 22343 - DNA, 21 bp, Homo sapiens
ctttttcatttccttaagttt

SEQ ID NO: 22344 - DNA, 19 bp, Homo sapiens
gtggtttgactctccttag

SEQ ID NO: 22345 - DNA, 20 bp, Homo sapiens
agctttcagaaggagttctc

SEQ ID NO: 22346 - DNA, 17 bp, Homo sapiens
tcaacctttctacctta

SEQ ID NO: 22347 - DNA, 21 bp, Homo sapiens
tcttgttccagctaggcaatg

SEQ ID NO: 22348 - DNA, 19 bp, Homo sapiens
tggtgtttttcacaaagta

SEQ ID NO: 22349 - DNA, 17 bp, Homo sapiens
gcaggccaagtggcatc

SEQ ID NO: 22350 - DNA, 17 bp, Homo sapiens
tattaggagatatctat

SEQ ID NO: 22351 - DNA, 22 bp, Homo sapiens
gtgtcttggttacccattattc

SEQ ID NO: 22352 - DNA, 19 bp, Homo sapiens
attatccccagctgccaga

SEQ ID NO: 22353 - DNA, 24 bp, Homo sapiens
gccacccctcttcagttccggtga

SEQ ID NO: 22354 - DNA, 23 bp, Homo sapiens
cccaagagatatttattaaacac

SEQ ID NO: 22355 - DNA, 19 bp, Homo sapiens
ggatgggcctttgagcctg

SEQ ID NO: 22356 - DNA, 22 bp, Homo sapiens
aaatgtctgttgaatttctgaa

SEQ ID NO: 22357 - DNA, 20 bp, Homo sapiens
ccatctagccctgtcctcca

SEQ ID NO: 22358 - DNA, 24 bp, Homo sapiens
acacagtgatgcctcacaccctga

SEQ ID NO: 22359 - DNA, 21 bp, Homo sapiens
accacacacagtgatgcctca

SEQ ID NO: 22360 - DNA, 22 bp, Homo sapiens
cctggcacactggacctcacca

SEQ ID NO: 22361 - DNA, 24 bp, Homo sapiens
ctttgaccacacacagtgatgcct

SEQ ID NO: 22362 - DNA, 20 bp, Homo sapiens
gcaatgcactgactgggcca

SEQ ID NO: 22363 - DNA, 16 bp, Homo sapiens
agaggaacccagtgga

SEQ ID NO: 22364 - DNA, 22 bp, Homo sapiens
cagactctgcttgggtttggtt

SEQ ID NO: 22365 - DNA, 21 bp, Homo sapiens
ccatctgctggtcaggaagtc

SEQ ID NO: 22366 - DNA, 27 bp, Homo sapiens
cctgcagcctcagttttgaattctttt

SEQ ID NO: 22367 - DNA, 19 bp, Homo sapiens
ctgtactccagcccgggtt

SEQ ID NO: 22368 - DNA, 22 bp, Homo sapiens
tttcttttgctgttttgttttt

SEQ ID NO: 22369 - DNA, 20 bp, Homo sapiens
agaaagcagcttttccaaga

SEQ ID NO: 22370 - DNA, 21 bp, Homo sapiens
agacgcaatttggccttgcca

SEQ ID NO: 22371 - DNA, 24 bp, Homo sapiens
gatcagccatcttgaaccaaagca

SEQ ID NO: 22372 - DNA, 20 bp, Homo sapiens
tctaccttctacttccgaga

SEQ ID NO: 22373 - DNA, 18 bp, Homo sapiens
ttggatatctaaaagtct

SEQ ID NO: 22374 - DNA, 19 bp, Homo sapiens
acctccggccctttggttt

SEQ ID NO: 22375 - DNA, 20 bp, Homo sapiens
cttttccctccaccatgaag

SEQ ID NO: 22376 - DNA, 17 bp, Homo sapiens
agagccttctcatctct

SEQ ID NO: 22377 - DNA, 22 bp, Homo sapiens
caacgactgtaacaggttacat

SEQ ID NO: 22378 - DNA, 21 bp, Homo sapiens
cctccaaccacgggctgttta

SEQ ID NO: 22379 - DNA, 18 bp, Homo sapiens
gcacacctctcccatcca

SEQ ID NO: 22380 - DNA, 20 bp, Homo sapiens
gttaagacaccaaaaactcc

SEQ ID NO: 22381 - DNA, 20 bp, Homo sapiens
tgagccatctcatgacccca

SEQ ID NO: 22382 - DNA, 19 bp, Homo sapiens
tgaggtttttctgccagtg

SEQ ID NO: 22383 - DNA, 21 bp, Homo sapiens
tttctgatcatttgcagctgt

SEQ ID NO: 22384 - DNA, 21 bp, Homo sapiens
gccgccccttgggctaaaagg

SEQ ID NO: 22385 - DNA, 21 bp, Homo sapiens
ttataaatgtatgtcttcatt

SEQ ID NO: 22386 - DNA, 22 bp, Homo sapiens
agtacaaaaaagtttaagattg

SEQ ID NO: 22387 - DNA, 21 bp, Homo sapiens
agtcctaaagtgaagaagcca

SEQ ID NO: 22388 - DNA, 21 bp, Homo sapiens
atctttatcattaaacatgaa

SEQ ID NO: 22389 - DNA, 20 bp, Homo sapiens
caaaatcttcactgaatatc

SEQ ID NO: 22390 - DNA, 21 bp, Homo sapiens
caacacctcctgatagtagta

SEQ ID NO: 22391 - DNA, 20 bp, Homo sapiens
cattgcattcaaaatcttca

SEQ ID NO: 22392 - DNA, 19 bp, Homo sapiens
gcatcaaaatacaacttca

SEQ ID NO: 22393 - DNA, 19 bp, Homo sapiens
gcatgtaatattctgagca

SEQ ID NO: 22394 - DNA, 21 bp, Homo sapiens
tggagactacaattcctggca

SEQ ID NO: 22395 - DNA, 18 bp, Homo sapiens
tgtttgcaaaggcaatgc

SEQ ID NO: 22396 - DNA, 18 bp, Homo sapiens
actgaagaaatgttgaca

SEQ ID NO: 22397 - DNA, 18 bp, Homo sapiens
ggaagtcttccagaatac

SEQ ID NO: 22398 - DNA, 27 bp, Homo sapiens
cccaggaatgaaaattaagattttgac

SEQ ID NO: 22399 - DNA, 21 bp, Homo sapiens
cctgtcagctgtttcttacca

SEQ ID NO: 22400 - DNA, 22 bp, Homo sapiens
tgacaaaataagaactaccctg

SEQ ID NO: 22401 - DNA, 24 bp, Homo sapiens
ctgaggtttcctgcagaccatgcc

SEQ ID NO: 22402 - DNA, 21 bp, Homo sapiens
ctgtactcagaatgggttcag

SEQ ID NO: 22403 - DNA, 20 bp, Homo sapiens
gccacgtgaacatccggcga

SEQ ID NO: 22404 - DNA, 21 bp, Homo sapiens
gttgcttggtcatagagccat

SEQ ID NO: 22405 - DNA, 16 bp, Homo sapiens
acagggacctgccacc

SEQ ID NO: 22406 - DNA, 21 bp, Homo sapiens
ccacggccccgctctgcccct

SEQ ID NO: 22407 - DNA, 19 bp, Homo sapiens
atcaaaccctttcctgcgc

SEQ ID NO: 22408 - DNA, 24 bp, Homo sapiens
cagttgaatttatggaatctacca

SEQ ID NO: 22409 - DNA, 24 bp, Homo sapiens
ccagagtttttatgtagcagggaa

SEQ ID NO: 22410 - DNA, 19 bp, Homo sapiens
ggtgcaaaagcagaaaata

SEQ ID NO: 22411 - DNA, 21 bp, Homo sapiens
aaccaaggactgagcaccctc

SEQ ID NO: 22412 - DNA, 19 bp, Homo sapiens
agcaccctctggattctga

SEQ ID NO: 22413 - DNA, 19 bp, Homo sapiens
cgccagtcctgctacctcc

SEQ ID NO: 22414 - DNA, 18 bp, Homo sapiens
tcatcccatcattttcca

SEQ ID NO: 22415 - DNA, 21 bp, Homo sapiens
aaccaaggactgagcaccctc

SEQ ID NO: 22416 - DNA, 19 bp, Homo sapiens
agcaccctctggattctga

SEQ ID NO: 22417 - DNA, 19 bp, Homo sapiens
cgccagtcctgctacctcc

SEQ ID NO: 22418 - DNA, 18 bp, Homo sapiens
tcatcccatcattttcca

SEQ ID NO: 22419 - DNA, 19 bp, Homo sapiens
aagtgtcccccctgagctc

SEQ ID NO: 22420 - DNA, 19 bp, Homo sapiens
cctcttctagttaccacgg

SEQ ID NO: 22421 - DNA, 19 bp, Homo sapiens
ctccccacaaaatcaggga

SEQ ID NO: 22422 - DNA, 19 bp, Homo sapiens
ctgcagctcctctgccttt

SEQ ID NO: 22423 - DNA, 20 bp, Homo sapiens
gctgcctcctcagcagcctc

SEQ ID NO: 22424 - DNA, 24 bp, Homo sapiens
taacgctccccaacagctacccct

SEQ ID NO: 22425 - DNA, 17 bp, Homo sapiens
tcacaatcatcttctcc

SEQ ID NO: 22426 - DNA, 16 bp, Homo sapiens
tcacgctcagcacaca

SEQ ID NO: 22427 - DNA, 17 bp, Homo sapiens
aggatcaagtcctagtt

SEQ ID NO: 22428 - DNA, 24 bp, Homo sapiens
caccaccaaaactgctcctcctcc

SEQ ID NO: 22429 - DNA, 22 bp, Homo sapiens
ccctctctcactccccacatcc

SEQ ID NO: 22430 - DNA, 22 bp, Homo sapiens
gcgcgatttcccgccgagcccg

SEQ ID NO: 22431 - DNA, 19 bp, Homo sapiens
ggtgaatcatcccggcaga

SEQ ID NO: 22432 - DNA, 19 bp, Homo sapiens
gtcctagttgttcagcatg

SEQ ID NO: 22433 - DNA, 18 bp, Homo sapiens
ttttatactgacacaaga

SEQ ID NO: 22434 - DNA, 22 bp, Homo sapiens
atctctcagcccagcgagatgc

SEQ ID NO: 22435 - DNA, 23 bp, Homo sapiens
gagaacttccaacaagcctcaaa

SEQ ID NO: 22436 - DNA, 23 bp, Homo sapiens
gcacaggcccgccctctgcctcc

SEQ ID NO: 22437 - DNA, 18 bp, Homo sapiens
ttattacaagatctttcc

SEQ ID NO: 22438 - DNA, 23 bp, Homo sapiens
aaggaaggggttggattgcaata

SEQ ID NO: 22439 - DNA, 22 bp, Homo sapiens
agattctagatcagatgctcca

SEQ ID NO: 22440 - DNA, 19 bp, Homo sapiens
atgttgcccccgtgagcca

SEQ ID NO: 22441 - DNA, 21 bp, Homo sapiens
caaccctccacctggtactcc

SEQ ID NO: 22442 - DNA, 18 bp, Homo sapiens
caagactctagagtccaa

SEQ ID NO: 22443 - DNA, 19 bp, Homo sapiens
ctcccctgccgctgtgcca

SEQ ID NO: 22444 - DNA, 17 bp, Homo sapiens
ctccctctcaggatcca

SEQ ID NO: 22445 - DNA, 24 bp, Homo sapiens
gggacagcccggccctgccccctc

SEQ ID NO: 22446 - DNA, 19 bp, Homo sapiens
tagcatcaccatctgtaaa

SEQ ID NO: 22447 - DNA, 17 bp, Homo sapiens
ctatattttctttttca

SEQ ID NO: 22448 - DNA, 18 bp, Homo sapiens
aatgctgccttgacacac

SEQ ID NO: 22449 - DNA, 21 bp, Homo sapiens
cagacaccaccccccacccca

SEQ ID NO: 22450 - DNA, 19 bp, Homo sapiens
gcctctgtccccgcctcag

SEQ ID NO: 22451 - DNA, 22 bp, Homo sapiens
tgcctggacacacacacacaca

SEQ ID NO: 22452 - DNA, 21 bp, Homo sapiens
acattgccatacattaactct

SEQ ID NO: 22453 - DNA, 21 bp, Homo sapiens
gtcttatttctggtttttaga

SEQ ID NO: 22454 - DNA, 17 bp, Homo sapiens
gggattggtgattgaca

SEQ ID NO: 22455 - DNA, 18 bp, Homo sapiens
cctgctgagagaggccca

SEQ ID NO: 22456 - DNA, 18 bp, Homo sapiens
acttgcaaaatcagtttt

SEQ ID NO: 22457 - DNA, 21 bp, Homo sapiens
agaacacatacacaacaacat

SEQ ID NO: 22458 - DNA, 21 bp, Homo sapiens
agctggggaagctgccgccca

SEQ ID NO: 22459 - DNA, 23 bp, Homo sapiens
ctctggtaggtgagggcctgagg

SEQ ID NO: 22460 - DNA, 21 bp, Homo sapiens
gggccccccgccccctcctct

SEQ ID NO: 22461 - DNA, 24 bp, Homo sapiens
gtgccttggccacgggaggctgct

SEQ ID NO: 22462 - DNA, 16 bp, Homo sapiens
ttgatggtggttgaaa

SEQ ID NO: 22463 - DNA, 21 bp, Homo sapiens
aaggcacctgtctcccttctg

SEQ ID NO: 22464 - DNA, 24 bp, Homo sapiens
cttcttcatggcttgtttactctt

SEQ ID NO: 22465 - DNA, 15 bp, Homo sapiens
gcacaggatctgcaa

SEQ ID NO: 22466 - DNA, 21 bp, Homo sapiens
atgtctagcggcgaacacttc

SEQ ID NO: 22467 - DNA, 22 bp, Homo sapiens
ggactaatccatcgatgactgg

SEQ ID NO: 22468 - DNA, 19 bp, Homo sapiens
tcgatgactggaaaagagg

SEQ ID NO: 22469 - DNA, 18 bp, Homo sapiens
catctggctcctgctgtc

SEQ ID NO: 22470 - DNA, 19 bp, Homo sapiens
cctggagaccatctggctc

SEQ ID NO: 22471 - DNA, 19 bp, Homo sapiens
gcgtcttggctataaggat

SEQ ID NO: 22472 - DNA, 22 bp, Homo sapiens
gcttgggttgcttccctgtccc

SEQ ID NO: 22473 - DNA, 21 bp, Homo sapiens
atagaaaataaactttgccca

SEQ ID NO: 22474 - DNA, 21 bp, Homo sapiens
ccaagatgaaacatttaccca

SEQ ID NO: 22475 - DNA, 20 bp, Homo sapiens
ccatcctcctccttcatacc

SEQ ID NO: 22476 - DNA, 19 bp, Homo sapiens
cccacaaaatgtaaaccca

SEQ ID NO: 22477 - DNA, 18 bp, Homo sapiens
ttctccatcagcaaccag

SEQ ID NO: 22478 - DNA, 22 bp, Homo sapiens
tttctccatcagcaaccaggga

SEQ ID NO: 22479 - DNA, 17 bp, Homo sapiens
actgaaatataatcaga

SEQ ID NO: 22480 - DNA, 23 bp, Homo sapiens
attcaagtgaagccatttgtgtg

SEQ ID NO: 22481 - DNA, 23 bp, Homo sapiens
cctcccaatccaaaacgtaactg

SEQ ID NO: 22482 - DNA, 17 bp, Homo sapiens
ccatcccgggcactcca

SEQ ID NO: 22483 - DNA, 16 bp, Homo sapiens
ctggggtttcaattga

SEQ ID NO: 22484 - DNA, 23 bp, Homo sapiens
ttttgatagaagggaagacctgc

SEQ ID NO: 22485 - DNA, 18 bp, Homo sapiens
tgttatttaggatttctg

SEQ ID NO: 22486 - DNA, 24 bp, Homo sapiens
ctacaaattaatgttggttgtcaa

SEQ ID NO: 22487 - DNA, 19 bp, Homo sapiens
gtggatggagagacatttg

SEQ ID NO: 22488 - DNA, 21 bp, Homo sapiens
taaggacctaaaagcacttta

SEQ ID NO: 22489 - DNA, 17 bp, Homo sapiens
tacatgggaagagtgct

SEQ ID NO: 22490 - DNA, 18 bp, Homo sapiens
taggacaccccaagtggt

SEQ ID NO: 22491 - DNA, 19 bp, Homo sapiens
ttaggaacctgtttcttac

SEQ ID NO: 22492 - DNA, 18 bp, Homo sapiens
acttgaaagactgcaata

SEQ ID NO: 22493 - DNA, 21 bp, Homo sapiens
gactgcaatagaaaactccca

SEQ ID NO: 22494 - DNA, 18 bp, Homo sapiens
gctatgggaaggctgcaa

SEQ ID NO: 22495 - DNA, 20 bp, Homo sapiens
gcttctctcttggccctgct

SEQ ID NO: 22496 - DNA, 16 bp, Homo sapiens
tgctttgccttgctgc

SEQ ID NO: 22497 - DNA, 19 bp, Homo sapiens
tgtagctattaatctgtgg

SEQ ID NO: 22498 - DNA, 17 bp, Homo sapiens
gccttagcactaccact

SEQ ID NO: 22499 - DNA, 24 bp, Homo sapiens
gccaggcgggctgcaggcacctca

SEQ ID NO: 22500 - DNA, 19 bp, Homo sapiens
gcctgccctccccagagca

SEQ ID NO: 22501 - DNA, 21 bp, Homo sapiens
gagacttgcagttagactcaa

SEQ ID NO: 22502 - DNA, 18 bp, Homo sapiens
ataatatgtagccagttt

SEQ ID NO: 22503 - DNA, 18 bp, Homo sapiens
cgcaatgtgaacaggtca

SEQ ID NO: 22504 - DNA, 19 bp, Homo sapiens
gatgaaataaacacaactc

SEQ ID NO: 22505 - DNA, 25 bp, Homo sapiens
ggagtccctcccgtccacctcctct

SEQ ID NO: 22506 - DNA, 20 bp, Homo sapiens
ggccctgttccagcaataag

SEQ ID NO: 22507 - DNA, 19 bp, Homo sapiens
tgaacatctgggaatcctg

SEQ ID NO: 22508 - DNA, 20 bp, Homo sapiens
accttctagaccacatgata

SEQ ID NO: 22509 - DNA, 18 bp, Homo sapiens
catctttcgtctgcacta

SEQ ID NO: 22510 - DNA, 20 bp, Homo sapiens
gaggggggggcagcaagaga

SEQ ID NO: 22511 - DNA, 19 bp, Homo sapiens
tccctctcctttggtcaga

SEQ ID NO: 22512 - DNA, 20 bp, Homo sapiens
accttctagaccacatgata

SEQ ID NO: 22513 - DNA, 18 bp, Homo sapiens
catctttcgtctgcacta

SEQ ID NO: 22514 - DNA, 20 bp, Homo sapiens
gaggggggggcagcaagaga

SEQ ID NO: 22515 - DNA, 19 bp, Homo sapiens
tccctctcctttggtcaga

SEQ ID NO: 22516 - DNA, 19 bp, Homo sapiens
aaggaacccggtgtgcaca

SEQ ID NO: 22517 - DNA, 20 bp, Homo sapiens
acatctaactcaactgtgaa

SEQ ID NO: 22518 - DNA, 21 bp, Homo sapiens
accacaggcccttccccttcc

SEQ ID NO: 22519 - DNA, 23 bp, Homo sapiens
agaagttttaaacagggctttca

SEQ ID NO: 22520 - DNA, 20 bp, Homo sapiens
atgacacttccttgctttgg

SEQ ID NO: 22521 - DNA, 19 bp, Homo sapiens
caccttttgaagcagcaac

SEQ ID NO: 22522 - DNA, 21 bp, Homo sapiens
ccttggtggttgaacttggag

SEQ ID NO: 22523 - DNA, 18 bp, Homo sapiens
cctttttgcaccgtcacc

SEQ ID NO: 22524 - DNA, 20 bp, Homo sapiens
ctctagcctggggggcttgt

SEQ ID NO: 22525 - DNA, 18 bp, Homo sapiens
ggtcctcagccctgccac

SEQ ID NO: 22526 - DNA, 18 bp, Homo sapiens
tagattgtaacccctcca

SEQ ID NO: 22527 - DNA, 20 bp, Homo sapiens
accttctagaccacatgata

SEQ ID NO: 22528 - DNA, 18 bp, Homo sapiens
catctttcgtctgcacta

SEQ ID NO: 22529 - DNA, 20 bp, Homo sapiens
ccttcccttcatccccttcc

SEQ ID NO: 22530 - DNA, 19 bp, Homo sapiens
cttggcagatggcctttaa

SEQ ID NO: 22531 - DNA, 20 bp, Homo sapiens
gaggggggggcagcaagaga

SEQ ID NO: 22532 - DNA, 22 bp, Homo sapiens
tacagagtgcagggcagagctt

SEQ ID NO: 22533 - DNA, 19 bp, Homo sapiens
tccctctcctttggtcaga

SEQ ID NO: 22534 - DNA, 21 bp, Homo sapiens
gaaaacattacgtcgacgggg

SEQ ID NO: 22535 - DNA, 20 bp, Homo sapiens
tagcgtttctactggtgcca

SEQ ID NO: 22536 - DNA, 18 bp, Homo sapiens
ggcggcggcagctgtagc

SEQ ID NO: 22537 - DNA, 23 bp, Homo sapiens
aaatcttaagagaatccacataa

SEQ ID NO: 22538 - DNA, 18 bp, Homo sapiens
agcccgcgccccgagccc

SEQ ID NO: 22539 - DNA, 20 bp, Homo sapiens
cagtagccgcctctgccgcc

SEQ ID NO: 22540 - DNA, 17 bp, Homo sapiens
ggagcttcccgaacctc

SEQ ID NO: 22541 - DNA, 15 bp, Homo sapiens
taatcatatatatgc

SEQ ID NO: 22542 - DNA, 23 bp, Homo sapiens
agctgtataggaacaatcacaca

SEQ ID NO: 22543 - DNA, 18 bp, Homo sapiens
ctttttctcccttcctca

SEQ ID NO: 22544 - DNA, 22 bp, Homo sapiens
tggatccataaatgtgaaactg

SEQ ID NO: 22545 - DNA, 19 bp, Homo sapiens
cagcacaaggaatttccct

SEQ ID NO: 22546 - DNA, 16 bp, Homo sapiens
atcaccttctgctcct

SEQ ID NO: 22547 - DNA, 19 bp, Homo sapiens
caaaaaccttgcttcctta

SEQ ID NO: 22548 - DNA, 20 bp, Homo sapiens
cacatggccatctgctcctc

SEQ ID NO: 22549 - DNA, 23 bp, Homo sapiens
cctgaggcggctgcttgaacctt

SEQ ID NO: 22550 - DNA, 24 bp, Homo sapiens
ccttccgtggttaatttcttccca

SEQ ID NO: 22551 - DNA, 25 bp, Homo sapiens
ctttaacaaaaaccttgcttcctta

SEQ ID NO: 22552 - DNA, 21 bp, Homo sapiens
gcttctctgcctacgtcccct

SEQ ID NO: 22553 - DNA, 23 bp, Homo sapiens
tcttgggacctgggaaggtttgc

SEQ ID NO: 22554 - DNA, 22 bp, Homo sapiens
ttgctgttctctgtatcgtgat

SEQ ID NO: 22555 - DNA, 21 bp, Homo sapiens
gaaggatccttcaccagcccc

SEQ ID NO: 22556 - DNA, 17 bp, Homo sapiens
gtataaagattccctct

SEQ ID NO: 22557 - DNA, 22 bp, Homo sapiens
tcaggtaatgggagtctctcca

SEQ ID NO: 22558 - DNA, 21 bp, Homo sapiens
aatgtgataagttcttatgcc

SEQ ID NO: 22559 - DNA, 16 bp, Homo sapiens
catccacattgtttta

SEQ ID NO: 22560 - DNA, 25 bp, Homo sapiens
ttttttcacaaatttgtcttgcctt

SEQ ID NO: 22561 - DNA, 20 bp, Homo sapiens
catatgaaaaacatcactta

SEQ ID NO: 22562 - DNA, 16 bp, Homo sapiens
ccaccctagtgtgaaa

SEQ ID NO: 22563 - DNA, 21 bp, Homo sapiens
taatcttttcctccttccctc

SEQ ID NO: 22564 - DNA, 20 bp, Homo sapiens
tatctctcattctcacctca

SEQ ID NO: 22565 - DNA, 18 bp, Homo sapiens
ttatatgccagaggcacc

SEQ ID NO: 22566 - DNA, 21 bp, Homo sapiens
ttctggggtagtacctgtgga

SEQ ID NO: 22567 - DNA, 19 bp, Homo sapiens
tcaggtgcagtggccctac

SEQ ID NO: 22568 - DNA, 20 bp, Homo sapiens
agattcttctggacaaaagt

SEQ ID NO: 22569 - DNA, 19 bp, Homo sapiens
ccagtgcctcccaggagtc

SEQ ID NO: 22570 - DNA, 21 bp, Homo sapiens
ttctggacaaaagtcacatat

SEQ ID NO: 22571 - DNA, 19 bp, Homo sapiens
catttaaaatatctcaatg

SEQ ID NO: 22572 - DNA, 22 bp, Homo sapiens
cccagcgggctacctgaaccaa

SEQ ID NO: 22573 - DNA, 23 bp, Homo sapiens
tctattttaggtaccgtttcaca

SEQ ID NO: 22574 - DNA, 18 bp, Homo sapiens
tttaggtaccgtttcaca

SEQ ID NO: 22575 - DNA, 22 bp, Homo sapiens
cctcttcatactattaaatttt

SEQ ID NO: 22576 - DNA, 19 bp, Homo sapiens
gtaaaatatctaacaggtg

SEQ ID NO: 22577 - DNA, 17 bp, Homo sapiens
tcaagtgattctcctgc

SEQ ID NO: 22578 - DNA, 21 bp, Homo sapiens
aataggtgaaaatcctgaaat

SEQ ID NO: 22579 - DNA, 22 bp, Homo sapiens
acttggatttttagttcggttt

SEQ ID NO: 22580 - DNA, 23 bp, Homo sapiens
agcctagcaccccactttccaca

SEQ ID NO: 22581 - DNA, 23 bp, Homo sapiens
atcctgcttttgaaatacatatt

SEQ ID NO: 22582 - DNA, 17 bp, Homo sapiens
cgagtggcgcccgtatg

SEQ ID NO: 22583 - DNA, 16 bp, Homo sapiens
ctctttcacttgattg

SEQ ID NO: 22584 - DNA, 23 bp, Homo sapiens
ctgcgcctcggcgtccccgagga

SEQ ID NO: 22585 - DNA, 18 bp, Homo sapiens
gcaagcaccacatgtgtt

SEQ ID NO: 22586 - DNA, 16 bp, Homo sapiens
ggtagaataatagtac

SEQ ID NO: 22587 - DNA, 18 bp, Homo sapiens
tctcccttttttatatca

SEQ ID NO: 22588 - DNA, 19 bp, Homo sapiens
tgaagtctctctataacat

SEQ ID NO: 22589 - DNA, 18 bp, Homo sapiens
ggttccaagtcttcttcc

SEQ ID NO: 22590 - DNA, 19 bp, Homo sapiens
gtgagactgtagtgtcagg

SEQ ID NO: 22591 - DNA, 19 bp, Homo sapiens
tcccaggttggttccaagt

SEQ ID NO: 22592 - DNA, 22 bp, Homo sapiens
catttttaccagggcttgggga

SEQ ID NO: 22593 - DNA, 19 bp, Homo sapiens
ttgccttgtttcattaatc

SEQ ID NO: 22594 - DNA, 19 bp, Homo sapiens
ccaaagcattgaaagccga

SEQ ID NO: 22595 - DNA, 18 bp, Homo sapiens
tggaataatgatgtgata

SEQ ID NO: 22596 - DNA, 22 bp, Homo sapiens
acgggttggtttcacctcctca

SEQ ID NO: 22597 - DNA, 21 bp, Homo sapiens
ccaagaatggaagcttgtgag

SEQ ID NO: 22598 - DNA, 17 bp, Homo sapiens
ccatctcccaggttcaa

SEQ ID NO: 22599 - DNA, 19 bp, Homo sapiens
cctccttagcaggtgccgt

SEQ ID NO: 22600 - DNA, 23 bp, Homo sapiens
gcccttactgtgattcctggctt

SEQ ID NO: 22601 - DNA, 20 bp, Homo sapiens
tctgcttttcacactgggtg

SEQ ID NO: 22602 - DNA, 22 bp, Homo sapiens
cacttcaccccatcccatacca

SEQ ID NO: 22603 - DNA, 20 bp, Homo sapiens
ccttccttgccccatcttcc

SEQ ID NO: 22604 - DNA, 20 bp, Homo sapiens
gccgtttcaggggttctggg

SEQ ID NO: 22605 - DNA, 21 bp, Homo sapiens
taagctagggacactcaagtg

SEQ ID NO: 22606 - DNA, 20 bp, Homo sapiens
cttggtataaaatcactttt

SEQ ID NO: 22607 - DNA, 20 bp, Homo sapiens
tggtcaggctggtcttgaac

SEQ ID NO: 22608 - DNA, 18 bp, Homo sapiens
ttcaagtgattctcatgc

SEQ ID NO: 22609 - DNA, 19 bp, Homo sapiens
agaaaagtgactgctccag

SEQ ID NO: 22610 - DNA, 21 bp, Homo sapiens
ggacatttggttcagaacgag

SEQ ID NO: 22611 - DNA, 24 bp, Homo sapiens
aaaaacatagtattagtgatactc

SEQ ID NO: 22612 - DNA, 17 bp, Homo sapiens
agcgctccatccccact

SEQ ID NO: 22613 - DNA, 20 bp, Homo sapiens
gactggtacctcttaatcag

SEQ ID NO: 22614 - DNA, 21 bp, Homo sapiens
ggtaattgttgatgaacagca

SEQ ID NO: 22615 - DNA, 18 bp, Homo sapiens
gggacaccaaggatctcc

SEQ ID NO: 22616 - DNA, 20 bp, Homo sapiens
aatgaagacaggaattttgt

SEQ ID NO: 22617 - DNA, 21 bp, Homo sapiens
agtctttcttcagctcacttg

SEQ ID NO: 22618 - DNA, 21 bp, Homo sapiens
atttgagttctcgtctgtccc

SEQ ID NO: 22619 - DNA, 17 bp, Homo sapiens
tccagaaattcctgcag

SEQ ID NO: 22620 - DNA, 21 bp, Homo sapiens
gggcaatccaccacttcctct

SEQ ID NO: 22621 - DNA, 19 bp, Homo sapiens
tccttctgcttctgtgacg

SEQ ID NO: 22622 - DNA, 18 bp, Homo sapiens
ttctcctgcctcagcctt

SEQ ID NO: 22623 - DNA, 20 bp, Homo sapiens
cacctgccagcgggctcggc

SEQ ID NO: 22624 - DNA, 20 bp, Homo sapiens
ctccatgtcagacacacgag

SEQ ID NO: 22625 - DNA, 17 bp, Homo sapiens
gtgtggccgtcagggtg

SEQ ID NO: 22626 - DNA, 18 bp, Homo sapiens
tgcagcgcccgcctgcca

SEQ ID NO: 22627 - DNA, 21 bp, Homo sapiens
atctgtgggactgtctgggcc

SEQ ID NO: 22628 - DNA, 22 bp, Homo sapiens
cctgggtaagactgaaagcatt

SEQ ID NO: 22629 - DNA, 20 bp, Homo sapiens
ctttaaggctttttaatttt

SEQ ID NO: 22630 - DNA, 22 bp, Homo sapiens
gactgtgcaaagggcttagcta

SEQ ID NO: 22631 - DNA, 25 bp, Homo sapiens
taagtgcttgttctagcataaatta

SEQ ID NO: 22632 - DNA, 19 bp, Homo sapiens
tgcctacttcaccatctct

SEQ ID NO: 22633 - DNA, 19 bp, Homo sapiens
gtccgcctcccaggttcaa

SEQ ID NO: 22634 - DNA, 18 bp, Homo sapiens
ttcaagcgattctcatgc

SEQ ID NO: 22635 - DNA, 23 bp, Homo sapiens
gcctgggcgcctccgccgggctc

SEQ ID NO: 22636 - DNA, 18 bp, Homo sapiens
ccagttattctccatctc

SEQ ID NO: 22637 - DNA, 22 bp, Homo sapiens
ccttgaagtctggactcttaaa

SEQ ID NO: 22638 - DNA, 18 bp, Homo sapiens
gtgcactttatttctatt

SEQ ID NO: 22639 - DNA, 19 bp, Homo sapiens
cacatgtccatgcattcca

SEQ ID NO: 22640 - DNA, 24 bp, Homo sapiens
ggcccacatgcacctcaggttcaa

SEQ ID NO: 22641 - DNA, 17 bp, Homo sapiens
ctattgagcttgcaggg

SEQ ID NO: 22642 - DNA, 18 bp, Homo sapiens
agatgttattttatgtca

SEQ ID NO: 22643 - DNA, 22 bp, Homo sapiens
ccatgtgtttgtatccatgttt

SEQ ID NO: 22644 - DNA, 19 bp, Homo sapiens
ccattgattctcctacatt

SEQ ID NO: 22645 - DNA, 18 bp, Homo sapiens
aaatagtggcattgcatg

SEQ ID NO: 22646 - DNA, 22 bp, Homo sapiens
agccaccacacccagccagtga

SEQ ID NO: 22647 - DNA, 21 bp, Homo sapiens
gggcccttacccagacagaca

SEQ ID NO: 22648 - DNA, 21 bp, Homo sapiens
aaacctttagtcgaagcttct

SEQ ID NO: 22649 - DNA, 22 bp, Homo sapiens
aatgtggggaaagcttcaatca

SEQ ID NO: 22650 - DNA, 19 bp, Homo sapiens
acgctacacacccacatga

SEQ ID NO: 22651 - DNA, 18 bp, Homo sapiens
actggtgaacgttcacct

SEQ ID NO: 22652 - DNA, 18 bp, Homo sapiens
ggccacacactcctgctt

SEQ ID NO: 22653 - DNA, 18 bp, Homo sapiens
tcacacctagaacactgt

SEQ ID NO: 22654 - DNA, 18 bp, Homo sapiens
ccctgcccaccctccctc

SEQ ID NO: 22655 - DNA, 22 bp, Homo sapiens
tgggtgggcacctgagagatta

SEQ ID NO: 22656 - DNA, 19 bp, Homo sapiens
ttccttgccactggtctca

SEQ ID NO: 22657 - DNA, 17 bp, Homo sapiens
aaaaacaaacaaacaaa

SEQ ID NO: 22658 - DNA, 18 bp, Homo sapiens
ctacacctccctggaggc

SEQ ID NO: 22659 - DNA, 22 bp, Homo sapiens
tcctgaaatttgccatctgaca

SEQ ID NO: 22660 - DNA, 18 bp, Homo sapiens
tgtcctttgcaccactga

SEQ ID NO: 22661 - DNA, 24 bp, Homo sapiens
atttgaaagcaggcagcctggctc

SEQ ID NO: 22662 - DNA, 19 bp, Homo sapiens
actcatcatggaaacaaca

SEQ ID NO: 22663 - DNA, 19 bp, Homo sapiens
caccacctccacttccaga

SEQ ID NO: 22664 - DNA, 22 bp, Homo sapiens
tatttgtaaaaacaatttttgg

SEQ ID NO: 22665 - DNA, 17 bp, Homo sapiens
tcctactcatcatggaa

SEQ ID NO: 22666 - DNA, 16 bp, Homo sapiens
ccctgtttgactaagt

SEQ ID NO: 22667 - DNA, 18 bp, Homo sapiens
gtggtcaagagagttctc

SEQ ID NO: 22668 - DNA, 18 bp, Homo sapiens
aatgtcaatgaacaagca

SEQ ID NO: 22669 - DNA, 19 bp, Homo sapiens
ctggggaccagcttggctc

SEQ ID NO: 22670 - DNA, 22 bp, Homo sapiens
ggacgcgtccgacggcggccgg

SEQ ID NO: 22671 - DNA, 21 bp, Homo sapiens
ggccggacgctgaggtggtcg

SEQ ID NO: 22672 - DNA, 21 bp, Homo sapiens
agacttgaaggtgtcatgccc

SEQ ID NO: 22673 - DNA, 19 bp, Homo sapiens
catgcccggtgtgtgcagg

SEQ ID NO: 22674 - DNA, 21 bp, Homo sapiens
ccacacagtgagaactgtagc

SEQ ID NO: 22675 - DNA, 21 bp, Homo sapiens
ctcccctccacccctgcctct

SEQ ID NO: 22676 - DNA, 19 bp, Homo sapiens
ctcctccacccctgcctct

SEQ ID NO: 22677 - DNA, 19 bp, Homo sapiens
ctcctccacccctgcctct

SEQ ID NO: 22678 - DNA, 17 bp, Homo sapiens
gagagccccgcctcctc

SEQ ID NO: 22679 - DNA, 22 bp, Homo sapiens
gcctctcctccacccctgcctc

SEQ ID NO: 22680 - DNA, 21 bp, Homo sapiens
acctcaatgatcgtctgtttc

SEQ ID NO: 22681 - DNA, 15 bp, Homo sapiens
tcaataattcaccag

SEQ ID NO: 22682 - DNA, 18 bp, Homo sapiens
tgggtggatcacctgagg

SEQ ID NO: 22683 - DNA, 28 bp, Homo sapiens
ttttcaagtcattaagagtgtttgttta

SEQ ID NO: 22684 - DNA, 17 bp, Homo sapiens
aggattaagaattttgt

SEQ ID NO: 22685 - DNA, 19 bp, Homo sapiens
atgtaaatctattgtatta

SEQ ID NO: 22686 - DNA, 24 bp, Homo sapiens
cagtaccaatcttgagtttctttt

SEQ ID NO: 22687 - DNA, 19 bp, Homo sapiens
tgcgaccctctcggcccgg

SEQ ID NO: 22688 - DNA, 20 bp, Homo sapiens
tgctcggggtgaaccattct

SEQ ID NO: 22689 - DNA, 20 bp, Homo sapiens
ttgagtttctttttctgtcc

SEQ ID NO: 22690 - DNA, 21 bp, Homo sapiens
tttctggtctactttgacttt

SEQ ID NO: 22691 - DNA, 20 bp, Homo sapiens
caagaataggtccttggcca

SEQ ID NO: 22692 - DNA, 22 bp, Homo sapiens
catgtttgtttcgaatgtctga

SEQ ID NO: 22693 - DNA, 23 bp, Homo sapiens
gtatgcccatgtctatcatacct

SEQ ID NO: 22694 - DNA, 21 bp, Homo sapiens
ttgcaatcattgcagcttctt

SEQ ID NO: 22695 - DNA, 17 bp, Homo sapiens
ttttccatctccatcct

SEQ ID NO: 22696 - DNA, 18 bp, Homo sapiens
gaaaacaatgtatttgaa

SEQ ID NO: 22697 - DNA, 22 bp, Homo sapiens
acaaaggatttgcattacgtca

SEQ ID NO: 22698 - DNA, 17 bp, Homo sapiens
gagatttatatgctgta

SEQ ID NO: 22699 - DNA, 23 bp, Homo sapiens
taagtttttggatctgctactga

SEQ ID NO: 22700 - DNA, 20 bp, Homo sapiens
tcctgctctccggaccccca

SEQ ID NO: 22701 - DNA, 20 bp, Homo sapiens
taggaaattgtatcagcctc

SEQ ID NO: 22702 - DNA, 21 bp, Homo sapiens
taggaaattgtatcagcctcc

SEQ ID NO: 22703 - DNA, 25 bp, Homo sapiens
cagagctcttgggagcagaacctta

SEQ ID NO: 22704 - DNA, 22 bp, Homo sapiens
cccagaagaactctctcaaaga

SEQ ID NO: 22705 - DNA, 16 bp, Homo sapiens
gggaggggaattgcca

SEQ ID NO: 22706 - DNA, 19 bp, Homo sapiens
tcttctaaatgctgattca

SEQ ID NO: 22707 - DNA, 20 bp, Homo sapiens
tggttaaaaaaaacagatta

SEQ ID NO: 22708 - DNA, 23 bp, Homo sapiens
gcttctcctctggcatctgttag

SEQ ID NO: 22709 - DNA, 19 bp, Homo sapiens
aaatgtaataaaatttatg

SEQ ID NO: 22710 - DNA, 21 bp, Homo sapiens
acgaggttcccctcccacctc

SEQ ID NO: 22711 - DNA, 16 bp, Homo sapiens
agctatttcttccccc

SEQ ID NO: 22712 - DNA, 18 bp, Homo sapiens
aactctatggtaggatca

SEQ ID NO: 22713 - DNA, 21 bp, Homo sapiens
caaagcccaacaatgatctca

SEQ ID NO: 22714 - DNA, 19 bp, Homo sapiens
actttgttttactgtctta

SEQ ID NO: 22715 - DNA, 17 bp, Homo sapiens
ctccagctgggatcaca

SEQ ID NO: 22716 - DNA, 22 bp, Homo sapiens
ctggcctctgctgatcctccca

SEQ ID NO: 22717 - DNA, 17 bp, Homo sapiens
gaccccttaccactgct

SEQ ID NO: 22718 - DNA, 19 bp, Homo sapiens
tcctcccaggcttccgtgt

SEQ ID NO: 22719 - DNA, 19 bp, Homo sapiens
tctggttgatgcctgtgaa

SEQ ID NO: 22720 - DNA, 18 bp, Homo sapiens
tggttgatgcctgtgaac

SEQ ID NO: 22721 - DNA, 22 bp, Homo sapiens
agaaatatatctctatctctct

SEQ ID NO: 22722 - DNA, 19 bp, Homo sapiens
ctctccttccttccacctg

SEQ ID NO: 22723 - DNA, 18 bp, Homo sapiens
gttgggctgcggtgctgc

SEQ ID NO: 22724 - DNA, 18 bp, Homo sapiens
tctagaatctggcacttt

SEQ ID NO: 22725 - DNA, 18 bp, Homo sapiens
tgggtctagaatctggca

SEQ ID NO: 22726 - DNA, 21 bp, Homo sapiens
tgttggtattcagctgtgatg

SEQ ID NO: 22727 - DNA, 21 bp, Homo sapiens
ttctcctgctccttgttttcc

SEQ ID NO: 22728 - DNA, 22 bp, Homo sapiens
agtgcacagtggccccatcata

SEQ ID NO: 22729 - DNA, 22 bp, Homo sapiens
atacttctgtttccatctgctg

SEQ ID NO: 22730 - DNA, 20 bp, Homo sapiens
caaacacccacatacctggc

SEQ ID NO: 22731 - DNA, 19 bp, Homo sapiens
gcctgctccctcacccagg

SEQ ID NO: 22732 - DNA, 20 bp, Homo sapiens
ttctgcctcttaagcctgct

SEQ ID NO: 22733 - DNA, 21 bp, Homo sapiens
aatgtgataagttcttatgcc

SEQ ID NO: 22734 - DNA, 16 bp, Homo sapiens
catccacattgtttta

SEQ ID NO: 22735 - DNA, 25 bp, Homo sapiens
ttttttcacaaatttgtcttgcctt

SEQ ID NO: 22736 - DNA, 18 bp, Homo sapiens
aggtgctgacaaagatga

SEQ ID NO: 22737 - DNA, 24 bp, Homo sapiens
cccaaggtttccaagataaaacca

SEQ ID NO: 22738 - DNA, 24 bp, Homo sapiens
gcctcagacctgactgcctggttc

SEQ ID NO: 22739 - DNA, 21 bp, Homo sapiens
tatctgccttagacaaaggct

SEQ ID NO: 22740 - DNA, 18 bp, Homo sapiens
aaacacagtgagccggga

SEQ ID NO: 22741 - DNA, 23 bp, Homo sapiens
cctccccctgtaatacctcctcc

SEQ ID NO: 22742 - DNA, 20 bp, Homo sapiens
tcctccccctgtaatacctc

SEQ ID NO: 22743 - DNA, 18 bp, Homo sapiens
ttcctgtgacactctgaa

SEQ ID NO: 22744 - DNA, 17 bp, Homo sapiens
agagaggtgtgccaggt

SEQ ID NO: 22745 - DNA, 18 bp, Homo sapiens
tcagatgctcgcctgtac

SEQ ID NO: 22746 - DNA, 22 bp, Homo sapiens
cagtctcgcgggatttccccct

SEQ ID NO: 22747 - DNA, 17 bp, Homo sapiens
accacccccatgcacac

SEQ ID NO: 22748 - DNA, 21 bp, Homo sapiens
cgcaggcctgagcagcgggga

SEQ ID NO: 22749 - DNA, 24 bp, Homo sapiens
ccagagattgcccaaggactggac

SEQ ID NO: 22750 - DNA, 23 bp, Homo sapiens
cccgccccccaccaccccactcc

SEQ ID NO: 22751 - DNA, 22 bp, Homo sapiens
tgcggcccgtggcatgaggttg

SEQ ID NO: 22752 - DNA, 19 bp, Homo sapiens
acccccagacctgctccta

SEQ ID NO: 22753 - DNA, 20 bp, Homo sapiens
accctaaaaaacctgcctgt

SEQ ID NO: 22754 - DNA, 18 bp, Homo sapiens
cctggtgacagtctgtgg

SEQ ID NO: 22755 - DNA, 16 bp, Homo sapiens
ccttaccagtcgtgca

SEQ ID NO: 22756 - DNA, 19 bp, Homo sapiens
gcaggagccctcctacccg

SEQ ID NO: 22757 - DNA, 21 bp, Homo sapiens
ccctccccggctctcctccca

SEQ ID NO: 22758 - DNA, 20 bp, Homo sapiens
gccagcaggggttctggaga

SEQ ID NO: 22759 - DNA, 19 bp, Homo sapiens
ccggacgacagatattaca

SEQ ID NO: 22760 - DNA, 20 bp, Homo sapiens
gggccaggctgggccaggtc

SEQ ID NO: 22761 - DNA, 19 bp, Homo sapiens
cctcagtccatccttggta

SEQ ID NO: 22762 - DNA, 19 bp, Homo sapiens
tctcgtaattcacaaccct

SEQ ID NO: 22763 - DNA, 19 bp, Homo sapiens
aaggaacccggtgtgcaca

SEQ ID NO: 22764 - DNA, 20 bp, Homo sapiens
acatctaactcaactgtgaa

SEQ ID NO: 22765 - DNA, 21 bp, Homo sapiens
accacaggcccttccccttcc

SEQ ID NO: 22766 - DNA, 23 bp, Homo sapiens
agaagttttaaacagggctttca

SEQ ID NO: 22767 - DNA, 20 bp, Homo sapiens
atgacacttccttgctttgg

SEQ ID NO: 22768 - DNA, 19 bp, Homo sapiens
caccttttgaagcagcaac

SEQ ID NO: 22769 - DNA, 21 bp, Homo sapiens
ccttggtggttgaacttggag

SEQ ID NO: 22770 - DNA, 18 bp, Homo sapiens
cctttttgcaccgtcacc

SEQ ID NO: 22771 - DNA, 20 bp, Homo sapiens
ctctagcctggggggcttgt

SEQ ID NO: 22772 - DNA, 18 bp, Homo sapiens
ggtcctcagccctgccac

SEQ ID NO: 22773 - DNA, 18 bp, Homo sapiens
tagattgtaacccctcca

SEQ ID NO: 22774 - DNA, 21 bp, Homo sapiens
cactataaaactattaacata

SEQ ID NO: 22775 - DNA, 19 bp, Homo sapiens
ctgcaagctccgcctccca

SEQ ID NO: 22776 - DNA, 24 bp, Homo sapiens
ttctcctgcctcagccaaaccttt

SEQ ID NO: 22777 - DNA, 21 bp, Homo sapiens
ttgtagacaggtagcaaaata

SEQ ID NO: 22778 - DNA, 23 bp, Homo sapiens
gactgaaaaactgttggttcatc

SEQ ID NO: 22779 - DNA, 16 bp, Homo sapiens
gaggttctttcccaca

SEQ ID NO: 22780 - DNA, 18 bp, Homo sapiens
gtagtgggaaagatacat

SEQ ID NO: 22781 - DNA, 20 bp, Homo sapiens
taacagtctgcatcatcatc

SEQ ID NO: 22782 - DNA, 22 bp, Homo sapiens
taggtggaaagagaaatgatgt

SEQ ID NO: 22783 - DNA, 19 bp, Homo sapiens
ctggatacacttttccaca

SEQ ID NO: 22784 - DNA, 19 bp, Homo sapiens
tgaagcaatttggatttaa

SEQ ID NO: 22785 - DNA, 21 bp, Homo sapiens
aggatttccacatcttggtga

SEQ ID NO: 22786 - DNA, 23 bp, Homo sapiens
gccactcctgggggctgtgggga

SEQ ID NO: 22787 - DNA, 20 bp, Homo sapiens
gtgcaacaaagattccatac

SEQ ID NO: 22788 - DNA, 21 bp, Homo sapiens
taggtggattctgattcactg

SEQ ID NO: 22789 - DNA, 20 bp, Homo sapiens
aaagtgccccctcccgttca

SEQ ID NO: 22790 - DNA, 22 bp, Homo sapiens
aaggtcataacctcaccagcca

SEQ ID NO: 22791 - DNA, 18 bp, Homo sapiens
agaaggggacacagatcc

SEQ ID NO: 22792 - DNA, 21 bp, Homo sapiens
cccacaagaccaagcatcaca

SEQ ID NO: 22793 - DNA, 21 bp, Homo sapiens
gcaaaggtcataacctcacca

SEQ ID NO: 22794 - DNA, 27 bp, Homo sapiens
gcgccggcagcggccgcggtgggttct

SEQ ID NO: 22795 - DNA, 22 bp, Homo sapiens
acagcgcattcttctgtagaca

SEQ ID NO: 22796 - DNA, 20 bp, Homo sapiens
taggaagtatcatgtaatca

SEQ ID NO: 22797 - DNA, 19 bp, Homo sapiens
agaagcccagccccaagga

SEQ ID NO: 22798 - DNA, 21 bp, Homo sapiens
ccagccccagcacagacccaa

SEQ ID NO: 22799 - DNA, 23 bp, Homo sapiens
ccccgaggccttcgtcgtcctca

SEQ ID NO: 22800 - DNA, 21 bp, Homo sapiens
ctctatccctcctctgcctct

SEQ ID NO: 22801 - DNA, 18 bp, Homo sapiens
ttcccctaccctaagctg

SEQ ID NO: 22802 - DNA, 21 bp, Homo sapiens
atttgaacacactgtacaata

SEQ ID NO: 22803 - DNA, 21 bp, Homo sapiens
tggaagagattcacgatttca

SEQ ID NO: 22804 - DNA, 21 bp, Homo sapiens
aaggttcaagtgattctcctg

SEQ ID NO: 22805 - DNA, 23 bp, Homo sapiens
ccagcggaaggagctgtgccccg

SEQ ID NO: 22806 - DNA, 18 bp, Homo sapiens
cccaagtgtccagcctct

SEQ ID NO: 22807 - DNA, 20 bp, Homo sapiens
cccactcagcactctgccag

SEQ ID NO: 22808 - DNA, 21 bp, Homo sapiens
ccccactcagcactctgccag

SEQ ID NO: 22809 - DNA, 18 bp, Homo sapiens
cttctcctcctccccctc

SEQ ID NO: 22810 - DNA, 18 bp, Homo sapiens
cttgggctgacctgaccc

SEQ ID NO: 22811 - DNA, 18 bp, Homo sapiens
gggatggacggcttcggc

SEQ ID NO: 22812 - DNA, 17 bp, Homo sapiens
tcaagtgattctcctgc

SEQ ID NO: 22813 - DNA, 18 bp, Homo sapiens
ttttggtgaaggatctgc

SEQ ID NO: 22814 - DNA, 21 bp, Homo sapiens
gacggcggcggcggcgacggc

SEQ ID NO: 22815 - DNA, 19 bp, Homo sapiens
gatggcggcggtgactgtg

SEQ ID NO: 22816 - DNA, 19 bp, Homo sapiens
tttccacaagaggaaatgt

SEQ ID NO: 22817 - DNA, 21 bp, Homo sapiens
ccaccggacagagaactttcc

SEQ ID NO: 22818 - DNA, 17 bp, Homo sapiens
gtccccgctgctgccac

SEQ ID NO: 22819 - DNA, 16 bp, Homo sapiens
aaccttttccgttgct

SEQ ID NO: 22820 - DNA, 19 bp, Homo sapiens
actggtggggacctgggac

SEQ ID NO: 22821 - DNA, 20 bp, Homo sapiens
cccagacccggaaccagccc

SEQ ID NO: 22822 - DNA, 19 bp, Homo sapiens
gccccgccccgcctggcca

SEQ ID NO: 22823 - DNA, 20 bp, Homo sapiens
caagaagacaacttgagcca

SEQ ID NO: 22824 - DNA, 22 bp, Homo sapiens
cagaaaaaaaaatgcctggtca

SEQ ID NO: 22825 - DNA, 20 bp, Homo sapiens
ccaccgccacccagcagtca

SEQ ID NO: 22826 - DNA, 18 bp, Homo sapiens
cgcgcggcgcggggcgcg

SEQ ID NO: 22827 - DNA, 19 bp, Homo sapiens
gccacccagcagtcagaga

SEQ ID NO: 22828 - DNA, 16 bp, Homo sapiens
aataactgcagtttat

SEQ ID NO: 22829 - DNA, 21 bp, Homo sapiens
cactaatttttcactgtgcca

SEQ ID NO: 22830 - DNA, 21 bp, Homo sapiens
ctctgatttggacttcgcttt

SEQ ID NO: 22831 - DNA, 19 bp, Homo sapiens
cttcaagagggtctgtgag

SEQ ID NO: 22832 - DNA, 22 bp, Homo sapiens
gagccaagatcatactactgca

SEQ ID NO: 22833 - DNA, 19 bp, Homo sapiens
gggcagggggacttcacca

SEQ ID NO: 22834 - DNA, 17 bp, Homo sapiens
tatggccccacaagctc

SEQ ID NO: 22835 - DNA, 17 bp, Homo sapiens
tgaagatacagatccta

SEQ ID NO: 22836 - DNA, 19 bp, Homo sapiens
tgatttggacttcgctttg

SEQ ID NO: 22837 - DNA, 18 bp, Homo sapiens
tggtataaagctgtgaac

SEQ ID NO: 22838 - DNA, 26 bp, Homo sapiens
ttcttaacaattatgtgcagtgtgtg

SEQ ID NO: 22839 - DNA, 21 bp, Homo sapiens
aaacaaaatggtgccactttg

SEQ ID NO: 22840 - DNA, 20 bp, Homo sapiens
ttgtggatcagactctacac

SEQ ID NO: 22841 - DNA, 19 bp, Homo sapiens
ctgctgggcagtggcgttc

SEQ ID NO: 22842 - DNA, 18 bp, Homo sapiens
ctgggcgggggcgcgcga

SEQ ID NO: 22843 - DNA, 22 bp, Homo sapiens
ggagatgctgtcgggccgcggc

SEQ ID NO: 22844 - DNA, 17 bp, Homo sapiens
gtgagaagaaaccagaa

SEQ ID NO: 22845 - DNA, 20 bp, Homo sapiens
actgtaacattccaacatct

SEQ ID NO: 22846 - DNA, 26 bp, Homo sapiens
agtccatccttcaaatgaccactcca

SEQ ID NO: 22847 - DNA, 20 bp, Homo sapiens
gtggttttagacacgctttc

SEQ ID NO: 22848 - DNA, 20 bp, Homo sapiens
taagattctttgatcccgac

SEQ ID NO: 22849 - DNA, 20 bp, Homo sapiens
cagaaaggtgaccaagacag

SEQ ID NO: 22850 - DNA, 25 bp, Homo sapiens
ctcttcagctttgcagtggtttgtg

SEQ ID NO: 22851 - DNA, 16 bp, Homo sapiens
gaaggtgaccaagaca

SEQ ID NO: 22852 - DNA, 20 bp, Homo sapiens
gtgtgaacactgcttggctg

SEQ ID NO: 22853 - DNA, 19 bp, Homo sapiens
tccccaggagaccacgctg

SEQ ID NO: 22854 - DNA, 20 bp, Homo sapiens
tggtgccctgacagggactg

SEQ ID NO: 22855 - DNA, 21 bp, Homo sapiens
cctaagtagagagccattgct

SEQ ID NO: 22856 - DNA, 16 bp, Homo sapiens
tgggatggctctgctt

SEQ ID NO: 22857 - DNA, 18 bp, Homo sapiens
gcttcagaaatccatgga

SEQ ID NO: 22858 - DNA, 17 bp, Homo sapiens
tgcaggtccagcttctt

SEQ ID NO: 22859 - DNA, 16 bp, Homo sapiens
ttgcaaaaccttttct

SEQ ID NO: 22860 - DNA, 21 bp, Homo sapiens
acggagaaagtttacgccgac

SEQ ID NO: 22861 - DNA, 18 bp, Homo sapiens
attttgttaaaaatcaaa

SEQ ID NO: 22862 - DNA, 19 bp, Homo sapiens
ggccgagtcagatcactat

SEQ ID NO: 22863 - DNA, 19 bp, Homo sapiens
aggttgagcgcattgagaa

SEQ ID NO: 22864 - DNA, 23 bp, Homo sapiens
caaacacgaatggggatatctgt

SEQ ID NO: 22865 - DNA, 16 bp, Homo sapiens
ctggagctgtttggcc

SEQ ID NO: 22866 - DNA, 22 bp, Homo sapiens
ggatggcagcgggaccggcggc

SEQ ID NO: 22867 - DNA, 20 bp, Homo sapiens
cacaccggtgacgccgacgg

SEQ ID NO: 22868 - DNA, 24 bp, Homo sapiens
cgaaagcctgctcaccagccgcca

SEQ ID NO: 22869 - DNA, 22 bp, Homo sapiens
gagcgcctccaggccagcatct

SEQ ID NO: 22870 - DNA, 19 bp, Homo sapiens
gtttaatcaaaatgcaatg

SEQ ID NO: 22871 - DNA, 18 bp, Homo sapiens
catccactgaaacatcct

SEQ ID NO: 22872 - DNA, 23 bp, Homo sapiens
ccatcctctcaagccccaggacc

SEQ ID NO: 22873 - DNA, 17 bp, Homo sapiens
tctgtctcaggccagat

SEQ ID NO: 22874 - DNA, 18 bp, Homo sapiens
tgctatgtatgactctga

SEQ ID NO: 22875 - DNA, 22 bp, Homo sapiens
caaattaaagaaggatgtctta

SEQ ID NO: 22876 - DNA, 18 bp, Homo sapiens
cctgcaacctccacctcc

SEQ ID NO: 22877 - DNA, 19 bp, Homo sapiens
ctgcaacctccacctccca

SEQ ID NO: 22878 - DNA, 21 bp, Homo sapiens
gccctggtacttgctgtcata

SEQ ID NO: 22879 - DNA, 18 bp, Homo sapiens
tccacctcccaggttcaa

SEQ ID NO: 22880 - DNA, 18 bp, Homo sapiens
aaaaccttgatctgtgaa

SEQ ID NO: 22881 - DNA, 16 bp, Homo sapiens
cccagccccgcgcagc

SEQ ID NO: 22882 - DNA, 22 bp, Homo sapiens
acagctggagtcaaacaactta

SEQ ID NO: 22883 - DNA, 18 bp, Homo sapiens
gaaggcggcggcggcggc

SEQ ID NO: 22884 - DNA, 17 bp, Homo sapiens
ggggtcacggcgcctga

SEQ ID NO: 22885 - DNA, 20 bp, Homo sapiens
tcgagcgtgtgtttttttaa

SEQ ID NO: 22886 - DNA, 22 bp, Homo sapiens
accacaatcctcctcctcctct

SEQ ID NO: 22887 - DNA, 18 bp, Homo sapiens
caatcctcctcctcctct

SEQ ID NO: 22888 - DNA, 18 bp, Homo sapiens
caatcctcctcctcctct

SEQ ID NO: 22889 - DNA, 17 bp, Homo sapiens
tccagagatggccccag

SEQ ID NO: 22890 - DNA, 18 bp, Homo sapiens
tgtggacgtctttggaat

SEQ ID NO: 22891 - DNA, 22 bp, Homo sapiens
ccttcccatctattgccttcca

SEQ ID NO: 22892 - DNA, 19 bp, Homo sapiens
tccagctttaactcagttg

SEQ ID NO: 22893 - DNA, 19 bp, Homo sapiens
aggagggtcctgattgcca

SEQ ID NO: 22894 - DNA, 16 bp, Homo sapiens
cacccatccctgcaaa

SEQ ID NO: 22895 - DNA, 19 bp, Homo sapiens
cccacagtcttgcaggtca

SEQ ID NO: 22896 - DNA, 22 bp, Homo sapiens
cctcatcatccttctcatcgct

SEQ ID NO: 22897 - DNA, 18 bp, Homo sapiens
ctctccttgcacatctgg

SEQ ID NO: 22898 - DNA, 25 bp, Homo sapiens
ttgtcaatgcttctcttgtggcact

SEQ ID NO: 22899 - DNA, 22 bp, Homo sapiens
caacggctccaccagggtcacc

SEQ ID NO: 22900 - DNA, 22 bp, Homo sapiens
ccgagtgtccagccccacctcc

SEQ ID NO: 22901 - DNA, 17 bp, Homo sapiens
gatctgcctttatccac

SEQ ID NO: 22902 - DNA, 18 bp, Homo sapiens
gcccctgtcctgggagtc

SEQ ID NO: 22903 - DNA, 20 bp, Homo sapiens
ggcatgtggctcagcagcaa

SEQ ID NO: 22904 - DNA, 18 bp, Homo sapiens
catttgactgttcaatga

SEQ ID NO: 22905 - DNA, 21 bp, Homo sapiens
ctttcacaaaacgaaatgcta

SEQ ID NO: 22906 - DNA, 21 bp, Homo sapiens
tcttgatatctcgaactttca

SEQ ID NO: 22907 - DNA, 19 bp, Homo sapiens
tgtccaacatggtaattca

SEQ ID NO: 22908 - DNA, 18 bp, Homo sapiens
tcgcacgccttcctgcca

SEQ ID NO: 22909 - DNA, 20 bp, Homo sapiens
caaagttatagcactgttcc

SEQ ID NO: 22910 - DNA, 23 bp, Homo sapiens
tgagccaggcatccatttccaca

SEQ ID NO: 22911 - DNA, 20 bp, Homo sapiens
agaagaaatatttttcacct

SEQ ID NO: 22912 - DNA, 19 bp, Homo sapiens
agggggtcccccaccctct

SEQ ID NO: 22913 - DNA, 20 bp, Homo sapiens
caagacatcaccctctcctc

SEQ ID NO: 22914 - DNA, 18 bp, Homo sapiens
cctgtcctcttcccagtt

SEQ ID NO: 22915 - DNA, 20 bp, Homo sapiens
cggaaggcggctggtgcaca

SEQ ID NO: 22916 - DNA, 21 bp, Homo sapiens
ctcccccgccctgctggcctc

SEQ ID NO: 22917 - DNA, 16 bp, Homo sapiens
ggctaattctaagcac

SEQ ID NO: 22918 - DNA, 21 bp, Homo sapiens
tcctctctcccccttgttatt

SEQ ID NO: 22919 - DNA, 20 bp, Homo sapiens
ggttctaaaagctgtctaca

SEQ ID NO: 22920 - DNA, 23 bp, Homo sapiens
gtaaactagtcttaagcgctttt

SEQ ID NO: 22921 - DNA, 21 bp, Homo sapiens
ccttggtggctgccctgtgga

SEQ ID NO: 22922 - DNA, 18 bp, Homo sapiens
gacaattcctcctgtcag

SEQ ID NO: 22923 - DNA, 22 bp, Homo sapiens
gacggggtttcaccatgctggc

SEQ ID NO: 22924 - DNA, 21 bp, Homo sapiens
taatccatgaaggccatcttg

SEQ ID NO: 22925 - DNA, 17 bp, Homo sapiens
tgaaaagctgttggcct

SEQ ID NO: 22926 - DNA, 17 bp, Homo sapiens
tgtatctcacactatga

SEQ ID NO: 22927 - DNA, 23 bp, Homo sapiens
aatggtcaaatctctccacctct

SEQ ID NO: 22928 - DNA, 19 bp, Homo sapiens
tgctgttagaatatgttga

SEQ ID NO: 22929 - DNA, 18 bp, Homo sapiens
tttttagagatcaatgag

SEQ ID NO: 22930 - DNA, 19 bp, Homo sapiens
attgtgaaggaggcccctc

SEQ ID NO: 22931 - DNA, 20 bp, Homo sapiens
cagacctgcccgtcccctca

SEQ ID NO: 22932 - DNA, 19 bp, Homo sapiens
cctgttggtactgttccag

SEQ ID NO: 22933 - DNA, 22 bp, Homo sapiens
ccttccccagttgttcccttca

SEQ ID NO: 22934 - DNA, 20 bp, Homo sapiens
cttgaacagtttcaggttat

SEQ ID NO: 22935 - DNA, 25 bp, Homo sapiens
aaaagactccttctcccaaagaaga

SEQ ID NO: 22936 - DNA, 22 bp, Homo sapiens
gaaaacatctacaagcccccca

SEQ ID NO: 22937 - DNA, 17 bp, Homo sapiens
aactagaatgttcaaaa

SEQ ID NO: 22938 - DNA, 21 bp, Homo sapiens
cacctcagagatttttcttca

SEQ ID NO: 22939 - DNA, 18 bp, Homo sapiens
ctcagagatttttcttca

SEQ ID NO: 22940 - DNA, 19 bp, Homo sapiens
tactactagtagcaaaata

SEQ ID NO: 22941 - DNA, 17 bp, Homo sapiens
tcacttagggatgtaat

SEQ ID NO: 22942 - DNA, 20 bp, Homo sapiens
tttctgatcacgaacaatag

SEQ ID NO: 22943 - DNA, 19 bp, Homo sapiens
cactgccccccatgcctca

SEQ ID NO: 22944 - DNA, 20 bp, Homo sapiens
ctgagccgacgcccttgccc

SEQ ID NO: 22945 - DNA, 20 bp, Homo sapiens
gtgtgccccgtcctcgattg

SEQ ID NO: 22946 - DNA, 21 bp, Homo sapiens
cgcccccgtgccgcccgccgc

SEQ ID NO: 22947 - DNA, 21 bp, Homo sapiens
atcgcacagaacaccaccctc

SEQ ID NO: 22948 - DNA, 21 bp, Homo sapiens
cacgaaatcacaaactcttca

SEQ ID NO: 22949 - DNA, 21 bp, Homo sapiens
cagaagggtgaaggctgtaga

SEQ ID NO: 22950 - DNA, 18 bp, Homo sapiens
gctgtggtgtttcttgtt

SEQ ID NO: 22951 - DNA, 17 bp, Homo sapiens
ggagcgtcatacacaca

SEQ ID NO: 22952 - DNA, 16 bp, Homo sapiens
tgccgtgactgtgatg

SEQ ID NO: 22953 - DNA, 21 bp, Homo sapiens
ttcagtggagttcaggttcca

SEQ ID NO: 22954 - DNA, 22 bp, Homo sapiens
accaacccatcaacatcaagcc

SEQ ID NO: 22955 - DNA, 16 bp, Homo sapiens
acctctgctcattcca

SEQ ID NO: 22956 - DNA, 21 bp, Homo sapiens
cacttgaagcatggtgtttca

SEQ ID NO: 22957 - DNA, 15 bp, Homo sapiens
cctgttcatgaggta

SEQ ID NO: 22958 - DNA, 19 bp, Homo sapiens
ctcaaaaatgacaacactt

SEQ ID NO: 22959 - DNA, 18 bp, Homo sapiens
ggttttggcttgtgatca

SEQ ID NO: 22960 - DNA, 19 bp, Homo sapiens
agtgggtgttgtgtgtgtg

SEQ ID NO: 22961 - DNA, 19 bp, Homo sapiens
ccagcccgaaattccctcc

SEQ ID NO: 22962 - DNA, 18 bp, Homo sapiens
ctttttgggtagaagaag

SEQ ID NO: 22963 - DNA, 23 bp, Homo sapiens
gccatgttaaaagtcactgtgca

SEQ ID NO: 22964 - DNA, 18 bp, Homo sapiens
tgaatcaagtgtatttca

SEQ ID NO: 22965 - DNA, 20 bp, Homo sapiens
tgaggaaccaaaggaagcaa

SEQ ID NO: 22966 - DNA, 19 bp, Homo sapiens
ttgaatctgttcgtggtca

SEQ ID NO: 22967 - DNA, 20 bp, Homo sapiens
tttatgataatttgccattg

SEQ ID NO: 22968 - DNA, 18 bp, Homo sapiens
actgcggcatgttgacca

SEQ ID NO: 22969 - DNA, 18 bp, Homo sapiens
ccagaccccagaccctca

SEQ ID NO: 22970 - DNA, 22 bp, Homo sapiens
tctgcctctcccacattcctcc

SEQ ID NO: 22971 - DNA, 20 bp, Homo sapiens
tgcctctcccacattcctcc

SEQ ID NO: 22972 - DNA, 18 bp, Homo sapiens
tgggatggggcttctgct

SEQ ID NO: 22973 - DNA, 16 bp, Homo sapiens
ctgcctgttgctctga

SEQ ID NO: 22974 - DNA, 20 bp, Homo sapiens
tcaaacatccagggaagcca

SEQ ID NO: 22975 - DNA, 18 bp, Homo sapiens
ccaggcacctaccgctgc

SEQ ID NO: 22976 - DNA, 28 bp, Homo sapiens
agcatccttcggacctcaccacgcgaaa

SEQ ID NO: 22977 - DNA, 22 bp, Homo sapiens
caccttttggaaatgcccattg

SEQ ID NO: 22978 - DNA, 18 bp, Homo sapiens
cccacaacctccgcctcc

SEQ ID NO: 22979 - DNA, 22 bp, Homo sapiens
cttattgaacttattttgcaca

SEQ ID NO: 22980 - DNA, 16 bp, Homo sapiens
gaacatgcgaagccac

SEQ ID NO: 22981 - DNA, 30 bp, Homo sapiens
gcttctgtaggtactagctgccttgatttt

SEQ ID NO: 22982 - DNA, 18 bp, Homo sapiens
gttaactagaaaatgtga

SEQ ID NO: 22983 - DNA, 18 bp, Homo sapiens
tccgcctcctgggttcaa

SEQ ID NO: 22984 - DNA, 20 bp, Homo sapiens
tggtcaggctggtcttgaac

SEQ ID NO: 22985 - DNA, 23 bp, Homo sapiens
tgtcagtttcaattatgaaactg

SEQ ID NO: 22986 - DNA, 21 bp, Homo sapiens
aagtcagtcacagaccactgc

SEQ ID NO: 22987 - DNA, 19 bp, Homo sapiens
gccaccgcacccggcctga

SEQ ID NO: 22988 - DNA, 19 bp, Homo sapiens
tcctggaaccaagcatcca

SEQ ID NO: 22989 - DNA, 21 bp, Homo sapiens
acatatcaacacaggttttta

SEQ ID NO: 22990 - DNA, 19 bp, Homo sapiens
accatggaattatatgaaa

SEQ ID NO: 22991 - DNA, 21 bp, Homo sapiens
acctaagatggccgccggccc

SEQ ID NO: 22992 - DNA, 18 bp, Homo sapiens
cttttaagaaaacatgga

SEQ ID NO: 22993 - DNA, 22 bp, Homo sapiens
aactggctggcaccagcttcat

SEQ ID NO: 22994 - DNA, 20 bp, Homo sapiens
agaacacaagtcacatttca

SEQ ID NO: 22995 - DNA, 24 bp, Homo sapiens
tgtacagctcatactttcctgctg

SEQ ID NO: 22996 - DNA, 19 bp, Homo sapiens
aagcagtcagccttctctc

SEQ ID NO: 22997 - DNA, 18 bp, Homo sapiens
ccaatagtccctgctcct

SEQ ID NO: 22998 - DNA, 21 bp, Homo sapiens
gcctgctgagaagcgtggtgc

SEQ ID NO: 22999 - DNA, 22 bp, Homo sapiens
aaggctgggtactcagcagcca

SEQ ID NO: 23000 - DNA, 20 bp, Homo sapiens
ctctgcagtgggggttgtgg

SEQ ID NO: 23001 - DNA, 21 bp, Homo sapiens
tccaagcaccgggaagacctc

SEQ ID NO: 23002 - DNA, 21 bp, Homo sapiens
tctgctgggtgtaactgctct

SEQ ID NO: 23003 - DNA, 16 bp, Homo sapiens
ccgcggagccccggga

SEQ ID NO: 23004 - DNA, 21 bp, Homo sapiens
gtgggcagcctcacttggctg

SEQ ID NO: 23005 - DNA, 18 bp, Homo sapiens
actagtagagactgagaa

SEQ ID NO: 23006 - DNA, 18 bp, Homo sapiens
gggcattactgagagata

SEQ ID NO: 23007 - DNA, 20 bp, Homo sapiens
tcttggtggcgggcgcctgt

SEQ ID NO: 23008 - DNA, 18 bp, Homo sapiens
tgggtggatcacctgagg

SEQ ID NO: 23009 - DNA, 18 bp, Homo sapiens
cttgaaaccaggcacttt

SEQ ID NO: 23010 - DNA, 21 bp, Homo sapiens
cccgggccgccccgcatccca

SEQ ID NO: 23011 - DNA, 23 bp, Homo sapiens
tgcccagctgctgccctccccag

SEQ ID NO: 23012 - DNA, 21 bp, Homo sapiens
caggtgaaagggcagctttaa

SEQ ID NO: 23013 - DNA, 22 bp, Homo sapiens
gagccaagattgcgccactgca

SEQ ID NO: 23014 - DNA, 19 bp, Homo sapiens
ttagtgatttcacgtttaa

SEQ ID NO: 23015 - DNA, 23 bp, Homo sapiens
aagcaagcgagggacttcactct

SEQ ID NO: 23016 - DNA, 18 bp, Homo sapiens
actgtggctgttgggttt

SEQ ID NO: 23017 - DNA, 20 bp, Homo sapiens
ccctccctgtcagcacagca

SEQ ID NO: 23018 - DNA, 18 bp, Homo sapiens
ccgtgtgtcttgtctgtg

SEQ ID NO: 23019 - DNA, 19 bp, Homo sapiens
ctggctgggcttccggtgt

SEQ ID NO: 23020 - DNA, 18 bp, Homo sapiens
gctttgatcccttggtct

SEQ ID NO: 23021 - DNA, 18 bp, Homo sapiens
tccagaactttgttctag

SEQ ID NO: 23022 - DNA, 19 bp, Homo sapiens
tccggcttggctgttccag

SEQ ID NO: 23023 - DNA, 23 bp, Homo sapiens
tggggtcatagattgtccagtca

SEQ ID NO: 23024 - DNA, 19 bp, Homo sapiens
tttgttctagattccttaa

SEQ ID NO: 23025 - DNA, 17 bp, Homo sapiens
aactgagcttgttattg

SEQ ID NO: 23026 - DNA, 15 bp, Homo sapiens
acagaatggctcctc

SEQ ID NO: 23027 - DNA, 22 bp, Homo sapiens
atctgcataactcagcagtcaa

SEQ ID NO: 23028 - DNA, 18 bp, Homo sapiens
cagggttccctgggccca

SEQ ID NO: 23029 - DNA, 21 bp, Homo sapiens
cttgtacagaaccagaatcct

SEQ ID NO: 23030 - DNA, 18 bp, Homo sapiens
ctttaacccaagaaccca

SEQ ID NO: 23031 - DNA, 24 bp, Homo sapiens
aaacattcactttgtttaagctta

SEQ ID NO: 23032 - DNA, 23 bp, Homo sapiens
aacattcactttgtttaagctta

SEQ ID NO: 23033 - DNA, 20 bp, Homo sapiens
cagtaatgaaataaaaaata

SEQ ID NO: 23034 - DNA, 19 bp, Homo sapiens
acagcgcacacccagaccc

SEQ ID NO: 23035 - DNA, 17 bp, Homo sapiens
caaaccctcgccccaca

SEQ ID NO: 23036 - DNA, 23 bp, Homo sapiens
cccgccacagcctacacgcatcc

SEQ ID NO: 23037 - DNA, 18 bp, Homo sapiens
gctctgatctcccatcca

SEQ ID NO: 23038 - DNA, 16 bp, Homo sapiens
gttcaagagcaacctg

SEQ ID NO: 23039 - DNA, 18 bp, Homo sapiens
tttttatttccacaacct

SEQ ID NO: 23040 - DNA, 19 bp, Homo sapiens
accagtggcagctggtgac

SEQ ID NO: 23041 - DNA, 19 bp, Homo sapiens
cagtggcagctggtgactg

SEQ ID NO: 23042 - DNA, 20 bp, Homo sapiens
gaggccctctctgcctttcc

SEQ ID NO: 23043 - DNA, 19 bp, Homo sapiens
tgtgaatagtcatttgact

SEQ ID NO: 23044 - DNA, 24 bp, Homo sapiens
tttttctgtcaggaaaacaatgtt

SEQ ID NO: 23045 - DNA, 21 bp, Homo sapiens
acatacctgttgtttatcagc

SEQ ID NO: 23046 - DNA, 22 bp, Homo sapiens
ctgttgtttatcagccattgta

SEQ ID NO: 23047 - DNA, 24 bp, Homo sapiens
cttgaaaaatttcagaacattttt

SEQ ID NO: 23048 - DNA, 23 bp, Homo sapiens
cagcctgggcaacagacatcctg

SEQ ID NO: 23049 - DNA, 18 bp, Homo sapiens
cttgattcacccaacaaa

SEQ ID NO: 23050 - DNA, 19 bp, Homo sapiens
gtggtttttgccattttta

SEQ ID NO: 23051 - DNA, 22 bp, Homo sapiens
gccctagggattatagccagga

SEQ ID NO: 23052 - DNA, 19 bp, Homo sapiens
aatgcagttaccagaccca

SEQ ID NO: 23053 - DNA, 17 bp, Homo sapiens
cagagacaaactctttg

SEQ ID NO: 23054 - DNA, 17 bp, Homo sapiens
ctcctgcttttactttt

SEQ ID NO: 23055 - DNA, 23 bp, Homo sapiens
cttctgcaaagcgtatcatctca

SEQ ID NO: 23056 - DNA, 18 bp, Homo sapiens
cttgagagtgtttgtgaa

SEQ ID NO: 23057 - DNA, 22 bp, Homo sapiens
gcttggagtgcttgtgtggtcc

SEQ ID NO: 23058 - DNA, 19 bp, Homo sapiens
tgttggaatcctctttgaa

SEQ ID NO: 23059 - DNA, 19 bp, Homo sapiens
ttaaagttagaagctagca

SEQ ID NO: 23060 - DNA, 17 bp, Homo sapiens
ccttcagaaactgtgag

SEQ ID NO: 23061 - DNA, 18 bp, Homo sapiens
gaaaaaaaagtgtaacaa

SEQ ID NO: 23062 - DNA, 21 bp, Homo sapiens
gaatgagaaaagccttcttcc

SEQ ID NO: 23063 - DNA, 28 bp, Homo sapiens
taggatatccctcacctgttcctgatga

SEQ ID NO: 23064 - DNA, 18 bp, Homo sapiens
tctttggtgtttttttaa

SEQ ID NO: 23065 - DNA, 19 bp, Homo sapiens
ctgggagaagaataaatca

SEQ ID NO: 23066 - DNA, 17 bp, Homo sapiens
aaacatttgggaaacca

SEQ ID NO: 23067 - DNA, 22 bp, Homo sapiens
accaaaaccattattgttttaa

SEQ ID NO: 23068 - DNA, 20 bp, Homo sapiens
tctgcatagttttgatgaag

SEQ ID NO: 23069 - DNA, 19 bp, Homo sapiens
ttattgttttaaagaatga

SEQ ID NO: 23070 - DNA, 20 bp, Homo sapiens
catgtaccaggtcagtgcag

SEQ ID NO: 23071 - DNA, 21 bp, Homo sapiens
aaacagaaacccaactacccc

SEQ ID NO: 23072 - DNA, 18 bp, Homo sapiens
acccagtcccatgccaga

SEQ ID NO: 23073 - DNA, 22 bp, Homo sapiens
caaagctgaaacgctctgagca

SEQ ID NO: 23074 - DNA, 21 bp, Homo sapiens
cattttattcacatgctccca

SEQ ID NO: 23075 - DNA, 23 bp, Homo sapiens
cctctttgtctgcctttaatttt

SEQ ID NO: 23076 - DNA, 20 bp, Homo sapiens
gcaggtgggtcaatgctctc

SEQ ID NO: 23077 - DNA, 17 bp, Homo sapiens
gtcatctcttctctgga

SEQ ID NO: 23078 - DNA, 20 bp, Homo sapiens
tgttcataagagaggactga

SEQ ID NO: 23079 - DNA, 17 bp, Homo sapiens
gtcatctcttctctgga

SEQ ID NO: 23080 - DNA, 19 bp, Homo sapiens
tctcaggtcagaggcacgg

SEQ ID NO: 23081 - DNA, 18 bp, Homo sapiens
acccagtcccatgccaga

SEQ ID NO: 23082 - DNA, 17 bp, Homo sapiens
gtcatctcttctctgga

SEQ ID NO: 23083 - DNA, 25 bp, Homo sapiens
cctggtaacatttcatattgctttt

SEQ ID NO: 23084 - DNA, 21 bp, Homo sapiens
taagtgggatctgtggatctg

SEQ ID NO: 23085 - DNA, 25 bp, Homo sapiens
cctggtaacatttcatattgctttt

SEQ ID NO: 23086 - DNA, 19 bp, Homo sapiens
cttaacggtcctctggtct

SEQ ID NO: 23087 - DNA, 22 bp, Homo sapiens
atcttggctcactgcaacctct

SEQ ID NO: 23088 - DNA, 19 bp, Homo sapiens
attccaaagatggttcaga

SEQ ID NO: 23089 - DNA, 20 bp, Homo sapiens
cagcgaggtacaccaggtgg

SEQ ID NO: 23090 - DNA, 20 bp, Homo sapiens
cctctgcctcccaggttcaa

SEQ ID NO: 23091 - DNA, 19 bp, Homo sapiens
ctgcaacctctgcctccca

SEQ ID NO: 23092 - DNA, 18 bp, Homo sapiens
gactgccaccacacccag

SEQ ID NO: 23093 - DNA, 19 bp, Homo sapiens
gtgtgaagcgttgtttggc

SEQ ID NO: 23094 - DNA, 23 bp, Homo sapiens
tctttttatgacctgtttgcctt

SEQ ID NO: 23095 - DNA, 21 bp, Homo sapiens
cctcaggttcaacctgtgata

SEQ ID NO: 23096 - DNA, 23 bp, Homo sapiens
cttcaagttattttaatgctctt

SEQ ID NO: 23097 - DNA, 22 bp, Homo sapiens
ggtagaagttttctactcagct

SEQ ID NO: 23098 - DNA, 16 bp, Homo sapiens
tgcgtctgtccacttg

SEQ ID NO: 23099 - DNA, 18 bp, Homo sapiens
gtgcctcaggactgcacc

SEQ ID NO: 23100 - DNA, 25 bp, Homo sapiens
ccaggccttaatcacccccattccg

SEQ ID NO: 23101 - DNA, 18 bp, Homo sapiens
cccggccttatgcactgc

SEQ ID NO: 23102 - DNA, 21 bp, Homo sapiens
cgggcaccgcccaccgagcca

SEQ ID NO: 23103 - DNA, 23 bp, Homo sapiens
aggccgccgcactgcctcccgca

SEQ ID NO: 23104 - DNA, 21 bp, Homo sapiens
ctccgcagacccgcgcccgct

SEQ ID NO: 23105 - DNA, 20 bp, Homo sapiens
gcagctcggccccgcgctgc

SEQ ID NO: 23106 - DNA, 23 bp, Homo sapiens
aaactaaagcctgcaagcgccac

SEQ ID NO: 23107 - DNA, 17 bp, Homo sapiens
ataaagttggatgttct

SEQ ID NO: 23108 - DNA, 21 bp, Homo sapiens
atgaggggaatgcagtgtcag

SEQ ID NO: 23109 - DNA, 20 bp, Homo sapiens
attagctgttcttctacatc

SEQ ID NO: 23110 - DNA, 16 bp, Homo sapiens
catctcaaaataatta

SEQ ID NO: 23111 - DNA, 19 bp, Homo sapiens
cttcagacttaatacagca

SEQ ID NO: 23112 - DNA, 17 bp, Homo sapiens
cttttgacttaacgtca

SEQ ID NO: 23113 - DNA, 22 bp, Homo sapiens
aaaatcatccttgacatgaaac

SEQ ID NO: 23114 - DNA, 18 bp, Homo sapiens
cccactaatggtatcact

SEQ ID NO: 23115 - DNA, 18 bp, Homo sapiens
tcctgtatccggcactgc

SEQ ID NO: 23116 - DNA, 21 bp, Homo sapiens
caggacaccagctgggtccag

SEQ ID NO: 23117 - DNA, 21 bp, Homo sapiens
cccgcagcagccccggcccca

SEQ ID NO: 23118 - DNA, 17 bp, Homo sapiens
ccgcccaccgccactat

SEQ ID NO: 23119 - DNA, 20 bp, Homo sapiens
atgttgtcaaagtttctgaa

SEQ ID NO: 23120 - DNA, 18 bp, Homo sapiens
catatagtaacatgcagt

SEQ ID NO: 23121 - DNA, 18 bp, Homo sapiens
ctacaaggaacagctagt

SEQ ID NO: 23122 - DNA, 17 bp, Homo sapiens
gtgagtgtgcatgttgt

SEQ ID NO: 23123 - DNA, 19 bp, Homo sapiens
gtgtagtttttatactaca

SEQ ID NO: 23124 - DNA, 22 bp, Homo sapiens
caccaaccgggacaaaacttca

SEQ ID NO: 23125 - DNA, 18 bp, Homo sapiens
ggaaaggggacagagtga

SEQ ID NO: 23126 - DNA, 19 bp, Homo sapiens
acgaaccattcgcatatgg

SEQ ID NO: 23127 - DNA, 26 bp, Homo sapiens
ggaactgctagaacgaaccattcgca

SEQ ID NO: 23128 - DNA, 19 bp, Homo sapiens
cacagtaccactgccacca

SEQ ID NO: 23129 - DNA, 20 bp, Homo sapiens
catgctgctcacttatgtca

SEQ ID NO: 23130 - DNA, 19 bp, Homo sapiens
gggttcaagaaaaaactgc

SEQ ID NO: 23131 - DNA, 30 bp, Homo sapiens
taaagtagtggtttcttcattgtttcctca

SEQ ID NO: 23132 - DNA, 22 bp, Homo sapiens
tctatggatgtgttttgtgtga

SEQ ID NO: 23133 - DNA, 26 bp, Homo sapiens
taaatgttgattttaatatggagcta

SEQ ID NO: 23134 - DNA, 18 bp, Homo sapiens
agtgatttatcactttca

SEQ ID NO: 23135 - DNA, 19 bp, Homo sapiens
cagaatgtttattacctca

SEQ ID NO: 23136 - DNA, 21 bp, Homo sapiens
ctgcagcagatttctttgata

SEQ ID NO: 23137 - DNA, 15 bp, Homo sapiens
gttgttatttcactg

SEQ ID NO: 23138 - DNA, 20 bp, Homo sapiens
gtttattacctcataagtgc

SEQ ID NO: 23139 - DNA, 21 bp, Homo sapiens
tctgtgtactcgaattgcttt

SEQ ID NO: 23140 - DNA, 23 bp, Homo sapiens
aggaatataaaaaccaccaccct

SEQ ID NO: 23141 - DNA, 22 bp, Homo sapiens
agttttgcaccacggcaagaaa

SEQ ID NO: 23142 - DNA, 25 bp, Homo sapiens
caaacctttccaacttctcacgtca

SEQ ID NO: 23143 - DNA, 23 bp, Homo sapiens
gcaccaccaccaccacccctact

SEQ ID NO: 23144 - DNA, 20 bp, Homo sapiens
tgcaaacctttccaacttct

SEQ ID NO: 23145 - DNA, 22 bp, Homo sapiens
ttaaaaataagctgggcgtggt

SEQ ID NO: 23146 - DNA, 22 bp, Homo sapiens
attgatgcaatttgatattttt

SEQ ID NO: 23147 - DNA, 22 bp, Homo sapiens
catgctgggtgatgaaagatta

SEQ ID NO: 23148 - DNA, 22 bp, Homo sapiens
cttaagctaccagattgctttt

SEQ ID NO: 23149 - DNA, 23 bp, Homo sapiens
ttcccctgagggaatcgcttttt

SEQ ID NO: 23150 - DNA, 24 bp, Homo sapiens
tttgaaaaatgtattttatcatta

SEQ ID NO: 23151 - DNA, 16 bp, Homo sapiens
gcggtcctcccggcca

SEQ ID NO: 23152 - DNA, 23 bp, Homo sapiens
attgcattttacgcaaactttga

SEQ ID NO: 23153 - DNA, 23 bp, Homo sapiens
aaattgccatctacagtattaca

SEQ ID NO: 23154 - DNA, 20 bp, Homo sapiens
agtaagtgggaaagtgagcg

SEQ ID NO: 23155 - DNA, 23 bp, Homo sapiens
tagaagtggctgtcatacgtgaa

SEQ ID NO: 23156 - DNA, 21 bp, Homo sapiens
caaaacttagagtgatttgga

SEQ ID NO: 23157 - DNA, 23 bp, Homo sapiens
aatatcataaaaggagctggtga

SEQ ID NO: 23158 - DNA, 18 bp, Homo sapiens
acctgccacttggcatta

SEQ ID NO: 23159 - DNA, 17 bp, Homo sapiens
caagcacaagcattgtg

SEQ ID NO: 23160 - DNA, 23 bp, Homo sapiens
ccttcccctgcgtttcctctcca

SEQ ID NO: 23161 - DNA, 25 bp, Homo sapiens
ctcggtacaacctttgagaaaaaga

SEQ ID NO: 23162 - DNA, 18 bp, Homo sapiens
cttgaaaatgttgcagta

SEQ ID NO: 23163 - DNA, 20 bp, Homo sapiens
gaaactaacaaagccacatt

SEQ ID NO: 23164 - DNA, 18 bp, Homo sapiens
gatgtcagtaacattcca

SEQ ID NO: 23165 - DNA, 17 bp, Homo sapiens
gcaaaacaaaaacaatt

SEQ ID NO: 23166 - DNA, 20 bp, Homo sapiens
ggacatttaacttgatctcc

SEQ ID NO: 23167 - DNA, 20 bp, Homo sapiens
ggaggtgcggcggcggcggc

SEQ ID NO: 23168 - DNA, 22 bp, Homo sapiens
ggccggtttccgcactgccaca

SEQ ID NO: 23169 - DNA, 20 bp, Homo sapiens
tagaggatatgaaatgccat

SEQ ID NO: 23170 - DNA, 20 bp, Homo sapiens
ttctgttcgatgcactcttt

SEQ ID NO: 23171 - DNA, 22 bp, Homo sapiens
tttttgttagtgaatttggaaa

SEQ ID NO: 23172 - DNA, 19 bp, Homo sapiens
ttttttttttcctatctca

SEQ ID NO: 23173 - DNA, 24 bp, Homo sapiens
accagcacttacaagcactgtgaa

SEQ ID NO: 23174 - DNA, 20 bp, Homo sapiens
agaaaacaatttttatttgg

SEQ ID NO: 23175 - DNA, 19 bp, Homo sapiens
agttgtaaactctcttgcc

SEQ ID NO: 23176 - DNA, 16 bp, Homo sapiens
caaaaacaagcttctt

SEQ ID NO: 23177 - DNA, 19 bp, Homo sapiens
gtctgagttaaatgcactt

SEQ ID NO: 23178 - DNA, 21 bp, Homo sapiens
taccaacttagtcatcaagcc

SEQ ID NO: 23179 - DNA, 20 bp, Homo sapiens
tgccagtaccaactgggatg

SEQ ID NO: 23180 - DNA, 19 bp, Homo sapiens
ctgaaatgatttttcttcc

SEQ ID NO: 23181 - DNA, 23 bp, Homo sapiens
agcaagcaggttcaaatacagta

SEQ ID NO: 23182 - DNA, 18 bp, Homo sapiens
cagctggcaggcattcat

SEQ ID NO: 23183 - DNA, 20 bp, Homo sapiens
cagttacatagtctacaata

SEQ ID NO: 23184 - DNA, 23 bp, Homo sapiens
ctgggttcaagcaattcttctga

SEQ ID NO: 23185 - DNA, 19 bp, Homo sapiens
tcaggcataatccctaata

SEQ ID NO: 23186 - DNA, 18 bp, Homo sapiens
tccgcctcctgggttcaa

SEQ ID NO: 23187 - DNA, 19 bp, Homo sapiens
ttccagagagacattcaca

SEQ ID NO: 23188 - DNA, 24 bp, Homo sapiens
ggagccggcgacggcggcagtggc

SEQ ID NO: 23189 - DNA, 21 bp, Homo sapiens
caatcttgaggactcccggtg

SEQ ID NO: 23190 - DNA, 22 bp, Homo sapiens
ccctgggtggtggacctgtgga

SEQ ID NO: 23191 - DNA, 22 bp, Homo sapiens
gagccaagatctcgccactgca

SEQ ID NO: 23192 - DNA, 21 bp, Homo sapiens
gcctctctagggccctggtga

SEQ ID NO: 23193 - DNA, 21 bp, Homo sapiens
tactggtggttgagtcaggac

SEQ ID NO: 23194 - DNA, 19 bp, Homo sapiens
tctctactcccaggtccag

SEQ ID NO: 23195 - DNA, 19 bp, Homo sapiens
tgggccccacaagctgcca

SEQ ID NO: 23196 - DNA, 22 bp, Homo sapiens
atcttggctcactgcaacctct

SEQ ID NO: 23197 - DNA, 20 bp, Homo sapiens
cctctgcctcccaggttcaa

SEQ ID NO: 23198 - DNA, 19 bp, Homo sapiens
ctgcaacctctgcctccca

SEQ ID NO: 23199 - DNA, 18 bp, Homo sapiens
gaaaaagcctaggacatt

SEQ ID NO: 23200 - DNA, 21 bp, Homo sapiens
taaaaacgtgtaagatgtggt

SEQ ID NO: 23201 - DNA, 21 bp, Homo sapiens
tccagatccagaccctcttat

SEQ ID NO: 23202 - DNA, 17 bp, Homo sapiens
ttctcttcaacagttca

SEQ ID NO: 23203 - DNA, 23 bp, Homo sapiens
aaaaaaacaatacagctatccaa

SEQ ID NO: 23204 - DNA, 23 bp, Homo sapiens
agtggctcttaaaaacaccctca

SEQ ID NO: 23205 - DNA, 17 bp, Homo sapiens
aaactgtcctggttatg

SEQ ID NO: 23206 - DNA, 19 bp, Homo sapiens
ctgcaagctccgcctccca

SEQ ID NO: 23207 - DNA, 19 bp, Homo sapiens
ggcagagtcaagacgaact

SEQ ID NO: 23208 - DNA, 17 bp, Homo sapiens
tcattttctttttatac

SEQ ID NO: 23209 - DNA, 20 bp, Homo sapiens
caccgccacactcgagccca

SEQ ID NO: 23210 - DNA, 20 bp, Homo sapiens
agaaagagttaactgtgctg

SEQ ID NO: 23211 - DNA, 21 bp, Homo sapiens
cagcccacactctgccacctc

SEQ ID NO: 23212 - DNA, 22 bp, Homo sapiens
cccatcatgggaggcttttgga

SEQ ID NO: 23213 - DNA, 20 bp, Homo sapiens
cggcccagaaaccagagcca

SEQ ID NO: 23214 - DNA, 19 bp, Homo sapiens
gcccaaggcagcgaggctt

SEQ ID NO: 23215 - DNA, 23 bp, Homo sapiens
tctgtctcatagcacatgtgaca

SEQ ID NO: 23216 - DNA, 20 bp, Homo sapiens
tggacaacagccacaagggg

SEQ ID NO: 23217 - DNA, 23 bp, Homo sapiens
gcaggagcagcccgcaccggaca

SEQ ID NO: 23218 - DNA, 17 bp, Homo sapiens
acaaacagtgtacactc

SEQ ID NO: 23219 - DNA, 23 bp, Homo sapiens
acataaaatgtgaaagcctgtaa

SEQ ID NO: 23220 - DNA, 17 bp, Homo sapiens
ccacgtgagtgagatga

SEQ ID NO: 23221 - DNA, 19 bp, Homo sapiens
ctgtgcatcaaagggatgt

SEQ ID NO: 23222 - DNA, 19 bp, Homo sapiens
gggctgccagaggttctga

SEQ ID NO: 23223 - DNA, 20 bp, Homo sapiens
tgcagaatgtaaacagcaga

SEQ ID NO: 23224 - DNA, 21 bp, Homo sapiens
tgtaatgttcatgtcataact

SEQ ID NO: 23225 - DNA, 19 bp, Homo sapiens
ccagcccttgttctgttcc

SEQ ID NO: 23226 - DNA, 22 bp, Homo sapiens
atcttggtttgatcaaatcttt

SEQ ID NO: 23227 - DNA, 18 bp, Homo sapiens
tccacctcacaggttcaa

SEQ ID NO: 23228 - DNA, 19 bp, Homo sapiens
ttcaagcgattctcgtggc

SEQ ID NO: 23229 - DNA, 19 bp, Homo sapiens
aaactcctgacctcaggtg

SEQ ID NO: 23230 - DNA, 19 bp, Homo sapiens
aagcaattctcctgcctca

SEQ ID NO: 23231 - DNA, 18 bp, Homo sapiens
cctgcaacctccacctcc

SEQ ID NO: 23232 - DNA, 18 bp, Homo sapiens
tccacctcctaggttcaa

SEQ ID NO: 23233 - DNA, 21 bp, Homo sapiens
acacccactcactttgcaata

SEQ ID NO: 23234 - DNA, 26 bp, Homo sapiens
agccaccatgtaacccctctcacctg

SEQ ID NO: 23235 - DNA, 19 bp, Homo sapiens
gagccttcgcaactcgcga

SEQ ID NO: 23236 - DNA, 21 bp, Homo sapiens
ggatcttcaagtcccatcata

SEQ ID NO: 23237 - DNA, 19 bp, Homo sapiens
tagaaaattgaaacacaga

SEQ ID NO: 23238 - DNA, 19 bp, Homo sapiens
tcagatcctttgaaaagag

SEQ ID NO: 23239 - DNA, 19 bp, Homo sapiens
gagccttcgcaactcgcga

SEQ ID NO: 23240 - DNA, 21 bp, Homo sapiens
acacccactcactttgcaata

SEQ ID NO: 23241 - DNA, 26 bp, Homo sapiens
agccaccatgtaacccctctcacctg

SEQ ID NO: 23242 - DNA, 19 bp, Homo sapiens
gagccttcgcaactcgcga

SEQ ID NO: 23243 - DNA, 21 bp, Homo sapiens
ggatcttcaagtcccatcata

SEQ ID NO: 23244 - DNA, 19 bp, Homo sapiens
tagaaaattgaaacacaga

SEQ ID NO: 23245 - DNA, 19 bp, Homo sapiens
tcagatcctttgaaaagag

SEQ ID NO: 23246 - DNA, 19 bp, Homo sapiens
gagccttcgcaactcgcga

SEQ ID NO: 23247 - DNA, 19 bp, Homo sapiens
gagccttcgcaactcgcga

SEQ ID NO: 23248 - DNA, 19 bp, Homo sapiens
gagccttcgcaactcgcga

SEQ ID NO: 23249 - DNA, 19 bp, Homo sapiens
gagccttcgcaactcgcga

SEQ ID NO: 23250 - DNA, 18 bp, Homo sapiens
aggtaaaaagttaacagg

SEQ ID NO: 23251 - DNA, 20 bp, Homo sapiens
caccaccgcgcgcccccgct

SEQ ID NO: 23252 - DNA, 21 bp, Homo sapiens
caccaccgcgcgcccccgctc

SEQ ID NO: 23253 - DNA, 22 bp, Homo sapiens
cctttcattttgctttaagttt

SEQ ID NO: 23254 - DNA, 18 bp, Homo sapiens
gtgtatgtgagtattctc

SEQ ID NO: 23255 - DNA, 19 bp, Homo sapiens
tgctgcttctattattgcc

SEQ ID NO: 23256 - DNA, 19 bp, Homo sapiens
agtctcactctgtcaccag

SEQ ID NO: 23257 - DNA, 18 bp, Homo sapiens
ccaaataggtcacattca

SEQ ID NO: 23258 - DNA, 20 bp, Homo sapiens
cctctgcctcctgggttcaa

SEQ ID NO: 23259 - DNA, 18 bp, Homo sapiens
tccgcctcccgggttcaa

SEQ ID NO: 23260 - DNA, 23 bp, Homo sapiens
tctgaaatgaggtctcctggccc

SEQ ID NO: 23261 - DNA, 20 bp, Homo sapiens
gtgagtagggggtttatgtt

SEQ ID NO: 23262 - DNA, 19 bp, Homo sapiens
aacaagaggcccaatctca

SEQ ID NO: 23263 - DNA, 19 bp, Homo sapiens
aagcccccacagctggcca

SEQ ID NO: 23264 - DNA, 25 bp, Homo sapiens
ccggggtacaagaggcccaatctca

SEQ ID NO: 23265 - DNA, 19 bp, Homo sapiens
cgtcccttgtgacaacacc

SEQ ID NO: 23266 - DNA, 20 bp, Homo sapiens
ggcttgaagcagggctccat

SEQ ID NO: 23267 - DNA, 19 bp, Homo sapiens
ccaaggatgctgttctcag

SEQ ID NO: 23268 - DNA, 24 bp, Homo sapiens
ccctgcctttgcagggcctgtgga

SEQ ID NO: 23269 - DNA, 19 bp, Homo sapiens
gcacgtgccatggctatgt

SEQ ID NO: 23270 - DNA, 20 bp, Homo sapiens
tcatgtgaagtgcttgcaaa

SEQ ID NO: 23271 - DNA, 19 bp, Homo sapiens
cctcgggcgccagccccac

SEQ ID NO: 23272 - DNA, 19 bp, Homo sapiens
ctcccatcagccatctggt

SEQ ID NO: 23273 - DNA, 22 bp, Homo sapiens
gatctctaagctgcaaaaactg

SEQ ID NO: 23274 - DNA, 23 bp, Homo sapiens
tttgggtggagcagagtcgcttt

SEQ ID NO: 23275 - DNA, 19 bp, Homo sapiens
gcttcaactattgcccttt

SEQ ID NO: 23276 - DNA, 20 bp, Homo sapiens
gggataaactagatatagca

SEQ ID NO: 23277 - DNA, 18 bp, Homo sapiens
ggccccttccgcaatctc

SEQ ID NO: 23278 - DNA, 22 bp, Homo sapiens
aaactgtaatgaaactacattg

SEQ ID NO: 23279 - DNA, 22 bp, Homo sapiens
cctgtacctcttctctgccctc

SEQ ID NO: 23280 - DNA, 22 bp, Homo sapiens
gagccaagatcacgacactgca

SEQ ID NO: 23281 - DNA, 19 bp, Homo sapiens
ggctgccccgtttttacta

SEQ ID NO: 23282 - DNA, 22 bp, Homo sapiens
atctgaacacagaaggtgtgaa

SEQ ID NO: 23283 - DNA, 18 bp, Homo sapiens
cctcgtctgggcacctca

SEQ ID NO: 23284 - DNA, 18 bp, Homo sapiens
gaccctgggcacagggga

SEQ ID NO: 23285 - DNA, 18 bp, Homo sapiens
gccttattacgcttttca

SEQ ID NO: 23286 - DNA, 22 bp, Homo sapiens
gcttcccgcagccgcctggccc

SEQ ID NO: 23287 - DNA, 21 bp, Homo sapiens
acacccactcactttgcaata

SEQ ID NO: 23288 - DNA, 26 bp, Homo sapiens
agccaccatgtaacccctctcacctg

SEQ ID NO: 23289 - DNA, 19 bp, Homo sapiens
gagccttcgcaactcgcga

SEQ ID NO: 23290 - DNA, 21 bp, Homo sapiens
ggatcttcaagtcccatcata

SEQ ID NO: 23291 - DNA, 19 bp, Homo sapiens
tagaaaattgaaacacaga

SEQ ID NO: 23292 - DNA, 19 bp, Homo sapiens
tcagatcctttgaaaagag

SEQ ID NO: 23293 - DNA, 21 bp, Homo sapiens
acacccactcactttgcaata

SEQ ID NO: 23294 - DNA, 26 bp, Homo sapiens
agccaccatgtaacccctctcacctg

SEQ ID NO: 23295 - DNA, 19 bp, Homo sapiens
gagccttcgcaactcgcga

SEQ ID NO: 23296 - DNA, 21 bp, Homo sapiens
ggatcttcaagtcccatcata

SEQ ID NO: 23297 - DNA, 19 bp, Homo sapiens
tagaaaattgaaacacaga

SEQ ID NO: 23298 - DNA, 19 bp, Homo sapiens
tcagatcctttgaaaagag

SEQ ID NO: 23299 - DNA, 21 bp, Homo sapiens
acacccactcactttgcaata

SEQ ID NO: 23300 - DNA, 26 bp, Homo sapiens
agccaccatgtaacccctctcacctg

SEQ ID NO: 23301 - DNA, 19 bp, Homo sapiens
gagccttcgcaactcgcga

SEQ ID NO: 23302 - DNA, 21 bp, Homo sapiens
ggatcttcaagtcccatcata

SEQ ID NO: 23303 - DNA, 19 bp, Homo sapiens
tagaaaattgaaacacaga

SEQ ID NO: 23304 - DNA, 19 bp, Homo sapiens
tcagatcctttgaaaagag

SEQ ID NO: 23305 - DNA, 16 bp, Homo sapiens
aaggactttggaccat

SEQ ID NO: 23306 - DNA, 18 bp, Homo sapiens
agggtggagtatgtatca

SEQ ID NO: 23307 - DNA, 25 bp, Homo sapiens
ctttggaccataggggatctttgga

SEQ ID NO: 23308 - DNA, 21 bp, Homo sapiens
gaagaatacaagatcccgtcc

SEQ ID NO: 23309 - DNA, 22 bp, Homo sapiens
tgggtcttcccagttgagactg

SEQ ID NO: 23310 - DNA, 16 bp, Homo sapiens
aaggactttggaccat

SEQ ID NO: 23311 - DNA, 18 bp, Homo sapiens
agggtggagtatgtatca

SEQ ID NO: 23312 - DNA, 25 bp, Homo sapiens
ctttggaccataggggatctttgga

SEQ ID NO: 23313 - DNA, 21 bp, Homo sapiens
gaagaatacaagatcccgtcc

SEQ ID NO: 23314 - DNA, 22 bp, Homo sapiens
tgggtcttcccagttgagactg

SEQ ID NO: 23315 - DNA, 18 bp, Homo sapiens
acccaggccgggctgcca

SEQ ID NO: 23316 - DNA, 19 bp, Homo sapiens
gagccttcctcttcccgca

SEQ ID NO: 23317 - DNA, 20 bp, Homo sapiens
ggagaggcggcggcggcggc

SEQ ID NO: 23318 - DNA, 20 bp, Homo sapiens
ttcctcttcccgcagcacgc

SEQ ID NO: 23319 - DNA, 24 bp, Homo sapiens
cccgggcagccgccttctgagccc

SEQ ID NO: 23320 - DNA, 19 bp, Homo sapiens
atcccttagccccgcggcg

SEQ ID NO: 23321 - DNA, 19 bp, Homo sapiens
ccgcgctgacatcacaacc

SEQ ID NO: 23322 - DNA, 20 bp, Homo sapiens
gcctccgagggctgcaggga

SEQ ID NO: 23323 - DNA, 18 bp, Homo sapiens
gtcagaagtagaatcata

SEQ ID NO: 23324 - DNA, 22 bp, Homo sapiens
ctctttgtcccctcagtttatg

SEQ ID NO: 23325 - DNA, 22 bp, Homo sapiens
ggctgcgtttcctccgctatca

SEQ ID NO: 23326 - DNA, 20 bp, Homo sapiens
tcctgtgctcacctccctga

SEQ ID NO: 23327 - DNA, 20 bp, Homo sapiens
gcgggtggatcactaggtca

SEQ ID NO: 23328 - DNA, 15 bp, Homo sapiens
ctatcaaggctaaac

SEQ ID NO: 23329 - DNA, 17 bp, Homo sapiens
gactccggcctctagaa

SEQ ID NO: 23330 - DNA, 18 bp, Homo sapiens
gccttccttttttatcca

SEQ ID NO: 23331 - DNA, 17 bp, Homo sapiens
tacatattgtctccttt

SEQ ID NO: 23332 - DNA, 19 bp, Homo sapiens
ttcagcggtgactgcccag

SEQ ID NO: 23333 - DNA, 19 bp, Homo sapiens
ttcagcggtgactgcccag

SEQ ID NO: 23334 - DNA, 23 bp, Homo sapiens
atccccggcggcggcgcggggcg

SEQ ID NO: 23335 - DNA, 19 bp, Homo sapiens
ctgctgggcaccctggctc

SEQ ID NO: 23336 - DNA, 23 bp, Homo sapiens
gtcccaggtcgctggccggctct

SEQ ID NO: 23337 - DNA, 25 bp, Homo sapiens
tagttagaggttataaattgctcta

SEQ ID NO: 23338 - DNA, 26 bp, Homo sapiens
tttgttttctcccttaaccctctgaa

SEQ ID NO: 23339 - DNA, 19 bp, Homo sapiens
ccctggcttagtctggata

SEQ ID NO: 23340 - DNA, 18 bp, Homo sapiens
ctctgtgcccctgcctct

SEQ ID NO: 23341 - DNA, 22 bp, Homo sapiens
gacactcctccctccccagtga

SEQ ID NO: 23342 - DNA, 18 bp, Homo sapiens
ggtggctccgtgcagcta

SEQ ID NO: 23343 - DNA, 18 bp, Homo sapiens
cccacgctcagctccgac

SEQ ID NO: 23344 - DNA, 24 bp, Homo sapiens
ggtacctttacaggagcacctaga

SEQ ID NO: 23345 - DNA, 20 bp, Homo sapiens
tgtctctgatgggtatttgc

SEQ ID NO: 23346 - DNA, 24 bp, Homo sapiens
atcccagagcttcccaggatccct

SEQ ID NO: 23347 - DNA, 18 bp, Homo sapiens
cctgccagggggctgcgg

SEQ ID NO: 23348 - DNA, 24 bp, Homo sapiens
atcccagagcttcccaggatccct

SEQ ID NO: 23349 - DNA, 18 bp, Homo sapiens
cctgccagggggctgcgg

SEQ ID NO: 23350 - DNA, 24 bp, Homo sapiens
atcccagagcttcccaggatccct

SEQ ID NO: 23351 - DNA, 18 bp, Homo sapiens
cctgccagggggctgcgg

SEQ ID NO: 23352 - DNA, 24 bp, Homo sapiens
atcccagagcttcccaggatccct

SEQ ID NO: 23353 - DNA, 18 bp, Homo sapiens
cctgccagggggctgcgg

SEQ ID NO: 23354 - DNA, 19 bp, Homo sapiens
gggcagcaggaactttgcc

SEQ ID NO: 23355 - DNA, 20 bp, Homo sapiens
tcagcaggaggctgccggaa

SEQ ID NO: 23356 - DNA, 21 bp, Homo sapiens
tctgccatacgcgggcgctgc

SEQ ID NO: 23357 - DNA, 17 bp, Homo sapiens
tgaaagacctgaaactc

SEQ ID NO: 23358 - DNA, 17 bp, Homo sapiens
tgaaagacctgaaactc

SEQ ID NO: 23359 - DNA, 17 bp, Homo sapiens
ttctgtcttccttcatt

SEQ ID NO: 23360 - DNA, 20 bp, Homo sapiens
cattgtccctgaatgctcca

SEQ ID NO: 23361 - DNA, 19 bp, Homo sapiens
cgcacggtacccgtgctgc

SEQ ID NO: 23362 - DNA, 21 bp, Homo sapiens
gcacaagccacggcggactct

SEQ ID NO: 23363 - DNA, 19 bp, Homo sapiens
gcttgaaaagccgcggaac

SEQ ID NO: 23364 - DNA, 17 bp, Homo sapiens
tcactcccagacattca

SEQ ID NO: 23365 - DNA, 20 bp, Homo sapiens
cattgtccctgaatgctcca

SEQ ID NO: 23366 - DNA, 21 bp, Homo sapiens
gcacaagccacggcggactct

SEQ ID NO: 23367 - DNA, 19 bp, Homo sapiens
gcttgaaaagccgcggaac

SEQ ID NO: 23368 - DNA, 17 bp, Homo sapiens
tcactcccagacattca

SEQ ID NO: 23369 - DNA, 18 bp, Homo sapiens
ccctctccctccacctcc

SEQ ID NO: 23370 - DNA, 21 bp, Homo sapiens
cctccctgccacaggcactgc

SEQ ID NO: 23371 - DNA, 19 bp, Homo sapiens
cgcacggtacccgtgctgc

SEQ ID NO: 23372 - DNA, 18 bp, Homo sapiens
ctgttttgccttcaccca

SEQ ID NO: 23373 - DNA, 21 bp, Homo sapiens
gcacaagccacggcggactct

SEQ ID NO: 23374 - DNA, 22 bp, Homo sapiens
gctacttttgctgttttatttt

SEQ ID NO: 23375 - DNA, 19 bp, Homo sapiens
gcttgaaaagccgcggaac

SEQ ID NO: 23376 - DNA, 19 bp, Homo sapiens
cgcacggtacccgtgctgc

SEQ ID NO: 23377 - DNA, 21 bp, Homo sapiens
gcacaagccacggcggactct

SEQ ID NO: 23378 - DNA, 19 bp, Homo sapiens
gcttgaaaagccgcggaac

SEQ ID NO: 23379 - DNA, 18 bp, Homo sapiens
ccccgactccgcacccca

SEQ ID NO: 23380 - DNA, 17 bp, Homo sapiens
ctccttcagccacctgg

SEQ ID NO: 23381 - DNA, 24 bp, Homo sapiens
gtggaaaccgcctgggaattccgg

SEQ ID NO: 23382 - DNA, 19 bp, Homo sapiens
tcaaacattcatgatggat

SEQ ID NO: 23383 - DNA, 19 bp, Homo sapiens
tcttcaattttttaagcaa

SEQ ID NO: 23384 - DNA, 19 bp, Homo sapiens
tgcctatgctgacattcca

SEQ ID NO: 23385 - DNA, 17 bp, Homo sapiens
tgggactgcattctgaa

SEQ ID NO: 23386 - DNA, 19 bp, Homo sapiens
tgtggatgttaccttgctt

SEQ ID NO: 23387 - DNA, 25 bp, Homo sapiens
atatcccaccatcacctcaaaccca

SEQ ID NO: 23388 - DNA, 18 bp, Homo sapiens
tttgcttacagtgcatca

SEQ ID NO: 23389 - DNA, 23 bp, Homo sapiens
accagacagacagatactgtgaa

SEQ ID NO: 23390 - DNA, 18 bp, Homo sapiens
caaagtcacctttctctc

SEQ ID NO: 23391 - DNA, 21 bp, Homo sapiens
caccacctgggaagcccttct

SEQ ID NO: 23392 - DNA, 24 bp, Homo sapiens
gaaacagagcacaggctgtctgca

SEQ ID NO: 23393 - DNA, 21 bp, Homo sapiens
gcacgtgtagagtttttgtca

SEQ ID NO: 23394 - DNA, 25 bp, Homo sapiens
gcgctctgctgttgccggtgagtct

SEQ ID NO: 23395 - DNA, 18 bp, Homo sapiens
ggttccgcccacttcttc

SEQ ID NO: 23396 - DNA, 23 bp, Homo sapiens
gtctgcaccacatacatggacac

SEQ ID NO: 23397 - DNA, 23 bp, Homo sapiens
gtgaaccctgaggagtggagtca

SEQ ID NO: 23398 - DNA, 23 bp, Homo sapiens
gtgaaccctgaggagtggagtca

SEQ ID NO: 23399 - DNA, 20 bp, Homo sapiens
tctgtagaaaacgttaattt

SEQ ID NO: 23400 - DNA, 18 bp, Homo sapiens
tggttattacaagagatt

SEQ ID NO: 23401 - DNA, 21 bp, Homo sapiens
tcatcctgatggaactattca

SEQ ID NO: 23402 - DNA, 18 bp, Homo sapiens
tcctgatggaactattca

SEQ ID NO: 23403 - DNA, 21 bp, Homo sapiens
accacctgagcccactgggca

SEQ ID NO: 23404 - DNA, 20 bp, Homo sapiens
ccctgcaggcaggtctgtgg

SEQ ID NO: 23405 - DNA, 20 bp, Homo sapiens
gcacgagggggcggctggga

SEQ ID NO: 23406 - DNA, 21 bp, Homo sapiens
ttttgtcagctgtttagcctt

SEQ ID NO: 23407 - DNA, 21 bp, Homo sapiens
ccatctctggaggtctcagga

SEQ ID NO: 23408 - DNA, 21 bp, Homo sapiens
ccctggtcaagaatctgtgag

SEQ ID NO: 23409 - DNA, 20 bp, Homo sapiens
cctggtcaagaatctgtgag

SEQ ID NO: 23410 - DNA, 20 bp, Homo sapiens
taattgtttagggtatcata

SEQ ID NO: 23411 - DNA, 18 bp, Homo sapiens
aatgaagaatgatgttat

SEQ ID NO: 23412 - DNA, 22 bp, Homo sapiens
gcggcccgaggccgtgcgcgag

SEQ ID NO: 23413 - DNA, 16 bp, Homo sapiens
ttaaggactttccact

SEQ ID NO: 23414 - DNA, 18 bp, Homo sapiens
actgcaacttccacctcc

SEQ ID NO: 23415 - DNA, 19 bp, Homo sapiens
agacagcatcttgctcctc

SEQ ID NO: 23416 - DNA, 18 bp, Homo sapiens
ccacccacctctgcctcc

SEQ ID NO: 23417 - DNA, 25 bp, Homo sapiens
ctggaattacaggcacctgccacta

SEQ ID NO: 23418 - DNA, 20 bp, Homo sapiens
cttttttattctttgacctt

SEQ ID NO: 23419 - DNA, 21 bp, Homo sapiens
gggcaacactatgcctggtta

SEQ ID NO: 23420 - DNA, 17 bp, Homo sapiens
tcagatggctgtgacta

SEQ ID NO: 23421 - DNA, 25 bp, Homo sapiens
tgcccacccccctgtcccccgagct

SEQ ID NO: 23422 - DNA, 20 bp, Homo sapiens
acctgccaccagccatggca

SEQ ID NO: 23423 - DNA, 16 bp, Homo sapiens
acagattaagcattga

SEQ ID NO: 23424 - DNA, 20 bp, Homo sapiens
ccactgagccactctctgaa

SEQ ID NO: 23425 - DNA, 19 bp, Homo sapiens
cccgcccgtacctgcactt

SEQ ID NO: 23426 - DNA, 25 bp, Homo sapiens
gtccgttgcagtttcaccaaatgta

SEQ ID NO: 23427 - DNA, 23 bp, Homo sapiens
tgaaagaacagattaagcattga

SEQ ID NO: 23428 - DNA, 20 bp, Homo sapiens
ccctgggcctgggtctgcgg

SEQ ID NO: 23429 - DNA, 19 bp, Homo sapiens
ctcccccagccactcccca

SEQ ID NO: 23430 - DNA, 18 bp, Homo sapiens
ctttgccatctctgctcc

SEQ ID NO: 23431 - DNA, 22 bp, Homo sapiens
gaggccatctggagagcccaga

SEQ ID NO: 23432 - DNA, 28 bp, Homo sapiens
gcagttctcccgtgagagggccttcgcg

SEQ ID NO: 23433 - DNA, 20 bp, Homo sapiens
gccgccctctcagtttcggg

SEQ ID NO: 23434 - DNA, 26 bp, Homo sapiens
tcctgcttcacaaaatggccaccgca

SEQ ID NO: 23435 - DNA, 23 bp, Homo sapiens
acagcctgctcccagtgctgtgt

SEQ ID NO: 23436 - DNA, 20 bp, Homo sapiens
catccccaccctgtgtacac

SEQ ID NO: 23437 - DNA, 16 bp, Homo sapiens
ccacactccctcctct

SEQ ID NO: 23438 - DNA, 16 bp, Homo sapiens
cccctgggatggctca

SEQ ID NO: 23439 - DNA, 19 bp, Homo sapiens
ctggttatttctcctctct

SEQ ID NO: 23440 - DNA, 21 bp, Homo sapiens
ggaggaggctggggtggaacc

SEQ ID NO: 23441 - DNA, 21 bp, Homo sapiens
tccttatgcgcactctcaaca

SEQ ID NO: 23442 - DNA, 18 bp, Homo sapiens
tggctcggggtggagcta

SEQ ID NO: 23443 - DNA, 25 bp, Homo sapiens
tggggcttgagctggagctcggtta

SEQ ID NO: 23444 - DNA, 19 bp, Homo sapiens
aagtatgaaaatgatttat

SEQ ID NO: 23445 - DNA, 21 bp, Homo sapiens
cacctagaacctccctccttt

SEQ ID NO: 23446 - DNA, 17 bp, Homo sapiens
cctctccttccaacaaa

SEQ ID NO: 23447 - DNA, 19 bp, Homo sapiens
gtgaatggggaagggagtc

SEQ ID NO: 23448 - DNA, 23 bp, Homo sapiens
tgaaggtatcttaggtggagcta

SEQ ID NO: 23449 - DNA, 22 bp, Homo sapiens
tatttcatcttcttcctttccc

SEQ ID NO: 23450 - DNA, 24 bp, Homo sapiens
ttctactgggcataattatatctt

SEQ ID NO: 23451 - DNA, 18 bp, Homo sapiens
cgatcctcccctggactc

SEQ ID NO: 23452 - DNA, 21 bp, Homo sapiens
caaaagggccatctctgccct

SEQ ID NO: 23453 - DNA, 18 bp, Homo sapiens
ccgagtccctttatgtca

SEQ ID NO: 23454 - DNA, 17 bp, Homo sapiens
gccccaggccactgtca

SEQ ID NO: 23455 - DNA, 22 bp, Homo sapiens
ggaaagctgcaataaagccaca

SEQ ID NO: 23456 - DNA, 19 bp, Homo sapiens
ggccgggtgcggtggctca

SEQ ID NO: 23457 - DNA, 17 bp, Homo sapiens
acaagaaaacatttaca

SEQ ID NO: 23458 - DNA, 16 bp, Homo sapiens
gcccaccaggcttctt

SEQ ID NO: 23459 - DNA, 22 bp, Homo sapiens
gggtccacacggcggctgctgc

SEQ ID NO: 23460 - DNA, 21 bp, Homo sapiens
gcacgtgtctggtcacatcca

SEQ ID NO: 23461 - DNA, 20 bp, Homo sapiens
ggcttctgtggttgctccca

SEQ ID NO: 23462 - DNA, 20 bp, Homo sapiens
ttctgaaataaagcatctcc

SEQ ID NO: 23463 - DNA, 20 bp, Homo sapiens
cctgacttttctttgtgaga

SEQ ID NO: 23464 - DNA, 20 bp, Homo sapiens
ctcttgaggctctggagtcc

SEQ ID NO: 23465 - DNA, 21 bp, Homo sapiens
actttcctgtgccttttgcat

SEQ ID NO: 23466 - DNA, 18 bp, Homo sapiens
ggtctcaagatggaactg

SEQ ID NO: 23467 - DNA, 21 bp, Homo sapiens
aagagaggctctcaaactttg

SEQ ID NO: 23468 - DNA, 24 bp, Homo sapiens
acctggactcggcgcgcctagctc

SEQ ID NO: 23469 - DNA, 21 bp, Homo sapiens
gcggagccttggagctgagcc

SEQ ID NO: 23470 - DNA, 20 bp, Homo sapiens
aagagaggtagaatggtgct

SEQ ID NO: 23471 - DNA, 23 bp, Homo sapiens
taggtgggaaggtggcatgggat

SEQ ID NO: 23472 - DNA, 24 bp, Homo sapiens
tgtaggaaaatatagttgtgggtg

SEQ ID NO: 23473 - DNA, 18 bp, Homo sapiens
gtcataagtcctttgtga

SEQ ID NO: 23474 - DNA, 23 bp, Homo sapiens
gttttggaatctgccttatacct

SEQ ID NO: 23475 - DNA, 25 bp, Homo sapiens
acaccctgggggcagctctctgcca

SEQ ID NO: 23476 - DNA, 20 bp, Homo sapiens
cgagaccggccttgtctgct

SEQ ID NO: 23477 - DNA, 21 bp, Homo sapiens
cttccacagagctcgtttgca

SEQ ID NO: 23478 - DNA, 19 bp, Homo sapiens
gtccaggagcagcagagga

SEQ ID NO: 23479 - DNA, 21 bp, Homo sapiens
acagggagggctgatacctcc

SEQ ID NO: 23480 - DNA, 23 bp, Homo sapiens
ctctggtgtgtgaaggtcggtgg

SEQ ID NO: 23481 - DNA, 21 bp, Homo sapiens
agagggtgagagccaccatca

SEQ ID NO: 23482 - DNA, 17 bp, Homo sapiens
atccacacagggctttt

SEQ ID NO: 23483 - DNA, 21 bp, Homo sapiens
cattaccacatccacacaggg

SEQ ID NO: 23484 - DNA, 17 bp, Homo sapiens
gtgactaaaagcccctg

SEQ ID NO: 23485 - DNA, 21 bp, Homo sapiens
acaatgttggcacaagactca

SEQ ID NO: 23486 - DNA, 19 bp, Homo sapiens
ctcagccggtcatgttgaa

SEQ ID NO: 23487 - DNA, 19 bp, Homo sapiens
ctgcaacatattcatcatc

SEQ ID NO: 23488 - DNA, 18 bp, Homo sapiens
agcatgaatgttaaccca

SEQ ID NO: 23489 - DNA, 17 bp, Homo sapiens
gcggggtgggggctgcc

SEQ ID NO: 23490 - DNA, 22 bp, Homo sapiens
acccaccaccacacccagctca

SEQ ID NO: 23491 - DNA, 20 bp, Homo sapiens
cctctgcctcccgggttcaa

SEQ ID NO: 23492 - DNA, 24 bp, Homo sapiens
ggagccggcgacggcggcagtggc

SEQ ID NO: 23493 - DNA, 18 bp, Homo sapiens
tggagtgatgtggagcta

SEQ ID NO: 23494 - DNA, 20 bp, Homo sapiens
ttccacacagcgcctgtaga

SEQ ID NO: 23495 - DNA, 25 bp, Homo sapiens
taaaagccagaagcatcttgtaata

SEQ ID NO: 23496 - DNA, 23 bp, Homo sapiens
tctgccttccttctgctttttgg

SEQ ID NO: 23497 - DNA, 21 bp, Homo sapiens
aaacacagctgatttcagtgg

SEQ ID NO: 23498 - DNA, 22 bp, Homo sapiens
gttccttacaatatctttctca

SEQ ID NO: 23499 - DNA, 21 bp, Homo sapiens
gccacctcgggaaagagttta

SEQ ID NO: 23500 - DNA, 21 bp, Homo sapiens
tttcactcactatttcacttt

SEQ ID NO: 23501 - DNA, 18 bp, Homo sapiens
atcccagctaacgtggca

SEQ ID NO: 23502 - DNA, 17 bp, Homo sapiens
atcttcccaatgaggaa

SEQ ID NO: 23503 - DNA, 23 bp, Homo sapiens
ccaagacttgagttggcaactca

SEQ ID NO: 23504 - DNA, 20 bp, Homo sapiens
cgtgggtggctctccttttg

SEQ ID NO: 23505 - DNA, 19 bp, Homo sapiens
gcctgacccaggccggcca

SEQ ID NO: 23506 - DNA, 22 bp, Homo sapiens
ggcctggtctgatctcatttta

SEQ ID NO: 23507 - DNA, 20 bp, Homo sapiens
atcaagcaggaacccctgga

SEQ ID NO: 23508 - DNA, 19 bp, Homo sapiens
atgcacccccaggcttcaa

SEQ ID NO: 23509 - DNA, 23 bp, Homo sapiens
gatgcagccctaactgcaaaagt

SEQ ID NO: 23510 - DNA, 20 bp, Homo sapiens
ggggtcactgggcctggcca

SEQ ID NO: 23511 - DNA, 24 bp, Homo sapiens
gtggttctgtagggacctttgtca

SEQ ID NO: 23512 - DNA, 16 bp, Homo sapiens
aaaccacatctctact

SEQ ID NO: 23513 - DNA, 24 bp, Homo sapiens
agcctggccaacatggcaaaacca

SEQ ID NO: 23514 - DNA, 19 bp, Homo sapiens
caacattcactatgtttgc

SEQ ID NO: 23515 - DNA, 18 bp, Homo sapiens
ccaggctcctattgaagg

SEQ ID NO: 23516 - DNA, 19 bp, Homo sapiens
ctgagaagcaacttgcatt

SEQ ID NO: 23517 - DNA, 22 bp, Homo sapiens
gaaccaagattgcaccactgca

SEQ ID NO: 23518 - DNA, 20 bp, Homo sapiens
taaatatctatttattatta

SEQ ID NO: 23519 - DNA, 18 bp, Homo sapiens
atgggacggctcctctga

SEQ ID NO: 23520 - DNA, 17 bp, Homo sapiens
caaccttccctagcccc

SEQ ID NO: 23521 - DNA, 25 bp, Homo sapiens
cccgaagagggctcggaggatgagc

SEQ ID NO: 23522 - DNA, 22 bp, Homo sapiens
cctctttgtggttgccttcact

SEQ ID NO: 23523 - DNA, 24 bp, Homo sapiens
cttcctgggccctcattgctgctt

SEQ ID NO: 23524 - DNA, 19 bp, Homo sapiens
tcctggtcagctgcgtgga

SEQ ID NO: 23525 - DNA, 19 bp, Homo sapiens
tctctccgcttcttgcaca

SEQ ID NO: 23526 - DNA, 19 bp, Homo sapiens
tgggcttgccacagcccca

SEQ ID NO: 23527 - DNA, 25 bp, Homo sapiens
cctgacacctggctgttttgatgtt

SEQ ID NO: 23528 - DNA, 17 bp, Homo sapiens
gtttctaattggaatgc

SEQ ID NO: 23529 - DNA, 20 bp, Homo sapiens
tttttttgtggcttcacttg

SEQ ID NO: 23530 - DNA, 18 bp, Homo sapiens
acgtgtgcagctcagcca

SEQ ID NO: 23531 - DNA, 18 bp, Homo sapiens
tcccaaatgatgctccag

SEQ ID NO: 23532 - DNA, 25 bp, Homo sapiens
ataatagacaaaagaaaatggcaca

SEQ ID NO: 23533 - DNA, 18 bp, Homo sapiens
atcctgcttcaagtcagc

SEQ ID NO: 23534 - DNA, 21 bp, Homo sapiens
gcagaaactaaagccttttta

SEQ ID NO: 23535 - DNA, 21 bp, Homo sapiens
cctctgctgctgccttggctt

SEQ ID NO: 23536 - DNA, 20 bp, Homo sapiens
ctccacaccccactgcctct

SEQ ID NO: 23537 - DNA, 19 bp, Homo sapiens
gaagccccagagaatctaa

SEQ ID NO: 23538 - DNA, 21 bp, Homo sapiens
gactggcaggtgactccctca

SEQ ID NO: 23539 - DNA, 19 bp, Homo sapiens
gattcagctcccatccctc

SEQ ID NO: 23540 - DNA, 21 bp, Homo sapiens
agtctcactctgttgcccagc

SEQ ID NO: 23541 - DNA, 22 bp, Homo sapiens
ccatggccgcctgcacagccag

SEQ ID NO: 23542 - DNA, 17 bp, Homo sapiens
ctgttttgctttgtttt

SEQ ID NO: 23543 - DNA, 19 bp, Homo sapiens
gcagtcacccgcgagtttt

SEQ ID NO: 23544 - DNA, 26 bp, Homo sapiens
gtgtcttcatggttgccgtgggtttt

SEQ ID NO: 23545 - DNA, 22 bp, Homo sapiens
tcctacccttgttgccatccca

SEQ ID NO: 23546 - DNA, 22 bp, Homo sapiens
accataggggaaagtttgggga

SEQ ID NO: 23547 - DNA, 18 bp, Homo sapiens
attatattgaaagtaaat

SEQ ID NO: 23548 - DNA, 18 bp, Homo sapiens
cagttaggagtcatggat

SEQ ID NO: 23549 - DNA, 23 bp, Homo sapiens
cttgggtttctgagtctgctttt

SEQ ID NO: 23550 - DNA, 18 bp, Homo sapiens
atgaaaggagggttctga

SEQ ID NO: 23551 - DNA, 18 bp, Homo sapiens
gaggaatggagattgcca

SEQ ID NO: 23552 - DNA, 19 bp, Homo sapiens
ccagggtcagctgttccag

SEQ ID NO: 23553 - DNA, 20 bp, Homo sapiens
atcagaagctcaccaaagca

SEQ ID NO: 23554 - DNA, 17 bp, Homo sapiens
attgccctcaacagcca

SEQ ID NO: 23555 - DNA, 15 bp, Homo sapiens
ggcctccttcccaca

SEQ ID NO: 23556 - DNA, 18 bp, Homo sapiens
gccacttgtaactgcaca

SEQ ID NO: 23557 - DNA, 18 bp, Homo sapiens
ggcttctgtgtgcctgtt

SEQ ID NO: 23558 - DNA, 20 bp, Homo sapiens
attccccccagtgctgctgc

SEQ ID NO: 23559 - DNA, 17 bp, Homo sapiens
caggcctccacctcccc

SEQ ID NO: 23560 - DNA, 21 bp, Homo sapiens
ccagagcagagctggagctga

SEQ ID NO: 23561 - DNA, 18 bp, Homo sapiens
ttgcgaccgcttgagccc

SEQ ID NO: 23562 - DNA, 19 bp, Homo sapiens
ctcacagcaactccattaa

SEQ ID NO: 23563 - DNA, 15 bp, Homo sapiens
ggccccaagctgaca

SEQ ID NO: 23564 - DNA, 18 bp, Homo sapiens
tcacgccgtagcctgtta

SEQ ID NO: 23565 - DNA, 21 bp, Homo sapiens
tggccctatcagcctgtgaac

SEQ ID NO: 23566 - DNA, 17 bp, Homo sapiens
accagagacaaatcaga

SEQ ID NO: 23567 - DNA, 19 bp, Homo sapiens
ccctgccatagccttgatg

SEQ ID NO: 23568 - DNA, 19 bp, Homo sapiens
cgcatcctgcacctgccac

SEQ ID NO: 23569 - DNA, 23 bp, Homo sapiens
ctgggcacaagccacctgccaaa

SEQ ID NO: 23570 - DNA, 16 bp, Homo sapiens
aagaaattagatccca

SEQ ID NO: 23571 - DNA, 19 bp, Homo sapiens
aagtagaatcacatgtaac

SEQ ID NO: 23572 - DNA, 18 bp, Homo sapiens
ttcaaaatcatttggaga

SEQ ID NO: 23573 - DNA, 20 bp, Homo sapiens
cgcgccgcccgtgcccgcgc

SEQ ID NO: 23574 - DNA, 23 bp, Homo sapiens
cgcgcgccacaccccagcgcgct

SEQ ID NO: 23575 - DNA, 19 bp, Homo sapiens
tgcctgctgctcttctcgg

SEQ ID NO: 23576 - DNA, 19 bp, Homo sapiens
ctcttcaaactgtgacttt

SEQ ID NO: 23577 - DNA, 18 bp, Homo sapiens
gccaagatggagatgcca

SEQ ID NO: 23578 - DNA, 20 bp, Homo sapiens
acaatgtggggtcggagctt

SEQ ID NO: 23579 - DNA, 23 bp, Homo sapiens
acggccatagctgtggactctct

SEQ ID NO: 23580 - DNA, 18 bp, Homo sapiens
agtattgcccccgtgttg

SEQ ID NO: 23581 - DNA, 16 bp, Homo sapiens
ccagcccacccacctt

SEQ ID NO: 23582 - DNA, 20 bp, Homo sapiens
ccagctaaataccctgcctg

SEQ ID NO: 23583 - DNA, 22 bp, Homo sapiens
cccatggcttccatctgagcca

SEQ ID NO: 23584 - DNA, 19 bp, Homo sapiens
ctgggccggggctgggctt

SEQ ID NO: 23585 - DNA, 17 bp, Homo sapiens
ggacggggcgcccgcgc

SEQ ID NO: 23586 - DNA, 18 bp, Homo sapiens
tccctgccacaacctgca

SEQ ID NO: 23587 - DNA, 26 bp, Homo sapiens
tctctggcacagtttgccttggcctt

SEQ ID NO: 23588 - DNA, 22 bp, Homo sapiens
tggtcccgggaattctgtgaac

SEQ ID NO: 23589 - DNA, 16 bp, Homo sapiens
caaggaggggactttc

SEQ ID NO: 23590 - DNA, 22 bp, Homo sapiens
tttctaataaatgattgctgta

SEQ ID NO: 23591 - DNA, 23 bp, Homo sapiens
agaccagcctcggcaacatgcca

SEQ ID NO: 23592 - DNA, 20 bp, Homo sapiens
cgcccagggcctgtgttcca

SEQ ID NO: 23593 - DNA, 18 bp, Homo sapiens
gcagtgaccacctcccct

SEQ ID NO: 23594 - DNA, 18 bp, Homo sapiens
ggggcagaacccctctta

SEQ ID NO: 23595 - DNA, 18 bp, Homo sapiens
ccagaggaagcctgtgta

SEQ ID NO: 23596 - DNA, 22 bp, Homo sapiens
ccagaccctggggcagcccctc

SEQ ID NO: 23597 - DNA, 21 bp, Homo sapiens
ccccgctccgccccccgccgc

SEQ ID NO: 23598 - DNA, 21 bp, Homo sapiens
cccttcatggcttgcctcctg

SEQ ID NO: 23599 - DNA, 21 bp, Homo sapiens
gccctggtccagcagggactg

SEQ ID NO: 23600 - DNA, 17 bp, Homo sapiens
tacagatgtgacctatc

SEQ ID NO: 23601 - DNA, 16 bp, Homo sapiens
tccccatcttcttgca

SEQ ID NO: 23602 - DNA, 21 bp, Homo sapiens
tttgacatgggaaaggagttg

SEQ ID NO: 23603 - DNA, 21 bp, Homo sapiens
gcccttgcggcctcctggccc

SEQ ID NO: 23604 - DNA, 16 bp, Homo sapiens
tccagaagctgcccag

SEQ ID NO: 23605 - DNA, 18 bp, Homo sapiens
tgggtggatcgcctgagg

SEQ ID NO: 23606 - DNA, 18 bp, Homo sapiens
gtcgccggagctgcaatg

SEQ ID NO: 23607 - DNA, 22 bp, Homo sapiens
aggccacacccactccaggaca

SEQ ID NO: 23608 - DNA, 22 bp, Homo sapiens
gcagccatagaggagagctttc

SEQ ID NO: 23609 - DNA, 23 bp, Homo sapiens
gtaggtttctctctgtaataaca

SEQ ID NO: 23610 - DNA, 21 bp, Homo sapiens
tcttggctccctgccatcagc

SEQ ID NO: 23611 - DNA, 21 bp, Homo sapiens
agtccatgagtgtgcacttca

SEQ ID NO: 23612 - DNA, 19 bp, Homo sapiens
aggaaatgtcttgactccc

SEQ ID NO: 23613 - DNA, 19 bp, Homo sapiens
ccagatccagagatcccca

SEQ ID NO: 23614 - DNA, 21 bp, Homo sapiens
ctctgtgggcagggcttgtgg

SEQ ID NO: 23615 - DNA, 18 bp, Homo sapiens
tccagagcagaggaatct

SEQ ID NO: 23616 - DNA, 23 bp, Homo sapiens
tggacactcaggcacagagtggc

SEQ ID NO: 23617 - DNA, 21 bp, Homo sapiens
tgtgggcagggcttgtgggtg

SEQ ID NO: 23618 - DNA, 17 bp, Homo sapiens
ttccagagatgcactcc

SEQ ID NO: 23619 - DNA, 19 bp, Homo sapiens
ggaactctgggggccctga

SEQ ID NO: 23620 - DNA, 18 bp, Homo sapiens
tagtcctgaaatattttt

SEQ ID NO: 23621 - DNA, 22 bp, Homo sapiens
ttacagctgagttagaagatga

SEQ ID NO: 23622 - DNA, 24 bp, Homo sapiens
cccgggcaggcccccagcacccca

SEQ ID NO: 23623 - DNA, 17 bp, Homo sapiens
ctaaaaatatctgtgaa

SEQ ID NO: 23624 - DNA, 19 bp, Homo sapiens
cttttcctcctctgcgtct

SEQ ID NO: 23625 - DNA, 23 bp, Homo sapiens
gcccaggccaccggccgggttct

SEQ ID NO: 23626 - DNA, 22 bp, Homo sapiens
gcctgaatccttgcctgtgtct

SEQ ID NO: 23627 - DNA, 19 bp, Homo sapiens
aagcaagaacaatcaggac

SEQ ID NO: 23628 - DNA, 20 bp, Homo sapiens
atcaggaaacttactggaga

SEQ ID NO: 23629 - DNA, 18 bp, Homo sapiens
caagaacaatcaggacca

SEQ ID NO: 23630 - DNA, 20 bp, Homo sapiens
ctgtggcctcactctctgaa

SEQ ID NO: 23631 - DNA, 17 bp, Homo sapiens
gaccaaatgtgagactg

SEQ ID NO: 23632 - DNA, 20 bp, Homo sapiens
ggaaccctaagtatagacct

SEQ ID NO: 23633 - DNA, 19 bp, Homo sapiens
ggtagctaatgtccgaaga

SEQ ID NO: 23634 - DNA, 20 bp, Homo sapiens
gtgactctctgagaaccagc

SEQ ID NO: 23635 - DNA, 23 bp, Homo sapiens
tcaacctaaaatgctggatccca

SEQ ID NO: 23636 - DNA, 22 bp, Homo sapiens
tgctgctcatcaggaaacttac

SEQ ID NO: 23637 - DNA, 16 bp, Homo sapiens
tggttcttacacatct

SEQ ID NO: 23638 - DNA, 23 bp, Homo sapiens
agaagaaaaacttggaggactca

SEQ ID NO: 23639 - DNA, 22 bp, Homo sapiens
atcttatataaaatttaactca

SEQ ID NO: 23640 - DNA, 16 bp, Homo sapiens
aaacactgaagatgtc

SEQ ID NO: 23641 - DNA, 20 bp, Homo sapiens
agatccacccacacctaagt

SEQ ID NO: 23642 - DNA, 18 bp, Homo sapiens
ttctcctgctgtttcctt

SEQ ID NO: 23643 - DNA, 20 bp, Homo sapiens
ttctgaaaccagagatctgt

SEQ ID NO: 23644 - DNA, 23 bp, Homo sapiens
ctctttccctctccctgtccctc

SEQ ID NO: 23645 - DNA, 24 bp, Homo sapiens
gtggacatttggcaggagttttga

SEQ ID NO: 23646 - DNA, 21 bp, Homo sapiens
gttgggtcaagatcctggttc

SEQ ID NO: 23647 - DNA, 17 bp, Homo sapiens
tttgttgattttggtgt

SEQ ID NO: 23648 - DNA, 22 bp, Homo sapiens
cccagatctgagcattctaggc

SEQ ID NO: 23649 - DNA, 19 bp, Homo sapiens
gtcaaataggaaacatcac

SEQ ID NO: 23650 - DNA, 20 bp, Homo sapiens
gtgctgtgatgcccatgaca

SEQ ID NO: 23651 - DNA, 17 bp, Homo sapiens
tttggtatggttctcag

SEQ ID NO: 23652 - DNA, 20 bp, Homo sapiens
actgacttcctgaactccca

SEQ ID NO: 23653 - DNA, 22 bp, Homo sapiens
ctcttgaagaactgacttcctg

SEQ ID NO: 23654 - DNA, 23 bp, Homo sapiens
tcatgcagatagtatacacatca

SEQ ID NO: 23655 - DNA, 18 bp, Homo sapiens
gtgcacactaccttccca

SEQ ID NO: 23656 - DNA, 17 bp, Homo sapiens
tcacttgtaccccacta

SEQ ID NO: 23657 - DNA, 18 bp, Homo sapiens
ctccccaccttgctgcct

SEQ ID NO: 23658 - DNA, 20 bp, Homo sapiens
tccagaatttggagtctcca

SEQ ID NO: 23659 - DNA, 22 bp, Homo sapiens
taaatactttagcaaaaacatt

SEQ ID NO: 23660 - DNA, 17 bp, Homo sapiens
tttgcaaactgatgtta

SEQ ID NO: 23661 - DNA, 21 bp, Homo sapiens
aaacattttaaaacttacctt

SEQ ID NO: 23662 - DNA, 26 bp, Homo sapiens
aatctcaaactccagcactggaatta

SEQ ID NO: 23663 - DNA, 20 bp, Homo sapiens
acaaaaacattttaaaactt

SEQ ID NO: 23664 - DNA, 16 bp, Homo sapiens
gagctacaaaatttca

SEQ ID NO: 23665 - DNA, 16 bp, Homo sapiens
tgccattctcctgcct

SEQ ID NO: 23666 - DNA, 21 bp, Homo sapiens
aagaattttaccattcagtta

SEQ ID NO: 23667 - DNA, 18 bp, Homo sapiens
agaactaaccagtacctc

SEQ ID NO: 23668 - DNA, 19 bp, Homo sapiens
ttatagatgtacatacctc

SEQ ID NO: 23669 - DNA, 18 bp, Homo sapiens
ttcagttgatcttcttca

SEQ ID NO: 23670 - DNA, 21 bp, Homo sapiens
aagaattttaccattcagtta

SEQ ID NO: 23671 - DNA, 18 bp, Homo sapiens
agaactaaccagtacctc

SEQ ID NO: 23672 - DNA, 19 bp, Homo sapiens
ttatagatgtacatacctc

SEQ ID NO: 23673 - DNA, 18 bp, Homo sapiens
ttcagttgatcttcttca

SEQ ID NO: 23674 - DNA, 21 bp, Homo sapiens
aagaattttaccattcagtta

SEQ ID NO: 23675 - DNA, 18 bp, Homo sapiens
agaactaaccagtacctc

SEQ ID NO: 23676 - DNA, 19 bp, Homo sapiens
ttatagatgtacatacctc

SEQ ID NO: 23677 - DNA, 18 bp, Homo sapiens
ttcagttgatcttcttca

SEQ ID NO: 23678 - DNA, 19 bp, Homo sapiens
aaactcctgacctcaggtg

SEQ ID NO: 23679 - DNA, 19 bp, Homo sapiens
cactttcacaaatatttgg

SEQ ID NO: 23680 - DNA, 20 bp, Homo sapiens
cctctgcctcccgggttcaa

SEQ ID NO: 23681 - DNA, 23 bp, Homo sapiens
gacttagaagccgcctgatcata

SEQ ID NO: 23682 - DNA, 23 bp, Homo sapiens
taaagcctacaagtgtgaaatta

SEQ ID NO: 23683 - DNA, 17 bp, Homo sapiens
tcaagtgattctcctgc

SEQ ID NO: 23684 - DNA, 19 bp, Homo sapiens
ttgcaaagggccaaatttc

SEQ ID NO: 23685 - DNA, 19 bp, Homo sapiens
aaacagctgcatggcacat

SEQ ID NO: 23686 - DNA, 21 bp, Homo sapiens
agggcagagcacatggccccc

SEQ ID NO: 23687 - DNA, 23 bp, Homo sapiens
ccagtcaagcagaaaaacaggca

SEQ ID NO: 23688 - DNA, 19 bp, Homo sapiens
ggactcccagctggagctg

SEQ ID NO: 23689 - DNA, 15 bp, Homo sapiens
tcctcagaaccattc

SEQ ID NO: 23690 - DNA, 18 bp, Homo sapiens
tttggcacaacttgcgag

SEQ ID NO: 23691 - DNA, 23 bp, Homo sapiens
aaatcttaggctaccacattcta

SEQ ID NO: 23692 - DNA, 19 bp, Homo sapiens
acaccctagaacactccta

SEQ ID NO: 23693 - DNA, 18 bp, Homo sapiens
atgcttaacagatcatta

SEQ ID NO: 23694 - DNA, 19 bp, Homo sapiens
ctgtattggacagcactgc

SEQ ID NO: 23695 - DNA, 24 bp, Homo sapiens
tccaattcaagcctctcaactcaa

SEQ ID NO: 23696 - DNA, 20 bp, Homo sapiens
ccagctgccagcccagctcc

SEQ ID NO: 23697 - DNA, 17 bp, Homo sapiens
acacaggaccagtttgc

SEQ ID NO: 23698 - DNA, 20 bp, Homo sapiens
ccgagtccactcacagccag

SEQ ID NO: 23699 - DNA, 19 bp, Homo sapiens
ctcagtagtggctgccagt

SEQ ID NO: 23700 - DNA, 20 bp, Homo sapiens
gggcggggatggctcggcca

SEQ ID NO: 23701 - DNA, 19 bp, Homo sapiens
ggggatggctcggccactg

SEQ ID NO: 23702 - DNA, 18 bp, Homo sapiens
caaacattttattctcaa

SEQ ID NO: 23703 - DNA, 21 bp, Homo sapiens
cgaggctgcagtgtgctgtga

SEQ ID NO: 23704 - DNA, 22 bp, Homo sapiens
ctctgcggtgtaaacagccgcg

SEQ ID NO: 23705 - DNA, 20 bp, Homo sapiens
cttgaagaaacaaaggctgg

SEQ ID NO: 23706 - DNA, 20 bp, Homo sapiens
acaccagcagccacaacctc

SEQ ID NO: 23707 - DNA, 19 bp, Homo sapiens
cccagaaccactcctccag

SEQ ID NO: 23708 - DNA, 24 bp, Homo sapiens
ctccagtcatgctcttgtccctca

SEQ ID NO: 23709 - DNA, 19 bp, Homo sapiens
ctggccaagctgatgacct

SEQ ID NO: 23710 - DNA, 21 bp, Homo sapiens
gctgttgtcacacccaaaggg

SEQ ID NO: 23711 - DNA, 18 bp, Homo sapiens
gggaatagaacctttcaa

SEQ ID NO: 23712 - DNA, 18 bp, Homo sapiens
taacaaaagtctttgata

SEQ ID NO: 23713 - DNA, 17 bp, Homo sapiens
tcaagaataaatggtgt

SEQ ID NO: 23714 - DNA, 18 bp, Homo sapiens
tccaggccaagtccaaca

SEQ ID NO: 23715 - DNA, 19 bp, Homo sapiens
tgaccagctcctccagtca

SEQ ID NO: 23716 - DNA, 20 bp, Homo sapiens
tgagccttcctctggaccca

SEQ ID NO: 23717 - DNA, 18 bp, Homo sapiens
gaccaccgcttgtgtgtg

SEQ ID NO: 23718 - DNA, 23 bp, Homo sapiens
gtcactgccaacttggtgactca

SEQ ID NO: 23719 - DNA, 17 bp, Homo sapiens
ctgtctcccgtcacccc

SEQ ID NO: 23720 - DNA, 20 bp, Homo sapiens
tctctagaacagggattcca

SEQ ID NO: 23721 - DNA, 20 bp, Homo sapiens
aggacatcaggcccatccca

SEQ ID NO: 23722 - DNA, 21 bp, Homo sapiens
ccatcccaccacactcactca

SEQ ID NO: 23723 - DNA, 19 bp, Homo sapiens
ttttcactgggaccttgca

SEQ ID NO: 23724 - DNA, 23 bp, Homo sapiens
ttttggtggaagtgggccttgaa

SEQ ID NO: 23725 - DNA, 21 bp, Homo sapiens
ttctgatggtgtgcatgtgag

SEQ ID NO: 23726 - DNA, 19 bp, Homo sapiens
agaaaatattcatgcatgc

SEQ ID NO: 23727 - DNA, 21 bp, Homo sapiens
tggtgtcctagcaggagacta

SEQ ID NO: 23728 - DNA, 20 bp, Homo sapiens
tgtcttctgagcacagtatt

SEQ ID NO: 23729 - DNA, 25 bp, Homo sapiens
ttcaagtggtatttaaaagctttaa

SEQ ID NO: 23730 - DNA, 21 bp, Homo sapiens
ttctgaatagcatttgctgta

SEQ ID NO: 23731 - DNA, 18 bp, Homo sapiens
ttggcatcaccggtgcac

SEQ ID NO: 23732 - DNA, 18 bp, Homo sapiens
ttctgatttttcattgct

SEQ ID NO: 23733 - DNA, 16 bp, Homo sapiens
gagccttttctcccca

SEQ ID NO: 23734 - DNA, 21 bp, Homo sapiens
gctctcaaggagatgctgcca

SEQ ID NO: 23735 - DNA, 18 bp, Homo sapiens
cggctcccgagtcgccca

SEQ ID NO: 23736 - DNA, 19 bp, Homo sapiens
tcttttcatggtttataac

SEQ ID NO: 23737 - DNA, 23 bp, Homo sapiens
tgatatatgtaatataccagagc

SEQ ID NO: 23738 - DNA, 19 bp, Homo sapiens
actcttcatggaaagcaac

SEQ ID NO: 23739 - DNA, 18 bp, Homo sapiens
cccatcttcattataata

SEQ ID NO: 23740 - DNA, 24 bp, Homo sapiens
cccccaatccccccagatcctgtg

SEQ ID NO: 23741 - DNA, 25 bp, Homo sapiens
gccccgaactgtggtcgccaggccc

SEQ ID NO: 23742 - DNA, 19 bp, Homo sapiens
ggccgggtgcggtggctca

SEQ ID NO: 23743 - DNA, 18 bp, Homo sapiens
tctctactaaaaatgcaa

SEQ ID NO: 23744 - DNA, 23 bp, Homo sapiens
tggagcccatgctgcctacagca

SEQ ID NO: 23745 - DNA, 18 bp, Homo sapiens
agaacttcatctccatct

SEQ ID NO: 23746 - DNA, 22 bp, Homo sapiens
tgctgctcatcagctgcccgct

SEQ ID NO: 23747 - DNA, 22 bp, Homo sapiens
ggacttaattgattggtatatt

SEQ ID NO: 23748 - DNA, 20 bp, Homo sapiens
agtctcactctgtcgcccag

SEQ ID NO: 23749 - DNA, 19 bp, Homo sapiens
ccccttaccctgctgttgt

SEQ ID NO: 23750 - DNA, 21 bp, Homo sapiens
gcctggggctgtgcttggctt

SEQ ID NO: 23751 - DNA, 19 bp, Homo sapiens
gttggcttgtggttcctcc

SEQ ID NO: 23752 - DNA, 21 bp, Homo sapiens
tcccttagccccccctcctct

SEQ ID NO: 23753 - DNA, 23 bp, Homo sapiens
accctgagcatatgccctcttgg

SEQ ID NO: 23754 - DNA, 18 bp, Homo sapiens
atgcctcatcacttaagc

SEQ ID NO: 23755 - DNA, 17 bp, Homo sapiens
cagatggggctgttttc

SEQ ID NO: 23756 - DNA, 16 bp, Homo sapiens
tcttctgttcctgtgt

SEQ ID NO: 23757 - DNA, 17 bp, Homo sapiens
cctggactgaaagtatc

SEQ ID NO: 23758 - DNA, 19 bp, Homo sapiens
tgctgttaattgtatgtac

SEQ ID NO: 23759 - DNA, 21 bp, Homo sapiens
cagaacttggatttcttaaat

SEQ ID NO: 23760 - DNA, 19 bp, Homo sapiens
gtgttggcgggattctgaa

SEQ ID NO: 23761 - DNA, 18 bp, Homo sapiens
ggaatgaaatttgataaa

SEQ ID NO: 23762 - DNA, 19 bp, Homo sapiens
ggataaagttgaggatcac

SEQ ID NO: 23763 - DNA, 17 bp, Homo sapiens
aatgagattctgacgtg

SEQ ID NO: 23764 - DNA, 16 bp, Homo sapiens
aggatggagtgcatca

SEQ ID NO: 23765 - DNA, 20 bp, Homo sapiens
caccaaaatagtgctcgagt

SEQ ID NO: 23766 - DNA, 22 bp, Homo sapiens
ccagtggtgacatgaccactcc

SEQ ID NO: 23767 - DNA, 19 bp, Homo sapiens
gatggctcatgtcacaggc

SEQ ID NO: 23768 - DNA, 21 bp, Homo sapiens
gtgcagctcactaccaacagc

SEQ ID NO: 23769 - DNA, 21 bp, Homo sapiens
gtgcagctcactaccaacagc

SEQ ID NO: 23770 - DNA, 23 bp, Homo sapiens
tgtccaggtttctcctgagctca

SEQ ID NO: 23771 - DNA, 19 bp, Homo sapiens
ccgccgccggccctcggtg

SEQ ID NO: 23772 - DNA, 21 bp, Homo sapiens
cccaaaacaggactgtggtga

SEQ ID NO: 23773 - DNA, 20 bp, Homo sapiens
gaattctctacgatggccat

SEQ ID NO: 23774 - DNA, 17 bp, Homo sapiens
gaggcattcctgctcat

SEQ ID NO: 23775 - DNA, 22 bp, Homo sapiens
acttgaggccattgaagctgca

SEQ ID NO: 23776 - DNA, 18 bp, Homo sapiens
catgaataaggtgccagg

SEQ ID NO: 23777 - DNA, 21 bp, Homo sapiens
catggatatcatgtatccttc

SEQ ID NO: 23778 - DNA, 23 bp, Homo sapiens
gcccagaggagggtaagactctg

SEQ ID NO: 23779 - DNA, 22 bp, Homo sapiens
tggggactgttttactctgata

SEQ ID NO: 23780 - DNA, 22 bp, Homo sapiens
gatattcatattatatacatca

SEQ ID NO: 23781 - DNA, 18 bp, Homo sapiens
acttccaaaaggtgctgg

SEQ ID NO: 23782 - DNA, 19 bp, Homo sapiens
atgccacgtactcagagta

SEQ ID NO: 23783 - DNA, 17 bp, Homo sapiens
cagaccaattctgtgac

SEQ ID NO: 23784 - DNA, 23 bp, Homo sapiens
cttaagtaattctataggatttt

SEQ ID NO: 23785 - DNA, 19 bp, Homo sapiens
gagtaggcctccatacttc

SEQ ID NO: 23786 - DNA, 18 bp, Homo sapiens
tctttttcagttgtcttt

SEQ ID NO: 23787 - DNA, 24 bp, Homo sapiens
tgagtggatgcagacatgagagta

SEQ ID NO: 23788 - DNA, 22 bp, Homo sapiens
agtaagtgttagtgtgttagtg

SEQ ID NO: 23789 - DNA, 20 bp, Homo sapiens
tccccttttcctcttatccc

SEQ ID NO: 23790 - DNA, 19 bp, Homo sapiens
agactctgccaccgtgtca

SEQ ID NO: 23791 - DNA, 19 bp, Homo sapiens
cccagaaagaggcgtccca

SEQ ID NO: 23792 - DNA, 18 bp, Homo sapiens
gagcagctgaaaatctca

SEQ ID NO: 23793 - DNA, 20 bp, Homo sapiens
tatttagggatctgcagcga

SEQ ID NO: 23794 - DNA, 22 bp, Homo sapiens
atacttctttgggtgctgtgct

SEQ ID NO: 23795 - DNA, 23 bp, Homo sapiens
aacgtaacacgagcagcaggctg

SEQ ID NO: 23796 - DNA, 23 bp, Homo sapiens
gccgcgagggagaggccgcggcc

SEQ ID NO: 23797 - DNA, 23 bp, Homo sapiens
cccgccacaccaaccaaccaata

SEQ ID NO: 23798 - DNA, 23 bp, Homo sapiens
ggaggacgcggaaggcctgcgag

SEQ ID NO: 23799 - DNA, 23 bp, Homo sapiens
ccacccccattctcagctcctcc

SEQ ID NO: 23800 - DNA, 22 bp, Homo sapiens
taccgcctctgtttctgcggcg

SEQ ID NO: 23801 - DNA, 18 bp, Homo sapiens
actggtgcctgctgtggc

SEQ ID NO: 23802 - DNA, 23 bp, Homo sapiens
ctgagcctccaggagctgccaga

SEQ ID NO: 23803 - DNA, 19 bp, Homo sapiens
gttgatagccctctagtca

SEQ ID NO: 23804 - DNA, 19 bp, Homo sapiens
tctttgctgaaacaaccca

SEQ ID NO: 23805 - DNA, 19 bp, Homo sapiens
ttaatgaggaaggcactga

SEQ ID NO: 23806 - DNA, 21 bp, Homo sapiens
aaaagcagcagcaaatgaaga

SEQ ID NO: 23807 - DNA, 23 bp, Homo sapiens
atttgagtaagttttacatgaca

SEQ ID NO: 23808 - DNA, 18 bp, Homo sapiens
gctgactaggttgggtca

SEQ ID NO: 23809 - DNA, 19 bp, Homo sapiens
ttcagcactttaacgcttt

SEQ ID NO: 23810 - DNA, 20 bp, Homo sapiens
atatattaggtcagctctta

SEQ ID NO: 23811 - DNA, 22 bp, Homo sapiens
caaactagctaaaggaaaccaa

SEQ ID NO: 23812 - DNA, 28 bp, Homo sapiens
gcctaaatgctttagttttaggtcattt

SEQ ID NO: 23813 - DNA, 24 bp, Homo sapiens
gtagctttaacaacttttctgtta

SEQ ID NO: 23814 - DNA, 23 bp, Homo sapiens
taagaactggagcaagtactctt

SEQ ID NO: 23815 - DNA, 16 bp, Homo sapiens
tgaactttgtttccca

SEQ ID NO: 23816 - DNA, 23 bp, Homo sapiens
tgggttctacgacattgaagttg

SEQ ID NO: 23817 - DNA, 23 bp, Homo sapiens
tttctttatagagaaagtacctt

SEQ ID NO: 23818 - DNA, 21 bp, Homo sapiens
caagcacaaggccatgcaggt

SEQ ID NO: 23819 - DNA, 17 bp, Homo sapiens
caccccatggccccggc

SEQ ID NO: 23820 - DNA, 20 bp, Homo sapiens
tgccaccaccaccagactca

SEQ ID NO: 23821 - DNA, 18 bp, Homo sapiens
ttggtgccttttcagcca

SEQ ID NO: 23822 - DNA, 16 bp, Homo sapiens
tccctgcaaagcctct

SEQ ID NO: 23823 - DNA, 16 bp, Homo sapiens
tgaagagatccaggta

SEQ ID NO: 23824 - DNA, 17 bp, Homo sapiens
gcaaatttggctcgata

SEQ ID NO: 23825 - DNA, 18 bp, Homo sapiens
gcacatcactgactggta

SEQ ID NO: 23826 - DNA, 17 bp, Homo sapiens
taaaaacatcattcaga

SEQ ID NO: 23827 - DNA, 20 bp, Homo sapiens
tggaagttacagggtagcat

SEQ ID NO: 23828 - DNA, 17 bp, Homo sapiens
tgagcatggcagtgcca

SEQ ID NO: 23829 - DNA, 19 bp, Homo sapiens
accatagtgtccccatccc

SEQ ID NO: 23830 - DNA, 19 bp, Homo sapiens
aagattggaggcttaatta

SEQ ID NO: 23831 - DNA, 17 bp, Homo sapiens
gggactgtttccaggca

SEQ ID NO: 23832 - DNA, 21 bp, Homo sapiens
aacctccgcctcctcatctca

SEQ ID NO: 23833 - DNA, 20 bp, Homo sapiens
atgggcacacagaaatgcac

SEQ ID NO: 23834 - DNA, 22 bp, Homo sapiens
gtggggtatgtttaattcctct

SEQ ID NO: 23835 - DNA, 20 bp, Homo sapiens
ttcaaatgcagattaattct

SEQ ID NO: 23836 - DNA, 17 bp, Homo sapiens
actgtgacctctggctt

SEQ ID NO: 23837 - DNA, 18 bp, Homo sapiens
ctcctctctcttcctctc

SEQ ID NO: 23838 - DNA, 20 bp, Homo sapiens
ctcttcctctcctctctctc

SEQ ID NO: 23839 - DNA, 20 bp, Homo sapiens
ctcttcctctcctctctctc

SEQ ID NO: 23840 - DNA, 20 bp, Homo sapiens
ctcttcctctcctctctctc

SEQ ID NO: 23841 - DNA, 22 bp, Homo sapiens
ctcttcctctcctctctctctc

SEQ ID NO: 23842 - DNA, 22 bp, Homo sapiens
ctcttcctctcctctcttcctc

SEQ ID NO: 23843 - DNA, 20 bp, Homo sapiens
ctctttctctcctctgtctc

SEQ ID NO: 23844 - DNA, 23 bp, Homo sapiens
tcctgtctctcctcccctcctct

SEQ ID NO: 23845 - DNA, 17 bp, Homo sapiens
tcttcctctcctctctc

SEQ ID NO: 23846 - DNA, 17 bp, Homo sapiens
tcttcctctcttctctc

SEQ ID NO: 23847 - DNA, 21 bp, Homo sapiens
cgaggctgactccgcgtgaga

SEQ ID NO: 23848 - DNA, 20 bp, Homo sapiens
ctgacccaagctcaggcaca

SEQ ID NO: 23849 - DNA, 23 bp, Homo sapiens
ttctggggcgtgaggcctgtgag

SEQ ID NO: 23850 - DNA, 19 bp, Homo sapiens
caccaccaagtcacttccc

SEQ ID NO: 23851 - DNA, 27 bp, Homo sapiens
ggccgtcccaaaacaaccatttcctct

SEQ ID NO: 23852 - DNA, 20 bp, Homo sapiens
tggcgcctgccttctggcca

SEQ ID NO: 23853 - DNA, 16 bp, Homo sapiens
cccttgcctgaactga

SEQ ID NO: 23854 - DNA, 24 bp, Homo sapiens
agagttttgtggttgggttaggtt

SEQ ID NO: 23855 - DNA, 19 bp, Homo sapiens
aggcctttcctgcaagctg

SEQ ID NO: 23856 - DNA, 19 bp, Homo sapiens
atcacgtcactgcatttca

SEQ ID NO: 23857 - DNA, 21 bp, Homo sapiens
cagattacacaaccagtgtct

SEQ ID NO: 23858 - DNA, 18 bp, Homo sapiens
ccacgagagtctgtgcac

SEQ ID NO: 23859 - DNA, 18 bp, Homo sapiens
gccaaggcgggcagctca

SEQ ID NO: 23860 - DNA, 22 bp, Homo sapiens
gtgccttggctcctagagtttt

SEQ ID NO: 23861 - DNA, 23 bp, Homo sapiens
tcttttattttctgttttgcctt

SEQ ID NO: 23862 - DNA, 20 bp, Homo sapiens
tttctgttttgccttatctt

SEQ ID NO: 23863 - DNA, 22 bp, Homo sapiens
gccctcctgggccgtctggcct

SEQ ID NO: 23864 - DNA, 18 bp, Homo sapiens
agctcatcagttcccata

SEQ ID NO: 23865 - DNA, 18 bp, Homo sapiens
agtagctatagccattaa

SEQ ID NO: 23866 - DNA, 20 bp, Homo sapiens
ataagcaatgatacatgaaa

SEQ ID NO: 23867 - DNA, 19 bp, Homo sapiens
tatttcatcgtgtttcaaa

SEQ ID NO: 23868 - DNA, 22 bp, Homo sapiens
aaatcttcaaatctgaatatac

SEQ ID NO: 23869 - DNA, 22 bp, Homo sapiens
aacaaaaacacatgatttggaa

SEQ ID NO: 23870 - DNA, 19 bp, Homo sapiens
gctctctctctgttttgtt

SEQ ID NO: 23871 - DNA, 20 bp, Homo sapiens
agtctcactctgttgcccag

SEQ ID NO: 23872 - DNA, 22 bp, Homo sapiens
gtgtccggaattggtgggttct

SEQ ID NO: 23873 - DNA, 24 bp, Homo sapiens
tgcaacctctacctcctggattca

SEQ ID NO: 23874 - DNA, 16 bp, Homo sapiens
tgcccactcgtgctgc

SEQ ID NO: 23875 - DNA, 20 bp, Homo sapiens
tggccaggctggtcttgaac

SEQ ID NO: 23876 - DNA, 18 bp, Homo sapiens
tgtttaaaaacagcatta

SEQ ID NO: 23877 - DNA, 22 bp, Homo sapiens
acacaggacctttggccgctcc

SEQ ID NO: 23878 - DNA, 24 bp, Homo sapiens
gaaaacaagtagtcctgtttgcca

SEQ ID NO: 23879 - DNA, 19 bp, Homo sapiens
taaaaacattttcaaagga

SEQ ID NO: 23880 - DNA, 17 bp, Homo sapiens
ttgcttctgttattacc

SEQ ID NO: 23881 - DNA, 18 bp, Homo sapiens
atgattcagtctgtacca

SEQ ID NO: 23882 - DNA, 17 bp, Homo sapiens
cagcaacctctgcctcc

SEQ ID NO: 23883 - DNA, 20 bp, Homo sapiens
cctctgcctcccaggttcaa

SEQ ID NO: 23884 - DNA, 20 bp, Homo sapiens
ttgccatgttgaaaatgttt

SEQ ID NO: 23885 - DNA, 18 bp, Homo sapiens
acacaggacttggccatg

SEQ ID NO: 23886 - DNA, 17 bp, Homo sapiens
ccacagtaccacagtgt

SEQ ID NO: 23887 - DNA, 16 bp, Homo sapiens
ccaggagagtcctcag

SEQ ID NO: 23888 - DNA, 20 bp, Homo sapiens
cggtgtgccagcttctgggt

SEQ ID NO: 23889 - DNA, 20 bp, Homo sapiens
tgggcaaagatgctgcctta

SEQ ID NO: 23890 - DNA, 21 bp, Homo sapiens
tgtgggggtggcaggcaggtg

SEQ ID NO: 23891 - DNA, 18 bp, Homo sapiens
gatgcaagccccttgcca

SEQ ID NO: 23892 - DNA, 19 bp, Homo sapiens
aagcaattctcctgcctca

SEQ ID NO: 23893 - DNA, 25 bp, Homo sapiens
caccaccaccacccagctatttttt

SEQ ID NO: 23894 - DNA, 16 bp, Homo sapiens
cgtcttcgtcttcctc

SEQ ID NO: 23895 - DNA, 23 bp, Homo sapiens
cgttcacagcaaacaggattcct

SEQ ID NO: 23896 - DNA, 20 bp, Homo sapiens
ttcttttggtgaccctccag

SEQ ID NO: 23897 - DNA, 24 bp, Homo sapiens
cccggaccacccctcatccagatg

SEQ ID NO: 23898 - DNA, 21 bp, Homo sapiens
gagacctttgtttctgtgatg

SEQ ID NO: 23899 - DNA, 19 bp, Homo sapiens
tgagtttcatatgaaattg

SEQ ID NO: 23900 - DNA, 25 bp, Homo sapiens
caggatagcagataacctgctttga

SEQ ID NO: 23901 - DNA, 19 bp, Homo sapiens
cgcgtatgtgagcatagca

SEQ ID NO: 23902 - DNA, 22 bp, Homo sapiens
gcctgtggtctctcagaagcca

SEQ ID NO: 23903 - DNA, 20 bp, Homo sapiens
gtaaaacatgcatttgcaat

SEQ ID NO: 23904 - DNA, 24 bp, Homo sapiens
tcttggaaaatgaggatctctgag

SEQ ID NO: 23905 - DNA, 20 bp, Homo sapiens
tgacgctgatgatcacacca

SEQ ID NO: 23906 - DNA, 21 bp, Homo sapiens
aaacactagaaaaagcattga

SEQ ID NO: 23907 - DNA, 19 bp, Homo sapiens
aacactagaaaaagcattg

SEQ ID NO: 23908 - DNA, 16 bp, Homo sapiens
cagcacaatggtgacc

SEQ ID NO: 23909 - DNA, 19 bp, Homo sapiens
tgaggtttttgttgttttt

SEQ ID NO: 23910 - DNA, 20 bp, Homo sapiens
cctctgcctcccaggttcaa

SEQ ID NO: 23911 - DNA, 19 bp, Homo sapiens
ctgcaacctctgcctccca

SEQ ID NO: 23912 - DNA, 25 bp, Homo sapiens
acttggacagagccctgcctggcct

SEQ ID NO: 23913 - DNA, 18 bp, Homo sapiens
caaggggatggcccaggc

SEQ ID NO: 23914 - DNA, 21 bp, Homo sapiens
cctgggcaattcacttaactt

SEQ ID NO: 23915 - DNA, 19 bp, Homo sapiens
ctataaggaatacacatac

SEQ ID NO: 23916 - DNA, 18 bp, Homo sapiens
ctggcgtctgcttggttt

SEQ ID NO: 23917 - DNA, 21 bp, Homo sapiens
gcaagaagtcacttatcacca

SEQ ID NO: 23918 - DNA, 17 bp, Homo sapiens
tacacccacatgcacac

SEQ ID NO: 23919 - DNA, 16 bp, Homo sapiens
tagccctagttgtcat

SEQ ID NO: 23920 - DNA, 18 bp, Homo sapiens
tcctgacctcatgatcca

SEQ ID NO: 23921 - DNA, 19 bp, Homo sapiens
ctctgggaagcaggaaggc

SEQ ID NO: 23922 - DNA, 19 bp, Homo sapiens
cacatgagaaaatatctga

SEQ ID NO: 23923 - DNA, 19 bp, Homo sapiens
cctgaaatggctttaaatt

SEQ ID NO: 23924 - DNA, 19 bp, Homo sapiens
tacccttcacaataccaca

SEQ ID NO: 23925 - DNA, 18 bp, Homo sapiens
tggaaatccacaatttga

SEQ ID NO: 23926 - DNA, 18 bp, Homo sapiens
tttgcagatttgtggtta

SEQ ID NO: 23927 - DNA, 20 bp, Homo sapiens
ccaggactctgcccaacaaa

SEQ ID NO: 23928 - DNA, 16 bp, Homo sapiens
cgtggagaattgctta

SEQ ID NO: 23929 - DNA, 18 bp, Homo sapiens
tattctgttaaatcctca

SEQ ID NO: 23930 - DNA, 19 bp, Homo sapiens
tgtgtcagcaatttctgga

SEQ ID NO: 23931 - DNA, 21 bp, Homo sapiens
tttttttatgatgtttggcct

SEQ ID NO: 23932 - DNA, 22 bp, Homo sapiens
caagatcgtgccacttcactcc

SEQ ID NO: 23933 - DNA, 15 bp, Homo sapiens
ccaagatcgtgccac

SEQ ID NO: 23934 - DNA, 18 bp, Homo sapiens
cctgcaacctccacctcc

SEQ ID NO: 23935 - DNA, 19 bp, Homo sapiens
tcatgatccacctgcctca

SEQ ID NO: 23936 - DNA, 18 bp, Homo sapiens
tccacctcccgggttcaa

SEQ ID NO: 23937 - DNA, 21 bp, Homo sapiens
tgcagtgacccaagatcgtgc

SEQ ID NO: 23938 - DNA, 20 bp, Homo sapiens
tggccaggctggtcttgaac

SEQ ID NO: 23939 - DNA, 24 bp, Homo sapiens
atatcaatcttagacattacctgt

SEQ ID NO: 23940 - DNA, 23 bp, Homo sapiens
cccgcttcctcaccacccccact

SEQ ID NO: 23941 - DNA, 20 bp, Homo sapiens
gtctctcccattctctagta

SEQ ID NO: 23942 - DNA, 26 bp, Homo sapiens
tatacccacttactaatgtggaatta

SEQ ID NO: 23943 - DNA, 20 bp, Homo sapiens
agtctcactctgttacccag

SEQ ID NO: 23944 - DNA, 18 bp, Homo sapiens
cctgcaacctccacctcc

SEQ ID NO: 23945 - DNA, 19 bp, Homo sapiens
ctgcaacctccacctccca

SEQ ID NO: 23946 - DNA, 18 bp, Homo sapiens
tccacctcccaggttcaa

SEQ ID NO: 23947 - DNA, 18 bp, Homo sapiens
ttcaagtgattctcatgc

SEQ ID NO: 23948 - DNA, 20 bp, Homo sapiens
acatgcattacacacatgca

SEQ ID NO: 23949 - DNA, 22 bp, Homo sapiens
ccccaggtctcagatggaatta

SEQ ID NO: 23950 - DNA, 16 bp, Homo sapiens
acgatgatgatgaaca

SEQ ID NO: 23951 - DNA, 23 bp, Homo sapiens
agccgagaccagccttttacctc

SEQ ID NO: 23952 - DNA, 25 bp, Homo sapiens
ggagatggcctcagctgtggggctg

SEQ ID NO: 23953 - DNA, 21 bp, Homo sapiens
aagctccacggccaccataga

SEQ ID NO: 23954 - DNA, 21 bp, Homo sapiens
agatgaacttttgtatcatta

SEQ ID NO: 23955 - DNA, 24 bp, Homo sapiens
tccacggccaccatagataaccca

SEQ ID NO: 23956 - DNA, 27 bp, Homo sapiens
tttgcttaatattacagaaccagttct

SEQ ID NO: 23957 - DNA, 18 bp, Homo sapiens
gccagctcttgctaagca

SEQ ID NO: 23958 - DNA, 18 bp, Homo sapiens
gtggtgtccagccagctc

SEQ ID NO: 23959 - DNA, 20 bp, Homo sapiens
tcaagcagttactgatcaga

SEQ ID NO: 23960 - DNA, 18 bp, Homo sapiens
tttttctttttttcctca

SEQ ID NO: 23961 - DNA, 18 bp, Homo sapiens
tggccacactgtcagtga

SEQ ID NO: 23962 - DNA, 18 bp, Homo sapiens
aacgctcacacttggctg

SEQ ID NO: 23963 - DNA, 17 bp, Homo sapiens
tccctgccaccacccca

SEQ ID NO: 23964 - DNA, 16 bp, Homo sapiens
acttacaaaaacttgc

SEQ ID NO: 23965 - DNA, 22 bp, Homo sapiens
agaagagagaaaaatatacatt

SEQ ID NO: 23966 - DNA, 20 bp, Homo sapiens
gtagttttgggttttttgtt

SEQ ID NO: 23967 - DNA, 19 bp, Homo sapiens
cccagaggaactgataagc

SEQ ID NO: 23968 - DNA, 21 bp, Homo sapiens
cctgggtgatttgggttttct

SEQ ID NO: 23969 - DNA, 23 bp, Homo sapiens
ggtgggtggggaagtgaaatgtt

SEQ ID NO: 23970 - DNA, 22 bp, Homo sapiens
ttgttctaggaatgagggtagg

SEQ ID NO: 23971 - DNA, 16 bp, Homo sapiens
cccgcccccatacctc

SEQ ID NO: 23972 - DNA, 18 bp, Homo sapiens
gataacccagtgcttaaa

SEQ ID NO: 23973 - DNA, 19 bp, Homo sapiens
agaaacagttaatttgggc

SEQ ID NO: 23974 - DNA, 23 bp, Homo sapiens
caagacatttgccaaatgtatta

SEQ ID NO: 23975 - DNA, 22 bp, Homo sapiens
gagccaagatcataccactgca

SEQ ID NO: 23976 - DNA, 23 bp, Homo sapiens
tgagtgtatgtctgaacctgtaa

SEQ ID NO: 23977 - DNA, 21 bp, Homo sapiens
tgtttcaagacatttgccaaa

SEQ ID NO: 23978 - DNA, 22 bp, Homo sapiens
aataggagacgaacgaatgtaa

SEQ ID NO: 23979 - DNA, 26 bp, Homo sapiens
aggtttcccattttctaatcattttt

SEQ ID NO: 23980 - DNA, 27 bp, Homo sapiens
ctgtgagatcaccgcaaacctacctta

SEQ ID NO: 23981 - DNA, 19 bp, Homo sapiens
gggtgtgtgtgtgtttgta

SEQ ID NO: 23982 - DNA, 20 bp, Homo sapiens
taggagaggctgggcccggt

SEQ ID NO: 23983 - DNA, 20 bp, Homo sapiens
tccagatctgttcttcacca

SEQ ID NO: 23984 - DNA, 17 bp, Homo sapiens
gtcatcaaaaagaggat

SEQ ID NO: 23985 - DNA, 18 bp, Homo sapiens
accaccgctccccctcct

SEQ ID NO: 23986 - DNA, 25 bp, Homo sapiens
cctcctcgtcctcgtcgtcgtcctc

SEQ ID NO: 23987 - DNA, 21 bp, Homo sapiens
actttttcaacttgaaccttc

SEQ ID NO: 23988 - DNA, 19 bp, Homo sapiens
cttttgggagttctgtgga

SEQ ID NO: 23989 - DNA, 17 bp, Homo sapiens
gcttctgttcctccgcc

SEQ ID NO: 23990 - DNA, 17 bp, Homo sapiens
cctcttctcttatcctc

SEQ ID NO: 23991 - DNA, 22 bp, Homo sapiens
ccttcccctttctctgtctcca

SEQ ID NO: 23992 - DNA, 18 bp, Homo sapiens
cagaattctgcacccttc

SEQ ID NO: 23993 - DNA, 23 bp, Homo sapiens
tggggatttgttcaatgtgaaat

SEQ ID NO: 23994 - DNA, 24 bp, Homo sapiens
ccagggggtcactcctcccacccc

SEQ ID NO: 23995 - DNA, 17 bp, Homo sapiens
cccagccatttgcattg

SEQ ID NO: 23996 - DNA, 18 bp, Homo sapiens
agtattcagaagtgcttg

SEQ ID NO: 23997 - DNA, 22 bp, Homo sapiens
tcatctaactcaagccaagtaa

SEQ ID NO: 23998 - DNA, 23 bp, Homo sapiens
ttcaaaaaatataccattggaga

SEQ ID NO: 23999 - DNA, 16 bp, Homo sapiens
cacctccagtctcatt

SEQ ID NO: 24000 - DNA, 22 bp, Homo sapiens
ccagcgtttcaacctcattcaa

SEQ ID NO: 24001 - DNA, 20 bp, Homo sapiens
ttcaaatgtgactcactttt

SEQ ID NO: 24002 - DNA, 18 bp, Homo sapiens
caattttggaaacatctc

SEQ ID NO: 24003 - DNA, 25 bp, Homo sapiens
gagactaggaccagagtccttagca

SEQ ID NO: 24004 - DNA, 22 bp, Homo sapiens
acctgagcccaaatcctggccc

SEQ ID NO: 24005 - DNA, 19 bp, Homo sapiens
taaaaacaaaatggacaaa

SEQ ID NO: 24006 - DNA, 21 bp, Homo sapiens
agacaccgcggtgggattcca

SEQ ID NO: 24007 - DNA, 16 bp, Homo sapiens
cagtcctgatgtcaca

SEQ ID NO: 24008 - DNA, 21 bp, Homo sapiens
tctccacgccggggacatttc

SEQ ID NO: 24009 - DNA, 18 bp, Homo sapiens
tcttttttgtttgtgtga

SEQ ID NO: 24010 - DNA, 19 bp, Homo sapiens
tctttctttattctaataa

SEQ ID NO: 24011 - DNA, 27 bp, Homo sapiens
aaccgacagcagtgtgaaggtgtgtca

SEQ ID NO: 24012 - DNA, 21 bp, Homo sapiens
cagcctggccaacttgatgaa

SEQ ID NO: 24013 - DNA, 22 bp, Homo sapiens
cctcttttacggaccatcctca

SEQ ID NO: 24014 - DNA, 18 bp, Homo sapiens
gtttctgcatggaataac

SEQ ID NO: 24015 - DNA, 17 bp, Homo sapiens
aaaaacaaacaaacaaa

SEQ ID NO: 24016 - DNA, 18 bp, Homo sapiens
ccagaccctcagcacgca

SEQ ID NO: 24017 - DNA, 18 bp, Homo sapiens
agacaacgctgcagagcc

SEQ ID NO: 24018 - DNA, 17 bp, Homo sapiens
ctgaactcacctggcct

SEQ ID NO: 24019 - DNA, 22 bp, Homo sapiens
gcctgggaagcaccgtctgccc

SEQ ID NO: 24020 - DNA, 20 bp, Homo sapiens
ggacttaatgtagcattgca

SEQ ID NO: 24021 - DNA, 19 bp, Homo sapiens
tttttctttttttccctca

SEQ ID NO: 24022 - DNA, 20 bp, Homo sapiens
agttcccaaactgcacttta

SEQ ID NO: 24023 - DNA, 20 bp, Homo sapiens
ctgaagatactccccagtgc

SEQ ID NO: 24024 - DNA, 22 bp, Homo sapiens
tgagacctcctgggtctagtca

SEQ ID NO: 24025 - DNA, 18 bp, Homo sapiens
acctctgccccaaggctg

SEQ ID NO: 24026 - DNA, 20 bp, Homo sapiens
aggctgatccccgtaaccta

SEQ ID NO: 24027 - DNA, 19 bp, Homo sapiens
gcctccctgcacctctgcc

SEQ ID NO: 24028 - DNA, 16 bp, Homo sapiens
aagagacttcttttgt

SEQ ID NO: 24029 - DNA, 21 bp, Homo sapiens
agcatcctgtcttcttctgtg

SEQ ID NO: 24030 - DNA, 20 bp, Homo sapiens
agtgagtgggaaggagagtg

SEQ ID NO: 24031 - DNA, 19 bp, Homo sapiens
caagcctgtttggccctga

SEQ ID NO: 24032 - DNA, 19 bp, Homo sapiens
caggaccagtgacagcacc

SEQ ID NO: 24033 - DNA, 22 bp, Homo sapiens
cttcttctgtgctgcctggttt

SEQ ID NO: 24034 - DNA, 18 bp, Homo sapiens
gccacgtgtttgcagcga

SEQ ID NO: 24035 - DNA, 19 bp, Homo sapiens
gctcatgcttctctaatca

SEQ ID NO: 24036 - DNA, 18 bp, Homo sapiens
acttttctactcctgtat

SEQ ID NO: 24037 - DNA, 20 bp, Homo sapiens
atgcccagatcacattccag

SEQ ID NO: 24038 - DNA, 20 bp, Homo sapiens
ggagatgatcagaaatctca

SEQ ID NO: 24039 - DNA, 24 bp, Homo sapiens
tcacacatcatcccatccttaata

SEQ ID NO: 24040 - DNA, 19 bp, Homo sapiens
acgtaatccagtatttgga

SEQ ID NO: 24041 - DNA, 20 bp, Homo sapiens
cagctaattacctcatcata

SEQ ID NO: 24042 - DNA, 24 bp, Homo sapiens
gaggccgtccgcccgactccaaga

SEQ ID NO: 24043 - DNA, 20 bp, Homo sapiens
ttattatcagttctatgcta

SEQ ID NO: 24044 - DNA, 23 bp, Homo sapiens
acctgaacctccttgcctgggct

SEQ ID NO: 24045 - DNA, 19 bp, Homo sapiens
cctcctcgccctgggctgc

SEQ ID NO: 24046 - DNA, 19 bp, Homo sapiens
cctcctcgccctgggctgc

SEQ ID NO: 24047 - DNA, 23 bp, Homo sapiens
gcctgggctgccccgcctgggtc

SEQ ID NO: 24048 - DNA, 20 bp, Homo sapiens
gctgtcgtcctggtgtcaga

SEQ ID NO: 24049 - DNA, 19 bp, Homo sapiens
ggcaagacagcgctgtggc

SEQ ID NO: 24050 - DNA, 20 bp, Homo sapiens
tcctgatgagggcgttgtgg

SEQ ID NO: 24051 - DNA, 23 bp, Homo sapiens
catcctgtcttcatcctcaagtg

SEQ ID NO: 24052 - DNA, 20 bp, Homo sapiens
gtacctcgggacatccatca

SEQ ID NO: 24053 - DNA, 19 bp, Homo sapiens
gtgaactgtcaggagttct

SEQ ID NO: 24054 - DNA, 22 bp, Homo sapiens
gtttccttgttctatttcagta

SEQ ID NO: 24055 - DNA, 21 bp, Homo sapiens
tctttctttctgtaactcctt

SEQ ID NO: 24056 - DNA, 18 bp, Homo sapiens
tcagttgcaggcattaca

SEQ ID NO: 24057 - DNA, 18 bp, Homo sapiens
cattcaaaattccccgtc

SEQ ID NO: 24058 - DNA, 21 bp, Homo sapiens
ccccacccctccctgcagctt

SEQ ID NO: 24059 - DNA, 19 bp, Homo sapiens
gaagtgaatccttggctta

SEQ ID NO: 24060 - DNA, 21 bp, Homo sapiens
gaccctggaggccccctcaca

SEQ ID NO: 24061 - DNA, 18 bp, Homo sapiens
tgagccttcctagggttt

SEQ ID NO: 24062 - DNA, 19 bp, Homo sapiens
gaaaaagaaaactacatca

SEQ ID NO: 24063 - DNA, 18 bp, Homo sapiens
gtatcattactattacta

SEQ ID NO: 24064 - DNA, 22 bp, Homo sapiens
tttgtaaatatatatatatatt

SEQ ID NO: 24065 - DNA, 21 bp, Homo sapiens
caacccattccctctgcttct

SEQ ID NO: 24066 - DNA, 20 bp, Homo sapiens
ccccacctgggtcccctgca

SEQ ID NO: 24067 - DNA, 21 bp, Homo sapiens
cctgaactcctgagcgacaga

SEQ ID NO: 24068 - DNA, 20 bp, Homo sapiens
cgacagaagccccaggcctc

SEQ ID NO: 24069 - DNA, 18 bp, Homo sapiens
gggagtgggacggctcct

SEQ ID NO: 24070 - DNA, 18 bp, Homo sapiens
cagttgccgctctccacc

SEQ ID NO: 24071 - DNA, 18 bp, Homo sapiens
cccccatgaccttctccc

SEQ ID NO: 24072 - DNA, 17 bp, Homo sapiens
cgccaccatacccagct

SEQ ID NO: 24073 - DNA, 22 bp, Homo sapiens
ttaattccaaaggctcttccaa

SEQ ID NO: 24074 - DNA, 20 bp, Homo sapiens
aacagagagaacgagcctgg

SEQ ID NO: 24075 - DNA, 17 bp, Homo sapiens
cggcggcggccgacagc

SEQ ID NO: 24076 - DNA, 20 bp, Homo sapiens
gtgtccagagctggcccttc

SEQ ID NO: 24077 - DNA, 18 bp, Homo sapiens
tgggattgtggcagccag

SEQ ID NO: 24078 - DNA, 21 bp, Homo sapiens
tctaggcagttatttttgttt

SEQ ID NO: 24079 - DNA, 19 bp, Homo sapiens
ccttgctattttcatatta

SEQ ID NO: 24080 - DNA, 19 bp, Homo sapiens
ttataaaatttatttgata

SEQ ID NO: 24081 - DNA, 21 bp, Homo sapiens
tcctgaggaacgactatctca

SEQ ID NO: 24082 - DNA, 18 bp, Homo sapiens
ggtgttgagttgccttca

SEQ ID NO: 24083 - DNA, 18 bp, Homo sapiens
tctggcctccatcctcca

SEQ ID NO: 24084 - DNA, 18 bp, Homo sapiens
agtagtggactcgactca

SEQ ID NO: 24085 - DNA, 17 bp, Homo sapiens
cccccaactccctccca

SEQ ID NO: 24086 - DNA, 19 bp, Homo sapiens
ccggcttccttttctgtcc

SEQ ID NO: 24087 - DNA, 22 bp, Homo sapiens
ctaggcaccccacgattagctg

SEQ ID NO: 24088 - DNA, 22 bp, Homo sapiens
ggcaaaagcgtagatcttgtca

SEQ ID NO: 24089 - DNA, 19 bp, Homo sapiens
tggatggactcctgcaggc

SEQ ID NO: 24090 - DNA, 20 bp, Homo sapiens
ttgtttgactttttgtacaa

SEQ ID NO: 24091 - DNA, 17 bp, Homo sapiens
aagccccagcagcccca

SEQ ID NO: 24092 - DNA, 19 bp, Homo sapiens
cagcagcagcagcagcccc

SEQ ID NO: 24093 - DNA, 21 bp, Homo sapiens
cccgaggcaccgccggtaagc

SEQ ID NO: 24094 - DNA, 22 bp, Homo sapiens
agctatgtctttctccagtgat

SEQ ID NO: 24095 - DNA, 22 bp, Homo sapiens
atttgaacttaggtgttggttt

SEQ ID NO: 24096 - DNA, 20 bp, Homo sapiens
ccacattatctcttttcaga

SEQ ID NO: 24097 - DNA, 19 bp, Homo sapiens
gcagagaacaaaaatttca

SEQ ID NO: 24098 - DNA, 17 bp, Homo sapiens
aaaagaaagcaaggata

SEQ ID NO: 24099 - DNA, 25 bp, Homo sapiens
gccttagctctgtggtgtctggctc

SEQ ID NO: 24100 - DNA, 18 bp, Homo sapiens
tcttagctgtctaatttt

SEQ ID NO: 24101 - DNA, 17 bp, Homo sapiens
tttaggtaatctgcact

SEQ ID NO: 24102 - DNA, 23 bp, Homo sapiens
actcttcaccacaccctgtattc

SEQ ID NO: 24103 - DNA, 19 bp, Homo sapiens
gcctgaaccttggcttggc

SEQ ID NO: 24104 - DNA, 17 bp, Homo sapiens
aaggagtacttgtactg

SEQ ID NO: 24105 - DNA, 18 bp, Homo sapiens
cacagtaagattccctct

SEQ ID NO: 24106 - DNA, 21 bp, Homo sapiens
cagacgtggtgtggtgcacac

SEQ ID NO: 24107 - DNA, 18 bp, Homo sapiens
ttgtactgctttgatttt

SEQ ID NO: 24108 - DNA, 22 bp, Homo sapiens
cacctttttaaaaaattgcaca

SEQ ID NO: 24109 - DNA, 21 bp, Homo sapiens
cctatggaactttgcctgatg

SEQ ID NO: 24110 - DNA, 20 bp, Homo sapiens
gcccctgcacaaggctgaca

SEQ ID NO: 24111 - DNA, 18 bp, Homo sapiens
agcacttcgccttgtcct

SEQ ID NO: 24112 - DNA, 17 bp, Homo sapiens
attatcagggcattcta

SEQ ID NO: 24113 - DNA, 20 bp, Homo sapiens
caaaattaatttctgcccct

SEQ ID NO: 24114 - DNA, 17 bp, Homo sapiens
cccacctgccccgagct

SEQ ID NO: 24115 - DNA, 23 bp, Homo sapiens
cctttccaatttttctattccag

SEQ ID NO: 24116 - DNA, 20 bp, Homo sapiens
ctctccccactccacgctcc

SEQ ID NO: 24117 - DNA, 20 bp, Homo sapiens
ggagcgacggcggctgcagc

SEQ ID NO: 24118 - DNA, 19 bp, Homo sapiens
accaccactcctacctttt

SEQ ID NO: 24119 - DNA, 22 bp, Homo sapiens
tctggctgcataactcacagga

SEQ ID NO: 24120 - DNA, 19 bp, Homo sapiens
tctgattgtgaatactgct

SEQ ID NO: 24121 - DNA, 19 bp, Homo sapiens
ttacgacgttgcctggtct

SEQ ID NO: 24122 - DNA, 21 bp, Homo sapiens
tttgatgtataacttcccctt

SEQ ID NO: 24123 - DNA, 24 bp, Homo sapiens
accagagacccagaccccactcca

SEQ ID NO: 24124 - DNA, 18 bp, Homo sapiens
agtcagacagcagctctg

SEQ ID NO: 24125 - DNA, 19 bp, Homo sapiens
cagctggtctgaccaccgt

SEQ ID NO: 24126 - DNA, 17 bp, Homo sapiens
ctgtctccttcctccca

SEQ ID NO: 24127 - DNA, 19 bp, Homo sapiens
cttgagtctctgctggctc

SEQ ID NO: 24128 - DNA, 19 bp, Homo sapiens
ggctccctggtagaagctg

SEQ ID NO: 24129 - DNA, 17 bp, Homo sapiens
aagactgaactttgtaa

SEQ ID NO: 24130 - DNA, 21 bp, Homo sapiens
agtaaaccagttcccaaacac

SEQ ID NO: 24131 - DNA, 21 bp, Homo sapiens
ttccagaaaccattgcaccag

SEQ ID NO: 24132 - DNA, 19 bp, Homo sapiens
acctaacagctccctttgg

SEQ ID NO: 24133 - DNA, 20 bp, Homo sapiens
atcccaccctctgcccaact

SEQ ID NO: 24134 - DNA, 23 bp, Homo sapiens
gtacacagggcctccctcaccca

SEQ ID NO: 24135 - DNA, 17 bp, Homo sapiens
atatatttgagcagtcc

SEQ ID NO: 24136 - DNA, 17 bp, Homo sapiens
tgtaagctggaaattta

SEQ ID NO: 24137 - DNA, 24 bp, Homo sapiens
tttgagcagtccctgctgacattt

SEQ ID NO: 24138 - DNA, 24 bp, Homo sapiens
aagaatctcagcagtattatcaca

SEQ ID NO: 24139 - DNA, 18 bp, Homo sapiens
acatcttcaccttcttca

SEQ ID NO: 24140 - DNA, 17 bp, Homo sapiens
caacaactgacttacta

SEQ ID NO: 24141 - DNA, 23 bp, Homo sapiens
gcaggtaaaaatgaaaatccata

SEQ ID NO: 24142 - DNA, 22 bp, Homo sapiens
tgccatccttagcatcagccca

SEQ ID NO: 24143 - DNA, 20 bp, Homo sapiens
ttccttgctgaagtccctaa

SEQ ID NO: 24144 - DNA, 17 bp, Homo sapiens
ccgcccctccctgctga

SEQ ID NO: 24145 - DNA, 25 bp, Homo sapiens
tggatgatgagcctgacgtggaact

SEQ ID NO: 24146 - DNA, 19 bp, Homo sapiens
atgttgagaaccctgatga

SEQ ID NO: 24147 - DNA, 19 bp, Homo sapiens
tcaatcactcagcccctcc

SEQ ID NO: 24148 - DNA, 23 bp, Homo sapiens
tctctcccaagtgccttgatctt

SEQ ID NO: 24149 - DNA, 22 bp, Homo sapiens
cccaccgtgatgacttgaaata

SEQ ID NO: 24150 - DNA, 17 bp, Homo sapiens
gaagaaaatccaaggct

SEQ ID NO: 24151 - DNA, 22 bp, Homo sapiens
tctagtgatctgcccacctcaa

SEQ ID NO: 24152 - DNA, 23 bp, Homo sapiens
aagacacccccctggacccatca

SEQ ID NO: 24153 - DNA, 16 bp, Homo sapiens
agtactacaagaacaa

SEQ ID NO: 24154 - DNA, 19 bp, Homo sapiens
catggcacacttcatggca

SEQ ID NO: 24155 - DNA, 18 bp, Homo sapiens
cccatcccagacccctca

SEQ ID NO: 24156 - DNA, 18 bp, Homo sapiens
gcatgtggtcaagatgca

SEQ ID NO: 24157 - DNA, 22 bp, Homo sapiens
tcaccatcaccaacccatccca

SEQ ID NO: 24158 - DNA, 25 bp, Homo sapiens
tgtcagtggcaaacaaccctatcca

SEQ ID NO: 24159 - DNA, 21 bp, Homo sapiens
agccaccatgcccagcctcct

SEQ ID NO: 24160 - DNA, 20 bp, Homo sapiens
cctctgcctcccaggttcaa

SEQ ID NO: 24161 - DNA, 19 bp, Homo sapiens
ctgcaacctctgcctccca

SEQ ID NO: 24162 - DNA, 21 bp, Homo sapiens
caatatggactgctatttact

SEQ ID NO: 24163 - DNA, 24 bp, Homo sapiens
caggagcacgtgttagtctggtta

SEQ ID NO: 24164 - DNA, 20 bp, Homo sapiens
ccagctatgggtgcccacct

SEQ ID NO: 24165 - DNA, 22 bp, Homo sapiens
gcaaagaggacctcagaaccca

SEQ ID NO: 24166 - DNA, 17 bp, Homo sapiens
ggggtcacattctgcag

SEQ ID NO: 24167 - DNA, 19 bp, Homo sapiens
cctcatggatgtctggtcc

SEQ ID NO: 24168 - DNA, 19 bp, Homo sapiens
ggaaagatcaaggaaccaa

SEQ ID NO: 24169 - DNA, 20 bp, Homo sapiens
cagggtgctcaggcctggtt

SEQ ID NO: 24170 - DNA, 25 bp, Homo sapiens
gcgggtagctcctggggctgagcca

SEQ ID NO: 24171 - DNA, 24 bp, Homo sapiens
ggaatacaggcatgagccaccgca

SEQ ID NO: 24172 - DNA, 18 bp, Homo sapiens
aagtagagtaatagcact

SEQ ID NO: 24173 - DNA, 19 bp, Homo sapiens
ccgagccgcccgcctcttc

SEQ ID NO: 24174 - DNA, 17 bp, Homo sapiens
tcttccttcagcgcgtc

SEQ ID NO: 24175 - DNA, 19 bp, Homo sapiens
aagcaattctcctgcctca

SEQ ID NO: 24176 - DNA, 18 bp, Homo sapiens
tgggtggatcacctgagg

SEQ ID NO: 24177 - DNA, 19 bp, Homo sapiens
cctttcggccgccgggctc

SEQ ID NO: 24178 - DNA, 17 bp, Homo sapiens
ctccaagacaaaacttc

SEQ ID NO: 24179 - DNA, 24 bp, Homo sapiens
cctttttgtgtttgcttttgtttt

SEQ ID NO: 24180 - DNA, 22 bp, Homo sapiens
tcctggtgactgaacttctggg

SEQ ID NO: 24181 - DNA, 21 bp, Homo sapiens
tgcagtgagccaagatcgtgc

SEQ ID NO: 24182 - DNA, 17 bp, Homo sapiens
acaaaatttacagtttt

SEQ ID NO: 24183 - DNA, 19 bp, Homo sapiens
actggaggaccaagctggt

SEQ ID NO: 24184 - DNA, 19 bp, Homo sapiens
tcattattgactcactttt

SEQ ID NO: 24185 - DNA, 23 bp, Homo sapiens
acctgggctccaagtctgagttc

SEQ ID NO: 24186 - DNA, 20 bp, Homo sapiens
actggtggggagaccatggc

SEQ ID NO: 24187 - DNA, 21 bp, Homo sapiens
ccgaggaatctgcctcccacc

SEQ ID NO: 24188 - DNA, 24 bp, Homo sapiens
cttgtgcagtgctggactcaccca

SEQ ID NO: 24189 - DNA, 27 bp, Homo sapiens
tggatggccctgccctgactggggctg

SEQ ID NO: 24190 - DNA, 19 bp, Homo sapiens
aatcccacacctcctgttt

SEQ ID NO: 24191 - DNA, 20 bp, Homo sapiens
ccaaccccatccccacctcc

SEQ ID NO: 24192 - DNA, 21 bp, Homo sapiens
tgcccagggtcctgccctcag

SEQ ID NO: 24193 - DNA, 23 bp, Homo sapiens
agccgagcagccgctgggcgctc

SEQ ID NO: 24194 - DNA, 18 bp, Homo sapiens
aggtcagtttatgaaaca

SEQ ID NO: 24195 - DNA, 18 bp, Homo sapiens
gcctctctgtacactgcc

SEQ ID NO: 24196 - DNA, 19 bp, Homo sapiens
gggatttggggtctggtta

SEQ ID NO: 24197 - DNA, 20 bp, Homo sapiens
tatcaataaattccatgttt

SEQ ID NO: 24198 - DNA, 20 bp, Homo sapiens
tcaataaattccatgtttag

SEQ ID NO: 24199 - DNA, 19 bp, Homo sapiens
tctggaagtattttcctcc

SEQ ID NO: 24200 - DNA, 20 bp, Homo sapiens
accagaaagcagcccactgg

SEQ ID NO: 24201 - DNA, 22 bp, Homo sapiens
tctcccatctcccagtccttca

SEQ ID NO: 24202 - DNA, 22 bp, Homo sapiens
tagcccgcggctcggctcagtc

SEQ ID NO: 24203 - DNA, 21 bp, Homo sapiens
ccaacttgtgaagcacacagc

SEQ ID NO: 24204 - DNA, 20 bp, Homo sapiens
ccagcatggggcctgtactt

SEQ ID NO: 24205 - DNA, 21 bp, Homo sapiens
ctgcctcagccgcctccccca

SEQ ID NO: 24206 - DNA, 20 bp, Homo sapiens
ggggaaaccaggtgattgcc

SEQ ID NO: 24207 - DNA, 18 bp, Homo sapiens
gtcaccacccctgcctcc

SEQ ID NO: 24208 - DNA, 19 bp, Homo sapiens
tcaccatgtactgatgatc

SEQ ID NO: 24209 - DNA, 23 bp, Homo sapiens
cagggagaaggacaaggcataca

SEQ ID NO: 24210 - DNA, 19 bp, Homo sapiens
gcgggccccagcctgaggg

SEQ ID NO: 24211 - DNA, 18 bp, Homo sapiens
catcttaaaacatgttga

SEQ ID NO: 24212 - DNA, 19 bp, Homo sapiens
cttctctgtatctgccttt

SEQ ID NO: 24213 - DNA, 24 bp, Homo sapiens
gcgcaggtctcaaggcggctgaga

SEQ ID NO: 24214 - DNA, 22 bp, Homo sapiens
tctgtgattctttttcccctcc

SEQ ID NO: 24215 - DNA, 27 bp, Homo sapiens
atgttgatgaagaacttcctgattaca

SEQ ID NO: 24216 - DNA, 22 bp, Homo sapiens
ccacttgccattcctagcgcga

SEQ ID NO: 24217 - DNA, 19 bp, Homo sapiens
ccagtggccgagcctgctg

SEQ ID NO: 24218 - DNA, 18 bp, Homo sapiens
tccccttggtcatgggat

SEQ ID NO: 24219 - DNA, 22 bp, Homo sapiens
ctgagaaaaacttttttattaa

SEQ ID NO: 24220 - DNA, 19 bp, Homo sapiens
tctaggattttatctgatg

SEQ ID NO: 24221 - DNA, 18 bp, Homo sapiens
ttatccccccatcactaa

SEQ ID NO: 24222 - DNA, 16 bp, Homo sapiens
agagacatcccgatct

SEQ ID NO: 24223 - DNA, 21 bp, Homo sapiens
ccctggcctgcggggacctgc

SEQ ID NO: 24224 - DNA, 23 bp, Homo sapiens
ctttggtagctaacagtcactga

SEQ ID NO: 24225 - DNA, 17 bp, Homo sapiens
gcgcgcacgcggatccc

SEQ ID NO: 24226 - DNA, 20 bp, Homo sapiens
tctgaggctgtttgggcttt

SEQ ID NO: 24227 - DNA, 18 bp, Homo sapiens
gcaatatattttgtaata

SEQ ID NO: 24228 - DNA, 19 bp, Homo sapiens
tctttttcactcatagaat

SEQ ID NO: 24229 - DNA, 25 bp, Homo sapiens
acccaccccatcctcggtctttgca

SEQ ID NO: 24230 - DNA, 21 bp, Homo sapiens
ccagcatctcaggagcacctc

SEQ ID NO: 24231 - DNA, 17 bp, Homo sapiens
ccggagcaaggccagga

SEQ ID NO: 24232 - DNA, 21 bp, Homo sapiens
ccggcgccctcttcacacgta

SEQ ID NO: 24233 - DNA, 20 bp, Homo sapiens
gcccagccccgcctcaggga

SEQ ID NO: 24234 - DNA, 17 bp, Homo sapiens
ggacagttgtgaaaata

SEQ ID NO: 24235 - DNA, 18 bp, Homo sapiens
tcccccacacccacccca

SEQ ID NO: 24236 - DNA, 21 bp, Homo sapiens
aaccaagacactacattgtct

SEQ ID NO: 24237 - DNA, 20 bp, Homo sapiens
gttctctgtttttccagttc

SEQ ID NO: 24238 - DNA, 22 bp, Homo sapiens
gttttcatttttataactggta

SEQ ID NO: 24239 - DNA, 22 bp, Homo sapiens
tttccaaaaatctggggtacta

SEQ ID NO: 24240 - DNA, 22 bp, Homo sapiens
ccccgccccagtcccgcagtcc

SEQ ID NO: 24241 - DNA, 21 bp, Homo sapiens
gagaagtaaaacttagctgca

SEQ ID NO: 24242 - DNA, 21 bp, Homo sapiens
gggatgagctccagcatgggg

SEQ ID NO: 24243 - DNA, 21 bp, Homo sapiens
ctctacaaaccaggacagctg

SEQ ID NO: 24244 - DNA, 24 bp, Homo sapiens
acatgagaactccatgtcacctcc

SEQ ID NO: 24245 - DNA, 18 bp, Homo sapiens
atttccactcccacaccc

SEQ ID NO: 24246 - DNA, 19 bp, Homo sapiens
ctgcaacctccgcctccca

SEQ ID NO: 24247 - DNA, 19 bp, Homo sapiens
tacttttgccttctgctca

SEQ ID NO: 24248 - DNA, 17 bp, Homo sapiens
tcaagtgattctcctgc

SEQ ID NO: 24249 - DNA, 18 bp, Homo sapiens
tccgcctcccaggttcaa

SEQ ID NO: 24250 - DNA, 18 bp, Homo sapiens
caggtgtgagccacttca

SEQ ID NO: 24251 - DNA, 20 bp, Homo sapiens
atgtggaggtttatgggtga

SEQ ID NO: 24252 - DNA, 24 bp, Homo sapiens
ccaggatgaggacccctccatctc

SEQ ID NO: 24253 - DNA, 19 bp, Homo sapiens
ccctgggcctttccatctc

SEQ ID NO: 24254 - DNA, 20 bp, Homo sapiens
ggaagtgtcagtatagaccc

SEQ ID NO: 24255 - DNA, 21 bp, Homo sapiens
gtagttgtcggtctcactgat

SEQ ID NO: 24256 - DNA, 24 bp, Homo sapiens
tcttgatggcatttcccttctgag

SEQ ID NO: 24257 - DNA, 23 bp, Homo sapiens
ttttgacccaggagggccgcgag

SEQ ID NO: 24258 - DNA, 19 bp, Homo sapiens
aaacagtgattgaaatttc

SEQ ID NO: 24259 - DNA, 20 bp, Homo sapiens
acaaaattccagggtttttg

SEQ ID NO: 24260 - DNA, 22 bp, Homo sapiens
agaaactctacaccaaatacac

SEQ ID NO: 24261 - DNA, 17 bp, Homo sapiens
agccacactccatcata

SEQ ID NO: 24262 - DNA, 18 bp, Homo sapiens
atccctggcctgttgtca

SEQ ID NO: 24263 - DNA, 19 bp, Homo sapiens
atgtaagctgtgctgttta

SEQ ID NO: 24264 - DNA, 16 bp, Homo sapiens
cagccctctgcctggc

SEQ ID NO: 24265 - DNA, 23 bp, Homo sapiens
ctccaaacactcctctaagcact

SEQ ID NO: 24266 - DNA, 19 bp, Homo sapiens
ctcctattagccatatgat

SEQ ID NO: 24267 - DNA, 19 bp, Homo sapiens
gttgtagagatagagccat

SEQ ID NO: 24268 - DNA, 23 bp, Homo sapiens
tagataactccagcaggaaactg

SEQ ID NO: 24269 - DNA, 20 bp, Homo sapiens
tttctttttaggtaactggt

SEQ ID NO: 24270 - DNA, 21 bp, Homo sapiens
agtgtccagcccagtgttgaa

SEQ ID NO: 24271 - DNA, 17 bp, Homo sapiens
ctcccctccctgcttct

SEQ ID NO: 24272 - DNA, 21 bp, Homo sapiens
gaggagtggcccccactcctc

SEQ ID NO: 24273 - DNA, 18 bp, Homo sapiens
gcaggggtggggtggggg

SEQ ID NO: 24274 - DNA, 23 bp, Homo sapiens
cttcacggaggagggcttgtgag

SEQ ID NO: 24275 - DNA, 19 bp, Homo sapiens
ggcatgctcttaggcccag

SEQ ID NO: 24276 - DNA, 16 bp, Homo sapiens
tctcctgcgtcagcct

SEQ ID NO: 24277 - DNA, 18 bp, Homo sapiens
tctctacaaaaaatacaa

SEQ ID NO: 24278 - DNA, 24 bp, Homo sapiens
ttatcatgatgctgtccctcctga

SEQ ID NO: 24279 - DNA, 23 bp, Homo sapiens
gaacagaagtttaagttattgtt

SEQ ID NO: 24280 - DNA, 27 bp, Homo sapiens
tctaagctgacctagtgattctgctga

SEQ ID NO: 24281 - DNA, 20 bp, Homo sapiens
ttcaagaccagcctgaccaa

SEQ ID NO: 24282 - DNA, 22 bp, Homo sapiens
gaacccaggagagccactctgg

SEQ ID NO: 24283 - DNA, 20 bp, Homo sapiens
agggacttctagcaaacctg

SEQ ID NO: 24284 - DNA, 16 bp, Homo sapiens
ctacaagcttgtccaa

SEQ ID NO: 24285 - DNA, 26 bp, Homo sapiens
cttcttctggaagttgcctgaatttt

SEQ ID NO: 24286 - DNA, 18 bp, Homo sapiens
taggtaagttatctactt

SEQ ID NO: 24287 - DNA, 20 bp, Homo sapiens
tttataacctgaaatcatct

SEQ ID NO: 24288 - DNA, 20 bp, Homo sapiens
acagagccctacagccaggg

SEQ ID NO: 24289 - DNA, 22 bp, Homo sapiens
gagccaagatcgcaccactgca

SEQ ID NO: 24290 - DNA, 17 bp, Homo sapiens
ggcggggtggggctgcc

SEQ ID NO: 24291 - DNA, 17 bp, Homo sapiens
ggtgaagacaagctgcg

SEQ ID NO: 24292 - DNA, 17 bp, Homo sapiens
gttcccggcacgggaga

SEQ ID NO: 24293 - DNA, 18 bp, Homo sapiens
agttcagtctagatggca

SEQ ID NO: 24294 - DNA, 16 bp, Homo sapiens
ccttccccaggcatcc

SEQ ID NO: 24295 - DNA, 22 bp, Homo sapiens
ctccccctctccttttgctctc

SEQ ID NO: 24296 - DNA, 19 bp, Homo sapiens
aataacaatgccaacatcc

SEQ ID NO: 24297 - DNA, 18 bp, Homo sapiens
gaggaaagcagctgtgag

SEQ ID NO: 24298 - DNA, 18 bp, Homo sapiens
gtatcaaatatctggcaa

SEQ ID NO: 24299 - DNA, 19 bp, Homo sapiens
gtgaagtatggtttggctg

SEQ ID NO: 24300 - DNA, 17 bp, Homo sapiens
ctgttttgctatatccc

SEQ ID NO: 24301 - DNA, 24 bp, Homo sapiens
ggcgcccgccacctcgcccggcta

SEQ ID NO: 24302 - DNA, 21 bp, Homo sapiens
tcttaaagctgccttaacctt

SEQ ID NO: 24303 - DNA, 20 bp, Homo sapiens
agacgtccctccctcgggga

SEQ ID NO: 24304 - DNA, 19 bp, Homo sapiens
ccttccatgaggcctggac

SEQ ID NO: 24305 - DNA, 20 bp, Homo sapiens
aagagacttttcccctgttt

SEQ ID NO: 24306 - DNA, 20 bp, Homo sapiens
agatggatgatgcacgactc

SEQ ID NO: 24307 - DNA, 19 bp, Homo sapiens
tgaggcttgtttctgccac

SEQ ID NO: 24308 - DNA, 21 bp, Homo sapiens
ttcctatccacagtcacttct

SEQ ID NO: 24309 - DNA, 19 bp, Homo sapiens
ccttcccccaccttcctcc

SEQ ID NO: 24310 - DNA, 17 bp, Homo sapiens
cgggaggcccgtcccag

SEQ ID NO: 24311 - DNA, 20 bp, Homo sapiens
gaactgggcaccctcgagcc

SEQ ID NO: 24312 - DNA, 20 bp, Homo sapiens
ggctgagaacgaaggatcac

SEQ ID NO: 24313 - DNA, 20 bp, Homo sapiens
tgcctcagtttctccatctc

SEQ ID NO: 24314 - DNA, 19 bp, Homo sapiens
tttccctcagcctgtgcac

SEQ ID NO: 24315 - DNA, 20 bp, Homo sapiens
agtcaccagaggagattcaa

SEQ ID NO: 24316 - DNA, 19 bp, Homo sapiens
tcctcaagaaaactattta

SEQ ID NO: 24317 - DNA, 20 bp, Homo sapiens
tgaacctgccgcctccgtgc

SEQ ID NO: 24318 - DNA, 17 bp, Homo sapiens
aggcagaaggatcactt

SEQ ID NO: 24319 - DNA, 18 bp, Homo sapiens
caccattctcctgcctca

SEQ ID NO: 24320 - DNA, 21 bp, Homo sapiens
tcttggtgatggtcaactctg

SEQ ID NO: 24321 - DNA, 24 bp, Homo sapiens
tggatgctggagtaagtggaattg

SEQ ID NO: 24322 - DNA, 17 bp, Homo sapiens
aggagcgaacactgcac

SEQ ID NO: 24323 - DNA, 19 bp, Homo sapiens
ccgctgctgcgcgcctggc

SEQ ID NO: 24324 - DNA, 22 bp, Homo sapiens
cttctctcttctcctttgcctc

SEQ ID NO: 24325 - DNA, 16 bp, Homo sapiens
gctctatttctgtggc

SEQ ID NO: 24326 - DNA, 22 bp, Homo sapiens
tcctttgcctcctcttccctca

SEQ ID NO: 24327 - DNA, 24 bp, Homo sapiens
atttggacaattatgtcctggtct

SEQ ID NO: 24328 - DNA, 20 bp, Homo sapiens
cacttgttcctcacaaaaac

SEQ ID NO: 24329 - DNA, 21 bp, Homo sapiens
ccacctctgcagtcctggaga

SEQ ID NO: 24330 - DNA, 17 bp, Homo sapiens
cgctcctcttctcccct

SEQ ID NO: 24331 - DNA, 23 bp, Homo sapiens
cttcccacttccattcttgcaca

SEQ ID NO: 24332 - DNA, 23 bp, Homo sapiens
gctcctcttctcccctcctcctc

SEQ ID NO: 24333 - DNA, 18 bp, Homo sapiens
tctttttttaaactttgc

SEQ ID NO: 24334 - DNA, 16 bp, Homo sapiens
tgttggcatcatctct

SEQ ID NO: 24335 - DNA, 22 bp, Homo sapiens
caggaacgactggccttggtca

SEQ ID NO: 24336 - DNA, 21 bp, Homo sapiens
ccgtaggagggacagtacctc

SEQ ID NO: 24337 - DNA, 21 bp, Homo sapiens
ctctccttttttcattccgat

SEQ ID NO: 24338 - DNA, 19 bp, Homo sapiens
tcaccatccagactgcaga

SEQ ID NO: 24339 - DNA, 20 bp, Homo sapiens
ttaaagaccccactcgacca

SEQ ID NO: 24340 - DNA, 26 bp, Homo sapiens
cggacgcgctgctcacctgtcttttt

SEQ ID NO: 24341 - DNA, 24 bp, Homo sapiens
catccacacctggcactcccctct

SEQ ID NO: 24342 - DNA, 21 bp, Homo sapiens
cccacccgcctcttccccttt

SEQ ID NO: 24343 - DNA, 18 bp, Homo sapiens
cctgccctcaccatctca

SEQ ID NO: 24344 - DNA, 21 bp, Homo sapiens
tgaggctggccacctgccact

SEQ ID NO: 24345 - DNA, 17 bp, Homo sapiens
tgccagacacggcgatt

SEQ ID NO: 24346 - DNA, 16 bp, Homo sapiens
ttcgaggtttctctca

SEQ ID NO: 24347 - DNA, 21 bp, Homo sapiens
ccttcccaaacacctccttcc

SEQ ID NO: 24348 - DNA, 21 bp, Homo sapiens
ccttcccaaacacctccttcc

SEQ ID NO: 24349 - DNA, 21 bp, Homo sapiens
ccttcccaaacacctctttcc

SEQ ID NO: 24350 - DNA, 19 bp, Homo sapiens
ccttcccaaacccctttcc

SEQ ID NO: 24351 - DNA, 22 bp, Homo sapiens
ccttcccaacaccgccttccca

SEQ ID NO: 24352 - DNA, 20 bp, Homo sapiens
ccttcccaacacctccttcc

SEQ ID NO: 24353 - DNA, 20 bp, Homo sapiens
ccttcccaacacctccttcc

SEQ ID NO: 24354 - DNA, 20 bp, Homo sapiens
ccttcccaacacctccttcc

SEQ ID NO: 24355 - DNA, 20 bp, Homo sapiens
ccttcccaacacctccttcc

SEQ ID NO: 24356 - DNA, 20 bp, Homo sapiens
ccttcccaacacctccttcc

SEQ ID NO: 24357 - DNA, 21 bp, Homo sapiens
ccttcccagacacctccttcc

SEQ ID NO: 24358 - DNA, 21 bp, Homo sapiens
ccttccccaacacctccttcc

SEQ ID NO: 24359 - DNA, 21 bp, Homo sapiens
ccttccccaacacctccttcc

SEQ ID NO: 24360 - DNA, 21 bp, Homo sapiens
ccttccccaacacctccttcc

SEQ ID NO: 24361 - DNA, 21 bp, Homo sapiens
ccttccccaacacttccttcc

SEQ ID NO: 24362 - DNA, 21 bp, Homo sapiens
ccttccccaacatccttccca

SEQ ID NO: 24363 - DNA, 24 bp, Homo sapiens
gaagagacattcaaatacatttca

SEQ ID NO: 24364 - DNA, 21 bp, Homo sapiens
tctccgctcactctcttcctc

SEQ ID NO: 24365 - DNA, 17 bp, Homo sapiens
gcctgatcaggagactg

SEQ ID NO: 24366 - DNA, 20 bp, Homo sapiens
tcagccagtggcgttgcgca

SEQ ID NO: 24367 - DNA, 22 bp, Homo sapiens
gagccaagatcacactactgca

SEQ ID NO: 24368 - DNA, 16 bp, Homo sapiens
ctgagaagcagagcca

SEQ ID NO: 24369 - DNA, 22 bp, Homo sapiens
ggccgcttgggcgcacttgccg

SEQ ID NO: 24370 - DNA, 22 bp, Homo sapiens
tggatggattctggtggatgaa

SEQ ID NO: 24371 - DNA, 21 bp, Homo sapiens
aaccatccagaaataccatcc

SEQ ID NO: 24372 - DNA, 17 bp, Homo sapiens
cagatctccaagaactc

SEQ ID NO: 24373 - DNA, 22 bp, Homo sapiens
catgtacgttcttgtacacaga

SEQ ID NO: 24374 - DNA, 18 bp, Homo sapiens
ccagatctccaagaactc

SEQ ID NO: 24375 - DNA, 26 bp, Homo sapiens
ctttccccacggctttaatcatgaaa

SEQ ID NO: 24376 - DNA, 21 bp, Homo sapiens
gtgccttgtgggttggacttt

SEQ ID NO: 24377 - DNA, 22 bp, Homo sapiens
acctctcatggctttttggttc

SEQ ID NO: 24378 - DNA, 23 bp, Homo sapiens
ggacaaagccaacaatccacttc

SEQ ID NO: 24379 - DNA, 24 bp, Homo sapiens
ggtgtatcacagcagtacctctca

SEQ ID NO: 24380 - DNA, 21 bp, Homo sapiens
tcttgaaaggtggtctgtgga

SEQ ID NO: 24381 - DNA, 24 bp, Homo sapiens
ttaaggacaaagccaacaatccac

SEQ ID NO: 24382 - DNA, 16 bp, Homo sapiens
actgataaattgtgat

SEQ ID NO: 24383 - DNA, 21 bp, Homo sapiens
ggtttgttattttaaaatcac

SEQ ID NO: 24384 - DNA, 21 bp, Homo sapiens
agagcatcttccacatcaact

SEQ ID NO: 24385 - DNA, 21 bp, Homo sapiens
cgagcgagcggcgcccagccc

SEQ ID NO: 24386 - DNA, 21 bp, Homo sapiens
gcagttttgtgaggcttttgt

SEQ ID NO: 24387 - DNA, 16 bp, Homo sapiens
tctggctgaggcttgc

SEQ ID NO: 24388 - DNA, 20 bp, Homo sapiens
tgtagaaaatgcttgtggtg

SEQ ID NO: 24389 - DNA, 18 bp, Homo sapiens
gacagcgcgtggcttggc

SEQ ID NO: 24390 - DNA, 19 bp, Homo sapiens
aatgtttccttttacttca

SEQ ID NO: 24391 - DNA, 22 bp, Homo sapiens
ggctcccgtgaaaactctatca

SEQ ID NO: 24392 - DNA, 19 bp, Homo sapiens
ggtggaagctctcaagctc

SEQ ID NO: 24393 - DNA, 19 bp, Homo sapiens
gtggcagatacttcaggct

SEQ ID NO: 24394 - DNA, 21 bp, Homo sapiens
tcgctctgtaacctgcgggta

SEQ ID NO: 24395 - DNA, 15 bp, Homo sapiens
acagacgccggccgc

SEQ ID NO: 24396 - DNA, 19 bp, Homo sapiens
cgcccccaccctcgagctc

SEQ ID NO: 24397 - DNA, 22 bp, Homo sapiens
cgggcgcccacctcgcccagcc

SEQ ID NO: 24398 - DNA, 19 bp, Homo sapiens
ctgagattctatttccaca

SEQ ID NO: 24399 - DNA, 20 bp, Homo sapiens
ctgttaggtccgcttggtcc

SEQ ID NO: 24400 - DNA, 22 bp, Homo sapiens
cttctttgtcttttttgatctt

SEQ ID NO: 24401 - DNA, 19 bp, Homo sapiens
gtattaggtgcatacatat

SEQ ID NO: 24402 - DNA, 20 bp, Homo sapiens
taaataaaaacataagtata

SEQ ID NO: 24403 - DNA, 18 bp, Homo sapiens
tgagattctatttccaca

SEQ ID NO: 24404 - DNA, 21 bp, Homo sapiens
ccccctgggccacgccgatca

SEQ ID NO: 24405 - DNA, 19 bp, Homo sapiens
cccgccgctgccgcctccg

SEQ ID NO: 24406 - DNA, 18 bp, Homo sapiens
cccgcaacctccgcctcc

SEQ ID NO: 24407 - DNA, 22 bp, Homo sapiens
ctgggattacaggcacctgcca

SEQ ID NO: 24408 - DNA, 18 bp, Homo sapiens
tccgcctcccaggttcaa

SEQ ID NO: 24409 - DNA, 22 bp, Homo sapiens
ccctgccctgggagacctgggg

SEQ ID NO: 24410 - DNA, 20 bp, Homo sapiens
cttctctgtttttctctccc

SEQ ID NO: 24411 - DNA, 20 bp, Homo sapiens
aaacacagaaggggcaggga

SEQ ID NO: 24412 - DNA, 22 bp, Homo sapiens
acacagggttaataaccaatca

SEQ ID NO: 24413 - DNA, 25 bp, Homo sapiens
atttgaaccagagaccgcttggcct

SEQ ID NO: 24414 - DNA, 18 bp, Homo sapiens
ggggcaaactgcttggca

SEQ ID NO: 24415 - DNA, 20 bp, Homo sapiens
tcaccaggacattctttcca

SEQ ID NO: 24416 - DNA, 20 bp, Homo sapiens
tcctctttcctctaaacctc

SEQ ID NO: 24417 - DNA, 22 bp, Homo sapiens
ttcagttgcacccctcacttgt

SEQ ID NO: 24418 - DNA, 17 bp, Homo sapiens
tgacggtagcttttgga

SEQ ID NO: 24419 - DNA, 21 bp, Homo sapiens
tgtgggggtggggtgggggtg

SEQ ID NO: 24420 - DNA, 15 bp, Homo sapiens
accactgtttggtcc

SEQ ID NO: 24421 - DNA, 20 bp, Homo sapiens
caaggtccctcaggctggtt

SEQ ID NO: 24422 - DNA, 17 bp, Homo sapiens
cacttgtgtggctgcct

SEQ ID NO: 24423 - DNA, 15 bp, Homo sapiens
ccaccaccttgcaga

SEQ ID NO: 24424 - DNA, 21 bp, Homo sapiens
ccccacccagctgccctcagc

SEQ ID NO: 24425 - DNA, 21 bp, Homo sapiens
ctttgggtcgttagtcctcca

SEQ ID NO: 24426 - DNA, 23 bp, Homo sapiens
gcaccagcatcagtcctgcctcc

SEQ ID NO: 24427 - DNA, 17 bp, Homo sapiens
gcacctactgtgtgctt

SEQ ID NO: 24428 - DNA, 21 bp, Homo sapiens
ggaggaggacccggcatgaca

SEQ ID NO: 24429 - DNA, 16 bp, Homo sapiens
tccatttctcatctct

SEQ ID NO: 24430 - DNA, 19 bp, Homo sapiens
tccctcaggctggttgtga

SEQ ID NO: 24431 - DNA, 18 bp, Homo sapiens
ccgcacttaactcttacc

SEQ ID NO: 24432 - DNA, 17 bp, Homo sapiens
cctggattgatctggtc

SEQ ID NO: 24433 - DNA, 19 bp, Homo sapiens
cgcgcgccgccgccgctgc

SEQ ID NO: 24434 - DNA, 18 bp, Homo sapiens
gctgcataaaatcttgca

SEQ ID NO: 24435 - DNA, 16 bp, Homo sapiens
ccactttctggtcaga

SEQ ID NO: 24436 - DNA, 21 bp, Homo sapiens
ccctctccttctccatgggca

SEQ ID NO: 24437 - DNA, 18 bp, Homo sapiens
gaaactgtttgtttgcca

SEQ ID NO: 24438 - DNA, 22 bp, Homo sapiens
gatgcccactttctggtcagac

SEQ ID NO: 24439 - DNA, 18 bp, Homo sapiens
tcggcagactggggcttc

SEQ ID NO: 24440 - DNA, 19 bp, Homo sapiens
acccagggcagggggaagc

SEQ ID NO: 24441 - DNA, 22 bp, Homo sapiens
gagccaagatcgcgccactgca

SEQ ID NO: 24442 - DNA, 19 bp, Homo sapiens
ggccgggtgcggtggctca

SEQ ID NO: 24443 - DNA, 21 bp, Homo sapiens
tgcacagacggcggcatcctc

SEQ ID NO: 24444 - DNA, 18 bp, Homo sapiens
tgtgacctgccagcttca

SEQ ID NO: 24445 - DNA, 20 bp, Homo sapiens
ccctggtggtgggcacctgt

SEQ ID NO: 24446 - DNA, 17 bp, Homo sapiens
tcaagtgattctcgtgc

SEQ ID NO: 24447 - DNA, 18 bp, Homo sapiens
tccgcctcccgggttcaa

SEQ ID NO: 24448 - DNA, 23 bp, Homo sapiens
tgagtgatcatcagatgagatta

SEQ ID NO: 24449 - DNA, 20 bp, Homo sapiens
tttgcttgggtttgaccact

SEQ ID NO: 24450 - DNA, 20 bp, Homo sapiens
aagcttacatgattcctaac

SEQ ID NO: 24451 - DNA, 19 bp, Homo sapiens
atggaagagctggttatag

SEQ ID NO: 24452 - DNA, 19 bp, Homo sapiens
gcttatagaaagcttgctt

SEQ ID NO: 24453 - DNA, 16 bp, Homo sapiens
ttggactgtttatgac

SEQ ID NO: 24454 - DNA, 23 bp, Homo sapiens
ccactttaaagtattacaactca

SEQ ID NO: 24455 - DNA, 25 bp, Homo sapiens
tcaaataggtcttgatatgaagcta

SEQ ID NO: 24456 - DNA, 17 bp, Homo sapiens
aaacacagaatatggga

SEQ ID NO: 24457 - DNA, 19 bp, Homo sapiens
acaagagtgtcagcactgt

SEQ ID NO: 24458 - DNA, 19 bp, Homo sapiens
cagtcctggcccctgcaca

SEQ ID NO: 24459 - DNA, 19 bp, Homo sapiens
ctcgggctgcaaaaggtga

SEQ ID NO: 24460 - DNA, 21 bp, Homo sapiens
gcaccaatccacactctgtat

SEQ ID NO: 24461 - DNA, 22 bp, Homo sapiens
gcacggcagcccgcctctcccc

SEQ ID NO: 24462 - DNA, 20 bp, Homo sapiens
aacagaggtgagcacctttc

SEQ ID NO: 24463 - DNA, 17 bp, Homo sapiens
aaccttgcatgtcatca

SEQ ID NO: 24464 - DNA, 23 bp, Homo sapiens
tcaccatcaagcaatccatgtca

SEQ ID NO: 24465 - DNA, 20 bp, Homo sapiens
gggcggggtcgtcgccgcca

SEQ ID NO: 24466 - DNA, 18 bp, Homo sapiens
cccctcaaagcagagcca

SEQ ID NO: 24467 - DNA, 23 bp, Homo sapiens
cttgtcaagggctctttggctga

SEQ ID NO: 24468 - DNA, 20 bp, Homo sapiens
acagggaagaaagtgaaggt

SEQ ID NO: 24469 - DNA, 23 bp, Homo sapiens
agggaagaaagtgaaggtaaccc

SEQ ID NO: 24470 - DNA, 18 bp, Homo sapiens
ttgtggaccctgggacct

SEQ ID NO: 24471 - DNA, 16 bp, Homo sapiens
accttcctgggcctca

SEQ ID NO: 24472 - DNA, 20 bp, Homo sapiens
cctctgcctcccgggttcaa

SEQ ID NO: 24473 - DNA, 21 bp, Homo sapiens
gcctctctggagacttgggga

SEQ ID NO: 24474 - DNA, 17 bp, Homo sapiens
ttctcctgccttagcct

SEQ ID NO: 24475 - DNA, 20 bp, Homo sapiens
tttctgagctagataacagg

SEQ ID NO: 24476 - DNA, 20 bp, Homo sapiens
cctccttgttgactgctgtt

SEQ ID NO: 24477 - DNA, 21 bp, Homo sapiens
cttctaatcattttttttgaa

SEQ ID NO: 24478 - DNA, 23 bp, Homo sapiens
ggcaattaataaatctcattgga

SEQ ID NO: 24479 - DNA, 18 bp, Homo sapiens
taagttccaattctacac

SEQ ID NO: 24480 - DNA, 20 bp, Homo sapiens
ttatacagaatatctcttta

SEQ ID NO: 24481 - DNA, 21 bp, Homo sapiens
acacaggacccttaactttgc

SEQ ID NO: 24482 - DNA, 22 bp, Homo sapiens
caaactattttgatggactgtg

SEQ ID NO: 24483 - DNA, 19 bp, Homo sapiens
cccatattgcatctttgaa

SEQ ID NO: 24484 - DNA, 21 bp, Homo sapiens
tgaagagatggatatcaagta

SEQ ID NO: 24485 - DNA, 22 bp, Homo sapiens
acacgagtcagcacacttttta

SEQ ID NO: 24486 - DNA, 20 bp, Homo sapiens
agcattaatgtaacaaaaag

SEQ ID NO: 24487 - DNA, 18 bp, Homo sapiens
gtaaacatcagaactagc

SEQ ID NO: 24488 - DNA, 22 bp, Homo sapiens
gaaccaagatcacgccactgca

SEQ ID NO: 24489 - DNA, 20 bp, Homo sapiens
caaatgaaatggacaatgca

SEQ ID NO: 24490 - DNA, 18 bp, Homo sapiens
gctctctgagggttctga

SEQ ID NO: 24491 - DNA, 16 bp, Homo sapiens
gggcagctgggctcgg

SEQ ID NO: 24492 - DNA, 19 bp, Homo sapiens
tagttgcaaagttagtcta

SEQ ID NO: 24493 - DNA, 17 bp, Homo sapiens
tggttgagaccaggtga

SEQ ID NO: 24494 - DNA, 18 bp, Homo sapiens
atgaaatttcatagctta

SEQ ID NO: 24495 - DNA, 24 bp, Homo sapiens
gattatattgaatgatttaaaact

SEQ ID NO: 24496 - DNA, 19 bp, Homo sapiens
ggaacaattaaaaacaaca

SEQ ID NO: 24497 - DNA, 18 bp, Homo sapiens
ggtgacccactattgttg

SEQ ID NO: 24498 - DNA, 21 bp, Homo sapiens
cctgtggcccgaatcgtgttt

SEQ ID NO: 24499 - DNA, 19 bp, Homo sapiens
tgaatgtgttgtttggttc

SEQ ID NO: 24500 - DNA, 21 bp, Homo sapiens
ctttcttctatatttataaac

SEQ ID NO: 24501 - DNA, 21 bp, Homo sapiens
gcagctgctgtttccggagtt

SEQ ID NO: 24502 - DNA, 20 bp, Homo sapiens
tggtatcactgattaactgt

SEQ ID NO: 24503 - DNA, 25 bp, Homo sapiens
aaaccatacttattactcaataacc

SEQ ID NO: 24504 - DNA, 18 bp, Homo sapiens
ccaatgattcacagtgac

SEQ ID NO: 24505 - DNA, 20 bp, Homo sapiens
ctaacatgagagatgaactt

SEQ ID NO: 24506 - DNA, 20 bp, Homo sapiens
gccagcatcaaggcttttaa

SEQ ID NO: 24507 - DNA, 27 bp, Homo sapiens
tctgagcctagaactttaattactttt

SEQ ID NO: 24508 - DNA, 22 bp, Homo sapiens
aaaccaatgtatttctcaaatg

SEQ ID NO: 24509 - DNA, 22 bp, Homo sapiens
cctccttggaagaaagaattca

SEQ ID NO: 24510 - DNA, 17 bp, Homo sapiens
gaccctggcataacatt

SEQ ID NO: 24511 - DNA, 18 bp, Homo sapiens
tcaaagtagtttacctca

SEQ ID NO: 24512 - DNA, 19 bp, Homo sapiens
gctgtctccctcctctgcc

SEQ ID NO: 24513 - DNA, 18 bp, Homo sapiens
gcacttaccgctgtgctt

SEQ ID NO: 24514 - DNA, 19 bp, Homo sapiens
ccctctgagaagggctgga

SEQ ID NO: 24515 - DNA, 21 bp, Homo sapiens
ccttgccgtggggaccttgga

SEQ ID NO: 24516 - DNA, 20 bp, Homo sapiens
agtcaaggcagggcacagtg

SEQ ID NO: 24517 - DNA, 19 bp, Homo sapiens
tcacttacccaatgcccca

SEQ ID NO: 24518 - DNA, 18 bp, Homo sapiens
aatagtttcccagtatta

SEQ ID NO: 24519 - DNA, 18 bp, Homo sapiens
agtgaaaccccatgtcta

SEQ ID NO: 24520 - DNA, 21 bp, Homo sapiens
ctgtctttctggttgaccctt

SEQ ID NO: 24521 - DNA, 20 bp, Homo sapiens
gaatttccattggtgtttct

SEQ ID NO: 24522 - DNA, 20 bp, Homo sapiens
ggctcacgcctacaatctca

SEQ ID NO: 24523 - DNA, 20 bp, Homo sapiens
acatttgttttaactgtgaa

SEQ ID NO: 24524 - DNA, 23 bp, Homo sapiens
cactgagaacacaaaggcctcta

SEQ ID NO: 24525 - DNA, 17 bp, Homo sapiens
ccgtcccgcctcacaaa

SEQ ID NO: 24526 - DNA, 21 bp, Homo sapiens
cctttaatgcaatcctcagtc

SEQ ID NO: 24527 - DNA, 21 bp, Homo sapiens
gcctgggactttgttaggttt

SEQ ID NO: 24528 - DNA, 23 bp, Homo sapiens
tgggactttgttaggtttagccg

SEQ ID NO: 24529 - DNA, 21 bp, Homo sapiens
tgggtcgccctacaagagagt

SEQ ID NO: 24530 - DNA, 23 bp, Homo sapiens
atgggcacgtgcccagaacacac

SEQ ID NO: 24531 - DNA, 21 bp, Homo sapiens
cgaggctgcagtgagctgtga

SEQ ID NO: 24532 - DNA, 19 bp, Homo sapiens
cccttgtgcgtatctcaca

SEQ ID NO: 24533 - DNA, 24 bp, Homo sapiens
tgccttttatggatacataatgct

SEQ ID NO: 24534 - DNA, 22 bp, Homo sapiens
tttgaaagtgtattattactaa

SEQ ID NO: 24535 - DNA, 19 bp, Homo sapiens
ctcctttgttaaaactttt

SEQ ID NO: 24536 - DNA, 18 bp, Homo sapiens
gattgctaaccaagtgat

SEQ ID NO: 24537 - DNA, 22 bp, Homo sapiens
acacaacgtaggcctaatcaca

SEQ ID NO: 24538 - DNA, 19 bp, Homo sapiens
ccttaggtttgcccctgaa

SEQ ID NO: 24539 - DNA, 18 bp, Homo sapiens
cctggccaagcctgtgga

SEQ ID NO: 24540 - DNA, 20 bp, Homo sapiens
gggtgtgtttggtctggtca

SEQ ID NO: 24541 - DNA, 22 bp, Homo sapiens
ggtaccggggtggggcgcggcg

SEQ ID NO: 24542 - DNA, 18 bp, Homo sapiens
tgcagacaagttagcaaa

SEQ ID NO: 24543 - DNA, 22 bp, Homo sapiens
gcgcagagcagcggggctgggg

SEQ ID NO: 24544 - DNA, 19 bp, Homo sapiens
ggcctaacccccatgtgac

SEQ ID NO: 24545 - DNA, 23 bp, Homo sapiens
tacctaggaacaaagaaacgcca

SEQ ID NO: 24546 - DNA, 20 bp, Homo sapiens
ccagttctcatgccctttca

SEQ ID NO: 24547 - DNA, 18 bp, Homo sapiens
ctcattgtggagctgcaa

SEQ ID NO: 24548 - DNA, 21 bp, Homo sapiens
ctctgggtctgggtctgtgag

SEQ ID NO: 24549 - DNA, 26 bp, Homo sapiens
ctgtccagaaccccgacaggcacatc

SEQ ID NO: 24550 - DNA, 23 bp, Homo sapiens
tcaaaggcctcattgtggagctg

SEQ ID NO: 24551 - DNA, 18 bp, Homo sapiens
agagaggttaaattctgg

SEQ ID NO: 24552 - DNA, 19 bp, Homo sapiens
ccaaaagaaatgatatgta

SEQ ID NO: 24553 - DNA, 17 bp, Homo sapiens
gggttgattttgttgta

SEQ ID NO: 24554 - DNA, 18 bp, Homo sapiens
taaaaacacacatacaaa

SEQ ID NO: 24555 - DNA, 22 bp, Homo sapiens
aaaatgggaagaaagcaacctc

SEQ ID NO: 24556 - DNA, 22 bp, Homo sapiens
atagaccaccaccacccactca

SEQ ID NO: 24557 - DNA, 19 bp, Homo sapiens
caaagtgccctctgctcct

SEQ ID NO: 24558 - DNA, 20 bp, Homo sapiens
ttgaagataaagctactgta

SEQ ID NO: 24559 - DNA, 19 bp, Homo sapiens
ctgtggaactgctgcttct

SEQ ID NO: 24560 - DNA, 21 bp, Homo sapiens
aacatcaccactgacattctg

SEQ ID NO: 24561 - DNA, 21 bp, Homo sapiens
aagcaacccatgcccattcca

SEQ ID NO: 24562 - DNA, 22 bp, Homo sapiens
aggaatgacacagagcatggag

SEQ ID NO: 24563 - DNA, 18 bp, Homo sapiens
atggagcaccatcactga

SEQ ID NO: 24564 - DNA, 19 bp, Homo sapiens
ccacctgtttctcatctct

SEQ ID NO: 24565 - DNA, 22 bp, Homo sapiens
gccaatcatccttacttcctta

SEQ ID NO: 24566 - DNA, 16 bp, Homo sapiens
tgcatcattttccatc

SEQ ID NO: 24567 - DNA, 19 bp, Homo sapiens
ttctgacgtgtccattcca

SEQ ID NO: 24568 - DNA, 19 bp, Homo sapiens
tatgtatttatatgtgttt

SEQ ID NO: 24569 - DNA, 16 bp, Homo sapiens
ttagaatactgttcca

SEQ ID NO: 24570 - DNA, 20 bp, Homo sapiens
aatgatactttcaatgtgcc

SEQ ID NO: 24571 - DNA, 22 bp, Homo sapiens
caaatatcctgtcagccaaatg

SEQ ID NO: 24572 - DNA, 19 bp, Homo sapiens
attgtctcctgtgttctca

SEQ ID NO: 24573 - DNA, 19 bp, Homo sapiens
cccgccgggcagccgtgca

SEQ ID NO: 24574 - DNA, 20 bp, Homo sapiens
tgctctcacgcttgttaaaa

SEQ ID NO: 24575 - DNA, 18 bp, Homo sapiens
tgggtggatcacctgaag

SEQ ID NO: 24576 - DNA, 19 bp, Homo sapiens
ctaaatatcaagaccagga

SEQ ID NO: 24577 - DNA, 24 bp, Homo sapiens
ttattgggtggcattatttggtta

SEQ ID NO: 24578 - DNA, 21 bp, Homo sapiens
tttcttctttgcttaaatctt

SEQ ID NO: 24579 - DNA, 24 bp, Homo sapiens
cccaggagtggagggctctgtgag

SEQ ID NO: 24580 - DNA, 21 bp, Homo sapiens
ataaaacttgttttagaagac

SEQ ID NO: 24581 - DNA, 18 bp, Homo sapiens
ggcaacggcggctggagc

SEQ ID NO: 24582 - DNA, 20 bp, Homo sapiens
agataaggactggaaatgtg

SEQ ID NO: 24583 - DNA, 18 bp, Homo sapiens
caaagacgcctgctgcac

SEQ ID NO: 24584 - DNA, 20 bp, Homo sapiens
caaattcagtgcccaccgga

SEQ ID NO: 24585 - DNA, 21 bp, Homo sapiens
gcacctcttaattcattttca

SEQ ID NO: 24586 - DNA, 17 bp, Homo sapiens
gtgatcatgtctagtaa

SEQ ID NO: 24587 - DNA, 16 bp, Homo sapiens
gtggatcagtttgatt

SEQ ID NO: 24588 - DNA, 21 bp, Homo sapiens
tgcaatgagctaagatcgtgc

SEQ ID NO: 24589 - DNA, 22 bp, Homo sapiens
ccaaaaaccatgtactaactta

SEQ ID NO: 24590 - DNA, 19 bp, Homo sapiens
ccaccttgtagaggctaga

SEQ ID NO: 24591 - DNA, 17 bp, Homo sapiens
cccatggaagaccctga

SEQ ID NO: 24592 - DNA, 20 bp, Homo sapiens
cctcctggattcctgcaact

SEQ ID NO: 24593 - DNA, 24 bp, Homo sapiens
cctgggggattccaagttgttgct

SEQ ID NO: 24594 - DNA, 19 bp, Homo sapiens
gaaaatgtggtttctgctg

SEQ ID NO: 24595 - DNA, 18 bp, Homo sapiens
ggacatgtaagcaagtaa

SEQ ID NO: 24596 - DNA, 18 bp, Homo sapiens
gtggcccatctgggagtc

SEQ ID NO: 24597 - DNA, 18 bp, Homo sapiens
ttcacctgtgtcctctgc

SEQ ID NO: 24598 - DNA, 19 bp, Homo sapiens
ttttgaggcaaagttcagt

SEQ ID NO: 24599 - DNA, 21 bp, Homo sapiens
agatcacaagaccagttcctc

SEQ ID NO: 24600 - DNA, 17 bp, Homo sapiens
cacatgtgcacatgcac

SEQ ID NO: 24601 - DNA, 22 bp, Homo sapiens
cagcctggccaacataatgaaa

SEQ ID NO: 24602 - DNA, 18 bp, Homo sapiens
cgccttccttctgcctcc

SEQ ID NO: 24603 - DNA, 24 bp, Homo sapiens
ctagtggtggagtctggtcctcca

SEQ ID NO: 24604 - DNA, 19 bp, Homo sapiens
ctgcctttctctgtctttt

SEQ ID NO: 24605 - DNA, 19 bp, Homo sapiens
tgcaggggtccctgtaggt

SEQ ID NO: 24606 - DNA, 20 bp, Homo sapiens
ttccagaaactgtgcatcta

SEQ ID NO: 24607 - DNA, 23 bp, Homo sapiens
agatccttctaaaacaacagtca

SEQ ID NO: 24608 - DNA, 21 bp, Homo sapiens
cccggtgggtcattctgtgga

SEQ ID NO: 24609 - DNA, 16 bp, Homo sapiens
cctgagctcccacaaa

SEQ ID NO: 24610 - DNA, 18 bp, Homo sapiens
cttctgcctccccggtgg

SEQ ID NO: 24611 - DNA, 19 bp, Homo sapiens
gacatgccctgcagcccca

SEQ ID NO: 24612 - DNA, 22 bp, Homo sapiens
tcctgagacccaaggttcctcc

SEQ ID NO: 24613 - DNA, 22 bp, Homo sapiens
tgtccttctgcctccccggtgg

SEQ ID NO: 24614 - DNA, 20 bp, Homo sapiens
cctgggaagccccccgcagc

SEQ ID NO: 24615 - DNA, 21 bp, Homo sapiens
tctgagggctcctgggtcact

SEQ ID NO: 24616 - DNA, 27 bp, Homo sapiens
agatttctttaactctcggaccagtga

SEQ ID NO: 24617 - DNA, 18 bp, Homo sapiens
cttccacccagtcccctc

SEQ ID NO: 24618 - DNA, 20 bp, Homo sapiens
tcatctggagctcttacctt

SEQ ID NO: 24619 - DNA, 19 bp, Homo sapiens
tgaatgagatgactaacgg

SEQ ID NO: 24620 - DNA, 23 bp, Homo sapiens
caggaagtctggaggctgaaaca

SEQ ID NO: 24621 - DNA, 25 bp, Homo sapiens
ctcccagggtgcagaggcctgcggg

SEQ ID NO: 24622 - DNA, 17 bp, Homo sapiens
gtgccacacagatgcca

SEQ ID NO: 24623 - DNA, 21 bp, Homo sapiens
agtgcacatcctgtgtcatca

SEQ ID NO: 24624 - DNA, 23 bp, Homo sapiens
agtttgcagtgcccctaatctca

SEQ ID NO: 24625 - DNA, 21 bp, Homo sapiens
cacccttatatcctcatttga

SEQ ID NO: 24626 - DNA, 25 bp, Homo sapiens
cttcttgcctttttgtctaagcctt

SEQ ID NO: 24627 - DNA, 20 bp, Homo sapiens
tcctgtgtcatcaatgtaaa

SEQ ID NO: 24628 - DNA, 21 bp, Homo sapiens
tgaatgagatcctgaaaatga

SEQ ID NO: 24629 - DNA, 21 bp, Homo sapiens
agcctgggcaacatagtgagt

SEQ ID NO: 24630 - DNA, 18 bp, Homo sapiens
aggtcttaatgcagtgtt

SEQ ID NO: 24631 - DNA, 23 bp, Homo sapiens
aagactatctgtttcccttgaca

SEQ ID NO: 24632 - DNA, 23 bp, Homo sapiens
aattattccagaaacagctgtca

SEQ ID NO: 24633 - DNA, 18 bp, Homo sapiens
gaaatcatgtccttgaaa

SEQ ID NO: 24634 - DNA, 20 bp, Homo sapiens
acacagggcaaagtactatg

SEQ ID NO: 24635 - DNA, 19 bp, Homo sapiens
atataatccagagctaaga

SEQ ID NO: 24636 - DNA, 19 bp, Homo sapiens
aaactcctgacctcaggtg

SEQ ID NO: 24637 - DNA, 18 bp, Homo sapiens
ccgtgcacctccacctcc

SEQ ID NO: 24638 - DNA, 18 bp, Homo sapiens
cggttcaccttgtgctgc

SEQ ID NO: 24639 - DNA, 16 bp, Homo sapiens
gacagagccagaccct

SEQ ID NO: 24640 - DNA, 22 bp, Homo sapiens
gagccaagatcgcaccactgca

SEQ ID NO: 24641 - DNA, 18 bp, Homo sapiens
tccgcctctcaggttcaa

SEQ ID NO: 24642 - DNA, 19 bp, Homo sapiens
aaactcctgacctcaggtg

SEQ ID NO: 24643 - DNA, 22 bp, Homo sapiens
ctggaattacaggcacctgcca

SEQ ID NO: 24644 - DNA, 19 bp, Homo sapiens
cagtgagccaagatcgtgc

SEQ ID NO: 24645 - DNA, 22 bp, Homo sapiens
gagccaagatcgtgccactgca

SEQ ID NO: 24646 - DNA, 19 bp, Homo sapiens
ccgggcccgggcccacctt

SEQ ID NO: 24647 - DNA, 18 bp, Homo sapiens
gaacaggaagtgccttgt

SEQ ID NO: 24648 - DNA, 17 bp, Homo sapiens
tgtccctctgcactcca

SEQ ID NO: 24649 - DNA, 20 bp, Homo sapiens
tcttatcaagttctgtcaat

SEQ ID NO: 24650 - DNA, 23 bp, Homo sapiens
tgggtaaaatgttagaactgtaa

SEQ ID NO: 24651 - DNA, 23 bp, Homo sapiens
ttgttaaagatctacttatttac

SEQ ID NO: 24652 - DNA, 20 bp, Homo sapiens
gggtttagaaatctttgcca

SEQ ID NO: 24653 - DNA, 22 bp, Homo sapiens
ggattcgtgctgggcccactcc

SEQ ID NO: 24654 - DNA, 18 bp, Homo sapiens
aaatgcctcataacctca

SEQ ID NO: 24655 - DNA, 22 bp, Homo sapiens
atccttcaccatgcaattaatg

SEQ ID NO: 24656 - DNA, 22 bp, Homo sapiens
atttacgtggacaactttcata

SEQ ID NO: 24657 - DNA, 22 bp, Homo sapiens
ggtcatgggggcaatcttaaac

SEQ ID NO: 24658 - DNA, 22 bp, Homo sapiens
tatgcttatttggtactttcac

SEQ ID NO: 24659 - DNA, 22 bp, Homo sapiens
tcaccattatttactgtttcct

SEQ ID NO: 24660 - DNA, 18 bp, Homo sapiens
ccacaccaaggcccacct

SEQ ID NO: 24661 - DNA, 19 bp, Homo sapiens
cttttgactggaaaggtca

SEQ ID NO: 24662 - DNA, 19 bp, Homo sapiens
tgtctgtgaagtgcctaac

SEQ ID NO: 24663 - DNA, 19 bp, Homo sapiens
aagaaataggggccctgct

SEQ ID NO: 24664 - DNA, 23 bp, Homo sapiens
agccactctcctgtcttctctcc

SEQ ID NO: 24665 - DNA, 19 bp, Homo sapiens
ctggatctctgttgggttt

SEQ ID NO: 24666 - DNA, 18 bp, Homo sapiens
gttccaggcacgcatcta

SEQ ID NO: 24667 - DNA, 18 bp, Homo sapiens
cctggaggaagaagggct

SEQ ID NO: 24668 - DNA, 18 bp, Homo sapiens
cttggagaggactttgaa

SEQ ID NO: 24669 - DNA, 20 bp, Homo sapiens
cgcgcgcccgcccgcggcgc

SEQ ID NO: 24670 - DNA, 19 bp, Homo sapiens
aattaaaggtatcaggtgg

SEQ ID NO: 24671 - DNA, 22 bp, Homo sapiens
caatattttccagtaacattaa

SEQ ID NO: 24672 - DNA, 17 bp, Homo sapiens
gtgaatgcacacatgtg

SEQ ID NO: 24673 - DNA, 21 bp, Homo sapiens
tcattcccgtcccagtttact

SEQ ID NO: 24674 - DNA, 22 bp, Homo sapiens
tgtctttcattcctagcactaa

SEQ ID NO: 24675 - DNA, 19 bp, Homo sapiens
aaactaagtgctctgccca

SEQ ID NO: 24676 - DNA, 19 bp, Homo sapiens
agtgaggaaggcatgtgtg

SEQ ID NO: 24677 - DNA, 21 bp, Homo sapiens
ttgtaaatggaaggtttcgag

SEQ ID NO: 24678 - DNA, 26 bp, Homo sapiens
agtccttggggacgtggcagatgcca

SEQ ID NO: 24679 - DNA, 22 bp, Homo sapiens
gcacctctagctgtctgcctca

SEQ ID NO: 24680 - DNA, 17 bp, Homo sapiens
gtgggtcagaagcgatc

SEQ ID NO: 24681 - DNA, 21 bp, Homo sapiens
ccaagcctgctctcctacatt

SEQ ID NO: 24682 - DNA, 21 bp, Homo sapiens
ctggtctagcccaggttgcca

SEQ ID NO: 24683 - DNA, 19 bp, Homo sapiens
gagatcacccttgcagtga

SEQ ID NO: 24684 - DNA, 20 bp, Homo sapiens
agaaggtgtgagtgtgagtg

SEQ ID NO: 24685 - DNA, 20 bp, Homo sapiens
tggctgcctccttcatccaa

SEQ ID NO: 24686 - DNA, 20 bp, Homo sapiens
aagacacctgtcaaatgtca

SEQ ID NO: 24687 - DNA, 22 bp, Homo sapiens
actcgcctctgctcctgtggtc

SEQ ID NO: 24688 - DNA, 17 bp, Homo sapiens
actgtgctcagattccc

SEQ ID NO: 24689 - DNA, 17 bp, Homo sapiens
ccccctgggatggctca

SEQ ID NO: 24690 - DNA, 21 bp, Homo sapiens
ggcccctctctgggcagtcag

SEQ ID NO: 24691 - DNA, 17 bp, Homo sapiens
tgctagcagctgtgatg

SEQ ID NO: 24692 - DNA, 21 bp, Homo sapiens
aactgggacatatagatacca

SEQ ID NO: 24693 - DNA, 18 bp, Homo sapiens
aagaaccaaatgcactgt

SEQ ID NO: 24694 - DNA, 18 bp, Homo sapiens
agcatccattttacttca

SEQ ID NO: 24695 - DNA, 23 bp, Homo sapiens
cttttcccttatgctttggcttt

SEQ ID NO: 24696 - DNA, 25 bp, Homo sapiens
ctttttgtggaacatgtagtttata

SEQ ID NO: 24697 - DNA, 20 bp, Homo sapiens
gaacactagtcctacctctg

SEQ ID NO: 24698 - DNA, 19 bp, Homo sapiens
gcttaatattctcattgca

SEQ ID NO: 24699 - DNA, 19 bp, Homo sapiens
tatcttgctctgagtagta

SEQ ID NO: 24700 - DNA, 18 bp, Homo sapiens
tcatctttttgcctttga

SEQ ID NO: 24701 - DNA, 21 bp, Homo sapiens
acccatccccatctcatctca

SEQ ID NO: 24702 - DNA, 17 bp, Homo sapiens
cagctggtgcagcctca

SEQ ID NO: 24703 - DNA, 19 bp, Homo sapiens
ccctgccaccttctctcca

SEQ ID NO: 24704 - DNA, 20 bp, Homo sapiens
gacagtgctggacatttcct

SEQ ID NO: 24705 - DNA, 22 bp, Homo sapiens
ggacttgcccgttggtgccagc

SEQ ID NO: 24706 - DNA, 17 bp, Homo sapiens
ccgcagcacactggcca

SEQ ID NO: 24707 - DNA, 19 bp, Homo sapiens
ctcaggaagctttgtaaga

SEQ ID NO: 24708 - DNA, 21 bp, Homo sapiens
gcctgggctcaagcctggccc

SEQ ID NO: 24709 - DNA, 20 bp, Homo sapiens
ggagggtctgggtccagtta

SEQ ID NO: 24710 - DNA, 22 bp, Homo sapiens
tcaggcctccccgggcccccca

SEQ ID NO: 24711 - DNA, 19 bp, Homo sapiens
tgccctcagtgacacctca

SEQ ID NO: 24712 - DNA, 18 bp, Homo sapiens
ccaagtctgcacatccca

SEQ ID NO: 24713 - DNA, 19 bp, Homo sapiens
cctgcaaccccccttcagc

SEQ ID NO: 24714 - DNA, 23 bp, Homo sapiens
gcccccccggagcccctctgaga

SEQ ID NO: 24715 - DNA, 17 bp, Homo sapiens
caagaacaagatgtgat

SEQ ID NO: 24716 - DNA, 19 bp, Homo sapiens
ctcctgagagcagtggtca

SEQ ID NO: 24717 - DNA, 19 bp, Homo sapiens
gccaggtgtgcatgggtcc

SEQ ID NO: 24718 - DNA, 20 bp, Homo sapiens
ggccccttcagaattcctca

SEQ ID NO: 24719 - DNA, 26 bp, Homo sapiens
gtctgagcctgcatcacctctggcct

SEQ ID NO: 24720 - DNA, 19 bp, Homo sapiens
agaaacaaatcattcgtgc

SEQ ID NO: 24721 - DNA, 18 bp, Homo sapiens
agatgggatgaaatttca

SEQ ID NO: 24722 - DNA, 19 bp, Homo sapiens
cagatgggatgaaatttca

SEQ ID NO: 24723 - DNA, 25 bp, Homo sapiens
ctggttgtgacattgtggtataata

SEQ ID NO: 24724 - DNA, 19 bp, Homo sapiens
gacccagcagttgcactca

SEQ ID NO: 24725 - DNA, 25 bp, Homo sapiens
taatattgcaagatgttaccattgg

SEQ ID NO: 24726 - DNA, 18 bp, Homo sapiens
aggagaaataccgccagg

SEQ ID NO: 24727 - DNA, 23 bp, Homo sapiens
cccagctcaagagctacctgagg

SEQ ID NO: 24728 - DNA, 23 bp, Homo sapiens
ccgacttcgccgactccgcgcca

SEQ ID NO: 24729 - DNA, 19 bp, Homo sapiens
cctgcgcagggcccgggga

SEQ ID NO: 24730 - DNA, 20 bp, Homo sapiens
gggtgggggagccctggcca

SEQ ID NO: 24731 - DNA, 21 bp, Homo sapiens
tgtaggggtggcgcctgcggg

SEQ ID NO: 24732 - DNA, 20 bp, Homo sapiens
aaggttccaatttattgtgc

SEQ ID NO: 24733 - DNA, 17 bp, Homo sapiens
atctgttattgcaaggt

SEQ ID NO: 24734 - DNA, 21 bp, Homo sapiens
ccggagacttctcctaacaaa

SEQ ID NO: 24735 - DNA, 18 bp, Homo sapiens
cgatatcatgccaattga

SEQ ID NO: 24736 - DNA, 18 bp, Homo sapiens
tgttttttcagaatggcc

SEQ ID NO: 24737 - DNA, 20 bp, Homo sapiens
ttcaacaaatgtaaaagatc

SEQ ID NO: 24738 - DNA, 17 bp, Homo sapiens
ttctgatgttttttcag

SEQ ID NO: 24739 - DNA, 15 bp, Homo sapiens
ttgtttgttttctgg

SEQ ID NO: 24740 - DNA, 18 bp, Homo sapiens
cagattcccaactcttct

SEQ ID NO: 24741 - DNA, 20 bp, Homo sapiens
caggcctccacctccagccc

SEQ ID NO: 24742 - DNA, 20 bp, Homo sapiens
caacccacctcccgtgcccc

SEQ ID NO: 24743 - DNA, 24 bp, Homo sapiens
cagctggagcgccaatcgtgctgc

SEQ ID NO: 24744 - DNA, 22 bp, Homo sapiens
ctcaaccactgcggcctaatcc

SEQ ID NO: 24745 - DNA, 22 bp, Homo sapiens
ctgctggactgttatttcttga

SEQ ID NO: 24746 - DNA, 20 bp, Homo sapiens
gtggaagctccgtgagacca

SEQ ID NO: 24747 - DNA, 20 bp, Homo sapiens
tggagcgccaatcgtgctgc

SEQ ID NO: 24748 - DNA, 25 bp, Homo sapiens
ttccaaaaataccccagtgtttcag

SEQ ID NO: 24749 - DNA, 19 bp, Homo sapiens
tctctgggcactgtactct

SEQ ID NO: 24750 - DNA, 19 bp, Homo sapiens
tgggtggaccacttgaggc

SEQ ID NO: 24751 - DNA, 22 bp, Homo sapiens
aatttgaggaactggatgtgac

SEQ ID NO: 24752 - DNA, 17 bp, Homo sapiens
acttcgtgctctgtgac

SEQ ID NO: 24753 - DNA, 18 bp, Homo sapiens
cctttaagaattcgtgga

SEQ ID NO: 24754 - DNA, 18 bp, Homo sapiens
ggcctgttcacagctaca

SEQ ID NO: 24755 - DNA, 17 bp, Homo sapiens
tgctatgaaagatgcaa

SEQ ID NO: 24756 - DNA, 22 bp, Homo sapiens
ggagagcagcggcggcggcggc

SEQ ID NO: 24757 - DNA, 20 bp, Homo sapiens
tgcggcgggcgcggcccggg

SEQ ID NO: 24758 - DNA, 20 bp, Homo sapiens
accctggctgaccactttga

SEQ ID NO: 24759 - DNA, 26 bp, Homo sapiens
aagaccatttatttgtgactctgaca

SEQ ID NO: 24760 - DNA, 19 bp, Homo sapiens
gggcaagttgattttgcca

SEQ ID NO: 24761 - DNA, 19 bp, Homo sapiens
accgggagcgcggtggcca

SEQ ID NO: 24762 - DNA, 19 bp, Homo sapiens
cgcgcggcgtttacccagc

SEQ ID NO: 24763 - DNA, 22 bp, Homo sapiens
gcctccgctggttgccaggctt

SEQ ID NO: 24764 - DNA, 18 bp, Homo sapiens
ttctcatcatcctgaaca

SEQ ID NO: 24765 - DNA, 20 bp, Homo sapiens
agtctcactctgtcgcccag

SEQ ID NO: 24766 - DNA, 22 bp, Homo sapiens
ctccttccctcttcagcggatc

SEQ ID NO: 24767 - DNA, 20 bp, Homo sapiens
ccatccacccacttccctca

SEQ ID NO: 24768 - DNA, 22 bp, Homo sapiens
gcagaggacttcagctaccttc

SEQ ID NO: 24769 - DNA, 18 bp, Homo sapiens
tatcctctcaaacttcca

SEQ ID NO: 24770 - DNA, 19 bp, Homo sapiens
ttatttccccttcatccta

SEQ ID NO: 24771 - DNA, 22 bp, Homo sapiens
aaggctggctggagtggagcca

SEQ ID NO: 24772 - DNA, 18 bp, Homo sapiens
gagttcgacagggagctg

SEQ ID NO: 24773 - DNA, 23 bp, Homo sapiens
tcctggtggacctgggtctggaa

SEQ ID NO: 24774 - DNA, 20 bp, Homo sapiens
aaccaggacgacctgcaagg

SEQ ID NO: 24775 - DNA, 23 bp, Homo sapiens
ttgcaacatagccccctccatca

SEQ ID NO: 24776 - DNA, 23 bp, Homo sapiens
ttggacatggcctatgtacctaa

SEQ ID NO: 24777 - DNA, 23 bp, Homo sapiens
cactactgatgttcacgatgcca

SEQ ID NO: 24778 - DNA, 16 bp, Homo sapiens
ccgacccattctcctt

SEQ ID NO: 24779 - DNA, 21 bp, Homo sapiens
tgtttaatcccatgcatgcca

SEQ ID NO: 24780 - DNA, 18 bp, Homo sapiens
gtatatatgaaaatttga

SEQ ID NO: 24781 - DNA, 17 bp, Homo sapiens
agggtaatgaaatgtca

SEQ ID NO: 24782 - DNA, 21 bp, Homo sapiens
ggtagttgggctgcagagtca

SEQ ID NO: 24783 - DNA, 18 bp, Homo sapiens
tgcctttctgcactgtca

SEQ ID NO: 24784 - DNA, 19 bp, Homo sapiens
tggccctgccactgtggac

SEQ ID NO: 24785 - DNA, 19 bp, Homo sapiens
tttacatcttcccactttt

SEQ ID NO: 24786 - DNA, 20 bp, Homo sapiens
atctgttggaggacatccca

SEQ ID NO: 24787 - DNA, 18 bp, Homo sapiens
cccgttcctttttcttca

SEQ ID NO: 24788 - DNA, 20 bp, Homo sapiens
ttcaagaccagcctgaccaa

SEQ ID NO: 24789 - DNA, 19 bp, Homo sapiens
atctttgtctggtgccaga

SEQ ID NO: 24790 - DNA, 20 bp, Homo sapiens
cttttttatggctgcataat

SEQ ID NO: 24791 - DNA, 22 bp, Homo sapiens
ttttaacacattgtatcattaa

SEQ ID NO: 24792 - DNA, 20 bp, Homo sapiens
agtctcactctgttgcccag

SEQ ID NO: 24793 - DNA, 20 bp, Homo sapiens
cactgtgaggagacagccac

SEQ ID NO: 24794 - DNA, 19 bp, Homo sapiens
tttctacagactgccattg

SEQ ID NO: 24795 - DNA, 22 bp, Homo sapiens
cagcctaggcaacacagtgaaa

SEQ ID NO: 24796 - DNA, 18 bp, Homo sapiens
cggagaggatttccacct

SEQ ID NO: 24797 - DNA, 20 bp, Homo sapiens
gcatggccattggcgggtct

SEQ ID NO: 24798 - DNA, 20 bp, Homo sapiens
ttgggcaaccccctccctca

SEQ ID NO: 24799 - DNA, 18 bp, Homo sapiens
atttgaagaaacatagga

SEQ ID NO: 24800 - DNA, 18 bp, Homo sapiens
gccgggtgtagtggctca

SEQ ID NO: 24801 - DNA, 21 bp, Homo sapiens
atgactcccactgctgcctct

SEQ ID NO: 24802 - DNA, 21 bp, Homo sapiens
gacagagcacccactgcccaa

SEQ ID NO: 24803 - DNA, 19 bp, Homo sapiens
aaaatgtcaaatgctttga

SEQ ID NO: 24804 - DNA, 21 bp, Homo sapiens
aaagaatgatcatcagtaaca

SEQ ID NO: 24805 - DNA, 20 bp, Homo sapiens
catgataataattatgaaga

SEQ ID NO: 24806 - DNA, 19 bp, Homo sapiens
caccctattcatttccttt

SEQ ID NO: 24807 - DNA, 16 bp, Homo sapiens
ttaacacttcttgaca

SEQ ID NO: 24808 - DNA, 18 bp, Homo sapiens
cctgccttgggcctccca

SEQ ID NO: 24809 - DNA, 23 bp, Homo sapiens
tgggcctcccagtgctggaatta

SEQ ID NO: 24810 - DNA, 20 bp, Homo sapiens
gaccctggctgtcagagtga

SEQ ID NO: 24811 - DNA, 17 bp, Homo sapiens
ttccagaaaaggcttca

SEQ ID NO: 24812 - DNA, 17 bp, Homo sapiens
ttcccagttttgccact

SEQ ID NO: 24813 - DNA, 22 bp, Homo sapiens
agaaggtggttcttcaagccga

SEQ ID NO: 24814 - DNA, 20 bp, Homo sapiens
ctgttttttgttttgtttta

SEQ ID NO: 24815 - DNA, 21 bp, Homo sapiens
ggcctccacgaggttccattt

SEQ ID NO: 24816 - DNA, 23 bp, Homo sapiens
ttctgcctctgtgactgctgctt

SEQ ID NO: 24817 - DNA, 26 bp, Homo sapiens
tatagcccagcttgataatggaacta

SEQ ID NO: 24818 - DNA, 23 bp, Homo sapiens
tttctaaaggctatattgctgta

SEQ ID NO: 24819 - DNA, 23 bp, Homo sapiens
cagctaggcttgaggcctcttca

SEQ ID NO: 24820 - DNA, 20 bp, Homo sapiens
aaggctgtgcaaatcctcca

SEQ ID NO: 24821 - DNA, 23 bp, Homo sapiens
tcgcgttaagaagcctggacaag

SEQ ID NO: 24822 - DNA, 23 bp, Homo sapiens
caaactggttgaaacacagcttt

SEQ ID NO: 24823 - DNA, 21 bp, Homo sapiens
caccaccacccatgcccctct

SEQ ID NO: 24824 - DNA, 18 bp, Homo sapiens
ggaaagcggggctgtggc

SEQ ID NO: 24825 - DNA, 17 bp, Homo sapiens
ggcctgctggtgccagc

SEQ ID NO: 24826 - DNA, 22 bp, Homo sapiens
gggtcccttctgcgctgccgca

SEQ ID NO: 24827 - DNA, 21 bp, Homo sapiens
cctcctgagtagatctgtggg

SEQ ID NO: 24828 - DNA, 17 bp, Homo sapiens
cctgagtagatctgtgg

SEQ ID NO: 24829 - DNA, 19 bp, Homo sapiens
gcctcgtcttcccgtctgc

SEQ ID NO: 24830 - DNA, 19 bp, Homo sapiens
agagtggcactccatctca

SEQ ID NO: 24831 - DNA, 18 bp, Homo sapiens
agcctctaacccgtcctg

SEQ ID NO: 24832 - DNA, 22 bp, Homo sapiens
gcctgagctccaggtctcgtct

SEQ ID NO: 24833 - DNA, 20 bp, Homo sapiens
ggagatctacagctaagacg

SEQ ID NO: 24834 - DNA, 22 bp, Homo sapiens
aaactccaacgttgtaattaca

SEQ ID NO: 24835 - DNA, 21 bp, Homo sapiens
agcttttaaaatttaaattac

SEQ ID NO: 24836 - DNA, 23 bp, Homo sapiens
cccatgccaaattcatcatgaag

SEQ ID NO: 24837 - DNA, 23 bp, Homo sapiens
ccttatttgcaatacttttccca

SEQ ID NO: 24838 - DNA, 20 bp, Homo sapiens
ctctctcaagaagcttttaa

SEQ ID NO: 24839 - DNA, 18 bp, Homo sapiens
cttttttatagtaaagcc

SEQ ID NO: 24840 - DNA, 18 bp, Homo sapiens
gtatgtttagatcccagg

SEQ ID NO: 24841 - DNA, 19 bp, Homo sapiens
tcctttaagagatattaga

SEQ ID NO: 24842 - DNA, 19 bp, Homo sapiens
tgatggagaattcactttg

SEQ ID NO: 24843 - DNA, 22 bp, Homo sapiens
ttcaggtattttcaagttttaa

SEQ ID NO: 24844 - DNA, 20 bp, Homo sapiens
caattacctcttttttgctc

SEQ ID NO: 24845 - DNA, 18 bp, Homo sapiens
gaacacatttaaacatca

SEQ ID NO: 24846 - DNA, 24 bp, Homo sapiens
gactgatcgaaagaaaacttgcca

SEQ ID NO: 24847 - DNA, 19 bp, Homo sapiens
gcagggccaggctttggca

SEQ ID NO: 24848 - DNA, 19 bp, Homo sapiens
ttgtcaccccaccaagcca

SEQ ID NO: 24849 - DNA, 21 bp, Homo sapiens
tcctgatggccgcttggtgag

SEQ ID NO: 24850 - DNA, 18 bp, Homo sapiens
ttcccacctctctaccta

SEQ ID NO: 24851 - DNA, 16 bp, Homo sapiens
gaagaatatttttggc

SEQ ID NO: 24852 - DNA, 23 bp, Homo sapiens
gcaactacaggactaactgtgtt

SEQ ID NO: 24853 - DNA, 22 bp, Homo sapiens
ggcacagtctgtgagtgggaag

SEQ ID NO: 24854 - DNA, 21 bp, Homo sapiens
aaactgggcccccatgccaca

SEQ ID NO: 24855 - DNA, 19 bp, Homo sapiens
ccaaaggatgcaacaacat

SEQ ID NO: 24856 - DNA, 22 bp, Homo sapiens
ccagcccccaggaggcccctgc

SEQ ID NO: 24857 - DNA, 21 bp, Homo sapiens
ccagtggtgccaggtgccacc

SEQ ID NO: 24858 - DNA, 21 bp, Homo sapiens
gcggcacttggggtttctggg

SEQ ID NO: 24859 - DNA, 16 bp, Homo sapiens
tggatgacagtcctga

SEQ ID NO: 24860 - DNA, 20 bp, Homo sapiens
caaagtcatggccatactca

SEQ ID NO: 24861 - DNA, 17 bp, Homo sapiens
ctctgctcctctgccct

SEQ ID NO: 24862 - DNA, 17 bp, Homo sapiens
ctctgtctcctgcctct

SEQ ID NO: 24863 - DNA, 18 bp, Homo sapiens
ctgtaagaacgaaagaat

SEQ ID NO: 24864 - DNA, 20 bp, Homo sapiens
ggaggaacagcatgccacca

SEQ ID NO: 24865 - DNA, 25 bp, Homo sapiens
taatggtgggtcttaatggaggctg

SEQ ID NO: 24866 - DNA, 21 bp, Homo sapiens
agataccttggcattgttata

SEQ ID NO: 24867 - DNA, 20 bp, Homo sapiens
agtaccagcttagtcaggta

SEQ ID NO: 24868 - DNA, 19 bp, Homo sapiens
tccttttccccccttcctt

SEQ ID NO: 24869 - DNA, 23 bp, Homo sapiens
tctgggcccggcctcgcctgccc

SEQ ID NO: 24870 - DNA, 17 bp, Homo sapiens
tctggtctgaccctctg

SEQ ID NO: 24871 - DNA, 19 bp, Homo sapiens
accggagaccctgccccca

SEQ ID NO: 24872 - DNA, 22 bp, Homo sapiens
caacccttcaatgcctgctcct

SEQ ID NO: 24873 - DNA, 18 bp, Homo sapiens
ccacccacctctgcctcc

SEQ ID NO: 24874 - DNA, 21 bp, Homo sapiens
cgagaatccactcaccggaga

SEQ ID NO: 24875 - DNA, 18 bp, Homo sapiens
tccacctcctgggttcaa

SEQ ID NO: 24876 - DNA, 18 bp, Homo sapiens
tccacctcctgggttcaa

SEQ ID NO: 24877 - DNA, 22 bp, Homo sapiens
atttgataggatccatatctaa

SEQ ID NO: 24878 - DNA, 19 bp, Homo sapiens
attttttcttattgccttg

SEQ ID NO: 24879 - DNA, 21 bp, Homo sapiens
ccaaactacaccaattaattt

SEQ ID NO: 24880 - DNA, 18 bp, Homo sapiens
gccctatctgcacttttt

SEQ ID NO: 24881 - DNA, 17 bp, Homo sapiens
gttgtcaattgtggtaa

SEQ ID NO: 24882 - DNA, 20 bp, Homo sapiens
tctattgttcaattctctaa

SEQ ID NO: 24883 - DNA, 22 bp, Homo sapiens
tggccgtacaaattacatttca

SEQ ID NO: 24884 - DNA, 21 bp, Homo sapiens
cttccaatgctgccttgatct

SEQ ID NO: 24885 - DNA, 20 bp, Homo sapiens
ttgcaaaacgtcgatctcct

SEQ ID NO: 24886 - DNA, 18 bp, Homo sapiens
agcactttacttgtatta

SEQ ID NO: 24887 - DNA, 24 bp, Homo sapiens
caaacatatttgaaagttaacttt

SEQ ID NO: 24888 - DNA, 24 bp, Homo sapiens
cctcaccacacatcagagaatgac

SEQ ID NO: 24889 - DNA, 19 bp, Homo sapiens
ctggactaccattgtgaga

SEQ ID NO: 24890 - DNA, 21 bp, Homo sapiens
gtggtgaaaccacctatgcaa

SEQ ID NO: 24891 - DNA, 23 bp, Homo sapiens
taccttgattacatatgttgtta

SEQ ID NO: 24892 - DNA, 24 bp, Homo sapiens
tcatggctgcctcaccacacatca

SEQ ID NO: 24893 - DNA, 20 bp, Homo sapiens
tggatggactcttcaaaact

SEQ ID NO: 24894 - DNA, 22 bp, Homo sapiens
ttctttgtaggtggagtttgtg

SEQ ID NO: 24895 - DNA, 19 bp, Homo sapiens
gtcccactgggctgtgagc

SEQ ID NO: 24896 - DNA, 20 bp, Homo sapiens
tccccggacccctgtgccag

SEQ ID NO: 24897 - DNA, 20 bp, Homo sapiens
agcttttctaactgtcactg

SEQ ID NO: 24898 - DNA, 18 bp, Homo sapiens
agggttatgacttgctca

SEQ ID NO: 24899 - DNA, 20 bp, Homo sapiens
cccaagttcatgacttttgc

SEQ ID NO: 24900 - DNA, 16 bp, Homo sapiens
tctctgcagtattagc

SEQ ID NO: 24901 - DNA, 22 bp, Homo sapiens
agggaagagaatagcatgatcc

SEQ ID NO: 24902 - DNA, 17 bp, Homo sapiens
gtggcacacggctgtaa

SEQ ID NO: 24903 - DNA, 17 bp, Homo sapiens
aacaaagagaaatgctg

SEQ ID NO: 24904 - DNA, 18 bp, Homo sapiens
aacttcaataatgtaata

SEQ ID NO: 24905 - DNA, 17 bp, Homo sapiens
accaaatatgtatctgt

SEQ ID NO: 24906 - DNA, 20 bp, Homo sapiens
ccaaggggtaggcaattcta

SEQ ID NO: 24907 - DNA, 23 bp, Homo sapiens
cccagcatcacttacacatccca

SEQ ID NO: 24908 - DNA, 22 bp, Homo sapiens
tccatatctggcttgcatgtgc

SEQ ID NO: 24909 - DNA, 22 bp, Homo sapiens
gggacagccggatcgcccctct

SEQ ID NO: 24910 - DNA, 22 bp, Homo sapiens
tccagcgcgggaccagcagcaa

SEQ ID NO: 24911 - DNA, 20 bp, Homo sapiens
caaagcagcagtggcctcta

SEQ ID NO: 24912 - DNA, 26 bp, Homo sapiens
ctatgagtgaatctggaattgctttt

SEQ ID NO: 24913 - DNA, 21 bp, Homo sapiens
gctgtcagtttgtgcaccata

SEQ ID NO: 24914 - DNA, 16 bp, Homo sapiens
aatgagatctcagtgg

SEQ ID NO: 24915 - DNA, 20 bp, Homo sapiens
ccaacctcctatgactgctt

SEQ ID NO: 24916 - DNA, 15 bp, Homo sapiens
tacagtacttcctga

SEQ ID NO: 24917 - DNA, 17 bp, Homo sapiens
agggagcagccatcaca

SEQ ID NO: 24918 - DNA, 21 bp, Homo sapiens
gcagaaatggaagcattttca

SEQ ID NO: 24919 - DNA, 23 bp, Homo sapiens
ttctgtcctctgcgcgtggtttg

SEQ ID NO: 24920 - DNA, 23 bp, Homo sapiens
taagcctcagttaaatggaatta

SEQ ID NO: 24921 - DNA, 17 bp, Homo sapiens
tcaaaaacataaatggc

SEQ ID NO: 24922 - DNA, 20 bp, Homo sapiens
tgaaactgcatgcagccata

SEQ ID NO: 24923 - DNA, 23 bp, Homo sapiens
gattgttttgtttttccttttgg

SEQ ID NO: 24924 - DNA, 17 bp, Homo sapiens
aaaacctcagttttaga

SEQ ID NO: 24925 - DNA, 19 bp, Homo sapiens
ttttaattggattttgata

SEQ ID NO: 24926 - DNA, 18 bp, Homo sapiens
cctacagctgcctggctc

SEQ ID NO: 24927 - DNA, 21 bp, Homo sapiens
ttctatgtgatggagtactgc

SEQ ID NO: 24928 - DNA, 22 bp, Homo sapiens
ccaggctcctttttctgtttct

SEQ ID NO: 24929 - DNA, 18 bp, Homo sapiens
tcaagtaggaacacccca

SEQ ID NO: 24930 - DNA, 21 bp, Homo sapiens
acccatcccatccaccacttc

SEQ ID NO: 24931 - DNA, 21 bp, Homo sapiens
agacccatgacatgtcttata

SEQ ID NO: 24932 - DNA, 22 bp, Homo sapiens
cccaacatgggagaattgtgaa

SEQ ID NO: 24933 - DNA, 17 bp, Homo sapiens
tatggtctatctatgat

SEQ ID NO: 24934 - DNA, 19 bp, Homo sapiens
cccccccccacctcactcc

SEQ ID NO: 24935 - DNA, 24 bp, Homo sapiens
gaaacgctaccagcagattctgag

SEQ ID NO: 24936 - DNA, 19 bp, Homo sapiens
tccagccctcacccacctt

SEQ ID NO: 24937 - DNA, 24 bp, Homo sapiens
tgaagttcgtggactcctacaata

SEQ ID NO: 24938 - DNA, 21 bp, Homo sapiens
tgtgctgctttaccgacacat

SEQ ID NO: 24939 - DNA, 19 bp, Homo sapiens
catcccctccttcatcctt

SEQ ID NO: 24940 - DNA, 19 bp, Homo sapiens
gccaccctcacctccttca

SEQ ID NO: 24941 - DNA, 19 bp, Homo sapiens
gcttcgcttttgatggagt

SEQ ID NO: 24942 - DNA, 19 bp, Homo sapiens
ggtgcacagcccctgacca

SEQ ID NO: 24943 - DNA, 24 bp, Homo sapiens
tccaataaaataagctacctgtga

SEQ ID NO: 24944 - DNA, 17 bp, Homo sapiens
ttggcttcgcttttgat

SEQ ID NO: 24945 - DNA, 20 bp, Homo sapiens
ccacccccacccccaccccc

SEQ ID NO: 24946 - DNA, 19 bp, Homo sapiens
aatttcagagcaagagtcg

SEQ ID NO: 24947 - DNA, 21 bp, Homo sapiens
aattatccaaagcatcactga

SEQ ID NO: 24948 - DNA, 19 bp, Homo sapiens
cgcagctcccgacgcaatg

SEQ ID NO: 24949 - DNA, 20 bp, Homo sapiens
cccccggagcaggccgtgca

SEQ ID NO: 24950 - DNA, 22 bp, Homo sapiens
cgcgccctcctcgtacccgtgc

SEQ ID NO: 24951 - DNA, 21 bp, Homo sapiens
ctcccctatctaggtgccttt

SEQ ID NO: 24952 - DNA, 19 bp, Homo sapiens
ctgccagttgcattcttcc

SEQ ID NO: 24953 - DNA, 25 bp, Homo sapiens
agtgggtaggaatttcatcaacaaa

SEQ ID NO: 24954 - DNA, 20 bp, Homo sapiens
gtggaatatctagccgccca

SEQ ID NO: 24955 - DNA, 21 bp, Homo sapiens
aaataaaagtgaccttttaca

SEQ ID NO: 24956 - DNA, 23 bp, Homo sapiens
gcttggatcagtaagtctggttc

SEQ ID NO: 24957 - DNA, 21 bp, Homo sapiens
cacagccacacttccatctca

SEQ ID NO: 24958 - DNA, 22 bp, Homo sapiens
ctccccaaaactggggtcccag

SEQ ID NO: 24959 - DNA, 19 bp, Homo sapiens
tgcctttccatttatttaa

SEQ ID NO: 24960 - DNA, 17 bp, Homo sapiens
ttcaacatcgtcttcca

SEQ ID NO: 24961 - DNA, 19 bp, Homo sapiens
ccctctgattgataagaca

SEQ ID NO: 24962 - DNA, 26 bp, Homo sapiens
gcctgggtctggagccgtcctggcct

SEQ ID NO: 24963 - DNA, 17 bp, Homo sapiens
acacagagatctcaaac

SEQ ID NO: 24964 - DNA, 18 bp, Homo sapiens
ccccctccggggtcatgc

SEQ ID NO: 24965 - DNA, 22 bp, Homo sapiens
gctcacttgactcatgctgcta

SEQ ID NO: 24966 - DNA, 20 bp, Homo sapiens
aggtattccaaatctcttct

SEQ ID NO: 24967 - DNA, 21 bp, Homo sapiens
ggtctagaaatgcttaaacta

SEQ ID NO: 24968 - DNA, 24 bp, Homo sapiens
cgaaaccagttttgcaatcaattc

SEQ ID NO: 24969 - DNA, 19 bp, Homo sapiens
ctccagtctgggtgtcaga

SEQ ID NO: 24970 - DNA, 18 bp, Homo sapiens
tcacagccccctgccaga

SEQ ID NO: 24971 - DNA, 22 bp, Homo sapiens
tctaaacatatgtaaacagaga

SEQ ID NO: 24972 - DNA, 22 bp, Homo sapiens
tgaatggattctgggtggagat

SEQ ID NO: 24973 - DNA, 19 bp, Homo sapiens
tgtgtatctaaacatatgt

SEQ ID NO: 24974 - DNA, 20 bp, Homo sapiens
cacacccacaccctattcat

SEQ ID NO: 24975 - DNA, 19 bp, Homo sapiens
cagaagaacgtggattgtg

SEQ ID NO: 24976 - DNA, 20 bp, Homo sapiens
gtaaaagtctcgttgctcat

SEQ ID NO: 24977 - DNA, 21 bp, Homo sapiens
taacagtcagtatccagcctc

SEQ ID NO: 24978 - DNA, 19 bp, Homo sapiens
tgtgtcctagttgaggcta

SEQ ID NO: 24979 - DNA, 23 bp, Homo sapiens
tttcttatgcctgtctttacttt

SEQ ID NO: 24980 - DNA, 24 bp, Homo sapiens
tttgtgacccacacccacacccta

SEQ ID NO: 24981 - DNA, 21 bp, Homo sapiens
ctcctcttcctcctcctcctc

SEQ ID NO: 24982 - DNA, 18 bp, Homo sapiens
ctgctcctcctcttcctc

SEQ ID NO: 24983 - DNA, 18 bp, Homo sapiens
atcctgaatgaacagtgg

SEQ ID NO: 24984 - DNA, 17 bp, Homo sapiens
cttcccctcctccttcc

SEQ ID NO: 24985 - DNA, 24 bp, Homo sapiens
gaagaagatattccaggaacctaa

SEQ ID NO: 24986 - DNA, 23 bp, Homo sapiens
gcctggatttgtatccttggctt

SEQ ID NO: 24987 - DNA, 18 bp, Homo sapiens
ggccaggcacccccaggg

SEQ ID NO: 24988 - DNA, 19 bp, Homo sapiens
aaagaaatgttcctctccc

SEQ ID NO: 24989 - DNA, 19 bp, Homo sapiens
aagaaaacttagccatgga

SEQ ID NO: 24990 - DNA, 18 bp, Homo sapiens
gaaatacaagtcatagta

SEQ ID NO: 24991 - DNA, 22 bp, Homo sapiens
gcagtcttcagcctccccagta

SEQ ID NO: 24992 - DNA, 20 bp, Homo sapiens
aaatcaaaggcgctttgaaa

SEQ ID NO: 24993 - DNA, 22 bp, Homo sapiens
gcgccaggagagtctcccccca

SEQ ID NO: 24994 - DNA, 21 bp, Homo sapiens
ggggctccaggcggctgcggc

SEQ ID NO: 24995 - DNA, 22 bp, Homo sapiens
gcctgggccgcggccgcagccc

SEQ ID NO: 24996 - DNA, 22 bp, Homo sapiens
cctaagcggagttgttgttttt

SEQ ID NO: 24997 - DNA, 22 bp, Homo sapiens
cttgagcgatctaatgtttctt

SEQ ID NO: 24998 - DNA, 18 bp, Homo sapiens
gtacctaaaaatattctc

SEQ ID NO: 24999 - DNA, 18 bp, Homo sapiens
taaaagatatttctgctg

SEQ ID NO: 25000 - DNA, 23 bp, Homo sapiens
tctgctgatcaaagatgatcaag

SEQ ID NO: 25001 - DNA, 18 bp, Homo sapiens
acaacagaaaacactttg

SEQ ID NO: 25002 - DNA, 24 bp, Homo sapiens
agggaagagaggggttctacccac

SEQ ID NO: 25003 - DNA, 18 bp, Homo sapiens
atttatgaagttatggca

SEQ ID NO: 25004 - DNA, 16 bp, Homo sapiens
ctgcagcatgctggga

SEQ ID NO: 25005 - DNA, 19 bp, Homo sapiens
cttgcttccagattgtttt

SEQ ID NO: 25006 - DNA, 19 bp, Homo sapiens
ggacatttaataatggacc

SEQ ID NO: 25007 - DNA, 18 bp, Homo sapiens
acaacagaaaacactttg

SEQ ID NO: 25008 - DNA, 24 bp, Homo sapiens
agggaagagaggggttctacccac

SEQ ID NO: 25009 - DNA, 18 bp, Homo sapiens
atttatgaagttatggca

SEQ ID NO: 25010 - DNA, 21 bp, Homo sapiens
cctacgttcatagccgtctca

SEQ ID NO: 25011 - DNA, 20 bp, Homo sapiens
ctacgttcatagccgtctca

SEQ ID NO: 25012 - DNA, 16 bp, Homo sapiens
ctgcagcatgctggga

SEQ ID NO: 25013 - DNA, 19 bp, Homo sapiens
cttgcttccagattgtttt

SEQ ID NO: 25014 - DNA, 19 bp, Homo sapiens
ggacatttaataatggacc

SEQ ID NO: 25015 - DNA, 19 bp, Homo sapiens
gtgaccatctccagccttc

SEQ ID NO: 25016 - DNA, 18 bp, Homo sapiens
acaacagaaaacactttg

SEQ ID NO: 25017 - DNA, 24 bp, Homo sapiens
agggaagagaggggttctacccac

SEQ ID NO: 25018 - DNA, 18 bp, Homo sapiens
atttatgaagttatggca

SEQ ID NO: 25019 - DNA, 21 bp, Homo sapiens
cctacgttcatagccgtctca

SEQ ID NO: 25020 - DNA, 20 bp, Homo sapiens
ctacgttcatagccgtctca

SEQ ID NO: 25021 - DNA, 16 bp, Homo sapiens
ctgcagcatgctggga

SEQ ID NO: 25022 - DNA, 19 bp, Homo sapiens
cttgcttccagattgtttt

SEQ ID NO: 25023 - DNA, 19 bp, Homo sapiens
ggacatttaataatggacc

SEQ ID NO: 25024 - DNA, 19 bp, Homo sapiens
gtgaccatctccagccttc

SEQ ID NO: 25025 - DNA, 18 bp, Homo sapiens
acaacagaaaacactttg

SEQ ID NO: 25026 - DNA, 24 bp, Homo sapiens
agggaagagaggggttctacccac

SEQ ID NO: 25027 - DNA, 18 bp, Homo sapiens
atttatgaagttatggca

SEQ ID NO: 25028 - DNA, 20 bp, Homo sapiens
catctgcatgggttgtgaga

SEQ ID NO: 25029 - DNA, 21 bp, Homo sapiens
cctacgttcatagccgtctca

SEQ ID NO: 25030 - DNA, 20 bp, Homo sapiens
ctacgttcatagccgtctca

SEQ ID NO: 25031 - DNA, 16 bp, Homo sapiens
ctgcagcatgctggga

SEQ ID NO: 25032 - DNA, 18 bp, Homo sapiens
ctgtctttctttgtctca

SEQ ID NO: 25033 - DNA, 19 bp, Homo sapiens
cttgcttccagattgtttt

SEQ ID NO: 25034 - DNA, 19 bp, Homo sapiens
ggacatttaataatggacc

SEQ ID NO: 25035 - DNA, 19 bp, Homo sapiens
gtgaccatctccagccttc

SEQ ID NO: 25036 - DNA, 18 bp, Homo sapiens
gaaaacctatggaaccta

SEQ ID NO: 25037 - DNA, 19 bp, Homo sapiens
agatcatctacagattcta

SEQ ID NO: 25038 - DNA, 24 bp, Homo sapiens
gtgtgtgtgcgcgtgcattgatta

SEQ ID NO: 25039 - DNA, 18 bp, Homo sapiens
ttttcttattgctgtgga

SEQ ID NO: 25040 - DNA, 19 bp, Homo sapiens
ccttcccctcccctcctcc

SEQ ID NO: 25041 - DNA, 21 bp, Homo sapiens
atcttggctcactgcaacctc

SEQ ID NO: 25042 - DNA, 20 bp, Homo sapiens
gatctagcctttccagtata

SEQ ID NO: 25043 - DNA, 17 bp, Homo sapiens
tatttgaaacatgcttt

SEQ ID NO: 25044 - DNA, 23 bp, Homo sapiens
cttatgctgtcttaaattatttt

SEQ ID NO: 25045 - DNA, 21 bp, Homo sapiens
taattccagagaatttttatc

SEQ ID NO: 25046 - DNA, 20 bp, Homo sapiens
aaaatgtgatttttgacata

SEQ ID NO: 25047 - DNA, 18 bp, Homo sapiens
caatatcaccaaagtatg

SEQ ID NO: 25048 - DNA, 19 bp, Homo sapiens
cgacttgagtgtaaacata

SEQ ID NO: 25049 - DNA, 21 bp, Homo sapiens
gccagaacgtgcctcaggagg

SEQ ID NO: 25050 - DNA, 20 bp, Homo sapiens
catagaaagactactgtcaa

SEQ ID NO: 25051 - DNA, 22 bp, Homo sapiens
ggtggatgggaaaaaatacttg

SEQ ID NO: 25052 - DNA, 19 bp, Homo sapiens
gtggagccaagctactgta

SEQ ID NO: 25053 - DNA, 18 bp, Homo sapiens
tgacatgacagccattcc

SEQ ID NO: 25054 - DNA, 17 bp, Homo sapiens
cgcacaccactgcctca

SEQ ID NO: 25055 - DNA, 24 bp, Homo sapiens
gtcctctttctcactagagactca

SEQ ID NO: 25056 - DNA, 23 bp, Homo sapiens
atgtcaggaaagccctaaactga

SEQ ID NO: 25057 - DNA, 21 bp, Homo sapiens
caaggtcatctctggcccagt

SEQ ID NO: 25058 - DNA, 21 bp, Homo sapiens
ctcccggcccccctgcactct

SEQ ID NO: 25059 - DNA, 21 bp, Homo sapiens
tagatgggttccgtaagaggc

SEQ ID NO: 25060 - DNA, 18 bp, Homo sapiens
tgcacctcccggacttca

SEQ ID NO: 25061 - DNA, 21 bp, Homo sapiens
aggcccaggggactctctcca

SEQ ID NO: 25062 - DNA, 21 bp, Homo sapiens
atcttggctcactgcaacctc

SEQ ID NO: 25063 - DNA, 18 bp, Homo sapiens
attgacttggacattttt

SEQ ID NO: 25064 - DNA, 20 bp, Homo sapiens
tagtgtaaacaaaaatttca

SEQ ID NO: 25065 - DNA, 23 bp, Homo sapiens
aaagtcttctgcagaatctccca

SEQ ID NO: 25066 - DNA, 22 bp, Homo sapiens
aagtcttctgcagaatctccca

SEQ ID NO: 25067 - DNA, 23 bp, Homo sapiens
atgttacagagcatgtcattgtc

SEQ ID NO: 25068 - DNA, 20 bp, Homo sapiens
ctaaatttgaccctctgggc

SEQ ID NO: 25069 - DNA, 18 bp, Homo sapiens
cctgcaacctccacctcc

SEQ ID NO: 25070 - DNA, 19 bp, Homo sapiens
tccagttcttgttttttgg

SEQ ID NO: 25071 - DNA, 17 bp, Homo sapiens
tcaagtgattctcctgc

SEQ ID NO: 25072 - DNA, 26 bp, Homo sapiens
tggtcggtgaggcccgggttattttt

SEQ ID NO: 25073 - DNA, 17 bp, Homo sapiens
ttctcctgccttagcct

SEQ ID NO: 25074 - DNA, 17 bp, Homo sapiens
aggcagcgatgctgagc

SEQ ID NO: 25075 - DNA, 19 bp, Homo sapiens
cgcgcgtgtgtacacatgc

SEQ ID NO: 25076 - DNA, 16 bp, Homo sapiens
ctaagaccccgcgggc

SEQ ID NO: 25077 - DNA, 18 bp, Homo sapiens
gagccttcctttcacaca

SEQ ID NO: 25078 - DNA, 28 bp, Homo sapiens
gcctggtcagccccgtggcctctggccc

SEQ ID NO: 25079 - DNA, 18 bp, Homo sapiens
ttccagaatgtatttcca

SEQ ID NO: 25080 - DNA, 20 bp, Homo sapiens
ctagtgccagaaacttggca

SEQ ID NO: 25081 - DNA, 27 bp, Homo sapiens
taaataaaacccatcagcatggggtta

SEQ ID NO: 25082 - DNA, 19 bp, Homo sapiens
aacaatccaatcccatgat

SEQ ID NO: 25083 - DNA, 16 bp, Homo sapiens
ctctaatgtaagtcta

SEQ ID NO: 25084 - DNA, 24 bp, Homo sapiens
cttaatcaccttctaaagatctca

SEQ ID NO: 25085 - DNA, 20 bp, Homo sapiens
tagaactctggatttttaga

SEQ ID NO: 25086 - DNA, 17 bp, Homo sapiens
ttttgtggttgtagcaa

SEQ ID NO: 25087 - DNA, 19 bp, Homo sapiens
atgtaaaaataagacatta

SEQ ID NO: 25088 - DNA, 21 bp, Homo sapiens
tatgcaattatatatctgata

SEQ ID NO: 25089 - DNA, 21 bp, Homo sapiens
agccgcagcctctcttgaggg

SEQ ID NO: 25090 - DNA, 17 bp, Homo sapiens
ctgaggcccagctgggc

SEQ ID NO: 25091 - DNA, 21 bp, Homo sapiens
gagcgcctctggttcctgctc

SEQ ID NO: 25092 - DNA, 16 bp, Homo sapiens
gccaggaggcacctga

SEQ ID NO: 25093 - DNA, 20 bp, Homo sapiens
tcccaggtgaccattctctg

SEQ ID NO: 25094 - DNA, 20 bp, Homo sapiens
tgggcacgagtatggtgaga

SEQ ID NO: 25095 - DNA, 17 bp, Homo sapiens
cagctgcagcagcacca

SEQ ID NO: 25096 - DNA, 23 bp, Homo sapiens
ctccagctcacacaacactgctt

SEQ ID NO: 25097 - DNA, 19 bp, Homo sapiens
gaaactccagctcacacaa

SEQ ID NO: 25098 - DNA, 18 bp, Homo sapiens
gaggaaagcagctgtgag

SEQ ID NO: 25099 - DNA, 18 bp, Homo sapiens
tcacacaacactgcttct

SEQ ID NO: 25100 - DNA, 24 bp, Homo sapiens
tgctatttctttctggttcctgca

SEQ ID NO: 25101 - DNA, 19 bp, Homo sapiens
agaccttcctgaggctgcc

SEQ ID NO: 25102 - DNA, 18 bp, Homo sapiens
ctctagaatagccaccca

SEQ ID NO: 25103 - DNA, 21 bp, Homo sapiens
cagcaacccacctgagtatga

SEQ ID NO: 25104 - DNA, 19 bp, Homo sapiens
cctctggggcctgcgagcc

SEQ ID NO: 25105 - DNA, 16 bp, Homo sapiens
cgagcccgccatgaga

SEQ ID NO: 25106 - DNA, 17 bp, Homo sapiens
ctacaagaagatcccca

SEQ ID NO: 25107 - DNA, 23 bp, Homo sapiens
gcacccattcctcggcgatctga

SEQ ID NO: 25108 - DNA, 24 bp, Homo sapiens
gggagaagaggctggctcagtgcc

SEQ ID NO: 25109 - DNA, 23 bp, Homo sapiens
ccaaagacactatttttgcagct

SEQ ID NO: 25110 - DNA, 19 bp, Homo sapiens
gatagatcccccatcctct

SEQ ID NO: 25111 - DNA, 20 bp, Homo sapiens
agtagttgaagtccagggca

SEQ ID NO: 25112 - DNA, 20 bp, Homo sapiens
agttaaaacaaaggacgcta

SEQ ID NO: 25113 - DNA, 18 bp, Homo sapiens
ctgagtcaagactctcaa

SEQ ID NO: 25114 - DNA, 19 bp, Homo sapiens
ctgctaccccagccaaaga

SEQ ID NO: 25115 - DNA, 21 bp, Homo sapiens
gcagcttgatgagtttttgtt

SEQ ID NO: 25116 - DNA, 20 bp, Homo sapiens
gtataggcaggtgtgaggga

SEQ ID NO: 25117 - DNA, 20 bp, Homo sapiens
gtgaccaaggcccatgtgtg

SEQ ID NO: 25118 - DNA, 18 bp, Homo sapiens
tatttttctttgttccca

SEQ ID NO: 25119 - DNA, 22 bp, Homo sapiens
tctggattgcggagggtggttc

SEQ ID NO: 25120 - DNA, 17 bp, Homo sapiens
tgtaattgtgggcatgt

SEQ ID NO: 25121 - DNA, 22 bp, Homo sapiens
ggaggagggggagccccggaca

SEQ ID NO: 25122 - DNA, 18 bp, Homo sapiens
cctgccctcctccaacaa

SEQ ID NO: 25123 - DNA, 22 bp, Homo sapiens
ctctgatggtgtcctcctctgg

SEQ ID NO: 25124 - DNA, 20 bp, Homo sapiens
ccagattccaaaggattcaa

SEQ ID NO: 25125 - DNA, 15 bp, Homo sapiens
ccctgaagtctctaa

SEQ ID NO: 25126 - DNA, 23 bp, Homo sapiens
cctctttgtgagatctgagcttt

SEQ ID NO: 25127 - DNA, 19 bp, Homo sapiens
ctcctacttatcttgctca

SEQ ID NO: 25128 - DNA, 21 bp, Homo sapiens
gctacagttgtgactcacact

SEQ ID NO: 25129 - DNA, 23 bp, Homo sapiens
ggcgctagaggtcctgcctctta

SEQ ID NO: 25130 - DNA, 19 bp, Homo sapiens
ggttctttacattgtgata

SEQ ID NO: 25131 - DNA, 19 bp, Homo sapiens
ccctaactagagttctaga

SEQ ID NO: 25132 - DNA, 18 bp, Homo sapiens
ttggatgtcttccttaga

SEQ ID NO: 25133 - DNA, 20 bp, Homo sapiens
aatctggccatgaaaacctc

SEQ ID NO: 25134 - DNA, 19 bp, Homo sapiens
caacaggcacttcccaaca

SEQ ID NO: 25135 - DNA, 21 bp, Homo sapiens
cagccgtcaggaatctggcca

SEQ ID NO: 25136 - DNA, 20 bp, Homo sapiens
tgaggtcccagtatgaactg

SEQ ID NO: 25137 - DNA, 18 bp, Homo sapiens
ggacaaatgctttcagtg

SEQ ID NO: 25138 - DNA, 25 bp, Homo sapiens
agtcctgctccctcacatgaagctg

SEQ ID NO: 25139 - DNA, 21 bp, Homo sapiens
ccattaaaaaaataatcctta

SEQ ID NO: 25140 - DNA, 23 bp, Homo sapiens
cctctgggtcctctccaagtcct

SEQ ID NO: 25141 - DNA, 22 bp, Homo sapiens
gcattttagatcaaacaattca

SEQ ID NO: 25142 - DNA, 24 bp, Homo sapiens
ggcatgagccacctcgcctggcca

SEQ ID NO: 25143 - DNA, 18 bp, Homo sapiens
tccgactcctgggttcaa

SEQ ID NO: 25144 - DNA, 20 bp, Homo sapiens
tggccaggctggtcttgaac

SEQ ID NO: 25145 - DNA, 18 bp, Homo sapiens
tggcttggcctgagactg

SEQ ID NO: 25146 - DNA, 20 bp, Homo sapiens
ttcttggacacaaccctcct

SEQ ID NO: 25147 - DNA, 22 bp, Homo sapiens
tcttcgcagggaagcctgtgga

SEQ ID NO: 25148 - DNA, 20 bp, Homo sapiens
gtgccaggagccatgtctga

SEQ ID NO: 25149 - DNA, 19 bp, Homo sapiens
taaaaacattttagacaaa

SEQ ID NO: 25150 - DNA, 22 bp, Homo sapiens
caatatcaaaaacaagtgcttg

SEQ ID NO: 25151 - DNA, 19 bp, Homo sapiens
gaaggtgatgtgaatgcga

SEQ ID NO: 25152 - DNA, 24 bp, Homo sapiens
cttgggcaactcgagcagctctcc

SEQ ID NO: 25153 - DNA, 20 bp, Homo sapiens
ggaaatgattgtgcggctgt

SEQ ID NO: 25154 - DNA, 21 bp, Homo sapiens
tgagtgggttccctcgtgggg

SEQ ID NO: 25155 - DNA, 19 bp, Homo sapiens
ccaggcttctcccaacaga

SEQ ID NO: 25156 - DNA, 21 bp, Homo sapiens
gttatgttgttggtagatttt

SEQ ID NO: 25157 - DNA, 19 bp, Homo sapiens
tgactatccaaacagctca

SEQ ID NO: 25158 - DNA, 18 bp, Homo sapiens
acactggagcctgcaata

SEQ ID NO: 25159 - DNA, 23 bp, Homo sapiens
agagagtatctgagaaccaacca

SEQ ID NO: 25160 - DNA, 21 bp, Homo sapiens
agcagtgcagccaccagggca

SEQ ID NO: 25161 - DNA, 21 bp, Homo sapiens
caagaggaccctgccttggtg

SEQ ID NO: 25162 - DNA, 23 bp, Homo sapiens
gaagaagtagtttactttggact

SEQ ID NO: 25163 - DNA, 18 bp, Homo sapiens
gcctcccacggtcagctg

SEQ ID NO: 25164 - DNA, 18 bp, Homo sapiens
gcgtcctcccccgtacct

SEQ ID NO: 25165 - DNA, 19 bp, Homo sapiens
atgacacagaagagcgctg

SEQ ID NO: 25166 - DNA, 20 bp, Homo sapiens
cgaccttccagcagctgacc

SEQ ID NO: 25167 - DNA, 20 bp, Homo sapiens
acttgtctacaaaccaggtg

SEQ ID NO: 25168 - DNA, 21 bp, Homo sapiens
atcattgcaaccttattaggc

SEQ ID NO: 25169 - DNA, 19 bp, Homo sapiens
ctctttaattcatagcctt

SEQ ID NO: 25170 - DNA, 17 bp, Homo sapiens
ggaacagtacgatctta

SEQ ID NO: 25171 - DNA, 19 bp, Homo sapiens
tctaactcatgtttttgat

SEQ ID NO: 25172 - DNA, 24 bp, Homo sapiens
acctgggttgttacctgcctgtct

SEQ ID NO: 25173 - DNA, 17 bp, Homo sapiens
atggctgggggttctga

SEQ ID NO: 25174 - DNA, 23 bp, Homo sapiens
cctgactaaatagcagtcaggga

SEQ ID NO: 25175 - DNA, 18 bp, Homo sapiens
ctctccttagagacacct

SEQ ID NO: 25176 - DNA, 18 bp, Homo sapiens
gtatgagtattcattcct

SEQ ID NO: 25177 - DNA, 17 bp, Homo sapiens
gtcatgagtaaaagctt

SEQ ID NO: 25178 - DNA, 23 bp, Homo sapiens
tgccattttttttcttctgtaca

SEQ ID NO: 25179 - DNA, 19 bp, Homo sapiens
cacacccccgtggctggaa

SEQ ID NO: 25180 - DNA, 18 bp, Homo sapiens
ccgggctcgggagttatg

SEQ ID NO: 25181 - DNA, 16 bp, Homo sapiens
gtggacttcctgttct

SEQ ID NO: 25182 - DNA, 18 bp, Homo sapiens
tgccaatgatagtgacca

SEQ ID NO: 25183 - DNA, 19 bp, Homo sapiens
aggtttcctatccccctca

SEQ ID NO: 25184 - DNA, 19 bp, Homo sapiens
aggcagtggtgggattcca

SEQ ID NO: 25185 - DNA, 23 bp, Homo sapiens
ccattttgcttcccagcactttt

SEQ ID NO: 25186 - DNA, 21 bp, Homo sapiens
tagcatttttttttttccaaa

SEQ ID NO: 25187 - DNA, 18 bp, Homo sapiens
gtgtgtgtcatgtggctg

SEQ ID NO: 25188 - DNA, 21 bp, Homo sapiens
atctgggttttctcctggctt

SEQ ID NO: 25189 - DNA, 15 bp, Homo sapiens
atggtgtgtccgacg

SEQ ID NO: 25190 - DNA, 23 bp, Homo sapiens
ccaataactcttttttttttcct

SEQ ID NO: 25191 - DNA, 18 bp, Homo sapiens
ggaggtggcggcggcggc

SEQ ID NO: 25192 - DNA, 22 bp, Homo sapiens
tggtgtgtccgacgtagagctg

SEQ ID NO: 25193 - DNA, 21 bp, Homo sapiens
caccaccaccatcatcctggc

SEQ ID NO: 25194 - DNA, 18 bp, Homo sapiens
ggtagaaggcctgttgtg

SEQ ID NO: 25195 - DNA, 24 bp, Homo sapiens
gcacctttttccctttccttctca

SEQ ID NO: 25196 - DNA, 20 bp, Homo sapiens
aggcattttgtttctggtga

SEQ ID NO: 25197 - DNA, 19 bp, Homo sapiens
ccagggctggctggcctgc

SEQ ID NO: 25198 - DNA, 20 bp, Homo sapiens
tactggtggctgttgatgac

SEQ ID NO: 25199 - DNA, 20 bp, Homo sapiens
tgcagctcaagcatgtctgc

SEQ ID NO: 25200 - DNA, 24 bp, Homo sapiens
tttgccatagctcagaccacttct

SEQ ID NO: 25201 - DNA, 19 bp, Homo sapiens
atgggaggcctatttgact

SEQ ID NO: 25202 - DNA, 19 bp, Homo sapiens
gatcttataccactctgta

SEQ ID NO: 25203 - DNA, 16 bp, Homo sapiens
ttgaaaagacctggaa

SEQ ID NO: 25204 - DNA, 19 bp, Homo sapiens
atgtgatgttcagcagcaa

SEQ ID NO: 25205 - DNA, 19 bp, Homo sapiens
cctggggatttcttggttt

SEQ ID NO: 25206 - DNA, 19 bp, Homo sapiens
ttataccagctgaatggca

SEQ ID NO: 25207 - DNA, 15 bp, Homo sapiens
ttgggatgtttttga

SEQ ID NO: 25208 - DNA, 21 bp, Homo sapiens
tttcttgagcgttttgatttt

SEQ ID NO: 25209 - DNA, 24 bp, Homo sapiens
cctggatttttttaaatcattttt

SEQ ID NO: 25210 - DNA, 19 bp, Homo sapiens
gaacactatgcattttgaa

SEQ ID NO: 25211 - DNA, 22 bp, Homo sapiens
tccctttttcccgtctgacccc

SEQ ID NO: 25212 - DNA, 20 bp, Homo sapiens
accatctgataagtcagaga

SEQ ID NO: 25213 - DNA, 20 bp, Homo sapiens
gcagactttaaccatctgat

SEQ ID NO: 25214 - DNA, 19 bp, Homo sapiens
ggagctcagtggaaatctc

SEQ ID NO: 25215 - DNA, 18 bp, Homo sapiens
tgaggattttgattcaga

SEQ ID NO: 25216 - DNA, 23 bp, Homo sapiens
tttgaaatgtggaggattttgaa

SEQ ID NO: 25217 - DNA, 23 bp, Homo sapiens
agtgcttgaccagtaatgtggtt

SEQ ID NO: 25218 - DNA, 24 bp, Homo sapiens
cctgagcctcctgaagttgctgct

SEQ ID NO: 25219 - DNA, 15 bp, Homo sapiens
ctgagcagggctgga

SEQ ID NO: 25220 - DNA, 18 bp, Homo sapiens
tccgcctcccgggttcaa

SEQ ID NO: 25221 - DNA, 17 bp, Homo sapiens
tgctgtgtggacttcat

SEQ ID NO: 25222 - DNA, 23 bp, Homo sapiens
catgggggagaacatacagccca

SEQ ID NO: 25223 - DNA, 19 bp, Homo sapiens
cattaacaaaacaatcact

SEQ ID NO: 25224 - DNA, 20 bp, Homo sapiens
ccaaggctgctaggcccacc

SEQ ID NO: 25225 - DNA, 19 bp, Homo sapiens
gcaaattaggatcacttga

SEQ ID NO: 25226 - DNA, 21 bp, Homo sapiens
gcggaggaggaagctgtggct

SEQ ID NO: 25227 - DNA, 23 bp, Homo sapiens
tcctttaaaaattccaaagctca

SEQ ID NO: 25228 - DNA, 24 bp, Homo sapiens
cagaagaatggcgtaaacccagga

SEQ ID NO: 25229 - DNA, 23 bp, Homo sapiens
agacccaatatacagggttttga

SEQ ID NO: 25230 - DNA, 25 bp, Homo sapiens
tttggcagtaatccagattgctttt

SEQ ID NO: 25231 - DNA, 22 bp, Homo sapiens
gcccccaaaaggagcccggtga

SEQ ID NO: 25232 - DNA, 20 bp, Homo sapiens
tctgaagagcacatctccac

SEQ ID NO: 25233 - DNA, 21 bp, Homo sapiens
atctcggctcaccccaacctc

SEQ ID NO: 25234 - DNA, 19 bp, Homo sapiens
tgcattcatccagctcacc

SEQ ID NO: 25235 - DNA, 22 bp, Homo sapiens
atcttggctcactgcaacctct

SEQ ID NO: 25236 - DNA, 19 bp, Homo sapiens
cccaccaccctacttgaca

SEQ ID NO: 25237 - DNA, 20 bp, Homo sapiens
cctctgcctcctgggttcaa

SEQ ID NO: 25238 - DNA, 21 bp, Homo sapiens
ctccatttcccctcctcctct

SEQ ID NO: 25239 - DNA, 21 bp, Homo sapiens
ctgtccccacctccaccctcc

SEQ ID NO: 25240 - DNA, 16 bp, Homo sapiens
gagccccaggatctca

SEQ ID NO: 25241 - DNA, 17 bp, Homo sapiens
tcaagtgattctcttgc

SEQ ID NO: 25242 - DNA, 19 bp, Homo sapiens
catcctcttccacgctcag

SEQ ID NO: 25243 - DNA, 18 bp, Homo sapiens
gagatcgagcttacctca

SEQ ID NO: 25244 - DNA, 18 bp, Homo sapiens
tcttccgccttccattgt

SEQ ID NO: 25245 - DNA, 24 bp, Homo sapiens
tccagggccctgggctggacctca

SEQ ID NO: 25246 - DNA, 25 bp, Homo sapiens
aggaataaagttgctgattcattcc

SEQ ID NO: 25247 - DNA, 17 bp, Homo sapiens
tgaagcttgtgtatcca

SEQ ID NO: 25248 - DNA, 19 bp, Homo sapiens
tggcagggcctagctgcta

SEQ ID NO: 25249 - DNA, 19 bp, Homo sapiens
aggtcttatagattcctga

SEQ ID NO: 25250 - DNA, 19 bp, Homo sapiens
tgaggaatacagtgagcag

SEQ ID NO: 25251 - DNA, 21 bp, Homo sapiens
catctcggacttgctgaatca

SEQ ID NO: 25252 - DNA, 16 bp, Homo sapiens
ctgttttggagactgc

SEQ ID NO: 25253 - DNA, 24 bp, Homo sapiens
gttttggagactgcctataagtta

SEQ ID NO: 25254 - DNA, 16 bp, Homo sapiens
actggtggcaggtgat

SEQ ID NO: 25255 - DNA, 17 bp, Homo sapiens
cctatggaggcccatga

SEQ ID NO: 25256 - DNA, 17 bp, Homo sapiens
gtctacagcctgaccca

SEQ ID NO: 25257 - DNA, 20 bp, Homo sapiens
tgtgttggaggccctctgga

SEQ ID NO: 25258 - DNA, 26 bp, Homo sapiens
gcttggaccgcgatggggctgggccc

SEQ ID NO: 25259 - DNA, 16 bp, Homo sapiens
agtagaagaaaccaca

SEQ ID NO: 25260 - DNA, 20 bp, Homo sapiens
tcttgagttgttttaatttt

SEQ ID NO: 25261 - DNA, 24 bp, Homo sapiens
tgtaaagggatcttgagttgtttt

SEQ ID NO: 25262 - DNA, 21 bp, Homo sapiens
ttgcattttagcacttgcact

SEQ ID NO: 25263 - DNA, 22 bp, Homo sapiens
aagaaataaaaatagccattga

SEQ ID NO: 25264 - DNA, 22 bp, Homo sapiens
agccacactcatccacatcctg

SEQ ID NO: 25265 - DNA, 17 bp, Homo sapiens
atgactcagtttcagtt

SEQ ID NO: 25266 - DNA, 17 bp, Homo sapiens
cactcatccacatcctg

SEQ ID NO: 25267 - DNA, 18 bp, Homo sapiens
catttcccaagtgcttca

SEQ ID NO: 25268 - DNA, 18 bp, Homo sapiens
aagaacgtggtcagagta

SEQ ID NO: 25269 - DNA, 21 bp, Homo sapiens
aagagataactgtaaatgtga

SEQ ID NO: 25270 - DNA, 19 bp, Homo sapiens
ccaggctacaagagaaaaa

SEQ ID NO: 25271 - DNA, 18 bp, Homo sapiens
cgtatccataaagacccg

SEQ ID NO: 25272 - DNA, 20 bp, Homo sapiens
tcatccccttatccttctcc

SEQ ID NO: 25273 - DNA, 17 bp, Homo sapiens
ttccaaacaccacttta

SEQ ID NO: 25274 - DNA, 18 bp, Homo sapiens
atgggattccttgccacc

SEQ ID NO: 25275 - DNA, 20 bp, Homo sapiens
ccacaacactcatctgtcaa

SEQ ID NO: 25276 - DNA, 24 bp, Homo sapiens
ggatccgctgcaccgtctgccaca

SEQ ID NO: 25277 - DNA, 21 bp, Homo sapiens
tgcgctgcccccagtgccaga

SEQ ID NO: 25278 - DNA, 17 bp, Homo sapiens
tgccctcatcccaccca

SEQ ID NO: 25279 - DNA, 21 bp, Homo sapiens
ggacataggcaaaataacttg

SEQ ID NO: 25280 - DNA, 17 bp, Homo sapiens
ggtatgagtatatacca

SEQ ID NO: 25281 - DNA, 18 bp, Homo sapiens
tggtggctgaatttccca

SEQ ID NO: 25282 - DNA, 22 bp, Homo sapiens
ttcataggtgttctgcatttga

SEQ ID NO: 25283 - DNA, 21 bp, Homo sapiens
gcaccccccggccctgcctcc

SEQ ID NO: 25284 - DNA, 19 bp, Homo sapiens
gggagcccgccccgcttcc

SEQ ID NO: 25285 - DNA, 23 bp, Homo sapiens
atgtattgatgtacagccttgaa

SEQ ID NO: 25286 - DNA, 20 bp, Homo sapiens
aaatccaaggtctccccatc

SEQ ID NO: 25287 - DNA, 21 bp, Homo sapiens
acctgaaccaacatctggttc

SEQ ID NO: 25288 - DNA, 18 bp, Homo sapiens
cacttcactctgcctttt

SEQ ID NO: 25289 - DNA, 22 bp, Homo sapiens
cagaaggaaaaaaatactctct

SEQ ID NO: 25290 - DNA, 25 bp, Homo sapiens
ctacaaaaaattagctgggcactgt

SEQ ID NO: 25291 - DNA, 20 bp, Homo sapiens
gctattaggaatatttacct

SEQ ID NO: 25292 - DNA, 22 bp, Homo sapiens
tgaagaaagccaagaaaaccca

SEQ ID NO: 25293 - DNA, 17 bp, Homo sapiens
ttttcacttcactctgc

SEQ ID NO: 25294 - DNA, 22 bp, Homo sapiens
atcgtttatcatattgaaacat

SEQ ID NO: 25295 - DNA, 25 bp, Homo sapiens
gcctctttatactcacttaaaccaa

SEQ ID NO: 25296 - DNA, 20 bp, Homo sapiens
cccagaatgataactgcaca

SEQ ID NO: 25297 - DNA, 18 bp, Homo sapiens
ctgctcatgtgtcagtgt

SEQ ID NO: 25298 - DNA, 17 bp, Homo sapiens
tccaactgctgtttcag

SEQ ID NO: 25299 - DNA, 18 bp, Homo sapiens
tctcctgctcatgtgtca

SEQ ID NO: 25300 - DNA, 18 bp, Homo sapiens
tgataactgcacagtggc

SEQ ID NO: 25301 - DNA, 16 bp, Homo sapiens
aagaaataggaagcca

SEQ ID NO: 25302 - DNA, 18 bp, Homo sapiens
ctgcacaggcactgtgca

SEQ ID NO: 25303 - DNA, 17 bp, Homo sapiens
tcactggagactcactt

SEQ ID NO: 25304 - DNA, 19 bp, Homo sapiens
tgcacagcttacactgtca

SEQ ID NO: 25305 - DNA, 21 bp, Homo sapiens
ttttggtgaattgggatttgc

SEQ ID NO: 25306 - DNA, 18 bp, Homo sapiens
cttctctctcttacctct

SEQ ID NO: 25307 - DNA, 20 bp, Homo sapiens
tggtttcctcccaacccccg

SEQ ID NO: 25308 - DNA, 17 bp, Homo sapiens
cctggcgctggccgtgg

SEQ ID NO: 25309 - DNA, 22 bp, Homo sapiens
cgcccccgggacccgtctcccc

SEQ ID NO: 25310 - DNA, 19 bp, Homo sapiens
ctcacggctccctttgcca

SEQ ID NO: 25311 - DNA, 21 bp, Homo sapiens
cttgtctcagaaagtccctca

SEQ ID NO: 25312 - DNA, 18 bp, Homo sapiens
tggtttgacttggaacta

SEQ ID NO: 25313 - DNA, 18 bp, Homo sapiens
tctgctgatgtttatctt

SEQ ID NO: 25314 - DNA, 18 bp, Homo sapiens
acttgatggtaaaatatg

SEQ ID NO: 25315 - DNA, 23 bp, Homo sapiens
gcatgttaacattgcctacctca

SEQ ID NO: 25316 - DNA, 20 bp, Homo sapiens
ttataaatcatccttcacca

SEQ ID NO: 25317 - DNA, 17 bp, Homo sapiens
aaggacaagtttgtcat

SEQ ID NO: 25318 - DNA, 20 bp, Homo sapiens
aggagagaaagggcagctcc

SEQ ID NO: 25319 - DNA, 20 bp, Homo sapiens
ccaacaccattcttccccca

SEQ ID NO: 25320 - DNA, 24 bp, Homo sapiens
ccctggtcagaaaaagcttgcgga

SEQ ID NO: 25321 - DNA, 21 bp, Homo sapiens
ctatggcctcactctacctct

SEQ ID NO: 25322 - DNA, 20 bp, Homo sapiens
ctgttttgtgtgcgttccca

SEQ ID NO: 25323 - DNA, 17 bp, Homo sapiens
ggaggctgggagtctga

SEQ ID NO: 25324 - DNA, 18 bp, Homo sapiens
tccgttgacagttgtgta

SEQ ID NO: 25325 - DNA, 21 bp, Homo sapiens
tccgttgacagttgtgtaaaa

SEQ ID NO: 25326 - DNA, 19 bp, Homo sapiens
cggcagcaaaactaacttc

SEQ ID NO: 25327 - DNA, 17 bp, Homo sapiens
tctcccactttgcaacc

SEQ ID NO: 25328 - DNA, 16 bp, Homo sapiens
acaggaaaagttggtt

SEQ ID NO: 25329 - DNA, 19 bp, Homo sapiens
ctgcaacctccgcctccca

SEQ ID NO: 25330 - DNA, 17 bp, Homo sapiens
tcaagtgattctcctgc

SEQ ID NO: 25331 - DNA, 18 bp, Homo sapiens
tccgcctcccaggttcaa

SEQ ID NO: 25332 - DNA, 18 bp, Homo sapiens
tcttgacctcatgatcca

SEQ ID NO: 25333 - DNA, 19 bp, Homo sapiens
tggttttcaggtgagattg

SEQ ID NO: 25334 - DNA, 18 bp, Homo sapiens
caaaaaaatgcaaaaacc

SEQ ID NO: 25335 - DNA, 18 bp, Homo sapiens
ccaaaaagagaaatgtaa

SEQ ID NO: 25336 - DNA, 19 bp, Homo sapiens
cccactcaaacctctccca

SEQ ID NO: 25337 - DNA, 18 bp, Homo sapiens
tcaggggactttttgtca

SEQ ID NO: 25338 - DNA, 16 bp, Homo sapiens
tctttcctcttgcaca

SEQ ID NO: 25339 - DNA, 24 bp, Homo sapiens
tgaaagaaatctatcatgcactga

SEQ ID NO: 25340 - DNA, 22 bp, Homo sapiens
tgtttccctctgagtgaaactg

SEQ ID NO: 25341 - DNA, 18 bp, Homo sapiens
caaagctttgggaagcca

SEQ ID NO: 25342 - DNA, 22 bp, Homo sapiens
cgcagtcctgacgagcgggtca

SEQ ID NO: 25343 - DNA, 22 bp, Homo sapiens
gagccaagatcgcaccactgca

SEQ ID NO: 25344 - DNA, 18 bp, Homo sapiens
taatccctgagttctttt

SEQ ID NO: 25345 - DNA, 17 bp, Homo sapiens
cccaccccttcccaagc

SEQ ID NO: 25346 - DNA, 17 bp, Homo sapiens
ggggcctcccccagcca

SEQ ID NO: 25347 - DNA, 25 bp, Homo sapiens
acttaataaatattagtaaatcctt

SEQ ID NO: 25348 - DNA, 18 bp, Homo sapiens
acttggcatgacgtcaca

SEQ ID NO: 25349 - DNA, 20 bp, Homo sapiens
cacacccgcacccgcgcctc

SEQ ID NO: 25350 - DNA, 19 bp, Homo sapiens
cagttcaacacaaatgtaa

SEQ ID NO: 25351 - DNA, 20 bp, Homo sapiens
aaggcctgatggaacacaga

SEQ ID NO: 25352 - DNA, 22 bp, Homo sapiens
acaaaacattaaactagtgtta

SEQ ID NO: 25353 - DNA, 21 bp, Homo sapiens
agcatataaaattttccccct

SEQ ID NO: 25354 - DNA, 20 bp, Homo sapiens
ctcttaccagtatttaactt

SEQ ID NO: 25355 - DNA, 23 bp, Homo sapiens
ctgtatggttttgttttgttttg

SEQ ID NO: 25356 - DNA, 19 bp, Homo sapiens
ggctactgcttcaatctca

SEQ ID NO: 25357 - DNA, 20 bp, Homo sapiens
aaggcctgatggaacacaga

SEQ ID NO: 25358 - DNA, 22 bp, Homo sapiens
acaaaacattaaactagtgtta

SEQ ID NO: 25359 - DNA, 21 bp, Homo sapiens
agcatataaaattttccccct

SEQ ID NO: 25360 - DNA, 20 bp, Homo sapiens
ctcttaccagtatttaactt

SEQ ID NO: 25361 - DNA, 23 bp, Homo sapiens
ctgtatggttttgttttgttttg

SEQ ID NO: 25362 - DNA, 19 bp, Homo sapiens
ggctactgcttcaatctca

SEQ ID NO: 25363 - DNA, 23 bp, Homo sapiens
aacaaatctggataaatgtgcaa

SEQ ID NO: 25364 - DNA, 22 bp, Homo sapiens
cagtattgtagagcaagtcttg

SEQ ID NO: 25365 - DNA, 19 bp, Homo sapiens
gcctgccccctgacacaca

SEQ ID NO: 25366 - DNA, 19 bp, Homo sapiens
aatggaagccaacacatca

SEQ ID NO: 25367 - DNA, 20 bp, Homo sapiens
acatactttatttcttctta

SEQ ID NO: 25368 - DNA, 17 bp, Homo sapiens
atgcctctctttttctt

SEQ ID NO: 25369 - DNA, 15 bp, Homo sapiens
gattttaacagctct

SEQ ID NO: 25370 - DNA, 17 bp, Homo sapiens
gctgaagacttttgtta

SEQ ID NO: 25371 - DNA, 18 bp, Homo sapiens
ggtacaaactcattgctg

SEQ ID NO: 25372 - DNA, 18 bp, Homo sapiens
tctctactaaaaatacaa

SEQ ID NO: 25373 - DNA, 20 bp, Homo sapiens
tctcttcctgagccttaact

SEQ ID NO: 25374 - DNA, 17 bp, Homo sapiens
tgatgtgatctatgaag

SEQ ID NO: 25375 - DNA, 21 bp, Homo sapiens
tgcaaattgaaaaccatgcaa

SEQ ID NO: 25376 - DNA, 20 bp, Homo sapiens
tggggcccggagtgaggctg

SEQ ID NO: 25377 - DNA, 18 bp, Homo sapiens
tgggtggatcacttgagg

SEQ ID NO: 25378 - DNA, 24 bp, Homo sapiens
tttgggcaaataggcgttactttt

SEQ ID NO: 25379 - DNA, 21 bp, Homo sapiens
aatcttactaacacctatgat

SEQ ID NO: 25380 - DNA, 18 bp, Homo sapiens
atggaaacaagccactta

SEQ ID NO: 25381 - DNA, 18 bp, Homo sapiens
attttatttatggtccag

SEQ ID NO: 25382 - DNA, 24 bp, Homo sapiens
cagaatgctttgaaattctaatgg

SEQ ID NO: 25383 - DNA, 20 bp, Homo sapiens
cccgacacctcacctttcgc

SEQ ID NO: 25384 - DNA, 17 bp, Homo sapiens
cctcacctttcgctgtt

SEQ ID NO: 25385 - DNA, 21 bp, Homo sapiens
ctctttctctctctctctctc

SEQ ID NO: 25386 - DNA, 18 bp, Homo sapiens
taaggataaaacacgtca

SEQ ID NO: 25387 - DNA, 22 bp, Homo sapiens
tatcggccacctgccaatcaca

SEQ ID NO: 25388 - DNA, 16 bp, Homo sapiens
tctctctctcttttct

SEQ ID NO: 25389 - DNA, 21 bp, Homo sapiens
ccaaaagagacccactgtaat

SEQ ID NO: 25390 - DNA, 18 bp, Homo sapiens
ccccgaaccccccctgca

SEQ ID NO: 25391 - DNA, 19 bp, Homo sapiens
gggggaaatgtgtgtgtca

SEQ ID NO: 25392 - DNA, 17 bp, Homo sapiens
tggcagtccagcagcaa

SEQ ID NO: 25393 - DNA, 21 bp, Homo sapiens
gcccctccgcccctagcccca

SEQ ID NO: 25394 - DNA, 20 bp, Homo sapiens
cctctgcctcccgggttcaa

SEQ ID NO: 25395 - DNA, 17 bp, Homo sapiens
tccagacttactcttct

SEQ ID NO: 25396 - DNA, 23 bp, Homo sapiens
ctcacctgcagcctgttgcccaa

SEQ ID NO: 25397 - DNA, 25 bp, Homo sapiens
aaccccgctcaacgcccacccctca

SEQ ID NO: 25398 - DNA, 20 bp, Homo sapiens
caaaacaaggaaatcacaca

SEQ ID NO: 25399 - DNA, 26 bp, Homo sapiens
caaccccgctcaacgcccacccctca

SEQ ID NO: 25400 - DNA, 20 bp, Homo sapiens
ccttagcacaatctattgta

SEQ ID NO: 25401 - DNA, 16 bp, Homo sapiens
gtctgagtctgtgcac

SEQ ID NO: 25402 - DNA, 19 bp, Homo sapiens
ttgtccctttgcaccttga

SEQ ID NO: 25403 - DNA, 28 bp, Homo sapiens
tttgttgctctgatcttaagtttctttt

SEQ ID NO: 25404 - DNA, 21 bp, Homo sapiens
ataccctttggattgatcaca

SEQ ID NO: 25405 - DNA, 21 bp, Homo sapiens
atctgggatctagacatctga

SEQ ID NO: 25406 - DNA, 20 bp, Homo sapiens
ccctcctcccctcccccaat

SEQ ID NO: 25407 - DNA, 18 bp, Homo sapiens
tagtctcgagtttttttt

SEQ ID NO: 25408 - DNA, 21 bp, Homo sapiens
tgtggggctgcatttgcggtg

SEQ ID NO: 25409 - DNA, 17 bp, Homo sapiens
ccccaaatttgacacca

SEQ ID NO: 25410 - DNA, 22 bp, Homo sapiens
ctctttctccccgctgtgcctc

SEQ ID NO: 25411 - DNA, 23 bp, Homo sapiens
ctgggggctcctctaacatctca

SEQ ID NO: 25412 - DNA, 20 bp, Homo sapiens
gatccagaccagcgtctggc

SEQ ID NO: 25413 - DNA, 18 bp, Homo sapiens
gcctggctgagggccggg

SEQ ID NO: 25414 - DNA, 22 bp, Homo sapiens
gcttctccctgacccccgccct

SEQ ID NO: 25415 - DNA, 19 bp, Homo sapiens
accagtcaggcttatttca

SEQ ID NO: 25416 - DNA, 19 bp, Homo sapiens
atcctacttctacccccac

SEQ ID NO: 25417 - DNA, 17 bp, Homo sapiens
ctcccgatcttgctgcc

SEQ ID NO: 25418 - DNA, 21 bp, Homo sapiens
gcagaagagagggttttctca

SEQ ID NO: 25419 - DNA, 19 bp, Homo sapiens
ggtggatgaagtatgtgtg

SEQ ID NO: 25420 - DNA, 20 bp, Homo sapiens
tatggctttgtccctatgac

SEQ ID NO: 25421 - DNA, 18 bp, Homo sapiens
ttcactcattgactcact

SEQ ID NO: 25422 - DNA, 22 bp, Homo sapiens
ttcaggttgtggctcttggttc

SEQ ID NO: 25423 - DNA, 21 bp, Homo sapiens
gaggccatctgaagccaaaga

SEQ ID NO: 25424 - DNA, 19 bp, Homo sapiens
atttttcctgctgcactga

SEQ ID NO: 25425 - DNA, 19 bp, Homo sapiens
aaggatgacaaacactatc

SEQ ID NO: 25426 - DNA, 23 bp, Homo sapiens
agtgctgactgcagaatgaaata

SEQ ID NO: 25427 - DNA, 19 bp, Homo sapiens
gatgtgtcactcagactca

SEQ ID NO: 25428 - DNA, 18 bp, Homo sapiens
ggcatgtgtgttcaggga

SEQ ID NO: 25429 - DNA, 22 bp, Homo sapiens
tgcttcctctcggcgcacccca

SEQ ID NO: 25430 - DNA, 15 bp, Homo sapiens
accctccctgctcct

SEQ ID NO: 25431 - DNA, 21 bp, Homo sapiens
acattactgaatttgtgaaga

SEQ ID NO: 25432 - DNA, 17 bp, Homo sapiens
agcttgctttttatctc

SEQ ID NO: 25433 - DNA, 21 bp, Homo sapiens
atccttgttaatgcaatttat

SEQ ID NO: 25434 - DNA, 28 bp, Homo sapiens
cctttttataatcaaatgcttttgtctt

SEQ ID NO: 25435 - DNA, 21 bp, Homo sapiens
gggcatttactgtgtgccaac

SEQ ID NO: 25436 - DNA, 21 bp, Homo sapiens
gtgctgtcctgacaacatgct

SEQ ID NO: 25437 - DNA, 25 bp, Homo sapiens
tctagtgtggtttcaaataactttt

SEQ ID NO: 25438 - DNA, 20 bp, Homo sapiens
tgaacatagattttctgcca

SEQ ID NO: 25439 - DNA, 21 bp, Homo sapiens
aagagataagggtgtttatga

SEQ ID NO: 25440 - DNA, 24 bp, Homo sapiens
acaaatttgaatttaatgttgtca

SEQ ID NO: 25441 - DNA, 18 bp, Homo sapiens
catcatcgtcatgtgttt

SEQ ID NO: 25442 - DNA, 23 bp, Homo sapiens
cgcccccaggctgtgccccacca

SEQ ID NO: 25443 - DNA, 22 bp, Homo sapiens
tcgtcaccaaactggaacctca

SEQ ID NO: 25444 - DNA, 16 bp, Homo sapiens
tggctcctgctgcaac

SEQ ID NO: 25445 - DNA, 17 bp, Homo sapiens
tgtgtggtacttagtca

SEQ ID NO: 25446 - DNA, 24 bp, Homo sapiens
agtgatctcaataccacaccctca

SEQ ID NO: 25447 - DNA, 17 bp, Homo sapiens
caagattctctgctttt

SEQ ID NO: 25448 - DNA, 18 bp, Homo sapiens
gaaatgaatcaaagtaat

SEQ ID NO: 25449 - DNA, 17 bp, Homo sapiens
gagcatcttgaaattca

SEQ ID NO: 25450 - DNA, 19 bp, Homo sapiens
agaaaatgggattgagtta

SEQ ID NO: 25451 - DNA, 18 bp, Homo sapiens
gctaactatatcacagaa

SEQ ID NO: 25452 - DNA, 24 bp, Homo sapiens
gtctgaactgcggccccagagcct

SEQ ID NO: 25453 - DNA, 22 bp, Homo sapiens
aaatttggatagcttaattata

SEQ ID NO: 25454 - DNA, 17 bp, Homo sapiens
aatctgttaagagcagg

SEQ ID NO: 25455 - DNA, 17 bp, Homo sapiens
ccacatacatttgccta

SEQ ID NO: 25456 - DNA, 18 bp, Homo sapiens
ctcagttgatttaatctt

SEQ ID NO: 25457 - DNA, 19 bp, Homo sapiens
ggttttggccctcttgcag

SEQ ID NO: 25458 - DNA, 19 bp, Homo sapiens
gtgtttgaatataaatgat

SEQ ID NO: 25459 - DNA, 19 bp, Homo sapiens
tctggttatcacctggtcc

SEQ ID NO: 25460 - DNA, 22 bp, Homo sapiens
ttttggctgtcaatatcataac

SEQ ID NO: 25461 - DNA, 19 bp, Homo sapiens
gcatcttcagaatccccca

SEQ ID NO: 25462 - DNA, 20 bp, Homo sapiens
aagttcccctgctctgtgaa

SEQ ID NO: 25463 - DNA, 17 bp, Homo sapiens
caacaactcctccactg

SEQ ID NO: 25464 - DNA, 22 bp, Homo sapiens
tcccaagttcccctgctctgtg

SEQ ID NO: 25465 - DNA, 18 bp, Homo sapiens
cttaaaagagccaatgcc

SEQ ID NO: 25466 - DNA, 18 bp, Homo sapiens
ctatggtactttgtgatt

SEQ ID NO: 25467 - DNA, 20 bp, Homo sapiens
ctgtggattatattgcttga

SEQ ID NO: 25468 - DNA, 18 bp, Homo sapiens
tgcttgacttctacctca

SEQ ID NO: 25469 - DNA, 18 bp, Homo sapiens
agaaggtacatcctgtcc

SEQ ID NO: 25470 - DNA, 21 bp, Homo sapiens
atctgggtggatgccttgcct

SEQ ID NO: 25471 - DNA, 18 bp, Homo sapiens
ggcattctaatgtgaaat

SEQ ID NO: 25472 - DNA, 20 bp, Homo sapiens
tctgagcagttttgtgcttt

SEQ ID NO: 25473 - DNA, 21 bp, Homo sapiens
tgaaatggattatttatctca

SEQ ID NO: 25474 - DNA, 21 bp, Homo sapiens
acgtgcttagcctttatttca

SEQ ID NO: 25475 - DNA, 16 bp, Homo sapiens
acttgtccttacgtca

SEQ ID NO: 25476 - DNA, 20 bp, Homo sapiens
cagccattccaatctcttct

SEQ ID NO: 25477 - DNA, 23 bp, Homo sapiens
ggaacctgctggcacctcactgg

SEQ ID NO: 25478 - DNA, 20 bp, Homo sapiens
tcttacgttgcttgagtctt

SEQ ID NO: 25479 - DNA, 24 bp, Homo sapiens
tgagtgggtcccagctgtgtgatt

SEQ ID NO: 25480 - DNA, 18 bp, Homo sapiens
attacctcctacttgcca

SEQ ID NO: 25481 - DNA, 18 bp, Homo sapiens
caggacctgggcccggtt

SEQ ID NO: 25482 - DNA, 21 bp, Homo sapiens
gcaccccactctcctgcctcc

SEQ ID NO: 25483 - DNA, 16 bp, Homo sapiens
aaggtgccaaatgcat

SEQ ID NO: 25484 - DNA, 17 bp, Homo sapiens
ctattccaaatgcaata

SEQ ID NO: 25485 - DNA, 23 bp, Homo sapiens
taaaataatcctttaatatccaa

SEQ ID NO: 25486 - DNA, 18 bp, Homo sapiens
tctgatattgcacttctt

SEQ ID NO: 25487 - DNA, 27 bp, Homo sapiens
accagggtcatagtgaaacgcaggtga

SEQ ID NO: 25488 - DNA, 24 bp, Homo sapiens
acctggcgtggagctgcctggttt

SEQ ID NO: 25489 - DNA, 21 bp, Homo sapiens
acgggacagaaccacatgcta

SEQ ID NO: 25490 - DNA, 20 bp, Homo sapiens
ccaggatgatggtttcactt

SEQ ID NO: 25491 - DNA, 21 bp, Homo sapiens
ggaggagaggggaaagagaca

SEQ ID NO: 25492 - DNA, 18 bp, Homo sapiens
tgctgaggcctgatgaca

SEQ ID NO: 25493 - DNA, 22 bp, Homo sapiens
tgtgtcagaaagcacttctgaa

SEQ ID NO: 25494 - DNA, 19 bp, Homo sapiens
ttctgtcccggtgagctct

SEQ ID NO: 25495 - DNA, 20 bp, Homo sapiens
gccacatactgctgacggcc

SEQ ID NO: 25496 - DNA, 17 bp, Homo sapiens
gcctctgacccatttta

SEQ ID NO: 25497 - DNA, 19 bp, Homo sapiens
gtgtggtgcctttgagcaa

SEQ ID NO: 25498 - DNA, 17 bp, Homo sapiens
ttatctcctgtgtttca

SEQ ID NO: 25499 - DNA, 19 bp, Homo sapiens
tttatttatggttaccata

SEQ ID NO: 25500 - DNA, 18 bp, Homo sapiens
gaccagacccctcactca

SEQ ID NO: 25501 - DNA, 21 bp, Homo sapiens
ggtccacgtgcctggctctga

SEQ ID NO: 25502 - DNA, 17 bp, Homo sapiens
tcagaccagacccctca

SEQ ID NO: 25503 - DNA, 20 bp, Homo sapiens
agaaaattcagcgctacagc

SEQ ID NO: 25504 - DNA, 19 bp, Homo sapiens
cagcagagggacctccctc

SEQ ID NO: 25505 - DNA, 20 bp, Homo sapiens
ccacgccccttcctacactg

SEQ ID NO: 25506 - DNA, 20 bp, Homo sapiens
cctcccccagacccctccca

SEQ ID NO: 25507 - DNA, 23 bp, Homo sapiens
gaaggatattacaggaatctctc

SEQ ID NO: 25508 - DNA, 18 bp, Homo sapiens
tcaccaccaatggcatca

SEQ ID NO: 25509 - DNA, 20 bp, Homo sapiens
aaacacgtgaactttggtga

SEQ ID NO: 25510 - DNA, 19 bp, Homo sapiens
aaggaataaattccgcaca

SEQ ID NO: 25511 - DNA, 21 bp, Homo sapiens
agtggagacccccccaaggca

SEQ ID NO: 25512 - DNA, 20 bp, Homo sapiens
caacccttgcattccaccct

SEQ ID NO: 25513 - DNA, 18 bp, Homo sapiens
cctggtctcccatgccca

SEQ ID NO: 25514 - DNA, 20 bp, Homo sapiens
ctctgcaagtgctactggca

SEQ ID NO: 25515 - DNA, 20 bp, Homo sapiens
ctgccctgtctcaaatctca

SEQ ID NO: 25516 - DNA, 25 bp, Homo sapiens
gcagatcttgaagggatatactttc

SEQ ID NO: 25517 - DNA, 20 bp, Homo sapiens
gccctgttcacacaaatttt

SEQ ID NO: 25518 - DNA, 18 bp, Homo sapiens
tcaatacctgccctgtct

SEQ ID NO: 25519 - DNA, 21 bp, Homo sapiens
tgcagctcaccgcgcatgtgc

SEQ ID NO: 25520 - DNA, 20 bp, Homo sapiens
tggagctaagagtccgtaac

SEQ ID NO: 25521 - DNA, 15 bp, Homo sapiens
tgggctggcctggcc

SEQ ID NO: 25522 - DNA, 18 bp, Homo sapiens
ttacctgccctgctgcct

SEQ ID NO: 25523 - DNA, 17 bp, Homo sapiens
actggttagttgtcatt

SEQ ID NO: 25524 - DNA, 22 bp, Homo sapiens
atataatatatatgctaaagta

SEQ ID NO: 25525 - DNA, 16 bp, Homo sapiens
atggaaactcttacct

SEQ ID NO: 25526 - DNA, 22 bp, Homo sapiens
cagaagaattacagccctgtca

SEQ ID NO: 25527 - DNA, 18 bp, Homo sapiens
ccaccttattgcctttcc

SEQ ID NO: 25528 - DNA, 20 bp, Homo sapiens
cccctggtactcagcacaca

SEQ ID NO: 25529 - DNA, 19 bp, Homo sapiens
cctggattgcacctttgaa

SEQ ID NO: 25530 - DNA, 24 bp, Homo sapiens
cttctttctgttgtgtttgatttt

SEQ ID NO: 25531 - DNA, 20 bp, Homo sapiens
gcaaagaaatacaggagacc

SEQ ID NO: 25532 - DNA, 22 bp, Homo sapiens
tctgacgagtatctgaaggcat

SEQ ID NO: 25533 - DNA, 18 bp, Homo sapiens
tgagaaaggaaaatctca

SEQ ID NO: 25534 - DNA, 21 bp, Homo sapiens
ttgaatttttaaaaaatttca

SEQ ID NO: 25535 - DNA, 19 bp, Homo sapiens
agtactacagcttcttcga

SEQ ID NO: 25536 - DNA, 19 bp, Homo sapiens
cccgagacccacctgcagc

SEQ ID NO: 25537 - DNA, 18 bp, Homo sapiens
ctcctcagcatccggcac

SEQ ID NO: 25538 - DNA, 18 bp, Homo sapiens
tgccgcctcctcagcatc

SEQ ID NO: 25539 - DNA, 18 bp, Homo sapiens
aatagtcaacctgaaaca

SEQ ID NO: 25540 - DNA, 20 bp, Homo sapiens
cctgacaccccattgctagt

SEQ ID NO: 25541 - DNA, 19 bp, Homo sapiens
gatgttctggctgagattg

SEQ ID NO: 25542 - DNA, 23 bp, Homo sapiens
tgagtttcttcaggatgaaactg

SEQ ID NO: 25543 - DNA, 20 bp, Homo sapiens
atacttctgctattaacgct

SEQ ID NO: 25544 - DNA, 18 bp, Homo sapiens
gaactatccacctcatta

SEQ ID NO: 25545 - DNA, 23 bp, Homo sapiens
gatgcaaggagctgcctgtgaca

SEQ ID NO: 25546 - DNA, 24 bp, Homo sapiens
tggggtgcctgcttgggctgggtc

SEQ ID NO: 25547 - DNA, 18 bp, Homo sapiens
tgggtggatcacttgagg

SEQ ID NO: 25548 - DNA, 19 bp, Homo sapiens
agaaacatgaaaactgcct

SEQ ID NO: 25549 - DNA, 19 bp, Homo sapiens
gccctccgccccagcccca

SEQ ID NO: 25550 - DNA, 19 bp, Homo sapiens
tgtggcccccgggacccca

SEQ ID NO: 25551 - DNA, 28 bp, Homo sapiens
acctgttttctgccgtgacctttggtcc

SEQ ID NO: 25552 - DNA, 23 bp, Homo sapiens
agtttcactctgttgcccaaggt

SEQ ID NO: 25553 - DNA, 23 bp, Homo sapiens
tcctttgactgatgttcagtgtc

SEQ ID NO: 25554 - DNA, 19 bp, Homo sapiens
tgctctgctgctggacttt

SEQ ID NO: 25555 - DNA, 26 bp, Homo sapiens
cccactgagggcaggagggcttgtgg

SEQ ID NO: 25556 - DNA, 23 bp, Homo sapiens
gcgcccagtccctcaccatcggc

SEQ ID NO: 25557 - DNA, 21 bp, Homo sapiens
atcttggctcactgcaacctc

SEQ ID NO: 25558 - DNA, 17 bp, Homo sapiens
tcaagtgattcttctgc

SEQ ID NO: 25559 - DNA, 18 bp, Homo sapiens
tccgtctcctgggttcaa

SEQ ID NO: 25560 - DNA, 21 bp, Homo sapiens
tttctttgtacacaccagaga

SEQ ID NO: 25561 - DNA, 17 bp, Homo sapiens
caggctcttgcacaccc

SEQ ID NO: 25562 - DNA, 17 bp, Homo sapiens
ctccctgtaaccaagga

SEQ ID NO: 25563 - DNA, 22 bp, Homo sapiens
ctgtgattccttcattgtttta

SEQ ID NO: 25564 - DNA, 18 bp, Homo sapiens
ttccagaaatcaggtctg

SEQ ID NO: 25565 - DNA, 20 bp, Homo sapiens
attccagagctcactgccct

SEQ ID NO: 25566 - DNA, 20 bp, Homo sapiens
cacgtgcctgtagcattcca

SEQ ID NO: 25567 - DNA, 19 bp, Homo sapiens
ccacactcaccctccctca

SEQ ID NO: 25568 - DNA, 18 bp, Homo sapiens
cccctggctcaggagccg

SEQ ID NO: 25569 - DNA, 17 bp, Homo sapiens
gaagagcactcccttcc

SEQ ID NO: 25570 - DNA, 19 bp, Homo sapiens
gcttatcaaagactgagaa

SEQ ID NO: 25571 - DNA, 19 bp, Homo sapiens
ggctcccaaattggaacca

SEQ ID NO: 25572 - DNA, 24 bp, Homo sapiens
tgcccccagaacttttggatactg

SEQ ID NO: 25573 - DNA, 21 bp, Homo sapiens
tgtcctggcctctccgtgaca

SEQ ID NO: 25574 - DNA, 20 bp, Homo sapiens
ttctgtttgaagatttgggg

SEQ ID NO: 25575 - DNA, 18 bp, Homo sapiens
accgcgtccggctcagga

SEQ ID NO: 25576 - DNA, 21 bp, Homo sapiens
atcttggctcactgcaacctc

SEQ ID NO: 25577 - DNA, 19 bp, Homo sapiens
cctgggccgtggtctcctg

SEQ ID NO: 25578 - DNA, 16 bp, Homo sapiens
aactaggaggctcaaa

SEQ ID NO: 25579 - DNA, 20 bp, Homo sapiens
aagagaacctcagcattgtg

SEQ ID NO: 25580 - DNA, 19 bp, Homo sapiens
tcagcattgtgcacgataa

SEQ ID NO: 25581 - DNA, 19 bp, Homo sapiens
atttgagctgtggttgagg

SEQ ID NO: 25582 - DNA, 19 bp, Homo sapiens
tctgctctgttttgcatgg

SEQ ID NO: 25583 - DNA, 21 bp, Homo sapiens
aatcttactaacacctatgat

SEQ ID NO: 25584 - DNA, 18 bp, Homo sapiens
atggaaacaagccactta

SEQ ID NO: 25585 - DNA, 18 bp, Homo sapiens
attttatttatggtccag

SEQ ID NO: 25586 - DNA, 24 bp, Homo sapiens
cagaatgctttgaaattctaatgg

SEQ ID NO: 25587 - DNA, 20 bp, Homo sapiens
cccgacacctcacctttcgc

SEQ ID NO: 25588 - DNA, 17 bp, Homo sapiens
cctcacctttcgctgtt

SEQ ID NO: 25589 - DNA, 21 bp, Homo sapiens
ctctttctctctctctctctc

SEQ ID NO: 25590 - DNA, 18 bp, Homo sapiens
taaggataaaacacgtca

SEQ ID NO: 25591 - DNA, 22 bp, Homo sapiens
tatcggccacctgccaatcaca

SEQ ID NO: 25592 - DNA, 16 bp, Homo sapiens
tctctctctcttttct

SEQ ID NO: 25593 - DNA, 19 bp, Homo sapiens
agagaacattcctctgcag

SEQ ID NO: 25594 - DNA, 18 bp, Homo sapiens
gattgttctgtccagttt

SEQ ID NO: 25595 - DNA, 21 bp, Homo sapiens
ttagctacttttcagaattga

SEQ ID NO: 25596 - DNA, 21 bp, Homo sapiens
aatcttactaacacctatgat

SEQ ID NO: 25597 - DNA, 18 bp, Homo sapiens
atggaaacaagccactta

SEQ ID NO: 25598 - DNA, 18 bp, Homo sapiens
attttatttatggtccag

SEQ ID NO: 25599 - DNA, 24 bp, Homo sapiens
cagaatgctttgaaattctaatgg

SEQ ID NO: 25600 - DNA, 20 bp, Homo sapiens
cccgacacctcacctttcgc

SEQ ID NO: 25601 - DNA, 17 bp, Homo sapiens
cctcacctttcgctgtt

SEQ ID NO: 25602 - DNA, 18 bp, Homo sapiens
ctcttacactagaatcct

SEQ ID NO: 25603 - DNA, 21 bp, Homo sapiens
ctctttctctctctctctctc

SEQ ID NO: 25604 - DNA, 18 bp, Homo sapiens
taaggataaaacacgtca

SEQ ID NO: 25605 - DNA, 22 bp, Homo sapiens
tatcggccacctgccaatcaca

SEQ ID NO: 25606 - DNA, 16 bp, Homo sapiens
tctctctctcttttct

SEQ ID NO: 25607 - DNA, 21 bp, Homo sapiens
ttctgtttcaacaatcattac

SEQ ID NO: 25608 - DNA, 16 bp, Homo sapiens
ccaaaaaaagatacct

SEQ ID NO: 25609 - DNA, 19 bp, Homo sapiens
taacacccagagcatgata

SEQ ID NO: 25610 - DNA, 18 bp, Homo sapiens
ttccgccctaatggaggt

SEQ ID NO: 25611 - DNA, 21 bp, Homo sapiens
aatcttactaacacctatgat

SEQ ID NO: 25612 - DNA, 18 bp, Homo sapiens
atggaaacaagccactta

SEQ ID NO: 25613 - DNA, 18 bp, Homo sapiens
attttatttatggtccag

SEQ ID NO: 25614 - DNA, 24 bp, Homo sapiens
cagaatgctttgaaattctaatgg

SEQ ID NO: 25615 - DNA, 20 bp, Homo sapiens
cccgacacctcacctttcgc

SEQ ID NO: 25616 - DNA, 17 bp, Homo sapiens
cctcacctttcgctgtt

SEQ ID NO: 25617 - DNA, 21 bp, Homo sapiens
ctctttctctctctctctctc

SEQ ID NO: 25618 - DNA, 18 bp, Homo sapiens
taaggataaaacacgtca

SEQ ID NO: 25619 - DNA, 22 bp, Homo sapiens
tatcggccacctgccaatcaca

SEQ ID NO: 25620 - DNA, 16 bp, Homo sapiens
tctctctctcttttct

SEQ ID NO: 25621 - DNA, 21 bp, Homo sapiens
ctgaaactgaagaatctggta

SEQ ID NO: 25622 - DNA, 19 bp, Homo sapiens
taacacccagagcatgata

SEQ ID NO: 25623 - DNA, 23 bp, Homo sapiens
cttaggcatggagaaaattactt

SEQ ID NO: 25624 - DNA, 19 bp, Homo sapiens
gacattttctggcttgtca

SEQ ID NO: 25625 - DNA, 19 bp, Homo sapiens
ggaggaggggtgaccgcca

SEQ ID NO: 25626 - DNA, 18 bp, Homo sapiens
aaagatcccttgaccctg

SEQ ID NO: 25627 - DNA, 18 bp, Homo sapiens
aagagctaggttaagtca

SEQ ID NO: 25628 - DNA, 18 bp, Homo sapiens
aggaagttgggttgagtt

SEQ ID NO: 25629 - DNA, 23 bp, Homo sapiens
tagggccatgttgggtcaagtta

SEQ ID NO: 25630 - DNA, 22 bp, Homo sapiens
taggtcagtgttgggtttggtt

SEQ ID NO: 25631 - DNA, 17 bp, Homo sapiens
tcaaaaattaagcatgt

SEQ ID NO: 25632 - DNA, 18 bp, Homo sapiens
tgaacaatgcttaacata

SEQ ID NO: 25633 - DNA, 21 bp, Homo sapiens
tcatagaatttcagcgttaga

SEQ ID NO: 25634 - DNA, 22 bp, Homo sapiens
ttcttacatattaaattagcta

SEQ ID NO: 25635 - DNA, 21 bp, Homo sapiens
ttttttgcttgtgttgatctt

SEQ ID NO: 25636 - DNA, 19 bp, Homo sapiens
cattgtcccatgccttgaa

SEQ ID NO: 25637 - DNA, 16 bp, Homo sapiens
ctgactcctctcctct

SEQ ID NO: 25638 - DNA, 20 bp, Homo sapiens
ggctgcagaactttccctct

SEQ ID NO: 25639 - DNA, 24 bp, Homo sapiens
gcccctcggagctccccctgcctc

SEQ ID NO: 25640 - DNA, 23 bp, Homo sapiens
gctccccctgcctcctcctcctc

SEQ ID NO: 25641 - DNA, 20 bp, Homo sapiens
tgccttttagggggctcttg

SEQ ID NO: 25642 - DNA, 20 bp, Homo sapiens
gtcccttcctgggtacccca

SEQ ID NO: 25643 - DNA, 20 bp, Homo sapiens
aatgtctgctctggggggca

SEQ ID NO: 25644 - DNA, 24 bp, Homo sapiens
atacaaggcatctacccagcccca

SEQ ID NO: 25645 - DNA, 23 bp, Homo sapiens
caggaggcagcagggtctggtca

SEQ ID NO: 25646 - DNA, 21 bp, Homo sapiens
catctgtactggaagggaccc

SEQ ID NO: 25647 - DNA, 22 bp, Homo sapiens
ggggaggaagctgttctcccca

SEQ ID NO: 25648 - DNA, 18 bp, Homo sapiens
ctctcaggaccatccgat

SEQ ID NO: 25649 - DNA, 19 bp, Homo sapiens
tgaccgtctcgtcttcctc

SEQ ID NO: 25650 - DNA, 24 bp, Homo sapiens
acagagcaagaccccacaactgta

SEQ ID NO: 25651 - DNA, 18 bp, Homo sapiens
ctcacctcctccgcctct

SEQ ID NO: 25652 - DNA, 19 bp, Homo sapiens
tgaatgagatacaccagga

SEQ ID NO: 25653 - DNA, 20 bp, Homo sapiens
ttcaagaccagcctgaccaa

SEQ ID NO: 25654 - DNA, 17 bp, Homo sapiens
tgtccgctgccgcctca

SEQ ID NO: 25655 - DNA, 24 bp, Homo sapiens
cccttccccctcttctcttgctca

SEQ ID NO: 25656 - DNA, 20 bp, Homo sapiens
cctctgcctcccgggttcaa

SEQ ID NO: 25657 - DNA, 19 bp, Homo sapiens
cgcccattggtgctcatgc

SEQ ID NO: 25658 - DNA, 17 bp, Homo sapiens
gcttctatcttggctgc

SEQ ID NO: 25659 - DNA, 26 bp, Homo sapiens
tctagaattctcccaacattattttt

SEQ ID NO: 25660 - DNA, 20 bp, Homo sapiens
tggccaggctggtcttgaac

SEQ ID NO: 25661 - DNA, 22 bp, Homo sapiens
acatcacatacaaggtttccac

SEQ ID NO: 25662 - DNA, 19 bp, Homo sapiens
atggtgcggcggctggcca

SEQ ID NO: 25663 - DNA, 20 bp, Homo sapiens
atgtttgtatatattcactc

SEQ ID NO: 25664 - DNA, 22 bp, Homo sapiens
ctattaaatgccctgagtgata

SEQ ID NO: 25665 - DNA, 20 bp, Homo sapiens
gcttacagataacagccaaa

SEQ ID NO: 25666 - DNA, 25 bp, Homo sapiens
ggacatgtgtacaggagaccaagaa

SEQ ID NO: 25667 - DNA, 16 bp, Homo sapiens
gtgataaaaccagttg

SEQ ID NO: 25668 - DNA, 21 bp, Homo sapiens
tccctgtggtaaacactctga

SEQ ID NO: 25669 - DNA, 18 bp, Homo sapiens
gaagacgaaaacagcaaa

SEQ ID NO: 25670 - DNA, 21 bp, Homo sapiens
gcttgaaatgctatgaaggca

SEQ ID NO: 25671 - DNA, 22 bp, Homo sapiens
aacagagctgggagcctggctg

SEQ ID NO: 25672 - DNA, 18 bp, Homo sapiens
cacacgctcacattggta

SEQ ID NO: 25673 - DNA, 18 bp, Homo sapiens
gtcctgaagttggattgt

SEQ ID NO: 25674 - DNA, 17 bp, Homo sapiens
tttcccccatcatgaaa

SEQ ID NO: 25675 - DNA, 19 bp, Homo sapiens
actcatcttttaaatatcc

SEQ ID NO: 25676 - DNA, 17 bp, Homo sapiens
agtacaatattgcctgt

SEQ ID NO: 25677 - DNA, 18 bp, Homo sapiens
attagagaccttataaaa

SEQ ID NO: 25678 - DNA, 21 bp, Homo sapiens
cctcctttacaattgatctca

SEQ ID NO: 25679 - DNA, 19 bp, Homo sapiens
ctattagtgccttgatctt

SEQ ID NO: 25680 - DNA, 17 bp, Homo sapiens
gtttcataagttaccca

SEQ ID NO: 25681 - DNA, 23 bp, Homo sapiens
tgaagaagaggacaacaagccca

SEQ ID NO: 25682 - DNA, 22 bp, Homo sapiens
gccgcgggtgatcgtcgggtct

SEQ ID NO: 25683 - DNA, 19 bp, Homo sapiens
gttcccctgttttatctca

SEQ ID NO: 25684 - DNA, 24 bp, Homo sapiens
taagtatacatttttattaattta

SEQ ID NO: 25685 - DNA, 20 bp, Homo sapiens
tcctctactaagcccagtta

SEQ ID NO: 25686 - DNA, 18 bp, Homo sapiens
agtccagtgccatgcctt

SEQ ID NO: 25687 - DNA, 19 bp, Homo sapiens
caggcacaaggttcaagtt

SEQ ID NO: 25688 - DNA, 21 bp, Homo sapiens
aggatcacattgcattgaccc

SEQ ID NO: 25689 - DNA, 18 bp, Homo sapiens
cctcctacagtttctgaa

SEQ ID NO: 25690 - DNA, 16 bp, Homo sapiens
ctcctcctaaatgaca

SEQ ID NO: 25691 - DNA, 18 bp, Homo sapiens
gacccaaagaactgcctg

SEQ ID NO: 25692 - DNA, 22 bp, Homo sapiens
tgaaagagtgaggatcaagacc

SEQ ID NO: 25693 - DNA, 20 bp, Homo sapiens
atgtctaagaagctcccatg

SEQ ID NO: 25694 - DNA, 19 bp, Homo sapiens
ctccaggaaggccatctga

SEQ ID NO: 25695 - DNA, 18 bp, Homo sapiens
gtatgaatgagtgtgaag

SEQ ID NO: 25696 - DNA, 23 bp, Homo sapiens
gtgtatgtgagaacttttgtttg

SEQ ID NO: 25697 - DNA, 21 bp, Homo sapiens
atctgatccatcccttggttt

SEQ ID NO: 25698 - DNA, 25 bp, Homo sapiens
cctctggaccactaacaagttctca

SEQ ID NO: 25699 - DNA, 21 bp, Homo sapiens
aaaaggtgctacggtagtgat

SEQ ID NO: 25700 - DNA, 21 bp, Homo sapiens
agcaagttcactacagcatca

SEQ ID NO: 25701 - DNA, 19 bp, Homo sapiens
ccaattttctttttactcc

SEQ ID NO: 25702 - DNA, 19 bp, Homo sapiens
cctgggtgatcaccacatc

SEQ ID NO: 25703 - DNA, 18 bp, Homo sapiens
gcctcaagttcaatatgg

SEQ ID NO: 25704 - DNA, 22 bp, Homo sapiens
ccctccacacccggggccagac

SEQ ID NO: 25705 - DNA, 19 bp, Homo sapiens
ctctccttccttccacctg

SEQ ID NO: 25706 - DNA, 18 bp, Homo sapiens
gttgggctgcggtgctgc

SEQ ID NO: 25707 - DNA, 18 bp, Homo sapiens
tctagaatctggcacttt

SEQ ID NO: 25708 - DNA, 18 bp, Homo sapiens
tgggtctagaatctggca

SEQ ID NO: 25709 - DNA, 21 bp, Homo sapiens
tgttggtattcagctgtgatg

SEQ ID NO: 25710 - DNA, 21 bp, Homo sapiens
ttctcctgctccttgttttcc

SEQ ID NO: 25711 - DNA, 19 bp, Homo sapiens
aggcagtaggcattcttta

SEQ ID NO: 25712 - DNA, 17 bp, Homo sapiens
gcctttcacagcttctt

SEQ ID NO: 25713 - DNA, 16 bp, Homo sapiens
tgcgtgttgaatccca

SEQ ID NO: 25714 - DNA, 22 bp, Homo sapiens
gagccaagatggcgccactgca

SEQ ID NO: 25715 - DNA, 19 bp, Homo sapiens
ggacttctaagagttttga

SEQ ID NO: 25716 - DNA, 18 bp, Homo sapiens
gtttgtttccttactgta

SEQ ID NO: 25717 - DNA, 22 bp, Homo sapiens
tcaggcctatcctctgctccca

SEQ ID NO: 25718 - DNA, 20 bp, Homo sapiens
tgtagtattttcccatctct

SEQ ID NO: 25719 - DNA, 19 bp, Homo sapiens
aaactcctgacctcaggtg

SEQ ID NO: 25720 - DNA, 20 bp, Homo sapiens
actgtaacattccaacatct

SEQ ID NO: 25721 - DNA, 15 bp, Homo sapiens
agaacccatttctca

SEQ ID NO: 25722 - DNA, 26 bp, Homo sapiens
agtccatccttcaaatgaccactcca

SEQ ID NO: 25723 - DNA, 20 bp, Homo sapiens
gtggttttagacacgctttc

SEQ ID NO: 25724 - DNA, 20 bp, Homo sapiens
taagattctttgatcccgac

SEQ ID NO: 25725 - DNA, 22 bp, Homo sapiens
tgaaccatcgctgaggttctga

SEQ ID NO: 25726 - DNA, 22 bp, Homo sapiens
tgagactacaggcacctgccac

SEQ ID NO: 25727 - DNA, 20 bp, Homo sapiens
cagcattaacacctcatctc

SEQ ID NO: 25728 - DNA, 18 bp, Homo sapiens
ctgtggcaccccagctca

SEQ ID NO: 25729 - DNA, 19 bp, Homo sapiens
cttacccacttcttcctca

SEQ ID NO: 25730 - DNA, 26 bp, Homo sapiens
acagacgttgcaccatatccatgcac

SEQ ID NO: 25731 - DNA, 16 bp, Homo sapiens
aggtttcaaagtctca

SEQ ID NO: 25732 - DNA, 19 bp, Homo sapiens
ccttgtccagtggagccca

SEQ ID NO: 25733 - DNA, 18 bp, Homo sapiens
cttgttctggtcactgtt

SEQ ID NO: 25734 - DNA, 18 bp, Homo sapiens
taacagcatgtaacataa

SEQ ID NO: 25735 - DNA, 22 bp, Homo sapiens
aggcacagattccccgtccaca

SEQ ID NO: 25736 - DNA, 20 bp, Homo sapiens
ctctgtcccccaaggagtca

SEQ ID NO: 25737 - DNA, 19 bp, Homo sapiens
ctgtagagtccattcccct

SEQ ID NO: 25738 - DNA, 19 bp, Homo sapiens
tttgaccaggtcctgtgag

SEQ ID NO: 25739 - DNA, 21 bp, Homo sapiens
ctggaccgtctttgtctgcga

SEQ ID NO: 25740 - DNA, 20 bp, Homo sapiens
gccgtcccccgactgcctca

SEQ ID NO: 25741 - DNA, 21 bp, Homo sapiens
aacatgtatgacaggggacca

SEQ ID NO: 25742 - DNA, 20 bp, Homo sapiens
aagggaggcccaaattctca

SEQ ID NO: 25743 - DNA, 19 bp, Homo sapiens
accctctggggtgaggcta

SEQ ID NO: 25744 - DNA, 19 bp, Homo sapiens
ctgagttgctgtttggtct

SEQ ID NO: 25745 - DNA, 20 bp, Homo sapiens
taaaaccagcctgtgatgtt

SEQ ID NO: 25746 - DNA, 22 bp, Homo sapiens
tgcccagagccccagtgtgctt

SEQ ID NO: 25747 - DNA, 15 bp, Homo sapiens
ttctaagctgtgaac

SEQ ID NO: 25748 - DNA, 16 bp, Homo sapiens
ttgccaaacaatatca

SEQ ID NO: 25749 - DNA, 19 bp, Homo sapiens
ttttctgagcagatcaata

SEQ ID NO: 25750 - DNA, 16 bp, Homo sapiens
cccgcacgcctcctca

SEQ ID NO: 25751 - DNA, 20 bp, Homo sapiens
cttgtgaatctgagctgtag

SEQ ID NO: 25752 - DNA, 19 bp, Homo sapiens
ctttttaaacacataatgt

SEQ ID NO: 25753 - DNA, 22 bp, Homo sapiens
tccttttgccagctaattgtga

SEQ ID NO: 25754 - DNA, 22 bp, Homo sapiens
cttgagtttttgggtttctttt

SEQ ID NO: 25755 - DNA, 22 bp, Homo sapiens
gtgatctgcccttctctgcctc

SEQ ID NO: 25756 - DNA, 17 bp, Homo sapiens
tcaagtgattctcctgc

SEQ ID NO: 25757 - DNA, 17 bp, Homo sapiens
ttcacctccaggttcaa

SEQ ID NO: 25758 - DNA, 18 bp, Homo sapiens
ttctcctgcctcagcctt

SEQ ID NO: 25759 - DNA, 18 bp, Homo sapiens
ccagttgcacctttctca

SEQ ID NO: 25760 - DNA, 22 bp, Homo sapiens
agcccagtgtgggcagatgcca

SEQ ID NO: 25761 - DNA, 25 bp, Homo sapiens
gataccagcatctggagcccctagg

SEQ ID NO: 25762 - DNA, 19 bp, Homo sapiens
tgaagagactggacaaagt

SEQ ID NO: 25763 - DNA, 20 bp, Homo sapiens
aaagttcatgaatctggtaa

SEQ ID NO: 25764 - DNA, 18 bp, Homo sapiens
attaaacatcaaagttat

SEQ ID NO: 25765 - DNA, 21 bp, Homo sapiens
tggtgctccagtgtagggcta

SEQ ID NO: 25766 - DNA, 17 bp, Homo sapiens
cacggtgaacatggcca

SEQ ID NO: 25767 - DNA, 25 bp, Homo sapiens
gtttgggctgttccacgcttggctc

SEQ ID NO: 25768 - DNA, 19 bp, Homo sapiens
agagaacattcctctgcag

SEQ ID NO: 25769 - DNA, 18 bp, Homo sapiens
gattgttctgtccagttt

SEQ ID NO: 25770 - DNA, 21 bp, Homo sapiens
ttagctacttttcagaattga

SEQ ID NO: 25771 - DNA, 22 bp, Homo sapiens
agctcagctgttgaggacaccc

SEQ ID NO: 25772 - DNA, 22 bp, Homo sapiens
agtgaccccaatcctataccca

SEQ ID NO: 25773 - DNA, 20 bp, Homo sapiens
caggggcagaaaacactaca

SEQ ID NO: 25774 - DNA, 22 bp, Homo sapiens
ccccactccaactccttctcca

SEQ ID NO: 25775 - DNA, 19 bp, Homo sapiens
ggaagccagaagcatccca

SEQ ID NO: 25776 - DNA, 17 bp, Homo sapiens
tccttctccaccaccca

SEQ ID NO: 25777 - DNA, 23 bp, Homo sapiens
ccttcccctggcatcacttccca

SEQ ID NO: 25778 - DNA, 17 bp, Homo sapiens
ggggcctggccacccct

SEQ ID NO: 25779 - DNA, 22 bp, Homo sapiens
acctgggccctgcccttggctc

SEQ ID NO: 25780 - DNA, 22 bp, Homo sapiens
agctcagctgttgaggacaccc

SEQ ID NO: 25781 - DNA, 22 bp, Homo sapiens
agtgaccccaatcctataccca

SEQ ID NO: 25782 - DNA, 20 bp, Homo sapiens
caggggcagaaaacactaca

SEQ ID NO: 25783 - DNA, 22 bp, Homo sapiens
ccaaaaacaaaatggagtctga

SEQ ID NO: 25784 - DNA, 22 bp, Homo sapiens
ccccactccaactccttctcca

SEQ ID NO: 25785 - DNA, 19 bp, Homo sapiens
ggaagccagaagcatccca

SEQ ID NO: 25786 - DNA, 17 bp, Homo sapiens
tccttctccaccaccca

SEQ ID NO: 25787 - DNA, 19 bp, Homo sapiens
ctgaagcctcagtccttca

SEQ ID NO: 25788 - DNA, 18 bp, Homo sapiens
ccgcggaatatcggctta

SEQ ID NO: 25789 - DNA, 18 bp, Homo sapiens
ccgcggaatatcggctta

SEQ ID NO: 25790 - DNA, 19 bp, Homo sapiens
ctgaagcctcagtccttca

SEQ ID NO: 25791 - DNA, 18 bp, Homo sapiens
gctccgccgcccgcctct

SEQ ID NO: 25792 - DNA, 23 bp, Homo sapiens
taagattacgttattgggtttgg

SEQ ID NO: 25793 - DNA, 22 bp, Homo sapiens
tggagtatttggcctgaaattg

SEQ ID NO: 25794 - DNA, 20 bp, Homo sapiens
gagactaccacaaacactac

SEQ ID NO: 25795 - DNA, 19 bp, Homo sapiens
agagtcatcagcaaactgt

SEQ ID NO: 25796 - DNA, 20 bp, Homo sapiens
gagactaccacaaacactac

SEQ ID NO: 25797 - DNA, 20 bp, Homo sapiens
tcaccctcttcagtcacctc

SEQ ID NO: 25798 - DNA, 21 bp, Homo sapiens
tctacattttctctgcacttt

SEQ ID NO: 25799 - DNA, 21 bp, Homo sapiens
cctcccccagccccctcccca

SEQ ID NO: 25800 - DNA, 20 bp, Homo sapiens
ctccccatcaataaaactct

SEQ ID NO: 25801 - DNA, 21 bp, Homo sapiens
gcagttttggtttcttttgcg

SEQ ID NO: 25802 - DNA, 15 bp, Homo sapiens
ctgtctttctttcct

SEQ ID NO: 25803 - DNA, 18 bp, Homo sapiens
tgtaaaagcaaaagccac

SEQ ID NO: 25804 - DNA, 18 bp, Homo sapiens
cctgcaacctccacctcc

SEQ ID NO: 25805 - DNA, 18 bp, Homo sapiens
tccacctcccgggttcaa

SEQ ID NO: 25806 - DNA, 17 bp, Homo sapiens
cccacatatgcctgtta

SEQ ID NO: 25807 - DNA, 21 bp, Homo sapiens
gtatctctaaatacaggatta

SEQ ID NO: 25808 - DNA, 23 bp, Homo sapiens
taagagaaaaataggctcagtta

SEQ ID NO: 25809 - DNA, 24 bp, Homo sapiens
tcatgctggtgatggctcccctgg

SEQ ID NO: 25810 - DNA, 23 bp, Homo sapiens
tccagatttttttctcctcaccc

SEQ ID NO: 25811 - DNA, 22 bp, Homo sapiens
tgcaccgggtacacttaacgtg

SEQ ID NO: 25812 - DNA, 21 bp, Homo sapiens
gcctggtataacctctggctc

SEQ ID NO: 25813 - DNA, 22 bp, Homo sapiens
acacagtgctacacagctttta

SEQ ID NO: 25814 - DNA, 18 bp, Homo sapiens
tagtgttaattctacaca

SEQ ID NO: 25815 - DNA, 21 bp, Homo sapiens
tgttgaatcttttcatgtgcc

SEQ ID NO: 25816 - DNA, 18 bp, Homo sapiens
ccagagcctggtcctgca

SEQ ID NO: 25817 - DNA, 19 bp, Homo sapiens
gttttggttagtgccacaa

SEQ ID NO: 25818 - DNA, 23 bp, Homo sapiens
ttctaagttaaatgtagtttgta

SEQ ID NO: 25819 - DNA, 21 bp, Homo sapiens
caccaccatctctctcctctt

SEQ ID NO: 25820 - DNA, 19 bp, Homo sapiens
gcatcagacctgttccaca

SEQ ID NO: 25821 - DNA, 24 bp, Homo sapiens
gtagaggccaggctgaaatgtcat

SEQ ID NO: 25822 - DNA, 18 bp, Homo sapiens
tgatgctgagcgtgaaca

SEQ ID NO: 25823 - DNA, 22 bp, Homo sapiens
ggaacctgctgcgtaaaaccat

SEQ ID NO: 25824 - DNA, 19 bp, Homo sapiens
cagaacatagtgtgcttca

SEQ ID NO: 25825 - DNA, 18 bp, Homo sapiens
cttaaagtcaatctgcga

SEQ ID NO: 25826 - DNA, 18 bp, Homo sapiens
gagagccattctatgtca

SEQ ID NO: 25827 - DNA, 21 bp, Homo sapiens
ggcggctcgcccgcctccgga

SEQ ID NO: 25828 - DNA, 19 bp, Homo sapiens
tagtgtgcttcaaaacatt

SEQ ID NO: 25829 - DNA, 19 bp, Homo sapiens
tcagaggcttctgctcgca

SEQ ID NO: 25830 - DNA, 23 bp, Homo sapiens
ttatccacaaaacagtcaatgtt

SEQ ID NO: 25831 - DNA, 25 bp, Homo sapiens
taggtatcaagtcaacatgaaattg

SEQ ID NO: 25832 - DNA, 17 bp, Homo sapiens
agcagtccgaccaagcc

SEQ ID NO: 25833 - DNA, 22 bp, Homo sapiens
caaagcagcagtccgaccaagc

SEQ ID NO: 25834 - DNA, 20 bp, Homo sapiens
gtatgagtatggcttggtta

SEQ ID NO: 25835 - DNA, 21 bp, Homo sapiens
tctttactagttattgtgaga

SEQ ID NO: 25836 - DNA, 19 bp, Homo sapiens
ttacagaagaaccagtgga

SEQ ID NO: 25837 - DNA, 19 bp, Homo sapiens
ttctcacctctcccttacc

SEQ ID NO: 25838 - DNA, 17 bp, Homo sapiens
gtgtgaaatttttggaa

SEQ ID NO: 25839 - DNA, 21 bp, Homo sapiens
tgccttttaaagttttgctga

SEQ ID NO: 25840 - DNA, 18 bp, Homo sapiens
gtgatgacaatatgacta

SEQ ID NO: 25841 - DNA, 21 bp, Homo sapiens
atcttggctcactgcagtctc

SEQ ID NO: 25842 - DNA, 20 bp, Homo sapiens
atgaagttgctagttaacac

SEQ ID NO: 25843 - DNA, 19 bp, Homo sapiens
atggtcatatatacttgtt

SEQ ID NO: 25844 - DNA, 21 bp, Homo sapiens
cattttctcttggggtattca

SEQ ID NO: 25845 - DNA, 17 bp, Homo sapiens
ctctccccggctatctg

SEQ ID NO: 25846 - DNA, 18 bp, Homo sapiens
ctgattggtgttgctgta

SEQ ID NO: 25847 - DNA, 20 bp, Homo sapiens
cttccaggtgttttccagtg

SEQ ID NO: 25848 - DNA, 21 bp, Homo sapiens
gtgtatgggtgattatttgat

SEQ ID NO: 25849 - DNA, 16 bp, Homo sapiens
tataacctcaccatcc

SEQ ID NO: 25850 - DNA, 21 bp, Homo sapiens
tcctgaactcctgggctcaag

SEQ ID NO: 25851 - DNA, 19 bp, Homo sapiens
tgagacgttaggggcatat

SEQ ID NO: 25852 - DNA, 16 bp, Homo sapiens
tgtttgtctttggtgt

SEQ ID NO: 25853 - DNA, 16 bp, Homo sapiens
ccagccgtcctttgaa

SEQ ID NO: 25854 - DNA, 22 bp, Homo sapiens
aaacccagcgcactttcacctc

SEQ ID NO: 25855 - DNA, 16 bp, Homo sapiens
aactgggatttcagat

SEQ ID NO: 25856 - DNA, 22 bp, Homo sapiens
cttcttcccttcctcctcagcc

SEQ ID NO: 25857 - DNA, 18 bp, Homo sapiens
ggcagggcaggggctcca

SEQ ID NO: 25858 - DNA, 20 bp, Homo sapiens
tgcccttgaacactcttaca

SEQ ID NO: 25859 - DNA, 20 bp, Homo sapiens
cctctgcctcctgggttcaa

SEQ ID NO: 25860 - DNA, 23 bp, Homo sapiens
ctccacatctgtgggatatctca

SEQ ID NO: 25861 - DNA, 18 bp, Homo sapiens
ttctcctgcttcagcctt

SEQ ID NO: 25862 - DNA, 22 bp, Homo sapiens
cacaattgtctctcacagtgta

SEQ ID NO: 25863 - DNA, 21 bp, Homo sapiens
ccctccccagcttcctgccca

SEQ ID NO: 25864 - DNA, 19 bp, Homo sapiens
aaactcctgacctcaggtg

SEQ ID NO: 25865 - DNA, 21 bp, Homo sapiens
caccacgcccagccttccctt

SEQ ID NO: 25866 - DNA, 18 bp, Homo sapiens
cctgcaacctccacctcc

SEQ ID NO: 25867 - DNA, 22 bp, Homo sapiens
ctgggattacaggcacctgtca

SEQ ID NO: 25868 - DNA, 19 bp, Homo sapiens
gactgtgcctgttattgtt

SEQ ID NO: 25869 - DNA, 18 bp, Homo sapiens
gccttaacagtggagttg

SEQ ID NO: 25870 - DNA, 18 bp, Homo sapiens
tgggtggatcacctgagg

SEQ ID NO: 25871 - DNA, 24 bp, Homo sapiens
ttctctacgtataaaaaaatacaa

SEQ ID NO: 25872 - DNA, 26 bp, Homo sapiens
ctcgaaaagttgtgatttagaagaca

SEQ ID NO: 25873 - DNA, 17 bp, Homo sapiens
ctttcagtactgtacta

SEQ ID NO: 25874 - DNA, 20 bp, Homo sapiens
gttctacttttggccaagga

SEQ ID NO: 25875 - DNA, 23 bp, Homo sapiens
tcacacagggttaagttcagtaa

SEQ ID NO: 25876 - DNA, 20 bp, Homo sapiens
tgggtgaccgagtgagactg

SEQ ID NO: 25877 - DNA, 22 bp, Homo sapiens
ttaaaaatgaaacaagtgtggt

SEQ ID NO: 25878 - DNA, 18 bp, Homo sapiens
ccctgtaaatacatgata

SEQ ID NO: 25879 - DNA, 21 bp, Homo sapiens
ctgaactctgaccctccgggc

SEQ ID NO: 25880 - DNA, 17 bp, Homo sapiens
gtctagttttcacttga

SEQ ID NO: 25881 - DNA, 22 bp, Homo sapiens
tggctttaactctcagctcctt

SEQ ID NO: 25882 - DNA, 19 bp, Homo sapiens
tggcttttaatatgaactg

SEQ ID NO: 25883 - DNA, 21 bp, Homo sapiens
atctttggtcccagcattttc

SEQ ID NO: 25884 - DNA, 23 bp, Homo sapiens
catcccagagcctcccaaggctg

SEQ ID NO: 25885 - DNA, 21 bp, Homo sapiens
ccctgaactattcctcagtga

SEQ ID NO: 25886 - DNA, 24 bp, Homo sapiens
gaactggctttgaccatgaaactg

SEQ ID NO: 25887 - DNA, 22 bp, Homo sapiens
tggttaatcctgcatgggatta

SEQ ID NO: 25888 - DNA, 17 bp, Homo sapiens
ttctttacctcttagcc

SEQ ID NO: 25889 - DNA, 18 bp, Homo sapiens
catgccctgcttcagctg

SEQ ID NO: 25890 - DNA, 21 bp, Homo sapiens
tattatttttttataaagaga

SEQ ID NO: 25891 - DNA, 18 bp, Homo sapiens
tccatctcccaggttcaa

SEQ ID NO: 25892 - DNA, 18 bp, Homo sapiens
tctgcccacctctgcctc

SEQ ID NO: 25893 - DNA, 20 bp, Homo sapiens
tctccaggctgtcttgcctt

SEQ ID NO: 25894 - DNA, 15 bp, Homo sapiens
aacttctctgctcct

SEQ ID NO: 25895 - DNA, 17 bp, Homo sapiens
aataaatgcaatttcct

SEQ ID NO: 25896 - DNA, 19 bp, Homo sapiens
agataatcaaattgtccta

SEQ ID NO: 25897 - DNA, 22 bp, Homo sapiens
atctacaatgtatatctgacaa

SEQ ID NO: 25898 - DNA, 16 bp, Homo sapiens
gacactttatctgcaa

SEQ ID NO: 25899 - DNA, 20 bp, Homo sapiens
ggaataattgcagtatgtgt

SEQ ID NO: 25900 - DNA, 18 bp, Homo sapiens
agaagaagcacctccaca

SEQ ID NO: 25901 - DNA, 19 bp, Homo sapiens
catcttaatgtcccaaggc

SEQ ID NO: 25902 - DNA, 19 bp, Homo sapiens
cctatggtcacttctgata

SEQ ID NO: 25903 - DNA, 17 bp, Homo sapiens
agagatgacacagaccc

SEQ ID NO: 25904 - DNA, 20 bp, Homo sapiens
ctgtactgccatcctattgc

SEQ ID NO: 25905 - DNA, 16 bp, Homo sapiens
gccgccacatttcctt

SEQ ID NO: 25906 - DNA, 20 bp, Homo sapiens
ttgcctgatcctcctagtgc

SEQ ID NO: 25907 - DNA, 24 bp, Homo sapiens
cctctttgttgcgttttgtgcttt

SEQ ID NO: 25908 - DNA, 22 bp, Homo sapiens
tgaggtacccttagatcctttt

SEQ ID NO: 25909 - DNA, 22 bp, Homo sapiens
atctacacatatttatatcaca

SEQ ID NO: 25910 - DNA, 22 bp, Homo sapiens
cctttttgcggccttatatttt

SEQ ID NO: 25911 - DNA, 23 bp, Homo sapiens
ctgtcttctcagcagttgatcca

SEQ ID NO: 25912 - DNA, 23 bp, Homo sapiens
acacggcattccgtgtgtgacca

SEQ ID NO: 25913 - DNA, 21 bp, Homo sapiens
ctggtgcccacgcccttgcca

SEQ ID NO: 25914 - DNA, 18 bp, Homo sapiens
tgctcccagccttcactg

SEQ ID NO: 25915 - DNA, 21 bp, Homo sapiens
aaatccattaaagaacaggaa

SEQ ID NO: 25916 - DNA, 19 bp, Homo sapiens
caggggccagaatatctca

SEQ ID NO: 25917 - DNA, 18 bp, Homo sapiens
ctttcttctttctgtgat

SEQ ID NO: 25918 - DNA, 20 bp, Homo sapiens
gcctattcaaaattatctct

SEQ ID NO: 25919 - DNA, 23 bp, Homo sapiens
tcagcacatcagtcatatgccca

SEQ ID NO: 25920 - DNA, 17 bp, Homo sapiens
tcctaaaattcctgtcc

SEQ ID NO: 25921 - DNA, 24 bp, Homo sapiens
tgggcaaaacctgtacaatgacaa

SEQ ID NO: 25922 - DNA, 23 bp, Homo sapiens
ccaccattctcactacaggcccc

SEQ ID NO: 25923 - DNA, 20 bp, Homo sapiens
gaggcagaagaaccccttga

SEQ ID NO: 25924 - DNA, 22 bp, Homo sapiens
gtcactgcgcccacctgtcaca

SEQ ID NO: 25925 - DNA, 19 bp, Homo sapiens
tttcttctatactgcctta

SEQ ID NO: 25926 - DNA, 19 bp, Homo sapiens
aggactgacaccctaatgc

SEQ ID NO: 25927 - DNA, 23 bp, Homo sapiens
aggagtataggacagaggaccaa

SEQ ID NO: 25928 - DNA, 21 bp, Homo sapiens
agtcatccctgaatcttgcca

SEQ ID NO: 25929 - DNA, 23 bp, Homo sapiens
ccagtcatccctgaatcttgcca

SEQ ID NO: 25930 - DNA, 20 bp, Homo sapiens
gtcatccctgaatcttgcca

SEQ ID NO: 25931 - DNA, 17 bp, Homo sapiens
acggtgttagaactctc

SEQ ID NO: 25932 - DNA, 24 bp, Homo sapiens
cctgtcttgaagaccctgacctca

SEQ ID NO: 25933 - DNA, 20 bp, Homo sapiens
ctcctgcccctttgtttttt

SEQ ID NO: 25934 - DNA, 24 bp, Homo sapiens
gccacgttgaagtaaaaacaaaca

SEQ ID NO: 25935 - DNA, 24 bp, Homo sapiens
gctttttggttgctgttgagtttt

SEQ ID NO: 25936 - DNA, 21 bp, Homo sapiens
tcatatagtgggatcatgcaa

SEQ ID NO: 25937 - DNA, 20 bp, Homo sapiens
tgaacatcaaagtgaaactg

SEQ ID NO: 25938 - DNA, 18 bp, Homo sapiens
aaggggcctgaggcctca

SEQ ID NO: 25939 - DNA, 18 bp, Homo sapiens
ctcccttcaaggatctca

SEQ ID NO: 25940 - DNA, 20 bp, Homo sapiens
taggaagctcctgggcttag

SEQ ID NO: 25941 - DNA, 21 bp, Homo sapiens
ccattaaccaggccccaccca

SEQ ID NO: 25942 - DNA, 18 bp, Homo sapiens
cccacaaggtagaaacaa

SEQ ID NO: 25943 - DNA, 17 bp, Homo sapiens
gcctcctgggcacccca

SEQ ID NO: 25944 - DNA, 24 bp, Homo sapiens
tgcaacctccatctcctggattca

SEQ ID NO: 25945 - DNA, 22 bp, Homo sapiens
acctcccccgcccgcctggcct

SEQ ID NO: 25946 - DNA, 20 bp, Homo sapiens
gggccagaccgcctccacct

SEQ ID NO: 25947 - DNA, 16 bp, Homo sapiens
tgtggcatctgatatt

SEQ ID NO: 25948 - DNA, 21 bp, Homo sapiens
ttccgcctgcgacagttccag

SEQ ID NO: 25949 - DNA, 26 bp, Homo sapiens
ccctggtgtctggaggggggttgtgg

SEQ ID NO: 25950 - DNA, 24 bp, Homo sapiens
gcagcaggcttaggatttttgtca

SEQ ID NO: 25951 - DNA, 20 bp, Homo sapiens
gcccctcttcccctacccct

SEQ ID NO: 25952 - DNA, 16 bp, Homo sapiens
gggcaaccctctgggc

SEQ ID NO: 25953 - DNA, 17 bp, Homo sapiens
gtgggcacagctcccca

SEQ ID NO: 25954 - DNA, 21 bp, Homo sapiens
tctgggcaaaatgtttggttt

SEQ ID NO: 25955 - DNA, 21 bp, Homo sapiens
ggtgggtgggagggggcaagt

SEQ ID NO: 25956 - DNA, 19 bp, Homo sapiens
aagcaattctcccacctca

SEQ ID NO: 25957 - DNA, 22 bp, Homo sapiens
atcttggctcactgcagcctct

SEQ ID NO: 25958 - DNA, 20 bp, Homo sapiens
cctctgcctcccaggttcaa

SEQ ID NO: 25959 - DNA, 26 bp, Homo sapiens
aaacgcttctgcaaacatttgttttt

SEQ ID NO: 25960 - DNA, 17 bp, Homo sapiens
caggctccctgctcctc

SEQ ID NO: 25961 - DNA, 19 bp, Homo sapiens
aagaaccaaaagccattga

SEQ ID NO: 25962 - DNA, 15 bp, Homo sapiens
agcacttattctgaa

SEQ ID NO: 25963 - DNA, 17 bp, Homo sapiens
agctttcttaaagaatc

SEQ ID NO: 25964 - DNA, 20 bp, Homo sapiens
agtaatgtattttgatctca

SEQ ID NO: 25965 - DNA, 19 bp, Homo sapiens
cctaggttacaagatccta

SEQ ID NO: 25966 - DNA, 17 bp, Homo sapiens
gcacttcaaatgcttca

SEQ ID NO: 25967 - DNA, 18 bp, Homo sapiens
tcctctgtcagcacttca

SEQ ID NO: 25968 - DNA, 18 bp, Homo sapiens
tgatctcagatttctttt

SEQ ID NO: 25969 - DNA, 20 bp, Homo sapiens
ttcttaaagaagatatagta

SEQ ID NO: 25970 - DNA, 22 bp, Homo sapiens
tttggggaaaatcttctggtgt

SEQ ID NO: 25971 - DNA, 20 bp, Homo sapiens
aggcgcccgtcaccacacca

SEQ ID NO: 25972 - DNA, 21 bp, Homo sapiens
agtatgaattctgtgcagcta

SEQ ID NO: 25973 - DNA, 23 bp, Homo sapiens
agtccccaggccagtgcttggca

SEQ ID NO: 25974 - DNA, 21 bp, Homo sapiens
cacgagggcaggacacagctt

SEQ ID NO: 25975 - DNA, 18 bp, Homo sapiens
ccacccctccccgcattg

SEQ ID NO: 25976 - DNA, 19 bp, Homo sapiens
ctgcaagctccgcctccca

SEQ ID NO: 25977 - DNA, 16 bp, Homo sapiens
tgccattctcctgtct

SEQ ID NO: 25978 - DNA, 21 bp, Homo sapiens
tggtcctgtgtacctgcggac

SEQ ID NO: 25979 - DNA, 19 bp, Homo sapiens
gctgtcctttaacaccgca

SEQ ID NO: 25980 - DNA, 18 bp, Homo sapiens
ataataggaacggcgaca

SEQ ID NO: 25981 - DNA, 25 bp, Homo sapiens
cactgtacttaataggaagcttcca

SEQ ID NO: 25982 - DNA, 19 bp, Homo sapiens
ccctccccatcctctttcc

SEQ ID NO: 25983 - DNA, 21 bp, Homo sapiens
acacagagccaaaccatatca

SEQ ID NO: 25984 - DNA, 23 bp, Homo sapiens
tgatgtgctttgatgtgagtctg

SEQ ID NO: 25985 - DNA, 19 bp, Homo sapiens
tttcacttgcttggtgcac

SEQ ID NO: 25986 - DNA, 25 bp, Homo sapiens
actttgaccgtgggctgtctggccc

SEQ ID NO: 25987 - DNA, 18 bp, Homo sapiens
agatcctgtacaacctca

SEQ ID NO: 25988 - DNA, 21 bp, Homo sapiens
caactttcttatcaggctcaa

SEQ ID NO: 25989 - DNA, 21 bp, Homo sapiens
ctagtagatctgtacctacta

SEQ ID NO: 25990 - DNA, 18 bp, Homo sapiens
tctgaagctacgtggcca

SEQ ID NO: 25991 - DNA, 18 bp, Homo sapiens
aacaggcccagctcctgc

SEQ ID NO: 25992 - DNA, 21 bp, Homo sapiens
acaggcctagctcctccctca

SEQ ID NO: 25993 - DNA, 17 bp, Homo sapiens
agctcctgccttttggt

SEQ ID NO: 25994 - DNA, 18 bp, Homo sapiens
cctgcctgacaatggcct

SEQ ID NO: 25995 - DNA, 20 bp, Homo sapiens
tacgcccatctcctacctca

SEQ ID NO: 25996 - DNA, 23 bp, Homo sapiens
tctgaagacccaaatcgtcctcc

SEQ ID NO: 25997 - DNA, 21 bp, Homo sapiens
ttaggccccgctcattcctta

SEQ ID NO: 25998 - DNA, 21 bp, Homo sapiens
ttcacagtggcctcactacgc

SEQ ID NO: 25999 - DNA, 17 bp, Homo sapiens
ctgcccttcacctttgg

SEQ ID NO: 26000 - DNA, 20 bp, Homo sapiens
tcaggtagagaagccgtgca

SEQ ID NO: 26001 - DNA, 19 bp, Homo sapiens
tgagcaagggaactcctca

SEQ ID NO: 26002 - DNA, 19 bp, Homo sapiens
taagggaagctaggaagtc

SEQ ID NO: 26003 - DNA, 21 bp, Homo sapiens
tggaagtcagacatgaaactg

SEQ ID NO: 26004 - DNA, 20 bp, Homo sapiens
ccacagacacaactggccac

SEQ ID NO: 26005 - DNA, 20 bp, Homo sapiens
gccaccgaggcaccgacagg

SEQ ID NO: 26006 - DNA, 19 bp, Homo sapiens
atttatgggttcttttcca

SEQ ID NO: 26007 - DNA, 18 bp, Homo sapiens
accagatatctctgggta

SEQ ID NO: 26008 - DNA, 20 bp, Homo sapiens
ccaaagttattttaatctat

SEQ ID NO: 26009 - DNA, 20 bp, Homo sapiens
tcagcattatcatgatatca

SEQ ID NO: 26010 - DNA, 25 bp, Homo sapiens
tctttttgttgttgtcattgatttt

SEQ ID NO: 26011 - DNA, 20 bp, Homo sapiens
ttccagtgatcatcctctaa

SEQ ID NO: 26012 - DNA, 23 bp, Homo sapiens
atttggacccaggttgcctgctc

SEQ ID NO: 26013 - DNA, 22 bp, Homo sapiens
ctattcacagcacctcctgctt

SEQ ID NO: 26014 - DNA, 20 bp, Homo sapiens
gacgactccaccgcctctct

SEQ ID NO: 26015 - DNA, 18 bp, Homo sapiens
tatcttgacttcattgcc

SEQ ID NO: 26016 - DNA, 22 bp, Homo sapiens
cagagcgcgtgtttctggtcgc

SEQ ID NO: 26017 - DNA, 22 bp, Homo sapiens
agaagcgtccgtgggaactcca

SEQ ID NO: 26018 - DNA, 23 bp, Homo sapiens
agcccgtggcctggcctgctaca

SEQ ID NO: 26019 - DNA, 23 bp, Homo sapiens
agcctccctctactcggcactgt

SEQ ID NO: 26020 - DNA, 19 bp, Homo sapiens
cagccttccacctgtgcta

SEQ ID NO: 26021 - DNA, 22 bp, Homo sapiens
cccgccttttcagccgtcacca

SEQ ID NO: 26022 - DNA, 17 bp, Homo sapiens
cccggcagagcacccgc

SEQ ID NO: 26023 - DNA, 17 bp, Homo sapiens
ctcagaggagctgcaag

SEQ ID NO: 26024 - DNA, 20 bp, Homo sapiens
ctctgaggagaggcctgggg

SEQ ID NO: 26025 - DNA, 21 bp, Homo sapiens
ctggagagggggccaggcaca

SEQ ID NO: 26026 - DNA, 20 bp, Homo sapiens
gacccgccttttcagccgtc

SEQ ID NO: 26027 - DNA, 19 bp, Homo sapiens
gcacctacaagcagcactg

SEQ ID NO: 26028 - DNA, 22 bp, Homo sapiens
gccacctccgccagccgcctcc

SEQ ID NO: 26029 - DNA, 27 bp, Homo sapiens
gggataccagcacggaggagcccccgg

SEQ ID NO: 26030 - DNA, 20 bp, Homo sapiens
tgagtgggggggcatggggc

SEQ ID NO: 26031 - DNA, 19 bp, Homo sapiens
ccctattattaactgtgca

SEQ ID NO: 26032 - DNA, 22 bp, Homo sapiens
ttcctggtgcttgtgttccatg

SEQ ID NO: 26033 - DNA, 20 bp, Homo sapiens
cagctccattataatcatct

SEQ ID NO: 26034 - DNA, 18 bp, Homo sapiens
catgagtaatgtgttaca

SEQ ID NO: 26035 - DNA, 20 bp, Homo sapiens
catgtaacaatcccattgga

SEQ ID NO: 26036 - DNA, 21 bp, Homo sapiens
gagccaagatcgcccactgca

SEQ ID NO: 26037 - DNA, 24 bp, Homo sapiens
gcctgtgggtgggccgcttggctc

SEQ ID NO: 26038 - DNA, 18 bp, Homo sapiens
ttctctactaaaatacaa

SEQ ID NO: 26039 - DNA, 20 bp, Homo sapiens
acaaccacgcagacagtcac

SEQ ID NO: 26040 - DNA, 20 bp, Homo sapiens
ccacgcagacagtcacacca

SEQ ID NO: 26041 - DNA, 16 bp, Homo sapiens
ctagcttgttcttgat

SEQ ID NO: 26042 - DNA, 21 bp, Homo sapiens
agctgagcaactggagcctcg

SEQ ID NO: 26043 - DNA, 18 bp, Homo sapiens
aacccagctcctcacttc

SEQ ID NO: 26044 - DNA, 19 bp, Homo sapiens
aagggcccatgctgcagcc

SEQ ID NO: 26045 - DNA, 21 bp, Homo sapiens
atacattaaacttttattctt

SEQ ID NO: 26046 - DNA, 22 bp, Homo sapiens
catcacctttgcccgtgtttta

SEQ ID NO: 26047 - DNA, 24 bp, Homo sapiens
taaaaaatgacagtttgtgtttaa

SEQ ID NO: 26048 - DNA, 20 bp, Homo sapiens
acatcacaataatctgggac

SEQ ID NO: 26049 - DNA, 19 bp, Homo sapiens
ccaggcttgtgccctttca

SEQ ID NO: 26050 - DNA, 22 bp, Homo sapiens
cttcacttcccgagggcgggtg

SEQ ID NO: 26051 - DNA, 24 bp, Homo sapiens
tcagaggaagtaaatgttcactta

SEQ ID NO: 26052 - DNA, 21 bp, Homo sapiens
tggagagatgtagtgatttaa

SEQ ID NO: 26053 - DNA, 20 bp, Homo sapiens
tggccccctggcattcctga

SEQ ID NO: 26054 - DNA, 21 bp, Homo sapiens
acaaaccaatatctgcacttg

SEQ ID NO: 26055 - DNA, 18 bp, Homo sapiens
gaattatccagcatatga

SEQ ID NO: 26056 - DNA, 21 bp, Homo sapiens
gtaaattgtactctcattcca

SEQ ID NO: 26057 - DNA, 25 bp, Homo sapiens
gttaccactttttaaaaagcttttt

SEQ ID NO: 26058 - DNA, 17 bp, Homo sapiens
tcctacagtatttactt

SEQ ID NO: 26059 - DNA, 21 bp, Homo sapiens
tctggccctgccatatgaaca

SEQ ID NO: 26060 - DNA, 23 bp, Homo sapiens
tgagattgtgactggcaattgtt

SEQ ID NO: 26061 - DNA, 16 bp, Homo sapiens
gacagagagggcagcc

SEQ ID NO: 26062 - DNA, 23 bp, Homo sapiens
aaacccggatcccgctgcatctc

SEQ ID NO: 26063 - DNA, 20 bp, Homo sapiens
agctcactcgtatgtcctgc

SEQ ID NO: 26064 - DNA, 20 bp, Homo sapiens
agctcactcgtatgtcctgc

SEQ ID NO: 26065 - DNA, 23 bp, Homo sapiens
cacagctcactcgtatgtcctgc

SEQ ID NO: 26066 - DNA, 20 bp, Homo sapiens
cagctcactcgtatgtcctg

SEQ ID NO: 26067 - DNA, 21 bp, Homo sapiens
cagctcactcgtatgtcctgc

SEQ ID NO: 26068 - DNA, 21 bp, Homo sapiens
cagctcactcgtatgtcctgc

SEQ ID NO: 26069 - DNA, 16 bp, Homo sapiens
cctgggggttcgggga

SEQ ID NO: 26070 - DNA, 22 bp, Homo sapiens
cttttttgttgtcttttacttt

SEQ ID NO: 26071 - DNA, 20 bp, Homo sapiens
aactcacagccgaagcactc

SEQ ID NO: 26072 - DNA, 19 bp, Homo sapiens
accatttcacaccattgta

SEQ ID NO: 26073 - DNA, 19 bp, Homo sapiens
cagttgggcagaatcatct

SEQ ID NO: 26074 - DNA, 22 bp, Homo sapiens
cctaaatgtactcagaacactt

SEQ ID NO: 26075 - DNA, 16 bp, Homo sapiens
ggggttatgtcccagt

SEQ ID NO: 26076 - DNA, 22 bp, Homo sapiens
acggaacccaccatgcactgca

SEQ ID NO: 26077 - DNA, 16 bp, Homo sapiens
tgccccgcataggcca

SEQ ID NO: 26078 - DNA, 17 bp, Homo sapiens
tttgactgctgcggcaa

SEQ ID NO: 26079 - DNA, 22 bp, Homo sapiens
ccttccccggctcccctgccca

SEQ ID NO: 26080 - DNA, 23 bp, Homo sapiens
agcgcaggaccaccgcgtgtgct

SEQ ID NO: 26081 - DNA, 18 bp, Homo sapiens
gaccccagagccggccca

SEQ ID NO: 26082 - DNA, 18 bp, Homo sapiens
gtcctgtcgcgggtgtgc

SEQ ID NO: 26083 - DNA, 21 bp, Homo sapiens
gtgaagctctgggacatggca

SEQ ID NO: 26084 - DNA, 19 bp, Homo sapiens
ttaaagctgccactgcaga

SEQ ID NO: 26085 - DNA, 16 bp, Homo sapiens
gaactccaagatctca

SEQ ID NO: 26086 - DNA, 22 bp, Homo sapiens
cctgaaggggcaccgtgggctg

SEQ ID NO: 26087 - DNA, 21 bp, Homo sapiens
aagagaggcatcggattctca

SEQ ID NO: 26088 - DNA, 16 bp, Homo sapiens
agatggagaccttgtc

SEQ ID NO: 26089 - DNA, 21 bp, Homo sapiens
aggctgcagtgagccacagtc

SEQ ID NO: 26090 - DNA, 21 bp, Homo sapiens
cagtcacgccactgcattcta

SEQ ID NO: 26091 - DNA, 24 bp, Homo sapiens
acccagggcctcacctgccactca

SEQ ID NO: 26092 - DNA, 17 bp, Homo sapiens
agcaccttctgtggctc

SEQ ID NO: 26093 - DNA, 18 bp, Homo sapiens
cgttgactaactatgctc

SEQ ID NO: 26094 - DNA, 21 bp, Homo sapiens
ctccctctctctccctctctc

SEQ ID NO: 26095 - DNA, 20 bp, Homo sapiens
ctccctctctctttaccctc

SEQ ID NO: 26096 - DNA, 21 bp, Homo sapiens
gcggcttgtcccaggctgctg

SEQ ID NO: 26097 - DNA, 24 bp, Homo sapiens
ggcctgggccttgctgtgggactg

SEQ ID NO: 26098 - DNA, 17 bp, Homo sapiens
ggtcccagctggaatta

SEQ ID NO: 26099 - DNA, 22 bp, Homo sapiens
tcctgtactgctatccgccaga

SEQ ID NO: 26100 - DNA, 22 bp, Homo sapiens
aaggacccaggatttgaaccca

SEQ ID NO: 26101 - DNA, 20 bp, Homo sapiens
agcggatgaaggttgagcca

SEQ ID NO: 26102 - DNA, 22 bp, Homo sapiens
agtctcactctgttgccaaggc

SEQ ID NO: 26103 - DNA, 15 bp, Homo sapiens
caagagagcatccag

SEQ ID NO: 26104 - DNA, 24 bp, Homo sapiens
ccagactcaagtgatcctcccacc

SEQ ID NO: 26105 - DNA, 17 bp, Homo sapiens
ctgcagccacgtggcca

SEQ ID NO: 26106 - DNA, 16 bp, Homo sapiens
ctgcttcagcctctca

SEQ ID NO: 26107 - DNA, 20 bp, Homo sapiens
gcccagaggaagttctccag

SEQ ID NO: 26108 - DNA, 19 bp, Homo sapiens
ggacggtatcccgagccca

SEQ ID NO: 26109 - DNA, 17 bp, Homo sapiens
gggcggggcaggcgcta

SEQ ID NO: 26110 - DNA, 25 bp, Homo sapiens
gtgctacgcaggtgaggggatccgg

SEQ ID NO: 26111 - DNA, 17 bp, Homo sapiens
tctctacgttaacgttt

SEQ ID NO: 26112 - DNA, 20 bp, Homo sapiens
tgagtgggatagtgtggggc

SEQ ID NO: 26113 - DNA, 19 bp, Homo sapiens
tggaggctgatgtgagctg

SEQ ID NO: 26114 - DNA, 20 bp, Homo sapiens
tttgttattcctacctttga

SEQ ID NO: 26115 - DNA, 19 bp, Homo sapiens
aaatgttttctccagcatc

SEQ ID NO: 26116 - DNA, 22 bp, Homo sapiens
ctcacaaaatatatttctgata

SEQ ID NO: 26117 - DNA, 23 bp, Homo sapiens
cctgatctgcctgccttggcctt

SEQ ID NO: 26118 - DNA, 21 bp, Homo sapiens
gcctgacccgcaggccgccgc

SEQ ID NO: 26119 - DNA, 23 bp, Homo sapiens
actcttcttcattgtgagatgca

SEQ ID NO: 26120 - DNA, 18 bp, Homo sapiens
cagttcctctcgtccaag

SEQ ID NO: 26121 - DNA, 19 bp, Homo sapiens
gctacgcgcagccgcctca

SEQ ID NO: 26122 - DNA, 20 bp, Homo sapiens
taacaatgtttaggatattg

SEQ ID NO: 26123 - DNA, 20 bp, Homo sapiens
tatgatggtaactccagtga

SEQ ID NO: 26124 - DNA, 19 bp, Homo sapiens
cgccagcaagcccccctcc

SEQ ID NO: 26125 - DNA, 26 bp, Homo sapiens
gaccccacggctgtccggacgtgcca

SEQ ID NO: 26126 - DNA, 19 bp, Homo sapiens
gctccgggagcttcggaga

SEQ ID NO: 26127 - DNA, 18 bp, Homo sapiens
ctttcctgcagcctggag

SEQ ID NO: 26128 - DNA, 24 bp, Homo sapiens
gatgtttgaaccctggacattcca

SEQ ID NO: 26129 - DNA, 22 bp, Homo sapiens
gtagccacacatcattgctggg

SEQ ID NO: 26130 - DNA, 21 bp, Homo sapiens
tggaaggggactagccagctc

SEQ ID NO: 26131 - DNA, 20 bp, Homo sapiens
tggacactaggaattgcagc

SEQ ID NO: 26132 - DNA, 23 bp, Homo sapiens
tgtgtctcaccgcccacaaccct

SEQ ID NO: 26133 - DNA, 25 bp, Homo sapiens
ccaacagggactccaatcaatcgga

SEQ ID NO: 26134 - DNA, 16 bp, Homo sapiens
tttggggcccgagaca

SEQ ID NO: 26135 - DNA, 17 bp, Homo sapiens
tggattgagccgggccc

SEQ ID NO: 26136 - DNA, 17 bp, Homo sapiens
gcagctcgcgggtcaca

SEQ ID NO: 26137 - DNA, 16 bp, Homo sapiens
atgccagcccttgctc

SEQ ID NO: 26138 - DNA, 25 bp, Homo sapiens
tgcacctctcctgtctgtgctcctc

SEQ ID NO: 26139 - DNA, 20 bp, Homo sapiens
ccagcagggcagcggctgag

SEQ ID NO: 26140 - DNA, 18 bp, Homo sapiens
tctatttttctaccggga

SEQ ID NO: 26141 - DNA, 18 bp, Homo sapiens
ggaaagcgacggcgcggc

SEQ ID NO: 26142 - DNA, 21 bp, Homo sapiens
cactactttgaaaccattcta

SEQ ID NO: 26143 - DNA, 26 bp, Homo sapiens
ttctccgacatggctacgtgatctca

SEQ ID NO: 26144 - DNA, 15 bp, Homo sapiens
agagagagaagcact

SEQ ID NO: 26145 - DNA, 21 bp, Homo sapiens
cctgagcagagcctgaattac

SEQ ID NO: 26146 - DNA, 25 bp, Homo sapiens
tctgtattgaccggtttttgttttt

SEQ ID NO: 26147 - DNA, 19 bp, Homo sapiens
aagcaattctcccatctca

SEQ ID NO: 26148 - DNA, 20 bp, Homo sapiens
cctctgtctcccgggttcaa

SEQ ID NO: 26149 - DNA, 19 bp, Homo sapiens
ctaggaactgaatcttttt

SEQ ID NO: 26150 - DNA, 18 bp, Homo sapiens
tgtcttttgacaatacca

SEQ ID NO: 26151 - DNA, 21 bp, Homo sapiens
ccctcctggaggacctgggaa

SEQ ID NO: 26152 - DNA, 25 bp, Homo sapiens
ccctgcgctgcacggaggtctgtgg

SEQ ID NO: 26153 - DNA, 17 bp, Homo sapiens
gcccagggcctgaccaa

SEQ ID NO: 26154 - DNA, 25 bp, Homo sapiens
tgcccaccaggctggccttggctga

SEQ ID NO: 26155 - DNA, 19 bp, Homo sapiens
tggacgtgacgtggggctg

SEQ ID NO: 26156 - DNA, 18 bp, Homo sapiens
ataatttcattttcctca

SEQ ID NO: 26157 - DNA, 16 bp, Homo sapiens
atttgagatcttttcc

SEQ ID NO: 26158 - DNA, 18 bp, Homo sapiens
caccatgcccggccttct

SEQ ID NO: 26159 - DNA, 19 bp, Homo sapiens
ttgttttattgcattgact

SEQ ID NO: 26160 - DNA, 19 bp, Homo sapiens
agacctccccagcaatgtg

SEQ ID NO: 26161 - DNA, 18 bp, Homo sapiens
atgcctcaggacatccta

SEQ ID NO: 26162 - DNA, 19 bp, Homo sapiens
agccaagatcctaccacta

SEQ ID NO: 26163 - DNA, 23 bp, Homo sapiens
gacagagcaatactcccgtctca

SEQ ID NO: 26164 - DNA, 22 bp, Homo sapiens
gagccaagattgcgccactgca

SEQ ID NO: 26165 - DNA, 22 bp, Homo sapiens
ttcaagatcagtctggacaaca

SEQ ID NO: 26166 - DNA, 19 bp, Homo sapiens
caccgtccgcttttcctga

SEQ ID NO: 26167 - DNA, 19 bp, Homo sapiens
gcaactgcgcggacgtgac

SEQ ID NO: 26168 - DNA, 21 bp, Homo sapiens
gcccctgtggccgccatcttg

SEQ ID NO: 26169 - DNA, 18 bp, Homo sapiens
ctccccatggtaaccagg

SEQ ID NO: 26170 - DNA, 24 bp, Homo sapiens
gcctgaactgatctcacttggctc

SEQ ID NO: 26171 - DNA, 19 bp, Homo sapiens
ggggcctgaactgatctca

SEQ ID NO: 26172 - DNA, 19 bp, Homo sapiens
gtgagtgtgggtgtgtgtg

SEQ ID NO: 26173 - DNA, 22 bp, Homo sapiens
gacggggtttcaacgtgttggc

SEQ ID NO: 26174 - DNA, 18 bp, Homo sapiens
cctaaggaatactacaca

SEQ ID NO: 26175 - DNA, 17 bp, Homo sapiens
gcaggacctttgtaggt

SEQ ID NO: 26176 - DNA, 17 bp, Homo sapiens
aaagatttcaaacctca

SEQ ID NO: 26177 - DNA, 17 bp, Homo sapiens
acaagggaaggggtcaa

SEQ ID NO: 26178 - DNA, 19 bp, Homo sapiens
actggaggctgcctggctc

SEQ ID NO: 26179 - DNA, 19 bp, Homo sapiens
ccaggctccttcaccaccc

SEQ ID NO: 26180 - DNA, 20 bp, Homo sapiens
gagatgcattggtagcaact

SEQ ID NO: 26181 - DNA, 19 bp, Homo sapiens
gaggatggagtgagagaca

SEQ ID NO: 26182 - DNA, 18 bp, Homo sapiens
gcgctcatcacctcttcc

SEQ ID NO: 26183 - DNA, 22 bp, Homo sapiens
tcatcatcaccaccatctccca

SEQ ID NO: 26184 - DNA, 20 bp, Homo sapiens
tcatgacataccagatgcca

SEQ ID NO: 26185 - DNA, 18 bp, Homo sapiens
tctacaagaaaatccaca

SEQ ID NO: 26186 - DNA, 22 bp, Homo sapiens
ttctgaaattgggtcctcctcc

SEQ ID NO: 26187 - DNA, 18 bp, Homo sapiens
cgatcctcccctggactc

SEQ ID NO: 26188 - DNA, 19 bp, Homo sapiens
ctgaagcctcagtccttca

SEQ ID NO: 26189 - DNA, 18 bp, Homo sapiens
cgatcctcccctggactc

SEQ ID NO: 26190 - DNA, 19 bp, Homo sapiens
agcacccaagctcttctgt

SEQ ID NO: 26191 - DNA, 21 bp, Homo sapiens
agtgagaatcctgtgttccca

SEQ ID NO: 26192 - DNA, 18 bp, Homo sapiens
ataaccccaccaccgcca

SEQ ID NO: 26193 - DNA, 19 bp, Homo sapiens
ctctgcttcctccgtcctc

SEQ ID NO: 26194 - DNA, 24 bp, Homo sapiens
ctctgtgtcgtgatggtctgtgaa

SEQ ID NO: 26195 - DNA, 22 bp, Homo sapiens
aaacccagctcccatgactctc

SEQ ID NO: 26196 - DNA, 22 bp, Homo sapiens
agaaaggacattccccctcccc

SEQ ID NO: 26197 - DNA, 25 bp, Homo sapiens
ccatcatgacatggtccccaggctg

SEQ ID NO: 26198 - DNA, 21 bp, Homo sapiens
ccttcacgtgaggtctgtgag

SEQ ID NO: 26199 - DNA, 21 bp, Homo sapiens
ccttcacgtgaggtctgtgag

SEQ ID NO: 26200 - DNA, 19 bp, Homo sapiens
cttaaacaactcctttcca

SEQ ID NO: 26201 - DNA, 21 bp, Homo sapiens
ttaggccccacctaactcttc

SEQ ID NO: 26202 - DNA, 21 bp, Homo sapiens
aactctgtctcaaaaataata

SEQ ID NO: 26203 - DNA, 23 bp, Homo sapiens
tgagatttgctattaggtctggt

SEQ ID NO: 26204 - DNA, 19 bp, Homo sapiens
actttgggcaataatcaga

SEQ ID NO: 26205 - DNA, 20 bp, Homo sapiens
ccatcaaattacaacagcca

SEQ ID NO: 26206 - DNA, 22 bp, Homo sapiens
tataggtaagcagcttacctca

SEQ ID NO: 26207 - DNA, 20 bp, Homo sapiens
aagtcaatacacaaatgtgc

SEQ ID NO: 26208 - DNA, 21 bp, Homo sapiens
aatgctttcagtgttgaaata

SEQ ID NO: 26209 - DNA, 22 bp, Homo sapiens
agtcaatacacaaatgtgccag

SEQ ID NO: 26210 - DNA, 17 bp, Homo sapiens
atagtatagtaaccaca

SEQ ID NO: 26211 - DNA, 19 bp, Homo sapiens
atggtggtcaaagcagtaa

SEQ ID NO: 26212 - DNA, 21 bp, Homo sapiens
catgaaagtgggaatcactga

SEQ ID NO: 26213 - DNA, 18 bp, Homo sapiens
ggaatgacctggaacagg

SEQ ID NO: 26214 - DNA, 17 bp, Homo sapiens
ttttggaccctataact

SEQ ID NO: 26215 - DNA, 15 bp, Homo sapiens
gattagcacccattg

SEQ ID NO: 26216 - DNA, 23 bp, Homo sapiens
gtttccagaataaatatgtgtgt

SEQ ID NO: 26217 - DNA, 19 bp, Homo sapiens
tactgcgactgaacggcgg

SEQ ID NO: 26218 - DNA, 20 bp, Homo sapiens
tgaaagaagtattcagagta

SEQ ID NO: 26219 - DNA, 15 bp, Homo sapiens
gattagcacccattg

SEQ ID NO: 26220 - DNA, 19 bp, Homo sapiens
tactgcgactgaacggcgg

SEQ ID NO: 26221 - DNA, 16 bp, Homo sapiens
aattaatatttcagtg

SEQ ID NO: 26222 - DNA, 21 bp, Homo sapiens
atattggtgatgtagcagcaa

SEQ ID NO: 26223 - DNA, 23 bp, Homo sapiens
gctattaagagtactttgtgtta

SEQ ID NO: 26224 - DNA, 21 bp, Homo sapiens
tatcactatagatcatagtta

SEQ ID NO: 26225 - DNA, 19 bp, Homo sapiens
tgcaacatcggtggatttt

SEQ ID NO: 26226 - DNA, 16 bp, Homo sapiens
aattaatatttcagtg

SEQ ID NO: 26227 - DNA, 21 bp, Homo sapiens
atattggtgatgtagcagcaa

SEQ ID NO: 26228 - DNA, 21 bp, Homo sapiens
tatcactatagatcatagtta

SEQ ID NO: 26229 - DNA, 19 bp, Homo sapiens
cctgtctcagaaataacaa

SEQ ID NO: 26230 - DNA, 19 bp, Homo sapiens
gatgctactcactttgatt

SEQ ID NO: 26231 - DNA, 21 bp, Homo sapiens
gtgcagcccactaaattgctc

SEQ ID NO: 26232 - DNA, 20 bp, Homo sapiens
tgcagcccactaaattgctc

SEQ ID NO: 26233 - DNA, 20 bp, Homo sapiens
accacacaattacttttata

SEQ ID NO: 26234 - DNA, 20 bp, Homo sapiens
accaccaaaatacatagctt

SEQ ID NO: 26235 - DNA, 21 bp, Homo sapiens
aggacaaagcatcagctgtcc

SEQ ID NO: 26236 - DNA, 23 bp, Homo sapiens
atgtggatgcattagtcaggtgg

SEQ ID NO: 26237 - DNA, 19 bp, Homo sapiens
catctaccaccctcctcct

SEQ ID NO: 26238 - DNA, 21 bp, Homo sapiens
gccacatgattaatccagtct

SEQ ID NO: 26239 - DNA, 17 bp, Homo sapiens
gcgcctctcacacaggt

SEQ ID NO: 26240 - DNA, 17 bp, Homo sapiens
tgggaaaggtgtttgtg

SEQ ID NO: 26241 - DNA, 22 bp, Homo sapiens
cattgataacagaactaacttc

SEQ ID NO: 26242 - DNA, 19 bp, Homo sapiens
tcagcaaaaggcaggagag

SEQ ID NO: 26243 - DNA, 23 bp, Homo sapiens
ttctgtcatacccacatctgtca

SEQ ID NO: 26244 - DNA, 20 bp, Homo sapiens
caggggacacacctgccaaa

SEQ ID NO: 26245 - DNA, 19 bp, Homo sapiens
aatacagaaggggtgtttg

SEQ ID NO: 26246 - DNA, 17 bp, Homo sapiens
ttccttggaatatagct

SEQ ID NO: 26247 - DNA, 18 bp, Homo sapiens
acccagaaagcctcacat

SEQ ID NO: 26248 - DNA, 17 bp, Homo sapiens
tcaagtgattcttgtgc

SEQ ID NO: 26249 - DNA, 18 bp, Homo sapiens
cacatgccaaacatcata

SEQ ID NO: 26250 - DNA, 24 bp, Homo sapiens
cctggcatgttctaaactgttttt

SEQ ID NO: 26251 - DNA, 23 bp, Homo sapiens
tacggcttcctgacttctgtgac

SEQ ID NO: 26252 - DNA, 16 bp, Homo sapiens
gggaatgttttctgaa

SEQ ID NO: 26253 - DNA, 21 bp, Homo sapiens
tctaggtactaaagcattttt

SEQ ID NO: 26254 - DNA, 17 bp, Homo sapiens
tgtgaagttttatacct

SEQ ID NO: 26255 - DNA, 19 bp, Homo sapiens
aggcagtctgtggcctcct

SEQ ID NO: 26256 - DNA, 19 bp, Homo sapiens
atttatatagctctcatgt

SEQ ID NO: 26257 - DNA, 22 bp, Homo sapiens
atttatatgtatttttaccaca

SEQ ID NO: 26258 - DNA, 21 bp, Homo sapiens
catgaaacagcagaattccag

SEQ ID NO: 26259 - DNA, 24 bp, Homo sapiens
ctactataagcaacagctccttca

SEQ ID NO: 26260 - DNA, 16 bp, Homo sapiens
ctgaactgtacacttt

SEQ ID NO: 26261 - DNA, 20 bp, Homo sapiens
gacttggtcaggcacataca

SEQ ID NO: 26262 - DNA, 22 bp, Homo sapiens
gtcagtggggcaagaaatctgg

SEQ ID NO: 26263 - DNA, 24 bp, Homo sapiens
tcttttcatgctaccttcaatctt

SEQ ID NO: 26264 - DNA, 22 bp, Homo sapiens
ttccagacttggtcaggcacat

SEQ ID NO: 26265 - DNA, 19 bp, Homo sapiens
cccggcctgcgcgcccagc

SEQ ID NO: 26266 - DNA, 17 bp, Homo sapiens
gcgaagccgagacggcc

SEQ ID NO: 26267 - DNA, 20 bp, Homo sapiens
gcgcctcggccgttgccctc

SEQ ID NO: 26268 - DNA, 19 bp, Homo sapiens
agtgccgacggtagcgaaa

SEQ ID NO: 26269 - DNA, 19 bp, Homo sapiens
accacacgattgttccact

SEQ ID NO: 26270 - DNA, 20 bp, Homo sapiens
gcaaggtcaaagacatatca

SEQ ID NO: 26271 - DNA, 15 bp, Homo sapiens
gcatcccttttgtga

SEQ ID NO: 26272 - DNA, 18 bp, Homo sapiens
aggtcgttcggctcgggt

SEQ ID NO: 26273 - DNA, 18 bp, Homo sapiens
cgaggtcgttcggctcgg

SEQ ID NO: 26274 - DNA, 20 bp, Homo sapiens
acaaaagcccgcttgctcgc

SEQ ID NO: 26275 - DNA, 18 bp, Homo sapiens
gcttttcctgccggtctg

SEQ ID NO: 26276 - DNA, 16 bp, Homo sapiens
ggctgaaggagtctcg

SEQ ID NO: 26277 - DNA, 21 bp, Homo sapiens
aaacagaaaccgggctcagtc

SEQ ID NO: 26278 - DNA, 19 bp, Homo sapiens
aagcaattctcctgcctca

SEQ ID NO: 26279 - DNA, 22 bp, Homo sapiens
agtaaatgggtatatgtgtttg

SEQ ID NO: 26280 - DNA, 16 bp, Homo sapiens
atttcctatcctctga

SEQ ID NO: 26281 - DNA, 20 bp, Homo sapiens
cctctgcctcccgggttcaa

SEQ ID NO: 26282 - DNA, 19 bp, Homo sapiens
ccttaatttatactctctc

SEQ ID NO: 26283 - DNA, 15 bp, Homo sapiens
tgcccttctctcctc

SEQ ID NO: 26284 - DNA, 20 bp, Homo sapiens
tggaagccttggtggattct

SEQ ID NO: 26285 - DNA, 21 bp, Homo sapiens
ccaccgccatcattctgctca

SEQ ID NO: 26286 - DNA, 18 bp, Homo sapiens
ttctgctcatcctcctcc

SEQ ID NO: 26287 - DNA, 17 bp, Homo sapiens
caatgattaactggcca

SEQ ID NO: 26288 - DNA, 24 bp, Homo sapiens
atctgggtggctcagctaacctct

SEQ ID NO: 26289 - DNA, 18 bp, Homo sapiens
catgcaccattgcaggga

SEQ ID NO: 26290 - DNA, 18 bp, Homo sapiens
cctggaggaaccagctgc

SEQ ID NO: 26291 - DNA, 20 bp, Homo sapiens
gcttttcacagtttgctttt

SEQ ID NO: 26292 - DNA, 20 bp, Homo sapiens
ggacatctcgtcactctgta

SEQ ID NO: 26293 - DNA, 19 bp, Homo sapiens
tctgttatctcttgatgag

SEQ ID NO: 26294 - DNA, 21 bp, Homo sapiens
ttccagcttgccctgttctag

SEQ ID NO: 26295 - DNA, 20 bp, Homo sapiens
agaaggtgaagacatataga

SEQ ID NO: 26296 - DNA, 21 bp, Homo sapiens
atctcactcacaaacatcaca

SEQ ID NO: 26297 - DNA, 18 bp, Homo sapiens
catgtatcaggacagaga

SEQ ID NO: 26298 - DNA, 16 bp, Homo sapiens
cgctcccatgctgctg

SEQ ID NO: 26299 - DNA, 18 bp, Homo sapiens
ctggctctcctctacctc

SEQ ID NO: 26300 - DNA, 17 bp, Homo sapiens
tggcagtccagcagcaa

SEQ ID NO: 26301 - DNA, 18 bp, Homo sapiens
ccatcagccatttactaa

SEQ ID NO: 26302 - DNA, 20 bp, Homo sapiens
aaaagacttctctgtaaaga

SEQ ID NO: 26303 - DNA, 23 bp, Homo sapiens
gcgcccagactggtatccgggga

SEQ ID NO: 26304 - DNA, 22 bp, Homo sapiens
attatgcttctaggttactttt

SEQ ID NO: 26305 - DNA, 20 bp, Homo sapiens
aaagttgggagaaaggggaa

SEQ ID NO: 26306 - DNA, 21 bp, Homo sapiens
aggagaaaggcggacaggtca

SEQ ID NO: 26307 - DNA, 22 bp, Homo sapiens
agggcgtgaagaatttccctct

SEQ ID NO: 26308 - DNA, 21 bp, Homo sapiens
caaagcatggccttaccagct

SEQ ID NO: 26309 - DNA, 20 bp, Homo sapiens
ggcgtgaagaatttccctct

SEQ ID NO: 26310 - DNA, 19 bp, Homo sapiens
taaggttaactcctcactc

SEQ ID NO: 26311 - DNA, 16 bp, Homo sapiens
ttgatattgcacagtg

SEQ ID NO: 26312 - DNA, 16 bp, Homo sapiens
ttgcacagtgcactta

SEQ ID NO: 26313 - DNA, 19 bp, Homo sapiens
caaacccccacttccctca

SEQ ID NO: 26314 - DNA, 22 bp, Homo sapiens
aaaaactaatttggcattttaa

SEQ ID NO: 26315 - DNA, 22 bp, Homo sapiens
acctggaaatacaactttgctt

SEQ ID NO: 26316 - DNA, 22 bp, Homo sapiens
gtgaacctggaaatacaacttt

SEQ ID NO: 26317 - DNA, 20 bp, Homo sapiens
tctttttcactgtgactgca

SEQ ID NO: 26318 - DNA, 17 bp, Homo sapiens
atgtactgtgtgtgaca

SEQ ID NO: 26319 - DNA, 22 bp, Homo sapiens
tcctgaagctcttactctaaga

SEQ ID NO: 26320 - DNA, 20 bp, Homo sapiens
ttcaagaccagcctgaccaa

SEQ ID NO: 26321 - DNA, 24 bp, Homo sapiens
ccacagtgcccagcccgaattgga

SEQ ID NO: 26322 - DNA, 21 bp, Homo sapiens
tatcatatagtaagcagaaga

SEQ ID NO: 26323 - DNA, 20 bp, Homo sapiens
tggtcaggctggtcttgaac

SEQ ID NO: 26324 - DNA, 18 bp, Homo sapiens
tgcgcggtagccgcccca

SEQ ID NO: 26325 - DNA, 21 bp, Homo sapiens
agctcttctagttcatctgct

SEQ ID NO: 26326 - DNA, 16 bp, Homo sapiens
aggaagagctacttca

SEQ ID NO: 26327 - DNA, 18 bp, Homo sapiens
tactaattccctactagc

SEQ ID NO: 26328 - DNA, 21 bp, Homo sapiens
agactgtgcgttgataccaaa

SEQ ID NO: 26329 - DNA, 21 bp, Homo sapiens
ctgagggcgaaagttgtgtgt

SEQ ID NO: 26330 - DNA, 21 bp, Homo sapiens
ggaggaggaagccgccgagac

SEQ ID NO: 26331 - DNA, 23 bp, Homo sapiens
ccttctctatggccttgctacct

SEQ ID NO: 26332 - DNA, 22 bp, Homo sapiens
tcctccatgctcccttaatccc

SEQ ID NO: 26333 - DNA, 21 bp, Homo sapiens
ccttcccctacccttccctcc

SEQ ID NO: 26334 - DNA, 17 bp, Homo sapiens
tcaagtgattctcctgc

SEQ ID NO: 26335 - DNA, 18 bp, Homo sapiens
tccacctcccgggttcaa

SEQ ID NO: 26336 - DNA, 20 bp, Homo sapiens
tgtttgtcttgtgtatcata

SEQ ID NO: 26337 - DNA, 23 bp, Homo sapiens
aagcaagagtgtcacagcagtaa

SEQ ID NO: 26338 - DNA, 18 bp, Homo sapiens
atcaaacaagaataaata

SEQ ID NO: 26339 - DNA, 18 bp, Homo sapiens
ttctttgtgatctactga

SEQ ID NO: 26340 - DNA, 22 bp, Homo sapiens
atttgagtcctgaggctggccc

SEQ ID NO: 26341 - DNA, 18 bp, Homo sapiens
cgccttatggctgtggtg

SEQ ID NO: 26342 - DNA, 28 bp, Homo sapiens
gcctggcgtcgtccgtgactcctggccc

SEQ ID NO: 26343 - DNA, 18 bp, Homo sapiens
gttcttcctcctccgcgt

SEQ ID NO: 26344 - DNA, 20 bp, Homo sapiens
tcctggcccttctctgtgga

SEQ ID NO: 26345 - DNA, 23 bp, Homo sapiens
ttctgacgaacccctgcttgtgg

SEQ ID NO: 26346 - DNA, 25 bp, Homo sapiens
ttctgagtatcggggggtctctgga

SEQ ID NO: 26347 - DNA, 20 bp, Homo sapiens
tccttgactatgcccctctc

SEQ ID NO: 26348 - DNA, 20 bp, Homo sapiens
tttggtatgggaggtgttag

SEQ ID NO: 26349 - DNA, 19 bp, Homo sapiens
aaggccgacaccactcctg

SEQ ID NO: 26350 - DNA, 22 bp, Homo sapiens
accccctcgcctcctactctga

SEQ ID NO: 26351 - DNA, 18 bp, Homo sapiens
ccgctgagaggctgcctc

SEQ ID NO: 26352 - DNA, 20 bp, Homo sapiens
ctctgggggcagatttgtgg

SEQ ID NO: 26353 - DNA, 18 bp, Homo sapiens
ctgcaccctcttctcttc

SEQ ID NO: 26354 - DNA, 24 bp, Homo sapiens
gctttactgtggctgtctggatcc

SEQ ID NO: 26355 - DNA, 18 bp, Homo sapiens
gttgattgtacgtagcca

SEQ ID NO: 26356 - DNA, 21 bp, Homo sapiens
tagccgaactccaggctgggc

SEQ ID NO: 26357 - DNA, 26 bp, Homo sapiens
tctgtaaaaaatgtatgctatcctct

SEQ ID NO: 26358 - DNA, 23 bp, Homo sapiens
atgtcaggaaagccctaaactga

SEQ ID NO: 26359 - DNA, 21 bp, Homo sapiens
caaggtcatctctggcccagt

SEQ ID NO: 26360 - DNA, 21 bp, Homo sapiens
ctcccggcccccctgcactct

SEQ ID NO: 26361 - DNA, 21 bp, Homo sapiens
tagatgggttccgtaagaggc

SEQ ID NO: 26362 - DNA, 18 bp, Homo sapiens
tgcacctcccggacttca

SEQ ID NO: 26363 - DNA, 25 bp, Homo sapiens
acctgggcctctctgtgtttggttc

SEQ ID NO: 26364 - DNA, 18 bp, Homo sapiens
acgggtgtgtttgctata

SEQ ID NO: 26365 - DNA, 24 bp, Homo sapiens
caggaggtttgtctcaacacttcc

SEQ ID NO: 26366 - DNA, 18 bp, Homo sapiens
cattgcttcaacacagca

SEQ ID NO: 26367 - DNA, 19 bp, Homo sapiens
ccaagcacttcccacctca

SEQ ID NO: 26368 - DNA, 19 bp, Homo sapiens
ctttttagaccttctttca

SEQ ID NO: 26369 - DNA, 21 bp, Homo sapiens
gaccatgtaacaaatacctca

SEQ ID NO: 26370 - DNA, 19 bp, Homo sapiens
gattcattgcttcaacaca

SEQ ID NO: 26371 - DNA, 17 bp, Homo sapiens
gccaagtggccatccta

SEQ ID NO: 26372 - DNA, 19 bp, Homo sapiens
gctgtgttttgttttgttt

SEQ ID NO: 26373 - DNA, 17 bp, Homo sapiens
ggtttttcattttctca

SEQ ID NO: 26374 - DNA, 22 bp, Homo sapiens
tcagtattatttcctaaaatga

SEQ ID NO: 26375 - DNA, 18 bp, Homo sapiens
ttaaataacaaaaccact

SEQ ID NO: 26376 - DNA, 21 bp, Homo sapiens
aacagatttgcagctcattcc

SEQ ID NO: 26377 - DNA, 21 bp, Homo sapiens
cctgagctggctgcctggccc

SEQ ID NO: 26378 - DNA, 17 bp, Homo sapiens
ctctgtcctcgttccct

SEQ ID NO: 26379 - DNA, 22 bp, Homo sapiens
tcctgcctcctttttccgttct

SEQ ID NO: 26380 - DNA, 20 bp, Homo sapiens
ttccagaatcaatgctgcag

SEQ ID NO: 26381 - DNA, 22 bp, Homo sapiens
ccatggtgcttccctccatctc

SEQ ID NO: 26382 - DNA, 22 bp, Homo sapiens
gggtgtctgctgggcccactta

SEQ ID NO: 26383 - DNA, 20 bp, Homo sapiens
taagtggatttcaaactgtg

SEQ ID NO: 26384 - DNA, 20 bp, Homo sapiens
tattgtgacgctctccctga

SEQ ID NO: 26385 - DNA, 19 bp, Homo sapiens
tgagatcaggctctttgag

SEQ ID NO: 26386 - DNA, 18 bp, Homo sapiens
ttctgtgtaacaggccac

SEQ ID NO: 26387 - DNA, 19 bp, Homo sapiens
agtgcttggaggtccgtgt

SEQ ID NO: 26388 - DNA, 21 bp, Homo sapiens
taaaatgctgagtcgatccca

SEQ ID NO: 26389 - DNA, 20 bp, Homo sapiens
ctggcctcacagccgtccca

SEQ ID NO: 26390 - DNA, 21 bp, Homo sapiens
gacgttggctgtgcttggtca

SEQ ID NO: 26391 - DNA, 23 bp, Homo sapiens
gtgagatgttaccacttacccct

SEQ ID NO: 26392 - DNA, 21 bp, Homo sapiens
taccctgagccacctctctca

SEQ ID NO: 26393 - DNA, 27 bp, Homo sapiens
ttactgccttttgtggaaattcaccta

SEQ ID NO: 26394 - DNA, 18 bp, Homo sapiens
tttctaggttgccttaat

SEQ ID NO: 26395 - DNA, 20 bp, Homo sapiens
ggaagaagcccgggatcccg

SEQ ID NO: 26396 - DNA, 18 bp, Homo sapiens
tgggtggatcacctgagg

SEQ ID NO: 26397 - DNA, 23 bp, Homo sapiens
catccagaacaccagatgttgta

SEQ ID NO: 26398 - DNA, 18 bp, Homo sapiens
cctcccactgccatggta

SEQ ID NO: 26399 - DNA, 20 bp, Homo sapiens
agtgttgcaccaaactaaca

SEQ ID NO: 26400 - DNA, 23 bp, Homo sapiens
ggcaacatagcgagactacctct

SEQ ID NO: 26401 - DNA, 21 bp, Homo sapiens
tcagcaggagtgccaggagaa

SEQ ID NO: 26402 - DNA, 17 bp, Homo sapiens
agcttgtgaaaatctca

SEQ ID NO: 26403 - DNA, 26 bp, Homo sapiens
caccaacccagtatcacaaaaactca

SEQ ID NO: 26404 - DNA, 20 bp, Homo sapiens
gtgtcccagaagcttttgtt

SEQ ID NO: 26405 - DNA, 20 bp, Homo sapiens
gccacgtcccagcaccactt

SEQ ID NO: 26406 - DNA, 19 bp, Homo sapiens
aggaagtagggttgaaata

SEQ ID NO: 26407 - DNA, 19 bp, Homo sapiens
acagaatgtcaacatcaca

SEQ ID NO: 26408 - DNA, 20 bp, Homo sapiens
acatcacctgcctgccggca

SEQ ID NO: 26409 - DNA, 21 bp, Homo sapiens
tgaatgaagacaatgtggaat

SEQ ID NO: 26410 - DNA, 20 bp, Homo sapiens
gaaagctcattatctgagaa

SEQ ID NO: 26411 - DNA, 24 bp, Homo sapiens
aactagagctagtcttcggattga

SEQ ID NO: 26412 - DNA, 24 bp, Homo sapiens
gttacaatcacaccaagtgactca

SEQ ID NO: 26413 - DNA, 19 bp, Homo sapiens
agtgggaaaaggtgttaag

SEQ ID NO: 26414 - DNA, 25 bp, Homo sapiens
agcctcgtcctggacccctacctcg

SEQ ID NO: 26415 - DNA, 17 bp, Homo sapiens
cccacccctgccccagc

SEQ ID NO: 26416 - DNA, 17 bp, Homo sapiens
gacccctgagccacccc

SEQ ID NO: 26417 - DNA, 19 bp, Homo sapiens
gcacgaggagcggatgaga

SEQ ID NO: 26418 - DNA, 21 bp, Homo sapiens
atgtgttaaattgtgctttaa

SEQ ID NO: 26419 - DNA, 21 bp, Homo sapiens
cctgtaccctaaaatttttca

SEQ ID NO: 26420 - DNA, 24 bp, Homo sapiens
tgtgcagcccttaggttcctgctg

SEQ ID NO: 26421 - DNA, 16 bp, Homo sapiens
ttttggtctgcagcaa

SEQ ID NO: 26422 - DNA, 20 bp, Homo sapiens
atgaaccgggtgggttctga

SEQ ID NO: 26423 - DNA, 21 bp, Homo sapiens
ctctctctctctttctctctc

SEQ ID NO: 26424 - DNA, 18 bp, Homo sapiens
tctttctctctctctctc

SEQ ID NO: 26425 - DNA, 17 bp, Homo sapiens
tgcagccttcctggact

SEQ ID NO: 26426 - DNA, 23 bp, Homo sapiens
cttcctgttggctgtctggcctt

SEQ ID NO: 26427 - DNA, 24 bp, Homo sapiens
gccttcctgttggctgtctggcct

SEQ ID NO: 26428 - DNA, 23 bp, Homo sapiens
gcgcagtatttattgctaaatta

SEQ ID NO: 26429 - DNA, 24 bp, Homo sapiens
tctgggatcttgtgagttactttt

SEQ ID NO: 26430 - DNA, 20 bp, Homo sapiens
caacctcgtcctctgcccct

SEQ ID NO: 26431 - DNA, 19 bp, Homo sapiens
cctcctcaacctcgtcctc

SEQ ID NO: 26432 - DNA, 19 bp, Homo sapiens
cctgggccagagctggttc

SEQ ID NO: 26433 - DNA, 24 bp, Homo sapiens
gccatggctaggaaagcgctgcca

SEQ ID NO: 26434 - DNA, 19 bp, Homo sapiens
tccagacactctgctgttt

SEQ ID NO: 26435 - DNA, 21 bp, Homo sapiens
ctttggctcccagccacctca

SEQ ID NO: 26436 - DNA, 19 bp, Homo sapiens
gagagttgaaaaactacct

SEQ ID NO: 26437 - DNA, 17 bp, Homo sapiens
gctgcgcgctcctcatg

SEQ ID NO: 26438 - DNA, 21 bp, Homo sapiens
ctgtctcaaaatattgcccaa

SEQ ID NO: 26439 - DNA, 22 bp, Homo sapiens
cttgagtaagaacaatcctttt

SEQ ID NO: 26440 - DNA, 23 bp, Homo sapiens
ggcaagaaggtatcctcttccca

SEQ ID NO: 26441 - DNA, 20 bp, Homo sapiens
tccaatgatgggacaggcct

SEQ ID NO: 26442 - DNA, 26 bp, Homo sapiens
tcttaagtactgactgctttgacttt

SEQ ID NO: 26443 - DNA, 20 bp, Homo sapiens
tgaccactcaggccagccca

SEQ ID NO: 26444 - DNA, 20 bp, Homo sapiens
tgatgatggctgcctggttt

SEQ ID NO: 26445 - DNA, 21 bp, Homo sapiens
ggggacagggactgctgtggc

SEQ ID NO: 26446 - DNA, 26 bp, Homo sapiens
atctgaatcatcagtattgtctgctt

SEQ ID NO: 26447 - DNA, 20 bp, Homo sapiens
catagacaactagagcagct

SEQ ID NO: 26448 - DNA, 26 bp, Homo sapiens
cctgccgtcgtagggaggcttgcgga

SEQ ID NO: 26449 - DNA, 20 bp, Homo sapiens
cctggtcaccctccatctct

SEQ ID NO: 26450 - DNA, 22 bp, Homo sapiens
gctgagccgcgccacgctgcaa

SEQ ID NO: 26451 - DNA, 18 bp, Homo sapiens
tccttttgtgcctcggaa

SEQ ID NO: 26452 - DNA, 19 bp, Homo sapiens
cctccttagccccactggt

SEQ ID NO: 26453 - DNA, 21 bp, Homo sapiens
ctttttcatccccttaccctt

SEQ ID NO: 26454 - DNA, 19 bp, Homo sapiens
tcaggtgcagaggaagtac

SEQ ID NO: 26455 - DNA, 22 bp, Homo sapiens
agctacttccatcccccgggga

SEQ ID NO: 26456 - DNA, 19 bp, Homo sapiens
gcggcttcaagagagagcg

SEQ ID NO: 26457 - DNA, 26 bp, Homo sapiens
cggctggggctgcggccgcgtggctc

SEQ ID NO: 26458 - DNA, 18 bp, Homo sapiens
gaagcatgtgaaaattca

SEQ ID NO: 26459 - DNA, 22 bp, Homo sapiens
tctgggcttccagcgctggcct

SEQ ID NO: 26460 - DNA, 17 bp, Homo sapiens
atggcttgaagtcctga

SEQ ID NO: 26461 - DNA, 21 bp, Homo sapiens
acaacctgcaaaaacggagct

SEQ ID NO: 26462 - DNA, 23 bp, Homo sapiens
cccaggagccgggaggcctgcgg

SEQ ID NO: 26463 - DNA, 22 bp, Homo sapiens
ccccggggataccctctgccag

SEQ ID NO: 26464 - DNA, 20 bp, Homo sapiens
ttgagaattgagtctttgga

SEQ ID NO: 26465 - DNA, 20 bp, Homo sapiens
aataaaattctgttgtttgt

SEQ ID NO: 26466 - DNA, 18 bp, Homo sapiens
accgactctgtcgttgcc

SEQ ID NO: 26467 - DNA, 22 bp, Homo sapiens
gttctagtttgtatcccctcaa

SEQ ID NO: 26468 - DNA, 20 bp, Homo sapiens
tctgtcgttgccttgatctt

SEQ ID NO: 26469 - DNA, 18 bp, Homo sapiens
agtaacaagcctgtcaaa

SEQ ID NO: 26470 - DNA, 21 bp, Homo sapiens
aaatgcagtatcttcagaatg

SEQ ID NO: 26471 - DNA, 18 bp, Homo sapiens
agaacactgccttgttcc

SEQ ID NO: 26472 - DNA, 21 bp, Homo sapiens
ccccacccagccccctgcagc

SEQ ID NO: 26473 - DNA, 17 bp, Homo sapiens
gccctgctgcaccatct

SEQ ID NO: 26474 - DNA, 23 bp, Homo sapiens
ttctttggaacaaatccccccca

SEQ ID NO: 26475 - DNA, 20 bp, Homo sapiens
agagaaggatgctgaggacc

SEQ ID NO: 26476 - DNA, 27 bp, Homo sapiens
cctagctactggtcctgggccattttt

SEQ ID NO: 26477 - DNA, 18 bp, Homo sapiens
cttgagaactcttggttt

SEQ ID NO: 26478 - DNA, 23 bp, Homo sapiens
ggttgctcatccatttttttcag

SEQ ID NO: 26479 - DNA, 20 bp, Homo sapiens
actggatgatgttcacaaca

SEQ ID NO: 26480 - DNA, 18 bp, Homo sapiens
agtatttccagaatctca

SEQ ID NO: 26481 - DNA, 23 bp, Homo sapiens
gaaggacattgaaaaaatgtaca

SEQ ID NO: 26482 - DNA, 19 bp, Homo sapiens
gagaagtagttgtgagaca

SEQ ID NO: 26483 - DNA, 27 bp, Homo sapiens
tggatgatgttcacaacaaagctgaca

SEQ ID NO: 26484 - DNA, 23 bp, Homo sapiens
gaccggacctcgaccggctcgtc

SEQ ID NO: 26485 - DNA, 18 bp, Homo sapiens
gcttgtttcctgctctga

SEQ ID NO: 26486 - DNA, 20 bp, Homo sapiens
tcctgctctgaggcttgtgg

SEQ ID NO: 26487 - DNA, 18 bp, Homo sapiens
ttgtttccaaatatgacc

SEQ ID NO: 26488 - DNA, 19 bp, Homo sapiens
acagagccagaccctgact

SEQ ID NO: 26489 - DNA, 23 bp, Homo sapiens
actggtgcacacctgtcatccca

SEQ ID NO: 26490 - DNA, 20 bp, Homo sapiens
aggccctgtgcatgtcccca

SEQ ID NO: 26491 - DNA, 19 bp, Homo sapiens
cccaacccgagaaccgggg

SEQ ID NO: 26492 - DNA, 19 bp, Homo sapiens
ccgtgtgctcgccatgtga

SEQ ID NO: 26493 - DNA, 18 bp, Homo sapiens
cctgaggcatgggatggg

SEQ ID NO: 26494 - DNA, 21 bp, Homo sapiens
cgaggctgcagggagctgtga

SEQ ID NO: 26495 - DNA, 19 bp, Homo sapiens
tctcaccgtgtgctcgcca

SEQ ID NO: 26496 - DNA, 22 bp, Homo sapiens
catttacaaatgcaaaaatgga

SEQ ID NO: 26497 - DNA, 19 bp, Homo sapiens
ttcctgtaagctacctgaa

SEQ ID NO: 26498 - DNA, 16 bp, Homo sapiens
aacacatcttgggcca

SEQ ID NO: 26499 - DNA, 17 bp, Homo sapiens
atctcaggctgggaaga

SEQ ID NO: 26500 - DNA, 17 bp, Homo sapiens
ccacatgagccatgtga

SEQ ID NO: 26501 - DNA, 21 bp, Homo sapiens
actactaccagcagaaaggga

SEQ ID NO: 26502 - DNA, 17 bp, Homo sapiens
gtggggtacagtagctg

SEQ ID NO: 26503 - DNA, 23 bp, Homo sapiens
aacaggaagcctgtggaggactg

SEQ ID NO: 26504 - DNA, 21 bp, Homo sapiens
ccttttcatatattttgcctt

SEQ ID NO: 26505 - DNA, 18 bp, Homo sapiens
agaagtctttacacctct

SEQ ID NO: 26506 - DNA, 19 bp, Homo sapiens
atcctaagcagttactctg

SEQ ID NO: 26507 - DNA, 22 bp, Homo sapiens
ctgccttttacacattgctttt

SEQ ID NO: 26508 - DNA, 20 bp, Homo sapiens
gttcttgtataccatgtttg

SEQ ID NO: 26509 - DNA, 19 bp, Homo sapiens
tctgttgcatgacaaacgt

SEQ ID NO: 26510 - DNA, 19 bp, Homo sapiens
ggtgaggcaatctgtgagc

SEQ ID NO: 26511 - DNA, 20 bp, Homo sapiens
agacacttgtgaaaccttgc

SEQ ID NO: 26512 - DNA, 15 bp, Homo sapiens
gaggaagaagagcaa

SEQ ID NO: 26513 - DNA, 25 bp, Homo sapiens
tcaagtatatactcatgttattttg

SEQ ID NO: 26514 - DNA, 25 bp, Homo sapiens
tgagacagcactgtttggtgccaga

SEQ ID NO: 26515 - DNA, 19 bp, Homo sapiens
agatctttgcatgaggtaa

SEQ ID NO: 26516 - DNA, 18 bp, Homo sapiens
agttttgaggttatgcac

SEQ ID NO: 26517 - DNA, 18 bp, Homo sapiens
ggctgcccatataagtca

SEQ ID NO: 26518 - DNA, 23 bp, Homo sapiens
tttcccacctccttccccccacc

SEQ ID NO: 26519 - DNA, 19 bp, Homo sapiens
cgccagctcctcctcctcc

SEQ ID NO: 26520 - DNA, 22 bp, Homo sapiens
gcccacaggcggatgttcccca

SEQ ID NO: 26521 - DNA, 16 bp, Homo sapiens
taaagctagtcctgta

SEQ ID NO: 26522 - DNA, 20 bp, Homo sapiens
gcactccagcctgggtgaca

SEQ ID NO: 26523 - DNA, 19 bp, Homo sapiens
ccaactgtcagtgccagtg

SEQ ID NO: 26524 - DNA, 25 bp, Homo sapiens
gaattcttgacgtggggtctctgga

SEQ ID NO: 26525 - DNA, 17 bp, Homo sapiens
gctcaaacgggctttta

SEQ ID NO: 26526 - DNA, 21 bp, Homo sapiens
tcttgacgtggggtctctgga

SEQ ID NO: 26527 - DNA, 25 bp, Homo sapiens
gggaatcacatttcaacatgagatt

SEQ ID NO: 26528 - DNA, 23 bp, Homo sapiens
tcccgctaggcccacctccaaca

SEQ ID NO: 26529 - DNA, 18 bp, Homo sapiens
acaaatgtggaagaaatc

SEQ ID NO: 26530 - DNA, 18 bp, Homo sapiens
acaagagtgcataccaga

SEQ ID NO: 26531 - DNA, 17 bp, Homo sapiens
atataacatgtttgcaa

SEQ ID NO: 26532 - DNA, 18 bp, Homo sapiens
ctacatatattttaaaaa

SEQ ID NO: 26533 - DNA, 22 bp, Homo sapiens
agtctcactctgttacccaggc

SEQ ID NO: 26534 - DNA, 20 bp, Homo sapiens
caccagccaactgcaactta

SEQ ID NO: 26535 - DNA, 22 bp, Homo sapiens
ccgagtgttgattttaatatca

SEQ ID NO: 26536 - DNA, 22 bp, Homo sapiens
ctctgaggaagagggtctgtgg

SEQ ID NO: 26537 - DNA, 19 bp, Homo sapiens
cttctttttccccctcctc

SEQ ID NO: 26538 - DNA, 17 bp, Homo sapiens
gcgattcccctgcctca

SEQ ID NO: 26539 - DNA, 21 bp, Homo sapiens
atttgggtcctagttgcttgg

SEQ ID NO: 26540 - DNA, 17 bp, Homo sapiens
cccacaggagccccgga

SEQ ID NO: 26541 - DNA, 16 bp, Homo sapiens
agaaaattcatacctg

SEQ ID NO: 26542 - DNA, 21 bp, Homo sapiens
cacctctatgcacttctttct

SEQ ID NO: 26543 - DNA, 17 bp, Homo sapiens
tccagagagattcccag

SEQ ID NO: 26544 - DNA, 19 bp, Homo sapiens
cttccagtgctttggcctt

SEQ ID NO: 26545 - DNA, 19 bp, Homo sapiens
ctggaaaggagcagtgcct

SEQ ID NO: 26546 - DNA, 22 bp, Homo sapiens
tgggagcctgggctgggctcag

SEQ ID NO: 26547 - DNA, 19 bp, Homo sapiens
caagaaatcagcaaccagc

SEQ ID NO: 26548 - DNA, 20 bp, Homo sapiens
catgctggctgtgaccccgg

SEQ ID NO: 26549 - DNA, 21 bp, Homo sapiens
cctcagggctaacggcactgt

SEQ ID NO: 26550 - DNA, 20 bp, Homo sapiens
gattatcaacaatggggcta

SEQ ID NO: 26551 - DNA, 21 bp, Homo sapiens
tctaataatgtttcttaatgg

SEQ ID NO: 26552 - DNA, 18 bp, Homo sapiens
agggaactcatactgtct

SEQ ID NO: 26553 - DNA, 15 bp, Homo sapiens
cccagaagccctcag

SEQ ID NO: 26554 - DNA, 22 bp, Homo sapiens
ctttttggatcagcattttgta

SEQ ID NO: 26555 - DNA, 18 bp, Homo sapiens
gttccctccatcattgcc

SEQ ID NO: 26556 - DNA, 20 bp, Homo sapiens
tgggccctgtgaagccagca

SEQ ID NO: 26557 - DNA, 21 bp, Homo sapiens
tttggcatttgtttaacctca

SEQ ID NO: 26558 - DNA, 17 bp, Homo sapiens
acttagagcttatcttc

SEQ ID NO: 26559 - DNA, 23 bp, Homo sapiens
cgaagacgtgccctaccctacca

SEQ ID NO: 26560 - DNA, 17 bp, Homo sapiens
gtggttttcttgctccc

SEQ ID NO: 26561 - DNA, 21 bp, Homo sapiens
tactaagtggttttcttgctc

SEQ ID NO: 26562 - DNA, 18 bp, Homo sapiens
tttacttccaatatttta

SEQ ID NO: 26563 - DNA, 21 bp, Homo sapiens
agccagccccagcactgagga

SEQ ID NO: 26564 - DNA, 17 bp, Homo sapiens
cacatggtgtgcacggg

SEQ ID NO: 26565 - DNA, 19 bp, Homo sapiens
caccacctgccctccttct

SEQ ID NO: 26566 - DNA, 20 bp, Homo sapiens
ctctttctccctcccgcctc

SEQ ID NO: 26567 - DNA, 18 bp, Homo sapiens
gccgacgaaccgacacgc

SEQ ID NO: 26568 - DNA, 19 bp, Homo sapiens
ttcccacctcctccctacc

SEQ ID NO: 26569 - DNA, 24 bp, Homo sapiens
acctctgtcaccaccaaagacggg

SEQ ID NO: 26570 - DNA, 18 bp, Homo sapiens
ccagggcccctctcccct

SEQ ID NO: 26571 - DNA, 22 bp, Homo sapiens
gaaaggatactccagccggaga

SEQ ID NO: 26572 - DNA, 17 bp, Homo sapiens
tgatgctgggtgtggcc

SEQ ID NO: 26573 - DNA, 18 bp, Homo sapiens
atctttattcatgtgtca

SEQ ID NO: 26574 - DNA, 20 bp, Homo sapiens
caatcttgaggtgccttctg

SEQ ID NO: 26575 - DNA, 17 bp, Homo sapiens
gtgaacaatggataaca

SEQ ID NO: 26576 - DNA, 21 bp, Homo sapiens
ttattaaccttcagccttcga

SEQ ID NO: 26577 - DNA, 17 bp, Homo sapiens
aagaaggcagcaattca

SEQ ID NO: 26578 - DNA, 22 bp, Homo sapiens
cccgaagaagagccagaatgag

SEQ ID NO: 26579 - DNA, 20 bp, Homo sapiens
ctattacagcctgagtaata

SEQ ID NO: 26580 - DNA, 18 bp, Homo sapiens
gcggccaaggccacggtg

SEQ ID NO: 26581 - DNA, 19 bp, Homo sapiens
ggcagcagtgtttagagca

SEQ ID NO: 26582 - DNA, 21 bp, Homo sapiens
gtaaaagaaacaaactttgta

SEQ ID NO: 26583 - DNA, 20 bp, Homo sapiens
tctttaacctctttaacctt

SEQ ID NO: 26584 - DNA, 24 bp, Homo sapiens
ttgaggaaaaatttcttaaagcaa

SEQ ID NO: 26585 - DNA, 20 bp, Homo sapiens
ccagaaagaatgagatataa

SEQ ID NO: 26586 - DNA, 17 bp, Homo sapiens
tcctttgaaacactgga

SEQ ID NO: 26587 - DNA, 22 bp, Homo sapiens
gagccaagatcacgccactgca

SEQ ID NO: 26588 - DNA, 20 bp, Homo sapiens
tctgggcaatcatttatttt

SEQ ID NO: 26589 - DNA, 22 bp, Homo sapiens
tcttggaattgggacctttgga

SEQ ID NO: 26590 - DNA, 17 bp, Homo sapiens
tgacagagccaaactcc

SEQ ID NO: 26591 - DNA, 20 bp, Homo sapiens
tgcagaaatgaggacgttat

SEQ ID NO: 26592 - DNA, 20 bp, Homo sapiens
ttaggaaatctaggacttcc

SEQ ID NO: 26593 - DNA, 19 bp, Homo sapiens
atcctagtctatctagctc

SEQ ID NO: 26594 - DNA, 19 bp, Homo sapiens
cagcacagacttctgctaa

SEQ ID NO: 26595 - DNA, 22 bp, Homo sapiens
tatcttctctgctgtcacactg

SEQ ID NO: 26596 - DNA, 19 bp, Homo sapiens
ttgcctggaccaagctact

SEQ ID NO: 26597 - DNA, 22 bp, Homo sapiens
ctgataggtggcaggcctgtgg

SEQ ID NO: 26598 - DNA, 18 bp, Homo sapiens
aaaaaatgttaagtcata

SEQ ID NO: 26599 - DNA, 24 bp, Homo sapiens
agtaataactagttggccaactga

SEQ ID NO: 26600 - DNA, 16 bp, Homo sapiens
ccagggacttgcccca

SEQ ID NO: 26601 - DNA, 21 bp, Homo sapiens
tgcccaggccactggccccag

SEQ ID NO: 26602 - DNA, 19 bp, Homo sapiens
ctgcaacctctgcctccca

SEQ ID NO: 26603 - DNA, 20 bp, Homo sapiens
ttttgagtcagtggtttatg

SEQ ID NO: 26604 - DNA, 19 bp, Homo sapiens
cccagaccaactcctttcc

SEQ ID NO: 26605 - DNA, 24 bp, Homo sapiens
agccagggcagggttttgcgttca

SEQ ID NO: 26606 - DNA, 18 bp, Homo sapiens
gcttgtacaaccaaacac

SEQ ID NO: 26607 - DNA, 21 bp, Homo sapiens
ccagtattctttttcttttcc

SEQ ID NO: 26608 - DNA, 19 bp, Homo sapiens
ctgacctttgggagaaaaa

SEQ ID NO: 26609 - DNA, 18 bp, Homo sapiens
gcttttaaaggcaaatca

SEQ ID NO: 26610 - DNA, 17 bp, Homo sapiens
gttggttattgtttaca

SEQ ID NO: 26611 - DNA, 20 bp, Homo sapiens
taggtggaaaacatggaatt

SEQ ID NO: 26612 - DNA, 19 bp, Homo sapiens
tgagaaacaaagtggcatt

SEQ ID NO: 26613 - DNA, 18 bp, Homo sapiens
ttgtggtttttgccattg

SEQ ID NO: 26614 - DNA, 20 bp, Homo sapiens
agctggggcaggggagccca

SEQ ID NO: 26615 - DNA, 18 bp, Homo sapiens
gtctttctctccatctct

SEQ ID NO: 26616 - DNA, 16 bp, Homo sapiens
ttctttatcctgtgaa

SEQ ID NO: 26617 - DNA, 19 bp, Homo sapiens
gcctgagccctcctgccca

SEQ ID NO: 26618 - DNA, 21 bp, Homo sapiens
tccaattcagactgtcagtga

SEQ ID NO: 26619 - DNA, 18 bp, Homo sapiens
tgtatattttctacattt

SEQ ID NO: 26620 - DNA, 19 bp, Homo sapiens
caccaagccctctatctcc

SEQ ID NO: 26621 - DNA, 20 bp, Homo sapiens
ccctggccccctccccgtaa

SEQ ID NO: 26622 - DNA, 20 bp, Homo sapiens
gagtagacagccccctcccc

SEQ ID NO: 26623 - DNA, 16 bp, Homo sapiens
gcctcagcttgctgct

SEQ ID NO: 26624 - DNA, 19 bp, Homo sapiens
aagcaattctcctgcctca

SEQ ID NO: 26625 - DNA, 19 bp, Homo sapiens
gaaaatatcaaacatgtta

SEQ ID NO: 26626 - DNA, 23 bp, Homo sapiens
gctatttcaaaagttactgagga

SEQ ID NO: 26627 - DNA, 25 bp, Homo sapiens
gtagttttaatttgggttttagtta

SEQ ID NO: 26628 - DNA, 17 bp, Homo sapiens
taattagtaaattccaa

SEQ ID NO: 26629 - DNA, 18 bp, Homo sapiens
taattttatatcgctttt

SEQ ID NO: 26630 - DNA, 21 bp, Homo sapiens
acctggacccaggccaggccc

SEQ ID NO: 26631 - DNA, 18 bp, Homo sapiens
cacctgctctctgtctca

SEQ ID NO: 26632 - DNA, 22 bp, Homo sapiens
caggatggtggagtctgcccca

SEQ ID NO: 26633 - DNA, 20 bp, Homo sapiens
ccaggcaccctctgccctgc

SEQ ID NO: 26634 - DNA, 20 bp, Homo sapiens
cctcattgacccgcgctgcc

SEQ ID NO: 26635 - DNA, 22 bp, Homo sapiens
gacccgcgctgccccgacctca

SEQ ID NO: 26636 - DNA, 24 bp, Homo sapiens
ggcaccctctgccctgcccggcca

SEQ ID NO: 26637 - DNA, 19 bp, Homo sapiens
cccccatgaggcctcctca

SEQ ID NO: 26638 - DNA, 18 bp, Homo sapiens
cctggagggcagcaatgg

SEQ ID NO: 26639 - DNA, 25 bp, Homo sapiens
ctctgacccccaagaggcctgtgag

SEQ ID NO: 26640 - DNA, 21 bp, Homo sapiens
gcccttccttcggaccgtgag

SEQ ID NO: 26641 - DNA, 22 bp, Homo sapiens
cccttcttaactagacctagac

SEQ ID NO: 26642 - DNA, 20 bp, Homo sapiens
gcagagcacacctgctgtca

SEQ ID NO: 26643 - DNA, 16 bp, Homo sapiens
ggcagggcgcccggcc

SEQ ID NO: 26644 - DNA, 24 bp, Homo sapiens
caagatcagccttcctcgccaccg

SEQ ID NO: 26645 - DNA, 18 bp, Homo sapiens
aagagtgatttttgagct

SEQ ID NO: 26646 - DNA, 24 bp, Homo sapiens
acaaatttaaagattatgttatta

SEQ ID NO: 26647 - DNA, 19 bp, Homo sapiens
acatttttacagttctcca

SEQ ID NO: 26648 - DNA, 20 bp, Homo sapiens
gaaagatgtcactagattct

SEQ ID NO: 26649 - DNA, 20 bp, Homo sapiens
ggccacctgtaaggcaaatc

SEQ ID NO: 26650 - DNA, 22 bp, Homo sapiens
tagtttcaaaattctcagtttg

SEQ ID NO: 26651 - DNA, 21 bp, Homo sapiens
ttgctgttgaaccttttatga

SEQ ID NO: 26652 - DNA, 24 bp, Homo sapiens
gcaaccgactggcatcacgggaga

SEQ ID NO: 26653 - DNA, 19 bp, Homo sapiens
tgggactcggctggagctg

SEQ ID NO: 26654 - DNA, 21 bp, Homo sapiens
gtgacgctgatggtttggggc

SEQ ID NO: 26655 - DNA, 20 bp, Homo sapiens
tgttttgaagaagagactga

SEQ ID NO: 26656 - DNA, 20 bp, Homo sapiens
tgagtgggtctcatgggaac

SEQ ID NO: 26657 - DNA, 17 bp, Homo sapiens
ttgcgaaggttagaaga

SEQ ID NO: 26658 - DNA, 22 bp, Homo sapiens
taaaacatgtttataaagtaca

SEQ ID NO: 26659 - DNA, 18 bp, Homo sapiens
tctctactaaaaatgcaa

SEQ ID NO: 26660 - DNA, 18 bp, Homo sapiens
tgggtggatcacctgagg

SEQ ID NO: 26661 - DNA, 21 bp, Homo sapiens
ctttttgattattgcattgta

SEQ ID NO: 26662 - DNA, 21 bp, Homo sapiens
gtctggatcatggcatgtaga

SEQ ID NO: 26663 - DNA, 16 bp, Homo sapiens
tccaacaacaacaaca

SEQ ID NO: 26664 - DNA, 25 bp, Homo sapiens
ttatgccggtatttagaaaaaataa

SEQ ID NO: 26665 - DNA, 19 bp, Homo sapiens
agcgctgtaaagcaccaac

SEQ ID NO: 26666 - DNA, 18 bp, Homo sapiens
cagttctaccttttatct

SEQ ID NO: 26667 - DNA, 19 bp, Homo sapiens
cctgcgccaccacaaccag

SEQ ID NO: 26668 - DNA, 16 bp, Homo sapiens
cagagagcagcactta

SEQ ID NO: 26669 - DNA, 20 bp, Homo sapiens
gcacacaacagaaccatagg

SEQ ID NO: 26670 - DNA, 20 bp, Homo sapiens
caaattcccccagcatctca

SEQ ID NO: 26671 - DNA, 21 bp, Homo sapiens
cctcccccaacccacgctcca

SEQ ID NO: 26672 - DNA, 18 bp, Homo sapiens
cctgcaacctccacctcc

SEQ ID NO: 26673 - DNA, 19 bp, Homo sapiens
ctgcaacctccacctccca

SEQ ID NO: 26674 - DNA, 21 bp, Homo sapiens
gctggaaccatttctcccgca

SEQ ID NO: 26675 - DNA, 18 bp, Homo sapiens
tccacctcccaggttcaa

SEQ ID NO: 26676 - DNA, 23 bp, Homo sapiens
tccagcccctctgtcaccccgcc

SEQ ID NO: 26677 - DNA, 23 bp, Homo sapiens
tccatatctgttcctctgttcct

SEQ ID NO: 26678 - DNA, 20 bp, Homo sapiens
tggccaggctggtcttgaac

SEQ ID NO: 26679 - DNA, 19 bp, Homo sapiens
catctgtctgccactgaga

SEQ ID NO: 26680 - DNA, 20 bp, Homo sapiens
ccaaagtgggaggcagggag

SEQ ID NO: 26681 - DNA, 23 bp, Homo sapiens
cccaatagggtgggggcctgtgg

SEQ ID NO: 26682 - DNA, 17 bp, Homo sapiens
gcctgctgagagaagcc

SEQ ID NO: 26683 - DNA, 17 bp, Homo sapiens
tcaagtgattctcctgc

SEQ ID NO: 26684 - DNA, 24 bp, Homo sapiens
tcttgaaagctgggggatgtgtgg

SEQ ID NO: 26685 - DNA, 20 bp, Homo sapiens
tggtcaggctggtcttgaac

SEQ ID NO: 26686 - DNA, 21 bp, Homo sapiens
tttgggagtgtgtgtctgttt

SEQ ID NO: 26687 - DNA, 20 bp, Homo sapiens
ggcgccttccgcgcaccggc

SEQ ID NO: 26688 - DNA, 18 bp, Homo sapiens
gagcaaagaacttgcaaa

SEQ ID NO: 26689 - DNA, 24 bp, Homo sapiens
gcgcagagctgggggcagccgggg

SEQ ID NO: 26690 - DNA, 18 bp, Homo sapiens
gctctccaaagcactttt

SEQ ID NO: 26691 - DNA, 19 bp, Homo sapiens
tttgcttgtctttgcccct

SEQ ID NO: 26692 - DNA, 19 bp, Homo sapiens
agaaacggattatgttgaa

SEQ ID NO: 26693 - DNA, 20 bp, Homo sapiens
gaacagaaacggattatgtt

SEQ ID NO: 26694 - DNA, 19 bp, Homo sapiens
gcagcttcaagtccgttga

SEQ ID NO: 26695 - DNA, 18 bp, Homo sapiens
acacatacatacacatac

SEQ ID NO: 26696 - DNA, 20 bp, Homo sapiens
ctgttgaggtgcccataaga

SEQ ID NO: 26697 - DNA, 20 bp, Homo sapiens
gccgcagcgcccggcccggg

SEQ ID NO: 26698 - DNA, 18 bp, Homo sapiens
aggatttatatctattca

SEQ ID NO: 26699 - DNA, 18 bp, Homo sapiens
gacccaaagatcatgata

SEQ ID NO: 26700 - DNA, 19 bp, Homo sapiens
ccgccaccgcctccacccc

SEQ ID NO: 26701 - DNA, 17 bp, Homo sapiens
ccgccgccccgccaccg

SEQ ID NO: 26702 - DNA, 23 bp, Homo sapiens
gcccaccaccaccttcccggtga

SEQ ID NO: 26703 - DNA, 18 bp, Homo sapiens
ttctcttcaacggtttca

SEQ ID NO: 26704 - DNA, 18 bp, Homo sapiens
gggttttggggtttcgtt

SEQ ID NO: 26705 - DNA, 19 bp, Homo sapiens
tctggctgagagctgtgga

SEQ ID NO: 26706 - DNA, 23 bp, Homo sapiens
tcaccaaagagcactcgatcctg

SEQ ID NO: 26707 - DNA, 16 bp, Homo sapiens
gcatccacctctgtgg

SEQ ID NO: 26708 - DNA, 17 bp, Homo sapiens
cccagaaaacagctcca

SEQ ID NO: 26709 - DNA, 20 bp, Homo sapiens
ctctggtgactgcctgcggg

SEQ ID NO: 26710 - DNA, 21 bp, Homo sapiens
gccctgcacccccgggagtca

SEQ ID NO: 26711 - DNA, 23 bp, Homo sapiens
ggttgcagtgagcagttatcaca

SEQ ID NO: 26712 - DNA, 19 bp, Homo sapiens
tccctaccaagccttcggc

SEQ ID NO: 26713 - DNA, 22 bp, Homo sapiens
gtcagttgccgctgttgctact

SEQ ID NO: 26714 - DNA, 20 bp, Homo sapiens
gagttgatccatctgagaaa

SEQ ID NO: 26715 - DNA, 19 bp, Homo sapiens
atagatgtatattattttg

SEQ ID NO: 26716 - DNA, 27 bp, Homo sapiens
atctggacaatggggactgtttagttt

SEQ ID NO: 26717 - DNA, 18 bp, Homo sapiens
attcaagtggtctaatgg

SEQ ID NO: 26718 - DNA, 17 bp, Homo sapiens
cagctgcaccgtgcggc

SEQ ID NO: 26719 - DNA, 19 bp, Homo sapiens
catgtaaggacgtgtcagg

SEQ ID NO: 26720 - DNA, 19 bp, Homo sapiens
ccaaggaacccggctaccc

SEQ ID NO: 26721 - DNA, 27 bp, Homo sapiens
ctctaccatggccgactcctctgtaaa

SEQ ID NO: 26722 - DNA, 19 bp, Homo sapiens
ccgccctacttccacctcc

SEQ ID NO: 26723 - DNA, 18 bp, Homo sapiens
cattctgaggtcattttt

SEQ ID NO: 26724 - DNA, 18 bp, Homo sapiens
gacaggacctagatctaa

SEQ ID NO: 26725 - DNA, 20 bp, Homo sapiens
gcggctgtccctgtgtgaca

SEQ ID NO: 26726 - DNA, 24 bp, Homo sapiens
ctaataacatcttgagttattttt

SEQ ID NO: 26727 - DNA, 18 bp, Homo sapiens
aggagtgatgttggaata

SEQ ID NO: 26728 - DNA, 22 bp, Homo sapiens
gagccaagactgtgccactgca

SEQ ID NO: 26729 - DNA, 24 bp, Homo sapiens
gcttgaagcaaagacctctggttt

SEQ ID NO: 26730 - DNA, 19 bp, Homo sapiens
tgggtggatcacttgaggc

SEQ ID NO: 26731 - DNA, 17 bp, Homo sapiens
cctccaacttgacatca

SEQ ID NO: 26732 - DNA, 19 bp, Homo sapiens
gcctctggcccaggagtta

SEQ ID NO: 26733 - DNA, 22 bp, Homo sapiens
ggcccgcgggtaaccacctcct

SEQ ID NO: 26734 - DNA, 18 bp, Homo sapiens
tcacaggccttgccatct

SEQ ID NO: 26735 - DNA, 21 bp, Homo sapiens
aggtgtttttggatgagacta

SEQ ID NO: 26736 - DNA, 20 bp, Homo sapiens
aagattcacaatgatatggt

SEQ ID NO: 26737 - DNA, 24 bp, Homo sapiens
acatctgatttgtttatcacctta

SEQ ID NO: 26738 - DNA, 18 bp, Homo sapiens
catatgtatgtatttata

SEQ ID NO: 26739 - DNA, 20 bp, Homo sapiens
gctttagttttaacaacagt

SEQ ID NO: 26740 - DNA, 23 bp, Homo sapiens
tcttttcaccaaaccctgacttt

SEQ ID NO: 26741 - DNA, 24 bp, Homo sapiens
ccctggtgacacctggaccttgga

SEQ ID NO: 26742 - DNA, 20 bp, Homo sapiens
gagttggacacaagatccaa

SEQ ID NO: 26743 - DNA, 22 bp, Homo sapiens
ggcagaggcctcaggaaccagc

SEQ ID NO: 26744 - DNA, 23 bp, Homo sapiens
tgggtgggccctgatccaagctg

SEQ ID NO: 26745 - DNA, 28 bp, Homo sapiens
ttatgccctctgtttcgataggaagctg

SEQ ID NO: 26746 - DNA, 17 bp, Homo sapiens
agaaatgaaccaccgca

SEQ ID NO: 26747 - DNA, 26 bp, Homo sapiens
agaccagcgcccgaaggccgacacgc

SEQ ID NO: 26748 - DNA, 21 bp, Homo sapiens
cctggcacacagcaggagcca

SEQ ID NO: 26749 - DNA, 19 bp, Homo sapiens
ggttatccagatgaggcta

SEQ ID NO: 26750 - DNA, 18 bp, Homo sapiens
agaataaattatatttca

SEQ ID NO: 26751 - DNA, 20 bp, Homo sapiens
attatgtacattactgggtt

SEQ ID NO: 26752 - DNA, 26 bp, Homo sapiens
cctaatgtgaagttttaatcactttt

SEQ ID NO: 26753 - DNA, 22 bp, Homo sapiens
tgttgcccaggctgtctttgaa

SEQ ID NO: 26754 - DNA, 17 bp, Homo sapiens
gaaccgaggcgcaggga

SEQ ID NO: 26755 - DNA, 25 bp, Homo sapiens
gtgggatcggttatcggtgcgctct

SEQ ID NO: 26756 - DNA, 24 bp, Homo sapiens
ctgcacccatcaacctgtcaccta

SEQ ID NO: 26757 - DNA, 19 bp, Homo sapiens
aggaatacagcatccttct

SEQ ID NO: 26758 - DNA, 18 bp, Homo sapiens
cctaaggaatactacaca

SEQ ID NO: 26759 - DNA, 17 bp, Homo sapiens
gcaggacctttgtaggt

SEQ ID NO: 26760 - DNA, 20 bp, Homo sapiens
tttttgtgtgttttaatctt

SEQ ID NO: 26761 - DNA, 18 bp, Homo sapiens
tccggcctgaatgatctc

SEQ ID NO: 26762 - DNA, 19 bp, Homo sapiens
tccccacgggcctgcagca

SEQ ID NO: 26763 - DNA, 18 bp, Homo sapiens
ggggcagaacccctctta

SEQ ID NO: 26764 - DNA, 25 bp, Homo sapiens
ggccgtcccaaaagcggccgcttcc

SEQ ID NO: 26765 - DNA, 21 bp, Homo sapiens
aaatgtcaagaagaacatcca

SEQ ID NO: 26766 - DNA, 17 bp, Homo sapiens
aactgggtgtctgtaca

SEQ ID NO: 26767 - DNA, 18 bp, Homo sapiens
atgtttaacggtgccaac

SEQ ID NO: 26768 - DNA, 19 bp, Homo sapiens
cgaggacagtcttgaaata

SEQ ID NO: 26769 - DNA, 17 bp, Homo sapiens
gcactatctatctttct

SEQ ID NO: 26770 - DNA, 19 bp, Homo sapiens
gccgttctgtgcttttccg

SEQ ID NO: 26771 - DNA, 20 bp, Homo sapiens
tagttttgtgacttaattac

SEQ ID NO: 26772 - DNA, 20 bp, Homo sapiens
tttatgtcaacaatattaat

SEQ ID NO: 26773 - DNA, 21 bp, Homo sapiens
cccacctccaacacctcctga

SEQ ID NO: 26774 - DNA, 26 bp, Homo sapiens
ccccatttctagaacatccctgccag

SEQ ID NO: 26775 - DNA, 24 bp, Homo sapiens
cccttgcagttctgggaactggac

SEQ ID NO: 26776 - DNA, 23 bp, Homo sapiens
gggaagtgtaagaaacacactga

SEQ ID NO: 26777 - DNA, 21 bp, Homo sapiens
ggggaaggaggctggcttgtc

SEQ ID NO: 26778 - DNA, 22 bp, Homo sapiens
tccaggggatgggaggttgtgg

SEQ ID NO: 26779 - DNA, 25 bp, Homo sapiens
tggatgctccttccaacaggagctg

SEQ ID NO: 26780 - DNA, 25 bp, Homo sapiens
cctgtggtactcatgctgttccact

SEQ ID NO: 26781 - DNA, 21 bp, Homo sapiens
cggtgaaaccccatctccact

SEQ ID NO: 26782 - DNA, 18 bp, Homo sapiens
tgggtggatcacctgagg

SEQ ID NO: 26783 - DNA, 18 bp, Homo sapiens
aaatggttagtgctattg

SEQ ID NO: 26784 - DNA, 18 bp, Homo sapiens
aagcagttcaagttgaca

SEQ ID NO: 26785 - DNA, 19 bp, Homo sapiens
aataacaacaagaatatca

SEQ ID NO: 26786 - DNA, 22 bp, Homo sapiens
accaaaaaattgcaatttgttt

SEQ ID NO: 26787 - DNA, 24 bp, Homo sapiens
agaaataaagctgtatctgccatt

SEQ ID NO: 26788 - DNA, 20 bp, Homo sapiens
caacctatttctctactctt

SEQ ID NO: 26789 - DNA, 21 bp, Homo sapiens
caaggggtattagcccagtta

SEQ ID NO: 26790 - DNA, 16 bp, Homo sapiens
ccgggaaaacatggga

SEQ ID NO: 26791 - DNA, 20 bp, Homo sapiens
gcatactggttttccaggtg

SEQ ID NO: 26792 - DNA, 19 bp, Homo sapiens
gtattttttgttgttttta

SEQ ID NO: 26793 - DNA, 20 bp, Homo sapiens
tcaaacagaattttaaggaa

SEQ ID NO: 26794 - DNA, 22 bp, Homo sapiens
tcctctgtgatatcatacagca

SEQ ID NO: 26795 - DNA, 19 bp, Homo sapiens
ttctgattatcagatttgt

SEQ ID NO: 26796 - DNA, 21 bp, Homo sapiens
ttgtttgtgtctctctgctgt

SEQ ID NO: 26797 - DNA, 19 bp, Homo sapiens
tttcttacactaaccgtca

SEQ ID NO: 26798 - DNA, 18 bp, Homo sapiens
aaatggttagtgctattg

SEQ ID NO: 26799 - DNA, 18 bp, Homo sapiens
aagcagttcaagttgaca

SEQ ID NO: 26800 - DNA, 19 bp, Homo sapiens
aataacaacaagaatatca

SEQ ID NO: 26801 - DNA, 22 bp, Homo sapiens
accaaaaaattgcaatttgttt

SEQ ID NO: 26802 - DNA, 24 bp, Homo sapiens
agaaataaagctgtatctgccatt

SEQ ID NO: 26803 - DNA, 20 bp, Homo sapiens
caacctatttctctactctt

SEQ ID NO: 26804 - DNA, 21 bp, Homo sapiens
caaggggtattagcccagtta

SEQ ID NO: 26805 - DNA, 16 bp, Homo sapiens
ccgggaaaacatggga

SEQ ID NO: 26806 - DNA, 20 bp, Homo sapiens
gcatactggttttccaggtg

SEQ ID NO: 26807 - DNA, 19 bp, Homo sapiens
gtattttttgttgttttta

SEQ ID NO: 26808 - DNA, 20 bp, Homo sapiens
tcaaacagaattttaaggaa

SEQ ID NO: 26809 - DNA, 22 bp, Homo sapiens
tcctctgtgatatcatacagca

SEQ ID NO: 26810 - DNA, 19 bp, Homo sapiens
ttctgattatcagatttgt

SEQ ID NO: 26811 - DNA, 21 bp, Homo sapiens
ttgtttgtgtctctctgctgt

SEQ ID NO: 26812 - DNA, 19 bp, Homo sapiens
tttcttacactaaccgtca

SEQ ID NO: 26813 - DNA, 25 bp, Homo sapiens
cctgtggtactcatgctgttccact

SEQ ID NO: 26814 - DNA, 21 bp, Homo sapiens
tggtgaaaccccatctccact

SEQ ID NO: 26815 - DNA, 25 bp, Homo sapiens
cctgtggtactcatgctgttccact

SEQ ID NO: 26816 - DNA, 21 bp, Homo sapiens
tggtgaaaccccatctccact

SEQ ID NO: 26817 - DNA, 18 bp, Homo sapiens
aaatggttagtgctattg

SEQ ID NO: 26818 - DNA, 18 bp, Homo sapiens
aagcagttcaagttgaca

SEQ ID NO: 26819 - DNA, 19 bp, Homo sapiens
aataacaacaagaatatca

SEQ ID NO: 26820 - DNA, 22 bp, Homo sapiens
accaaaaaattgcaatttgttt

SEQ ID NO: 26821 - DNA, 24 bp, Homo sapiens
agaaataaaactgtatctgacatt

SEQ ID NO: 26822 - DNA, 20 bp, Homo sapiens
caacctatttctctactctt

SEQ ID NO: 26823 - DNA, 21 bp, Homo sapiens
caaggggtattagcccagtta

SEQ ID NO: 26824 - DNA, 20 bp, Homo sapiens
gcatactggttttccaggtg

SEQ ID NO: 26825 - DNA, 19 bp, Homo sapiens
gtattttttgttgttttta

SEQ ID NO: 26826 - DNA, 20 bp, Homo sapiens
tcaaacagaattttaaggaa

SEQ ID NO: 26827 - DNA, 24 bp, Homo sapiens
tcctcatatctggaaacttgtgaa

SEQ ID NO: 26828 - DNA, 22 bp, Homo sapiens
tcctctgtgatatcatacagca

SEQ ID NO: 26829 - DNA, 19 bp, Homo sapiens
ttctgattatcagatttgt

SEQ ID NO: 26830 - DNA, 21 bp, Homo sapiens
ttgtttgtgtctctctgctgt

SEQ ID NO: 26831 - DNA, 19 bp, Homo sapiens
tttcttacactaaccgtca

SEQ ID NO: 26832 - DNA, 17 bp, Homo sapiens
aaaatgtcaaggaatga

SEQ ID NO: 26833 - DNA, 19 bp, Homo sapiens
tattgcctctttcacattg

SEQ ID NO: 26834 - DNA, 24 bp, Homo sapiens
ttctgacccatgggagatttggag

SEQ ID NO: 26835 - DNA, 17 bp, Homo sapiens
aaaatgtcaaggaatga

SEQ ID NO: 26836 - DNA, 19 bp, Homo sapiens
tattgcctctttcacattg

SEQ ID NO: 26837 - DNA, 24 bp, Homo sapiens
aagttgttgatcagacccttctct

SEQ ID NO: 26838 - DNA, 18 bp, Homo sapiens
cactcagaagctaacctc

SEQ ID NO: 26839 - DNA, 20 bp, Homo sapiens
ctgaacctgtggtcaggctc

SEQ ID NO: 26840 - DNA, 17 bp, Homo sapiens
gggagacgagagggtca

SEQ ID NO: 26841 - DNA, 18 bp, Homo sapiens
ttcaagttgttgatcaga

SEQ ID NO: 26842 - DNA, 24 bp, Homo sapiens
aagttgttgatcagacccttctct

SEQ ID NO: 26843 - DNA, 18 bp, Homo sapiens
cactcagaagctaacctc

SEQ ID NO: 26844 - DNA, 20 bp, Homo sapiens
ctgaacctgtggtcaggctc

SEQ ID NO: 26845 - DNA, 17 bp, Homo sapiens
gggagacgagagggtca

SEQ ID NO: 26846 - DNA, 18 bp, Homo sapiens
ttcaagttgttgatcaga

SEQ ID NO: 26847 - DNA, 24 bp, Homo sapiens
aagttgttgatcagacccttctct

SEQ ID NO: 26848 - DNA, 18 bp, Homo sapiens
cactcagaagctaacctc

SEQ ID NO: 26849 - DNA, 20 bp, Homo sapiens
ctgaacctgtggtcaggctc

SEQ ID NO: 26850 - DNA, 17 bp, Homo sapiens
gggagacgagagggtca

SEQ ID NO: 26851 - DNA, 18 bp, Homo sapiens
ttcaagttgttgatcaga

SEQ ID NO: 26852 - DNA, 19 bp, Homo sapiens
atgttattgttttcaacct

SEQ ID NO: 26853 - DNA, 17 bp, Homo sapiens
gtgaagttgtaaacaca

SEQ ID NO: 26854 - DNA, 18 bp, Homo sapiens
tccccatcatccacgcca

SEQ ID NO: 26855 - DNA, 18 bp, Homo sapiens
tcctgacctcatgatcca

SEQ ID NO: 26856 - DNA, 18 bp, Homo sapiens
ttctcctgcctcagcctt

SEQ ID NO: 26857 - DNA, 19 bp, Homo sapiens
atgttattgttttcaacct

SEQ ID NO: 26858 - DNA, 17 bp, Homo sapiens
gtgaagttgtaaacaca

SEQ ID NO: 26859 - DNA, 18 bp, Homo sapiens
tccccatcatccacgcca

SEQ ID NO: 26860 - DNA, 18 bp, Homo sapiens
tcctgacctcatgatcca

SEQ ID NO: 26861 - DNA, 18 bp, Homo sapiens
ttctcctgcctcagcctt

SEQ ID NO: 26862 - DNA, 19 bp, Homo sapiens
atgttattgttttcaacct

SEQ ID NO: 26863 - DNA, 17 bp, Homo sapiens
gtgaagttgtaaacaca

SEQ ID NO: 26864 - DNA, 18 bp, Homo sapiens
tccccatcatccacgcca

SEQ ID NO: 26865 - DNA, 18 bp, Homo sapiens
tcctgacctcatgatcca

SEQ ID NO: 26866 - DNA, 18 bp, Homo sapiens
ttctcctgcctcagcctt

SEQ ID NO: 26867 - DNA, 18 bp, Homo sapiens
gagaatgtgatttttggc

SEQ ID NO: 26868 - DNA, 22 bp, Homo sapiens
gccgcgccgtgccgcctggccc

SEQ ID NO: 26869 - DNA, 25 bp, Homo sapiens
gcgggaggatgggggctacaccttc

SEQ ID NO: 26870 - DNA, 20 bp, Homo sapiens
gtctggctggccaacgggga

SEQ ID NO: 26871 - DNA, 18 bp, Homo sapiens
tccaacgagagcacccgc

SEQ ID NO: 26872 - DNA, 17 bp, Homo sapiens
gaaccactatgaagcta

SEQ ID NO: 26873 - DNA, 20 bp, Homo sapiens
tctgtattgaaaatggcttt

SEQ ID NO: 26874 - DNA, 23 bp, Homo sapiens
gcttgggcacagtgccctggctc

SEQ ID NO: 26875 - DNA, 19 bp, Homo sapiens
tgtctctccctgttcagct

SEQ ID NO: 26876 - DNA, 19 bp, Homo sapiens
tcagttgtgtatttgttca

SEQ ID NO: 26877 - DNA, 20 bp, Homo sapiens
tcctagaaaaggtcagaccc

SEQ ID NO: 26878 - DNA, 17 bp, Homo sapiens
catcacccacctctgga

SEQ ID NO: 26879 - DNA, 16 bp, Homo sapiens
cccacccctccctgca

SEQ ID NO: 26880 - DNA, 17 bp, Homo sapiens
gccctcagcagaacttc

SEQ ID NO: 26881 - DNA, 20 bp, Homo sapiens
ggtggatggagaagaggttg

SEQ ID NO: 26882 - DNA, 21 bp, Homo sapiens
ttgaaaattaatcgccaccct

SEQ ID NO: 26883 - DNA, 25 bp, Homo sapiens
ccacttttacttttcgtccaaataa

SEQ ID NO: 26884 - DNA, 21 bp, Homo sapiens
ctacaagaagctaggctctgt

SEQ ID NO: 26885 - DNA, 21 bp, Homo sapiens
ctgtgaattaaagagcagagt

SEQ ID NO: 26886 - DNA, 20 bp, Homo sapiens
gcctctgtcccccagtgatc

SEQ ID NO: 26887 - DNA, 25 bp, Homo sapiens
ccacttttacttttcgtccaaataa

SEQ ID NO: 26888 - DNA, 21 bp, Homo sapiens
ctacaagaagctaggctctgt

SEQ ID NO: 26889 - DNA, 21 bp, Homo sapiens
ctgtgaattaaagagcagagt

SEQ ID NO: 26890 - DNA, 20 bp, Homo sapiens
gcctctgtcccccagtgatc

SEQ ID NO: 26891 - DNA, 21 bp, Homo sapiens
aaggaataagaagttacctac

SEQ ID NO: 26892 - DNA, 21 bp, Homo sapiens
aaggaataagaagttacctac

SEQ ID NO: 26893 - DNA, 25 bp, Homo sapiens
aaggagactccaccctggggtccca

SEQ ID NO: 26894 - DNA, 18 bp, Homo sapiens
tgcagatttcttgctgct

SEQ ID NO: 26895 - DNA, 25 bp, Homo sapiens
aaggagactccaccctggggtccca

SEQ ID NO: 26896 - DNA, 18 bp, Homo sapiens
tgcagatttcttgctgct

SEQ ID NO: 26897 - DNA, 23 bp, Homo sapiens
gtttttactttctgttgccacaa

SEQ ID NO: 26898 - DNA, 26 bp, Homo sapiens
ggatgttggccaccaggtgcctttca

SEQ ID NO: 26899 - DNA, 18 bp, Homo sapiens
gtgcacactaccttccca

SEQ ID NO: 26900 - DNA, 17 bp, Homo sapiens
tcacttgtaccccacta

SEQ ID NO: 26901 - DNA, 20 bp, Homo sapiens
atcccgcagtataggcttaa

SEQ ID NO: 26902 - DNA, 26 bp, Homo sapiens
ccgcagtataggcttaagtcactttt

SEQ ID NO: 26903 - DNA, 24 bp, Homo sapiens
gaaaattgtgggaatcccccctca

SEQ ID NO: 26904 - DNA, 23 bp, Homo sapiens
gtagaagaaacagagtttttgtt

SEQ ID NO: 26905 - DNA, 19 bp, Homo sapiens
tctgcctatgttgcactct

SEQ ID NO: 26906 - DNA, 23 bp, Homo sapiens
cagccaggggtccagagctagcc

SEQ ID NO: 26907 - DNA, 22 bp, Homo sapiens
ctctttctctcctgcagtcccg

SEQ ID NO: 26908 - DNA, 21 bp, Homo sapiens
ctgcctgccccacctgcctca

SEQ ID NO: 26909 - DNA, 16 bp, Homo sapiens
gacgggtcctttggta

SEQ ID NO: 26910 - DNA, 19 bp, Homo sapiens
gcctctcctcgaaaagtca

SEQ ID NO: 26911 - DNA, 23 bp, Homo sapiens
tgccttcctccccaagcacctca

SEQ ID NO: 26912 - DNA, 23 bp, Homo sapiens
cagccaggggtccagagctagcc

SEQ ID NO: 26913 - DNA, 22 bp, Homo sapiens
ctctttctctcctgcagtcccg

SEQ ID NO: 26914 - DNA, 21 bp, Homo sapiens
ctgcctgccccacctgcctca

SEQ ID NO: 26915 - DNA, 21 bp, Homo sapiens
agctttgagcactgcactgtt

SEQ ID NO: 26916 - DNA, 21 bp, Homo sapiens
aacaggaagcccagagagggc

SEQ ID NO: 26917 - DNA, 19 bp, Homo sapiens
acccacagcttgctcttct

SEQ ID NO: 26918 - DNA, 22 bp, Homo sapiens
atctatgtctgctgcctggctc

SEQ ID NO: 26919 - DNA, 18 bp, Homo sapiens
cctgccccctccacttcc

SEQ ID NO: 26920 - DNA, 22 bp, Homo sapiens
gcgcagagcgaggggcggctgg

SEQ ID NO: 26921 - DNA, 18 bp, Homo sapiens
tccagaacaagtccctcc

SEQ ID NO: 26922 - DNA, 21 bp, Homo sapiens
gccactgctgctggcggattt

SEQ ID NO: 26923 - DNA, 25 bp, Homo sapiens
acaggctcacactgcccttacttta

SEQ ID NO: 26924 - DNA, 22 bp, Homo sapiens
tagatggaggaggtgtgggctg

SEQ ID NO: 26925 - DNA, 21 bp, Homo sapiens
tttgggcagtagatttacttt

SEQ ID NO: 26926 - DNA, 19 bp, Homo sapiens
aagcaattctcctgcctca

SEQ ID NO: 26927 - DNA, 16 bp, Homo sapiens
tttgggacaaaactgt

SEQ ID NO: 26928 - DNA, 19 bp, Homo sapiens
actaaaaatttacaagaga

SEQ ID NO: 26929 - DNA, 24 bp, Homo sapiens
tgggaagagtttagtgtgaaactg

SEQ ID NO: 26930 - DNA, 21 bp, Homo sapiens
cctcctggtggccttgccgcc

SEQ ID NO: 26931 - DNA, 21 bp, Homo sapiens
ccttggcgctggaccagtgag

SEQ ID NO: 26932 - DNA, 21 bp, Homo sapiens
tgagatcacttcaccgtggtc

SEQ ID NO: 26933 - DNA, 23 bp, Homo sapiens
aaaacaaagggcatgcccaaagc

SEQ ID NO: 26934 - DNA, 18 bp, Homo sapiens
cctccaatgtggacattt

SEQ ID NO: 26935 - DNA, 16 bp, Homo sapiens
gtctgtggaactgaga

SEQ ID NO: 26936 - DNA, 16 bp, Homo sapiens
tttgggacaaaactgt

SEQ ID NO: 26937 - DNA, 16 bp, Homo sapiens
tttgggacaaaactgt

SEQ ID NO: 26938 - DNA, 23 bp, Homo sapiens
agtactttccagcctgtgtttca

SEQ ID NO: 26939 - DNA, 21 bp, Homo sapiens
atccttggcactactacaatg

SEQ ID NO: 26940 - DNA, 22 bp, Homo sapiens
caagcgccccagcaggcactgt

SEQ ID NO: 26941 - DNA, 25 bp, Homo sapiens
cacctctacttctgttcttccctca

SEQ ID NO: 26942 - DNA, 18 bp, Homo sapiens
cactgactagaatctgga

SEQ ID NO: 26943 - DNA, 23 bp, Homo sapiens
cccggcaagggcaggaattggga

SEQ ID NO: 26944 - DNA, 19 bp, Homo sapiens
ctccccttcctctgctcct

SEQ ID NO: 26945 - DNA, 18 bp, Homo sapiens
tgaagagacaattcaggg

SEQ ID NO: 26946 - DNA, 21 bp, Homo sapiens
tggaggagaccccgccagtgg

SEQ ID NO: 26947 - DNA, 17 bp, Homo sapiens
cccgcccagccagagct

SEQ ID NO: 26948 - DNA, 20 bp, Homo sapiens
catgcactggaatgcgggga

SEQ ID NO: 26949 - DNA, 21 bp, Homo sapiens
cctacccccaactttccccta

SEQ ID NO: 26950 - DNA, 17 bp, Homo sapiens
cctggtttcccatctct

SEQ ID NO: 26951 - DNA, 25 bp, Homo sapiens
ctggtcattgggctgatcattgcca

SEQ ID NO: 26952 - DNA, 21 bp, Homo sapiens
gcggtttcccaagcctttgtc

SEQ ID NO: 26953 - DNA, 18 bp, Homo sapiens
taattccaaatgctgtta

SEQ ID NO: 26954 - DNA, 20 bp, Homo sapiens
ttgccatcacagagacacag

SEQ ID NO: 26955 - DNA, 24 bp, Homo sapiens
aaacattataattaaatttctgaa

SEQ ID NO: 26956 - DNA, 16 bp, Homo sapiens
acaaaagtaggctaga

SEQ ID NO: 26957 - DNA, 19 bp, Homo sapiens
caagaaaatcacaacttga

SEQ ID NO: 26958 - DNA, 25 bp, Homo sapiens
gaaactatagaaccaaaaaataaca

SEQ ID NO: 26959 - DNA, 21 bp, Homo sapiens
tgaagaaattaagaaaaccta

SEQ ID NO: 26960 - DNA, 22 bp, Homo sapiens
gtaaattacacctgcagtgcaa

SEQ ID NO: 26961 - DNA, 18 bp, Homo sapiens
aaagatatttgaaatttc

SEQ ID NO: 26962 - DNA, 20 bp, Homo sapiens
ctatcatgttaatactatta

SEQ ID NO: 26963 - DNA, 19 bp, Homo sapiens
accttggctgacttggctc

SEQ ID NO: 26964 - DNA, 19 bp, Homo sapiens
ccggggctgaagccacaca

SEQ ID NO: 26965 - DNA, 19 bp, Homo sapiens
gcccccatcttgggggtca

SEQ ID NO: 26966 - DNA, 15 bp, Homo sapiens
tcctgctagcacctc

SEQ ID NO: 26967 - DNA, 23 bp, Homo sapiens
aggagaaacggctctacaggtca

SEQ ID NO: 26968 - DNA, 20 bp, Homo sapiens
atttatcgaattatcacgca

SEQ ID NO: 26969 - DNA, 21 bp, Homo sapiens
tgagatggtttttgtcaaaga

SEQ ID NO: 26970 - DNA, 21 bp, Homo sapiens
tcatggtaactactgaaccta

SEQ ID NO: 26971 - DNA, 19 bp, Homo sapiens
tggtcctagttttgtgcac

SEQ ID NO: 26972 - DNA, 18 bp, Homo sapiens
tctgaaggcaaaccaggt

SEQ ID NO: 26973 - DNA, 17 bp, Homo sapiens
ccccaaccccaagacca

SEQ ID NO: 26974 - DNA, 21 bp, Homo sapiens
ggcggggcgccccaagagccc

SEQ ID NO: 26975 - DNA, 22 bp, Homo sapiens
gggaggtttggggggcatcaac

SEQ ID NO: 26976 - DNA, 18 bp, Homo sapiens
aacacaaggtgggcaggg

SEQ ID NO: 26977 - DNA, 24 bp, Homo sapiens
ctctgagaaggggaggacctctgg

SEQ ID NO: 26978 - DNA, 23 bp, Homo sapiens
tgggcctcctctaacaggggctg

SEQ ID NO: 26979 - DNA, 22 bp, Homo sapiens
atttgataggatccatatctaa

SEQ ID NO: 26980 - DNA, 19 bp, Homo sapiens
attttttcttattgccttg

SEQ ID NO: 26981 - DNA, 21 bp, Homo sapiens
ccaaactacaccaattaattt

SEQ ID NO: 26982 - DNA, 18 bp, Homo sapiens
gccctatctgcacttttt

SEQ ID NO: 26983 - DNA, 17 bp, Homo sapiens
gttgtcaattgtggtaa

SEQ ID NO: 26984 - DNA, 20 bp, Homo sapiens
tctattgttcaattctctaa

SEQ ID NO: 26985 - DNA, 22 bp, Homo sapiens
tggccgtacaaattacatttca

SEQ ID NO: 26986 - DNA, 24 bp, Homo sapiens
aaagaaatccccccttcagaacag

SEQ ID NO: 26987 - DNA, 20 bp, Homo sapiens
ctgggtctgggtttggatct

SEQ ID NO: 26988 - DNA, 24 bp, Homo sapiens
aaagaaatccccccttcagaacag

SEQ ID NO: 26989 - DNA, 20 bp, Homo sapiens
ctgggtctgggtttggatct

SEQ ID NO: 26990 - DNA, 19 bp, Homo sapiens
aaaatcatcatcactataa

SEQ ID NO: 26991 - DNA, 24 bp, Homo sapiens
atcaatatgttttcaatgcctgat

SEQ ID NO: 26992 - DNA, 21 bp, Homo sapiens
ggttgttttgtggatttcttt

SEQ ID NO: 26993 - DNA, 19 bp, Homo sapiens
ccaggcaggggacgcacca

SEQ ID NO: 26994 - DNA, 21 bp, Homo sapiens
cctcctggtggccttgacgcc

SEQ ID NO: 26995 - DNA, 17 bp, Homo sapiens
aaatagctataatacct

SEQ ID NO: 26996 - DNA, 22 bp, Homo sapiens
actagtaaacatatgttcctaa

SEQ ID NO: 26997 - DNA, 23 bp, Homo sapiens
atcaatggtttaacagttatcca

SEQ ID NO: 26998 - DNA, 20 bp, Homo sapiens
caatccaactgtactggcca

SEQ ID NO: 26999 - DNA, 19 bp, Homo sapiens
cacatgcacacatgtgcca

SEQ ID NO: 27000 - DNA, 18 bp, Homo sapiens
catcagtatagtgtttta

SEQ ID NO: 27001 - DNA, 20 bp, Homo sapiens
ctgcacccaccaacctgtca

SEQ ID NO: 27002 - DNA, 19 bp, Homo sapiens
gtctgtcacacatgcacac

SEQ ID NO: 27003 - DNA, 20 bp, Homo sapiens
tatgactctctgctatccca

SEQ ID NO: 27004 - DNA, 23 bp, Homo sapiens
tctgcattgagcatattttctta

SEQ ID NO: 27005 - DNA, 17 bp, Homo sapiens
aaaaacaaacaaacaaa

SEQ ID NO: 27006 - DNA, 18 bp, Homo sapiens
aattccagtctgtgcatc

SEQ ID NO: 27007 - DNA, 18 bp, Homo sapiens
aattccagtctgtgcatc

SEQ ID NO: 27008 - DNA, 19 bp, Homo sapiens
aaaatcatcatcactataa

SEQ ID NO: 27009 - DNA, 24 bp, Homo sapiens
atcaatatgttttcaatgcctgat

SEQ ID NO: 27010 - DNA, 21 bp, Homo sapiens
ggttgttttgtggatttcttt

SEQ ID NO: 27011 - DNA, 17 bp, Homo sapiens
acacaccactttcctga

SEQ ID NO: 27012 - DNA, 17 bp, Homo sapiens
ctgggtgctgctggcct

SEQ ID NO: 27013 - DNA, 23 bp, Homo sapiens
gaaacacatcaaaataaataatg

SEQ ID NO: 27014 - DNA, 23 bp, Homo sapiens
tctggcgtctgacccttcagtgc

SEQ ID NO: 27015 - DNA, 19 bp, Homo sapiens
aaagaaattaataggacca

SEQ ID NO: 27016 - DNA, 17 bp, Homo sapiens
aagaaattaataggacc

SEQ ID NO: 27017 - DNA, 18 bp, Homo sapiens
attttacctgtttttggt

SEQ ID NO: 27018 - DNA, 19 bp, Homo sapiens
aaagaaattaataggacca

SEQ ID NO: 27019 - DNA, 17 bp, Homo sapiens
aagaaattaataggacc

SEQ ID NO: 27020 - DNA, 18 bp, Homo sapiens
attttacctgtttttggt

SEQ ID NO: 27021 - DNA, 15 bp, Homo sapiens
agagggggcgggaca

SEQ ID NO: 27022 - DNA, 20 bp, Homo sapiens
catgaagtcactgattagtt

SEQ ID NO: 27023 - DNA, 18 bp, Homo sapiens
gtcccttgtttttgatca

SEQ ID NO: 27024 - DNA, 17 bp, Homo sapiens
tcgacttgaaccactcc

SEQ ID NO: 27025 - DNA, 15 bp, Homo sapiens
agagggggcgggaca

SEQ ID NO: 27026 - DNA, 19 bp, Homo sapiens
agccacactcctggcatcc

SEQ ID NO: 27027 - DNA, 20 bp, Homo sapiens
catgaagtcactgattagtt

SEQ ID NO: 27028 - DNA, 18 bp, Homo sapiens
gtcccttgtttttgatca

SEQ ID NO: 27029 - DNA, 17 bp, Homo sapiens
tcgacttgaaccactcc

SEQ ID NO: 27030 - DNA, 15 bp, Homo sapiens
agagggggcgggaca

SEQ ID NO: 27031 - DNA, 19 bp, Homo sapiens
agccacactcctggcatcc

SEQ ID NO: 27032 - DNA, 20 bp, Homo sapiens
catgaagtcactgattagtt

SEQ ID NO: 27033 - DNA, 18 bp, Homo sapiens
gtcccttgtttttgatca

SEQ ID NO: 27034 - DNA, 17 bp, Homo sapiens
tcgacttgaaccactcc

SEQ ID NO: 27035 - DNA, 15 bp, Homo sapiens
agagggggcgggaca

SEQ ID NO: 27036 - DNA, 19 bp, Homo sapiens
agccacactcctggcatcc

SEQ ID NO: 27037 - DNA, 20 bp, Homo sapiens
catgaagtcactgattagtt

SEQ ID NO: 27038 - DNA, 18 bp, Homo sapiens
gtcccttgtttttgatca

SEQ ID NO: 27039 - DNA, 17 bp, Homo sapiens
tcgacttgaaccactcc

SEQ ID NO: 27040 - DNA, 20 bp, Homo sapiens
cgcatgcgtcttcgtgccgt

SEQ ID NO: 27041 - DNA, 21 bp, Homo sapiens
ggtagatggggagcaggattg

SEQ ID NO: 27042 - DNA, 18 bp, Homo sapiens
ggtggggttaggttccca

SEQ ID NO: 27043 - DNA, 23 bp, Homo sapiens
tagatgggtaccaggtggggtta

SEQ ID NO: 27044 - DNA, 21 bp, Homo sapiens
tgctcccagtctctcgctctg

SEQ ID NO: 27045 - DNA, 21 bp, Homo sapiens
cctcctggtggccttgccgcc

SEQ ID NO: 27046 - DNA, 21 bp, Homo sapiens
ccttggcgctggaccagtgag

SEQ ID NO: 27047 - DNA, 19 bp, Homo sapiens
cagggaagcacctggctca

SEQ ID NO: 27048 - DNA, 21 bp, Homo sapiens
ccttcctcctacctcttccca

SEQ ID NO: 27049 - DNA, 17 bp, Homo sapiens
ctggctcaatcatgtca

SEQ ID NO: 27050 - DNA, 18 bp, Homo sapiens
gtggtgttggcccattga

SEQ ID NO: 27051 - DNA, 15 bp, Homo sapiens
tggggtccttagatc

SEQ ID NO: 27052 - DNA, 19 bp, Homo sapiens
caatttgagcaccattctc

SEQ ID NO: 27053 - DNA, 22 bp, Homo sapiens
gcaagagccagacaggactttg

SEQ ID NO: 27054 - DNA, 21 bp, Homo sapiens
ggaaggggagaagccacattg

SEQ ID NO: 27055 - DNA, 19 bp, Homo sapiens
tgctccatccctcctctct

SEQ ID NO: 27056 - DNA, 16 bp, Homo sapiens
ttactctgtcattgcc

SEQ ID NO: 27057 - DNA, 23 bp, Homo sapiens
aacaggaagcctgcatgtgactg

SEQ ID NO: 27058 - DNA, 16 bp, Homo sapiens
catgttcttaactgct

SEQ ID NO: 27059 - DNA, 19 bp, Homo sapiens
cccagaaattgagcttcag

SEQ ID NO: 27060 - DNA, 17 bp, Homo sapiens
taaccctgcctgtacta

SEQ ID NO: 27061 - DNA, 22 bp, Homo sapiens
aataatgttattgagcaatgaa

SEQ ID NO: 27062 - DNA, 17 bp, Homo sapiens
attgaatgattaaacta

SEQ ID NO: 27063 - DNA, 23 bp, Homo sapiens
gcgcctctcccgcccctgtctcc

SEQ ID NO: 27064 - DNA, 22 bp, Homo sapiens
tctggattgtgcagactggtgc

SEQ ID NO: 27065 - DNA, 21 bp, Homo sapiens
aaaacacctctgtcaatgtaa

SEQ ID NO: 27066 - DNA, 21 bp, Homo sapiens
atcatggagctgagaatttca

SEQ ID NO: 27067 - DNA, 20 bp, Homo sapiens
cgcccgcatccccgcgccgc

SEQ ID NO: 27068 - DNA, 21 bp, Homo sapiens
gcgcagctacggcggcggcag

SEQ ID NO: 27069 - DNA, 23 bp, Homo sapiens
cggagcagctcagccctgcagtg

SEQ ID NO: 27070 - DNA, 23 bp, Homo sapiens
gccctcgggtgattatttggctc

SEQ ID NO: 27071 - DNA, 20 bp, Homo sapiens
tccgcgctcggagcagctca

SEQ ID NO: 27072 - DNA, 18 bp, Homo sapiens
ccaccccagtgcctgaga

SEQ ID NO: 27073 - DNA, 17 bp, Homo sapiens
tggccacactcccctac

SEQ ID NO: 27074 - DNA, 21 bp, Homo sapiens
ctctctctctctttctctctc

SEQ ID NO: 27075 - DNA, 21 bp, Homo sapiens
ctctttctctctctctgtctc

SEQ ID NO: 27076 - DNA, 21 bp, Homo sapiens
ccatactgcagccccatccca

SEQ ID NO: 27077 - DNA, 22 bp, Homo sapiens
ctctagtgtccccatctgtaaa

SEQ ID NO: 27078 - DNA, 19 bp, Homo sapiens
ggtgatgctggctacagcc

SEQ ID NO: 27079 - DNA, 21 bp, Homo sapiens
agcctcacagcgagcctcctg

SEQ ID NO: 27080 - DNA, 19 bp, Homo sapiens
gctgcatgcctggaccacc

SEQ ID NO: 27081 - DNA, 20 bp, Homo sapiens
ttctgtcacccttgcactct

SEQ ID NO: 27082 - DNA, 16 bp, Homo sapiens
ttgccctccccttctc

SEQ ID NO: 27083 - DNA, 21 bp, Homo sapiens
agcctcacagcgagcctcctg

SEQ ID NO: 27084 - DNA, 19 bp, Homo sapiens
gctgcatgcctggaccacc

SEQ ID NO: 27085 - DNA, 20 bp, Homo sapiens
ttctgtcacccttgcactct

SEQ ID NO: 27086 - DNA, 16 bp, Homo sapiens
ttgccctccccttctc

SEQ ID NO: 27087 - DNA, 22 bp, Homo sapiens
ttggtttcctggtggtatcata

SEQ ID NO: 27088 - DNA, 22 bp, Homo sapiens
cggggccaggctgggtccagca

SEQ ID NO: 27089 - DNA, 17 bp, Homo sapiens
aagcagtacggaagatg

SEQ ID NO: 27090 - DNA, 17 bp, Homo sapiens
agacatacttgctttaa

SEQ ID NO: 27091 - DNA, 20 bp, Homo sapiens
gatcctgaaagtcttgggga

SEQ ID NO: 27092 - DNA, 23 bp, Homo sapiens
gctgatcctgaaagtcttgggga

SEQ ID NO: 27093 - DNA, 22 bp, Homo sapiens
accagttccaaagtcagtaatt

SEQ ID NO: 27094 - DNA, 22 bp, Homo sapiens
ccccttttctttccagtgccca

SEQ ID NO: 27095 - DNA, 19 bp, Homo sapiens
cctcagggtggctgtgata

SEQ ID NO: 27096 - DNA, 23 bp, Homo sapiens
ccttccccaggggagcctgcgaa

SEQ ID NO: 27097 - DNA, 19 bp, Homo sapiens
gcaaaccctcagcagtcct

SEQ ID NO: 27098 - DNA, 24 bp, Homo sapiens
gcaatacgcctttccaatctttat

SEQ ID NO: 27099 - DNA, 17 bp, Homo sapiens
caggtacgcgccgccgc

SEQ ID NO: 27100 - DNA, 19 bp, Homo sapiens
tggcctcagtgtggcattg

SEQ ID NO: 27101 - DNA, 16 bp, Homo sapiens
aaacatgaaggactcc

SEQ ID NO: 27102 - DNA, 22 bp, Homo sapiens
agctacagaagttcagccatga

SEQ ID NO: 27103 - DNA, 20 bp, Homo sapiens
aggttgggattaccacacca

SEQ ID NO: 27104 - DNA, 17 bp, Homo sapiens
agtgagaaataagacct

SEQ ID NO: 27105 - DNA, 23 bp, Homo sapiens
caaaacattttataatatatatc

SEQ ID NO: 27106 - DNA, 17 bp, Homo sapiens
ccttccccgcgcacccc

SEQ ID NO: 27107 - DNA, 17 bp, Homo sapiens
ctttttcatacattgca

SEQ ID NO: 27108 - DNA, 21 bp, Homo sapiens
gcgcaccccgcacggcccggg

SEQ ID NO: 27109 - DNA, 19 bp, Homo sapiens
tatttctggaaacatatca

SEQ ID NO: 27110 - DNA, 20 bp, Homo sapiens
tctggcctctgtttccccca

SEQ ID NO: 27111 - DNA, 24 bp, Homo sapiens
tgtggtttctgcctaaaattggca

SEQ ID NO: 27112 - DNA, 22 bp, Homo sapiens
tgttcttctactggctgtgatg

SEQ ID NO: 27113 - DNA, 21 bp, Homo sapiens
ttcaggtacattaagctttag

SEQ ID NO: 27114 - DNA, 18 bp, Homo sapiens
atgtagtgacagtggcca

SEQ ID NO: 27115 - DNA, 17 bp, Homo sapiens
caagaacaaaactccat

SEQ ID NO: 27116 - DNA, 19 bp, Homo sapiens
cactgccccctgacgacct

SEQ ID NO: 27117 - DNA, 18 bp, Homo sapiens
cgtttcaatgtgaacttt

SEQ ID NO: 27118 - DNA, 22 bp, Homo sapiens
gagccaagatcatgccactgca

SEQ ID NO: 27119 - DNA, 20 bp, Homo sapiens
gtctcagtaggatactccat

SEQ ID NO: 27120 - DNA, 18 bp, Homo sapiens
gttttggaaacctataac

SEQ ID NO: 27121 - DNA, 17 bp, Homo sapiens
tacctgttgtttagcaa

SEQ ID NO: 27122 - DNA, 21 bp, Homo sapiens
tgaaacgaaacaaatgtaata

SEQ ID NO: 27123 - DNA, 18 bp, Homo sapiens
ctagaagaggcatcttca

SEQ ID NO: 27124 - DNA, 19 bp, Homo sapiens
ggatgacagtatggaactg

SEQ ID NO: 27125 - DNA, 22 bp, Homo sapiens
ttgatgacctcaatatgagttt

SEQ ID NO: 27126 - DNA, 17 bp, Homo sapiens
gggaaacaagtaaacca

SEQ ID NO: 27127 - DNA, 21 bp, Homo sapiens
gtgtctcagcctcctgagcag

SEQ ID NO: 27128 - DNA, 17 bp, Homo sapiens
atgtggggaaacatttt

SEQ ID NO: 27129 - DNA, 23 bp, Homo sapiens
cctaccagggctttcttggcttt

SEQ ID NO: 27130 - DNA, 19 bp, Homo sapiens
ccttcgtgcctcatggaat

SEQ ID NO: 27131 - DNA, 27 bp, Homo sapiens
ctctgtgtgtgtatgtgtgtgtttata

SEQ ID NO: 27132 - DNA, 18 bp, Homo sapiens
cttcttcaatttctttca

SEQ ID NO: 27133 - DNA, 26 bp, Homo sapiens
tgaatgggtttctatatatgggtctg

SEQ ID NO: 27134 - DNA, 20 bp, Homo sapiens
tccagccgagaccttttgat

SEQ ID NO: 27135 - DNA, 20 bp, Homo sapiens
tccagccgagaccttttgat

SEQ ID NO: 27136 - DNA, 20 bp, Homo sapiens
tccagccgagaccttttgat

SEQ ID NO: 27137 - DNA, 19 bp, Homo sapiens
aaaaacaaaaacaaacaaa

SEQ ID NO: 27138 - DNA, 19 bp, Homo sapiens
aataagtatcctactcaaa

SEQ ID NO: 27139 - DNA, 20 bp, Homo sapiens
ccaaaacctgtttgggaagc

SEQ ID NO: 27140 - DNA, 19 bp, Homo sapiens
cttggtttacccaagtcat

SEQ ID NO: 27141 - DNA, 18 bp, Homo sapiens
tgctattgatttctctct

SEQ ID NO: 27142 - DNA, 20 bp, Homo sapiens
cctatggcagaaggcaacca

SEQ ID NO: 27143 - DNA, 21 bp, Homo sapiens
acaaaagtcgggagcgccaca

SEQ ID NO: 27144 - DNA, 22 bp, Homo sapiens
acaaaattgtcatctatgtatc

SEQ ID NO: 27145 - DNA, 23 bp, Homo sapiens
agccaaggaatgtcttcccctga

SEQ ID NO: 27146 - DNA, 22 bp, Homo sapiens
agtagcacagaggtgtgttctg

SEQ ID NO: 27147 - DNA, 27 bp, Homo sapiens
cagggcgtccggggctgcgccacttcc

SEQ ID NO: 27148 - DNA, 19 bp, Homo sapiens
tcacaagttgctagaccaa

SEQ ID NO: 27149 - DNA, 19 bp, Homo sapiens
tcctgaactcacacaacaa

SEQ ID NO: 27150 - DNA, 19 bp, Homo sapiens
aaggctggcccctgctgca

SEQ ID NO: 27151 - DNA, 22 bp, Homo sapiens
ggagccccccgcccggcccctc

SEQ ID NO: 27152 - DNA, 22 bp, Homo sapiens
ggagccccccgcccggcccctc

SEQ ID NO: 27153 - DNA, 18 bp, Homo sapiens
aaacgatcactctggtgc

SEQ ID NO: 27154 - DNA, 21 bp, Homo sapiens
tctggtgcgggtgtttggttt

SEQ ID NO: 27155 - DNA, 18 bp, Homo sapiens
cggaataacttcctgcag

SEQ ID NO: 27156 - DNA, 22 bp, Homo sapiens
cttgttggacttccccactcca

SEQ ID NO: 27157 - DNA, 21 bp, Homo sapiens
gtgctgtccactaagcactgc

SEQ ID NO: 27158 - DNA, 18 bp, Homo sapiens
ttcaatcatccctatcca

SEQ ID NO: 27159 - DNA, 19 bp, Homo sapiens
agtgcgtgatgtggtatga

SEQ ID NO: 27160 - DNA, 19 bp, Homo sapiens
atcacatttaaacactgtt

SEQ ID NO: 27161 - DNA, 18 bp, Homo sapiens
atgaaactgtgtgtcaga

SEQ ID NO: 27162 - DNA, 19 bp, Homo sapiens
caaaattgcaaaagcctta

SEQ ID NO: 27163 - DNA, 24 bp, Homo sapiens
cagaagaattgaggatctgatgga

SEQ ID NO: 27164 - DNA, 19 bp, Homo sapiens
gcagccctactggaacaca

SEQ ID NO: 27165 - DNA, 21 bp, Homo sapiens
gtccttccctgtaacattgga

SEQ ID NO: 27166 - DNA, 23 bp, Homo sapiens
cccccaaccccaaactttcacca

SEQ ID NO: 27167 - DNA, 22 bp, Homo sapiens
ccctcctaggcccacttcctcc

SEQ ID NO: 27168 - DNA, 19 bp, Homo sapiens
cggaggagtctatactatc

SEQ ID NO: 27169 - DNA, 21 bp, Homo sapiens
ctctgactctagttctgcgga

SEQ ID NO: 27170 - DNA, 21 bp, Homo sapiens
ggaaggaggctggctggctca

SEQ ID NO: 27171 - DNA, 19 bp, Homo sapiens
taaaaaccacccaaacact

SEQ ID NO: 27172 - DNA, 23 bp, Homo sapiens
tagttatttacaacttttgctca

SEQ ID NO: 27173 - DNA, 20 bp, Homo sapiens
tcatgagcaacattaggcta

SEQ ID NO: 27174 - DNA, 18 bp, Homo sapiens
tccttctcccaggttcaa

SEQ ID NO: 27175 - DNA, 22 bp, Homo sapiens
tgcccagggtgccctgcctcag

SEQ ID NO: 27176 - DNA, 21 bp, Homo sapiens
tgggattataggcgtctgcca

SEQ ID NO: 27177 - DNA, 18 bp, Homo sapiens
ttagtactcagataataa

SEQ ID NO: 27178 - DNA, 17 bp, Homo sapiens
accaccatcattgtcta

SEQ ID NO: 27179 - DNA, 23 bp, Homo sapiens
agaagaatttctgttctcacacc

SEQ ID NO: 27180 - DNA, 18 bp, Homo sapiens
cacagacaaagagcccat

SEQ ID NO: 27181 - DNA, 18 bp, Homo sapiens
gcccggctgctacctctg

SEQ ID NO: 27182 - DNA, 19 bp, Homo sapiens
tcagctgccccttacttca

SEQ ID NO: 27183 - DNA, 21 bp, Homo sapiens
tgctgtctcctcaactcaacc

SEQ ID NO: 27184 - DNA, 17 bp, Homo sapiens
accaccatcattgtcta

SEQ ID NO: 27185 - DNA, 23 bp, Homo sapiens
agaagaatttctgttctcacacc

SEQ ID NO: 27186 - DNA, 18 bp, Homo sapiens
cacagacaaagagcccat

SEQ ID NO: 27187 - DNA, 18 bp, Homo sapiens
gcccggctgctacctctg

SEQ ID NO: 27188 - DNA, 19 bp, Homo sapiens
tcagctgccccttacttca

SEQ ID NO: 27189 - DNA, 21 bp, Homo sapiens
tgctgtctcctcaactcaacc

SEQ ID NO: 27190 - DNA, 16 bp, Homo sapiens
acagggagagttggtt

SEQ ID NO: 27191 - DNA, 21 bp, Homo sapiens
aaacagaaaccattctaggtg

SEQ ID NO: 27192 - DNA, 21 bp, Homo sapiens
aaacagaaaccattctaggtg

SEQ ID NO: 27193 - DNA, 21 bp, Homo sapiens
aaacagaaaccattctaggtg

SEQ ID NO: 27194 - DNA, 16 bp, Homo sapiens
actgaaaaactgggaa

SEQ ID NO: 27195 - DNA, 18 bp, Homo sapiens
ccccgagagagctggcca

SEQ ID NO: 27196 - DNA, 17 bp, Homo sapiens
ctctgggaagtggctgc

SEQ ID NO: 27197 - DNA, 18 bp, Homo sapiens
gtgtataaaacacagtgc

SEQ ID NO: 27198 - DNA, 17 bp, Homo sapiens
tccagaaattcctgcag

SEQ ID NO: 27199 - DNA, 21 bp, Homo sapiens
gccagttcccacagcacccca

SEQ ID NO: 27200 - DNA, 21 bp, Homo sapiens
gccagttcccacagcacccca

SEQ ID NO: 27201 - DNA, 16 bp, Homo sapiens
aataacactgtctcct

SEQ ID NO: 27202 - DNA, 19 bp, Homo sapiens
ccacccccttccctgctga

SEQ ID NO: 27203 - DNA, 16 bp, Homo sapiens
aataacactgtctcct

SEQ ID NO: 27204 - DNA, 16 bp, Homo sapiens
aataacactgtctcct

SEQ ID NO: 27205 - DNA, 18 bp, Homo sapiens
actgtgaataactgtgtt

SEQ ID NO: 27206 - DNA, 19 bp, Homo sapiens
ccacccccttccctgctga

SEQ ID NO: 27207 - DNA, 17 bp, Homo sapiens
tgaagtgaactatgaag

SEQ ID NO: 27208 - DNA, 18 bp, Homo sapiens
tggagacaaaggcatcat

SEQ ID NO: 27209 - DNA, 21 bp, Homo sapiens
ttgagatcaagccccacgatg

SEQ ID NO: 27210 - DNA, 19 bp, Homo sapiens
gccttggccgcctgagccc

SEQ ID NO: 27211 - DNA, 18 bp, Homo sapiens
ataaaggtgttaagctta

SEQ ID NO: 27212 - DNA, 21 bp, Homo sapiens
caagattatgtcaattggtta

SEQ ID NO: 27213 - DNA, 22 bp, Homo sapiens
tctattatttttctactaaaga

SEQ ID NO: 27214 - DNA, 18 bp, Homo sapiens
ataaaggtgttaagctta

SEQ ID NO: 27215 - DNA, 21 bp, Homo sapiens
caagattatgtcaattggtta

SEQ ID NO: 27216 - DNA, 22 bp, Homo sapiens
tctattatttttctactaaaga

SEQ ID NO: 27217 - DNA, 28 bp, Homo sapiens
agtgatcctctctcaaaccacaccccca

SEQ ID NO: 27218 - DNA, 27 bp, Homo sapiens
ccagccctgccacctgggcccacctcc

SEQ ID NO: 27219 - DNA, 24 bp, Homo sapiens
cctctgagagaccacgggaaccca

SEQ ID NO: 27220 - DNA, 19 bp, Homo sapiens
ctccgggaggcgggctgcg

SEQ ID NO: 27221 - DNA, 17 bp, Homo sapiens
gagaggctgggcagagg

SEQ ID NO: 27222 - DNA, 25 bp, Homo sapiens
tcttggtggcgtccctttctgtgag

SEQ ID NO: 27223 - DNA, 18 bp, Homo sapiens
tgtattttcagtgtttta

SEQ ID NO: 27224 - DNA, 18 bp, Homo sapiens
ctcatacctctctgcctc

SEQ ID NO: 27225 - DNA, 22 bp, Homo sapiens
gtgctgcggattgaggtcccgg

SEQ ID NO: 27226 - DNA, 18 bp, Homo sapiens
aaaggtgcatataccact

SEQ ID NO: 27227 - DNA, 21 bp, Homo sapiens
atctgagaaagcctctggccc

SEQ ID NO: 27228 - DNA, 18 bp, Homo sapiens
gacaggccgcttgctgca

SEQ ID NO: 27229 - DNA, 17 bp, Homo sapiens
ggaggcaacagaggtga

SEQ ID NO: 27230 - DNA, 21 bp, Homo sapiens
aacagtggtctgtagcactca

SEQ ID NO: 27231 - DNA, 15 bp, Homo sapiens
aagcaattctccttc

SEQ ID NO: 27232 - DNA, 20 bp, Homo sapiens
gtgggctcctgaccaagcac

SEQ ID NO: 27233 - DNA, 23 bp, Homo sapiens
tggagtgcaatagcgcaatctca

SEQ ID NO: 27234 - DNA, 17 bp, Homo sapiens
tggcattgacaaaccca

SEQ ID NO: 27235 - DNA, 18 bp, Homo sapiens
gaagaaattgggaacatt

SEQ ID NO: 27236 - DNA, 21 bp, Homo sapiens
tatcaactgaatagaccttct

SEQ ID NO: 27237 - DNA, 17 bp, Homo sapiens
ttctcctgccttagcct

SEQ ID NO: 27238 - DNA, 26 bp, Homo sapiens
aactccagacccttcacatcaattta

SEQ ID NO: 27239 - DNA, 22 bp, Homo sapiens
ccagagggtcttactgttccag

SEQ ID NO: 27240 - DNA, 18 bp, Homo sapiens
ccagggacactgacctca

SEQ ID NO: 27241 - DNA, 27 bp, Homo sapiens
ccttcccagagggtcttactgttccag

SEQ ID NO: 27242 - DNA, 18 bp, Homo sapiens
gcggctgcctcacgtgcg

SEQ ID NO: 27243 - DNA, 26 bp, Homo sapiens
gtgtatgtgggtcaccgttgggctct

SEQ ID NO: 27244 - DNA, 16 bp, Homo sapiens
tcacttccgctcccgc

SEQ ID NO: 27245 - DNA, 15 bp, Homo sapiens
tccagaaactttcca

SEQ ID NO: 27246 - DNA, 18 bp, Homo sapiens
ttatggctgggtctggtt

SEQ ID NO: 27247 - DNA, 16 bp, Homo sapiens
acaaaattgtgtttgt

SEQ ID NO: 27248 - DNA, 27 bp, Homo sapiens
atggagctagtgtcccagctgaagcta

SEQ ID NO: 27249 - DNA, 22 bp, Homo sapiens
gagccaagatcacgccactgca

SEQ ID NO: 27250 - DNA, 20 bp, Homo sapiens
agttttaatcaagatgttca

SEQ ID NO: 27251 - DNA, 17 bp, Homo sapiens
tgatggaaacctgtgag

SEQ ID NO: 27252 - DNA, 20 bp, Homo sapiens
gaaaagcaggcactgttcac

SEQ ID NO: 27253 - DNA, 22 bp, Homo sapiens
tgctcccatacacctggcactg

SEQ ID NO: 27254 - DNA, 21 bp, Homo sapiens
gccagttcccacagcacccca

SEQ ID NO: 27255 - DNA, 18 bp, Homo sapiens
agcattttatttcccgca

SEQ ID NO: 27256 - DNA, 19 bp, Homo sapiens
agggctgacgctccggtgc

SEQ ID NO: 27257 - DNA, 22 bp, Homo sapiens
caagatcgtgccattccactcc

SEQ ID NO: 27258 - DNA, 19 bp, Homo sapiens
cagtcctattagtgtttaa

SEQ ID NO: 27259 - DNA, 17 bp, Homo sapiens
ggagtcccccctgccca

SEQ ID NO: 27260 - DNA, 18 bp, Homo sapiens
tttcactgttttcctgca

SEQ ID NO: 27261 - DNA, 21 bp, Homo sapiens
acactattcatatattctgaa

SEQ ID NO: 27262 - DNA, 19 bp, Homo sapiens
atttattttcccctgtgat

SEQ ID NO: 27263 - DNA, 21 bp, Homo sapiens
caaatagtaaagagatgtgat

SEQ ID NO: 27264 - DNA, 22 bp, Homo sapiens
tacatacatacacatacacaca

SEQ ID NO: 27265 - DNA, 19 bp, Homo sapiens
ttgctgttgaggtaacttg

SEQ ID NO: 27266 - DNA, 19 bp, Homo sapiens
accagcagacactgccggg

SEQ ID NO: 27267 - DNA, 19 bp, Homo sapiens
accagcagacactgccggg

SEQ ID NO: 27268 - DNA, 17 bp, Homo sapiens
atgcaacaaggacttca

SEQ ID NO: 27269 - DNA, 20 bp, Homo sapiens
cacctacccacacctgcttt

SEQ ID NO: 27270 - DNA, 19 bp, Homo sapiens
accagcagacactgccggg

SEQ ID NO: 27271 - DNA, 17 bp, Homo sapiens
atgcaacaaggacttca

SEQ ID NO: 27272 - DNA, 20 bp, Homo sapiens
cacctacccacacctgcttt

SEQ ID NO: 27273 - DNA, 19 bp, Homo sapiens
accagcagacactgccggg

SEQ ID NO: 27274 - DNA, 17 bp, Homo sapiens
atgcaacaaggacttca

SEQ ID NO: 27275 - DNA, 20 bp, Homo sapiens
cacctacccacacctgcttt

SEQ ID NO: 27276 - DNA, 15 bp, Homo sapiens
ccgacctccaccccc

SEQ ID NO: 27277 - DNA, 20 bp, Homo sapiens
ccttcttccccaccaacaaa

SEQ ID NO: 27278 - DNA, 23 bp, Homo sapiens
ctgcacaagggcacctgcagcta

SEQ ID NO: 27279 - DNA, 20 bp, Homo sapiens
ctgtggatgggggccgtgat

SEQ ID NO: 27280 - DNA, 18 bp, Homo sapiens
gactccatcccccacccc

SEQ ID NO: 27281 - DNA, 18 bp, Homo sapiens
tgaggaatctaccagttg

SEQ ID NO: 27282 - DNA, 18 bp, Homo sapiens
tgctagccttctacccca

SEQ ID NO: 27283 - DNA, 20 bp, Homo sapiens
tggaacccagcaggatcaca

SEQ ID NO: 27284 - DNA, 21 bp, Homo sapiens
tttttcatacctagtgggata

SEQ ID NO: 27285 - DNA, 17 bp, Homo sapiens
gccccttggctggcaga

SEQ ID NO: 27286 - DNA, 18 bp, Homo sapiens
ttggaacaaatcgcccct

SEQ ID NO: 27287 - DNA, 20 bp, Homo sapiens
caaacggtgttcatgatact

SEQ ID NO: 27288 - DNA, 24 bp, Homo sapiens
gtcctgaataagtctactggaaga

SEQ ID NO: 27289 - DNA, 23 bp, Homo sapiens
tcatatatactgtaatatatgct

SEQ ID NO: 27290 - DNA, 17 bp, Homo sapiens
tctcacctctattacct

SEQ ID NO: 27291 - DNA, 21 bp, Homo sapiens
ttaggaaaaactacacattct

SEQ ID NO: 27292 - DNA, 19 bp, Homo sapiens
ttctgtctactgtactctt

SEQ ID NO: 27293 - DNA, 21 bp, Homo sapiens
tcagtctcaaagtcaccttga

SEQ ID NO: 27294 - DNA, 19 bp, Homo sapiens
tctccactttctggaacca

SEQ ID NO: 27295 - DNA, 20 bp, Homo sapiens
caaccactctctctgcccct

SEQ ID NO: 27296 - DNA, 20 bp, Homo sapiens
ccatctgtctttctgtccct

SEQ ID NO: 27297 - DNA, 19 bp, Homo sapiens
ctgagttgcggccacttca

SEQ ID NO: 27298 - DNA, 24 bp, Homo sapiens
gcctctctgcctgaatctgcctct

SEQ ID NO: 27299 - DNA, 19 bp, Homo sapiens
ttggggagctgtctggctc

SEQ ID NO: 27300 - DNA, 20 bp, Homo sapiens
ggaggaggaagggagcacca

SEQ ID NO: 27301 - DNA, 19 bp, Homo sapiens
gggagcagaaggagcgcga

SEQ ID NO: 27302 - DNA, 23 bp, Homo sapiens
agaatgttggtaatgccatgtca

SEQ ID NO: 27303 - DNA, 18 bp, Homo sapiens
gatacaggcatatgtcat

SEQ ID NO: 27304 - DNA, 20 bp, Homo sapiens
ggagaggcggcggccgcggc

SEQ ID NO: 27305 - DNA, 17 bp, Homo sapiens
ttggtttgcttcaacaa

SEQ ID NO: 27306 - DNA, 19 bp, Homo sapiens
cccccgggcccgccgcagc

SEQ ID NO: 27307 - DNA, 19 bp, Homo sapiens
tgtcccactagcgggctct

SEQ ID NO: 27308 - DNA, 16 bp, Homo sapiens
cccttcccttttccag

SEQ ID NO: 27309 - DNA, 21 bp, Homo sapiens
aaatacctttcttccttgtaa

SEQ ID NO: 27310 - DNA, 19 bp, Homo sapiens
ccgaagcgagccgaagcat

SEQ ID NO: 27311 - DNA, 21 bp, Homo sapiens
actggagaggaaaacttgtca

SEQ ID NO: 27312 - DNA, 17 bp, Homo sapiens
agagtatctgctttcca

SEQ ID NO: 27313 - DNA, 20 bp, Homo sapiens
agttggttcaaactgttgga

SEQ ID NO: 27314 - DNA, 23 bp, Homo sapiens
caacagcctgcccagatccctct

SEQ ID NO: 27315 - DNA, 20 bp, Homo sapiens
ccctcctgaatggaacccca

SEQ ID NO: 27316 - DNA, 22 bp, Homo sapiens
cccttccccacctttgccctcc

SEQ ID NO: 27317 - DNA, 23 bp, Homo sapiens
ggacaaaaaaatgtaaaatactt

SEQ ID NO: 27318 - DNA, 23 bp, Homo sapiens
tgcccagtctggtgcctgcccca

SEQ ID NO: 27319 - DNA, 20 bp, Homo sapiens
accctttggaaaccctgggg

SEQ ID NO: 27320 - DNA, 18 bp, Homo sapiens
agctaatcttgtcattaa

SEQ ID NO: 27321 - DNA, 19 bp, Homo sapiens
catcttagagatggagaca

SEQ ID NO: 27322 - DNA, 20 bp, Homo sapiens
ctgtgtgtctttttaccctg

SEQ ID NO: 27323 - DNA, 21 bp, Homo sapiens
gcacctgtctgtccatctgca

SEQ ID NO: 27324 - DNA, 20 bp, Homo sapiens
gggtttcacacctcttgtta

SEQ ID NO: 27325 - DNA, 20 bp, Homo sapiens
gttggtatttgggcacttta

SEQ ID NO: 27326 - DNA, 21 bp, Homo sapiens
tccttttttcttagacacatc

SEQ ID NO: 27327 - DNA, 18 bp, Homo sapiens
atgcccaaccaggttcca

SEQ ID NO: 27328 - DNA, 18 bp, Homo sapiens
ccacaggaggggcacccg

SEQ ID NO: 27329 - DNA, 18 bp, Homo sapiens
ccacaggaggggcacccg

SEQ ID NO: 27330 - DNA, 18 bp, Homo sapiens
tcctggcgttaagctttt

SEQ ID NO: 27331 - DNA, 21 bp, Homo sapiens
tcctggtggaggggatcttgg

SEQ ID NO: 27332 - DNA, 19 bp, Homo sapiens
tcttgggcactggtagcag

SEQ ID NO: 27333 - DNA, 20 bp, Homo sapiens
tggccaggctggtcttgaac

SEQ ID NO: 27334 - DNA, 19 bp, Homo sapiens
aaggacaagctcttcatga

SEQ ID NO: 27335 - DNA, 21 bp, Homo sapiens
ccacgaccagctggcacctca

SEQ ID NO: 27336 - DNA, 19 bp, Homo sapiens
ccgccactgctgccagcga

SEQ ID NO: 27337 - DNA, 20 bp, Homo sapiens
ctcagcagcaggtacgtacc

SEQ ID NO: 27338 - DNA, 23 bp, Homo sapiens
gagcttgacaccctcgcgtcaca

SEQ ID NO: 27339 - DNA, 21 bp, Homo sapiens
tcacattttcttcttgagcaa

SEQ ID NO: 27340 - DNA, 18 bp, Homo sapiens
tcacggtgatgttgcaca

SEQ ID NO: 27341 - DNA, 22 bp, Homo sapiens
tcctgatgtgacggactgtgaa

SEQ ID NO: 27342 - DNA, 22 bp, Homo sapiens
tctggcaccactgccctggtcc

SEQ ID NO: 27343 - DNA, 19 bp, Homo sapiens
aaggacaagctcttcatga

SEQ ID NO: 27344 - DNA, 21 bp, Homo sapiens
ccacgaccagctggcacctca

SEQ ID NO: 27345 - DNA, 19 bp, Homo sapiens
ccgccactgctgccagcga

SEQ ID NO: 27346 - DNA, 20 bp, Homo sapiens
ctcagcagcaggtacgtacc

SEQ ID NO: 27347 - DNA, 18 bp, Homo sapiens
tcacggtgatgttgcaca

SEQ ID NO: 27348 - DNA, 22 bp, Homo sapiens
tcctgatgtgacggactgtgaa

SEQ ID NO: 27349 - DNA, 22 bp, Homo sapiens
tctggcaccactgccctggtcc

SEQ ID NO: 27350 - DNA, 18 bp, Homo sapiens
agaagattgtggttgcca

SEQ ID NO: 27351 - DNA, 16 bp, Homo sapiens
agctgcagctgatggg

SEQ ID NO: 27352 - DNA, 19 bp, Homo sapiens
atctggagaagcccctggg

SEQ ID NO: 27353 - DNA, 27 bp, Homo sapiens
ccttttccaatttgttgtcttcatttt

SEQ ID NO: 27354 - DNA, 15 bp, Homo sapiens
gcctgggggcagata

SEQ ID NO: 27355 - DNA, 21 bp, Homo sapiens
cacaccaggcaccagtgtctt

SEQ ID NO: 27356 - DNA, 17 bp, Homo sapiens
agctatcaaaggaaatg

SEQ ID NO: 27357 - DNA, 19 bp, Homo sapiens
cacaactgtcttagactgc

SEQ ID NO: 27358 - DNA, 19 bp, Homo sapiens
cacttaaattctctaaccg

SEQ ID NO: 27359 - DNA, 20 bp, Homo sapiens
ctccaagcatcagcagagcc

SEQ ID NO: 27360 - DNA, 20 bp, Homo sapiens
tctcctgagtgctgcaagtt

SEQ ID NO: 27361 - DNA, 18 bp, Homo sapiens
aaagttgggttcttggca

SEQ ID NO: 27362 - DNA, 20 bp, Homo sapiens
acgtggctaccaaatgccta

SEQ ID NO: 27363 - DNA, 19 bp, Homo sapiens
caaagatcaaggaatgtca

SEQ ID NO: 27364 - DNA, 17 bp, Homo sapiens
ccgtggaagcacactct

SEQ ID NO: 27365 - DNA, 20 bp, Homo sapiens
ggaccaataaacagcctcct

SEQ ID NO: 27366 - DNA, 17 bp, Homo sapiens
gtcatctctggtgtcag

SEQ ID NO: 27367 - DNA, 24 bp, Homo sapiens
gtcattgcgtgtgtgtggtttgtg

SEQ ID NO: 27368 - DNA, 17 bp, Homo sapiens
tgggtattatgcagtgc

SEQ ID NO: 27369 - DNA, 18 bp, Homo sapiens
tgtaccaatttcttttaa

SEQ ID NO: 27370 - DNA, 18 bp, Homo sapiens
ttcaaatgtaaattgttc

SEQ ID NO: 27371 - DNA, 20 bp, Homo sapiens
ttgcgtgtgtgtggtttgtg

SEQ ID NO: 27372 - DNA, 20 bp, Homo sapiens
acgtggctaccaaatgccta

SEQ ID NO: 27373 - DNA, 19 bp, Homo sapiens
caaagatcaaggaatgtca

SEQ ID NO: 27374 - DNA, 17 bp, Homo sapiens
ccgtggaagcacactct

SEQ ID NO: 27375 - DNA, 20 bp, Homo sapiens
ggaccaataaacagcctcct

SEQ ID NO: 27376 - DNA, 17 bp, Homo sapiens
gtcatctctggtgtcag

SEQ ID NO: 27377 - DNA, 24 bp, Homo sapiens
gtcattgcgtgtgtgtggtttgtg

SEQ ID NO: 27378 - DNA, 17 bp, Homo sapiens
tgggtattatgcagtgc

SEQ ID NO: 27379 - DNA, 18 bp, Homo sapiens
tgtaccaatttcttttaa

SEQ ID NO: 27380 - DNA, 18 bp, Homo sapiens
ttcaaatgtaaattgttc

SEQ ID NO: 27381 - DNA, 20 bp, Homo sapiens
ttgcgtgtgtgtggtttgtg

SEQ ID NO: 27382 - DNA, 18 bp, Homo sapiens
cctggccccacgcagctc

SEQ ID NO: 27383 - DNA, 21 bp, Homo sapiens
cgagcttccccgcaccggcca

SEQ ID NO: 27384 - DNA, 19 bp, Homo sapiens
atggctataaagctgtggc

SEQ ID NO: 27385 - DNA, 21 bp, Homo sapiens
caagaaatgcttcttggacta

SEQ ID NO: 27386 - DNA, 20 bp, Homo sapiens
gatgtgcaaaacgcagtcca

SEQ ID NO: 27387 - DNA, 17 bp, Homo sapiens
gcctggaaacactacca

SEQ ID NO: 27388 - DNA, 20 bp, Homo sapiens
tgaacctgccgcctccgtgc

SEQ ID NO: 27389 - DNA, 21 bp, Homo sapiens
cagcattcagcacaggtgcca

SEQ ID NO: 27390 - DNA, 22 bp, Homo sapiens
ctaaatgtcattctccatctct

SEQ ID NO: 27391 - DNA, 17 bp, Homo sapiens
cagtggtgtctctcacc

SEQ ID NO: 27392 - DNA, 20 bp, Homo sapiens
cactcattgtctttgaggaa

SEQ ID NO: 27393 - DNA, 16 bp, Homo sapiens
ccaaaagtttcttact

SEQ ID NO: 27394 - DNA, 21 bp, Homo sapiens
gtcagagggtggggtaaccaa

SEQ ID NO: 27395 - DNA, 20 bp, Homo sapiens
gttcttcttcttgccagtgt

SEQ ID NO: 27396 - DNA, 23 bp, Homo sapiens
atgaaagaaaaaatattgtcata

SEQ ID NO: 27397 - DNA, 17 bp, Homo sapiens
acctgcctcctcttcgg

SEQ ID NO: 27398 - DNA, 20 bp, Homo sapiens
gtccgtgcagcactaacgta

SEQ ID NO: 27399 - DNA, 22 bp, Homo sapiens
cccgccgcccggctcctctcgg

SEQ ID NO: 27400 - DNA, 15 bp, Homo sapiens
tcctccagcatctca

SEQ ID NO: 27401 - DNA, 21 bp, Homo sapiens
ggatgattttttcttcaggga

SEQ ID NO: 27402 - DNA, 17 bp, Homo sapiens
taaaaatgtgagatgtg

SEQ ID NO: 27403 - DNA, 19 bp, Homo sapiens
tcctggaggaagctcatga

SEQ ID NO: 27404 - DNA, 18 bp, Homo sapiens
tctttattttaatgatgt

SEQ ID NO: 27405 - DNA, 18 bp, Homo sapiens
tgatactgattttccttt

SEQ ID NO: 27406 - DNA, 23 bp, Homo sapiens
tgttaaaaatgctgtcaaatcct

SEQ ID NO: 27407 - DNA, 19 bp, Homo sapiens
ctgcacacagactgcaagt

SEQ ID NO: 27408 - DNA, 18 bp, Homo sapiens
gtttagaaccaaaccaca

SEQ ID NO: 27409 - DNA, 21 bp, Homo sapiens
actacaatgctctgtcatctc

SEQ ID NO: 27410 - DNA, 17 bp, Homo sapiens
agaaataaaactgctca

SEQ ID NO: 27411 - DNA, 18 bp, Homo sapiens
agtaagatgtgaaattca

SEQ ID NO: 27412 - DNA, 19 bp, Homo sapiens
caacttaacactgaaccca

SEQ ID NO: 27413 - DNA, 18 bp, Homo sapiens
ctgagcagttatatttta

SEQ ID NO: 27414 - DNA, 22 bp, Homo sapiens
gcactttctaatttattagaga

SEQ ID NO: 27415 - DNA, 26 bp, Homo sapiens
gttttcataatcgaaagaaacgggta

SEQ ID NO: 27416 - DNA, 17 bp, Homo sapiens
tccatttctgaagtatt

SEQ ID NO: 27417 - DNA, 18 bp, Homo sapiens
ttattttattttaccata

SEQ ID NO: 27418 - DNA, 22 bp, Homo sapiens
ggacgcgtccgacggcggccgg

SEQ ID NO: 27419 - DNA, 21 bp, Homo sapiens
ggccggacgctgaggtggtcg

SEQ ID NO: 27420 - DNA, 24 bp, Homo sapiens
cccgcccctttcctgcccgcccca

SEQ ID NO: 27421 - DNA, 19 bp, Homo sapiens
ggctccgccccctccccct

SEQ ID NO: 27422 - DNA, 22 bp, Homo sapiens
cggggcggccagggccgctgca

SEQ ID NO: 27423 - DNA, 18 bp, Homo sapiens
ggccagcattgccactgc

SEQ ID NO: 27424 - DNA, 21 bp, Homo sapiens
caagatttggaagtttagtca

SEQ ID NO: 27425 - DNA, 20 bp, Homo sapiens
taccttcttagtcacgtgca

SEQ ID NO: 27426 - DNA, 22 bp, Homo sapiens
tgtaattgtgatttacctgtgc

SEQ ID NO: 27427 - DNA, 21 bp, Homo sapiens
cccacaacccacacacaccac

SEQ ID NO: 27428 - DNA, 23 bp, Homo sapiens
cgcctgccccatccccatcccca

SEQ ID NO: 27429 - DNA, 18 bp, Homo sapiens
tctctaggcctctgctct

SEQ ID NO: 27430 - DNA, 19 bp, Homo sapiens
tctgtctttcttggtgtct

SEQ ID NO: 27431 - DNA, 19 bp, Homo sapiens
ttctgtctctctccctacc

SEQ ID NO: 27432 - DNA, 21 bp, Homo sapiens
tctgttatcagcaatgtgcaa

SEQ ID NO: 27433 - DNA, 19 bp, Homo sapiens
tgaattcaactccagacac

SEQ ID NO: 27434 - DNA, 24 bp, Homo sapiens
ttttgaaaatgacggtgtctgact

SEQ ID NO: 27435 - DNA, 24 bp, Homo sapiens
ttttttgcattatatgcatttatg

SEQ ID NO: 27436 - DNA, 17 bp, Homo sapiens
ctgaggcccggcgaggt

SEQ ID NO: 27437 - DNA, 15 bp, Homo sapiens
ctccccatggccggg

SEQ ID NO: 27438 - DNA, 24 bp, Homo sapiens
tgagtattatgacagtgtgcatca

SEQ ID NO: 27439 - DNA, 19 bp, Homo sapiens
gactgaggaaaatttacca

SEQ ID NO: 27440 - DNA, 21 bp, Homo sapiens
gcccccacgtcctctgaaata

SEQ ID NO: 27441 - DNA, 20 bp, Homo sapiens
tgaggaaaatttaccagtca

SEQ ID NO: 27442 - DNA, 22 bp, Homo sapiens
acctccagtctttcccctgtga

SEQ ID NO: 27443 - DNA, 20 bp, Homo sapiens
agggccaacctattacttca

SEQ ID NO: 27444 - DNA, 24 bp, Homo sapiens
cccatcgtcactctccatggcctc

SEQ ID NO: 27445 - DNA, 21 bp, Homo sapiens
gcttcatgcgactccatgtca

SEQ ID NO: 27446 - DNA, 20 bp, Homo sapiens
tggtcaggctggtcttgaac

SEQ ID NO: 27447 - DNA, 18 bp, Homo sapiens
cctgaataatgctggctc

SEQ ID NO: 27448 - DNA, 19 bp, Homo sapiens
ctcctgctgaaaaatgtta

SEQ ID NO: 27449 - DNA, 20 bp, Homo sapiens
cccccagaacccgcgccatc

SEQ ID NO: 27450 - DNA, 18 bp, Homo sapiens
cgaggctgctaggcccag

SEQ ID NO: 27451 - DNA, 17 bp, Homo sapiens
ctgtaagtccttgtgtg

SEQ ID NO: 27452 - DNA, 23 bp, Homo sapiens
gcctcagggcccatcaggagtca

SEQ ID NO: 27453 - DNA, 20 bp, Homo sapiens
gtgtattgtgattatttgat

SEQ ID NO: 27454 - DNA, 22 bp, Homo sapiens
ccccccccacccttctctctcc

SEQ ID NO: 27455 - DNA, 22 bp, Homo sapiens
ccccttcaccggggctgttgtg

SEQ ID NO: 27456 - DNA, 20 bp, Homo sapiens
tgtctttgttaccccagggg

SEQ ID NO: 27457 - DNA, 21 bp, Homo sapiens
ttctggacagctgaacactct

SEQ ID NO: 27458 - DNA, 22 bp, Homo sapiens
aggatctgctccgcctttggcc

SEQ ID NO: 27459 - DNA, 18 bp, Homo sapiens
attgcactgagcattcca

SEQ ID NO: 27460 - DNA, 20 bp, Homo sapiens
cctaccactcccccgctttt

SEQ ID NO: 27461 - DNA, 19 bp, Homo sapiens
tggcaatgatgtgccttga

SEQ ID NO: 27462 - DNA, 16 bp, Homo sapiens
tggccaggcgtggtgg

SEQ ID NO: 27463 - DNA, 22 bp, Homo sapiens
caatgaagagcttgagtttgaa

SEQ ID NO: 27464 - DNA, 22 bp, Homo sapiens
gcaatctgcccgcctctgcctc

SEQ ID NO: 27465 - DNA, 23 bp, Homo sapiens
gcaatctgcccgcctctgcctcc

SEQ ID NO: 27466 - DNA, 21 bp, Homo sapiens
gtgccagatctttaactgtat

SEQ ID NO: 27467 - DNA, 21 bp, Homo sapiens
atctggtaactccatgatgaa

SEQ ID NO: 27468 - DNA, 22 bp, Homo sapiens
ccccagagaccattaaccaata

SEQ ID NO: 27469 - DNA, 23 bp, Homo sapiens
gcagttgaacaaaaattatggca

SEQ ID NO: 27470 - DNA, 19 bp, Homo sapiens
gtgaatacttagatttgta

SEQ ID NO: 27471 - DNA, 21 bp, Homo sapiens
aaaagcctgttagtattttca

SEQ ID NO: 27472 - DNA, 19 bp, Homo sapiens
acctggattttttgtttgg

SEQ ID NO: 27473 - DNA, 22 bp, Homo sapiens
agaacagttcctcagctggtca

SEQ ID NO: 27474 - DNA, 17 bp, Homo sapiens
attcttttttctattta

SEQ ID NO: 27475 - DNA, 19 bp, Homo sapiens
ccatataaattgtttattc

SEQ ID NO: 27476 - DNA, 21 bp, Homo sapiens
ctaaagaagtgactcacctga

SEQ ID NO: 27477 - DNA, 24 bp, Homo sapiens
ctcaggaagtcctcccctacatct

SEQ ID NO: 27478 - DNA, 18 bp, Homo sapiens
tcacactactctgttcct

SEQ ID NO: 27479 - DNA, 26 bp, Homo sapiens
ttcctcagctggtcatgctgagctca

SEQ ID NO: 27480 - DNA, 20 bp, Homo sapiens
acaaccacccccaagcctca

SEQ ID NO: 27481 - DNA, 21 bp, Homo sapiens
attctacctgcatttcaatta

SEQ ID NO: 27482 - DNA, 17 bp, Homo sapiens
cactcccctctccctct

SEQ ID NO: 27483 - DNA, 19 bp, Homo sapiens
ccaagcatgccagcttctg

SEQ ID NO: 27484 - DNA, 19 bp, Homo sapiens
cctgttcacctctttccac

SEQ ID NO: 27485 - DNA, 18 bp, Homo sapiens
ctgggcaaagcccactat

SEQ ID NO: 27486 - DNA, 17 bp, Homo sapiens
gctccctcccatctgta

SEQ ID NO: 27487 - DNA, 20 bp, Homo sapiens
tatcattaaagtaaagattt

SEQ ID NO: 27488 - DNA, 21 bp, Homo sapiens
ccctctccaacccactctcca

SEQ ID NO: 27489 - DNA, 22 bp, Homo sapiens
aacatcaacattttttgtgctt

SEQ ID NO: 27490 - DNA, 21 bp, Homo sapiens
aagaggtatgtagtcacagta

SEQ ID NO: 27491 - DNA, 18 bp, Homo sapiens
caagggtttgggttttga

SEQ ID NO: 27492 - DNA, 22 bp, Homo sapiens
cgccgccccggctgcgcacgcg

SEQ ID NO: 27493 - DNA, 16 bp, Homo sapiens
ccgtgcccagcacccg

SEQ ID NO: 27494 - DNA, 16 bp, Homo sapiens
ggtggaagtcctccag

SEQ ID NO: 27495 - DNA, 20 bp, Homo sapiens
taaaggatgagcctggggtc

SEQ ID NO: 27496 - DNA, 18 bp, Homo sapiens
aaaccatccatgacccca

SEQ ID NO: 27497 - DNA, 19 bp, Homo sapiens
aaatttttgaaatcgtggt

SEQ ID NO: 27498 - DNA, 19 bp, Homo sapiens
agcacagaactccagcccc

SEQ ID NO: 27499 - DNA, 19 bp, Homo sapiens
ctgcaacgcctgcctctca

SEQ ID NO: 27500 - DNA, 20 bp, Homo sapiens
tctatttattttgagtcact

SEQ ID NO: 27501 - DNA, 19 bp, Homo sapiens
ctgaggtgttccctggctt

SEQ ID NO: 27502 - DNA, 20 bp, Homo sapiens
tcctcctccccttaaccacc

SEQ ID NO: 27503 - DNA, 19 bp, Homo sapiens
gcaaagaactttgagggtc

SEQ ID NO: 27504 - DNA, 23 bp, Homo sapiens
gcagtcacagggggcctgtgtca

SEQ ID NO: 27505 - DNA, 21 bp, Homo sapiens
ggtgggtggggaggggcagtt

SEQ ID NO: 27506 - DNA, 18 bp, Homo sapiens
tctcaggaggactttgag

SEQ ID NO: 27507 - DNA, 25 bp, Homo sapiens
cctcccctcttgcactttctctcca

SEQ ID NO: 27508 - DNA, 20 bp, Homo sapiens
cctttattcgtttgtactca

SEQ ID NO: 27509 - DNA, 25 bp, Homo sapiens
aaataatgaagagacacatgtgtta

SEQ ID NO: 27510 - DNA, 19 bp, Homo sapiens
tgattatgctgacattcca

SEQ ID NO: 27511 - DNA, 21 bp, Homo sapiens
aatgaagttcagattcccttc

SEQ ID NO: 27512 - DNA, 24 bp, Homo sapiens
atctggagtattaatgtttggttc

SEQ ID NO: 27513 - DNA, 20 bp, Homo sapiens
gattgctttgtgaagctctt

SEQ ID NO: 27514 - DNA, 23 bp, Homo sapiens
gcaaattttatgaagtgcctacc

SEQ ID NO: 27515 - DNA, 19 bp, Homo sapiens
tactttttggggtcagata

SEQ ID NO: 27516 - DNA, 21 bp, Homo sapiens
tcagcagaaatagggttttct

SEQ ID NO: 27517 - DNA, 19 bp, Homo sapiens
atcaaaaaataaaagtttt

SEQ ID NO: 27518 - DNA, 20 bp, Homo sapiens
gttgatggtattgattgaaa

SEQ ID NO: 27519 - DNA, 19 bp, Homo sapiens
tctgattttttgagcacta

SEQ ID NO: 27520 - DNA, 25 bp, Homo sapiens
acagaaagctgccttcttcacttga

SEQ ID NO: 27521 - DNA, 22 bp, Homo sapiens
atcttcttcatggtgttaggga

SEQ ID NO: 27522 - DNA, 22 bp, Homo sapiens
gaagaacttatctttattctca

SEQ ID NO: 27523 - DNA, 23 bp, Homo sapiens
tacagcaaaataaaaatttaaca

SEQ ID NO: 27524 - DNA, 19 bp, Homo sapiens
tcaagttctctccacctct

SEQ ID NO: 27525 - DNA, 18 bp, Homo sapiens
aaacatagcaagatctca

SEQ ID NO: 27526 - DNA, 21 bp, Homo sapiens
aactagagtgcatttaaaata

SEQ ID NO: 27527 - DNA, 23 bp, Homo sapiens
aatgtgggaactggacacccaga

SEQ ID NO: 27528 - DNA, 28 bp, Homo sapiens
atataatcaaagaattttctgtacatat

SEQ ID NO: 27529 - DNA, 21 bp, Homo sapiens
atctgtgggactgtctgggcc

SEQ ID NO: 27530 - DNA, 21 bp, Homo sapiens
cctgcctccttgagtcacttt

SEQ ID NO: 27531 - DNA, 22 bp, Homo sapiens
cctgggtaagactgaaagcatt

SEQ ID NO: 27532 - DNA, 20 bp, Homo sapiens
ctttaaggctttttaatttt

SEQ ID NO: 27533 - DNA, 22 bp, Homo sapiens
gactgtgcaaagggcttagcta

SEQ ID NO: 27534 - DNA, 24 bp, Homo sapiens
ggcaacatgtgccttcacacttta

SEQ ID NO: 27535 - DNA, 25 bp, Homo sapiens
taagtgcttgttctagcataaatta

SEQ ID NO: 27536 - DNA, 17 bp, Homo sapiens
tgcatatcaccatgagt

SEQ ID NO: 27537 - DNA, 19 bp, Homo sapiens
tgcctacttcaccatctct

SEQ ID NO: 27538 - DNA, 16 bp, Homo sapiens
caccaggctttgcaaa

SEQ ID NO: 27539 - DNA, 19 bp, Homo sapiens
gctgtctcctgcatatcca

SEQ ID NO: 27540 - DNA, 17 bp, Homo sapiens
tctcctgcatatccagc

SEQ ID NO: 27541 - DNA, 19 bp, Homo sapiens
gatctctaatgtggaggtg

SEQ ID NO: 27542 - DNA, 24 bp, Homo sapiens
tggcacagtcctggtgtggtgctg

SEQ ID NO: 27543 - DNA, 24 bp, Homo sapiens
aactttgcccccatctcacccagt

SEQ ID NO: 27544 - DNA, 25 bp, Homo sapiens
agatcttgttacctcctcatctaca

SEQ ID NO: 27545 - DNA, 21 bp, Homo sapiens
tccaatcaatctccttactca

SEQ ID NO: 27546 - DNA, 22 bp, Homo sapiens
gagccaagatcgtgccactgca

SEQ ID NO: 27547 - DNA, 21 bp, Homo sapiens
tcctagaacacacgatgggct

SEQ ID NO: 27548 - DNA, 24 bp, Homo sapiens
atcaaagacaagtaatgtgtctca

SEQ ID NO: 27549 - DNA, 18 bp, Homo sapiens
gaaaagcctatcatcata

SEQ ID NO: 27550 - DNA, 18 bp, Homo sapiens
taagtgatgctattccaa

SEQ ID NO: 27551 - DNA, 19 bp, Homo sapiens
tgcccacatgacctgttcc

SEQ ID NO: 27552 - DNA, 18 bp, Homo sapiens
tgcttcacatggttaaaa

SEQ ID NO: 27553 - DNA, 23 bp, Homo sapiens
acaacctgaagcacaagttccca

SEQ ID NO: 27554 - DNA, 19 bp, Homo sapiens
cctttccccaccaccgcaa

SEQ ID NO: 27555 - DNA, 17 bp, Homo sapiens
gcatcgtgctgcaggtg

SEQ ID NO: 27556 - DNA, 23 bp, Homo sapiens
tcctggtgatgggttactgtgag

SEQ ID NO: 27557 - DNA, 19 bp, Homo sapiens
tgtgcaaccactgcttctt

SEQ ID NO: 27558 - DNA, 15 bp, Homo sapiens
ttccccaccaccgca

SEQ ID NO: 27559 - DNA, 17 bp, Homo sapiens
acctggagcagctgctg

SEQ ID NO: 27560 - DNA, 18 bp, Homo sapiens
ccaatcgttctctgttcc

SEQ ID NO: 27561 - DNA, 20 bp, Homo sapiens
ctgagaaataacttgctctg

SEQ ID NO: 27562 - DNA, 24 bp, Homo sapiens
gcacacgagtgaacgagtgcagga

SEQ ID NO: 27563 - DNA, 21 bp, Homo sapiens
ggactcccaacaggggtaccc

SEQ ID NO: 27564 - DNA, 23 bp, Homo sapiens
gtgaacgagtgcaggaaccagct

SEQ ID NO: 27565 - DNA, 21 bp, Homo sapiens
tcactttcctgaccatgccca

SEQ ID NO: 27566 - DNA, 20 bp, Homo sapiens
accacacacttgcacacccc

SEQ ID NO: 27567 - DNA, 18 bp, Homo sapiens
cagcgaaagtctgctaac

SEQ ID NO: 27568 - DNA, 19 bp, Homo sapiens
cttggagtccatctggttt

SEQ ID NO: 27569 - DNA, 18 bp, Homo sapiens
cttggctccccctgtctc

SEQ ID NO: 27570 - DNA, 19 bp, Homo sapiens
ccccacccccatcctgcgc

SEQ ID NO: 27571 - DNA, 19 bp, Homo sapiens
atcgaaggcttaccctatt

SEQ ID NO: 27572 - DNA, 19 bp, Homo sapiens
caaccctccatatggctct

SEQ ID NO: 27573 - DNA, 25 bp, Homo sapiens
cctatataataattgctttggcttt

SEQ ID NO: 27574 - DNA, 24 bp, Homo sapiens
cttccagggagctcttttaatctt

SEQ ID NO: 27575 - DNA, 23 bp, Homo sapiens
ctttttgtttcttgctttgcttt

SEQ ID NO: 27576 - DNA, 19 bp, Homo sapiens
gctctccagtggcttttaa

SEQ ID NO: 27577 - DNA, 21 bp, Homo sapiens
taagattattatagtctggtt

SEQ ID NO: 27578 - DNA, 21 bp, Homo sapiens
tccccctcccaaccctccata

SEQ ID NO: 27579 - DNA, 23 bp, Homo sapiens
tcctataccgctctcccaacaaa

SEQ ID NO: 27580 - DNA, 19 bp, Homo sapiens
caaaaagcacttcctccca

SEQ ID NO: 27581 - DNA, 19 bp, Homo sapiens
taaaattgtaaaaggctgc

SEQ ID NO: 27582 - DNA, 20 bp, Homo sapiens
tatgaactcgctttatacct

SEQ ID NO: 27583 - DNA, 20 bp, Homo sapiens
tctacctagcaactgtcttc

SEQ ID NO: 27584 - DNA, 27 bp, Homo sapiens
ccatcaagactgagaaaaagcacacca

SEQ ID NO: 27585 - DNA, 23 bp, Homo sapiens
ttctggtgatcgaggacttccgg

SEQ ID NO: 27586 - DNA, 24 bp, Homo sapiens
caccaccaccgcctcctacccttc

SEQ ID NO: 27587 - DNA, 16 bp, Homo sapiens
cagaagcctgttccag

SEQ ID NO: 27588 - DNA, 17 bp, Homo sapiens
cccagctagagacccca

SEQ ID NO: 27589 - DNA, 17 bp, Homo sapiens
tgaagttttggtatcgc

SEQ ID NO: 27590 - DNA, 21 bp, Homo sapiens
aacactcttcagtacataata

SEQ ID NO: 27591 - DNA, 20 bp, Homo sapiens
ccctccccatccccagccca

SEQ ID NO: 27592 - DNA, 23 bp, Homo sapiens
ggtcttaactctgattgtagcaa

SEQ ID NO: 27593 - DNA, 20 bp, Homo sapiens
agggtaaccagatgatctca

SEQ ID NO: 27594 - DNA, 17 bp, Homo sapiens
gccactgcctcttacct

SEQ ID NO: 27595 - DNA, 20 bp, Homo sapiens
gtgatgttggatgccagtta

SEQ ID NO: 27596 - DNA, 24 bp, Homo sapiens
caaggctgaagtgtatagtgtata

SEQ ID NO: 27597 - DNA, 17 bp, Homo sapiens
aagaaaaaaaccacaca

SEQ ID NO: 27598 - DNA, 19 bp, Homo sapiens
aagaagaaaaaggtttgca

SEQ ID NO: 27599 - DNA, 18 bp, Homo sapiens
ctacaggggagttttgtt

SEQ ID NO: 27600 - DNA, 20 bp, Homo sapiens
gcggagtctgtcctgtgacg

SEQ ID NO: 27601 - DNA, 18 bp, Homo sapiens
gtaaccggcatgtttcca

SEQ ID NO: 27602 - DNA, 24 bp, Homo sapiens
taaaaacattttaaaaacatagaa

SEQ ID NO: 27603 - DNA, 19 bp, Homo sapiens
tttgcttgctcatatgcat

SEQ ID NO: 27604 - DNA, 19 bp, Homo sapiens
aattgattcctatactatg

SEQ ID NO: 27605 - DNA, 25 bp, Homo sapiens
actggtgataataacagcaaccact

SEQ ID NO: 27606 - DNA, 16 bp, Homo sapiens
agtcttccagtcacgc

SEQ ID NO: 27607 - DNA, 23 bp, Homo sapiens
atccaaacaaacaacaaaccaaa

SEQ ID NO: 27608 - DNA, 17 bp, Homo sapiens
caaatgcctattcttta

SEQ ID NO: 27609 - DNA, 25 bp, Homo sapiens
ctgcgggccaacagcaaccacttcc

SEQ ID NO: 27610 - DNA, 18 bp, Homo sapiens
aaaagccagggtcagcca

SEQ ID NO: 27611 - DNA, 16 bp, Homo sapiens
caaatttagcacctta

SEQ ID NO: 27612 - DNA, 24 bp, Homo sapiens
cccagagacagcccccacatccca

SEQ ID NO: 27613 - DNA, 24 bp, Homo sapiens
gccaccttgaggcagcctatccca

SEQ ID NO: 27614 - DNA, 19 bp, Homo sapiens
gctctggagaggcccccac

SEQ ID NO: 27615 - DNA, 16 bp, Homo sapiens
ggacctgggaatgcac

SEQ ID NO: 27616 - DNA, 21 bp, Homo sapiens
gggcagctgcaggccacagtg

SEQ ID NO: 27617 - DNA, 23 bp, Homo sapiens
gtttcatcatattggtcagggtg

SEQ ID NO: 27618 - DNA, 21 bp, Homo sapiens
tcctgaaccactggccccaac

SEQ ID NO: 27619 - DNA, 18 bp, Homo sapiens
tctacctcctgggttcaa

SEQ ID NO: 27620 - DNA, 20 bp, Homo sapiens
tgtcccattccctctctgta

SEQ ID NO: 27621 - DNA, 20 bp, Homo sapiens
ggctcctggaactgcagcag

SEQ ID NO: 27622 - DNA, 16 bp, Homo sapiens
caacctttaaaacatc

SEQ ID NO: 27623 - DNA, 18 bp, Homo sapiens
caagatgtctaggcccgg

SEQ ID NO: 27624 - DNA, 19 bp, Homo sapiens
ccaaaatcacgccactgca

SEQ ID NO: 27625 - DNA, 25 bp, Homo sapiens
ttctggttcctatgaagatttggaa

SEQ ID NO: 27626 - DNA, 20 bp, Homo sapiens
aagcgccttttcctgcagct

SEQ ID NO: 27627 - DNA, 22 bp, Homo sapiens
accagagagcagcccacgggca

SEQ ID NO: 27628 - DNA, 18 bp, Homo sapiens
acctcggctgctaggccc

SEQ ID NO: 27629 - DNA, 17 bp, Homo sapiens
ccacggccccactgtcc

SEQ ID NO: 27630 - DNA, 20 bp, Homo sapiens
gcgtaggggccgttgcccgc

SEQ ID NO: 27631 - DNA, 20 bp, Homo sapiens
gggcagatgctaggtcagtt

SEQ ID NO: 27632 - DNA, 18 bp, Homo sapiens
gtgctggtaagacctgct

SEQ ID NO: 27633 - DNA, 21 bp, Homo sapiens
gtggcaaaggggtaggctcta

SEQ ID NO: 27634 - DNA, 18 bp, Homo sapiens
cttgtgccctcactatgc

SEQ ID NO: 27635 - DNA, 20 bp, Homo sapiens
ccctgctagagcagccgcgc

SEQ ID NO: 27636 - DNA, 27 bp, Homo sapiens
ctactccacacatgcaggaggcgggtg

SEQ ID NO: 27637 - DNA, 16 bp, Homo sapiens
gaaataacgcattcga

SEQ ID NO: 27638 - DNA, 24 bp, Homo sapiens
tgagaagattaaaaaaaaatctca

SEQ ID NO: 27639 - DNA, 21 bp, Homo sapiens
ctccagaaacctactggatga

SEQ ID NO: 27640 - DNA, 17 bp, Homo sapiens
ctgtggagaagtctcct

SEQ ID NO: 27641 - DNA, 19 bp, Homo sapiens
ggatggaggcagggggctg

SEQ ID NO: 27642 - DNA, 18 bp, Homo sapiens
cactgcctcatggcatca

SEQ ID NO: 27643 - DNA, 20 bp, Homo sapiens
ctgcctcatggcatcatcca

SEQ ID NO: 27644 - DNA, 20 bp, Homo sapiens
cccttccccaccctctggcc

SEQ ID NO: 27645 - DNA, 20 bp, Homo sapiens
cttctctggtcctctgcatc

SEQ ID NO: 27646 - DNA, 18 bp, Homo sapiens
caagacactgcctaaggt

SEQ ID NO: 27647 - DNA, 21 bp, Homo sapiens
caataaagcagactattccta

SEQ ID NO: 27648 - DNA, 20 bp, Homo sapiens
ctgggccctaggcctagccc

SEQ ID NO: 27649 - DNA, 19 bp, Homo sapiens
aaggatccattgtaccgtt

SEQ ID NO: 27650 - DNA, 21 bp, Homo sapiens
cctgagcagaatggaatcatt

SEQ ID NO: 27651 - DNA, 18 bp, Homo sapiens
ctctattccccctgccct

SEQ ID NO: 27652 - DNA, 20 bp, Homo sapiens
tgaatgggctttcagaaggc

SEQ ID NO: 27653 - DNA, 18 bp, Homo sapiens
accttctggagtacactg

SEQ ID NO: 27654 - DNA, 18 bp, Homo sapiens
atctcttaaaatgaggaa

SEQ ID NO: 27655 - DNA, 21 bp, Homo sapiens
caagactggtggacaagtgta

SEQ ID NO: 27656 - DNA, 18 bp, Homo sapiens
ccaggggcaatgtttaca

SEQ ID NO: 27657 - DNA, 23 bp, Homo sapiens
cccacagtacaaaggtaccgtca

SEQ ID NO: 27658 - DNA, 27 bp, Homo sapiens
gagagccaggagcccttcaaggtctcc

SEQ ID NO: 27659 - DNA, 18 bp, Homo sapiens
tagcagactgtgcaggga

SEQ ID NO: 27660 - DNA, 21 bp, Homo sapiens
tctgccgccatggttgtgcaa

SEQ ID NO: 27661 - DNA, 18 bp, Homo sapiens
ggaccccgtgctgcctca

SEQ ID NO: 27662 - DNA, 19 bp, Homo sapiens
acaaaactgttatctgatg

SEQ ID NO: 27663 - DNA, 22 bp, Homo sapiens
gtcctcctgagctgtgatcaga

SEQ ID NO: 27664 - DNA, 18 bp, Homo sapiens
aaagttgggactgagcag

SEQ ID NO: 27665 - DNA, 21 bp, Homo sapiens
agaaagggtggccactttccc

SEQ ID NO: 27666 - DNA, 18 bp, Homo sapiens
agggcgcgcggcatttcc

SEQ ID NO: 27667 - DNA, 17 bp, Homo sapiens
ctccccaacctcctcca

SEQ ID NO: 27668 - DNA, 17 bp, Homo sapiens
gctagaacacagcaggg

SEQ ID NO: 27669 - DNA, 18 bp, Homo sapiens
gacacctacagcatcagg

SEQ ID NO: 27670 - DNA, 23 bp, Homo sapiens
ccgttcagttctcctgggctcca

SEQ ID NO: 27671 - DNA, 18 bp, Homo sapiens
cgggagggaacatcctgc

SEQ ID NO: 27672 - DNA, 18 bp, Homo sapiens
ctgttgcaggcaaatgta

SEQ ID NO: 27673 - DNA, 20 bp, Homo sapiens
agcctaagagctaaggcagt

SEQ ID NO: 27674 - DNA, 18 bp, Homo sapiens
gatcctgaaacatgcggg

SEQ ID NO: 27675 - DNA, 19 bp, Homo sapiens
gtggtctttcttgttttta

SEQ ID NO: 27676 - DNA, 17 bp, Homo sapiens
tcctgaaacatgcggga

SEQ ID NO: 27677 - DNA, 19 bp, Homo sapiens
aactgttgagttgatcaca

SEQ ID NO: 27678 - DNA, 21 bp, Homo sapiens
aactgttgagttgatcacata

SEQ ID NO: 27679 - DNA, 17 bp, Homo sapiens
aatcgcaccttatctga

SEQ ID NO: 27680 - DNA, 19 bp, Homo sapiens
accacttacagctttctca

SEQ ID NO: 27681 - DNA, 21 bp, Homo sapiens
agttttctttctttccttgtc

SEQ ID NO: 27682 - DNA, 20 bp, Homo sapiens
atgtttgaggacctgcaata

SEQ ID NO: 27683 - DNA, 21 bp, Homo sapiens
ccaaagatcaaacacagcatt

SEQ ID NO: 27684 - DNA, 19 bp, Homo sapiens
cggtggaatgacgtggcca

SEQ ID NO: 27685 - DNA, 15 bp, Homo sapiens
ctcctttatcttgca

SEQ ID NO: 27686 - DNA, 22 bp, Homo sapiens
ggaacatggggaccaacaaagc

SEQ ID NO: 27687 - DNA, 19 bp, Homo sapiens
tctgagatctggtgtcaga

SEQ ID NO: 27688 - DNA, 18 bp, Homo sapiens
ttggcaaatcgcacctta

SEQ ID NO: 27689 - DNA, 23 bp, Homo sapiens
tttgatttttcaagagacaagaa

SEQ ID NO: 27690 - DNA, 19 bp, Homo sapiens
aactgttgagttgatcaca

SEQ ID NO: 27691 - DNA, 21 bp, Homo sapiens
aactgttgagttgatcacata

SEQ ID NO: 27692 - DNA, 17 bp, Homo sapiens
aatcgcaccttatctga

SEQ ID NO: 27693 - DNA, 19 bp, Homo sapiens
accacttacagctttctca

SEQ ID NO: 27694 - DNA, 21 bp, Homo sapiens
agttttctttctttccttgtc

SEQ ID NO: 27695 - DNA, 20 bp, Homo sapiens
atgtttgaggacctgcaata

SEQ ID NO: 27696 - DNA, 21 bp, Homo sapiens
ccaaagatcaaacacagcatt

SEQ ID NO: 27697 - DNA, 19 bp, Homo sapiens
cggtggaatgacgtggcca

SEQ ID NO: 27698 - DNA, 15 bp, Homo sapiens
ctcctttatcttgca

SEQ ID NO: 27699 - DNA, 22 bp, Homo sapiens
ggaacatggggaccaacaaagc

SEQ ID NO: 27700 - DNA, 19 bp, Homo sapiens
tctgagatctggtgtcaga

SEQ ID NO: 27701 - DNA, 18 bp, Homo sapiens
ttggcaaatcgcacctta

SEQ ID NO: 27702 - DNA, 23 bp, Homo sapiens
tttgatttttcaagagacaagaa

SEQ ID NO: 27703 - DNA, 21 bp, Homo sapiens
aactgggacatatagatacca

SEQ ID NO: 27704 - DNA, 18 bp, Homo sapiens
aagaaccaaatgcactgt

SEQ ID NO: 27705 - DNA, 25 bp, Homo sapiens
ctttttgtggaacatgtagtttata

SEQ ID NO: 27706 - DNA, 20 bp, Homo sapiens
gaacactagtcctacctctg

SEQ ID NO: 27707 - DNA, 19 bp, Homo sapiens
gcttaatattctcattgca

SEQ ID NO: 27708 - DNA, 19 bp, Homo sapiens
tatcttgctctgagtagta

SEQ ID NO: 27709 - DNA, 18 bp, Homo sapiens
accactaattgtgtacat

SEQ ID NO: 27710 - DNA, 30 bp, Homo sapiens; identical to SEQ ID NO: 11049

SEQ ID NO: 27711 - DNA, 21 bp, Homo sapiens
ctaagcaaacaagttggaatt

SEQ ID NO: 27712 - DNA, 20 bp, Homo sapiens
cctctgcctcctgggttcaa

SEQ ID NO: 27713 - DNA, 22 bp, Homo sapiens
tgttctcatctatgttaatgaa

SEQ ID NO: 27714 - DNA, 16 bp, Homo sapiens
gccagcccgcacgcgc

SEQ ID NO: 27715 - DNA, 22 bp, Homo sapiens
gcccgcacgcgctcatctttct

SEQ ID NO: 27716 - DNA, 18 bp, Homo sapiens
accagcctcctcagacaa

SEQ ID NO: 27717 - DNA, 19 bp, Homo sapiens
atgtttggcgggcatgtga

SEQ ID NO: 27718 - DNA, 21 bp, Homo sapiens
ctgctttgatgtgaactggta

SEQ ID NO: 27719 - DNA, 19 bp, Homo sapiens
gaaacagaggaacccatca

SEQ ID NO: 27720 - DNA, 19 bp, Homo sapiens
gaagaaacagaggaaccca

SEQ ID NO: 27721 - DNA, 18 bp, Homo sapiens
gatgcgaaatggatattc

SEQ ID NO: 27722 - DNA, 22 bp, Homo sapiens
ggttttggcccctttgctgcaa

SEQ ID NO: 27723 - DNA, 18 bp, Homo sapiens
tctagcttgaaacttttg

SEQ ID NO: 27724 - DNA, 18 bp, Homo sapiens
acacccgctccacctgca

SEQ ID NO: 27725 - DNA, 18 bp, Homo sapiens
accccgagaccgcgctgg

SEQ ID NO: 27726 - DNA, 16 bp, Homo sapiens
acccgctccacctgca

SEQ ID NO: 27727 - DNA, 19 bp, Homo sapiens
cacacccgctccacctgca

SEQ ID NO: 27728 - DNA, 21 bp, Homo sapiens
gcaggactgagggtttttgca

SEQ ID NO: 27729 - DNA, 21 bp, Homo sapiens
gcaggactgagggtttttgca

SEQ ID NO: 27730 - DNA, 21 bp, Homo sapiens
acgctcaaccccaagtccttt

SEQ ID NO: 27731 - DNA, 24 bp, Homo sapiens
acttggaccgcttcagcctgggct

SEQ ID NO: 27732 - DNA, 23 bp, Homo sapiens
aggtgtccctcccctgctagtca

SEQ ID NO: 27733 - DNA, 22 bp, Homo sapiens
cctgctgagacctaggttgcca

SEQ ID NO: 27734 - DNA, 23 bp, Homo sapiens
gccacccagctggacacgggaga

SEQ ID NO: 27735 - DNA, 18 bp, Homo sapiens
gttcttccccctccatgt

SEQ ID NO: 27736 - DNA, 19 bp, Homo sapiens
tcatcatactggcactgtt

SEQ ID NO: 27737 - DNA, 16 bp, Homo sapiens
aggtcaacattgacca

SEQ ID NO: 27738 - DNA, 19 bp, Homo sapiens
cattggaggagtggtttaa

SEQ ID NO: 27739 - DNA, 24 bp, Homo sapiens
cctagaagttcttgattcattttt

SEQ ID NO: 27740 - DNA, 17 bp, Homo sapiens
tcactgatatatgtaga

SEQ ID NO: 27741 - DNA, 21 bp, Homo sapiens
tggggtctcctgggttcagcg

SEQ ID NO: 27742 - DNA, 18 bp, Homo sapiens
agtaagataatctcatca

SEQ ID NO: 27743 - DNA, 17 bp, Homo sapiens
aagtctgactagaattc

SEQ ID NO: 27744 - DNA, 20 bp, Homo sapiens
aggcatcagagtaatcttca

SEQ ID NO: 27745 - DNA, 23 bp, Homo sapiens
caaagaaggcaataaggaaccca

SEQ ID NO: 27746 - DNA, 17 bp, Homo sapiens
caccatctcccctcaaa

SEQ ID NO: 27747 - DNA, 20 bp, Homo sapiens
tttaagtggctaacatccaa

SEQ ID NO: 27748 - DNA, 18 bp, Homo sapiens
agaaaacaccctcaaagg

SEQ ID NO: 27749 - DNA, 20 bp, Homo sapiens
cagaagaactccattcttgt

SEQ ID NO: 27750 - DNA, 24 bp, Homo sapiens
tgtatgaacaagtgtttttggaat

SEQ ID NO: 27751 - DNA, 22 bp, Homo sapiens
ttatttcatcttccctattcca

SEQ ID NO: 27752 - DNA, 19 bp, Homo sapiens
ttgagtctccctggtggag

SEQ ID NO: 27753 - DNA, 20 bp, Homo sapiens
cacacagccatgcattgtca

SEQ ID NO: 27754 - DNA, 23 bp, Homo sapiens
ccctggaggggagggtctgtggg

SEQ ID NO: 27755 - DNA, 22 bp, Homo sapiens
gcctgggagacccatctggtcc

SEQ ID NO: 27756 - DNA, 19 bp, Homo sapiens
cgagatcttggaggtccgg

SEQ ID NO: 27757 - DNA, 20 bp, Homo sapiens
agtcatgatgatgggcagcg

SEQ ID NO: 27758 - DNA, 17 bp, Homo sapiens
cggctggacgtgcgcga

SEQ ID NO: 27759 - DNA, 23 bp, Homo sapiens
tgaaagaaccagagaggctctga

SEQ ID NO: 27760 - DNA, 19 bp, Homo sapiens
tgtgttggagttttctgga

SEQ ID NO: 27761 - DNA, 20 bp, Homo sapiens
cgccggccggccagcaccca

SEQ ID NO: 27762 - DNA, 19 bp, Homo sapiens
acagcatttatttgtacta

SEQ ID NO: 27763 - DNA, 20 bp, Homo sapiens
agatataccgtgtgaagcta

SEQ ID NO: 27764 - DNA, 17 bp, Homo sapiens
atatgtatgtgtggtta

SEQ ID NO: 27765 - DNA, 17 bp, Homo sapiens
atgcttaagctatgtca

SEQ ID NO: 27766 - DNA, 24 bp, Homo sapiens
gagacataatgacagctgatgtta

SEQ ID NO: 27767 - DNA, 19 bp, Homo sapiens
tcatgcttaagctatgtca

SEQ ID NO: 27768 - DNA, 22 bp, Homo sapiens
actaccagatgtgtgcagtgca

SEQ ID NO: 27769 - DNA, 22 bp, Homo sapiens
ataaggtggttgtgctactgta

SEQ ID NO: 27770 - DNA, 21 bp, Homo sapiens
gtatactgacaactgtttaca

SEQ ID NO: 27771 - DNA, 19 bp, Homo sapiens
tttgttacaaagccactga

SEQ ID NO: 27772 - DNA, 19 bp, Homo sapiens
acacaggacatcgttgctg

SEQ ID NO: 27773 - DNA, 21 bp, Homo sapiens
agaccccccgaccctccccca

SEQ ID NO: 27774 - DNA, 21 bp, Homo sapiens
agtgccgtggaggtgtgtgtg

SEQ ID NO: 27775 - DNA, 18 bp, Homo sapiens
cggacagacgtcccgcca

SEQ ID NO: 27776 - DNA, 23 bp, Homo sapiens
ctccagacacaatggcactgctt

SEQ ID NO: 27777 - DNA, 20 bp, Homo sapiens
gacagacgtcccgccaccca

SEQ ID NO: 27778 - DNA, 18 bp, Homo sapiens
gggcgactgtcctgcgtg

SEQ ID NO: 27779 - DNA, 21 bp, Homo sapiens
cgaaatggacaaagtggcatc

SEQ ID NO: 27780 - DNA, 19 bp, Homo sapiens
cctcccccttgtcctttcc

SEQ ID NO: 27781 - DNA, 24 bp, Homo sapiens
gcctggactgttttctctcggctc

SEQ ID NO: 27782 - DNA, 18 bp, Homo sapiens
gcgaccttcctcatccac

SEQ ID NO: 27783 - DNA, 24 bp, Homo sapiens
tgggcatttttattttatgaaata

SEQ ID NO: 27784 - DNA, 18 bp, Homo sapiens
tgggctcatatggggctg

SEQ ID NO: 27785 - DNA, 23 bp, Homo sapiens
aatttcaaatggatccgatctaa

SEQ ID NO: 27786 - DNA, 26 bp, Homo sapiens
tactggagagagacacacagatctaa

SEQ ID NO: 27787 - DNA, 17 bp, Homo sapiens
ctagttcctcttttgat

SEQ ID NO: 27788 - DNA, 18 bp, Homo sapiens
ctagttcctcttttgata

SEQ ID NO: 27789 - DNA, 18 bp, Homo sapiens
tccacttcccaggttcaa

SEQ ID NO: 27790 - DNA, 22 bp, Homo sapiens
tgataaggctgttaacattaca

SEQ ID NO: 27791 - DNA, 19 bp, Homo sapiens
tggatcaagaatgcattaa

SEQ ID NO: 27792 - DNA, 20 bp, Homo sapiens
tggccgggctggtcttgaac

SEQ ID NO: 27793 - DNA, 18 bp, Homo sapiens
ttcaagcgattctcatgc

SEQ ID NO: 27794 - DNA, 17 bp, Homo sapiens
ttgacataccaagtggt

SEQ ID NO: 27795 - DNA, 20 bp, Homo sapiens
tttctttatgatcttaactt

SEQ ID NO: 27796 - DNA, 19 bp, Homo sapiens
agcacgttgacctccctct

SEQ ID NO: 27797 - DNA, 17 bp, Homo sapiens
ccagcccccaccccacc

SEQ ID NO: 27798 - DNA, 18 bp, Homo sapiens
cctgctggttcttggccc

SEQ ID NO: 27799 - DNA, 19 bp, Homo sapiens
ctccagcccccaccccacc

SEQ ID NO: 27800 - DNA, 18 bp, Homo sapiens
gtatatatgaaaatttga

SEQ ID NO: 27801 - DNA, 24 bp, Homo sapiens
cacacaatccccagggttcctgag

SEQ ID NO: 27802 - DNA, 16 bp, Homo sapiens
caccgctcatcccgat

SEQ ID NO: 27803 - DNA, 21 bp, Homo sapiens
gcaataccgggccgtgtcctc

SEQ ID NO: 27804 - DNA, 21 bp, Homo sapiens
ggacttggaatgaggcctaca

SEQ ID NO: 27805 - DNA, 24 bp, Homo sapiens
ttgagacgccttacaaatgatgga

SEQ ID NO: 27806 - DNA, 21 bp, Homo sapiens
aatggcactgttgcaaactca

SEQ ID NO: 27807 - DNA, 17 bp, Homo sapiens
caaactaaaggtgcact

SEQ ID NO: 27808 - DNA, 17 bp, Homo sapiens
cggctggacgtgcgcga

SEQ ID NO: 27809 - DNA, 22 bp, Homo sapiens
ggcggggcagtgaggactccgc

SEQ ID NO: 27810 - DNA, 20 bp, Homo sapiens
aactccatcagatcttctca

SEQ ID NO: 27811 - DNA, 22 bp, Homo sapiens
tatgacctgtgccctgttcttc

SEQ ID NO: 27812 - DNA, 19 bp, Homo sapiens
ttctcacctcctcttagcc

SEQ ID NO: 27813 - DNA, 21 bp, Homo sapiens
tttttttgatgaagccgagca

SEQ ID NO: 27814 - DNA, 21 bp, Homo sapiens
gcccccgcccgccctccccca

SEQ ID NO: 27815 - DNA, 20 bp, Homo sapiens
gccccggagcctcgccctcc

SEQ ID NO: 27816 - DNA, 21 bp, Homo sapiens
tttttttgatgaagccgagca

SEQ ID NO: 27817 - DNA, 18 bp, Homo sapiens
gtggggttatgtatcaga

SEQ ID NO: 27818 - DNA, 20 bp, Homo sapiens
agtttcactctgtcgcccag

SEQ ID NO: 27819 - DNA, 18 bp, Homo sapiens
caccgcccaccacctcct

SEQ ID NO: 27820 - DNA, 20 bp, Homo sapiens
ccacaactttggacacccca

SEQ ID NO: 27821 - DNA, 19 bp, Homo sapiens
cctggggagttcctggtcc

SEQ ID NO: 27822 - DNA, 20 bp, Homo sapiens
cgtgtggtcacccgccgtcc

SEQ ID NO: 27823 - DNA, 23 bp, Homo sapiens
aagtgcttcaaatacttctctct

SEQ ID NO: 27824 - DNA, 19 bp, Homo sapiens
aatgtttccttttacttca

SEQ ID NO: 27825 - DNA, 22 bp, Homo sapiens
ccctgttaatgaacaggacaaa

SEQ ID NO: 27826 - DNA, 20 bp, Homo sapiens
aggagaaatacctgatgtag

SEQ ID NO: 27827 - DNA, 21 bp, Homo sapiens
tactataaagacacatgcaca

SEQ ID NO: 27828 - DNA, 19 bp, Homo sapiens
tgaacaatgagaatacatg

SEQ ID NO: 27829 - DNA, 19 bp, Homo sapiens
attcaagtggattctaaat

SEQ ID NO: 27830 - DNA, 23 bp, Homo sapiens
ggagacgcagcggcggccgcagc

SEQ ID NO: 27831 - DNA, 16 bp, Homo sapiens
gtgcctaaatgtagta

SEQ ID NO: 27832 - DNA, 21 bp, Homo sapiens
tcactttccccatcacactca

SEQ ID NO: 27833 - DNA, 21 bp, Homo sapiens
aaagtggtaccgacttcccca

SEQ ID NO: 27834 - DNA, 22 bp, Homo sapiens
ggacaatgctggtacgtaccca

SEQ ID NO: 27835 - DNA, 21 bp, Homo sapiens
aaagtggtaccgacttcccca

SEQ ID NO: 27836 - DNA, 18 bp, Homo sapiens
caaactgtggagatcact

SEQ ID NO: 27837 - DNA, 17 bp, Homo sapiens
ctccccaaccaagtcca

SEQ ID NO: 27838 - DNA, 22 bp, Homo sapiens
ggacaatgctggtacgtaccca

SEQ ID NO: 27839 - DNA, 20 bp, Homo sapiens
ggttttggggatgcagtcaa

SEQ ID NO: 27840 - DNA, 18 bp, Homo sapiens
agctatgattaggacaac

SEQ ID NO: 27841 - DNA, 17 bp, Homo sapiens
gggttttctgaccctca

SEQ ID NO: 27842 - DNA, 19 bp, Homo sapiens
actaaggacacaagaatca

SEQ ID NO: 27843 - DNA, 20 bp, Homo sapiens
ccactacctcctccaacaaa

SEQ ID NO: 27844 - DNA, 19 bp, Homo sapiens
ccctccacccactacctcc

SEQ ID NO: 27845 - DNA, 18 bp, Homo sapiens
ctccagagctggcccttc

SEQ ID NO: 27846 - DNA, 21 bp, Homo sapiens
cttagggaggttggtgtcaga

SEQ ID NO: 27847 - DNA, 19 bp, Homo sapiens
gctctgagccagattccac

SEQ ID NO: 27848 - DNA, 18 bp, Homo sapiens
ggaggagggcagggcttg

SEQ ID NO: 27849 - DNA, 22 bp, Homo sapiens
gggacagctaccactgtcctct

SEQ ID NO: 27850 - DNA, 24 bp, Homo sapiens
tggatgggggtgatgcagggactg

SEQ ID NO: 27851 - DNA, 16 bp, Homo sapiens
atctccaaggtgaggt

SEQ ID NO: 27852 - DNA, 18 bp, Homo sapiens
atcttgacctcttggctc

SEQ ID NO: 27853 - DNA, 18 bp, Homo sapiens
catcaccatttttcctga

SEQ ID NO: 27854 - DNA, 16 bp, Homo sapiens
atctccaaggtgaggt

SEQ ID NO: 27855 - DNA, 18 bp, Homo sapiens
atcttgacctcttggctc

SEQ ID NO: 27856 - DNA, 18 bp, Homo sapiens
catcaccatttttcctga

SEQ ID NO: 27857 - DNA, 16 bp, Homo sapiens
atctccaaggtgaggt

SEQ ID NO: 27858 - DNA, 18 bp, Homo sapiens
atcttgacctcttggctc

SEQ ID NO: 27859 - DNA, 18 bp, Homo sapiens
catcaccatttttcctga

SEQ ID NO: 27860 - DNA, 16 bp, Homo sapiens
atctccaaggtgaggt

SEQ ID NO: 27861 - DNA, 18 bp, Homo sapiens
atcttgacctcttggctc

SEQ ID NO: 27862 - DNA, 18 bp, Homo sapiens
catcaccatttttcctga

SEQ ID NO: 27863 - DNA, 16 bp, Homo sapiens
atctccaaggtgaggt

SEQ ID NO: 27864 - DNA, 18 bp, Homo sapiens
atcttgacctcttggctc

SEQ ID NO: 27865 - DNA, 18 bp, Homo sapiens
catcaccatttttcctga

SEQ ID NO: 27866 - DNA, 18 bp, Homo sapiens
acagggatttaatacctt

SEQ ID NO: 27867 - DNA, 19 bp, Homo sapiens
gattttggactttcacaaa

SEQ ID NO: 27868 - DNA, 22 bp, Homo sapiens
gtatttttgtataacttgattg

SEQ ID NO: 27869 - DNA, 26 bp, Homo sapiens
aaagacacgattcctcagaccagtga

SEQ ID NO: 27870 - DNA, 20 bp, Homo sapiens
cagagactataaagatttca

SEQ ID NO: 27871 - DNA, 18 bp, Homo sapiens
ccttagatctcccttcca

SEQ ID NO: 27872 - DNA, 21 bp, Homo sapiens
ccttcccttcacttctgtcca

SEQ ID NO: 27873 - DNA, 16 bp, Homo sapiens
ttcagagaccgttcca

SEQ ID NO: 27874 - DNA, 21 bp, Homo sapiens
ttccagagaccaccttcccag

SEQ ID NO: 27875 - DNA, 26 bp, Homo sapiens
aaagacacgattcctcagaccagtga

SEQ ID NO: 27876 - DNA, 22 bp, Homo sapiens
acagataatgtcttttaatcca

SEQ ID NO: 27877 - DNA, 20 bp, Homo sapiens
cagagactataaagatttca

SEQ ID NO: 27878 - DNA, 22 bp, Homo sapiens
cagcctggccaacacaatgaaa

SEQ ID NO: 27879 - DNA, 18 bp, Homo sapiens
ccttagatctcccttcca

SEQ ID NO: 27880 - DNA, 18 bp, Homo sapiens
gcacattagctccgctca

SEQ ID NO: 27881 - DNA, 21 bp, Homo sapiens
ttcaaggtgagtagcttccaa

SEQ ID NO: 27882 - DNA, 21 bp, Homo sapiens
ttccagagaccaccttcccag

SEQ ID NO: 27883 - DNA, 21 bp, Homo sapiens
caagggcgagcccccgccgcg

SEQ ID NO: 27884 - DNA, 21 bp, Homo sapiens
ccaccgccgccgccgccgctc

SEQ ID NO: 27885 - DNA, 22 bp, Homo sapiens
acagctggagtcaaacaactta

SEQ ID NO: 27886 - DNA, 20 bp, Homo sapiens
aagaaagaagcccaggtgtc

SEQ ID NO: 27887 - DNA, 19 bp, Homo sapiens
ccccatctcagagctcaga

SEQ ID NO: 27888 - DNA, 18 bp, Homo sapiens
gcccacacctccacctcc

SEQ ID NO: 27889 - DNA, 20 bp, Homo sapiens
aagaaagaagcccaggtgtc

SEQ ID NO: 27890 - DNA, 19 bp, Homo sapiens
ccccatctcagagctcaga

SEQ ID NO: 27891 - DNA, 18 bp, Homo sapiens
gcccacacctccacctcc

SEQ ID NO: 27892 - DNA, 19 bp, Homo sapiens
agatataacattcagttcc

SEQ ID NO: 27893 - DNA, 20 bp, Homo sapiens
ccaaatatgtattttcctaa

SEQ ID NO: 27894 - DNA, 20 bp, Homo sapiens
cttctaaccccctctgctct

SEQ ID NO: 27895 - DNA, 23 bp, Homo sapiens
gcctgatcttgcctgtctggctc

SEQ ID NO: 27896 - DNA, 19 bp, Homo sapiens
gggatccttgggcccatca

SEQ ID NO: 27897 - DNA, 18 bp, Homo sapiens
gtttcctggaaaagaaga

SEQ ID NO: 27898 - DNA, 26 bp, Homo sapiens
tacaatcagttgactttaagtgaaag

SEQ ID NO: 27899 - DNA, 22 bp, Homo sapiens
tcccctcttctgctaatacctc

SEQ ID NO: 27900 - DNA, 18 bp, Homo sapiens
tcctggtttgactcagtt

SEQ ID NO: 27901 - DNA, 26 bp, Homo sapiens
ttctggccaaggggtgggcctgtgaa

SEQ ID NO: 27902 - DNA, 18 bp, Homo sapiens
agtgagtggagagccagc

SEQ ID NO: 27903 - DNA, 20 bp, Homo sapiens
gtccgtgcaccgatgcacac

SEQ ID NO: 27904 - DNA, 22 bp, Homo sapiens
tctcttttgagttttatacctt

SEQ ID NO: 27905 - DNA, 23 bp, Homo sapiens
cttagtgctctgaatttactttt

SEQ ID NO: 27906 - DNA, 19 bp, Homo sapiens
gattttaatcaccattaca

SEQ ID NO: 27907 - DNA, 20 bp, Homo sapiens
tacgcgctctccctgtttag

SEQ ID NO: 27908 - DNA, 17 bp, Homo sapiens
caacaccggaacaagcc

SEQ ID NO: 27909 - DNA, 18 bp, Homo sapiens
gaggcagaaacaccagcc

SEQ ID NO: 27910 - DNA, 19 bp, Homo sapiens
ttttttgttttcccccact

SEQ ID NO: 27911 - DNA, 22 bp, Homo sapiens
tctgtgcgcggccggctggctc

SEQ ID NO: 27912 - DNA, 23 bp, Homo sapiens
atctgggaatgattgtctagcct

SEQ ID NO: 27913 - DNA, 23 bp, Homo sapiens
ccacagctgaggtccttctctca

SEQ ID NO: 27914 - DNA, 18 bp, Homo sapiens
ccaccccatctgagaaac

SEQ ID NO: 27915 - DNA, 22 bp, Homo sapiens
ctttggaaaaaagatctgggaa

SEQ ID NO: 27916 - DNA, 21 bp, Homo sapiens
gacaatgctgaatgggctcct

SEQ ID NO: 27917 - DNA, 24 bp, Homo sapiens
gcctgggcgagcttgctgtggtcc

SEQ ID NO: 27918 - DNA, 20 bp, Homo sapiens
tcctggtggatggacctcgg

SEQ ID NO: 27919 - DNA, 20 bp, Homo sapiens
tgagaaagttgtatacactc

SEQ ID NO: 27920 - DNA, 23 bp, Homo sapiens
tggatggacctcgggtgcagctg

SEQ ID NO: 27921 - DNA, 21 bp, Homo sapiens
tggtaccaccccatctgagaa

SEQ ID NO: 27922 - DNA, 16 bp, Homo sapiens
aaacaggaccagccgg

SEQ ID NO: 27923 - DNA, 19 bp, Homo sapiens
aggaaagacttttatgtca

SEQ ID NO: 27924 - DNA, 21 bp, Homo sapiens
cactgaacccattgtttcttt

SEQ ID NO: 27925 - DNA, 18 bp, Homo sapiens
cacccccttcctgtcacc

SEQ ID NO: 27926 - DNA, 22 bp, Homo sapiens
aagacacgaagcgacctaccca

SEQ ID NO: 27927 - DNA, 21 bp, Homo sapiens
agctcattcctctacctcata

SEQ ID NO: 27928 - DNA, 20 bp, Homo sapiens
ggcctctggagaccatcttg

SEQ ID NO: 27929 - DNA, 23 bp, Homo sapiens
gtcctgcattctgactgagattg

SEQ ID NO: 27930 - DNA, 23 bp, Homo sapiens
tgcaagctcattcctctacctca

SEQ ID NO: 27931 - DNA, 19 bp, Homo sapiens
gccacactccaagcacctg

SEQ ID NO: 27932 - DNA, 21 bp, Homo sapiens
atctgggtcccattctggtct

SEQ ID NO: 27933 - DNA, 22 bp, Homo sapiens
gctttgtcccagaagtccagag

SEQ ID NO: 27934 - DNA, 20 bp, Homo sapiens
aataggcatttaatgaaaca

SEQ ID NO: 27935 - DNA, 23 bp, Homo sapiens
tttgggtggagcagagtcgcttt

SEQ ID NO: 27936 - DNA, 18 bp, Homo sapiens
gccacagaagatgtcatg

SEQ ID NO: 27937 - DNA, 21 bp, Homo sapiens
tgaatgagacaaaagcagtgg

SEQ ID NO: 27938 - DNA, 23 bp, Homo sapiens
ctccttctctctttcttgctcca

SEQ ID NO: 27939 - DNA, 19 bp, Homo sapiens
tagtgccaactttcttgga

SEQ ID NO: 27940 - DNA, 19 bp, Homo sapiens
acggtgtacgagctccctc

SEQ ID NO: 27941 - DNA, 24 bp, Homo sapiens
tctgtgtgcagactcccaacgcca

SEQ ID NO: 27942 - DNA, 23 bp, Homo sapiens
cttctttggcttgttttgttttt

SEQ ID NO: 27943 - DNA, 18 bp, Homo sapiens
tggatcacacacattcga

SEQ ID NO: 27944 - DNA, 24 bp, Homo sapiens
cagaagaactgcttgaacctggga

SEQ ID NO: 27945 - DNA, 22 bp, Homo sapiens
cagcctggccaacacgatgaaa

SEQ ID NO: 27946 - DNA, 18 bp, Homo sapiens
agtgatcatcccacctca

SEQ ID NO: 27947 - DNA, 25 bp, Homo sapiens
gagactaatcctagagtactttgca

SEQ ID NO: 27948 - DNA, 21 bp, Homo sapiens
attcattttgaccacgaggca

SEQ ID NO: 27949 - DNA, 22 bp, Homo sapiens
gagtttcttcttcaaggtctca

SEQ ID NO: 27950 - DNA, 16 bp, Homo sapiens
cattcaaatgttttac

SEQ ID NO: 27951 - DNA, 18 bp, Homo sapiens
cctgcaacctccacctcc

SEQ ID NO: 27952 - DNA, 21 bp, Homo sapiens
taagaatctttacttgatata

SEQ ID NO: 27953 - DNA, 24 bp, Homo sapiens
tgcaacctccacctcctggattca

SEQ ID NO: 27954 - DNA, 21 bp, Homo sapiens
actaacagttttagaaagtga

SEQ ID NO: 27955 - DNA, 24 bp, Homo sapiens
agctatccttttgcctttacctca

SEQ ID NO: 27956 - DNA, 19 bp, Homo sapiens
cctcaccactattacccta

SEQ ID NO: 27957 - DNA, 18 bp, Homo sapiens
ctccctggccatgctgaa

SEQ ID NO: 27958 - DNA, 20 bp, Homo sapiens
cactgcctggatgcatctca

SEQ ID NO: 27959 - DNA, 19 bp, Homo sapiens
gtgggtttcccctttgatt

SEQ ID NO: 27960 - DNA, 18 bp, Homo sapiens
tcactggctgatgcagca

SEQ ID NO: 27961 - DNA, 19 bp, Homo sapiens
ttccagcccaaactgcaca

SEQ ID NO: 27962 - DNA, 17 bp, Homo sapiens
ccattacccaaaccact

SEQ ID NO: 27963 - DNA, 18 bp, Homo sapiens
ctgtagctcaatcagtgt

SEQ ID NO: 27964 - DNA, 23 bp, Homo sapiens
gaattaaggtaacatcaatacct

SEQ ID NO: 27965 - DNA, 18 bp, Homo sapiens
tcctcacccttccacttt

SEQ ID NO: 27966 - DNA, 22 bp, Homo sapiens
tgggccctggcttaagccgaca

SEQ ID NO: 27967 - DNA, 19 bp, Homo sapiens
aacccagcccatttgcaca

SEQ ID NO: 27968 - DNA, 21 bp, Homo sapiens
tgcgggtggctccatcagcca

SEQ ID NO: 27969 - DNA, 25 bp, Homo sapiens
tggggtgggggactaggctcagccg

SEQ ID NO: 27970 - DNA, 21 bp, Homo sapiens
ggagaccgcggcggcggcggc

SEQ ID NO: 27971 - DNA, 17 bp, Homo sapiens
gaagaccatcttcatga

SEQ ID NO: 27972 - DNA, 19 bp, Homo sapiens
tgaggccagagcttgcttt

SEQ ID NO: 27973 - DNA, 24 bp, Homo sapiens
accaggcccacctggaatcccaca

SEQ ID NO: 27974 - DNA, 20 bp, Homo sapiens
aggtgttggctgcctggccc

SEQ ID NO: 27975 - DNA, 21 bp, Homo sapiens
cactgagtatgttcattgcca

SEQ ID NO: 27976 - DNA, 20 bp, Homo sapiens
cccctgtcctcccctgggca

SEQ ID NO: 27977 - DNA, 18 bp, Homo sapiens
ggcacccctcactttccc

SEQ ID NO: 27978 - DNA, 24 bp, Homo sapiens
accaggcccacctggaatcccaca

SEQ ID NO: 27979 - DNA, 20 bp, Homo sapiens
aggtgttggctgcctggccc

SEQ ID NO: 27980 - DNA, 21 bp, Homo sapiens
cactgagtatgttcattgcca

SEQ ID NO: 27981 - DNA, 20 bp, Homo sapiens
cccctgtcctcccctgggca

SEQ ID NO: 27982 - DNA, 18 bp, Homo sapiens
ggcacccctcactttccc

SEQ ID NO: 27983 - DNA, 18 bp, Homo sapiens
caactttcccaatgtggc

SEQ ID NO: 27984 - DNA, 22 bp, Homo sapiens
ctttcaggtactaaatacctca

SEQ ID NO: 27985 - DNA, 18 bp, Homo sapiens
tatagacaaataataagc

SEQ ID NO: 27986 - DNA, 19 bp, Homo sapiens
gcttcaactattgcccttt

SEQ ID NO: 27987 - DNA, 20 bp, Homo sapiens
gggataaactagatatagca

SEQ ID NO: 27988 - DNA, 23 bp, Homo sapiens
gcgcgaaacatggcggggcagga

SEQ ID NO: 27989 - DNA, 21 bp, Homo sapiens
aaactacagaaccacatccca

SEQ ID NO: 27990 - DNA, 22 bp, Homo sapiens
atcttggctcactgcaacctct

SEQ ID NO: 27991 - DNA, 21 bp, Homo sapiens
atggcacatgcttccactcca

SEQ ID NO: 27992 - DNA, 20 bp, Homo sapiens
cacacctggctgttttcttt

SEQ ID NO: 27993 - DNA, 21 bp, Homo sapiens
cagtgctctgtcagcagcctg

SEQ ID NO: 27994 - DNA, 20 bp, Homo sapiens
cctctgcctcccgggttcaa

SEQ ID NO: 27995 - DNA, 22 bp, Homo sapiens
ctttgggaacaaactcttcctt

SEQ ID NO: 27996 - DNA, 25 bp, Homo sapiens
tgcaacctccgcctcctggattcca

SEQ ID NO: 27997 - DNA, 21 bp, Homo sapiens
aaactacagaaccacatccca

SEQ ID NO: 27998 - DNA, 22 bp, Homo sapiens
atcttggctcactgcaacctct

SEQ ID NO: 27999 - DNA, 21 bp, Homo sapiens
atggcacatgcttccactcca

SEQ ID NO: 28000 - DNA, 20 bp, Homo sapiens
cacacctggctgttttcttt

SEQ ID NO: 28001 - DNA, 21 bp, Homo sapiens
cagtgctctgtcagcagcctg

SEQ ID NO: 28002 - DNA, 20 bp, Homo sapiens
cctctgcctcccgggttcaa

SEQ ID NO: 28003 - DNA, 22 bp, Homo sapiens
ctttgggaacaaactcttcctt

SEQ ID NO: 28004 - DNA, 25 bp, Homo sapiens
tgcaacctccgcctcctggattcca

SEQ ID NO: 28005 - DNA, 21 bp, Homo sapiens
aaactacagaaccacatccca

SEQ ID NO: 28006 - DNA, 22 bp, Homo sapiens
atcttggctcactgcaacctct

SEQ ID NO: 28007 - DNA, 21 bp, Homo sapiens
atggcacatgcttccactcca

SEQ ID NO: 28008 - DNA, 20 bp, Homo sapiens
cacacctggctgttttcttt

SEQ ID NO: 28009 - DNA, 21 bp, Homo sapiens
cagtgctctgtcagcagcctg

SEQ ID NO: 28010 - DNA, 20 bp, Homo sapiens
cctctgcctcccgggttcaa

SEQ ID NO: 28011 - DNA, 22 bp, Homo sapiens
ctttgggaacaaactcttcctt

SEQ ID NO: 28012 - DNA, 24 bp, Homo sapiens
gtccaccctcccaggccgacgtca

SEQ ID NO: 28013 - DNA, 25 bp, Homo sapiens
tgcaacctccgcctcctggattcca

SEQ ID NO: 28014 - DNA, 20 bp, Homo sapiens
tgccgctcaccctattccag

SEQ ID NO: 28015 - DNA, 21 bp, Homo sapiens
tttgtgtcttatgttcatcac

SEQ ID NO: 28016 - DNA, 22 bp, Homo sapiens
atatccaaccccagcaatttat

SEQ ID NO: 28017 - DNA, 17 bp, Homo sapiens
gctcactgtcttccaca

SEQ ID NO: 28018 - DNA, 18 bp, Homo sapiens
tgctacttccccatcttt

SEQ ID NO: 28019 - DNA, 17 bp, Homo sapiens
gctcactgtcttccaca

SEQ ID NO: 28020 - DNA, 18 bp, Homo sapiens
tgctacttccccatcttt

SEQ ID NO: 28021 - DNA, 18 bp, Homo sapiens
ccgtcatccgccactgcg

SEQ ID NO: 28022 - DNA, 21 bp, Homo sapiens
tgtggacgccgtcatccgcca

SEQ ID NO: 28023 - DNA, 19 bp, Homo sapiens
agtgaaagaggcgtgttgt

SEQ ID NO: 28024 - DNA, 19 bp, Homo sapiens
tggccagtcagccacaggg

SEQ ID NO: 28025 - DNA, 24 bp, Homo sapiens
tttaagcagtttccaccttgcttt

SEQ ID NO: 28026 - DNA, 19 bp, Homo sapiens
acccccgtgtcctcagcac

SEQ ID NO: 28027 - DNA, 19 bp, Homo sapiens
ccgtgtcctcagcacccca

SEQ ID NO: 28028 - DNA, 24 bp, Homo sapiens
gtccctctgggaggtcaactgcgg

SEQ ID NO: 28029 - DNA, 18 bp, Homo sapiens
gctctgcagaccacctct

SEQ ID NO: 28030 - DNA, 20 bp, Homo sapiens
tctttttatagcaccagact

SEQ ID NO: 28031 - DNA, 19 bp, Homo sapiens
tgggccctcaggggctgca

SEQ ID NO: 28032 - DNA, 22 bp, Homo sapiens
cctcactctggccttgctgctt

SEQ ID NO: 28033 - DNA, 24 bp, Homo sapiens
caaacctcctccttttcaccttca

SEQ ID NO: 28034 - DNA, 18 bp, Homo sapiens
ccaaaagctttcactgaa

SEQ ID NO: 28035 - DNA, 17 bp, Homo sapiens
ccaccttttgttgtttg

SEQ ID NO: 28036 - DNA, 25 bp, Homo sapiens
ccttttcaccttcatccttaacttt

SEQ ID NO: 28037 - DNA, 20 bp, Homo sapiens
ccttttttccccttcccctc

SEQ ID NO: 28038 - DNA, 18 bp, Homo sapiens
ctgttggtcagaaagatg

SEQ ID NO: 28039 - DNA, 19 bp, Homo sapiens
gagcgcctctcgtgctcgc

SEQ ID NO: 28040 - DNA, 24 bp, Homo sapiens
tcagaaaaaaataaagtcctttta

SEQ ID NO: 28041 - DNA, 19 bp, Homo sapiens
tccttttctcccccttctc

SEQ ID NO: 28042 - DNA, 22 bp, Homo sapiens
tctggagtcacagtattaatga

SEQ ID NO: 28043 - DNA, 20 bp, Homo sapiens
tgtctaagaaaactagctta

SEQ ID NO: 28044 - DNA, 17 bp, Homo sapiens
tcccgaggctgctccag

SEQ ID NO: 28045 - DNA, 18 bp, Homo sapiens
tcttctaccgcaatgact

SEQ ID NO: 28046 - DNA, 20 bp, Homo sapiens
tggcactcagcttggggctg

SEQ ID NO: 28047 - DNA, 17 bp, Homo sapiens
tcccgaggctgctccag

SEQ ID NO: 28048 - DNA, 18 bp, Homo sapiens
tcttctaccgcaatgact

SEQ ID NO: 28049 - DNA, 20 bp, Homo sapiens
tggcactcagcttggggctg

SEQ ID NO: 28050 - DNA, 19 bp, Homo sapiens
caccaccaccaccaccact

SEQ ID NO: 28051 - DNA, 19 bp, Homo sapiens
cacctctcataagcacttt

SEQ ID NO: 28052 - DNA, 18 bp, Homo sapiens
ccgtgatgagcacagcca

SEQ ID NO: 28053 - DNA, 19 bp, Homo sapiens
cctcccctgacctccacca

SEQ ID NO: 28054 - DNA, 17 bp, Homo sapiens
ctggcctcccccatccc

SEQ ID NO: 28055 - DNA, 17 bp, Homo sapiens
ggaggctgacgttgcca

SEQ ID NO: 28056 - DNA, 17 bp, Homo sapiens
gggatggtgcagctgtg

SEQ ID NO: 28057 - DNA, 19 bp, Homo sapiens
tcagtctgctcatccgtaa

SEQ ID NO: 28058 - DNA, 20 bp, Homo sapiens
tgacgttgccaaaccagcca

SEQ ID NO: 28059 - DNA, 22 bp, Homo sapiens
tgctgagggctgcctcttgaca

SEQ ID NO: 28060 - DNA, 21 bp, Homo sapiens
ttgagacgctaatgttcatga

SEQ ID NO: 28061 - DNA, 19 bp, Homo sapiens
acgctacacacccacatga

SEQ ID NO: 28062 - DNA, 18 bp, Homo sapiens
actggtgaacgttcacct

SEQ ID NO: 28063 - DNA, 18 bp, Homo sapiens
ggccacacactcctgctt

SEQ ID NO: 28064 - DNA, 18 bp, Homo sapiens
tcacacctagaacactgt

SEQ ID NO: 28065 - DNA, 21 bp, Homo sapiens
agagccggtcagattccccta

SEQ ID NO: 28066 - DNA, 17 bp, Homo sapiens
cgacccacctctgccca

SEQ ID NO: 28067 - DNA, 21 bp, Homo sapiens
agagccggtcagattccccta

SEQ ID NO: 28068 - DNA, 17 bp, Homo sapiens
cgacccacctctgccca

SEQ ID NO: 28069 - DNA, 21 bp, Homo sapiens
agagccggtcagattccccta

SEQ ID NO: 28070 - DNA, 17 bp, Homo sapiens
cgacccacctctgccca

SEQ ID NO: 28071 - DNA, 21 bp, Homo sapiens
agagccggtcagattccccta

SEQ ID NO: 28072 - DNA, 17 bp, Homo sapiens
cgacccacctctgccca

SEQ ID NO: 28073 - DNA, 21 bp, Homo sapiens
agagccggtcagattccccta

SEQ ID NO: 28074 - DNA, 17 bp, Homo sapiens
cgacccacctctgccca

SEQ ID NO: 28075 - DNA, 21 bp, Homo sapiens
agagccggtcagattccccta

SEQ ID NO: 28076 - DNA, 17 bp, Homo sapiens
cgacccacctctgccca

SEQ ID NO: 28077 - DNA, 20 bp, Homo sapiens
aatgtggggccccttgttca

SEQ ID NO: 28078 - DNA, 20 bp, Homo sapiens
atagtttttagttattattc

SEQ ID NO: 28079 - DNA, 22 bp, Homo sapiens
gcttctctatcccccttctgcc

SEQ ID NO: 28080 - DNA, 22 bp, Homo sapiens
aactttgccagcaaaaatcagg

SEQ ID NO: 28081 - DNA, 23 bp, Homo sapiens
cacaaacagctaagacaatctca

SEQ ID NO: 28082 - DNA, 19 bp, Homo sapiens
ccattaggtgatgctttgg

SEQ ID NO: 28083 - DNA, 17 bp, Homo sapiens
cctgggccattctctga

SEQ ID NO: 28084 - DNA, 20 bp, Homo sapiens
ctttggcgagggtctgtggg

SEQ ID NO: 28085 - DNA, 22 bp, Homo sapiens
gagccaagatcacaccactgca

SEQ ID NO: 28086 - DNA, 19 bp, Homo sapiens
gcaaccatgagataataca

SEQ ID NO: 28087 - DNA, 21 bp, Homo sapiens
ggacaatttctccacctgcaa

SEQ ID NO: 28088 - DNA, 22 bp, Homo sapiens
gtagcagtggcatcgcttggtt

SEQ ID NO: 28089 - DNA, 21 bp, Homo sapiens
tacccatgtcagttatctcca

SEQ ID NO: 28090 - DNA, 18 bp, Homo sapiens
aatggaaatgatatcatc

SEQ ID NO: 28091 - DNA, 19 bp, Homo sapiens
atccacagatattgggaca

SEQ ID NO: 28092 - DNA, 28 bp, Homo sapiens
aagtgtggctgcccttctgagaccctca

SEQ ID NO: 28093 - DNA, 18 bp, Homo sapiens
ctggcctcttccacccca

SEQ ID NO: 28094 - DNA, 21 bp, Homo sapiens
gggcagctttggccagcagtg

SEQ ID NO: 28095 - DNA, 18 bp, Homo sapiens
aataaagtgtattcctcc

SEQ ID NO: 28096 - DNA, 21 bp, Homo sapiens
ccttttgcctgccttggcttt

SEQ ID NO: 28097 - DNA, 21 bp, Homo sapiens
cgtcagagctgacccactcac

SEQ ID NO: 28098 - DNA, 24 bp, Homo sapiens
tatacaaatcttcattttcataca

SEQ ID NO: 28099 - DNA, 18 bp, Homo sapiens
acactccagggcggagtt

SEQ ID NO: 28100 - DNA, 21 bp, Homo sapiens
catctcttgctcccgaggctg

SEQ ID NO: 28101 - DNA, 23 bp, Homo sapiens
cccagcctgggcctctcttgcag

SEQ ID NO: 28102 - DNA, 22 bp, Homo sapiens
ccctgagccccaggtcttgtgg

SEQ ID NO: 28103 - DNA, 19 bp, Homo sapiens
gacttaaaggactgcaata

SEQ ID NO: 28104 - DNA, 18 bp, Homo sapiens
tccccaggacactcagtt

SEQ ID NO: 28105 - DNA, 21 bp, Homo sapiens
tctggatgcccagacacctct

SEQ ID NO: 28106 - DNA, 21 bp, Homo sapiens
tgctgctgctgcctccgccgc

SEQ ID NO: 28107 - DNA, 20 bp, Homo sapiens
agtctcactctgttgcccag

SEQ ID NO: 28108 - DNA, 17 bp, Homo sapiens
tcaagcgattcttgtgc

SEQ ID NO: 28109 - DNA, 23 bp, Homo sapiens
cctaagtagtttttcattatttt

SEQ ID NO: 28110 - DNA, 20 bp, Homo sapiens
acccttttgctagtgtgctt

SEQ ID NO: 28111 - DNA, 20 bp, Homo sapiens
catgaggtggtgtgcagagg

SEQ ID NO: 28112 - DNA, 23 bp, Homo sapiens
ctctaactaacatgtggtatgta

SEQ ID NO: 28113 - DNA, 18 bp, Homo sapiens
gatttactcatctatcca

SEQ ID NO: 28114 - DNA, 24 bp, Homo sapiens
gttcaaaaacacatgaactgcaga

SEQ ID NO: 28115 - DNA, 18 bp, Homo sapiens
tcctgaactacaagcaaa

SEQ ID NO: 28116 - DNA, 22 bp, Homo sapiens
tctcttgatatgcttttgtttt

SEQ ID NO: 28117 - DNA, 21 bp, Homo sapiens
tcttcaatttcttagtccctc

SEQ ID NO: 28118 - DNA, 20 bp, Homo sapiens
tgaatgaccaccgtttccgt

SEQ ID NO: 28119 - DNA, 19 bp, Homo sapiens
accaatcaaatttcgcctt

SEQ ID NO: 28120 - DNA, 21 bp, Homo sapiens
acggagctggacgactcagtc

SEQ ID NO: 28121 - DNA, 20 bp, Homo sapiens
cctaggcgcggttcaggtca

SEQ ID NO: 28122 - DNA, 16 bp, Homo sapiens
ctccccaactccttcc

SEQ ID NO: 28123 - DNA, 22 bp, Homo sapiens
ctctgacctgggggcttctgga

SEQ ID NO: 28124 - DNA, 19 bp, Homo sapiens
gagggaccccgcttgggct

SEQ ID NO: 28125 - DNA, 20 bp, Homo sapiens
tggcccctccccaactcctt

SEQ ID NO: 28126 - DNA, 18 bp, Homo sapiens
ttgaggaaactgaggcaa

SEQ ID NO: 28127 - DNA, 21 bp, Homo sapiens
tctctttatctcccttgcctt

SEQ ID NO: 28128 - DNA, 18 bp, Homo sapiens
ttccagaatctggcccag

SEQ ID NO: 28129 - DNA, 19 bp, Homo sapiens
atcctacccaggccaccac

SEQ ID NO: 28130 - DNA, 17 bp, Homo sapiens
cctctgccccagcccca

SEQ ID NO: 28131 - DNA, 21 bp, Homo sapiens
gcccctcctccactctcctct

SEQ ID NO: 28132 - DNA, 21 bp, Homo sapiens
gcccctcctccactctcctct

SEQ ID NO: 28133 - DNA, 20 bp, Homo sapiens
accaaaattgggcctgcact

SEQ ID NO: 28134 - DNA, 18 bp, Homo sapiens
accacctttccatcccca

SEQ ID NO: 28135 - DNA, 20 bp, Homo sapiens
cgatggtcctacacattcca

SEQ ID NO: 28136 - DNA, 19 bp, Homo sapiens
gaagccagtacagatcttt

SEQ ID NO: 28137 - DNA, 22 bp, Homo sapiens
gtaaccaaacaagaagacctca

SEQ ID NO: 28138 - DNA, 18 bp, Homo sapiens
accacctttccatcccca

SEQ ID NO: 28139 - DNA, 19 bp, Homo sapiens
gaagccagtacagatcttt

SEQ ID NO: 28140 - DNA, 22 bp, Homo sapiens
gtaaccaaacaagaagacctca

SEQ ID NO: 28141 - DNA, 21 bp, Homo sapiens
gccccctccccaccctccctc

SEQ ID NO: 28142 - DNA, 26 bp, Homo sapiens
tcctggggagccacggaaggttgtgg

SEQ ID NO: 28143 - DNA, 16 bp, Homo sapiens
aagacataaatgagga

SEQ ID NO: 28144 - DNA, 20 bp, Homo sapiens
ccatgttaaatcccattcat

SEQ ID NO: 28145 - DNA, 21 bp, Homo sapiens
ctaaattaacattgggaaatc

SEQ ID NO: 28146 - DNA, 21 bp, Homo sapiens
ctgtggaaaaatatttaagat

SEQ ID NO: 28147 - DNA, 19 bp, Homo sapiens
tacttttgacaacaaatta

SEQ ID NO: 28148 - DNA, 23 bp, Homo sapiens
caaacttgacagtaaatcacaca

SEQ ID NO: 28149 - DNA, 19 bp, Homo sapiens
catgttattaaatttgtat

SEQ ID NO: 28150 - DNA, 22 bp, Homo sapiens
ctaacgtacattcaacagatca

SEQ ID NO: 28151 - DNA, 19 bp, Homo sapiens
agttttccataaactgtta

SEQ ID NO: 28152 - DNA, 27 bp, Homo sapiens
ccttttgtggtatggttttttggcctt

SEQ ID NO: 28153 - DNA, 20 bp, Homo sapiens
ctcctcaatgtgtaaacagg

SEQ ID NO: 28154 - DNA, 23 bp, Homo sapiens
gtatatatgtcttgctcagatta

SEQ ID NO: 28155 - DNA, 18 bp, Homo sapiens
tgtaaacatgacccactt

SEQ ID NO: 28156 - DNA, 17 bp, Homo sapiens
ttttcttgtttccatga

SEQ ID NO: 28157 - DNA, 17 bp, Homo sapiens
tgcaaaattagcttttt

SEQ ID NO: 28158 - DNA, 17 bp, Homo sapiens
tgcaaaattagcttttt

SEQ ID NO: 28159 - DNA, 20 bp, Homo sapiens
acaacctttcatgtagcccc

SEQ ID NO: 28160 - DNA, 22 bp, Homo sapiens
atcttcatggatagctcagagg

SEQ ID NO: 28161 - DNA, 19 bp, Homo sapiens
caccaccaccaccaccatc

SEQ ID NO: 28162 - DNA, 22 bp, Homo sapiens
ccacagtcaccactccatgaca

SEQ ID NO: 28163 - DNA, 20 bp, Homo sapiens
ccatcttcatggatagctca

SEQ ID NO: 28164 - DNA, 20 bp, Homo sapiens
tagttttgccgctggactct

SEQ ID NO: 28165 - DNA, 22 bp, Homo sapiens
tctgttcatcctgaacattttt

SEQ ID NO: 28166 - DNA, 18 bp, Homo sapiens
tgcatcatcaccatggta

SEQ ID NO: 28167 - DNA, 22 bp, Homo sapiens
ttcaagattacaacatctgtta

SEQ ID NO: 28168 - DNA, 21 bp, Homo sapiens
ccagccccagcacagacccaa

SEQ ID NO: 28169 - DNA, 23 bp, Homo sapiens
ccccgaggccttcgtcgtcctca

SEQ ID NO: 28170 - DNA, 21 bp, Homo sapiens
ctctatccctcctctgcctct

SEQ ID NO: 28171 - DNA, 18 bp, Homo sapiens
ttcccctaccctaagctg

SEQ ID NO: 28172 - DNA, 24 bp, Homo sapiens
atattttcagagaaagttacctaa

SEQ ID NO: 28173 - DNA, 21 bp, Homo sapiens
ccacccccatgaccaccacca

SEQ ID NO: 28174 - DNA, 24 bp, Homo sapiens
cctaactattaagatcactgtgta

SEQ ID NO: 28175 - DNA, 23 bp, Homo sapiens
ggttcttggagggtatgtcagtg

SEQ ID NO: 28176 - DNA, 24 bp, Homo sapiens
tataaattgggatttaagactgta

SEQ ID NO: 28177 - DNA, 26 bp, Homo sapiens
tctgcaacattcacaccattgcttcc

SEQ ID NO: 28178 - DNA, 21 bp, Homo sapiens
ggaggcagtgattccaagctg

SEQ ID NO: 28179 - DNA, 21 bp, Homo sapiens
ggaggcagtgattccaagctg

SEQ ID NO: 28180 - DNA, 21 bp, Homo sapiens
ggaggcagtgattccaagctg

SEQ ID NO: 28181 - DNA, 21 bp, Homo sapiens
aaggtgtcaacagggtagtta

SEQ ID NO: 28182 - DNA, 17 bp, Homo sapiens
agagcctttagagctct

SEQ ID NO: 28183 - DNA, 22 bp, Homo sapiens
ctgagatatgtacacagtcatt

SEQ ID NO: 28184 - DNA, 19 bp, Homo sapiens
agagatttatttgggcaaa

SEQ ID NO: 28185 - DNA, 22 bp, Homo sapiens
atcttcatggatagctcagagg

SEQ ID NO: 28186 - DNA, 20 bp, Homo sapiens
ccatcttcatggatagctca

SEQ ID NO: 28187 - DNA, 20 bp, Homo sapiens
tagttttgccgctggactct

SEQ ID NO: 28188 - DNA, 22 bp, Homo sapiens
tcagaacttaatttacaaataa

SEQ ID NO: 28189 - DNA, 22 bp, Homo sapiens
tctgttcatcctgaacattttt

SEQ ID NO: 28190 - DNA, 22 bp, Homo sapiens
ttcaagattacaacatctgtta

SEQ ID NO: 28191 - DNA, 20 bp, Homo sapiens
ttgtagttatgttagatatt

SEQ ID NO: 28192 - DNA, 18 bp, Homo sapiens
ttttcttcacacagtgtt

SEQ ID NO: 28193 - DNA, 20 bp, Homo sapiens
acagcagcatttttatttca

SEQ ID NO: 28194 - DNA, 25 bp, Homo sapiens
ccttacccctggctgtttggacttt

SEQ ID NO: 28195 - DNA, 24 bp, Homo sapiens
gtcaatgctatttttgtttttaga

SEQ ID NO: 28196 - DNA, 19 bp, Homo sapiens
tgacatctttttaaagctt

SEQ ID NO: 28197 - DNA, 19 bp, Homo sapiens
tcaccatcgtgtttgcaaa

SEQ ID NO: 28198 - DNA, 18 bp, Homo sapiens
tcataaaccaatgtggca

SEQ ID NO: 28199 - DNA, 20 bp, Homo sapiens
tgtcctcagagcaggggcca

SEQ ID NO: 28200 - DNA, 21 bp, Homo sapiens
gtgtgccaccatgcttggcta

SEQ ID NO: 28201 - DNA, 19 bp, Homo sapiens
aagttccacaggatggtca

SEQ ID NO: 28202 - DNA, 19 bp, Homo sapiens
ctctccctgcttttgcctt

SEQ ID NO: 28203 - DNA, 19 bp, Homo sapiens
gtccactggtgggacaaga

SEQ ID NO: 28204 - DNA, 17 bp, Homo sapiens
gtctaacattttttgcc

SEQ ID NO: 28205 - DNA, 19 bp, Homo sapiens
tcctcctttcccctctctc

SEQ ID NO: 28206 - DNA, 21 bp, Homo sapiens
aaataaaagtgaccttttaca

SEQ ID NO: 28207 - DNA, 21 bp, Homo sapiens
aaataaaagtgaccttttaca

SEQ ID NO: 28208 - DNA, 19 bp, Homo sapiens
acccagagacaaagaaccc

SEQ ID NO: 28209 - DNA, 20 bp, Homo sapiens
agtgaggaggctggatccaa

SEQ ID NO: 28210 - DNA, 22 bp, Homo sapiens
gaccctcagcgtacccgcctca

SEQ ID NO: 28211 - DNA, 19 bp, Homo sapiens
gcctgaccttgtgatctgc

SEQ ID NO: 28212 - DNA, 20 bp, Homo sapiens
gggttctgtatatgaagctg

SEQ ID NO: 28213 - DNA, 20 bp, Homo sapiens
tacaaatatcacgttcttat

SEQ ID NO: 28214 - DNA, 17 bp, Homo sapiens
tctgtgccaggcacttc

SEQ ID NO: 28215 - DNA, 19 bp, Homo sapiens
ttccttttatcggttcatt

SEQ ID NO: 28216 - DNA, 18 bp, Homo sapiens
aggaacccagagcaccaa

SEQ ID NO: 28217 - DNA, 22 bp, Homo sapiens
atctgagtctcagcctgggtcc

SEQ ID NO: 28218 - DNA, 17 bp, Homo sapiens
ccctccccacctaccct

SEQ ID NO: 28219 - DNA, 18 bp, Homo sapiens
ccgggcggcttcacccca

SEQ ID NO: 28220 - DNA, 18 bp, Homo sapiens
ctcccgctccagcggcac

SEQ ID NO: 28221 - DNA, 22 bp, Homo sapiens
gcctctctgagcctctgtctct

SEQ ID NO: 28222 - DNA, 16 bp, Homo sapiens
aatgatactgtgttcc

SEQ ID NO: 28223 - DNA, 17 bp, Homo sapiens
ataattttcctgtgaca

SEQ ID NO: 28224 - DNA, 18 bp, Homo sapiens
tcaaaacagcatcggcca

SEQ ID NO: 28225 - DNA, 16 bp, Homo sapiens
tgatactgtgttccct

SEQ ID NO: 28226 - DNA, 17 bp, Homo sapiens
caggattatgcagtcca

SEQ ID NO: 28227 - DNA, 21 bp, Homo sapiens
ctctggctctggggcttgggg

SEQ ID NO: 28228 - DNA, 18 bp, Homo sapiens
gcaacacatctgatctaa

SEQ ID NO: 28229 - DNA, 22 bp, Homo sapiens
tgaggttgtgactgtggctggt

SEQ ID NO: 28230 - DNA, 17 bp, Homo sapiens
ggcggggtgcatttcca

SEQ ID NO: 28231 - DNA, 20 bp, Homo sapiens
tggaactcagaatgaaactg

SEQ ID NO: 28232 - DNA, 16 bp, Homo sapiens
aaagacctagaaccca

SEQ ID NO: 28233 - DNA, 22 bp, Homo sapiens
agaaatgactgtaaatatttca

SEQ ID NO: 28234 - DNA, 20 bp, Homo sapiens
agtttcactctgtgaggagt

SEQ ID NO: 28235 - DNA, 17 bp, Homo sapiens
ctattttgtgtccttga

SEQ ID NO: 28236 - DNA, 19 bp, Homo sapiens
ctcccagaagaccaaactg

SEQ ID NO: 28237 - DNA, 20 bp, Homo sapiens
gtccctctgagtgtgtcttg

SEQ ID NO: 28238 - DNA, 19 bp, Homo sapiens
tgtagcatgccttggtttt

SEQ ID NO: 28239 - DNA, 22 bp, Homo sapiens
agaaatgactgtaaatatttca

SEQ ID NO: 28240 - DNA, 20 bp, Homo sapiens
agtttcactctgtgaggagt

SEQ ID NO: 28241 - DNA, 17 bp, Homo sapiens
ctattttgtgtccttga

SEQ ID NO: 28242 - DNA, 19 bp, Homo sapiens
ctcccagaagaccaaactg

SEQ ID NO: 28243 - DNA, 20 bp, Homo sapiens
gtccctctgagtgtgtcttg

SEQ ID NO: 28244 - DNA, 22 bp, Homo sapiens
agaaatgactgtaaatatttca

SEQ ID NO: 28245 - DNA, 20 bp, Homo sapiens
agtttcactctgtgaggagt

SEQ ID NO: 28246 - DNA, 17 bp, Homo sapiens
ctattttgtgtccttga

SEQ ID NO: 28247 - DNA, 19 bp, Homo sapiens
ctcccagaagaccaaactg

SEQ ID NO: 28248 - DNA, 20 bp, Homo sapiens
gtccctctgagtgtgtcttg

SEQ ID NO: 28249 - DNA, 22 bp, Homo sapiens
agaaatgactgtaaatatttca

SEQ ID NO: 28250 - DNA, 20 bp, Homo sapiens
agtttcactctgtgaggagt

SEQ ID NO: 28251 - DNA, 17 bp, Homo sapiens
ctattttgtgtccttga

SEQ ID NO: 28252 - DNA, 19 bp, Homo sapiens
ctcccagaagaccaaactg

SEQ ID NO: 28253 - DNA, 20 bp, Homo sapiens
gtccctctgagtgtgtcttg

SEQ ID NO: 28254 - DNA, 22 bp, Homo sapiens
agaaatgactgtaaatatttca

SEQ ID NO: 28255 - DNA, 20 bp, Homo sapiens
agtttcactctgtgaggagt

SEQ ID NO: 28256 - DNA, 17 bp, Homo sapiens
ctattttgtgtccttga

SEQ ID NO: 28257 - DNA, 19 bp, Homo sapiens
ctcccagaagaccaaactg

SEQ ID NO: 28258 - DNA, 20 bp, Homo sapiens
gtccctctgagtgtgtcttg

SEQ ID NO: 28259 - DNA, 21 bp, Homo sapiens
accctctaggggctttgggga

SEQ ID NO: 28260 - DNA, 18 bp, Homo sapiens
caaccttcctccctactc

SEQ ID NO: 28261 - DNA, 20 bp, Homo sapiens
ccctctaggggctttgggga

SEQ ID NO: 28262 - DNA, 22 bp, Homo sapiens
gcacaaccttcctccctactca

SEQ ID NO: 28263 - DNA, 22 bp, Homo sapiens
tcagattgagataagatccttt

SEQ ID NO: 28264 - DNA, 18 bp, Homo sapiens
tgaaaccagctagtgtgt

SEQ ID NO: 28265 - DNA, 22 bp, Homo sapiens
tggcctgtccccacatccagca

SEQ ID NO: 28266 - DNA, 18 bp, Homo sapiens
gaaagagcgagtgcctct

SEQ ID NO: 28267 - DNA, 24 bp, Homo sapiens
tcaaatatatgattgctgatagta

SEQ ID NO: 28268 - DNA, 18 bp, Homo sapiens
cctttgcccacgtggtga

SEQ ID NO: 28269 - DNA, 19 bp, Homo sapiens
gataaaaaaaaagtgagca

SEQ ID NO: 28270 - DNA, 22 bp, Homo sapiens
tgttggtcacagaaacatgacc

SEQ ID NO: 28271 - DNA, 18 bp, Homo sapiens
ttaccaaagcagcataat

SEQ ID NO: 28272 - DNA, 21 bp, Homo sapiens
aacaccaggcccagcgccctc

SEQ ID NO: 28273 - DNA, 21 bp, Homo sapiens
accctgggccctctctcctca

SEQ ID NO: 28274 - DNA, 22 bp, Homo sapiens
tgaggtttggtctgggctcagt

SEQ ID NO: 28275 - DNA, 22 bp, Homo sapiens
atcttggctcacagcaacctct

SEQ ID NO: 28276 - DNA, 17 bp, Homo sapiens
ctcactgtgttgcccaa

SEQ ID NO: 28277 - DNA, 16 bp, Homo sapiens
gatgaaatgtctgttt

SEQ ID NO: 28278 - DNA, 17 bp, Homo sapiens
tcaagtgattctcgtgc

SEQ ID NO: 28279 - DNA, 18 bp, Homo sapiens
tctacctcctgggttcaa

SEQ ID NO: 28280 - DNA, 23 bp, Homo sapiens
tggtcttgaactcttgggctcaa

SEQ ID NO: 28281 - DNA, 21 bp, Homo sapiens
aagagaggcccaggctactgg

SEQ ID NO: 28282 - DNA, 21 bp, Homo sapiens
ccctgctgcggagaccgcgga

SEQ ID NO: 28283 - DNA, 16 bp, Homo sapiens
actcacggcctccatg

SEQ ID NO: 28284 - DNA, 20 bp, Homo sapiens
gatcctgaaaagtgttatga

SEQ ID NO: 28285 - DNA, 21 bp, Homo sapiens
gtgtgtcaccacgctcggcta

SEQ ID NO: 28286 - DNA, 18 bp, Homo sapiens
tcctgaaaagtgttatga

SEQ ID NO: 28287 - DNA, 25 bp, Homo sapiens
agcccggggagcctaggaccactca

SEQ ID NO: 28288 - DNA, 16 bp, Homo sapiens
cccacgattttctcca

SEQ ID NO: 28289 - DNA, 25 bp, Homo sapiens
agcccggggagcctaggaccactca

SEQ ID NO: 28290 - DNA, 16 bp, Homo sapiens
cccacgattttctcca

SEQ ID NO: 28291 - DNA, 25 bp, Homo sapiens
agcccggggagcctaggaccactca

SEQ ID NO: 28292 - DNA, 16 bp, Homo sapiens
cccacgattttctcca

SEQ ID NO: 28293 - DNA, 25 bp, Homo sapiens
agcccggggagcctaggaccactca

SEQ ID NO: 28294 - DNA, 16 bp, Homo sapiens
cccacgattttctcca

SEQ ID NO: 28295 - DNA, 18 bp, Homo sapiens
acagacactgatacccag

SEQ ID NO: 28296 - DNA, 25 bp, Homo sapiens
agcccggggagcctaggaccactca

SEQ ID NO: 28297 - DNA, 16 bp, Homo sapiens
cccacgattttctcca

SEQ ID NO: 28298 - DNA, 17 bp, Homo sapiens
gtgggaaacgagtgctg

SEQ ID NO: 28299 - DNA, 19 bp, Homo sapiens
gtgtctcaaaacaaacaaa

SEQ ID NO: 28300 - DNA, 25 bp, Homo sapiens
agcccggggagcctaggaccactca

SEQ ID NO: 28301 - DNA, 16 bp, Homo sapiens
cccacgattttctcca

SEQ ID NO: 28302 - DNA, 17 bp, Homo sapiens
gtgggaaacgagtgctg

SEQ ID NO: 28303 - DNA, 19 bp, Homo sapiens
gtgtctcaaaacaaacaaa

SEQ ID NO: 28304 - DNA, 16 bp, Homo sapiens
ccacacctctgtctcc

SEQ ID NO: 28305 - DNA, 17 bp, Homo sapiens
cccggacggcagatgcc

SEQ ID NO: 28306 - DNA, 18 bp, Homo sapiens
ctcccagccgagccctca

SEQ ID NO: 28307 - DNA, 17 bp, Homo sapiens
ctccccaatctcttcca

SEQ ID NO: 28308 - DNA, 19 bp, Homo sapiens
ctgcaagctccgcctccca

SEQ ID NO: 28309 - DNA, 16 bp, Homo sapiens
ggcttctgactcattt

SEQ ID NO: 28310 - DNA, 17 bp, Homo sapiens
tacagaagtccaggaga

SEQ ID NO: 28311 - DNA, 21 bp, Homo sapiens
tcataaagggtttgattttta

SEQ ID NO: 28312 - DNA, 23 bp, Homo sapiens
tgtctctcaagggcacccagctt

SEQ ID NO: 28313 - DNA, 17 bp, Homo sapiens
ttctcctgcttcagcct

SEQ ID NO: 28314 - DNA, 22 bp, Homo sapiens
cacaccaaccacctccacttca

SEQ ID NO: 28315 - DNA, 20 bp, Homo sapiens
tccactccactccctccctc

SEQ ID NO: 28316 - DNA, 18 bp, Homo sapiens
tccctccctcttttctca

SEQ ID NO: 28317 - DNA, 24 bp, Homo sapiens
ctgtcgggcaagatagctccttca

SEQ ID NO: 28318 - DNA, 17 bp, Homo sapiens
tgttgtcctgtgtcatc

SEQ ID NO: 28319 - DNA, 17 bp, Homo sapiens
atcctaagcatgcttta

SEQ ID NO: 28320 - DNA, 22 bp, Homo sapiens
atctgaggaaagaaatctggta

SEQ ID NO: 28321 - DNA, 20 bp, Homo sapiens
cactctctatatccatttga

SEQ ID NO: 28322 - DNA, 23 bp, Homo sapiens
ccttttcactaagcctttacttt

SEQ ID NO: 28323 - DNA, 21 bp, Homo sapiens
tcagaaaaaggctttctttca

SEQ ID NO: 28324 - DNA, 20 bp, Homo sapiens
ttccagaaatacaatgctag

SEQ ID NO: 28325 - DNA, 22 bp, Homo sapiens
ttcttctttttagctgatctca

SEQ ID NO: 28326 - DNA, 19 bp, Homo sapiens
ttttttccgcagacttctt

SEQ ID NO: 28327 - DNA, 17 bp, Homo sapiens
atcctaagcatgcttta

SEQ ID NO: 28328 - DNA, 22 bp, Homo sapiens
atctgaggaaagaaatctggta

SEQ ID NO: 28329 - DNA, 20 bp, Homo sapiens
cactctctatatccatttga

SEQ ID NO: 28330 - DNA, 23 bp, Homo sapiens
ccttttcactaagcctttacttt

SEQ ID NO: 28331 - DNA, 21 bp, Homo sapiens
tcagaaaaaggctttctttca

SEQ ID NO: 28332 - DNA, 20 bp, Homo sapiens
ttccagaaatacaatgctag

SEQ ID NO: 28333 - DNA, 22 bp, Homo sapiens
ttcttctttttagctgatctca

SEQ ID NO: 28334 - DNA, 19 bp, Homo sapiens
ttttttccgcagacttctt

SEQ ID NO: 28335 - DNA, 17 bp, Homo sapiens
atcctaagcatgcttta

SEQ ID NO: 28336 - DNA, 22 bp, Homo sapiens
atctgaggaaagaaatctggta

SEQ ID NO: 28337 - DNA, 20 bp, Homo sapiens
cactctctatatccatttga

SEQ ID NO: 28338 - DNA, 23 bp, Homo sapiens
ccttttcactaagcctttacttt

SEQ ID NO: 28339 - DNA, 21 bp, Homo sapiens
tcagaaaaaggctttctttca

SEQ ID NO: 28340 - DNA, 20 bp, Homo sapiens
ttccagaaatacaatgctag

SEQ ID NO: 28341 - DNA, 22 bp, Homo sapiens
ttcttctttttagctgatctca

SEQ ID NO: 28342 - DNA, 19 bp, Homo sapiens
ttttttccgcagacttctt

SEQ ID NO: 28343 - DNA, 17 bp, Homo sapiens
atcctaagcatgcttta

SEQ ID NO: 28344 - DNA, 22 bp, Homo sapiens
atctgaggaaagaaatctggta

SEQ ID NO: 28345 - DNA, 20 bp, Homo sapiens
cactctctatatccatttga

SEQ ID NO: 28346 - DNA, 23 bp, Homo sapiens
ccttttcactaagcctttacttt

SEQ ID NO: 28347 - DNA, 21 bp, Homo sapiens
tcagaaaaaggctttctttca

SEQ ID NO: 28348 - DNA, 20 bp, Homo sapiens
ttccagaaatacaatgctag

SEQ ID NO: 28349 - DNA, 22 bp, Homo sapiens
ttcttctttttagctgatctca

SEQ ID NO: 28350 - DNA, 19 bp, Homo sapiens
ttttttccgcagacttctt

SEQ ID NO: 28351 - DNA, 17 bp, Homo sapiens
atcctaagcatgcttta

SEQ ID NO: 28352 - DNA, 22 bp, Homo sapiens
atctgaggaaagaaatctggta

SEQ ID NO: 28353 - DNA, 20 bp, Homo sapiens
cactctctatatccatttga

SEQ ID NO: 28354 - DNA, 23 bp, Homo sapiens
ccttttcactaagcctttacttt

SEQ ID NO: 28355 - DNA, 21 bp, Homo sapiens
tcagaaaaaggctttctttca

SEQ ID NO: 28356 - DNA, 20 bp, Homo sapiens
ttccagaaatacaatgctag

SEQ ID NO: 28357 - DNA, 22 bp, Homo sapiens
ttcttctttttagctgatctca

SEQ ID NO: 28358 - DNA, 19 bp, Homo sapiens
ttttttccgcagacttctt

SEQ ID NO: 28359 - DNA, 20 bp, Homo sapiens
agaattacattgtatagccc

SEQ ID NO: 28360 - DNA, 22 bp, Homo sapiens
attactgctgttctagccccca

SEQ ID NO: 28361 - DNA, 20 bp, Homo sapiens
ctgttagggtacatacgcta

SEQ ID NO: 28362 - DNA, 19 bp, Homo sapiens
tcgttgttgttttaagttt

SEQ ID NO: 28363 - DNA, 20 bp, Homo sapiens
agaattacattgtatagccc

SEQ ID NO: 28364 - DNA, 22 bp, Homo sapiens
attactgctgttctagccccca

SEQ ID NO: 28365 - DNA, 20 bp, Homo sapiens
ctgttagggtacatacgcta

SEQ ID NO: 28366 - DNA, 19 bp, Homo sapiens
tcgttgttgttttaagttt

SEQ ID NO: 28367 - DNA, 20 bp, Homo sapiens
ccacagcattcctccatctt

SEQ ID NO: 28368 - DNA, 17 bp, Homo sapiens
gaaaacgcacctccatc

SEQ ID NO: 28369 - DNA, 18 bp, Homo sapiens
gacatttccctcctggga

SEQ ID NO: 28370 - DNA, 17 bp, Homo sapiens
gtagagatgattcggat

SEQ ID NO: 28371 - DNA, 18 bp, Homo sapiens
tcagccacacctgtcagc

SEQ ID NO: 28372 - DNA, 20 bp, Homo sapiens
ccacagcattcctccatctt

SEQ ID NO: 28373 - DNA, 17 bp, Homo sapiens
gaaaacgcacctccatc

SEQ ID NO: 28374 - DNA, 18 bp, Homo sapiens
gacatttccctcctggga

SEQ ID NO: 28375 - DNA, 17 bp, Homo sapiens
gtagagatgattcggat

SEQ ID NO: 28376 - DNA, 18 bp, Homo sapiens
tcagccacacctgtcagc

SEQ ID NO: 28377 - DNA, 19 bp, Homo sapiens
atattgtaccgctacccct

SEQ ID NO: 28378 - DNA, 21 bp, Homo sapiens
ccgagggagaactgaccatgg

SEQ ID NO: 28379 - DNA, 21 bp, Homo sapiens
cctcccttggatctgacctta

SEQ ID NO: 28380 - DNA, 24 bp, Homo sapiens
tttgaaaggctgaagatgtctgct

SEQ ID NO: 28381 - DNA, 19 bp, Homo sapiens
ggaatgatataatctgtcc

SEQ ID NO: 28382 - DNA, 19 bp, Homo sapiens
tttctgttttgcttttaaa

SEQ ID NO: 28383 - DNA, 19 bp, Homo sapiens
ttttgatgatggaggtatg

SEQ ID NO: 28384 - DNA, 18 bp, Homo sapiens
cttctccagctctgctct

SEQ ID NO: 28385 - DNA, 21 bp, Homo sapiens
gcagtgatctgtcactgacca

SEQ ID NO: 28386 - DNA, 26 bp, Homo sapiens
taccccagagcactacaattctctga

SEQ ID NO: 28387 - DNA, 18 bp, Homo sapiens
cgcggagcccggcccgga

SEQ ID NO: 28388 - DNA, 22 bp, Homo sapiens
gcagcttccctgagcctttcca

SEQ ID NO: 28389 - DNA, 22 bp, Homo sapiens
gcagcttccctgagcctttcca

SEQ ID NO: 28390 - DNA, 26 bp, Homo sapiens
gctccatgtgaccctccctctgcctc

SEQ ID NO: 28391 - DNA, 26 bp, Homo sapiens
gctccatgtgaccctccctctgcctc

SEQ ID NO: 28392 - DNA, 26 bp, Homo sapiens
gctccatgtgaccctccctctgcctc

SEQ ID NO: 28393 - DNA, 21 bp, Homo sapiens
agcattgcttgaggttgccca

SEQ ID NO: 28394 - DNA, 21 bp, Homo sapiens
cagttgtgagccaagattgta

SEQ ID NO: 28395 - DNA, 20 bp, Homo sapiens
ttggcattcagtattggtgg

SEQ ID NO: 28396 - DNA, 20 bp, Homo sapiens
tggacagttggctctacctc

SEQ ID NO: 28397 - DNA, 20 bp, Homo sapiens
tggacagttggctctacctc

SEQ ID NO: 28398 - DNA, 20 bp, Homo sapiens
aaaatggggcaggccacacc

SEQ ID NO: 28399 - DNA, 19 bp, Homo sapiens
ccccactgccccctgcagc

SEQ ID NO: 28400 - DNA, 25 bp, Homo sapiens
gaatgaagtcacctcgcccccctct

SEQ ID NO: 28401 - DNA, 19 bp, Homo sapiens
gccccttggcaccatcctg

SEQ ID NO: 28402 - DNA, 22 bp, Homo sapiens
ggacttggcatttaggattcca

SEQ ID NO: 28403 - DNA, 20 bp, Homo sapiens
aaaatggggcaggccacacc

SEQ ID NO: 28404 - DNA, 19 bp, Homo sapiens
ccccactgccccctgcagc

SEQ ID NO: 28405 - DNA, 25 bp, Homo sapiens
gaatgaagtcacctcgcccccctct

SEQ ID NO: 28406 - DNA, 19 bp, Homo sapiens
gccccttggcaccatcctg

SEQ ID NO: 28407 - DNA, 22 bp, Homo sapiens
ggacttggcatttaggattcca

SEQ ID NO: 28408 - DNA, 18 bp, Homo sapiens
cagcagcagcagcaccat

SEQ ID NO: 28409 - DNA, 18 bp, Homo sapiens
cagcagcagcagcagcca

SEQ ID NO: 28410 - DNA, 17 bp, Homo sapiens
catcatcaccatcacca

SEQ ID NO: 28411 - DNA, 21 bp, Homo sapiens
ccaatcatttgcaaagtgagg

SEQ ID NO: 28412 - DNA, 16 bp, Homo sapiens
ctgatgccaattcatc

SEQ ID NO: 28413 - DNA, 17 bp, Homo sapiens
gaacacagcttgcttgc

SEQ ID NO: 28414 - DNA, 25 bp, Homo sapiens
gcagaagatagatacagccttttca

SEQ ID NO: 28415 - DNA, 21 bp, Homo sapiens
ggctaattgccaccaatttca

SEQ ID NO: 28416 - DNA, 22 bp, Homo sapiens
taaaataacattgtacatccaa

SEQ ID NO: 28417 - DNA, 18 bp, Homo sapiens
tcagtaggacaagtgtcg

SEQ ID NO: 28418 - DNA, 18 bp, Homo sapiens
tcatcaccatcaccacca

SEQ ID NO: 28419 - DNA, 19 bp, Homo sapiens
tcctccatctccgctctct

SEQ ID NO: 28420 - DNA, 17 bp, Homo sapiens
tgaatttctgtcttgcc

SEQ ID NO: 28421 - DNA, 19 bp, Homo sapiens
cctcccccaccctgccctg

SEQ ID NO: 28422 - DNA, 23 bp, Homo sapiens
cttagtgctctgaatttactttt

SEQ ID NO: 28423 - DNA, 19 bp, Homo sapiens
gattttaatcaccattaca

SEQ ID NO: 28424 - DNA, 17 bp, Homo sapiens
tcaagtgattcttgtgc

SEQ ID NO: 28425 - DNA, 19 bp, Homo sapiens
tgtcgtaagaatatctgtc

SEQ ID NO: 28426 - DNA, 17 bp, Homo sapiens
tcaagtgattcttgtgc

SEQ ID NO: 28427 - DNA, 19 bp, Homo sapiens
tgtcgtaagaatatctgtc

SEQ ID NO: 28428 - DNA, 17 bp, Homo sapiens
tcaagtgattcttgtgc

SEQ ID NO: 28429 - DNA, 19 bp, Homo sapiens
tgtcgtaagaatatctgtc

SEQ ID NO: 28430 - DNA, 17 bp, Homo sapiens
tcaagtgattcttgtgc

SEQ ID NO: 28431 - DNA, 19 bp, Homo sapiens
tgtcgtaagaatatctgtc

SEQ ID NO: 28432 - DNA, 19 bp, Homo sapiens
aagcaattctcctgcctca

SEQ ID NO: 28433 - DNA, 23 bp, Homo sapiens
taggattccaccttgttctggtg

SEQ ID NO: 28434 - DNA, 19 bp, Homo sapiens
tgtcgtaagaatatctgtc

SEQ ID NO: 28435 - DNA, 19 bp, Homo sapiens
tgtcgtaagaatatctgtc

SEQ ID NO: 28436 - DNA, 17 bp, Homo sapiens
atgcttttattcaggga

SEQ ID NO: 28437 - DNA, 20 bp, Homo sapiens
tgcacagaggccccgccccc

SEQ ID NO: 28438 - DNA, 22 bp, Homo sapiens
aagatgcagtctctgctgatca

SEQ ID NO: 28439 - DNA, 19 bp, Homo sapiens
aagtgacaacttagggagc

SEQ ID NO: 28440 - DNA, 18 bp, Homo sapiens
agcctcctgctctgtgaa

SEQ ID NO: 28441 - DNA, 20 bp, Homo sapiens
agtgaatggggacactcgtg

SEQ ID NO: 28442 - DNA, 17 bp, Homo sapiens
caacagcatcatctgca

SEQ ID NO: 28443 - DNA, 20 bp, Homo sapiens
ccactctatttttttaggtt

SEQ ID NO: 28444 - DNA, 22 bp, Homo sapiens
ctctcctgtgagatttcacttt

SEQ ID NO: 28445 - DNA, 18 bp, Homo sapiens
gaggagtgcatggcgaga

SEQ ID NO: 28446 - DNA, 19 bp, Homo sapiens
gccaggcggccgcttggcc

SEQ ID NO: 28447 - DNA, 20 bp, Homo sapiens
gcgtctgcactgatgaccgt

SEQ ID NO: 28448 - DNA, 23 bp, Homo sapiens
gcgttcctggacaaacagcctca

SEQ ID NO: 28449 - DNA, 18 bp, Homo sapiens
ggtcctactgctgtgagc

SEQ ID NO: 28450 - DNA, 17 bp, Homo sapiens
tcgacttcattttgcca

SEQ ID NO: 28451 - DNA, 19 bp, Homo sapiens
tctgcacctaaacccatac

SEQ ID NO: 28452 - DNA, 21 bp, Homo sapiens
tgaccgtctgagcccagctca

SEQ ID NO: 28453 - DNA, 20 bp, Homo sapiens
tgccccgttgcctatcacag

SEQ ID NO: 28454 - DNA, 19 bp, Homo sapiens
tgtcccgcgggcgagttct

SEQ ID NO: 28455 - DNA, 22 bp, Homo sapiens
aagatgcagtctctgctgatca

SEQ ID NO: 28456 - DNA, 19 bp, Homo sapiens
aagtgacaacttagggagc

SEQ ID NO: 28457 - DNA, 18 bp, Homo sapiens
agcctcctgctctgtgaa

SEQ ID NO: 28458 - DNA, 20 bp, Homo sapiens
agtgaatggggacactcgtg

SEQ ID NO: 28459 - DNA, 17 bp, Homo sapiens
caacagcatcatctgca

SEQ ID NO: 28460 - DNA, 20 bp, Homo sapiens
ccactctatttttttaggtt

SEQ ID NO: 28461 - DNA, 22 bp, Homo sapiens
ctctcctgtgagatttcacttt

SEQ ID NO: 28462 - DNA, 18 bp, Homo sapiens
gaggagtgcatggcgaga

SEQ ID NO: 28463 - DNA, 19 bp, Homo sapiens
gccaggcggccgcttggcc

SEQ ID NO: 28464 - DNA, 20 bp, Homo sapiens
gcgtctgcactgatgaccgt

SEQ ID NO: 28465 - DNA, 23 bp, Homo sapiens
gcgttcctggacaaacagcctca

SEQ ID NO: 28466 - DNA, 18 bp, Homo sapiens
ggtcctactgctgtgagc

SEQ ID NO: 28467 - DNA, 17 bp, Homo sapiens
tcgacttcattttgcca

SEQ ID NO: 28468 - DNA, 19 bp, Homo sapiens
tctgcacctaaacccatac

SEQ ID NO: 28469 - DNA, 21 bp, Homo sapiens
tgaccgtctgagcccagctca

SEQ ID NO: 28470 - DNA, 20 bp, Homo sapiens
tgccccgttgcctatcacag

SEQ ID NO: 28471 - DNA, 19 bp, Homo sapiens
tgtcccgcgggcgagttct

SEQ ID NO: 28472 - DNA, 18 bp, Homo sapiens
agcctcctgctctgtgaa

SEQ ID NO: 28473 - DNA, 20 bp, Homo sapiens
ccactctatttttttaggtt

SEQ ID NO: 28474 - DNA, 19 bp, Homo sapiens
gccaggcggccgcttggcc

SEQ ID NO: 28475 - DNA, 20 bp, Homo sapiens
gcgtctgcactgatgaccgt

SEQ ID NO: 28476 - DNA, 23 bp, Homo sapiens
gcgttcctggacaaacagcctca

SEQ ID NO: 28477 - DNA, 21 bp, Homo sapiens
tgaccgtctgagcccagctca

SEQ ID NO: 28478 - DNA, 18 bp, Homo sapiens
tgatagaaagttaagcca

SEQ ID NO: 28479 - DNA, 19 bp, Homo sapiens
aagattatagtaccagtca

SEQ ID NO: 28480 - DNA, 17 bp, Homo sapiens
atatagaggaaaggggc

SEQ ID NO: 28481 - DNA, 18 bp, Homo sapiens
tgtgaataactcaagtca

SEQ ID NO: 28482 - DNA, 20 bp, Homo sapiens
ttcaaaagaatatctgtctg

SEQ ID NO: 28483 - DNA, 19 bp, Homo sapiens
aagattatagtaccagtca

SEQ ID NO: 28484 - DNA, 17 bp, Homo sapiens
atatagaggaaaggggc

SEQ ID NO: 28485 - DNA, 19 bp, Homo sapiens
aagattatagtaccagtca

SEQ ID NO: 28486 - DNA, 17 bp, Homo sapiens
atatagaggaaaggggc

SEQ ID NO: 28487 - DNA, 19 bp, Homo sapiens
aagattatagtaccagtca

SEQ ID NO: 28488 - DNA, 17 bp, Homo sapiens
atatagaggaaaggggc

SEQ ID NO: 28489 - DNA, 19 bp, Homo sapiens
aagattatagtaccagtca

SEQ ID NO: 28490 - DNA, 17 bp, Homo sapiens
atatagaggaaaggggc

SEQ ID NO: 28491 - DNA, 17 bp, Homo sapiens
aggaaatgcttggattc

SEQ ID NO: 28492 - DNA, 17 bp, Homo sapiens
ccatctattttttacca

SEQ ID NO: 28493 - DNA, 19 bp, Homo sapiens
ggacccacaaaactaacct

SEQ ID NO: 28494 - DNA, 20 bp, Homo sapiens
ttgttaatggcctgtgacat

SEQ ID NO: 28495 - DNA, 20 bp, Homo sapiens
atttattttcagctgtctgc

SEQ ID NO: 28496 - DNA, 15 bp, Homo sapiens
actcattacgtgatc

SEQ ID NO: 28497 - DNA, 20 bp, Homo sapiens
agttgcattaaataaagtat

SEQ ID NO: 28498 - DNA, 17 bp, Homo sapiens
gtgatcccagactggaa

SEQ ID NO: 28499 - DNA, 24 bp, Homo sapiens
acctgggctcaagtggcttggcct

SEQ ID NO: 28500 - DNA, 19 bp, Homo sapiens
gggagtctccctatgttgc

SEQ ID NO: 28501 - DNA, 18 bp, Homo sapiens
agcaaaaagtaaagaaca

SEQ ID NO: 28502 - DNA, 19 bp, Homo sapiens
ataaagcaagctatctgca

SEQ ID NO: 28503 - DNA, 17 bp, Homo sapiens
ctgtgtagttttgtttt

SEQ ID NO: 28504 - DNA, 18 bp, Homo sapiens
gccacagcaaaaagtaaa

SEQ ID NO: 28505 - DNA, 17 bp, Homo sapiens
ctgtgtagttttgtttt

SEQ ID NO: 28506 - DNA, 18 bp, Homo sapiens
agcaaaaagtaaagaaca

SEQ ID NO: 28507 - DNA, 19 bp, Homo sapiens
ataaagcaagctatctgca

SEQ ID NO: 28508 - DNA, 17 bp, Homo sapiens
ctgtgtagttttgtttt

SEQ ID NO: 28509 - DNA, 18 bp, Homo sapiens
gccacagcaaaaagtaaa

SEQ ID NO: 28510 - DNA, 21 bp, Homo sapiens
aggcagaaaaacttgaaatac

SEQ ID NO: 28511 - DNA, 18 bp, Homo sapiens
tctacgggaaatgggtca

SEQ ID NO: 28512 - DNA, 23 bp, Homo sapiens
tctttagcttagcccagtttcca

SEQ ID NO: 28513 - DNA, 21 bp, Homo sapiens
tggatgcattggctgaaattg

SEQ ID NO: 28514 - DNA, 23 bp, Homo sapiens
tttgatataaaaagaaactatag

SEQ ID NO: 28515 - DNA, 20 bp, Homo sapiens
ctgcccccctcctcacctgg

SEQ ID NO: 28516 - DNA, 18 bp, Homo sapiens
agcaaaaagtaaagaaca

SEQ ID NO: 28517 - DNA, 19 bp, Homo sapiens
ataaagcaagctatctgca

SEQ ID NO: 28518 - DNA, 17 bp, Homo sapiens
ctgtgtagttttgtttt

SEQ ID NO: 28519 - DNA, 18 bp, Homo sapiens
gccacagcaaaaagtaaa

SEQ ID NO: 28520 - DNA, 19 bp, Homo sapiens
tgtgttggccggttctgaa

SEQ ID NO: 28521 - DNA, 18 bp, Homo sapiens
atgaggggttcccttgaa

SEQ ID NO: 28522 - DNA, 21 bp, Homo sapiens
cagggtcgtgaggtttctggt

SEQ ID NO: 28523 - DNA, 18 bp, Homo sapiens
cctgaccgagcctgtgag

SEQ ID NO: 28524 - DNA, 23 bp, Homo sapiens
gcttctctgccattagcagccct

SEQ ID NO: 28525 - DNA, 21 bp, Homo sapiens
ggaaacagaaactcccaactg

SEQ ID NO: 28526 - DNA, 21 bp, Homo sapiens
gtcccaaaatgggattggaga

SEQ ID NO: 28527 - DNA, 22 bp, Homo sapiens
agacttccttatttatcaatta

SEQ ID NO: 28528 - DNA, 24 bp, Homo sapiens
agccacagggacccaagcagtcga

SEQ ID NO: 28529 - DNA, 19 bp, Homo sapiens
agctcactctctaggtctc

SEQ ID NO: 28530 - DNA, 20 bp, Homo sapiens
caaggttgtggccttaggtt

SEQ ID NO: 28531 - DNA, 25 bp, Homo sapiens
ccaagcactttcctcttttacagct

SEQ ID NO: 28532 - DNA, 19 bp, Homo sapiens
cgaggaactccggctgctt

SEQ ID NO: 28533 - DNA, 22 bp, Homo sapiens
ctctgtgcgagagatctgtgaa

SEQ ID NO: 28534 - DNA, 16 bp, Homo sapiens
ctttctcagcatatca

SEQ ID NO: 28535 - DNA, 17 bp, Homo sapiens
gatacaactccccgatc

SEQ ID NO: 28536 - DNA, 19 bp, Homo sapiens
gcaagagccatgtttttga

SEQ ID NO: 28537 - DNA, 18 bp, Homo sapiens
gttactcacacttatgtc

SEQ ID NO: 28538 - DNA, 20 bp, Homo sapiens
taagtgggtctcgcctgggc

SEQ ID NO: 28539 - DNA, 21 bp, Homo sapiens
tctagggttgtagcttttgat

SEQ ID NO: 28540 - DNA, 22 bp, Homo sapiens
tctagggttgtagcttttgata

SEQ ID NO: 28541 - DNA, 21 bp, Homo sapiens
tcagtcctggcaccatgcaca

SEQ ID NO: 28542 - DNA, 23 bp, Homo sapiens
agaaaagggagccccaaatgcaa

SEQ ID NO: 28543 - DNA, 22 bp, Homo sapiens
agaccctcctcctcctccatct

SEQ ID NO: 28544 - DNA, 19 bp, Homo sapiens
aggatttgctatgacctca

SEQ ID NO: 28545 - DNA, 19 bp, Homo sapiens
ctcctcctcctccatctct

SEQ ID NO: 28546 - DNA, 21 bp, Homo sapiens
tcatccagcagcctcccctcc

SEQ ID NO: 28547 - DNA, 19 bp, Homo sapiens
ctgcaagctccgcctccca

SEQ ID NO: 28548 - DNA, 16 bp, Homo sapiens
tgccattctcctgcct

SEQ ID NO: 28549 - DNA, 18 bp, Homo sapiens
agataattactgccttga

SEQ ID NO: 28550 - DNA, 21 bp, Homo sapiens
cagtacccaccaccttcttct

SEQ ID NO: 28551 - DNA, 18 bp, Homo sapiens
catatcccttccagatgg

SEQ ID NO: 28552 - DNA, 22 bp, Homo sapiens
ggctccatcccccgccccctct

SEQ ID NO: 28553 - DNA, 18 bp, Homo sapiens
gtgcggagttttggaata

SEQ ID NO: 28554 - DNA, 18 bp, Homo sapiens
taagaaacttatttctca

SEQ ID NO: 28555 - DNA, 23 bp, Homo sapiens
tatcccaagaatgcaagatttca

SEQ ID NO: 28556 - DNA, 23 bp, Homo sapiens
gaggctgagcatcatgaagagaa

SEQ ID NO: 28557 - DNA, 19 bp, Homo sapiens
agatgcaggaacttccaca

SEQ ID NO: 28558 - DNA, 24 bp, Homo sapiens
attttctctgccttccttatctca

SEQ ID NO: 28559 - DNA, 16 bp, Homo sapiens
caacagtggcttttaa

SEQ ID NO: 28560 - DNA, 21 bp, Homo sapiens
ggtagtcagcccacctcctct

SEQ ID NO: 28561 - DNA, 20 bp, Homo sapiens
tatttgtaacttcccaactg

SEQ ID NO: 28562 - DNA, 16 bp, Homo sapiens
tgaacccctttggcct

SEQ ID NO: 28563 - DNA, 16 bp, Homo sapiens
aggatgccaatgatgc

SEQ ID NO: 28564 - DNA, 20 bp, Homo sapiens
caggcaaatcacgccacctc

SEQ ID NO: 28565 - DNA, 20 bp, Homo sapiens
ccagatggtctgagaagtga

SEQ ID NO: 28566 - DNA, 19 bp, Homo sapiens
tctctgagcctgtctccca

SEQ ID NO: 28567 - DNA, 20 bp, Homo sapiens
tgaatattatccaacatggg

SEQ ID NO: 28568 - DNA, 19 bp, Homo sapiens
ttttttcattctacagcat

SEQ ID NO: 28569 - DNA, 19 bp, Homo sapiens
acatgtgattgttttgttt

SEQ ID NO: 28570 - DNA, 19 bp, Homo sapiens
cccaccccaacccacccca

SEQ ID NO: 28571 - DNA, 18 bp, Homo sapiens
gcccaccccaccccaacc

SEQ ID NO: 28572 - DNA, 19 bp, Homo sapiens
tcagaatgaatgcagttgt

SEQ ID NO: 28573 - DNA, 21 bp, Homo sapiens
tgctgtctccttcccacatcc

SEQ ID NO: 28574 - DNA, 15 bp, Homo sapiens
ttcattgagcagtta

SEQ ID NO: 28575 - DNA, 18 bp, Homo sapiens
gagtcttgtggtgaaaca

SEQ ID NO: 28576 - DNA, 20 bp, Homo sapiens
gcttaagtcatggaattcta

SEQ ID NO: 28577 - DNA, 20 bp, Homo sapiens
tctttttatggctgaataat

SEQ ID NO: 28578 - DNA, 24 bp, Homo sapiens
cttcttcatctctgttttgctctt

SEQ ID NO: 28579 - DNA, 21 bp, Homo sapiens
ggttgtggactcggtcactgc

SEQ ID NO: 28580 - DNA, 24 bp, Homo sapiens
cttcttcatctctgttttgctctt

SEQ ID NO: 28581 - DNA, 21 bp, Homo sapiens
ggttgtggactcggtcactgc

SEQ ID NO: 28582 - DNA, 20 bp, Homo sapiens
atgatttcaaaatcagtttt

SEQ ID NO: 28583 - DNA, 22 bp, Homo sapiens
ccaaacaaaactgaaccacaaa

SEQ ID NO: 28584 - DNA, 20 bp, Homo sapiens
cttccacgagccaggggtgc

SEQ ID NO: 28585 - DNA, 18 bp, Homo sapiens
cttgttctatttttcaat

SEQ ID NO: 28586 - DNA, 20 bp, Homo sapiens
taagggaacaatccatgtga

SEQ ID NO: 28587 - DNA, 23 bp, Homo sapiens
taatcagaaaagtaattttgtca

SEQ ID NO: 28588 - DNA, 17 bp, Homo sapiens
tccctcagcagctctca

SEQ ID NO: 28589 - DNA, 20 bp, Homo sapiens
tgcaaattaaaacatatttc

SEQ ID NO: 28590 - DNA, 23 bp, Homo sapiens
ttgtttgatccctaaccctacaa

SEQ ID NO: 28591 - DNA, 17 bp, Homo sapiens
caccctcgcctcacagc

SEQ ID NO: 28592 - DNA, 22 bp, Homo sapiens
gaatcaacagatcaatgacata

SEQ ID NO: 28593 - DNA, 23 bp, Homo sapiens
tcccattttccttcaccgtgaca

SEQ ID NO: 28594 - DNA, 22 bp, Homo sapiens
gaatcaacagatcaatgacata

SEQ ID NO: 28595 - DNA, 23 bp, Homo sapiens
tcccattttccttcaccgtgaca

SEQ ID NO: 28596 - DNA, 21 bp, Homo sapiens
accccactggagtggtgctgg

SEQ ID NO: 28597 - DNA, 19 bp, Homo sapiens
atgacctctcagcctctca

SEQ ID NO: 28598 - DNA, 20 bp, Homo sapiens
cctggctctgcgggttgctg

SEQ ID NO: 28599 - DNA, 18 bp, Homo sapiens
aagaagcccaccactagg

SEQ ID NO: 28600 - DNA, 20 bp, Homo sapiens
ccaaagtcactcctgttttg

SEQ ID NO: 28601 - DNA, 22 bp, Homo sapiens
gaaggaactacttcagtgcaca

SEQ ID NO: 28602 - DNA, 23 bp, Homo sapiens
tttaggatgttctggatgctttt

SEQ ID NO: 28603 - DNA, 20 bp, Homo sapiens
ttgatcaatacaacagtata

SEQ ID NO: 28604 - DNA, 21 bp, Homo sapiens
aactagctggcatggtagcac

SEQ ID NO: 28605 - DNA, 18 bp, Homo sapiens
cagatacttgggaggcca

SEQ ID NO: 28606 - DNA, 20 bp, Homo sapiens
cagctcactgtttttggtgc

SEQ ID NO: 28607 - DNA, 20 bp, Homo sapiens
ctgtctttccagcatgccct

SEQ ID NO: 28608 - DNA, 17 bp, Homo sapiens
tgaaagcctacagctca

SEQ ID NO: 28609 - DNA, 17 bp, Homo sapiens
caggtacgcgccgccgc

SEQ ID NO: 28610 - DNA, 17 bp, Homo sapiens
caggtacgcgccgccgc

SEQ ID NO: 28611 - DNA, 19 bp, Homo sapiens
tggcctcagtgtggcattg

SEQ ID NO: 28612 - DNA, 23 bp, Homo sapiens
gcaggagcagcccgcaccggaca

SEQ ID NO: 28613 - DNA, 23 bp, Homo sapiens
acccaagaagttcaggagctgcc

SEQ ID NO: 28614 - DNA, 22 bp, Homo sapiens
acctcaagctttactgacttca

SEQ ID NO: 28615 - DNA, 21 bp, Homo sapiens
agccaagatcacaccactgca

SEQ ID NO: 28616 - DNA, 22 bp, Homo sapiens
ccttgtggtataaagtattata

SEQ ID NO: 28617 - DNA, 23 bp, Homo sapiens
ggccgcccccgcccgtctcctct

SEQ ID NO: 28618 - DNA, 21 bp, Homo sapiens
taaatggatttcagtatagct

SEQ ID NO: 28619 - DNA, 17 bp, Homo sapiens
tggaattgggagtctga

SEQ ID NO: 28620 - DNA, 22 bp, Homo sapiens
acctcaagctttactgacttca

SEQ ID NO: 28621 - DNA, 21 bp, Homo sapiens
agccaagatcacaccactgca

SEQ ID NO: 28622 - DNA, 22 bp, Homo sapiens
ccttgtggtataaagtattata

SEQ ID NO: 28623 - DNA, 23 bp, Homo sapiens
ggccgcccccgcccgtctcctct

SEQ ID NO: 28624 - DNA, 19 bp, Homo sapiens
caacttaacactgaaccca

SEQ ID NO: 28625 - DNA, 16 bp, Homo sapiens
agtgagtccttaccgc

SEQ ID NO: 28626 - DNA, 21 bp, Homo sapiens
aaggcacagggcaaggagcca

SEQ ID NO: 28627 - DNA, 16 bp, Homo sapiens
agtgagtccttaccgc

SEQ ID NO: 28628 - DNA, 21 bp, Homo sapiens
gcaggcctttcacgtcagcta

SEQ ID NO: 28629 - DNA, 20 bp, Homo sapiens
ggtttttactgctgcagcag

SEQ ID NO: 28630 - DNA, 23 bp, Homo sapiens
tgaggagcaggcctttcacgtca

SEQ ID NO: 28631 - DNA, 16 bp, Homo sapiens
ccgtgcccagcacccg

SEQ ID NO: 28632 - DNA, 16 bp, Homo sapiens
ggtggaagtcctccag

SEQ ID NO: 28633 - DNA, 18 bp, Homo sapiens
aacacaggcttgtcgtgc

SEQ ID NO: 28634 - DNA, 18 bp, Homo sapiens
ccccgttcattttctcca

SEQ ID NO: 28635 - DNA, 19 bp, Homo sapiens
cttctgcagcccctcccca

SEQ ID NO: 28636 - DNA, 20 bp, Homo sapiens
ggctgcccccccgttcattt

SEQ ID NO: 28637 - DNA, 19 bp, Homo sapiens
gtgatgatcctcccatccg

SEQ ID NO: 28638 - DNA, 23 bp, Homo sapiens
gtgcatggctgcccccccgttca

SEQ ID NO: 28639 - DNA, 19 bp, Homo sapiens
tctgggttggctgttccag

SEQ ID NO: 28640 - DNA, 25 bp, Homo sapiens
aacgtcattgcgatttatcttgctt

SEQ ID NO: 28641 - DNA, 17 bp, Homo sapiens
acagctgcagcaggtga

SEQ ID NO: 28642 - DNA, 18 bp, Homo sapiens
acgcaccagcggaagctc

SEQ ID NO: 28643 - DNA, 22 bp, Homo sapiens
agacgggctgaagcgagccctc

SEQ ID NO: 28644 - DNA, 20 bp, Homo sapiens
ctctgaaaagtgggctgtga

SEQ ID NO: 28645 - DNA, 18 bp, Homo sapiens
gccctcaggagttttggg

SEQ ID NO: 28646 - DNA, 19 bp, Homo sapiens
gtctgtggaggaggcaaga

SEQ ID NO: 28647 - DNA, 18 bp, Homo sapiens
tcattctgaaccttatca

SEQ ID NO: 28648 - DNA, 19 bp, Homo sapiens
tctggacaaagactacctg

SEQ ID NO: 28649 - DNA, 17 bp, Homo sapiens
tcttgaagacaactctg

SEQ ID NO: 28650 - DNA, 25 bp, Homo sapiens
aacgtcattgcgatttatcttgctt

SEQ ID NO: 28651 - DNA, 17 bp, Homo sapiens
acagctgcagcaggtga

SEQ ID NO: 28652 - DNA, 18 bp, Homo sapiens
acgcaccagcggaagctc

SEQ ID NO: 28653 - DNA, 20 bp, Homo sapiens
ctctgaaaagtgggctgtga

SEQ ID NO: 28654 - DNA, 19 bp, Homo sapiens
gtctgtggaggaggcaaga

SEQ ID NO: 28655 - DNA, 18 bp, Homo sapiens
tcattctgaaccttatca

SEQ ID NO: 28656 - DNA, 19 bp, Homo sapiens
tctggacaaagactacctg

SEQ ID NO: 28657 - DNA, 17 bp, Homo sapiens
tcttgaagacaactctg

SEQ ID NO: 28658 - DNA, 21 bp, Homo sapiens
tgcacagacagcaccctcctc

SEQ ID NO: 28659 - DNA, 25 bp, Homo sapiens
aacgtcattgcgatttatcttgctt

SEQ ID NO: 28660 - DNA, 17 bp, Homo sapiens
acagctgcagcaggtga

SEQ ID NO: 28661 - DNA, 18 bp, Homo sapiens
acgcaccagcggaagctc

SEQ ID NO: 28662 - DNA, 20 bp, Homo sapiens
ctctgaaaagtgggctgtga

SEQ ID NO: 28663 - DNA, 19 bp, Homo sapiens
gtctgtggaggaggcaaga

SEQ ID NO: 28664 - DNA, 18 bp, Homo sapiens
tcattctgaaccttatca

SEQ ID NO: 28665 - DNA, 17 bp, Homo sapiens
tcttgaagacaactctg

SEQ ID NO: 28666 - DNA, 23 bp, Homo sapiens
gcaggagcagcccgcaccggaca

SEQ ID NO: 28667 - DNA, 21 bp, Homo sapiens
aagagaggcccaggctactgg

SEQ ID NO: 28668 - DNA, 21 bp, Homo sapiens
ccctgctgcggagaccgcgga

SEQ ID NO: 28669 - DNA, 21 bp, Homo sapiens
ctcccccggagcagcactttg

SEQ ID NO: 28670 - DNA, 21 bp, Homo sapiens
ctctctctctctccctctctc

SEQ ID NO: 28671 - DNA, 20 bp, Homo sapiens
tctcctcctcctcctcctct

SEQ ID NO: 28672 - DNA, 26 bp, Homo sapiens
aaatttgttctttgatattggaatta

SEQ ID NO: 28673 - DNA, 22 bp, Homo sapiens
agggtagaagtaagacatatca

SEQ ID NO: 28674 - DNA, 22 bp, Homo sapiens
ctgctttggcttgcgcacggtg

SEQ ID NO: 28675 - DNA, 23 bp, Homo sapiens
cttaacctcattggaggatctca

SEQ ID NO: 28676 - DNA, 21 bp, Homo sapiens
gcactacagattgagctttat

SEQ ID NO: 28677 - DNA, 19 bp, Homo sapiens
ggaggaggaagtactgcta

SEQ ID NO: 28678 - DNA, 16 bp, Homo sapiens
tgaaaagattgaagag

SEQ ID NO: 28679 - DNA, 21 bp, Homo sapiens
tgaatggcagatgtggagcta

SEQ ID NO: 28680 - DNA, 19 bp, Homo sapiens
agcattttgaattactttt

SEQ ID NO: 28681 - DNA, 24 bp, Homo sapiens
actgaagttgtggttgttaggttc

SEQ ID NO: 28682 - DNA, 20 bp, Homo sapiens
atttgattccttgtgcacat

SEQ ID NO: 28683 - DNA, 24 bp, Homo sapiens
cagttctgcaaaaatgacctataa

SEQ ID NO: 28684 - DNA, 18 bp, Homo sapiens
ctcaacatggcagaacca

SEQ ID NO: 28685 - DNA, 18 bp, Homo sapiens
gttttaatgttcttttga

SEQ ID NO: 28686 - DNA, 20 bp, Homo sapiens
tgttttataaacaacatcaa

SEQ ID NO: 28687 - DNA, 21 bp, Homo sapiens
ttctttgggtgtaaagcgttt

SEQ ID NO: 28688 - DNA, 15 bp, Homo sapiens
tttaattgggtgggg

SEQ ID NO: 28689 - DNA, 19 bp, Homo sapiens
cctttttccttctaagtca

SEQ ID NO: 28690 - DNA, 20 bp, Homo sapiens
gcacgccaccacgcccagct

SEQ ID NO: 28691 - DNA, 17 bp, Homo sapiens
gctaataaactgcgatg

SEQ ID NO: 28692 - DNA, 19 bp, Homo sapiens
gctcccaaacttaacagca

SEQ ID NO: 28693 - DNA, 19 bp, Homo sapiens
taggaggcaagagatctga

SEQ ID NO: 28694 - DNA, 22 bp, Homo sapiens
tccagctggacaaagactctgg

SEQ ID NO: 28695 - DNA, 23 bp, Homo sapiens
tttctttgtatgcctttggcctt

SEQ ID NO: 28696 - DNA, 16 bp, Homo sapiens
aatgatactgtgttcc

SEQ ID NO: 28697 - DNA, 17 bp, Homo sapiens
ataattttcctgtgaca

SEQ ID NO: 28698 - DNA, 16 bp, Homo sapiens
tgatactgtgttccct

SEQ ID NO: 28699 - DNA, 17 bp, Homo sapiens
gagttccaaagatctca

SEQ ID NO: 28700 - DNA, 18 bp, Homo sapiens
ggcttctgtttctgcatt

SEQ ID NO: 28701 - DNA, 19 bp, Homo sapiens
ggtggaccaaagggatgca

SEQ ID NO: 28702 - DNA, 21 bp, Homo sapiens
attacccccgtgaaagctttt

SEQ ID NO: 28703 - DNA, 20 bp, Homo sapiens
gtgtgtgtggagctcgggtg

SEQ ID NO: 28704 - DNA, 18 bp, Homo sapiens
agaaaaattaccaggtca

SEQ ID NO: 28705 - DNA, 22 bp, Homo sapiens
ccttttgagctgtcttgacgtt

SEQ ID NO: 28706 - DNA, 18 bp, Homo sapiens
agaaaaattaccaggtca

SEQ ID NO: 28707 - DNA, 22 bp, Homo sapiens
ccttttgagctgtcttgacgtt

SEQ ID NO: 28708 - DNA, 20 bp, Homo sapiens
acacttgagcttgccactct

SEQ ID NO: 28709 - DNA, 18 bp, Homo sapiens
agacacacccacagaagg

SEQ ID NO: 28710 - DNA, 18 bp, Homo sapiens
ccaccctcaatcagtacc

SEQ ID NO: 28711 - DNA, 16 bp, Homo sapiens
gcttgccttgaagggg

SEQ ID NO: 28712 - DNA, 21 bp, Homo sapiens
tggatgggtcctcacgcagac

SEQ ID NO: 28713 - DNA, 18 bp, Homo sapiens
aaatctttgtgcaagaaa

SEQ ID NO: 28714 - DNA, 21 bp, Homo sapiens
acaaagttaagcacaagatct

SEQ ID NO: 28715 - DNA, 18 bp, Homo sapiens
tggtttcaaatgaaacta

SEQ ID NO: 28716 - DNA, 22 bp, Homo sapiens
tgtgggatgtaaatttgtaggt

SEQ ID NO: 28717 - DNA, 23 bp, Homo sapiens
ttataaatgtagtgtttcattgg

SEQ ID NO: 28718 - DNA, 25 bp, Homo sapiens
accctgggccatcctcacatgtgac

SEQ ID NO: 28719 - DNA, 23 bp, Homo sapiens
gcgccgcggccgcctcctcctcc

SEQ ID NO: 28720 - DNA, 18 bp, Homo sapiens
ggcaggcactcccatcca

SEQ ID NO: 28721 - DNA, 18 bp, Homo sapiens
tgcattgttaatcatcca

SEQ ID NO: 28722 - DNA, 23 bp, Homo sapiens
gcgccgcggccgcctcctcctcc

SEQ ID NO: 28723 - DNA, 23 bp, Homo sapiens
gcgccgcggccgcctcctcctcc

SEQ ID NO: 28724 - DNA, 23 bp, Homo sapiens
gcgccgcggccgcctcctcctcc

SEQ ID NO: 28725 - DNA, 23 bp, Homo sapiens
gcgccgcggccgcctcctcctcc

SEQ ID NO: 28726 - DNA, 18 bp, Homo sapiens
cgcaggccctttacttca

SEQ ID NO: 28727 - DNA, 18 bp, Homo sapiens
aaacagggcagccagtga

SEQ ID NO: 28728 - DNA, 17 bp, Homo sapiens
agaatggccagatctaa

SEQ ID NO: 28729 - DNA, 24 bp, Homo sapiens
ccagtagagtgaggaagtgagaca

SEQ ID NO: 28730 - DNA, 22 bp, Homo sapiens
cttcgccagcagccttggtttt

SEQ ID NO: 28731 - DNA, 18 bp, Homo sapiens
gaacctagaatgagactg

SEQ ID NO: 28732 - DNA, 21 bp, Homo sapiens
tctgcaaaaagtgaattcttc

SEQ ID NO: 28733 - DNA, 21 bp, Homo sapiens
actcaaataaagcgtgtaata

SEQ ID NO: 28734 - DNA, 19 bp, Homo sapiens
gcgtgtaataaataagtta

SEQ ID NO: 28735 - DNA, 19 bp, Homo sapiens
tgaatatttatatcttgta

SEQ ID NO: 28736 - DNA, 24 bp, Homo sapiens
tttctgcacgtggttgccttagtc

SEQ ID NO: 28737 - DNA, 17 bp, Homo sapiens
aacctaaggtatgtgcc

SEQ ID NO: 28738 - DNA, 19 bp, Homo sapiens
aagtggggtggggaactca

SEQ ID NO: 28739 - DNA, 19 bp, Homo sapiens
tggatcacaaacagcacaa

SEQ ID NO: 28740 - DNA, 20 bp, Homo sapiens
atagtatatgtggacacata

SEQ ID NO: 28741 - DNA, 19 bp, Homo sapiens
ttctttgggtgcattttgt

SEQ ID NO: 28742 - DNA, 20 bp, Homo sapiens
agttgtccacaggagatcca

SEQ ID NO: 28743 - DNA, 19 bp, Homo sapiens
cctggaaactgcttggtgc

SEQ ID NO: 28744 - DNA, 21 bp, Homo sapiens
taaaatacaaaaaattagcca

SEQ ID NO: 28745 - DNA, 23 bp, Homo sapiens
ttcaggtatgtgggaagctctga

SEQ ID NO: 28746 - DNA, 22 bp, Homo sapiens
aaacttcaaaaacttcatggca

SEQ ID NO: 28747 - DNA, 20 bp, Homo sapiens
tcctaagctccaagcatgtc

SEQ ID NO: 28748 - DNA, 19 bp, Homo sapiens
tgcccaggagcccccatcc

SEQ ID NO: 28749 - DNA, 20 bp, Homo sapiens
tgcccaggagcccccatcct

SEQ ID NO: 28750 - DNA, 16 bp, Homo sapiens
aaagtcaagctgcact

SEQ ID NO: 28751 - DNA, 19 bp, Homo sapiens
cgtggttgagaagcatcag

SEQ ID NO: 28752 - DNA, 22 bp, Homo sapiens
gctctgaacttctccttcatcc

SEQ ID NO: 28753 - DNA, 16 bp, Homo sapiens
gatctttctccgtgga

SEQ ID NO: 28754 - DNA, 20 bp, Homo sapiens
tgctcttacagcctgttcca

SEQ ID NO: 28755 - DNA, 22 bp, Homo sapiens
ccgtagaatttcgcttcaccga

SEQ ID NO: 28756 - DNA, 18 bp, Homo sapiens
tcgtggacttctaagaaa

SEQ ID NO: 28757 - DNA, 19 bp, Homo sapiens
agggaaggccgaggtctca

SEQ ID NO: 28758 - DNA, 19 bp, Homo sapiens
ccagggcacagccctgaca

SEQ ID NO: 28759 - DNA, 16 bp, Homo sapiens
cctagctttgaactga

SEQ ID NO: 28760 - DNA, 18 bp, Homo sapiens
gtttgagttgaggaccaa

SEQ ID NO: 28761 - DNA, 21 bp, Homo sapiens
gcgtcgggcacagggcagctc

SEQ ID NO: 28762 - DNA, 20 bp, Homo sapiens
ccctcagtccgtccgcgctt

SEQ ID NO: 28763 - DNA, 19 bp, Homo sapiens
aaagatttgaaaacttacc

SEQ ID NO: 28764 - DNA, 20 bp, Homo sapiens
caaggttacttagccagtaa

SEQ ID NO: 28765 - DNA, 20 bp, Homo sapiens
taactcttaatcttcacaat

SEQ ID NO: 28766 - DNA, 17 bp, Homo sapiens
ccatgggacctcagcaa

SEQ ID NO: 28767 - DNA, 20 bp, Homo sapiens
tgggttgcctcccacaagtc

SEQ ID NO: 28768 - DNA, 20 bp, Homo sapiens
ccgcccaaaaacaaatcctc

SEQ ID NO: 28769 - DNA, 22 bp, Homo sapiens
ctcagggacacctcctctgata

SEQ ID NO: 28770 - DNA, 20 bp, Homo sapiens
tccgggaagccaacagtgtt

SEQ ID NO: 28771 - DNA, 23 bp, Homo sapiens
tggaatgcaatggcgcgatctca

SEQ ID NO: 28772 - DNA, 19 bp, Homo sapiens
aagcaattctcctgcctca

SEQ ID NO: 28773 - DNA, 22 bp, Homo sapiens
tcctgcttctagaaccacctca

SEQ ID NO: 28774 - DNA, 18 bp, Homo sapiens
tgcttctagaaccacctc

SEQ ID NO: 28775 - DNA, 18 bp, Homo sapiens
tgtctcctctccatctct

SEQ ID NO: 28776 - DNA, 17 bp, Homo sapiens
tttgtgtgtttttttaa

SEQ ID NO: 28777 - DNA, 18 bp, Homo sapiens
cctgcaacctccacctcc

SEQ ID NO: 28778 - DNA, 19 bp, Homo sapiens
tttcactctgtcgccaggc

SEQ ID NO: 28779 - DNA, 20 bp, Homo sapiens
acttgatcaggaaagtgaca

SEQ ID NO: 28780 - DNA, 22 bp, Homo sapiens
agtttcactctgtcacccaggc

SEQ ID NO: 28781 - DNA, 22 bp, Homo sapiens
ctctttagtattgggatcccag

SEQ ID NO: 28782 - DNA, 22 bp, Homo sapiens
tgatctcgcctcctgggttcaa

SEQ ID NO: 28783 - DNA, 20 bp, Homo sapiens
tggccaggctggtcttgaac

SEQ ID NO: 28784 - DNA, 19 bp, Homo sapiens
tgtggatgctttcctacgc

SEQ ID NO: 28785 - DNA, 20 bp, Homo sapiens
atacacttaccactgggtga

SEQ ID NO: 28786 - DNA, 22 bp, Homo sapiens
ccttttctgttggtttggtttt

SEQ ID NO: 28787 - DNA, 24 bp, Homo sapiens
ccaggccctgccaggttcccaccc

SEQ ID NO: 28788 - DNA, 19 bp, Homo sapiens
tacacggccgacctgtcgc

SEQ ID NO: 28789 - DNA, 19 bp, Homo sapiens
gtgatgaagaagccagtta

SEQ ID NO: 28790 - DNA, 20 bp, Homo sapiens
ttctggcccttcccacacca

SEQ ID NO: 28791 - DNA, 20 bp, Homo sapiens
atctgtactccccagatctc

SEQ ID NO: 28792 - DNA, 22 bp, Homo sapiens
catgctcacctcccctaccctg

SEQ ID NO: 28793 - DNA, 20 bp, Homo sapiens
gggggtccccctcaaccgca

SEQ ID NO: 28794 - DNA, 20 bp, Homo sapiens
tgagctcccagtaggggctg

SEQ ID NO: 28795 - DNA, 20 bp, Homo sapiens
cccacctggaacccgacctc

SEQ ID NO: 28796 - DNA, 17 bp, Homo sapiens
tcaagtgattctcctgc

SEQ ID NO: 28797 - DNA, 18 bp, Homo sapiens
tccgcctcccgggttcaa

SEQ ID NO: 28798 - DNA, 18 bp, Homo sapiens
ttctcctgcctcagcctt

SEQ ID NO: 28799 - DNA, 20 bp, Homo sapiens
aactacaccccgcctcccct

SEQ ID NO: 28800 - DNA, 24 bp, Homo sapiens
cacatgctcatggccagaatctta

SEQ ID NO: 28801 - DNA, 19 bp, Homo sapiens
caggtgggatatgtcctca

SEQ ID NO: 28802 - DNA, 20 bp, Homo sapiens
ccagtctttttgggggtttc

SEQ ID NO: 28803 - DNA, 23 bp, Homo sapiens
cctgcttgtcctggaccactttt

SEQ ID NO: 28804 - DNA, 21 bp, Homo sapiens
gattgctcagagttcctttag

SEQ ID NO: 28805 - DNA, 19 bp, Homo sapiens
gtagctttcctgggctcca

SEQ ID NO: 28806 - DNA, 20 bp, Homo sapiens
tctatttccagactactgga

SEQ ID NO: 28807 - DNA, 22 bp, Homo sapiens
cccagaccccctcgccactcca

SEQ ID NO: 28808 - DNA, 19 bp, Homo sapiens
tgtccatacagatgttaca

SEQ ID NO: 28809 - DNA, 23 bp, Homo sapiens
cctcctcgccttcagcctcctca

SEQ ID NO: 28810 - DNA, 22 bp, Homo sapiens
gcagctcaaggtccacatctgc

SEQ ID NO: 28811 - DNA, 22 bp, Homo sapiens
gcagctcaaggtccacatctgc

SEQ ID NO: 28812 - DNA, 21 bp, Homo sapiens
tgaagtttcctttttcccaca

SEQ ID NO: 28813 - DNA, 23 bp, Homo sapiens
gggaccgcggcggtaactgtggc

SEQ ID NO: 28814 - DNA, 21 bp, Homo sapiens
gccctaacctgcctcctttgc

SEQ ID NO: 28815 - DNA, 16 bp, Homo sapiens
accaccctctgctcct

SEQ ID NO: 28816 - DNA, 19 bp, Homo sapiens
tcctggatacagaacacaa

SEQ ID NO: 28817 - DNA, 18 bp, Homo sapiens
aatagtattcctgaaata

SEQ ID NO: 28818 - DNA, 19 bp, Homo sapiens
atctgaggttctatttgat

SEQ ID NO: 28819 - DNA, 16 bp, Homo sapiens
gataaaaacgtagcta

SEQ ID NO: 28820 - DNA, 19 bp, Homo sapiens
cttgaagcccaggctgatg

SEQ ID NO: 28821 - DNA, 18 bp, Homo sapiens
gaaaggagatacacttct

SEQ ID NO: 28822 - DNA, 22 bp, Homo sapiens
gaggctgacctgaaagcaggta

SEQ ID NO: 28823 - DNA, 19 bp, Homo sapiens
ggtcaagttccgtctgcca

SEQ ID NO: 28824 - DNA, 22 bp, Homo sapiens
ttaggagtgcaccagtactctc

SEQ ID NO: 28825 - DNA, 17 bp, Homo sapiens
gataaggcacatgtgaa

SEQ ID NO: 28826 - DNA, 19 bp, Homo sapiens
gctatgcgttacctctgat

SEQ ID NO: 28827 - DNA, 18 bp, Homo sapiens
gtcttcagcttgatcaga

SEQ ID NO: 28828 - DNA, 20 bp, Homo sapiens
tcatgagtgacaagtgtagc

SEQ ID NO: 28829 - DNA, 21 bp, Homo sapiens
ttccagatgttattgttccag

SEQ ID NO: 28830 - DNA, 19 bp, Homo sapiens
cctcacccaagaaaccccc

SEQ ID NO: 28831 - DNA, 18 bp, Homo sapiens
cctgatgaccctctgcgg

SEQ ID NO: 28832 - DNA, 20 bp, Homo sapiens
cttccaagctgcttagcctt

SEQ ID NO: 28833 - DNA, 19 bp, Homo sapiens
gggccttctcaatgagcac

SEQ ID NO: 28834 - DNA, 22 bp, Homo sapiens
ttattacactgtctgctcctga

SEQ ID NO: 28835 - DNA, 23 bp, Homo sapiens
cccaggtgaggattcacatccca

SEQ ID NO: 28836 - DNA, 25 bp, Homo sapiens
cccaggtgaggattcacatcccaaa

SEQ ID NO: 28837 - DNA, 20 bp, Homo sapiens
gaaaccacctagggaccacg

SEQ ID NO: 28838 - DNA, 23 bp, Homo sapiens
gcctgagtcaggacacctggctt

SEQ ID NO: 28839 - DNA, 21 bp, Homo sapiens
tgggtgggctgagtggaggtg

SEQ ID NO: 28840 - DNA, 28 bp, Homo sapiens
aagaggaatcaccagggcccggatctaa

SEQ ID NO: 28841 - DNA, 16 bp, Homo sapiens
ccaggcactgcacagc

SEQ ID NO: 28842 - DNA, 22 bp, Homo sapiens
cctggaaactaccattgtgagg

SEQ ID NO: 28843 - DNA, 19 bp, Homo sapiens
tggacaatcagcatggaat

SEQ ID NO: 28844 - DNA, 18 bp, Homo sapiens
tgaatgagatcatgcgca

SEQ ID NO: 28845 - DNA, 17 bp, Homo sapiens
caaaaccaagatggtga

SEQ ID NO: 28846 - DNA, 18 bp, Homo sapiens
cgtcctcactgctacact

SEQ ID NO: 28847 - DNA, 19 bp, Homo sapiens
tctggtcgtcctcactgct

SEQ ID NO: 28848 - DNA, 19 bp, Homo sapiens
actaaaaatttacaagaga

SEQ ID NO: 28849 - DNA, 19 bp, Homo sapiens
cttttctcgtaaactttgc

SEQ ID NO: 28850 - DNA, 18 bp, Homo sapiens
tctttctctctctggtgt

SEQ ID NO: 28851 - DNA, 16 bp, Homo sapiens
aaacagacccacattg

SEQ ID NO: 28852 - DNA, 16 bp, Homo sapiens
cacattggaacagtga

SEQ ID NO: 28853 - DNA, 23 bp, Homo sapiens
agaaacccggggttgggggctca

SEQ ID NO: 28854 - DNA, 22 bp, Homo sapiens
cggggcggccagggctagagtg

SEQ ID NO: 28855 - DNA, 18 bp, Homo sapiens
gggggtggggttgaaata

SEQ ID NO: 28856 - DNA, 21 bp, Homo sapiens
taattccagagtactgtcctc

SEQ ID NO: 28857 - DNA, 29 bp, Homo sapiens
taggtctcccactttctaggatcattttt

SEQ ID NO: 28858 - DNA, 20 bp, Homo sapiens
tctgtgactggtgccataga

SEQ ID NO: 28859 - DNA, 15 bp, Homo sapiens
tgccatcggctgtga

SEQ ID NO: 28860 - DNA, 19 bp, Homo sapiens
aacaagaggcccaatctca

SEQ ID NO: 28861 - DNA, 19 bp, Homo sapiens
aagcccccacagctggcca

SEQ ID NO: 28862 - DNA, 25 bp, Homo sapiens
ccggggtacaagaggcccaatctca

SEQ ID NO: 28863 - DNA, 19 bp, Homo sapiens
cgtcccttgtgacaacacc

SEQ ID NO: 28864 - DNA, 20 bp, Homo sapiens
ggcttgaagcagggctccat

SEQ ID NO: 28865 - DNA, 22 bp, Homo sapiens
acccagagcacaggagctgcca

SEQ ID NO: 28866 - DNA, 17 bp, Homo sapiens
ccatcccctgatgccca

SEQ ID NO: 28867 - DNA, 21 bp, Homo sapiens
ccccaaggtccccccacagct

SEQ ID NO: 28868 - DNA, 19 bp, Homo sapiens
gctgtcctggcatttgtgg

SEQ ID NO: 28869 - DNA, 18 bp, Homo sapiens
acagcccaaggcagagct

SEQ ID NO: 28870 - DNA, 21 bp, Homo sapiens
catgctggcccaccccggcgg

SEQ ID NO: 28871 - DNA, 21 bp, Homo sapiens
cgcctgcccttgccccactcc

SEQ ID NO: 28872 - DNA, 20 bp, Homo sapiens
gaagaagagaaagacagcca

SEQ ID NO: 28873 - DNA, 21 bp, Homo sapiens
gcaccacatgcctctgtctcc

SEQ ID NO: 28874 - DNA, 19 bp, Homo sapiens
gggtgggcctggacggctg

SEQ ID NO: 28875 - DNA, 19 bp, Homo sapiens
gggtgggcctgggcagctg

SEQ ID NO: 28876 - DNA, 19 bp, Homo sapiens
gggtgggcctgggcagctg

SEQ ID NO: 28877 - DNA, 20 bp, Homo sapiens
tgcacagaaccctcgcccct

SEQ ID NO: 28878 - DNA, 18 bp, Homo sapiens
ataccatactacacaatg

SEQ ID NO: 28879 - DNA, 19 bp, Homo sapiens
ttgaagcattgcatctttt

SEQ ID NO: 28880 - DNA, 21 bp, Homo sapiens
atcttggctcactgcaacctc

SEQ ID NO: 28881 - DNA, 17 bp, Homo sapiens
cctctgtcctgcagcag

SEQ ID NO: 28882 - DNA, 23 bp, Homo sapiens
gccagctccaacccaaagccctg

SEQ ID NO: 28883 - DNA, 22 bp, Homo sapiens
gcctgaagccttcctctggctt

SEQ ID NO: 28884 - DNA, 18 bp, Homo sapiens
tccgcctcctgggttcaa

SEQ ID NO: 28885 - DNA, 18 bp, Homo sapiens
tgcagcagaacccctcct

SEQ ID NO: 28886 - DNA, 20 bp, Homo sapiens
acctctagacacccctctcc

SEQ ID NO: 28887 - DNA, 21 bp, Homo sapiens
ctctagacacccctctccacc

SEQ ID NO: 28888 - DNA, 19 bp, Homo sapiens
gggggcttccaagttgttt

SEQ ID NO: 28889 - DNA, 20 bp, Homo sapiens
gtcatatatatcactcaggc

SEQ ID NO: 28890 - DNA, 19 bp, Homo sapiens
tctccccacagcctcaagg

SEQ ID NO: 28891 - DNA, 20 bp, Homo sapiens
ggaggtgcggcggcggcggc

SEQ ID NO: 28892 - DNA, 17 bp, Homo sapiens
ccccacacttgttccag

SEQ ID NO: 28893 - DNA, 19 bp, Homo sapiens
ctccctctctcttctgctc

SEQ ID NO: 28894 - DNA, 20 bp, Homo sapiens
ctgcctggccaggcagatct

SEQ ID NO: 28895 - DNA, 20 bp, Homo sapiens
tcccccaacccccaccccac

SEQ ID NO: 28896 - DNA, 18 bp, Homo sapiens
agcatcacatcttctgtg

SEQ ID NO: 28897 - DNA, 19 bp, Homo sapiens
ggccctccctgtttccaca

SEQ ID NO: 28898 - DNA, 18 bp, Homo sapiens
gtccagactgaacgcagc

SEQ ID NO: 28899 - DNA, 20 bp, Homo sapiens
tagtagacagccattaaatt

SEQ ID NO: 28900 - DNA, 19 bp, Homo sapiens
acaaatgttacactagaca

SEQ ID NO: 28901 - DNA, 21 bp, Homo sapiens
atggctgtactggatatccca

SEQ ID NO: 28902 - DNA, 18 bp, Homo sapiens
ccagtatttccccttctc

SEQ ID NO: 28903 - DNA, 24 bp, Homo sapiens
ctggttcctccctgccccttgcca

SEQ ID NO: 28904 - DNA, 17 bp, Homo sapiens
gcgcggcggcgggcggc

SEQ ID NO: 28905 - DNA, 23 bp, Homo sapiens
acacagctatcaagtgctaagtt

SEQ ID NO: 28906 - DNA, 18 bp, Homo sapiens
caaaccaacatttggtga

SEQ ID NO: 28907 - DNA, 18 bp, Homo sapiens
tctggtgcaatctgtgaa

SEQ ID NO: 28908 - DNA, 22 bp, Homo sapiens
atcttggctcactgcaaccctc

SEQ ID NO: 28909 - DNA, 18 bp, Homo sapiens
atggatacatgaaaatta

SEQ ID NO: 28910 - DNA, 21 bp, Homo sapiens
cttacctgatgccttgatttt

SEQ ID NO: 28911 - DNA, 20 bp, Homo sapiens
gcacgccaccatgcccagct

SEQ ID NO: 28912 - DNA, 23 bp, Homo sapiens
tgcctgacaattagctctattca

SEQ ID NO: 28913 - DNA, 24 bp, Homo sapiens
ttaaagtaatttcagagcactttt

SEQ ID NO: 28914 - DNA, 20 bp, Homo sapiens
ccaacacagaacttccattc

SEQ ID NO: 28915 - DNA, 17 bp, Homo sapiens
ctcttccgcgttaccta

SEQ ID NO: 28916 - DNA, 19 bp, Homo sapiens
aggaacctgagcctggctg

SEQ ID NO: 28917 - DNA, 17 bp, Homo sapiens
atcctcttccttcacag

SEQ ID NO: 28918 - DNA, 22 bp, Homo sapiens
cactaccagagttctctagcaa

SEQ ID NO: 28919 - DNA, 20 bp, Homo sapiens
ctgcattcagtcctttgatg

SEQ ID NO: 28920 - DNA, 19 bp, Homo sapiens
cttgccagctgacgtcaca

SEQ ID NO: 28921 - DNA, 21 bp, Homo sapiens
gcctctgtcccaattctgagt

SEQ ID NO: 28922 - DNA, 22 bp, Homo sapiens
gtagagacaggatttcaccatg

SEQ ID NO: 28923 - DNA, 19 bp, Homo sapiens
gtgaactcacacatgtgta

SEQ ID NO: 28924 - DNA, 22 bp, Homo sapiens
gtgaagctgcagccggcatcca

SEQ ID NO: 28925 - DNA, 16 bp, Homo sapiens
gttgcgtagtcttgaa

SEQ ID NO: 28926 - DNA, 21 bp, Homo sapiens
tcatcatcatcatctctgcta

SEQ ID NO: 28927 - DNA, 26 bp, Homo sapiens
tgggtgggtttctacctttgaaactg

SEQ ID NO: 28928 - DNA, 22 bp, Homo sapiens
ttttgggacaatgcctctgtcc

SEQ ID NO: 28929 - DNA, 17 bp, Homo sapiens
cagcgacgcctgcccag

SEQ ID NO: 28930 - DNA, 19 bp, Homo sapiens
gggcggggcggccgctgcc

SEQ ID NO: 28931 - DNA, 23 bp, Homo sapiens
aaaatgagatgccagaagcctca

SEQ ID NO: 28932 - DNA, 19 bp, Homo sapiens
cctgtgcttcacatctgaa

SEQ ID NO: 28933 - DNA, 17 bp, Homo sapiens
gtggagtggtctggtga

SEQ ID NO: 28934 - DNA, 17 bp, Homo sapiens
tcaagtgattctcctgc

SEQ ID NO: 28935 - DNA, 18 bp, Homo sapiens
tccgcctcccaggttcaa

SEQ ID NO: 28936 - DNA, 20 bp, Homo sapiens
acagaacttcaagtctcttc

SEQ ID NO: 28937 - DNA, 16 bp, Homo sapiens
agaactgttgatttca

SEQ ID NO: 28938 - DNA, 19 bp, Homo sapiens
agatcgttaacatgggtaa

SEQ ID NO: 28939 - DNA, 23 bp, Homo sapiens
cctctttgtagatgatgtatttt

SEQ ID NO: 28940 - DNA, 21 bp, Homo sapiens
cctgctccctgatctgtcaga

SEQ ID NO: 28941 - DNA, 16 bp, Homo sapiens
ctagttcaatgctagg

SEQ ID NO: 28942 - DNA, 22 bp, Homo sapiens
ggcccatttcttttcaaactga

SEQ ID NO: 28943 - DNA, 16 bp, Homo sapiens
taattccacactgtta

SEQ ID NO: 28944 - DNA, 23 bp, Homo sapiens
tctgtattgatggactcatttct

SEQ ID NO: 28945 - DNA, 19 bp, Homo sapiens
tgagaagtactggcagaca

SEQ ID NO: 28946 - DNA, 18 bp, Homo sapiens
ttcattcatgtctggaga

SEQ ID NO: 28947 - DNA, 23 bp, Homo sapiens
tttttccaactcaatgaatgaca

SEQ ID NO: 28948 - DNA, 23 bp, Homo sapiens
tttaagaagtcaaaagataccac

SEQ ID NO: 28949 - DNA, 24 bp, Homo sapiens
tgaatgcgactttggatgagatta

SEQ ID NO: 28950 - DNA, 20 bp, Homo sapiens
tgagattaagaaggcccagt

SEQ ID NO: 28951 - DNA, 23 bp, Homo sapiens
tctccgactgatcgctgatctca

SEQ ID NO: 28952 - DNA, 20 bp, Homo sapiens
tgctgcggtcctctctccga

SEQ ID NO: 28953 - DNA, 21 bp, Homo sapiens
cggaaacttttagctccacga

SEQ ID NO: 28954 - DNA, 16 bp, Homo sapiens
ctccctcctcttcctc

SEQ ID NO: 28955 - DNA, 16 bp, Homo sapiens
ctcctccagctgttgt

SEQ ID NO: 28956 - DNA, 19 bp, Homo sapiens
gcgatgccctcggacttca

SEQ ID NO: 28957 - DNA, 21 bp, Homo sapiens
gcggctgtccgggcgatgaca

SEQ ID NO: 28958 - DNA, 20 bp, Homo sapiens
gcttctctcggctctgtctc

SEQ ID NO: 28959 - DNA, 20 bp, Homo sapiens
tcccggctcaggaacagcag

SEQ ID NO: 28960 - DNA, 16 bp, Homo sapiens
attgctgattttctct

SEQ ID NO: 28961 - DNA, 20 bp, Homo sapiens
ttggtggatcaaaaatgcca

SEQ ID NO: 28962 - DNA, 16 bp, Homo sapiens
attgctgattttctct

SEQ ID NO: 28963 - DNA, 20 bp, Homo sapiens
ttggtggatcaaaaatgcca

SEQ ID NO: 28964 - DNA, 19 bp, Homo sapiens
ctgtgaccacctcattgct

SEQ ID NO: 28965 - DNA, 19 bp, Homo sapiens
tatctgtggcctatgaggc

SEQ ID NO: 28966 - DNA, 20 bp, Homo sapiens
catagaaagactactgtcaa

SEQ ID NO: 28967 - DNA, 18 bp, Homo sapiens
tgacatgacagccattcc

SEQ ID NO: 28968 - DNA, 20 bp, Homo sapiens
catagaaagactactgtcaa

SEQ ID NO: 28969 - DNA, 19 bp, Homo sapiens
agaagtggtcagactctgg

SEQ ID NO: 28970 - DNA, 20 bp, Homo sapiens
agggtggagtaatttgtcca

SEQ ID NO: 28971 - DNA, 17 bp, Homo sapiens
atctctatatctagata

SEQ ID NO: 28972 - DNA, 16 bp, Homo sapiens
ccttgtgtttgttata

SEQ ID NO: 28973 - DNA, 19 bp, Homo sapiens
ggaaagagagctaattcac

SEQ ID NO: 28974 - DNA, 20 bp, Homo sapiens
ttccagaaacagcctcacag

SEQ ID NO: 28975 - DNA, 21 bp, Homo sapiens
atgtgactttgtagatattcc

SEQ ID NO: 28976 - DNA, 17 bp, Homo sapiens
cccccaaccacccacca

SEQ ID NO: 28977 - DNA, 17 bp, Homo sapiens
gtagcaggcagttccca

SEQ ID NO: 28978 - DNA, 20 bp, Homo sapiens
tactgacaccccactggcta

SEQ ID NO: 28979 - DNA, 17 bp, Homo sapiens
tcttcaccactgatctc

SEQ ID NO: 28980 - DNA, 22 bp, Homo sapiens
tttcttcattcagcttagcctt

SEQ ID NO: 28981 - DNA, 20 bp, Homo sapiens
cactgtccccaccctccttc

SEQ ID NO: 28982 - DNA, 22 bp, Homo sapiens
cagggcacgtgctcacagccct

SEQ ID NO: 28983 - DNA, 21 bp, Homo sapiens
ccacgggctccctgctccccc

SEQ ID NO: 28984 - DNA, 16 bp, Homo sapiens
ctgcgcggcctcgtca

SEQ ID NO: 28985 - DNA, 18 bp, Homo sapiens
ggagcgcccggccccctc

SEQ ID NO: 28986 - DNA, 20 bp, Homo sapiens
ggcttgctgtgtctcactgt

SEQ ID NO: 28987 - DNA, 20 bp, Homo sapiens
cactgtccccaccctccttc

SEQ ID NO: 28988 - DNA, 22 bp, Homo sapiens
cagggcacgtgctcacagccct

SEQ ID NO: 28989 - DNA, 21 bp, Homo sapiens
ccacgggctccctgctccccc

SEQ ID NO: 28990 - DNA, 16 bp, Homo sapiens
ctgcgcggcctcgtca

SEQ ID NO: 28991 - DNA, 20 bp, Homo sapiens
ggcttgctgtgtctcactgt

SEQ ID NO: 28992 - DNA, 27 bp, Homo sapiens
acaaagactcagctacttcttttctta

SEQ ID NO: 28993 - DNA, 20 bp, Homo sapiens
caaaatatatctctgctctt

SEQ ID NO: 28994 - DNA, 18 bp, Homo sapiens
ccccacccgccggcacgc

SEQ ID NO: 28995 - DNA, 22 bp, Homo sapiens
cgcgccgctgctccgcgcgctg

SEQ ID NO: 28996 - DNA, 21 bp, Homo sapiens
ctcccctgcgccctctcctct

SEQ ID NO: 28997 - DNA, 20 bp, Homo sapiens
tatgttgctggaacatttct

SEQ ID NO: 28998 - DNA, 20 bp, Homo sapiens
acgcttaacacctctaacaa

SEQ ID NO: 28999 - DNA, 18 bp, Homo sapiens
catattagctcccactca

SEQ ID NO: 29000 - DNA, 20 bp, Homo sapiens
ctgctgagctctgtgtgatt

SEQ ID NO: 29001 - DNA, 22 bp, Homo sapiens
gatgccatccccactgaaccca

SEQ ID NO: 29002 - DNA, 24 bp, Homo sapiens
gtgcctcaccacctgctgagctct

SEQ ID NO: 29003 - DNA, 21 bp, Homo sapiens
tttctccccattttccaggga

SEQ ID NO: 29004 - DNA, 20 bp, Homo sapiens
aggcggaaacagcacttcat

SEQ ID NO: 29005 - DNA, 22 bp, Homo sapiens
ccagcccctgctcagcccctcc

SEQ ID NO: 29006 - DNA, 20 bp, Homo sapiens
gctgccacctcgcccagcca

SEQ ID NO: 29007 - DNA, 19 bp, Homo sapiens
ttcttcatcgttgagcttt

SEQ ID NO: 29008 - DNA, 18 bp, Homo sapiens
catgtgttccgtgaggga

SEQ ID NO: 29009 - DNA, 22 bp, Homo sapiens
gaattctgcaaagctactacga

SEQ ID NO: 29010 - DNA, 20 bp, Homo sapiens
tggagacttaactttaagca

SEQ ID NO: 29011 - DNA, 24 bp, Homo sapiens
ctgctggcaaaaggcctgtactca

SEQ ID NO: 29012 - DNA, 21 bp, Homo sapiens
gactgtcaccatgctgacaga

SEQ ID NO: 29013 - DNA, 21 bp, Homo sapiens
ggaaaacagaatagaagcaca

SEQ ID NO: 29014 - DNA, 18 bp, Homo sapiens
atcaggatagacaccaag

SEQ ID NO: 29015 - DNA, 20 bp, Homo sapiens
agaaaattctgtggctgtgc

SEQ ID NO: 29016 - DNA, 20 bp, Homo sapiens
tatgttcttttgttcagtga

SEQ ID NO: 29017 - DNA, 21 bp, Homo sapiens
tgctgtcagcataatgattgt

SEQ ID NO: 29018 - DNA, 19 bp, Homo sapiens
atcccaggaacctgtcaaa

SEQ ID NO: 29019 - DNA, 18 bp, Homo sapiens
cacagctcccagcttctt

SEQ ID NO: 29020 - DNA, 20 bp, Homo sapiens
tgcccatgtcctaatcccag

SEQ ID NO: 29021 - DNA, 19 bp, Homo sapiens
ccctcagcaacgccgtgca

SEQ ID NO: 29022 - DNA, 18 bp, Homo sapiens
cagggctaggctcagcca

SEQ ID NO: 29023 - DNA, 22 bp, Homo sapiens
tcacattgcttttatttcctcc

SEQ ID NO: 29024 - DNA, 25 bp, Homo sapiens
ttaaagctattctcacattgctttt

SEQ ID NO: 29025 - DNA, 22 bp, Homo sapiens
gggcggggcagggagcccgcca

SEQ ID NO: 29026 - DNA, 19 bp, Homo sapiens
cttcctgttgctccctcca

SEQ ID NO: 29027 - DNA, 21 bp, Homo sapiens
tcagagcctgtgcccttccca

SEQ ID NO: 29028 - DNA, 17 bp, Homo sapiens
tctccccacatgtacca

SEQ ID NO: 29029 - DNA, 20 bp, Homo sapiens
gccctcgggtggaagctgac

SEQ ID NO: 29030 - DNA, 21 bp, Homo sapiens
tcgatccagtctccgacttcc

SEQ ID NO: 29031 - DNA, 21 bp, Homo sapiens
gagccaagattgtgccactac

SEQ ID NO: 29032 - DNA, 19 bp, Homo sapiens
ggccgggtgcggtggctca

SEQ ID NO: 29033 - DNA, 18 bp, Homo sapiens
tgggtggatcacctgagg

SEQ ID NO: 29034 - DNA, 18 bp, Homo sapiens
tgggtggatcacttgagg

SEQ ID NO: 29035 - DNA, 20 bp, Homo sapiens
cctctgcctcccgggttcaa

SEQ ID NO: 29036 - DNA, 17 bp, Homo sapiens
tcaagtgattctcctgc

SEQ ID NO: 29037 - DNA, 18 bp, Homo sapiens
ttctcctgcctcagcctt

SEQ ID NO: 29038 - DNA, 21 bp, Homo sapiens
gcctaactttgtgttcactga

SEQ ID NO: 29039 - DNA, 17 bp, Homo sapiens
aagtctgactagaattc

SEQ ID NO: 29040 - DNA, 20 bp, Homo sapiens
aggcatcagagtaatcttca

SEQ ID NO: 29041 - DNA, 23 bp, Homo sapiens
caaagaaggcaataaggaaccca

SEQ ID NO: 29042 - DNA, 17 bp, Homo sapiens
caccatctcccctcaaa

SEQ ID NO: 29043 - DNA, 20 bp, Homo sapiens
tttaagtggctaacatccaa

SEQ ID NO: 29044 - DNA, 17 bp, Homo sapiens
aagtctgactagaattc

SEQ ID NO: 29045 - DNA, 20 bp, Homo sapiens
aggcatcagagtaatcttca

SEQ ID NO: 29046 - DNA, 17 bp, Homo sapiens
caccatctcccctcaaa

SEQ ID NO: 29047 - DNA, 20 bp, Homo sapiens
tttaagtggctaacatccaa

SEQ ID NO: 29048 - DNA, 22 bp, Homo sapiens
agtgatcctcccgccttgccct

SEQ ID NO: 29049 - DNA, 20 bp, Homo sapiens
cctctgcctcccaggttcaa

SEQ ID NO: 29050 - DNA, 20 bp, Homo sapiens
ctgaccagccctcgtcagcc

SEQ ID NO: 29051 - DNA, 19 bp, Homo sapiens
ctgcaacctctgcctccca

SEQ ID NO: 29052 - DNA, 18 bp, Homo sapiens
gcgtgccaccactccggg

SEQ ID NO: 29053 - DNA, 23 bp, Homo sapiens
ggacagccccgcctccgccccct

SEQ ID NO: 29054 - DNA, 22 bp, Homo sapiens
ggcgtgagccaccaacaccctg

SEQ ID NO: 29055 - DNA, 26 bp, Homo sapiens
aacaaaaagaacaaaaaaatctgcag

SEQ ID NO: 29056 - DNA, 23 bp, Homo sapiens
ccttccccacttccttccctcca

SEQ ID NO: 29057 - DNA, 24 bp, Homo sapiens
gaaagtttttaagtaaacctccca

SEQ ID NO: 29058 - DNA, 23 bp, Homo sapiens
acaaaaattattgagcaacccta

SEQ ID NO: 29059 - DNA, 22 bp, Homo sapiens
gtgccaaaaacctgtggatttt

SEQ ID NO: 29060 - DNA, 18 bp, Homo sapiens
atacagaaaccggaccca

SEQ ID NO: 29061 - DNA, 21 bp, Homo sapiens
ctctctctctctttattttca

SEQ ID NO: 29062 - DNA, 22 bp, Homo sapiens
gcaccattgttttaatacggca

SEQ ID NO: 29063 - DNA, 18 bp, Homo sapiens
ccgagtggctgtcggctc

SEQ ID NO: 29064 - DNA, 16 bp, Homo sapiens
cccaggttccatacca

SEQ ID NO: 29065 - DNA, 24 bp, Homo sapiens
cccagtgaggtggaagacttcgag

SEQ ID NO: 29066 - DNA, 24 bp, Homo sapiens
gcacctaccccaggttccatacca

SEQ ID NO: 29067 - DNA, 22 bp, Homo sapiens
gtattatctacaattattggca

SEQ ID NO: 29068 - DNA, 18 bp, Homo sapiens
acattttgagattaactg

SEQ ID NO: 29069 - DNA, 21 bp, Homo sapiens
gaccctgtcctccccccgcca

SEQ ID NO: 29070 - DNA, 20 bp, Homo sapiens
gactatcccaactttatttt

SEQ ID NO: 29071 - DNA, 15 bp, Homo sapiens
acatttggccctgtg

SEQ ID NO: 29072 - DNA, 19 bp, Homo sapiens
cccccaccctccacctgcc

SEQ ID NO: 29073 - DNA, 23 bp, Homo sapiens
cccggggagagaaccagtatgag

SEQ ID NO: 29074 - DNA, 19 bp, Homo sapiens
gcccccacccccaccctcc

SEQ ID NO: 29075 - DNA, 27 bp, Homo sapiens
gcccctctgcctatgtccctctgcctc

SEQ ID NO: 29076 - DNA, 22 bp, Homo sapiens
gcctgagccaatgtgtctgtct

SEQ ID NO: 29077 - DNA, 23 bp, Homo sapiens
gcttgggcctgagagtttgatct

SEQ ID NO: 29078 - DNA, 19 bp, Homo sapiens
tgggctgcacgtggagctg

SEQ ID NO: 29079 - DNA, 19 bp, Homo sapiens
ccctctctccagaggacac

SEQ ID NO: 29080 - DNA, 24 bp, Homo sapiens
tcataggcagtgatcctagaccaa

SEQ ID NO: 29081 - DNA, 21 bp, Homo sapiens
actaacctggagacagtaaca

SEQ ID NO: 29082 - DNA, 17 bp, Homo sapiens
agacatctcctcacccc

SEQ ID NO: 29083 - DNA, 19 bp, Homo sapiens
agacttgggggcaggcgcc

SEQ ID NO: 29084 - DNA, 25 bp, Homo sapiens
agagattcccctggaccacacctcc

SEQ ID NO: 29085 - DNA, 18 bp, Homo sapiens
agtgaatgggaaagggtg

SEQ ID NO: 29086 - DNA, 20 bp, Homo sapiens
cctgaaaaatgactgtccca

SEQ ID NO: 29087 - DNA, 23 bp, Homo sapiens
cggatctcccctgaccgctctcc

SEQ ID NO: 29088 - DNA, 21 bp, Homo sapiens
tcctgaaaaatgactgtccca

SEQ ID NO: 29089 - DNA, 24 bp, Homo sapiens
tgggacctgctaagtgtggaatta

SEQ ID NO: 29090 - DNA, 18 bp, Homo sapiens
ttcctctggagctttgca

SEQ ID NO: 29091 - DNA, 20 bp, Homo sapiens
ccagatgccttctagattca

SEQ ID NO: 29092 - DNA, 21 bp, Homo sapiens
cagcgtcgcccccgtgaccct

SEQ ID NO: 29093 - DNA, 20 bp, Homo sapiens
ccagatgccttctagattca

SEQ ID NO: 29094 - DNA, 20 bp, Homo sapiens
ttgccaagacacccacacta

SEQ ID NO: 29095 - DNA, 18 bp, Homo sapiens
gaaagagcgagtgcctct

SEQ ID NO: 29096 - DNA, 19 bp, Homo sapiens
gagtgcgagccgcccgcca

SEQ ID NO: 29097 - DNA, 21 bp, Homo sapiens
ccatcatctcatctctggatg

SEQ ID NO: 29098 - DNA, 21 bp, Homo sapiens
ccaaaagaagcggagatttaa

SEQ ID NO: 29099 - DNA, 22 bp, Homo sapiens
ggttgtgaagaggtgttttttc

SEQ ID NO: 29100 - DNA, 21 bp, Homo sapiens
ccaaaagaagcggagatttaa

SEQ ID NO: 29101 - DNA, 21 bp, Homo sapiens
ccaaaagaagcggagatttaa

SEQ ID NO: 29102 - DNA, 21 bp, Homo sapiens
ccaaaagaagcggagatttaa

SEQ ID NO: 29103 - DNA, 21 bp, Homo sapiens
ccaaaagaagcggagatttaa

SEQ ID NO: 29104 - DNA, 18 bp, Homo sapiens
agtaaaggcctcatctcc

SEQ ID NO: 29105 - DNA, 22 bp, Homo sapiens
caagtgatatcacctctcttca

SEQ ID NO: 29106 - DNA, 22 bp, Homo sapiens
cccataccttctggttgcttca

SEQ ID NO: 29107 - DNA, 20 bp, Homo sapiens
ggggtcgcggcagccgcacc

SEQ ID NO: 29108 - DNA, 20 bp, Homo sapiens
ggtggaagggggtgtgcgtg

SEQ ID NO: 29109 - DNA, 18 bp, Homo sapiens
tcccaataactaatgcta

SEQ ID NO: 29110 - DNA, 20 bp, Homo sapiens
ggggtcgcggcagccgcacc

SEQ ID NO: 29111 - DNA, 18 bp, Homo sapiens
agtaaaggcctcatctcc

SEQ ID NO: 29112 - DNA, 22 bp, Homo sapiens
caagtgatatcacctctcttca

SEQ ID NO: 29113 - DNA, 22 bp, Homo sapiens
cccataccttctggttgcttca

SEQ ID NO: 29114 - DNA, 20 bp, Homo sapiens
ggggtcgcggcagccgcacc

SEQ ID NO: 29115 - DNA, 20 bp, Homo sapiens
ggtggaagggggtgtgcgtg

SEQ ID NO: 29116 - DNA, 18 bp, Homo sapiens
tcccaataactaatgcta

SEQ ID NO: 29117 - DNA, 20 bp, Homo sapiens
gcctcatcgaccgtctgccc

SEQ ID NO: 29118 - DNA, 19 bp, Homo sapiens
atgccccaaagtttcttgt

SEQ ID NO: 29119 - DNA, 24 bp, Homo sapiens
caaatacattttgaaactagcttt

SEQ ID NO: 29120 - DNA, 24 bp, Homo sapiens
cagacaccttcccccacccatacc

SEQ ID NO: 29121 - DNA, 22 bp, Homo sapiens
tacaaatggatacactaacgga

SEQ ID NO: 29122 - DNA, 19 bp, Homo sapiens
tccctaacaactgtttcag

SEQ ID NO: 29123 - DNA, 19 bp, Homo sapiens
tccctaacaactgtttcag

SEQ ID NO: 29124 - DNA, 21 bp, Homo sapiens
agcttccaagagtaaacactg

SEQ ID NO: 29125 - DNA, 19 bp, Homo sapiens
gtctgtgggtttctggtcc

SEQ ID NO: 29126 - DNA, 21 bp, Homo sapiens
agcttccaagagtaaacactg

SEQ ID NO: 29127 - DNA, 19 bp, Homo sapiens
gtctgtgggtttctggtcc

SEQ ID NO: 29128 - DNA, 21 bp, Homo sapiens
agcttccaagagtaaacactg

SEQ ID NO: 29129 - DNA, 24 bp, Homo sapiens
cctgggagccggcgggaggtctgc

SEQ ID NO: 29130 - DNA, 19 bp, Homo sapiens
ggaggaggtgtggtcacca

SEQ ID NO: 29131 - DNA, 19 bp, Homo sapiens
gtctgtgggtttctggtcc

SEQ ID NO: 29132 - DNA, 22 bp, Homo sapiens
tagttgtattattgttgtttca

SEQ ID NO: 29133 - DNA, 21 bp, Homo sapiens
tggaataataatgtgggatta

SEQ ID NO: 29134 - DNA, 22 bp, Homo sapiens
ttccatgttctacttcagctaa

SEQ ID NO: 29135 - DNA, 21 bp, Homo sapiens
acctgataggattgcctgctt

SEQ ID NO: 29136 - DNA, 18 bp, Homo sapiens
agcattgaaggaactctc

SEQ ID NO: 29137 - DNA, 21 bp, Homo sapiens
acctgataggattgcctgctt

SEQ ID NO: 29138 - DNA, 18 bp, Homo sapiens
agcattgaaggaactctc

SEQ ID NO: 29139 - DNA, 21 bp, Homo sapiens
acctgataggattgcctgctt

SEQ ID NO: 29140 - DNA, 18 bp, Homo sapiens
agcattgaaggaactctc

SEQ ID NO: 29141 - DNA, 24 bp, Homo sapiens
atttgggccctgtgctgcctgcct

SEQ ID NO: 29142 - DNA, 15 bp, Homo sapiens
cctatctcttcccac

SEQ ID NO: 29143 - DNA, 24 bp, Homo sapiens
cctcatagtatctgccttggtctt

SEQ ID NO: 29144 - DNA, 23 bp, Homo sapiens
cctgcttccccaccccctcctca

SEQ ID NO: 29145 - DNA, 23 bp, Homo sapiens
cctgtaccctcccctggtctaca

SEQ ID NO: 29146 - DNA, 20 bp, Homo sapiens
ccttaatggagaaacgggcc

SEQ ID NO: 29147 - DNA, 18 bp, Homo sapiens
tctagatagtgttagaga

SEQ ID NO: 29148 - DNA, 20 bp, Homo sapiens
ctatcattttgaatacagta

SEQ ID NO: 29149 - DNA, 18 bp, Homo sapiens
tctgtttcttcccacaaa

SEQ ID NO: 29150 - DNA, 23 bp, Homo sapiens
tgaatggattattgtatgagcta

SEQ ID NO: 29151 - DNA, 20 bp, Homo sapiens
tttctttctgtttcttccca

SEQ ID NO: 29152 - DNA, 23 bp, Homo sapiens
tttgagctctcttaattgctttt

SEQ ID NO: 29153 - DNA, 20 bp, Homo sapiens
gagccgcagcgccgcggcga

SEQ ID NO: 29154 - DNA, 19 bp, Homo sapiens
aagtgatgccctcctgcca

SEQ ID NO: 29155 - DNA, 24 bp, Homo sapiens
ccttacgcttgtgggggtctgcgg

SEQ ID NO: 29156 - DNA, 16 bp, Homo sapiens
ctagacgctgctagga

SEQ ID NO: 29157 - DNA, 20 bp, Homo sapiens
aacccatcggtcctactgtt

SEQ ID NO: 29158 - DNA, 20 bp, Homo sapiens
atctttcagccttgaaatgt

SEQ ID NO: 29159 - DNA, 24 bp, Homo sapiens
ctgaccacttatcaaacccatcgg

SEQ ID NO: 29160 - DNA, 20 bp, Homo sapiens
tggtttctaacattgaactg

SEQ ID NO: 29161 - DNA, 22 bp, Homo sapiens
tttccaggccatgcttcttacc

SEQ ID NO: 29162 - DNA, 24 bp, Homo sapiens
cctcttagaactggttttaacctt

SEQ ID NO: 29163 - DNA, 24 bp, Homo sapiens
gcgcctcggccgccgccgccgcct

SEQ ID NO: 29164 - DNA, 24 bp, Homo sapiens
gcttttcccccaaagtatcatgtg

SEQ ID NO: 29165 - DNA, 18 bp, Homo sapiens
ttgagattttttcagtga

SEQ ID NO: 29166 - DNA, 20 bp, Homo sapiens
aacagtcttggccatttctc

SEQ ID NO: 29167 - DNA, 19 bp, Homo sapiens
cttgatgataaccagtgga

SEQ ID NO: 29168 - DNA, 18 bp, Homo sapiens
ttcatgatcaacatctct

SEQ ID NO: 29169 - DNA, 16 bp, Homo sapiens
gccgggtgctttcctg

SEQ ID NO: 29170 - DNA, 22 bp, Homo sapiens
tctgtccatcaccagcaaccaa

SEQ ID NO: 29171 - DNA, 22 bp, Homo sapiens
cccattttgacaaagtggaaca

SEQ ID NO: 29172 - DNA, 18 bp, Homo sapiens
tacagatcaactctctca

SEQ ID NO: 29173 - DNA, 20 bp, Homo sapiens
aaattggtgcaaatatatac

SEQ ID NO: 29174 - DNA, 21 bp, Homo sapiens
actcatcttctaaaatctgtg

SEQ ID NO: 29175 - DNA, 18 bp, Homo sapiens
atttcagatgatgcagcc

SEQ ID NO: 29176 - DNA, 21 bp, Homo sapiens
cgtttacttgagtttaagata

SEQ ID NO: 29177 - DNA, 18 bp, Homo sapiens
cttgatatcgtttggttc

SEQ ID NO: 29178 - DNA, 18 bp, Homo sapiens
ccagcccccaggccctct

SEQ ID NO: 29179 - DNA, 17 bp, Homo sapiens
cccccaggccctctccc

SEQ ID NO: 29180 - DNA, 20 bp, Homo sapiens
ctccaaatggagctctactt

SEQ ID NO: 29181 - DNA, 17 bp, Homo sapiens
gatgtgatgacagtagc

SEQ ID NO: 29182 - DNA, 19 bp, Homo sapiens
gtatgtattagtctgctgg

SEQ ID NO: 29183 - DNA, 18 bp, Homo sapiens
aaggtcacctatagaagc

SEQ ID NO: 29184 - DNA, 19 bp, Homo sapiens
accttgggctgggtctatg

SEQ ID NO: 29185 - DNA, 21 bp, Homo sapiens
gagctgcaacaggccttgcca

SEQ ID NO: 29186 - DNA, 22 bp, Homo sapiens
ggagtcaggtatgcaggcattg

SEQ ID NO: 29187 - DNA, 22 bp, Homo sapiens
gggacaacaagcttctttcttc

SEQ ID NO: 29188 - DNA, 28 bp, Homo sapiens
tgaatggactctctcttcagtgggatta

SEQ ID NO: 29189 - DNA, 18 bp, Homo sapiens
tgggacaacaagcttctt

SEQ ID NO: 29190 - DNA, 17 bp, Homo sapiens
tttgttttggccactga

SEQ ID NO: 29191 - DNA, 21 bp, Homo sapiens
cctccttaaagagaaggatct

SEQ ID NO: 29192 - DNA, 16 bp, Homo sapiens
gctcagaaagatacca

SEQ ID NO: 29193 - DNA, 18 bp, Homo sapiens
ggatggatcccttggctg

SEQ ID NO: 29194 - DNA, 20 bp, Homo sapiens
tggatgtacaaatggaactg

SEQ ID NO: 29195 - DNA, 22 bp, Homo sapiens
gcccactaaggaggaggagtca

SEQ ID NO: 29196 - DNA, 21 bp, Homo sapiens
gcccctgtccaccctccccca

SEQ ID NO: 29197 - DNA, 22 bp, Homo sapiens
agaaatctcaaactgtactgta

SEQ ID NO: 29198 - DNA, 18 bp, Homo sapiens
atcccatacatgaaatta

SEQ ID NO: 29199 - DNA, 19 bp, Homo sapiens
caggacagtttatgaaata

SEQ ID NO: 29200 - DNA, 18 bp, Homo sapiens
ggagttaaatgtcctgca

SEQ ID NO: 29201 - DNA, 19 bp, Homo sapiens
ggagttaaatgtcctgcaa

SEQ ID NO: 29202 - DNA, 19 bp, Homo sapiens
ttaggtggtcagtcctttt

SEQ ID NO: 29203 - DNA, 21 bp, Homo sapiens
aggagaaacaatttataggca

SEQ ID NO: 29204 - DNA, 18 bp, Homo sapiens
tccagaaacagcctccag

SEQ ID NO: 29205 - DNA, 21 bp, Homo sapiens
atgtgactttgtagatattcc

SEQ ID NO: 29206 - DNA, 17 bp, Homo sapiens
cccccaaccacccacca

SEQ ID NO: 29207 - DNA, 17 bp, Homo sapiens
gtagcaggcagttccca

SEQ ID NO: 29208 - DNA, 20 bp, Homo sapiens
tactgacaccccactggcta

SEQ ID NO: 29209 - DNA, 18 bp, Homo sapiens
tccagaaacagcctccag

SEQ ID NO: 29210 - DNA, 17 bp, Homo sapiens
tcttcaccactgatctc

SEQ ID NO: 29211 - DNA, 22 bp, Homo sapiens
tttcttcattcagcttagcctt

SEQ ID NO: 29212 - DNA, 18 bp, Homo sapiens
aagtaatgatcttctggt

SEQ ID NO: 29213 - DNA, 25 bp, Homo sapiens
gcaccatggagcagcctgcatgtga

SEQ ID NO: 29214 - DNA, 18 bp, Homo sapiens
gcatgttcaaagctgaca

SEQ ID NO: 29215 - DNA, 19 bp, Homo sapiens
cccagcgccctctacctcc

SEQ ID NO: 29216 - DNA, 19 bp, Homo sapiens
ccccacctccctgcagctt

SEQ ID NO: 29217 - DNA, 21 bp, Homo sapiens
ccctgccagggggtttgagga

SEQ ID NO: 29218 - DNA, 21 bp, Homo sapiens
ctcttgagagccccacccctg

SEQ ID NO: 29219 - DNA, 17 bp, Homo sapiens
gccagggggtttgagga

SEQ ID NO: 29220 - DNA, 22 bp, Homo sapiens
gggcggcctgcagaccctgcca

SEQ ID NO: 29221 - DNA, 21 bp, Homo sapiens
aggatccactactgtctttaa

SEQ ID NO: 29222 - DNA, 21 bp, Homo sapiens
catctctgcagacccctctcc

SEQ ID NO: 29223 - DNA, 25 bp, Homo sapiens
tctctccctgtggctggtctggttc

SEQ ID NO: 29224 - DNA, 21 bp, Homo sapiens
gcagctaaaataaaaatttca

SEQ ID NO: 29225 - DNA, 17 bp, Homo sapiens
tctgggcagtcagcact

SEQ ID NO: 29226 - DNA, 18 bp, Homo sapiens
ataaacatccatgacatc

SEQ ID NO: 29227 - DNA, 18 bp, Homo sapiens
cctgaaggagacctatgg

SEQ ID NO: 29228 - DNA, 23 bp, Homo sapiens
ctgtgtattacgcaaagtcctag

SEQ ID NO: 29229 - DNA, 17 bp, Homo sapiens
gtccccaaagcatgtca

SEQ ID NO: 29230 - DNA, 22 bp, Homo sapiens
tccacacgtggaaatctgtgga

SEQ ID NO: 29231 - DNA, 19 bp, Homo sapiens
aatacagaaggggtgtttg

SEQ ID NO: 29232 - DNA, 17 bp, Homo sapiens
ttccttggaatatagct

SEQ ID NO: 29233 - DNA, 19 bp, Homo sapiens
aatacagaaggggtgtttg

SEQ ID NO: 29234 - DNA, 17 bp, Homo sapiens
ttccttggaatatagct

SEQ ID NO: 29235 - DNA, 23 bp, Homo sapiens
actcctttcttagtcttcttcca

SEQ ID NO: 29236 - DNA, 21 bp, Homo sapiens
atctgccctggctgtttgccc

SEQ ID NO: 29237 - DNA, 17 bp, Homo sapiens
caggagttctagaccaa

SEQ ID NO: 29238 - DNA, 22 bp, Homo sapiens
ccatgtagtctcctgggcctca

SEQ ID NO: 29239 - DNA, 19 bp, Homo sapiens
tcctccatggagggcctgc

SEQ ID NO: 29240 - DNA, 18 bp, Homo sapiens
aatgatactgaatgagtc

SEQ ID NO: 29241 - DNA, 17 bp, Homo sapiens
cacatatatgaagtgaa

SEQ ID NO: 29242 - DNA, 18 bp, Homo sapiens
ccagtggcaactgcctgc

SEQ ID NO: 29243 - DNA, 16 bp, Homo sapiens
ctccctggtggtctta

SEQ ID NO: 29244 - DNA, 16 bp, Homo sapiens
aaaagcaacaaacaaa

SEQ ID NO: 29245 - DNA, 17 bp, Homo sapiens
gaatgataatcagtttt

SEQ ID NO: 29246 - DNA, 23 bp, Homo sapiens
gatcccaagagacgcacatgatg

SEQ ID NO: 29247 - DNA, 23 bp, Homo sapiens
gccatgacgtgtctgcttggctc

SEQ ID NO: 29248 - DNA, 20 bp, Homo sapiens
tggctccctgatataagctg

SEQ ID NO: 29249 - DNA, 20 bp, Homo sapiens
ataatagaaagaaagctaca

SEQ ID NO: 29250 - DNA, 20 bp, Homo sapiens
ctgtttgaaagcttcacctc

SEQ ID NO: 29251 - DNA, 19 bp, Homo sapiens
cttgttccgacctgtcaat

SEQ ID NO: 29252 - DNA, 18 bp, Homo sapiens
gggttttttgaaatccca

SEQ ID NO: 29253 - DNA, 18 bp, Homo sapiens
agcctaccagcttagctc

SEQ ID NO: 29254 - DNA, 21 bp, Homo sapiens
acctgggcctcaggcctgctc

SEQ ID NO: 29255 - DNA, 20 bp, Homo sapiens
agaagaaagagaaattgtcc

SEQ ID NO: 29256 - DNA, 19 bp, Homo sapiens
gggggcttaccagcaaagc

SEQ ID NO: 29257 - DNA, 21 bp, Homo sapiens
tctccaggctgcctgggcttt

SEQ ID NO: 29258 - DNA, 20 bp, Homo sapiens
atgtcattgtaatgatttca

SEQ ID NO: 29259 - DNA, 20 bp, Homo sapiens
catttttatcaaatgtgtga

SEQ ID NO: 29260 - DNA, 21 bp, Homo sapiens
ctgtagaagggggacatgcca

SEQ ID NO: 29261 - DNA, 22 bp, Homo sapiens
gcctgagctgtctgtctcgttt

SEQ ID NO: 29262 - DNA, 20 bp, Homo sapiens
gtgtgaacgatacttggcta

SEQ ID NO: 29263 - DNA, 18 bp, Homo sapiens
tacaaagaaatttccctc

SEQ ID NO: 29264 - DNA, 21 bp, Homo sapiens
catcctctttgccccctcagg

SEQ ID NO: 29265 - DNA, 21 bp, Homo sapiens
ccttgacagccagtctgtgaa

SEQ ID NO: 29266 - DNA, 18 bp, Homo sapiens
gaatacagcactgcttgc

SEQ ID NO: 29267 - DNA, 22 bp, Homo sapiens
ttgatgatatttaaccagtttt

SEQ ID NO: 29268 - DNA, 23 bp, Homo sapiens
ttgtaaccattttctatttgtgc

SEQ ID NO: 29269 - DNA, 17 bp, Homo sapiens
ctggcattgcacttttt

SEQ ID NO: 29270 - DNA, 23 bp, Homo sapiens
ctttgtggttccagatttttttt

SEQ ID NO: 29271 - DNA, 22 bp, Homo sapiens
tttgagcaatctgggcactttt

SEQ ID NO: 29272 - DNA, 17 bp, Homo sapiens
accaaaacaaataaaga

SEQ ID NO: 29273 - DNA, 21 bp, Homo sapiens
atcttggctcactgcaacctc

SEQ ID NO: 29274 - DNA, 18 bp, Homo sapiens
tccgcctcctgggttcaa

SEQ ID NO: 29275 - DNA, 20 bp, Homo sapiens
tggccagcgtggtcttgaac

SEQ ID NO: 29276 - DNA, 18 bp, Homo sapiens
ttaaaaatgatacttaga

SEQ ID NO: 29277 - DNA, 22 bp, Homo sapiens
ctccaggcattgtttacctgct

SEQ ID NO: 29278 - DNA, 23 bp, Homo sapiens
gcgggggccgcggccgccggccc

SEQ ID NO: 29279 - DNA, 20 bp, Homo sapiens
gcggtagcagctgccggtgg

SEQ ID NO: 29280 - DNA, 20 bp, Homo sapiens
aaacacagaagcatgagtgg

SEQ ID NO: 29281 - DNA, 17 bp, Homo sapiens
actcccagtgatgatct

SEQ ID NO: 29282 - DNA, 21 bp, Homo sapiens
atttgagtaactgtcaggctt

SEQ ID NO: 29283 - DNA, 19 bp, Homo sapiens
gggctttatgtctttgtta

SEQ ID NO: 29284 - DNA, 21 bp, Homo sapiens
tatttttttatggaaataata

SEQ ID NO: 29285 - DNA, 18 bp, Homo sapiens
tctttgccactgatctca

SEQ ID NO: 29286 - DNA, 26 bp, Homo sapiens
tctttttgtgttatgcacttaatttt

SEQ ID NO: 29287 - DNA, 21 bp, Homo sapiens
agccagggccgagcgtgccag

SEQ ID NO: 29288 - DNA, 18 bp, Homo sapiens
gcccttcaggtctaaagc

SEQ ID NO: 29289 - DNA, 19 bp, Homo sapiens
ggtacaaaaaagcctgtaa

SEQ ID NO: 29290 - DNA, 24 bp, Homo sapiens
ggtctagaatatgtacacgcagct

SEQ ID NO: 29291 - DNA, 19 bp, Homo sapiens
tcttgaagatgacaaaagt

SEQ ID NO: 29292 - DNA, 21 bp, Homo sapiens
caagatcacaggagccactgc

SEQ ID NO: 29293 - DNA, 19 bp, Homo sapiens
cagatgaatatttaactca

SEQ ID NO: 29294 - DNA, 17 bp, Homo sapiens
ctctactaaacatgcaa

SEQ ID NO: 29295 - DNA, 20 bp, Homo sapiens
gtctcggaaacacagagcca

SEQ ID NO: 29296 - DNA, 21 bp, Homo sapiens
acctgggatctctggcattac

SEQ ID NO: 29297 - DNA, 18 bp, Homo sapiens
ataaaacactatctgatg

SEQ ID NO: 29298 - DNA, 16 bp, Homo sapiens
ccacccaccctccctc

SEQ ID NO: 29299 - DNA, 16 bp, Homo sapiens
ctctccttctccatct

SEQ ID NO: 29300 - DNA, 16 bp, Homo sapiens
ctgtctcaactgtgca

SEQ ID NO: 29301 - DNA, 23 bp, Homo sapiens
ggcaattatctctcttccaggga

SEQ ID NO: 29302 - DNA, 18 bp, Homo sapiens
gtccatctcttttgatca

SEQ ID NO: 29303 - DNA, 20 bp, Homo sapiens
tgcctgtccctctccttctc

SEQ ID NO: 29304 - DNA, 25 bp, Homo sapiens
ggccgtcccgagcccccgcttcctc

SEQ ID NO: 29305 - DNA, 21 bp, Homo sapiens
aagagaggcccaggctactgg

SEQ ID NO: 29306 - DNA, 21 bp, Homo sapiens
ccctgctgcggagaccgcgga

SEQ ID NO: 29307 - DNA, 21 bp, Homo sapiens
aagagaggcccaggctactgg

SEQ ID NO: 29308 - DNA, 21 bp, Homo sapiens
ccctgctgcggagaccgcgga

SEQ ID NO: 29309 - DNA, 18 bp, Homo sapiens
accccgagggcccaggga

SEQ ID NO: 29310 - DNA, 18 bp, Homo sapiens
gctgagtcctcttgcaca

SEQ ID NO: 29311 - DNA, 22 bp, Homo sapiens
acttgttatggttgtttggacc

SEQ ID NO: 29312 - DNA, 20 bp, Homo sapiens
atcctgaggcaaagtagtga

SEQ ID NO: 29313 - DNA, 17 bp, Homo sapiens
ggcacctccggttctcc

SEQ ID NO: 29314 - DNA, 17 bp, Homo sapiens
tactggattgtgtttgt

SEQ ID NO: 29315 - DNA, 18 bp, Homo sapiens
aacatccagaggtgagac

SEQ ID NO: 29316 - DNA, 19 bp, Homo sapiens
aagtttgtaaaattcctta

SEQ ID NO: 29317 - DNA, 21 bp, Homo sapiens
aggaagtaatgggaaggggtt

SEQ ID NO: 29318 - DNA, 18 bp, Homo sapiens
cccgcaacctccgcctcc

SEQ ID NO: 29319 - DNA, 19 bp, Homo sapiens
cctttcttctcacacgtcg

SEQ ID NO: 29320 - DNA, 18 bp, Homo sapiens
tccgcctcccgggttcaa

SEQ ID NO: 29321 - DNA, 23 bp, Homo sapiens
cagctgttctagagcgggaatta

SEQ ID NO: 29322 - DNA, 22 bp, Homo sapiens
cttatttgtcttctacacccca

SEQ ID NO: 29323 - DNA, 18 bp, Homo sapiens
tgtctgtggaaaatggga

SEQ ID NO: 29324 - DNA, 21 bp, Homo sapiens
acagacctccctacagctgta

SEQ ID NO: 29325 - DNA, 22 bp, Homo sapiens
acttgggggatctccttggcct

SEQ ID NO: 29326 - DNA, 22 bp, Homo sapiens
agaaggtacttactcttgtacc

SEQ ID NO: 29327 - DNA, 18 bp, Homo sapiens
atgcctcaaagccttgct

SEQ ID NO: 29328 - DNA, 23 bp, Homo sapiens
cagctgttctagagcgggaatta

SEQ ID NO: 29329 - DNA, 20 bp, Homo sapiens
ctatttggaaatccctaaca

SEQ ID NO: 29330 - DNA, 22 bp, Homo sapiens
cttatttgtcttctacacccca

SEQ ID NO: 29331 - DNA, 18 bp, Homo sapiens
tccgcctcccgggttcaa

SEQ ID NO: 29332 - DNA, 18 bp, Homo sapiens
tgtctgtggaaaatggga

SEQ ID NO: 29333 - DNA, 21 bp, Homo sapiens
acagacctccctacagctgta

SEQ ID NO: 29334 - DNA, 22 bp, Homo sapiens
acttgggggatctccttggcct

SEQ ID NO: 29335 - DNA, 22 bp, Homo sapiens
agaaggtacttactcttgtacc

SEQ ID NO: 29336 - DNA, 18 bp, Homo sapiens
atgcctcaaagccttgct

SEQ ID NO: 29337 - DNA, 23 bp, Homo sapiens
cagctgttctagagcgggaatta

SEQ ID NO: 29338 - DNA, 24 bp, Homo sapiens
cctctagctccaactgagaaccca

SEQ ID NO: 29339 - DNA, 16 bp, Homo sapiens
cctgctgaaggagtcc

SEQ ID NO: 29340 - DNA, 20 bp, Homo sapiens
ctatttggaaatccctaaca

SEQ ID NO: 29341 - DNA, 22 bp, Homo sapiens
cttatttgtcttctacacccca

SEQ ID NO: 29342 - DNA, 18 bp, Homo sapiens
tccgcctcccgggttcaa

SEQ ID NO: 29343 - DNA, 18 bp, Homo sapiens
tgtctgtggaaaatggga

SEQ ID NO: 29344 - DNA, 21 bp, Homo sapiens
acagacctccctacagctgta

SEQ ID NO: 29345 - DNA, 22 bp, Homo sapiens
acttgggggatctccttggcct

SEQ ID NO: 29346 - DNA, 22 bp, Homo sapiens
agaaggtacttactcttgtacc

SEQ ID NO: 29347 - DNA, 18 bp, Homo sapiens
atgcctcaaagccttgct

SEQ ID NO: 29348 - DNA, 23 bp, Homo sapiens
cagctgttctagagcgggaatta

SEQ ID NO: 29349 - DNA, 24 bp, Homo sapiens
cctctagctccaactgagaaccca

SEQ ID NO: 29350 - DNA, 20 bp, Homo sapiens
ctatttggaaatccctaaca

SEQ ID NO: 29351 - DNA, 22 bp, Homo sapiens
cttatttgtcttctacacccca

SEQ ID NO: 29352 - DNA, 18 bp, Homo sapiens
tccgcctcccgggttcaa

SEQ ID NO: 29353 - DNA, 18 bp, Homo sapiens
tgtctgtggaaaatggga

SEQ ID NO: 29354 - DNA, 16 bp, Homo sapiens
aggacacggtgcctca

SEQ ID NO: 29355 - DNA, 17 bp, Homo sapiens
caggacggccccgtccc

SEQ ID NO: 29356 - DNA, 19 bp, Homo sapiens
caggctctcagtcacccct

SEQ ID NO: 29357 - DNA, 20 bp, Homo sapiens
ccctgatgacaccctgcgag

SEQ ID NO: 29358 - DNA, 21 bp, Homo sapiens
cctgttcttcctcccaacgaa

SEQ ID NO: 29359 - DNA, 19 bp, Homo sapiens
ggcttctggggccatcttg

SEQ ID NO: 29360 - DNA, 23 bp, Homo sapiens
gtccaccccaactcctgacagca

SEQ ID NO: 29361 - DNA, 21 bp, Homo sapiens
taggactacagacgtttatca

SEQ ID NO: 29362 - DNA, 23 bp, Homo sapiens
tgcccaggacggccccgtcccag

SEQ ID NO: 29363 - DNA, 22 bp, Homo sapiens
aatggtcataacagtgcctgtt

SEQ ID NO: 29364 - DNA, 22 bp, Homo sapiens
acctggacttccagtctggctc

SEQ ID NO: 29365 - DNA, 18 bp, Homo sapiens
caagacaccaaacccttc

SEQ ID NO: 29366 - DNA, 21 bp, Homo sapiens
cccttgtgttacctcccgcca

SEQ ID NO: 29367 - DNA, 22 bp, Homo sapiens
gcacctcttgttttcctttttc

SEQ ID NO: 29368 - DNA, 24 bp, Homo sapiens
gcgctgggccgaacatactggaga

SEQ ID NO: 29369 - DNA, 20 bp, Homo sapiens
tcctggcccaggcctggcgg

SEQ ID NO: 29370 - DNA, 18 bp, Homo sapiens
tctgagccccccactttt

SEQ ID NO: 29371 - DNA, 21 bp, Homo sapiens
agccaagcagctgccttcctt

SEQ ID NO: 29372 - DNA, 21 bp, Homo sapiens
ctgtatttcccttaattcctc

SEQ ID NO: 29373 - DNA, 23 bp, Homo sapiens
ggggacccggtagcggcggtggc

SEQ ID NO: 29374 - DNA, 19 bp, Homo sapiens
ttcctgtgtgctccctgag

SEQ ID NO: 29375 - DNA, 19 bp, Homo sapiens
cctctaagctgcattgaga

SEQ ID NO: 29376 - DNA, 19 bp, Homo sapiens
cctggcagggacttctggg

SEQ ID NO: 29377 - DNA, 21 bp, Homo sapiens
gaagcctctgcccatccccct

SEQ ID NO: 29378 - DNA, 17 bp, Homo sapiens
gttgaattaaactagca

SEQ ID NO: 29379 - DNA, 18 bp, Homo sapiens
cgaatcttcctgaaaatg

SEQ ID NO: 29380 - DNA, 20 bp, Homo sapiens
ggaacctgcccgtctcccct

SEQ ID NO: 29381 - DNA, 18 bp, Homo sapiens
gggccttacgtgggattg

SEQ ID NO: 29382 - DNA, 23 bp, Homo sapiens
agggcattcatgaaagaacaact

SEQ ID NO: 29383 - DNA, 19 bp, Homo sapiens
ttaaaaatctaagatgtgg

SEQ ID NO: 29384 - DNA, 16 bp, Homo sapiens
agctcaccctgctcct

SEQ ID NO: 29385 - DNA, 24 bp, Homo sapiens
atttctgggccttatgtggggttg

SEQ ID NO: 29386 - DNA, 18 bp, Homo sapiens
gtctgggtcgtcttttga

SEQ ID NO: 29387 - DNA, 17 bp, Homo sapiens
gtgtgagggtgcaggga

SEQ ID NO: 29388 - DNA, 21 bp, Homo sapiens
tcccgccctccccctgccaga

SEQ ID NO: 29389 - DNA, 19 bp, Homo sapiens
tgcgatggtgctgcacccc

SEQ ID NO: 29390 - DNA, 19 bp, Homo sapiens
agaaatagtttttgctgtt

SEQ ID NO: 29391 - DNA, 19 bp, Homo sapiens
ccagggcttgctaaatcca

SEQ ID NO: 29392 - DNA, 18 bp, Homo sapiens
gcttccaggcagcctgtt

SEQ ID NO: 29393 - DNA, 20 bp, Homo sapiens
gttcctttcaggcttccgtg

SEQ ID NO: 29394 - DNA, 25 bp, Homo sapiens
caacatcacatcactcaccatttta

SEQ ID NO: 29395 - DNA, 21 bp, Homo sapiens
cggctacaacaattcatagaa

SEQ ID NO: 29396 - DNA, 20 bp, Homo sapiens
ctctggagctactcctgcta

SEQ ID NO: 29397 - DNA, 16 bp, Homo sapiens
gtgggcataggtggca

SEQ ID NO: 29398 - DNA, 21 bp, Homo sapiens
tcctttgaatgttccaacaaa

SEQ ID NO: 29399 - DNA, 22 bp, Homo sapiens
tctgaagcctctgttgtggctc

SEQ ID NO: 29400 - DNA, 19 bp, Homo sapiens
tctgtctcatgttcgtgca

SEQ ID NO: 29401 - DNA, 18 bp, Homo sapiens
aagagacttcttctgttc

SEQ ID NO: 29402 - DNA, 22 bp, Homo sapiens
acctgcccgccacatcctctgc

SEQ ID NO: 29403 - DNA, 18 bp, Homo sapiens
cacccgtccacctgccca

SEQ ID NO: 29404 - DNA, 21 bp, Homo sapiens
gctttcccgggaggtctggag

SEQ ID NO: 29405 - DNA, 17 bp, Homo sapiens
ggccccgagtctgtgaa

SEQ ID NO: 29406 - DNA, 23 bp, Homo sapiens
gaggcgcggtgctcggcccggga

SEQ ID NO: 29407 - DNA, 18 bp, Homo sapiens
cagctctcctgtaactca

SEQ ID NO: 29408 - DNA, 17 bp, Homo sapiens
cggacctgcgacttccg

SEQ ID NO: 29409 - DNA, 23 bp, Homo sapiens
cagaagattcaaggagctgtaga

SEQ ID NO: 29410 - DNA, 23 bp, Homo sapiens
gatatatcagcaaaaacacatca

SEQ ID NO: 29411 - DNA, 17 bp, Homo sapiens
tgttggggggcctttga

SEQ ID NO: 29412 - DNA, 22 bp, Homo sapiens
atctcggctcactgcaatctct

SEQ ID NO: 29413 - DNA, 20 bp, Homo sapiens
gcctgcgcacctaaacactg

SEQ ID NO: 29414 - DNA, 17 bp, Homo sapiens
tcaagtgattctcctgc

SEQ ID NO: 29415 - DNA, 20 bp, Homo sapiens
tggccaggctggtcttgaac

SEQ ID NO: 29416 - DNA, 19 bp, Homo sapiens
tttgtttgtactgcggcaa

SEQ ID NO: 29417 - DNA, 18 bp, Homo sapiens
cctcacaaaagagccaga

SEQ ID NO: 29418 - DNA, 18 bp, Homo sapiens
cctggtcaggcctgtgga

SEQ ID NO: 29419 - DNA, 20 bp, Homo sapiens
cgcccctgatcacccgcccc

SEQ ID NO: 29420 - DNA, 24 bp, Homo sapiens
gtgccggagcagctcgtgcagcta

SEQ ID NO: 29421 - DNA, 18 bp, Homo sapiens
gagcacacagttgcagct

SEQ ID NO: 29422 - DNA, 20 bp, Homo sapiens
ttctcattgctgagcacaca

SEQ ID NO: 29423 - DNA, 19 bp, Homo sapiens
acagggtgtggactcaact

SEQ ID NO: 29424 - DNA, 19 bp, Homo sapiens
ccccaccacccggtgctgc

SEQ ID NO: 29425 - DNA, 25 bp, Homo sapiens
cctccccagccagctcctgtctgta

SEQ ID NO: 29426 - DNA, 20 bp, Homo sapiens
cctctgcctcccgggttcaa

SEQ ID NO: 29427 - DNA, 22 bp, Homo sapiens
cctgccctccccagccagctcc

SEQ ID NO: 29428 - DNA, 19 bp, Homo sapiens
gagtcacagaatggagcta

SEQ ID NO: 29429 - DNA, 18 bp, Homo sapiens
gctcaacatcctgcaatg

SEQ ID NO: 29430 - DNA, 19 bp, Homo sapiens
gttcaaaggacacacccta

SEQ ID NO: 29431 - DNA, 17 bp, Homo sapiens
tcaagtgattctcctgc

SEQ ID NO: 29432 - DNA, 21 bp, Homo sapiens
tgacagctacgagccagccca

SEQ ID NO: 29433 - DNA, 21 bp, Homo sapiens
accctcgctctcacaccccct

SEQ ID NO: 29434 - DNA, 22 bp, Homo sapiens
cttaagacccctcctctacttc

SEQ ID NO: 29435 - DNA, 24 bp, Homo sapiens
tcccaggcttactctcccaataaa

SEQ ID NO: 29436 - DNA, 18 bp, Homo sapiens
aaaaacaaaacaaacaaa

SEQ ID NO: 29437 - DNA, 22 bp, Homo sapiens
gagccaagatcgtgccactgca

SEQ ID NO: 29438 - DNA, 21 bp, Homo sapiens
tgcagtgagccaagatcgtgc

SEQ ID NO: 29439 - DNA, 19 bp, Homo sapiens
tgggaggacaggcatatgc

SEQ ID NO: 29440 - DNA, 17 bp, Homo sapiens
tttctctgtgcaactag

SEQ ID NO: 29441 - DNA, 23 bp, Homo sapiens
acactcaaggccgctgcccgcca

SEQ ID NO: 29442 - DNA, 16 bp, Homo sapiens
tactgacgcgagcagc

SEQ ID NO: 29443 - DNA, 21 bp, Homo sapiens
gtgtgtatcttcatctggctg

SEQ ID NO: 29444 - DNA, 24 bp, Homo sapiens
tggggacagaagctccagcatttg

SEQ ID NO: 29445 - DNA, 24 bp, Homo sapiens
ttagggaacaagaggcatcactca

SEQ ID NO: 29446 - DNA, 19 bp, Homo sapiens
aactgaagtcttttacatc

SEQ ID NO: 29447 - DNA, 17 bp, Homo sapiens
atcctgaagaatgttga

SEQ ID NO: 29448 - DNA, 22 bp, Homo sapiens
ctctctctctcttttttttctc

SEQ ID NO: 29449 - DNA, 19 bp, Homo sapiens
ccagcaagcctctatcttg

SEQ ID NO: 29450 - DNA, 18 bp, Homo sapiens
gatcccagcataaagtta

SEQ ID NO: 29451 - DNA, 20 bp, Homo sapiens
gtgctggctgggagttctgg

SEQ ID NO: 29452 - DNA, 21 bp, Homo sapiens
ttagttgctattcaaattaat

SEQ ID NO: 29453 - DNA, 21 bp, Homo sapiens
accacaaaaaataatctgaga

SEQ ID NO: 29454 - DNA, 18 bp, Homo sapiens
ctcctcggataatgtgaa

SEQ ID NO: 29455 - DNA, 21 bp, Homo sapiens
tttggaatgatgaaagcatgt

SEQ ID NO: 29456 - DNA, 20 bp, Homo sapiens
cctgtggccgccacttttga

SEQ ID NO: 29457 - DNA, 24 bp, Homo sapiens
gccgcttctgcaaggtctcaggga

SEQ ID NO: 29458 - DNA, 17 bp, Homo sapiens
tccaagaaagtttcctt

SEQ ID NO: 29459 - DNA, 19 bp, Homo sapiens
tctcagggacgggctgcag

SEQ ID NO: 29460 - DNA, 23 bp, Homo sapiens
ttttgatgatcagaggtcttgag

SEQ ID NO: 29461 - DNA, 22 bp, Homo sapiens
caacagaccaacagataactca

SEQ ID NO: 29462 - DNA, 17 bp, Homo sapiens
cccaccctccctgcact

SEQ ID NO: 29463 - DNA, 20 bp, Homo sapiens
tcacctgcccagccatggca

SEQ ID NO: 29464 - DNA, 24 bp, Homo sapiens
agacctaggttgagcagagctcca

SEQ ID NO: 29465 - DNA, 21 bp, Homo sapiens
ttacttcagtcgcctctgcgc

SEQ ID NO: 29466 - DNA, 19 bp, Homo sapiens
acaacccccaaagtccacg

SEQ ID NO: 29467 - DNA, 25 bp, Homo sapiens
ccaccaggtcctgccttttgcggtg

SEQ ID NO: 29468 - DNA, 18 bp, Homo sapiens
cccagatgctgatacaca

SEQ ID NO: 29469 - DNA, 21 bp, Homo sapiens
cctcaacacacatccatctca

SEQ ID NO: 29470 - DNA, 21 bp, Homo sapiens
gatatagataccatagtcaag

SEQ ID NO: 29471 - DNA, 17 bp, Homo sapiens
agcgcgctcttacctca

SEQ ID NO: 29472 - DNA, 22 bp, Homo sapiens
gtgaaaatcaggaggtgtaata

SEQ ID NO: 29473 - DNA, 21 bp, Homo sapiens
atttaggaatgccttcgatga

SEQ ID NO: 29474 - DNA, 17 bp, Homo sapiens
gactcaagggctgtaga

SEQ ID NO: 29475 - DNA, 18 bp, Homo sapiens
taggcaaaacaccaatgc

SEQ ID NO: 29476 - DNA, 17 bp, Homo sapiens
tgatggttaatatgaaa

SEQ ID NO: 29477 - DNA, 19 bp, Homo sapiens
aatgtgaccaccgtcagcc

SEQ ID NO: 29478 - DNA, 19 bp, Homo sapiens
ccgctgcctgtgcccccca

SEQ ID NO: 29479 - DNA, 19 bp, Homo sapiens
cacccgagctacaatctct

SEQ ID NO: 29480 - DNA, 20 bp, Homo sapiens
ggaggaggagactgaggagc

SEQ ID NO: 29481 - DNA, 19 bp, Homo sapiens
caccctctccctctgtgcc

SEQ ID NO: 29482 - DNA, 19 bp, Homo sapiens
ggcttctgtctgtatctca

SEQ ID NO: 29483 - DNA, 18 bp, Homo sapiens
gtgggaaccctcctatca

SEQ ID NO: 29484 - DNA, 19 bp, Homo sapiens
aacatgggcaaagtaatca

SEQ ID NO: 29485 - DNA, 21 bp, Homo sapiens
caaacttccccgcctccacgt

SEQ ID NO: 29486 - DNA, 19 bp, Homo sapiens
tggcctactcaacatgaag

SEQ ID NO: 29487 - DNA, 22 bp, Homo sapiens
ccttctgaccaacctctcccca

SEQ ID NO: 29488 - DNA, 21 bp, Homo sapiens
gaacactagaaagcgctgtga

SEQ ID NO: 29489 - DNA, 22 bp, Homo sapiens
gagggccgagggagaagattcc

SEQ ID NO: 29490 - DNA, 22 bp, Homo sapiens
gcaccccttgtgttttccctct

SEQ ID NO: 29491 - DNA, 20 bp, Homo sapiens
tgtgggaagggcgtgttttt

SEQ ID NO: 29492 - DNA, 24 bp, Homo sapiens
gcacagccagagacagagcccctc

SEQ ID NO: 29493 - DNA, 19 bp, Homo sapiens
tggagaagcacagccagag

SEQ ID NO: 29494 - DNA, 22 bp, Homo sapiens
ttctgtctctggagacccttga

SEQ ID NO: 29495 - DNA, 22 bp, Homo sapiens
aggagagagaagaaacaggcca

SEQ ID NO: 29496 - DNA, 17 bp, Homo sapiens
gccaccttctgtggagt

SEQ ID NO: 29497 - DNA, 20 bp, Homo sapiens
agtctggttacattaagaaa

SEQ ID NO: 29498 - DNA, 18 bp, Homo sapiens
cccattctgacccctgac

SEQ ID NO: 29499 - DNA, 19 bp, Homo sapiens
ctcccccatttctggctct

SEQ ID NO: 29500 - DNA, 23 bp, Homo sapiens
taagggactcgcctagggtctca

SEQ ID NO: 29501 - DNA, 18 bp, Homo sapiens
aatgtaaagaatatgaca

SEQ ID NO: 29502 - DNA, 18 bp, Homo sapiens
acactacccaactttaaa

SEQ ID NO: 29503 - DNA, 20 bp, Homo sapiens
acctaaaagtattaaattcc

SEQ ID NO: 29504 - DNA, 18 bp, Homo sapiens
ccaaaggctcctagatct

SEQ ID NO: 29505 - DNA, 18 bp, Homo sapiens
ctcaaagacataaaagca

SEQ ID NO: 29506 - DNA, 23 bp, Homo sapiens
gaagaaaacccaggaaatgccat

SEQ ID NO: 29507 - DNA, 18 bp, Homo sapiens
gctatttgcagactacag

SEQ ID NO: 29508 - DNA, 18 bp, Homo sapiens
ttttcccatccctcccca

SEQ ID NO: 29509 - DNA, 22 bp, Homo sapiens
acctatcagcccttgaaattct

SEQ ID NO: 29510 - DNA, 21 bp, Homo sapiens
acggtccctacctagacccca

SEQ ID NO: 29511 - DNA, 19 bp, Homo sapiens
tccaggtggggactgttcc

SEQ ID NO: 29512 - DNA, 19 bp, Homo sapiens
aggaaatgccccccatcct

SEQ ID NO: 29513 - DNA, 20 bp, Homo sapiens
caagtccctgcagctggcca

SEQ ID NO: 29514 - DNA, 19 bp, Homo sapiens
cacggcaacctccacctcc

SEQ ID NO: 29515 - DNA, 23 bp, Homo sapiens
ccacccttgcacccccagcctcc

SEQ ID NO: 29516 - DNA, 19 bp, Homo sapiens
cgcccccgcccgctgctga

SEQ ID NO: 29517 - DNA, 16 bp, Homo sapiens
cttgggctcctacctc

SEQ ID NO: 29518 - DNA, 18 bp, Homo sapiens
gcctctccccagcttctt

SEQ ID NO: 29519 - DNA, 18 bp, Homo sapiens
tccacctcccgggttcaa

SEQ ID NO: 29520 - DNA, 20 bp, Homo sapiens
ttctgtctttcccttccacc

SEQ ID NO: 29521 - DNA, 18 bp, Homo sapiens
tgtcagtgggagcctcca

SEQ ID NO: 29522 - DNA, 19 bp, Homo sapiens
aaaaatgaacaaagaaatg

SEQ ID NO: 29523 - DNA, 22 bp, Homo sapiens
gcctaataaaataaatggttga

SEQ ID NO: 29524 - DNA, 17 bp, Homo sapiens
tacccctatgactgcct

SEQ ID NO: 29525 - DNA, 18 bp, Homo sapiens
tgggtggatcacctgagg

SEQ ID NO: 29526 - DNA, 18 bp, Homo sapiens
ttccctcattgaaagatg

SEQ ID NO: 29527 - DNA, 19 bp, Homo sapiens
cttcgtcccctccgcctct

SEQ ID NO: 29528 - DNA, 17 bp, Homo sapiens
gcgaccgttctgcctcc

SEQ ID NO: 29529 - DNA, 21 bp, Homo sapiens
acctggactcacagcctggct

SEQ ID NO: 29530 - DNA, 17 bp, Homo sapiens
tcaagcgattctcatgc

SEQ ID NO: 29531 - DNA, 18 bp, Homo sapiens
tgtagcatgactgcctct

SEQ ID NO: 29532 - DNA, 21 bp, Homo sapiens
atcccaagcctgataaatcta

SEQ ID NO: 29533 - DNA, 20 bp, Homo sapiens
ccagagcctgcagaaggcta

SEQ ID NO: 29534 - DNA, 19 bp, Homo sapiens
gaatcaacagttgaaactg

SEQ ID NO: 29535 - DNA, 25 bp, Homo sapiens
gtcacgaccagaagcatttaccaca

SEQ ID NO: 29536 - DNA, 17 bp, Homo sapiens
atcctagcacgtgggga

SEQ ID NO: 29537 - DNA, 22 bp, Homo sapiens
gtgtccggaattggtgggttct

SEQ ID NO: 29538 - DNA, 21 bp, Homo sapiens
aagtgaaatatacagccttaa

SEQ ID NO: 29539 - DNA, 20 bp, Homo sapiens
tgggatccaggcgcccggtt

SEQ ID NO: 29540 - DNA, 19 bp, Homo sapiens
tttccatcaagtgaaatat

SEQ ID NO: 29541 - DNA, 20 bp, Homo sapiens
aggatctcagcactctgacc

SEQ ID NO: 29542 - DNA, 23 bp, Homo sapiens
ctctaaatgggatttaacccaca

SEQ ID NO: 29543 - DNA, 18 bp, Homo sapiens
gaaaatttcacagagcta

SEQ ID NO: 29544 - DNA, 19 bp, Homo sapiens
gcagctttagaatagcttc

SEQ ID NO: 29545 - DNA, 24 bp, Homo sapiens
tcactgaggccatatctttttaca

SEQ ID NO: 29546 - DNA, 17 bp, Homo sapiens
aaatggaacaacttcac

SEQ ID NO: 29547 - DNA, 22 bp, Homo sapiens
atcttggctcactgcagcctct

SEQ ID NO: 29548 - DNA, 20 bp, Homo sapiens
atttccttggaaactccctt

SEQ ID NO: 29549 - DNA, 20 bp, Homo sapiens
cctctgcctcctgggttcaa

SEQ ID NO: 29550 - DNA, 18 bp, Homo sapiens
cctgctttcatcccctga

SEQ ID NO: 29551 - DNA, 18 bp, Homo sapiens
tctgatgaacactttgga

SEQ ID NO: 29552 - DNA, 20 bp, Homo sapiens
tctgctgatgttttatagag

SEQ ID NO: 29553 - DNA, 19 bp, Homo sapiens
ttccaaggatctaatccag

SEQ ID NO: 29554 - DNA, 21 bp, Homo sapiens
aaaacaaaaacccaaccaaac

SEQ ID NO: 29555 - DNA, 22 bp, Homo sapiens
aactgacaaattaaggaggtta

SEQ ID NO: 29556 - DNA, 21 bp, Homo sapiens
gaaccatgaaaacctctgtga

SEQ ID NO: 29557 - DNA, 21 bp, Homo sapiens
aagttgacttttagttcctaa

SEQ ID NO: 29558 - DNA, 18 bp, Homo sapiens
aaggcttgatgtgtataa

SEQ ID NO: 29559 - DNA, 17 bp, Homo sapiens
tccaagaaagattctga

SEQ ID NO: 29560 - DNA, 25 bp, Homo sapiens
gaggacatatgataatgataccaaa

SEQ ID NO: 29561 - DNA, 18 bp, Homo sapiens
caaccctccggactctcc

SEQ ID NO: 29562 - DNA, 21 bp, Homo sapiens
ccttcccttcatcccttccca

SEQ ID NO: 29563 - DNA, 18 bp, Homo sapiens
ggccgggtgcagtggctc

SEQ ID NO: 29564 - DNA, 19 bp, Homo sapiens
ggcctgagcatccatccta

SEQ ID NO: 29565 - DNA, 18 bp, Homo sapiens
gggatcccctagctgtcc

SEQ ID NO: 29566 - DNA, 19 bp, Homo sapiens
tgttccaggcactgtccta

SEQ ID NO: 29567 - DNA, 18 bp, Homo sapiens
gttcttctcctcgggtgt

SEQ ID NO: 29568 - DNA, 18 bp, Homo sapiens
aagtgtggtgtttggttt

SEQ ID NO: 29569 - DNA, 20 bp, Homo sapiens
attcattaccttacagtgta

SEQ ID NO: 29570 - DNA, 19 bp, Homo sapiens
cctttaataatggagcatc

SEQ ID NO: 29571 - DNA, 18 bp, Homo sapiens
gcctcggccacttggttc

SEQ ID NO: 29572 - DNA, 17 bp, Homo sapiens
ggatcatcgcctgttct

SEQ ID NO: 29573 - DNA, 24 bp, Homo sapiens
gttgaatcatgtgattctagatta

SEQ ID NO: 29574 - DNA, 23 bp, Homo sapiens
taaaaacctagtcaaacaaggaa

SEQ ID NO: 29575 - DNA, 19 bp, Homo sapiens
tctgaaaactagatgcacc

SEQ ID NO: 29576 - DNA, 17 bp, Homo sapiens
tctggacagaccacaac

SEQ ID NO: 29577 - DNA, 20 bp, Homo sapiens
ttactgtcatgtcatttacc

SEQ ID NO: 29578 - DNA, 21 bp, Homo sapiens
ttgatgagtgattgcctgtcc

SEQ ID NO: 29579 - DNA, 17 bp, Homo sapiens
agccagtggaaattgcc

SEQ ID NO: 29580 - DNA, 19 bp, Homo sapiens
ttctctactgaaaatacaa

SEQ ID NO: 29581 - DNA, 24 bp, Homo sapiens
attggtgtttacaccctcttgtca

SEQ ID NO: 29582 - DNA, 17 bp, Homo sapiens
ctagccgtgtccacgca

SEQ ID NO: 29583 - DNA, 26 bp, Homo sapiens
tctcttttacccctgatcttggcttt

SEQ ID NO: 29584 - DNA, 21 bp, Homo sapiens
gtgtagcattgttcttgatta

SEQ ID NO: 29585 - DNA, 18 bp, Homo sapiens
ggatgggctgggtttagt

SEQ ID NO: 29586 - DNA, 20 bp, Homo sapiens
gctgaagaagaattttgcct

SEQ ID NO: 29587 - DNA, 16 bp, Homo sapiens
ctgtctttccttctga

SEQ ID NO: 29588 - DNA, 25 bp, Homo sapiens
aacctaatttcaatcttactgtaaa

SEQ ID NO: 29589 - DNA, 19 bp, Homo sapiens
cccatggagtgctctccca

SEQ ID NO: 29590 - DNA, 22 bp, Homo sapiens
gagccaagatcccgccactgca

SEQ ID NO: 29591 - DNA, 19 bp, Homo sapiens
ggaataatgttccatcatg

SEQ ID NO: 29592 - DNA, 20 bp, Homo sapiens
ccaaaagatgatgatgtgat

SEQ ID NO: 29593 - DNA, 20 bp, Homo sapiens
ttgggccagaaggtagggta

SEQ ID NO: 29594 - DNA, 17 bp, Homo sapiens
acaggcagtgaggatga

SEQ ID NO: 29595 - DNA, 20 bp, Homo sapiens
agaccacacctgccacggtc

SEQ ID NO: 29596 - DNA, 23 bp, Homo sapiens
gacagaggaccacctccccatac

SEQ ID NO: 29597 - DNA, 21 bp, Homo sapiens
gcagaggcccagagcccctgc

SEQ ID NO: 29598 - DNA, 21 bp, Homo sapiens
gccccagtgacggtctggtct

SEQ ID NO: 29599 - DNA, 20 bp, Homo sapiens
gatattgattatacaccttt

SEQ ID NO: 29600 - DNA, 19 bp, Homo sapiens
tcttaatatcagcaaggtg

SEQ ID NO: 29601 - DNA, 18 bp, Homo sapiens
tttaggtgattctaattc

SEQ ID NO: 29602 - DNA, 18 bp, Homo sapiens
caataacatgtctgctcc

SEQ ID NO: 29603 - DNA, 16 bp, Homo sapiens
gaaatagttaatttgt

SEQ ID NO: 29604 - DNA, 18 bp, Homo sapiens
acacttaataatagctca

SEQ ID NO: 29605 - DNA, 17 bp, Homo sapiens
catttgactttaagtaa

SEQ ID NO: 29606 - DNA, 22 bp, Homo sapiens
cctaatgtgtagggttgttata

SEQ ID NO: 29607 - DNA, 22 bp, Homo sapiens
tcctgaagaaatagatatagct

SEQ ID NO: 29608 - DNA, 21 bp, Homo sapiens
caacccctcccctgcctccac

SEQ ID NO: 29609 - DNA, 20 bp, Homo sapiens
tgaagaggcactttcgagta

SEQ ID NO: 29610 - DNA, 23 bp, Homo sapiens
ttgttagtttatcttggcactga

SEQ ID NO: 29611 - DNA, 21 bp, Homo sapiens
actgcaagcgctgagtccttc

SEQ ID NO: 29612 - DNA, 23 bp, Homo sapiens
agcaattttttaaagggcagata

SEQ ID NO: 29613 - DNA, 24 bp, Homo sapiens
atttgagtccagccatcttggttc

SEQ ID NO: 29614 - DNA, 19 bp, Homo sapiens
gcagggagggaacttgcca

SEQ ID NO: 29615 - DNA, 20 bp, Homo sapiens
ggacgaggcatctcaggtgg

SEQ ID NO: 29616 - DNA, 19 bp, Homo sapiens
ggatctcagaacagtcttt

SEQ ID NO: 29617 - DNA, 19 bp, Homo sapiens
gggcaaggggctttcagtg

SEQ ID NO: 29618 - DNA, 19 bp, Homo sapiens
gtgagtctaaatatattca

SEQ ID NO: 29619 - DNA, 23 bp, Homo sapiens
tctttgtcagatgggacacttca

SEQ ID NO: 29620 - DNA, 18 bp, Homo sapiens
tgctcccagagtcactca

SEQ ID NO: 29621 - DNA, 18 bp, Homo sapiens
ctagccacctctgcctct

SEQ ID NO: 29622 - DNA, 20 bp, Homo sapiens
gcctagccacctctgcctct

SEQ ID NO: 29623 - DNA, 20 bp, Homo sapiens
aaaaacaaggagctttagct

SEQ ID NO: 29624 - DNA, 22 bp, Homo sapiens
aactttgggagcttcaggatca

SEQ ID NO: 29625 - DNA, 23 bp, Homo sapiens
actaagagttcacctgtccttca

SEQ ID NO: 29626 - DNA, 21 bp, Homo sapiens
gcctgggcccgttcctggtct

SEQ ID NO: 29627 - DNA, 18 bp, Homo sapiens
tccgcatcctaggttcaa

SEQ ID NO: 29628 - DNA, 21 bp, Homo sapiens
gccagcggtttggcaccgtac

SEQ ID NO: 29629 - DNA, 17 bp, Homo sapiens
ccctttttcctatacct

SEQ ID NO: 29630 - DNA, 15 bp, Homo sapiens
cctgttcttgcaaca

SEQ ID NO: 29631 - DNA, 19 bp, Homo sapiens
tcacatcccagaagaaact

SEQ ID NO: 29632 - DNA, 20 bp, Homo sapiens
tcacctgtgatttatccaca

SEQ ID NO: 29633 - DNA, 16 bp, Homo sapiens
tcctgtgatattgtga

SEQ ID NO: 29634 - DNA, 23 bp, Homo sapiens
tgggtagcttcaggatggggctg

SEQ ID NO: 29635 - DNA, 18 bp, Homo sapiens
tgtcaactaaagcattgg

SEQ ID NO: 29636 - DNA, 23 bp, Homo sapiens
ttcaaaaaatataccattggaga

SEQ ID NO: 29637 - DNA, 16 bp, Homo sapiens
accaccaaccaggtca

SEQ ID NO: 29638 - DNA, 18 bp, Homo sapiens
gaaaagtgaagcccactg

SEQ ID NO: 29639 - DNA, 18 bp, Homo sapiens
taggattttatttgtact

SEQ ID NO: 29640 - DNA, 21 bp, Homo sapiens
tttcacttctcctggctcact

SEQ ID NO: 29641 - DNA, 24 bp, Homo sapiens
tcctgactttcggtggcttgtgga

SEQ ID NO: 29642 - DNA, 22 bp, Homo sapiens
acaccatcggggaccgaggacc

SEQ ID NO: 29643 - DNA, 19 bp, Homo sapiens
cttccccatcttctcctct

SEQ ID NO: 29644 - DNA, 26 bp, Homo sapiens
ggccccactccacgacaaccacttcc

SEQ ID NO: 29645 - DNA, 23 bp, Homo sapiens
gggcccctgcgcccgggctggca

SEQ ID NO: 29646 - DNA, 21 bp, Homo sapiens
tccctcagatccaggccctca

SEQ ID NO: 29647 - DNA, 20 bp, Homo sapiens
cagtgaaaaatgtgattcca

SEQ ID NO: 29648 - DNA, 17 bp, Homo sapiens
ctgtggaatgctattga

SEQ ID NO: 29649 - DNA, 23 bp, Homo sapiens
tgaatgaaccagctatggaattg

SEQ ID NO: 29650 - DNA, 18 bp, Homo sapiens
tttgttacagcagcactg

SEQ ID NO: 29651 - DNA, 19 bp, Homo sapiens
aagcgattctcccacctca

SEQ ID NO: 29652 - DNA, 21 bp, Homo sapiens
ggtaagagtttgtagactctt

SEQ ID NO: 29653 - DNA, 21 bp, Homo sapiens
aactaaagtataatcaaagta

SEQ ID NO: 29654 - DNA, 21 bp, Homo sapiens
actggaaattcttttacttca

SEQ ID NO: 29655 - DNA, 19 bp, Homo sapiens
atgtatttgttgagttttg

SEQ ID NO: 29656 - DNA, 18 bp, Homo sapiens
gaagaaccagacctggac

SEQ ID NO: 29657 - DNA, 23 bp, Homo sapiens
ggggcgctagtaaactgatgata

SEQ ID NO: 29658 - DNA, 22 bp, Homo sapiens
tactggaaattcttttacttca

SEQ ID NO: 29659 - DNA, 18 bp, Homo sapiens
tcttctctatgcactctt

SEQ ID NO: 29660 - DNA, 19 bp, Homo sapiens
aagcaattctcctacctca

SEQ ID NO: 29661 - DNA, 20 bp, Homo sapiens
gaaattaataagatactaaa

SEQ ID NO: 29662 - DNA, 21 bp, Homo sapiens
gaaaaccgcccctggacgttt

SEQ ID NO: 29663 - DNA, 21 bp, Homo sapiens
ttgccgttgaaaaatacagtg

SEQ ID NO: 29664 - DNA, 23 bp, Homo sapiens
ccaccaccgcccagctcagctca

SEQ ID NO: 29665 - DNA, 21 bp, Homo sapiens
cctcatcacacccttacctcc

SEQ ID NO: 29666 - DNA, 21 bp, Homo sapiens
gaaaatctgacctggcatttt

SEQ ID NO: 29667 - DNA, 18 bp, Homo sapiens
gaggagcctgggatccca

SEQ ID NO: 29668 - DNA, 18 bp, Homo sapiens
gtccacatcctgagccca

SEQ ID NO: 29669 - DNA, 18 bp, Homo sapiens
gttaacttcatacacaca

SEQ ID NO: 29670 - DNA, 17 bp, Homo sapiens
tctgctttgaccatgtg

SEQ ID NO: 29671 - DNA, 18 bp, Homo sapiens
ttacctcccaccccctca

SEQ ID NO: 29672 - DNA, 18 bp, Homo sapiens
caacccctcctcttccct

SEQ ID NO: 29673 - DNA, 16 bp, Homo sapiens
cccggaaggcaatggg

SEQ ID NO: 29674 - DNA, 17 bp, Homo sapiens
gatggggtcttgccata

SEQ ID NO: 29675 - DNA, 18 bp, Homo sapiens
gctcctgtgttttgtttt

SEQ ID NO: 29676 - DNA, 24 bp, Homo sapiens
ctcggtatcacctttgaggaaaaa

SEQ ID NO: 29677 - DNA, 21 bp, Homo sapiens
gctctaagtttcacttttcca

SEQ ID NO: 29678 - DNA, 19 bp, Homo sapiens
tgtggggtgtatttctgga

SEQ ID NO: 29679 - DNA, 17 bp, Homo sapiens
tgaatcaaagttattca

SEQ ID NO: 29680 - DNA, 21 bp, Homo sapiens
ttttttggcaatcagtttgta

SEQ ID NO: 29681 - DNA, 16 bp, Homo sapiens
aatatctgctccttcc

SEQ ID NO: 29682 - DNA, 23 bp, Homo sapiens
gcttgaagccacaaataaaactc

SEQ ID NO: 29683 - DNA, 22 bp, Homo sapiens
ttctttgtcccactgtagtttg

SEQ ID NO: 29684 - DNA, 22 bp, Homo sapiens
caggccctccagctgctggcca

SEQ ID NO: 29685 - DNA, 19 bp, Homo sapiens
ctgcctgctgacccacctg

SEQ ID NO: 29686 - DNA, 19 bp, Homo sapiens
gcaacaaggaaactatcct

SEQ ID NO: 29687 - DNA, 21 bp, Homo sapiens
gcctgggttggcttcctgccc

SEQ ID NO: 29688 - DNA, 23 bp, Homo sapiens
ctgatgagccctctcattcctcc

SEQ ID NO: 29689 - DNA, 22 bp, Homo sapiens
ggcctgctcctcggcggagcgg

SEQ ID NO: 29690 - DNA, 22 bp, Homo sapiens
ttcacaaagtgccccctccatg

SEQ ID NO: 29691 - DNA, 19 bp, Homo sapiens
ttggggatttgcttgggct

SEQ ID NO: 29692 - DNA, 22 bp, Homo sapiens
gcctgggctcctgccatggccc

SEQ ID NO: 29693 - DNA, 20 bp, Homo sapiens
cgaggtcggcgggggtctgg

SEQ ID NO: 29694 - DNA, 20 bp, Homo sapiens
gggcaggtagggactctgcc

SEQ ID NO: 29695 - DNA, 21 bp, Homo sapiens
tcctcctgcctcagctactca

SEQ ID NO: 29696 - DNA, 20 bp, Homo sapiens
tgggcttccaacggagactg

SEQ ID NO: 29697 - DNA, 19 bp, Homo sapiens
aaatataaaggtgtttgct

SEQ ID NO: 29698 - DNA, 18 bp, Homo sapiens
accaaaacaaaatttgag

SEQ ID NO: 29699 - DNA, 24 bp, Homo sapiens
agcaagattggaaaatcaagaagg

SEQ ID NO: 29700 - DNA, 20 bp, Homo sapiens
gaaaatcaagaaggcattga

SEQ ID NO: 29701 - DNA, 19 bp, Homo sapiens
tacttgctcagtgctgtct

SEQ ID NO: 29702 - DNA, 20 bp, Homo sapiens
ttattagtgtttcattgata

SEQ ID NO: 29703 - DNA, 18 bp, Homo sapiens
gaggtccccaagatctcc

SEQ ID NO: 29704 - DNA, 23 bp, Homo sapiens
tgggtggcaggctgggcctagca

SEQ ID NO: 29705 - DNA, 24 bp, Homo sapiens
gctggtttgagggccaccactgca

SEQ ID NO: 29706 - DNA, 23 bp, Homo sapiens
tgagaggagagaaatacacgtct

SEQ ID NO: 29707 - DNA, 18 bp, Homo sapiens
ccgcaggggctcttggga

SEQ ID NO: 29708 - DNA, 19 bp, Homo sapiens
cacagtaaaagaattcctt

SEQ ID NO: 29709 - DNA, 16 bp, Homo sapiens
cctcacccaggagtca

SEQ ID NO: 29710 - DNA, 22 bp, Homo sapiens
ctggcttacaataaatgcccaa

SEQ ID NO: 29711 - DNA, 24 bp, Homo sapiens
cttctctgtgaaacactctacctt

SEQ ID NO: 29712 - DNA, 23 bp, Homo sapiens
gtttctgctgacttgcctggctt

SEQ ID NO: 29713 - DNA, 19 bp, Homo sapiens
agaggggatgagttgtgtg

SEQ ID NO: 29714 - DNA, 19 bp, Homo sapiens
gccgccgccgctgctcctc

SEQ ID NO: 29715 - DNA, 22 bp, Homo sapiens
gcctggcctgggccgtctgccc

SEQ ID NO: 29716 - DNA, 21 bp, Homo sapiens
gcccaggtggcctcctggccc

SEQ ID NO: 29717 - DNA, 19 bp, Homo sapiens
gtgagtgagtgtgtgtgtg

SEQ ID NO: 29718 - DNA, 23 bp, Homo sapiens
gtgtgtgtgggggggactcggct

SEQ ID NO: 29719 - DNA, 19 bp, Homo sapiens
gtgagtgagtgtgtgtgtg

SEQ ID NO: 29720 - DNA, 23 bp, Homo sapiens
gtgtgtgtgggggggactcggct

SEQ ID NO: 29721 - DNA, 21 bp, Homo sapiens
ccgcggatagcactggcgacc

SEQ ID NO: 29722 - DNA, 19 bp, Homo sapiens
gtgagtgagtgtgtgtgtg

SEQ ID NO: 29723 - DNA, 23 bp, Homo sapiens
gtgtgtgtgggggggactcggct

SEQ ID NO: 29724 - DNA, 18 bp, Homo sapiens
aatgaccacaaatgtagc

SEQ ID NO: 29725 - DNA, 22 bp, Homo sapiens
agcatgtttgttttcctctgtg

SEQ ID NO: 29726 - DNA, 17 bp, Homo sapiens
aggatggggagctggca

SEQ ID NO: 29727 - DNA, 19 bp, Homo sapiens
ccccactgacccccgctgc

SEQ ID NO: 29728 - DNA, 18 bp, Homo sapiens
cccccaaaacttgggctg

SEQ ID NO: 29729 - DNA, 22 bp, Homo sapiens
gcacctctctcctctgtcttca

SEQ ID NO: 29730 - DNA, 21 bp, Homo sapiens
gcctgtcctggctgctggccc

SEQ ID NO: 29731 - DNA, 24 bp, Homo sapiens
gcttttcttcctcccctgctctct

SEQ ID NO: 29732 - DNA, 19 bp, Homo sapiens
tcatgtggttgttgcagca

SEQ ID NO: 29733 - DNA, 21 bp, Homo sapiens
atagatgggttacaaatacat

SEQ ID NO: 29734 - DNA, 22 bp, Homo sapiens
caggattgtggacatttggtta

SEQ ID NO: 29735 - DNA, 24 bp, Homo sapiens
gtgttttggttaatcacaaatttt

SEQ ID NO: 29736 - DNA, 21 bp, Homo sapiens
agaaaggacatggccttcccc

SEQ ID NO: 29737 - DNA, 18 bp, Homo sapiens
gcctaccaagacactact

SEQ ID NO: 29738 - DNA, 18 bp, Homo sapiens
acagcccagcgagggtga

SEQ ID NO: 29739 - DNA, 18 bp, Homo sapiens
aggccgagtggactctca

SEQ ID NO: 29740 - DNA, 20 bp, Homo sapiens
ccctgtgcccggcccacctt

SEQ ID NO: 29741 - DNA, 21 bp, Homo sapiens
ctcccgaaggcctcacctctg

SEQ ID NO: 29742 - DNA, 20 bp, Homo sapiens
gcacggagcatgtggctggg

SEQ ID NO: 29743 - DNA, 21 bp, Homo sapiens
atcttggctcactgcaacctc

SEQ ID NO: 29744 - DNA, 18 bp, Homo sapiens
cctgcaacctccacctcc

SEQ ID NO: 29745 - DNA, 23 bp, Homo sapiens
taatcaagggagaaacccattac

SEQ ID NO: 29746 - DNA, 21 bp, Homo sapiens
tagtccagctctgtgatctga

SEQ ID NO: 29747 - DNA, 20 bp, Homo sapiens
acttttcttttccccctgta

SEQ ID NO: 29748 - DNA, 21 bp, Homo sapiens
ctccttctctctctctctctc

SEQ ID NO: 29749 - DNA, 19 bp, Homo sapiens
accaaagcgcccactggca

SEQ ID NO: 29750 - DNA, 22 bp, Homo sapiens
accgtttactctgcaaaactga

SEQ ID NO: 29751 - DNA, 23 bp, Homo sapiens
gccctggcccccacccctaagga

SEQ ID NO: 29752 - DNA, 19 bp, Homo sapiens
tcaccgtttactctgcaaa

SEQ ID NO: 29753 - DNA, 19 bp, Homo sapiens
tgcatcttgccaggctcct

SEQ ID NO: 29754 - DNA, 20 bp, Homo sapiens
gcctctgtctgtgaaagtca

SEQ ID NO: 29755 - DNA, 18 bp, Homo sapiens
tctgggtctgcctgactc

SEQ ID NO: 29756 - DNA, 16 bp, Homo sapiens
gagccacggaatctca

SEQ ID NO: 29757 - DNA, 18 bp, Homo sapiens
accacatatttccatctg

SEQ ID NO: 29758 - DNA, 18 bp, Homo sapiens
agcaattctcctgcctca

SEQ ID NO: 29759 - DNA, 20 bp, Homo sapiens
tttgggcagttctggaaact

SEQ ID NO: 29760 - DNA, 19 bp, Homo sapiens
cacagtaacctttatccaa

SEQ ID NO: 29761 - DNA, 20 bp, Homo sapiens
aacacatgcgcgcgcacaca

SEQ ID NO: 29762 - DNA, 17 bp, Homo sapiens
cttgaagagcaacatca

SEQ ID NO: 29763 - DNA, 22 bp, Homo sapiens
ctttggggaaggtgatttgtgg

SEQ ID NO: 29764 - DNA, 20 bp, Homo sapiens
ggagacggcagcggcatggc

SEQ ID NO: 29765 - DNA, 23 bp, Homo sapiens
ttctttggggaaggtgatttgtg

SEQ ID NO: 29766 - DNA, 18 bp, Homo sapiens
ccgtggaggaccaccctg

SEQ ID NO: 29767 - DNA, 19 bp, Homo sapiens
accaagccctctgctctga

SEQ ID NO: 29768 - DNA, 18 bp, Homo sapiens
cctgccactgccacagta

SEQ ID NO: 29769 - DNA, 18 bp, Homo sapiens
gaacagggacttgaacca

SEQ ID NO: 29770 - DNA, 19 bp, Homo sapiens
gtgtgtttgtcacttggtt

SEQ ID NO: 29771 - DNA, 17 bp, Homo sapiens
taggagcaaagtctctc

SEQ ID NO: 29772 - DNA, 22 bp, Homo sapiens
gatactgacaccaaatgccttt

SEQ ID NO: 29773 - DNA, 19 bp, Homo sapiens
cagaagaaaaataaagctt

SEQ ID NO: 29774 - DNA, 19 bp, Homo sapiens
taggaaatagaatttatga

SEQ ID NO: 29775 - DNA, 18 bp, Homo sapiens
ttaccaaatatataactt

SEQ ID NO: 29776 - DNA, 21 bp, Homo sapiens
ccctgtgctggaggtttgagg

SEQ ID NO: 29777 - DNA, 24 bp, Homo sapiens
gcttctctaaagcatcttacccct

SEQ ID NO: 29778 - DNA, 19 bp, Homo sapiens
tctaataataacatttaaa

SEQ ID NO: 29779 - DNA, 20 bp, Homo sapiens
aaaatctccagacattgcca

SEQ ID NO: 29780 - DNA, 19 bp, Homo sapiens
ccttcaggaagcctgtgaa

SEQ ID NO: 29781 - DNA, 27 bp, Homo sapiens
cggcgcgcgcagaatctcgtgctgctg

SEQ ID NO: 29782 - DNA, 24 bp, Homo sapiens
ggcacgatctgcaaactccgcctc

SEQ ID NO: 29783 - DNA, 21 bp, Homo sapiens
tacctgaaggtgactccgagt

SEQ ID NO: 29784 - DNA, 17 bp, Homo sapiens
tcaagtgattcttctgc

SEQ ID NO: 29785 - DNA, 20 bp, Homo sapiens
tggccaggctggtcttgaac

SEQ ID NO: 29786 - DNA, 20 bp, Homo sapiens
aacggtgaacacaagattca

SEQ ID NO: 29787 - DNA, 19 bp, Homo sapiens
attatggagattaaccact

SEQ ID NO: 29788 - DNA, 19 bp, Homo sapiens
taaacggggtgaggtcaca

SEQ ID NO: 29789 - DNA, 19 bp, Homo sapiens
tactgcagatttcaccctt

SEQ ID NO: 29790 - DNA, 22 bp, Homo sapiens
aaacggtgacctgaccacctca

SEQ ID NO: 29791 - DNA, 19 bp, Homo sapiens
ctccccatccaattaccta

SEQ ID NO: 29792 - DNA, 24 bp, Homo sapiens
gacaaagcttaactctttcaacca

SEQ ID NO: 29793 - DNA, 18 bp, Homo sapiens
gagtactttgggaagcca

SEQ ID NO: 29794 - DNA, 21 bp, Homo sapiens
ggatcttgccaccacattcca

SEQ ID NO: 29795 - DNA, 21 bp, Homo sapiens
tatttcaagtcagtgctcaaa

SEQ ID NO: 29796 - DNA, 21 bp, Homo sapiens
tgaatggaccctcttctaggc

SEQ ID NO: 29797 - DNA, 22 bp, Homo sapiens
atgcaaactgagggatattcta

SEQ ID NO: 29798 - DNA, 18 bp, Homo sapiens
tccatagaaaacactgga

SEQ ID NO: 29799 - DNA, 23 bp, Homo sapiens
cctccccgcaggtgatcatcctc

SEQ ID NO: 29800 - DNA, 17 bp, Homo sapiens
cttgaggttgcctggct

SEQ ID NO: 29801 - DNA, 19 bp, Homo sapiens
tttgatagcacaacagtgt

SEQ ID NO: 29802 - DNA, 23 bp, Homo sapiens
gaggaggatgactgggtccggtc

SEQ ID NO: 29803 - DNA, 22 bp, Homo sapiens
ctaatgtttcagaattactttt

SEQ ID NO: 29804 - DNA, 17 bp, Homo sapiens
aagtaatgctggacaca

SEQ ID NO: 29805 - DNA, 19 bp, Homo sapiens
agatcctggacttcatgta

SEQ ID NO: 29806 - DNA, 18 bp, Homo sapiens
cctggcccagcctgtgaa

SEQ ID NO: 29807 - DNA, 21 bp, Homo sapiens
aactaaattcatctcaaaatg

SEQ ID NO: 29808 - DNA, 24 bp, Homo sapiens
tcatctcaaaatgattataaatca

SEQ ID NO: 29809 - DNA, 18 bp, Homo sapiens
gacacgcaaattcgtgaa

SEQ ID NO: 29810 - DNA, 21 bp, Homo sapiens
ccacactttggttttccttca

SEQ ID NO: 29811 - DNA, 18 bp, Homo sapiens
ctgtatggacacttgctt

SEQ ID NO: 29812 - DNA, 18 bp, Homo sapiens
gtagtgactgtattcttg

SEQ ID NO: 29813 - DNA, 18 bp, Homo sapiens
ggccgaaggcttgttatg

SEQ ID NO: 29814 - DNA, 22 bp, Homo sapiens
aagctccatatttacagctata

SEQ ID NO: 29815 - DNA, 18 bp, Homo sapiens
ccatcacacccagtgctc

SEQ ID NO: 29816 - DNA, 25 bp, Homo sapiens
gtttaaaggctgtccaatcctctaa

SEQ ID NO: 29817 - DNA, 24 bp, Homo sapiens
accacaggtgtgtgtttccccttt

SEQ ID NO: 29818 - DNA, 18 bp, Homo sapiens
tgtggaagacatgccgac

SEQ ID NO: 29819 - DNA, 15 bp, Homo sapiens
aacgtttgtgccaac

SEQ ID NO: 29820 - DNA, 19 bp, Homo sapiens
cggtgagagaatgtttctg

SEQ ID NO: 29821 - DNA, 19 bp, Homo sapiens
aaactcctgacctcaggtg

SEQ ID NO: 29822 - DNA, 20 bp, Homo sapiens
agtctcactctgtcacacag

SEQ ID NO: 29823 - DNA, 21 bp, Homo sapiens
cagagtaccagggtctgtaga

SEQ ID NO: 29824 - DNA, 18 bp, Homo sapiens
caggataagccactgcac

SEQ ID NO: 29825 - DNA, 20 bp, Homo sapiens
tggccaggctggtcttgaac

SEQ ID NO: 29826 - DNA, 23 bp, Homo sapiens
cctctccctcaccaccatcatca

SEQ ID NO: 29827 - DNA, 24 bp, Homo sapiens
tcaccaccatcatcatcggctgct

SEQ ID NO: 29828 - DNA, 21 bp, Homo sapiens
tgcttcctcctttattgtatc

SEQ ID NO: 29829 - DNA, 15 bp, Homo sapiens
tccatatttagttgt

SEQ ID NO: 29830 - DNA, 21 bp, Homo sapiens
gaaactttcgaacaaaaccaa

SEQ ID NO: 29831 - DNA, 18 bp, Homo sapiens
gagagccgcgtctgtgta

SEQ ID NO: 29832 - DNA, 22 bp, Homo sapiens
gggcccccgccggcgcgctgca

SEQ ID NO: 29833 - DNA, 22 bp, Homo sapiens
tctttttgttcggttgctttgg

SEQ ID NO: 29834 - DNA, 22 bp, Homo sapiens
accattcacacctaaagactga

SEQ ID NO: 29835 - DNA, 21 bp, Homo sapiens
ccaggacgtggcggcagggga

SEQ ID NO: 29836 - DNA, 25 bp, Homo sapiens
gccgcggcggcggcggcggacggcc

SEQ ID NO: 29837 - DNA, 18 bp, Homo sapiens
caactcttcctcccctct

SEQ ID NO: 29838 - DNA, 18 bp, Homo sapiens
cctggggtggcctggccc

SEQ ID NO: 29839 - DNA, 15 bp, Homo sapiens
ctcttcctcccctct

SEQ ID NO: 29840 - DNA, 17 bp, Homo sapiens
gaggtcccgggcttagt

SEQ ID NO: 29841 - DNA, 20 bp, Homo sapiens
gggtggagatcaggtcccgg

SEQ ID NO: 29842 - DNA, 25 bp, Homo sapiens
gccacagggagggaggtcttgggga

SEQ ID NO: 29843 - DNA, 19 bp, Homo sapiens
ggggcaaccccctgcggtg

SEQ ID NO: 29844 - DNA, 22 bp, Homo sapiens
gggggaggaggcgaccctgtca

SEQ ID NO: 29845 - DNA, 18 bp, Homo sapiens
cagaacagctttcaccaa

SEQ ID NO: 29846 - DNA, 23 bp, Homo sapiens
ggcttagtatctttctcattaca

SEQ ID NO: 29847 - DNA, 21 bp, Homo sapiens
ccccccagcaagggactggac

SEQ ID NO: 29848 - DNA, 17 bp, Homo sapiens
tccttgcgagcccccca

SEQ ID NO: 29849 - DNA, 21 bp, Homo sapiens
cccatggcttcagaagagcta

SEQ ID NO: 29850 - DNA, 23 bp, Homo sapiens
taagtttgtgaaaatctacatta

SEQ ID NO: 29851 - DNA, 19 bp, Homo sapiens
ctgtgaagaatgctattga

SEQ ID NO: 29852 - DNA, 19 bp, Homo sapiens
gaattcattcactattgta

SEQ ID NO: 29853 - DNA, 19 bp, Homo sapiens
ggtgtttgaaaatttgcca

SEQ ID NO: 29854 - DNA, 21 bp, Homo sapiens
tcttgatccaaagtttgtgaa

SEQ ID NO: 29855 - DNA, 20 bp, Homo sapiens
tgtaaaggagtgctgtctta

SEQ ID NO: 29856 - DNA, 23 bp, Homo sapiens
ccaaactcatcctaaatctctca

SEQ ID NO: 29857 - DNA, 15 bp, Homo sapiens
gctggggagttttta

SEQ ID NO: 29858 - DNA, 16 bp, Homo sapiens
tccatattagttccca

SEQ ID NO: 29859 - DNA, 20 bp, Homo sapiens
cagatgggacaagaagccgc

SEQ ID NO: 29860 - DNA, 19 bp, Homo sapiens
ccctccccaacccactcca

SEQ ID NO: 29861 - DNA, 20 bp, Homo sapiens
ccctgaaacctgagacctgt

SEQ ID NO: 29862 - DNA, 17 bp, Homo sapiens
ctcccaccctctgcttc

SEQ ID NO: 29863 - DNA, 23 bp, Homo sapiens
gatgaggctttacctcagacaag

SEQ ID NO: 29864 - DNA, 15 bp, Homo sapiens
ggagagggacagagg

SEQ ID NO: 29865 - DNA, 23 bp, Homo sapiens
ggaggaggaaaagccacaagaga

SEQ ID NO: 29866 - DNA, 17 bp, Homo sapiens
tcatactggacagaaac

SEQ ID NO: 29867 - DNA, 17 bp, Homo sapiens
aagtcatcaagtaaaca

SEQ ID NO: 29868 - DNA, 20 bp, Homo sapiens
aggaaagagagttacacctt

SEQ ID NO: 29869 - DNA, 23 bp, Homo sapiens
caccacagcatctgcccctgcta

SEQ ID NO: 29870 - DNA, 21 bp, Homo sapiens
gtagctttaatgatttttgtt

SEQ ID NO: 29871 - DNA, 23 bp, Homo sapiens
gttcagcatgtttgcacttgtta

SEQ ID NO: 29872 - DNA, 18 bp, Homo sapiens
atgcccatacgcagcgta

SEQ ID NO: 29873 - DNA, 17 bp, Homo sapiens
cccagacaacagatgcc

SEQ ID NO: 29874 - DNA, 17 bp, Homo sapiens
gtagtttacagtattta

SEQ ID NO: 29875 - DNA, 19 bp, Homo sapiens
cagtctgggaaaaactgtg

SEQ ID NO: 29876 - DNA, 21 bp, Homo sapiens
acatcttcacacggcacgaca

SEQ ID NO: 29877 - DNA, 18 bp, Homo sapiens
cagagggagaaataagcc

SEQ ID NO: 29878 - DNA, 22 bp, Homo sapiens
cccagtgtcgcacggtgaagat

SEQ ID NO: 29879 - DNA, 24 bp, Homo sapiens
cccctctcgtggtcgttctggccc

SEQ ID NO: 29880 - DNA, 17 bp, Homo sapiens
ccctctgtcccctctgc

SEQ ID NO: 29881 - DNA, 22 bp, Homo sapiens
ccgtgtgtccttctgtggccgc

SEQ ID NO: 29882 - DNA, 19 bp, Homo sapiens
ctgcccctgccctgcctct

SEQ ID NO: 29883 - DNA, 19 bp, Homo sapiens
gcaaggagttgggtttgga

SEQ ID NO: 29884 - DNA, 21 bp, Homo sapiens
gccacggcagtcgcttggttt

SEQ ID NO: 29885 - DNA, 21 bp, Homo sapiens
gcctccgccctctcagcctgt

SEQ ID NO: 29886 - DNA, 21 bp, Homo sapiens
gcctctgtcctctcagcctgt

SEQ ID NO: 29887 - DNA, 21 bp, Homo sapiens
gtgctgtgggccagggaatcc

SEQ ID NO: 29888 - DNA, 17 bp, Homo sapiens
tggtatggctattcttg

SEQ ID NO: 29889 - DNA, 17 bp, Homo sapiens
cagtttggattgatgaa

SEQ ID NO: 29890 - DNA, 19 bp, Homo sapiens
ctccataccagacaaatga

SEQ ID NO: 29891 - DNA, 21 bp, Homo sapiens
ctggaagcaggggaggtacga

SEQ ID NO: 29892 - DNA, 18 bp, Homo sapiens
ctgtggtccagagactca

SEQ ID NO: 29893 - DNA, 17 bp, Homo sapiens
gagcccagaaagcctca

SEQ ID NO: 29894 - DNA, 20 bp, Homo sapiens
gccatccacaagggcccagt

SEQ ID NO: 29895 - DNA, 18 bp, Homo sapiens
ttccaggacctggcccag

SEQ ID NO: 29896 - DNA, 23 bp, Homo sapiens
tttaggtaataatgtattacttt

SEQ ID NO: 29897 - DNA, 19 bp, Homo sapiens
aaggtcacggtctagatca

SEQ ID NO: 29898 - DNA, 17 bp, Homo sapiens
agtaaatttggcttaca

SEQ ID NO: 29899 - DNA, 22 bp, Homo sapiens
tatgagaaatagaaacatttct

SEQ ID NO: 29900 - DNA, 20 bp, Homo sapiens
tcatacatacctacattcag

SEQ ID NO: 29901 - DNA, 17 bp, Homo sapiens
aaaaacaaacaaacgaa

SEQ ID NO: 29902 - DNA, 20 bp, Homo sapiens
gcgcgccaccacgcccagct

SEQ ID NO: 29903 - DNA, 18 bp, Homo sapiens
actgaaatcaaggcctca

SEQ ID NO: 29904 - DNA, 18 bp, Homo sapiens
actgaaatcaaggcctca

SEQ ID NO: 29905 - DNA, 22 bp, Homo sapiens
cacagagaaattatattcctta

SEQ ID NO: 29906 - DNA, 21 bp, Homo sapiens
tgagaattataattatatgaa

SEQ ID NO: 29907 - DNA, 21 bp, Homo sapiens
aaatgcagcatctgcgatgtg

SEQ ID NO: 29908 - DNA, 18 bp, Homo sapiens
agtggcacaacagtatgc

SEQ ID NO: 29909 - DNA, 21 bp, Homo sapiens
ttttgggattgtagcgtctgc

SEQ ID NO: 29910 - DNA, 18 bp, Homo sapiens
aaagattttatttagtaa

SEQ ID NO: 29911 - DNA, 19 bp, Homo sapiens
acctggagactctctgtta

SEQ ID NO: 29912 - DNA, 19 bp, Homo sapiens
actatgcgagtatataaca

SEQ ID NO: 29913 - DNA, 21 bp, Homo sapiens
cttcttagttgtcttgtcttt

SEQ ID NO: 29914 - DNA, 17 bp, Homo sapiens
gttcaggaaactcagtg

SEQ ID NO: 29915 - DNA, 17 bp, Homo sapiens
caagaacaatgacacca

SEQ ID NO: 29916 - DNA, 18 bp, Homo sapiens
caccatcttctattcaaa

SEQ ID NO: 29917 - DNA, 18 bp, Homo sapiens
cctacaccaagttaccta

SEQ ID NO: 29918 - DNA, 18 bp, Homo sapiens
ctacaagaacaatgacac

SEQ ID NO: 29919 - DNA, 19 bp, Homo sapiens
cttgaattcatgttggtct

SEQ ID NO: 29920 - DNA, 18 bp, Homo sapiens
tccgcctcccgggttcaa

SEQ ID NO: 29921 - DNA, 17 bp, Homo sapiens
ttctcctgcttcagctt

SEQ ID NO: 29922 - DNA, 22 bp, Homo sapiens
acggctgctcggcttgatcaca

SEQ ID NO: 29923 - DNA, 19 bp, Homo sapiens
tcctgtccgtgtttgttta

SEQ ID NO: 29924 - DNA, 17 bp, Homo sapiens
ttgcaaatgtcagtttc

SEQ ID NO: 29925 - DNA, 22 bp, Homo sapiens
caagaagtaggctgggcccggt

SEQ ID NO: 29926 - DNA, 22 bp, Homo sapiens
ctttggtggggtgggcttcgga

SEQ ID NO: 29927 - DNA, 17 bp, Homo sapiens
atgcagtttgggcattt

SEQ ID NO: 29928 - DNA, 22 bp, Homo sapiens
taaaacatgtaaaaggatttgg

SEQ ID NO: 29929 - DNA, 22 bp, Homo sapiens
tttcaactgtaatcagttaata

SEQ ID NO: 29930 - DNA, 18 bp, Homo sapiens
agccagggagagtgagtc

SEQ ID NO: 29931 - DNA, 18 bp, Homo sapiens
cagccccaccaggcctca

SEQ ID NO: 29932 - DNA, 23 bp, Homo sapiens
cagccccaccaggcctcatttca

SEQ ID NO: 29933 - DNA, 19 bp, Homo sapiens
cgagagggactattaccca

SEQ ID NO: 29934 - DNA, 16 bp, Homo sapiens
ctgagcaaaactgcag

SEQ ID NO: 29935 - DNA, 16 bp, Homo sapiens
gagtgagtcccccaga

SEQ ID NO: 29936 - DNA, 20 bp, Homo sapiens
ggagacaaccacagatccta

SEQ ID NO: 29937 - DNA, 20 bp, Homo sapiens
taaggttatgattgaatcta

SEQ ID NO: 29938 - DNA, 25 bp, Homo sapiens
ttgttggtatggttgtttttgtttt

SEQ ID NO: 29939 - DNA, 21 bp, Homo sapiens
aaatcttgaaaagggtttctg

SEQ ID NO: 29940 - DNA, 22 bp, Homo sapiens
taggtatttttaaattgttttt

SEQ ID NO: 29941 - DNA, 20 bp, Homo sapiens
atagtgaataatttgatcaa

SEQ ID NO: 29942 - DNA, 18 bp, Homo sapiens
tcgtcttcctgggcttca

SEQ ID NO: 29943 - DNA, 19 bp, Homo sapiens
acatgaaacttttcatgaa

SEQ ID NO: 29944 - DNA, 18 bp, Homo sapiens
tggtcttagcctgtagac

SEQ ID NO: 29945 - DNA, 20 bp, Homo sapiens
ttttttgctgctatggtctt

SEQ ID NO: 29946 - DNA, 23 bp, Homo sapiens
ccttagttgctggctttgacctt

SEQ ID NO: 29947 - DNA, 21 bp, Homo sapiens
caaccctccctgctaacccct

SEQ ID NO: 29948 - DNA, 21 bp, Homo sapiens
ccaccgccaccatgaccgcca

SEQ ID NO: 29949 - DNA, 17 bp, Homo sapiens
cgggtctgcccgctgca

SEQ ID NO: 29950 - DNA, 20 bp, Homo sapiens
cgtccccgacatgcatctca

SEQ ID NO: 29951 - DNA, 22 bp, Homo sapiens
gccacctcctcccagcccccca

SEQ ID NO: 29952 - DNA, 22 bp, Homo sapiens
gcccccttgcctttcaaactgg

SEQ ID NO: 29953 - DNA, 24 bp, Homo sapiens
gcctgggctgcggatgcctgggcc

SEQ ID NO: 29954 - DNA, 19 bp, Homo sapiens
ggcaagcccccttgccttt

SEQ ID NO: 29955 - DNA, 20 bp, Homo sapiens
cacctcttctcaggcacccc

SEQ ID NO: 29956 - DNA, 26 bp, Homo sapiens
tattcctagcaaaataaaatctctaa

SEQ ID NO: 29957 - DNA, 22 bp, Homo sapiens
tccttctggtatatgcatgtca

SEQ ID NO: 29958 - DNA, 26 bp, Homo sapiens
tcgctccttctggtatatgcatgtca

SEQ ID NO: 29959 - DNA, 22 bp, Homo sapiens
tctaagaaatctatgttcctga

SEQ ID NO: 29960 - DNA, 23 bp, Homo sapiens
tgaaattcttcaccaacatttca

SEQ ID NO: 29961 - DNA, 18 bp, Homo sapiens
ttttggtggtggataaat

SEQ ID NO: 29962 - DNA, 20 bp, Homo sapiens
agttttcttttcatcccagc

SEQ ID NO: 29963 - DNA, 22 bp, Homo sapiens
ccaaacagagcatgaggaacca

SEQ ID NO: 29964 - DNA, 18 bp, Homo sapiens
agttggtgcatctagaaa

SEQ ID NO: 29965 - DNA, 20 bp, Homo sapiens
catcctcttccattaaccag

SEQ ID NO: 29966 - DNA, 19 bp, Homo sapiens
catctccgcatcgcatcct

SEQ ID NO: 29967 - DNA, 19 bp, Homo sapiens
gcatcctcttccattaacc

SEQ ID NO: 29968 - DNA, 21 bp, Homo sapiens
gccagtgcggctgccaggttc

SEQ ID NO: 29969 - DNA, 18 bp, Homo sapiens
ggccagccgcccacttcc

SEQ ID NO: 29970 - DNA, 25 bp, Homo sapiens
tccattaaccagtggccggttgcca

SEQ ID NO: 29971 - DNA, 19 bp, Homo sapiens
atggtcttgggcaaacata

SEQ ID NO: 29972 - DNA, 19 bp, Homo sapiens
cctatgaactaatgacaac

SEQ ID NO: 29973 - DNA, 19 bp, Homo sapiens
gaatttgtgacgaaagctg

SEQ ID NO: 29974 - DNA, 20 bp, Homo sapiens
gggatttaatatattttgaa

SEQ ID NO: 29975 - DNA, 19 bp, Homo sapiens
gtcgatgtgcatgctttta

SEQ ID NO: 29976 - DNA, 20 bp, Homo sapiens
tgagtgggcttcaccagcta

SEQ ID NO: 29977 - DNA, 18 bp, Homo sapiens
cccggcttgaaaacttca

SEQ ID NO: 29978 - DNA, 17 bp, Homo sapiens
tgaagagatggttcaga

SEQ ID NO: 29979 - DNA, 19 bp, Homo sapiens
caccctagtccagcagctc

SEQ ID NO: 29980 - DNA, 22 bp, Homo sapiens
acactgcagtcagatcctgtta

SEQ ID NO: 29981 - DNA, 21 bp, Homo sapiens
agactagccactcctgccagg

SEQ ID NO: 29982 - DNA, 21 bp, Homo sapiens
acacctaggtctgagaactca

SEQ ID NO: 29983 - DNA, 18 bp, Homo sapiens
atcctggtctgcacctct

SEQ ID NO: 29984 - DNA, 18 bp, Homo sapiens
cttcctcctagcaaccaa

SEQ ID NO: 29985 - DNA, 23 bp, Homo sapiens
tgaatggactttactagtggggc

SEQ ID NO: 29986 - DNA, 18 bp, Homo sapiens
actgtcccttggactcca

SEQ ID NO: 29987 - DNA, 20 bp, Homo sapiens
agaaataaacgcattctgtc

SEQ ID NO: 29988 - DNA, 20 bp, Homo sapiens
agtctcactctgttgcccag

SEQ ID NO: 29989 - DNA, 19 bp, Homo sapiens
cagtcttcaggacaccatt

SEQ ID NO: 29990 - DNA, 23 bp, Homo sapiens
cggcagcttctgacgctgggcca

SEQ ID NO: 29991 - DNA, 18 bp, Homo sapiens
tgcggaaccaggcttctt

SEQ ID NO: 29992 - DNA, 20 bp, Homo sapiens
ttttgtagaacacaacagtg

SEQ ID NO: 29993 - DNA, 18 bp, Homo sapiens
cacagacccccttgctcc

SEQ ID NO: 29994 - DNA, 18 bp, Homo sapiens
ccacccctccccgcattg

SEQ ID NO: 29995 - DNA, 17 bp, Homo sapiens
ctttgccactgtccttg

SEQ ID NO: 29996 - DNA, 22 bp, Homo sapiens
ttttttatatttgccactgtta

SEQ ID NO: 29997 - DNA, 21 bp, Homo sapiens
cttgctgctggggtcattttt

SEQ ID NO: 29998 - DNA, 16 bp, Homo sapiens
gcaaatatctccctct

SEQ ID NO: 29999 - DNA, 15 bp, Homo sapiens
tatctcaggagcccc

SEQ ID NO: 30000 - DNA, 21 bp, Homo sapiens
ttctggacactcaaacacatc

SEQ ID NO: 30001 - DNA, 17 bp, Homo sapiens
accccacccccacctct

SEQ ID NO: 30002 - DNA, 20 bp, Homo sapiens
agggtcccacccctcacccc

SEQ ID NO: 30003 - DNA, 19 bp, Homo sapiens
ctagggagcccgtcctcca

SEQ ID NO: 30004 - DNA, 24 bp, Homo sapiens
caagaaacacttgctgaatctgca

SEQ ID NO: 30005 - DNA, 20 bp, Homo sapiens
ccaattctaaatgccctgga

SEQ ID NO: 30006 - DNA, 18 bp, Homo sapiens
gttactctgtgtttgctg

SEQ ID NO: 30007 - DNA, 20 bp, Homo sapiens
tgtcgccaaagcccatggtg

SEQ ID NO: 30008 - DNA, 18 bp, Homo sapiens
ttactgcgggccgctccg

SEQ ID NO: 30009 - DNA, 24 bp, Homo sapiens
acttgagaaattaccttttggttt

SEQ ID NO: 30010 - DNA, 18 bp, Homo sapiens
cctgtaatcccaatactg

SEQ ID NO: 30011 - DNA, 19 bp, Homo sapiens
ctgtttttcagaaccctca

SEQ ID NO: 30012 - DNA, 21 bp, Homo sapiens
ttctgcccttctttgctttgg

SEQ ID NO: 30013 - DNA, 20 bp, Homo sapiens
ccatccccagcctccacccc

SEQ ID NO: 30014 - DNA, 18 bp, Homo sapiens
cccactgcctcccctgtt

SEQ ID NO: 30015 - DNA, 21 bp, Homo sapiens
ctatcccatccccagcctcca

SEQ ID NO: 30016 - DNA, 18 bp, Homo sapiens
ctggccctcaattagcta

SEQ ID NO: 30017 - DNA, 23 bp, Homo sapiens
ccttcccctgtggccactttcca

SEQ ID NO: 30018 - DNA, 19 bp, Homo sapiens
ctccccatgtacccaagga

SEQ ID NO: 30019 - DNA, 19 bp, Homo sapiens
ctgttttggcaagacccca

SEQ ID NO: 30020 - DNA, 18 bp, Homo sapiens
tgcccagaccccattcca

SEQ ID NO: 30021 - DNA, 18 bp, Homo sapiens
atcctgaatgaacagtgg

SEQ ID NO: 30022 - DNA, 17 bp, Homo sapiens
cttcccctcctccttcc

SEQ ID NO: 30023 - DNA, 21 bp, Homo sapiens
gagaaaggggccgtggtcagc

SEQ ID NO: 30024 - DNA, 23 bp, Homo sapiens
gcctggatttgtatccttggctt

SEQ ID NO: 30025 - DNA, 18 bp, Homo sapiens
ggccaggcacccccaggg

SEQ ID NO: 30026 - DNA, 21 bp, Homo sapiens
ccttttcattctccttgcttt

SEQ ID NO: 30027 - DNA, 24 bp, Homo sapiens
agtcagagatcttggtatgggctg

SEQ ID NO: 30028 - DNA, 21 bp, Homo sapiens
ccattttctctattctttcca

SEQ ID NO: 30029 - DNA, 19 bp, Homo sapiens
agtgttttctttttgggta

SEQ ID NO: 30030 - DNA, 20 bp, Homo sapiens
cagcagcagcagcaacacca

SEQ ID NO: 30031 - DNA, 20 bp, Homo sapiens
cgcccccgcccgcgccccct

SEQ ID NO: 30032 - DNA, 21 bp, Homo sapiens
ctttttgggtacgtattgttt

SEQ ID NO: 30033 - DNA, 18 bp, Homo sapiens
ggcatcctcaggagcccc

SEQ ID NO: 30034 - DNA, 18 bp, Homo sapiens
ggggtcaatgtgatgctg

SEQ ID NO: 30035 - DNA, 25 bp, Homo sapiens
gtgtttggaaacatctgtggactct

SEQ ID NO: 30036 - DNA, 21 bp, Homo sapiens
aatggtcacagaatgcctttt

SEQ ID NO: 30037 - DNA, 20 bp, Homo sapiens
ctgtgatttctgttttgttt

SEQ ID NO: 30038 - DNA, 24 bp, Homo sapiens
actcggagatgctaaactgtctta

SEQ ID NO: 30039 - DNA, 19 bp, Homo sapiens
actgcaagggcattttcca

SEQ ID NO: 30040 - DNA, 17 bp, Homo sapiens
acttaattggaaaacac

SEQ ID NO: 30041 - DNA, 19 bp, Homo sapiens
cagggttgggtggctcagt

SEQ ID NO: 30042 - DNA, 20 bp, Homo sapiens
cctcggcctgggcaccctca

SEQ ID NO: 30043 - DNA, 18 bp, Homo sapiens
cctgctgaggggaagcca

SEQ ID NO: 30044 - DNA, 21 bp, Homo sapiens
ctggaagcctgaccctctggt

SEQ ID NO: 30045 - DNA, 23 bp, Homo sapiens
gagggtcccacagacgtaacctg

SEQ ID NO: 30046 - DNA, 25 bp, Homo sapiens
gcctggaagcctgaccctctggttc

SEQ ID NO: 30047 - DNA, 18 bp, Homo sapiens
gcttgggggtgctgcttg

SEQ ID NO: 30048 - DNA, 22 bp, Homo sapiens
tcgtaacaaaacaacgtcccct

SEQ ID NO: 30049 - DNA, 17 bp, Homo sapiens
tttgaaccggtctgtct

SEQ ID NO: 30050 - DNA, 20 bp, Homo sapiens
agctcctcagtcaacaaaca

SEQ ID NO: 30051 - DNA, 21 bp, Homo sapiens
gagacaagacttctctgttta

SEQ ID NO: 30052 - DNA, 19 bp, Homo sapiens
gcaccaatctactgtgaga

SEQ ID NO: 30053 - DNA, 17 bp, Homo sapiens
atgtttgcagagtattt

SEQ ID NO: 30054 - DNA, 18 bp, Homo sapiens
cagcacccagacaagcca

SEQ ID NO: 30055 - DNA, 20 bp, Homo sapiens
ctccctccactccatctggt

SEQ ID NO: 30056 - DNA, 17 bp, Homo sapiens
tgttattgtgtattgcc

SEQ ID NO: 30057 - DNA, 24 bp, Homo sapiens
aggctgctgtcccggcgggagctg

SEQ ID NO: 30058 - DNA, 22 bp, Homo sapiens
gcccctctgctgcgtctgccct

SEQ ID NO: 30059 - DNA, 20 bp, Homo sapiens
agtaagaggactactcagca

SEQ ID NO: 30060 - DNA, 20 bp, Homo sapiens
cccagaagattagcatgcca

SEQ ID NO: 30061 - DNA, 23 bp, Homo sapiens
tgggtgggctctgatgcagaact

SEQ ID NO: 30062 - DNA, 19 bp, Homo sapiens
caaacagagaaggaaccca

SEQ ID NO: 30063 - DNA, 23 bp, Homo sapiens
cctcacccttgggctttgctgcc

SEQ ID NO: 30064 - DNA, 23 bp, Homo sapiens
ccttccctgccccaactccctcc

SEQ ID NO: 30065 - DNA, 21 bp, Homo sapiens
tccctgctcctaacccctgcc

SEQ ID NO: 30066 - DNA, 19 bp, Homo sapiens
tgtcaccacctgaacattc

SEQ ID NO: 30067 - DNA, 17 bp, Homo sapiens
tctcaccccaccccacc

SEQ ID NO: 30068 - DNA, 23 bp, Homo sapiens
tgggaacaatggaaaaaattaca

SEQ ID NO: 30069 - DNA, 18 bp, Homo sapiens
ttcattttgactgttcca

SEQ ID NO: 30070 - DNA, 16 bp, Homo sapiens
ggctttaccttttgat

SEQ ID NO: 30071 - DNA, 21 bp, Homo sapiens
tatgctggaaacattatccca

SEQ ID NO: 30072 - DNA, 19 bp, Homo sapiens
gatgttccccatattgtga

SEQ ID NO: 30073 - DNA, 19 bp, Homo sapiens
ttcaggcagccggtgcaca

SEQ ID NO: 30074 - DNA, 21 bp, Homo sapiens
aactgatgtttacaaaccaga

SEQ ID NO: 30075 - DNA, 15 bp, Homo sapiens
aggtacccagtgata

SEQ ID NO: 30076 - DNA, 22 bp, Homo sapiens
tctgctggaaactcctgaagag

SEQ ID NO: 30077 - DNA, 23 bp, Homo sapiens
ttaccatgtttcatcttggcata

SEQ ID NO: 30078 - DNA, 18 bp, Homo sapiens
aagtttctccagatttct

SEQ ID NO: 30079 - DNA, 24 bp, Homo sapiens
atccttagcccccatatctggctg

SEQ ID NO: 30080 - DNA, 18 bp, Homo sapiens
atgtacttgggcatctca

SEQ ID NO: 30081 - DNA, 21 bp, Homo sapiens
ccagtgcgcttcctctgttcc

SEQ ID NO: 30082 - DNA, 18 bp, Homo sapiens
cccgctggcagccaggca

SEQ ID NO: 30083 - DNA, 17 bp, Homo sapiens
gcagctgcttctgcccc

SEQ ID NO: 30084 - DNA, 21 bp, Homo sapiens
gccccctgccacccctcccca

SEQ ID NO: 30085 - DNA, 18 bp, Homo sapiens
tcctacctcccctgcctg

SEQ ID NO: 30086 - DNA, 19 bp, Homo sapiens
cctccccgctcccacctcc

SEQ ID NO: 30087 - DNA, 24 bp, Homo sapiens
caacaacaataataaagatgtgaa

SEQ ID NO: 30088 - DNA, 21 bp, Homo sapiens
gctgtcccctcagcgggggcc

SEQ ID NO: 30089 - DNA, 20 bp, Homo sapiens
acggcccgcctatcattagc

SEQ ID NO: 30090 - DNA, 19 bp, Homo sapiens
cccccgtccctatcggcag

SEQ ID NO: 30091 - DNA, 18 bp, Homo sapiens
agaaacgggaagccacta

SEQ ID NO: 30092 - DNA, 24 bp, Homo sapiens
catgtacctctggtgtgtcaggga

SEQ ID NO: 30093 - DNA, 20 bp, Homo sapiens
cttcctaccgggattaccta

SEQ ID NO: 30094 - DNA, 21 bp, Homo sapiens
gtaagttttattttgaagtgt

SEQ ID NO: 30095 - DNA, 21 bp, Homo sapiens
taatgtcttctatatgtaata

SEQ ID NO: 30096 - DNA, 15 bp, Homo sapiens
tctggcctcccattc

SEQ ID NO: 30097 - DNA, 24 bp, Homo sapiens
aaagaacggcgtcattgcctgtca

SEQ ID NO: 30098 - DNA, 22 bp, Homo sapiens
atttgaacagatgttttggctc

SEQ ID NO: 30099 - DNA, 18 bp, Homo sapiens
ggtgccgccgcccgcccc

SEQ ID NO: 30100 - DNA, 20 bp, Homo sapiens
taggaaatgccagcactccc

SEQ ID NO: 30101 - DNA, 18 bp, Homo sapiens
tctccagcgatcttccca

SEQ ID NO: 30102 - DNA, 18 bp, Homo sapiens
acacaggacccagtctgc

SEQ ID NO: 30103 - DNA, 18 bp, Homo sapiens
ccctgttcccagcactca

SEQ ID NO: 30104 - DNA, 18 bp, Homo sapiens
cccttgcttgactcagtt

SEQ ID NO: 30105 - DNA, 21 bp, Homo sapiens
gcgccttcgggcgtggactct

SEQ ID NO: 30106 - DNA, 19 bp, Homo sapiens
tcgcggcccacaagcatcc

SEQ ID NO: 30107 - DNA, 18 bp, Homo sapiens
ccttcctcacacatccct

SEQ ID NO: 30108 - DNA, 21 bp, Homo sapiens
ccttcccctccactcccttcc

SEQ ID NO: 30109 - DNA, 22 bp, Homo sapiens
gcaatgtaccacaaaccgagtg

SEQ ID NO: 30110 - DNA, 24 bp, Homo sapiens
ataggactgatggaaatgatttca

SEQ ID NO: 30111 - DNA, 18 bp, Homo sapiens
gcggcgtcccggctgcta

SEQ ID NO: 30112 - DNA, 19 bp, Homo sapiens
aagtgaaactgggctttaa

SEQ ID NO: 30113 - DNA, 22 bp, Homo sapiens
tcttgctaccagcaataaatca

SEQ ID NO: 30114 - DNA, 21 bp, Homo sapiens
tggccactcttgatgtgaggc

SEQ ID NO: 30115 - DNA, 20 bp, Homo sapiens
ccccaggcgtcaggaactgc

SEQ ID NO: 30116 - DNA, 16 bp, Homo sapiens
atattgtgcttaaatt

SEQ ID NO: 30117 - DNA, 17 bp, Homo sapiens
ccataaggtgcagtagg

SEQ ID NO: 30118 - DNA, 20 bp, Homo sapiens
catctggagcacttgtttta

SEQ ID NO: 30119 - DNA, 26 bp, Homo sapiens
cctgccatccagttttggatcttttt

SEQ ID NO: 30120 - DNA, 22 bp, Homo sapiens
tcctaagaacaatgccaacaaa

SEQ ID NO: 30121 - DNA, 26 bp, Homo sapiens
tcttgatcgttgtggaaggtttggag

SEQ ID NO: 30122 - DNA, 16 bp, Homo sapiens
ttatcttgtcattgcc

SEQ ID NO: 30123 - DNA, 21 bp, Homo sapiens
attaaaatgctaaatattgca

SEQ ID NO: 30124 - DNA, 20 bp, Homo sapiens
cagactgtcacttgctgtta

SEQ ID NO: 30125 - DNA, 20 bp, Homo sapiens
ctttactactgtaaacagta

SEQ ID NO: 30126 - DNA, 18 bp, Homo sapiens
tgaggcccaggacccacc

SEQ ID NO: 30127 - DNA, 18 bp, Homo sapiens
ttgcctctcccctgctca

SEQ ID NO: 30128 - DNA, 22 bp, Homo sapiens
tttctcatttggtaatggtgtt

SEQ ID NO: 30129 - DNA, 18 bp, Homo sapiens
caggcaacctcccatccc

SEQ ID NO: 30130 - DNA, 20 bp, Homo sapiens
cacctcccccccaccaactc

SEQ ID NO: 30131 - DNA, 18 bp, Homo sapiens
catcacccacctcattga

SEQ ID NO: 30132 - DNA, 19 bp, Homo sapiens
acctcctactaccaccaca

SEQ ID NO: 30133 - DNA, 22 bp, Homo sapiens
caagtgtgccctcctctcttct

SEQ ID NO: 30134 - DNA, 25 bp, Homo sapiens
tggcccccaatggtcagaagagcca

SEQ ID NO: 30135 - DNA, 17 bp, Homo sapiens
ttccttccaatacccca

SEQ ID NO: 30136 - DNA, 19 bp, Homo sapiens
acacagctagctcctcatc

SEQ ID NO: 30137 - DNA, 16 bp, Homo sapiens
accactgactcttgct

SEQ ID NO: 30138 - DNA, 17 bp, Homo sapiens
actgactcttgctctgg

SEQ ID NO: 30139 - DNA, 21 bp, Homo sapiens
agtacacacagctagctcctc

SEQ ID NO: 30140 - DNA, 19 bp, Homo sapiens
cagagccaacaggctatat

SEQ ID NO: 30141 - DNA, 18 bp, Homo sapiens
ctgtggttatgttgtttt

SEQ ID NO: 30142 - DNA, 22 bp, Homo sapiens
gaacaattttaagaaaataaca

SEQ ID NO: 30143 - DNA, 19 bp, Homo sapiens
gccctaaccacttcttaca

SEQ ID NO: 30144 - DNA, 17 bp, Homo sapiens
gcttggactccatttta

SEQ ID NO: 30145 - DNA, 19 bp, Homo sapiens
tgtatatgtttgaaatttt

SEQ ID NO: 30146 - DNA, 19 bp, Homo sapiens
tgtatcaggtgtttcagaa

SEQ ID NO: 30147 - DNA, 17 bp, Homo sapiens
gtattgttacagctgaa

SEQ ID NO: 30148 - DNA, 21 bp, Homo sapiens
tcaaaatctttagaatagtta

SEQ ID NO: 30149 - DNA, 21 bp, Homo sapiens
tctccagctgattttaacttt

SEQ ID NO: 30150 - DNA, 18 bp, Homo sapiens
cacactgctaagatttca

SEQ ID NO: 30151 - DNA, 18 bp, Homo sapiens
catatgtatgtagatatg

SEQ ID NO: 30152 - DNA, 19 bp, Homo sapiens
tcttaccatttccctaaca

SEQ ID NO: 30153 - DNA, 18 bp, Homo sapiens
taagtacacacaaacaaa

SEQ ID NO: 30154 - DNA, 17 bp, Homo sapiens
aaacagacaaacaagaa

SEQ ID NO: 30155 - DNA, 22 bp, Homo sapiens
aaagaaagtctccagaccagga

SEQ ID NO: 30156 - DNA, 21 bp, Homo sapiens
agctgacacttctgaaactca

SEQ ID NO: 30157 - DNA, 18 bp, Homo sapiens
cctccttgcaatgggctg

SEQ ID NO: 30158 - DNA, 22 bp, Homo sapiens
ccccacccactccctacagtcc

SEQ ID NO: 30159 - DNA, 20 bp, Homo sapiens
ccggggtcctcccagggctg

SEQ ID NO: 30160 - DNA, 20 bp, Homo sapiens
ctgcccccaatgccccgagg

SEQ ID NO: 30161 - DNA, 21 bp, Homo sapiens
ttctgacccactgggatttgc

SEQ ID NO: 30162 - DNA, 19 bp, Homo sapiens
ttcaggctggctatgaact

SEQ ID NO: 30163 - DNA, 19 bp, Homo sapiens
tggcagggcctagctgcta

SEQ ID NO: 30164 - DNA, 20 bp, Homo sapiens
atgtgaatttaagtgtgaaa

SEQ ID NO: 30165 - DNA, 21 bp, Homo sapiens
ttggcagtgtcatctctgaga

SEQ ID NO: 30166 - DNA, 21 bp, Homo sapiens
agaaaattcagctgattactg

SEQ ID NO: 30167 - DNA, 21 bp, Homo sapiens
actgtaaaaatcacctgcaca

SEQ ID NO: 30168 - DNA, 19 bp, Homo sapiens
tacaaaagcaaattttgca

SEQ ID NO: 30169 - DNA, 18 bp, Homo sapiens
ttctgtctttctggttcc

SEQ ID NO: 30170 - DNA, 19 bp, Homo sapiens
aagcaattctcctgcctca

SEQ ID NO: 30171 - DNA, 18 bp, Homo sapiens
aatttgacttttgttcca

SEQ ID NO: 30172 - DNA, 23 bp, Homo sapiens
agaaaaaagaaagcagaagagcc

SEQ ID NO: 30173 - DNA, 18 bp, Homo sapiens
agagctgaaaaactacct

SEQ ID NO: 30174 - DNA, 17 bp, Homo sapiens
agctggacaaatgtcat

SEQ ID NO: 30175 - DNA, 18 bp, Homo sapiens
cccccaaatcctgttcca

SEQ ID NO: 30176 - DNA, 18 bp, Homo sapiens
aattttgcagaattcctc

SEQ ID NO: 30177 - DNA, 23 bp, Homo sapiens
agtattcttgatcctgtgtttca

SEQ ID NO: 30178 - DNA, 18 bp, Homo sapiens
gtaacaagcacactattt

SEQ ID NO: 30179 - DNA, 18 bp, Homo sapiens
attgtatgtactattgta

SEQ ID NO: 30180 - DNA, 23 bp, Homo sapiens
acttgaacaatttgatttggctt

SEQ ID NO: 30181 - DNA, 17 bp, Homo sapiens
aggaagcctggaattca

SEQ ID NO: 30182 - DNA, 21 bp, Homo sapiens
ccactaatttgcccacaacaa

SEQ ID NO: 30183 - DNA, 24 bp, Homo sapiens
taaatggatataggattgaagtta

SEQ ID NO: 30184 - DNA, 21 bp, Homo sapiens
ttaaagcaagattcaattcct

SEQ ID NO: 30185 - DNA, 22 bp, Homo sapiens
atgtcatagaaatattgactca

SEQ ID NO: 30186 - DNA, 18 bp, Homo sapiens
agataaaacagacatcca

SEQ ID NO: 30187 - DNA, 22 bp, Homo sapiens
ctggaaaggaacaagtgcctcg

SEQ ID NO: 30188 - DNA, 18 bp, Homo sapiens
gaacagttctgcaaaata

SEQ ID NO: 30189 - DNA, 18 bp, Homo sapiens
gaaacccgcatggaatta

SEQ ID NO: 30190 - DNA, 22 bp, Homo sapiens
ggaaagaggctccagcatgggg

SEQ ID NO: 30191 - DNA, 16 bp, Homo sapiens
ggtgctgaccttgcca

SEQ ID NO: 30192 - DNA, 19 bp, Homo sapiens
ggaaagagagaaaatcact

SEQ ID NO: 30193 - DNA, 18 bp, Homo sapiens
tctcctgctttgtgcctt

SEQ ID NO: 30194 - DNA, 22 bp, Homo sapiens
tggcctcaatgccctcctttat

SEQ ID NO: 30195 - DNA, 22 bp, Homo sapiens
cctgacttgggaggccggcgga

SEQ ID NO: 30196 - DNA, 19 bp, Homo sapiens
gcccaggcccagggcccca

SEQ ID NO: 30197 - DNA, 18 bp, Homo sapiens
ctgcccggctgccacccc

SEQ ID NO: 30198 - DNA, 20 bp, Homo sapiens
gagcgcctctgccccgccgc

SEQ ID NO: 30199 - DNA, 20 bp, Homo sapiens
ggctgccatcccgtctagga

SEQ ID NO: 30200 - DNA, 22 bp, Homo sapiens
tctgtgtgctgctgtctggctc

SEQ ID NO: 30201 - DNA, 19 bp, Homo sapiens
agcatggcctgggatctca

SEQ ID NO: 30202 - DNA, 17 bp, Homo sapiens
cccagacacaccatctc

SEQ ID NO: 30203 - DNA, 22 bp, Homo sapiens
acagcgagaactgcactacctt

SEQ ID NO: 30204 - DNA, 18 bp, Homo sapiens
cgctgagcgccgtggcca

SEQ ID NO: 30205 - DNA, 24 bp, Homo sapiens
gagctgcgggaacaccgagacccc

SEQ ID NO: 30206 - DNA, 23 bp, Homo sapiens
tctggacgagccttgcctgacct

SEQ ID NO: 30207 - DNA, 24 bp, Homo sapiens
gaacactcaaaattccagcaatga

SEQ ID NO: 30208 - DNA, 23 bp, Homo sapiens
tgttaaaatcaggatttttagtg

SEQ ID NO: 30209 - DNA, 19 bp, Homo sapiens
caaatcacgcatctctact

SEQ ID NO: 30210 - DNA, 20 bp, Homo sapiens
gcagtgccccacttcatgga

SEQ ID NO: 30211 - DNA, 22 bp, Homo sapiens
gagcaccctccctgcccgtctt

SEQ ID NO: 30212 - DNA, 16 bp, Homo sapiens
atatgttagatacaca

SEQ ID NO: 30213 - DNA, 15 bp, Homo sapiens
atcatatgttagata

SEQ ID NO: 30214 - DNA, 18 bp, Homo sapiens
accagagagactcaagca

SEQ ID NO: 30215 - DNA, 18 bp, Homo sapiens
agagctacacagaggtga

SEQ ID NO: 30216 - DNA, 18 bp, Homo sapiens
ggtggcaggaggtatgtc

SEQ ID NO: 30217 - DNA, 18 bp, Homo sapiens
ttttccccttgcatatca

SEQ ID NO: 30218 - DNA, 20 bp, Homo sapiens
cctctgcctcctgggttcaa

SEQ ID NO: 30219 - DNA, 20 bp, Homo sapiens
cgcccccaggccacctgctc

SEQ ID NO: 30220 - DNA, 21 bp, Homo sapiens
ctcctcaggactgcagcactg

SEQ ID NO: 30221 - DNA, 22 bp, Homo sapiens
gaaggtcatccaagtttcctcc

SEQ ID NO: 30222 - DNA, 22 bp, Homo sapiens
gcccccaggccacctgctccgg

SEQ ID NO: 30223 - DNA, 22 bp, Homo sapiens
gttccgcacgatccggaaccca

SEQ ID NO: 30224 - DNA, 17 bp, Homo sapiens
accagagagctgctggg

SEQ ID NO: 30225 - DNA, 17 bp, Homo sapiens
atattgatttctgcctt

SEQ ID NO: 30226 - DNA, 19 bp, Homo sapiens
atggtgccaatggaacctc

SEQ ID NO: 30227 - DNA, 20 bp, Homo sapiens
caaaatgacattttgccaaa

SEQ ID NO: 30228 - DNA, 19 bp, Homo sapiens
cagcctctagggacccctc

SEQ ID NO: 30229 - DNA, 18 bp, Homo sapiens
tgctccacagccatccca

SEQ ID NO: 30230 - DNA, 17 bp, Homo sapiens
ttcaagaccttcaccaa

SEQ ID NO: 30231 - DNA, 20 bp, Homo sapiens
ttctggcctagtcccttcca

SEQ ID NO: 30232 - DNA, 25 bp, Homo sapiens
ctacagcctgacccatgggcaccgt

SEQ ID NO: 30233 - DNA, 21 bp, Homo sapiens
acacccacctctaaggactca

SEQ ID NO: 30234 - DNA, 20 bp, Homo sapiens
cagtgtttcactgtctcaac

SEQ ID NO: 30235 - DNA, 22 bp, Homo sapiens
gtcacccgtcaaccagagcgtg

SEQ ID NO: 30236 - DNA, 23 bp, Homo sapiens
gagagatatcctggctgaagctg

SEQ ID NO: 30237 - DNA, 21 bp, Homo sapiens
taacccattaggaaatagagc

SEQ ID NO: 30238 - DNA, 19 bp, Homo sapiens
tatcaaggaccaccaccac

SEQ ID NO: 30239 - DNA, 20 bp, Homo sapiens
tccatcagggagacctggaa

SEQ ID NO: 30240 - DNA, 24 bp, Homo sapiens
tgaatgaccacaactgtgaagtta

SEQ ID NO: 30241 - DNA, 17 bp, Homo sapiens
acgcttgtaatcgcagc

SEQ ID NO: 30242 - DNA, 23 bp, Homo sapiens
actgctgccattgtagtttgctg

SEQ ID NO: 30243 - DNA, 16 bp, Homo sapiens
agaatcactgctgcca

SEQ ID NO: 30244 - DNA, 20 bp, Homo sapiens
gtcttaaaataaaagctttt

SEQ ID NO: 30245 - DNA, 19 bp, Homo sapiens
tcagagccaatgttgtaca

SEQ ID NO: 30246 - DNA, 19 bp, Homo sapiens
ttgagacgtcaatgggacg

SEQ ID NO: 30247 - DNA, 23 bp, Homo sapiens
aagaagatacagaagaatataat

SEQ ID NO: 30248 - DNA, 18 bp, Homo sapiens
tccagaaggtgttgccag

SEQ ID NO: 30249 - DNA, 19 bp, Homo sapiens
cacatagtcatttagatga

SEQ ID NO: 30250 - DNA, 18 bp, Homo sapiens
tcagcaagaggcgttcga

SEQ ID NO: 30251 - DNA, 18 bp, Homo sapiens
aggggcctccatccctct

SEQ ID NO: 30252 - DNA, 19 bp, Homo sapiens
ccacatattcttgccaatt

SEQ ID NO: 30253 - DNA, 18 bp, Homo sapiens
ccccgacccccatggcca

SEQ ID NO: 30254 - DNA, 23 bp, Homo sapiens
gcgagagggagagcgtgcgcgag

SEQ ID NO: 30255 - DNA, 23 bp, Homo sapiens
cctcccatgcagaggtcagtgag

SEQ ID NO: 30256 - DNA, 18 bp, Homo sapiens
aagtgccaatgtgaaatt

SEQ ID NO: 30257 - DNA, 20 bp, Homo sapiens
ggagagaagctgaggcctca

SEQ ID NO: 30258 - DNA, 18 bp, Homo sapiens
ccgccgcctcctcattca

SEQ ID NO: 30259 - DNA, 17 bp, Homo sapiens
ctggagaaattatgact

SEQ ID NO: 30260 - DNA, 24 bp, Homo sapiens
tgagtggacttcatattatgacta

SEQ ID NO: 30261 - DNA, 19 bp, Homo sapiens
aaaatgaaaaaggttgcaa

SEQ ID NO: 30262 - DNA, 16 bp, Homo sapiens
aaactttactagatgc

SEQ ID NO: 30263 - DNA, 18 bp, Homo sapiens
atgggcgtcctttgactg

SEQ ID NO: 30264 - DNA, 18 bp, Homo sapiens
aagagaggttatagagta

SEQ ID NO: 30265 - DNA, 20 bp, Homo sapiens
ggcacatgacaactttgcca

SEQ ID NO: 30266 - DNA, 19 bp, Homo sapiens
tatttaataaagctactca

SEQ ID NO: 30267 - DNA, 18 bp, Homo sapiens
tgagttctgatcactttt

SEQ ID NO: 30268 - DNA, 20 bp, Homo sapiens
aaggaagctaaatttgcaca

SEQ ID NO: 30269 - DNA, 22 bp, Homo sapiens
ccacttcacctcatcccagcca

SEQ ID NO: 30270 - DNA, 22 bp, Homo sapiens
ggagccgtgaggatccacagta

SEQ ID NO: 30271 - DNA, 20 bp, Homo sapiens
ggcgagttgaagaatttctc

SEQ ID NO: 30272 - DNA, 20 bp, Homo sapiens
tcaagaaatcaagtacttca

SEQ ID NO: 30273 - DNA, 19 bp, Homo sapiens
tctgaaaactgataacagg

SEQ ID NO: 30274 - DNA, 22 bp, Homo sapiens
ttatttcagagcccatccccca

SEQ ID NO: 30275 - DNA, 19 bp, Homo sapiens
acaaacatgggtggtaaca

SEQ ID NO: 30276 - DNA, 23 bp, Homo sapiens
catgtaagatggcaactgtatta

SEQ ID NO: 30277 - DNA, 18 bp, Homo sapiens
aacaataaatactatgca

SEQ ID NO: 30278 - DNA, 17 bp, Homo sapiens
aatgctgcagtctgcac

SEQ ID NO: 30279 - DNA, 17 bp, Homo sapiens
agagcaggcagagatga

SEQ ID NO: 30280 - DNA, 23 bp, Homo sapiens
ccctccccaacccacatacctcc

SEQ ID NO: 30281 - DNA, 24 bp, Homo sapiens
ccctccccaacccacatacctcca

SEQ ID NO: 30282 - DNA, 21 bp, Homo sapiens
ccctgccgcggggcctgtgag

SEQ ID NO: 30283 - DNA, 18 bp, Homo sapiens
cctcgcgcgggcacccca

SEQ ID NO: 30284 - DNA, 21 bp, Homo sapiens
cctggaggatcccagtgagct

SEQ ID NO: 30285 - DNA, 18 bp, Homo sapiens
cgcacagcgcggctggga

SEQ ID NO: 30286 - DNA, 20 bp, Homo sapiens
gcccggtggatctcaggagt

SEQ ID NO: 30287 - DNA, 19 bp, Homo sapiens
gtcgatattgattacttta

SEQ ID NO: 30288 - DNA, 20 bp, Homo sapiens
tacctgcaagatgctgcaca

SEQ ID NO: 30289 - DNA, 25 bp, Homo sapiens
tcacgcaaggtccacactcattcca

SEQ ID NO: 30290 - DNA, 19 bp, Homo sapiens
tgagtttcagaatattcca

SEQ ID NO: 30291 - DNA, 18 bp, Homo sapiens
tcacaggccttgccatct

SEQ ID NO: 30292 - DNA, 16 bp, Homo sapiens
ctccctccctgcccct

SEQ ID NO: 30293 - DNA, 18 bp, Homo sapiens
tttgatgaccgcctggag

SEQ ID NO: 30294 - DNA, 20 bp, Homo sapiens
agttgttaaacaacatgcta

SEQ ID NO: 30295 - DNA, 23 bp, Homo sapiens
ggactttccagtgatgccactga

SEQ ID NO: 30296 - DNA, 22 bp, Homo sapiens
catgacctgtacctgagtatct

SEQ ID NO: 30297 - DNA, 19 bp, Homo sapiens
ttctacagtctggctctaa

SEQ ID NO: 30298 - DNA, 19 bp, Homo sapiens
ctgtgcaggggggctgcgg

SEQ ID NO: 30299 - DNA, 20 bp, Homo sapiens
taagactttccatcttggca

SEQ ID NO: 30300 - DNA, 16 bp, Homo sapiens
tacaaaattcatagtt

SEQ ID NO: 30301 - DNA, 21 bp, Homo sapiens
tccaaaccactatgctcttca

SEQ ID NO: 30302 - DNA, 22 bp, Homo sapiens
agagatgatccagacagagatg

SEQ ID NO: 30303 - DNA, 19 bp, Homo sapiens
atgtctttctcaccttctc

SEQ ID NO: 30304 - DNA, 19 bp, Homo sapiens
cttacagaaagataccctc

SEQ ID NO: 30305 - DNA, 19 bp, Homo sapiens
gtccagttagcatgatttg

SEQ ID NO: 30306 - DNA, 21 bp, Homo sapiens
aaatcttgaaaagggtttctg

SEQ ID NO: 30307 - DNA, 22 bp, Homo sapiens
acacagttgcaaacagtcctca

SEQ ID NO: 30308 - DNA, 21 bp, Homo sapiens
gcttgaaattacattcagaag

SEQ ID NO: 30309 - DNA, 19 bp, Homo sapiens
gtagctttagccctttgtt

SEQ ID NO: 30310 - DNA, 21 bp, Homo sapiens
tggaacttgaagtataattta

SEQ ID NO: 30311 - DNA, 16 bp, Homo sapiens
catgagggtgtggtca

SEQ ID NO: 30312 - DNA, 18 bp, Homo sapiens
cttccagaagcaacccag

SEQ ID NO: 30313 - DNA, 17 bp, Homo sapiens
tgcaattaatctttata

SEQ ID NO: 30314 - DNA, 24 bp, Homo sapiens
tttagttatccctgcattattttt

SEQ ID NO: 30315 - DNA, 18 bp, Homo sapiens
aataccattcactactca

SEQ ID NO: 30316 - DNA, 18 bp, Homo sapiens
atggcttatttctatgac

SEQ ID NO: 30317 - DNA, 18 bp, Homo sapiens
ggaccccaaatgtcactg

SEQ ID NO: 30318 - DNA, 23 bp, Homo sapiens
gtgaaacagttgctgtgaacttt

SEQ ID NO: 30319 - DNA, 22 bp, Homo sapiens
tggcatcttcaatatgaatcta

SEQ ID NO: 30320 - DNA, 18 bp, Homo sapiens
agcctcaggtggcagatg

SEQ ID NO: 30321 - DNA, 17 bp, Homo sapiens
gcttacatcccattttg

SEQ ID NO: 30322 - DNA, 19 bp, Homo sapiens
gtctactgttttaatgaga

SEQ ID NO: 30323 - DNA, 21 bp, Homo sapiens
tagaaccttaggtagaactcc

SEQ ID NO: 30324 - DNA, 22 bp, Homo sapiens
ttcagtttaacagttcctttaa

SEQ ID NO: 30325 - DNA, 17 bp, Homo sapiens
caccaccaccgtggtct

SEQ ID NO: 30326 - DNA, 21 bp, Homo sapiens
atcttgaatgagctgatctct

SEQ ID NO: 30327 - DNA, 21 bp, Homo sapiens
gcggctgccactgtgggctct

SEQ ID NO: 30328 - DNA, 17 bp, Homo sapiens
tgcctaccttcccactt

SEQ ID NO: 30329 - DNA, 18 bp, Homo sapiens
ccctgccgataaccagca

SEQ ID NO: 30330 - DNA, 19 bp, Homo sapiens
agtcttactcagctatcca

SEQ ID NO: 30331 - DNA, 18 bp, Homo sapiens
taatgaaactgtgtgtac

SEQ ID NO: 30332 - DNA, 17 bp, Homo sapiens
tgcattccaagcttttt

SEQ ID NO: 30333 - DNA, 23 bp, Homo sapiens
tggttgtacttttcttattataa

SEQ ID NO: 30334 - DNA, 18 bp, Homo sapiens
ttctacatcactggacac

SEQ ID NO: 30335 - DNA, 19 bp, Homo sapiens
gcctgtccctgactattga

SEQ ID NO: 30336 - DNA, 20 bp, Homo sapiens
agcccctcctgttcaaaaca

SEQ ID NO: 30337 - DNA, 22 bp, Homo sapiens
ccagacacccctccccgcactg

SEQ ID NO: 30338 - DNA, 20 bp, Homo sapiens
gtgctttgtcctggactcca

SEQ ID NO: 30339 - DNA, 21 bp, Homo sapiens
gtggccctccagcccagctca

SEQ ID NO: 30340 - DNA, 20 bp, Homo sapiens
gtgtgtatgactgtgtgact

SEQ ID NO: 30341 - DNA, 19 bp, Homo sapiens
tcttggcctcccactccca

SEQ ID NO: 30342 - DNA, 20 bp, Homo sapiens
acacttgggcccatgcacac

SEQ ID NO: 30343 - DNA, 22 bp, Homo sapiens
acggagtctgcccaagactgca

SEQ ID NO: 30344 - DNA, 22 bp, Homo sapiens
agaagaaatgcctccccaggtc

SEQ ID NO: 30345 - DNA, 22 bp, Homo sapiens
catcatcatcatcctcctgtgc

SEQ ID NO: 30346 - DNA, 22 bp, Homo sapiens
cttcctgggccctggtccttca

SEQ ID NO: 30347 - DNA, 23 bp, Homo sapiens
gcagagtcagatgtttctgggta

SEQ ID NO: 30348 - DNA, 19 bp, Homo sapiens
acttagagactaattagac

SEQ ID NO: 30349 - DNA, 17 bp, Homo sapiens
gcaataccttctgtgat

SEQ ID NO: 30350 - DNA, 18 bp, Homo sapiens
agaagggcctgacgtacc

SEQ ID NO: 30351 - DNA, 20 bp, Homo sapiens
agccagggaagcagccgctc

SEQ ID NO: 30352 - DNA, 23 bp, Homo sapiens
atctacaacctctggttcggcta

SEQ ID NO: 30353 - DNA, 21 bp, Homo sapiens
catcctcaacatcctcaaagg

SEQ ID NO: 30354 - DNA, 20 bp, Homo sapiens
ccgatctcctactacaagcc

SEQ ID NO: 30355 - DNA, 16 bp, Homo sapiens
tgcacaacaagcttct

SEQ ID NO: 30356 - DNA, 21 bp, Homo sapiens
gctgtatttggagctgagcca

SEQ ID NO: 30357 - DNA, 21 bp, Homo sapiens
acacccacctctaaggactca

SEQ ID NO: 30358 - DNA, 20 bp, Homo sapiens
cagtgtttcactgtctcaac

SEQ ID NO: 30359 - DNA, 18 bp, Homo sapiens
ctatccttctctgcctct

SEQ ID NO: 30360 - DNA, 24 bp, Homo sapiens
gcctgaactgtctgcccctgatct

SEQ ID NO: 30361 - DNA, 15 bp, Homo sapiens
cctttaagaggcgga

SEQ ID NO: 30362 - DNA, 22 bp, Homo sapiens
gatgttaaatggtggacgagta

SEQ ID NO: 30363 - DNA, 20 bp, Homo sapiens
ctataaagcaaaaacattta

SEQ ID NO: 30364 - DNA, 19 bp, Homo sapiens
tgtttgaaggtatactgta

SEQ ID NO: 30365 - DNA, 21 bp, Homo sapiens
acttgaatgacttcctggttt

SEQ ID NO: 30366 - DNA, 19 bp, Homo sapiens
caaggaaaggggaaaccca

SEQ ID NO: 30367 - DNA, 20 bp, Homo sapiens
cccactcaccctctgccagg

SEQ ID NO: 30368 - DNA, 18 bp, Homo sapiens
gaccaccatcctcagaag

SEQ ID NO: 30369 - DNA, 21 bp, Homo sapiens
gcaccaaatggtatttctgga

SEQ ID NO: 30370 - DNA, 20 bp, Homo sapiens
gcctctttctggagacccca

SEQ ID NO: 30371 - DNA, 21 bp, Homo sapiens
gctttgtcaggtcagcccaac

SEQ ID NO: 30372 - DNA, 22 bp, Homo sapiens
tcaacaccagagttcagtgttt

SEQ ID NO: 30373 - DNA, 20 bp, Homo sapiens
tggtttcctggcataaatta

SEQ ID NO: 30374 - DNA, 19 bp, Homo sapiens
caggctccttttcaccctg

SEQ ID NO: 30375 - DNA, 23 bp, Homo sapiens
gagaagcacagcacaggggctca

SEQ ID NO: 30376 - DNA, 23 bp, Homo sapiens
gcccctccccatcccctccctct

SEQ ID NO: 30377 - DNA, 18 bp, Homo sapiens
gggtgggcccagaaggtg

SEQ ID NO: 30378 - DNA, 21 bp, Homo sapiens
gttagtcttcatccccacgtg

SEQ ID NO: 30379 - DNA, 18 bp, Homo sapiens
agccacacccctcctgct

SEQ ID NO: 30380 - DNA, 19 bp, Homo sapiens
gaatggacctgagtagctg

SEQ ID NO: 30381 - DNA, 20 bp, Homo sapiens
caggatcaacagggtttgtt

SEQ ID NO: 30382 - DNA, 24 bp, Homo sapiens
aggagttctatttgttcctgggga

SEQ ID NO: 30383 - DNA, 23 bp, Homo sapiens
ccactgtggctcatctcttgcca

SEQ ID NO: 30384 - DNA, 18 bp, Homo sapiens
ctgggcactggctggtct

SEQ ID NO: 30385 - DNA, 28 bp, Homo sapiens
cttcagtatttgtggcagttttagtttt

SEQ ID NO: 30386 - DNA, 17 bp, Homo sapiens
tctccacgcacagtgtt

SEQ ID NO: 30387 - DNA, 21 bp, Homo sapiens
tctgcctgacccagccacccc

SEQ ID NO: 30388 - DNA, 19 bp, Homo sapiens
aagacatcccccctccatc

SEQ ID NO: 30389 - DNA, 22 bp, Homo sapiens
ccctggtcccagtccctttcca

SEQ ID NO: 30390 - DNA, 18 bp, Homo sapiens
tccagctgtcgcgccagt

SEQ ID NO: 30391 - DNA, 21 bp, Homo sapiens
aagactctaaacaaaaacctc

SEQ ID NO: 30392 - DNA, 20 bp, Homo sapiens
aagccatcacaaaacactat

SEQ ID NO: 30393 - DNA, 22 bp, Homo sapiens
caaaatttagataacctttgaa

SEQ ID NO: 30394 - DNA, 19 bp, Homo sapiens
catcaaactagagacccca

SEQ ID NO: 30395 - DNA, 23 bp, Homo sapiens
gaccccagctccccttctcgcca

SEQ ID NO: 30396 - DNA, 19 bp, Homo sapiens
gcgctcagggcccgggcgg

SEQ ID NO: 30397 - DNA, 17 bp, Homo sapiens
gttcatcgcagcatgtt

SEQ ID NO: 30398 - DNA, 19 bp, Homo sapiens
cccagcttcctccccgcaa

SEQ ID NO: 30399 - DNA, 17 bp, Homo sapiens
ggacgacaccgatttcc

SEQ ID NO: 30400 - DNA, 18 bp, Homo sapiens
ggcgggtgaagtttgcca

SEQ ID NO: 30401 - DNA, 23 bp, Homo sapiens
accgtcgcggagaggtttgtgga

SEQ ID NO: 30402 - DNA, 21 bp, Homo sapiens
ccatataacaaaaatggattc

SEQ ID NO: 30403 - DNA, 25 bp, Homo sapiens
cctcttctttagttgctttcgtttt

SEQ ID NO: 30404 - DNA, 17 bp, Homo sapiens
agcttgtgaaaatctca

SEQ ID NO: 30405 - DNA, 21 bp, Homo sapiens
tcctgtatggagatttgagaa

SEQ ID NO: 30406 - DNA, 24 bp, Homo sapiens
agaagggcccacccctcgcctgcc

SEQ ID NO: 30407 - DNA, 18 bp, Homo sapiens
cacatggcccccaggctg

SEQ ID NO: 30408 - DNA, 21 bp, Homo sapiens
ccccaggctgcggttgcctgg

SEQ ID NO: 30409 - DNA, 20 bp, Homo sapiens
ctattttttacagcgagcaa

SEQ ID NO: 30410 - DNA, 18 bp, Homo sapiens
tctcctgtaacatttttt

SEQ ID NO: 30411 - DNA, 18 bp, Homo sapiens
gcagttttattacctttg

SEQ ID NO: 30412 - DNA, 24 bp, Homo sapiens
tacatgttgttcatattcataaca

SEQ ID NO: 30413 - DNA, 19 bp, Homo sapiens
ttgcgaaagacttgaaaac

SEQ ID NO: 30414 - DNA, 18 bp, Homo sapiens
agatataaaaacaactcc

SEQ ID NO: 30415 - DNA, 20 bp, Homo sapiens
cagctttagacaaaacccca

SEQ ID NO: 30416 - DNA, 21 bp, Homo sapiens
catggatgttgccttagcctt

SEQ ID NO: 30417 - DNA, 22 bp, Homo sapiens
gcccgcatgccctagactcact

SEQ ID NO: 30418 - DNA, 19 bp, Homo sapiens
ggcagcgtaacacgcccta

SEQ ID NO: 30419 - DNA, 18 bp, Homo sapiens
tgattccacgttgctttt

SEQ ID NO: 30420 - DNA, 21 bp, Homo sapiens
tgcacgcatcgaaggatctga

SEQ ID NO: 30421 - DNA, 21 bp, Homo sapiens
tgggcgcggccgacctggtcc

SEQ ID NO: 30422 - DNA, 19 bp, Homo sapiens
ctcctcctcctgccgcctc

SEQ ID NO: 30423 - DNA, 24 bp, Homo sapiens
cttcccagactctcctctgtccct

SEQ ID NO: 30424 - DNA, 20 bp, Homo sapiens
gctgtatttcactgctgctg

SEQ ID NO: 30425 - DNA, 17 bp, Homo sapiens
cctgagaggtttgtgga

SEQ ID NO: 30426 - DNA, 18 bp, Homo sapiens
gccccctgtctctcaggg

SEQ ID NO: 30427 - DNA, 23 bp, Homo sapiens
cctaagtggtaagcaattacttt

SEQ ID NO: 30428 - DNA, 20 bp, Homo sapiens
taaaacttcaaataaaacca

SEQ ID NO: 30429 - DNA, 18 bp, Homo sapiens
tcttctgacattactgct

SEQ ID NO: 30430 - DNA, 21 bp, Homo sapiens
ttttcatgtgtctgtgtttgt

SEQ ID NO: 30431 - DNA, 22 bp, Homo sapiens
aagaggacaggaaggcttctga

SEQ ID NO: 30432 - DNA, 18 bp, Homo sapiens
accctggtggtgcagtga

SEQ ID NO: 30433 - DNA, 19 bp, Homo sapiens
agatcaattcccttacttc

SEQ ID NO: 30434 - DNA, 21 bp, Homo sapiens
agggattaacaagatgccata

SEQ ID NO: 30435 - DNA, 21 bp, Homo sapiens
atgttctacttatgcactgcc

SEQ ID NO: 30436 - DNA, 18 bp, Homo sapiens
cccctctgccaggatcct

SEQ ID NO: 30437 - DNA, 18 bp, Homo sapiens
gctggagtgctgcaggtg

SEQ ID NO: 30438 - DNA, 23 bp, Homo sapiens
tccagaccacgggccaaatccct

SEQ ID NO: 30439 - DNA, 19 bp, Homo sapiens
tggaagcagttccaccaca

SEQ ID NO: 30440 - DNA, 22 bp, Homo sapiens
tgggtgggcacccgtcaggctg

SEQ ID NO: 30441 - DNA, 21 bp, Homo sapiens
ttgcaaaacctccgagccttc

SEQ ID NO: 30442 - DNA, 18 bp, Homo sapiens
gtcgagccacttgctttg

SEQ ID NO: 30443 - DNA, 18 bp, Homo sapiens
agaccatgaattatggca

SEQ ID NO: 30444 - DNA, 18 bp, Homo sapiens
atcctgaaaaagacggtg

SEQ ID NO: 30445 - DNA, 17 bp, Homo sapiens
ctcataatcatgttgaa

SEQ ID NO: 30446 - DNA, 24 bp, Homo sapiens
gtcatagaaaataaatgattttta

SEQ ID NO: 30447 - DNA, 18 bp, Homo sapiens
acctagagctcactctct

SEQ ID NO: 30448 - DNA, 17 bp, Homo sapiens
atagttatgtctgtgta

SEQ ID NO: 30449 - DNA, 24 bp, Homo sapiens
atttgaaccaggcctgcctgactc

SEQ ID NO: 30450 - DNA, 20 bp, Homo sapiens
catcctctcctctagcaggt

SEQ ID NO: 30451 - DNA, 20 bp, Homo sapiens
ccccacccccattcccaagc

SEQ ID NO: 30452 - DNA, 21 bp, Homo sapiens
ccttctcctcatccctcccca

SEQ ID NO: 30453 - DNA, 19 bp, Homo sapiens
gaagccaacatagagactg

SEQ ID NO: 30454 - DNA, 22 bp, Homo sapiens
gggaaggcgcggcggcggcggc

SEQ ID NO: 30455 - DNA, 17 bp, Homo sapiens
gggcctgccattactca

SEQ ID NO: 30456 - DNA, 20 bp, Homo sapiens
tcaacagcatcttcattgta

SEQ ID NO: 30457 - DNA, 18 bp, Homo sapiens
tccagaaagtttgtacca

SEQ ID NO: 30458 - DNA, 23 bp, Homo sapiens
tgttccttcacttaataatatca

SEQ ID NO: 30459 - DNA, 19 bp, Homo sapiens
gatggaaacagggccactt

SEQ ID NO: 30460 - DNA, 20 bp, Homo sapiens
tccaggtgccccacctattt

SEQ ID NO: 30461 - DNA, 23 bp, Homo sapiens
accacacctgcacttctgcctca

SEQ ID NO: 30462 - DNA, 16 bp, Homo sapiens
cctgcacttctgcctc

SEQ ID NO: 30463 - DNA, 17 bp, Homo sapiens
gaaaaagggtgtccagt

SEQ ID NO: 30464 - DNA, 24 bp, Homo sapiens
tcccatcatgggggcccatcctca

SEQ ID NO: 30465 - DNA, 18 bp, Homo sapiens
tccggacctcatgatcca

SEQ ID NO: 30466 - DNA, 20 bp, Homo sapiens
tgcacgttcatctatgtgtg

SEQ ID NO: 30467 - DNA, 18 bp, Homo sapiens
tgctttacagatgattgc

SEQ ID NO: 30468 - DNA, 21 bp, Homo sapiens
cgaggctgctgctggctgtga

SEQ ID NO: 30469 - DNA, 21 bp, Homo sapiens
acatttcattgtgatactgta

SEQ ID NO: 30470 - DNA, 23 bp, Homo sapiens
cttaagaaatgcaataatccttt

SEQ ID NO: 30471 - DNA, 19 bp, Homo sapiens
cttgagactgagtctctcc

SEQ ID NO: 30472 - DNA, 24 bp, Homo sapiens
gtgtgtgtaagtgcatttgtatta

SEQ ID NO: 30473 - DNA, 22 bp, Homo sapiens
tgacaatagtgcccacacctta

SEQ ID NO: 30474 - DNA, 17 bp, Homo sapiens
tgctgttagtttctatt

SEQ ID NO: 30475 - DNA, 22 bp, Homo sapiens
ttctgttggccaggacacagat

SEQ ID NO: 30476 - DNA, 22 bp, Homo sapiens
acttctctctagctgtatctaa

SEQ ID NO: 30477 - DNA, 18 bp, Homo sapiens
ggaaacagaaactcgcag

SEQ ID NO: 30478 - DNA, 19 bp, Homo sapiens
aattttttatgtctctgga

SEQ ID NO: 30479 - DNA, 21 bp, Homo sapiens
gcctctccctcttcctctgct

SEQ ID NO: 30480 - DNA, 25 bp, Homo sapiens
tgaagagttgctaggattcagagta

SEQ ID NO: 30481 - DNA, 22 bp, Homo sapiens
aaaccccctttaaaacaaaaca

SEQ ID NO: 30482 - DNA, 23 bp, Homo sapiens
atggagtttaaaattggaatgca

SEQ ID NO: 30483 - DNA, 22 bp, Homo sapiens
ccaacctgaaatgtctgttata

SEQ ID NO: 30484 - DNA, 19 bp, Homo sapiens
tttcccagagcatggtgtt

SEQ ID NO: 30485 - DNA, 21 bp, Homo sapiens
acaggaaagacgggcattaca

SEQ ID NO: 30486 - DNA, 21 bp, Homo sapiens
aggctagttccagccccagtc

SEQ ID NO: 30487 - DNA, 21 bp, Homo sapiens
atcttggctcactgcaacctc

SEQ ID NO: 30488 - DNA, 18 bp, Homo sapiens
cctgcaacctccacctcc

SEQ ID NO: 30489 - DNA, 22 bp, Homo sapiens
cctgggtaatttttgtattttt

SEQ ID NO: 30490 - DNA, 19 bp, Homo sapiens
cgtctcctgggttcttgat

SEQ ID NO: 30491 - DNA, 18 bp, Homo sapiens
ctgttatctgagcatgaa

SEQ ID NO: 30492 - DNA, 20 bp, Homo sapiens
cttctgccctgtatacctca

SEQ ID NO: 30493 - DNA, 19 bp, Homo sapiens
gtcattaaaaacagcatta

SEQ ID NO: 30494 - DNA, 18 bp, Homo sapiens
tccacctcctgggttcaa

SEQ ID NO: 30495 - DNA, 15 bp, Homo sapiens
tggctggaaaaggga

SEQ ID NO: 30496 - DNA, 21 bp, Homo sapiens
gcctgggctgtcagccggcct

SEQ ID NO: 30497 - DNA, 21 bp, Homo sapiens
gcgggacccggctgccggcgg

SEQ ID NO: 30498 - DNA, 18 bp, Homo sapiens
tctggcggcggcggtggg

SEQ ID NO: 30499 - DNA, 22 bp, Homo sapiens
aagagtagcggacgttttgcca

SEQ ID NO: 30500 - DNA, 18 bp, Homo sapiens
caaccttcacctactcct

SEQ ID NO: 30501 - DNA, 21 bp, Homo sapiens
cctcccccttactactcccca

SEQ ID NO: 30502 - DNA, 22 bp, Homo sapiens
ccttggcggctgagcctgtgga

SEQ ID NO: 30503 - DNA, 23 bp, Homo sapiens
gcccgccccaccgtgggctctgg

SEQ ID NO: 30504 - DNA, 20 bp, Homo sapiens
gcgcgccaccacgaccagct

SEQ ID NO: 30505 - DNA, 20 bp, Homo sapiens
gggcggggttcttttttcca

SEQ ID NO: 30506 - DNA, 18 bp, Homo sapiens
tttggaaacctcgcggta

SEQ ID NO: 30507 - DNA, 18 bp, Homo sapiens
ctctggacggtgctttca

SEQ ID NO: 30508 - DNA, 21 bp, Homo sapiens
ggcccacgtgccccgagccca

SEQ ID NO: 30509 - DNA, 24 bp, Homo sapiens
ttaaagaaaatacaaagatgcagt

SEQ ID NO: 30510 - DNA, 21 bp, Homo sapiens
ttctgcctctggacggtgctt

SEQ ID NO: 30511 - DNA, 21 bp, Homo sapiens
acagtgttgggtgtaccaccc

SEQ ID NO: 30512 - DNA, 15 bp, Homo sapiens
accccaccatgccac

SEQ ID NO: 30513 - DNA, 23 bp, Homo sapiens
agaaatgccaagaaggctgagtc

SEQ ID NO: 30514 - DNA, 20 bp, Homo sapiens
cccgcccccgcttggcacca

SEQ ID NO: 30515 - DNA, 20 bp, Homo sapiens
cgcggagcgggcgggtggga

SEQ ID NO: 30516 - DNA, 18 bp, Homo sapiens
ctgcaccaccaccgacac

SEQ ID NO: 30517 - DNA, 18 bp, Homo sapiens
ctgtcctgcccccaagga

SEQ ID NO: 30518 - DNA, 22 bp, Homo sapiens
gaggccacccgcagggcccaga

SEQ ID NO: 30519 - DNA, 15 bp, Homo sapiens
gcttggcaccacttc

SEQ ID NO: 30520 - DNA, 25 bp, Homo sapiens
acccacgccgcacctcatccgtgca

SEQ ID NO: 30521 - DNA, 21 bp, Homo sapiens
atttctttaggaagttaccca

SEQ ID NO: 30522 - DNA, 18 bp, Homo sapiens
ctccacacagtaacattt

SEQ ID NO: 30523 - DNA, 17 bp, Homo sapiens
gtatccatagttgtcat

SEQ ID NO: 30524 - DNA, 18 bp, Homo sapiens
ctcttcaccagcaaccag

SEQ ID NO: 30525 - DNA, 23 bp, Homo sapiens
gagggccaagggctggaacctcc

SEQ ID NO: 30526 - DNA, 24 bp, Homo sapiens
gcgtctgcacctgtgtctgctcgg

SEQ ID NO: 30527 - DNA, 19 bp, Homo sapiens
agttcgccttctcgcccga

SEQ ID NO: 30528 - DNA, 19 bp, Homo sapiens
ccataaccctccctgctga

SEQ ID NO: 30529 - DNA, 19 bp, Homo sapiens
cccacaccagcggctggag

SEQ ID NO: 30530 - DNA, 22 bp, Homo sapiens
ccgccccagtacagcctgctga

SEQ ID NO: 30531 - DNA, 17 bp, Homo sapiens
cgccaccctccaccccc

SEQ ID NO: 30532 - DNA, 23 bp, Homo sapiens
gcctgagtcggagagcctgttcc

SEQ ID NO: 30533 - DNA, 19 bp, Homo sapiens
ctgacaggcagctgcacca

SEQ ID NO: 30534 - DNA, 16 bp, Homo sapiens
tccagagtgttgccag

SEQ ID NO: 30535 - DNA, 21 bp, Homo sapiens
tgggtggacagacaggggctg

SEQ ID NO: 30536 - DNA, 22 bp, Homo sapiens
accacgcccacccctcccctct

SEQ ID NO: 30537 - DNA, 17 bp, Homo sapiens
cactttcttctccattc

SEQ ID NO: 30538 - DNA, 19 bp, Homo sapiens
catcctctccctcacccca

SEQ ID NO: 30539 - DNA, 21 bp, Homo sapiens
aaggtgtaacacctttgcagt

SEQ ID NO: 30540 - DNA, 24 bp, Homo sapiens
agcatgtaaatcaggaacaacttt

SEQ ID NO: 30541 - DNA, 17 bp, Homo sapiens
attgacaatcccataat

SEQ ID NO: 30542 - DNA, 17 bp, Homo sapiens
ccctggtgctgttccag

SEQ ID NO: 30543 - DNA, 19 bp, Homo sapiens
tgccctggtgctgttccag

SEQ ID NO: 30544 - DNA, 16 bp, Homo sapiens
cccagaaatgtctcag

SEQ ID NO: 30545 - DNA, 15 bp, Homo sapiens
actgttgcttggccc

SEQ ID NO: 30546 - DNA, 18 bp, Homo sapiens
atgctatgtcactattca

SEQ ID NO: 30547 - DNA, 24 bp, Homo sapiens
gcaagtttaaatatttgagcttta

SEQ ID NO: 30548 - DNA, 20 bp, Homo sapiens
ggcatttggtaactcaaaga

SEQ ID NO: 30549 - DNA, 19 bp, Homo sapiens
gcttccacacacttattta

SEQ ID NO: 30550 - DNA, 20 bp, Homo sapiens
tttggtatagtataagttca

SEQ ID NO: 30551 - DNA, 21 bp, Homo sapiens
aaacaccaccaaagaaaataa

SEQ ID NO: 30552 - DNA, 19 bp, Homo sapiens
acccatccccctaccacta

SEQ ID NO: 30553 - DNA, 22 bp, Homo sapiens
acctatcagcccttcggtctca

SEQ ID NO: 30554 - DNA, 17 bp, Homo sapiens
agacacaaacacatgga

SEQ ID NO: 30555 - DNA, 19 bp, Homo sapiens
cacacccaccactcccatc

SEQ ID NO: 30556 - DNA, 19 bp, Homo sapiens
taaaaacaccaccaaagaa

SEQ ID NO: 30557 - DNA, 21 bp, Homo sapiens
agaaacttctccctcaccccc

SEQ ID NO: 30558 - DNA, 19 bp, Homo sapiens
aggaaacacccccaggagg

SEQ ID NO: 30559 - DNA, 20 bp, Homo sapiens
cagagcccaactcaaggctt

SEQ ID NO: 30560 - DNA, 19 bp, Homo sapiens
gcactgacctgtagtgaaa

SEQ ID NO: 30561 - DNA, 21 bp, Homo sapiens
ggcttaaatggcaccagactc

SEQ ID NO: 30562 - DNA, 18 bp, Homo sapiens
tgtcttggttgctgctct

SEQ ID NO: 30563 - DNA, 23 bp, Homo sapiens
acttgaactgaaattattggctt

SEQ ID NO: 30564 - DNA, 21 bp, Homo sapiens
agttttctttctttttaaagc

SEQ ID NO: 30565 - DNA, 20 bp, Homo sapiens
tcaccgcaacctccacctcc

SEQ ID NO: 30566 - DNA, 18 bp, Homo sapiens
tccacctcccgggttcaa

SEQ ID NO: 30567 - DNA, 19 bp, Homo sapiens
ttaaatattcaaataatta

SEQ ID NO: 30568 - DNA, 20 bp, Homo sapiens
ttccagaaaatgagattcca

SEQ ID NO: 30569 - DNA, 22 bp, Homo sapiens
tgcaagctccaggaagcactga

SEQ ID NO: 30570 - DNA, 21 bp, Homo sapiens
aaagttgggaaaactccagca

SEQ ID NO: 30571 - DNA, 18 bp, Homo sapiens
cacacatgagctcacaca

SEQ ID NO: 30572 - DNA, 20 bp, Homo sapiens
cacttccaatgccagtttga

SEQ ID NO: 30573 - DNA, 21 bp, Homo sapiens
cctccccagtgcctcttccag

SEQ ID NO: 30574 - DNA, 18 bp, Homo sapiens
cctgcaacctccacctcc

SEQ ID NO: 30575 - DNA, 20 bp, Homo sapiens
ctctccttcctgattctgat

SEQ ID NO: 30576 - DNA, 22 bp, Homo sapiens
ggctctgacctatgtctttgaa

SEQ ID NO: 30577 - DNA, 23 bp, Homo sapiens
gtgtgtgccaccatgcttggcta

SEQ ID NO: 30578 - DNA, 18 bp, Homo sapiens
tccacctcccgggttcaa

SEQ ID NO: 30579 - DNA, 20 bp, Homo sapiens
tctgaaaacacttccaatgc

SEQ ID NO: 30580 - DNA, 21 bp, Homo sapiens
tgaggccattcatattctgta

SEQ ID NO: 30581 - DNA, 21 bp, Homo sapiens
tggattcctagtcagaggtga

SEQ ID NO: 30582 - DNA, 20 bp, Homo sapiens
ttcagcgctgaactgtacta

SEQ ID NO: 30583 - DNA, 22 bp, Homo sapiens
gcttccccttctcctctggctc

SEQ ID NO: 30584 - DNA, 18 bp, Homo sapiens
gctgctgctggtgagctt

SEQ ID NO: 30585 - DNA, 22 bp, Homo sapiens
cctcacccacaaagagaagaca

SEQ ID NO: 30586 - DNA, 21 bp, Homo sapiens
ctccccgtcctcctgctccct

SEQ ID NO: 30587 - DNA, 18 bp, Homo sapiens
cttggaggggactggtgg

SEQ ID NO: 30588 - DNA, 18 bp, Homo sapiens
tgaagacaggtgctccgg

SEQ ID NO: 30589 - DNA, 19 bp, Homo sapiens
aggatttgtgctcctatga

SEQ ID NO: 30590 - DNA, 20 bp, Homo sapiens
cagacgttatacatattcac

SEQ ID NO: 30591 - DNA, 18 bp, Homo sapiens
ctatcctccagatattac

SEQ ID NO: 30592 - DNA, 16 bp, Homo sapiens
gagctggattttctca

SEQ ID NO: 30593 - DNA, 23 bp, Homo sapiens
taaatggatttcaggtgctgcta

SEQ ID NO: 30594 - DNA, 20 bp, Homo sapiens
tccaaaggttctttcattcc

SEQ ID NO: 30595 - DNA, 25 bp, Homo sapiens
tttctgaatcagttttcttaacttt

SEQ ID NO: 30596 - DNA, 22 bp, Homo sapiens
actggaattctgtctccagaga

SEQ ID NO: 30597 - DNA, 19 bp, Homo sapiens
atggttgtcagtgcattct

SEQ ID NO: 30598 - DNA, 19 bp, Homo sapiens
ccagtctttaggcaatggg

SEQ ID NO: 30599 - DNA, 19 bp, Homo sapiens
tggcagggcctagctgcta

SEQ ID NO: 30600 - DNA, 18 bp, Homo sapiens
accagcggtgtgcaggga

SEQ ID NO: 30601 - DNA, 18 bp, Homo sapiens
caagatcagaggggttca

SEQ ID NO: 30602 - DNA, 19 bp, Homo sapiens
catgtgcttccatacagtg

SEQ ID NO: 30603 - DNA, 24 bp, Homo sapiens
gccaagatgataaaaaaaaccttc

SEQ ID NO: 30604 - DNA, 17 bp, Homo sapiens
gccacttgtggcaaaca

SEQ ID NO: 30605 - DNA, 23 bp, Homo sapiens
gcctggatagactgcctgcgtcc

SEQ ID NO: 30606 - DNA, 20 bp, Homo sapiens
gggtttctgaagcttttgca

SEQ ID NO: 30607 - DNA, 20 bp, Homo sapiens
tatgttcagaagccaacaaa

SEQ ID NO: 30608 - DNA, 25 bp, Homo sapiens
tcacaccacattacacatgtgcttc

SEQ ID NO: 30609 - DNA, 22 bp, Homo sapiens
ttgctgttgggcacacctggat

SEQ ID NO: 30610 - DNA, 20 bp, Homo sapiens
tttcatcacagaacagtgtt

SEQ ID NO: 30611 - DNA, 22 bp, Homo sapiens
taccttgcagctgtattgctca

SEQ ID NO: 30612 - DNA, 22 bp, Homo sapiens
tttgggtggaagaggcatagaa

SEQ ID NO: 30613 - DNA, 19 bp, Homo sapiens
aggtcacagaagccaacga

SEQ ID NO: 30614 - DNA, 18 bp, Homo sapiens
ctgggctacagcaagcca

SEQ ID NO: 30615 - DNA, 18 bp, Homo sapiens
ctgtttcctccgccccca

SEQ ID NO: 30616 - DNA, 18 bp, Homo sapiens
gccctccgccccgcccca

SEQ ID NO: 30617 - DNA, 21 bp, Homo sapiens
gcctctcagtgcccctgccct

SEQ ID NO: 30618 - DNA, 19 bp, Homo sapiens
tcctgccctcctcttcctc

SEQ ID NO: 30619 - DNA, 17 bp, Homo sapiens
ttcctacctccttcacc

SEQ ID NO: 30620 - DNA, 18 bp, Homo sapiens
actctctggaagttctgg

SEQ ID NO: 30621 - DNA, 19 bp, Homo sapiens
agacatcacccacaagggg

SEQ ID NO: 30622 - DNA, 20 bp, Homo sapiens
cccgcggatggcagtctgga

SEQ ID NO: 30623 - DNA, 24 bp, Homo sapiens
ctctgatgatggagatgaagtgaa

SEQ ID NO: 30624 - DNA, 16 bp, Homo sapiens
gccccacctttgcaaa

SEQ ID NO: 30625 - DNA, 25 bp, Homo sapiens
aacaaaacgataatatttcacatca

SEQ ID NO: 30626 - DNA, 24 bp, Homo sapiens
agcactgctgaacagacaactagc

SEQ ID NO: 30627 - DNA, 20 bp, Homo sapiens
cactgaccaatcaccccaac

SEQ ID NO: 30628 - DNA, 22 bp, Homo sapiens
cataccccctgccctcctctga

SEQ ID NO: 30629 - DNA, 21 bp, Homo sapiens
ctctgaagtgaagatctggaa

SEQ ID NO: 30630 - DNA, 17 bp, Homo sapiens
ttcttcctccttctggt

SEQ ID NO: 30631 - DNA, 20 bp, Homo sapiens
tgtctgccaagccagcccca

SEQ ID NO: 30632 - DNA, 18 bp, Homo sapiens
atacctctgagttcctga

SEQ ID NO: 30633 - DNA, 21 bp, Homo sapiens
attttttttttccattggttt

SEQ ID NO: 30634 - DNA, 16 bp, Homo sapiens
gagggccggacaaaag

SEQ ID NO: 30635 - DNA, 19 bp, Homo sapiens
agtattaccccacctgtcc

SEQ ID NO: 30636 - DNA, 20 bp, Homo sapiens
gcagtgttgtggtttttgtt

SEQ ID NO: 30637 - DNA, 16 bp, Homo sapiens
tgcaggccaagctctt

SEQ ID NO: 30638 - DNA, 19 bp, Homo sapiens
aactgatcatggcttccca

SEQ ID NO: 30639 - DNA, 22 bp, Homo sapiens
caaaaatgtggaaggcctccca

SEQ ID NO: 30640 - DNA, 18 bp, Homo sapiens
gaaaaagcctcagtttcc

SEQ ID NO: 30641 - DNA, 22 bp, Homo sapiens
gtcaaaacagttttgtggaact

SEQ ID NO: 30642 - DNA, 18 bp, Homo sapiens
ttcttaatactgtaccac

SEQ ID NO: 30643 - DNA, 24 bp, Homo sapiens
aggataatttgcatatccatcacc

SEQ ID NO: 30644 - DNA, 18 bp, Homo sapiens
agtattgcataactttaa

SEQ ID NO: 30645 - DNA, 19 bp, Homo sapiens
atcctggtggtaggtctct

SEQ ID NO: 30646 - DNA, 20 bp, Homo sapiens
caaaggatataaatgactaa

SEQ ID NO: 30647 - DNA, 18 bp, Homo sapiens
cctgagcctgcatggcct

SEQ ID NO: 30648 - DNA, 22 bp, Homo sapiens
gacaagcctgagcaacatatca

SEQ ID NO: 30649 - DNA, 19 bp, Homo sapiens
gacgcaggcgccattgcac

SEQ ID NO: 30650 - DNA, 18 bp, Homo sapiens
gagcagctacgtaacctg

SEQ ID NO: 30651 - DNA, 18 bp, Homo sapiens
gccatatcactgagggta

SEQ ID NO: 30652 - DNA, 17 bp, Homo sapiens
ggatcaggcagctccaa

SEQ ID NO: 30653 - DNA, 18 bp, Homo sapiens
ttacaccttctttctgta

SEQ ID NO: 30654 - DNA, 20 bp, Homo sapiens
ttatacatatttgtagggta

SEQ ID NO: 30655 - DNA, 21 bp, Homo sapiens
aagctttctgtcagaattcaa

SEQ ID NO: 30656 - DNA, 20 bp, Homo sapiens
accaatatgaggaatgtgca

SEQ ID NO: 30657 - DNA, 18 bp, Homo sapiens
accaaaaccaaacagaga

SEQ ID NO: 30658 - DNA, 19 bp, Homo sapiens
accacgaccaccgtggcca

SEQ ID NO: 30659 - DNA, 17 bp, Homo sapiens
acctaaggggcaggtga

SEQ ID NO: 30660 - DNA, 20 bp, Homo sapiens
caagaaaagggcagtcccca

SEQ ID NO: 30661 - DNA, 21 bp, Homo sapiens
cagaagaattggaccaggtca

SEQ ID NO: 30662 - DNA, 19 bp, Homo sapiens
ccaccaggggcattaggta

SEQ ID NO: 30663 - DNA, 21 bp, Homo sapiens
cgtgaccaggaggaacagcct

SEQ ID NO: 30664 - DNA, 19 bp, Homo sapiens
ctccatgccacacgggtgg

SEQ ID NO: 30665 - DNA, 19 bp, Homo sapiens
ctcctctgccgctgtccca

SEQ ID NO: 30666 - DNA, 19 bp, Homo sapiens
cttccacaactttcctcca

SEQ ID NO: 30667 - DNA, 23 bp, Homo sapiens
cttgacattgggcctacactgta

SEQ ID NO: 30668 - DNA, 18 bp, Homo sapiens
ctttttccatttatttaa

SEQ ID NO: 30669 - DNA, 20 bp, Homo sapiens
gacacagcactcacagccca

SEQ ID NO: 30670 - DNA, 18 bp, Homo sapiens
gaccaccgtggccatctg

SEQ ID NO: 30671 - DNA, 22 bp, Homo sapiens
gcacctctttcttcctctgtca

SEQ ID NO: 30672 - DNA, 17 bp, Homo sapiens
ggacacgccacacccag

SEQ ID NO: 30673 - DNA, 18 bp, Homo sapiens
tgtctgtggggcagcaga

SEQ ID NO: 30674 - DNA, 23 bp, Homo sapiens
atctgggccgcctcacccggctc

SEQ ID NO: 30675 - DNA, 28 bp, Homo sapiens
attgtgaataagtggaatacagctctca

SEQ ID NO: 30676 - DNA, 18 bp, Homo sapiens
cacagactcgcactgtca

SEQ ID NO: 30677 - DNA, 22 bp, Homo sapiens
caggatgtcaccacccatgcca

SEQ ID NO: 30678 - DNA, 18 bp, Homo sapiens
cccagactttctcatcca

SEQ ID NO: 30679 - DNA, 22 bp, Homo sapiens
ccccactctcctataagcatga

SEQ ID NO: 30680 - DNA, 22 bp, Homo sapiens
ccccatccgtctcttctgcaga

SEQ ID NO: 30681 - DNA, 19 bp, Homo sapiens
ctgcctggccagctgcccc

SEQ ID NO: 30682 - DNA, 19 bp, Homo sapiens
cttggcaacctcctggccc

SEQ ID NO: 30683 - DNA, 25 bp, Homo sapiens
gaagacatgcccccagaacatgtca

SEQ ID NO: 30684 - DNA, 21 bp, Homo sapiens
gagatcatcacctccaccacc

SEQ ID NO: 30685 - DNA, 19 bp, Homo sapiens
ggcccggacaatcctgcag

SEQ ID NO: 30686 - DNA, 19 bp, Homo sapiens
gtgaaggccaaggctgact

SEQ ID NO: 30687 - DNA, 20 bp, Homo sapiens
tcttgtgtgagggcctgtgg

SEQ ID NO: 30688 - DNA, 20 bp, Homo sapiens
tgaacacccaagagctcttg

SEQ ID NO: 30689 - DNA, 21 bp, Homo sapiens
tgatggacagcaccaccaccc

SEQ ID NO: 30690 - DNA, 20 bp, Homo sapiens
tgcagacacagaaccacctc

SEQ ID NO: 30691 - DNA, 20 bp, Homo sapiens
aggttcctaaacaactcact

SEQ ID NO: 30692 - DNA, 18 bp, Homo sapiens
cagcctgggctgacacct

SEQ ID NO: 30693 - DNA, 17 bp, Homo sapiens
ccattattagattatgt

SEQ ID NO: 30694 - DNA, 18 bp, Homo sapiens
gcctgggctgacacctgg

SEQ ID NO: 30695 - DNA, 26 bp, Homo sapiens
acaccccgaagcccacctgcaatctc

SEQ ID NO: 30696 - DNA, 15 bp, Homo sapiens
cctgcaatctcccac

SEQ ID NO: 30697 - DNA, 19 bp, Homo sapiens
gaccaacctgacctacatg

SEQ ID NO: 30698 - DNA, 22 bp, Homo sapiens
tgctgtgaaaagcttcattcca

SEQ ID NO: 30699 - DNA, 19 bp, Homo sapiens
aagtctgatggagaccaca

SEQ ID NO: 30700 - DNA, 22 bp, Homo sapiens
aatgtgggaaaactttcaatca

SEQ ID NO: 30701 - DNA, 22 bp, Homo sapiens
aatgtgggaaactcttcatgtg

SEQ ID NO: 30702 - DNA, 19 bp, Homo sapiens
accagaaaatccacactgg

SEQ ID NO: 30703 - DNA, 22 bp, Homo sapiens
agacctaggtactaaaattcca

SEQ ID NO: 30704 - DNA, 18 bp, Homo sapiens
cagcactttgggaagcca

SEQ ID NO: 30705 - DNA, 22 bp, Homo sapiens
gagccaagatcatgccactgca

SEQ ID NO: 30706 - DNA, 21 bp, Homo sapiens
tccagggcagctcagacctca

SEQ ID NO: 30707 - DNA, 22 bp, Homo sapiens
ttacaatgctgtacagtgagag

SEQ ID NO: 30708 - DNA, 19 bp, Homo sapiens
ttcataccagagagaaacc

SEQ ID NO: 30709 - DNA, 19 bp, Homo sapiens
aggagaatagtggttgcca

SEQ ID NO: 30710 - DNA, 25 bp, Homo sapiens
aaaaaatcatttctagattattttt

SEQ ID NO: 30711 - DNA, 24 bp, Homo sapiens
tacactctgattttcaagctcctc

SEQ ID NO: 30712 - DNA, 18 bp, Homo sapiens
tttctttgtagctacttg

SEQ ID NO: 30713 - DNA, 18 bp, Homo sapiens
catttccccaggccaagt

SEQ ID NO: 30714 - DNA, 19 bp, Homo sapiens
cctctctgggcctgtgcag

SEQ ID NO: 30715 - DNA, 21 bp, Homo sapiens
ccttggtaactgatggactca

SEQ ID NO: 30716 - DNA, 18 bp, Homo sapiens
gaccttagcatggggcta

SEQ ID NO: 30717 - DNA, 18 bp, Homo sapiens
gaccttagcatggggcta

SEQ ID NO: 30718 - DNA, 19 bp, Homo sapiens
aaaacaaaaaccccacaaa

SEQ ID NO: 30719 - DNA, 21 bp, Homo sapiens
cctacccagcctgctgcctca

SEQ ID NO: 30720 - DNA, 28 bp, Homo sapiens
ccttaatggagaaaaaaaaacctaataa

SEQ ID NO: 30721 - DNA, 21 bp, Homo sapiens
cagaaggaggaggacctggga

SEQ ID NO: 30722 - DNA, 18 bp, Homo sapiens
gcctgcagtgtgaggctg

SEQ ID NO: 30723 - DNA, 24 bp, Homo sapiens
ggattcttcaaacgctccctccca

SEQ ID NO: 30724 - DNA, 23 bp, Homo sapiens
taggaaatccattcacagttctt

SEQ ID NO: 30725 - DNA, 18 bp, Homo sapiens
acccaggccccccaccca

SEQ ID NO: 30726 - DNA, 18 bp, Homo sapiens
gtccagtccaagcccacc

SEQ ID NO: 30727 - DNA, 19 bp, Homo sapiens
ccaattccacatttctgaa

SEQ ID NO: 30728 - DNA, 18 bp, Homo sapiens
ctgatatcatattcctcc

SEQ ID NO: 30729 - DNA, 25 bp, Homo sapiens
gcttctccctgtcttcctctcctct

SEQ ID NO: 30730 - DNA, 18 bp, Homo sapiens
tctctactaaaaatacaa

SEQ ID NO: 30731 - DNA, 19 bp, Homo sapiens
tgggtggatcgcctgagat

SEQ ID NO: 30732 - DNA, 18 bp, Homo sapiens
ttgcactactgcattcca

SEQ ID NO: 30733 - DNA, 19 bp, Homo sapiens
agtctgcagttagagccaa

SEQ ID NO: 30734 - DNA, 22 bp, Homo sapiens
gacagaggaatcccccaaacta

SEQ ID NO: 30735 - DNA, 22 bp, Homo sapiens
gagccaagatcaggccactgca

SEQ ID NO: 30736 - DNA, 18 bp, Homo sapiens
tgacagaggaatccccca

SEQ ID NO: 30737 - DNA, 17 bp, Homo sapiens
tggggaagatctgagag

SEQ ID NO: 30738 - DNA, 18 bp, Homo sapiens
cttccttcatgcacatca

SEQ ID NO: 30739 - DNA, 22 bp, Homo sapiens
gtgtatggacagcttactcgac

SEQ ID NO: 30740 - DNA, 22 bp, Homo sapiens
gttccttccttcatgcacatca

SEQ ID NO: 30741 - DNA, 17 bp, Homo sapiens
tcagagtactcacactg

SEQ ID NO: 30742 - DNA, 19 bp, Homo sapiens
cattgagtacctcctgccc

SEQ ID NO: 30743 - DNA, 24 bp, Homo sapiens
ccctggtgacccggggtcagcgga

SEQ ID NO: 30744 - DNA, 18 bp, Homo sapiens
tcctttaaggtctttgga

SEQ ID NO: 30745 - DNA, 18 bp, Homo sapiens
aactcctggaagacccga

SEQ ID NO: 30746 - DNA, 19 bp, Homo sapiens
acctccccaccaagcctcc

SEQ ID NO: 30747 - DNA, 16 bp, Homo sapiens
agaaatgaaatgtcat

SEQ ID NO: 30748 - DNA, 24 bp, Homo sapiens
cagtggtgcaatcatagccttaaa

SEQ ID NO: 30749 - DNA, 24 bp, Homo sapiens
cccctccagaggtctcgctcgcag

SEQ ID NO: 30750 - DNA, 24 bp, Homo sapiens
cgcccaccccccccgaccccacca

SEQ ID NO: 30751 - DNA, 20 bp, Homo sapiens
gcctctatcctcctttcgag

SEQ ID NO: 30752 - DNA, 22 bp, Homo sapiens
tcctggtggttggggaccgtgg

SEQ ID NO: 30753 - DNA, 21 bp, Homo sapiens
tctcacctccccaccaagcct

SEQ ID NO: 30754 - DNA, 18 bp, Homo sapiens
tgaattttcctggctcca

SEQ ID NO: 30755 - DNA, 25 bp, Homo sapiens
aagtacccacacctttggccagtaa

SEQ ID NO: 30756 - DNA, 19 bp, Homo sapiens
caagtttcccaagtcctca

SEQ ID NO: 30757 - DNA, 20 bp, Homo sapiens
cagttagctctaaattctgg

SEQ ID NO: 30758 - DNA, 20 bp, Homo sapiens
gctacttttctgcagggata

SEQ ID NO: 30759 - DNA, 20 bp, Homo sapiens
gttaccttctccatacacta

SEQ ID NO: 30760 - DNA, 19 bp, Homo sapiens
tcatgttgaatgcatttgt

SEQ ID NO: 30761 - DNA, 23 bp, Homo sapiens
tcattgatgaatacaagtaccca

SEQ ID NO: 30762 - DNA, 22 bp, Homo sapiens
aaaaaaattaaaactctgtata

SEQ ID NO: 30763 - DNA, 18 bp, Homo sapiens
aggcaatttcgttcctgg

SEQ ID NO: 30764 - DNA, 20 bp, Homo sapiens
atccagactgtttcagccca

SEQ ID NO: 30765 - DNA, 20 bp, Homo sapiens
cacaggcatcagcagtccca

SEQ ID NO: 30766 - DNA, 19 bp, Homo sapiens
cacgtaccattggctgtaa

SEQ ID NO: 30767 - DNA, 22 bp, Homo sapiens
caggcatcagcagtcccattca

SEQ ID NO: 30768 - DNA, 19 bp, Homo sapiens
caggttatcccttgctctg

SEQ ID NO: 30769 - DNA, 18 bp, Homo sapiens
ccacccccttccacctcc

SEQ ID NO: 30770 - DNA, 24 bp, Homo sapiens
ccagactgacgctgaaatccctca

SEQ ID NO: 30771 - DNA, 21 bp, Homo sapiens
ccagggctactaaagacttca

SEQ ID NO: 30772 - DNA, 19 bp, Homo sapiens
cctccttagactgagctgt

SEQ ID NO: 30773 - DNA, 21 bp, Homo sapiens
cctgcctccacctcccacccc

SEQ ID NO: 30774 - DNA, 21 bp, Homo sapiens
cctttagtctgtaaaactcct

SEQ ID NO: 30775 - DNA, 19 bp, Homo sapiens
gcaccccaatgccaggata

SEQ ID NO: 30776 - DNA, 20 bp, Homo sapiens
tcaccatcatatgccccaaa

SEQ ID NO: 30777 - DNA, 23 bp, Homo sapiens
tccggatcagtacatgcatgtca

SEQ ID NO: 30778 - DNA, 21 bp, Homo sapiens
tgccaggagccagctgtgtga

SEQ ID NO: 30779 - DNA, 26 bp, Homo sapiens
tttccttgggaatctgcctccctcca

SEQ ID NO: 30780 - DNA, 18 bp, Homo sapiens
agacactgcttcttctca

SEQ ID NO: 30781 - DNA, 17 bp, Homo sapiens
atcttgacctctggctt

SEQ ID NO: 30782 - DNA, 26 bp, Homo sapiens
atggtcctcatcccgatgggaaactg

SEQ ID NO: 30783 - DNA, 17 bp, Homo sapiens
attaagaaaacatggtg

SEQ ID NO: 30784 - DNA, 22 bp, Homo sapiens
cagcctggccaacataatgaaa

SEQ ID NO: 30785 - DNA, 20 bp, Homo sapiens
ccaataataccgtcaattga

SEQ ID NO: 30786 - DNA, 24 bp, Homo sapiens
cctcatcaaggcctcctcgctcct

SEQ ID NO: 30787 - DNA, 22 bp, Homo sapiens
gcacccagcagcatctgcctca

SEQ ID NO: 30788 - DNA, 22 bp, Homo sapiens
gcccaagtgagacagaacctca

SEQ ID NO: 30789 - DNA, 18 bp, Homo sapiens
gctgtggcaatcgtcccc

SEQ ID NO: 30790 - DNA, 22 bp, Homo sapiens
gggggtgggggggcaccaagca

SEQ ID NO: 30791 - DNA, 19 bp, Homo sapiens
gttttggtcgtcacagcag

SEQ ID NO: 30792 - DNA, 27 bp, Homo sapiens
tgcgtggactggatgtgtccccagaat

SEQ ID NO: 30793 - DNA, 22 bp, Homo sapiens
tggccactttgacctggggctg

SEQ ID NO: 30794 - DNA, 21 bp, Homo sapiens
aacacgtgggcatttattgtt

SEQ ID NO: 30795 - DNA, 20 bp, Homo sapiens
acttactttgtgtctaggaa

SEQ ID NO: 30796 - DNA, 17 bp, Homo sapiens
atttttagggtatcata

SEQ ID NO: 30797 - DNA, 22 bp, Homo sapiens
cctaggtgcaattaggttgttt

SEQ ID NO: 30798 - DNA, 23 bp, Homo sapiens
ctttggtttttgatacctgtgga

SEQ ID NO: 30799 - DNA, 23 bp, Homo sapiens
gcagttttaatactgctgtgtca

SEQ ID NO: 30800 - DNA, 21 bp, Homo sapiens
tgaggtagagctgtgcattaa

SEQ ID NO: 30801 - DNA, 21 bp, Homo sapiens
tgggattgccaggctgtggtt

SEQ ID NO: 30802 - DNA, 19 bp, Homo sapiens
ccaaagccaggggcccacc

SEQ ID NO: 30803 - DNA, 19 bp, Homo sapiens
ccaggaaggaaaccctgtg

SEQ ID NO: 30804 - DNA, 23 bp, Homo sapiens
gaaccaggaaggaaaccctgtgg

SEQ ID NO: 30805 - DNA, 26 bp, Homo sapiens
gcctgggccagcctgcctcctggcct

SEQ ID NO: 30806 - DNA, 17 bp, Homo sapiens
tgtctgtggagttcagg

SEQ ID NO: 30807 - DNA, 23 bp, Homo sapiens
aaagccaggttacgcaacaggca

SEQ ID NO: 30808 - DNA, 18 bp, Homo sapiens
agaataaaggcaaccagt

SEQ ID NO: 30809 - DNA, 17 bp, Homo sapiens
gatccatcccttgagct

SEQ ID NO: 30810 - DNA, 18 bp, Homo sapiens
aaggaactggcatgcaca

SEQ ID NO: 30811 - DNA, 19 bp, Homo sapiens
cccaccaggccctctgttg

SEQ ID NO: 30812 - DNA, 21 bp, Homo sapiens
cctggaggaaggactgactgg

SEQ ID NO: 30813 - DNA, 17 bp, Homo sapiens
cctggctcgagcacaca

SEQ ID NO: 30814 - DNA, 17 bp, Homo sapiens
gcccccagcacccctgc

SEQ ID NO: 30815 - DNA, 22 bp, Homo sapiens
gcccccagcacccctgcctgct

SEQ ID NO: 30816 - DNA, 22 bp, Homo sapiens
ccagttctccatcccccacccc

SEQ ID NO: 30817 - DNA, 18 bp, Homo sapiens
cccaccctcccccattcc

SEQ ID NO: 30818 - DNA, 19 bp, Homo sapiens
cctgtgtgaccgttggccc

SEQ ID NO: 30819 - DNA, 20 bp, Homo sapiens
ccttgatgtttagcacttta

SEQ ID NO: 30820 - DNA, 24 bp, Homo sapiens
cggggcgcacccccagctacctcc

SEQ ID NO: 30821 - DNA, 17 bp, Homo sapiens
ctccaggcctgcccact

SEQ ID NO: 30822 - DNA, 19 bp, Homo sapiens
ctggcctcacctccaccca

SEQ ID NO: 30823 - DNA, 20 bp, Homo sapiens
ggttgcccctcctcatggga

SEQ ID NO: 30824 - DNA, 18 bp, Homo sapiens
tgcccactccctacgctg

SEQ ID NO: 30825 - DNA, 17 bp, Homo sapiens
accccgagggcacctca

SEQ ID NO: 30826 - DNA, 24 bp, Homo sapiens
accgggtccctccaggctgctgcc

SEQ ID NO: 30827 - DNA, 20 bp, Homo sapiens
aggaaagagagttccaatcc

SEQ ID NO: 30828 - DNA, 16 bp, Homo sapiens
cctcccaggcccctgc

SEQ ID NO: 30829 - DNA, 17 bp, Homo sapiens
cctgctgcccaagtcac

SEQ ID NO: 30830 - DNA, 24 bp, Homo sapiens
ccttccccagaggcctacccccca

SEQ ID NO: 30831 - DNA, 19 bp, Homo sapiens
ctgcctggccctgctcccc

SEQ ID NO: 30832 - DNA, 23 bp, Homo sapiens
ctttggccagagagacctgtgag

SEQ ID NO: 30833 - DNA, 17 bp, Homo sapiens
gctcgattgtttggttt

SEQ ID NO: 30834 - DNA, 22 bp, Homo sapiens
tccatggccactccctgccccc

SEQ ID NO: 30835 - DNA, 18 bp, Homo sapiens
tctttctctcccgtctca

SEQ ID NO: 30836 - DNA, 19 bp, Homo sapiens
agtaagatacaggtttctt

SEQ ID NO: 30837 - DNA, 22 bp, Homo sapiens
gcttgggctgttgtacgggttc

SEQ ID NO: 30838 - DNA, 20 bp, Homo sapiens
gtcctttagtttccactgga

SEQ ID NO: 30839 - DNA, 23 bp, Homo sapiens
ttgtttcttctgttatactatca

SEQ ID NO: 30840 - DNA, 16 bp, Homo sapiens
acatacacaagatcca

SEQ ID NO: 30841 - DNA, 21 bp, Homo sapiens
ctcaccctacttccaaattac

SEQ ID NO: 30842 - DNA, 23 bp, Homo sapiens
aaacccagcccacagccacctct

SEQ ID NO: 30843 - DNA, 22 bp, Homo sapiens
acctgagctgcccatcctgcct

SEQ ID NO: 30844 - DNA, 23 bp, Homo sapiens
caacggctccaagactccccttc

SEQ ID NO: 30845 - DNA, 22 bp, Homo sapiens
cccaggtggacccacccaacga

SEQ ID NO: 30846 - DNA, 18 bp, Homo sapiens
ctggccacactctctgaa

SEQ ID NO: 30847 - DNA, 17 bp, Homo sapiens
gtctgaaaaacctggtg

SEQ ID NO: 30848 - DNA, 33 bp, Homo sapiens
tcgacccgccccttctgtccactcccggcccca

SEQ ID NO: 30849 - DNA, 18 bp, Homo sapiens
cttgacacattttgaaca

SEQ ID NO: 30850 - DNA, 21 bp, Homo sapiens
acgccctcagccgccttgcca

SEQ ID NO: 30851 - DNA, 21 bp, Homo sapiens
caacaggcagaggctacccta

SEQ ID NO: 30852 - DNA, 21 bp, Homo sapiens
cgcccccagccgcgcgcccca

SEQ ID NO: 30853 - DNA, 18 bp, Homo sapiens
ggccgacgcctcccccca

SEQ ID NO: 30854 - DNA, 23 bp, Homo sapiens
aattgctacccaacattactgtt

SEQ ID NO: 30855 - DNA, 22 bp, Homo sapiens
cattccaaattgctacccaaca

SEQ ID NO: 30856 - DNA, 18 bp, Homo sapiens
ttgtttctcacatgcata

SEQ ID NO: 30857 - DNA, 21 bp, Homo sapiens
caggaatgctgccttccttca

SEQ ID NO: 30858 - DNA, 22 bp, Homo sapiens
cgcaacagctctgtacccctgc

SEQ ID NO: 30859 - DNA, 21 bp, Homo sapiens
tccaccctctcccctgttcct

SEQ ID NO: 30860 - DNA, 24 bp, Homo sapiens
ttttgaggattgcagacctgtgga

SEQ ID NO: 30861 - DNA, 17 bp, Homo sapiens
agaaaagacatgctcca

SEQ ID NO: 30862 - DNA, 20 bp, Homo sapiens
cctctgcctcctgggttcaa

SEQ ID NO: 30863 - DNA, 19 bp, Homo sapiens
gaattcctggtgtttcatc

SEQ ID NO: 30864 - DNA, 18 bp, Homo sapiens
tacaaaaagaatctgcca

SEQ ID NO: 30865 - DNA, 24 bp, Homo sapiens
tatagattaagccctataatgcta

SEQ ID NO: 30866 - DNA, 22 bp, Homo sapiens
tgctgtctcctaaggtcaccca

SEQ ID NO: 30867 - DNA, 21 bp, Homo sapiens
catggacagcatcatcactga

SEQ ID NO: 30868 - DNA, 22 bp, Homo sapiens
gcctgggctccagctttggctc

SEQ ID NO: 30869 - DNA, 21 bp, Homo sapiens
gtgctgtccatggacagcagc

SEQ ID NO: 30870 - DNA, 16 bp, Homo sapiens
tttggctctggcacag

SEQ ID NO: 30871 - DNA, 19 bp, Homo sapiens
agctccgttaagcacacac

SEQ ID NO: 30872 - DNA, 17 bp, Homo sapiens
agtagaacactcatttg

SEQ ID NO: 30873 - DNA, 21 bp, Homo sapiens
ccagagtcaggcctgctgtta

SEQ ID NO: 30874 - DNA, 16 bp, Homo sapiens
ccagggggtttgggga

SEQ ID NO: 30875 - DNA, 20 bp, Homo sapiens
cccctccaggccagtgtgca

SEQ ID NO: 30876 - DNA, 24 bp, Homo sapiens
cctagatttccctggctcactttt

SEQ ID NO: 30877 - DNA, 23 bp, Homo sapiens
ctctgcaccagggggtttgggga

SEQ ID NO: 30878 - DNA, 23 bp, Homo sapiens
tcttatctgctgctttgtgtctt

SEQ ID NO: 30879 - DNA, 22 bp, Homo sapiens
agtctcactttgtcacctaagc

SEQ ID NO: 30880 - DNA, 19 bp, Homo sapiens
cttttggtaactctgggga

SEQ ID NO: 30881 - DNA, 22 bp, Homo sapiens
taaagacttctctaagataatg

SEQ ID NO: 30882 - DNA, 21 bp, Homo sapiens
taattccaaaatactggtatc

SEQ ID NO: 30883 - DNA, 17 bp, Homo sapiens
ttctcctgccttagcct

SEQ ID NO: 30884 - DNA, 23 bp, Homo sapiens
atcacatgcagcttctgctctta

SEQ ID NO: 30885 - DNA, 19 bp, Homo sapiens
atggtttcagcatgggcta

SEQ ID NO: 30886 - DNA, 17 bp, Homo sapiens
gattcggaatggaacta

SEQ ID NO: 30887 - DNA, 19 bp, Homo sapiens
gttggtgcccctgccatca

SEQ ID NO: 30888 - DNA, 23 bp, Homo sapiens
taaatataaagtcaagactaact

SEQ ID NO: 30889 - DNA, 21 bp, Homo sapiens
tcagaaaggcagactctctca

SEQ ID NO: 30890 - DNA, 21 bp, Homo sapiens
aaacctggcagataccacctt

SEQ ID NO: 30891 - DNA, 20 bp, Homo sapiens
atttgaacccaggtctgccc

SEQ ID NO: 30892 - DNA, 21 bp, Homo sapiens
tcaaaagaaagcctggtggtt

SEQ ID NO: 30893 - DNA, 20 bp, Homo sapiens
catttgagaaacatgacaaa

SEQ ID NO: 30894 - DNA, 19 bp, Homo sapiens
cgaccccacctctgttcct

SEQ ID NO: 30895 - DNA, 19 bp, Homo sapiens
tcggcgccgcctcctgcca

SEQ ID NO: 30896 - DNA, 18 bp, Homo sapiens
tgggagtagccccactgc

SEQ ID NO: 30897 - DNA, 18 bp, Homo sapiens
atgtcctacccacaactc

SEQ ID NO: 30898 - DNA, 20 bp, Homo sapiens
aaaaacaaaaaacaaacaaa

SEQ ID NO: 30899 - DNA, 20 bp, Homo sapiens
cagtggtgtaatcatgacta

SEQ ID NO: 30900 - DNA, 16 bp, Homo sapiens
ccccatgattcagtta

SEQ ID NO: 30901 - DNA, 20 bp, Homo sapiens
ataataccactagggcctct

SEQ ID NO: 30902 - DNA, 18 bp, Homo sapiens
ctgactcagaatctgatg

SEQ ID NO: 30903 - DNA, 23 bp, Homo sapiens
cttctcccaaagcgccactgaaa

SEQ ID NO: 30904 - DNA, 25 bp, Homo sapiens
ttttttgcagaggtatcagtttatg

SEQ ID NO: 30905 - DNA, 19 bp, Homo sapiens
gcagagcatggccctccta

SEQ ID NO: 30906 - DNA, 18 bp, Homo sapiens
ccaggcagtttggcacca

SEQ ID NO: 30907 - DNA, 18 bp, Homo sapiens
cccaacctcacgcagctc

SEQ ID NO: 30908 - DNA, 21 bp, Homo sapiens
ctgagctgaaaacttcactcc

SEQ ID NO: 30909 - DNA, 21 bp, Homo sapiens
gcaccattctcatctttctca

SEQ ID NO: 30910 - DNA, 20 bp, Homo sapiens
gccagacccctgacacgccc

SEQ ID NO: 30911 - DNA, 22 bp, Homo sapiens
gcgttggccactggtgcatttt

SEQ ID NO: 30912 - DNA, 17 bp, Homo sapiens
ggctgtgttgtttgctc

SEQ ID NO: 30913 - DNA, 24 bp, Homo sapiens
gtctcagatcttgatgtgtgacta

SEQ ID NO: 30914 - DNA, 26 bp, Homo sapiens
gtctgaacctgccgtgttcttggctt

SEQ ID NO: 30915 - DNA, 22 bp, Homo sapiens
aacgtgtattctctttgaacta

SEQ ID NO: 30916 - DNA, 17 bp, Homo sapiens
cggggccgcatctgcct

SEQ ID NO: 30917 - DNA, 18 bp, Homo sapiens
aggccccagcattgttca

SEQ ID NO: 30918 - DNA, 21 bp, Homo sapiens
aatttacaggttaccaactca

SEQ ID NO: 30919 - DNA, 17 bp, Homo sapiens
atggcttaattctgaca

SEQ ID NO: 30920 - DNA, 24 bp, Homo sapiens
ctgcactccagcctgggtgtcaga

SEQ ID NO: 30921 - DNA, 19 bp, Homo sapiens
gctagtaactgtgatacca

SEQ ID NO: 30922 - DNA, 21 bp, Homo sapiens
ggcatcatagaaggccctgga

SEQ ID NO: 30923 - DNA, 21 bp, Homo sapiens
ggccaaagggaagttgtatta

SEQ ID NO: 30924 - DNA, 18 bp, Homo sapiens
tgtgataccatactataa

SEQ ID NO: 30925 - DNA, 23 bp, Homo sapiens
actttagcatgttgttgatcatg

SEQ ID NO: 30926 - DNA, 23 bp, Homo sapiens
gcagcaagctgagggtctttgtt

SEQ ID NO: 30927 - DNA, 21 bp, Homo sapiens
agcaagcaagatggggttctc

SEQ ID NO: 30928 - DNA, 20 bp, Homo sapiens
ctcctgaagaaaaagcctat

SEQ ID NO: 30929 - DNA, 21 bp, Homo sapiens
gatgtgggatggcagcagcca

SEQ ID NO: 30930 - DNA, 20 bp, Homo sapiens
gtgcattgtcagttacgtca

SEQ ID NO: 30931 - DNA, 20 bp, Homo sapiens
tctgagaaaccacccagtgc

SEQ ID NO: 30932 - DNA, 18 bp, Homo sapiens
ttctcccctacccaggga

SEQ ID NO: 30933 - DNA, 21 bp, Homo sapiens
acaaagactcagccaagagtt

SEQ ID NO: 30934 - DNA, 18 bp, Homo sapiens
actggccttgatcagtgt

SEQ ID NO: 30935 - DNA, 21 bp, Homo sapiens
aggtacggcggcaatgtgagg

SEQ ID NO: 30936 - DNA, 19 bp, Homo sapiens
ccaacccctagatcccacc

SEQ ID NO: 30937 - DNA, 17 bp, Homo sapiens
ccactctggtactatca

SEQ ID NO: 30938 - DNA, 20 bp, Homo sapiens
tctctttattccctttgatc

SEQ ID NO: 30939 - DNA, 18 bp, Homo sapiens
cgggagagctgctggcca

SEQ ID NO: 30940 - DNA, 22 bp, Homo sapiens
aagatgcatagttgaccagtca

SEQ ID NO: 30941 - DNA, 19 bp, Homo sapiens
accagaagagacatctatt

SEQ ID NO: 30942 - DNA, 16 bp, Homo sapiens
atcctgagccatggtg

SEQ ID NO: 30943 - DNA, 24 bp, Homo sapiens
atttgtactgaaattgtacatgat

SEQ ID NO: 30944 - DNA, 18 bp, Homo sapiens
aaagttgggatttggcag

SEQ ID NO: 30945 - DNA, 20 bp, Homo sapiens
agaaaaatctttacccaaat

SEQ ID NO: 30946 - DNA, 17 bp, Homo sapiens
atgccctgactgttcca

SEQ ID NO: 30947 - DNA, 17 bp, Homo sapiens
tgacagggacacaacca

SEQ ID NO: 30948 - DNA, 21 bp, Homo sapiens
tttggtcccctcacatttggc

SEQ ID NO: 30949 - DNA, 22 bp, Homo sapiens
cttctgaactttgttttgacct

SEQ ID NO: 30950 - DNA, 21 bp, Homo sapiens
tgtgttcatgtattttctgaa

SEQ ID NO: 30951 - DNA, 24 bp, Homo sapiens
gagggccgggacagctttcctctc

SEQ ID NO: 30952 - DNA, 24 bp, Homo sapiens
gcctgggctgagggtctctggccc

SEQ ID NO: 30953 - DNA, 17 bp, Homo sapiens
tcttcagccctcgctct

SEQ ID NO: 30954 - DNA, 16 bp, Homo sapiens
aggcctgaggtactca

SEQ ID NO: 30955 - DNA, 20 bp, Homo sapiens
gaatgcaagtttaattacca

SEQ ID NO: 30956 - DNA, 23 bp, Homo sapiens
gcttggaaaaatcttgcttggct

SEQ ID NO: 30957 - DNA, 19 bp, Homo sapiens
agtggtggtgttacctcac

SEQ ID NO: 30958 - DNA, 19 bp, Homo sapiens
cctgaactgtgggtggctg

SEQ ID NO: 30959 - DNA, 21 bp, Homo sapiens
tctgcctgagatcccacccca

SEQ ID NO: 30960 - DNA, 17 bp, Homo sapiens
actgccagctctgctcc

SEQ ID NO: 30961 - DNA, 20 bp, Homo sapiens
agctgtcccgtcccccagga

SEQ ID NO: 30962 - DNA, 20 bp, Homo sapiens
atggtgaaaccccatgtcta

SEQ ID NO: 30963 - DNA, 21 bp, Homo sapiens
cacacgcatacacacatgaac

SEQ ID NO: 30964 - DNA, 17 bp, Homo sapiens
cacatgcacatgtgcac

SEQ ID NO: 30965 - DNA, 19 bp, Homo sapiens
ccagccatccccgccacca

SEQ ID NO: 30966 - DNA, 22 bp, Homo sapiens
cctcctcaccaacgtgtcctca

SEQ ID NO: 30967 - DNA, 21 bp, Homo sapiens
ggcatctcacactgcaaccgc

SEQ ID NO: 30968 - DNA, 19 bp, Homo sapiens
ggccctggcttctgcgacg

SEQ ID NO: 30969 - DNA, 19 bp, Homo sapiens
tgtgggggtggtgggggtg

SEQ ID NO: 30970 - DNA, 19 bp, Homo sapiens
aaggcctacgggttcaaga

SEQ ID NO: 30971 - DNA, 22 bp, Homo sapiens
accatcgtcaacgtgcagacca

SEQ ID NO: 30972 - DNA, 21 bp, Homo sapiens
aggactacatggcggacgcca

SEQ ID NO: 30973 - DNA, 20 bp, Homo sapiens
gagccgcaaggcgcccaagc

SEQ ID NO: 30974 - DNA, 18 bp, Homo sapiens
gcccgaccaccacttcct

SEQ ID NO: 30975 - DNA, 22 bp, Homo sapiens
gcctggacaccacgccgggctc

SEQ ID NO: 30976 - DNA, 21 bp, Homo sapiens
gcggaagaagagggccttctc

SEQ ID NO: 30977 - DNA, 18 bp, Homo sapiens
ggcctggacaccacgccg

SEQ ID NO: 30978 - DNA, 23 bp, Homo sapiens
tactacatggagggctctgtgga

SEQ ID NO: 30979 - DNA, 20 bp, Homo sapiens
ttctacttctgcatcgtcac

SEQ ID NO: 30980 - DNA, 23 bp, Homo sapiens
aagaaaacgagctgagggtctaa

SEQ ID NO: 30981 - DNA, 19 bp, Homo sapiens
accccctctgcagatctga

SEQ ID NO: 30982 - DNA, 24 bp, Homo sapiens
ccagagaccacaggagccgtacca

SEQ ID NO: 30983 - DNA, 20 bp, Homo sapiens
ccttaggtggccccacgagc

SEQ ID NO: 30984 - DNA, 18 bp, Homo sapiens
ctctgtgtccttgctgcc

SEQ ID NO: 30985 - DNA, 20 bp, Homo sapiens
gcctgaaactctcaggagtc

SEQ ID NO: 30986 - DNA, 20 bp, Homo sapiens
tgggcagcagcatgaggctg

SEQ ID NO: 30987 - DNA, 24 bp, Homo sapiens
agtgttcaaaaccccagccaatga

SEQ ID NO: 30988 - DNA, 21 bp, Homo sapiens
cccaggccggagatctgcgag

SEQ ID NO: 30989 - DNA, 18 bp, Homo sapiens
cccatttctcatttaaca

SEQ ID NO: 30990 - DNA, 23 bp, Homo sapiens
cattcctggccccgccccctgca

SEQ ID NO: 30991 - DNA, 18 bp, Homo sapiens
aacaggacccatatcaac

SEQ ID NO: 30992 - DNA, 18 bp, Homo sapiens
aaacacagaattcagtga

SEQ ID NO: 30993 - DNA, 24 bp, Homo sapiens
ctttacagggtgcaaacagcaaga

SEQ ID NO: 30994 - DNA, 22 bp, Homo sapiens
gcacctctctggtcttcccttt

SEQ ID NO: 30995 - DNA, 19 bp, Homo sapiens
gccttttcatcactacccg

SEQ ID NO: 30996 - DNA, 20 bp, Homo sapiens
taccagattcgtgtcactgc

SEQ ID NO: 30997 - DNA, 18 bp, Homo sapiens
tttgatgtaacttctcac

SEQ ID NO: 30998 - DNA, 19 bp, Homo sapiens
aggagctggaccccagtga

SEQ ID NO: 30999 - DNA, 17 bp, Homo sapiens
caaagaaatggagaccc

SEQ ID NO: 31000 - DNA, 20 bp, Homo sapiens
gcaggcttctctccctgcca

SEQ ID NO: 31001 - DNA, 21 bp, Homo sapiens
gggaaagagcccagcctgcca

SEQ ID NO: 31002 - DNA, 20 bp, Homo sapiens
gtgggtcacacaagccctta

SEQ ID NO: 31003 - DNA, 23 bp, Homo sapiens
taaatggatgttgcttgaagctg

SEQ ID NO: 31004 - DNA, 17 bp, Homo sapiens
tgggctcacaaaactga

SEQ ID NO: 31005 - DNA, 22 bp, Homo sapiens
gcccctgtaggtccctctggga

SEQ ID NO: 31006 - DNA, 19 bp, Homo sapiens
tgggggtcaggacaatttt

SEQ ID NO: 31007 - DNA, 23 bp, Homo sapiens
ttctttggcctgggtggtttata

SEQ ID NO: 31008 - DNA, 23 bp, Homo sapiens
ccctgcccggcggggcctgtgaa

SEQ ID NO: 31009 - DNA, 19 bp, Homo sapiens
ctgcccgaactcccacctc

SEQ ID NO: 31010 - DNA, 18 bp, Homo sapiens
cttaatgctggtccttca

SEQ ID NO: 31011 - DNA, 18 bp, Homo sapiens
gcaccaccaccaccacct

SEQ ID NO: 31012 - DNA, 25 bp, Homo sapiens
gcctcatcgccgtggccgtctgcct

SEQ ID NO: 31013 - DNA, 19 bp, Homo sapiens
gctttggcacccaccaagg

SEQ ID NO: 31014 - DNA, 19 bp, Homo sapiens
gtgcctggagcctgggcca

SEQ ID NO: 31015 - DNA, 18 bp, Homo sapiens
tgaatatgcaatgggagt

SEQ ID NO: 31016 - DNA, 19 bp, Homo sapiens
aggactaccagcttgctca

SEQ ID NO: 31017 - DNA, 16 bp, Homo sapiens
ccagcttgctcagtta

SEQ ID NO: 31018 - DNA, 16 bp, Homo sapiens
ccatctcagtttgcaa

SEQ ID NO: 31019 - DNA, 19 bp, Homo sapiens
cttgccctcgaattctgca

SEQ ID NO: 31020 - DNA, 21 bp, Homo sapiens
gctgtttcctcctcctccccc

SEQ ID NO: 31021 - DNA, 17 bp, Homo sapiens
gttcaatcactgatggg

SEQ ID NO: 31022 - DNA, 20 bp, Homo sapiens
aatgtttatgatatgttaaa

SEQ ID NO: 31023 - DNA, 20 bp, Homo sapiens
aggagaaagagaaataacct

SEQ ID NO: 31024 - DNA, 21 bp, Homo sapiens
cctttttatttcagtttagcc

SEQ ID NO: 31025 - DNA, 21 bp, Homo sapiens
gcaatagattcattcagtgga

SEQ ID NO: 31026 - DNA, 18 bp, Homo sapiens
gccatcctgtatacacca

SEQ ID NO: 31027 - DNA, 16 bp, Homo sapiens
tggcattctctagcaa

SEQ ID NO: 31028 - DNA, 22 bp, Homo sapiens
atcttggctcactgcagcctct

SEQ ID NO: 31029 - DNA, 21 bp, Homo sapiens
caccatcaccatcctttttca

SEQ ID NO: 31030 - DNA, 18 bp, Homo sapiens
catcaccatcctttttca

SEQ ID NO: 31031 - DNA, 20 bp, Homo sapiens
cctctgcctcctgggttcaa

SEQ ID NO: 31032 - DNA, 16 bp, Homo sapiens
gcctttttgccactca

SEQ ID NO: 31033 - DNA, 24 bp, Homo sapiens
taaaaacatatcagaacaaatgaa

SEQ ID NO: 31034 - DNA, 18 bp, Homo sapiens
tcaccatttgcctgtaaa

SEQ ID NO: 31035 - DNA, 20 bp, Homo sapiens
tcatttgtcacagtgactca

SEQ ID NO: 31036 - DNA, 20 bp, Homo sapiens
tgggtgggctctaaatttgg

SEQ ID NO: 31037 - DNA, 17 bp, Homo sapiens
ctgaacaatccatttga

SEQ ID NO: 31038 - DNA, 18 bp, Homo sapiens
gaatttcttgtagtcata

SEQ ID NO: 31039 - DNA, 18 bp, Homo sapiens
tagcttcaagaatttctt

SEQ ID NO: 31040 - DNA, 17 bp, Homo sapiens
catgtaccgtgctgcag

SEQ ID NO: 31041 - DNA, 20 bp, Homo sapiens
ctcatcagtaatattcacca

SEQ ID NO: 31042 - DNA, 19 bp, Homo sapiens
cttgagattatgagactga

SEQ ID NO: 31043 - DNA, 18 bp, Homo sapiens
tgaaccggagacatcact

SEQ ID NO: 31044 - DNA, 22 bp, Homo sapiens
ttagctttctcccattacctca

SEQ ID NO: 31045 - DNA, 22 bp, Homo sapiens
tccacggccagcccctccctca

SEQ ID NO: 31046 - DNA, 21 bp, Homo sapiens
gtcccacccacctctgcctcc

SEQ ID NO: 31047 - DNA, 20 bp, Homo sapiens
acaaaaattagctgggcgtt

SEQ ID NO: 31048 - DNA, 18 bp, Homo sapiens
agacatttaggtatctca

SEQ ID NO: 31049 - DNA, 21 bp, Homo sapiens
cactgccttttgccctcgcca

SEQ ID NO: 31050 - DNA, 23 bp, Homo sapiens
cccctgggccctgaatggagcta

SEQ ID NO: 31051 - DNA, 22 bp, Homo sapiens
ctatcccaagtgtgatccttca

SEQ ID NO: 31052 - DNA, 24 bp, Homo sapiens
tccacctagggccacctagtggta

SEQ ID NO: 31053 - DNA, 17 bp, Homo sapiens
acaaaagctagcctgga

SEQ ID NO: 31054 - DNA, 20 bp, Homo sapiens
cataccccagcctgcactga

SEQ ID NO: 31055 - DNA, 20 bp, Homo sapiens
gcccccacccgccatcctct

SEQ ID NO: 31056 - DNA, 21 bp, Homo sapiens
agagcaagcacatctccatct

SEQ ID NO: 31057 - DNA, 20 bp, Homo sapiens
aggaggtaccagcacctgcc

SEQ ID NO: 31058 - DNA, 19 bp, Homo sapiens
caagcacatctccatctct

SEQ ID NO: 31059 - DNA, 16 bp, Homo sapiens
cccagccctgtcccag

SEQ ID NO: 31060 - DNA, 24 bp, Homo sapiens
ccccacccggaggacccctgcggc

SEQ ID NO: 31061 - DNA, 23 bp, Homo sapiens
cctccccaccattcccgtactca

SEQ ID NO: 31062 - DNA, 16 bp, Homo sapiens
ctccctcctctactct

SEQ ID NO: 31063 - DNA, 22 bp, Homo sapiens
ctgggctagagcaagcacatct

SEQ ID NO: 31064 - DNA, 18 bp, Homo sapiens
gagatgggggacctgtgg

SEQ ID NO: 31065 - DNA, 17 bp, Homo sapiens
gagtcgcccaggttagc

SEQ ID NO: 31066 - DNA, 23 bp, Homo sapiens
tctcagggtgaggagctgccagt

SEQ ID NO: 31067 - DNA, 19 bp, Homo sapiens
tgccccatcccatccccct

SEQ ID NO: 31068 - DNA, 22 bp, Homo sapiens
tggctcctcagcccacagaggg

SEQ ID NO: 31069 - DNA, 20 bp, Homo sapiens
tgggctggctggcatgaggc

SEQ ID NO: 31070 - DNA, 24 bp, Homo sapiens
tgtgtggaacgagttcttggaatg

SEQ ID NO: 31071 - DNA, 22 bp, Homo sapiens
ccccacccactccctacagtcc

SEQ ID NO: 31072 - DNA, 20 bp, Homo sapiens
ctgcccccaatgccccgagg

SEQ ID NO: 31073 - DNA, 21 bp, Homo sapiens
ttctgacccactgggatttgc

SEQ ID NO: 31074 - DNA, 18 bp, Homo sapiens
agatgtgactcagatcct

SEQ ID NO: 31075 - DNA, 20 bp, Homo sapiens
agctgtggctgcttgtttca

SEQ ID NO: 31076 - DNA, 21 bp, Homo sapiens
agtgtgtggggggtgtgtgtg

SEQ ID NO: 31077 - DNA, 23 bp, Homo sapiens
ataaagctgtggctgcttgtttc

SEQ ID NO: 31078 - DNA, 18 bp, Homo sapiens
catcttaaagttggagca

SEQ ID NO: 31079 - DNA, 20 bp, Homo sapiens
ccatcctacttaaacaccta

SEQ ID NO: 31080 - DNA, 24 bp, Homo sapiens
cctgtctgaacccctcgttcttca

SEQ ID NO: 31081 - DNA, 18 bp, Homo sapiens
cttcacctgccacctcgt

SEQ ID NO: 31082 - DNA, 20 bp, Homo sapiens
cttgggttttcaagttgctt

SEQ ID NO: 31083 - DNA, 19 bp, Homo sapiens
cttggtgtcggtttgggag

SEQ ID NO: 31084 - DNA, 19 bp, Homo sapiens
gaaggacctcagacatttt

SEQ ID NO: 31085 - DNA, 20 bp, Homo sapiens
gcaaggcattcttgggtttt

SEQ ID NO: 31086 - DNA, 18 bp, Homo sapiens
gtcacatgataaaagttt

SEQ ID NO: 31087 - DNA, 25 bp, Homo sapiens
tctttttatactttgtcttgttttt

SEQ ID NO: 31088 - DNA, 18 bp, Homo sapiens
tgcgtgtgcacatgtgtg

SEQ ID NO: 31089 - DNA, 20 bp, Homo sapiens
ttttgatgatggttgtgtga

SEQ ID NO: 31090 - DNA, 20 bp, Homo sapiens
accttttctatgtctaaata

SEQ ID NO: 31091 - DNA, 17 bp, Homo sapiens
tgacttcaactttggca

SEQ ID NO: 31092 - DNA, 18 bp, Homo sapiens
tcttcctctctttcattc

SEQ ID NO: 31093 - DNA, 21 bp, Homo sapiens
agatgaaacaagatcatgaaa

SEQ ID NO: 31094 - DNA, 22 bp, Homo sapiens
agattctaagaaaatgttcaca

SEQ ID NO: 31095 - DNA, 19 bp, Homo sapiens
attgctgaaaaatgagttt

SEQ ID NO: 31096 - DNA, 22 bp, Homo sapiens
ccacagtgccctgcttacctgc

SEQ ID NO: 31097 - DNA, 18 bp, Homo sapiens
cgggcagggaacatcaca

SEQ ID NO: 31098 - DNA, 23 bp, Homo sapiens
cttaggaattcatatgcacctta

SEQ ID NO: 31099 - DNA, 18 bp, Homo sapiens
gccaacccaaatgcccat

SEQ ID NO: 31100 - DNA, 24 bp, Homo sapiens
gccgccaacaaaacgtcgatcacc

SEQ ID NO: 31101 - DNA, 22 bp, Homo sapiens
taaactaaagagcttctgcaca

SEQ ID NO: 31102 - DNA, 19 bp, Homo sapiens
tgaacaatgagaatacatg

SEQ ID NO: 31103 - DNA, 17 bp, Homo sapiens
aagtaactactacaggt

SEQ ID NO: 31104 - DNA, 23 bp, Homo sapiens
acgcccttcagcaccccctccca

SEQ ID NO: 31105 - DNA, 17 bp, Homo sapiens
ccacggcaacaggttgc

SEQ ID NO: 31106 - DNA, 18 bp, Homo sapiens
cctgcaacctccacctcc

SEQ ID NO: 31107 - DNA, 16 bp, Homo sapiens
gaatttactctacaac

SEQ ID NO: 31108 - DNA, 18 bp, Homo sapiens
gcccttcagcaccccctc

SEQ ID NO: 31109 - DNA, 24 bp, Homo sapiens
gcctgagctgtcttgtctgtgttt

SEQ ID NO: 31110 - DNA, 21 bp, Homo sapiens
gcttggactgcttctctgtct

SEQ ID NO: 31111 - DNA, 19 bp, Homo sapiens
gtcacacaggagccctgga

SEQ ID NO: 31112 - DNA, 21 bp, Homo sapiens
gtcaggattgctattcctgct

SEQ ID NO: 31113 - DNA, 19 bp, Homo sapiens
taaatgctgtgggaagcca

SEQ ID NO: 31114 - DNA, 20 bp, Homo sapiens
taagcaatcctcccacttca

SEQ ID NO: 31115 - DNA, 25 bp, Homo sapiens
tacatggctcaagttccatctgcca

SEQ ID NO: 31116 - DNA, 18 bp, Homo sapiens
tccacctcccgggttcaa

SEQ ID NO: 31117 - DNA, 20 bp, Homo sapiens
tggtcaggctggtcttgaac

SEQ ID NO: 31118 - DNA, 19 bp, Homo sapiens
tttccctcccctgacctct

SEQ ID NO: 31119 - DNA, 22 bp, Homo sapiens
agaagtctcaccggcagagcca

SEQ ID NO: 31120 - DNA, 22 bp, Homo sapiens
caggacatgacgccgctcagcg

SEQ ID NO: 31121 - DNA, 19 bp, Homo sapiens
ctggaaatgactgttccag

SEQ ID NO: 31122 - DNA, 18 bp, Homo sapiens
ggagcccaagaagtctca

SEQ ID NO: 31123 - DNA, 21 bp, Homo sapiens
gtatcatgcaccaactgtgaa

SEQ ID NO: 31124 - DNA, 20 bp, Homo sapiens
tccagttggtcctgctgcca

SEQ ID NO: 31125 - DNA, 18 bp, Homo sapiens
ccccacccggcccgcagc

SEQ ID NO: 31126 - DNA, 21 bp, Homo sapiens
ccccaccctctgccccccagc

SEQ ID NO: 31127 - DNA, 24 bp, Homo sapiens
ctccgccggtccccaccctctgcc

SEQ ID NO: 31128 - DNA, 23 bp, Homo sapiens
gactattttaaccaatattgtca

SEQ ID NO: 31129 - DNA, 18 bp, Homo sapiens
tccagagaggcaccccag

SEQ ID NO: 31130 - DNA, 20 bp, Homo sapiens
ttcaagaccagcctgaccaa

SEQ ID NO: 31131 - DNA, 16 bp, Homo sapiens
tccaggaaacccgctg

SEQ ID NO: 31132 - DNA, 18 bp, Homo sapiens
cttcacccaccagctggc

SEQ ID NO: 31133 - DNA, 21 bp, Homo sapiens
acaagctgaaggcagcagctt

SEQ ID NO: 31134 - DNA, 18 bp, Homo sapiens
ggagaaaggacctcctgg

SEQ ID NO: 31135 - DNA, 23 bp, Homo sapiens
ggtgggtggaggggtttgcagtg

SEQ ID NO: 31136 - DNA, 22 bp, Homo sapiens
ttctgtcttcctttgctaactt

SEQ ID NO: 31137 - DNA, 18 bp, Homo sapiens
accagcaatacaacgtca

SEQ ID NO: 31138 - DNA, 23 bp, Homo sapiens
agtctcctacttccctaccggca

SEQ ID NO: 31139 - DNA, 19 bp, Homo sapiens
atttgtgacctgaacctga

SEQ ID NO: 31140 - DNA, 19 bp, Homo sapiens
ccagacggaggacctggaa

SEQ ID NO: 31141 - DNA, 23 bp, Homo sapiens
ccttggcggtggaaggccccagc

SEQ ID NO: 31142 - DNA, 21 bp, Homo sapiens
cgtttcagtcccttccttggt

SEQ ID NO: 31143 - DNA, 22 bp, Homo sapiens
ctgcattgacaataaagatggg

SEQ ID NO: 31144 - DNA, 19 bp, Homo sapiens
ctgtcgggagcatttgtga

SEQ ID NO: 31145 - DNA, 16 bp, Homo sapiens
gtacaatgacaagcac

SEQ ID NO: 31146 - DNA, 19 bp, Homo sapiens
gtgaagttgggctcagccg

SEQ ID NO: 31147 - DNA, 24 bp, Homo sapiens
gtgggcgaacatctggtcagcatc

SEQ ID NO: 31148 - DNA, 21 bp, Homo sapiens
tcaccatcgaaggcccatcca

SEQ ID NO: 31149 - DNA, 21 bp, Homo sapiens
tcctaaccttactaaagacca

SEQ ID NO: 31150 - DNA, 19 bp, Homo sapiens
cagctagatgatcatcata

SEQ ID NO: 31151 - DNA, 18 bp, Homo sapiens
ctgtcctttcaagagcca

SEQ ID NO: 31152 - DNA, 22 bp, Homo sapiens
cttctttatgccacttaggctt

SEQ ID NO: 31153 - DNA, 19 bp, Homo sapiens
cctggaaaggatctgggaa

SEQ ID NO: 31154 - DNA, 18 bp, Homo sapiens
cttgggtttgtctggctt

SEQ ID NO: 31155 - DNA, 19 bp, Homo sapiens
gatatattattttattcca

SEQ ID NO: 31156 - DNA, 28 bp, Homo sapiens
gcctggacaacttgggtttgtctggctt

SEQ ID NO: 31157 - DNA, 21 bp, Homo sapiens
tcgtgggtaacttgcttttgg

SEQ ID NO: 31158 - DNA, 21 bp, Homo sapiens
tgtcagctacttcattcctgt

SEQ ID NO: 31159 - DNA, 23 bp, Homo sapiens
tgtgttataaatatggcaagaaa

SEQ ID NO: 31160 - DNA, 18 bp, Homo sapiens
aacagattaacactggta

SEQ ID NO: 31161 - DNA, 22 bp, Homo sapiens
acttcagaggcagccaatcata

SEQ ID NO: 31162 - DNA, 21 bp, Homo sapiens
ggaaaatataaggaaatactg

SEQ ID NO: 31163 - DNA, 18 bp, Homo sapiens
tatctgcccatgaaaaca

SEQ ID NO: 31164 - DNA, 23 bp, Homo sapiens
agatctaaagcctttttatccca

SEQ ID NO: 31165 - DNA, 18 bp, Homo sapiens
agctcttcacagatctca

SEQ ID NO: 31166 - DNA, 22 bp, Homo sapiens
agttgtgtgaggattgcattaa

SEQ ID NO: 31167 - DNA, 21 bp, Homo sapiens
cttagtgaccatttggcatca

SEQ ID NO: 31168 - DNA, 17 bp, Homo sapiens
cttctttgtattatgat

SEQ ID NO: 31169 - DNA, 21 bp, Homo sapiens
gacttagtgaccatttggcat

SEQ ID NO: 31170 - DNA, 23 bp, Homo sapiens
taaaattagaatcaagacagctg

SEQ ID NO: 31171 - DNA, 18 bp, Homo sapiens
tatagtggaaagcagtct

SEQ ID NO: 31172 - DNA, 17 bp, Homo sapiens
tctgttttgtgtttact

SEQ ID NO: 31173 - DNA, 20 bp, Homo sapiens
ttttactttgtttgtacaaa

SEQ ID NO: 31174 - DNA, 21 bp, Homo sapiens
agacaggtttttggcttatca

SEQ ID NO: 31175 - DNA, 21 bp, Homo sapiens
agaggcttgcagatttgcttt

SEQ ID NO: 31176 - DNA, 19 bp, Homo sapiens
agccctttagagttcctga

SEQ ID NO: 31177 - DNA, 23 bp, Homo sapiens
atcttagtctcttcaggatcttt

SEQ ID NO: 31178 - DNA, 21 bp, Homo sapiens
ccaactgaaaacaacagtgac

SEQ ID NO: 31179 - DNA, 20 bp, Homo sapiens
cctgaggcatcgaatgggct

SEQ ID NO: 31180 - DNA, 23 bp, Homo sapiens
ccttccccatgctgttgtcccca

SEQ ID NO: 31181 - DNA, 22 bp, Homo sapiens
ctctctctctcctctctctctc

SEQ ID NO: 31182 - DNA, 17 bp, Homo sapiens
ctctctctctctcctct

SEQ ID NO: 31183 - DNA, 18 bp, Homo sapiens
cttgagctgaacctggtc

SEQ ID NO: 31184 - DNA, 20 bp, Homo sapiens
gaaattaaaacaggacccca

SEQ ID NO: 31185 - DNA, 21 bp, Homo sapiens
ggtttttggcttatcacagca

SEQ ID NO: 31186 - DNA, 23 bp, Homo sapiens
taagtgggtatacgctgaagctg

SEQ ID NO: 31187 - DNA, 18 bp, Homo sapiens
tctctcctcattttagtt

SEQ ID NO: 31188 - DNA, 22 bp, Homo sapiens
tggaagctcctagtagaggctg

SEQ ID NO: 31189 - DNA, 16 bp, Homo sapiens
tttggagacacccagg

SEQ ID NO: 31190 - DNA, 19 bp, Homo sapiens
ttttgatggtggataagat

SEQ ID NO: 31191 - DNA, 18 bp, Homo sapiens
aagtaactactttggctc

SEQ ID NO: 31192 - DNA, 17 bp, Homo sapiens
catatccctcaggcctc

SEQ ID NO: 31193 - DNA, 17 bp, Homo sapiens
acacccatttcaagtgt

SEQ ID NO: 31194 - DNA, 17 bp, Homo sapiens
agtttccaaagtcacag

SEQ ID NO: 31195 - DNA, 20 bp, Homo sapiens
cttcttcagacactgaacat

SEQ ID NO: 31196 - DNA, 19 bp, Homo sapiens
ggcctttgaactgcagcag

SEQ ID NO: 31197 - DNA, 23 bp, Homo sapiens
tactttgtttaaacttttttaaa

SEQ ID NO: 31198 - DNA, 20 bp, Homo sapiens
tagggttgatctgccacctc

SEQ ID NO: 31199 - DNA, 22 bp, Homo sapiens
tcagtggtgtagctgtaactat

SEQ ID NO: 31200 - DNA, 21 bp, Homo sapiens
tcctgaaccccattcaagaaa

SEQ ID NO: 31201 - DNA, 19 bp, Homo sapiens
tgaagaggctgccaaagta

SEQ ID NO: 31202 - DNA, 20 bp, Homo sapiens
tgcctctgtccacatttccc

SEQ ID NO: 31203 - DNA, 18 bp, Homo sapiens
tttctgattgctactgtg

SEQ ID NO: 31204 - DNA, 24 bp, Homo sapiens
tagctaaaacagaaacgtaaggcc

SEQ ID NO: 31205 - DNA, 19 bp, Homo sapiens
accagagaatccacactgg

SEQ ID NO: 31206 - DNA, 21 bp, Homo sapiens
catcttagacttcatcagaca

SEQ ID NO: 31207 - DNA, 23 bp, Homo sapiens
gcaaagcctttaaagcgtcttcc

SEQ ID NO: 31208 - DNA, 19 bp, Homo sapiens
tgtagcaatgcagttatga

SEQ ID NO: 31209 - DNA, 20 bp, Homo sapiens
ttttttgtagcaatgcagtt

SEQ ID NO: 31210 - DNA, 22 bp, Homo sapiens
cttgagtaggattcacatttaa

SEQ ID NO: 31211 - DNA, 18 bp, Homo sapiens
tagacatcgaaacattca

SEQ ID NO: 31212 - DNA, 19 bp, Homo sapiens
tagcacacacttttcctga

SEQ ID NO: 31213 - DNA, 20 bp, Homo sapiens
ttttcctgacaggcacagtg

SEQ ID NO: 31214 - DNA, 19 bp, Homo sapiens
ggatcttcagcaaccagcc

SEQ ID NO: 31215 - DNA, 19 bp, Homo sapiens
aagcaattctcctgcctca

SEQ ID NO: 31216 - DNA, 19 bp, Homo sapiens
aagcaattctcctgcctca

SEQ ID NO: 31217 - DNA, 22 bp, Homo sapiens
aatgtggcaaatttttcagaca

SEQ ID NO: 31218 - DNA, 21 bp, Homo sapiens
accacttattcaccatcaagc

SEQ ID NO: 31219 - DNA, 22 bp, Homo sapiens
agtaatgctacaaccattgcac

SEQ ID NO: 31220 - DNA, 19 bp, Homo sapiens
atagtggagagaaacctta

SEQ ID NO: 31221 - DNA, 22 bp, Homo sapiens
caattgagtatataatcattga

SEQ ID NO: 31222 - DNA, 21 bp, Homo sapiens
cacccgactccacctcccaaa

SEQ ID NO: 31223 - DNA, 23 bp, Homo sapiens
cctgggtaattttttgtgttttt

SEQ ID NO: 31224 - DNA, 24 bp, Homo sapiens
ctgggtttcaccgtgttagccaga

SEQ ID NO: 31225 - DNA, 20 bp, Homo sapiens
gctgacactacagttgtgtg

SEQ ID NO: 31226 - DNA, 18 bp, Homo sapiens
tccacttcccaggttcaa

SEQ ID NO: 31227 - DNA, 22 bp, Homo sapiens
tgaagagaaaccatacagaggt

SEQ ID NO: 31228 - DNA, 18 bp, Homo sapiens
tgtcatctacaaacaaat

SEQ ID NO: 31229 - DNA, 18 bp, Homo sapiens
ttctcctgcctcagcctt

SEQ ID NO: 31230 - DNA, 24 bp, Homo sapiens
agtctcactctgtcacctaggttg

SEQ ID NO: 31231 - DNA, 20 bp, Homo sapiens
caacctctgcgaggcctgtg

SEQ ID NO: 31232 - DNA, 20 bp, Homo sapiens
cctctgcctcccgggttcaa

SEQ ID NO: 31233 - DNA, 18 bp, Homo sapiens
cctgcccccaccttccca

SEQ ID NO: 31234 - DNA, 23 bp, Homo sapiens
gcctgagctactgcgcttggccc

SEQ ID NO: 31235 - DNA, 18 bp, Homo sapiens
ggactcggttgggctcgg

SEQ ID NO: 31236 - DNA, 19 bp, Homo sapiens
gtaccaccccacctgccca

SEQ ID NO: 31237 - DNA, 21 bp, Homo sapiens
tgaatctgcccagttcccaca

SEQ ID NO: 31238 - DNA, 19 bp, Homo sapiens
ttccgcccgcctctgcctc

SEQ ID NO: 31239 - DNA, 24 bp, Homo sapiens
atctgagaatgtccttcttggttt

SEQ ID NO: 31240 - DNA, 26 bp, Homo sapiens
ctctgttaccagtggggggcctgtgg

SEQ ID NO: 31241 - DNA, 20 bp, Homo sapiens
ctggagcgattgcctggccc

SEQ ID NO: 31242 - DNA, 19 bp, Homo sapiens
gaaacctagtaatgccatc

SEQ ID NO: 31243 - DNA, 27 bp, Homo sapiens
gcctgggccccctgcactgcctggtcc

SEQ ID NO: 31244 - DNA, 17 bp, Homo sapiens
gggctgatggtccctcc

SEQ ID NO: 31245 - DNA, 29 bp, Homo sapiens
tcccctgtgagccgtggcttgtctggtct

SEQ ID NO: 31246 - DNA, 18 bp, Homo sapiens
tcctgaactcctcaagca

SEQ ID NO: 31247 - DNA, 22 bp, Homo sapiens
tggggaggtggatcctctgcca

SEQ ID NO: 31248 - DNA, 24 bp, Homo sapiens
aacactggaaatcattttaccaca

SEQ ID NO: 31249 - DNA, 19 bp, Homo sapiens
cccgaaaaagactacctgg

SEQ ID NO: 31250 - DNA, 19 bp, Homo sapiens
ccttcaataagccccacta

SEQ ID NO: 31251 - DNA, 18 bp, Homo sapiens
ctccttctttgttctggt

SEQ ID NO: 31252 - DNA, 18 bp, Homo sapiens
ctggacatagacatcaac

SEQ ID NO: 31253 - DNA, 18 bp, Homo sapiens
ctgtgagctgatcctcca

SEQ ID NO: 31254 - DNA, 19 bp, Homo sapiens
gctccaagagataacacat

SEQ ID NO: 31255 - DNA, 18 bp, Homo sapiens
gtctgactgcagatgcca

SEQ ID NO: 31256 - DNA, 18 bp, Homo sapiens
tgatgggaacatctacca

SEQ ID NO: 31257 - DNA, 24 bp, Homo sapiens
ttctggggcaaggagagcttgtgg

SEQ ID NO: 31258 - DNA, 20 bp, Homo sapiens
caacccttattccactgcct

SEQ ID NO: 31259 - DNA, 19 bp, Homo sapiens
ttcttccctgccttacctt

SEQ ID NO: 31260 - DNA, 19 bp, Homo sapiens
aaacacagaagactatttc

SEQ ID NO: 31261 - DNA, 19 bp, Homo sapiens
aagcaattctcctgcctca

SEQ ID NO: 31262 - DNA, 24 bp, Homo sapiens
caccactagtgcctctggatttag

SEQ ID NO: 31263 - DNA, 24 bp, Homo sapiens
cctcttttaaatgtacttgacttt

SEQ ID NO: 31264 - DNA, 18 bp, Homo sapiens
ctgtgttcacactgaatt

SEQ ID NO: 31265 - DNA, 19 bp, Homo sapiens
tctcctgcctcagccttcg

SEQ ID NO: 31266 - DNA, 21 bp, Homo sapiens
atttgggctaaagtttggctt

SEQ ID NO: 31267 - DNA, 17 bp, Homo sapiens
ctcacctcctctgcctt

SEQ ID NO: 31268 - DNA, 18 bp, Homo sapiens
cttctctggctctgccct

SEQ ID NO: 31269 - DNA, 22 bp, Homo sapiens
tccactgtcttccctggtggag

SEQ ID NO: 31270 - DNA, 16 bp, Homo sapiens
tgagtgagtatgtgtg

SEQ ID NO: 31271 - DNA, 17 bp, Homo sapiens
acaaaagtagccttaca

SEQ ID NO: 31272 - DNA, 23 bp, Homo sapiens
ataaatgttatgaaaaggcagaa

SEQ ID NO: 31273 - DNA, 18 bp, Homo sapiens
cctgataagctctgtgaa

SEQ ID NO: 31274 - DNA, 18 bp, Homo sapiens
ggagcccagctgggattg

SEQ ID NO: 31275 - DNA, 17 bp, Homo sapiens
taagcccaagtcatttt

SEQ ID NO: 31276 - DNA, 21 bp, Homo sapiens
tcaccctgtttacatgccata

SEQ ID NO: 31277 - DNA, 26 bp, Homo sapiens
tcttttcatgttaaaagccttaatct

SEQ ID NO: 31278 - DNA, 18 bp, Homo sapiens
tgtgcgcttattgtctca

SEQ ID NO: 31279 - DNA, 22 bp, Homo sapiens
agtctcccaccaccctgctggc

SEQ ID NO: 31280 - DNA, 24 bp, Homo sapiens
atgtggagatgggacagtgggtga

SEQ ID NO: 31281 - DNA, 16 bp, Homo sapiens
caagcactcctgcctc

SEQ ID NO: 31282 - DNA, 23 bp, Homo sapiens
ccatcctccacccaggcacttcc

SEQ ID NO: 31283 - DNA, 22 bp, Homo sapiens
ccttcagagcgaggatctgtgg

SEQ ID NO: 31284 - DNA, 22 bp, Homo sapiens
gcctgggtctctgatttggcct

SEQ ID NO: 31285 - DNA, 20 bp, Homo sapiens
taatcctgggagacaggtca

SEQ ID NO: 31286 - DNA, 21 bp, Homo sapiens
tatctccgagcaaagcctcca

SEQ ID NO: 31287 - DNA, 21 bp, Homo sapiens
tccaagcaccacgactccctg

SEQ ID NO: 31288 - DNA, 18 bp, Homo sapiens
tggaataaaaccacttct

SEQ ID NO: 31289 - DNA, 20 bp, Homo sapiens
tgggagcccaggctccgccc

SEQ ID NO: 31290 - DNA, 17 bp, Homo sapiens
tgtgcctgccactggct

SEQ ID NO: 31291 - DNA, 19 bp, Homo sapiens
aaattagcacaacaaagaa

SEQ ID NO: 31292 - DNA, 22 bp, Homo sapiens
agtcttcatttaatttattgtc

SEQ ID NO: 31293 - DNA, 19 bp, Homo sapiens
tgcctcctccctgttccag

SEQ ID NO: 31294 - DNA, 23 bp, Homo sapiens
tttgatgcaattttatcataaga

SEQ ID NO: 31295 - DNA, 21 bp, Homo sapiens
atctttatgctgcattagaga

SEQ ID NO: 31296 - DNA, 17 bp, Homo sapiens
gcccagaaaagcatcca

SEQ ID NO: 31297 - DNA, 15 bp, Homo sapiens
gctcccaggctgcac

SEQ ID NO: 31298 - DNA, 23 bp, Homo sapiens
atctagacgttcaagtttgcaaa

SEQ ID NO: 31299 - DNA, 21 bp, Homo sapiens
ccaatgcattccttcaacaaa

SEQ ID NO: 31300 - DNA, 23 bp, Homo sapiens
ccagggctgcactctagattcca

SEQ ID NO: 31301 - DNA, 19 bp, Homo sapiens
cttttgggggttcagagga

SEQ ID NO: 31302 - DNA, 24 bp, Homo sapiens
gagacatcctttctgaatacttct

SEQ ID NO: 31303 - DNA, 21 bp, Homo sapiens
taaaaccaggttaatggctaa

SEQ ID NO: 31304 - DNA, 21 bp, Homo sapiens
tataaagaaacacaagattta

SEQ ID NO: 31305 - DNA, 20 bp, Homo sapiens
tctgaatacttcttgatggg

SEQ ID NO: 31306 - DNA, 15 bp, Homo sapiens
agccttcctgccgca

SEQ ID NO: 31307 - DNA, 19 bp, Homo sapiens
ctgtttgccttctactttt

SEQ ID NO: 31308 - DNA, 15 bp, Homo sapiens
tcacttgtctcactt

SEQ ID NO: 31309 - DNA, 25 bp, Homo sapiens
cttcacagtgagtcgctttggcttt

SEQ ID NO: 31310 - DNA, 18 bp, Homo sapiens
gggagaagacatgttgca

SEQ ID NO: 31311 - DNA, 18 bp, Homo sapiens
gtgaagtgaaaacaatca

SEQ ID NO: 31312 - DNA, 24 bp, Homo sapiens
tctttttatgtctgttttgttttt

SEQ ID NO: 31313 - DNA, 19 bp, Homo sapiens
tgatttctgcttcactttg

SEQ ID NO: 31314 - DNA, 20 bp, Homo sapiens
tttccaaattgtcttcttac

SEQ ID NO: 31315 - DNA, 17 bp, Homo sapiens
caacactatctgtacta

SEQ ID NO: 31316 - DNA, 18 bp, Homo sapiens
tgggtggatcacctgagg

SEQ ID NO: 31317 - DNA, 19 bp, Homo sapiens
actctagaatatctagcaa

SEQ ID NO: 31318 - DNA, 20 bp, Homo sapiens
tttctaatacatgtacagtg

SEQ ID NO: 31319 - DNA, 21 bp, Homo sapiens
atcttggctcactgcaacctc

SEQ ID NO: 31320 - DNA, 18 bp, Homo sapiens
cctgcaacctccacctcc

SEQ ID NO: 31321 - DNA, 19 bp, Homo sapiens
ctgcaacctccacctccca

SEQ ID NO: 31322 - DNA, 22 bp, Homo sapiens
ggaagcagtaggaagccactga

SEQ ID NO: 31323 - DNA, 18 bp, Homo sapiens
tccacctcccaggttcaa

SEQ ID NO: 31324 - DNA, 22 bp, Homo sapiens
ttctcctactccattgcttttt

SEQ ID NO: 31325 - DNA, 19 bp, Homo sapiens
ctctccttccaggcccatc

SEQ ID NO: 31326 - DNA, 22 bp, Homo sapiens
atagctgtgaatacccgctcca

SEQ ID NO: 31327 - DNA, 21 bp, Homo sapiens
gctctgctgagtgggctgcga

SEQ ID NO: 31328 - DNA, 17 bp, Homo sapiens
ggcaggagaagctgctg

SEQ ID NO: 31329 - DNA, 24 bp, Homo sapiens
gccgcccctccctccgcgcgggga

SEQ ID NO: 31330 - DNA, 21 bp, Homo sapiens
ctcccttcactaatgcttttt

SEQ ID NO: 31331 - DNA, 16 bp, Homo sapiens
tctctagaatcttcct

SEQ ID NO: 31332 - DNA, 24 bp, Homo sapiens
tgcctaaattgccacacctattca

SEQ ID NO: 31333 - DNA, 21 bp, Homo sapiens
tggtttttctaatagaaactg

SEQ ID NO: 31334 - DNA, 19 bp, Homo sapiens
cttgataaatgacagggtg

SEQ ID NO: 31335 - DNA, 22 bp, Homo sapiens
gcctaacccgcggccgcgtgca

SEQ ID NO: 31336 - DNA, 17 bp, Homo sapiens
caggattgggggcccgg

SEQ ID NO: 31337 - DNA, 18 bp, Homo sapiens
ggggaagagatgattcca

SEQ ID NO: 31338 - DNA, 25 bp, Homo sapiens
tgggtgggcctccccattgaaagtg

SEQ ID NO: 31339 - DNA, 24 bp, Homo sapiens
aagctccacgggagcaaatacaga

SEQ ID NO: 31340 - DNA, 17 bp, Homo sapiens
ggcttctgcttcatttt

SEQ ID NO: 31341 - DNA, 19 bp, Homo sapiens
tgctactgaaaaatggctg

SEQ ID NO: 31342 - DNA, 21 bp, Homo sapiens
tggtaaatatccagcgcttca

SEQ ID NO: 31343 - DNA, 19 bp, Homo sapiens
cagggcctcgatggcctca

SEQ ID NO: 31344 - DNA, 29 bp, Homo sapiens
gccaccactgtgacaaccaaaagtatctc

SEQ ID NO: 31345 - DNA, 20 bp, Homo sapiens
ggcctcagcctcatacctca

SEQ ID NO: 31346 - DNA, 24 bp, Homo sapiens
tcacctgctagtcactggacgtac

SEQ ID NO: 31347 - DNA, 18 bp, Homo sapiens
tccaaagtggctgcccag

SEQ ID NO: 31348 - DNA, 20 bp, Homo sapiens
ttccagaaatcgaccctcta

SEQ ID NO: 31349 - DNA, 21 bp, Homo sapiens
gaagccatcggaggccagcga

SEQ ID NO: 31350 - DNA, 18 bp, Homo sapiens
gagatggaggacatgcgg

SEQ ID NO: 31351 - DNA, 18 bp, Homo sapiens
ggcaaggtgctcaaactg

SEQ ID NO: 31352 - DNA, 20 bp, Homo sapiens
tcagtcacccggagacccga

SEQ ID NO: 31353 - DNA, 22 bp, Homo sapiens
tcttgggccggaagatcgtgga

SEQ ID NO: 31354 - DNA, 22 bp, Homo sapiens
ttttttcatagctcagaaaact

SEQ ID NO: 31355 - DNA, 25 bp, Homo sapiens
cggggccgctgactggcctcggtca

SEQ ID NO: 31356 - DNA, 20 bp, Homo sapiens
cgggtgggatcgtcctggcc

SEQ ID NO: 31357 - DNA, 21 bp, Homo sapiens
ctttactgcagggcctgcgag

SEQ ID NO: 31358 - DNA, 17 bp, Homo sapiens
gacaaaacctcatggca

SEQ ID NO: 31359 - DNA, 21 bp, Homo sapiens
gcccctcggagaccactccag

SEQ ID NO: 31360 - DNA, 22 bp, Homo sapiens
gtcagtgccaacgctggtgttt

SEQ ID NO: 31361 - DNA, 21 bp, Homo sapiens
gtgtgccaccacgctcggcta

SEQ ID NO: 31362 - DNA, 21 bp, Homo sapiens
tccccactgttgatcctctga

SEQ ID NO: 31363 - DNA, 20 bp, Homo sapiens
tcccggacccgacaatgggc

SEQ ID NO: 31364 - DNA, 18 bp, Homo sapiens
tccgtctcccaggttcaa

SEQ ID NO: 31365 - DNA, 16 bp, Homo sapiens
tgcaaacgtttccaaa

SEQ ID NO: 31366 - DNA, 18 bp, Homo sapiens
tggctgttttccacccaa

SEQ ID NO: 31367 - DNA, 18 bp, Homo sapiens
tgtgcaaatgtgcaggga

SEQ ID NO: 31368 - DNA, 23 bp, Homo sapiens
ttctcctgtgggacaaccaggga

SEQ ID NO: 31369 - DNA, 20 bp, Homo sapiens
cctgtgtctcctgggttcaa

SEQ ID NO: 31370 - DNA, 22 bp, Homo sapiens
tctgggctctcgtcgttggcct

SEQ ID NO: 31371 - DNA, 19 bp, Homo sapiens
tctgtccacctctgcccct

SEQ ID NO: 31372 - DNA, 23 bp, Homo sapiens
ttctggtggtggagcaggtccgg

SEQ ID NO: 31373 - DNA, 19 bp, Homo sapiens
acagggccactgtcctcca

SEQ ID NO: 31374 - DNA, 18 bp, Homo sapiens
cctcccgcccgccggcct

SEQ ID NO: 31375 - DNA, 26 bp, Homo sapiens
ctttgagggccgtggagggctgtgga

SEQ ID NO: 31376 - DNA, 22 bp, Homo sapiens
cttccattcccagctcttgtgc

SEQ ID NO: 31377 - DNA, 22 bp, Homo sapiens
aagttcatctcccaccaggaca

SEQ ID NO: 31378 - DNA, 20 bp, Homo sapiens
ccctgccgacccctgcagta

SEQ ID NO: 31379 - DNA, 20 bp, Homo sapiens
tcattgattacttcatcaca

SEQ ID NO: 31380 - DNA, 22 bp, Homo sapiens
tggaaaggactggacgaaatga

SEQ ID NO: 31381 - DNA, 21 bp, Homo sapiens
tgggactttgatatttttgaa

SEQ ID NO: 31382 - DNA, 23 bp, Homo sapiens
cctgcccccgagacccagcccca

SEQ ID NO: 31383 - DNA, 18 bp, Homo sapiens
cttctctccctcctcctc

SEQ ID NO: 31384 - DNA, 23 bp, Homo sapiens
tcctgacgtggcggagctgtgga

SEQ ID NO: 31385 - DNA, 21 bp, Homo sapiens
catgtgctgctgttgcaaaga

SEQ ID NO: 31386 - DNA, 21 bp, Homo sapiens
tatgatgcaaaaaaggttttg

SEQ ID NO: 31387 - DNA, 20 bp, Homo sapiens
tgctggggcaagatgcagta

SEQ ID NO: 31388 - DNA, 19 bp, Homo sapiens
aaaagcatcgttgattaca

SEQ ID NO: 31389 - DNA, 22 bp, Homo sapiens
atcctcatggacccaatggaga

SEQ ID NO: 31390 - DNA, 22 bp, Homo sapiens
gcccttgatgcaacgcacgtca

SEQ ID NO: 31391 - DNA, 18 bp, Homo sapiens
cccggccccacccaactc

SEQ ID NO: 31392 - DNA, 24 bp, Homo sapiens
cgcctctctatcctctcttcctct

SEQ ID NO: 31393 - DNA, 17 bp, Homo sapiens
aatggagacccatctaa

SEQ ID NO: 31394 - DNA, 22 bp, Homo sapiens
atcttggctcactgcaacctct

SEQ ID NO: 31395 - DNA, 19 bp, Homo sapiens
cagaagaacataaattgtg

SEQ ID NO: 31396 - DNA, 19 bp, Homo sapiens
ctaccatctccctctctca

SEQ ID NO: 31397 - DNA, 22 bp, Homo sapiens
gctcctgcggaaatctacatta

SEQ ID NO: 31398 - DNA, 18 bp, Homo sapiens
ggttactggctgagttct

SEQ ID NO: 31399 - DNA, 18 bp, Homo sapiens
tctacctcctgggttcaa

SEQ ID NO: 31400 - DNA, 21 bp, Homo sapiens
tgcattcatctttgtaccccc

SEQ ID NO: 31401 - DNA, 22 bp, Homo sapiens
atttggcccctcttctcacatc

SEQ ID NO: 31402 - DNA, 23 bp, Homo sapiens
caaggaaaaaagagaaaacatac

SEQ ID NO: 31403 - DNA, 21 bp, Homo sapiens
cctgacccacagcatatatgc

SEQ ID NO: 31404 - DNA, 16 bp, Homo sapiens
ctatgggggctccggc

SEQ ID NO: 31405 - DNA, 19 bp, Homo sapiens
ctcaaaggaagctgcaagt

SEQ ID NO: 31406 - DNA, 22 bp, Homo sapiens
gcggtgctgccgcgcgagctct

SEQ ID NO: 31407 - DNA, 18 bp, Homo sapiens
tgacatgttcatgagtca

SEQ ID NO: 31408 - DNA, 17 bp, Homo sapiens
aacccagctctcctctc

SEQ ID NO: 31409 - DNA, 16 bp, Homo sapiens
cttgaaactgtgtgct

SEQ ID NO: 31410 - DNA, 20 bp, Homo sapiens
gccttgaggagatgctgcca

SEQ ID NO: 31411 - DNA, 21 bp, Homo sapiens
tgttgttgatgtaatttgtga

SEQ ID NO: 31412 - DNA, 16 bp, Homo sapiens
aaggcattcttgcacc

SEQ ID NO: 31413 - DNA, 25 bp, Homo sapiens
gatacaatgtaaaaaacaattggtt

SEQ ID NO: 31414 - DNA, 16 bp, Homo sapiens
cgccagcagccagccc

SEQ ID NO: 31415 - DNA, 19 bp, Homo sapiens
agccatttaaaaagtaaca

SEQ ID NO: 31416 - DNA, 19 bp, Homo sapiens
atcaaatgaaagagcattc

SEQ ID NO: 31417 - DNA, 25 bp, Homo sapiens
atgtttttctcccctgctcattgcc

SEQ ID NO: 31418 - DNA, 21 bp, Homo sapiens
caagagacttgggtttagtta

SEQ ID NO: 31419 - DNA, 16 bp, Homo sapiens
ctaagatgactatcca

SEQ ID NO: 31420 - DNA, 19 bp, Homo sapiens
tactagtgaagatactagt

SEQ ID NO: 31421 - DNA, 21 bp, Homo sapiens
tctgagcaactacttactttt

SEQ ID NO: 31422 - DNA, 25 bp, Homo sapiens
tctgtcattgttttatattgtgtaa

SEQ ID NO: 31423 - DNA, 19 bp, Homo sapiens
tgtttttctcccctgctca

SEQ ID NO: 31424 - DNA, 26 bp, Homo sapiens
ttaaaaataaatagtaccacttttct

SEQ ID NO: 31425 - DNA, 25 bp, Homo sapiens
gtgtctcacagcttggctgagctct

SEQ ID NO: 31426 - DNA, 18 bp, Homo sapiens
gctacctgccttctttca

SEQ ID NO: 31427 - DNA, 19 bp, Homo sapiens
aagcaattctcctgcttca

SEQ ID NO: 31428 - DNA, 24 bp, Homo sapiens
agaacgggtcagctcagcaggcca

SEQ ID NO: 31429 - DNA, 22 bp, Homo sapiens
atctcggctcactacagcctct

SEQ ID NO: 31430 - DNA, 20 bp, Homo sapiens
caacctctagagtagctggg

SEQ ID NO: 31431 - DNA, 18 bp, Homo sapiens
cccgcaacctccgcctcc

SEQ ID NO: 31432 - DNA, 19 bp, Homo sapiens
cctgctgcgtgccacctca

SEQ ID NO: 31433 - DNA, 18 bp, Homo sapiens
ctgctgcgtgccacctca

SEQ ID NO: 31434 - DNA, 16 bp, Homo sapiens
ctgcttcagcctctca

SEQ ID NO: 31435 - DNA, 23 bp, Homo sapiens
gccacctcaggaaactcagggga

SEQ ID NO: 31436 - DNA, 22 bp, Homo sapiens
gtacccggcctacccttgggta

SEQ ID NO: 31437 - DNA, 17 bp, Homo sapiens
tacagtcccaaggagga

SEQ ID NO: 31438 - DNA, 18 bp, Homo sapiens
tcaatatgttttgatgat

SEQ ID NO: 31439 - DNA, 18 bp, Homo sapiens
tccgcctcccgggttcaa

SEQ ID NO: 31440 - DNA, 19 bp, Homo sapiens
tctcctgcattagccttcc

SEQ ID NO: 31441 - DNA, 16 bp, Homo sapiens
tctcctgcttcaacct

SEQ ID NO: 31442 - DNA, 19 bp, Homo sapiens
tgcgttggtcttttctgag

SEQ ID NO: 31443 - DNA, 20 bp, Homo sapiens
tggccaggctggtcttgaac

SEQ ID NO: 31444 - DNA, 18 bp, Homo sapiens
agaaaacttttttgtgct

SEQ ID NO: 31445 - DNA, 25 bp, Homo sapiens
atgcccacctacctatccagatgta

SEQ ID NO: 31446 - DNA, 18 bp, Homo sapiens
ggcggaagaattttgcca

SEQ ID NO: 31447 - DNA, 20 bp, Homo sapiens
actttggagaaaactcccca

SEQ ID NO: 31448 - DNA, 22 bp, Homo sapiens
gagccaagatcgtgccactgca

SEQ ID NO: 31449 - DNA, 22 bp, Homo sapiens
ggacctctcctatcatgatgaa

SEQ ID NO: 31450 - DNA, 24 bp, Homo sapiens
tctatagctgtttcagattttttt

SEQ ID NO: 31451 - DNA, 20 bp, Homo sapiens
tgctaaatatgactgtaaca

SEQ ID NO: 31452 - DNA, 22 bp, Homo sapiens
tgttaacattgcctggacttca

SEQ ID NO: 31453 - DNA, 19 bp, Homo sapiens
accagagatttttactggg

SEQ ID NO: 31454 - DNA, 18 bp, Homo sapiens
ggtaaagagtgctcctca

SEQ ID NO: 31455 - DNA, 18 bp, Homo sapiens
caggactaccagaccgcc

SEQ ID NO: 31456 - DNA, 23 bp, Homo sapiens
cctagtaaattctgaatgctttt

SEQ ID NO: 31457 - DNA, 20 bp, Homo sapiens
gtctagttccaaatttggta

SEQ ID NO: 31458 - DNA, 24 bp, Homo sapiens
gtttggaagacaactgcttgttcc

SEQ ID NO: 31459 - DNA, 21 bp, Homo sapiens
gttttggtctttttataactt

SEQ ID NO: 31460 - DNA, 18 bp, Homo sapiens
agccatttgaaattactg

SEQ ID NO: 31461 - DNA, 22 bp, Homo sapiens
ctgtcctccaccctggacccca

SEQ ID NO: 31462 - DNA, 18 bp, Homo sapiens
gaggagggagctaccctt

SEQ ID NO: 31463 - DNA, 25 bp, Homo sapiens
gcttgagctgctccaaacctggccc

SEQ ID NO: 31464 - DNA, 20 bp, Homo sapiens
tatttccctgactgttgcct

SEQ ID NO: 31465 - DNA, 18 bp, Homo sapiens
ttattaatttatttccct

SEQ ID NO: 31466 - DNA, 19 bp, Homo sapiens
ttccttggaactcctgcct

SEQ ID NO: 31467 - DNA, 19 bp, Homo sapiens
ttcgccagaagtttgtgag

SEQ ID NO: 31468 - DNA, 18 bp, Homo sapiens
cccaggctttctctccca

SEQ ID NO: 31469 - DNA, 20 bp, Homo sapiens
cctagatacatgttcccaca

SEQ ID NO: 31470 - DNA, 19 bp, Homo sapiens
gcccagcaccaacagtttt

SEQ ID NO: 31471 - DNA, 21 bp, Homo sapiens
gcggggggcaagaacagcagg

SEQ ID NO: 31472 - DNA, 21 bp, Homo sapiens
tagatgcctcggagagcatca

SEQ ID NO: 31473 - DNA, 19 bp, Homo sapiens
tctgggccagcttggactc

SEQ ID NO: 31474 - DNA, 21 bp, Homo sapiens
ttccctcaactctctgccctc

SEQ ID NO: 31475 - DNA, 17 bp, Homo sapiens
atgtctaatggagttct

SEQ ID NO: 31476 - DNA, 19 bp, Homo sapiens
cctacccgtaaaatatgaa

SEQ ID NO: 31477 - DNA, 22 bp, Homo sapiens
ctttttgtagactgtagtttat

SEQ ID NO: 31478 - DNA, 19 bp, Homo sapiens
tgggtggaccacctgagat

SEQ ID NO: 31479 - DNA, 20 bp, Homo sapiens
ttcaagaccagcctgaccaa

SEQ ID NO: 31480 - DNA, 25 bp, Homo sapiens
ctactgaccaaaaaagaacatttta

SEQ ID NO: 31481 - DNA, 23 bp, Homo sapiens
ggttggaggctgagttcttttga

SEQ ID NO: 31482 - DNA, 19 bp, Homo sapiens
tagggaaggagcctttcaa

SEQ ID NO: 31483 - DNA, 22 bp, Homo sapiens
tactgtcaggctgggccctccc

SEQ ID NO: 31484 - DNA, 16 bp, Homo sapiens
agtaccatggttctga

SEQ ID NO: 31485 - DNA, 21 bp, Homo sapiens
cagaattccacccatctttca

SEQ ID NO: 31486 - DNA, 21 bp, Homo sapiens
ccatggttctgacagagactg

SEQ ID NO: 31487 - DNA, 22 bp, Homo sapiens
ggcccgcaggtaaccacctcct

SEQ ID NO: 31488 - DNA, 18 bp, Homo sapiens
tcacaggccttgccatct

SEQ ID NO: 31489 - DNA, 18 bp, Homo sapiens
agcctcctgagtagctca

SEQ ID NO: 31490 - DNA, 21 bp, Homo sapiens
gaagaggtagcagatgaatct

SEQ ID NO: 31491 - DNA, 18 bp, Homo sapiens
tatatcatatagggtgaa

SEQ ID NO: 31492 - DNA, 19 bp, Homo sapiens
tcatagtccttttgatttt

SEQ ID NO: 31493 - DNA, 22 bp, Homo sapiens
tggatcattccaattgaagttg

SEQ ID NO: 31494 - DNA, 20 bp, Homo sapiens
tggtcaggctggtcttgaac

SEQ ID NO: 31495 - DNA, 22 bp, Homo sapiens
agttgcttttgttgcagagtta

SEQ ID NO: 31496 - DNA, 20 bp, Homo sapiens
tttccaggatggtaataggt

SEQ ID NO: 31497 - DNA, 18 bp, Homo sapiens
actacatgaatgcagtga

SEQ ID NO: 31498 - DNA, 22 bp, Homo sapiens
attcacagcttgttatacatca

SEQ ID NO: 31499 - DNA, 22 bp, Homo sapiens
cagaaaccatatgtgtgtaatg

SEQ ID NO: 31500 - DNA, 18 bp, Homo sapiens
gttgtagtttttttgcct

SEQ ID NO: 31501 - DNA, 24 bp, Homo sapiens
tatctttcaagacaaaaacctcat

SEQ ID NO: 31502 - DNA, 19 bp, Homo sapiens
tctggctgcagatctggag

SEQ ID NO: 31503 - DNA, 21 bp, Homo sapiens
aatcagcttttctaagatcaa

SEQ ID NO: 31504 - DNA, 19 bp, Homo sapiens
tctgctctgatcttttagg

SEQ ID NO: 31505 - DNA, 17 bp, Homo sapiens
caaccctccccctgccc

SEQ ID NO: 31506 - DNA, 21 bp, Homo sapiens
ccttccccaagccagctgccc

SEQ ID NO: 31507 - DNA, 18 bp, Homo sapiens
cgcgcggcgcccgcgccc

SEQ ID NO: 31508 - DNA, 19 bp, Homo sapiens
agaatttgttatatttttg

SEQ ID NO: 31509 - DNA, 19 bp, Homo sapiens
agatgacagccatgatgaa

SEQ ID NO: 31510 - DNA, 20 bp, Homo sapiens
atttagcagtaatccattaa

SEQ ID NO: 31511 - DNA, 24 bp, Homo sapiens
cccctggctcccagctgccggcga

SEQ ID NO: 31512 - DNA, 20 bp, Homo sapiens
ccgggctagcggcagacgag

SEQ ID NO: 31513 - DNA, 20 bp, Homo sapiens
gacctcagacaggaaactgg

SEQ ID NO: 31514 - DNA, 21 bp, Homo sapiens
gccgccccccaggtgcccggg

SEQ ID NO: 31515 - DNA, 18 bp, Homo sapiens
ggaggcggcggcggcggc

SEQ ID NO: 31516 - DNA, 21 bp, Homo sapiens
ttgtctatgtacaaaacacaa

SEQ ID NO: 31517 - DNA, 17 bp, Homo sapiens
atcctcttcctcctagg

SEQ ID NO: 31518 - DNA, 19 bp, Homo sapiens
cagtgagccaagatcgtgc

SEQ ID NO: 31519 - DNA, 22 bp, Homo sapiens
gagccaagatcgtgccactgca

SEQ ID NO: 31520 - DNA, 19 bp, Homo sapiens
gtgaggccctacctgaccc

SEQ ID NO: 31521 - DNA, 18 bp, Homo sapiens
tggagccaccggctgtga

SEQ ID NO: 31522 - DNA, 18 bp, Homo sapiens
tgggtggatcacctgagg

SEQ ID NO: 31523 - DNA, 18 bp, Homo sapiens
ttccagaaaagggcccag

SEQ ID NO: 31524 - DNA, 24 bp, Homo sapiens
tttcagctgcttgaaaacattgta

SEQ ID NO: 31525 - DNA, 24 bp, Homo sapiens
tttcctgtgcctttccctccagaa

SEQ ID NO: 31526 - DNA, 19 bp, Homo sapiens
aacccttgtcttttactca

SEQ ID NO: 31527 - DNA, 20 bp, Homo sapiens
cctctgcctcccaggttcaa

SEQ ID NO: 31528 - DNA, 19 bp, Homo sapiens
ctgcaacctctgcctccca

SEQ ID NO: 31529 - DNA, 17 bp, Homo sapiens
tcaagtgattctcctgc

SEQ ID NO: 31530 - DNA, 18 bp, Homo sapiens
acagcagcaggtatgtgt

SEQ ID NO: 31531 - DNA, 19 bp, Homo sapiens
ccaagagctattacagaga

SEQ ID NO: 31532 - DNA, 20 bp, Homo sapiens
cccaggcagctgctgcctcc

SEQ ID NO: 31533 - DNA, 20 bp, Homo sapiens
gactgcagtgcgcttaacca

SEQ ID NO: 31534 - DNA, 23 bp, Homo sapiens
tcttgagtcggagtgtttgcgag

SEQ ID NO: 31535 - DNA, 18 bp, Homo sapiens
tctttctcccttttcctc

SEQ ID NO: 31536 - DNA, 20 bp, Homo sapiens
tggatatgagtgtgtgtgca

SEQ ID NO: 31537 - DNA, 21 bp, Homo sapiens
tacaaagtagatagcattata

SEQ ID NO: 31538 - DNA, 17 bp, Homo sapiens
cctcttcgcttgcttta

SEQ ID NO: 31539 - DNA, 18 bp, Homo sapiens
cctaccagcccacggtgg

SEQ ID NO: 31540 - DNA, 22 bp, Homo sapiens
gagcgccttcaccagctgccct

SEQ ID NO: 31541 - DNA, 18 bp, Homo sapiens
gccggtggtctctggcct

SEQ ID NO: 31542 - DNA, 21 bp, Homo sapiens
gcttggaggtggccttcgtta

SEQ ID NO: 31543 - DNA, 17 bp, Homo sapiens
tcctgaccagcacttca

SEQ ID NO: 31544 - DNA, 24 bp, Homo sapiens
agtgaccctcccacctcattctca

SEQ ID NO: 31545 - DNA, 21 bp, Homo sapiens
attcaatgggttgcataccca

SEQ ID NO: 31546 - DNA, 20 bp, Homo sapiens
cagaagaaaaaccttcagcc

SEQ ID NO: 31547 - DNA, 24 bp, Homo sapiens
gaaatgtagaaaaaccttcagcca

SEQ ID NO: 31548 - DNA, 20 bp, Homo sapiens
tcccccttgggtgcctatgc

SEQ ID NO: 31549 - DNA, 19 bp, Homo sapiens
aaaacttgattctataatg

SEQ ID NO: 31550 - DNA, 20 bp, Homo sapiens
aaactaaagcccatggacca

SEQ ID NO: 31551 - DNA, 21 bp, Homo sapiens
cttgtttaaaaatcacattta

SEQ ID NO: 31552 - DNA, 18 bp, Homo sapiens
acacagggctaagactgt

SEQ ID NO: 31553 - DNA, 17 bp, Homo sapiens
cagcgcacgcacaccgg

SEQ ID NO: 31554 - DNA, 22 bp, Homo sapiens
gcctgagctacggtgcctggcc

SEQ ID NO: 31555 - DNA, 18 bp, Homo sapiens
tccgcctcccgggttcaa

SEQ ID NO: 31556 - DNA, 23 bp, Homo sapiens
tgtctctctctgtcacccaggct

SEQ ID NO: 31557 - DNA, 21 bp, Homo sapiens
catatgtataatgtgccaggt

SEQ ID NO: 31558 - DNA, 19 bp, Homo sapiens
gagaagtttaaaaagataa

SEQ ID NO: 31559 - DNA, 20 bp, Homo sapiens
tatgaaggtttctcatactt

SEQ ID NO: 31560 - DNA, 19 bp, Homo sapiens
cagagatcactgccctgtg

SEQ ID NO: 31561 - DNA, 15 bp, Homo sapiens
ctcctttaaatctgg

SEQ ID NO: 31562 - DNA, 20 bp, Homo sapiens
gaacaccaactaaatttgaa

SEQ ID NO: 31563 - DNA, 20 bp, Homo sapiens
gacatacaatccagcagcag

SEQ ID NO: 31564 - DNA, 18 bp, Homo sapiens
gagcatttaatcattttt

SEQ ID NO: 31565 - DNA, 20 bp, Homo sapiens
gcagtttccaaggtggcatc

SEQ ID NO: 31566 - DNA, 18 bp, Homo sapiens
gtatctattaactggcca

SEQ ID NO: 31567 - DNA, 18 bp, Homo sapiens
gtccaggatgccaaggga

SEQ ID NO: 31568 - DNA, 21 bp, Homo sapiens
gtgctagtacttgtgggtttt

SEQ ID NO: 31569 - DNA, 21 bp, Homo sapiens
taaaaggtaatagcatcttcc

SEQ ID NO: 31570 - DNA, 22 bp, Homo sapiens
tcaaaaaggcaacgttacttca

SEQ ID NO: 31571 - DNA, 19 bp, Homo sapiens
tcttattatatgtccctta

SEQ ID NO: 31572 - DNA, 22 bp, Homo sapiens
tgaagaaattatttgaaaccca

SEQ ID NO: 31573 - DNA, 18 bp, Homo sapiens
tgtagactttaaaaacaa

SEQ ID NO: 31574 - DNA, 18 bp, Homo sapiens
tttttctccttttatctc

SEQ ID NO: 31575 - DNA, 18 bp, Homo sapiens
acactaacattttcctta

SEQ ID NO: 31576 - DNA, 18 bp, Homo sapiens
ccagttttccacctcgca

SEQ ID NO: 31577 - DNA, 20 bp, Homo sapiens
gagtaactgccaaaatatca

SEQ ID NO: 31578 - DNA, 20 bp, Homo sapiens
ttgcaaagagcacgcctctt

SEQ ID NO: 31579 - DNA, 22 bp, Homo sapiens
gaaaaggaggtttggtgagaca

SEQ ID NO: 31580 - DNA, 21 bp, Homo sapiens
aaggctggcatcttcgtgagt

SEQ ID NO: 31581 - DNA, 19 bp, Homo sapiens
agagccaggagaccaggga

SEQ ID NO: 31582 - DNA, 24 bp, Homo sapiens
caggtgtggggctgggcatggtca

SEQ ID NO: 31583 - DNA, 21 bp, Homo sapiens
tattatggagctgcttcctct

SEQ ID NO: 31584 - DNA, 18 bp, Homo sapiens
tcctggagcagcacctca

SEQ ID NO: 31585 - DNA, 17 bp, Homo sapiens
tggtgcaagagttctga

SEQ ID NO: 31586 - DNA, 21 bp, Homo sapiens
aagtaatttacaaacctctca

SEQ ID NO: 31587 - DNA, 23 bp, Homo sapiens
cagcactaattagtgtccaactc

SEQ ID NO: 31588 - DNA, 20 bp, Homo sapiens
cctctctactagcaccatca

SEQ ID NO: 31589 - DNA, 18 bp, Homo sapiens
cttggtttagtctgtgaa

SEQ ID NO: 31590 - DNA, 22 bp, Homo sapiens
gagcacacggtctcttttgttc

SEQ ID NO: 31591 - DNA, 18 bp, Homo sapiens
ggcggcggcgactgcggc

SEQ ID NO: 31592 - DNA, 24 bp, Homo sapiens
tagggttaggaccaggttaggtca

SEQ ID NO: 31593 - DNA, 21 bp, Homo sapiens
tctgagcacacggtctctttt

SEQ ID NO: 31594 - DNA, 23 bp, Homo sapiens
aggtacagcacataggccaggag

SEQ ID NO: 31595 - DNA, 21 bp, Homo sapiens
atctcccagcaggtagagcag

SEQ ID NO: 31596 - DNA, 21 bp, Homo sapiens
cccagctcaaactgacaggag

SEQ ID NO: 31597 - DNA, 20 bp, Homo sapiens
ccccaccaccacccccagct

SEQ ID NO: 31598 - DNA, 21 bp, Homo sapiens
cctcaaacagccgctgtctca

SEQ ID NO: 31599 - DNA, 21 bp, Homo sapiens
ctcggctcgggaggcctggga

SEQ ID NO: 31600 - DNA, 21 bp, Homo sapiens
gcatcagacacaggtacagca

SEQ ID NO: 31601 - DNA, 20 bp, Homo sapiens
gcctctgtgatcttctccat

SEQ ID NO: 31602 - DNA, 19 bp, Homo sapiens
ggggtctaataacaaacta

SEQ ID NO: 31603 - DNA, 21 bp, Homo sapiens
ggtagagcagagccggagcca

SEQ ID NO: 31604 - DNA, 21 bp, Homo sapiens
taaaccaatggaaagaagggg

SEQ ID NO: 31605 - DNA, 19 bp, Homo sapiens
tctgggaaaggacctgggg

SEQ ID NO: 31606 - DNA, 20 bp, Homo sapiens
tgccaagtaccctgctccag

SEQ ID NO: 31607 - DNA, 20 bp, Homo sapiens
ttggagagaaggtctccttg

SEQ ID NO: 31608 - DNA, 24 bp, Homo sapiens
ggccaggagatcgacaccatcctg

SEQ ID NO: 31609 - DNA, 21 bp, Homo sapiens
gtgagtcattttagaatatta

SEQ ID NO: 31610 - DNA, 20 bp, Homo sapiens
taaatgtgtcttggtatgaa

SEQ ID NO: 31611 - DNA, 19 bp, Homo sapiens
tattaattatttcagtcca

SEQ ID NO: 31612 - DNA, 17 bp, Homo sapiens
tgtcttggtatgaattt

SEQ ID NO: 31613 - DNA, 18 bp, Homo sapiens
actgtgatcgtgtggcct

SEQ ID NO: 31614 - DNA, 18 bp, Homo sapiens
caagaacagcttccagac

SEQ ID NO: 31615 - DNA, 19 bp, Homo sapiens
acagttgccaaacccattg

SEQ ID NO: 31616 - DNA, 25 bp, Homo sapiens
acgcttcatccacggctccttccca

SEQ ID NO: 31617 - DNA, 19 bp, Homo sapiens
cgcccttgccccctcgtca

SEQ ID NO: 31618 - DNA, 20 bp, Homo sapiens
gccgggtgcatggcagccct

SEQ ID NO: 31619 - DNA, 21 bp, Homo sapiens
gctcctttgttcctccccctc

SEQ ID NO: 31620 - DNA, 22 bp, Homo sapiens
tctggtgccaacacagttgcca

SEQ ID NO: 31621 - DNA, 20 bp, Homo sapiens
ccactgcctcccaggttcaa

SEQ ID NO: 31622 - DNA, 22 bp, Homo sapiens
ccactggcatctgaattcatca

SEQ ID NO: 31623 - DNA, 21 bp, Homo sapiens
cccagtgataacaatgggata

SEQ ID NO: 31624 - DNA, 22 bp, Homo sapiens
gaagaataataatccattcagt

SEQ ID NO: 31625 - DNA, 21 bp, Homo sapiens
gaagttttaaaaatttcccca

SEQ ID NO: 31626 - DNA, 17 bp, Homo sapiens
tcaagtgattctcctgc

SEQ ID NO: 31627 - DNA, 20 bp, Homo sapiens
ttgccagaaggctcttttta

SEQ ID NO: 31628 - DNA, 21 bp, Homo sapiens
ttgtttgttttttccttctgg

SEQ ID NO: 31629 - DNA, 20 bp, Homo sapiens
acaacaggtacaaagcccta

SEQ ID NO: 31630 - DNA, 25 bp, Homo sapiens
agagaaggtttcagcacttcagaca

SEQ ID NO: 31631 - DNA, 19 bp, Homo sapiens
cctgctttctttctgttcc

SEQ ID NO: 31632 - DNA, 21 bp, Homo sapiens
acagccttcatctcctcctct

SEQ ID NO: 31633 - DNA, 16 bp, Homo sapiens
ccgcgaaccccactgg

SEQ ID NO: 31634 - DNA, 19 bp, Homo sapiens
cctcaggccgtggccctgc

SEQ ID NO: 31635 - DNA, 24 bp, Homo sapiens
cctcaggccgtggccctgctgcct

SEQ ID NO: 31636 - DNA, 21 bp, Homo sapiens
gcccagctgtggtcccggtga

SEQ ID NO: 31637 - DNA, 19 bp, Homo sapiens
tttcttgggggcctgagga

SEQ ID NO: 31638 - DNA, 17 bp, Homo sapiens
caccaccaccaccctct

SEQ ID NO: 31639 - DNA, 20 bp, Homo sapiens
agtggttttggtggaggctg

SEQ ID NO: 31640 - DNA, 18 bp, Homo sapiens
aagaaaagcagtttgcag

SEQ ID NO: 31641 - DNA, 15 bp, Homo sapiens
ggttgcaacgtgaca

SEQ ID NO: 31642 - DNA, 22 bp, Homo sapiens
ataacttcaataaagattgtaa

SEQ ID NO: 31643 - DNA, 20 bp, Homo sapiens
actgagactttaactggtaa

SEQ ID NO: 31644 - DNA, 18 bp, Homo sapiens
actgtggcgctcacctgt

SEQ ID NO: 31645 - DNA, 24 bp, Homo sapiens
aggcagctctcctcattttcccca

SEQ ID NO: 31646 - DNA, 15 bp, Homo sapiens
gataatatagtagag

SEQ ID NO: 31647 - DNA, 19 bp, Homo sapiens
tgggtgacagtgtgagact

SEQ ID NO: 31648 - DNA, 21 bp, Homo sapiens
aggccttcctagttagggcca

SEQ ID NO: 31649 - DNA, 17 bp, Homo sapiens
atggtcatggctgtttc

SEQ ID NO: 31650 - DNA, 18 bp, Homo sapiens
cagaccctctccagtgta

SEQ ID NO: 31651 - DNA, 20 bp, Homo sapiens
ccagaccctctccagtgtac

SEQ ID NO: 31652 - DNA, 22 bp, Homo sapiens
ccccggttctttccccacccca

SEQ ID NO: 31653 - DNA, 19 bp, Homo sapiens
tatgtatttatcaacatgt

SEQ ID NO: 31654 - DNA, 20 bp, Homo sapiens
cataattttccattccagtt

SEQ ID NO: 31655 - DNA, 19 bp, Homo sapiens
ctgacatacatggttcttt

SEQ ID NO: 31656 - DNA, 21 bp, Homo sapiens
gcagaggatttaacctttgca

SEQ ID NO: 31657 - DNA, 22 bp, Homo sapiens
gggtatgaaaaaaaaaactgca

SEQ ID NO: 31658 - DNA, 19 bp, Homo sapiens
tcagcaggctggtgatgga

SEQ ID NO: 31659 - DNA, 21 bp, Homo sapiens
tgcagtgagctataatcgtgc

SEQ ID NO: 31660 - DNA, 21 bp, Homo sapiens
tggaaatcatcagcatgagat

SEQ ID NO: 31661 - DNA, 24 bp, Homo sapiens
tttcccatttgaataactagaata

SEQ ID NO: 31662 - DNA, 21 bp, Homo sapiens
tggtggttcctgctgcactga

SEQ ID NO: 31663 - DNA, 23 bp, Homo sapiens
ctctgtcacatgctcagtttgtg

SEQ ID NO: 31664 - DNA, 18 bp, Homo sapiens
gctccttggtattcctga

SEQ ID NO: 31665 - DNA, 23 bp, Homo sapiens
tttaagtcattactgagttactt

SEQ ID NO: 31666 - DNA, 19 bp, Homo sapiens
aatcaaagatttaaacagt

SEQ ID NO: 31667 - DNA, 17 bp, Homo sapiens
acacttaaaaccaccaa

SEQ ID NO: 31668 - DNA, 25 bp, Homo sapiens
agaaagcagcatgaacagaaccaca

SEQ ID NO: 31669 - DNA, 23 bp, Homo sapiens
agagattctgcttggtctagtca

SEQ ID NO: 31670 - DNA, 22 bp, Homo sapiens
agcctgggtgatggagatgcca

SEQ ID NO: 31671 - DNA, 19 bp, Homo sapiens
cagtcccttaaaaattcca

SEQ ID NO: 31672 - DNA, 18 bp, Homo sapiens
accgcagaccgcaagcca

SEQ ID NO: 31673 - DNA, 19 bp, Homo sapiens
agatgggtgctggtcctca

SEQ ID NO: 31674 - DNA, 21 bp, Homo sapiens
agtggctctcctgattcttca

SEQ ID NO: 31675 - DNA, 18 bp, Homo sapiens
cagccacgctctgtgaca

SEQ ID NO: 31676 - DNA, 19 bp, Homo sapiens
cagtaacatcaagtgctca

SEQ ID NO: 31677 - DNA, 24 bp, Homo sapiens
ccttgggctgagaggacctgggaa

SEQ ID NO: 31678 - DNA, 21 bp, Homo sapiens
gtgcctatttcatcctggtgg

SEQ ID NO: 31679 - DNA, 23 bp, Homo sapiens
tgagaggacctgggaagcccctc

SEQ ID NO: 31680 - DNA, 19 bp, Homo sapiens
ctggcttgcagtctggccc

SEQ ID NO: 31681 - DNA, 24 bp, Homo sapiens
taggaagccttccagtgtgagctg

SEQ ID NO: 31682 - DNA, 15 bp, Homo sapiens
ttgggatctgctggt

SEQ ID NO: 31683 - DNA, 18 bp, Homo sapiens
aggcattgctgcagaacc

SEQ ID NO: 31684 - DNA, 17 bp, Homo sapiens
gccacgtccgacgagga

SEQ ID NO: 31685 - DNA, 17 bp, Homo sapiens
ggaaacggggcccagcc

SEQ ID NO: 31686 - DNA, 21 bp, Homo sapiens
accctgagttggtgctttgga

SEQ ID NO: 31687 - DNA, 19 bp, Homo sapiens
aggttctgctcagccttaa

SEQ ID NO: 31688 - DNA, 18 bp, Homo sapiens
cacttgactggccaccag

SEQ ID NO: 31689 - DNA, 19 bp, Homo sapiens
cagaccaactctgctgtta

SEQ ID NO: 31690 - DNA, 18 bp, Homo sapiens
cccaaagacagcttgcac

SEQ ID NO: 31691 - DNA, 21 bp, Homo sapiens
cctaacctggaagcctgtgag

SEQ ID NO: 31692 - DNA, 19 bp, Homo sapiens
cctagattttaacactgca

SEQ ID NO: 31693 - DNA, 24 bp, Homo sapiens
ccttgattgagttgcttgggcttt

SEQ ID NO: 31694 - DNA, 20 bp, Homo sapiens
gctgcatcccttttgagcaa

SEQ ID NO: 31695 - DNA, 23 bp, Homo sapiens
ggactgggagaggaatctaagaa

SEQ ID NO: 31696 - DNA, 18 bp, Homo sapiens
gggaactgtgtctggtca

SEQ ID NO: 31697 - DNA, 21 bp, Homo sapiens
tctgctttatgtgtgtgtgta

SEQ ID NO: 31698 - DNA, 17 bp, Homo sapiens
tgcagagcattctctac

SEQ ID NO: 31699 - DNA, 19 bp, Homo sapiens
aaactcctgacctcaggtg

SEQ ID NO: 31700 - DNA, 19 bp, Homo sapiens
aagcaattctcctgcctca

SEQ ID NO: 31701 - DNA, 22 bp, Homo sapiens
accttgtgatccacccacctcg

SEQ ID NO: 31702 - DNA, 20 bp, Homo sapiens
agcatccactctcctgcggt

SEQ ID NO: 31703 - DNA, 22 bp, Homo sapiens
atctcggctcactgcaatctct

SEQ ID NO: 31704 - DNA, 21 bp, Homo sapiens
atcttggctcactgcaacctc

SEQ ID NO: 31705 - DNA, 23 bp, Homo sapiens
attctccgttttctgaattgcat

SEQ ID NO: 31706 - DNA, 18 bp, Homo sapiens
cccgcaacctccgcctcc

SEQ ID NO: 31707 - DNA, 21 bp, Homo sapiens
ccgaattctccgttttctgaa

SEQ ID NO: 31708 - DNA, 19 bp, Homo sapiens
ctgcaatctctgcctccca

SEQ ID NO: 31709 - DNA, 21 bp, Homo sapiens
gagatgcacaccttcgcttct

SEQ ID NO: 31710 - DNA, 21 bp, Homo sapiens
gcaaatatccttgtttctgat

SEQ ID NO: 31711 - DNA, 19 bp, Homo sapiens
ggccccctagtagctggca

SEQ ID NO: 31712 - DNA, 19 bp, Homo sapiens
gggtgggtcccagaagtga

SEQ ID NO: 31713 - DNA, 19 bp, Homo sapiens
gtatatgtgggtctatgat

SEQ ID NO: 31714 - DNA, 19 bp, Homo sapiens
tatatgtgggtctatgatg

SEQ ID NO: 31715 - DNA, 18 bp, Homo sapiens
tcacgtcagtgcatgtca

SEQ ID NO: 31716 - DNA, 18 bp, Homo sapiens
tccacttctcaggttcaa

SEQ ID NO: 31717 - DNA, 17 bp, Homo sapiens
tctcctgcgggattgca

SEQ ID NO: 31718 - DNA, 20 bp, Homo sapiens
tctctgcctcccaggttcaa

SEQ ID NO: 31719 - DNA, 20 bp, Homo sapiens
tggccaggctggtcttgaac

SEQ ID NO: 31720 - DNA, 22 bp, Homo sapiens
gacctcatcactggatttgcca

SEQ ID NO: 31721 - DNA, 19 bp, Homo sapiens
acaaaagcatgatcattca

SEQ ID NO: 31722 - DNA, 21 bp, Homo sapiens
acttgaagcctgatctggcct

SEQ ID NO: 31723 - DNA, 19 bp, Homo sapiens
agttcccctagttactaca

SEQ ID NO: 31724 - DNA, 19 bp, Homo sapiens
attcccccaatggacaaga

SEQ ID NO: 31725 - DNA, 22 bp, Homo sapiens
attccctgcagaagccgcagca

SEQ ID NO: 31726 - DNA, 19 bp, Homo sapiens
ctacaagtatgctgggata

SEQ ID NO: 31727 - DNA, 21 bp, Homo sapiens
ggctcatctctgctgcagtaa

SEQ ID NO: 31728 - DNA, 19 bp, Homo sapiens
gggccgcccgctcgcctcc

SEQ ID NO: 31729 - DNA, 20 bp, Homo sapiens
tcatgcccaatctggaccaa

SEQ ID NO: 31730 - DNA, 17 bp, Homo sapiens
tgagccacaaaggctgg

SEQ ID NO: 31731 - DNA, 21 bp, Homo sapiens
tgatctcacccctgtacttca

SEQ ID NO: 31732 - DNA, 19 bp, Homo sapiens
ttgctgagagcaacttgca

SEQ ID NO: 31733 - DNA, 20 bp, Homo sapiens
agcaactggtacaactggtc

SEQ ID NO: 31734 - DNA, 22 bp, Homo sapiens
cataagggcttcatctcaagtg

SEQ ID NO: 31735 - DNA, 20 bp, Homo sapiens
ccaggcaatatctcaggata

SEQ ID NO: 31736 - DNA, 20 bp, Homo sapiens
tcccctataacataatgcta

SEQ ID NO: 31737 - DNA, 21 bp, Homo sapiens
tttcttcaacaaccttgactt

SEQ ID NO: 31738 - DNA, 20 bp, Homo sapiens
aaaaccagccaagatctgtt

SEQ ID NO: 31739 - DNA, 17 bp, Homo sapiens
aacccagaaagacctgg

SEQ ID NO: 31740 - DNA, 17 bp, Homo sapiens
attcctggtgtctgata

SEQ ID NO: 31741 - DNA, 20 bp, Homo sapiens
catcaaattcttatcttttc

SEQ ID NO: 31742 - DNA, 20 bp, Homo sapiens
cttagaaaacatctgctcca

SEQ ID NO: 31743 - DNA, 19 bp, Homo sapiens
gatattttcttgatgaagt

SEQ ID NO: 31744 - DNA, 19 bp, Homo sapiens
gatctgttcacacacctct

SEQ ID NO: 31745 - DNA, 17 bp, Homo sapiens
tctagtttgcaccttga

SEQ ID NO: 31746 - DNA, 22 bp, Homo sapiens
tgagtggatttcaagcatttgc

SEQ ID NO: 31747 - DNA, 18 bp, Homo sapiens
tgccagaaatctttgcca

SEQ ID NO: 31748 - DNA, 18 bp, Homo sapiens
tttattagttctttgata

SEQ ID NO: 31749 - DNA, 16 bp, Homo sapiens
atctgcttaacttgta

SEQ ID NO: 31750 - DNA, 19 bp, Homo sapiens
catcagtctcttctccaga

SEQ ID NO: 31751 - DNA, 20 bp, Homo sapiens
ccaccaactatttctggata

SEQ ID NO: 31752 - DNA, 20 bp, Homo sapiens
ccaccaactatttctggata

SEQ ID NO: 31753 - DNA, 18 bp, Homo sapiens
ccagagatcaatccctca

SEQ ID NO: 31754 - DNA, 20 bp, Homo sapiens
tgtgtagggtatgcccagca

SEQ ID NO: 31755 - DNA, 19 bp, Homo sapiens
aagcaattctcctgcctca

SEQ ID NO: 31756 - DNA, 18 bp, Homo sapiens
actgccacctccacctcc

SEQ ID NO: 31757 - DNA, 22 bp, Homo sapiens
aggcctctctccccgttcattt

SEQ ID NO: 31758 - DNA, 19 bp, Homo sapiens
cacatggtattgcacatga

SEQ ID NO: 31759 - DNA, 20 bp, Homo sapiens
gcattgaaacccacatggta

SEQ ID NO: 31760 - DNA, 22 bp, Homo sapiens
tcaaagacataaaaggatgcac

SEQ ID NO: 31761 - DNA, 17 bp, Homo sapiens
tcaagtgattctcctgc

SEQ ID NO: 31762 - DNA, 22 bp, Homo sapiens
aaaaggtatcagtaattgaaga

SEQ ID NO: 31763 - DNA, 20 bp, Homo sapiens
aaccttgaaaaaagattaga

SEQ ID NO: 31764 - DNA, 20 bp, Homo sapiens
cacaccaaaacccatctgta

SEQ ID NO: 31765 - DNA, 18 bp, Homo sapiens
gcacacataagaatgcat

SEQ ID NO: 31766 - DNA, 20 bp, Homo sapiens
tcaagtgggtccctgatctc

SEQ ID NO: 31767 - DNA, 18 bp, Homo sapiens
tctgcctcacacctttga

SEQ ID NO: 31768 - DNA, 17 bp, Homo sapiens
aagtgaatgagatgtca

SEQ ID NO: 31769 - DNA, 15 bp, Homo sapiens
attcacttctgcctt

SEQ ID NO: 31770 - DNA, 18 bp, Homo sapiens
gggcaacatttggcccaa

SEQ ID NO: 31771 - DNA, 20 bp, Homo sapiens
tgaatgagatgtcaccagga

SEQ ID NO: 31772 - DNA, 18 bp, Homo sapiens
ttgggatgggcgtctgct

SEQ ID NO: 31773 - DNA, 21 bp, Homo sapiens
accagaaggaaaccctatgaa

SEQ ID NO: 31774 - DNA, 19 bp, Homo sapiens
taaagccttaattgttcca

SEQ ID NO: 31775 - DNA, 18 bp, Homo sapiens
tcaagacttcaaatgcat

SEQ ID NO: 31776 - DNA, 25 bp, Homo sapiens
cttacagcaattacagattattttt

SEQ ID NO: 31777 - DNA, 18 bp, Homo sapiens
gataataattagatcttg

SEQ ID NO: 31778 - DNA, 15 bp, Homo sapiens
atgacatcccagtta

SEQ ID NO: 31779 - DNA, 20 bp, Homo sapiens
cagcagggtaagagacacca

SEQ ID NO: 31780 - DNA, 19 bp, Homo sapiens
ttccagaagcaggtttcag

SEQ ID NO: 31781 - DNA, 23 bp, Homo sapiens
acagagaggtcagccccacccga

SEQ ID NO: 31782 - DNA, 22 bp, Homo sapiens
ccttcccctcagcctctcccca

SEQ ID NO: 31783 - DNA, 19 bp, Homo sapiens
gcctctgtgctccatccta

SEQ ID NO: 31784 - DNA, 20 bp, Homo sapiens
gcggcgctggagctttcgtc

SEQ ID NO: 31785 - DNA, 18 bp, Homo sapiens
tcaagaaggccttctcca

SEQ ID NO: 31786 - DNA, 19 bp, Homo sapiens
agccgaactcaacagtctc

SEQ ID NO: 31787 - DNA, 19 bp, Homo sapiens
gagaataggactacgtcat

SEQ ID NO: 31788 - DNA, 22 bp, Homo sapiens
gtgccgcccgtgctctgaactg

SEQ ID NO: 31789 - DNA, 20 bp, Homo sapiens
ctgaaaaagatcatttctcc

SEQ ID NO: 31790 - DNA, 19 bp, Homo sapiens
gacagcgaagaacctcctg

SEQ ID NO: 31791 - DNA, 17 bp, Homo sapiens
gttcagaaatcatacct

SEQ ID NO: 31792 - DNA, 18 bp, Homo sapiens
tctttctttgcccagtaa

SEQ ID NO: 31793 - DNA, 18 bp, Homo sapiens
aaaacatgtgaatactac

SEQ ID NO: 31794 - DNA, 21 bp, Homo sapiens
aagccagaagacgtgcaccca

SEQ ID NO: 31795 - DNA, 22 bp, Homo sapiens
aagcttccttccgtagcctctt

SEQ ID NO: 31796 - DNA, 16 bp, Homo sapiens
aggtgcactctattca

SEQ ID NO: 31797 - DNA, 20 bp, Homo sapiens
agtttcactctgttgcccag

SEQ ID NO: 31798 - DNA, 20 bp, Homo sapiens
cagcctgcacagggcaaggc

SEQ ID NO: 31799 - DNA, 23 bp, Homo sapiens
ctcggtacaatctttgaaagaaa

SEQ ID NO: 31800 - DNA, 17 bp, Homo sapiens
gagcacagcgggcctgt

SEQ ID NO: 31801 - DNA, 19 bp, Homo sapiens
gggcttgagggcttttgtt

SEQ ID NO: 31802 - DNA, 24 bp, Homo sapiens
gttctctcagttagcagctgggca

SEQ ID NO: 31803 - DNA, 19 bp, Homo sapiens
tttcactttaaaatgcgca

SEQ ID NO: 31804 - DNA, 20 bp, Homo sapiens
ggaacagacctggctgtggc

SEQ ID NO: 31805 - DNA, 23 bp, Homo sapiens
tacgctaaaaaagggaacttcca

SEQ ID NO: 31806 - DNA, 16 bp, Homo sapiens
tgtgtgtcccgcagtt

SEQ ID NO: 31807 - DNA, 18 bp, Homo sapiens
cacccggtgcctgcctca

SEQ ID NO: 31808 - DNA, 20 bp, Homo sapiens
gcctctgtccctggcggcca

SEQ ID NO: 31809 - DNA, 27 bp, Homo sapiens
gcctgggccgcttgctggctgtggcct

SEQ ID NO: 31810 - DNA, 19 bp, Homo sapiens
tccttggagtttacgctca

SEQ ID NO: 31811 - DNA, 18 bp, Homo sapiens
acctcagccctcatgtca

SEQ ID NO: 31812 - DNA, 22 bp, Homo sapiens
cagcctggccaacataatgaaa

SEQ ID NO: 31813 - DNA, 19 bp, Homo sapiens
cttaggcagttccagagct

SEQ ID NO: 31814 - DNA, 17 bp, Homo sapiens
gatttagccatgatgaa

SEQ ID NO: 31815 - DNA, 18 bp, Homo sapiens
gtgtcaaaacacatttat

SEQ ID NO: 31816 - DNA, 25 bp, Homo sapiens
gtgcttttacaaattggtgagtttt

SEQ ID NO: 31817 - DNA, 20 bp, Homo sapiens
tctttgtactttttaacttt

SEQ ID NO: 31818 - DNA, 22 bp, Homo sapiens
ctaccaagtttaaattaaccaa

SEQ ID NO: 31819 - DNA, 22 bp, Homo sapiens
gtgttgtctgttggcgcgctct

SEQ ID NO: 31820 - DNA, 15 bp, Homo sapiens
gttaggctgggacaa

SEQ ID NO: 31821 - DNA, 16 bp, Homo sapiens
acagagaagtatcttg

SEQ ID NO: 31822 - DNA, 21 bp, Homo sapiens
agactgtcaagattgtatacc

SEQ ID NO: 31823 - DNA, 18 bp, Homo sapiens
cctttaagaaaacatgga

SEQ ID NO: 31824 - DNA, 20 bp, Homo sapiens
cttgacttttttgtcttaca

SEQ ID NO: 31825 - DNA, 22 bp, Homo sapiens
ccgctctgccacgttccctgag

SEQ ID NO: 31826 - DNA, 18 bp, Homo sapiens
gtccacccctcaccgaca

SEQ ID NO: 31827 - DNA, 20 bp, Homo sapiens
ccctccccagccccctctcc

SEQ ID NO: 31828 - DNA, 22 bp, Homo sapiens
actggagaaatcaaagtgatca

SEQ ID NO: 31829 - DNA, 24 bp, Homo sapiens
gcttgagctgagatggactggtct

SEQ ID NO: 31830 - DNA, 19 bp, Homo sapiens
tgggcgcccaaggcgctgg

SEQ ID NO: 31831 - DNA, 19 bp, Homo sapiens
aaagctgggagggaggcga

SEQ ID NO: 31832 - DNA, 21 bp, Homo sapiens
gatatcatcagaaaattacca

SEQ ID NO: 31833 - DNA, 21 bp, Homo sapiens
tttgaaaaaaaaaaaaagtgg

SEQ ID NO: 31834 - DNA, 21 bp, Homo sapiens
agccatcccagagcctgggga

SEQ ID NO: 31835 - DNA, 16 bp, Homo sapiens
cagagccacaacaaca

SEQ ID NO: 31836 - DNA, 17 bp, Homo sapiens
gcagagcaggcacacct

SEQ ID NO: 31837 - DNA, 19 bp, Homo sapiens
ggtgaagccttacctgcgg

SEQ ID NO: 31838 - DNA, 19 bp, Homo sapiens
tctggagcttttctggtcc

SEQ ID NO: 31839 - DNA, 18 bp, Homo sapiens
tgaatgagacccagctga

SEQ ID NO: 31840 - DNA, 16 bp, Homo sapiens
ctgaggctggcggtgg

SEQ ID NO: 31841 - DNA, 22 bp, Homo sapiens
tgcctacgggtacttgcagctg

SEQ ID NO: 31842 - DNA, 16 bp, Homo sapiens
aaggaacctcaggcac

SEQ ID NO: 31843 - DNA, 20 bp, Homo sapiens
agaaacaaggcccccagtga

SEQ ID NO: 31844 - DNA, 22 bp, Homo sapiens
agtcgcagagagggaccccggg

SEQ ID NO: 31845 - DNA, 22 bp, Homo sapiens
caggctcccctttccttaaagc

SEQ ID NO: 31846 - DNA, 18 bp, Homo sapiens
catcctctcccaagcacc

SEQ ID NO: 31847 - DNA, 21 bp, Homo sapiens
gcctgctgagctcagctggca

SEQ ID NO: 31848 - DNA, 21 bp, Homo sapiens
ggaggagccttggtggcgaga

SEQ ID NO: 31849 - DNA, 18 bp, Homo sapiens
actgaactatatcaagaa

SEQ ID NO: 31850 - DNA, 23 bp, Homo sapiens
agaagaggacctcctttccccca

SEQ ID NO: 31851 - DNA, 19 bp, Homo sapiens
agaattggagagaactgtt

SEQ ID NO: 31852 - DNA, 24 bp, Homo sapiens
catttttatcaaaagcaggttatt

SEQ ID NO: 31853 - DNA, 21 bp, Homo sapiens
cctttcccccaacctcctcca

SEQ ID NO: 31854 - DNA, 19 bp, Homo sapiens
tcaaaagcaggttatttcc

SEQ ID NO: 31855 - DNA, 19 bp, Homo sapiens
tccatttgcaatgagaaac

SEQ ID NO: 31856 - DNA, 20 bp, Homo sapiens
tggacacttgccaatgatga

SEQ ID NO: 31857 - DNA, 20 bp, Homo sapiens
aaggatgtcatttcatgagt

SEQ ID NO: 31858 - DNA, 17 bp, Homo sapiens
aagtgtgacatgcttta

SEQ ID NO: 31859 - DNA, 19 bp, Homo sapiens
acatcttcatttttcctca

SEQ ID NO: 31860 - DNA, 21 bp, Homo sapiens
atccaattactgtgccttcta

SEQ ID NO: 31861 - DNA, 23 bp, Homo sapiens
caaaccagctaacaccattacag

SEQ ID NO: 31862 - DNA, 18 bp, Homo sapiens
ccaccccaccttctcctt

SEQ ID NO: 31863 - DNA, 19 bp, Homo sapiens
ctgccacattgtttccttt

SEQ ID NO: 31864 - DNA, 20 bp, Homo sapiens
ctttgttctgccttggtctt

SEQ ID NO: 31865 - DNA, 25 bp, Homo sapiens
ttccccagacaggtatacttcttca

SEQ ID NO: 31866 - DNA, 19 bp, Homo sapiens
ttggtaaaattacatttaa

SEQ ID NO: 31867 - DNA, 17 bp, Homo sapiens
acaacatcagtacactc

SEQ ID NO: 31868 - DNA, 23 bp, Homo sapiens
agaaatattcattatctgtcatt

SEQ ID NO: 31869 - DNA, 21 bp, Homo sapiens
atagagctgtgcagatcttca

SEQ ID NO: 31870 - DNA, 21 bp, Homo sapiens
ctttaagtatgtgcagtttgt

SEQ ID NO: 31871 - DNA, 19 bp, Homo sapiens
tgagcacagcaagctgaca

SEQ ID NO: 31872 - DNA, 21 bp, Homo sapiens
tgttgaggaaacaatctgttg

SEQ ID NO: 31873 - DNA, 18 bp, Homo sapiens
ttaaagtcacctctactg

SEQ ID NO: 31874 - DNA, 19 bp, Homo sapiens
ttacctaataattacctca

SEQ ID NO: 31875 - DNA, 19 bp, Homo sapiens
gttttttctgttgcaacag

SEQ ID NO: 31876 - DNA, 24 bp, Homo sapiens
tctaagacctccaagcttgttttt

SEQ ID NO: 31877 - DNA, 25 bp, Homo sapiens
ttcttgtatcttggctgtctggttt

SEQ ID NO: 31878 - DNA, 21 bp, Homo sapiens
tttcttgtatcttggctgtct

SEQ ID NO: 31879 - DNA, 26 bp, Homo sapiens
agtggtctccttacgtgctcacaccc

SEQ ID NO: 31880 - DNA, 17 bp, Homo sapiens
tgaacagacctgtcagc

SEQ ID NO: 31881 - DNA, 15 bp, Homo sapiens
ttggtagttggcata

SEQ ID NO: 31882 - DNA, 18 bp, Homo sapiens
ggcctgtagccccatttt

SEQ ID NO: 31883 - DNA, 21 bp, Homo sapiens
gttcccataatccgcacctgt

SEQ ID NO: 31884 - DNA, 20 bp, Homo sapiens
tgaaccactaattgagatta

SEQ ID NO: 31885 - DNA, 17 bp, Homo sapiens
tgccctgtctcagatga

SEQ ID NO: 31886 - DNA, 23 bp, Homo sapiens
agaaactgcaggttctcttgtga

SEQ ID NO: 31887 - DNA, 19 bp, Homo sapiens
attttgctaactgttaaca

SEQ ID NO: 31888 - DNA, 20 bp, Homo sapiens
cctctgcctcccaggttcaa

SEQ ID NO: 31889 - DNA, 20 bp, Homo sapiens
cctttgtccacgggctattg

SEQ ID NO: 31890 - DNA, 19 bp, Homo sapiens
ctctggtctccttgcctct

SEQ ID NO: 31891 - DNA, 19 bp, Homo sapiens
ctgagctgcctgcaggttc

SEQ ID NO: 31892 - DNA, 19 bp, Homo sapiens
ctgcaacctctgcctccca

SEQ ID NO: 31893 - DNA, 16 bp, Homo sapiens
gagggcaagatccaag

SEQ ID NO: 31894 - DNA, 21 bp, Homo sapiens
gcccctgtggctggctggccc

SEQ ID NO: 31895 - DNA, 20 bp, Homo sapiens
gcccttcctccaggtgtgtg

SEQ ID NO: 31896 - DNA, 19 bp, Homo sapiens
gctctttgcaaacgaaaga

SEQ ID NO: 31897 - DNA, 19 bp, Homo sapiens
gtgaaacaaaccaatgcac

SEQ ID NO: 31898 - DNA, 22 bp, Homo sapiens
cagagcggccacccccacctca

SEQ ID NO: 31899 - DNA, 24 bp, Homo sapiens
gccaccgcccgtgggcatcgatga

SEQ ID NO: 31900 - DNA, 18 bp, Homo sapiens
atttgtgctgggatggaa

SEQ ID NO: 31901 - DNA, 18 bp, Homo sapiens
cagagaatatccaatgca

SEQ ID NO: 31902 - DNA, 19 bp, Homo sapiens
ccctttgacctgccttttt

SEQ ID NO: 31903 - DNA, 20 bp, Homo sapiens
cctcttcacccctttgacct

SEQ ID NO: 31904 - DNA, 18 bp, Homo sapiens
ctcccccacctttcctct

SEQ ID NO: 31905 - DNA, 22 bp, Homo sapiens
gccctcccaccttttctttaga

SEQ ID NO: 31906 - DNA, 22 bp, Homo sapiens
ggtgggtggagagccctgtttg

SEQ ID NO: 31907 - DNA, 23 bp, Homo sapiens
tccaaggcccccagcaggctctc

SEQ ID NO: 31908 - DNA, 17 bp, Homo sapiens
aaagttggagcctggca

SEQ ID NO: 31909 - DNA, 20 bp, Homo sapiens
ccataaatgcatacacatac

SEQ ID NO: 31910 - DNA, 17 bp, Homo sapiens
ctcacaggaactgttca

SEQ ID NO: 31911 - DNA, 19 bp, Homo sapiens
ctccagggacaggcactgc

SEQ ID NO: 31912 - DNA, 25 bp, Homo sapiens
gcctggactctaggggatgccgcca

SEQ ID NO: 31913 - DNA, 22 bp, Homo sapiens
acccccagggcctccttcccca

SEQ ID NO: 31914 - DNA, 19 bp, Homo sapiens
ctgctgctgcctgatggag

SEQ ID NO: 31915 - DNA, 21 bp, Homo sapiens
aaggtcacctgttctccagcc

SEQ ID NO: 31916 - DNA, 21 bp, Homo sapiens
acctgagcttcttgtctgctt

SEQ ID NO: 31917 - DNA, 18 bp, Homo sapiens
accttgttaaacgttgac

SEQ ID NO: 31918 - DNA, 19 bp, Homo sapiens
acgctgtcgcccagccatg

SEQ ID NO: 31919 - DNA, 22 bp, Homo sapiens
atttgggggttttgtttggttc

SEQ ID NO: 31920 - DNA, 23 bp, Homo sapiens
cactcccgaaagctccgttgtca

SEQ ID NO: 31921 - DNA, 20 bp, Homo sapiens
ccaccagtggccttgcggta

SEQ ID NO: 31922 - DNA, 22 bp, Homo sapiens
cctaccaacagcgcccacccca

SEQ ID NO: 31923 - DNA, 23 bp, Homo sapiens
ccttttgtttatgttttggcctt

SEQ ID NO: 31924 - DNA, 20 bp, Homo sapiens
ctttgaggctttttgtttta

SEQ ID NO: 31925 - DNA, 23 bp, Homo sapiens
gccacttctagggacactgggga

SEQ ID NO: 31926 - DNA, 18 bp, Homo sapiens
gccgggagggtttgggga

SEQ ID NO: 31927 - DNA, 20 bp, Homo sapiens
ggtcttagtggctgcagcag

SEQ ID NO: 31928 - DNA, 22 bp, Homo sapiens
gtaagaaacaaggaaatcactc

SEQ ID NO: 31929 - DNA, 18 bp, Homo sapiens
gtggatatatggcattga

SEQ ID NO: 31930 - DNA, 17 bp, Homo sapiens
atatttccttttcctca

SEQ ID NO: 31931 - DNA, 19 bp, Homo sapiens
ctgcaagctccgcctccca

SEQ ID NO: 31932 - DNA, 23 bp, Homo sapiens
tcacaaatattaatatttccttt

SEQ ID NO: 31933 - DNA, 25 bp, Homo sapiens
tgagtcactttattgggttcagtca

SEQ ID NO: 31934 - DNA, 21 bp, Homo sapiens
acaaaaggacctcccagagtt

SEQ ID NO: 31935 - DNA, 18 bp, Homo sapiens
accagtgctgtttggcct

SEQ ID NO: 31936 - DNA, 27 bp, Homo sapiens
gcttgtgtctttgtcattgtctggttc

SEQ ID NO: 31937 - DNA, 17 bp, Homo sapiens
gtcaaatggcctgccca

SEQ ID NO: 31938 - DNA, 20 bp, Homo sapiens
tggtgggtatgggtccccta

SEQ ID NO: 31939 - DNA, 22 bp, Homo sapiens
acacaggaaagtcgtactgttc

SEQ ID NO: 31940 - DNA, 22 bp, Homo sapiens
agaggcccttcacccagagcca

SEQ ID NO: 31941 - DNA, 16 bp, Homo sapiens
caggaaccattttcac

SEQ ID NO: 31942 - DNA, 18 bp, Homo sapiens
gattctttttctccccct

SEQ ID NO: 31943 - DNA, 19 bp, Homo sapiens
tgatttccaacatgaggtt

SEQ ID NO: 31944 - DNA, 23 bp, Homo sapiens
ctgacaggattttaggtcacttt

SEQ ID NO: 31945 - DNA, 20 bp, Homo sapiens
ggattttaggtcactttgta

SEQ ID NO: 31946 - DNA, 21 bp, Homo sapiens
ccaaacagatatctaaacact

SEQ ID NO: 31947 - DNA, 21 bp, Homo sapiens
ccgagcgcgggcggctccccg

SEQ ID NO: 31948 - DNA, 19 bp, Homo sapiens
gtcggtccagtccttgcct

SEQ ID NO: 31949 - DNA, 20 bp, Homo sapiens
aagagaggtaggagaggctg

SEQ ID NO: 31950 - DNA, 22 bp, Homo sapiens
caggcttccctgtctgtagagc

SEQ ID NO: 31951 - DNA, 21 bp, Homo sapiens
gcaagtgccatccacacttgc

SEQ ID NO: 31952 - DNA, 18 bp, Homo sapiens
gctaaccatcttatgagt

SEQ ID NO: 31953 - DNA, 21 bp, Homo sapiens
gtgttggtacctgtggatttt

SEQ ID NO: 31954 - DNA, 18 bp, Homo sapiens
tattgaagtgtctaacaa

SEQ ID NO: 31955 - DNA, 26 bp, Homo sapiens
tcttttacagaggctattttaatctt

SEQ ID NO: 31956 - DNA, 22 bp, Homo sapiens
tggaatttatagaggctacaac

SEQ ID NO: 31957 - DNA, 25 bp, Homo sapiens
gcttccctgtgtcctctctccctct

SEQ ID NO: 31958 - DNA, 19 bp, Homo sapiens
tgcatgcggacttactttg

SEQ ID NO: 31959 - DNA, 17 bp, Homo sapiens
ttgaagatatgtgctta

SEQ ID NO: 31960 - DNA, 23 bp, Homo sapiens
ttgtttctccctctggtaacatc

SEQ ID NO: 31961 - DNA, 23 bp, Homo sapiens
ccctccccaccaacttctctgcc

SEQ ID NO: 31962 - DNA, 23 bp, Homo sapiens
ccttggtgtcagggacctgagag

SEQ ID NO: 31963 - DNA, 17 bp, Homo sapiens
ggcttggcccactgcca

SEQ ID NO: 31964 - DNA, 21 bp, Homo sapiens
cagggttcatgattactgtga

SEQ ID NO: 31965 - DNA, 23 bp, Homo sapiens
catactaggttaaagataaagtg

SEQ ID NO: 31966 - DNA, 21 bp, Homo sapiens
catccatggaattttggaatg

SEQ ID NO: 31967 - DNA, 18 bp, Homo sapiens
ctctaaacaaatgcatgc

SEQ ID NO: 31968 - DNA, 17 bp, Homo sapiens
ggggactcttaaaaaga

SEQ ID NO: 31969 - DNA, 18 bp, Homo sapiens
tcaggaacagaccattca

SEQ ID NO: 31970 - DNA, 26 bp, Homo sapiens
tgaatggtaactttttaatgtgaaac

SEQ ID NO: 31971 - DNA, 21 bp, Homo sapiens
tgagtaatttgtacagtcaat

SEQ ID NO: 31972 - DNA, 20 bp, Homo sapiens
ttccttgctgactcatttcc

SEQ ID NO: 31973 - DNA, 20 bp, Homo sapiens
ttgaaaacaacagacgtaca

SEQ ID NO: 31974 - DNA, 16 bp, Homo sapiens
agcccggcactacggg

SEQ ID NO: 31975 - DNA, 18 bp, Homo sapiens
cccgccgcccccgccctc

SEQ ID NO: 31976 - DNA, 17 bp, Homo sapiens
ctcagcgccgccgacac

SEQ ID NO: 31977 - DNA, 19 bp, Homo sapiens
ggcaaaggttcccacctta

SEQ ID NO: 31978 - DNA, 19 bp, Homo sapiens
tctccatcaccgcaaccaa

SEQ ID NO: 31979 - DNA, 17 bp, Homo sapiens
tgaagagactgtggagt

SEQ ID NO: 31980 - DNA, 18 bp, Homo sapiens
agagtgagacaagcaaca

SEQ ID NO: 31981 - DNA, 20 bp, Homo sapiens
gcggctgtagcggcgtgaca

SEQ ID NO: 31982 - DNA, 21 bp, Homo sapiens
ggagacggcggcggctgtagc

SEQ ID NO: 31983 - DNA, 24 bp, Homo sapiens
caaataatgaagatctctccttca

SEQ ID NO: 31984 - DNA, 20 bp, Homo sapiens
ctctccttcagtctgctctg

SEQ ID NO: 31985 - DNA, 19 bp, Homo sapiens
cccacagcccgtgttcccg

SEQ ID NO: 31986 - DNA, 23 bp, Homo sapiens
ccccgcccgccggcccctccagc

SEQ ID NO: 31987 - DNA, 21 bp, Homo sapiens
tatccctcactcatttagcca

SEQ ID NO: 31988 - DNA, 17 bp, Homo sapiens
ccccagaggaccagagc

SEQ ID NO: 31989 - DNA, 23 bp, Homo sapiens
ggagatggaggcggcggcgtggc

SEQ ID NO: 31990 - DNA, 19 bp, Homo sapiens
aaaaagatacagtgagtaa

SEQ ID NO: 31991 - DNA, 18 bp, Homo sapiens
atagagagcatatggata

SEQ ID NO: 31992 - DNA, 24 bp, Homo sapiens
ccgagtctcagatattctgttata

SEQ ID NO: 31993 - DNA, 19 bp, Homo sapiens
ctttcctgacctctggttt

SEQ ID NO: 31994 - DNA, 24 bp, Homo sapiens
tacgtttattttcttcataaatta

SEQ ID NO: 31995 - DNA, 21 bp, Homo sapiens
cagaaccttttttaaatgtaa

SEQ ID NO: 31996 - DNA, 18 bp, Homo sapiens
gtgcggtggtgtgtgtag

SEQ ID NO: 31997 - DNA, 24 bp, Homo sapiens
tctgggaagttctgaatttctttt

SEQ ID NO: 31998 - DNA, 20 bp, Homo sapiens
ccccacccccaccccgctgc

SEQ ID NO: 31999 - DNA, 23 bp, Homo sapiens
ctggtgattaattagcaattctc

SEQ ID NO: 32000 - DNA, 20 bp, Homo sapiens
gcctggattgctcactgttt

SEQ ID NO: 32001 - DNA, 18 bp, Homo sapiens
accaccaaaatagctaca

SEQ ID NO: 32002 - DNA, 18 bp, Homo sapiens
acctgggtaactgcctgg

SEQ ID NO: 32003 - DNA, 23 bp, Homo sapiens
cacttccgtccaaagtccactta

SEQ ID NO: 32004 - DNA, 22 bp, Homo sapiens
cccctccccacctcctgccccc

SEQ ID NO: 32005 - DNA, 22 bp, Homo sapiens
aggcacttgctgagcccacgct

SEQ ID NO: 32006 - DNA, 21 bp, Homo sapiens
ccaatgccaaagaggcaccga

SEQ ID NO: 32007 - DNA, 18 bp, Homo sapiens
cgtgtaggaaacccagtg

SEQ ID NO: 32008 - DNA, 22 bp, Homo sapiens
gtgtccagaattggtgggttct

SEQ ID NO: 32009 - DNA, 19 bp, Homo sapiens
ctgagtcgcggggcagctc

SEQ ID NO: 32010 - DNA, 22 bp, Homo sapiens
tgaagtctcacgcctacattca

SEQ ID NO: 32011 - DNA, 22 bp, Homo sapiens
acctgggccacagtgcctgcct

SEQ ID NO: 32012 - DNA, 21 bp, Homo sapiens
ccaagagaatctgttctagac

SEQ ID NO: 32013 - DNA, 16 bp, Homo sapiens
cccatatcatcagctg

SEQ ID NO: 32014 - DNA, 16 bp, Homo sapiens
gggaagttttatcagt

SEQ ID NO: 32015 - DNA, 16 bp, Homo sapiens
tgaagttgtggtaaca

SEQ ID NO: 32016 - DNA, 17 bp, Homo sapiens
ctattaatagaatgagg

SEQ ID NO: 32017 - DNA, 19 bp, Homo sapiens
ggaatagtagaagaggtga

SEQ ID NO: 32018 - DNA, 18 bp, Homo sapiens
tggtcctaatctgtaaat

SEQ ID NO: 32019 - DNA, 20 bp, Homo sapiens
tgtatcagcagcatttctga

SEQ ID NO: 32020 - DNA, 21 bp, Homo sapiens
cccaccacaccccagctgcga

SEQ ID NO: 32021 - DNA, 20 bp, Homo sapiens
aagacttcagcagcaaacca

SEQ ID NO: 32022 - DNA, 17 bp, Homo sapiens
atccgttcctcctctga

SEQ ID NO: 32023 - DNA, 22 bp, Homo sapiens
cctacagaagacatagaagatg

SEQ ID NO: 32024 - DNA, 21 bp, Homo sapiens
ctgcaggtggaagtgcttttc

SEQ ID NO: 32025 - DNA, 17 bp, Homo sapiens
gaagaggctcgcctccc

SEQ ID NO: 32026 - DNA, 20 bp, Homo sapiens
gcaggtggaagtgcttttct

SEQ ID NO: 32027 - DNA, 23 bp, Homo sapiens
tcaaagacttcagcagcaaacca

SEQ ID NO: 32028 - DNA, 21 bp, Homo sapiens
agcagccactggtgccactgc

SEQ ID NO: 32029 - DNA, 21 bp, Homo sapiens
atctctaaagcaaaagcctca

SEQ ID NO: 32030 - DNA, 25 bp, Homo sapiens
cttatgggaatcctgagctgctttt

SEQ ID NO: 32031 - DNA, 20 bp, Homo sapiens
gaatgctggatttctctgga

SEQ ID NO: 32032 - DNA, 16 bp, Homo sapiens
gacccatctctgccct

SEQ ID NO: 32033 - DNA, 21 bp, Homo sapiens
gactaattgggaaacggggaa

SEQ ID NO: 32034 - DNA, 23 bp, Homo sapiens
gagcaccttcagcatgagttgtt

SEQ ID NO: 32035 - DNA, 22 bp, Homo sapiens
gcttcagagtttcacctgccca

SEQ ID NO: 32036 - DNA, 18 bp, Homo sapiens
gtccaggaggcctgtgga

SEQ ID NO: 32037 - DNA, 19 bp, Homo sapiens
gtccaggaggcctgtggac

SEQ ID NO: 32038 - DNA, 21 bp, Homo sapiens
tgagtggattgcttgagccta

SEQ ID NO: 32039 - DNA, 24 bp, Homo sapiens
ttcttttatgtaacatgtagttta

SEQ ID NO: 32040 - DNA, 17 bp, Homo sapiens
aataccaaaatactact

SEQ ID NO: 32041 - DNA, 20 bp, Homo sapiens
agtacttttgcccatgtgct

SEQ ID NO: 32042 - DNA, 22 bp, Homo sapiens
atcttgtaaggctatatttttt

SEQ ID NO: 32043 - DNA, 20 bp, Homo sapiens
cgtccccgcccagcctgctc

SEQ ID NO: 32044 - DNA, 18 bp, Homo sapiens
gagcattaaattatccta

SEQ ID NO: 32045 - DNA, 18 bp, Homo sapiens
tccctctccactcctgaa

SEQ ID NO: 32046 - DNA, 18 bp, Homo sapiens
cagttctaaaatactttt

SEQ ID NO: 32047 - DNA, 17 bp, Homo sapiens
aaacactgaaaggcttc

SEQ ID NO: 32048 - DNA, 18 bp, Homo sapiens
actcagtgtacatctgaa

SEQ ID NO: 32049 - DNA, 18 bp, Homo sapiens
agcttgatgctctcagtc

SEQ ID NO: 32050 - DNA, 22 bp, Homo sapiens
tcctgatgatgaagtgatttgc

SEQ ID NO: 32051 - DNA, 19 bp, Homo sapiens
tgctttgcttaacaacatc

SEQ ID NO: 32052 - DNA, 20 bp, Homo sapiens
tggaggatatttggctttga

SEQ ID NO: 32053 - DNA, 20 bp, Homo sapiens
tttgagcagttgtctggtcc

SEQ ID NO: 32054 - DNA, 18 bp, Homo sapiens
catatggctagccagctt

SEQ ID NO: 32055 - DNA, 17 bp, Homo sapiens
gcaattgtgaatgggag

SEQ ID NO: 32056 - DNA, 22 bp, Homo sapiens
ggcattttcccagatgtttaca

SEQ ID NO: 32057 - DNA, 19 bp, Homo sapiens
ggttttcagtatgaaccta

SEQ ID NO: 32058 - DNA, 21 bp, Homo sapiens
tatttcctcaaatttgcctca

SEQ ID NO: 32059 - DNA, 18 bp, Homo sapiens
tgggctcaagtcactttt

SEQ ID NO: 32060 - DNA, 22 bp, Homo sapiens
ttgtaatcatgttaccattaca

SEQ ID NO: 32061 - DNA, 22 bp, Homo sapiens
tttaagaactgtattttatttt

SEQ ID NO: 32062 - DNA, 20 bp, Homo sapiens
accacactttcctcctactc

SEQ ID NO: 32063 - DNA, 20 bp, Homo sapiens
agaaaattcataaaaatgta

SEQ ID NO: 32064 - DNA, 20 bp, Homo sapiens
cgctttacaaaggcatgact

SEQ ID NO: 32065 - DNA, 18 bp, Homo sapiens
ctcttctgatgcatggca

SEQ ID NO: 32066 - DNA, 19 bp, Homo sapiens
ctgatttcttgactctcaa

SEQ ID NO: 32067 - DNA, 18 bp, Homo sapiens
gacacatcacatgcatca

SEQ ID NO: 32068 - DNA, 21 bp, Homo sapiens
ggcactattcctggtgcagta

SEQ ID NO: 32069 - DNA, 17 bp, Homo sapiens
tagctttgagtggcaga

SEQ ID NO: 32070 - DNA, 21 bp, Homo sapiens
tggtcctaaggaagcatgagc

SEQ ID NO: 32071 - DNA, 20 bp, Homo sapiens
tgtgagactccaagctcctt

SEQ ID NO: 32072 - DNA, 18 bp, Homo sapiens
tgtgttatgaatttctga

SEQ ID NO: 32073 - DNA, 19 bp, Homo sapiens
ggacgacggcggcggcggc

SEQ ID NO: 32074 - DNA, 22 bp, Homo sapiens
gtgctgtccgtgccccaggctg

SEQ ID NO: 32075 - DNA, 21 bp, Homo sapiens
atccccaaagacattatctgt

SEQ ID NO: 32076 - DNA, 25 bp, Homo sapiens
attaactctcttttcttgcatctca

SEQ ID NO: 32077 - DNA, 17 bp, Homo sapiens
caatacatgattaaatg

SEQ ID NO: 32078 - DNA, 18 bp, Homo sapiens
cagcttggaaggcattga

SEQ ID NO: 32079 - DNA, 25 bp, Homo sapiens
cataaactaattatttctctggata

SEQ ID NO: 32080 - DNA, 17 bp, Homo sapiens
catgtattctaacattt

SEQ ID NO: 32081 - DNA, 21 bp, Homo sapiens
gctgtgggcaactgttttgtt

SEQ ID NO: 32082 - DNA, 19 bp, Homo sapiens
gtagcagtgttattctaca

SEQ ID NO: 32083 - DNA, 24 bp, Homo sapiens
tagaaggtggaaaccaaaaccctc

SEQ ID NO: 32084 - DNA, 20 bp, Homo sapiens
tcacttattaactctctttt

SEQ ID NO: 32085 - DNA, 19 bp, Homo sapiens
aaactcctgacctcaggtg

SEQ ID NO: 32086 - DNA, 19 bp, Homo sapiens
agctgtggttgtctcgttt

SEQ ID NO: 32087 - DNA, 28 bp, Homo sapiens
caaaatcttcaccttgagtacaatgtac

SEQ ID NO: 32088 - DNA, 17 bp, Homo sapiens
cttgaaaccctatttct

SEQ ID NO: 32089 - DNA, 21 bp, Homo sapiens
gaaaaatgagacaatatatcc

SEQ ID NO: 32090 - DNA, 20 bp, Homo sapiens
gacatctacttgggagctgt

SEQ ID NO: 32091 - DNA, 18 bp, Homo sapiens
gctgtggttgtctcgttt

SEQ ID NO: 32092 - DNA, 21 bp, Homo sapiens
ggcagcagggccctcaagcca

SEQ ID NO: 32093 - DNA, 21 bp, Homo sapiens
tcaaaatcttcaccttgagta

SEQ ID NO: 32094 - DNA, 20 bp, Homo sapiens
tctcacaaaatacagatatg

SEQ ID NO: 32095 - DNA, 26 bp, Homo sapiens
ttaggggtaacacaacacagatactt

SEQ ID NO: 32096 - DNA, 20 bp, Homo sapiens
tttccatcgctgaagactct

SEQ ID NO: 32097 - DNA, 19 bp, Homo sapiens
aaacactgatagtatctca

SEQ ID NO: 32098 - DNA, 21 bp, Homo sapiens
acacagaaatgtagctgtgtt

SEQ ID NO: 32099 - DNA, 21 bp, Homo sapiens
acctgagacttgccgtctggc

SEQ ID NO: 32100 - DNA, 20 bp, Homo sapiens
agcttccagatagcaccgtt

SEQ ID NO: 32101 - DNA, 18 bp, Homo sapiens
atggaaggtattaaacta

SEQ ID NO: 32102 - DNA, 22 bp, Homo sapiens
catagtggtaaataattatgaa

SEQ ID NO: 32103 - DNA, 19 bp, Homo sapiens
gataaatatgcatgctttt

SEQ ID NO: 32104 - DNA, 21 bp, Homo sapiens
ggtaaatggagaaaatatttc

SEQ ID NO: 32105 - DNA, 21 bp, Homo sapiens
aacaggcttattttctgtgaa

SEQ ID NO: 32106 - DNA, 19 bp, Homo sapiens
acttttccagtaaatgaag

SEQ ID NO: 32107 - DNA, 19 bp, Homo sapiens
ctgtctttcccatcttcga

SEQ ID NO: 32108 - DNA, 18 bp, Homo sapiens
tcctgaactgggaacaaa

SEQ ID NO: 32109 - DNA, 24 bp, Homo sapiens
acagtgtgcaaagaccagtcctca

SEQ ID NO: 32110 - DNA, 19 bp, Homo sapiens
accttccccagaaccctca

SEQ ID NO: 32111 - DNA, 25 bp, Homo sapiens
gaaagctgggctagaaaatctctca

SEQ ID NO: 32112 - DNA, 19 bp, Homo sapiens
gttttctaagccaccctca

SEQ ID NO: 32113 - DNA, 16 bp, Homo sapiens
tagtgtcatttcagga

SEQ ID NO: 32114 - DNA, 17 bp, Homo sapiens
tgcccagaagggcccca

SEQ ID NO: 32115 - DNA, 18 bp, Homo sapiens
ttatatgccagtcacacc

SEQ ID NO: 32116 - DNA, 18 bp, Homo sapiens
caattggaaactttcaca

SEQ ID NO: 32117 - DNA, 17 bp, Homo sapiens
ctttctttctgttagca

SEQ ID NO: 32118 - DNA, 20 bp, Homo sapiens
aaggctggagtttggaatca

SEQ ID NO: 32119 - DNA, 19 bp, Homo sapiens
cctttgctatatgcagtca

SEQ ID NO: 32120 - DNA, 19 bp, Homo sapiens
gtccactgaagcgtgcaga

SEQ ID NO: 32121 - DNA, 18 bp, Homo sapiens
tctcttggcttccatgga

SEQ ID NO: 32122 - DNA, 20 bp, Homo sapiens
agaatacggtaagcttccca

SEQ ID NO: 32123 - DNA, 20 bp, Homo sapiens
tgtatcaggagaatcaagct

SEQ ID NO: 32124 - DNA, 24 bp, Homo sapiens
ggaacaagtctcccaaatttccca

SEQ ID NO: 32125 - DNA, 19 bp, Homo sapiens
tagtgaatcacccacaagg

SEQ ID NO: 32126 - DNA, 18 bp, Homo sapiens
ccagaaagccagcttggt

SEQ ID NO: 32127 - DNA, 22 bp, Homo sapiens
gagccaagatcacgccactgca

SEQ ID NO: 32128 - DNA, 23 bp, Homo sapiens
gcactcagcatctttgttcttca

SEQ ID NO: 32129 - DNA, 21 bp, Homo sapiens
ggttgctctggtcttttttga

SEQ ID NO: 32130 - DNA, 20 bp, Homo sapiens
gtcctgaaatggattggaga

SEQ ID NO: 32131 - DNA, 18 bp, Homo sapiens
tattccaacgaattctca

SEQ ID NO: 32132 - DNA, 18 bp, Homo sapiens
tactggcagagctgtggc

SEQ ID NO: 32133 - DNA, 19 bp, Homo sapiens
gtatgaattgctgatactt

SEQ ID NO: 32134 - DNA, 20 bp, Homo sapiens
taaaccaacgggaaaattag

SEQ ID NO: 32135 - DNA, 21 bp, Homo sapiens
gagaagccgcacggctgtggc

SEQ ID NO: 32136 - DNA, 21 bp, Homo sapiens
acctgatttggcttctggctc

SEQ ID NO: 32137 - DNA, 21 bp, Homo sapiens
acctgggcagtcctctggttt

SEQ ID NO: 32138 - DNA, 17 bp, Homo sapiens
agccagtggaaattgcc

SEQ ID NO: 32139 - DNA, 19 bp, Homo sapiens
cctgggcagtcctctggtt

SEQ ID NO: 32140 - DNA, 21 bp, Homo sapiens
ctgcggagcaattcttgcttt

SEQ ID NO: 32141 - DNA, 18 bp, Homo sapiens
gagacgcctggggtccca

SEQ ID NO: 32142 - DNA, 20 bp, Homo sapiens
ggctctttaatctcatttta

SEQ ID NO: 32143 - DNA, 18 bp, Homo sapiens
gggacagacttgaaggca

SEQ ID NO: 32144 - DNA, 19 bp, Homo sapiens
tctgaaaatgcttcttggt

SEQ ID NO: 32145 - DNA, 20 bp, Homo sapiens
tggcattccagcaggagcta

SEQ ID NO: 32146 - DNA, 19 bp, Homo sapiens
aaataaatatgtttgtcat

SEQ ID NO: 32147 - DNA, 26 bp, Homo sapiens
acttgaattgcttgatactttggttt

SEQ ID NO: 32148 - DNA, 18 bp, Homo sapiens
cctgctcaacctggcaga

SEQ ID NO: 32149 - DNA, 19 bp, Homo sapiens
ccttctcagtttctcccca

SEQ ID NO: 32150 - DNA, 22 bp, Homo sapiens
ctcctctaggaactatgttgaa

SEQ ID NO: 32151 - DNA, 19 bp, Homo sapiens
ctggggctacctgatctga

SEQ ID NO: 32152 - DNA, 21 bp, Homo sapiens
ctgtgtattacccttgctttt

SEQ ID NO: 32153 - DNA, 18 bp, Homo sapiens
ggcaattaccccggtgga

SEQ ID NO: 32154 - DNA, 24 bp, Homo sapiens
taagagggcaggcagcagcagtgc

SEQ ID NO: 32155 - DNA, 16 bp, Homo sapiens
tgaatggggatcccag

SEQ ID NO: 32156 - DNA, 20 bp, Homo sapiens
accacacagttacacattca

SEQ ID NO: 32157 - DNA, 19 bp, Homo sapiens
agatggtagcagaaactga

SEQ ID NO: 32158 - DNA, 21 bp, Homo sapiens
ccaacgaagggggtgccctgt

SEQ ID NO: 32159 - DNA, 19 bp, Homo sapiens
gccagaaaccttcagaagg

SEQ ID NO: 32160 - DNA, 23 bp, Homo sapiens
tcttgcttccggaagcttgcgaa

SEQ ID NO: 32161 - DNA, 19 bp, Homo sapiens
tgggaactgggtggaactg

SEQ ID NO: 32162 - DNA, 22 bp, Homo sapiens
tttctccctgcccagccaggga

SEQ ID NO: 32163 - DNA, 19 bp, Homo sapiens
agccaggatcactcactct

SEQ ID NO: 32164 - DNA, 25 bp, Homo sapiens
ccaccccagtgtctcactccactga

SEQ ID NO: 32165 - DNA, 21 bp, Homo sapiens
cccaagatattaaaccagtga

SEQ ID NO: 32166 - DNA, 19 bp, Homo sapiens
cttctctgcactgcccctc

SEQ ID NO: 32167 - DNA, 19 bp, Homo sapiens
gcaggaggttcatggccca

SEQ ID NO: 32168 - DNA, 19 bp, Homo sapiens
gccaaggaagcccagctga

SEQ ID NO: 32169 - DNA, 21 bp, Homo sapiens
gcctttgtcaggaccctgtga

SEQ ID NO: 32170 - DNA, 23 bp, Homo sapiens
gctgcaaagcagatgtgcaggga

SEQ ID NO: 32171 - DNA, 21 bp, Homo sapiens
tctgccgggcattgtttgttt

SEQ ID NO: 32172 - DNA, 22 bp, Homo sapiens
tgtagtttgacagagtatgcta

SEQ ID NO: 32173 - DNA, 22 bp, Homo sapiens
ctttggctgaggggcttgggaa

SEQ ID NO: 32174 - DNA, 17 bp, Homo sapiens
gctccctgctttggctg

SEQ ID NO: 32175 - DNA, 21 bp, Homo sapiens
tgagaccagtgtatcaggtca

SEQ ID NO: 32176 - DNA, 24 bp, Homo sapiens
aggaagtcatgtctcactactttt

SEQ ID NO: 32177 - DNA, 18 bp, Homo sapiens
tgggtggatcacctgagg

SEQ ID NO: 32178 - DNA, 20 bp, Homo sapiens
ttcaagaccagcctgaccaa

SEQ ID NO: 32179 - DNA, 21 bp, Homo sapiens
atgttgtaaacagctgttcca

SEQ ID NO: 32180 - DNA, 21 bp, Homo sapiens
tctttagtaatttaatcttca

SEQ ID NO: 32181 - DNA, 24 bp, Homo sapiens
tgcaacctccgcctcctggattca

SEQ ID NO: 32182 - DNA, 21 bp, Homo sapiens
tgcaattgtgtctggtatgct

SEQ ID NO: 32183 - DNA, 19 bp, Homo sapiens
tgtcataaatgtcacaata

SEQ ID NO: 32184 - DNA, 19 bp, Homo sapiens
atatgttcggtaaatgctc

SEQ ID NO: 32185 - DNA, 18 bp, Homo sapiens
ctccacctcctctactct

SEQ ID NO: 32186 - DNA, 23 bp, Homo sapiens
tagcctttttatgagacaggtca

SEQ ID NO: 32187 - DNA, 21 bp, Homo sapiens
tgccagacacaccctccccag

SEQ ID NO: 32188 - DNA, 21 bp, Homo sapiens
caggactacgtaaattggact

SEQ ID NO: 32189 - DNA, 19 bp, Homo sapiens
gaagaagcctggggcctca

SEQ ID NO: 32190 - DNA, 21 bp, Homo sapiens
cttgtctttcagaattactta

SEQ ID NO: 32191 - DNA, 18 bp, Homo sapiens
gtcctttaagaagaaggg

SEQ ID NO: 32192 - DNA, 18 bp, Homo sapiens
gtgccatctccgttaaaa

SEQ ID NO: 32193 - DNA, 21 bp, Homo sapiens
tctattttctatgaccagaga

SEQ ID NO: 32194 - DNA, 21 bp, Homo sapiens
acagccagcatgactgcttct

SEQ ID NO: 32195 - DNA, 20 bp, Homo sapiens
actgcaatgttaacaacggt

SEQ ID NO: 32196 - DNA, 18 bp, Homo sapiens
cagtaccctcagtgcctg

SEQ ID NO: 32197 - DNA, 23 bp, Homo sapiens
ccactgatgaggccctcctagcc

SEQ ID NO: 32198 - DNA, 22 bp, Homo sapiens
cctcccaccccataactgttcc

SEQ ID NO: 32199 - DNA, 19 bp, Homo sapiens
cttcctgttgaacttccta

SEQ ID NO: 32200 - DNA, 20 bp, Homo sapiens
gagaatacaggaagccccca

SEQ ID NO: 32201 - DNA, 24 bp, Homo sapiens
gcaaaatctctctgtcctaaacta

SEQ ID NO: 32202 - DNA, 21 bp, Homo sapiens
gcttgagtgaatgttaggcct

SEQ ID NO: 32203 - DNA, 17 bp, Homo sapiens
tcctgggattctgggga

SEQ ID NO: 32204 - DNA, 19 bp, Homo sapiens
cctgagtagtccctggctt

SEQ ID NO: 32205 - DNA, 21 bp, Homo sapiens
cctgagtagtccctggctttt

SEQ ID NO: 32206 - DNA, 20 bp, Homo sapiens
gtgtgtgtgggtggggacta

SEQ ID NO: 32207 - DNA, 30 bp, Homo sapiens
gcgacctcatctgccgcaaccggacggcta

SEQ ID NO: 32208 - DNA, 22 bp, Homo sapiens
ggaaagcggcagcggcggcggc

SEQ ID NO: 32209 - DNA, 20 bp, Homo sapiens
agtgaattacccaacttaac

SEQ ID NO: 32210 - DNA, 21 bp, Homo sapiens
cgcgggtggcccctctggcat

SEQ ID NO: 32211 - DNA, 20 bp, Homo sapiens
cttctatcttgccttgtctt

SEQ ID NO: 32212 - DNA, 25 bp, Homo sapiens
gcagcacattatcagcagtgaccta

SEQ ID NO: 32213 - DNA, 20 bp, Homo sapiens
aacaggagtgatgtcatttc

SEQ ID NO: 32214 - DNA, 23 bp, Homo sapiens
aatgtgaccgtctgtatgacccg

SEQ ID NO: 32215 - DNA, 22 bp, Homo sapiens
acccgtttaccgtgctataatc

SEQ ID NO: 32216 - DNA, 21 bp, Homo sapiens
atgtggccacacggtggatga

SEQ ID NO: 32217 - DNA, 18 bp, Homo sapiens
ccactcctcaccaccagc

SEQ ID NO: 32218 - DNA, 19 bp, Homo sapiens
ctatctccctttctgtgat

SEQ ID NO: 32219 - DNA, 20 bp, Homo sapiens
gaagaaaaataaagccattg

SEQ ID NO: 32220 - DNA, 23 bp, Homo sapiens
gcttggcaggtgctttttggttc

SEQ ID NO: 32221 - DNA, 16 bp, Homo sapiens
gttcctgagcttccgg

SEQ ID NO: 32222 - DNA, 20 bp, Homo sapiens
tatcctgatccctgaatttc

SEQ ID NO: 32223 - DNA, 18 bp, Homo sapiens
tcaacgttctgaaaccac

SEQ ID NO: 32224 - DNA, 18 bp, Homo sapiens
tcaagaaatcatcatctg

SEQ ID NO: 32225 - DNA, 19 bp, Homo sapiens
tgtagtacatggccaactt

SEQ ID NO: 32226 - DNA, 21 bp, Homo sapiens
ctggccaccatcatctttgca

SEQ ID NO: 32227 - DNA, 21 bp, Homo sapiens
tttccagttgcatttaatttt

SEQ ID NO: 32228 - DNA, 17 bp, Homo sapiens
aaaaaaataccactgtg

SEQ ID NO: 32229 - DNA, 22 bp, Homo sapiens
aaaagtttaaaactttctaata

SEQ ID NO: 32230 - DNA, 19 bp, Homo sapiens
cctccaacagctgctttaa

SEQ ID NO: 32231 - DNA, 19 bp, Homo sapiens
attcagtttcccccaagga

SEQ ID NO: 32232 - DNA, 22 bp, Homo sapiens
gagccaagattgcaccactgca

SEQ ID NO: 32233 - DNA, 18 bp, Homo sapiens
tggagaccacttactttg

SEQ ID NO: 32234 - DNA, 20 bp, Homo sapiens
tagttgaaaaataaaatctc

SEQ ID NO: 32235 - DNA, 22 bp, Homo sapiens
tgttcatatttcttgcatatca

SEQ ID NO: 32236 - DNA, 23 bp, Homo sapiens
cctcgggcgctacgaacccggca

SEQ ID NO: 32237 - DNA, 19 bp, Homo sapiens
aggttccacggcagccacg

SEQ ID NO: 32238 - DNA, 16 bp, Homo sapiens
cacaggctctttggca

SEQ ID NO: 32239 - DNA, 18 bp, Homo sapiens
ccacttccccttccctct

SEQ ID NO: 32240 - DNA, 19 bp, Homo sapiens
cgcgcccccgtacccgcgt

SEQ ID NO: 32241 - DNA, 19 bp, Homo sapiens
gtcgggtttaccaatcagc

SEQ ID NO: 32242 - DNA, 19 bp, Homo sapiens
cgtcgcggtggtggactct

SEQ ID NO: 32243 - DNA, 17 bp, Homo sapiens
aagaagatacagatctg

SEQ ID NO: 32244 - DNA, 20 bp, Homo sapiens
aagatacagatctgcactga

SEQ ID NO: 32245 - DNA, 20 bp, Homo sapiens
atctgtgacctatatcaagt

SEQ ID NO: 32246 - DNA, 26 bp, Homo sapiens
ctcttccattgtacatgtgggttata

SEQ ID NO: 32247 - DNA, 23 bp, Homo sapiens
tatctgtgacctatatcaagtac

SEQ ID NO: 32248 - DNA, 18 bp, Homo sapiens
tcaagtgattctgatgca

SEQ ID NO: 32249 - DNA, 24 bp, Homo sapiens
tctagaattttgtattttatttca

SEQ ID NO: 32250 - DNA, 21 bp, Homo sapiens
tggccatagaaaagtaagctt

SEQ ID NO: 32251 - DNA, 20 bp, Homo sapiens
ttgtggaataagtgttccag

SEQ ID NO: 32252 - DNA, 19 bp, Homo sapiens
aagcaattctcctgcttca

SEQ ID NO: 32253 - DNA, 18 bp, Homo sapiens
actcatctcctcctccca

SEQ ID NO: 32254 - DNA, 17 bp, Homo sapiens
ccccagagacagagcca

SEQ ID NO: 32255 - DNA, 21 bp, Homo sapiens
ccttccccatgattctctaca

SEQ ID NO: 32256 - DNA, 16 bp, Homo sapiens
cgcacaaagagtttat

SEQ ID NO: 32257 - DNA, 17 bp, Homo sapiens
ttctcctgcttcagcct

SEQ ID NO: 32258 - DNA, 25 bp, Homo sapiens
cgatcgttattcccccaattcatca

SEQ ID NO: 32259 - DNA, 19 bp, Homo sapiens
ctctctctctccctctctc

SEQ ID NO: 32260 - DNA, 24 bp, Homo sapiens
gcattgtagtctacctgcatgtga

SEQ ID NO: 32261 - DNA, 18 bp, Homo sapiens
aagccatcttcgcgatcg

SEQ ID NO: 32262 - DNA, 21 bp, Homo sapiens
agtctcctacacgcagtcaac

SEQ ID NO: 32263 - DNA, 19 bp, Homo sapiens
ataaatgtataccccttac

SEQ ID NO: 32264 - DNA, 21 bp, Homo sapiens
ggaaatgttacagtaatccac

SEQ ID NO: 32265 - DNA, 20 bp, Homo sapiens
tccctaaatgtaaccaggga

SEQ ID NO: 32266 - DNA, 23 bp, Homo sapiens
agtttgccattgttgcagagtta

SEQ ID NO: 32267 - DNA, 15 bp, Homo sapiens
agtttttctgtctca

SEQ ID NO: 32268 - DNA, 17 bp, Homo sapiens
ccagcaccttttcttta

SEQ ID NO: 32269 - DNA, 18 bp, Homo sapiens
gtttgccattgttgcaga

SEQ ID NO: 32270 - DNA, 19 bp, Homo sapiens
tggaaaaattgtgtttaca

SEQ ID NO: 32271 - DNA, 24 bp, Homo sapiens
tggtttccttttaccatgaaattg

SEQ ID NO: 32272 - DNA, 22 bp, Homo sapiens
ccccaccccagtgcccacaggc

SEQ ID NO: 32273 - DNA, 20 bp, Homo sapiens
gcctgaccctcagggagtca

SEQ ID NO: 32274 - DNA, 19 bp, Homo sapiens
tcatttcctttttgcacac

SEQ ID NO: 32275 - DNA, 21 bp, Homo sapiens
tccctattcacaaccagtgca

SEQ ID NO: 32276 - DNA, 22 bp, Homo sapiens
agcggccctccccactgccctc

SEQ ID NO: 32277 - DNA, 18 bp, Homo sapiens
gccccagggcccaccttt

SEQ ID NO: 32278 - DNA, 16 bp, Homo sapiens
aacatcacttgagcca

SEQ ID NO: 32279 - DNA, 18 bp, Homo sapiens
aaggtaagtgggcaaaga

SEQ ID NO: 32280 - DNA, 27 bp, Homo sapiens
ccacatttctgtactgttcctctttca

SEQ ID NO: 32281 - DNA, 22 bp, Homo sapiens
cttgttccagtttctgtcactg

SEQ ID NO: 32282 - DNA, 20 bp, Homo sapiens
cttttttgcccttggctctt

SEQ ID NO: 32283 - DNA, 18 bp, Homo sapiens
gataaacatcacttgagc

SEQ ID NO: 32284 - DNA, 18 bp, Homo sapiens
taaaaatgactttgggat

SEQ ID NO: 32285 - DNA, 18 bp, Homo sapiens
tatctactcttctgtgat

SEQ ID NO: 32286 - DNA, 18 bp, Homo sapiens
agccacagcacccagcca

SEQ ID NO: 32287 - DNA, 18 bp, Homo sapiens
tccacctcctgggttcaa

SEQ ID NO: 32288 - DNA, 21 bp, Homo sapiens
aaactaaagaaggcccaccac

SEQ ID NO: 32289 - DNA, 16 bp, Homo sapiens
acagtaataatgggag

SEQ ID NO: 32290 - DNA, 21 bp, Homo sapiens
agtggaaaacccacgatctga

SEQ ID NO: 32291 - DNA, 25 bp, Homo sapiens
gttctccaaaacgctctaaaacggg

SEQ ID NO: 32292 - DNA, 24 bp, Homo sapiens
acctttgcagaataaactctctcc

SEQ ID NO: 32293 - DNA, 21 bp, Homo sapiens
agctgtctcctgccccaggga

SEQ ID NO: 32294 - DNA, 19 bp, Homo sapiens
aggtgcctctccctcacca

SEQ ID NO: 32295 - DNA, 22 bp, Homo sapiens
agtgcctgtgcccactctgtgc

SEQ ID NO: 32296 - DNA, 17 bp, Homo sapiens
ccgcgcacgccgcctca

SEQ ID NO: 32297 - DNA, 22 bp, Homo sapiens
gcgaccctcagcccggcgggga

SEQ ID NO: 32298 - DNA, 23 bp, Homo sapiens
gctgtttttttgttgttgtttta

SEQ ID NO: 32299 - DNA, 21 bp, Homo sapiens
gctttgatggtctggtgccag

SEQ ID NO: 32300 - DNA, 19 bp, Homo sapiens
tcttcgggtacaaccctga

SEQ ID NO: 32301 - DNA, 17 bp, Homo sapiens
cccagcaaagaactggc

SEQ ID NO: 32302 - DNA, 21 bp, Homo sapiens
cgttgcacagaaattctgaga

SEQ ID NO: 32303 - DNA, 22 bp, Homo sapiens
ctttggtgctagaagcctgcgg

SEQ ID NO: 32304 - DNA, 19 bp, Homo sapiens
gtatgtgtgaggaatttgg

SEQ ID NO: 32305 - DNA, 17 bp, Homo sapiens
cctgctgacaggcaaca

SEQ ID NO: 32306 - DNA, 19 bp, Homo sapiens
ctgagcaccggttcctttt

SEQ ID NO: 32307 - DNA, 24 bp, Homo sapiens
gcattgtatgcctcaaatgtctca

SEQ ID NO: 32308 - DNA, 20 bp, Homo sapiens
tgctttttaaaataatgact

SEQ ID NO: 32309 - DNA, 23 bp, Homo sapiens
ttgtaaatactgtaatatattta

SEQ ID NO: 32310 - DNA, 22 bp, Homo sapiens
tttttctaactatattactgta

SEQ ID NO: 32311 - DNA, 19 bp, Homo sapiens
aggccccacacagtcttca

SEQ ID NO: 32312 - DNA, 21 bp, Homo sapiens
atctcccagcaggtagagcag

SEQ ID NO: 32313 - DNA, 23 bp, Homo sapiens
cagcttgcctgacccccatgtca

SEQ ID NO: 32314 - DNA, 21 bp, Homo sapiens
ccaggctcccaactccaccct

SEQ ID NO: 32315 - DNA, 20 bp, Homo sapiens
ccccaccaccacccccagct

SEQ ID NO: 32316 - DNA, 21 bp, Homo sapiens
ctcggctcgggaggcttggga

SEQ ID NO: 32317 - DNA, 21 bp, Homo sapiens
gcatcagacacaggtacagca

SEQ ID NO: 32318 - DNA, 20 bp, Homo sapiens
gcctctgtgatcttctccat

SEQ ID NO: 32319 - DNA, 19 bp, Homo sapiens
ggggtctaataacaaacta

SEQ ID NO: 32320 - DNA, 21 bp, Homo sapiens
ggtagagcagagccggagcca

SEQ ID NO: 32321 - DNA, 21 bp, Homo sapiens
taaaccaatggaaagaagggg

SEQ ID NO: 32322 - DNA, 19 bp, Homo sapiens
tctgggaaaggacctgggg

SEQ ID NO: 32323 - DNA, 20 bp, Homo sapiens
tgccaagtaccctgctccag

SEQ ID NO: 32324 - DNA, 21 bp, Homo sapiens
tggcctccccagcgtggggct

SEQ ID NO: 32325 - DNA, 27 bp, Homo sapiens
tggggtggcagctgattaggcccagca

SEQ ID NO: 32326 - DNA, 20 bp, Homo sapiens
ttggagagaaggtctccttg

SEQ ID NO: 32327 - DNA, 23 bp, Homo sapiens
ccatcagttcccccagtacctcc

SEQ ID NO: 32328 - DNA, 19 bp, Homo sapiens
tcaccctgtcaagttaaca

SEQ ID NO: 32329 - DNA, 18 bp, Homo sapiens
tgttgggagccctttgga

SEQ ID NO: 32330 - DNA, 19 bp, Homo sapiens
cctgggccgccggctgttt

SEQ ID NO: 32331 - DNA, 19 bp, Homo sapiens
aatgtttataccaggctca

SEQ ID NO: 32332 - DNA, 20 bp, Homo sapiens
attgggtgggtctcccacta

SEQ ID NO: 32333 - DNA, 18 bp, Homo sapiens
ccagtggtggtctggttt

SEQ ID NO: 32334 - DNA, 24 bp, Homo sapiens
cccagagtggtagcctctcagtga

SEQ ID NO: 32335 - DNA, 21 bp, Homo sapiens
cctcccagattgcatctccag

SEQ ID NO: 32336 - DNA, 18 bp, Homo sapiens
ctggccaccaggtccagt

SEQ ID NO: 32337 - DNA, 18 bp, Homo sapiens
gcctgcaaatgtccagca

SEQ ID NO: 32338 - DNA, 19 bp, Homo sapiens
tcatgacactaagatgtga

SEQ ID NO: 32339 - DNA, 22 bp, Homo sapiens
tccaacatggttcttctgttcc

SEQ ID NO: 32340 - DNA, 20 bp, Homo sapiens
tttgagaggcgctccttgca

SEQ ID NO: 32341 - DNA, 18 bp, Homo sapiens
gcttggtgacctccctca

SEQ ID NO: 32342 - DNA, 24 bp, Homo sapiens
tgaccaccaccatccaccagttca

SEQ ID NO: 32343 - DNA, 19 bp, Homo sapiens
acctgcagctgagctgcca

SEQ ID NO: 32344 - DNA, 16 bp, Homo sapiens
agtaccatggttctga

SEQ ID NO: 32345 - DNA, 21 bp, Homo sapiens
cagaattccacccatctttca

SEQ ID NO: 32346 - DNA, 25 bp, Homo sapiens
ccatcccaggtcaccacctggctga

SEQ ID NO: 32347 - DNA, 21 bp, Homo sapiens
ccatggttctgacagagactg

SEQ ID NO: 32348 - DNA, 17 bp, Homo sapiens
cctccaacttgacatca

SEQ ID NO: 32349 - DNA, 18 bp, Homo sapiens
atttgaactgtgacttgt

SEQ ID NO: 32350 - DNA, 19 bp, Homo sapiens
catgtattgcatgtaaagg

SEQ ID NO: 32351 - DNA, 18 bp, Homo sapiens
tactactacactttacca

SEQ ID NO: 32352 - DNA, 20 bp, Homo sapiens
tcttcttcacaataatagga

SEQ ID NO: 32353 - DNA, 19 bp, Homo sapiens
acagaggcacagggcaggc

SEQ ID NO: 32354 - DNA, 20 bp, Homo sapiens
aggcattttgtttctggtga

SEQ ID NO: 32355 - DNA, 19 bp, Homo sapiens
ccagggctggctggcctgc

SEQ ID NO: 32356 - DNA, 17 bp, Homo sapiens
tgaaaattaatggatgc

SEQ ID NO: 32357 - DNA, 19 bp, Homo sapiens
ttctctactaaaaatacaa

SEQ ID NO: 32358 - DNA, 24 bp, Homo sapiens
tttgccatagctcagaccacttct

SEQ ID NO: 32359 - DNA, 19 bp, Homo sapiens
cctgagcaagcatcatttt

SEQ ID NO: 32360 - DNA, 17 bp, Homo sapiens
tagcctggtggcagatg

SEQ ID NO: 32361 - DNA, 22 bp, Homo sapiens
ttccttggggctagctcacttt

SEQ ID NO: 32362 - DNA, 17 bp, Homo sapiens
aagatgtgaatttttgt

SEQ ID NO: 32363 - DNA, 20 bp, Homo sapiens
tcatacacacacaattcagt

SEQ ID NO: 32364 - DNA, 16 bp, Homo sapiens
aacagtctgttttctt

SEQ ID NO: 32365 - DNA, 19 bp, Homo sapiens
actcattaccgtattcgcc

SEQ ID NO: 32366 - DNA, 21 bp, Homo sapiens
gttttctatttacgcatgata

SEQ ID NO: 32367 - DNA, 21 bp, Homo sapiens
tctgctgaggtccttgcgtgg

SEQ ID NO: 32368 - DNA, 19 bp, Homo sapiens
tgctgttaatcgtcactgt

SEQ ID NO: 32369 - DNA, 17 bp, Homo sapiens
gctttgattcttggttc

SEQ ID NO: 32370 - DNA, 21 bp, Homo sapiens
gtgtctccagggaacccacgg

SEQ ID NO: 32371 - DNA, 16 bp, Homo sapiens
ttgtcccctgacctca

SEQ ID NO: 32372 - DNA, 24 bp, Homo sapiens
gaagtctcagttcagtgaacacaa

SEQ ID NO: 32373 - DNA, 24 bp, Homo sapiens
gtatatatgtgtatgctcagatta

SEQ ID NO: 32374 - DNA, 23 bp, Homo sapiens
gcctgaaccccaacccaacccta

SEQ ID NO: 32375 - DNA, 18 bp, Homo sapiens
tggccttcctggaccgca

SEQ ID NO: 32376 - DNA, 23 bp, Homo sapiens
gcagatgcttttcttataatcta

SEQ ID NO: 32377 - DNA, 19 bp, Homo sapiens
gcagttttacagtattcct

SEQ ID NO: 32378 - DNA, 23 bp, Homo sapiens
tttgtgacttaggattttgatgt

SEQ ID NO: 32379 - DNA, 20 bp, Homo sapiens
aaggaccaaccagtttgggt

SEQ ID NO: 32380 - DNA, 21 bp, Homo sapiens
gggcagtgctgccgtgccaac

SEQ ID NO: 32381 - DNA, 25 bp, Homo sapiens
gtatgtatgtatatgtatatgatta

SEQ ID NO: 32382 - DNA, 17 bp, Homo sapiens
tccagaaacaactgcgg

SEQ ID NO: 32383 - DNA, 18 bp, Homo sapiens
ttgctgcagagctctgca

SEQ ID NO: 32384 - DNA, 21 bp, Homo sapiens
agggtttttaaagaataacct

SEQ ID NO: 32385 - DNA, 20 bp, Homo sapiens
agtctcactctgttgcccag

SEQ ID NO: 32386 - DNA, 22 bp, Homo sapiens
ccaaaatagcagctggtagtaa

SEQ ID NO: 32387 - DNA, 17 bp, Homo sapiens
ccagtcatcttatttct

SEQ ID NO: 32388 - DNA, 16 bp, Homo sapiens
ggtcaattacatttca

SEQ ID NO: 32389 - DNA, 24 bp, Homo sapiens
taaattatgtatcattttagcata

SEQ ID NO: 32390 - DNA, 18 bp, Homo sapiens
tccgcctcccgggttcaa

SEQ ID NO: 32391 - DNA, 20 bp, Homo sapiens
cagttctacctaacgtccca

SEQ ID NO: 32392 - DNA, 23 bp, Homo sapiens
attagggtaaagtatccatcacc

SEQ ID NO: 32393 - DNA, 18 bp, Homo sapiens
caccattctcctgcctca

SEQ ID NO: 32394 - DNA, 18 bp, Homo sapiens
cctgcaacctccacctcc

SEQ ID NO: 32395 - DNA, 19 bp, Homo sapiens
ctgcaacctccacctccca

SEQ ID NO: 32396 - DNA, 19 bp, Homo sapiens
ctgcaacctccgcctccca

SEQ ID NO: 32397 - DNA, 18 bp, Homo sapiens
gccagtggctttaaactg

SEQ ID NO: 32398 - DNA, 21 bp, Homo sapiens
ggttatgttatctacagatta

SEQ ID NO: 32399 - DNA, 21 bp, Homo sapiens
tatgcccaatttctgcttcca

SEQ ID NO: 32400 - DNA, 17 bp, Homo sapiens
tcaagtgattcttctgc

SEQ ID NO: 32401 - DNA, 21 bp, Homo sapiens
tcagaggcacaagattctctc

SEQ ID NO: 32402 - DNA, 18 bp, Homo sapiens
tccgcctcccaggttcaa

SEQ ID NO: 32403 - DNA, 18 bp, Homo sapiens
tgaattgttcccatagct

SEQ ID NO: 32404 - DNA, 23 bp, Homo sapiens
agccctacctgtcttcccacctg

SEQ ID NO: 32405 - DNA, 17 bp, Homo sapiens
tcatatttattcctgca

SEQ ID NO: 32406 - DNA, 19 bp, Homo sapiens
tcttctgtaatgggtaatg

SEQ ID NO: 32407 - DNA, 21 bp, Homo sapiens
tcttttaattgtcttaatttt

SEQ ID NO: 32408 - DNA, 17 bp, Homo sapiens
aggaccacatctggtca

SEQ ID NO: 32409 - DNA, 19 bp, Homo sapiens
attaagaaaacagggaatg

SEQ ID NO: 32410 - DNA, 22 bp, Homo sapiens
ctcaccacaactcccaaagcat

SEQ ID NO: 32411 - DNA, 23 bp, Homo sapiens
ctcgccggtgaaagctcagccta

SEQ ID NO: 32412 - DNA, 15 bp, Homo sapiens
tcccttttcttacca

SEQ ID NO: 32413 - DNA, 19 bp, Homo sapiens
tttcaaaataaaattccat

SEQ ID NO: 32414 - DNA, 24 bp, Homo sapiens
acccatcccagaaacacaatctca

SEQ ID NO: 32415 - DNA, 19 bp, Homo sapiens
agcaggacacctcacctga

SEQ ID NO: 32416 - DNA, 19 bp, Homo sapiens
ccactgagttggggaaaga

SEQ ID NO: 32417 - DNA, 18 bp, Homo sapiens
ccccaccccctaggatcc

SEQ ID NO: 32418 - DNA, 18 bp, Homo sapiens
ggcacctcactggcactg

SEQ ID NO: 32419 - DNA, 19 bp, Homo sapiens
ggtggatggaagggagcat

SEQ ID NO: 32420 - DNA, 16 bp, Homo sapiens
gtctagaagaggcagc

SEQ ID NO: 32421 - DNA, 21 bp, Homo sapiens
agtggttctcctactttctca

SEQ ID NO: 32422 - DNA, 18 bp, Homo sapiens
gccttggtggaggattgg

SEQ ID NO: 32423 - DNA, 25 bp, Homo sapiens
tgaagaactcctgattgtgaaactg

SEQ ID NO: 32424 - DNA, 22 bp, Homo sapiens
agcactgatgtaggagatacac

SEQ ID NO: 32425 - DNA, 19 bp, Homo sapiens
attaatttaacatgcattt

SEQ ID NO: 32426 - DNA, 18 bp, Homo sapiens
ccctggagaaggacttgc

SEQ ID NO: 32427 - DNA, 20 bp, Homo sapiens
ctgaaagagccctctccttg

SEQ ID NO: 32428 - DNA, 23 bp, Homo sapiens
gctgtatagttatttttgtttta

SEQ ID NO: 32429 - DNA, 19 bp, Homo sapiens
aagtgtgttggaaatccac

SEQ ID NO: 32430 - DNA, 18 bp, Homo sapiens
cctgaacttcctctggca

SEQ ID NO: 32431 - DNA, 21 bp, Homo sapiens
tttcagaattgactcatttcc

SEQ ID NO: 32432 - DNA, 23 bp, Homo sapiens
acctctcatcagcccaggtccca

SEQ ID NO: 32433 - DNA, 20 bp, Homo sapiens
cattcttcacggatgccgta

SEQ ID NO: 32434 - DNA, 21 bp, Homo sapiens
ggccgggtgcagtggctccta

SEQ ID NO: 32435 - DNA, 16 bp, Homo sapiens
tccaaaaacagtgatt

SEQ ID NO: 32436 - DNA, 18 bp, Homo sapiens
tctgtgctcacccattgt

SEQ ID NO: 32437 - DNA, 26 bp, Homo sapiens
cctctttgtgactattccttagcctt

SEQ ID NO: 32438 - DNA, 21 bp, Homo sapiens
aaaagacccctaaaaagccta

SEQ ID NO: 32439 - DNA, 18 bp, Homo sapiens
cctggaggtgcttggcct

SEQ ID NO: 32440 - DNA, 16 bp, Homo sapiens
cgcgctggcgctgctg

SEQ ID NO: 32441 - DNA, 20 bp, Homo sapiens
cgcggagcttcgcgctgctg

SEQ ID NO: 32442 - DNA, 19 bp, Homo sapiens
ctaccttgagccaagccaa

SEQ ID NO: 32443 - DNA, 21 bp, Homo sapiens
gacaccttgtacttttcctca

SEQ ID NO: 32444 - DNA, 22 bp, Homo sapiens
gagccaagatcgcaccactgca

SEQ ID NO: 32445 - DNA, 23 bp, Homo sapiens
gcccctgctgttctcagcagcca

SEQ ID NO: 32446 - DNA, 19 bp, Homo sapiens
ggccgggtgcggtggctca

SEQ ID NO: 32447 - DNA, 24 bp, Homo sapiens
tgagtagacaggatattgcattaa

SEQ ID NO: 32448 - DNA, 24 bp, Homo sapiens
tttatgccatgactgaccttaata

SEQ ID NO: 32449 - DNA, 22 bp, Homo sapiens
agctcctgtttcttttcatctc

SEQ ID NO: 32450 - DNA, 19 bp, Homo sapiens
gttttcatgctgctgataa

SEQ ID NO: 32451 - DNA, 19 bp, Homo sapiens
tccttaactcagtgtgcta

SEQ ID NO: 32452 - DNA, 20 bp, Homo sapiens
aacagtgaccacagttgcca

SEQ ID NO: 32453 - DNA, 22 bp, Homo sapiens
acttgccggcggttgcttgctc

SEQ ID NO: 32454 - DNA, 17 bp, Homo sapiens
ccagcttttcaatgtga

SEQ ID NO: 32455 - DNA, 16 bp, Homo sapiens
cccggccacccgcagc

SEQ ID NO: 32456 - DNA, 19 bp, Homo sapiens
ccgtcgagtctctcagtga

SEQ ID NO: 32457 - DNA, 21 bp, Homo sapiens
ctacctatcaaagctgaacca

SEQ ID NO: 32458 - DNA, 23 bp, Homo sapiens
tctggctcagggtctcaggttgc

SEQ ID NO: 32459 - DNA, 21 bp, Homo sapiens
tgaatggactttgcaccagtg

SEQ ID NO: 32460 - DNA, 20 bp, Homo sapiens
ttctgctgactaatgcactc

SEQ ID NO: 32461 - DNA, 21 bp, Homo sapiens
ttttatatgcctattattcac

SEQ ID NO: 32462 - DNA, 25 bp, Homo sapiens
atttgactgtgtggctctttggccc

SEQ ID NO: 32463 - DNA, 18 bp, Homo sapiens
cccgcgccgctctgccag

SEQ ID NO: 32464 - DNA, 19 bp, Homo sapiens
gcctctggccgcctggctc

SEQ ID NO: 32465 - DNA, 23 bp, Homo sapiens
ggggatggctacacgcggctgtg

SEQ ID NO: 32466 - DNA, 15 bp, Homo sapiens
tccagacctaccact

SEQ ID NO: 32467 - DNA, 21 bp, Homo sapiens
tactagttctacttgctctga

SEQ ID NO: 32468 - DNA, 22 bp, Homo sapiens
ttttgattgttttcttaacttt

SEQ ID NO: 32469 - DNA, 20 bp, Homo sapiens
agcttcacattattttactt

SEQ ID NO: 32470 - DNA, 21 bp, Homo sapiens
gaactaatgtctcatatgatg

SEQ ID NO: 32471 - DNA, 17 bp, Homo sapiens
gttgtgacaaatgtgta

SEQ ID NO: 32472 - DNA, 22 bp, Homo sapiens
tatcaggttcacctgcttgata

SEQ ID NO: 32473 - DNA, 17 bp, Homo sapiens
tatttgtgatctactgt

SEQ ID NO: 32474 - DNA, 20 bp, Homo sapiens
ttaaatcagtgctgttttta

SEQ ID NO: 32475 - DNA, 18 bp, Homo sapiens
ttagaatgactgttacag

SEQ ID NO: 32476 - DNA, 19 bp, Homo sapiens
ccatgccctcagcaccact

SEQ ID NO: 32477 - DNA, 19 bp, Homo sapiens
ctcttcccaacttcctcca

SEQ ID NO: 32478 - DNA, 21 bp, Homo sapiens
gctgggagcccttttgtttta

SEQ ID NO: 32479 - DNA, 21 bp, Homo sapiens
atttcagtggagtgaagttca

SEQ ID NO: 32480 - DNA, 18 bp, Homo sapiens
cagcactgtctgtctgtg

SEQ ID NO: 32481 - DNA, 21 bp, Homo sapiens
gttggtgctgagaacagcctt

SEQ ID NO: 32482 - DNA, 19 bp, Homo sapiens
aagcaattctcctgcctca

SEQ ID NO: 32483 - DNA, 21 bp, Homo sapiens
atgttgctcaggctggtcaca

SEQ ID NO: 32484 - DNA, 18 bp, Homo sapiens
cgtcctcctcagcactca

SEQ ID NO: 32485 - DNA, 19 bp, Homo sapiens
gcctccagcctcaggagca

SEQ ID NO: 32486 - DNA, 18 bp, Homo sapiens
tccgcctcccgggttcaa

SEQ ID NO: 32487 - DNA, 19 bp, Homo sapiens
agcagaagactggtttaca

SEQ ID NO: 32488 - DNA, 25 bp, Homo sapiens
ggttgaagtggtggtgttctttgaa

SEQ ID NO: 32489 - DNA, 23 bp, Homo sapiens
taccactccaagtaaatcattgc

SEQ ID NO: 32490 - DNA, 20 bp, Homo sapiens
tcttttatggccatctgcca

SEQ ID NO: 32491 - DNA, 22 bp, Homo sapiens
tttcgtggaaactccatgttta

SEQ ID NO: 32492 - DNA, 20 bp, Homo sapiens
gcagccaccgctgtccgcca

SEQ ID NO: 32493 - DNA, 19 bp, Homo sapiens
ggtgcgagaccaagtgtag

SEQ ID NO: 32494 - DNA, 17 bp, Homo sapiens
aactaaggatctgtggg

SEQ ID NO: 32495 - DNA, 21 bp, Homo sapiens
acatgctttgtttattcctgc

SEQ ID NO: 32496 - DNA, 22 bp, Homo sapiens
acttggaagcactgcctgggct

SEQ ID NO: 32497 - DNA, 21 bp, Homo sapiens
agcattgctcctgtgctgcca

SEQ ID NO: 32498 - DNA, 22 bp, Homo sapiens
agttttctttctccagatgcta

SEQ ID NO: 32499 - DNA, 24 bp, Homo sapiens
atttggatattccttccctggtcc

SEQ ID NO: 32500 - DNA, 18 bp, Homo sapiens
catcatcatagagactga

SEQ ID NO: 32501 - DNA, 17 bp, Homo sapiens
gcggctgttcacagggc

SEQ ID NO: 32502 - DNA, 21 bp, Homo sapiens
ggagcgttggaggcattggca

SEQ ID NO: 32503 - DNA, 18 bp, Homo sapiens
tatgtcatcatcagccca

SEQ ID NO: 32504 - DNA, 23 bp, Homo sapiens
gctattgaaaaggttattttgta

SEQ ID NO: 32505 - DNA, 21 bp, Homo sapiens
tctgtattataaccattgttt

SEQ ID NO: 32506 - DNA, 22 bp, Homo sapiens
gctctgagctgggctgtcactt

SEQ ID NO: 32507 - DNA, 20 bp, Homo sapiens
gagaatacatagtctaacca

SEQ ID NO: 32508 - DNA, 19 bp, Homo sapiens
gtggtaccaagattagcaa

SEQ ID NO: 32509 - DNA, 20 bp, Homo sapiens
cagcaggagcagtggatgaa

SEQ ID NO: 32510 - DNA, 19 bp, Homo sapiens
cagcctgtcctttacttca

SEQ ID NO: 32511 - DNA, 21 bp, Homo sapiens
cccaaaggaactggatgggct

SEQ ID NO: 32512 - DNA, 23 bp, Homo sapiens
ccctggtgctctggatttttgga

SEQ ID NO: 32513 - DNA, 18 bp, Homo sapiens
cctgcaacctccacctcc

SEQ ID NO: 32514 - DNA, 20 bp, Homo sapiens
ctcaaaccgggatcatgacg

SEQ ID NO: 32515 - DNA, 20 bp, Homo sapiens
gatgccactgatgactattt

SEQ ID NO: 32516 - DNA, 20 bp, Homo sapiens
gcctgggctgcgggtggggc

SEQ ID NO: 32517 - DNA, 18 bp, Homo sapiens
tccacctcctgggttcaa

SEQ ID NO: 32518 - DNA, 16 bp, Homo sapiens
tgcaaaaattatatca

SEQ ID NO: 32519 - DNA, 20 bp, Homo sapiens
tggatgggctgcagtgaggt

SEQ ID NO: 32520 - DNA, 15 bp, Homo sapiens
ttctgcagttgatcc

SEQ ID NO: 32521 - DNA, 20 bp, Homo sapiens
cacctctgcagtcctcttca

SEQ ID NO: 32522 - DNA, 21 bp, Homo sapiens
ccacccctcaccaacacctct

SEQ ID NO: 32523 - DNA, 17 bp, Homo sapiens
aagaccctgggtccagt

SEQ ID NO: 32524 - DNA, 22 bp, Homo sapiens
atcaatatgtttgtgcagtgat

SEQ ID NO: 32525 - DNA, 20 bp, Homo sapiens
ccagaagcccttcttgccca

SEQ ID NO: 32526 - DNA, 16 bp, Homo sapiens
ccctcaccaactttcc

SEQ ID NO: 32527 - DNA, 22 bp, Homo sapiens
cgccccatcagcacttaagcca

SEQ ID NO: 32528 - DNA, 18 bp, Homo sapiens
ctaaagagccctctgggc

SEQ ID NO: 32529 - DNA, 19 bp, Homo sapiens
ctgggtctggtccttacca

SEQ ID NO: 32530 - DNA, 17 bp, Homo sapiens
gtctggtccttaccaac

SEQ ID NO: 32531 - DNA, 26 bp, Homo sapiens
gtgcctgcagctcacctgtgggtttt

SEQ ID NO: 32532 - DNA, 25 bp, Homo sapiens
taccaggaccccctccccctacctc

SEQ ID NO: 32533 - DNA, 18 bp, Homo sapiens
tctcaggttccagcaagt

SEQ ID NO: 32534 - DNA, 18 bp, Homo sapiens
tttaactttctaccagga

SEQ ID NO: 32535 - DNA, 21 bp, Homo sapiens
tttgaactggaaggtctgggg

SEQ ID NO: 32536 - DNA, 21 bp, Homo sapiens
ttttcctgagatcacacacag

SEQ ID NO: 32537 - DNA, 23 bp, Homo sapiens
agtctggcctcatgaagatgcca

SEQ ID NO: 32538 - DNA, 18 bp, Homo sapiens
acactttaaaggacagca

SEQ ID NO: 32539 - DNA, 22 bp, Homo sapiens
acgaaaggtgatatatctttaa

SEQ ID NO: 32540 - DNA, 22 bp, Homo sapiens
gtgaatgccatgagagttctga

SEQ ID NO: 32541 - DNA, 18 bp, Homo sapiens
tgagtaaaattcttaagc

SEQ ID NO: 32542 - DNA, 20 bp, Homo sapiens
tggctttcagcgtagaattg

SEQ ID NO: 32543 - DNA, 19 bp, Homo sapiens
tgtgtggggtgcagttttt

SEQ ID NO: 32544 - DNA, 17 bp, Homo sapiens
tttttagatttgctttt

SEQ ID NO: 32545 - DNA, 19 bp, Homo sapiens
attaatcaacatgccttgt

SEQ ID NO: 32546 - DNA, 20 bp, Homo sapiens
ccttttcatatacttaatct

SEQ ID NO: 32547 - DNA, 23 bp, Homo sapiens
gaataagagttcctgtagctcct

SEQ ID NO: 32548 - DNA, 21 bp, Homo sapiens
gattacaggcatcagccacca

SEQ ID NO: 32549 - DNA, 24 bp, Homo sapiens
ttgacaatgaataagagttcctgt

SEQ ID NO: 32550 - DNA, 20 bp, Homo sapiens
gctggaaactttacctggta

SEQ ID NO: 32551 - DNA, 22 bp, Homo sapiens
actcagctggcccactccacag

SEQ ID NO: 32552 - DNA, 22 bp, Homo sapiens
ccgccctgtcaccttcacctcc

SEQ ID NO: 32553 - DNA, 20 bp, Homo sapiens
ctgccccctcagcacacaca

SEQ ID NO: 32554 - DNA, 21 bp, Homo sapiens
gcaccagcagctcttgccacc

SEQ ID NO: 32555 - DNA, 21 bp, Homo sapiens
tgggggcggtgagggctccac

SEQ ID NO: 32556 - DNA, 27 bp, Homo sapiens
aagtatggtcaaaggaaaaaaatccca

SEQ ID NO: 32557 - DNA, 20 bp, Homo sapiens
acattttagataactgtgaa

SEQ ID NO: 32558 - DNA, 19 bp, Homo sapiens
agatctgaaaagaaacctt

SEQ ID NO: 32559 - DNA, 20 bp, Homo sapiens
ccctatgaggaaatctggag

SEQ ID NO: 32560 - DNA, 20 bp, Homo sapiens
cctcctcatgcagtgttgta

SEQ ID NO: 32561 - DNA, 16 bp, Homo sapiens
cctgacatccagcaaa

SEQ ID NO: 32562 - DNA, 19 bp, Homo sapiens
ggactaaaatttcccactg

SEQ ID NO: 32563 - DNA, 19 bp, Homo sapiens
gtatgtgttcatattcgat

SEQ ID NO: 32564 - DNA, 18 bp, Homo sapiens
tcagaactcatgccaaca

SEQ ID NO: 32565 - DNA, 22 bp, Homo sapiens
ttagccacttcatttctattta

SEQ ID NO: 32566 - DNA, 24 bp, Homo sapiens
tttgggggtcattttgtcatcaga

SEQ ID NO: 32567 - DNA, 17 bp, Homo sapiens
tttgtgtgtttttttaa

SEQ ID NO: 32568 - DNA, 19 bp, Homo sapiens
caagacactctatgtatta

SEQ ID NO: 32569 - DNA, 19 bp, Homo sapiens
ctgaagctttttctggcct

SEQ ID NO: 32570 - DNA, 20 bp, Homo sapiens
cttctcctccagaacaagtg

SEQ ID NO: 32571 - DNA, 18 bp, Homo sapiens
tgtcttaaccctgttcca

SEQ ID NO: 32572 - DNA, 19 bp, Homo sapiens
ttgtaaatttgtatatatg

SEQ ID NO: 32573 - DNA, 17 bp, Homo sapiens
aaaaacaaacaaacaaa

SEQ ID NO: 32574 - DNA, 20 bp, Homo sapiens
cctgtccttcagaacacttc

SEQ ID NO: 32575 - DNA, 18 bp, Homo sapiens
cttcacgactgaatgcac

SEQ ID NO: 32576 - DNA, 21 bp, Homo sapiens
gtgggagccaggaagcctcag

SEQ ID NO: 32577 - DNA, 19 bp, Homo sapiens
aagacatatcaaacatgca

SEQ ID NO: 32578 - DNA, 21 bp, Homo sapiens
aagttaaaaaaagacatatca

SEQ ID NO: 32579 - DNA, 19 bp, Homo sapiens
accaccaccactaccacga

SEQ ID NO: 32580 - DNA, 17 bp, Homo sapiens
actgcctgggaatttga

SEQ ID NO: 32581 - DNA, 19 bp, Homo sapiens
atcttgacccaagagttct

SEQ ID NO: 32582 - DNA, 21 bp, Homo sapiens
caaataacactaaccccatga

SEQ ID NO: 32583 - DNA, 24 bp, Homo sapiens
caactataacaataaaactgtaaa

SEQ ID NO: 32584 - DNA, 19 bp, Homo sapiens
caccaccaccaccaccact

SEQ ID NO: 32585 - DNA, 15 bp, Homo sapiens
cactaccacgagcaa

SEQ ID NO: 32586 - DNA, 22 bp, Homo sapiens
ccagctgcctggcctgtacttg

SEQ ID NO: 32587 - DNA, 25 bp, Homo sapiens
cgcccccgcaccaggccggtactca

SEQ ID NO: 32588 - DNA, 19 bp, Homo sapiens
cgggaacccaacaggcact

SEQ ID NO: 32589 - DNA, 17 bp, Homo sapiens
gcattccaacagtgaca

SEQ ID NO: 32590 - DNA, 19 bp, Homo sapiens
ggaacagaaacaagcactt

SEQ ID NO: 32591 - DNA, 19 bp, Homo sapiens
tagaccaagggcacatcca

SEQ ID NO: 32592 - DNA, 20 bp, Homo sapiens
tgctgttagtactgctgctg

SEQ ID NO: 32593 - DNA, 20 bp, Homo sapiens
aacacagaagacttctgtga

SEQ ID NO: 32594 - DNA, 22 bp, Homo sapiens
gaaaaattgccaaaacaaagaa

SEQ ID NO: 32595 - DNA, 17 bp, Homo sapiens
tccagcgtgatggtgtt

SEQ ID NO: 32596 - DNA, 20 bp, Homo sapiens
tccagcgtgatggtgttagg

SEQ ID NO: 32597 - DNA, 17 bp, Homo sapiens
tttctccccacgtgcca

SEQ ID NO: 32598 - DNA, 15 bp, Homo sapiens
gccaccaagcttttt

SEQ ID NO: 32599 - DNA, 22 bp, Homo sapiens
tggtgcaggacagctgccagca

SEQ ID NO: 32600 - DNA, 18 bp, Homo sapiens
agaaagccctgagcattg

SEQ ID NO: 32601 - DNA, 21 bp, Homo sapiens
ccctgcacccgagcggcacct

SEQ ID NO: 32602 - DNA, 16 bp, Homo sapiens
gccaggcacagatccc

SEQ ID NO: 32603 - DNA, 22 bp, Homo sapiens
gtgtttttcatcaatcagtttt

SEQ ID NO: 32604 - DNA, 22 bp, Homo sapiens
tggaagttctccaatagtggct

SEQ ID NO: 32605 - DNA, 22 bp, Homo sapiens
tggtgttagtgaattttgcaaa

SEQ ID NO: 32606 - DNA, 19 bp, Homo sapiens
caaatactgacccattctg

SEQ ID NO: 32607 - DNA, 25 bp, Homo sapiens
cccaaatactgacccattctggact

SEQ ID NO: 32608 - DNA, 21 bp, Homo sapiens
ggacagggaattgggatacct

SEQ ID NO: 32609 - DNA, 19 bp, Homo sapiens
tgtcttagagaacttgtca

SEQ ID NO: 32610 - DNA, 24 bp, Homo sapiens
ttctggacttttgtaaacatacct

SEQ ID NO: 32611 - DNA, 18 bp, Homo sapiens
ccaccgcccctgccgcca

SEQ ID NO: 32612 - DNA, 22 bp, Homo sapiens
gtatcagagggggccttcgccg

SEQ ID NO: 32613 - DNA, 19 bp, Homo sapiens
gtgggagagttgactgtgt

SEQ ID NO: 32614 - DNA, 17 bp, Homo sapiens
cggggcgggcgcggcga

SEQ ID NO: 32615 - DNA, 20 bp, Homo sapiens
aactcgtcccctcttccaca

SEQ ID NO: 32616 - DNA, 22 bp, Homo sapiens
caaataacaaaactgcaacact

SEQ ID NO: 32617 - DNA, 30 bp, Homo sapiens
cgacccgcctcccgcccgcccgccggcctc

SEQ ID NO: 32618 - DNA, 20 bp, Homo sapiens
gcgccagcagcccgcgcccc

SEQ ID NO: 32619 - DNA, 23 bp, Homo sapiens
gggctcgcccccgcccctccctc

SEQ ID NO: 32620 - DNA, 18 bp, Homo sapiens
acatcgaatgtagcttac

SEQ ID NO: 32621 - DNA, 19 bp, Homo sapiens
agtaagggtatgcttacca

SEQ ID NO: 32622 - DNA, 18 bp, Homo sapiens
gaaatattatttacctta

SEQ ID NO: 32623 - DNA, 19 bp, Homo sapiens
tcagataccacaaacttta

SEQ ID NO: 32624 - DNA, 20 bp, Homo sapiens
tttaagagtgttaagtcatt

SEQ ID NO: 32625 - DNA, 18 bp, Homo sapiens
agagccactgcagagtca

SEQ ID NO: 32626 - DNA, 15 bp, Homo sapiens
gcactgctgtttcct

SEQ ID NO: 32627 - DNA, 18 bp, Homo sapiens
ccctgcacctgcacctca

SEQ ID NO: 32628 - DNA, 21 bp, Homo sapiens
cctcatcatccccctcctgcc

SEQ ID NO: 32629 - DNA, 22 bp, Homo sapiens
atgggtaaggaacagtctgtga

SEQ ID NO: 32630 - DNA, 17 bp, Homo sapiens
tcaagtgattctcctgc

SEQ ID NO: 32631 - DNA, 21 bp, Homo sapiens
tgggattataggtgcccatca

SEQ ID NO: 32632 - DNA, 24 bp, Homo sapiens
ttcaataccttgaagaaagattca

SEQ ID NO: 32633 - DNA, 22 bp, Homo sapiens
gcccacccagcgcacagtcagg

SEQ ID NO: 32634 - DNA, 22 bp, Homo sapiens
gcctggattcctgtgcctgctc

SEQ ID NO: 32635 - DNA, 19 bp, Homo sapiens
ggtggaggacgcgcaggag

SEQ ID NO: 32636 - DNA, 18 bp, Homo sapiens
tgcccagtcttccatctc

SEQ ID NO: 32637 - DNA, 21 bp, Homo sapiens
tttgagcaattttctcgactt

SEQ ID NO: 32638 - DNA, 19 bp, Homo sapiens
ccccccgcgcccgccccca

SEQ ID NO: 32639 - DNA, 20 bp, Homo sapiens
ctctctctcttctctgtctc

SEQ ID NO: 32640 - DNA, 19 bp, Homo sapiens
cttctctctctccgtctct

SEQ ID NO: 32641 - DNA, 22 bp, Homo sapiens
caccaatgtcctagctgtatta

SEQ ID NO: 32642 - DNA, 22 bp, Homo sapiens
ctttttcaaagcatctaatctt

SEQ ID NO: 32643 - DNA, 18 bp, Homo sapiens
cccagctccgcgagctca

SEQ ID NO: 32644 - DNA, 20 bp, Homo sapiens
gttgtgtgggctttttttga

SEQ ID NO: 32645 - DNA, 21 bp, Homo sapiens
taggttcagggatgagcaaca

SEQ ID NO: 32646 - DNA, 25 bp, Homo sapiens
tgctaaatcataggagaaaaatcta

SEQ ID NO: 32647 - DNA, 20 bp, Homo sapiens
cgtctgtgtattggaggccc

SEQ ID NO: 32648 - DNA, 21 bp, Homo sapiens
gcccgcggtttgaggtccttc

SEQ ID NO: 32649 - DNA, 24 bp, Homo sapiens
gcctaataaatgctcgttacttga

SEQ ID NO: 32650 - DNA, 26 bp, Homo sapiens
gcctgggctttatgggtctctggccc

SEQ ID NO: 32651 - DNA, 21 bp, Homo sapiens
gcggtttgaggtccttcgtta

SEQ ID NO: 32652 - DNA, 20 bp, Homo sapiens
ggggcgccccgccctggcca

SEQ ID NO: 32653 - DNA, 21 bp, Homo sapiens
tgcctcagtttccccatctct

SEQ ID NO: 32654 - DNA, 18 bp, Homo sapiens
ggccttgttggtgcccac

SEQ ID NO: 32655 - DNA, 20 bp, Homo sapiens
cagaaaccatttgagccagg

SEQ ID NO: 32656 - DNA, 23 bp, Homo sapiens
ccttccctatcacccctccccca

SEQ ID NO: 32657 - DNA, 17 bp, Homo sapiens
gcaacattcataactta

SEQ ID NO: 32658 - DNA, 18 bp, Homo sapiens
tccacctcccgggttcaa

SEQ ID NO: 32659 - DNA, 20 bp, Homo sapiens
ttttttcatgaactttaatc

SEQ ID NO: 32660 - DNA, 26 bp, Homo sapiens
acagcccattaagttccctggtattt

SEQ ID NO: 32661 - DNA, 24 bp, Homo sapiens
ccccacccaacccctatgttagtt

SEQ ID NO: 32662 - DNA, 22 bp, Homo sapiens
tactccctggagccttctcccg

SEQ ID NO: 32663 - DNA, 19 bp, Homo sapiens
accgtcccctacccaggga

SEQ ID NO: 32664 - DNA, 24 bp, Homo sapiens
agaaattactgatgaagcagcatg

SEQ ID NO: 32665 - DNA, 21 bp, Homo sapiens
cccaagccagggccccggtga

SEQ ID NO: 32666 - DNA, 22 bp, Homo sapiens
gcgcttggagctgctgagcttt

SEQ ID NO: 32667 - DNA, 24 bp, Homo sapiens
tctgaccacacttcatcctccccc

SEQ ID NO: 32668 - DNA, 18 bp, Homo sapiens
acagcaaaggatttgcaa

SEQ ID NO: 32669 - DNA, 18 bp, Homo sapiens
caggaaaaatctgttcca

SEQ ID NO: 32670 - DNA, 20 bp, Homo sapiens
tcagcacattgcaccagtta

SEQ ID NO: 32671 - DNA, 17 bp, Homo sapiens
accgacgccattagcta

SEQ ID NO: 32672 - DNA, 19 bp, Homo sapiens
catgccacaaagcatatca

SEQ ID NO: 32673 - DNA, 22 bp, Homo sapiens
cctgaggcagtccgatggggct

SEQ ID NO: 32674 - DNA, 19 bp, Homo sapiens
gccccctgtgcccaccctc

SEQ ID NO: 32675 - DNA, 23 bp, Homo sapiens
tagggttgatgaaggctcggccg

SEQ ID NO: 32676 - DNA, 24 bp, Homo sapiens
tcctgttctgttagtaccaaagtt

SEQ ID NO: 32677 - DNA, 17 bp, Homo sapiens
actgaacatattagcta

SEQ ID NO: 32678 - DNA, 17 bp, Homo sapiens
tcctggcagctctgtgg

SEQ ID NO: 32679 - DNA, 18 bp, Homo sapiens
atgtgacagaatgttcca

SEQ ID NO: 32680 - DNA, 24 bp, Homo sapiens
cttaggcagctcaagcttgctttt

SEQ ID NO: 32681 - DNA, 21 bp, Homo sapiens
tggtaggtgctgtttggaata

SEQ ID NO: 32682 - DNA, 19 bp, Homo sapiens
tgtaacgtggaaatcttat

SEQ ID NO: 32683 - DNA, 18 bp, Homo sapiens
tgtgtgtgagcgggactt

SEQ ID NO: 32684 - DNA, 21 bp, Homo sapiens
aaccactaacacctctgcaca

SEQ ID NO: 32685 - DNA, 22 bp, Homo sapiens
atctggaccatcgacctggcct

SEQ ID NO: 32686 - DNA, 17 bp, Homo sapiens
catccagcagctctacc

SEQ ID NO: 32687 - DNA, 21 bp, Homo sapiens
ccgtgtgttgtcatgtcactc

SEQ ID NO: 32688 - DNA, 17 bp, Homo sapiens
ggcagttagccagctca

SEQ ID NO: 32689 - DNA, 18 bp, Homo sapiens
tccgcctcctgggttcaa

SEQ ID NO: 32690 - DNA, 18 bp, Homo sapiens
aagtatccagtcacctca

SEQ ID NO: 32691 - DNA, 19 bp, Homo sapiens
cagagtagcctagatgaca

SEQ ID NO: 32692 - DNA, 21 bp, Homo sapiens
ccaccacccctttgcacatca

SEQ ID NO: 32693 - DNA, 19 bp, Homo sapiens
gattgacctggagattttt

SEQ ID NO: 32694 - DNA, 17 bp, Homo sapiens
tgggtgggctcaggaag

SEQ ID NO: 32695 - DNA, 20 bp, Homo sapiens
aatccaaagaaatttgcagg

SEQ ID NO: 32696 - DNA, 20 bp, Homo sapiens
gctgattcaactgttttgtt

SEQ ID NO: 32697 - DNA, 19 bp, Homo sapiens
ggtattgttgtagtttatg

SEQ ID NO: 32698 - DNA, 21 bp, Homo sapiens
gttctgtgattctttaagcaa

SEQ ID NO: 32699 - DNA, 25 bp, Homo sapiens
tctcaaatgagcttaaactgcaagt

SEQ ID NO: 32700 - DNA, 16 bp, Homo sapiens
ttccagcaaaattcca

SEQ ID NO: 32701 - DNA, 22 bp, Homo sapiens
acttgatgggtacgtttggtcc

SEQ ID NO: 32702 - DNA, 21 bp, Homo sapiens
agtggccacaaaactgtgtta

SEQ ID NO: 32703 - DNA, 18 bp, Homo sapiens
ctgcctgggagccccccc

SEQ ID NO: 32704 - DNA, 23 bp, Homo sapiens
tcttggtgcccctgggcttcgga

SEQ ID NO: 32705 - DNA, 23 bp, Homo sapiens
ttctgatggcctagctgtgtgga

SEQ ID NO: 32706 - DNA, 20 bp, Homo sapiens
cctctgcctcccaggtttaa

SEQ ID NO: 32707 - DNA, 21 bp, Homo sapiens
cgtcttctcgccctggacaaa

SEQ ID NO: 32708 - DNA, 20 bp, Homo sapiens
ctgttttgaggacgataccc

SEQ ID NO: 32709 - DNA, 16 bp, Homo sapiens
gcattgtcccatttta

SEQ ID NO: 32710 - DNA, 20 bp, Homo sapiens
gccagagtgcttgtgactca

SEQ ID NO: 32711 - DNA, 23 bp, Homo sapiens
aacagatttcctcccaaacctta

SEQ ID NO: 32712 - DNA, 20 bp, Homo sapiens
acccattgctgatggcacac

SEQ ID NO: 32713 - DNA, 21 bp, Homo sapiens
acttctgtgcccgcttggtcc

SEQ ID NO: 32714 - DNA, 18 bp, Homo sapiens
agacagaaatgttacttc

SEQ ID NO: 32715 - DNA, 19 bp, Homo sapiens
cagcccatccgcgtgctgt

SEQ ID NO: 32716 - DNA, 17 bp, Homo sapiens
cccccacatcatgcttc

SEQ ID NO: 32717 - DNA, 20 bp, Homo sapiens
cctgaactgccatctgcaga

SEQ ID NO: 32718 - DNA, 20 bp, Homo sapiens
ccttccccccttccctttcc

SEQ ID NO: 32719 - DNA, 18 bp, Homo sapiens
ctgaccacatgccagtga

SEQ ID NO: 32720 - DNA, 21 bp, Homo sapiens
tctgaagaaacctgtccccac

SEQ ID NO: 32721 - DNA, 19 bp, Homo sapiens
tgagcatggcatgaggctg

SEQ ID NO: 32722 - DNA, 16 bp, Homo sapiens
tgaggaaagatagcaa

SEQ ID NO: 32723 - DNA, 19 bp, Homo sapiens
tggtcccaacctgaagctg

SEQ ID NO: 32724 - DNA, 22 bp, Homo sapiens
ttgtttcttcctctatgacatg

SEQ ID NO: 32725 - DNA, 23 bp, Homo sapiens
acctggtcaaggccaggatccca

SEQ ID NO: 32726 - DNA, 18 bp, Homo sapiens
cagggctaggcccagcca

SEQ ID NO: 32727 - DNA, 28 bp, Homo sapiens
cccccaacctgcagggaagatgaccata

SEQ ID NO: 32728 - DNA, 20 bp, Homo sapiens
cctgggtcactgttccccca

SEQ ID NO: 32729 - DNA, 20 bp, Homo sapiens
cctgggttcttccacacaaa

SEQ ID NO: 32730 - DNA, 17 bp, Homo sapiens
ctcatcctcctccgcct

SEQ ID NO: 32731 - DNA, 17 bp, Homo sapiens
ctcccttccctgcctct

SEQ ID NO: 32732 - DNA, 22 bp, Homo sapiens
ctctggggcacagacctgtgag

SEQ ID NO: 32733 - DNA, 24 bp, Homo sapiens
gctgcgctgctggccgcctggctt

SEQ ID NO: 32734 - DNA, 24 bp, Homo sapiens
gggacgcaactgctgcacctgctc

SEQ ID NO: 32735 - DNA, 19 bp, Homo sapiens
ggttctggctctgacacag

SEQ ID NO: 32736 - DNA, 22 bp, Homo sapiens
gtccagctcaaaggccacctcc

SEQ ID NO: 32737 - DNA, 22 bp, Homo sapiens
tggaactaaggaggctacagca

SEQ ID NO: 32738 - DNA, 20 bp, Homo sapiens
tgtttcagcgcctgctccag

SEQ ID NO: 32739 - DNA, 20 bp, Homo sapiens
cagaggccatctctactact

SEQ ID NO: 32740 - DNA, 18 bp, Homo sapiens
gcccaaacccacattcca

SEQ ID NO: 32741 - DNA, 29 bp, Homo sapiens
gcttaggcagcattgatttaggtcacttt

SEQ ID NO: 32742 - DNA, 26 bp, Homo sapiens
gtatatgtgtatatttgcattgatta

SEQ ID NO: 32743 - DNA, 23 bp, Homo sapiens
tagatggtacctggcatggactg

SEQ ID NO: 32744 - DNA, 20 bp, Homo sapiens
cccttctgtcactggcctca

SEQ ID NO: 32745 - DNA, 21 bp, Homo sapiens
gatgaggcttgcggctgtggc

SEQ ID NO: 32746 - DNA, 26 bp, Homo sapiens
tcctgctggcctggaagactctgtgg

SEQ ID NO: 32747 - DNA, 20 bp, Homo sapiens
aagcaaagaaagccacattg

SEQ ID NO: 32748 - DNA, 20 bp, Homo sapiens
agcctttttaagagaggcca

SEQ ID NO: 32749 - DNA, 21 bp, Homo sapiens
gtgtttcggttggtaagttct

SEQ ID NO: 32750 - DNA, 24 bp, Homo sapiens
attctcgcctgctttctcatctca

SEQ ID NO: 32751 - DNA, 18 bp, Homo sapiens
caactcatcctctgcccc

SEQ ID NO: 32752 - DNA, 18 bp, Homo sapiens
gtgagttacacgtactca

SEQ ID NO: 32753 - DNA, 21 bp, Homo sapiens
ctgggccccaacctcatccaa

SEQ ID NO: 32754 - DNA, 20 bp, Homo sapiens
agcagttggtttaccaagca

SEQ ID NO: 32755 - DNA, 18 bp, Homo sapiens
atcctcttgcctcagctg

SEQ ID NO: 32756 - DNA, 19 bp, Homo sapiens
gcaactgctatttgagttt

SEQ ID NO: 32757 - DNA, 25 bp, Homo sapiens
gtatggttttggggttatttggttg

SEQ ID NO: 32758 - DNA, 19 bp, Homo sapiens
gtggcattaacataactca

SEQ ID NO: 32759 - DNA, 20 bp, Homo sapiens
tggtatggatggcccttaga

SEQ ID NO: 32760 - DNA, 18 bp, Homo sapiens
ttaaaaatgacactctga

SEQ ID NO: 32761 - DNA, 24 bp, Homo sapiens
tttaagtggttgtgctgcttcaca

SEQ ID NO: 32762 - DNA, 20 bp, Homo sapiens
accctctcgtcaagctcatc

SEQ ID NO: 32763 - DNA, 20 bp, Homo sapiens
agtctcactctgttgcccgg

SEQ ID NO: 32764 - DNA, 19 bp, Homo sapiens
ctgcaacctccgcctccca

SEQ ID NO: 32765 - DNA, 18 bp, Homo sapiens
gccgccccctgaaggcgg

SEQ ID NO: 32766 - DNA, 16 bp, Homo sapiens
tgaaggccacttccca

SEQ ID NO: 32767 - DNA, 17 bp, Homo sapiens
tggaggtggtgtcatca

SEQ ID NO: 32768 - DNA, 23 bp, Homo sapiens
tggctttcccactctgtgcctca

SEQ ID NO: 32769 - DNA, 17 bp, Homo sapiens
agcaaattatgtttaca

SEQ ID NO: 32770 - DNA, 22 bp, Homo sapiens
agcaccttctttcctgtctctt

SEQ ID NO: 32771 - DNA, 20 bp, Homo sapiens
atctgggtttggtttggttt

SEQ ID NO: 32772 - DNA, 19 bp, Homo sapiens
ctctgatgagaacacttgc

SEQ ID NO: 32773 - DNA, 19 bp, Homo sapiens
gctgtagtccagtgcgtgt

SEQ ID NO: 32774 - DNA, 20 bp, Homo sapiens
ggctctccttcccccgggga

SEQ ID NO: 32775 - DNA, 20 bp, Homo sapiens
gggctttagagcttttgtta

SEQ ID NO: 32776 - DNA, 17 bp, Homo sapiens
tcttctgtgccccagtg

SEQ ID NO: 32777 - DNA, 23 bp, Homo sapiens
tgtccagctcctagaattcctca

SEQ ID NO: 32778 - DNA, 20 bp, Homo sapiens
aaaaccatccttaaccccat

SEQ ID NO: 32779 - DNA, 18 bp, Homo sapiens
cactgcccctccccccct

SEQ ID NO: 32780 - DNA, 18 bp, Homo sapiens
ccctcccccccttcctct

SEQ ID NO: 32781 - DNA, 22 bp, Homo sapiens
cctcccccccttcctcttgcca

SEQ ID NO: 32782 - DNA, 20 bp, Homo sapiens
gcccacccccacaccctcca

SEQ ID NO: 32783 - DNA, 21 bp, Homo sapiens
tcccggtgtccgtctcttcca

SEQ ID NO: 32784 - DNA, 21 bp, Homo sapiens
tgacattttctccccttcctc

SEQ ID NO: 32785 - DNA, 16 bp, Homo sapiens
gcctgtggtaagcaac

SEQ ID NO: 32786 - DNA, 21 bp, Homo sapiens
ctggcgatgaggaagatcttg

SEQ ID NO: 32787 - DNA, 21 bp, Homo sapiens
gactacctactcagcattcca

SEQ ID NO: 32788 - DNA, 15 bp, Homo sapiens
ggcgacggcggcggc

SEQ ID NO: 32789 - DNA, 21 bp, Homo sapiens
atctttggtatggttgcctta

SEQ ID NO: 32790 - DNA, 24 bp, Homo sapiens
caagctagatatctttatttgata

SEQ ID NO: 32791 - DNA, 22 bp, Homo sapiens
cactaagagggatgcgcaaagc

SEQ ID NO: 32792 - DNA, 17 bp, Homo sapiens
ccaaagttttacagaca

SEQ ID NO: 32793 - DNA, 19 bp, Homo sapiens
tggaagctggcatggacta

SEQ ID NO: 32794 - DNA, 23 bp, Homo sapiens
tttgtttggggtatttttggtgt

SEQ ID NO: 32795 - DNA, 18 bp, Homo sapiens
acatcagtccacaagcaa

SEQ ID NO: 32796 - DNA, 22 bp, Homo sapiens
agtttcactctgtcgcccaagc

SEQ ID NO: 32797 - DNA, 21 bp, Homo sapiens
cgaatgttaatgtctaagaca

SEQ ID NO: 32798 - DNA, 20 bp, Homo sapiens
ctcaaaaaaaaaaaaagcat

SEQ ID NO: 32799 - DNA, 23 bp, Homo sapiens
gcagttgaaaattaactgcatta

SEQ ID NO: 32800 - DNA, 21 bp, Homo sapiens
tgcagtgagctaagatcgtgc

SEQ ID NO: 32801 - DNA, 18 bp, Homo sapiens
accctaagggccccatga

SEQ ID NO: 32802 - DNA, 25 bp, Homo sapiens
accctccaaggcaggcttcccttta

SEQ ID NO: 32803 - DNA, 22 bp, Homo sapiens
aggccccagcccggctccttca

SEQ ID NO: 32804 - DNA, 17 bp, Homo sapiens
caagatagataacactc

SEQ ID NO: 32805 - DNA, 18 bp, Homo sapiens
gcccctaaaccacttcct

SEQ ID NO: 32806 - DNA, 19 bp, Homo sapiens
tccaggggcctgtctccag

SEQ ID NO: 32807 - DNA, 19 bp, Homo sapiens
tgcccagagcaccctgctc

SEQ ID NO: 32808 - DNA, 24 bp, Homo sapiens
ttctggtgatccctgagtttgcgg

SEQ ID NO: 32809 - DNA, 16 bp, Homo sapiens
ctctttatgtagtttg

SEQ ID NO: 32810 - DNA, 17 bp, Homo sapiens
tccttttgcatctggaa

SEQ ID NO: 32811 - DNA, 20 bp, Homo sapiens
tctctttatgtagtttgact

SEQ ID NO: 32812 - DNA, 17 bp, Homo sapiens
acctctttcactaccca

SEQ ID NO: 32813 - DNA, 16 bp, Homo sapiens
ccagctgccccatccc

SEQ ID NO: 32814 - DNA, 17 bp, Homo sapiens
ccccagggaactcagtt

SEQ ID NO: 32815 - DNA, 23 bp, Homo sapiens
ggacaaagagggcaaatgagatc

SEQ ID NO: 32816 - DNA, 18 bp, Homo sapiens
gttcccccagggaactca

SEQ ID NO: 32817 - DNA, 19 bp, Homo sapiens
taaatgtgccagtgtggag

SEQ ID NO: 32818 - DNA, 19 bp, Homo sapiens
tcaatacggtaccaaagat

SEQ ID NO: 32819 - DNA, 19 bp, Homo sapiens
tcaggaaccatgccccttc

SEQ ID NO: 32820 - DNA, 21 bp, Homo sapiens
accacaacgcaattccatttt

SEQ ID NO: 32821 - DNA, 23 bp, Homo sapiens
caaattttaaaatttcgacttca

SEQ ID NO: 32822 - DNA, 24 bp, Homo sapiens
cccttctatgaaggggaagcagac

SEQ ID NO: 32823 - DNA, 17 bp, Homo sapiens
cctcttcccccaacaag

SEQ ID NO: 32824 - DNA, 19 bp, Homo sapiens
ctgatgaattgcttagcct

SEQ ID NO: 32825 - DNA, 18 bp, Homo sapiens
gacataacctagcagcag

SEQ ID NO: 32826 - DNA, 22 bp, Homo sapiens
gactacaccatctctcaagcca

SEQ ID NO: 32827 - DNA, 17 bp, Homo sapiens
cctaggccgatgcaatg

SEQ ID NO: 32828 - DNA, 21 bp, Homo sapiens
gtatattctgtcactcagctg

SEQ ID NO: 32829 - DNA, 19 bp, Homo sapiens
gtcatggtctggtgccaga

SEQ ID NO: 32830 - DNA, 20 bp, Homo sapiens
tttctaacattgcagcagtt

SEQ ID NO: 32831 - DNA, 21 bp, Homo sapiens
agggacatttcctagccagct

SEQ ID NO: 32832 - DNA, 20 bp, Homo sapiens
cacagcccaccctccccgca

SEQ ID NO: 32833 - DNA, 20 bp, Homo sapiens
ctccaggtctctggactcca

SEQ ID NO: 32834 - DNA, 22 bp, Homo sapiens
gctgtcttcacaggtctgatgt

SEQ ID NO: 32835 - DNA, 18 bp, Homo sapiens
acaaaaaaagcgtttacc

SEQ ID NO: 32836 - DNA, 21 bp, Homo sapiens
atgaagtcttttaacagtctc

SEQ ID NO: 32837 - DNA, 22 bp, Homo sapiens
cagcctgcccaacatagtgaaa

SEQ ID NO: 32838 - DNA, 19 bp, Homo sapiens
cctcagtattagtctgtga

SEQ ID NO: 32839 - DNA, 18 bp, Homo sapiens
ccttctatgaaagcagtc

SEQ ID NO: 32840 - DNA, 20 bp, Homo sapiens
ctggtaaagacatttgtgat

SEQ ID NO: 32841 - DNA, 22 bp, Homo sapiens
ggcggccggcggcgaccatggc

SEQ ID NO: 32842 - DNA, 19 bp, Homo sapiens
gtgaccattatactgtgta

SEQ ID NO: 32843 - DNA, 19 bp, Homo sapiens
aatgactgatccttcctcc

SEQ ID NO: 32844 - DNA, 22 bp, Homo sapiens
agaaagaatttattctcctccc

SEQ ID NO: 32845 - DNA, 22 bp, Homo sapiens
gcagaaagaatttattctcctc

SEQ ID NO: 32846 - DNA, 19 bp, Homo sapiens
tagataagggaaaaatgtg

SEQ ID NO: 32847 - DNA, 22 bp, Homo sapiens
tcctcaaatacatggcacattc

SEQ ID NO: 32848 - DNA, 22 bp, Homo sapiens
gaaatgtgcagaaagccattga

SEQ ID NO: 32849 - DNA, 18 bp, Homo sapiens
atgccagcacacactgcc

SEQ ID NO: 32850 - DNA, 22 bp, Homo sapiens
cctcagcctccgagttgctttt

SEQ ID NO: 32851 - DNA, 21 bp, Homo sapiens
cctgcaagggggaccctgcca

SEQ ID NO: 32852 - DNA, 19 bp, Homo sapiens
gacttgtggaaatcattca

SEQ ID NO: 32853 - DNA, 19 bp, Homo sapiens
gagtgggctcgggatgctg

SEQ ID NO: 32854 - DNA, 19 bp, Homo sapiens
ctctgaggatggggcttgt

SEQ ID NO: 32855 - DNA, 18 bp, Homo sapiens
ctctgtgcaaagctgcca

SEQ ID NO: 32856 - DNA, 22 bp, Homo sapiens
acttgaggagatccagcagcaa

SEQ ID NO: 32857 - DNA, 21 bp, Homo sapiens
caccaagcagaacctctggtc

SEQ ID NO: 32858 - DNA, 18 bp, Homo sapiens
catctgcagtgtgtcagg

SEQ ID NO: 32859 - DNA, 18 bp, Homo sapiens
gcaccatctgcagtgtgt

SEQ ID NO: 32860 - DNA, 18 bp, Homo sapiens
actgcaacttccacctcc

SEQ ID NO: 32861 - DNA, 24 bp, Homo sapiens
caaacgataacattttaaggacta

SEQ ID NO: 32862 - DNA, 23 bp, Homo sapiens
catcatatgttcacagtgtttta

SEQ ID NO: 32863 - DNA, 22 bp, Homo sapiens
tctactaggttataagtagtat

SEQ ID NO: 32864 - DNA, 17 bp, Homo sapiens
tgatacttgaataatca

SEQ ID NO: 32865 - DNA, 18 bp, Homo sapiens
ttcaagtgattctcctgc

SEQ ID NO: 32866 - DNA, 25 bp, Homo sapiens
tttgtaatcatttttgtttaactga

SEQ ID NO: 32867 - DNA, 23 bp, Homo sapiens
cagaaggggaaatgattccctca

SEQ ID NO: 32868 - DNA, 21 bp, Homo sapiens
tgggtggacgtgcagagactg

SEQ ID NO: 32869 - DNA, 16 bp, Homo sapiens
ggttccgtgggcagcc

SEQ ID NO: 32870 - DNA, 23 bp, Homo sapiens
tgtggagggagtgacttgcactg

SEQ ID NO: 32871 - DNA, 20 bp, Homo sapiens
aaggtggacccctgcctcca

SEQ ID NO: 32872 - DNA, 18 bp, Homo sapiens
aagtaggacggaaagctc

SEQ ID NO: 32873 - DNA, 18 bp, Homo sapiens
agcaaactaaacaataaa

SEQ ID NO: 32874 - DNA, 22 bp, Homo sapiens
ccctgggtcaggcgcttgtgga

SEQ ID NO: 32875 - DNA, 21 bp, Homo sapiens
gactcctttgatgtcaaactg

SEQ ID NO: 32876 - DNA, 21 bp, Homo sapiens
gatcctggcctaacctggtga

SEQ ID NO: 32877 - DNA, 22 bp, Homo sapiens
ccttggggttggggagatctgc

SEQ ID NO: 32878 - DNA, 17 bp, Homo sapiens
acgttcacaccattctc

SEQ ID NO: 32879 - DNA, 18 bp, Homo sapiens
attctgatagtttagaac

SEQ ID NO: 32880 - DNA, 18 bp, Homo sapiens
caccattctcctgcctca

SEQ ID NO: 32881 - DNA, 19 bp, Homo sapiens
ccaggttctgtctcttcca

SEQ ID NO: 32882 - DNA, 23 bp, Homo sapiens
gcaatgacaattcaaccatatct

SEQ ID NO: 32883 - DNA, 17 bp, Homo sapiens
ggcttttatttccaacc

SEQ ID NO: 32884 - DNA, 17 bp, Homo sapiens
gggagacaccttgctcc

SEQ ID NO: 32885 - DNA, 22 bp, Homo sapiens
tacctcctcacctgcagatcta

SEQ ID NO: 32886 - DNA, 23 bp, Homo sapiens
tgcattcatcattaaatatccta

SEQ ID NO: 32887 - DNA, 19 bp, Homo sapiens
tgttgcaatgacaatagca

SEQ ID NO: 32888 - DNA, 19 bp, Homo sapiens
ttggatctttctagatctt

SEQ ID NO: 32889 - DNA, 22 bp, Homo sapiens
aaggtgggtttttcccattcat

SEQ ID NO: 32890 - DNA, 18 bp, Homo sapiens
acccccagcggatgcaca

SEQ ID NO: 32891 - DNA, 26 bp, Homo sapiens
ccaccccagtgcgtctcgcctgctga

SEQ ID NO: 32892 - DNA, 20 bp, Homo sapiens
cgatccccgtgcgctcctca

SEQ ID NO: 32893 - DNA, 22 bp, Homo sapiens
tctgtgtcctctttactcccca

SEQ ID NO: 32894 - DNA, 17 bp, Homo sapiens
acagcaggaagaggtga

SEQ ID NO: 32895 - DNA, 18 bp, Homo sapiens
aggattcaactcgtgata

SEQ ID NO: 32896 - DNA, 23 bp, Homo sapiens
ccatataacatgggattttcctc

SEQ ID NO: 32897 - DNA, 23 bp, Homo sapiens
tttccctcagtcctcataacttc

SEQ ID NO: 32898 - DNA, 18 bp, Homo sapiens
ttttctttgtggcagtca

SEQ ID NO: 32899 - DNA, 19 bp, Homo sapiens
aactgtaatgctcaaaata

SEQ ID NO: 32900 - DNA, 18 bp, Homo sapiens
caccaaaatgctcctatc

SEQ ID NO: 32901 - DNA, 23 bp, Homo sapiens
tttcaaaatgtaccttattccca

SEQ ID NO: 32902 - DNA, 18 bp, Homo sapiens
caaactgggggttgtggg

SEQ ID NO: 32903 - DNA, 16 bp, Homo sapiens
ctattcccactcccct

SEQ ID NO: 32904 - DNA, 17 bp, Homo sapiens
ctgctttggagctgtgt

SEQ ID NO: 32905 - DNA, 16 bp, Homo sapiens
cttctctgttttgact

SEQ ID NO: 32906 - DNA, 23 bp, Homo sapiens
gcctgtggaacattgtctggtcc

SEQ ID NO: 32907 - DNA, 20 bp, Homo sapiens
tcactttgccatgtttcctt

SEQ ID NO: 32908 - DNA, 18 bp, Homo sapiens
tgaatgctacttggatgc

SEQ ID NO: 32909 - DNA, 20 bp, Homo sapiens
ttcaaacatcatatgccgga

SEQ ID NO: 32910 - DNA, 21 bp, Homo sapiens
aaacatcaccttgtttttcca

SEQ ID NO: 32911 - DNA, 20 bp, Homo sapiens
ccctcaccacaaccgaatga

SEQ ID NO: 32912 - DNA, 22 bp, Homo sapiens
ctctgaaaatgaagatttggaa

SEQ ID NO: 32913 - DNA, 18 bp, Homo sapiens
ctgccctggcatcaccca

SEQ ID NO: 32914 - DNA, 17 bp, Homo sapiens
aagagatcgttagagtg

SEQ ID NO: 32915 - DNA, 24 bp, Homo sapiens
cctaagtggataaaatgtactttt

SEQ ID NO: 32916 - DNA, 21 bp, Homo sapiens
ctgctttgacttcagccatgg

SEQ ID NO: 32917 - DNA, 24 bp, Homo sapiens
gctctgaggcaagacttcgacttt

SEQ ID NO: 32918 - DNA, 19 bp, Homo sapiens
gtgttgtattacttgttta

SEQ ID NO: 32919 - DNA, 19 bp, Homo sapiens
taaaaacatcatgggaaaa

SEQ ID NO: 32920 - DNA, 19 bp, Homo sapiens
tacaacttaaaaggaactt

SEQ ID NO: 32921 - DNA, 18 bp, Homo sapiens
tgaggcaagacttcgact

SEQ ID NO: 32922 - DNA, 23 bp, Homo sapiens
gagacatagcggcccgggcgctg

SEQ ID NO: 32923 - DNA, 23 bp, Homo sapiens
accacacagtgctccctgccctg

SEQ ID NO: 32924 - DNA, 24 bp, Homo sapiens
atccttggctgcttccttttctta

SEQ ID NO: 32925 - DNA, 22 bp, Homo sapiens
atctccaagtgtcctggtgcca

SEQ ID NO: 32926 - DNA, 18 bp, Homo sapiens
caccacctgccttctctt

SEQ ID NO: 32927 - DNA, 18 bp, Homo sapiens
cttcggtttttttaatgc

SEQ ID NO: 32928 - DNA, 23 bp, Homo sapiens
gcaggaagttgcttggcccgaca

SEQ ID NO: 32929 - DNA, 21 bp, Homo sapiens
gctatttattttgtgcagaga

SEQ ID NO: 32930 - DNA, 19 bp, Homo sapiens
aggaggctgggggatcacc

SEQ ID NO: 32931 - DNA, 21 bp, Homo sapiens
cccctccccgcacccacctcc

SEQ ID NO: 32932 - DNA, 16 bp, Homo sapiens
cccgccccaccccagc

SEQ ID NO: 32933 - DNA, 26 bp, Homo sapiens
cctccttaccttggcaagcccttgta

SEQ ID NO: 32934 - DNA, 19 bp, Homo sapiens
cctgagctcctgtctgcct

SEQ ID NO: 32935 - DNA, 22 bp, Homo sapiens
ccttccctgcagcccctcccca

SEQ ID NO: 32936 - DNA, 20 bp, Homo sapiens
gaggaagcattccccacccc

SEQ ID NO: 32937 - DNA, 28 bp, Homo sapiens
ggtgggtgtgtctgagggggtgtgtttg

SEQ ID NO: 32938 - DNA, 22 bp, Homo sapiens
tctcggagctggatccccgtca

SEQ ID NO: 32939 - DNA, 21 bp, Homo sapiens
tctggggcctccagtccttca

SEQ ID NO: 32940 - DNA, 22 bp, Homo sapiens
tggatggtcgggattgaggctg

SEQ ID NO: 32941 - DNA, 22 bp, Homo sapiens
tgtaaagatgtgcttgtgggtg

SEQ ID NO: 32942 - DNA, 20 bp, Homo sapiens
tgtaagtggcaggtgtgtgt

SEQ ID NO: 32943 - DNA, 23 bp, Homo sapiens
ttagaacatattacaaagtagca

SEQ ID NO: 32944 - DNA, 20 bp, Homo sapiens
aacacttggaagctctgtga

SEQ ID NO: 32945 - DNA, 25 bp, Homo sapiens
aagaacagatcaagaagctgtcaca

SEQ ID NO: 32946 - DNA, 18 bp, Homo sapiens
agccttcctcttatctca

SEQ ID NO: 32947 - DNA, 21 bp, Homo sapiens
agtattgctgcccgcatgtca

SEQ ID NO: 32948 - DNA, 19 bp, Homo sapiens
atccatacctatatgtggc

SEQ ID NO: 32949 - DNA, 18 bp, Homo sapiens
caggattggacccagtta

SEQ ID NO: 32950 - DNA, 20 bp, Homo sapiens
cctggttgcagccacgtaga

SEQ ID NO: 32951 - DNA, 18 bp, Homo sapiens
gaaggcttagtgtgcaac

SEQ ID NO: 32952 - DNA, 23 bp, Homo sapiens
gcagtattttgcgtctctgggta

SEQ ID NO: 32953 - DNA, 19 bp, Homo sapiens
ggcttagtgtgcaactcat

SEQ ID NO: 32954 - DNA, 23 bp, Homo sapiens
cagaagagccaggatctgctgga

SEQ ID NO: 32955 - DNA, 23 bp, Homo sapiens
cgaggttgtggtggccctgctca

SEQ ID NO: 32956 - DNA, 21 bp, Homo sapiens
gcatccctgagggagcctttg

SEQ ID NO: 32957 - DNA, 23 bp, Homo sapiens
tctgcctttctttatgcccttgg

SEQ ID NO: 32958 - DNA, 21 bp, Homo sapiens
acctgagcggcaccctggtct

SEQ ID NO: 32959 - DNA, 21 bp, Homo sapiens
ccatgatgtccttggactcca

SEQ ID NO: 32960 - DNA, 19 bp, Homo sapiens
ctggcctcaagttatttca

SEQ ID NO: 32961 - DNA, 20 bp, Homo sapiens
tctgctgcagttaccacagc

SEQ ID NO: 32962 - DNA, 18 bp, Homo sapiens
cctatccaagaagaccca

SEQ ID NO: 32963 - DNA, 17 bp, Homo sapiens
tctgtttccattatcac

SEQ ID NO: 32964 - DNA, 21 bp, Homo sapiens
cttctcatttcccttaacctt

SEQ ID NO: 32965 - DNA, 19 bp, Homo sapiens
gcttacagattatacctca

SEQ ID NO: 32966 - DNA, 18 bp, Homo sapiens
acttcaccccatgtccca

SEQ ID NO: 32967 - DNA, 24 bp, Homo sapiens
cccagacccgttacccactaccct

SEQ ID NO: 32968 - DNA, 19 bp, Homo sapiens
cccccccccacttcacccc

SEQ ID NO: 32969 - DNA, 19 bp, Homo sapiens
gggtggggggatgggactg

SEQ ID NO: 32970 - DNA, 23 bp, Homo sapiens
tcctgttgtgctcagccccaaca

SEQ ID NO: 32971 - DNA, 19 bp, Homo sapiens
cagattaatgttgtcaagc

SEQ ID NO: 32972 - DNA, 21 bp, Homo sapiens
atttggacagatgcctgactc

SEQ ID NO: 32973 - DNA, 16 bp, Homo sapiens
cggctccctatctgtc

SEQ ID NO: 32974 - DNA, 17 bp, Homo sapiens
attgacatatggtttgc

SEQ ID NO: 32975 - DNA, 21 bp, Homo sapiens
caggcattgcccaaacatttc

SEQ ID NO: 32976 - DNA, 22 bp, Homo sapiens
cttacccttgaacgtggttcaa

SEQ ID NO: 32977 - DNA, 20 bp, Homo sapiens
gactaacagcaactccatca

SEQ ID NO: 32978 - DNA, 21 bp, Homo sapiens
gattgacatatggtttgccag

SEQ ID NO: 32979 - DNA, 21 bp, Homo sapiens
gtatgtgtgtaattatggcta

SEQ ID NO: 32980 - DNA, 18 bp, Homo sapiens
ttgcccaaacatttcttt

SEQ ID NO: 32981 - DNA, 17 bp, Homo sapiens
catcaggaaggaggatg

SEQ ID NO: 32982 - DNA, 24 bp, Homo sapiens
agggcccaaatgcataagtttctt

SEQ ID NO: 32983 - DNA, 20 bp, Homo sapiens
caaatgcataagtttctttg

SEQ ID NO: 32984 - DNA, 16 bp, Homo sapiens
tgattgcccttcatcc

SEQ ID NO: 32985 - DNA, 19 bp, Homo sapiens
ttgaatttctaagaagcct

SEQ ID NO: 32986 - DNA, 19 bp, Homo sapiens
aagcaattctcttgcctca

SEQ ID NO: 32987 - DNA, 21 bp, Homo sapiens
atcttggctcactgcaacctc

SEQ ID NO: 32988 - DNA, 18 bp, Homo sapiens
cctgcaacctccacctcc

SEQ ID NO: 32989 - DNA, 19 bp, Homo sapiens
ctgcaacctccacctccca

SEQ ID NO: 32990 - DNA, 16 bp, Homo sapiens
ggcccttgtggggtga

SEQ ID NO: 32991 - DNA, 18 bp, Homo sapiens
tccacctcccaggttcaa

SEQ ID NO: 32992 - DNA, 21 bp, Homo sapiens
tgacttgcccagggtcactca

SEQ ID NO: 32993 - DNA, 23 bp, Homo sapiens
acaacagaaaatacaactcctgg

SEQ ID NO: 32994 - DNA, 22 bp, Homo sapiens
acagggtagaattagagacaat

SEQ ID NO: 32995 - DNA, 19 bp, Homo sapiens
agtcacagaccttgcctca

SEQ ID NO: 32996 - DNA, 19 bp, Homo sapiens
ataagcactgcacatgaga

SEQ ID NO: 32997 - DNA, 20 bp, Homo sapiens
ccacatttctctttctcttt

SEQ ID NO: 32998 - DNA, 18 bp, Homo sapiens
cttccccctttcctttcc

SEQ ID NO: 32999 - DNA, 17 bp, Homo sapiens
tgataatttagcagcaa

SEQ ID NO: 33000 - DNA, 20 bp, Homo sapiens
tgtgtatctatcattagcta

SEQ ID NO: 33001 - DNA, 23 bp, Homo sapiens
tgttttttcaagtcttccaggta

SEQ ID NO: 33002 - DNA, 19 bp, Homo sapiens
agatttcgccatattgctc

SEQ ID NO: 33003 - DNA, 20 bp, Homo sapiens
gctgtgatcacagttgtatg

SEQ ID NO: 33004 - DNA, 23 bp, Homo sapiens
ccaccagcctgacctcatacact

SEQ ID NO: 33005 - DNA, 18 bp, Homo sapiens
ccattgagttttgatcag

SEQ ID NO: 33006 - DNA, 18 bp, Homo sapiens
gatgctagaatcccccct

SEQ ID NO: 33007 - DNA, 19 bp, Homo sapiens
gcaagagcacatcaacggg

SEQ ID NO: 33008 - DNA, 20 bp, Homo sapiens
gctggttcactagtgtcaga

SEQ ID NO: 33009 - DNA, 18 bp, Homo sapiens
ggattgtcaatcctttaa

SEQ ID NO: 33010 - DNA, 24 bp, Homo sapiens
tagtacaccttagcgctgagactg

SEQ ID NO: 33011 - DNA, 23 bp, Homo sapiens
tggctctcttcagcatgtaattg

SEQ ID NO: 33012 - DNA, 24 bp, Homo sapiens
cttaagtaacaaagtaatcacttt

SEQ ID NO: 33013 - DNA, 22 bp, Homo sapiens
gaagaaattatttgacattttt

SEQ ID NO: 33014 - DNA, 24 bp, Homo sapiens
gaatcatagttgcctgcatatatg

SEQ ID NO: 33015 - DNA, 24 bp, Homo sapiens
acctgggctgtggggaactggtct

SEQ ID NO: 33016 - DNA, 22 bp, Homo sapiens
cccgccgcccgtgttctcctgg

SEQ ID NO: 33017 - DNA, 21 bp, Homo sapiens
tgcatccgcagcgtggggctg

SEQ ID NO: 33018 - DNA, 19 bp, Homo sapiens
gcagaggaggaagcccttc

SEQ ID NO: 33019 - DNA, 21 bp, Homo sapiens
tcaacagcaaaattaacccgc

SEQ ID NO: 33020 - DNA, 20 bp, Homo sapiens
tgaaggagaggattcaggta

SEQ ID NO: 33021 - DNA, 21 bp, Homo sapiens
gccagtcacctccctttttta

SEQ ID NO: 33022 - DNA, 19 bp, Homo sapiens
actttttggaaaactgcca

SEQ ID NO: 33023 - DNA, 20 bp, Homo sapiens
ctctgatgggctgctagtgg

SEQ ID NO: 33024 - DNA, 21 bp, Homo sapiens
tgactaaaaggctttggttca

SEQ ID NO: 33025 - DNA, 22 bp, Homo sapiens
tgccaaactgttttccacgaca

SEQ ID NO: 33026 - DNA, 23 bp, Homo sapiens
caacctgattctgatgactgcgg

SEQ ID NO: 33027 - DNA, 17 bp, Homo sapiens
gaatgcactgcttgcca

SEQ ID NO: 33028 - DNA, 23 bp, Homo sapiens
ggcgtgagccaccacgcccggcc

SEQ ID NO: 33029 - DNA, 21 bp, Homo sapiens
actgactcccccatcagctca

SEQ ID NO: 33030 - DNA, 23 bp, Homo sapiens
ccccaccccgagaaccctcagct

SEQ ID NO: 33031 - DNA, 19 bp, Homo sapiens
cctcagctctcaaaggtca

SEQ ID NO: 33032 - DNA, 24 bp, Homo sapiens
cccagctcaaggagcttatgcagg

SEQ ID NO: 33033 - DNA, 22 bp, Homo sapiens
ccgccctcagtaagcagcttgc

SEQ ID NO: 33034 - DNA, 19 bp, Homo sapiens
gaattcaagagcctgtgga

SEQ ID NO: 33035 - DNA, 20 bp, Homo sapiens
gccagccgtctcctactcca

SEQ ID NO: 33036 - DNA, 16 bp, Homo sapiens
gccgtcctggactcca

SEQ ID NO: 33037 - DNA, 19 bp, Homo sapiens
gctgtccggcagtgccagc

SEQ ID NO: 33038 - DNA, 22 bp, Homo sapiens
ggagcctgcaaaccctgcagtg

SEQ ID NO: 33039 - DNA, 18 bp, Homo sapiens
ggccatggtcagtgtgtt

SEQ ID NO: 33040 - DNA, 21 bp, Homo sapiens
gttacagcagccctcacctca

SEQ ID NO: 33041 - DNA, 17 bp, Homo sapiens
tcccttccattcttgaa

SEQ ID NO: 33042 - DNA, 18 bp, Homo sapiens
ttctgataccaccaggtt

SEQ ID NO: 33043 - DNA, 21 bp, Homo sapiens
agaaaggatctccagcctccc

SEQ ID NO: 33044 - DNA, 18 bp, Homo sapiens
cctcaaaatttaaactga

SEQ ID NO: 33045 - DNA, 20 bp, Homo sapiens
cgcgcggcgccgcgctcggc

SEQ ID NO: 33046 - DNA, 18 bp, Homo sapiens
ggtaaaagggtagttgtg

SEQ ID NO: 33047 - DNA, 18 bp, Homo sapiens
agaataatggctacttct

SEQ ID NO: 33048 - DNA, 24 bp, Homo sapiens
cgcgcgccccgggcccggccgctg

SEQ ID NO: 33049 - DNA, 16 bp, Homo sapiens
gagcttgctttccaca

SEQ ID NO: 33050 - DNA, 16 bp, Homo sapiens
gcaccccgccgcttcc

SEQ ID NO: 33051 - DNA, 21 bp, Homo sapiens
gccccggcggcggcctggcct

SEQ ID NO: 33052 - DNA, 23 bp, Homo sapiens
ggaggaggggacttttagagcca

SEQ ID NO: 33053 - DNA, 19 bp, Homo sapiens
gggggaagaggctggcaga

SEQ ID NO: 33054 - DNA, 18 bp, Homo sapiens
acacctgcactagagaac

SEQ ID NO: 33055 - DNA, 23 bp, Homo sapiens
acggcgctctctggactacccct

SEQ ID NO: 33056 - DNA, 19 bp, Homo sapiens
agtccttccacgccctaga

SEQ ID NO: 33057 - DNA, 18 bp, Homo sapiens
attacacaagacaaagaa

SEQ ID NO: 33058 - DNA, 23 bp, Homo sapiens
ggcaggaatcccgccctgcagtg

SEQ ID NO: 33059 - DNA, 20 bp, Homo sapiens
tggaggtctggactacccct

SEQ ID NO: 33060 - DNA, 23 bp, Homo sapiens
tggatggatttgatgtaaaatta

SEQ ID NO: 33061 - DNA, 19 bp, Homo sapiens
acagccaaagaaggaattg

SEQ ID NO: 33062 - DNA, 21 bp, Homo sapiens
gatggcttcccttctggaaca

SEQ ID NO: 33063 - DNA, 16 bp, Homo sapiens
tgaagagattatggag

SEQ ID NO: 33064 - DNA, 24 bp, Homo sapiens
tccatttctaccttgtatgcctca

SEQ ID NO: 33065 - DNA, 18 bp, Homo sapiens
acctatgctcatgcacat

SEQ ID NO: 33066 - DNA, 19 bp, Homo sapiens
agacatacacatgcactca

SEQ ID NO: 33067 - DNA, 21 bp, Homo sapiens
aggattgtcaccttcacccca

SEQ ID NO: 33068 - DNA, 19 bp, Homo sapiens
atgttcccacactctctta

SEQ ID NO: 33069 - DNA, 18 bp, Homo sapiens
caaacgtatttaacacag

SEQ ID NO: 33070 - DNA, 22 bp, Homo sapiens
ctgacatacactcatggactca

SEQ ID NO: 33071 - DNA, 17 bp, Homo sapiens
gcatacacaccaacaca

SEQ ID NO: 33072 - DNA, 17 bp, Homo sapiens
gcgcgcctgtatatgtg

SEQ ID NO: 33073 - DNA, 24 bp, Homo sapiens
gtgtggcaggcacacagctttgaa

SEQ ID NO: 33074 - DNA, 16 bp, Homo sapiens
tgagcacgcacgtgta

SEQ ID NO: 33075 - DNA, 21 bp, Homo sapiens
aaaatcagacaaaagttttaa

SEQ ID NO: 33076 - DNA, 23 bp, Homo sapiens
gtagttttgagtagtattttgtt

SEQ ID NO: 33077 - DNA, 20 bp, Homo sapiens
tgagagtctgaaagtggcca

SEQ ID NO: 33078 - DNA, 20 bp, Homo sapiens
ttcccacctccatttcaata

SEQ ID NO: 33079 - DNA, 19 bp, Homo sapiens
aagcaattctcctgcctca

SEQ ID NO: 33080 - DNA, 19 bp, Homo sapiens
aagcaattctcctgcctca

SEQ ID NO: 33081 - DNA, 20 bp, Homo sapiens
agtctcactctgtcgcccag

SEQ ID NO: 33082 - DNA, 20 bp, Homo sapiens
cagagccaggagacagatcc

SEQ ID NO: 33083 - DNA, 23 bp, Homo sapiens
cattccgttttctagttcattga

SEQ ID NO: 33084 - DNA, 18 bp, Homo sapiens
ccaaatctcttctgttcc

SEQ ID NO: 33085 - DNA, 19 bp, Homo sapiens
ccaggctcgtgtctaccca

SEQ ID NO: 33086 - DNA, 19 bp, Homo sapiens
ccagttgctcaccatgaga

SEQ ID NO: 33087 - DNA, 18 bp, Homo sapiens
ctcattcccttctttcca

SEQ ID NO: 33088 - DNA, 17 bp, Homo sapiens
ctcccaaaccagagcca

SEQ ID NO: 33089 - DNA, 20 bp, Homo sapiens
gactgcagcacattactgcc

SEQ ID NO: 33090 - DNA, 20 bp, Homo sapiens
ggattcaaacccagttcctc

SEQ ID NO: 33091 - DNA, 18 bp, Homo sapiens
tccgcctcccaggttcaa

SEQ ID NO: 33092 - DNA, 20 bp, Homo sapiens
tggccaggctggtcttgaac

SEQ ID NO: 33093 - DNA, 23 bp, Homo sapiens
ttgcccccctctctctccatctc

SEQ ID NO: 33094 - DNA, 17 bp, Homo sapiens
gtgcaacctcaccgcca

SEQ ID NO: 33095 - DNA, 23 bp, Homo sapiens
acaaagcatattaaatggcaata

SEQ ID NO: 33096 - DNA, 21 bp, Homo sapiens
atcccacctcatcccactttt

SEQ ID NO: 33097 - DNA, 17 bp, Homo sapiens
ttccaaattttaagctg

SEQ ID NO: 33098 - DNA, 19 bp, Homo sapiens
gagtccttcggtggcctca

SEQ ID NO: 33099 - DNA, 16 bp, Homo sapiens
gtccccacggtgactg

SEQ ID NO: 33100 - DNA, 19 bp, Homo sapiens
caaccctcaccttccctcc

SEQ ID NO: 33101 - DNA, 20 bp, Homo sapiens
ccctcaccttccctccctta

SEQ ID NO: 33102 - DNA, 22 bp, Homo sapiens
gcgagcagcgcagggcggcctc

SEQ ID NO: 33103 - DNA, 19 bp, Homo sapiens
aaatacctaaccagtactt

SEQ ID NO: 33104 - DNA, 21 bp, Homo sapiens
aaatacctaaccagtacttct

SEQ ID NO: 33105 - DNA, 18 bp, Homo sapiens
cccagattttggtttcca

SEQ ID NO: 33106 - DNA, 21 bp, Homo sapiens
cccagattttggtttccaata

SEQ ID NO: 33107 - DNA, 21 bp, Homo sapiens
ctttagaaagcatgtaaagta

SEQ ID NO: 33108 - DNA, 20 bp, Homo sapiens
tgcccagattttggtttcca

SEQ ID NO: 33109 - DNA, 20 bp, Homo sapiens
tggtatcctacatggaatta

SEQ ID NO: 33110 - DNA, 22 bp, Homo sapiens
agagaatcatgcctccccatct

SEQ ID NO: 33111 - DNA, 23 bp, Homo sapiens
cctcaacgagtttctttggtctt

SEQ ID NO: 33112 - DNA, 21 bp, Homo sapiens
ccttatgtttgatactctctc

SEQ ID NO: 33113 - DNA, 19 bp, Homo sapiens
tcagtaccaatggctgtgc

SEQ ID NO: 33114 - DNA, 19 bp, Homo sapiens
tgatgtccagtgtgtgctg

SEQ ID NO: 33115 - DNA, 19 bp, Homo sapiens
ggccagctatctcctttca

SEQ ID NO: 33116 - DNA, 19 bp, Homo sapiens
cacccacacccccatttgg

SEQ ID NO: 33117 - DNA, 17 bp, Homo sapiens
cagggggattacttccc

SEQ ID NO: 33118 - DNA, 22 bp, Homo sapiens
ccccaacccccaccagacctca

SEQ ID NO: 33119 - DNA, 21 bp, Homo sapiens
cctgccctagaccctgccaga

SEQ ID NO: 33120 - DNA, 27 bp, Homo sapiens
agcctttgttgtcctcccatccatcca

SEQ ID NO: 33121 - DNA, 21 bp, Homo sapiens
tcttcaggagagggcctgtgg

SEQ ID NO: 33122 - DNA, 24 bp, Homo sapiens
tgagtctgcttcagtctggagctg

SEQ ID NO: 33123 - DNA, 21 bp, Homo sapiens
aaaggacaaactcactccccc

SEQ ID NO: 33124 - DNA, 18 bp, Homo sapiens
gctctgcagagcttttaa

SEQ ID NO: 33125 - DNA, 17 bp, Homo sapiens
gtacccagtatcagcaa

SEQ ID NO: 33126 - DNA, 17 bp, Homo sapiens
gtccattcctgctccca

SEQ ID NO: 33127 - DNA, 19 bp, Homo sapiens
taatttttctatgcagcta

SEQ ID NO: 33128 - DNA, 19 bp, Homo sapiens
tatagtgtcaaaagtgtct

SEQ ID NO: 33129 - DNA, 21 bp, Homo sapiens
tatgatggtagagcctcgcaa

SEQ ID NO: 33130 - DNA, 18 bp, Homo sapiens
tctgctgataccttgatg

SEQ ID NO: 33131 - DNA, 21 bp, Homo sapiens
aaatgcagtgattatgcatgt

SEQ ID NO: 33132 - DNA, 20 bp, Homo sapiens
accattgttatttccacttt

SEQ ID NO: 33133 - DNA, 19 bp, Homo sapiens
cactttctccaatacttgt

SEQ ID NO: 33134 - DNA, 22 bp, Homo sapiens
ttgatataaatgttcttaaact

SEQ ID NO: 33135 - DNA, 21 bp, Homo sapiens
gacagagatcagaatacattg

SEQ ID NO: 33136 - DNA, 21 bp, Homo sapiens
ccaaacttatatatatactcc

SEQ ID NO: 33137 - DNA, 19 bp, Homo sapiens
ccagaaatgacactcacag

SEQ ID NO: 33138 - DNA, 18 bp, Homo sapiens
ctgtggcattgcttcctt

SEQ ID NO: 33139 - DNA, 18 bp, Homo sapiens
gttttggcatacagttta

SEQ ID NO: 33140 - DNA, 19 bp, Homo sapiens
taaatgggtgagatggaac

SEQ ID NO: 33141 - DNA, 18 bp, Homo sapiens
tgggtggatcacttgaag

SEQ ID NO: 33142 - DNA, 22 bp, Homo sapiens
tcctctggccctccttccctca

SEQ ID NO: 33143 - DNA, 18 bp, Homo sapiens
tgaaattaaaaaagtgga

SEQ ID NO: 33144 - DNA, 19 bp, Homo sapiens
ttcaatttcaaattgcacc

SEQ ID NO: 33145 - DNA, 21 bp, Homo sapiens
acttgaactgtggagaggctt

SEQ ID NO: 33146 - DNA, 18 bp, Homo sapiens
agcaaaacagtatcctga

SEQ ID NO: 33147 - DNA, 18 bp, Homo sapiens
agtgtgctccagcattaa

SEQ ID NO: 33148 - DNA, 23 bp, Homo sapiens
atttttattgtggtgtttggttc

SEQ ID NO: 33149 - DNA, 22 bp, Homo sapiens
cgagaaaagagcccatttgcag

SEQ ID NO: 33150 - DNA, 20 bp, Homo sapiens
gcactggagccatgctgcta

SEQ ID NO: 33151 - DNA, 18 bp, Homo sapiens
gtagatttactgcagagc

SEQ ID NO: 33152 - DNA, 25 bp, Homo sapiens
gtttattaagagtgtactcactgta

SEQ ID NO: 33153 - DNA, 25 bp, Homo sapiens
tctgcattatgtccagattgctttt

SEQ ID NO: 33154 - DNA, 20 bp, Homo sapiens
tgaaattgagtctgacctca

SEQ ID NO: 33155 - DNA, 22 bp, Homo sapiens
tgcaaattaacatagtctctta

SEQ ID NO: 33156 - DNA, 18 bp, Homo sapiens
tgctgttagataccacta

SEQ ID NO: 33157 - DNA, 22 bp, Homo sapiens
tgctttttaaaaaataaatgct

SEQ ID NO: 33158 - DNA, 16 bp, Homo sapiens
tggagtgtttttggag

SEQ ID NO: 33159 - DNA, 26 bp, Homo sapiens
ttagtgtgtaaagaatgcattcttca

SEQ ID NO: 33160 - DNA, 18 bp, Homo sapiens
ttctttatggagtgtttt

SEQ ID NO: 33161 - DNA, 18 bp, Homo sapiens
aaacacagaccttggtga

SEQ ID NO: 33162 - DNA, 26 bp, Homo sapiens
atttgaactcggtagttgtttgacct

SEQ ID NO: 33163 - DNA, 21 bp, Homo sapiens
tgcccagtctgggatggctca

SEQ ID NO: 33164 - DNA, 26 bp, Homo sapiens
gcttggaccgcgatggggctgggccc

SEQ ID NO: 33165 - DNA, 21 bp, Homo sapiens
atctgaatcctggtgcctggc

SEQ ID NO: 33166 - DNA, 16 bp, Homo sapiens
cagagatcgccctttg

SEQ ID NO: 33167 - DNA, 22 bp, Homo sapiens
ctaactgtgccctcgaccactt

SEQ ID NO: 33168 - DNA, 19 bp, Homo sapiens
ctgtggtcccaggtactca

SEQ ID NO: 33169 - DNA, 22 bp, Homo sapiens
gcacagcctcccctcctatcca

SEQ ID NO: 33170 - DNA, 22 bp, Homo sapiens
taaatgatagagcatgaggctg

SEQ ID NO: 33171 - DNA, 18 bp, Homo sapiens
tctgttctgtgtctgctg

SEQ ID NO: 33172 - DNA, 20 bp, Homo sapiens
tgctccacctcttcatctct

SEQ ID NO: 33173 - DNA, 19 bp, Homo sapiens
aaactcctgacctcaggtg

SEQ ID NO: 33174 - DNA, 19 bp, Homo sapiens
aaagactccaggaagcgta

SEQ ID NO: 33175 - DNA, 19 bp, Homo sapiens
atttcagtcgtaacgcatc

SEQ ID NO: 33176 - DNA, 22 bp, Homo sapiens
cctatttttctttggtttgcaa

SEQ ID NO: 33177 - DNA, 18 bp, Homo sapiens
cctggtggctgtttggct

SEQ ID NO: 33178 - DNA, 22 bp, Homo sapiens
ccttagaccaaaggcaacacaa

SEQ ID NO: 33179 - DNA, 18 bp, Homo sapiens
gaagtgtgcctcgtggaa

SEQ ID NO: 33180 - DNA, 17 bp, Homo sapiens
ggaggaggcgtgttcca

SEQ ID NO: 33181 - DNA, 20 bp, Homo sapiens
gtcctgcagtgtctgtgagc

SEQ ID NO: 33182 - DNA, 19 bp, Homo sapiens
tctcctgctttatgttttt

SEQ ID NO: 33183 - DNA, 26 bp, Homo sapiens
tgagattggaatgattgagttcagtt

SEQ ID NO: 33184 - DNA, 18 bp, Homo sapiens
cccacccctggctgtgac

SEQ ID NO: 33185 - DNA, 22 bp, Homo sapiens
gcctgcgtcctgccaggagtca

SEQ ID NO: 33186 - DNA, 20 bp, Homo sapiens
aagacacctgtcaaatgtca

SEQ ID NO: 33187 - DNA, 19 bp, Homo sapiens
aagacctatcatgccaaga

SEQ ID NO: 33188 - DNA, 22 bp, Homo sapiens
actcgcctctgctcctgtggtc

SEQ ID NO: 33189 - DNA, 17 bp, Homo sapiens
actgtgctcagattccc

SEQ ID NO: 33190 - DNA, 21 bp, Homo sapiens
aggccctcggctcggccgaga

SEQ ID NO: 33191 - DNA, 19 bp, Homo sapiens
cccagtggcctcgtcccag

SEQ ID NO: 33192 - DNA, 17 bp, Homo sapiens
ccccctgggatggctca

SEQ ID NO: 33193 - DNA, 17 bp, Homo sapiens
cgctagcagctgtgatg

SEQ ID NO: 33194 - DNA, 21 bp, Homo sapiens
ggcccctctctgggcagtcag

SEQ ID NO: 33195 - DNA, 18 bp, Homo sapiens
agatgattactgctttga

SEQ ID NO: 33196 - DNA, 23 bp, Homo sapiens
tacagatcattcatatgtgtaca

SEQ ID NO: 33197 - DNA, 20 bp, Homo sapiens
cgccctgcaagctcatgcaa

SEQ ID NO: 33198 - DNA, 22 bp, Homo sapiens
taagtggggctgtatcaggctg

SEQ ID NO: 33199 - DNA, 20 bp, Homo sapiens
tcctgcggcagagttgttca

SEQ ID NO: 33200 - DNA, 17 bp, Homo sapiens
acttctgggtatatatc

SEQ ID NO: 33201 - DNA, 18 bp, Homo sapiens
tgtccttaagttgggagc

SEQ ID NO: 33202 - DNA, 17 bp, Homo sapiens
ccctcctccctgctcct

SEQ ID NO: 33203 - DNA, 20 bp, Homo sapiens
ccctggtgaggaagatctgc

SEQ ID NO: 33204 - DNA, 16 bp, Homo sapiens
gcagacacctgttcca

SEQ ID NO: 33205 - DNA, 21 bp, Homo sapiens
gcggaggagaggaaggcctac

SEQ ID NO: 33206 - DNA, 27 bp, Homo sapiens
agctgcacagcggctaactagctttat

SEQ ID NO: 33207 - DNA, 17 bp, Homo sapiens
atatacctttctaatca

SEQ ID NO: 33208 - DNA, 20 bp, Homo sapiens
ccctcagtattatgatctca

SEQ ID NO: 33209 - DNA, 17 bp, Homo sapiens
gaaatctcacacatttc

SEQ ID NO: 33210 - DNA, 18 bp, Homo sapiens
tcacagtctctctaatca

SEQ ID NO: 33211 - DNA, 18 bp, Homo sapiens
aagtcttcagtaacacta

SEQ ID NO: 33212 - DNA, 22 bp, Homo sapiens
aatgtggcaaatttttcagaca

SEQ ID NO: 33213 - DNA, 18 bp, Homo sapiens
cccttaaggaacatcaga

SEQ ID NO: 33214 - DNA, 16 bp, Homo sapiens
ctggcccaacaaacta

SEQ ID NO: 33215 - DNA, 17 bp, Homo sapiens
aaccaaaggtttacttt

SEQ ID NO: 33216 - DNA, 18 bp, Homo sapiens
caagagcataggagtttt

SEQ ID NO: 33217 - DNA, 19 bp, Homo sapiens
catgagaactagaaaggaa

SEQ ID NO: 33218 - DNA, 22 bp, Homo sapiens
ccagattaaggtatttgtctaa

SEQ ID NO: 33219 - DNA, 18 bp, Homo sapiens
gcctcagtcatgaaattg

SEQ ID NO: 33220 - DNA, 17 bp, Homo sapiens
tctgtaattgctattgc

SEQ ID NO: 33221 - DNA, 18 bp, Homo sapiens
tgggtggatcacctgagg

SEQ ID NO: 33222 - DNA, 19 bp, Homo sapiens
ttatacattttaggggtag

SEQ ID NO: 33223 - DNA, 23 bp, Homo sapiens
ttgaatttttaaagtaaagctca

SEQ ID NO: 33224 - DNA, 24 bp, Homo sapiens
tttagtgtgcctggggtcactttt

SEQ ID NO: 33225 - DNA, 21 bp, Homo sapiens
acctgagccgcaacactgccg

SEQ ID NO: 33226 - DNA, 24 bp, Homo sapiens
acctggacacagacttgccggctc

SEQ ID NO: 33227 - DNA, 21 bp, Homo sapiens
actgcagtgcaggcagtctga

SEQ ID NO: 33228 - DNA, 23 bp, Homo sapiens
atccggggttccagcccctgatg

SEQ ID NO: 33229 - DNA, 18 bp, Homo sapiens
caacatcatcattactaa

SEQ ID NO: 33230 - DNA, 21 bp, Homo sapiens
ccgcgggaggtctcaccaact

SEQ ID NO: 33231 - DNA, 17 bp, Homo sapiens
ggccaacagctgtgaac

SEQ ID NO: 33232 - DNA, 21 bp, Homo sapiens
ggccttggaaaatcccattca

SEQ ID NO: 33233 - DNA, 23 bp, Homo sapiens
tcttggtcaaaggggcttgggga

SEQ ID NO: 33234 - DNA, 17 bp, Homo sapiens
gaaaatgtcacatctat

SEQ ID NO: 33235 - DNA, 17 bp, Homo sapiens
ttaacaaggctagttca

SEQ ID NO: 33236 - DNA, 19 bp, Homo sapiens
agaatacagagagcttacc

SEQ ID NO: 33237 - DNA, 21 bp, Homo sapiens
ctttttccatgcgttaacttt

SEQ ID NO: 33238 - DNA, 21 bp, Homo sapiens
aacccgtggactaagaacgca

SEQ ID NO: 33239 - DNA, 23 bp, Homo sapiens
ccccattgcccagcactgtctca

SEQ ID NO: 33240 - DNA, 20 bp, Homo sapiens
ccttccccctcctctctcca

SEQ ID NO: 33241 - DNA, 18 bp, Homo sapiens
ctccccctcaagccaact

SEQ ID NO: 33242 - DNA, 17 bp, Homo sapiens
taaacagcgcaaaggca

SEQ ID NO: 33243 - DNA, 18 bp, Homo sapiens
attgacagcacatatacc

SEQ ID NO: 33244 - DNA, 21 bp, Homo sapiens
ctaaatgtattacttctgata

SEQ ID NO: 33245 - DNA, 16 bp, Homo sapiens
gcattctcttctgtga

SEQ ID NO: 33246 - DNA, 20 bp, Homo sapiens
tctttttgtggttgctggct

SEQ ID NO: 33247 - DNA, 22 bp, Homo sapiens
caaggaccccatcaagtgtaca

SEQ ID NO: 33248 - DNA, 19 bp, Homo sapiens
cctgacatggtactgtgca

SEQ ID NO: 33249 - DNA, 23 bp, Homo sapiens
gtcatttattgcccaagtttaca

SEQ ID NO: 33250 - DNA, 23 bp, Homo sapiens
tgaaggaatcttcctggagttca

SEQ ID NO: 33251 - DNA, 18 bp, Homo sapiens
tgcgtgtgtgcttgtggg

SEQ ID NO: 33252 - DNA, 19 bp, Homo sapiens
ggacggtatcccgagccca

SEQ ID NO: 33253 - DNA, 20 bp, Homo sapiens
tccagttgggcagcagggaa

SEQ ID NO: 33254 - DNA, 22 bp, Homo sapiens
aaggacccaggatttgaaccca

SEQ ID NO: 33255 - DNA, 15 bp, Homo sapiens
caagagagcatccag

SEQ ID NO: 33256 - DNA, 19 bp, Homo sapiens
cccagaggaagttctccag

SEQ ID NO: 33257 - DNA, 17 bp, Homo sapiens
ctgcagccacgtggcca

SEQ ID NO: 33258 - DNA, 18 bp, Homo sapiens
ggagggggctgtgttgtg

SEQ ID NO: 33259 - DNA, 17 bp, Homo sapiens
tctctacgttaacgttt

SEQ ID NO: 33260 - DNA, 19 bp, Homo sapiens
aaacacaggtcatcagtga

SEQ ID NO: 33261 - DNA, 19 bp, Homo sapiens
acaaaaaattagccaggtt

SEQ ID NO: 33262 - DNA, 17 bp, Homo sapiens
aggcagaaggatcactt

SEQ ID NO: 33263 - DNA, 23 bp, Homo sapiens
gaaactccatctccaacaaaaca

SEQ ID NO: 33264 - DNA, 18 bp, Homo sapiens
tcctttaatgattgtgct

SEQ ID NO: 33265 - DNA, 18 bp, Homo sapiens
tctgtcttttaagtgacc

SEQ ID NO: 33266 - DNA, 21 bp, Homo sapiens
tttaagtgaccatcaattcaa

SEQ ID NO: 33267 - DNA, 19 bp, Homo sapiens
tctcaatgctaacaccaca

SEQ ID NO: 33268 - DNA, 21 bp, Homo sapiens
caacccggcacacctgctcct

SEQ ID NO: 33269 - DNA, 17 bp, Homo sapiens
cagggctgggtcagtta

SEQ ID NO: 33270 - DNA, 20 bp, Homo sapiens
gacagcggtagcaaccagct

SEQ ID NO: 33271 - DNA, 22 bp, Homo sapiens
acaattgatatattgctttatt

SEQ ID NO: 33272 - DNA, 24 bp, Homo sapiens
acgatgcagcccaccattaactca

SEQ ID NO: 33273 - DNA, 17 bp, Homo sapiens
tgtggtgggaaaagcta

SEQ ID NO: 33274 - DNA, 25 bp, Homo sapiens
ttaactcattcatgtagtttattca

SEQ ID NO: 33275 - DNA, 19 bp, Homo sapiens
aagcctccagatgttttca

SEQ ID NO: 33276 - DNA, 23 bp, Homo sapiens
atctgtgaaacccaaactctcaa

SEQ ID NO: 33277 - DNA, 18 bp, Homo sapiens
atgtaaccatacacttta

SEQ ID NO: 33278 - DNA, 18 bp, Homo sapiens
cagttgtaaataatcaga

SEQ ID NO: 33279 - DNA, 21 bp, Homo sapiens
cctacagagaaaattctgata

SEQ ID NO: 33280 - DNA, 20 bp, Homo sapiens
cgctggccgccagcagctca

SEQ ID NO: 33281 - DNA, 20 bp, Homo sapiens
ctccaagacgagggcctcat

SEQ ID NO: 33282 - DNA, 22 bp, Homo sapiens
gaaagtcttattaaaagcctcc

SEQ ID NO: 33283 - DNA, 17 bp, Homo sapiens
ggcgagggcgctggccg

SEQ ID NO: 33284 - DNA, 21 bp, Homo sapiens
gtaaccatacactttattcca

SEQ ID NO: 33285 - DNA, 22 bp, Homo sapiens
atatctcagatttgaaacctca

SEQ ID NO: 33286 - DNA, 23 bp, Homo sapiens
cccagaagagagtccccaagtga

SEQ ID NO: 33287 - DNA, 18 bp, Homo sapiens
gagcccctcatcatcccc

SEQ ID NO: 33288 - DNA, 23 bp, Homo sapiens
cagcaagagaagaatctgctcta

SEQ ID NO: 33289 - DNA, 19 bp, Homo sapiens
aaaaaagaggcaaacaaag

SEQ ID NO: 33290 - DNA, 17 bp, Homo sapiens
cccagcgacactaggga

SEQ ID NO: 33291 - DNA, 25 bp, Homo sapiens
cctttatgcgtgttgttttcacttt

SEQ ID NO: 33292 - DNA, 19 bp, Homo sapiens
gtcttcattattttcctca

SEQ ID NO: 33293 - DNA, 18 bp, Homo sapiens
tatatgtgggtgtaggtc

SEQ ID NO: 33294 - DNA, 22 bp, Homo sapiens
tctcttccgtgtctttgacctt

SEQ ID NO: 33295 - DNA, 17 bp, Homo sapiens
aaactacagagtttatg

SEQ ID NO: 33296 - DNA, 23 bp, Homo sapiens
aagactactatacaaactacaga

SEQ ID NO: 33297 - DNA, 20 bp, Homo sapiens
aggtgcgcactaccacacca

SEQ ID NO: 33298 - DNA, 20 bp, Homo sapiens
attgttctatttgtatatat

SEQ ID NO: 33299 - DNA, 19 bp, Homo sapiens
aatgctaatgaacagctca

SEQ ID NO: 33300 - DNA, 23 bp, Homo sapiens
acctgggtgtggtgctgcctggc

SEQ ID NO: 33301 - DNA, 20 bp, Homo sapiens
actggtcagggaactgtggc

SEQ ID NO: 33302 - DNA, 21 bp, Homo sapiens
agaaagcccacctctcctccc

SEQ ID NO: 33303 - DNA, 25 bp, Homo sapiens
cccagagacacccagtttctcagtg

SEQ ID NO: 33304 - DNA, 22 bp, Homo sapiens
cctagggggctggggttgctgc

SEQ ID NO: 33305 - DNA, 19 bp, Homo sapiens
cttccagtgtgaattttgg

SEQ ID NO: 33306 - DNA, 23 bp, Homo sapiens
actactactaacttgctctgtga

SEQ ID NO: 33307 - DNA, 20 bp, Homo sapiens
actgtatacagtatacttta

SEQ ID NO: 33308 - DNA, 22 bp, Homo sapiens
agccaagattgaaaacagtgtt

SEQ ID NO: 33309 - DNA, 21 bp, Homo sapiens
catgtggcctgtgggctgcaa

SEQ ID NO: 33310 - DNA, 19 bp, Homo sapiens
ctcctgcttatcttgcaca

SEQ ID NO: 33311 - DNA, 19 bp, Homo sapiens
ggagcttttagaactccca

SEQ ID NO: 33312 - DNA, 22 bp, Homo sapiens
taattggtctgacatggagttg

SEQ ID NO: 33313 - DNA, 18 bp, Homo sapiens
tctgatgtagtttgtgga

SEQ ID NO: 33314 - DNA, 17 bp, Homo sapiens
tgaccaagtcatttgac

SEQ ID NO: 33315 - DNA, 19 bp, Homo sapiens
ttttggtccagttctaaca

SEQ ID NO: 33316 - DNA, 22 bp, Homo sapiens
aatggtcacatgccatctcttc

SEQ ID NO: 33317 - DNA, 21 bp, Homo sapiens
catctaagaagaaatagatca

SEQ ID NO: 33318 - DNA, 19 bp, Homo sapiens
taaagaactttcctcagga

SEQ ID NO: 33319 - DNA, 18 bp, Homo sapiens
tacaggttacatcattgc

SEQ ID NO: 33320 - DNA, 20 bp, Homo sapiens
ttttttgtctttgccactac

SEQ ID NO: 33321 - DNA, 19 bp, Homo sapiens
acttttaaaagataccctc

SEQ ID NO: 33322 - DNA, 20 bp, Homo sapiens
agtcctcgcaggagacacca

SEQ ID NO: 33323 - DNA, 19 bp, Homo sapiens
cttgataattggttcctcc

SEQ ID NO: 33324 - DNA, 19 bp, Homo sapiens
tagttgcacagtatgtgta

SEQ ID NO: 33325 - DNA, 19 bp, Homo sapiens
tgcactattggagccctgg

SEQ ID NO: 33326 - DNA, 16 bp, Homo sapiens
atcacttacagaacca

SEQ ID NO: 33327 - DNA, 16 bp, Homo sapiens
gcttggacgcgctgct

SEQ ID NO: 33328 - DNA, 24 bp, Homo sapiens
tgctgtaaagcaaaatatttgtga

SEQ ID NO: 33329 - DNA, 22 bp, Homo sapiens
cctgagatggtccactctgtgg

SEQ ID NO: 33330 - DNA, 19 bp, Homo sapiens
gggttcccgtatggaactg

SEQ ID NO: 33331 - DNA, 20 bp, Homo sapiens
tgctctgcgggagaaaagcc

SEQ ID NO: 33332 - DNA, 21 bp, Homo sapiens
aggccagcattcagcctgaga

SEQ ID NO: 33333 - DNA, 16 bp, Homo sapiens
ccagggaagccccctg

SEQ ID NO: 33334 - DNA, 19 bp, Homo sapiens
cctgaatcatacccttgga

SEQ ID NO: 33335 - DNA, 19 bp, Homo sapiens
acccgtgcacctgtcctgc

SEQ ID NO: 33336 - DNA, 25 bp, Homo sapiens
ctttgagggactgggggacttgggg

SEQ ID NO: 33337 - DNA, 23 bp, Homo sapiens
actttttcagtggttcttggtcc

SEQ ID NO: 33338 - DNA, 18 bp, Homo sapiens
ccgcctcattcccacccc

SEQ ID NO: 33339 - DNA, 18 bp, Homo sapiens
cctcattcccacccccaa

SEQ ID NO: 33340 - DNA, 21 bp, Homo sapiens
ctcatttgatgtattaatcat

SEQ ID NO: 33341 - DNA, 18 bp, Homo sapiens
gcttcttccagttcattt

SEQ ID NO: 33342 - DNA, 18 bp, Homo sapiens
gttttctaaatcattttt

SEQ ID NO: 33343 - DNA, 22 bp, Homo sapiens
tttcccatttctgcattaaata

SEQ ID NO: 33344 - DNA, 22 bp, Homo sapiens
agaagagatcccccgtccccca

SEQ ID NO: 33345 - DNA, 20 bp, Homo sapiens
agataaaggttggggacagg

SEQ ID NO: 33346 - DNA, 18 bp, Homo sapiens
agatgtatatgctttcta

SEQ ID NO: 33347 - DNA, 26 bp, Homo sapiens
atagagctgcattgtcggtgattcca

SEQ ID NO: 33348 - DNA, 20 bp, Homo sapiens
tccattttctattacctgga

SEQ ID NO: 33349 - DNA, 25 bp, Homo sapiens
acatggtccgtgccatgtcacctcc

SEQ ID NO: 33350 - DNA, 17 bp, Homo sapiens
acccagtgtacacacca

SEQ ID NO: 33351 - DNA, 19 bp, Homo sapiens
agtctcctaccctctcagc

SEQ ID NO: 33352 - DNA, 21 bp, Homo sapiens
cacctgcaccgccctgctctt

SEQ ID NO: 33353 - DNA, 24 bp, Homo sapiens
cagtgtacacaccacctacgtgca

SEQ ID NO: 33354 - DNA, 19 bp, Homo sapiens
ctccatagggaaaggcttc

SEQ ID NO: 33355 - DNA, 19 bp, Homo sapiens
ctgagagcagaggccgtgc

SEQ ID NO: 33356 - DNA, 22 bp, Homo sapiens
gcctccagctgacctctggctc

SEQ ID NO: 33357 - DNA, 26 bp, Homo sapiens
gcttgagccctgtttcttcctggcct

SEQ ID NO: 33358 - DNA, 20 bp, Homo sapiens
gtgtgccaggccaggacagc

SEQ ID NO: 33359 - DNA, 18 bp, Homo sapiens
tgggtgcagcgtgaggct

SEQ ID NO: 33360 - DNA, 22 bp, Homo sapiens
gccatgagggaggttctggggg

SEQ ID NO: 33361 - DNA, 21 bp, Homo sapiens
agcaccatgttttttctatga

SEQ ID NO: 33362 - DNA, 17 bp, Homo sapiens
ccccagcacagatgcca

SEQ ID NO: 33363 - DNA, 19 bp, Homo sapiens
ccttggcccgggcctgtgg

SEQ ID NO: 33364 - DNA, 18 bp, Homo sapiens
ctcaccctcaccatctga

SEQ ID NO: 33365 - DNA, 24 bp, Homo sapiens
ggacaaggaaaggatcagatacct

SEQ ID NO: 33366 - DNA, 17 bp, Homo sapiens
tgtctgtggctgaagga

SEQ ID NO: 33367 - DNA, 18 bp, Homo sapiens
atcttaccattattttac

SEQ ID NO: 33368 - DNA, 25 bp, Homo sapiens
caaaaacaaaacaccagggacacat

SEQ ID NO: 33369 - DNA, 20 bp, Homo sapiens
taagaaataaaagtgcttct

SEQ ID NO: 33370 - DNA, 22 bp, Homo sapiens
tctaagaaataaaagtgcttct

SEQ ID NO: 33371 - DNA, 20 bp, Homo sapiens
agctgtgtgaacttagcttt

SEQ ID NO: 33372 - DNA, 22 bp, Homo sapiens
ctaccagacttcaaaatttact

SEQ ID NO: 33373 - DNA, 22 bp, Homo sapiens
ggatcaaacacaaagggcatca

SEQ ID NO: 33374 - DNA, 17 bp, Homo sapiens
agaaacttactgtgctg

SEQ ID NO: 33375 - DNA, 18 bp, Homo sapiens
agggccagcaaagaatta

SEQ ID NO: 33376 - DNA, 16 bp, Homo sapiens
agtgattctgatacac

SEQ ID NO: 33377 - DNA, 17 bp, Homo sapiens
gtaggtggggaagatgt

SEQ ID NO: 33378 - DNA, 21 bp, Homo sapiens
tctgaaggtgctttttccaca

SEQ ID NO: 33379 - DNA, 25 bp, Homo sapiens
tttctttcagtcattgtcttagttt

SEQ ID NO: 33380 - DNA, 18 bp, Homo sapiens
gcgcgccgggagctgctg

SEQ ID NO: 33381 - DNA, 19 bp, Homo sapiens
gttacaccctggcactgtt

SEQ ID NO: 33382 - DNA, 17 bp, Homo sapiens
tcataattcagcattaa

SEQ ID NO: 33383 - DNA, 19 bp, Homo sapiens
tgagcctaccgccgccaga

SEQ ID NO: 33384 - DNA, 17 bp, Homo sapiens
cctgcaccagcatgtca

SEQ ID NO: 33385 - DNA, 18 bp, Homo sapiens
ctgtgcctctcctcattc

SEQ ID NO: 33386 - DNA, 18 bp, Homo sapiens
gggaatgggatattgaca

SEQ ID NO: 33387 - DNA, 23 bp, Homo sapiens
tatacttagatatagtgcattgt

SEQ ID NO: 33388 - DNA, 20 bp, Homo sapiens
tcagtccagttgaagaattg

SEQ ID NO: 33389 - DNA, 22 bp, Homo sapiens
accacacagcatcatcgcccca

SEQ ID NO: 33390 - DNA, 18 bp, Homo sapiens
atcaaaccccaggtctgc

SEQ ID NO: 33391 - DNA, 19 bp, Homo sapiens
cctgggccagctctggctt

SEQ ID NO: 33392 - DNA, 20 bp, Homo sapiens
ctctctcccttttcagtgtc

SEQ ID NO: 33393 - DNA, 22 bp, Homo sapiens
accacacagcatcatcgcccca

SEQ ID NO: 33394 - DNA, 22 bp, Homo sapiens
acttgctgtcggcctttggctt

SEQ ID NO: 33395 - DNA, 18 bp, Homo sapiens
agctggacttgccgctgt

SEQ ID NO: 33396 - DNA, 18 bp, Homo sapiens
atcaaaccccaggtctgc

SEQ ID NO: 33397 - DNA, 22 bp, Homo sapiens
ccaattctggtttcacattcag

SEQ ID NO: 33398 - DNA, 18 bp, Homo sapiens
ccaggagttttgaccagg

SEQ ID NO: 33399 - DNA, 19 bp, Homo sapiens
cctgggccagctctggctt

SEQ ID NO: 33400 - DNA, 20 bp, Homo sapiens
ctctctcccttttcagtgtc

SEQ ID NO: 33401 - DNA, 18 bp, Homo sapiens
tctgtcactgccaccgta

SEQ ID NO: 33402 - DNA, 22 bp, Homo sapiens
aatggtcatatcaaatgttctt

SEQ ID NO: 33403 - DNA, 17 bp, Homo sapiens
ttccagacgttgttcca

SEQ ID NO: 33404 - DNA, 23 bp, Homo sapiens
gaaaaagagttaagggaaatcta

SEQ ID NO: 33405 - DNA, 21 bp, Homo sapiens
gtgcagctgttgttggatttt

SEQ ID NO: 33406 - DNA, 21 bp, Homo sapiens
gtttccagtggacacaaggtg

SEQ ID NO: 33407 - DNA, 20 bp, Homo sapiens
ccctggtgacggccacctgc

SEQ ID NO: 33408 - DNA, 20 bp, Homo sapiens
cgagccgctgcctccgctcc

SEQ ID NO: 33409 - DNA, 20 bp, Homo sapiens
tcctggcgccggacgtgtgg

SEQ ID NO: 33410 - DNA, 21 bp, Homo sapiens
ttccagaagcacttgcttcag

SEQ ID NO: 33411 - DNA, 20 bp, Homo sapiens
gaccccgagagcggcggcgc

SEQ ID NO: 33412 - DNA, 19 bp, Homo sapiens
aacaaatcctctgacctca

SEQ ID NO: 33413 - DNA, 19 bp, Homo sapiens
tagaaagtgctttgaaata

SEQ ID NO: 33414 - DNA, 18 bp, Homo sapiens
tgggtaattggtgctggc

SEQ ID NO: 33415 - DNA, 20 bp, Homo sapiens
acagagaatcctgccttggt

SEQ ID NO: 33416 - DNA, 19 bp, Homo sapiens
atgtttggtagctctctga

SEQ ID NO: 33417 - DNA, 21 bp, Homo sapiens
caaacttgtttttgtactgtc

SEQ ID NO: 33418 - DNA, 22 bp, Homo sapiens
ccaccccctcccacagcccacc

SEQ ID NO: 33419 - DNA, 16 bp, Homo sapiens
ctttttccactttgca

SEQ ID NO: 33420 - DNA, 21 bp, Homo sapiens
gaaagaacagaaatttgcaca

SEQ ID NO: 33421 - DNA, 20 bp, Homo sapiens
gaaagcccaaattacacctc

SEQ ID NO: 33422 - DNA, 24 bp, Homo sapiens
gaatcctagaaaaataatccctaa

SEQ ID NO: 33423 - DNA, 18 bp, Homo sapiens
gcccacctccacttttga

SEQ ID NO: 33424 - DNA, 24 bp, Homo sapiens
gctctctagctcttgcactctgaa

SEQ ID NO: 33425 - DNA, 19 bp, Homo sapiens
tctagctcttgcactctga

SEQ ID NO: 33426 - DNA, 18 bp, Homo sapiens
tctatggaaaactactca

SEQ ID NO: 33427 - DNA, 19 bp, Homo sapiens
tctcccagaacacagtgtt

SEQ ID NO: 33428 - DNA, 18 bp, Homo sapiens
tgcaaggtggcctactca

SEQ ID NO: 33429 - DNA, 20 bp, Homo sapiens
aggcacatcccaccttacct

SEQ ID NO: 33430 - DNA, 25 bp, Homo sapiens
cctctcacttggctgatttgacctt

SEQ ID NO: 33431 - DNA, 26 bp, Homo sapiens
cctcttgatctgttgtttatggcctt

SEQ ID NO: 33432 - DNA, 24 bp, Homo sapiens
cttgtccctcagtgggggttctct

SEQ ID NO: 33433 - DNA, 20 bp, Homo sapiens
gcgtatcttgccatgtgtca

SEQ ID NO: 33434 - DNA, 18 bp, Homo sapiens
tggtgtatgaggttctga

SEQ ID NO: 33435 - DNA, 19 bp, Homo sapiens
aggcgcaaagcttcggtga

SEQ ID NO: 33436 - DNA, 21 bp, Homo sapiens
cgcagacgcgccccgcccctc

SEQ ID NO: 33437 - DNA, 25 bp, Homo sapiens
ctcaaacgcaaagaaaactgcaggt

SEQ ID NO: 33438 - DNA, 21 bp, Homo sapiens
gcccatggagcactgtcctca

SEQ ID NO: 33439 - DNA, 23 bp, Homo sapiens
agaaaggtggccttggacaaaac

SEQ ID NO: 33440 - DNA, 19 bp, Homo sapiens
ctgagccccaggtctgtct

SEQ ID NO: 33441 - DNA, 15 bp, Homo sapiens
gccatgcctgcctct

SEQ ID NO: 33442 - DNA, 19 bp, Homo sapiens
ggcatgcatatgtgagata

SEQ ID NO: 33443 - DNA, 17 bp, Homo sapiens
ttggctctgtccagcaa

SEQ ID NO: 33444 - DNA, 21 bp, Homo sapiens
ccctagaccagctcctctcca

SEQ ID NO: 33445 - DNA, 19 bp, Homo sapiens
gactcgcgttccctccagc

SEQ ID NO: 33446 - DNA, 19 bp, Homo sapiens
tggcgtctcggcgtggaac

SEQ ID NO: 33447 - DNA, 21 bp, Homo sapiens
gcatcttacccattttcttca

SEQ ID NO: 33448 - DNA, 18 bp, Homo sapiens
tccgcctcctgggttcaa

SEQ ID NO: 33449 - DNA, 21 bp, Homo sapiens
ttcaagtgattctcctgccac

SEQ ID NO: 33450 - DNA, 25 bp, Homo sapiens
acctgggtccagtgtagcctggctc

SEQ ID NO: 33451 - DNA, 26 bp, Homo sapiens
atggcccacattttggcatgagggtg

SEQ ID NO: 33452 - DNA, 18 bp, Homo sapiens
cagcaaagcctcatggca

SEQ ID NO: 33453 - DNA, 18 bp, Homo sapiens
caggtgagaaattgtgct

SEQ ID NO: 33454 - DNA, 19 bp, Homo sapiens
ccacttcccagccgcccca

SEQ ID NO: 33455 - DNA, 19 bp, Homo sapiens
ctgcctgaccctccactgc

SEQ ID NO: 33456 - DNA, 22 bp, Homo sapiens
gcctcagcccacacctgcctca

SEQ ID NO: 33457 - DNA, 21 bp, Homo sapiens
gcctgggcccccagcttggcc

SEQ ID NO: 33458 - DNA, 20 bp, Homo sapiens
gctaaccttggccaccacca

SEQ ID NO: 33459 - DNA, 16 bp, Homo sapiens
tgctcctctgccctca

SEQ ID NO: 33460 - DNA, 19 bp, Homo sapiens
acactgatgatacctccaa

SEQ ID NO: 33461 - DNA, 17 bp, Homo sapiens
ccaactcaaacactttt

SEQ ID NO: 33462 - DNA, 23 bp, Homo sapiens
gctcatatgaacactgctctgaa

SEQ ID NO: 33463 - DNA, 21 bp, Homo sapiens
taccaacatttaaagcttaaa

SEQ ID NO: 33464 - DNA, 17 bp, Homo sapiens
caaatatgtatacctgg

SEQ ID NO: 33465 - DNA, 20 bp, Homo sapiens
cagatctgccatcgatcgca

SEQ ID NO: 33466 - DNA, 21 bp, Homo sapiens
cttaaacttccacatcactgc

SEQ ID NO: 33467 - DNA, 16 bp, Homo sapiens
cttattctctctttct

SEQ ID NO: 33468 - DNA, 18 bp, Homo sapiens
ctttccggcctgctccag

SEQ ID NO: 33469 - DNA, 20 bp, Homo sapiens
tccagaaagtcacactctca

SEQ ID NO: 33470 - DNA, 23 bp, Homo sapiens
ttcattgtgttgtactggatgca

SEQ ID NO: 33471 - DNA, 19 bp, Homo sapiens
tttctataccactgtcatt

SEQ ID NO: 33472 - DNA, 22 bp, Homo sapiens
ctaaaagatggaatatttgcgg

SEQ ID NO: 33473 - DNA, 20 bp, Homo sapiens
acatcttttaacttctcagt

SEQ ID NO: 33474 - DNA, 23 bp, Homo sapiens
ctgagatatgcaaaatactcatt

SEQ ID NO: 33475 - DNA, 21 bp, Homo sapiens
ctgcttaatggaaaaaatact

SEQ ID NO: 33476 - DNA, 25 bp, Homo sapiens
gacctcactaaactgtttatgtgac

SEQ ID NO: 33477 - DNA, 20 bp, Homo sapiens
gactttaggattaacttgta

SEQ ID NO: 33478 - DNA, 20 bp, Homo sapiens
gtttctggctcttagactca

SEQ ID NO: 33479 - DNA, 18 bp, Homo sapiens
tttcttataccaatgtga

SEQ ID NO: 33480 - DNA, 21 bp, Homo sapiens
acagaaaacctatactctttg

SEQ ID NO: 33481 - DNA, 18 bp, Homo sapiens
aggacctagactacttct

SEQ ID NO: 33482 - DNA, 17 bp, Homo sapiens
ataatatgagccagagc

SEQ ID NO: 33483 - DNA, 21 bp, Homo sapiens
atgcagtttcttcatacttct

SEQ ID NO: 33484 - DNA, 19 bp, Homo sapiens
gaacagtgtactcttctga

SEQ ID NO: 33485 - DNA, 24 bp, Homo sapiens
gagattctggcctctgcatattct

SEQ ID NO: 33486 - DNA, 16 bp, Homo sapiens
gatggatggagcactc

SEQ ID NO: 33487 - DNA, 21 bp, Homo sapiens
gtgcaatacattggtgagttc

SEQ ID NO: 33488 - DNA, 20 bp, Homo sapiens
tttgggaagatttttgttca

SEQ ID NO: 33489 - DNA, 19 bp, Homo sapiens
tttttcatggctttgtttt

SEQ ID NO: 33490 - DNA, 17 bp, Homo sapiens
ccaaagatcctctcacc

SEQ ID NO: 33491 - DNA, 22 bp, Homo sapiens
tctcttttgagttttatacctt

SEQ ID NO: 33492 - DNA, 20 bp, Homo sapiens
gatgaaaacataatgcctta

SEQ ID NO: 33493 - DNA, 16 bp, Homo sapiens
gtgctattttttgtaa

SEQ ID NO: 33494 - DNA, 18 bp, Homo sapiens
tacacatacatacacaca

SEQ ID NO: 33495 - DNA, 19 bp, Homo sapiens
tcctgaatacactattttg

SEQ ID NO: 33496 - DNA, 19 bp, Homo sapiens
tgtttatggacacatgaaa

SEQ ID NO: 33497 - DNA, 21 bp, Homo sapiens
aaatgtgttcctaagaagaca

SEQ ID NO: 33498 - DNA, 19 bp, Homo sapiens
acacagtgaaaatccagga

SEQ ID NO: 33499 - DNA, 17 bp, Homo sapiens
acattatattactaata

SEQ ID NO: 33500 - DNA, 18 bp, Homo sapiens
gatgtaataactactttg

SEQ ID NO: 33501 - DNA, 19 bp, Homo sapiens
ttgatgatttcgtgaaata

SEQ ID NO: 33502 - DNA, 16 bp, Homo sapiens
ctgatgaaaccttgaa

SEQ ID NO: 33503 - DNA, 17 bp, Homo sapiens
tcctggctccttcacca

SEQ ID NO: 33504 - DNA, 22 bp, Homo sapiens
acaaaatcatgattagttacaa

SEQ ID NO: 33505 - DNA, 17 bp, Homo sapiens
agagagagaaaaacacc

SEQ ID NO: 33506 - DNA, 21 bp, Homo sapiens
aaaaacagctgtaacaaagaa

SEQ ID NO: 33507 - DNA, 18 bp, Homo sapiens
acacaccaatatacatca

SEQ ID NO: 33508 - DNA, 22 bp, Homo sapiens
agagaaaagaacagctcccgac

SEQ ID NO: 33509 - DNA, 19 bp, Homo sapiens
attgcattcctctatgatg

SEQ ID NO: 33510 - DNA, 22 bp, Homo sapiens
catcttggctcagtctccctca

SEQ ID NO: 33511 - DNA, 21 bp, Homo sapiens
catttttaaaatgtaaaaatg

SEQ ID NO: 33512 - DNA, 22 bp, Homo sapiens
ccataacaataacctgctgtta

SEQ ID NO: 33513 - DNA, 18 bp, Homo sapiens
gtgatgacaatatgggtt

SEQ ID NO: 33514 - DNA, 19 bp, Homo sapiens
gttgatggaaaatggacta

SEQ ID NO: 33515 - DNA, 20 bp, Homo sapiens
tgggcatattgcaatgatga

SEQ ID NO: 33516 - DNA, 19 bp, Homo sapiens
tgtatatatacacagtaga

SEQ ID NO: 33517 - DNA, 18 bp, Homo sapiens
agtgccaaaaaattgtat

SEQ ID NO: 33518 - DNA, 20 bp, Homo sapiens
gtatgtgttgttgcttgact

SEQ ID NO: 33519 - DNA, 24 bp, Homo sapiens
ttggagtcattgtgggttattttt

SEQ ID NO: 33520 - DNA, 19 bp, Homo sapiens
ccgtagaaagtactttgtc

SEQ ID NO: 33521 - DNA, 21 bp, Homo sapiens
tattggatatgtcatttctgt

SEQ ID NO: 33522 - DNA, 18 bp, Homo sapiens
aaacatgtaactctgctt

SEQ ID NO: 33523 - DNA, 21 bp, Homo sapiens
acttgtcatctgacaaccact

SEQ ID NO: 33524 - DNA, 22 bp, Homo sapiens
atcttggctcactgcaacctct

SEQ ID NO: 33525 - DNA, 19 bp, Homo sapiens
catacccctggccataggc

SEQ ID NO: 33526 - DNA, 19 bp, Homo sapiens
ccgtagaaagtactttgtc

SEQ ID NO: 33527 - DNA, 20 bp, Homo sapiens
cctctgcctcccaggttcaa

SEQ ID NO: 33528 - DNA, 19 bp, Homo sapiens
ctgcaacctctgcctccca

SEQ ID NO: 33529 - DNA, 19 bp, Homo sapiens
cttttccttcttactgtga

SEQ ID NO: 33530 - DNA, 23 bp, Homo sapiens
gtatgtatgagtgtgtgcatttg

SEQ ID NO: 33531 - DNA, 24 bp, Homo sapiens
tgggcaattgtaacacaatggcaa

SEQ ID NO: 33532 - DNA, 21 bp, Homo sapiens
cttgtggtgtgaccatgttca

SEQ ID NO: 33533 - DNA, 18 bp, Homo sapiens
tctttgcattgttcctcc

SEQ ID NO: 33534 - DNA, 20 bp, Homo sapiens
ttgctcgccgcagccgcctc

SEQ ID NO: 33535 - DNA, 19 bp, Homo sapiens
aaactcctgacctcaggtg

SEQ ID NO: 33536 - DNA, 19 bp, Homo sapiens
aaatcaactcaatatatca

SEQ ID NO: 33537 - DNA, 18 bp, Homo sapiens
aggtaaaatactagtcag

SEQ ID NO: 33538 - DNA, 25 bp, Homo sapiens
atttcatgcttggtcaaaaacatca

SEQ ID NO: 33539 - DNA, 17 bp, Homo sapiens
tcaagtgattcttgtgc

SEQ ID NO: 33540 - DNA, 18 bp, Homo sapiens
tgaagagattacctagag

SEQ ID NO: 33541 - DNA, 20 bp, Homo sapiens
tgttaaaacaagtgatttcc

SEQ ID NO: 33542 - DNA, 23 bp, Homo sapiens
aagtgaaaccttatacccattaa

SEQ ID NO: 33543 - DNA, 18 bp, Homo sapiens
cattgatagacatgtgtg

SEQ ID NO: 33544 - DNA, 19 bp, Homo sapiens
ccttggcatcatgtcctca

SEQ ID NO: 33545 - DNA, 24 bp, Homo sapiens
ttctccacatttttgccaacgctt

SEQ ID NO: 33546 - DNA, 20 bp, Homo sapiens
tttccctaattaatggtgtt

SEQ ID NO: 33547 - DNA, 21 bp, Homo sapiens
accattagcaagattaaccaa

SEQ ID NO: 33548 - DNA, 20 bp, Homo sapiens
agccctaaacactgatgtca

SEQ ID NO: 33549 - DNA, 19 bp, Homo sapiens
atgcttgctccccacacta

SEQ ID NO: 33550 - DNA, 17 bp, Homo sapiens
cattatttctaacactt

SEQ ID NO: 33551 - DNA, 18 bp, Homo sapiens
ctgggcagttcgggcttt

SEQ ID NO: 33552 - DNA, 22 bp, Homo sapiens
gaaccaggagaaaggggtgagg

SEQ ID NO: 33553 - DNA, 21 bp, Homo sapiens
ggaacagcagccgggctgtgg

SEQ ID NO: 33554 - DNA, 18 bp, Homo sapiens
ggacatggcccctggctg

SEQ ID NO: 33555 - DNA, 20 bp, Homo sapiens
gggggtgcgggtgtgtgctg

SEQ ID NO: 33556 - DNA, 20 bp, Homo sapiens
tcccgcttcccacctgcatc

SEQ ID NO: 33557 - DNA, 17 bp, Homo sapiens
ttttgggatgaaatgtc

SEQ ID NO: 33558 - DNA, 15 bp, Homo sapiens
acctgttgtctgtta

SEQ ID NO: 33559 - DNA, 22 bp, Homo sapiens
atctcggttcactgcaacctct

SEQ ID NO: 33560 - DNA, 23 bp, Homo sapiens
ccatttccaaagaacccaagtag

SEQ ID NO: 33561 - DNA, 19 bp, Homo sapiens
cctcatgtcctcgcctctg

SEQ ID NO: 33562 - DNA, 20 bp, Homo sapiens
cctctgcctcccaggttcaa

SEQ ID NO: 33563 - DNA, 19 bp, Homo sapiens
ctgcaacctctgcctccca

SEQ ID NO: 33564 - DNA, 21 bp, Homo sapiens
gctcctcatgtcctcgcctct

SEQ ID NO: 33565 - DNA, 23 bp, Homo sapiens
tttaagtgatcttttgtgatttt

SEQ ID NO: 33566 - DNA, 18 bp, Homo sapiens
caatatatagtgataatg

SEQ ID NO: 33567 - DNA, 21 bp, Homo sapiens
ctttggtggtggaagaaagaa

SEQ ID NO: 33568 - DNA, 21 bp, Homo sapiens
actttagaaaagatcatcttc

SEQ ID NO: 33569 - DNA, 16 bp, Homo sapiens
agtactacagttttca

SEQ ID NO: 33570 - DNA, 22 bp, Homo sapiens
cagtgttttaccgtccccagcc

SEQ ID NO: 33571 - DNA, 21 bp, Homo sapiens
tggacacatggaagggagcca

SEQ ID NO: 33572 - DNA, 19 bp, Homo sapiens
acagcaacaggcccagtga

SEQ ID NO: 33573 - DNA, 19 bp, Homo sapiens
ccttcccctccagtgcgca

SEQ ID NO: 33574 - DNA, 22 bp, Homo sapiens
ctttctgggaataaacatcaca

SEQ ID NO: 33575 - DNA, 22 bp, Homo sapiens
gtgtccagaattggtgggttct

SEQ ID NO: 33576 - DNA, 19 bp, Homo sapiens
tgggtggatcacttgaagc

SEQ ID NO: 33577 - DNA, 18 bp, Homo sapiens
caccacacaccggaccac

SEQ ID NO: 33578 - DNA, 19 bp, Homo sapiens
acgcgattctcctgcctca

SEQ ID NO: 33579 - DNA, 19 bp, Homo sapiens
atgacgtggtgggctacgt

SEQ ID NO: 33580 - DNA, 22 bp, Homo sapiens
cccttccccaccccccgggcct

SEQ ID NO: 33581 - DNA, 19 bp, Homo sapiens
cgcagggcagagccggcca

SEQ ID NO: 33582 - DNA, 22 bp, Homo sapiens
ctttacacccccacctgcctct

SEQ ID NO: 33583 - DNA, 19 bp, Homo sapiens
gcctcgccttcccacccca

SEQ ID NO: 33584 - DNA, 19 bp, Homo sapiens
gggcagagccggccaccta

SEQ ID NO: 33585 - DNA, 15 bp, Homo sapiens
gggcgagggggtgca

SEQ ID NO: 33586 - DNA, 19 bp, Homo sapiens
gtgctttggtgtattgagt

SEQ ID NO: 33587 - DNA, 19 bp, Homo sapiens
gtgctttggtgtattgagt

SEQ ID NO: 33588 - DNA, 19 bp, Homo sapiens
gtgctttggtgtattgagt

SEQ ID NO: 33589 - DNA, 19 bp, Homo sapiens
gtgctttggtgtattgagt

SEQ ID NO: 33590 - DNA, 19 bp, Homo sapiens
gtgctttggtgtattgagt

SEQ ID NO: 33591 - DNA, 19 bp, Homo sapiens
gtgctttggtgtattgagt

SEQ ID NO: 33592 - DNA, 19 bp, Homo sapiens
gtgctttggtgtattgagt

SEQ ID NO: 33593 - DNA, 19 bp, Homo sapiens
gtgctttggtgtattgagt

SEQ ID NO: 33594 - DNA, 19 bp, Homo sapiens
gtgctttggtgtattgagt

SEQ ID NO: 33595 - DNA, 19 bp, Homo sapiens
gtgctttggtgtattgagt

SEQ ID NO: 33596 - DNA, 19 bp, Homo sapiens
gtgctttggtgtattgagt

SEQ ID NO: 33597 - DNA, 19 bp, Homo sapiens
gtgctttggtgtattgagt

SEQ ID NO: 33598 - DNA, 19 bp, Homo sapiens
gtgctttggtgtattgagt

SEQ ID NO: 33599 - DNA, 19 bp, Homo sapiens
gtgctttggtgtattgagt

SEQ ID NO: 33600 - DNA, 19 bp, Homo sapiens
gtgctttggtgtattgagt

SEQ ID NO: 33601 - DNA, 19 bp, Homo sapiens
gtgctttggtgtattgagt

SEQ ID NO: 33602 - DNA, 19 bp, Homo sapiens
gtgctttggtgtattgagt

SEQ ID NO: 33603 - DNA, 19 bp, Homo sapiens
gtgctttggtgtattgagt

SEQ ID NO: 33604 - DNA, 19 bp, Homo sapiens
gtgctttggtgtattgagt

SEQ ID NO: 33605 - DNA, 19 bp, Homo sapiens
gtgctttggtgtattgagt

SEQ ID NO: 33606 - DNA, 19 bp, Homo sapiens
gtgctttggtgtattgagt

SEQ ID NO: 33607 - DNA, 25 bp, Homo sapiens
tgggcagctgctactcagtgccaac

SEQ ID NO: 33608 - DNA, 20 bp, Homo sapiens
agcttcttgtattggcagtg

SEQ ID NO: 33609 - DNA, 22 bp, Homo sapiens
ccacctcttcctgaaagtcctc

SEQ ID NO: 33610 - DNA, 21 bp, Homo sapiens
ctctgggactaagcctgcgag

SEQ ID NO: 33611 - DNA, 20 bp, Homo sapiens
gacgacaggaaatggtgaca

SEQ ID NO: 33612 - DNA, 19 bp, Homo sapiens
gccagatgcctctcaggag

SEQ ID NO: 33613 - DNA, 21 bp, Homo sapiens
gctcccctgttttcttcctct

SEQ ID NO: 33614 - DNA, 21 bp, Homo sapiens
gctctgggactaagcctgcga

SEQ ID NO: 33615 - DNA, 21 bp, Homo sapiens
tgggggcggcggggctaggac

SEQ ID NO: 33616 - DNA, 19 bp, Homo sapiens
aacagattagaggccattg

SEQ ID NO: 33617 - DNA, 18 bp, Homo sapiens
ccagaaaggccttaatga

SEQ ID NO: 33618 - DNA, 18 bp, Homo sapiens
cgatggtctccatgtatt

SEQ ID NO: 33619 - DNA, 19 bp, Homo sapiens
gtcttctgtcctgatcagg

SEQ ID NO: 33620 - DNA, 25 bp, Homo sapiens
tgacccagcagagcactccctccca

SEQ ID NO: 33621 - DNA, 19 bp, Homo sapiens
aggctaacctttctaagct

SEQ ID NO: 33622 - DNA, 17 bp, Homo sapiens
atcgtaagaatgactga

SEQ ID NO: 33623 - DNA, 22 bp, Homo sapiens
ccagattaatgcataaagccaa

SEQ ID NO: 33624 - DNA, 15 bp, Homo sapiens
cccagttgcctttaa

SEQ ID NO: 33625 - DNA, 17 bp, Homo sapiens
gcattgcaccctggtgt

SEQ ID NO: 33626 - DNA, 21 bp, Homo sapiens
ccaactgagactcccatcttt

SEQ ID NO: 33627 - DNA, 19 bp, Homo sapiens
cttttcctgttttatctca

SEQ ID NO: 33628 - DNA, 19 bp, Homo sapiens
tggccacctcctctgagaa

SEQ ID NO: 33629 - DNA, 20 bp, Homo sapiens
ccagatgcccgccccgcccc

SEQ ID NO: 33630 - DNA, 20 bp, Homo sapiens
ccagcccctagccccactcc

SEQ ID NO: 33631 - DNA, 22 bp, Homo sapiens
cccatactgggaggctggcgag

SEQ ID NO: 33632 - DNA, 17 bp, Homo sapiens
ctgaaatggttcccacc

SEQ ID NO: 33633 - DNA, 18 bp, Homo sapiens
gcccagcccctagcccca

SEQ ID NO: 33634 - DNA, 24 bp, Homo sapiens
tcctgatggctgtggagtctgtgg

SEQ ID NO: 33635 - DNA, 22 bp, Homo sapiens
tgtctgagccccggctgtgatg

SEQ ID NO: 33636 - DNA, 22 bp, Homo sapiens
ggtgattgtgaagtgctgacca

SEQ ID NO: 33637 - DNA, 20 bp, Homo sapiens
tcctcttatttagtgttacc

SEQ ID NO: 33638 - DNA, 23 bp, Homo sapiens
ttaaaaataatagggaatgtggt

SEQ ID NO: 33639 - DNA, 21 bp, Homo sapiens
ccacattcattcctccatttc

SEQ ID NO: 33640 - DNA, 18 bp, Homo sapiens
ccagtagagctgcccttc

SEQ ID NO: 33641 - DNA, 19 bp, Homo sapiens
ctggagataagtaatggtg

SEQ ID NO: 33642 - DNA, 17 bp, Homo sapiens
gaccagccacaccaagt

SEQ ID NO: 33643 - DNA, 18 bp, Homo sapiens
gagcaggacgttgagata

SEQ ID NO: 33644 - DNA, 18 bp, Homo sapiens
gtacattcactgctgcca

SEQ ID NO: 33645 - DNA, 22 bp, Homo sapiens
tagatccttgaaagcaatgtca

SEQ ID NO: 33646 - DNA, 23 bp, Homo sapiens
tccatacagcaagacacctggca

SEQ ID NO: 33647 - DNA, 22 bp, Homo sapiens
tctgcgaaggcccctgatggag

SEQ ID NO: 33648 - DNA, 21 bp, Homo sapiens
tggggtcatgagagctagtta

SEQ ID NO: 33649 - DNA, 16 bp, Homo sapiens
tttcttcctagtatca

SEQ ID NO: 33650 - DNA, 18 bp, Homo sapiens
agctggtctgacactacg

SEQ ID NO: 33651 - DNA, 18 bp, Homo sapiens
cagaaggccattgatgaa

SEQ ID NO: 33652 - DNA, 20 bp, Homo sapiens
ccctccccagtgtcttccca

SEQ ID NO: 33653 - DNA, 22 bp, Homo sapiens
gagaccatcctgcccatccgag

SEQ ID NO: 33654 - DNA, 24 bp, Homo sapiens
gcctcctgttgaccagcctggttt

SEQ ID NO: 33655 - DNA, 19 bp, Homo sapiens
tgctgctgtccagctgcta

SEQ ID NO: 33656 - DNA, 19 bp, Homo sapiens
aagcaattctcctgcctca

SEQ ID NO: 33657 - DNA, 17 bp, Homo sapiens
caaggctgcctgcctca

SEQ ID NO: 33658 - DNA, 21 bp, Homo sapiens
cagaaagtcacagcacatgtg

SEQ ID NO: 33659 - DNA, 18 bp, Homo sapiens
cagtggtgcaatctcacc

SEQ ID NO: 33660 - DNA, 19 bp, Homo sapiens
cttctgtgactaattttta

SEQ ID NO: 33661 - DNA, 18 bp, Homo sapiens
ggtatgagcagcctctca

SEQ ID NO: 33662 - DNA, 18 bp, Homo sapiens
tccgcctcctgggttcaa

SEQ ID NO: 33663 - DNA, 20 bp, Homo sapiens
agtttaagacttttgtcatg

SEQ ID NO: 33664 - DNA, 21 bp, Homo sapiens
ccaaaggtagacctgctgtta

SEQ ID NO: 33665 - DNA, 17 bp, Homo sapiens
cctctttaactcagtta

SEQ ID NO: 33666 - DNA, 20 bp, Homo sapiens
ctgctagagcctactgtgaa

SEQ ID NO: 33667 - DNA, 24 bp, Homo sapiens
gctagtcagtatgcaccaccacag

SEQ ID NO: 33668 - DNA, 19 bp, Homo sapiens
cgcccccacctccaccctc

SEQ ID NO: 33669 - DNA, 19 bp, Homo sapiens
ttgcaagattccaagttct

SEQ ID NO: 33670 - DNA, 26 bp, Homo sapiens
atctgggtgccatcattttctggttc

SEQ ID NO: 33671 - DNA, 23 bp, Homo sapiens
agctcttcaactatgtctttgaa

SEQ ID NO: 33672 - DNA, 24 bp, Homo sapiens
aggatggaatcaaacaatatgcaa

SEQ ID NO: 33673 - DNA, 21 bp, Homo sapiens
attgacattccagtagagcaa

SEQ ID NO: 33674 - DNA, 22 bp, Homo sapiens
gcaaatacttcagtgcctgcta

SEQ ID NO: 33675 - DNA, 19 bp, Homo sapiens
gcaggcttgcaacctctca

SEQ ID NO: 33676 - DNA, 21 bp, Homo sapiens
ttctggcctcagttctgtgag

SEQ ID NO: 33677 - DNA, 18 bp, Homo sapiens
aggggattattcaaagta

SEQ ID NO: 33678 - DNA, 16 bp, Homo sapiens
tgaagagattgaaaga

SEQ ID NO: 33679 - DNA, 16 bp, Homo sapiens
tgcaacatttctctga

SEQ ID NO: 33680 - DNA, 22 bp, Homo sapiens
aaacttgtggggaaccacattg

SEQ ID NO: 33681 - DNA, 21 bp, Homo sapiens
catgatctgtacctaagctca

SEQ ID NO: 33682 - DNA, 20 bp, Homo sapiens
cggagtgtggagctggacca

SEQ ID NO: 33683 - DNA, 17 bp, Homo sapiens
agatggattttatctgg

SEQ ID NO: 33684 - DNA, 17 bp, Homo sapiens
cccatctcaccacactg

SEQ ID NO: 33685 - DNA, 21 bp, Homo sapiens
gctgttttgtctgacaccaga

SEQ ID NO: 33686 - DNA, 24 bp, Homo sapiens
gtgtgtccattagacatttggcta

SEQ ID NO: 33687 - DNA, 20 bp, Homo sapiens
aggtagcctgagcctagtta

SEQ ID NO: 33688 - DNA, 21 bp, Homo sapiens
cagatgccttaatgtgaagct

SEQ ID NO: 33689 - DNA, 20 bp, Homo sapiens
cttaacatttaaaactgata

SEQ ID NO: 33690 - DNA, 19 bp, Homo sapiens
tgctaacatcactgtcata

SEQ ID NO: 33691 - DNA, 24 bp, Homo sapiens
tttctttatggttttaaaactctt

SEQ ID NO: 33692 - DNA, 17 bp, Homo sapiens
tggtggaaggcttggag

SEQ ID NO: 33693 - DNA, 24 bp, Homo sapiens
ttaaaaactacatacaaagttgtg

SEQ ID NO: 33694 - DNA, 22 bp, Homo sapiens
catccagtatttaacccagcca

SEQ ID NO: 33695 - DNA, 16 bp, Homo sapiens
gctgcaacatgggcgg

SEQ ID NO: 33696 - DNA, 18 bp, Homo sapiens
gtagatactggaaatgta

SEQ ID NO: 33697 - DNA, 18 bp, Homo sapiens
tctattttgaaagtggta

SEQ ID NO: 33698 - DNA, 21 bp, Homo sapiens
caatttgttgtgattttcagc

SEQ ID NO: 33699 - DNA, 19 bp, Homo sapiens
cagaaaaatgattgtttca

SEQ ID NO: 33700 - DNA, 20 bp, Homo sapiens
ccagaaaaatgattgtttca

SEQ ID NO: 33701 - DNA, 18 bp, Homo sapiens
cttttatatcccattttg

SEQ ID NO: 33702 - DNA, 17 bp, Homo sapiens
caaaaatactgtcctgg

SEQ ID NO: 33703 - DNA, 18 bp, Homo sapiens
ccctaccagatgccagca

SEQ ID NO: 33704 - DNA, 16 bp, Homo sapiens
ccttttttcccctacc

SEQ ID NO: 33705 - DNA, 21 bp, Homo sapiens
gcctgttccgccggagcagca

SEQ ID NO: 33706 - DNA, 22 bp, Homo sapiens
gagccaagatcatgccactgca

SEQ ID NO: 33707 - DNA, 21 bp, Homo sapiens
acgagggtggcccacctctca

SEQ ID NO: 33708 - DNA, 21 bp, Homo sapiens
agccttccctttggaatccca

SEQ ID NO: 33709 - DNA, 21 bp, Homo sapiens
gagctactaaacgctcagtga

SEQ ID NO: 33710 - DNA, 18 bp, Homo sapiens
tccctggcttagccgtca

SEQ ID NO: 33711 - DNA, 20 bp, Homo sapiens
ttctaaatcccagcaaccaa

SEQ ID NO: 33712 - DNA, 17 bp, Homo sapiens
agaggttatcttaccat

SEQ ID NO: 33713 - DNA, 18 bp, Homo sapiens
cagatctacaatttgcta

SEQ ID NO: 33714 - DNA, 18 bp, Homo sapiens
ctttttgaaatgcagttt

SEQ ID NO: 33715 - DNA, 22 bp, Homo sapiens
tactgtaaaacagttttataca

SEQ ID NO: 33716 - DNA, 20 bp, Homo sapiens
taggaaacttttgcagtttg

SEQ ID NO: 33717 - DNA, 16 bp, Homo sapiens
ttcactgaagcctatg

SEQ ID NO: 33718 - DNA, 18 bp, Homo sapiens
atgcaacaacaacacaca

SEQ ID NO: 33719 - DNA, 24 bp, Homo sapiens
cagtactttgtccatttgggacct

SEQ ID NO: 33720 - DNA, 20 bp, Homo sapiens
gcgcgcctctgccgagcgca

SEQ ID NO: 33721 - DNA, 22 bp, Homo sapiens
acctggcatgactgtttgtttc

SEQ ID NO: 33722 - DNA, 20 bp, Homo sapiens
acgaaagggggtggccttga

SEQ ID NO: 33723 - DNA, 21 bp, Homo sapiens
cctgtgtgccccagcaatcta

SEQ ID NO: 33724 - DNA, 22 bp, Homo sapiens
cttgccttttaggatgttctta

SEQ ID NO: 33725 - DNA, 21 bp, Homo sapiens
tgatgttcttcctggaattca

SEQ ID NO: 33726 - DNA, 20 bp, Homo sapiens
ttcctgtgctcatctccgga

SEQ ID NO: 33727 - DNA, 24 bp, Homo sapiens
ttgtttctcatcttcataatacca

SEQ ID NO: 33728 - DNA, 21 bp, Homo sapiens
tttcactgtgaattcactttt

SEQ ID NO: 33729 - DNA, 19 bp, Homo sapiens
gcctgggcagagggcccgg

SEQ ID NO: 33730 - DNA, 22 bp, Homo sapiens
aggtctcactgtgttgcccacg

SEQ ID NO: 33731 - DNA, 18 bp, Homo sapiens
ccacagtgccttgatcag

SEQ ID NO: 33732 - DNA, 19 bp, Homo sapiens
cttcaaggctgttttgact

SEQ ID NO: 33733 - DNA, 21 bp, Homo sapiens
gccgagtgacaggccgcagcc

SEQ ID NO: 33734 - DNA, 17 bp, Homo sapiens
gcctccgccccggcctc

SEQ ID NO: 33735 - DNA, 18 bp, Homo sapiens
ggcttctgcgagtcctcg

SEQ ID NO: 33736 - DNA, 20 bp, Homo sapiens
gtacggccgctctgctgcta

SEQ ID NO: 33737 - DNA, 18 bp, Homo sapiens
tggagaggagtctattca

SEQ ID NO: 33738 - DNA, 22 bp, Homo sapiens
gctctacttcaggtttcactcc

SEQ ID NO: 33739 - DNA, 20 bp, Homo sapiens
acgtgcttttattatatcca

SEQ ID NO: 33740 - DNA, 22 bp, Homo sapiens
agaagagagagcagagcccctt

SEQ ID NO: 33741 - DNA, 19 bp, Homo sapiens
aggcaaggccctttctgta

SEQ ID NO: 33742 - DNA, 21 bp, Homo sapiens
aggctaggattgggctagtta

SEQ ID NO: 33743 - DNA, 19 bp, Homo sapiens
ccaagattgcactactgca

SEQ ID NO: 33744 - DNA, 19 bp, Homo sapiens
ccaagccacctgcttcctc

SEQ ID NO: 33745 - DNA, 19 bp, Homo sapiens
gaaagtggcttgccaaaac

SEQ ID NO: 33746 - DNA, 20 bp, Homo sapiens
taggacttgaagtctagtta

SEQ ID NO: 33747 - DNA, 20 bp, Homo sapiens
tccaccagcggattctgaga

SEQ ID NO: 33748 - DNA, 18 bp, Homo sapiens
tgagtggatcacctgagg

SEQ ID NO: 33749 - DNA, 23 bp, Homo sapiens
aaaattccaatgactgtgctgtg

SEQ ID NO: 33750 - DNA, 21 bp, Homo sapiens
accagagaaacagagatgggc

SEQ ID NO: 33751 - DNA, 18 bp, Homo sapiens
cctgcaacctccacctcc

SEQ ID NO: 33752 - DNA, 19 bp, Homo sapiens
ggcatgcaccaccacgcca

SEQ ID NO: 33753 - DNA, 18 bp, Homo sapiens
gtccactgagaaattaga

SEQ ID NO: 33754 - DNA, 18 bp, Homo sapiens
tccacctcctgggttcaa

SEQ ID NO: 33755 - DNA, 19 bp, Homo sapiens
aaccctgtcccaccccacc

SEQ ID NO: 33756 - DNA, 21 bp, Homo sapiens
aatcgccaccccctcctgcca

SEQ ID NO: 33757 - DNA, 19 bp, Homo sapiens
cgtccccactgggcccaca

SEQ ID NO: 33758 - DNA, 21 bp, Homo sapiens
ctccctgatggccatgctgag

SEQ ID NO: 33759 - DNA, 22 bp, Homo sapiens
gagcagccccagcgcctcatct

SEQ ID NO: 33760 - DNA, 20 bp, Homo sapiens
gaggtgggactggcctctcc

SEQ ID NO: 33761 - DNA, 18 bp, Homo sapiens
ccccaccaggtggcagca

SEQ ID NO: 33762 - DNA, 22 bp, Homo sapiens
ccgcgagttcaaccgcaaccag

SEQ ID NO: 33763 - DNA, 16 bp, Homo sapiens
tgagatccattcttcc

SEQ ID NO: 33764 - DNA, 21 bp, Homo sapiens
ttttggctttcgagggcctgt

SEQ ID NO: 33765 - DNA, 21 bp, Homo sapiens
ggcctcaaagttcttctttac

SEQ ID NO: 33766 - DNA, 18 bp, Homo sapiens
gtgtgtatgaaaagcttg

SEQ ID NO: 33767 - DNA, 16 bp, Homo sapiens
tttttaacatgtagtt

SEQ ID NO: 33768 - DNA, 16 bp, Homo sapiens
gctgttcagggtgaca

SEQ ID NO: 33769 - DNA, 19 bp, Homo sapiens
ttcttcagtccttaagctt

SEQ ID NO: 33770 - DNA, 18 bp, Homo sapiens
accaaggcaggcctgtta

SEQ ID NO: 33771 - DNA, 18 bp, Homo sapiens
catcagaggacacactca

SEQ ID NO: 33772 - DNA, 17 bp, Homo sapiens
ctactgatgttttgatg

SEQ ID NO: 33773 - DNA, 19 bp, Homo sapiens
cactttcacaaaaaacgtt

SEQ ID NO: 33774 - DNA, 21 bp, Homo sapiens
tccaccctgcctctgacagca

SEQ ID NO: 33775 - DNA, 18 bp, Homo sapiens
agtgagagtggcgcccca

SEQ ID NO: 33776 - DNA, 19 bp, Homo sapiens
cactttcacaaaaaacgtt

SEQ ID NO: 33777 - DNA, 22 bp, Homo sapiens
tagttttgaaagcctcacctct

SEQ ID NO: 33778 - DNA, 21 bp, Homo sapiens
tccaccctgcctctgacagca

SEQ ID NO: 33779 - DNA, 22 bp, Homo sapiens
ccaaggttccctctctgttcct

SEQ ID NO: 33780 - DNA, 21 bp, Homo sapiens
cctgctgcttcttattcccca

SEQ ID NO: 33781 - DNA, 18 bp, Homo sapiens
ctagaatgctctgatcca

SEQ ID NO: 33782 - DNA, 22 bp, Homo sapiens
gaccctggaaccctacacttga

SEQ ID NO: 33783 - DNA, 19 bp, Homo sapiens
gcacagcagccatacccct

SEQ ID NO: 33784 - DNA, 20 bp, Homo sapiens
gtcaagagtatttgatcaga

SEQ ID NO: 33785 - DNA, 20 bp, Homo sapiens
tcaccatcattaccaccatc

SEQ ID NO: 33786 - DNA, 24 bp, Homo sapiens
tctgaagacagcacagcagccata

SEQ ID NO: 33787 - DNA, 24 bp, Homo sapiens
aattgtgtttgttttaaggaatga

SEQ ID NO: 33788 - DNA, 16 bp, Homo sapiens
acttgaccctatttga

SEQ ID NO: 33789 - DNA, 20 bp, Homo sapiens
agctacagtgatcttagctt

SEQ ID NO: 33790 - DNA, 18 bp, Homo sapiens
caacctcaagctctttta

SEQ ID NO: 33791 - DNA, 21 bp, Homo sapiens
catgatctacaaacatggtct

SEQ ID NO: 33792 - DNA, 22 bp, Homo sapiens
cttctaatcttggcctccatca

SEQ ID NO: 33793 - DNA, 23 bp, Homo sapiens
ggaaactgaaactctgtggaata

SEQ ID NO: 33794 - DNA, 20 bp, Homo sapiens
tgtaattcagcttctcagat

SEQ ID NO: 33795 - DNA, 24 bp, Homo sapiens
ggccaaaatatgctatatttgtat

SEQ ID NO: 33796 - DNA, 22 bp, Homo sapiens
ttttggtggcatgcttgctgag

SEQ ID NO: 33797 - DNA, 19 bp, Homo sapiens
aagggaaaaagttgtatca

SEQ ID NO: 33798 - DNA, 16 bp, Homo sapiens
atatcttaagaatgtg

SEQ ID NO: 33799 - DNA, 23 bp, Homo sapiens
caagagggctttattacacctca

SEQ ID NO: 33800 - DNA, 17 bp, Homo sapiens
ccagaagtggtgcgcca

SEQ ID NO: 33801 - DNA, 22 bp, Homo sapiens
gacacatatcattctgtgatta

SEQ ID NO: 33802 - DNA, 15 bp, Homo sapiens
tgtccagaagagtca

SEQ ID NO: 33803 - DNA, 23 bp, Homo sapiens
aaccaaggctgctgttcatccca

SEQ ID NO: 33804 - DNA, 24 bp, Homo sapiens
cccaaggcatcttaccaacagctg

SEQ ID NO: 33805 - DNA, 17 bp, Homo sapiens
ctgagccctcccagggc

SEQ ID NO: 33806 - DNA, 18 bp, Homo sapiens
ggacaccctgggctacaa

SEQ ID NO: 33807 - DNA, 24 bp, Homo sapiens
tctgtatggcacaaactttcctcc

SEQ ID NO: 33808 - DNA, 24 bp, Homo sapiens
agtgcttggacggaacccggcgct

SEQ ID NO: 33809 - DNA, 21 bp, Homo sapiens
aaagagacctgaggttcatcc

SEQ ID NO: 33810 - DNA, 20 bp, Homo sapiens
aaatggttgacacctttaca

SEQ ID NO: 33811 - DNA, 21 bp, Homo sapiens
ctcatttgacacactattaga

SEQ ID NO: 33812 - DNA, 19 bp, Homo sapiens
ggaattttctagaatctca

SEQ ID NO: 33813 - DNA, 19 bp, Homo sapiens
gtcctccaagagaaccctg

SEQ ID NO: 33814 - DNA, 22 bp, Homo sapiens
cccttgcttccaaagcgaacca

SEQ ID NO: 33815 - DNA, 25 bp, Homo sapiens
aaaacggggcacccactcccacctc

SEQ ID NO: 33816 - DNA, 17 bp, Homo sapiens
caaacatggacctgttg

SEQ ID NO: 33817 - DNA, 19 bp, Homo sapiens
ccacctgccctctccccca

SEQ ID NO: 33818 - DNA, 19 bp, Homo sapiens
cctacgtgcggcccggtgg

SEQ ID NO: 33819 - DNA, 22 bp, Homo sapiens
cctggagaggcggacgatgggc

SEQ ID NO: 33820 - DNA, 21 bp, Homo sapiens
gcctgggatgatgcttggtct

SEQ ID NO: 33821 - DNA, 19 bp, Homo sapiens
ggcacccactcccacctcc

SEQ ID NO: 33822 - DNA, 19 bp, Homo sapiens
ggtagaatcagtagagcca

SEQ ID NO: 33823 - DNA, 17 bp, Homo sapiens
taaaaaaagcaaagatg

SEQ ID NO: 33824 - DNA, 18 bp, Homo sapiens
tctaactaatacccccct

SEQ ID NO: 33825 - DNA, 18 bp, Homo sapiens
tctgttacctgtttgctg

SEQ ID NO: 33826 - DNA, 18 bp, Homo sapiens
ttcctgtcccatcattac

SEQ ID NO: 33827 - DNA, 19 bp, Homo sapiens
ttgaggccaccaagctcct

SEQ ID NO: 33828 - DNA, 21 bp, Homo sapiens
ttgggaacagcccctgtgaca

SEQ ID NO: 33829 - DNA, 18 bp, Homo sapiens
atataccaagaacattca

SEQ ID NO: 33830 - DNA, 19 bp, Homo sapiens
caggtgcaaaggcagctta

SEQ ID NO: 33831 - DNA, 20 bp, Homo sapiens
ccatattcaatatcatacca

SEQ ID NO: 33832 - DNA, 24 bp, Homo sapiens
gctgtaatgtttttaaatgcagtg

SEQ ID NO: 33833 - DNA, 20 bp, Homo sapiens
gcttagcaaaatacttttaa

SEQ ID NO: 33834 - DNA, 22 bp, Homo sapiens
taagaacatagtacgccagtgt

SEQ ID NO: 33835 - DNA, 17 bp, Homo sapiens
tagtcaaacccagggta

SEQ ID NO: 33836 - DNA, 20 bp, Homo sapiens
ttgaaaattgatttacctca

SEQ ID NO: 33837 - DNA, 24 bp, Homo sapiens
ttttatagatttaatatcataaca

SEQ ID NO: 33838 - DNA, 22 bp, Homo sapiens
ttttggtgaacctgacttgtgg

SEQ ID NO: 33839 - DNA, 21 bp, Homo sapiens
cacactcaaagttgtctcttt

SEQ ID NO: 33840 - DNA, 20 bp, Homo sapiens
ctgcttcatcttttatctca

SEQ ID NO: 33841 - DNA, 18 bp, Homo sapiens
acaaacacatctgcccaa

SEQ ID NO: 33842 - DNA, 17 bp, Homo sapiens
agttccttttctgtcct

SEQ ID NO: 33843 - DNA, 17 bp, Homo sapiens
agttttctatttcccca

SEQ ID NO: 33844 - DNA, 19 bp, Homo sapiens
attactgccctatgttgtc

SEQ ID NO: 33845 - DNA, 17 bp, Homo sapiens
caaacacatctgcccaa

SEQ ID NO: 33846 - DNA, 22 bp, Homo sapiens
ctccctctctcttctctttctc

SEQ ID NO: 33847 - DNA, 21 bp, Homo sapiens
ctctctctctctccctctctc

SEQ ID NO: 33848 - DNA, 22 bp, Homo sapiens
ggttgttcattttttttttcaa

SEQ ID NO: 33849 - DNA, 18 bp, Homo sapiens
tagtgtgtaagttttcta

SEQ ID NO: 33850 - DNA, 19 bp, Homo sapiens
tgaacccaacttttcccca

SEQ ID NO: 33851 - DNA, 18 bp, Homo sapiens
atcccataccagcaccgt

SEQ ID NO: 33852 - DNA, 18 bp, Homo sapiens
cccaggcatcccatacca

SEQ ID NO: 33853 - DNA, 20 bp, Homo sapiens
ccccggccgcccctcgcagc

SEQ ID NO: 33854 - DNA, 17 bp, Homo sapiens
gcccgaggcgcagggga

SEQ ID NO: 33855 - DNA, 27 bp, Homo sapiens
ggttgatttttgtggtgttttgtttaa

SEQ ID NO: 33856 - DNA, 24 bp, Homo sapiens
ttttgtggtgttttgtttaataga

SEQ ID NO: 33857 - DNA, 20 bp, Homo sapiens
gtcttccaactgaaatctca

SEQ ID NO: 33858 - DNA, 23 bp, Homo sapiens
tatctccaacttcctaaaggctt

SEQ ID NO: 33859 - DNA, 23 bp, Homo sapiens
aagcatctgggatcaccccactc

SEQ ID NO: 33860 - DNA, 24 bp, Homo sapiens
acacctgtcccccttccccaacca

SEQ ID NO: 33861 - DNA, 19 bp, Homo sapiens
caccaccgctgccaaccct

SEQ ID NO: 33862 - DNA, 21 bp, Homo sapiens
ccttccccaaccatggcccca

SEQ ID NO: 33863 - DNA, 18 bp, Homo sapiens
gactgtccttgggagttt

SEQ ID NO: 33864 - DNA, 17 bp, Homo sapiens
tgcagaatccagcccct

SEQ ID NO: 33865 - DNA, 24 bp, Homo sapiens
acttgggccttcatgccatggcct

SEQ ID NO: 33866 - DNA, 20 bp, Homo sapiens
agaatttccccccagttccc

SEQ ID NO: 33867 - DNA, 20 bp, Homo sapiens
atgtggcccacagtaggtga

SEQ ID NO: 33868 - DNA, 21 bp, Homo sapiens
gtcctccatgaggacatggga

SEQ ID NO: 33869 - DNA, 22 bp, Homo sapiens
tgtggtatctccccctaccaca

SEQ ID NO: 33870 - DNA, 19 bp, Homo sapiens
acttggcactgcgcacaca

SEQ ID NO: 33871 - DNA, 24 bp, Homo sapiens
agaaggactgtatctacacctgtt

SEQ ID NO: 33872 - DNA, 18 bp, Homo sapiens
ccaagacactatgccaat

SEQ ID NO: 33873 - DNA, 23 bp, Homo sapiens
ccaggacgaccagtgcatcctca

SEQ ID NO: 33874 - DNA, 21 bp, Homo sapiens
cctaccctccccagctttcca

SEQ ID NO: 33875 - DNA, 20 bp, Homo sapiens
ccttccccttccttctttcc

SEQ ID NO: 33876 - DNA, 20 bp, Homo sapiens
gccatagtaggggttctggg

SEQ ID NO: 33877 - DNA, 22 bp, Homo sapiens
gcctggaccttgttcttggctc

SEQ ID NO: 33878 - DNA, 24 bp, Homo sapiens
gtatgtgtggacatgtgttcactg

SEQ ID NO: 33879 - DNA, 18 bp, Homo sapiens
cactgcctgccttgctcc

SEQ ID NO: 33880 - DNA, 19 bp, Homo sapiens
cagctgcaacagacatcct

SEQ ID NO: 33881 - DNA, 17 bp, Homo sapiens
ccaccccatacctgctg

SEQ ID NO: 33882 - DNA, 18 bp, Homo sapiens
ccagtatttatctctgga

SEQ ID NO: 33883 - DNA, 17 bp, Homo sapiens
ctgagatacccattgct

SEQ ID NO: 33884 - DNA, 22 bp, Homo sapiens
ggaaagactgagatggttgcca

SEQ ID NO: 33885 - DNA, 21 bp, Homo sapiens
gtcctgaaaccgaatggcaga

SEQ ID NO: 33886 - DNA, 23 bp, Homo sapiens
tcactgggcccacagctgggcaa

SEQ ID NO: 33887 - DNA, 23 bp, Homo sapiens
tccaagttgtttactctgttcct

SEQ ID NO: 33888 - DNA, 27 bp, Homo sapiens
atggacagctttcctaacaagagatta

SEQ ID NO: 33889 - DNA, 19 bp, Homo sapiens
ccataattaacatcactta

SEQ ID NO: 33890 - DNA, 25 bp, Homo sapiens
aaatatgggctcctgatggacctca

SEQ ID NO: 33891 - DNA, 17 bp, Homo sapiens
acttctggaaacttcca

SEQ ID NO: 33892 - DNA, 19 bp, Homo sapiens
attccagtaatgtcattga

SEQ ID NO: 33893 - DNA, 23 bp, Homo sapiens
tggatccaacccagatgagactg

SEQ ID NO: 33894 - DNA, 20 bp, Homo sapiens
tttccatgccgaacaactca

SEQ ID NO: 33895 - DNA, 26 bp, Homo sapiens
aacccaggggtctgagcatggagcta

SEQ ID NO: 33896 - DNA, 19 bp, Homo sapiens
aagaccttcaagcttccaa

SEQ ID NO: 33897 - DNA, 22 bp, Homo sapiens
aggctgtcagactgacctgtaa

SEQ ID NO: 33898 - DNA, 20 bp, Homo sapiens
agtgaggaagggcatgttgt

SEQ ID NO: 33899 - DNA, 23 bp, Homo sapiens
catctcataaatgtcactcttta

SEQ ID NO: 33900 - DNA, 22 bp, Homo sapiens
ccaccgccgcgatgctcgcccg

SEQ ID NO: 33901 - DNA, 24 bp, Homo sapiens
ttccattggactggaggcttgtgg

SEQ ID NO: 33902 - DNA, 19 bp, Homo sapiens
atctctcagaccaatctca

SEQ ID NO: 33903 - DNA, 19 bp, Homo sapiens
cactttcctttcccactca

SEQ ID NO: 33904 - DNA, 19 bp, Homo sapiens
cagaaccagcaagtgctcc

SEQ ID NO: 33905 - DNA, 19 bp, Homo sapiens
catgaatgtttgaaaggaa

SEQ ID NO: 33906 - DNA, 18 bp, Homo sapiens
catggtaaaatgttctct

SEQ ID NO: 33907 - DNA, 21 bp, Homo sapiens
ccagggctctggatctcatca

SEQ ID NO: 33908 - DNA, 22 bp, Homo sapiens
ttgtttctttttctacatagca

SEQ ID NO: 33909 - DNA, 23 bp, Homo sapiens
ttttggtgacttaagcttatgaa

SEQ ID NO: 33910 - DNA, 20 bp, Homo sapiens
tccacctgaaacttggtgat

SEQ ID NO: 33911 - DNA, 19 bp, Homo sapiens
actaaaattctactggaga

SEQ ID NO: 33912 - DNA, 19 bp, Homo sapiens
ctgccacagcctgcctcca

SEQ ID NO: 33913 - DNA, 17 bp, Homo sapiens
cttgactcggtgtcaga

SEQ ID NO: 33914 - DNA, 22 bp, Homo sapiens
gatgtttgaaaacagttcctct

SEQ ID NO: 33915 - DNA, 18 bp, Homo sapiens
caagttcttggcctgcct

SEQ ID NO: 33916 - DNA, 16 bp, Homo sapiens
cccgcttcctgccatc

SEQ ID NO: 33917 - DNA, 16 bp, Homo sapiens
gcgcctgggattctga

SEQ ID NO: 33918 - DNA, 18 bp, Homo sapiens
ttagcacagagttcctca

SEQ ID NO: 33919 - DNA, 24 bp, Homo sapiens
agctggggcagggggccgtgccca

SEQ ID NO: 33920 - DNA, 24 bp, Homo sapiens
gcccaccccacccactgtggtctg

SEQ ID NO: 33921 - DNA, 23 bp, Homo sapiens
ccctccccggaggcgcctgtgga

SEQ ID NO: 33922 - DNA, 22 bp, Homo sapiens
agccatcgtggcccacttgaca

SEQ ID NO: 33923 - DNA, 19 bp, Homo sapiens
gccgcggcccgcctggcct

SEQ ID NO: 33924 - DNA, 18 bp, Homo sapiens
tcttcctctcttctcctc

SEQ ID NO: 33925 - DNA, 17 bp, Homo sapiens
tttatacacccggcacc

SEQ ID NO: 33926 - DNA, 20 bp, Homo sapiens
aaacacatgtttttttctga

SEQ ID NO: 33927 - DNA, 19 bp, Homo sapiens
aaagaagaaactgctcctg

SEQ ID NO: 33928 - DNA, 21 bp, Homo sapiens
accagaaggaacttcatcctg

SEQ ID NO: 33929 - DNA, 22 bp, Homo sapiens
agctcctcctcatgtttcaaca

SEQ ID NO: 33930 - DNA, 22 bp, Homo sapiens
cacccaccatccctccagccca

SEQ ID NO: 33931 - DNA, 19 bp, Homo sapiens
ccctcacaacctcccttta

SEQ ID NO: 33932 - DNA, 18 bp, Homo sapiens
cttgaagaaacccagggc

SEQ ID NO: 33933 - DNA, 23 bp, Homo sapiens
gatggtgtccacattttacccca

SEQ ID NO: 33934 - DNA, 19 bp, Homo sapiens
gctcagccgccctgcctcc

SEQ ID NO: 33935 - DNA, 18 bp, Homo sapiens
ggcctgcaaatcccattt

SEQ ID NO: 33936 - DNA, 22 bp, Homo sapiens
gggtgatgataaactgtggcca

SEQ ID NO: 33937 - DNA, 18 bp, Homo sapiens
tcccaggcagagctgcag

SEQ ID NO: 33938 - DNA, 24 bp, Homo sapiens
tgagatctcgagtttgggtttgtt

SEQ ID NO: 33939 - DNA, 19 bp, Homo sapiens
tttgagtccaggcctgcct

SEQ ID NO: 33940 - DNA, 22 bp, Homo sapiens
tttgcttgaacagccctcttct

SEQ ID NO: 33941 - DNA, 22 bp, Homo sapiens
actatgtaatggctatatttca

SEQ ID NO: 33942 - DNA, 17 bp, Homo sapiens
agcattaatcccaaagg

SEQ ID NO: 33943 - DNA, 17 bp, Homo sapiens
gaagaccacagcattaa

SEQ ID NO: 33944 - DNA, 20 bp, Homo sapiens
gtctcttgagtttcaacaga

SEQ ID NO: 33945 - DNA, 23 bp, Homo sapiens
taggtgggaaaaccatggtgctg

SEQ ID NO: 33946 - DNA, 19 bp, Homo sapiens
cctgcttccactcccctca

SEQ ID NO: 33947 - DNA, 17 bp, Homo sapiens
ggagagaaaggctcctt

SEQ ID NO: 33948 - DNA, 16 bp, Homo sapiens
tggacgacggctctgg

SEQ ID NO: 33949 - DNA, 19 bp, Homo sapiens
atgaagttcctgtgaacat

SEQ ID NO: 33950 - DNA, 21 bp, Homo sapiens
tgatgccattgatatatctaa

SEQ ID NO: 33951 - DNA, 18 bp, Homo sapiens
agatgggtcctagcctga

SEQ ID NO: 33952 - DNA, 20 bp, Homo sapiens
agtttcactctgttgcccag

SEQ ID NO: 33953 - DNA, 19 bp, Homo sapiens
ctgcaacctccgcctccca

SEQ ID NO: 33954 - DNA, 20 bp, Homo sapiens
cttcagctgcccttggtctt

SEQ ID NO: 33955 - DNA, 19 bp, Homo sapiens
gagtccaagataccactga

SEQ ID NO: 33956 - DNA, 19 bp, Homo sapiens
taggaaatagtccacttgc

SEQ ID NO: 33957 - DNA, 18 bp, Homo sapiens
tccgcctcccaggttcaa

SEQ ID NO: 33958 - DNA, 21 bp, Homo sapiens
tgccctgggtcaattctcctt

SEQ ID NO: 33959 - DNA, 21 bp, Homo sapiens
tggcctttacctatttcttca

SEQ ID NO: 33960 - DNA, 17 bp, Homo sapiens
atataaaggtttggtga

SEQ ID NO: 33961 - DNA, 19 bp, Homo sapiens
cacaactatgaacatttct

SEQ ID NO: 33962 - DNA, 22 bp, Homo sapiens
ggtgaatgagctggccagccca

SEQ ID NO: 33963 - DNA, 18 bp, Homo sapiens
aaaactgcaagaatatca

SEQ ID NO: 33964 - DNA, 18 bp, Homo sapiens
agggaaaactaataaagc

SEQ ID NO: 33965 - DNA, 18 bp, Homo sapiens
agtactacagccttccag

SEQ ID NO: 33966 - DNA, 18 bp, Homo sapiens
atcttgcaaataatcaga

SEQ ID NO: 33967 - DNA, 17 bp, Homo sapiens
gcaaaagctttgtgatg

SEQ ID NO: 33968 - DNA, 20 bp, Homo sapiens
gcaccaatctacaactatgt

SEQ ID NO: 33969 - DNA, 22 bp, Homo sapiens
gcatcccaaggccactaacaca

SEQ ID NO: 33970 - DNA, 20 bp, Homo sapiens
ggaaaactaataaagccaca

SEQ ID NO: 33971 - DNA, 17 bp, Homo sapiens
ggatcccacggactgtt

SEQ ID NO: 33972 - DNA, 17 bp, Homo sapiens
tattgtttttcccattg

SEQ ID NO: 33973 - DNA, 19 bp, Homo sapiens
tctggggattgtttggcct

SEQ ID NO: 33974 - DNA, 19 bp, Homo sapiens
caaataaaagttcatttcc

SEQ ID NO: 33975 - DNA, 19 bp, Homo sapiens
ctctggaagcagcgtgtga

SEQ ID NO: 33976 - DNA, 18 bp, Homo sapiens
gtctaatgcagtcaggag

SEQ ID NO: 33977 - DNA, 23 bp, Homo sapiens
accaactctgtttcctcattgcc

SEQ ID NO: 33978 - DNA, 19 bp, Homo sapiens
cattttcttttcaaaatta

SEQ ID NO: 33979 - DNA, 22 bp, Homo sapiens
cctaggcaatccattgacattt

SEQ ID NO: 33980 - DNA, 21 bp, Homo sapiens
ctccccactcaggcatctgat

SEQ ID NO: 33981 - DNA, 20 bp, Homo sapiens
tagaattttctacccttggc

SEQ ID NO: 33982 - DNA, 22 bp, Homo sapiens
tcacaccaactctgtttcctca

SEQ ID NO: 33983 - DNA, 17 bp, Homo sapiens
cagtaccagcatatgct

SEQ ID NO: 33984 - DNA, 19 bp, Homo sapiens
gtaccagcatatgctctga

SEQ ID NO: 33985 - DNA, 19 bp, Homo sapiens
aagaacttgtcaatcgcct

SEQ ID NO: 33986 - DNA, 20 bp, Homo sapiens
aagggaaggaagaggtccca

SEQ ID NO: 33987 - DNA, 20 bp, Homo sapiens
aaaatctcagttgtctttga

SEQ ID NO: 33988 - DNA, 22 bp, Homo sapiens
aattgaatattgttttgtctca

SEQ ID NO: 33989 - DNA, 24 bp, Homo sapiens
ctgaggttaatgtgaacactgctt

SEQ ID NO: 33990 - DNA, 18 bp, Homo sapiens
tttttgtgatttactttt

SEQ ID NO: 33991 - DNA, 17 bp, Homo sapiens
gcctgtcacccatccta

SEQ ID NO: 33992 - DNA, 20 bp, Homo sapiens
aacctcgttatatctcctgc

SEQ ID NO: 33993 - DNA, 23 bp, Homo sapiens
cctgcttcccttccaccacctca

SEQ ID NO: 33994 - DNA, 23 bp, Homo sapiens
tagacttgaagaacatgaacctg

SEQ ID NO: 33995 - DNA, 23 bp, Homo sapiens
tgattcagtggtcagatcatcca

SEQ ID NO: 33996 - DNA, 18 bp, Homo sapiens
agtagtgaccgtgcttta

SEQ ID NO: 33997 - DNA, 18 bp, Homo sapiens
gtgagcagtgtttggcta

SEQ ID NO: 33998 - DNA, 21 bp, Homo sapiens
tttaaaaaacggtgccaggta

SEQ ID NO: 33999 - DNA, 18 bp, Homo sapiens
ccaaaagccacgttgttt

SEQ ID NO: 34000 - DNA, 18 bp, Homo sapiens
ctttttacaaataatgct

SEQ ID NO: 34001 - DNA, 21 bp, Homo sapiens
ttgccttgtcttggatcctca

SEQ ID NO: 34002 - DNA, 18 bp, Homo sapiens
accgcagagttgtataat

SEQ ID NO: 34003 - DNA, 21 bp, Homo sapiens
ccaggcatacacaggaagcca

SEQ ID NO: 34004 - DNA, 16 bp, Homo sapiens
tcctgcagtttctgaa

SEQ ID NO: 34005 - DNA, 16 bp, Homo sapiens
aaacccagccccttgc

SEQ ID NO: 34006 - DNA, 18 bp, Homo sapiens
ccagccccttgcccacct

SEQ ID NO: 34007 - DNA, 17 bp, Homo sapiens
ctttgggagtttgtgaa

SEQ ID NO: 34008 - DNA, 21 bp, Homo sapiens
gccccttgcccacctgcctct

SEQ ID NO: 34009 - DNA, 18 bp, Homo sapiens
cctgattcctgaatcatt

SEQ ID NO: 34010 - DNA, 20 bp, Homo sapiens
cgagctgtagccaccctgct

SEQ ID NO: 34011 - DNA, 19 bp, Homo sapiens
tctggactgttttaatttt

SEQ ID NO: 34012 - DNA, 18 bp, Homo sapiens
tggaagctgaaacaccag

SEQ ID NO: 34013 - DNA, 22 bp, Homo sapiens
ccagcaccttgtgcccttgcca

SEQ ID NO: 34014 - DNA, 20 bp, Homo sapiens
agactctgattctacagtga

SEQ ID NO: 34015 - DNA, 19 bp, Homo sapiens
ctgtattgaatcagaatgc

SEQ ID NO: 34016 - DNA, 22 bp, Homo sapiens
ggaacagtattacagtgtccta

SEQ ID NO: 34017 - DNA, 21 bp, Homo sapiens
aagcatgcaaaaacacattga

SEQ ID NO: 34018 - DNA, 22 bp, Homo sapiens
acctgagctggggcctgtgctt

SEQ ID NO: 34019 - DNA, 19 bp, Homo sapiens
agtcagtcacaatctcccc

SEQ ID NO: 34020 - DNA, 19 bp, Homo sapiens
atcacaacgcccctatcca

SEQ ID NO: 34021 - DNA, 19 bp, Homo sapiens
cagtctggcaagcattgta

SEQ ID NO: 34022 - DNA, 19 bp, Homo sapiens
cctcaatcacctcatacca

SEQ ID NO: 34023 - DNA, 16 bp, Homo sapiens
cttgtctcagatctct

SEQ ID NO: 34024 - DNA, 19 bp, Homo sapiens
tagcttctggactaacatc

SEQ ID NO: 34025 - DNA, 24 bp, Homo sapiens
tctgtagaagcctctatctcctct

SEQ ID NO: 34026 - DNA, 22 bp, Homo sapiens
tggacacagtccaacgtgagct

SEQ ID NO: 34027 - DNA, 21 bp, Homo sapiens
ctaacttttttttttgtgatt

SEQ ID NO: 34028 - DNA, 19 bp, Homo sapiens
ctaagaaattatcttttga

SEQ ID NO: 34029 - DNA, 24 bp, Homo sapiens
gcttggaatgacttgttttggttt

SEQ ID NO: 34030 - DNA, 19 bp, Homo sapiens
tattgtctgaaagaatctt

SEQ ID NO: 34031 - DNA, 21 bp, Homo sapiens
tcatgagttgctgtggcattt

SEQ ID NO: 34032 - DNA, 23 bp, Homo sapiens
tgcaaatttgataattctcctga

SEQ ID NO: 34033 - DNA, 20 bp, Homo sapiens
tgctcttctaaaatgtttca

SEQ ID NO: 34034 - DNA, 19 bp, Homo sapiens
attatttggcctcacatca

SEQ ID NO: 34035 - DNA, 22 bp, Homo sapiens
aggagagagaggcagaagaacc

SEQ ID NO: 34036 - DNA, 25 bp, Homo sapiens
gaggcagaagaaccctggcctgaga

SEQ ID NO: 34037 - DNA, 19 bp, Homo sapiens
gccaccctgaggcctctgg

SEQ ID NO: 34038 - DNA, 15 bp, Homo sapiens
gtctgatctgtgaat

SEQ ID NO: 34039 - DNA, 20 bp, Homo sapiens
tagagctttctttcacaaaa

SEQ ID NO: 34040 - DNA, 18 bp, Homo sapiens
tcaaaaaacaaaaaccca

SEQ ID NO: 34041 - DNA, 18 bp, Homo sapiens
tccaaaacaaattcctcc

SEQ ID NO: 34042 - DNA, 17 bp, Homo sapiens
cccgcccagccagcagc

SEQ ID NO: 34043 - DNA, 21 bp, Homo sapiens
tgaatggggtggatgagactg

SEQ ID NO: 34044 - DNA, 21 bp, Homo sapiens
ttcaaaaaaaaagttccggat

SEQ ID NO: 34045 - DNA, 17 bp, Homo sapiens
aaaaacaaacaaacaaa

SEQ ID NO: 34046 - DNA, 20 bp, Homo sapiens
aggaaactccaaacagatca

SEQ ID NO: 34047 - DNA, 19 bp, Homo sapiens
gatacagggtgaaaatgaa

SEQ ID NO: 34048 - DNA, 20 bp, Homo sapiens
gctttagctgggttcagtca

SEQ ID NO: 34049 - DNA, 20 bp, Homo sapiens
gttgaagcgtcagtctttga

SEQ ID NO: 34050 - DNA, 19 bp, Homo sapiens
taaaacatgccatacattg

SEQ ID NO: 34051 - DNA, 18 bp, Homo sapiens
tattgaatatgtgtacac

SEQ ID NO: 34052 - DNA, 18 bp, Homo sapiens
ttttctaatcacagcagt

SEQ ID NO: 34053 - DNA, 20 bp, Homo sapiens
acttgatgcacaacatcaca

SEQ ID NO: 34054 - DNA, 18 bp, Homo sapiens
cctgcaacctccacctcc

SEQ ID NO: 34055 - DNA, 19 bp, Homo sapiens
gactgtgcctgttattgtt

SEQ ID NO: 34056 - DNA, 18 bp, Homo sapiens
gccttaacagtggagttg

SEQ ID NO: 34057 - DNA, 21 bp, Homo sapiens
gtcctcaacaagcacgagctg

SEQ ID NO: 34058 - DNA, 18 bp, Homo sapiens
tccacctcccgggttcaa

SEQ ID NO: 34059 - DNA, 18 bp, Homo sapiens
tgggtgggtcacctgagg

SEQ ID NO: 34060 - DNA, 21 bp, Homo sapiens
ttctctactaaaaaaatacaa

SEQ ID NO: 34061 - DNA, 17 bp, Homo sapiens
aactacaatctgagcaa

SEQ ID NO: 34062 - DNA, 18 bp, Homo sapiens
cagaatttcacaacaata

SEQ ID NO: 34063 - DNA, 19 bp, Homo sapiens
aagcaattctcccacctca

SEQ ID NO: 34064 - DNA, 21 bp, Homo sapiens
cacgtggccattttccttcaa

SEQ ID NO: 34065 - DNA, 22 bp, Homo sapiens
gcctgggttgtgacttctactg

SEQ ID NO: 34066 - DNA, 18 bp, Homo sapiens
gtgttatttaagagatca

SEQ ID NO: 34067 - DNA, 22 bp, Homo sapiens
taggtgccctgcattccaccca

SEQ ID NO: 34068 - DNA, 22 bp, Homo sapiens
acaaatttggtgccacattatc

SEQ ID NO: 34069 - DNA, 20 bp, Homo sapiens
acatatattaagacatatca

SEQ ID NO: 34070 - DNA, 18 bp, Homo sapiens
caaactgggggcttgtta

SEQ ID NO: 34071 - DNA, 18 bp, Homo sapiens
cacctgtttcagcagtta

SEQ ID NO: 34072 - DNA, 19 bp, Homo sapiens
cactttcatttttcatctg

SEQ ID NO: 34073 - DNA, 19 bp, Homo sapiens
ccaatcagaggcactttca

SEQ ID NO: 34074 - DNA, 25 bp, Homo sapiens
ctctggtacagacaaatgccatgaa

SEQ ID NO: 34075 - DNA, 24 bp, Homo sapiens
gcttggattgctgacctctgactt

SEQ ID NO: 34076 - DNA, 22 bp, Homo sapiens
gtttgtgttattcaccactgta

SEQ ID NO: 34077 - DNA, 18 bp, Homo sapiens
tcctgacctcatgatcca

SEQ ID NO: 34078 - DNA, 25 bp, Homo sapiens
ttcaaaaacctgacattaatagcta

SEQ ID NO: 34079 - DNA, 17 bp, Homo sapiens
acacacactatatacat

SEQ ID NO: 34080 - DNA, 22 bp, Homo sapiens
accttgtgatccccctgcctcg

SEQ ID NO: 34081 - DNA, 19 bp, Homo sapiens
atatattaacatggcttca

SEQ ID NO: 34082 - DNA, 20 bp, Homo sapiens
cctctgcctcccaggttcag

SEQ ID NO: 34083 - DNA, 18 bp, Homo sapiens
cctgcaacctccacctcc

SEQ ID NO: 34084 - DNA, 19 bp, Homo sapiens
ctgcaacctccacctccca

SEQ ID NO: 34085 - DNA, 22 bp, Homo sapiens
ctggttatattccaccataaca

SEQ ID NO: 34086 - DNA, 24 bp, Homo sapiens
gacttactaggtttgggcatttca

SEQ ID NO: 34087 - DNA, 17 bp, Homo sapiens
gcgattcccctgcctca

SEQ ID NO: 34088 - DNA, 18 bp, Homo sapiens
tccacctcccaggttcaa

SEQ ID NO: 34089 - DNA, 19 bp, Homo sapiens
ttctgtatgtagacgtaga

SEQ ID NO: 34090 - DNA, 22 bp, Homo sapiens
aatgtgggaagacttttagaca

SEQ ID NO: 34091 - DNA, 21 bp, Homo sapiens
atcttggctcactgcaacctc

SEQ ID NO: 34092 - DNA, 22 bp, Homo sapiens
attcacaccttattcaacatca

SEQ ID NO: 34093 - DNA, 20 bp, Homo sapiens
cactcactttccacagatgc

SEQ ID NO: 34094 - DNA, 19 bp, Homo sapiens
atccttcatttccaagtca

SEQ ID NO: 34095 - DNA, 18 bp, Homo sapiens
acaccagatcactgtgca

SEQ ID NO: 34096 - DNA, 21 bp, Homo sapiens
accaaaagatctgtgatcaga

SEQ ID NO: 34097 - DNA, 19 bp, Homo sapiens
caatgtagacaatgtgata

SEQ ID NO: 34098 - DNA, 23 bp, Homo sapiens
ccttgcgcagacattggttttga

SEQ ID NO: 34099 - DNA, 24 bp, Homo sapiens
cttctcattgctgtatcatcccaa

SEQ ID NO: 34100 - DNA, 18 bp, Homo sapiens
tcagacccctccagacat

SEQ ID NO: 34101 - DNA, 19 bp, Homo sapiens
agatccttttacatcatca

SEQ ID NO: 34102 - DNA, 21 bp, Homo sapiens
agtgagtttcctcatttcatc

SEQ ID NO: 34103 - DNA, 18 bp, Homo sapiens
caagccctcctttcccct

SEQ ID NO: 34104 - DNA, 20 bp, Homo sapiens
cagatcccatcctgctcctc

SEQ ID NO: 34105 - DNA, 20 bp, Homo sapiens
cagatcccatcctgctcctc

SEQ ID NO: 34106 - DNA, 20 bp, Homo sapiens
cagatcccatcctgctcctc

SEQ ID NO: 34107 - DNA, 20 bp, Homo sapiens
cagatcccatcctgctcctc

SEQ ID NO: 34108 - DNA, 20 bp, Homo sapiens
cagatcccatcctgctcctc

SEQ ID NO: 34109 - DNA, 20 bp, Homo sapiens
cagatcccatcctgctcctc

SEQ ID NO: 34110 - DNA, 23 bp, Homo sapiens
cctcctttcccctgggggccctc

SEQ ID NO: 34111 - DNA, 19 bp, Homo sapiens
ctacaaatttaggattgtt

SEQ ID NO: 34112 - DNA, 20 bp, Homo sapiens
ctgtcttctgttgtgtccca

SEQ ID NO: 34113 - DNA, 17 bp, Homo sapiens
gggaggggtgacagcca

SEQ ID NO: 34114 - DNA, 18 bp, Homo sapiens
taagtttttagtgagtgt

SEQ ID NO: 34115 - DNA, 20 bp, Homo sapiens
tagatccttttacatcatca

SEQ ID NO: 34116 - DNA, 19 bp, Homo sapiens
aataaggaacaccttatta

SEQ ID NO: 34117 - DNA, 20 bp, Homo sapiens
aggaaacttggttttttggc

SEQ ID NO: 34118 - DNA, 25 bp, Homo sapiens
catggatttgctcactggttactca

SEQ ID NO: 34119 - DNA, 21 bp, Homo sapiens
ccagtgggaaaaacattcttc

SEQ ID NO: 34120 - DNA, 19 bp, Homo sapiens
ccattcttaactcatgcca

SEQ ID NO: 34121 - DNA, 23 bp, Homo sapiens
ggagagaaggctggaggctgaca

SEQ ID NO: 34122 - DNA, 21 bp, Homo sapiens
ggtcactgataccagatccca

SEQ ID NO: 34123 - DNA, 22 bp, Homo sapiens
tcaccatttcacacccacctcc

SEQ ID NO: 34124 - DNA, 23 bp, Homo sapiens
tcactttctgttagctccctcca

SEQ ID NO: 34125 - DNA, 18 bp, Homo sapiens
tggatggatctcttgagg

SEQ ID NO: 34126 - DNA, 21 bp, Homo sapiens
ttccttgactgctcttcacca

SEQ ID NO: 34127 - DNA, 21 bp, Homo sapiens
ttggaatgaatgctggtactt

SEQ ID NO: 34128 - DNA, 20 bp, Homo sapiens
ttggttcctagagtagagta

SEQ ID NO: 34129 - DNA, 20 bp, Homo sapiens
cctcctcgcgttcttcccca

SEQ ID NO: 34130 - DNA, 21 bp, Homo sapiens
cgcgtacgagtgtctacgggc

SEQ ID NO: 34131 - DNA, 20 bp, Homo sapiens
ggaagagggggtggccgcca

SEQ ID NO: 34132 - DNA, 17 bp, Homo sapiens
tcgtttcccctcgcaaa

SEQ ID NO: 34133 - DNA, 15 bp, Homo sapiens
agagagggaaagacc

SEQ ID NO: 34134 - DNA, 20 bp, Homo sapiens
atcagaacttggattttatc

SEQ ID NO: 34135 - DNA, 19 bp, Homo sapiens
cattcccctttgcagctat

SEQ ID NO: 34136 - DNA, 20 bp, Homo sapiens
cctctgccctccaggttcaa

SEQ ID NO: 34137 - DNA, 18 bp, Homo sapiens
ggagctttggaaacttca

SEQ ID NO: 34138 - DNA, 21 bp, Homo sapiens
cctgtggctgcctgcacccca

SEQ ID NO: 34139 - DNA, 20 bp, Homo sapiens
gcacccatacctaggacccc

SEQ ID NO: 34140 - DNA, 20 bp, Homo sapiens
cctggccagccttcctgcct

SEQ ID NO: 34141 - DNA, 22 bp, Homo sapiens
tcaccccaccacacgcagactc

SEQ ID NO: 34142 - DNA, 20 bp, Homo sapiens
tgcaggggctgcacatccca

SEQ ID NO: 34143 - DNA, 22 bp, Homo sapiens
aaggtgtcaatggggagtgtca

SEQ ID NO: 34144 - DNA, 20 bp, Homo sapiens
aatcctgctgtcagagctca

SEQ ID NO: 34145 - DNA, 19 bp, Homo sapiens
atgtctaataaatgatgtc

SEQ ID NO: 34146 - DNA, 22 bp, Homo sapiens
caccaccaccactgcccatctt

SEQ ID NO: 34147 - DNA, 23 bp, Homo sapiens
cagttccccccaccctcacccca

SEQ ID NO: 34148 - DNA, 22 bp, Homo sapiens
ccccaccccccaccctgccagc

SEQ ID NO: 34149 - DNA, 16 bp, Homo sapiens
ccttttgaagagctca

SEQ ID NO: 34150 - DNA, 21 bp, Homo sapiens
gcagttttaagggtgatgtgt

SEQ ID NO: 34151 - DNA, 22 bp, Homo sapiens
gggctacatgtgcatcaacata

SEQ ID NO: 34152 - DNA, 16 bp, Homo sapiens
gtgaccaccttttgaa

SEQ ID NO: 34153 - DNA, 20 bp, Homo sapiens
tagatgcttggcatgaggtt

SEQ ID NO: 34154 - DNA, 24 bp, Homo sapiens
tatgtctaataaatgatgtcctct

SEQ ID NO: 34155 - DNA, 22 bp, Homo sapiens
tccacagacacactaggaaagc

SEQ ID NO: 34156 - DNA, 20 bp, Homo sapiens
tttcttcatggctgccgcac

SEQ ID NO: 34157 - DNA, 16 bp, Homo sapiens
aaacaaccccccaagc

SEQ ID NO: 34158 - DNA, 22 bp, Homo sapiens
acaaaacaggcgaaatacctca

SEQ ID NO: 34159 - DNA, 21 bp, Homo sapiens
acccacacaccattcagaaca

SEQ ID NO: 34160 - DNA, 18 bp, Homo sapiens
atgtccagtagcatttct

SEQ ID NO: 34161 - DNA, 19 bp, Homo sapiens
catgaagcaaaatctctaa

SEQ ID NO: 34162 - DNA, 19 bp, Homo sapiens
cccacccacacaccattca

SEQ ID NO: 34163 - DNA, 18 bp, Homo sapiens
cctttaaaaaacatctga

SEQ ID NO: 34164 - DNA, 19 bp, Homo sapiens
gaatgatcactatgttaaa

SEQ ID NO: 34165 - DNA, 21 bp, Homo sapiens
gttgaaaattccctttggtct

SEQ ID NO: 34166 - DNA, 19 bp, Homo sapiens
tagatcagagctacaagtt

SEQ ID NO: 34167 - DNA, 22 bp, Homo sapiens
tcctcccggcttccgccgccgc

SEQ ID NO: 34168 - DNA, 18 bp, Homo sapiens
cctgcaacctccacctcc

SEQ ID NO: 34169 - DNA, 21 bp, Homo sapiens
ctcaccgtggaagtttgtgag

SEQ ID NO: 34170 - DNA, 18 bp, Homo sapiens
gacctagatgagagtcca

SEQ ID NO: 34171 - DNA, 21 bp, Homo sapiens
ttaggaaatgtctagacctcc

SEQ ID NO: 34172 - DNA, 20 bp, Homo sapiens
tttgatgtaatatggacatc

SEQ ID NO: 34173 - DNA, 19 bp, Homo sapiens
ccaccctctcccagaggac

SEQ ID NO: 34174 - DNA, 20 bp, Homo sapiens
ccccaggccaccctctccca

SEQ ID NO: 34175 - DNA, 18 bp, Homo sapiens
gcctcctgtccctctgtc

SEQ ID NO: 34176 - DNA, 19 bp, Homo sapiens
tggaggcagaagggaccca

SEQ ID NO: 34177 - DNA, 22 bp, Homo sapiens
gctcagtgacaagggctttgaa

SEQ ID NO: 34178 - DNA, 20 bp, Homo sapiens
tgctaggttcacaccctcct

SEQ ID NO: 34179 - DNA, 24 bp, Homo sapiens
tggcactgctaggttcacaccctc

SEQ ID NO: 34180 - DNA, 16 bp, Homo sapiens
ttaaccatgggcagga

SEQ ID NO: 34181 - DNA, 18 bp, Homo sapiens
ttgcttgctgcctggctc

SEQ ID NO: 34182 - DNA, 21 bp, Homo sapiens
acaatgatttgtactgtctaa

SEQ ID NO: 34183 - DNA, 18 bp, Homo sapiens
acattgggaacatatttc

SEQ ID NO: 34184 - DNA, 18 bp, Homo sapiens
atacccaaatacacagca

SEQ ID NO: 34185 - DNA, 19 bp, Homo sapiens
ccagtagagaaatgcactt

SEQ ID NO: 34186 - DNA, 18 bp, Homo sapiens
cttgaagccccttggctt

SEQ ID NO: 34187 - DNA, 20 bp, Homo sapiens
gagtaaaagtctacccctct

SEQ ID NO: 34188 - DNA, 20 bp, Homo sapiens
gccttcccacaagggcccgg

SEQ ID NO: 34189 - DNA, 20 bp, Homo sapiens
tggagaggtagggccagagg

SEQ ID NO: 34190 - DNA, 20 bp, Homo sapiens
ttattacctgccttagcttt

SEQ ID NO: 34191 - DNA, 21 bp, Homo sapiens
cctatggaaaacctgtggata

SEQ ID NO: 34192 - DNA, 19 bp, Homo sapiens
atcttagcgcctcctgcca

SEQ ID NO: 34193 - DNA, 17 bp, Homo sapiens
agtttgtggcatacaac

SEQ ID NO: 34194 - DNA, 16 bp, Homo sapiens
cagcatctgcctctat

SEQ ID NO: 34195 - DNA, 15 bp, Homo sapiens
tggtgttgtatactt

SEQ ID NO: 34196 - DNA, 20 bp, Homo sapiens
caactccatccacggatccc

SEQ ID NO: 34197 - DNA, 19 bp, Homo sapiens
cagggtgtgtttcccccac

SEQ ID NO: 34198 - DNA, 19 bp, Homo sapiens
cctcaaccctgaggagtca

SEQ ID NO: 34199 - DNA, 21 bp, Homo sapiens
gcccccaccctctctccctca

SEQ ID NO: 34200 - DNA, 18 bp, Homo sapiens
gtgggttgcagtgtcagg

SEQ ID NO: 34201 - DNA, 19 bp, Homo sapiens
tgggaccagtgtgtagctg

SEQ ID NO: 34202 - DNA, 20 bp, Homo sapiens
acaaaacagaacaagtctca

SEQ ID NO: 34203 - DNA, 24 bp, Homo sapiens
cacttggttttaataaattactca

SEQ ID NO: 34204 - DNA, 17 bp, Homo sapiens
cctggcggtggggcctg

SEQ ID NO: 34205 - DNA, 20 bp, Homo sapiens
ctgttatatactcagtgcaa

SEQ ID NO: 34206 - DNA, 17 bp, Homo sapiens
gtcatctaaaagctttt

SEQ ID NO: 34207 - DNA, 20 bp, Homo sapiens
tcagatgtgtttggtaatca

SEQ ID NO: 34208 - DNA, 19 bp, Homo sapiens
tgaacataagttcatttcc

SEQ ID NO: 34209 - DNA, 16 bp, Homo sapiens
cctgacctccaataaa

SEQ ID NO: 34210 - DNA, 19 bp, Homo sapiens
tggttggagtgtttttaga

SEQ ID NO: 34211 - DNA, 21 bp, Homo sapiens
cagcccctggtctgtgatcag

SEQ ID NO: 34212 - DNA, 21 bp, Homo sapiens
cctactctcctccattctcca

SEQ ID NO: 34213 - DNA, 21 bp, Homo sapiens
cttaatagaatctatgtggta

SEQ ID NO: 34214 - DNA, 21 bp, Homo sapiens
aaggaccagatgattcacatg

SEQ ID NO: 34215 - DNA, 21 bp, Homo sapiens
aattatgacaaaaattactct

SEQ ID NO: 34216 - DNA, 20 bp, Homo sapiens
agctcataattaccatgaca

SEQ ID NO: 34217 - DNA, 20 bp, Homo sapiens
agtactacttgatttgtgtt

SEQ ID NO: 34218 - DNA, 19 bp, Homo sapiens
ctgattgctctgatattgt

SEQ ID NO: 34219 - DNA, 18 bp, Homo sapiens
ggaaacagccagaagcca

SEQ ID NO: 34220 - DNA, 21 bp, Homo sapiens
taatacaacagatagctttga

SEQ ID NO: 34221 - DNA, 21 bp, Homo sapiens
tgctcatggtatgtcaaacct

SEQ ID NO: 34222 - DNA, 16 bp, Homo sapiens
tggtaatgtccataga

SEQ ID NO: 34223 - DNA, 24 bp, Homo sapiens
ttctgtaagtatgtgtattttatg

SEQ ID NO: 34224 - DNA, 26 bp, Homo sapiens
aaaaaacaattccaaatgtgaaacta

SEQ ID NO: 34225 - DNA, 22 bp, Homo sapiens
gccctggcttcaggggctgtga

SEQ ID NO: 34226 - DNA, 24 bp, Homo sapiens
gcttgggctgcgtgcgttctgcct

SEQ ID NO: 34227 - DNA, 20 bp, Homo sapiens
aatgaagctaatcttcttcc

SEQ ID NO: 34228 - DNA, 21 bp, Homo sapiens
atccaaagctacccagtccct

SEQ ID NO: 34229 - DNA, 21 bp, Homo sapiens
cggccccttccccaaatccca

SEQ ID NO: 34230 - DNA, 24 bp, Homo sapiens
gtgtcttgctgcttggtgggtgct

SEQ ID NO: 34231 - DNA, 17 bp, Homo sapiens
ttttggtgtttataact

SEQ ID NO: 34232 - DNA, 16 bp, Homo sapiens
aatatctgccattttc

SEQ ID NO: 34233 - DNA, 15 bp, Homo sapiens
aatcattaccatggc

SEQ ID NO: 34234 - DNA, 20 bp, Homo sapiens
cgcaccactaatatctgcca

SEQ ID NO: 34235 - DNA, 24 bp, Homo sapiens
ctatctatctcccctattccctca

SEQ ID NO: 34236 - DNA, 19 bp, Homo sapiens
taagagcagtggcatcaca

SEQ ID NO: 34237 - DNA, 22 bp, Homo sapiens
tcttagaatcttgcagcagtga

SEQ ID NO: 34238 - DNA, 22 bp, Homo sapiens
ttttgatgatgtttcatggtgg

SEQ ID NO: 34239 - DNA, 18 bp, Homo sapiens
aggaacctggacccagtt

SEQ ID NO: 34240 - DNA, 18 bp, Homo sapiens
cctggacccagttggctc

SEQ ID NO: 34241 - DNA, 18 bp, Homo sapiens
tctttttcactttcttgc

SEQ ID NO: 34242 - DNA, 20 bp, Homo sapiens
acccaccagtctttctggga

SEQ ID NO: 34243 - DNA, 22 bp, Homo sapiens
ccctggtggtgcaggctgtgaa

SEQ ID NO: 34244 - DNA, 20 bp, Homo sapiens
gccacttctgaagggttctg

SEQ ID NO: 34245 - DNA, 18 bp, Homo sapiens
gtgtaaagagtatcattc

SEQ ID NO: 34246 - DNA, 19 bp, Homo sapiens
tccccttgcggcccctgct

SEQ ID NO: 34247 - DNA, 22 bp, Homo sapiens
aacacgacacaagctcactccc

SEQ ID NO: 34248 - DNA, 24 bp, Homo sapiens
atgtggctgctttctgtctctgcc

SEQ ID NO: 34249 - DNA, 24 bp, Homo sapiens
ccactatggtgggctccgtcagca

SEQ ID NO: 34250 - DNA, 18 bp, Homo sapiens
ctcccagaaccgcagctg

SEQ ID NO: 34251 - DNA, 19 bp, Homo sapiens
gaggacaatcccccatctc

SEQ ID NO: 34252 - DNA, 22 bp, Homo sapiens
gcaaatacttcatgagcttagc

SEQ ID NO: 34253 - DNA, 17 bp, Homo sapiens
aaaaacaaacaaacaaa

SEQ ID NO: 34254 - DNA, 23 bp, Homo sapiens
acccagagctgtgggaggacccc

SEQ ID NO: 34255 - DNA, 20 bp, Homo sapiens
cctctgcctcccaggttcaa

SEQ ID NO: 34256 - DNA, 19 bp, Homo sapiens
ctgcaacctctgcctccca

SEQ ID NO: 34257 - DNA, 18 bp, Homo sapiens
tccacctcgcaggttcaa

SEQ ID NO: 34258 - DNA, 23 bp, Homo sapiens
acatacagtctctgtcataacta

SEQ ID NO: 34259 - DNA, 21 bp, Homo sapiens
tggtacgtgaattgcttggta

SEQ ID NO: 34260 - DNA, 20 bp, Homo sapiens
agcctccagaacagatgcca

SEQ ID NO: 34261 - DNA, 24 bp, Homo sapiens
caaataatgatcaatgctatttca

SEQ ID NO: 34262 - DNA, 21 bp, Homo sapiens
ccatcgccagccgggccctca

SEQ ID NO: 34263 - DNA, 22 bp, Homo sapiens
gccaacattgaaacataccttc

SEQ ID NO: 34264 - DNA, 17 bp, Homo sapiens
gccacatcaagtctcct

SEQ ID NO: 34265 - DNA, 19 bp, Homo sapiens
ggttaccatgtccatcccc

SEQ ID NO: 34266 - DNA, 18 bp, Homo sapiens
tgctatttcagtgagcaa

SEQ ID NO: 34267 - DNA, 15 bp, Homo sapiens
gatggaatgtgaagc

SEQ ID NO: 34268 - DNA, 19 bp, Homo sapiens
ggcatacatctcacactca

SEQ ID NO: 34269 - DNA, 18 bp, Homo sapiens
ttgacacattcagtaact

SEQ ID NO: 34270 - DNA, 21 bp, Homo sapiens
aaaaacttccaatgacaagaa

SEQ ID NO: 34271 - DNA, 23 bp, Homo sapiens
acctgctcactgttctgtctcaa

SEQ ID NO: 34272 - DNA, 24 bp, Homo sapiens
agacctagtgctgtttcttccaca

SEQ ID NO: 34273 - DNA, 20 bp, Homo sapiens
gtgttgcctcctaccttgcc

SEQ ID NO: 34274 - DNA, 17 bp, Homo sapiens
tgtttcttccacatatt

SEQ ID NO: 34275 - DNA, 23 bp, Homo sapiens
caaactggataaagggtgcccaa

SEQ ID NO: 34276 - DNA, 21 bp, Homo sapiens
ccctggcccccagggactgga

SEQ ID NO: 34277 - DNA, 20 bp, Homo sapiens
gccggggacacaccatcctg

SEQ ID NO: 34278 - DNA, 21 bp, Homo sapiens
ggacacaccatcctgctcgca

SEQ ID NO: 34279 - DNA, 18 bp, Homo sapiens
aatcatacctactgtaaa

SEQ ID NO: 34280 - DNA, 19 bp, Homo sapiens
gattaagctgttgaaccta

SEQ ID NO: 34281 - DNA, 25 bp, Homo sapiens
tccccagaccaaaggaaacatttca

SEQ ID NO: 34282 - DNA, 20 bp, Homo sapiens
tcttgttgtctgtggcactt

SEQ ID NO: 34283 - DNA, 20 bp, Homo sapiens
tgtgggcacctggaaatcta

SEQ ID NO: 34284 - DNA, 19 bp, Homo sapiens
ttgccaatatgttcattac

SEQ ID NO: 34285 - DNA, 19 bp, Homo sapiens
aagccatcttccatagttg

SEQ ID NO: 34286 - DNA, 20 bp, Homo sapiens
agtgaatggaaaataagtgt

SEQ ID NO: 34287 - DNA, 21 bp, Homo sapiens
atcaaattctttgggtatctc

SEQ ID NO: 34288 - DNA, 19 bp, Homo sapiens
cccacatcgctcccctttt

SEQ ID NO: 34289 - DNA, 21 bp, Homo sapiens
cgtagataacaatacactgaa

SEQ ID NO: 34290 - DNA, 18 bp, Homo sapiens
ctgttttgctacaaccca

SEQ ID NO: 34291 - DNA, 23 bp, Homo sapiens
gcatcaaattctttgggtatctc

SEQ ID NO: 34292 - DNA, 21 bp, Homo sapiens
tactgacaggagcagcagcta

SEQ ID NO: 34293 - DNA, 22 bp, Homo sapiens
tgaatggaaaataagtgtggag

SEQ ID NO: 34294 - DNA, 16 bp, Homo sapiens
tgacagatctttgata

SEQ ID NO: 34295 - DNA, 19 bp, Homo sapiens
tgtataattcagatttatc

SEQ ID NO: 34296 - DNA, 19 bp, Homo sapiens
ggctaaaaaaactttgtca

SEQ ID NO: 34297 - DNA, 17 bp, Homo sapiens
tagatcaacattcctca

SEQ ID NO: 34298 - DNA, 19 bp, Homo sapiens
tcaccaaataatcttacct

SEQ ID NO: 34299 - DNA, 20 bp, Homo sapiens
tctgaaccaaaatcttccca

SEQ ID NO: 34300 - DNA, 18 bp, Homo sapiens
tgcacatcagctgtgatg

SEQ ID NO: 34301 - DNA, 22 bp, Homo sapiens
tgtgggggtgtgtgtgtgtgtg

SEQ ID NO: 34302 - DNA, 18 bp, Homo sapiens
aaagctatgcttctgtga

SEQ ID NO: 34303 - DNA, 20 bp, Homo sapiens
atacattagcatgttaaatt

SEQ ID NO: 34304 - DNA, 24 bp, Homo sapiens
gcttccctgtccttgagggcgtct

SEQ ID NO: 34305 - DNA, 20 bp, Homo sapiens
tgcacgggacccagctcctt

SEQ ID NO: 34306 - DNA, 23 bp, Homo sapiens
agtccccaggccagtgcttggca

SEQ ID NO: 34307 - DNA, 18 bp, Homo sapiens
cacagacccccttgctcc

SEQ ID NO: 34308 - DNA, 18 bp, Homo sapiens
ccacccctccccgcattg

SEQ ID NO: 34309 - DNA, 17 bp, Homo sapiens
ctttgccactgtccttg

SEQ ID NO: 34310 - DNA, 22 bp, Homo sapiens
gagccaagatcatgccactgca

SEQ ID NO: 34311 - DNA, 21 bp, Homo sapiens
aagatgatttccatataccag

SEQ ID NO: 34312 - DNA, 21 bp, Homo sapiens
accatagataaaagcctcata

SEQ ID NO: 34313 - DNA, 18 bp, Homo sapiens
acccaccgcagccccctg

SEQ ID NO: 34314 - DNA, 19 bp, Homo sapiens
ccatagataaaagcctcat

SEQ ID NO: 34315 - DNA, 19 bp, Homo sapiens
gccctccctcttaagctga

SEQ ID NO: 34316 - DNA, 18 bp, Homo sapiens
gtcaccatagataaaagc

SEQ ID NO: 34317 - DNA, 19 bp, Homo sapiens
gttcttccatcttccgatg

SEQ ID NO: 34318 - DNA, 18 bp, Homo sapiens
caattcactatttgccca

SEQ ID NO: 34319 - DNA, 20 bp, Homo sapiens
ccccttttccctgaaccacg

SEQ ID NO: 34320 - DNA, 18 bp, Homo sapiens
gtgatgacaattaaatca

SEQ ID NO: 34321 - DNA, 18 bp, Homo sapiens
tacgatgtgtgtgtcaca

SEQ ID NO: 34322 - DNA, 20 bp, Homo sapiens
ttgtttgttagccttgactg

SEQ ID NO: 34323 - DNA, 20 bp, Homo sapiens
cacctcccttccctttttta

SEQ ID NO: 34324 - DNA, 21 bp, Homo sapiens
cacctcccttcctttttttca

SEQ ID NO: 34325 - DNA, 23 bp, Homo sapiens
ggcgtgagccaccgcgcccggcc

SEQ ID NO: 34326 - DNA, 27 bp, Homo sapiens
tctgggcagtaaacctagctcattttt

SEQ ID NO: 34327 - DNA, 19 bp, Homo sapiens
tgccattttgataatgcta

SEQ ID NO: 34328 - DNA, 21 bp, Homo sapiens
ccaggagccactctcccagct

SEQ ID NO: 34329 - DNA, 24 bp, Homo sapiens
tgccacatccctgtcacacaccca

SEQ ID NO: 34330 - DNA, 19 bp, Homo sapiens
aaaacagaagtcaatgcaa

SEQ ID NO: 34331 - DNA, 19 bp, Homo sapiens
acaaatgaaaagttgcata

SEQ ID NO: 34332 - DNA, 20 bp, Homo sapiens
atggctttaaaatggagcta

SEQ ID NO: 34333 - DNA, 17 bp, Homo sapiens
cttttaggggctgcgga

SEQ ID NO: 34334 - DNA, 21 bp, Homo sapiens
ggcgtacactggcacctggtg

SEQ ID NO: 34335 - DNA, 18 bp, Homo sapiens
tagcattttatgtacaaa

SEQ ID NO: 34336 - DNA, 20 bp, Homo sapiens
ttgcctagatcccccatctc

SEQ ID NO: 34337 - DNA, 20 bp, Homo sapiens
aaaattggcatcaattttaa

SEQ ID NO: 34338 - DNA, 22 bp, Homo sapiens
aaagtgagggaaccatttcctc

SEQ ID NO: 34339 - DNA, 18 bp, Homo sapiens
acccagccctgtctgtta

SEQ ID NO: 34340 - DNA, 20 bp, Homo sapiens
atcactgtgtgaagctttca

SEQ ID NO: 34341 - DNA, 18 bp, Homo sapiens
ctcggctcccgcactgct

SEQ ID NO: 34342 - DNA, 25 bp, Homo sapiens
ccagcgaggccaagaccaccagcca

SEQ ID NO: 34343 - DNA, 21 bp, Homo sapiens
cctaaagactcaaagtatctc

SEQ ID NO: 34344 - DNA, 17 bp, Homo sapiens
ctcagacatggctgcaa

SEQ ID NO: 34345 - DNA, 19 bp, Homo sapiens
gtgcccagagccttcctcc

SEQ ID NO: 34346 - DNA, 21 bp, Homo sapiens
gtgtctgagctcacttgattg

SEQ ID NO: 34347 - DNA, 19 bp, Homo sapiens
gttgcacaaatgtgaatac

SEQ ID NO: 34348 - DNA, 21 bp, Homo sapiens
tctctgagaagtagcccctcc

SEQ ID NO: 34349 - DNA, 20 bp, Homo sapiens
tgcccagagccttcctccag

SEQ ID NO: 34350 - DNA, 21 bp, Homo sapiens
tgggtgggccctgcggtgaac

SEQ ID NO: 34351 - DNA, 19 bp, Homo sapiens
acacaggagttagaaatgc

SEQ ID NO: 34352 - DNA, 22 bp, Homo sapiens
ccgtgatagaatgcagattcaa

SEQ ID NO: 34353 - DNA, 15 bp, Homo sapiens
cctacagcagatgcc

SEQ ID NO: 34354 - DNA, 19 bp, Homo sapiens
gaatttgggcaagctattt

SEQ ID NO: 34355 - DNA, 20 bp, Homo sapiens
tgtgtatgctgtagtttgtg

SEQ ID NO: 34356 - DNA, 20 bp, Homo sapiens
cctctgcctcctgggttcaa

SEQ ID NO: 34357 - DNA, 22 bp, Homo sapiens
caggagttctcccaccacctca

SEQ ID NO: 34358 - DNA, 22 bp, Homo sapiens
aagagacatccgctccctctca

SEQ ID NO: 34359 - DNA, 26 bp, Homo sapiens
caactaagcagcctcagatctgtaaa

SEQ ID NO: 34360 - DNA, 17 bp, Homo sapiens
gaagaaaccaatcgccc

SEQ ID NO: 34361 - DNA, 19 bp, Homo sapiens
acaagatgccatctgtcaa

SEQ ID NO: 34362 - DNA, 23 bp, Homo sapiens
agtggcctgaacacacaccttca

SEQ ID NO: 34363 - DNA, 19 bp, Homo sapiens
tgattgggaaatctgccag

SEQ ID NO: 34364 - DNA, 21 bp, Homo sapiens
agccttcaacaaccaacaacc

SEQ ID NO: 34365 - DNA, 19 bp, Homo sapiens
ccagcacaggtagccagca

SEQ ID NO: 34366 - DNA, 19 bp, Homo sapiens
ggaaattcaaaggaaccaa

SEQ ID NO: 34367 - DNA, 22 bp, Homo sapiens
gggaggcatagaagccacactg

SEQ ID NO: 34368 - DNA, 24 bp, Homo sapiens
tctgcccatcactctggtgtggta

SEQ ID NO: 34369 - DNA, 15 bp, Homo sapiens
ttctcacaacagtgt

SEQ ID NO: 34370 - DNA, 22 bp, Homo sapiens
tttgtgcccctagattattttt

SEQ ID NO: 34371 - DNA, 21 bp, Homo sapiens
ttcttcctccttcttctggtg

SEQ ID NO: 34372 - DNA, 20 bp, Homo sapiens
gattttatttggaaaggtgg

SEQ ID NO: 34373 - DNA, 20 bp, Homo sapiens
ccttgtttggggttctgtgg

SEQ ID NO: 34374 - DNA, 22 bp, Homo sapiens
gtgcttgggcactggtgggcct

SEQ ID NO: 34375 - DNA, 19 bp, Homo sapiens
tggggttctgtgggtttgg

SEQ ID NO: 34376 - DNA, 18 bp, Homo sapiens
aatttgacttttgttcca

SEQ ID NO: 34377 - DNA, 18 bp, Homo sapiens
agacctgaaaaactacct

SEQ ID NO: 34378 - DNA, 18 bp, Homo sapiens
cccccaaatcctgttcca

SEQ ID NO: 34379 - DNA, 20 bp, Homo sapiens
cctctgcctcccgggttcaa

SEQ ID NO: 34380 - DNA, 18 bp, Homo sapiens
tgcccagaacagcgctcc

SEQ ID NO: 34381 - DNA, 18 bp, Homo sapiens
cctgtgggttgctggctt

SEQ ID NO: 34382 - DNA, 18 bp, Homo sapiens
aaaattgagccctggcca

SEQ ID NO: 34383 - DNA, 20 bp, Homo sapiens
caccaccacgacagcccttc

SEQ ID NO: 34384 - DNA, 21 bp, Homo sapiens
ccatggggctagagactgcca

SEQ ID NO: 34385 - DNA, 21 bp, Homo sapiens
cccacttcccaaatatgcctc

SEQ ID NO: 34386 - DNA, 17 bp, Homo sapiens
ccctacccaatctttcc

SEQ ID NO: 34387 - DNA, 23 bp, Homo sapiens
cctcccccaaccacctgccctcc

SEQ ID NO: 34388 - DNA, 22 bp, Homo sapiens
ctccgatctctcccaccccacc

SEQ ID NO: 34389 - DNA, 20 bp, Homo sapiens
gctgcttcatccacagaagg

SEQ ID NO: 34390 - DNA, 18 bp, Homo sapiens
tcttgggcatccccctca

SEQ ID NO: 34391 - DNA, 21 bp, Homo sapiens
aatcaccattctccttcctct

SEQ ID NO: 34392 - DNA, 25 bp, Homo sapiens
agcctggccaacatggcaaatccca

SEQ ID NO: 34393 - DNA, 19 bp, Homo sapiens
atgaagtgaagtgaacaca

SEQ ID NO: 34394 - DNA, 18 bp, Homo sapiens
ctggggttataactgata

SEQ ID NO: 34395 - DNA, 18 bp, Homo sapiens
atggagtctccctctgtc

SEQ ID NO: 34396 - DNA, 26 bp, Homo sapiens
tcatcctcctaaatttcactgtctta

SEQ ID NO: 34397 - DNA, 18 bp, Homo sapiens
tctgcccacctctgcctc

SEQ ID NO: 34398 - DNA, 21 bp, Homo sapiens
aatcagctcctattgaactta

SEQ ID NO: 34399 - DNA, 21 bp, Homo sapiens
catgtgtgcatatctatagta

SEQ ID NO: 34400 - DNA, 24 bp, Homo sapiens
gtatatattttgtacactttgtta

SEQ ID NO: 34401 - DNA, 21 bp, Homo sapiens
gtgtgacaactgatcgggtga

SEQ ID NO: 34402 - DNA, 20 bp, Homo sapiens
tcatgctgctattcctgcaa

SEQ ID NO: 34403 - DNA, 19 bp, Homo sapiens
tgggctagcactgaaactg

SEQ ID NO: 34404 - DNA, 19 bp, Homo sapiens
acaggatataaccggagtt

SEQ ID NO: 34405 - DNA, 20 bp, Homo sapiens
agaatgaaataaaccagagt

SEQ ID NO: 34406 - DNA, 23 bp, Homo sapiens
agagttagacccgcgggggttgg

SEQ ID NO: 34407 - DNA, 17 bp, Homo sapiens
agatcaaagctgcagtt

SEQ ID NO: 34408 - DNA, 19 bp, Homo sapiens
agtggatggaaggggactg

SEQ ID NO: 34409 - DNA, 21 bp, Homo sapiens
caaagctgcagttgcatttga

SEQ ID NO: 34410 - DNA, 21 bp, Homo sapiens
cacttcgccctccccatttga

SEQ ID NO: 34411 - DNA, 16 bp, Homo sapiens
ccccgccccccgcact

SEQ ID NO: 34412 - DNA, 22 bp, Homo sapiens
ttttggtggtggtggctgttgg

SEQ ID NO: 34413 - DNA, 22 bp, Homo sapiens
acatcttcacaccagcaggaca

SEQ ID NO: 34414 - DNA, 23 bp, Homo sapiens
ctgcgtgagtctgtacagggata

SEQ ID NO: 34415 - DNA, 21 bp, Homo sapiens
gtgatacccaaagctgagcag

SEQ ID NO: 34416 - DNA, 19 bp, Homo sapiens
tagcattcccgtgtacaaa

SEQ ID NO: 34417 - DNA, 20 bp, Homo sapiens
tcgacatcagtgatacccaa

SEQ ID NO: 34418 - DNA, 24 bp, Homo sapiens
cagcgagtatatgaacaacaaaga

SEQ ID NO: 34419 - DNA, 17 bp, Homo sapiens
cgctcgattgccagtgg

SEQ ID NO: 34420 - DNA, 20 bp, Homo sapiens
tgacacagatatccccacca

SEQ ID NO: 34421 - DNA, 18 bp, Homo sapiens
aaaagacttttttttaaa

SEQ ID NO: 34422 - DNA, 21 bp, Homo sapiens
gagttgtagataaaatgtcat

SEQ ID NO: 34423 - DNA, 20 bp, Homo sapiens
aggaaatagccctcaagata

SEQ ID NO: 34424 - DNA, 24 bp, Homo sapiens
tttttttatttttggccttgtctt

SEQ ID NO: 34425 - DNA, 18 bp, Homo sapiens
aggtgtgtacatctctca

SEQ ID NO: 34426 - DNA, 21 bp, Homo sapiens
cttccaagcacatgcatggca

SEQ ID NO: 34427 - DNA, 20 bp, Homo sapiens
tttggttggccttctggtct

SEQ ID NO: 34428 - DNA, 22 bp, Homo sapiens
cactccctggcacaatgccgta

SEQ ID NO: 34429 - DNA, 20 bp, Homo sapiens
cccagacccaccagacacca

SEQ ID NO: 34430 - DNA, 18 bp, Homo sapiens
gcccacccactttcctct

SEQ ID NO: 34431 - DNA, 20 bp, Homo sapiens
gtctctctgctgtaccagct

SEQ ID NO: 34432 - DNA, 18 bp, Homo sapiens
gaacaacgtggttattgt

SEQ ID NO: 34433 - DNA, 20 bp, Homo sapiens
actctggtgatccaaacaaa

SEQ ID NO: 34434 - DNA, 16 bp, Homo sapiens
aggctggcctctacat

SEQ ID NO: 34435 - DNA, 17 bp, Homo sapiens
atgaatgagagttctgg

SEQ ID NO: 34436 - DNA, 21 bp, Homo sapiens
ctcttacctaaactctggtga

SEQ ID NO: 34437 - DNA, 19 bp, Homo sapiens
gaggctggcctctacatca

SEQ ID NO: 34438 - DNA, 18 bp, Homo sapiens
gcttgcaggtggaactcc

SEQ ID NO: 34439 - DNA, 20 bp, Homo sapiens
acaaaacaaaacaaaactca

SEQ ID NO: 34440 - DNA, 24 bp, Homo sapiens
ctatttctgttacacaatttgtta

SEQ ID NO: 34441 - DNA, 19 bp, Homo sapiens
ggaagagaacacacccatc

SEQ ID NO: 34442 - DNA, 18 bp, Homo sapiens
tgtaatatttccaagtca

SEQ ID NO: 34443 - DNA, 25 bp, Homo sapiens
ttttttcaactatgtcattaacttt

SEQ ID NO: 34444 - DNA, 18 bp, Homo sapiens
cattaatgtttgataagg

SEQ ID NO: 34445 - DNA, 20 bp, Homo sapiens
gtatcaagatcagtgtcaga

SEQ ID NO: 34446 - DNA, 18 bp, Homo sapiens
taattctccctctgtcct

SEQ ID NO: 34447 - DNA, 21 bp, Homo sapiens
tgtccttttaagaattatttt

SEQ ID NO: 34448 - DNA, 20 bp, Homo sapiens
aagccatattccagcagtga

SEQ ID NO: 34449 - DNA, 21 bp, Homo sapiens
aagtgctaaaaaattaaacca

SEQ ID NO: 34450 - DNA, 15 bp, Homo sapiens
catcaagataccttt

SEQ ID NO: 34451 - DNA, 23 bp, Homo sapiens
ctttgacctcaatggaggtttgc

SEQ ID NO: 34452 - DNA, 22 bp, Homo sapiens
gcaggaggcaagggctgcaaca

SEQ ID NO: 34453 - DNA, 23 bp, Homo sapiens
gtttggggagcagcccctggctc

SEQ ID NO: 34454 - DNA, 19 bp, Homo sapiens
taacagtctgtgctgtcca

SEQ ID NO: 34455 - DNA, 21 bp, Homo sapiens
tcacttccactcataatccac

SEQ ID NO: 34456 - DNA, 21 bp, Homo sapiens
gcctgaactgtggccgtgtct

SEQ ID NO: 34457 - DNA, 21 bp, Homo sapiens
gcgaggccacgacaggcctca

SEQ ID NO: 34458 - DNA, 21 bp, Homo sapiens
ggcgcccgcggcggccgtggc

SEQ ID NO: 34459 - DNA, 23 bp, Homo sapiens
gggttctcggcggcggctgtggc

SEQ ID NO: 34460 - DNA, 18 bp, Homo sapiens
agaatttaaaacacctct

SEQ ID NO: 34461 - DNA, 18 bp, Homo sapiens
tggagccagcaagtgctt

SEQ ID NO: 34462 - DNA, 18 bp, Homo sapiens
gcctctggctgctggttt

SEQ ID NO: 34463 - DNA, 17 bp, Homo sapiens
actttggcccttggttt

SEQ ID NO: 34464 - DNA, 17 bp, Homo sapiens
tccagaagaaggtccag

SEQ ID NO: 34465 - DNA, 23 bp, Homo sapiens
tctgcctgctttccacctcccca

SEQ ID NO: 34466 - DNA, 18 bp, Homo sapiens
ttgctcatcgcctggttc

SEQ ID NO: 34467 - DNA, 18 bp, Homo sapiens
ccacccatctgttccgtt

SEQ ID NO: 34468 - DNA, 16 bp, Homo sapiens
gagtcctggcatttac

SEQ ID NO: 34469 - DNA, 19 bp, Homo sapiens
atttgtaaatattgtacaa

SEQ ID NO: 34470 - DNA, 21 bp, Homo sapiens
cctgccccgcccctcccccca

SEQ ID NO: 34471 - DNA, 20 bp, Homo sapiens
ctctctgtctgcaccaggga

SEQ ID NO: 34472 - DNA, 25 bp, Homo sapiens
gaagttgaatgcttaatcccgggaa

SEQ ID NO: 34473 - DNA, 22 bp, Homo sapiens
gggaccctgccccgcccctccc

SEQ ID NO: 34474 - DNA, 19 bp, Homo sapiens
tcacccagcagccactgcc

SEQ ID NO: 34475 - DNA, 18 bp, Homo sapiens
tggcaaccacacaactca

SEQ ID NO: 34476 - DNA, 22 bp, Homo sapiens
accctcactcctggagattcca

SEQ ID NO: 34477 - DNA, 27 bp, Homo sapiens
atttaagctattaaaatttgtacaata

SEQ ID NO: 34478 - DNA, 19 bp, Homo sapiens
gtctcactctgttgcccag

SEQ ID NO: 34479 - DNA, 18 bp, Homo sapiens
ccaagcaatcctcccacc

SEQ ID NO: 34480 - DNA, 16 bp, Homo sapiens
ggcggggtctctgtca

SEQ ID NO: 34481 - DNA, 24 bp, Homo sapiens
tcctcccacctcagcctctggtgt

SEQ ID NO: 34482 - DNA, 24 bp, Homo sapiens
atgactgtataaaacttgttgaca

SEQ ID NO: 34483 - DNA, 18 bp, Homo sapiens
ccacattcaccttgtaaa

SEQ ID NO: 34484 - DNA, 20 bp, Homo sapiens
gatcccaccattagcctgta

SEQ ID NO: 34485 - DNA, 17 bp, Homo sapiens
tttgatctgtgtttgtt

SEQ ID NO: 34486 - DNA, 16 bp, Homo sapiens
tgggcgcgactggttc

SEQ ID NO: 34487 - DNA, 17 bp, Homo sapiens
gaacatggtggaaaatg

SEQ ID NO: 34488 - DNA, 24 bp, Homo sapiens
gattttccaaaattttggtgtgaa

SEQ ID NO: 34489 - DNA, 24 bp, Homo sapiens
gcttcctgccacccacccacctct

SEQ ID NO: 34490 - DNA, 22 bp, Homo sapiens
tctctttatagtgagaaaattt

SEQ ID NO: 34491 - DNA, 18 bp, Homo sapiens
tctgtcgtctcccatcca

SEQ ID NO: 34492 - DNA, 21 bp, Homo sapiens
tttgcttgtctgaaacacctc

SEQ ID NO: 34493 - DNA, 19 bp, Homo sapiens
ttttgtatgtgcgtgtgtt

SEQ ID NO: 34494 - DNA, 20 bp, Homo sapiens
aaaccttttttcttaacttt

SEQ ID NO: 34495 - DNA, 22 bp, Homo sapiens
aacaaaaaggacgaccatgcaa

SEQ ID NO: 34496 - DNA, 20 bp, Homo sapiens
aaggtcaccaacagcaaaga

SEQ ID NO: 34497 - DNA, 22 bp, Homo sapiens
accaggaaaataatatgtacca

SEQ ID NO: 34498 - DNA, 20 bp, Homo sapiens
acttgaggttacaaagctca

SEQ ID NO: 34499 - DNA, 16 bp, Homo sapiens
atattgcttcctctga

SEQ ID NO: 34500 - DNA, 18 bp, Homo sapiens
atattgcttcctctgata

SEQ ID NO: 34501 - DNA, 19 bp, Homo sapiens
atctcagctctggctcttt

SEQ ID NO: 34502 - DNA, 21 bp, Homo sapiens
ctatctatctacaaatctatc

SEQ ID NO: 34503 - DNA, 20 bp, Homo sapiens
ctggagccaaaattttgagt

SEQ ID NO: 34504 - DNA, 19 bp, Homo sapiens
ctgtagccagactgcctct

SEQ ID NO: 34505 - DNA, 16 bp, Homo sapiens
tggtcacggtggtggt

SEQ ID NO: 34506 - DNA, 20 bp, Homo sapiens
ttctaccttccttgtgcctt

SEQ ID NO: 34507 - DNA, 25 bp, Homo sapiens
acaaactccgttatgatatatccta

SEQ ID NO: 34508 - DNA, 22 bp, Homo sapiens
accaggactatgtagaagtaga

SEQ ID NO: 34509 - DNA, 16 bp, Homo sapiens
accattcttttgcaca

SEQ ID NO: 34510 - DNA, 23 bp, Homo sapiens
atttgtaatttttctgtacgata

SEQ ID NO: 34511 - DNA, 21 bp, Homo sapiens
tcccaaaatagaatgtttcag

SEQ ID NO: 34512 - DNA, 21 bp, Homo sapiens
tttgtaccacagtattaatcg

SEQ ID NO: 34513 - DNA, 23 bp, Homo sapiens
aagcaagcgagggacttcactct

SEQ ID NO: 34514 - DNA, 18 bp, Homo sapiens
actgtggctgttgggttt

SEQ ID NO: 34515 - DNA, 20 bp, Homo sapiens
ccctccctgtcagcacagca

SEQ ID NO: 34516 - DNA, 18 bp, Homo sapiens
ccgtgtgtcttgtctgtg

SEQ ID NO: 34517 - DNA, 19 bp, Homo sapiens
ctggctgggcttccggtgt

SEQ ID NO: 34518 - DNA, 18 bp, Homo sapiens
gctttgatcccttggtct

SEQ ID NO: 34519 - DNA, 18 bp, Homo sapiens
tccagaactttgttctag

SEQ ID NO: 34520 - DNA, 19 bp, Homo sapiens
tccggcttggctgttccag

SEQ ID NO: 34521 - DNA, 23 bp, Homo sapiens
tggggtcatagattgtccagtca

SEQ ID NO: 34522 - DNA, 19 bp, Homo sapiens
tttgttctagattccttaa

SEQ ID NO: 34523 - DNA, 18 bp, Homo sapiens
aagctggtcctcaaagta

SEQ ID NO: 34524 - DNA, 19 bp, Homo sapiens
gacttcatggctgacttgc

SEQ ID NO: 34525 - DNA, 20 bp, Homo sapiens
taccatgaaagaaaagatca

SEQ ID NO: 34526 - DNA, 19 bp, Homo sapiens
agctctatcatattctgaa

SEQ ID NO: 34527 - DNA, 16 bp, Homo sapiens
caaacaaccttggctg

SEQ ID NO: 34528 - DNA, 18 bp, Homo sapiens
ttgagaatgtttgttgta

SEQ ID NO: 34529 - DNA, 20 bp, Homo sapiens
atgtcaaaaatctgcaaacc

SEQ ID NO: 34530 - DNA, 21 bp, Homo sapiens
ctcaacatcctgaagctgatc

SEQ ID NO: 34531 - DNA, 21 bp, Homo sapiens
tctgggcagaagacctgcgag

SEQ ID NO: 34532 - DNA, 22 bp, Homo sapiens
caaggaaagctggcaaacacac

SEQ ID NO: 34533 - DNA, 19 bp, Homo sapiens
ctcccccacaacttctcca

SEQ ID NO: 34534 - DNA, 20 bp, Homo sapiens
ctgctgaacagtagcaataa

SEQ ID NO: 34535 - DNA, 20 bp, Homo sapiens
ggtttgtttggagtaaccaa

SEQ ID NO: 34536 - DNA, 19 bp, Homo sapiens
tcctctctattaatacctc

SEQ ID NO: 34537 - DNA, 18 bp, Homo sapiens
tgtgtaaaatagccttcc

SEQ ID NO: 34538 - DNA, 18 bp, Homo sapiens
agcagtcccccagtgtca

SEQ ID NO: 34539 - DNA, 18 bp, Homo sapiens
cagcagcaggactgagaa

SEQ ID NO: 34540 - DNA, 19 bp, Homo sapiens
gagatcacctcctacacca

SEQ ID NO: 34541 - DNA, 22 bp, Homo sapiens
gctgtaatgcaaatggctggtg

SEQ ID NO: 34542 - DNA, 18 bp, Homo sapiens
tccccggaacatcggcaa

SEQ ID NO: 34543 - DNA, 21 bp, Homo sapiens
tggctggtggagtatgtgatg

SEQ ID NO: 34544 - DNA, 19 bp, Homo sapiens
aacagactccaggccctga

SEQ ID NO: 34545 - DNA, 21 bp, Homo sapiens
tatccagtcacagtgaatttg

SEQ ID NO: 34546 - DNA, 23 bp, Homo sapiens
tttaggtaatgataagcattttt

SEQ ID NO: 34547 - DNA, 20 bp, Homo sapiens
caagaaatcttagaaccagc

SEQ ID NO: 34548 - DNA, 17 bp, Homo sapiens
cacaccatctccatctc

SEQ ID NO: 34549 - DNA, 16 bp, Homo sapiens
cccagattgaggatcc

SEQ ID NO: 34550 - DNA, 20 bp, Homo sapiens
ctagacagactgcgggcaca

SEQ ID NO: 34551 - DNA, 22 bp, Homo sapiens
ctggccaagctgaccgatagct

SEQ ID NO: 34552 - DNA, 20 bp, Homo sapiens
cttggggctggtttggtttt

SEQ ID NO: 34553 - DNA, 24 bp, Homo sapiens
ctttgatgataaaacaagacttgt

SEQ ID NO: 34554 - DNA, 21 bp, Homo sapiens
gactgcaaagtccacatccga

SEQ ID NO: 34555 - DNA, 22 bp, Homo sapiens
taaatgggagggattgaggcta

SEQ ID NO: 34556 - DNA, 21 bp, Homo sapiens
tgcacacaccatctccatctc

SEQ ID NO: 34557 - DNA, 24 bp, Homo sapiens
ttagggagaagatagcattcttca

SEQ ID NO: 34558 - DNA, 18 bp, Homo sapiens
ttggggctggtttggttt

SEQ ID NO: 34559 - DNA, 20 bp, Homo sapiens
aaggatttcagcaaaccacc

SEQ ID NO: 34560 - DNA, 19 bp, Homo sapiens
acgaaactgtgactttcca

SEQ ID NO: 34561 - DNA, 18 bp, Homo sapiens
acggcacatagagatgaa

SEQ ID NO: 34562 - DNA, 18 bp, Homo sapiens
ccatcccatagctcctgc

SEQ ID NO: 34563 - DNA, 21 bp, Homo sapiens
cccaccccccagcgtcatctc

SEQ ID NO: 34564 - DNA, 23 bp, Homo sapiens
gggacgggggcacccacttcctt

SEQ ID NO: 34565 - DNA, 17 bp, Homo sapiens
tgaagaggagatccagg

SEQ ID NO: 34566 - DNA, 20 bp, Homo sapiens
tttcagcaaaccaccacctc

SEQ ID NO: 34567 - DNA, 23 bp, Homo sapiens
atctccacccattaaacatgaag

SEQ ID NO: 34568 - DNA, 23 bp, Homo sapiens
gcccagtgtggtgtgtctggctt

SEQ ID NO: 34569 - DNA, 21 bp, Homo sapiens
cagtagttttatttccacagc

SEQ ID NO: 34570 - DNA, 21 bp, Homo sapiens
tctgtgtagcaccattcacca

SEQ ID NO: 34571 - DNA, 23 bp, Homo sapiens
tgaatgtaactcctggtgtgaag

SEQ ID NO: 34572 - DNA, 24 bp, Homo sapiens
aaggcatccacatttaagtcacca

SEQ ID NO: 34573 - DNA, 18 bp, Homo sapiens
acccttgatggctaatca

SEQ ID NO: 34574 - DNA, 19 bp, Homo sapiens
agagaagctagacagaagg

SEQ ID NO: 34575 - DNA, 16 bp, Homo sapiens
caagaacaaaaaacca

SEQ ID NO: 34576 - DNA, 21 bp, Homo sapiens
ccaaacaaacaaacaaacaaa

SEQ ID NO: 34577 - DNA, 19 bp, Homo sapiens
cctccttgaccaaacctca

SEQ ID NO: 34578 - DNA, 19 bp, Homo sapiens
gaccaaggcatccacattt

SEQ ID NO: 34579 - DNA, 23 bp, Homo sapiens
gccacctctgagtgctctgagga

SEQ ID NO: 34580 - DNA, 22 bp, Homo sapiens
tccctctgagcccacgattgga

SEQ ID NO: 34581 - DNA, 23 bp, Homo sapiens
tctgaggaaaacatggcactctt

SEQ ID NO: 34582 - DNA, 19 bp, Homo sapiens
tgaacaatgagatcacatg

SEQ ID NO: 34583 - DNA, 21 bp, Homo sapiens
ccaggcatttaaaatacctaa

SEQ ID NO: 34584 - DNA, 20 bp, Homo sapiens
taaacctgcagaaaatcctt

SEQ ID NO: 34585 - DNA, 17 bp, Homo sapiens
tagcacaattcctggca

SEQ ID NO: 34586 - DNA, 23 bp, Homo sapiens
tttcacaaaatcaaaatattgta

SEQ ID NO: 34587 - DNA, 20 bp, Homo sapiens
ctatgattgctttgtgttca

SEQ ID NO: 34588 - DNA, 20 bp, Homo sapiens
tgaatttcaaaatgaagctg

SEQ ID NO: 34589 - DNA, 18 bp, Homo sapiens
tgattcggcttcactttg

SEQ ID NO: 34590 - DNA, 21 bp, Homo sapiens
tgctgttagccatgtctattg

SEQ ID NO: 34591 - DNA, 24 bp, Homo sapiens
tggtgtgccccttgagtgaggcta

SEQ ID NO: 34592 - DNA, 18 bp, Homo sapiens
accgcggacttgccctga

SEQ ID NO: 34593 - DNA, 22 bp, Homo sapiens
atctaagattcatagctcagct

SEQ ID NO: 34594 - DNA, 19 bp, Homo sapiens
cactctgtacccaccattc

SEQ ID NO: 34595 - DNA, 19 bp, Homo sapiens
ccactctgtacccaccatt

SEQ ID NO: 34596 - DNA, 17 bp, Homo sapiens
ctccaaagggaaatctt

SEQ ID NO: 34597 - DNA, 19 bp, Homo sapiens
cttgtaacagaacacctct

SEQ ID NO: 34598 - DNA, 21 bp, Homo sapiens
gaaaaagatttagacatacta

SEQ ID NO: 34599 - DNA, 20 bp, Homo sapiens
gaaggttggtcatttctctg

SEQ ID NO: 34600 - DNA, 18 bp, Homo sapiens
gatactgaagaaactccc

SEQ ID NO: 34601 - DNA, 18 bp, Homo sapiens
ggcccttttcctgtgacg

SEQ ID NO: 34602 - DNA, 21 bp, Homo sapiens
tgaagaaactcccccaaccca

SEQ ID NO: 34603 - DNA, 23 bp, Homo sapiens
ctgcacacttggacagcagggtg

SEQ ID NO: 34604 - DNA, 26 bp, Homo sapiens
gagatgggatgtctttgcatatctct

SEQ ID NO: 34605 - DNA, 20 bp, Homo sapiens
tgtctgtgaaagtgccaaga

SEQ ID NO: 34606 - DNA, 20 bp, Homo sapiens
agctacagctctacaaccag

SEQ ID NO: 34607 - DNA, 20 bp, Homo sapiens
cgcatcctgcacctcctcac

SEQ ID NO: 34608 - DNA, 19 bp, Homo sapiens
tgcaaagccagaaacttct

SEQ ID NO: 34609 - DNA, 19 bp, Homo sapiens
aaactcctgacctcaggtg

SEQ ID NO: 34610 - DNA, 19 bp, Homo sapiens
cagaaaattatccttttca

SEQ ID NO: 34611 - DNA, 18 bp, Homo sapiens
ggagctataccaaaatct

SEQ ID NO: 34612 - DNA, 18 bp, Homo sapiens
ggtgatccgcccgcctcc

SEQ ID NO: 34613 - DNA, 18 bp, Homo sapiens
tccgcctcccgggttcaa

SEQ ID NO: 34614 - DNA, 23 bp, Homo sapiens
tggggtcagttgggtgcccagtt

SEQ ID NO: 34615 - DNA, 16 bp, Homo sapiens
cttttctagcagctgc

SEQ ID NO: 34616 - DNA, 19 bp, Homo sapiens
gctgcttagaaatacggct

SEQ ID NO: 34617 - DNA, 21 bp, Homo sapiens
tcagttaagaaatctacttta

SEQ ID NO: 34618 - DNA, 17 bp, Homo sapiens
acagataactcaaacct

SEQ ID NO: 34619 - DNA, 19 bp, Homo sapiens
actgccaggcttgctcctc

SEQ ID NO: 34620 - DNA, 18 bp, Homo sapiens
agcactcggaattcctga

SEQ ID NO: 34621 - DNA, 19 bp, Homo sapiens
atatagaaacatatggata

SEQ ID NO: 34622 - DNA, 19 bp, Homo sapiens
atttctttggctcttgaca

SEQ ID NO: 34623 - DNA, 23 bp, Homo sapiens
atttgaacacatttctttggctc

SEQ ID NO: 34624 - DNA, 17 bp, Homo sapiens
cattactttaggttcaa

SEQ ID NO: 34625 - DNA, 22 bp, Homo sapiens
ccattacatgcacatgtactca

SEQ ID NO: 34626 - DNA, 22 bp, Homo sapiens
cctctaagactgtgttggtctt

SEQ ID NO: 34627 - DNA, 19 bp, Homo sapiens
taaaacatcatcaacataa

SEQ ID NO: 34628 - DNA, 17 bp, Homo sapiens
tcctggaaaaactataa

SEQ ID NO: 34629 - DNA, 21 bp, Homo sapiens
tctgctttaatgtgcatggtg

SEQ ID NO: 34630 - DNA, 23 bp, Homo sapiens
tgctgaaattaggaaccacaggt

SEQ ID NO: 34631 - DNA, 19 bp, Homo sapiens
tggatgccaaatgagactg

SEQ ID NO: 34632 - DNA, 19 bp, Homo sapiens
aagaggaattaccacctca

SEQ ID NO: 34633 - DNA, 20 bp, Homo sapiens
cagaaaagaagatcctatca

SEQ ID NO: 34634 - DNA, 19 bp, Homo sapiens
ccacacatttggcactgtt

SEQ ID NO: 34635 - DNA, 18 bp, Homo sapiens
ccagaagaggcatctcca

SEQ ID NO: 34636 - DNA, 24 bp, Homo sapiens
ccatgacactgacaagaggaatta

SEQ ID NO: 34637 - DNA, 22 bp, Homo sapiens
cccactttggcattttcctaac

SEQ ID NO: 34638 - DNA, 23 bp, Homo sapiens
ctgatataactcaggctgcaatt

SEQ ID NO: 34639 - DNA, 19 bp, Homo sapiens
taacagtctgagactcctc

SEQ ID NO: 34640 - DNA, 21 bp, Homo sapiens
ccaggggccacccgcctggca

SEQ ID NO: 34641 - DNA, 20 bp, Homo sapiens
cctccccctgcctctcctcc

SEQ ID NO: 34642 - DNA, 22 bp, Homo sapiens
cgtctccacaagagtttacaaa

SEQ ID NO: 34643 - DNA, 21 bp, Homo sapiens
cttagcgcttttaagttattt

SEQ ID NO: 34644 - DNA, 25 bp, Homo sapiens
gcctgggcttctctattcttggccc

SEQ ID NO: 34645 - DNA, 25 bp, Homo sapiens
tgaatgggtccggtgcttggagctg

SEQ ID NO: 34646 - DNA, 22 bp, Homo sapiens
cctcttcgtggttgtgtttctc

SEQ ID NO: 34647 - DNA, 20 bp, Homo sapiens
gggcatctgaagctttacca

SEQ ID NO: 34648 - DNA, 17 bp, Homo sapiens
tctctggaaggcccctt

SEQ ID NO: 34649 - DNA, 24 bp, Homo sapiens
ctatttatagttgcctttggcctt

SEQ ID NO: 34650 - DNA, 20 bp, Homo sapiens
gaaggatccctctcctctct

SEQ ID NO: 34651 - DNA, 22 bp, Homo sapiens
tgttggctcccgtgtctgctga

SEQ ID NO: 34652 - DNA, 19 bp, Homo sapiens
aagcaattctcctgcctca

SEQ ID NO: 34653 - DNA, 20 bp, Homo sapiens
gacggggtctcactctgtcg

SEQ ID NO: 34654 - DNA, 24 bp, Homo sapiens
tcaagcgatcctcccaccacctca

SEQ ID NO: 34655 - DNA, 18 bp, Homo sapiens
tccgcctcccgggttcaa

SEQ ID NO: 34656 - DNA, 20 bp, Homo sapiens
aagtttgtgtgaaagatgtg

SEQ ID NO: 34657 - DNA, 23 bp, Homo sapiens
acacctgtttacaaaaagaatca

SEQ ID NO: 34658 - DNA, 18 bp, Homo sapiens
accatgctcttccacaca

SEQ ID NO: 34659 - DNA, 20 bp, Homo sapiens
agcagcacagaaacaagcta

SEQ ID NO: 34660 - DNA, 18 bp, Homo sapiens
gatcctgaaagcagactg

SEQ ID NO: 34661 - DNA, 19 bp, Homo sapiens
taaaaactacctaaacact

SEQ ID NO: 34662 - DNA, 18 bp, Homo sapiens
ttcaaacatctgtggtgt

SEQ ID NO: 34663 - DNA, 25 bp, Homo sapiens
ccattaacccactttgcttgtctca

SEQ ID NO: 34664 - DNA, 20 bp, Homo sapiens
cctaggaaatgactgtccca

SEQ ID NO: 34665 - DNA, 22 bp, Homo sapiens
cgggcgggggtggccgcgacca

SEQ ID NO: 34666 - DNA, 18 bp, Homo sapiens
gcacttgtatgatgcttt

SEQ ID NO: 34667 - DNA, 16 bp, Homo sapiens
gcgccaccattaaccc

SEQ ID NO: 34668 - DNA, 23 bp, Homo sapiens
gttttagcgccaccattaaccca

SEQ ID NO: 34669 - DNA, 20 bp, Homo sapiens
taatctcatcacggatatgt

SEQ ID NO: 34670 - DNA, 20 bp, Homo sapiens
tgaagagattttggtgagga

SEQ ID NO: 34671 - DNA, 21 bp, Homo sapiens
aatacaaaaatgagttttgca

SEQ ID NO: 34672 - DNA, 21 bp, Homo sapiens
accaattcttagaaacacttt

SEQ ID NO: 34673 - DNA, 22 bp, Homo sapiens
atctaagttatgaaatccaaca

SEQ ID NO: 34674 - DNA, 23 bp, Homo sapiens
ccttttcatatatttataacttt

SEQ ID NO: 34675 - DNA, 19 bp, Homo sapiens
gaatagtttcctgatgtca

SEQ ID NO: 34676 - DNA, 20 bp, Homo sapiens
tgaatttttaaggctttcct

SEQ ID NO: 34677 - DNA, 22 bp, Homo sapiens
agtcctctttctttatccttag

SEQ ID NO: 34678 - DNA, 17 bp, Homo sapiens
tcctgtttttcattctc

SEQ ID NO: 34679 - DNA, 18 bp, Homo sapiens
ggactctaagtgagactg

SEQ ID NO: 34680 - DNA, 21 bp, Homo sapiens
tttctttatgtgtttgctgta

SEQ ID NO: 34681 - DNA, 22 bp, Homo sapiens
gcgcggaggagcagcggccggg

SEQ ID NO: 34682 - DNA, 24 bp, Homo sapiens
ggccgggtgtccacccccatcctg

SEQ ID NO: 34683 - DNA, 23 bp, Homo sapiens
tgtccacccccatcctgcgccca

SEQ ID NO: 34684 - DNA, 19 bp, Homo sapiens
cattttctcgttatattca

SEQ ID NO: 34685 - DNA, 21 bp, Homo sapiens
ccaaatcacttttccatctct

SEQ ID NO: 34686 - DNA, 18 bp, Homo sapiens
gagtttcagatccacact

SEQ ID NO: 34687 - DNA, 19 bp, Homo sapiens
gccactgatttttgaggaa

SEQ ID NO: 34688 - DNA, 24 bp, Homo sapiens
tatccattacagtaaaggatttca

SEQ ID NO: 34689 - DNA, 21 bp, Homo sapiens
ttcattggcttcaaaatccaa

SEQ ID NO: 34690 - DNA, 19 bp, Homo sapiens
aactttggaaagtgtgtta

SEQ ID NO: 34691 - DNA, 22 bp, Homo sapiens
actcatttggatgattctgtga

SEQ ID NO: 34692 - DNA, 19 bp, Homo sapiens
gtcagattgtgtcaagtca

SEQ ID NO: 34693 - DNA, 16 bp, Homo sapiens
tcaaggaacttgcaaa

SEQ ID NO: 34694 - DNA, 21 bp, Homo sapiens
ttttgttaatatgcagtttta

SEQ ID NO: 34695 - DNA, 18 bp, Homo sapiens
aaatgtgtttactgcttt

SEQ ID NO: 34696 - DNA, 19 bp, Homo sapiens
attcaagtggagagggtta

SEQ ID NO: 34697 - DNA, 18 bp, Homo sapiens
gaaaactccaggcatcga

SEQ ID NO: 34698 - DNA, 26 bp, Homo sapiens
tgaaaagatcaccttaagtgaaatta

SEQ ID NO: 34699 - DNA, 19 bp, Homo sapiens
tgtaggtgttgtgagcttt

SEQ ID NO: 34700 - DNA, 16 bp, Homo sapiens
ttgaggagacaagtga

SEQ ID NO: 34701 - DNA, 17 bp, Homo sapiens
aaaaatgaaagtgtggt

SEQ ID NO: 34702 - DNA, 15 bp, Homo sapiens
gtccctttctgcctt

SEQ ID NO: 34703 - DNA, 21 bp, Homo sapiens
tgggcattcagtattctgaga

SEQ ID NO: 34704 - DNA, 19 bp, Homo sapiens
ccccaagtcccccctgcag

SEQ ID NO: 34705 - DNA, 17 bp, Homo sapiens
cctctccccttgccccg

SEQ ID NO: 34706 - DNA, 20 bp, Homo sapiens
ccttccccccaagtcccccc

SEQ ID NO: 34707 - DNA, 18 bp, Homo sapiens
tccctaccagtgtcttgt

SEQ ID NO: 34708 - DNA, 19 bp, Homo sapiens
acagaagagtcttgttcca

SEQ ID NO: 34709 - DNA, 19 bp, Homo sapiens
aggtgaagaggcactttca

SEQ ID NO: 34710 - DNA, 17 bp, Homo sapiens
atcctagaaggctaaca

SEQ ID NO: 34711 - DNA, 18 bp, Homo sapiens
catcggataaaagaggat

SEQ ID NO: 34712 - DNA, 24 bp, Homo sapiens
gcttgcggcagtacaatgccccca

SEQ ID NO: 34713 - DNA, 21 bp, Homo sapiens
gttagagaggaaaacatcgga

SEQ ID NO: 34714 - DNA, 18 bp, Homo sapiens
gttcctccctgctctgca

SEQ ID NO: 34715 - DNA, 21 bp, Homo sapiens
tcacggcaaagagagccacct

SEQ ID NO: 34716 - DNA, 21 bp, Homo sapiens
ctcacctccccagcggctcct

SEQ ID NO: 34717 - DNA, 22 bp, Homo sapiens
cgaattgtccgtgctcactcca

SEQ ID NO: 34718 - DNA, 22 bp, Homo sapiens
gccgcctcagggacttggagga

SEQ ID NO: 34719 - DNA, 22 bp, Homo sapiens
tcaaacaatatttatcacacat

SEQ ID NO: 34720 - DNA, 23 bp, Homo sapiens
ccaaccacaggtaaaccacaaca

SEQ ID NO: 34721 - DNA, 22 bp, Homo sapiens
gaaggatcagaccaccacccct

SEQ ID NO: 34722 - DNA, 20 bp, Homo sapiens
gccttgccacccctctgagg

SEQ ID NO: 34723 - DNA, 19 bp, Homo sapiens
ggatgggctgaaggggctg

SEQ ID NO: 34724 - DNA, 26 bp, Homo sapiens
ggccgtcccagacccccgcttcccct

SEQ ID NO: 34725 - DNA, 21 bp, Homo sapiens
ggcctccacaaaggcctggca

SEQ ID NO: 34726 - DNA, 20 bp, Homo sapiens
gtctgggcactgacgcagct

SEQ ID NO: 34727 - DNA, 19 bp, Homo sapiens
tctggtcttggcgagctct

SEQ ID NO: 34728 - DNA, 16 bp, Homo sapiens
accacctcctgctcct

SEQ ID NO: 34729 - DNA, 22 bp, Homo sapiens
caccatcctgccaccaccttct

SEQ ID NO: 34730 - DNA, 16 bp, Homo sapiens
cttcctctagagctcg

SEQ ID NO: 34731 - DNA, 19 bp, Homo sapiens
gcaagtgcttcccagccca

SEQ ID NO: 34732 - DNA, 25 bp, Homo sapiens
tgtgggagggtggttactgtgggtg

SEQ ID NO: 34733 - DNA, 19 bp, Homo sapiens
aagcaattctcccacctca

SEQ ID NO: 34734 - DNA, 18 bp, Homo sapiens
ctgggagaaccagatgat

SEQ ID NO: 34735 - DNA, 17 bp, Homo sapiens
tagccttgaattcctgg

SEQ ID NO: 34736 - DNA, 19 bp, Homo sapiens
gacaacacgagtttgtgtg

SEQ ID NO: 34737 - DNA, 23 bp, Homo sapiens
tggggttgttgggcagcctgcca

SEQ ID NO: 34738 - DNA, 23 bp, Homo sapiens
agccttcttccaaaagagccaga

SEQ ID NO: 34739 - DNA, 23 bp, Homo sapiens
ctcccactaaaaagctaactcca

SEQ ID NO: 34740 - DNA, 21 bp, Homo sapiens
tcttggtggagaggttgcgga

SEQ ID NO: 34741 - DNA, 18 bp, Homo sapiens
aatttggattttgttcca

SEQ ID NO: 34742 - DNA, 21 bp, Homo sapiens
gaatttttggtgctgtccgga

SEQ ID NO: 34743 - DNA, 23 bp, Homo sapiens
gtccagagtgttagcttagagct

SEQ ID NO: 34744 - DNA, 19 bp, Homo sapiens
gtttcaacattcaatctaa

SEQ ID NO: 34745 - DNA, 19 bp, Homo sapiens
taggtctataaatcaccca

SEQ ID NO: 34746 - DNA, 18 bp, Homo sapiens
tgtctgtgaagtctgaga

SEQ ID NO: 34747 - DNA, 22 bp, Homo sapiens
ttcaagtgattctcatctcagc

SEQ ID NO: 34748 - DNA, 23 bp, Homo sapiens
aacttatccatgtagatatagca

SEQ ID NO: 34749 - DNA, 18 bp, Homo sapiens
cagacctgtgaattcaaa

SEQ ID NO: 34750 - DNA, 22 bp, Homo sapiens
cagttgtaattcagtttaatga

SEQ ID NO: 34751 - DNA, 20 bp, Homo sapiens
ctgttctcttatgtgtccca

SEQ ID NO: 34752 - DNA, 19 bp, Homo sapiens
gacggctcagcatggactg

SEQ ID NO: 34753 - DNA, 21 bp, Homo sapiens
gtgtgtgtaattgctggacta

SEQ ID NO: 34754 - DNA, 24 bp, Homo sapiens
ttctgggaaaaacagacctgtgaa

SEQ ID NO: 34755 - DNA, 21 bp, Homo sapiens
acatttgtccaccctgagaga

SEQ ID NO: 34756 - DNA, 27 bp, Homo sapiens
ccctgtgctcagcctggaattgttata

SEQ ID NO: 34757 - DNA, 21 bp, Homo sapiens
cttctccatctgctttacttt

SEQ ID NO: 34758 - DNA, 22 bp, Homo sapiens
gtagaagttgttcattgccgaa

SEQ ID NO: 34759 - DNA, 19 bp, Homo sapiens
accagagatgaacccactg

SEQ ID NO: 34760 - DNA, 19 bp, Homo sapiens
cccgaatggccttgtgcct

SEQ ID NO: 34761 - DNA, 17 bp, Homo sapiens
cgaatggccttgtgcct

SEQ ID NO: 34762 - DNA, 19 bp, Homo sapiens
ttccagaaatacagggtcc

SEQ ID NO: 34763 - DNA, 20 bp, Homo sapiens
cttcctcctcctcctcctct

SEQ ID NO: 34764 - DNA, 22 bp, Homo sapiens
gcgccggccccttcccatgcgg

SEQ ID NO: 34765 - DNA, 20 bp, Homo sapiens
aaatgtgttgccagacttaa

SEQ ID NO: 34766 - DNA, 19 bp, Homo sapiens
acgttatgaaaactaacca

SEQ ID NO: 34767 - DNA, 21 bp, Homo sapiens
gaatttttctctttttctgga

SEQ ID NO: 34768 - DNA, 19 bp, Homo sapiens
tggctctcaactggaattg

SEQ ID NO: 34769 - DNA, 16 bp, Homo sapiens
ttgagtcctctggttt

SEQ ID NO: 34770 - DNA, 23 bp, Homo sapiens
aaaccaatgaagcaatctattgt

SEQ ID NO: 34771 - DNA, 22 bp, Homo sapiens
aatgtctgattttgaagtcaca

SEQ ID NO: 34772 - DNA, 21 bp, Homo sapiens
aattgcaaatatcagatcctt

SEQ ID NO: 34773 - DNA, 17 bp, Homo sapiens
acaccgtcagcaatcca

SEQ ID NO: 34774 - DNA, 22 bp, Homo sapiens
agagtcacggaatctgtactga

SEQ ID NO: 34775 - DNA, 20 bp, Homo sapiens
cagacctcccttgcattgaa

SEQ ID NO: 34776 - DNA, 25 bp, Homo sapiens
cctaagtaactgccaagtttttttt

SEQ ID NO: 34777 - DNA, 22 bp, Homo sapiens
gaaaatgtcacagaccatgata

SEQ ID NO: 34778 - DNA, 20 bp, Homo sapiens
tgggtaacagagtgagactg

SEQ ID NO: 34779 - DNA, 21 bp, Homo sapiens
aaccaggccacacagcagggg

SEQ ID NO: 34780 - DNA, 21 bp, Homo sapiens
aatctggaaaaaaattacctg

SEQ ID NO: 34781 - DNA, 19 bp, Homo sapiens
actacttatagattttacc

SEQ ID NO: 34782 - DNA, 18 bp, Homo sapiens
cagtaccagtccgtggca

SEQ ID NO: 34783 - DNA, 16 bp, Homo sapiens
gcacctactgtgtgct

SEQ ID NO: 34784 - DNA, 18 bp, Homo sapiens
tccgcctcctgggttcaa

SEQ ID NO: 34785 - DNA, 20 bp, Homo sapiens
tcctgagctccacgccttca

SEQ ID NO: 34786 - DNA, 22 bp, Homo sapiens
aatttagaaattatatccctaa

SEQ ID NO: 34787 - DNA, 21 bp, Homo sapiens
agcagtgtctgtcactttcca

SEQ ID NO: 34788 - DNA, 19 bp, Homo sapiens
ctttgtgtgctggtttata

SEQ ID NO: 34789 - DNA, 25 bp, Homo sapiens
ggagagtcagggcggcggctgcggc

SEQ ID NO: 34790 - DNA, 20 bp, Homo sapiens
tcccggaacagcctatctca

SEQ ID NO: 34791 - DNA, 21 bp, Homo sapiens
tgtatcaaacagcacaagcag

SEQ ID NO: 34792 - DNA, 24 bp, Homo sapiens
aggatgctcacttgttcctactga

SEQ ID NO: 34793 - DNA, 17 bp, Homo sapiens
agtctgtttaattgcct

SEQ ID NO: 34794 - DNA, 16 bp, Homo sapiens
tcaccaccggcacaca

SEQ ID NO: 34795 - DNA, 21 bp, Homo sapiens
aaaccctgccccaatgcacct

SEQ ID NO: 34796 - DNA, 22 bp, Homo sapiens
cagagggtgggggacctggcgg

SEQ ID NO: 34797 - DNA, 17 bp, Homo sapiens
ccagccttgcctcatca

SEQ ID NO: 34798 - DNA, 20 bp, Homo sapiens
tggcagggagcactacccct

SEQ ID NO: 34799 - DNA, 22 bp, Homo sapiens
aacttgattttacatttattta

SEQ ID NO: 34800 - DNA, 18 bp, Homo sapiens
cccgcaacctccgcctcc

SEQ ID NO: 34801 - DNA, 19 bp, Homo sapiens
cgctacaacctccacctcc

SEQ ID NO: 34802 - DNA, 21 bp, Homo sapiens
ctgcctgattctcctgcctca

SEQ ID NO: 34803 - DNA, 18 bp, Homo sapiens
ctgcctggccaccacccc

SEQ ID NO: 34804 - DNA, 24 bp, Homo sapiens
ggcatgagccaccgcacccggcca

SEQ ID NO: 34805 - DNA, 18 bp, Homo sapiens
tccgcctcccgggttcaa

SEQ ID NO: 34806 - DNA, 18 bp, Homo sapiens
tgcccggccgccatccca

SEQ ID NO: 34807 - DNA, 24 bp, Homo sapiens
acatgatgttttcacacacatttt

SEQ ID NO: 34808 - DNA, 17 bp, Homo sapiens
cccagctccccgcagct

SEQ ID NO: 34809 - DNA, 23 bp, Homo sapiens
ccccggggccccggctggggttg

SEQ ID NO: 34810 - DNA, 21 bp, Homo sapiens
cccttccccactgttcactcc

SEQ ID NO: 34811 - DNA, 17 bp, Homo sapiens
cctctgggaggcaggag

SEQ ID NO: 34812 - DNA, 18 bp, Homo sapiens
ctgtctttctctgagcct

SEQ ID NO: 34813 - DNA, 18 bp, Homo sapiens
gtggcggcgcgcgggcca

SEQ ID NO: 34814 - DNA, 24 bp, Homo sapiens
tctgccaccatggccattgtgcag

SEQ ID NO: 34815 - DNA, 20 bp, Homo sapiens
tggaaactggtatgagcctg

SEQ ID NO: 34816 - DNA, 22 bp, Homo sapiens
gatgaaaggaacagtctgtgca

SEQ ID NO: 34817 - DNA, 21 bp, Homo sapiens
gtatgtgtgagtataagttga

SEQ ID NO: 34818 - DNA, 21 bp, Homo sapiens
caggatagctgggtccattca

SEQ ID NO: 34819 - DNA, 19 bp, Homo sapiens
ctaaccctcatccagggct

SEQ ID NO: 34820 - DNA, 17 bp, Homo sapiens
ggccctggcataagctg

SEQ ID NO: 34821 - DNA, 23 bp, Homo sapiens
gtgtgtgtgggtgggtgtgagtg

SEQ ID NO: 34822 - DNA, 24 bp, Homo sapiens
tcttgcttgtccccaaatcaccta

SEQ ID NO: 34823 - DNA, 18 bp, Homo sapiens
tggcatgtgtttcttgga

SEQ ID NO: 34824 - DNA, 20 bp, Homo sapiens
tgtatgggtgtgtgtgggtg

SEQ ID NO: 34825 - DNA, 16 bp, Homo sapiens
ctcctgcacccttttt

SEQ ID NO: 34826 - DNA, 19 bp, Homo sapiens
cttccactcagttccccca

SEQ ID NO: 34827 - DNA, 18 bp, Homo sapiens
cacgtagacaggctgtaa

SEQ ID NO: 34828 - DNA, 20 bp, Homo sapiens
cccaatgaccccccttcagc

SEQ ID NO: 34829 - DNA, 18 bp, Homo sapiens
cttcagccccgggtgcca

SEQ ID NO: 34830 - DNA, 19 bp, Homo sapiens
cttctcattgtcttaattt

SEQ ID NO: 34831 - DNA, 23 bp, Homo sapiens
gctcctcattcctcccctgccct

SEQ ID NO: 34832 - DNA, 23 bp, Homo sapiens
ggaggaggggagaaggggagaca

SEQ ID NO: 34833 - DNA, 18 bp, Homo sapiens
ttaatttcgctttgtgca

SEQ ID NO: 34834 - DNA, 27 bp, Homo sapiens
cctccaggatccttactaataatgggc

SEQ ID NO: 34835 - DNA, 17 bp, Homo sapiens
ctctttgctctgcctct

SEQ ID NO: 34836 - DNA, 22 bp, Homo sapiens
actccagacactgaactgtcct

SEQ ID NO: 34837 - DNA, 21 bp, Homo sapiens
gcctgggtgagtgttgggctc

SEQ ID NO: 34838 - DNA, 18 bp, Homo sapiens
atgcccatttttatatgc

SEQ ID NO: 34839 - DNA, 17 bp, Homo sapiens
catggaaacagcaagca

SEQ ID NO: 34840 - DNA, 22 bp, Homo sapiens
ctctctccctctttctcctctc

SEQ ID NO: 34841 - DNA, 21 bp, Homo sapiens
ctctctctctcttcctctctc

SEQ ID NO: 34842 - DNA, 20 bp, Homo sapiens
gcgccgcagccgccccctcc

SEQ ID NO: 34843 - DNA, 22 bp, Homo sapiens
tggtctgttttgacagaaactg

SEQ ID NO: 34844 - DNA, 17 bp, Homo sapiens
aagttgcagagatgtga

SEQ ID NO: 34845 - DNA, 18 bp, Homo sapiens
ggtccacgcgccgtctcc

SEQ ID NO: 34846 - DNA, 19 bp, Homo sapiens
attcagttaattcacttga

SEQ ID NO: 34847 - DNA, 22 bp, Homo sapiens
catttgtgccccactgacctga

SEQ ID NO: 34848 - DNA, 19 bp, Homo sapiens
cgtggcgcccatcctctga

SEQ ID NO: 34849 - DNA, 20 bp, Homo sapiens
ctattcttctcagaccctca

SEQ ID NO: 34850 - DNA, 16 bp, Homo sapiens
atcctgggcccagatc

SEQ ID NO: 34851 - DNA, 20 bp, Homo sapiens
cctgccttcccacattctga

SEQ ID NO: 34852 - DNA, 18 bp, Homo sapiens
gtgtttgtctggtgtcag

SEQ ID NO: 34853 - DNA, 19 bp, Homo sapiens
ttcaaaatagcattcccca

SEQ ID NO: 34854 - DNA, 20 bp, Homo sapiens
ttctacagtcgtcgattttt

SEQ ID NO: 34855 - DNA, 22 bp, Homo sapiens
cagagtcccagctcctcagtca

SEQ ID NO: 34856 - DNA, 17 bp, Homo sapiens
ccagaaaattgcttcca

SEQ ID NO: 34857 - DNA, 23 bp, Homo sapiens
ccagtcctgctggcctgctctta

SEQ ID NO: 34858 - DNA, 20 bp, Homo sapiens
cttttcctagagactacgcc

SEQ ID NO: 34859 - DNA, 23 bp, Homo sapiens
tcactttcctcagccaaaggtcc

SEQ ID NO: 34860 - DNA, 19 bp, Homo sapiens
ctctttcccctttgcccct

SEQ ID NO: 34861 - DNA, 22 bp, Homo sapiens
tccctctgttgccatcagcttg

SEQ ID NO: 34862 - DNA, 20 bp, Homo sapiens
tggtggcaagtttctctgga

SEQ ID NO: 34863 - DNA, 16 bp, Homo sapiens
aggatcatgggaccag

SEQ ID NO: 34864 - DNA, 17 bp, Homo sapiens
tcaatgtacaaatcagc

SEQ ID NO: 34865 - DNA, 19 bp, Homo sapiens
aacacgagacaaaacaatc

SEQ ID NO: 34866 - DNA, 16 bp, Homo sapiens
catgtttgggggtctg

SEQ ID NO: 34867 - DNA, 24 bp, Homo sapiens
ccaaacatggacgtcctcccctcc

SEQ ID NO: 34868 - DNA, 23 bp, Homo sapiens
ccaggcagcgccccaggaagcca

SEQ ID NO: 34869 - DNA, 18 bp, Homo sapiens
ctgcaaagctgtgcaggg

SEQ ID NO: 34870 - DNA, 20 bp, Homo sapiens
tgggcaaagcagccacccca

SEQ ID NO: 34871 - DNA, 18 bp, Homo sapiens
tgtgtaagaatgtgtttt

SEQ ID NO: 34872 - DNA, 19 bp, Homo sapiens
aactcttaacagatgcagt

SEQ ID NO: 34873 - DNA, 19 bp, Homo sapiens
agcaacccttctcacctta

SEQ ID NO: 34874 - DNA, 22 bp, Homo sapiens
caggaaccccatccttgcttca

SEQ ID NO: 34875 - DNA, 22 bp, Homo sapiens
cccaccccgtctgtgtccccca

SEQ ID NO: 34876 - DNA, 19 bp, Homo sapiens
cctcagacacaccatttca

SEQ ID NO: 34877 - DNA, 22 bp, Homo sapiens
ctgtgcccccacccccgcctcc

SEQ ID NO: 34878 - DNA, 17 bp, Homo sapiens
gtacgcagccacctcct

SEQ ID NO: 34879 - DNA, 19 bp, Homo sapiens
gttttcatcactagactca

SEQ ID NO: 34880 - DNA, 18 bp, Homo sapiens
tattaaaatgtctggcaa

SEQ ID NO: 34881 - DNA, 24 bp, Homo sapiens
tccaagtacattatgaccccctca

SEQ ID NO: 34882 - DNA, 24 bp, Homo sapiens
tgtccagcaacggtaccgtttaca

SEQ ID NO: 34883 - DNA, 19 bp, Homo sapiens
ttcaggtattatttacttt

SEQ ID NO: 34884 - DNA, 22 bp, Homo sapiens
atccacagccttacactaggca

SEQ ID NO: 34885 - DNA, 17 bp, Homo sapiens
catggttttttgacctt

SEQ ID NO: 34886 - DNA, 19 bp, Homo sapiens
caaagccatgcctgctcct

SEQ ID NO: 34887 - DNA, 17 bp, Homo sapiens
cttcaagtctcatttta

SEQ ID NO: 34888 - DNA, 19 bp, Homo sapiens
tccttttgacgtacttttg

SEQ ID NO: 34889 - DNA, 21 bp, Homo sapiens
tcttgatgaaacatcttcgaa

SEQ ID NO: 34890 - DNA, 18 bp, Homo sapiens
tgcttgctgccatatgtg

SEQ ID NO: 34891 - DNA, 18 bp, Homo sapiens
ttgacactgatctggtcc

SEQ ID NO: 34892 - DNA, 24 bp, Homo sapiens
aagagaggtgtctgtctagccctg

SEQ ID NO: 34893 - DNA, 21 bp, Homo sapiens
cgacgagcaggcactggaaga

SEQ ID NO: 34894 - DNA, 19 bp, Homo sapiens
gtgggagggctcaacttta

SEQ ID NO: 34895 - DNA, 21 bp, Homo sapiens
taaacataaaaaaattagcct

SEQ ID NO: 34896 - DNA, 19 bp, Homo sapiens
catcaatcatccctgtcca

SEQ ID NO: 34897 - DNA, 22 bp, Homo sapiens
ccaaggaatatgaagtgagaca

SEQ ID NO: 34898 - DNA, 22 bp, Homo sapiens
ggctccagcagatgatgagata

SEQ ID NO: 34899 - DNA, 22 bp, Homo sapiens
caaactgtaagaatgctgttgt

SEQ ID NO: 34900 - DNA, 21 bp, Homo sapiens
gctctctactatgccttgatg

SEQ ID NO: 34901 - DNA, 18 bp, Homo sapiens
ttaatgaaagtgttgcac

SEQ ID NO: 34902 - DNA, 19 bp, Homo sapiens
caatttattttccgcagca

SEQ ID NO: 34903 - DNA, 19 bp, Homo sapiens
cctatggaaaatgcagctg

SEQ ID NO: 34904 - DNA, 19 bp, Homo sapiens
tttggcaccactctctgaa

SEQ ID NO: 34905 - DNA, 19 bp, Homo sapiens
cattgttagtgtaatctca

SEQ ID NO: 34906 - DNA, 16 bp, Homo sapiens
ctcttcctcctcccct

SEQ ID NO: 34907 - DNA, 20 bp, Homo sapiens
tccctcagcccagactcagt

SEQ ID NO: 34908 - DNA, 18 bp, Homo sapiens
ttattcccctggactccg

SEQ ID NO: 34909 - DNA, 19 bp, Homo sapiens
tggagctgcagctgggcca

SEQ ID NO: 34910 - DNA, 18 bp, Homo sapiens
agtaaggtgttactccca

SEQ ID NO: 34911 - DNA, 18 bp, Homo sapiens
atctctcagaccagctca

SEQ ID NO: 34912 - DNA, 20 bp, Homo sapiens
catggtccagccccatttga

SEQ ID NO: 34913 - DNA, 23 bp, Homo sapiens
ccacgaacaccagcccaaactga

SEQ ID NO: 34914 - DNA, 17 bp, Homo sapiens
cccacgcccagttccag

SEQ ID NO: 34915 - DNA, 20 bp, Homo sapiens
ctccaacctgggacatccca

SEQ ID NO: 34916 - DNA, 19 bp, Homo sapiens
gccccggccgggcccagcc

SEQ ID NO: 34917 - DNA, 19 bp, Homo sapiens
gctgataccacctacctca

SEQ ID NO: 34918 - DNA, 19 bp, Homo sapiens
tgggtggatcacctgagat

SEQ ID NO: 34919 - DNA, 18 bp, Homo sapiens
ttccagaaaggcctccag

SEQ ID NO: 34920 - DNA, 20 bp, Homo sapiens
catagaaaatgtacacttca

SEQ ID NO: 34921 - DNA, 18 bp, Homo sapiens
gaattaacatatatgatg

SEQ ID NO: 34922 - DNA, 18 bp, Homo sapiens
gtaaccggaagtgctgtc

SEQ ID NO: 34923 - DNA, 17 bp, Homo sapiens
tgcccagagagctgccc

SEQ ID NO: 34924 - DNA, 21 bp, Homo sapiens
acccagagccacacacgcccg

SEQ ID NO: 34925 - DNA, 17 bp, Homo sapiens
gagtcagactctaagaa

SEQ ID NO: 34926 - DNA, 16 bp, Homo sapiens
gtgactccaccagtta

SEQ ID NO: 34927 - DNA, 19 bp, Homo sapiens
agctaaaaagatcatgata

SEQ ID NO: 34928 - DNA, 20 bp, Homo sapiens
atgtaatgttgtgatattcc

SEQ ID NO: 34929 - DNA, 18 bp, Homo sapiens
ctcattttgcgaggctta

SEQ ID NO: 34930 - DNA, 19 bp, Homo sapiens
gctgttagttggcttttga

SEQ ID NO: 34931 - DNA, 20 bp, Homo sapiens
ggcgattggcatcgatctct

SEQ ID NO: 34932 - DNA, 18 bp, Homo sapiens
ctgggagaagaccacctg

SEQ ID NO: 34933 - DNA, 23 bp, Homo sapiens
gcaaagagaactacctcatatgc

SEQ ID NO: 34934 - DNA, 19 bp, Homo sapiens
ttccttttgatggctgcat

SEQ ID NO: 34935 - DNA, 21 bp, Homo sapiens
agaaaagaaagcaagaacaga

SEQ ID NO: 34936 - DNA, 25 bp, Homo sapiens
agctcccatcacaagcttggcattg

SEQ ID NO: 34937 - DNA, 22 bp, Homo sapiens
agttccccctctttctgggtca

SEQ ID NO: 34938 - DNA, 23 bp, Homo sapiens
atagatatatagagatatagata

SEQ ID NO: 34939 - DNA, 16 bp, Homo sapiens
caccagggtttgggga

SEQ ID NO: 34940 - DNA, 18 bp, Homo sapiens
cctggtgcaggccggtgg

SEQ ID NO: 34941 - DNA, 18 bp, Homo sapiens
gccaccagggtttgggga

SEQ ID NO: 34942 - DNA, 20 bp, Homo sapiens
ggaacctgaggagccacctg

SEQ ID NO: 34943 - DNA, 18 bp, Homo sapiens
tcagttccattttacctc

SEQ ID NO: 34944 - DNA, 21 bp, Homo sapiens
tcccgcctcccctcaccctca

SEQ ID NO: 34945 - DNA, 16 bp, Homo sapiens
tgcaaaacctaccttc

SEQ ID NO: 34946 - DNA, 18 bp, Homo sapiens
tgcccagaaattacccca

SEQ ID NO: 34947 - DNA, 21 bp, Homo sapiens
gggcttcgagggatggcggcg

SEQ ID NO: 34948 - DNA, 23 bp, Homo sapiens
tcccagaggaactgactaaggct

SEQ ID NO: 34949 - DNA, 24 bp, Homo sapiens
tgaccccagtcatcctgcaggtga

SEQ ID NO: 34950 - DNA, 15 bp, Homo sapiens
tggaaagctacatca

SEQ ID NO: 34951 - DNA, 18 bp, Homo sapiens
ttttgcccgcgtatctca

SEQ ID NO: 34952 - DNA, 18 bp, Homo sapiens
ggcggcaggagctgggcc

SEQ ID NO: 34953 - DNA, 19 bp, Homo sapiens
gaaaaaataagtgattcaa

SEQ ID NO: 34954 - DNA, 17 bp, Homo sapiens
tattaaaggatatgcaa

SEQ ID NO: 34955 - DNA, 19 bp, Homo sapiens
accatatgatattccactt

SEQ ID NO: 34956 - DNA, 17 bp, Homo sapiens
ctgagcctgagtcattt

SEQ ID NO: 34957 - DNA, 21 bp, Homo sapiens
taaatggattacactggggct

SEQ ID NO: 34958 - DNA, 20 bp, Homo sapiens
ttttgttatgtgcagtttat

SEQ ID NO: 34959 - DNA, 19 bp, Homo sapiens
ctgttttggtccaacccca

SEQ ID NO: 34960 - DNA, 19 bp, Homo sapiens
gctatggtgcagacattcc

SEQ ID NO: 34961 - DNA, 21 bp, Homo sapiens
ttctgatgagtctctgcttgc

SEQ ID NO: 34962 - DNA, 16 bp, Homo sapiens
cctgcggacagtcagg

SEQ ID NO: 34963 - DNA, 20 bp, Homo sapiens
cgcagtcaggaattctgaga

SEQ ID NO: 34964 - DNA, 19 bp, Homo sapiens
ggcgcacttcaaaaccctc

SEQ ID NO: 34965 - DNA, 21 bp, Homo sapiens
acttgatagtgcttttggtcc

SEQ ID NO: 34966 - DNA, 20 bp, Homo sapiens
ggcagccagcaaacttgata

SEQ ID NO: 34967 - DNA, 18 bp, Homo sapiens
tggtcctagatgattttt

SEQ ID NO: 34968 - DNA, 22 bp, Homo sapiens
ttatgtaatgaaaaacaaatag

SEQ ID NO: 34969 - DNA, 21 bp, Homo sapiens
agtagttgaattttgcaaagc

SEQ ID NO: 34970 - DNA, 21 bp, Homo sapiens
ccttggtgcgatgtctgtgag

SEQ ID NO: 34971 - DNA, 21 bp, Homo sapiens
ccttggtgcgatgtctgtgag

SEQ ID NO: 34972 - DNA, 18 bp, Homo sapiens
ctgcagcatccttgtgtg

SEQ ID NO: 34973 - DNA, 23 bp, Homo sapiens
acaaaatgatggacccaatgcac

SEQ ID NO: 34974 - DNA, 19 bp, Homo sapiens
agcttccagtccaatctca

SEQ ID NO: 34975 - DNA, 20 bp, Homo sapiens
caacccttttgtctgcctct

SEQ ID NO: 34976 - DNA, 21 bp, Homo sapiens
caatttacttgccattactca

SEQ ID NO: 34977 - DNA, 19 bp, Homo sapiens
cagggcctgagccaagcta

SEQ ID NO: 34978 - DNA, 19 bp, Homo sapiens
gctgtgcccaagttgtggt

SEQ ID NO: 34979 - DNA, 17 bp, Homo sapiens
tcaaatgcttggcttct

SEQ ID NO: 34980 - DNA, 17 bp, Homo sapiens
tcagactagtttagtta

SEQ ID NO: 34981 - DNA, 18 bp, Homo sapiens
tccaatctaaccacatca

SEQ ID NO: 34982 - DNA, 17 bp, Homo sapiens
tgagcactcccaagtct

SEQ ID NO: 34983 - DNA, 18 bp, Homo sapiens
ttgaagtcagatgtggta

SEQ ID NO: 34984 - DNA, 19 bp, Homo sapiens
agcaccttctcgtccacca

SEQ ID NO: 34985 - DNA, 19 bp, Homo sapiens
gcctctgtcccccaggtgt

SEQ ID NO: 34986 - DNA, 20 bp, Homo sapiens
ggagcttcccaccatctaca

SEQ ID NO: 34987 - DNA, 17 bp, Homo sapiens
aattccaacaactccaa

SEQ ID NO: 34988 - DNA, 18 bp, Homo sapiens
caggaggcctgggcccag

SEQ ID NO: 34989 - DNA, 22 bp, Homo sapiens
ccctgatgaccctccctgcgag

SEQ ID NO: 34990 - DNA, 17 bp, Homo sapiens
ctgccaggtgctggcca

SEQ ID NO: 34991 - DNA, 18 bp, Homo sapiens
gagctgtgttgaaatcca

SEQ ID NO: 34992 - DNA, 17 bp, Homo sapiens
gcctagcatagatttgc

SEQ ID NO: 34993 - DNA, 20 bp, Homo sapiens
tctgctttactctcatgtgg

SEQ ID NO: 34994 - DNA, 24 bp, Homo sapiens
ttatagctattagaataaaatctc

SEQ ID NO: 34995 - DNA, 23 bp, Homo sapiens
agcatttatgacctcttctatga

SEQ ID NO: 34996 - DNA, 22 bp, Homo sapiens
cccagcttggcctcccgcaatg

SEQ ID NO: 34997 - DNA, 17 bp, Homo sapiens
tcaagtgattctcctgc

SEQ ID NO: 34998 - DNA, 20 bp, Homo sapiens
ttcaagaccagcctgaccaa

SEQ ID NO: 34999 - DNA, 23 bp, Homo sapiens
agcatttatgacctcttctatga

SEQ ID NO: 35000 - DNA, 17 bp, Homo sapiens
tcaagtgattctcctgc

SEQ ID NO: 35001 - DNA, 18 bp, Homo sapiens
cggagaggacctccaacc

SEQ ID NO: 35002 - DNA, 23 bp, Homo sapiens
acctggacttaagcatctggctc

SEQ ID NO: 35003 - DNA, 18 bp, Homo sapiens
cagcccttctgaccaccg

SEQ ID NO: 35004 - DNA, 17 bp, Homo sapiens
aggacaccccccacccc

SEQ ID NO: 35005 - DNA, 16 bp, Homo sapiens
atcctctcccctcagg

SEQ ID NO: 35006 - DNA, 23 bp, Homo sapiens
ccagatgattaaacgttgtatta

SEQ ID NO: 35007 - DNA, 22 bp, Homo sapiens
ccctgcattgaggccttgtgga

SEQ ID NO: 35008 - DNA, 16 bp, Homo sapiens
gaacggccactcgaga

SEQ ID NO: 35009 - DNA, 21 bp, Homo sapiens
gaccccgggcttcatccacat

SEQ ID NO: 35010 - DNA, 18 bp, Homo sapiens
acatttgtgcttaaattg

SEQ ID NO: 35011 - DNA, 17 bp, Homo sapiens
agaaacaaacaaacaaa

SEQ ID NO: 35012 - DNA, 21 bp, Homo sapiens
cccacctccacagccaggatg

SEQ ID NO: 35013 - DNA, 19 bp, Homo sapiens
cctagatgtcaactccaca

SEQ ID NO: 35014 - DNA, 22 bp, Homo sapiens
agcgaccttggcctcagttcac

SEQ ID NO: 35015 - DNA, 23 bp, Homo sapiens
agggaggctgctggacccacccc

SEQ ID NO: 35016 - DNA, 20 bp, Homo sapiens
ccaatgcccacttcccctcc

SEQ ID NO: 35017 - DNA, 23 bp, Homo sapiens
cccaaacactggtttgcatccca

SEQ ID NO: 35018 - DNA, 18 bp, Homo sapiens
ctgcccactgcactcttt

SEQ ID NO: 35019 - DNA, 20 bp, Homo sapiens
gttttctccatggcaggaca

SEQ ID NO: 35020 - DNA, 18 bp, Homo sapiens
aaagtgacaaaaacgtgt

SEQ ID NO: 35021 - DNA, 19 bp, Homo sapiens
agtagctacgactgcaagc

SEQ ID NO: 35022 - DNA, 18 bp, Homo sapiens
ccacctccacctcccaaa

SEQ ID NO: 35023 - DNA, 18 bp, Homo sapiens
ccccacttagagacaatg

SEQ ID NO: 35024 - DNA, 18 bp, Homo sapiens
cctcccacctccacctcc

SEQ ID NO: 35025 - DNA, 18 bp, Homo sapiens
catggtgatttttgcaat

SEQ ID NO: 35026 - DNA, 18 bp, Homo sapiens
ctttacttttaatacagg

SEQ ID NO: 35027 - DNA, 19 bp, Homo sapiens
ttgcaaagagtagcttttt

SEQ ID NO: 35028 - DNA, 19 bp, Homo sapiens
ttttgttttgaagagttga

SEQ ID NO: 35029 - DNA, 21 bp, Homo sapiens
gaagaccagacagattcagag

SEQ ID NO: 35030 - DNA, 19 bp, Homo sapiens
acgagaatgttaccatgca

SEQ ID NO: 35031 - DNA, 20 bp, Homo sapiens
catgtcgtggctggctacaa

SEQ ID NO: 35032 - DNA, 22 bp, Homo sapiens
gattaagacttttcacaaaata

SEQ ID NO: 35033 - DNA, 20 bp, Homo sapiens
taaatggactttggggagac

SEQ ID NO: 35034 - DNA, 22 bp, Homo sapiens
taggtgccctgttctcctacca

SEQ ID NO: 35035 - DNA, 21 bp, Homo sapiens
tgctcaaaggaaagtcagtgg

SEQ ID NO: 35036 - DNA, 21 bp, Homo sapiens
tgtgcagctagctttgtttta

SEQ ID NO: 35037 - DNA, 16 bp, Homo sapiens
ccagtggccatgtgaa

SEQ ID NO: 35038 - DNA, 18 bp, Homo sapiens
gaaaggtactgtaggcag

SEQ ID NO: 35039 - DNA, 18 bp, Homo sapiens
ggtgatccacctacctcg

SEQ ID NO: 35040 - DNA, 17 bp, Homo sapiens
caacaacaactgctaca

SEQ ID NO: 35041 - DNA, 17 bp, Homo sapiens
ccaatatcaattgtgtg

SEQ ID NO: 35042 - DNA, 21 bp, Homo sapiens
ccccacccacagtgctgcact

SEQ ID NO: 35043 - DNA, 19 bp, Homo sapiens
ccccctgcccacctctcca

SEQ ID NO: 35044 - DNA, 25 bp, Homo sapiens
cgcccaccccctgcccacctctcca

SEQ ID NO: 35045 - DNA, 17 bp, Homo sapiens
ctgtgagccctacctta

SEQ ID NO: 35046 - DNA, 17 bp, Homo sapiens
cttacccctctgcccct

SEQ ID NO: 35047 - DNA, 18 bp, Homo sapiens
gctgttgctgcttggtct

SEQ ID NO: 35048 - DNA, 22 bp, Homo sapiens
gcttggagtgctgctgcctggc

SEQ ID NO: 35049 - DNA, 21 bp, Homo sapiens
tctgggctgctaacctggcct

SEQ ID NO: 35050 - DNA, 20 bp, Homo sapiens
tgagggtggtgggcctgcgg

SEQ ID NO: 35051 - DNA, 20 bp, Homo sapiens
taggtggaaaacatggaatt

SEQ ID NO: 35052 - DNA, 18 bp, Homo sapiens
ttgtggtttttgccattg

SEQ ID NO: 35053 - DNA, 18 bp, Homo sapiens
gctgtggccagggcccca

SEQ ID NO: 35054 - DNA, 22 bp, Homo sapiens
tagatgccctggtgtagggctg

SEQ ID NO: 35055 - DNA, 17 bp, Homo sapiens
atcttggcttctggccc

SEQ ID NO: 35056 - DNA, 18 bp, Homo sapiens
atggaaatagcatatcta

SEQ ID NO: 35057 - DNA, 20 bp, Homo sapiens
ctgggtaaaatgactattga

SEQ ID NO: 35058 - DNA, 19 bp, Homo sapiens
gattgctttgtaaatgttt

SEQ ID NO: 35059 - DNA, 21 bp, Homo sapiens
aagtatcttgtatcgactaca

SEQ ID NO: 35060 - DNA, 21 bp, Homo sapiens
caaaatacacaacttttagca

SEQ ID NO: 35061 - DNA, 22 bp, Homo sapiens
ccttggtggcggaatggcgttg

SEQ ID NO: 35062 - DNA, 20 bp, Homo sapiens
ctcccctaaaccccacccca

SEQ ID NO: 35063 - DNA, 21 bp, Homo sapiens
ctctagcaaacatgtagttta

SEQ ID NO: 35064 - DNA, 18 bp, Homo sapiens
ctctctgagtatttagct

SEQ ID NO: 35065 - DNA, 17 bp, Homo sapiens
ctgggtccctcccacaa

SEQ ID NO: 35066 - DNA, 24 bp, Homo sapiens
cttaggtgataaggaatcattttt

SEQ ID NO: 35067 - DNA, 20 bp, Homo sapiens
gtcctttaaaaaatggagga

SEQ ID NO: 35068 - DNA, 23 bp, Homo sapiens
tctgagtagttgtccatcacttt

SEQ ID NO: 35069 - DNA, 21 bp, Homo sapiens
ttgtggtggaaggtgaaaggc

SEQ ID NO: 35070 - DNA, 19 bp, Homo sapiens
acatttaataaaatgaggg

SEQ ID NO: 35071 - DNA, 20 bp, Homo sapiens
accaaggatccatctgggct

SEQ ID NO: 35072 - DNA, 24 bp, Homo sapiens
agcacactataatatagtgaactg

SEQ ID NO: 35073 - DNA, 24 bp, Homo sapiens
caaggaaagaaaattttttctaca

SEQ ID NO: 35074 - DNA, 19 bp, Homo sapiens
cctcaccaccttccctcca

SEQ ID NO: 35075 - DNA, 23 bp, Homo sapiens
gctttttgcctgatgccatttta

SEQ ID NO: 35076 - DNA, 18 bp, Homo sapiens
tcatggttgtaaaccaaa

SEQ ID NO: 35077 - DNA, 17 bp, Homo sapiens
ctctccgcctctgcctc

SEQ ID NO: 35078 - DNA, 17 bp, Homo sapiens
ctctccgcctctgcctc

SEQ ID NO: 35079 - DNA, 20 bp, Homo sapiens
acagacactcaaactcccaa

SEQ ID NO: 35080 - DNA, 17 bp, Homo sapiens
cccgccctgccccagct

SEQ ID NO: 35081 - DNA, 20 bp, Homo sapiens
tcacccatgctcaggccatt

SEQ ID NO: 35082 - DNA, 17 bp, Homo sapiens
tgctcaggccattccag

SEQ ID NO: 35083 - DNA, 21 bp, Homo sapiens
ccattttccagcagcgctcga

SEQ ID NO: 35084 - DNA, 20 bp, Homo sapiens
ggttacaaggatttgcaata

SEQ ID NO: 35085 - DNA, 21 bp, Homo sapiens
gtattcttgttcacttgatta

SEQ ID NO: 35086 - DNA, 20 bp, Homo sapiens
ccacctccgcctccacctcc

SEQ ID NO: 35087 - DNA, 20 bp, Homo sapiens
ccgattccacctccgcctcc

SEQ ID NO: 35088 - DNA, 17 bp, Homo sapiens
cctgccccgcccacttt

SEQ ID NO: 35089 - DNA, 18 bp, Homo sapiens
ggccagacaacctcaggg

SEQ ID NO: 35090 - DNA, 21 bp, Homo sapiens
taccagcgtctccttcgggta

SEQ ID NO: 35091 - DNA, 27 bp, Homo sapiens
tcccagagcgccccgagggggcagcga

SEQ ID NO: 35092 - DNA, 19 bp, Homo sapiens
tgcccaaggccaacctcct

SEQ ID NO: 35093 - DNA, 21 bp, Homo sapiens
aaaatgcacagaaaccattgg

SEQ ID NO: 35094 - DNA, 19 bp, Homo sapiens
tggctgcccaacgtggagc

SEQ ID NO: 35095 - DNA, 20 bp, Homo sapiens
aaaaacgaataagcaaagaa

SEQ ID NO: 35096 - DNA, 19 bp, Homo sapiens
gcaaatacaggtgcattta

SEQ ID NO: 35097 - DNA, 16 bp, Homo sapiens
tatgaattgttcatcg

SEQ ID NO: 35098 - DNA, 17 bp, Homo sapiens
tgacagtcaccacgagg

SEQ ID NO: 35099 - DNA, 19 bp, Homo sapiens
gattacttttcacaaaata

SEQ ID NO: 35100 - DNA, 19 bp, Homo sapiens
aatgagattctaactagga

SEQ ID NO: 35101 - DNA, 18 bp, Homo sapiens
caacaactttacttgcct

SEQ ID NO: 35102 - DNA, 21 bp, Homo sapiens
ccatatttgtttaattgtatt

SEQ ID NO: 35103 - DNA, 20 bp, Homo sapiens
gaggcagaagaatcacttca

SEQ ID NO: 35104 - DNA, 25 bp, Homo sapiens
aaaataccactgtacttgttttaca

SEQ ID NO: 35105 - DNA, 22 bp, Homo sapiens
tcagcacatgttgagttttcta

SEQ ID NO: 35106 - DNA, 25 bp, Homo sapiens
cccatcacagccacaccacatccca

SEQ ID NO: 35107 - DNA, 25 bp, Homo sapiens
cccatcacagccacaccacatccca

SEQ ID NO: 35108 - DNA, 18 bp, Homo sapiens
ggacgggctgggcccagt

SEQ ID NO: 35109 - DNA, 20 bp, Homo sapiens
aggcccactccagcctgaga

SEQ ID NO: 35110 - DNA, 21 bp, Homo sapiens
atgttcacacatgcacactca

SEQ ID NO: 35111 - DNA, 21 bp, Homo sapiens
cctgctgacatctacctgcca

SEQ ID NO: 35112 - DNA, 21 bp, Homo sapiens
gaggttggcatcccccatccc

SEQ ID NO: 35113 - DNA, 22 bp, Homo sapiens
ggaggaggaagccagcagcaca

SEQ ID NO: 35114 - DNA, 20 bp, Homo sapiens
gggcccttggtgtgctcaca

SEQ ID NO: 35115 - DNA, 19 bp, Homo sapiens
ggggacaggtcggctgtgg

SEQ ID NO: 35116 - DNA, 17 bp, Homo sapiens
gtgcagctctggtctgc

SEQ ID NO: 35117 - DNA, 18 bp, Homo sapiens
tccgcctcccgggttcaa

SEQ ID NO: 35118 - DNA, 24 bp, Homo sapiens
atcagatagcaatagacctctaga

SEQ ID NO: 35119 - DNA, 18 bp, Homo sapiens
caccatgattgtaagttc

SEQ ID NO: 35120 - DNA, 24 bp, Homo sapiens
catgtactattaatgaaaatgtta

SEQ ID NO: 35121 - DNA, 22 bp, Homo sapiens
agatggagttataactgtcata

SEQ ID NO: 35122 - DNA, 20 bp, Homo sapiens
agtctcactctgtcgcccag

SEQ ID NO: 35123 - DNA, 21 bp, Homo sapiens
attaatttacagacatttgaa

SEQ ID NO: 35124 - DNA, 18 bp, Homo sapiens
cagaatgcgggaagccgc

SEQ ID NO: 35125 - DNA, 19 bp, Homo sapiens
cccagaaatataccctgac

SEQ ID NO: 35126 - DNA, 18 bp, Homo sapiens
cctgcaacctccacctcc

SEQ ID NO: 35127 - DNA, 19 bp, Homo sapiens
ctgcaacctccacctccca

SEQ ID NO: 35128 - DNA, 18 bp, Homo sapiens
tccacctcccaggttcaa

SEQ ID NO: 35129 - DNA, 18 bp, Homo sapiens
ttcaagcgattctcatgc

SEQ ID NO: 35130 - DNA, 17 bp, Homo sapiens
atgttgggtttcctgat

SEQ ID NO: 35131 - DNA, 21 bp, Homo sapiens
catgatttcttttggtcaatc

SEQ ID NO: 35132 - DNA, 22 bp, Homo sapiens
cccccaaacttatcagaatcct

SEQ ID NO: 35133 - DNA, 20 bp, Homo sapiens
aactgctaaaatacctctgt

SEQ ID NO: 35134 - DNA, 19 bp, Homo sapiens
actgtaatgttacatgcac

SEQ ID NO: 35135 - DNA, 18 bp, Homo sapiens
ctgagttatttgtacaga

SEQ ID NO: 35136 - DNA, 22 bp, Homo sapiens
gtcatggaatacaacctttaga

SEQ ID NO: 35137 - DNA, 19 bp, Homo sapiens
gtgagagctgttttgtttt

SEQ ID NO: 35138 - DNA, 19 bp, Homo sapiens
taagtaaaatttatttcac

SEQ ID NO: 35139 - DNA, 15 bp, Homo sapiens
tattaagaaaactcc

SEQ ID NO: 35140 - DNA, 17 bp, Homo sapiens
tctttgcaaacagtgtt

SEQ ID NO: 35141 - DNA, 22 bp, Homo sapiens
acaataattaataattgttcaa

SEQ ID NO: 35142 - DNA, 21 bp, Homo sapiens
tatgtgcatgtttgatatttt

SEQ ID NO: 35143 - DNA, 19 bp, Homo sapiens
tattatcttcctgtgctgt

SEQ ID NO: 35144 - DNA, 19 bp, Homo sapiens
tgaaaacaaaatcagtttt

SEQ ID NO: 35145 - DNA, 19 bp, Homo sapiens
caagtccctagctccctca

SEQ ID NO: 35146 - DNA, 18 bp, Homo sapiens
cctctaataagacatcgg

SEQ ID NO: 35147 - DNA, 19 bp, Homo sapiens
gcctctggcccaggagtta

SEQ ID NO: 35148 - DNA, 22 bp, Homo sapiens
ggcccgcgggtaaccacctcct

SEQ ID NO: 35149 - DNA, 21 bp, Homo sapiens
tgaagagcagagcttacctca

SEQ ID NO: 35150 - DNA, 22 bp, Homo sapiens
agaccatcctggatgcccagga

SEQ ID NO: 35151 - DNA, 18 bp, Homo sapiens
cggcagcagcagcagcac

SEQ ID NO: 35152 - DNA, 22 bp, Homo sapiens
ttaccagcatgaagttcaccta

SEQ ID NO: 35153 - DNA, 20 bp, Homo sapiens
ggccagtgcgacggcaaatc

SEQ ID NO: 35154 - DNA, 16 bp, Homo sapiens
cccagccctgttccag

SEQ ID NO: 35155 - DNA, 20 bp, Homo sapiens
ctctccttccttcttattga

SEQ ID NO: 35156 - DNA, 17 bp, Homo sapiens
cccaaatcgtcatggaa

SEQ ID NO: 35157 - DNA, 20 bp, Homo sapiens
ctcttctaccctccccctct

SEQ ID NO: 35158 - DNA, 22 bp, Homo sapiens
gagtacaccgttcactattgta

SEQ ID NO: 35159 - DNA, 19 bp, Homo sapiens
ggacagccagctccgccct

SEQ ID NO: 35160 - DNA, 22 bp, Homo sapiens
acggcaccacagaagcctggca

SEQ ID NO: 35161 - DNA, 28 bp, Homo sapiens
agaggaccagtattttcatttccataaa

SEQ ID NO: 35162 - DNA, 18 bp, Homo sapiens
atctgctccttatctcca

SEQ ID NO: 35163 - DNA, 21 bp, Homo sapiens
ccaaggggagacattgctcca

SEQ ID NO: 35164 - DNA, 17 bp, Homo sapiens
ccaggccacccccacca

SEQ ID NO: 35165 - DNA, 21 bp, Homo sapiens
ctccttaaatttatcttcaca

SEQ ID NO: 35166 - DNA, 22 bp, Homo sapiens
gagaagtaagacagagaagccg

SEQ ID NO: 35167 - DNA, 22 bp, Homo sapiens
tccagaaggggttcaccttaaa

SEQ ID NO: 35168 - DNA, 19 bp, Homo sapiens
actgtccgacccctgcaca

SEQ ID NO: 35169 - DNA, 19 bp, Homo sapiens
cttaacatctgtcctgatg

SEQ ID NO: 35170 - DNA, 18 bp, Homo sapiens
gcggtgaagatctgtgga

SEQ ID NO: 35171 - DNA, 20 bp, Homo sapiens
gtgagcatgatcgcgacact

SEQ ID NO: 35172 - DNA, 16 bp, Homo sapiens
gttttaggtcttgtca

SEQ ID NO: 35173 - DNA, 19 bp, Homo sapiens
tccttccacagccgcatct

SEQ ID NO: 35174 - DNA, 18 bp, Homo sapiens
tgctcaaggcaatttcca

SEQ ID NO: 35175 - DNA, 18 bp, Homo sapiens
gcattaatcttgcagttt

SEQ ID NO: 35176 - DNA, 22 bp, Homo sapiens
gctgcttctgttttttcattaa

SEQ ID NO: 35177 - DNA, 26 bp, Homo sapiens
atggaacagtgtctcagctggaactg

SEQ ID NO: 35178 - DNA, 19 bp, Homo sapiens
catctgtctggctcatgag

SEQ ID NO: 35179 - DNA, 20 bp, Homo sapiens
cttttggggaccactgccca

SEQ ID NO: 35180 - DNA, 18 bp, Homo sapiens
aaaaaagcaaacgaagaa

SEQ ID NO: 35181 - DNA, 21 bp, Homo sapiens
aactagaaccagcacacgaaa

SEQ ID NO: 35182 - DNA, 16 bp, Homo sapiens
aagaacgctgaaccca

SEQ ID NO: 35183 - DNA, 18 bp, Homo sapiens
acaccgcaacagaatgat

SEQ ID NO: 35184 - DNA, 18 bp, Homo sapiens
ccagaaaatgccatgtta

SEQ ID NO: 35185 - DNA, 20 bp, Homo sapiens
ggaggtgtcagtgattgcca

SEQ ID NO: 35186 - DNA, 21 bp, Homo sapiens
gttgaatcggggcctttgttc

SEQ ID NO: 35187 - DNA, 19 bp, Homo sapiens
tatgattgtgccactgcac

SEQ ID NO: 35188 - DNA, 16 bp, Homo sapiens
tgatcgtaacacattc

SEQ ID NO: 35189 - DNA, 22 bp, Homo sapiens
tttaggcttcacaaattatttt

SEQ ID NO: 35190 - DNA, 17 bp, Homo sapiens
ctcagcgccgccgacac

SEQ ID NO: 35191 - DNA, 20 bp, Homo sapiens
acagtgacatcctctccctc

SEQ ID NO: 35192 - DNA, 23 bp, Homo sapiens
atctgggctcaggtgtatggccc

SEQ ID NO: 35193 - DNA, 19 bp, Homo sapiens
ccattatgaaaaacacagc

SEQ ID NO: 35194 - DNA, 20 bp, Homo sapiens
cctgccccaacccccgtcca

SEQ ID NO: 35195 - DNA, 20 bp, Homo sapiens
cgtcccccaggattgatcca

SEQ ID NO: 35196 - DNA, 18 bp, Homo sapiens
ctctttcagccatcctga

SEQ ID NO: 35197 - DNA, 19 bp, Homo sapiens
ctttttggttgagaaagga

SEQ ID NO: 35198 - DNA, 17 bp, Homo sapiens
gcagtcagctgctgtta

SEQ ID NO: 35199 - DNA, 18 bp, Homo sapiens
tcaccattcccctcacaa

SEQ ID NO: 35200 - DNA, 20 bp, Homo sapiens
tcctggagatcctaatgggc

SEQ ID NO: 35201 - DNA, 23 bp, Homo sapiens
tccttcctaagtactcatcaaat

SEQ ID NO: 35202 - DNA, 20 bp, Homo sapiens
tgaaatcaccattcccctca

SEQ ID NO: 35203 - DNA, 18 bp, Homo sapiens
tgagcccagccttcccca

SEQ ID NO: 35204 - DNA, 18 bp, Homo sapiens
tgagccttcttggcccca

SEQ ID NO: 35205 - DNA, 19 bp, Homo sapiens
ttgagcaagggcccctaga

SEQ ID NO: 35206 - DNA, 20 bp, Homo sapiens
atccaccactgtaatatcat

SEQ ID NO: 35207 - DNA, 20 bp, Homo sapiens
cacctcagcctcctgaacag

SEQ ID NO: 35208 - DNA, 22 bp, Homo sapiens
catcgagacattaaatctcaga

SEQ ID NO: 35209 - DNA, 21 bp, Homo sapiens
cctgtgctccacctccctcca

SEQ ID NO: 35210 - DNA, 23 bp, Homo sapiens
gtttgtacagatatgtttggccc

SEQ ID NO: 35211 - DNA, 19 bp, Homo sapiens
tatttcttttcttccattg

SEQ ID NO: 35212 - DNA, 23 bp, Homo sapiens
tggtcttgaactcctgggttcaa

SEQ ID NO: 35213 - DNA, 22 bp, Homo sapiens
agcccccaaactgcatataata

SEQ ID NO: 35214 - DNA, 18 bp, Homo sapiens
agtaagatgttactttca

SEQ ID NO: 35215 - DNA, 18 bp, Homo sapiens
atgctaccttttttgtta

SEQ ID NO: 35216 - DNA, 18 bp, Homo sapiens
ccaacaagagacttggca

SEQ ID NO: 35217 - DNA, 19 bp, Homo sapiens
ttaaaacatagggtgagta

SEQ ID NO: 35218 - DNA, 22 bp, Homo sapiens
ttttttcatggtcccttgcttt

SEQ ID NO: 35219 - DNA, 24 bp, Homo sapiens
ttttttgttaacaagacactgact

SEQ ID NO: 35220 - DNA, 20 bp, Homo sapiens
ctctgaaccagaagtcatca

SEQ ID NO: 35221 - DNA, 17 bp, Homo sapiens
gcccagtggctttaaac

SEQ ID NO: 35222 - DNA, 19 bp, Homo sapiens
tgcaaggtgctgcctaact

SEQ ID NO: 35223 - DNA, 18 bp, Homo sapiens
ggtgcccgagtgatctga

SEQ ID NO: 35224 - DNA, 24 bp, Homo sapiens
tcctcatcttggagggtttgggga

SEQ ID NO: 35225 - DNA, 19 bp, Homo sapiens
tcttccttgcactccttga

SEQ ID NO: 35226 - DNA, 21 bp, Homo sapiens
ttaaacccccaccactccccg

SEQ ID NO: 35227 - DNA, 25 bp, Homo sapiens
tttcttccttgcactccttgatctt

SEQ ID NO: 35228 - DNA, 19 bp, Homo sapiens
aacagaaaaaaggtattga

SEQ ID NO: 35229 - DNA, 23 bp, Homo sapiens
caaatttccttaggattatagta

SEQ ID NO: 35230 - DNA, 26 bp, Homo sapiens
gaaagtgtatttttggtatgaagctg

SEQ ID NO: 35231 - DNA, 16 bp, Homo sapiens
tggacacattatctta

SEQ ID NO: 35232 - DNA, 22 bp, Homo sapiens
aatacagactgtttgtttacca

SEQ ID NO: 35233 - DNA, 22 bp, Homo sapiens
gcagctttgagggggaacagtt

SEQ ID NO: 35234 - DNA, 21 bp, Homo sapiens
tctgtatcatacattgctttt

SEQ ID NO: 35235 - DNA, 23 bp, Homo sapiens
ggtgggccaggcagcgcaccgca

SEQ ID NO: 35236 - DNA, 25 bp, Homo sapiens
gtttgggtcttttgtgccgtggctc

SEQ ID NO: 35237 - DNA, 21 bp, Homo sapiens
aaatagcttatggccctgtgc

SEQ ID NO: 35238 - DNA, 18 bp, Homo sapiens
gcatctgccccggtgaag

SEQ ID NO: 35239 - DNA, 17 bp, Homo sapiens
tcagcgggagtcaccta

SEQ ID NO: 35240 - DNA, 21 bp, Homo sapiens
aaaaggtagaacttggatgat

SEQ ID NO: 35241 - DNA, 20 bp, Homo sapiens
catagacaactagagcagct

SEQ ID NO: 35242 - DNA, 20 bp, Homo sapiens
ccacagccatagacaactag

SEQ ID NO: 35243 - DNA, 20 bp, Homo sapiens
acaaaattgcaccttgtgtc

SEQ ID NO: 35244 - DNA, 18 bp, Homo sapiens
catgtactgttgatgagg

SEQ ID NO: 35245 - DNA, 19 bp, Homo sapiens
ccttagtctccttactctt

SEQ ID NO: 35246 - DNA, 17 bp, Homo sapiens
ctcattttgtctgtcat

SEQ ID NO: 35247 - DNA, 22 bp, Homo sapiens
ctctaatttctattacatgtaa

SEQ ID NO: 35248 - DNA, 23 bp, Homo sapiens
tctttttgtggcaaaagaaactt

SEQ ID NO: 35249 - DNA, 19 bp, Homo sapiens
tgagcatgtgtcccacagc

SEQ ID NO: 35250 - DNA, 21 bp, Homo sapiens
tttcagtcacattgcattgta

SEQ ID NO: 35251 - DNA, 21 bp, Homo sapiens
tttctcaatattgttttggct

SEQ ID NO: 35252 - DNA, 23 bp, Homo sapiens
acctgggaaatttgatttggttt

SEQ ID NO: 35253 - DNA, 22 bp, Homo sapiens
caatgcttgatgtcatcaagca

SEQ ID NO: 35254 - DNA, 19 bp, Homo sapiens
cccgccgccagctacccgg

SEQ ID NO: 35255 - DNA, 24 bp, Homo sapiens
ccctggcgaagctggtgctgtgag

SEQ ID NO: 35256 - DNA, 18 bp, Homo sapiens
ctgccttgtctgccccca

SEQ ID NO: 35257 - DNA, 23 bp, Homo sapiens
gcctggaaccagactgtttgctt

SEQ ID NO: 35258 - DNA, 22 bp, Homo sapiens
gctattgctgtaccttgtgtta

SEQ ID NO: 35259 - DNA, 16 bp, Homo sapiens
gtggattgatttgatt

SEQ ID NO: 35260 - DNA, 20 bp, Homo sapiens
gtgtctcggccaaggcgagc

SEQ ID NO: 35261 - DNA, 18 bp, Homo sapiens
tgagtgatgtttcccata

SEQ ID NO: 35262 - DNA, 19 bp, Homo sapiens
tgtgttttaacaggggctg

SEQ ID NO: 35263 - DNA, 20 bp, Homo sapiens
tttcccatacaactcaggga

SEQ ID NO: 35264 - DNA, 21 bp, Homo sapiens
acccacattccccaatcaata

SEQ ID NO: 35265 - DNA, 23 bp, Homo sapiens
ccagaacaagttctgtgtgcctc

SEQ ID NO: 35266 - DNA, 17 bp, Homo sapiens
cttcacctactgacatg

SEQ ID NO: 35267 - DNA, 19 bp, Homo sapiens
gaccagaacacgagcccct

SEQ ID NO: 35268 - DNA, 25 bp, Homo sapiens
gccattaaggaatgaactctttcaa

SEQ ID NO: 35269 - DNA, 23 bp, Homo sapiens
gcctgactgccaagccacctgca

SEQ ID NO: 35270 - DNA, 22 bp, Homo sapiens
tcccaatctcccatttttacca

SEQ ID NO: 35271 - DNA, 18 bp, Homo sapiens
caatttttctgagagaag

SEQ ID NO: 35272 - DNA, 22 bp, Homo sapiens
aaaatagctacaggtaaccctt

SEQ ID NO: 35273 - DNA, 19 bp, Homo sapiens
agtgtgtaaaaatcaatca

SEQ ID NO: 35274 - DNA, 25 bp, Homo sapiens
cctgggggtgcgcccaagtcacttt

SEQ ID NO: 35275 - DNA, 22 bp, Homo sapiens
gcacgggccgcctctgctctcc

SEQ ID NO: 35276 - DNA, 17 bp, Homo sapiens
ggcgatctgcccacctc

SEQ ID NO: 35277 - DNA, 19 bp, Homo sapiens
gtcttggctgggtttgtca

SEQ ID NO: 35278 - DNA, 21 bp, Homo sapiens
tgtgggagtaaattgaaggtg

SEQ ID NO: 35279 - DNA, 19 bp, Homo sapiens
ttccagaaataaccaccag

SEQ ID NO: 35280 - DNA, 22 bp, Homo sapiens
ttttgatccaaaggatctgtgg

SEQ ID NO: 35281 - DNA, 27 bp, Homo sapiens
agaataggagcaagccagcactagtca

SEQ ID NO: 35282 - DNA, 21 bp, Homo sapiens
tcagctaactaagtgactcaa

SEQ ID NO: 35283 - DNA, 23 bp, Homo sapiens
agaaaaaagaaaggaatctgaca

SEQ ID NO: 35284 - DNA, 21 bp, Homo sapiens
aacaagttttgtgtttgctgt

SEQ ID NO: 35285 - DNA, 23 bp, Homo sapiens
agcgcatttaaggggtttttgtt

SEQ ID NO: 35286 - DNA, 20 bp, Homo sapiens
tccttttcactccgaatcgc

SEQ ID NO: 35287 - DNA, 21 bp, Homo sapiens
atctgcatctgctgacctcaa

SEQ ID NO: 35288 - DNA, 22 bp, Homo sapiens
ctctctccttccccagtgtaca

SEQ ID NO: 35289 - DNA, 24 bp, Homo sapiens
cttgggtaatccactagggctttt

SEQ ID NO: 35290 - DNA, 23 bp, Homo sapiens
cttttgttactgtccttaatttt

SEQ ID NO: 35291 - DNA, 19 bp, Homo sapiens
tccccttggactcaactta

SEQ ID NO: 35292 - DNA, 19 bp, Homo sapiens
tctggccacagagctgcag

SEQ ID NO: 35293 - DNA, 20 bp, Homo sapiens
tgagattttgttgaagttca

SEQ ID NO: 35294 - DNA, 22 bp, Homo sapiens
ttcacagaactttgcagcagtt

SEQ ID NO: 35295 - DNA, 27 bp, Homo sapiens
atgtcacttcagaaacttcctgcccta

SEQ ID NO: 35296 - DNA, 18 bp, Homo sapiens
tgcagctgcacctaagca

SEQ ID NO: 35297 - DNA, 23 bp, Homo sapiens
gcaccacgtgtttagacacagca

SEQ ID NO: 35298 - DNA, 21 bp, Homo sapiens
ggcgacggcgacggcgacggc

SEQ ID NO: 35299 - DNA, 20 bp, Homo sapiens
tctctccgccttcctctgcc

SEQ ID NO: 35300 - DNA, 19 bp, Homo sapiens
acacagcggccccacctca

SEQ ID NO: 35301 - DNA, 26 bp, Homo sapiens
atggggtttccctggatgtggggctg

SEQ ID NO: 35302 - DNA, 17 bp, Homo sapiens
gccttcttgcggacggt

SEQ ID NO: 35303 - DNA, 25 bp, Homo sapiens
gcttgggagcccatcgtcctggctc

SEQ ID NO: 35304 - DNA, 23 bp, Homo sapiens
cgcgtgtggtccttgcgccgctg

SEQ ID NO: 35305 - DNA, 18 bp, Homo sapiens
agaggaacaggccttggg

SEQ ID NO: 35306 - DNA, 22 bp, Homo sapiens
agctggggggcagtgctgtcca

SEQ ID NO: 35307 - DNA, 17 bp, Homo sapiens
cagctggtagtccatca

SEQ ID NO: 35308 - DNA, 20 bp, Homo sapiens
cccagacccctgaccacccc

SEQ ID NO: 35309 - DNA, 21 bp, Homo sapiens
gaataacactgttgcttcctg

SEQ ID NO: 35310 - DNA, 22 bp, Homo sapiens
gcacctgccccacctgcccaca

SEQ ID NO: 35311 - DNA, 19 bp, Homo sapiens
ggcccccagcctgagactg

SEQ ID NO: 35312 - DNA, 20 bp, Homo sapiens
gtgtctggtttgcttggctg

SEQ ID NO: 35313 - DNA, 26 bp, Homo sapiens
tcgcccttatttccaccctcacctcc

SEQ ID NO: 35314 - DNA, 19 bp, Homo sapiens
tgatgggaagatgagatta

SEQ ID NO: 35315 - DNA, 22 bp, Homo sapiens
ttgacaatgaataaagggcacg

SEQ ID NO: 35316 - DNA, 19 bp, Homo sapiens
ttttgggatcaggtgcctg

SEQ ID NO: 35317 - DNA, 18 bp, Homo sapiens
ctctccttccccgctctg

SEQ ID NO: 35318 - DNA, 18 bp, Homo sapiens
gaatatgaaatatttgca

SEQ ID NO: 35319 - DNA, 20 bp, Homo sapiens
agtgagtaaaccacacttcc

SEQ ID NO: 35320 - DNA, 18 bp, Homo sapiens
atgtgaatactatattcc

SEQ ID NO: 35321 - DNA, 19 bp, Homo sapiens
ccggccccgggcccagctt

SEQ ID NO: 35322 - DNA, 22 bp, Homo sapiens
tacttttttatgagttatgata

SEQ ID NO: 35323 - DNA, 21 bp, Homo sapiens
ccatctagactccatctcaaa

SEQ ID NO: 35324 - DNA, 22 bp, Homo sapiens
cccgtgggctccggcgtgaggc

SEQ ID NO: 35325 - DNA, 19 bp, Homo sapiens
gcagctgtcgggacgtgac

SEQ ID NO: 35326 - DNA, 20 bp, Homo sapiens
tcctgaacttctcccattaa

SEQ ID NO: 35327 - DNA, 23 bp, Homo sapiens
tgtaggaaataaaagtgatgata

SEQ ID NO: 35328 - DNA, 19 bp, Homo sapiens
agttgataaaaattgttga

SEQ ID NO: 35329 - DNA, 27 bp, Homo sapiens
atcatatacgtaagtatagttcctcaa

SEQ ID NO: 35330 - DNA, 23 bp, Homo sapiens
gacactctctgatgcctgagaga

SEQ ID NO: 35331 - DNA, 17 bp, Homo sapiens
gggtaatttttgtaaga

SEQ ID NO: 35332 - DNA, 18 bp, Homo sapiens
gtgaaatagaaaatgtca

SEQ ID NO: 35333 - DNA, 17 bp, Homo sapiens
tatcccaacatgcctgg

SEQ ID NO: 35334 - DNA, 16 bp, Homo sapiens
tctcctgggatgctca

SEQ ID NO: 35335 - DNA, 17 bp, Homo sapiens
aacaccagaaggtgtgg

SEQ ID NO: 35336 - DNA, 17 bp, Homo sapiens
aattttctatcaaatgg

SEQ ID NO: 35337 - DNA, 25 bp, Homo sapiens
gaagaaattgactcttgcagttttt

SEQ ID NO: 35338 - DNA, 17 bp, Homo sapiens
acaggaagggcattaca

SEQ ID NO: 35339 - DNA, 21 bp, Homo sapiens
agccagggaggtggtagccca

SEQ ID NO: 35340 - DNA, 19 bp, Homo sapiens
gtttgcaactgatagctca

SEQ ID NO: 35341 - DNA, 20 bp, Homo sapiens
tagttctacaaaaatcagct

SEQ ID NO: 35342 - DNA, 17 bp, Homo sapiens
gaacctgctaaggccat

SEQ ID NO: 35343 - DNA, 18 bp, Homo sapiens
actgaaatgtactagctg

SEQ ID NO: 35344 - DNA, 20 bp, Homo sapiens
gtggtacccacacatcagca

SEQ ID NO: 35345 - DNA, 18 bp, Homo sapiens
catccacagcgtgtcctc

SEQ ID NO: 35346 - DNA, 16 bp, Homo sapiens
caggtgtattagacca

SEQ ID NO: 35347 - DNA, 18 bp, Homo sapiens
cctcacactgcctggccc

SEQ ID NO: 35348 - DNA, 20 bp, Homo sapiens
ctccagtatccctcattcca

SEQ ID NO: 35349 - DNA, 23 bp, Homo sapiens
gtgctttggctaagatagatact

SEQ ID NO: 35350 - DNA, 18 bp, Homo sapiens
tctgatttgaaaggagta

SEQ ID NO: 35351 - DNA, 21 bp, Homo sapiens
tgataacatgacctggggctt

SEQ ID NO: 35352 - DNA, 19 bp, Homo sapiens
ccttactgaaagtacctct

SEQ ID NO: 35353 - DNA, 20 bp, Homo sapiens
ttctcggaacaattacctta

SEQ ID NO: 35354 - DNA, 23 bp, Homo sapiens
atctcaccggggaaattatttta

SEQ ID NO: 35355 - DNA, 21 bp, Homo sapiens
gcaagcctgctcactgtcatg

SEQ ID NO: 35356 - DNA, 19 bp, Homo sapiens
tacaaaatagcaccacagt

SEQ ID NO: 35357 - DNA, 23 bp, Homo sapiens
aacagcacatgcaaaggccctga

SEQ ID NO: 35358 - DNA, 17 bp, Homo sapiens
accaccatatctggcta

SEQ ID NO: 35359 - DNA, 21 bp, Homo sapiens
acttactgaaattcccagtca

SEQ ID NO: 35360 - DNA, 21 bp, Homo sapiens
ccccacccgcacctgcagtcc

SEQ ID NO: 35361 - DNA, 19 bp, Homo sapiens
ctgcaacctccgcctccca

SEQ ID NO: 35362 - DNA, 21 bp, Homo sapiens
tcaccccaacacctcacctcc

SEQ ID NO: 35363 - DNA, 18 bp, Homo sapiens
tccgcctcccaggttcaa

SEQ ID NO: 35364 - DNA, 24 bp, Homo sapiens
tgcaacctctgcctcctggattca

SEQ ID NO: 35365 - DNA, 17 bp, Homo sapiens
aaaagtctgtcttgcca

SEQ ID NO: 35366 - DNA, 20 bp, Homo sapiens
aaagaacaaaaacacttccc

SEQ ID NO: 35367 - DNA, 19 bp, Homo sapiens
actgaaacagcttcaccta

SEQ ID NO: 35368 - DNA, 18 bp, Homo sapiens
agtcagactcattgttga

SEQ ID NO: 35369 - DNA, 22 bp, Homo sapiens
cagtctacaaaaagaaaaaata

SEQ ID NO: 35370 - DNA, 22 bp, Homo sapiens
tgataaaaagtctgtcttgcca

SEQ ID NO: 35371 - DNA, 19 bp, Homo sapiens
ttaccaccaccaccctttt

SEQ ID NO: 35372 - DNA, 18 bp, Homo sapiens
aagaccctaaaactgccc

SEQ ID NO: 35373 - DNA, 22 bp, Homo sapiens
agcctttctgcaggagattcaa

SEQ ID NO: 35374 - DNA, 21 bp, Homo sapiens
ccctgtgctggggggccttgg

SEQ ID NO: 35375 - DNA, 21 bp, Homo sapiens
acaattgatgtttagtactat

SEQ ID NO: 35376 - DNA, 19 bp, Homo sapiens
acagagatgccgtatacta

SEQ ID NO: 35377 - DNA, 16 bp, Homo sapiens
accatgactatgtcat

SEQ ID NO: 35378 - DNA, 22 bp, Homo sapiens
actaccttttacaaatgttaca

SEQ ID NO: 35379 - DNA, 18 bp, Homo sapiens
atcctaatactgaccaca

SEQ ID NO: 35380 - DNA, 19 bp, Homo sapiens
attctacccacctatggtc

SEQ ID NO: 35381 - DNA, 18 bp, Homo sapiens
caaatagttcgtatttaa

SEQ ID NO: 35382 - DNA, 20 bp, Homo sapiens
cagtaggaaaacttcaaata

SEQ ID NO: 35383 - DNA, 20 bp, Homo sapiens
ccttcctgccaactgttcca

SEQ ID NO: 35384 - DNA, 19 bp, Homo sapiens
gactttgaaaaattcctta

SEQ ID NO: 35385 - DNA, 23 bp, Homo sapiens
tagttttaggagagtttttctta

SEQ ID NO: 35386 - DNA, 23 bp, Homo sapiens
tcaaaacccatttgccgtatact

SEQ ID NO: 35387 - DNA, 18 bp, Homo sapiens
tctgtggggtttttttgg

SEQ ID NO: 35388 - DNA, 18 bp, Homo sapiens
tgaaaactgaccaaatga

SEQ ID NO: 35389 - DNA, 23 bp, Homo sapiens
acctttttcccccctctccctct

SEQ ID NO: 35390 - DNA, 20 bp, Homo sapiens
agagatattagatatttctt

SEQ ID NO: 35391 - DNA, 19 bp, Homo sapiens
agctctagaatgcttacca

SEQ ID NO: 35392 - DNA, 24 bp, Homo sapiens
cacttcatacaaggaaaacttcga

SEQ ID NO: 35393 - DNA, 21 bp, Homo sapiens
gatacaatcaaaggaacttca

SEQ ID NO: 35394 - DNA, 19 bp, Homo sapiens
gcaatgatattacctctga

SEQ ID NO: 35395 - DNA, 19 bp, Homo sapiens
tcaaaagattatgaatagc

SEQ ID NO: 35396 - DNA, 22 bp, Homo sapiens
ttgatatatgagtatttaaact

SEQ ID NO: 35397 - DNA, 19 bp, Homo sapiens
actggtggcaggctgtggc

SEQ ID NO: 35398 - DNA, 17 bp, Homo sapiens
accagagacacactggg

SEQ ID NO: 35399 - DNA, 19 bp, Homo sapiens
gacggagcctcccggctcg

SEQ ID NO: 35400 - DNA, 22 bp, Homo sapiens
gccagggaccgcctgctgccaa

SEQ ID NO: 35401 - DNA, 16 bp, Homo sapiens
actatgaagacattct

SEQ ID NO: 35402 - DNA, 19 bp, Homo sapiens
tcaggttatttcctaatgt

SEQ ID NO: 35403 - DNA, 22 bp, Homo sapiens
cacgacaccatcatcgatgcca

SEQ ID NO: 35404 - DNA, 21 bp, Homo sapiens
ctgcacccccagtcctgggga

SEQ ID NO: 35405 - DNA, 19 bp, Homo sapiens
tgtctgtgtggcacagaga

SEQ ID NO: 35406 - DNA, 22 bp, Homo sapiens
agcttccactttgggaacatgt

SEQ ID NO: 35407 - DNA, 19 bp, Homo sapiens
atagaagagaagacatatg

SEQ ID NO: 35408 - DNA, 19 bp, Homo sapiens
tgtcgatgcttacatctta

SEQ ID NO: 35409 - DNA, 22 bp, Homo sapiens
gagccaagatcgtgccactgca

SEQ ID NO: 35410 - DNA, 18 bp, Homo sapiens
tccgcctcccgggttcaa

SEQ ID NO: 35411 - DNA, 21 bp, Homo sapiens
tgcagtgagccaagatcgtgc

SEQ ID NO: 35412 - DNA, 22 bp, Homo sapiens
caggcaattactagccctagtt

SEQ ID NO: 35413 - DNA, 18 bp, Homo sapiens
cccccagcccacccacca

SEQ ID NO: 35414 - DNA, 21 bp, Homo sapiens
ctctgccatgagggctttgga

SEQ ID NO: 35415 - DNA, 19 bp, Homo sapiens
ctgataataaatgggctct

SEQ ID NO: 35416 - DNA, 19 bp, Homo sapiens
ggcgtcatctctcttctgt

SEQ ID NO: 35417 - DNA, 21 bp, Homo sapiens
taaatgggctctctcagaggc

SEQ ID NO: 35418 - DNA, 21 bp, Homo sapiens
tccaagataccagcattcctc

SEQ ID NO: 35419 - DNA, 20 bp, Homo sapiens
accacagctgcctcttcctc

SEQ ID NO: 35420 - DNA, 21 bp, Homo sapiens
acctaggggaaaccatctctc

SEQ ID NO: 35421 - DNA, 18 bp, Homo sapiens
acggctgcagacccatga

SEQ ID NO: 35422 - DNA, 19 bp, Homo sapiens
ccccatctttgactcagtt

SEQ ID NO: 35423 - DNA, 21 bp, Homo sapiens
cctcccccaactcttcctcca

SEQ ID NO: 35424 - DNA, 18 bp, Homo sapiens
cgcctcagccctgcctcc

SEQ ID NO: 35425 - DNA, 24 bp, Homo sapiens
cgccttgttctgaagctttctcta

SEQ ID NO: 35426 - DNA, 16 bp, Homo sapiens
ctctccccctgcttct

SEQ ID NO: 35427 - DNA, 19 bp, Homo sapiens
ctcttcctcctcctcctct

SEQ ID NO: 35428 - DNA, 21 bp, Homo sapiens
cttcattcctcctctgtctct

SEQ ID NO: 35429 - DNA, 21 bp, Homo sapiens
gatgccaccctccctgaaccc

SEQ ID NO: 35430 - DNA, 21 bp, Homo sapiens
gcccctggagctcaggggtca

SEQ ID NO: 35431 - DNA, 19 bp, Homo sapiens
ggcctccctgctctgtgat

SEQ ID NO: 35432 - DNA, 21 bp, Homo sapiens
tgatggtttctcccagactag

SEQ ID NO: 35433 - DNA, 19 bp, Homo sapiens
tgcttcctagcacattcca

SEQ ID NO: 35434 - DNA, 24 bp, Homo sapiens
tggcctccatgaggggcagggcca

SEQ ID NO: 35435 - DNA, 20 bp, Homo sapiens
ttcagaataggtcaaaattc

SEQ ID NO: 35436 - DNA, 17 bp, Homo sapiens
ttccagaatgtggtggt

SEQ ID NO: 35437 - DNA, 17 bp, Homo sapiens
ttgggagacctttgtca

SEQ ID NO: 35438 - DNA, 21 bp, Homo sapiens
ttttggggccaagatggctgc

SEQ ID NO: 35439 - DNA, 22 bp, Homo sapiens
gagccaagatcacgccactgca

SEQ ID NO: 35440 - DNA, 18 bp, Homo sapiens
tgccctctccccgtctct

SEQ ID NO: 35441 - DNA, 20 bp, Homo sapiens
caaggtcaccaggtacagtt

SEQ ID NO: 35442 - DNA, 24 bp, Homo sapiens
cccacccacatacatttctgccag

SEQ ID NO: 35443 - DNA, 25 bp, Homo sapiens
cgcgcgccgccgccccgcgctgctg

SEQ ID NO: 35444 - DNA, 19 bp, Homo sapiens
gaaaagtccacaatttccc

SEQ ID NO: 35445 - DNA, 20 bp, Homo sapiens
gacagggagggcccatcacc

SEQ ID NO: 35446 - DNA, 21 bp, Homo sapiens
gcctgagctgtcgcacctggc

SEQ ID NO: 35447 - DNA, 23 bp, Homo sapiens
ctttgcgagctgcatttggcctt

SEQ ID NO: 35448 - DNA, 16 bp, Homo sapiens
gtgatgacagaatcag

SEQ ID NO: 35449 - DNA, 18 bp, Homo sapiens
tgaacgaggctgactgtg

SEQ ID NO: 35450 - DNA, 21 bp, Homo sapiens
aaggattctagaaaattatga

SEQ ID NO: 35451 - DNA, 26 bp, Homo sapiens
ccctgatggttgcaaaggcttgggaa

SEQ ID NO: 35452 - DNA, 19 bp, Homo sapiens
cccttttccttagaccccg

SEQ ID NO: 35453 - DNA, 19 bp, Homo sapiens
cctgtaccttggctacttc

SEQ ID NO: 35454 - DNA, 20 bp, Homo sapiens
ccttcgcctcctgggttcaa

SEQ ID NO: 35455 - DNA, 19 bp, Homo sapiens
ctcagtgacccatctctga

SEQ ID NO: 35456 - DNA, 19 bp, Homo sapiens
taggaaacattttgttgta

SEQ ID NO: 35457 - DNA, 17 bp, Homo sapiens
tccctgagtgcacctca

SEQ ID NO: 35458 - DNA, 16 bp, Homo sapiens
agcggatgcccaatga

SEQ ID NO: 35459 - DNA, 16 bp, Homo sapiens
cacacacactcactca

SEQ ID NO: 35460 - DNA, 17 bp, Homo sapiens
cagacgcatcccatttc

SEQ ID NO: 35461 - DNA, 22 bp, Homo sapiens
cagggcgcacactctcgcgcac

SEQ ID NO: 35462 - DNA, 18 bp, Homo sapiens
gcagagtgagagccttcg

SEQ ID NO: 35463 - DNA, 21 bp, Homo sapiens
accacgcagtccctccacttt

SEQ ID NO: 35464 - DNA, 21 bp, Homo sapiens
gtttgcttgcagtgctttctt

SEQ ID NO: 35465 - DNA, 19 bp, Homo sapiens
aaacctctcatttttgttt

SEQ ID NO: 35466 - DNA, 19 bp, Homo sapiens
agacgttacatttcattcg

SEQ ID NO: 35467 - DNA, 16 bp, Homo sapiens
cactctcatctgctca

SEQ ID NO: 35468 - DNA, 20 bp, Homo sapiens
catcttatgtttgtatgaga

SEQ ID NO: 35469 - DNA, 21 bp, Homo sapiens
cttaaaataactatcatgaaa

SEQ ID NO: 35470 - DNA, 21 bp, Homo sapiens
gccctacatcttgccttggta

SEQ ID NO: 35471 - DNA, 19 bp, Homo sapiens
gtgtgtgtgagtgtatgcg

SEQ ID NO: 35472 - DNA, 19 bp, Homo sapiens
tcctatctgaatctctgaa

SEQ ID NO: 35473 - DNA, 24 bp, Homo sapiens
tggtgggttctcaaagcagtacca

SEQ ID NO: 35474 - DNA, 19 bp, Homo sapiens
tgtgggagtatttgtggtg

SEQ ID NO: 35475 - DNA, 18 bp, Homo sapiens
accagccacccctgtcct

SEQ ID NO: 35476 - DNA, 26 bp, Homo sapiens
atggattcagtcctggtgtgtgattg

SEQ ID NO: 35477 - DNA, 19 bp, Homo sapiens
caacaacttttgtattact

SEQ ID NO: 35478 - DNA, 23 bp, Homo sapiens
ccctgatgatgtaacacctgcga

SEQ ID NO: 35479 - DNA, 23 bp, Homo sapiens
ctaatgtttttggtttgtatggt

SEQ ID NO: 35480 - DNA, 17 bp, Homo sapiens
gagaccatcctgctgtc

SEQ ID NO: 35481 - DNA, 23 bp, Homo sapiens
gagcctttgactcagacattttt

SEQ ID NO: 35482 - DNA, 16 bp, Homo sapiens
gcttccatagtctttg

SEQ ID NO: 35483 - DNA, 18 bp, Homo sapiens
ggaaggactcccacctca

SEQ ID NO: 35484 - DNA, 20 bp, Homo sapiens
tacagtttgcagtggatcta

SEQ ID NO: 35485 - DNA, 20 bp, Homo sapiens
tccaactctctaagcactaa

SEQ ID NO: 35486 - DNA, 20 bp, Homo sapiens
tccctgcctgattctctgag

SEQ ID NO: 35487 - DNA, 23 bp, Homo sapiens
tgagtcccttccaagtgagattg

SEQ ID NO: 35488 - DNA, 17 bp, Homo sapiens
cctaaaggctgacagtg

SEQ ID NO: 35489 - DNA, 17 bp, Homo sapiens
gatctttgacactattg

SEQ ID NO: 35490 - DNA, 20 bp, Homo sapiens
aaaattagctgggtgcgatg

SEQ ID NO: 35491 - DNA, 19 bp, Homo sapiens
aatccgagagtcccaattc

SEQ ID NO: 35492 - DNA, 19 bp, Homo sapiens
acatcaacagtctacgtca

SEQ ID NO: 35493 - DNA, 19 bp, Homo sapiens
actcaaactggggattcca

SEQ ID NO: 35494 - DNA, 20 bp, Homo sapiens
gctgcagcattgcacggcac

SEQ ID NO: 35495 - DNA, 21 bp, Homo sapiens
ggccacagtcagggcaacttt

SEQ ID NO: 35496 - DNA, 18 bp, Homo sapiens
tggggcgcgtggtgtgtg

SEQ ID NO: 35497 - DNA, 19 bp, Homo sapiens
cctccgtcctcctcctgtc

SEQ ID NO: 35498 - DNA, 16 bp, Homo sapiens
ggtgcgtgtttgtgta

SEQ ID NO: 35499 - DNA, 22 bp, Homo sapiens
acacagaacttgctgctgtgtt

SEQ ID NO: 35500 - DNA, 23 bp, Homo sapiens
tcttttgaagatagattctttca

SEQ ID NO: 35501 - DNA, 20 bp, Homo sapiens
tggagaattcatgcctttca

SEQ ID NO: 35502 - DNA, 19 bp, Homo sapiens
ttgtagtaatgactgtgtt

SEQ ID NO: 35503 - DNA, 17 bp, Homo sapiens
acgtgagtcagcagcaa

SEQ ID NO: 35504 - DNA, 19 bp, Homo sapiens
agagagaaacacacacctt

SEQ ID NO: 35505 - DNA, 19 bp, Homo sapiens
caacggctgagccagccca

SEQ ID NO: 35506 - DNA, 20 bp, Homo sapiens
cagccggtctcaggctgctg

SEQ ID NO: 35507 - DNA, 18 bp, Homo sapiens
ccgaagtgcccctctgaa

SEQ ID NO: 35508 - DNA, 20 bp, Homo sapiens
ccgtggagtaacacagccag

SEQ ID NO: 35509 - DNA, 24 bp, Homo sapiens
ctctgaatgaagaggaacctgcgg

SEQ ID NO: 35510 - DNA, 22 bp, Homo sapiens
gaaccgtggacacacactgcac

SEQ ID NO: 35511 - DNA, 16 bp, Homo sapiens
gggtgaggtgtctgct

SEQ ID NO: 35512 - DNA, 23 bp, Homo sapiens
tacccgcctgtgtcgcttttgca

SEQ ID NO: 35513 - DNA, 20 bp, Homo sapiens
tcctggtcacgatctggtga

SEQ ID NO: 35514 - DNA, 18 bp, Homo sapiens
aaacactgactcaatctt

SEQ ID NO: 35515 - DNA, 18 bp, Homo sapiens
aagaggcactaatgacat

SEQ ID NO: 35516 - DNA, 18 bp, Homo sapiens
agtgagtaaagtagaata

SEQ ID NO: 35517 - DNA, 21 bp, Homo sapiens
tatgatggaccaggttggcca

SEQ ID NO: 35518 - DNA, 21 bp, Homo sapiens
tccatcagaaataatacttta

SEQ ID NO: 35519 - DNA, 21 bp, Homo sapiens
ttacttcaccatttattgtgc

SEQ ID NO: 35520 - DNA, 21 bp, Homo sapiens
acagagccagatcagaaccca

SEQ ID NO: 35521 - DNA, 17 bp, Homo sapiens
acccatctcccccttcc

SEQ ID NO: 35522 - DNA, 15 bp, Homo sapiens
aggagccagtcttcc

SEQ ID NO: 35523 - DNA, 19 bp, Homo sapiens
aggctgatttgttcctagt

SEQ ID NO: 35524 - DNA, 19 bp, Homo sapiens
atggtctgaatgtaaactg

SEQ ID NO: 35525 - DNA, 19 bp, Homo sapiens
ccagaaaaagtgccagtga

SEQ ID NO: 35526 - DNA, 21 bp, Homo sapiens
ccagctgaccaggcaagacct

SEQ ID NO: 35527 - DNA, 18 bp, Homo sapiens
cctaccagaggcaaccaa

SEQ ID NO: 35528 - DNA, 19 bp, Homo sapiens
cctgcacccgcttcttccc

SEQ ID NO: 35529 - DNA, 19 bp, Homo sapiens
cgggttacaggagatccga

SEQ ID NO: 35530 - DNA, 18 bp, Homo sapiens
ctgagcggcgtttggttc

SEQ ID NO: 35531 - DNA, 20 bp, Homo sapiens
gagagtcgcaaaactgccaa

SEQ ID NO: 35532 - DNA, 17 bp, Homo sapiens
gagtgtcgcttcccaca

SEQ ID NO: 35533 - DNA, 17 bp, Homo sapiens
gcacccgcttcttcccc

SEQ ID NO: 35534 - DNA, 17 bp, Homo sapiens
gtctacctacctgcctt

SEQ ID NO: 35535 - DNA, 19 bp, Homo sapiens
taagtaaaacactaccact

SEQ ID NO: 35536 - DNA, 19 bp, Homo sapiens
tactgaatatcaactgtga

SEQ ID NO: 35537 - DNA, 20 bp, Homo sapiens
tggaagactcttgggtccaa

SEQ ID NO: 35538 - DNA, 21 bp, Homo sapiens
ttccctcagctccaactcttc

SEQ ID NO: 35539 - DNA, 20 bp, Homo sapiens
ttctcaagtggtttgttgta

SEQ ID NO: 35540 - DNA, 22 bp, Homo sapiens
gagccaagatcgcgccactgca

SEQ ID NO: 35541 - DNA, 17 bp, Homo sapiens
tggatgcctactgtgga

SEQ ID NO: 35542 - DNA, 22 bp, Homo sapiens
acagagaactggaatctcactt

SEQ ID NO: 35543 - DNA, 18 bp, Homo sapiens
agaaaaatcactgtgctg

SEQ ID NO: 35544 - DNA, 18 bp, Homo sapiens
cccagagattctacccag

SEQ ID NO: 35545 - DNA, 17 bp, Homo sapiens
cgcaaaagatgtacctg

SEQ ID NO: 35546 - DNA, 21 bp, Homo sapiens
ctttatggttcaataaatata

SEQ ID NO: 35547 - DNA, 21 bp, Homo sapiens
aagaatcccgctggcatcctg

SEQ ID NO: 35548 - DNA, 18 bp, Homo sapiens
acactcatagttttgcca

SEQ ID NO: 35549 - DNA, 21 bp, Homo sapiens
gcgccggccgagaaggcgccg

SEQ ID NO: 35550 - DNA, 21 bp, Homo sapiens
acctggcttgttgcttggctt

SEQ ID NO: 35551 - DNA, 19 bp, Homo sapiens
cagtttcttgctttcttca

SEQ ID NO: 35552 - DNA, 22 bp, Homo sapiens
catatttgtgtcctcgccagct

SEQ ID NO: 35553 - DNA, 17 bp, Homo sapiens
gaggcagtggaagaagg

SEQ ID NO: 35554 - DNA, 20 bp, Homo sapiens
tccacacggttagccgtgca

SEQ ID NO: 35555 - DNA, 18 bp, Homo sapiens
accccccagaatttctca

SEQ ID NO: 35556 - DNA, 19 bp, Homo sapiens
catcaccacccaccctgtc

SEQ ID NO: 35557 - DNA, 20 bp, Homo sapiens
ctcccagagcaaccctgggc

SEQ ID NO: 35558 - DNA, 17 bp, Homo sapiens
ctgcttccagggggtcc

SEQ ID NO: 35559 - DNA, 16 bp, Homo sapiens
gggcttggaaatctga

SEQ ID NO: 35560 - DNA, 19 bp, Homo sapiens
gtccagctgagctccacct

SEQ ID NO: 35561 - DNA, 17 bp, Homo sapiens
tcctgaacctggaacaa

SEQ ID NO: 35562 - DNA, 20 bp, Homo sapiens
tcctgcttccccggcaccct

SEQ ID NO: 35563 - DNA, 23 bp, Homo sapiens
tctggggtggaccctgtgtgatt

SEQ ID NO: 35564 - DNA, 23 bp, Homo sapiens
ggcacacgccacctcgcccggcc

SEQ ID NO: 35565 - DNA, 18 bp, Homo sapiens
tccgcctcccgggttcaa

SEQ ID NO: 35566 - DNA, 21 bp, Homo sapiens
agaaaatccagcagctgtcag

SEQ ID NO: 35567 - DNA, 22 bp, Homo sapiens
caaccctgtgctctctggcccc

SEQ ID NO: 35568 - DNA, 17 bp, Homo sapiens
ccagcagctcctgcccc

SEQ ID NO: 35569 - DNA, 19 bp, Homo sapiens
ccccagggcccccctgagc

SEQ ID NO: 35570 - DNA, 23 bp, Homo sapiens
cttccattccatttagcctttgg

SEQ ID NO: 35571 - DNA, 16 bp, Homo sapiens
gtggccaagtggagca

SEQ ID NO: 35572 - DNA, 17 bp, Homo sapiens
tgcaggctcaggcttct

SEQ ID NO: 35573 - DNA, 18 bp, Homo sapiens
aagcaaagacctttctct

SEQ ID NO: 35574 - DNA, 19 bp, Homo sapiens
agtggaggaaagaatgcat

SEQ ID NO: 35575 - DNA, 22 bp, Homo sapiens
cctggaagagtccactgccaaa

SEQ ID NO: 35576 - DNA, 18 bp, Homo sapiens
ctctattctctgcactaa

SEQ ID NO: 35577 - DNA, 19 bp, Homo sapiens
cttttgactccatcaactt

SEQ ID NO: 35578 - DNA, 22 bp, Homo sapiens
gagccaagatcacaccactgca

SEQ ID NO: 35579 - DNA, 23 bp, Homo sapiens
gggctgcaaagtgacaactgcac

SEQ ID NO: 35580 - DNA, 18 bp, Homo sapiens
ggggaattggtgattaca

SEQ ID NO: 35581 - DNA, 21 bp, Homo sapiens
taatccaagatactcaggagg

SEQ ID NO: 35582 - DNA, 17 bp, Homo sapiens
tcaagtgattcttctgc

SEQ ID NO: 35583 - DNA, 21 bp, Homo sapiens
tctggagtacaatggcatgat

SEQ ID NO: 35584 - DNA, 20 bp, Homo sapiens
tggccaggctggtcttgaac

SEQ ID NO: 35585 - DNA, 16 bp, Homo sapiens
acaaacactgatctcc

SEQ ID NO: 35586 - DNA, 18 bp, Homo sapiens
aggaatcaagtcttcccc

SEQ ID NO: 35587 - DNA, 16 bp, Homo sapiens
gaagggcatcttgtac

SEQ ID NO: 35588 - DNA, 19 bp, Homo sapiens
tcttgggggttctgcagga

SEQ ID NO: 35589 - DNA, 19 bp, Homo sapiens
agttgaccactgcagcagt

SEQ ID NO: 35590 - DNA, 20 bp, Homo sapiens
ggtctccaaccacagggcca

SEQ ID NO: 35591 - DNA, 25 bp, Homo sapiens
cccagttacttaaggaactaagtga

SEQ ID NO: 35592 - DNA, 21 bp, Homo sapiens
gacctctcagaaaaacttgcc

SEQ ID NO: 35593 - DNA, 19 bp, Homo sapiens
tcatttctgagtgatctca

SEQ ID NO: 35594 - DNA, 23 bp, Homo sapiens
tctgagtgatctcacagattttt

SEQ ID NO: 35595 - DNA, 19 bp, Homo sapiens
ccccagccgccggcacggc

SEQ ID NO: 35596 - DNA, 17 bp, Homo sapiens
ctctctgccctgcttct

SEQ ID NO: 35597 - DNA, 22 bp, Homo sapiens
gagggcagctaacaagggctga

SEQ ID NO: 35598 - DNA, 20 bp, Homo sapiens
ggaggcggctggtgccgcca

SEQ ID NO: 35599 - DNA, 23 bp, Homo sapiens
tacagcttttatttgtgaattaa

SEQ ID NO: 35600 - DNA, 23 bp, Homo sapiens
ttgctacagcttttatttgtgaa

SEQ ID NO: 35601 - DNA, 21 bp, Homo sapiens
agtagcccccctgaagttaga

SEQ ID NO: 35602 - DNA, 19 bp, Homo sapiens
ataaacaactgtggtgcta

SEQ ID NO: 35603 - DNA, 22 bp, Homo sapiens
taggatcatggtattgaccagt

SEQ ID NO: 35604 - DNA, 19 bp, Homo sapiens
ttttgtttgcggcacctac

SEQ ID NO: 35605 - DNA, 18 bp, Homo sapiens
atcatgctgcaatatgat

SEQ ID NO: 35606 - DNA, 17 bp, Homo sapiens
ccaccccttgcctgagg

SEQ ID NO: 35607 - DNA, 16 bp, Homo sapiens
ccagctccctgcctcc

SEQ ID NO: 35608 - DNA, 20 bp, Homo sapiens
ctgatttcctccatgcacac

SEQ ID NO: 35609 - DNA, 22 bp, Homo sapiens
gacggcacccctggcttcctca

SEQ ID NO: 35610 - DNA, 25 bp, Homo sapiens
tccttgtgtctgtttctctgttcct

SEQ ID NO: 35611 - DNA, 22 bp, Homo sapiens
tctatgcaacttgatcctctag

SEQ ID NO: 35612 - DNA, 18 bp, Homo sapiens
ttcaagacttcaagaaca

SEQ ID NO: 35613 - DNA, 22 bp, Homo sapiens
agaaaaatatatatatctggtt

SEQ ID NO: 35614 - DNA, 19 bp, Homo sapiens
tggttttaaagccttgaac

SEQ ID NO: 35615 - DNA, 20 bp, Homo sapiens
caccacaagacctattaaca

SEQ ID NO: 35616 - DNA, 21 bp, Homo sapiens
acagcacccctgagctgggca

SEQ ID NO: 35617 - DNA, 20 bp, Homo sapiens
caaccttccccctacctcct

SEQ ID NO: 35618 - DNA, 24 bp, Homo sapiens
cctggtaagcggagggcctgagga

SEQ ID NO: 35619 - DNA, 20 bp, Homo sapiens
cttactagttgtttgacctt

SEQ ID NO: 35620 - DNA, 17 bp, Homo sapiens
gagaggaacagaggtga

SEQ ID NO: 35621 - DNA, 21 bp, Homo sapiens
agggccaccatgagcccaaga

SEQ ID NO: 35622 - DNA, 24 bp, Homo sapiens
ccccacctacaactgaagacaatg

SEQ ID NO: 35623 - DNA, 21 bp, Homo sapiens
cctctttgcttcctcggtttt

SEQ ID NO: 35624 - DNA, 21 bp, Homo sapiens
gcatatccagctcctcactca

SEQ ID NO: 35625 - DNA, 21 bp, Homo sapiens
ggtgggtgggaccctgcttgt

SEQ ID NO: 35626 - DNA, 20 bp, Homo sapiens
agcctaaaacgacacaccca

SEQ ID NO: 35627 - DNA, 18 bp, Homo sapiens
aagtagaagcttaaactt

SEQ ID NO: 35628 - DNA, 18 bp, Homo sapiens
ctaggcggtaattgcttt

SEQ ID NO: 35629 - DNA, 18 bp, Homo sapiens
tgggacacacgtgtgtga

SEQ ID NO: 35630 - DNA, 24 bp, Homo sapiens
acttgtatagatgatttttggctt

SEQ ID NO: 35631 - DNA, 18 bp, Homo sapiens
actttttacttgtataga

SEQ ID NO: 35632 - DNA, 22 bp, Homo sapiens
gattgcacttgcctgccatgat

SEQ ID NO: 35633 - DNA, 17 bp, Homo sapiens
acacaggagccccccac

SEQ ID NO: 35634 - DNA, 26 bp, Homo sapiens
agtgacttccccggtatccactctca

SEQ ID NO: 35635 - DNA, 18 bp, Homo sapiens
ccataggaggtttgtgag

SEQ ID NO: 35636 - DNA, 19 bp, Homo sapiens
cgcgcctgctttagagaca

SEQ ID NO: 35637 - DNA, 20 bp, Homo sapiens
gccatggtcccctcacttga

SEQ ID NO: 35638 - DNA, 20 bp, Homo sapiens
accacactctccttcccaca

SEQ ID NO: 35639 - DNA, 20 bp, Homo sapiens
cagccctctaccctggatgt

SEQ ID NO: 35640 - DNA, 22 bp, Homo sapiens
tcaagtactcatcacccaccca

SEQ ID NO: 35641 - DNA, 20 bp, Homo sapiens
aaacgaaagcacaccaccca

SEQ ID NO: 35642 - DNA, 15 bp, Homo sapiens
aagtaaaagagctta

SEQ ID NO: 35643 - DNA, 18 bp, Homo sapiens
cagtcaacaagcaccttc

SEQ ID NO: 35644 - DNA, 21 bp, Homo sapiens
ctcaaagaacacagtagcacc

SEQ ID NO: 35645 - DNA, 19 bp, Homo sapiens
ctgtctccccatccttcca

SEQ ID NO: 35646 - DNA, 19 bp, Homo sapiens
tctataacagtaaacccca

SEQ ID NO: 35647 - DNA, 19 bp, Homo sapiens
tgcagtagcctgtccccaa

SEQ ID NO: 35648 - DNA, 20 bp, Homo sapiens
ttgctcccaagggccctcac

SEQ ID NO: 35649 - DNA, 24 bp, Homo sapiens
accagacaatgaatgaactatgaa

SEQ ID NO: 35650 - DNA, 23 bp, Homo sapiens
ctattatcaccaaacaatatgtt

SEQ ID NO: 35651 - DNA, 24 bp, Homo sapiens
taccatctctctctccccctacct

SEQ ID NO: 35652 - DNA, 24 bp, Homo sapiens
tgaattaaacccattgtgaggttg

SEQ ID NO: 35653 - DNA, 17 bp, Homo sapiens
tgctagtcataactgta

SEQ ID NO: 35654 - DNA, 17 bp, Homo sapiens
tgtactagttactatga

SEQ ID NO: 35655 - DNA, 18 bp, Homo sapiens
cctctaataagacatcgg

SEQ ID NO: 35656 - DNA, 19 bp, Homo sapiens
gcctctggcccaggagtta

SEQ ID NO: 35657 - DNA, 17 bp, Homo sapiens
aggccacgagaagctgc

SEQ ID NO: 35658 - DNA, 22 bp, Homo sapiens
atcctgcaacagctggactcaa

SEQ ID NO: 35659 - DNA, 17 bp, Homo sapiens
cctaggcgtatgtgtat

SEQ ID NO: 35660 - DNA, 18 bp, Homo sapiens
gatggctcctgccccata

SEQ ID NO: 35661 - DNA, 18 bp, Homo sapiens
tgacaaggaaggagttga

SEQ ID NO: 35662 - DNA, 16 bp, Homo sapiens
caaatctgaggcctgt

SEQ ID NO: 35663 - DNA, 22 bp, Homo sapiens
gcggaggaggggcccctctttc

SEQ ID NO: 35664 - DNA, 20 bp, Homo sapiens
atcaacaccataacatcaca

SEQ ID NO: 35665 - DNA, 24 bp, Homo sapiens
caacgctcggaaaccgccagacac

SEQ ID NO: 35666 - DNA, 23 bp, Homo sapiens
cccaggaggcggggcgcctgtgg

SEQ ID NO: 35667 - DNA, 17 bp, Homo sapiens
gaacctgctaaggccat

SEQ ID NO: 35668 - DNA, 21 bp, Homo sapiens
actggatgtctttcttcttca

SEQ ID NO: 35669 - DNA, 21 bp, Homo sapiens
atgagagctccagccattcca

SEQ ID NO: 35670 - DNA, 18 bp, Homo sapiens
cacccagccttgctgcct

SEQ ID NO: 35671 - DNA, 21 bp, Homo sapiens
agccatgtcctccaagcctcc

SEQ ID NO: 35672 - DNA, 21 bp, Homo sapiens
tctgagtaaacagtaattact

SEQ ID NO: 35673 - DNA, 19 bp, Homo sapiens
agaaggaaaaaacatttaa

SEQ ID NO: 35674 - DNA, 20 bp, Homo sapiens
cttaggtaatcccaaaaact

SEQ ID NO: 35675 - DNA, 20 bp, Homo sapiens
gagtccattcacctgagaaa

SEQ ID NO: 35676 - DNA, 19 bp, Homo sapiens
actcttttcatcttctgca

SEQ ID NO: 35677 - DNA, 22 bp, Homo sapiens
cacacgtgctcacccacccgca

SEQ ID NO: 35678 - DNA, 23 bp, Homo sapiens
cctccctcttggtgggtctgtgg

SEQ ID NO: 35679 - DNA, 18 bp, Homo sapiens
cttgatgggggctgtgag

SEQ ID NO: 35680 - DNA, 23 bp, Homo sapiens
gaaaccaggacaggccatctgca

SEQ ID NO: 35681 - DNA, 19 bp, Homo sapiens
ggacaggccatctgcagtg

SEQ ID NO: 35682 - DNA, 18 bp, Homo sapiens
gtgaaagcagccagctca

SEQ ID NO: 35683 - DNA, 17 bp, Homo sapiens
agatttccattcccaca

SEQ ID NO: 35684 - DNA, 20 bp, Homo sapiens
agttgttaaacaacatgcta

SEQ ID NO: 35685 - DNA, 16 bp, Homo sapiens
caaagcccgcgcgctg

SEQ ID NO: 35686 - DNA, 21 bp, Homo sapiens
ccattaataggcaatcattta

SEQ ID NO: 35687 - DNA, 19 bp, Homo sapiens
cctgctcctccaaagccag

SEQ ID NO: 35688 - DNA, 23 bp, Homo sapiens
ggactttccagtgatgccactga

SEQ ID NO: 35689 - DNA, 23 bp, Homo sapiens
tcagcatagacttaatcccctta

SEQ ID NO: 35690 - DNA, 19 bp, Homo sapiens
tgaaactggaaagccatag

SEQ ID NO: 35691 - DNA, 22 bp, Homo sapiens
tttctggagctcctttaatctt

SEQ ID NO: 35692 - DNA, 19 bp, Homo sapiens
agggtggacttagaaagca

SEQ ID NO: 35693 - DNA, 21 bp, Homo sapiens
cgcccctgtctcaggcacctc

SEQ ID NO: 35694 - DNA, 24 bp, Homo sapiens
gcgagtgcatgtgctactgctgct

SEQ ID NO: 35695 - DNA, 17 bp, Homo sapiens
aactatccatgtagtca

SEQ ID NO: 35696 - DNA, 18 bp, Homo sapiens
gatggcagtggctgtagg

SEQ ID NO: 35697 - DNA, 22 bp, Homo sapiens
aaaaactaagaagaacaatgaa

SEQ ID NO: 35698 - DNA, 17 bp, Homo sapiens
acctgaagattgtaata

SEQ ID NO: 35699 - DNA, 17 bp, Homo sapiens
agagatgaaatgtgcat

SEQ ID NO: 35700 - DNA, 21 bp, Homo sapiens
ctgctcattcttgacatagct

SEQ ID NO: 35701 - DNA, 22 bp, Homo sapiens
gcaaattggaaagccatcttat

SEQ ID NO: 35702 - DNA, 21 bp, Homo sapiens
gtagagtttattgttcagaga

SEQ ID NO: 35703 - DNA, 19 bp, Homo sapiens
tgatcattttactaacata

SEQ ID NO: 35704 - DNA, 20 bp, Homo sapiens
tgtctgtgaagcttttaaac

SEQ ID NO: 35705 - DNA, 19 bp, Homo sapiens
acatctatttccattgatc

SEQ ID NO: 35706 - DNA, 20 bp, Homo sapiens
aggagagccccagtactgcc

SEQ ID NO: 35707 - DNA, 21 bp, Homo sapiens
agtggatggggagtctgtgtg

SEQ ID NO: 35708 - DNA, 23 bp, Homo sapiens
atgcccagaaggccaccccccag

SEQ ID NO: 35709 - DNA, 16 bp, Homo sapiens
caccctacccagtacc

SEQ ID NO: 35710 - DNA, 18 bp, Homo sapiens
catgcccagaaggccacc

SEQ ID NO: 35711 - DNA, 21 bp, Homo sapiens
ccagccctacaacccccaggc

SEQ ID NO: 35712 - DNA, 23 bp, Homo sapiens
cccagaaggccaccccccagtgg

SEQ ID NO: 35713 - DNA, 22 bp, Homo sapiens
gccaggaaacccaccgtgtgtg

SEQ ID NO: 35714 - DNA, 16 bp, Homo sapiens
gcccggctgctggcca

SEQ ID NO: 35715 - DNA, 21 bp, Homo sapiens
gcctaccaaggtgactgtgca

SEQ ID NO: 35716 - DNA, 17 bp, Homo sapiens
gcggctgtccagccgat

SEQ ID NO: 35717 - DNA, 19 bp, Homo sapiens
gcggctgtccattcctgac

SEQ ID NO: 35718 - DNA, 24 bp, Homo sapiens
gggctgcgtaagggggtccagcac

SEQ ID NO: 35719 - DNA, 16 bp, Homo sapiens
tccagaggtaccccag

SEQ ID NO: 35720 - DNA, 21 bp, Homo sapiens
tccagcacgactgtgtcctct

SEQ ID NO: 35721 - DNA, 19 bp, Homo sapiens
tctgcggcgccttggcctt

SEQ ID NO: 35722 - DNA, 22 bp, Homo sapiens
tgcccagaaggccaccccccag

SEQ ID NO: 35723 - DNA, 20 bp, Homo sapiens
tgcccaggagctgactccag

SEQ ID NO: 35724 - DNA, 19 bp, Homo sapiens
agttgtgtaaccgtgacca

SEQ ID NO: 35725 - DNA, 23 bp, Homo sapiens
cttgagcagtcacctctcatttt

SEQ ID NO: 35726 - DNA, 19 bp, Homo sapiens
gttgtgtaaccgtgaccac

SEQ ID NO: 35727 - DNA, 21 bp, Homo sapiens
taatttagaaatgaattaaaa

SEQ ID NO: 35728 - DNA, 20 bp, Homo sapiens
tgcccaccccatccccgagc

SEQ ID NO: 35729 - DNA, 20 bp, Homo sapiens
ttgggtttttattgttgttt

SEQ ID NO: 35730 - DNA, 24 bp, Homo sapiens
aggttggcaggaccacctccgcct

SEQ ID NO: 35731 - DNA, 18 bp, Homo sapiens
atcccagctgtcattgtt

SEQ ID NO: 35732 - DNA, 18 bp, Homo sapiens
gccagggaaaccattcta

SEQ ID NO: 35733 - DNA, 18 bp, Homo sapiens
acagaaaactgctggctg

SEQ ID NO: 35734 - DNA, 17 bp, Homo sapiens
cagcaggaaatggtgag

SEQ ID NO: 35735 - DNA, 21 bp, Homo sapiens
aaaatagctttgaagatactt

SEQ ID NO: 35736 - DNA, 19 bp, Homo sapiens
aaaaatgtcctttgtcata

SEQ ID NO: 35737 - DNA, 18 bp, Homo sapiens
acatctttcttgtttctt

SEQ ID NO: 35738 - DNA, 18 bp, Homo sapiens
agaaaagtgctcttgagt

SEQ ID NO: 35739 - DNA, 22 bp, Homo sapiens
atcttggctcactgcaacctct

SEQ ID NO: 35740 - DNA, 21 bp, Homo sapiens
cttttcacttgctttcatttt

SEQ ID NO: 35741 - DNA, 18 bp, Homo sapiens
gcagtgaacttgctgtca

SEQ ID NO: 35742 - DNA, 24 bp, Homo sapiens
taaatgccagtcttagtgtgaagc

SEQ ID NO: 35743 - DNA, 24 bp, Homo sapiens
taccatgagttttaagcctcacat

SEQ ID NO: 35744 - DNA, 21 bp, Homo sapiens
tccttaaatttgtatgtatca

SEQ ID NO: 35745 - DNA, 19 bp, Homo sapiens
tcgatgccaggagattcaa

SEQ ID NO: 35746 - DNA, 19 bp, Homo sapiens
ttcacttgctttcattttt

SEQ ID NO: 35747 - DNA, 26 bp, Homo sapiens
ttttttatattggctgtctggatttt

SEQ ID NO: 35748 - DNA, 19 bp, Homo sapiens
agtgatccaatctaagaaa

SEQ ID NO: 35749 - DNA, 21 bp, Homo sapiens
cctgcacaccatagcccacct

SEQ ID NO: 35750 - DNA, 23 bp, Homo sapiens
gcagaggactcttcagcctgtca

SEQ ID NO: 35751 - DNA, 21 bp, Homo sapiens
gcatgacagagggtctttgtt

SEQ ID NO: 35752 - DNA, 21 bp, Homo sapiens
gccagtgtcagcagtcagaga

SEQ ID NO: 35753 - DNA, 19 bp, Homo sapiens
ggcggcggccaccgcggca

SEQ ID NO: 35754 - DNA, 22 bp, Homo sapiens
gttctcagctttccttaagcga

SEQ ID NO: 35755 - DNA, 21 bp, Homo sapiens
tgtgaccaccctcctcttact

SEQ ID NO: 35756 - DNA, 20 bp, Homo sapiens
cctgtgttctcctctgtgga

SEQ ID NO: 35757 - DNA, 19 bp, Homo sapiens
gccaaatggcaaatgtgta

SEQ ID NO: 35758 - DNA, 19 bp, Homo sapiens
ggtttaatgtagcccagct

SEQ ID NO: 35759 - DNA, 18 bp, Homo sapiens
tattacattctttcctga

SEQ ID NO: 35760 - DNA, 22 bp, Homo sapiens
tctcttttgactaaatcaccta

SEQ ID NO: 35761 - DNA, 21 bp, Homo sapiens
aaaagatatgcatgtgctgta

SEQ ID NO: 35762 - DNA, 24 bp, Homo sapiens
agctgctgaagaacatgttgctca

SEQ ID NO: 35763 - DNA, 18 bp, Homo sapiens
agttgtggctctgttttt

SEQ ID NO: 35764 - DNA, 16 bp, Homo sapiens
ctcagtaagaatgtga

SEQ ID NO: 35765 - DNA, 22 bp, Homo sapiens
gaattatatgtacatctctgga

SEQ ID NO: 35766 - DNA, 25 bp, Homo sapiens
tgaaattgattacaaatacatttga

SEQ ID NO: 35767 - DNA, 26 bp, Homo sapiens
acaataggccttttctttatcattca

SEQ ID NO: 35768 - DNA, 19 bp, Homo sapiens
actaaaagccactttgtga

SEQ ID NO: 35769 - DNA, 18 bp, Homo sapiens
cacctcatcctcaaactc

SEQ ID NO: 35770 - DNA, 19 bp, Homo sapiens
catgatattcttcatctca

SEQ ID NO: 35771 - DNA, 21 bp, Homo sapiens
gaccagcatgctaatcagtgt

SEQ ID NO: 35772 - DNA, 19 bp, Homo sapiens
tcctctgttcttccagttc

SEQ ID NO: 35773 - DNA, 19 bp, Homo sapiens
tctgaaaactgaggagtgt

SEQ ID NO: 35774 - DNA, 23 bp, Homo sapiens
tggggtttgttaacatggaacta

SEQ ID NO: 35775 - DNA, 23 bp, Homo sapiens
tttgccagttccagatctctttt

SEQ ID NO: 35776 - DNA, 24 bp, Homo sapiens
aagaaatacttttatgttatccct

SEQ ID NO: 35777 - DNA, 17 bp, Homo sapiens
gcttttacccaatctca

SEQ ID NO: 35778 - DNA, 21 bp, Homo sapiens
gtgccagggtgtatctgggta

SEQ ID NO: 35779 - DNA, 20 bp, Homo sapiens
gttgaaaacttagtatatga

SEQ ID NO: 35780 - DNA, 20 bp, Homo sapiens
ttctttgatgcatgcagttt

SEQ ID NO: 35781 - DNA, 17 bp, Homo sapiens
aagcagccagggtctca

SEQ ID NO: 35782 - DNA, 19 bp, Homo sapiens
agtctcactctgtcaccag

SEQ ID NO: 35783 - DNA, 20 bp, Homo sapiens
cctctgcctcccaggttcaa

SEQ ID NO: 35784 - DNA, 19 bp, Homo sapiens
ctgcaacctctgcctccca

SEQ ID NO: 35785 - DNA, 16 bp, Homo sapiens
tgtgtgtgactattga

SEQ ID NO: 35786 - DNA, 23 bp, Homo sapiens
aacattctcaaaacatcacatca

SEQ ID NO: 35787 - DNA, 18 bp, Homo sapiens
gtaacatgattacataat

SEQ ID NO: 35788 - DNA, 20 bp, Homo sapiens
gtgaacaggttcccatacca

SEQ ID NO: 35789 - DNA, 18 bp, Homo sapiens
ttcagagtccagatggca

SEQ ID NO: 35790 - DNA, 19 bp, Homo sapiens
agggtcccggggcccggtt

SEQ ID NO: 35791 - DNA, 18 bp, Homo sapiens
ccaccgactcccacctcc

SEQ ID NO: 35792 - DNA, 19 bp, Homo sapiens
aagtacttgaattgctttt

SEQ ID NO: 35793 - DNA, 20 bp, Homo sapiens
cacatttaacctactgtcaa

SEQ ID NO: 35794 - DNA, 24 bp, Homo sapiens
cctcaggccccgtcccggcgccgc

SEQ ID NO: 35795 - DNA, 19 bp, Homo sapiens
gactgagcaaaatatctca

SEQ ID NO: 35796 - DNA, 23 bp, Homo sapiens
tcttttcaatgggttttaatttt

SEQ ID NO: 35797 - DNA, 21 bp, Homo sapiens
tgctctataaatagtattcca

SEQ ID NO: 35798 - DNA, 18 bp, Homo sapiens
aaagaagtctgtctaaga

SEQ ID NO: 35799 - DNA, 22 bp, Homo sapiens
aactgactgataaagctgtaca

SEQ ID NO: 35800 - DNA, 20 bp, Homo sapiens
aagttttaatgatctgccat

SEQ ID NO: 35801 - DNA, 26 bp, Homo sapiens
ccgttgagtaatgccaagttgttttt

SEQ ID NO: 35802 - DNA, 21 bp, Homo sapiens
cgaattattccaggtagatcc

SEQ ID NO: 35803 - DNA, 19 bp, Homo sapiens
tagaattttcccaccaacg

SEQ ID NO: 35804 - DNA, 18 bp, Homo sapiens
tgtgcctaacaagcaaca

SEQ ID NO: 35805 - DNA, 22 bp, Homo sapiens
cgccagctccactcccaccttc

SEQ ID NO: 35806 - DNA, 16 bp, Homo sapiens
tccccccaccacccca

SEQ ID NO: 35807 - DNA, 20 bp, Homo sapiens
cctggcggcggcagccgcac

SEQ ID NO: 35808 - DNA, 18 bp, Homo sapiens
ggacctggcggcggcagc

SEQ ID NO: 35809 - DNA, 24 bp, Homo sapiens
tacttactgtgatgactgctgtct

SEQ ID NO: 35810 - DNA, 19 bp, Homo sapiens
ggaaacacagtccacatca

SEQ ID NO: 35811 - DNA, 19 bp, Homo sapiens
tctggttctaggcctttga

SEQ ID NO: 35812 - DNA, 25 bp, Homo sapiens
aaatcctatttcaacactgaaattg

SEQ ID NO: 35813 - DNA, 24 bp, Homo sapiens
atttagtagaattttttagtttta

SEQ ID NO: 35814 - DNA, 20 bp, Homo sapiens
cacggaaatgaaagcctttt

SEQ ID NO: 35815 - DNA, 20 bp, Homo sapiens
ccattacagtggcctggata

SEQ ID NO: 35816 - DNA, 21 bp, Homo sapiens
gccattacagtggcctggata

SEQ ID NO: 35817 - DNA, 19 bp, Homo sapiens
ggctttggtactgaaactg

SEQ ID NO: 35818 - DNA, 26 bp, Homo sapiens
ggggacggcgacagcgcggctctgtg

SEQ ID NO: 35819 - DNA, 19 bp, Homo sapiens
gtctgttgttacccacgta

SEQ ID NO: 35820 - DNA, 17 bp, Homo sapiens
gtggccatccgccgcgg

SEQ ID NO: 35821 - DNA, 18 bp, Homo sapiens
cccgctccacatttccct

SEQ ID NO: 35822 - DNA, 20 bp, Homo sapiens
ctagagcccgctggtatgat

SEQ ID NO: 35823 - DNA, 15 bp, Homo sapiens
ctcattctggatcca

SEQ ID NO: 35824 - DNA, 18 bp, Homo sapiens
gcagcactacaacgtgca

SEQ ID NO: 35825 - DNA, 19 bp, Homo sapiens
ggacagccaagtggagcta

SEQ ID NO: 35826 - DNA, 22 bp, Homo sapiens
tatgcaatttatatgccagata

SEQ ID NO: 35827 - DNA, 17 bp, Homo sapiens
tctgtgggttctttcaa

SEQ ID NO: 35828 - DNA, 23 bp, Homo sapiens
tgaatgggtctctagactgggac

SEQ ID NO: 35829 - DNA, 18 bp, Homo sapiens
cagccgagaagttcctgg

SEQ ID NO: 35830 - DNA, 21 bp, Homo sapiens
gaccccgagcggcgctgccgg

SEQ ID NO: 35831 - DNA, 23 bp, Homo sapiens
gccacccccctccatcctggggg

SEQ ID NO: 35832 - DNA, 19 bp, Homo sapiens
atgatcctaaactttttgg

SEQ ID NO: 35833 - DNA, 22 bp, Homo sapiens
ccttccacatgttaacagtaga

SEQ ID NO: 35834 - DNA, 22 bp, Homo sapiens
gctgcaatcgtatggctttctc

SEQ ID NO: 35835 - DNA, 23 bp, Homo sapiens
ggcgcaggacgcggccgatctcc

SEQ ID NO: 35836 - DNA, 20 bp, Homo sapiens
gggagcggtggggagagcat

SEQ ID NO: 35837 - DNA, 19 bp, Homo sapiens
tggagccacagaaccagct

SEQ ID NO: 35838 - DNA, 20 bp, Homo sapiens
ttccacatgttaacagtaga

SEQ ID NO: 35839 - DNA, 18 bp, Homo sapiens
actgggataaaaatgtca

SEQ ID NO: 35840 - DNA, 18 bp, Homo sapiens
cggaagaacccatcaaag

SEQ ID NO: 35841 - DNA, 20 bp, Homo sapiens
ggaagaacccatcaaagccc

SEQ ID NO: 35842 - DNA, 16 bp, Homo sapiens
actatttgaaacattc

SEQ ID NO: 35843 - DNA, 25 bp, Homo sapiens
agcccatctcctgtcttgcagttca

SEQ ID NO: 35844 - DNA, 23 bp, Homo sapiens
ccctggctgttagggtctgggag

SEQ ID NO: 35845 - DNA, 18 bp, Homo sapiens
cctccagctgtctggcct

SEQ ID NO: 35846 - DNA, 20 bp, Homo sapiens
gcccttcacgccttaacact

SEQ ID NO: 35847 - DNA, 24 bp, Homo sapiens
ctgcaaatctgcacacacaacgaa

SEQ ID NO: 35848 - DNA, 19 bp, Homo sapiens
ctttgtaatgcagtttgtg

SEQ ID NO: 35849 - DNA, 16 bp, Homo sapiens
tgggacgggtttactt

SEQ ID NO: 35850 - DNA, 25 bp, Homo sapiens
cacacacaccactaatttccctgaa

SEQ ID NO: 35851 - DNA, 19 bp, Homo sapiens
atggacacactaacagcac

SEQ ID NO: 35852 - DNA, 22 bp, Homo sapiens
catggttaaggaaagaatgcaa

SEQ ID NO: 35853 - DNA, 17 bp, Homo sapiens
ctgacaatcattgcagc

SEQ ID NO: 35854 - DNA, 19 bp, Homo sapiens
tctgtaaatccacctttga

SEQ ID NO: 35855 - DNA, 22 bp, Homo sapiens
aaaacaaaattaaaacccaaat

SEQ ID NO: 35856 - DNA, 17 bp, Homo sapiens
aagttctctcaagtgtc

SEQ ID NO: 35857 - DNA, 20 bp, Homo sapiens
gggtagcaatcttgttgcca

SEQ ID NO: 35858 - DNA, 21 bp, Homo sapiens
ttgttgccacatgtgcagcaa

SEQ ID NO: 35859 - DNA, 22 bp, Homo sapiens
atgggcatcttccatgccacca

SEQ ID NO: 35860 - DNA, 23 bp, Homo sapiens
tctaatcaagagaattttgctcc

SEQ ID NO: 35861 - DNA, 21 bp, Homo sapiens
tgaagatcacaaggtggtatc

SEQ ID NO: 35862 - DNA, 20 bp, Homo sapiens
gactgtataaatgcatttta

SEQ ID NO: 35863 - DNA, 20 bp, Homo sapiens
gcataatcactgtctgccta

SEQ ID NO: 35864 - DNA, 22 bp, Homo sapiens
ttgaaatttatcattttatcat

SEQ ID NO: 35865 - DNA, 22 bp, Homo sapiens
agccacatttggccaggcctcc

SEQ ID NO: 35866 - DNA, 18 bp, Homo sapiens
gatttattcccttgactt

SEQ ID NO: 35867 - DNA, 18 bp, Homo sapiens
tctattgtatgtcactta

SEQ ID NO: 35868 - DNA, 24 bp, Homo sapiens
aactagcataattaacttagttct

SEQ ID NO: 35869 - DNA, 23 bp, Homo sapiens
gcaagtcttccagccctgctgct

SEQ ID NO: 35870 - DNA, 23 bp, Homo sapiens
gcacggccccgtcttctgcctcc

SEQ ID NO: 35871 - DNA, 21 bp, Homo sapiens
ggaaacagaacacagcagtga

SEQ ID NO: 35872 - DNA, 23 bp, Homo sapiens
tatttcagacttcagaaaccatt

SEQ ID NO: 35873 - DNA, 19 bp, Homo sapiens
tcctgctaaataacctgca

SEQ ID NO: 35874 - DNA, 23 bp, Homo sapiens
tggaaacctcctcttccagctta

SEQ ID NO: 35875 - DNA, 18 bp, Homo sapiens
aaaaggtgctaaaatgat

SEQ ID NO: 35876 - DNA, 19 bp, Homo sapiens
actgaggatgaactgtgtt

SEQ ID NO: 35877 - DNA, 21 bp, Homo sapiens
cccactttccagaccattcca

SEQ ID NO: 35878 - DNA, 25 bp, Homo sapiens
ctgtgttttgcagcattttgtttta

SEQ ID NO: 35879 - DNA, 19 bp, Homo sapiens
gctctttgacacatggaca

SEQ ID NO: 35880 - DNA, 17 bp, Homo sapiens
aaaaacaagcaaacaaa

SEQ ID NO: 35881 - DNA, 24 bp, Homo sapiens
cccacttctcaccaccaccgccat

SEQ ID NO: 35882 - DNA, 17 bp, Homo sapiens
gacaccccgcagcttct

SEQ ID NO: 35883 - DNA, 19 bp, Homo sapiens
agatatggaagttatgaca

SEQ ID NO: 35884 - DNA, 18 bp, Homo sapiens
agcagaagatagatgcca

SEQ ID NO: 35885 - DNA, 19 bp, Homo sapiens
tctcataatggatatctca

SEQ ID NO: 35886 - DNA, 20 bp, Homo sapiens
cgctgttaccaagaatgact

SEQ ID NO: 35887 - DNA, 20 bp, Homo sapiens
gcaaggactctcattgggtt

SEQ ID NO: 35888 - DNA, 18 bp, Homo sapiens
gcgcgctgctggatctaa

SEQ ID NO: 35889 - DNA, 21 bp, Homo sapiens
caatagatctatccttgccag

SEQ ID NO: 35890 - DNA, 18 bp, Homo sapiens
cagtggaagctgctgtta

SEQ ID NO: 35891 - DNA, 15 bp, Homo sapiens
ccaggaggcccacct

SEQ ID NO: 35892 - DNA, 23 bp, Homo sapiens
cctaagtagttttgaatttcttt

SEQ ID NO: 35893 - DNA, 22 bp, Homo sapiens
gagccaagatcaggccactgca

SEQ ID NO: 35894 - DNA, 20 bp, Homo sapiens
tggctagaagtggcagaggg

SEQ ID NO: 35895 - DNA, 18 bp, Homo sapiens
tgggtggatcagttgagg

SEQ ID NO: 35896 - DNA, 17 bp, Homo sapiens
tgtcccagtggaagctg

SEQ ID NO: 35897 - DNA, 17 bp, Homo sapiens
caaacatctttcagctg

SEQ ID NO: 35898 - DNA, 21 bp, Homo sapiens
cacgtctctctggcccactca

SEQ ID NO: 35899 - DNA, 20 bp, Homo sapiens
cagagtgcccaggcactcct

SEQ ID NO: 35900 - DNA, 20 bp, Homo sapiens
tcttggcagcagaccagtgg

SEQ ID NO: 35901 - DNA, 20 bp, Homo sapiens
tggagaaatcacagagaggt

SEQ ID NO: 35902 - DNA, 20 bp, Homo sapiens
gaacagaagagtcctctgtt

SEQ ID NO: 35903 - DNA, 17 bp, Homo sapiens
gagctgatgaaatctca

SEQ ID NO: 35904 - DNA, 22 bp, Homo sapiens
ggtaatggaataaaggatgcat

SEQ ID NO: 35905 - DNA, 21 bp, Homo sapiens
tctgtttctcaaccttatcca

SEQ ID NO: 35906 - DNA, 17 bp, Homo sapiens
tgcagctctctttctgc

SEQ ID NO: 35907 - DNA, 17 bp, Homo sapiens
tgcagctctctttctgc

SEQ ID NO: 35908 - DNA, 17 bp, Homo sapiens
tgcagctctctttctgc

SEQ ID NO: 35909 - DNA, 22 bp, Homo sapiens
tgtctggttggtttaacaaaga

SEQ ID NO: 35910 - DNA, 19 bp, Homo sapiens
ccctccccacttgcttccc

SEQ ID NO: 35911 - DNA, 22 bp, Homo sapiens
taaatgcttatcagcatgaaat

SEQ ID NO: 35912 - DNA, 16 bp, Homo sapiens
ccattagagcttaaga

SEQ ID NO: 35913 - DNA, 19 bp, Homo sapiens
gattcccgcccgcttcctc

SEQ ID NO: 35914 - DNA, 22 bp, Homo sapiens
ggtattttctccaaatgttcac

SEQ ID NO: 35915 - DNA, 22 bp, Homo sapiens
accttagaggcagggaacagca

SEQ ID NO: 35916 - DNA, 22 bp, Homo sapiens
cagcaatgccaaatttccctct

SEQ ID NO: 35917 - DNA, 21 bp, Homo sapiens
gcccctcaattccaggagtca

SEQ ID NO: 35918 - DNA, 23 bp, Homo sapiens
cactatggttaaataaggtctta

SEQ ID NO: 35919 - DNA, 18 bp, Homo sapiens
cagccatttagcatttaa

SEQ ID NO: 35920 - DNA, 18 bp, Homo sapiens
ctgtcacagtaacacttt

SEQ ID NO: 35921 - DNA, 18 bp, Homo sapiens
aactactcaatgaaaaca

SEQ ID NO: 35922 - DNA, 20 bp, Homo sapiens
atatttgtgcagaaactgca

SEQ ID NO: 35923 - DNA, 18 bp, Homo sapiens
cgagcggaattccggcgg

SEQ ID NO: 35924 - DNA, 21 bp, Homo sapiens
ggcatgctcggcagcccggga

SEQ ID NO: 35925 - DNA, 16 bp, Homo sapiens
cccagacttcctcccc

SEQ ID NO: 35926 - DNA, 23 bp, Homo sapiens
gagacgcgactggcggctccagc

SEQ ID NO: 35927 - DNA, 17 bp, Homo sapiens
ggctccagcagggacta

SEQ ID NO: 35928 - DNA, 16 bp, Homo sapiens
cttaacaaacctttga

SEQ ID NO: 35929 - DNA, 21 bp, Homo sapiens
gacagagctgagctcaaaata

SEQ ID NO: 35930 - DNA, 22 bp, Homo sapiens
aaaaagaacatttttccagtgt

SEQ ID NO: 35931 - DNA, 19 bp, Homo sapiens
aactagaaaagtcaaagta

SEQ ID NO: 35932 - DNA, 21 bp, Homo sapiens
gactctaaaagatttgccaaa

SEQ ID NO: 35933 - DNA, 18 bp, Homo sapiens
gggtcgttgggccctgtc

SEQ ID NO: 35934 - DNA, 21 bp, Homo sapiens
tttaggaaacgaaatatttcc

SEQ ID NO: 35935 - DNA, 23 bp, Homo sapiens
aatcaccttcagaatcatgtcga

SEQ ID NO: 35936 - DNA, 18 bp, Homo sapiens
caccattctcctgcctca

SEQ ID NO: 35937 - DNA, 18 bp, Homo sapiens
caggttgacaccattctc

SEQ ID NO: 35938 - DNA, 21 bp, Homo sapiens
ccttcccctcttcttctttcc

SEQ ID NO: 35939 - DNA, 21 bp, Homo sapiens
gcccctgcccctctgttggag

SEQ ID NO: 35940 - DNA, 19 bp, Homo sapiens
aaataaataggcagagcta

SEQ ID NO: 35941 - DNA, 22 bp, Homo sapiens
aaggcacctcaaagatgtctca

SEQ ID NO: 35942 - DNA, 20 bp, Homo sapiens
agaccagcctcatcaacata

SEQ ID NO: 35943 - DNA, 23 bp, Homo sapiens
ctgaaatatgactgccatatgaa

SEQ ID NO: 35944 - DNA, 19 bp, Homo sapiens
gtttatacttgaggactga

SEQ ID NO: 35945 - DNA, 21 bp, Homo sapiens
tgactgccatatgaatgtgat

SEQ ID NO: 35946 - DNA, 24 bp, Homo sapiens
atcatttattgcatctcataacta

SEQ ID NO: 35947 - DNA, 18 bp, Homo sapiens
attaaacagctatgtaaa

SEQ ID NO: 35948 - DNA, 19 bp, Homo sapiens
ctcattgtctccttcccat

SEQ ID NO: 35949 - DNA, 17 bp, Homo sapiens
ctctgactgctttgatc

SEQ ID NO: 35950 - DNA, 18 bp, Homo sapiens
cttccaagcacttctggt

SEQ ID NO: 35951 - DNA, 16 bp, Homo sapiens
cttctccctctgactg

SEQ ID NO: 35952 - DNA, 20 bp, Homo sapiens
gaaaaactaaaaatgaacca

SEQ ID NO: 35953 - DNA, 22 bp, Homo sapiens
tttgggtaattctgccacattt

SEQ ID NO: 35954 - DNA, 25 bp, Homo sapiens
gaatatttgggcagggtttttgtta

SEQ ID NO: 35955 - DNA, 20 bp, Homo sapiens
tgaacagttatcacatttaa

SEQ ID NO: 35956 - DNA, 19 bp, Homo sapiens
cctcctgccgccgccgcta

SEQ ID NO: 35957 - DNA, 19 bp, Homo sapiens
gccgccgccgctgctcctc

SEQ ID NO: 35958 - DNA, 18 bp, Homo sapiens
gttgcttttatcactgcc

SEQ ID NO: 35959 - DNA, 16 bp, Homo sapiens
ttgtgcatagggaagc

SEQ ID NO: 35960 - DNA, 19 bp, Homo sapiens
attcaagtgagaagtaaat

SEQ ID NO: 35961 - DNA, 19 bp, Homo sapiens
ctctaaatgtgacatgcaa

SEQ ID NO: 35962 - DNA, 22 bp, Homo sapiens
ctctcatttgttaatgctttcc

SEQ ID NO: 35963 - DNA, 24 bp, Homo sapiens
ataataaaaaaaaaagccctttaa

SEQ ID NO: 35964 - DNA, 23 bp, Homo sapiens
tcattttctttcattttatattc

SEQ ID NO: 35965 - DNA, 22 bp, Homo sapiens
acaggaaaaccacccacagctg

SEQ ID NO: 35966 - DNA, 21 bp, Homo sapiens
actctgagggcaaactgctga

SEQ ID NO: 35967 - DNA, 22 bp, Homo sapiens
atgtagacaatacagctttgga

SEQ ID NO: 35968 - DNA, 24 bp, Homo sapiens
ccctcccctttctctttctttcca

SEQ ID NO: 35969 - DNA, 23 bp, Homo sapiens
ccctccctgcctcggcagcgcgg

SEQ ID NO: 35970 - DNA, 22 bp, Homo sapiens
gcttccacggcgtgtttggttc

SEQ ID NO: 35971 - DNA, 19 bp, Homo sapiens
gttttcatactcgatcggg

SEQ ID NO: 35972 - DNA, 22 bp, Homo sapiens
tccttacttcctgcctcagtta

SEQ ID NO: 35973 - DNA, 22 bp, Homo sapiens
tgctttttcctttgcttcttga

SEQ ID NO: 35974 - DNA, 22 bp, Homo sapiens
aacaggaaaccaatcacctggc

SEQ ID NO: 35975 - DNA, 17 bp, Homo sapiens
aatctttccatttaaca

SEQ ID NO: 35976 - DNA, 21 bp, Homo sapiens
agttcaagttcaaagctgttc

SEQ ID NO: 35977 - DNA, 18 bp, Homo sapiens
catcctcacaacagcccc

SEQ ID NO: 35978 - DNA, 19 bp, Homo sapiens
ctcccccgaccaaacccca

SEQ ID NO: 35979 - DNA, 22 bp, Homo sapiens
gcaccactttcaagatgcttca

SEQ ID NO: 35980 - DNA, 17 bp, Homo sapiens
tgtttcagctcattcca

SEQ ID NO: 35981 - DNA, 18 bp, Homo sapiens
aggaattgaaatacaaca

SEQ ID NO: 35982 - DNA, 18 bp, Homo sapiens
agcccctgtctttcccac

SEQ ID NO: 35983 - DNA, 26 bp, Homo sapiens
ccacacagatggtgtggaccatgctg

SEQ ID NO: 35984 - DNA, 22 bp, Homo sapiens
gaagagaccagccctcctccca

SEQ ID NO: 35985 - DNA, 19 bp, Homo sapiens
gggtgggggacaggagctg

SEQ ID NO: 35986 - DNA, 19 bp, Homo sapiens
gtggatgttacagggtggc

SEQ ID NO: 35987 - DNA, 22 bp, Homo sapiens
cagctgttccacctggacccca

SEQ ID NO: 35988 - DNA, 23 bp, Homo sapiens
gaggccatcctctccatccgaga

SEQ ID NO: 35989 - DNA, 22 bp, Homo sapiens
gcctgctccatggaggcagaga

SEQ ID NO: 35990 - DNA, 21 bp, Homo sapiens
ggaggcgcggcggctgcaggc

SEQ ID NO: 35991 - DNA, 23 bp, Homo sapiens
gtggctttgtttccagtttttgt

SEQ ID NO: 35992 - DNA, 18 bp, Homo sapiens
tggccttaatgctaaagc

SEQ ID NO: 35993 - DNA, 23 bp, Homo sapiens
ttccacaccttgaaataaacaga

SEQ ID NO: 35994 - DNA, 23 bp, Homo sapiens
gagagtctcaacagccccttcca

SEQ ID NO: 35995 - DNA, 19 bp, Homo sapiens
gccacggtaaaagcaaaca

SEQ ID NO: 35996 - DNA, 23 bp, Homo sapiens
gctggacgcggtcggcctggtcc

SEQ ID NO: 35997 - DNA, 19 bp, Homo sapiens
tggtgaaaccccatctcca

SEQ ID NO: 35998 - DNA, 19 bp, Homo sapiens
tttctggcccttattgctg

SEQ ID NO: 35999 - DNA, 21 bp, Homo sapiens
caggtgatacatagcctggta

SEQ ID NO: 36000 - DNA, 21 bp, Homo sapiens
gaaaaaggactagacctgtgt

SEQ ID NO: 36001 - DNA, 17 bp, Homo sapiens
gcctggtacttttttgt

SEQ ID NO: 36002 - DNA, 18 bp, Homo sapiens
ctgggcggctcctggttc

SEQ ID NO: 36003 - DNA, 18 bp, Homo sapiens
aaggatgaactgacacct

SEQ ID NO: 36004 - DNA, 19 bp, Homo sapiens
atatggatttagattatca

SEQ ID NO: 36005 - DNA, 24 bp, Homo sapiens
gactgctttgcataaaactgggaa

SEQ ID NO: 36006 - DNA, 17 bp, Homo sapiens
gaggagagctatgtttt

SEQ ID NO: 36007 - DNA, 17 bp, Homo sapiens
gatgacctcgatatgga

SEQ ID NO: 36008 - DNA, 21 bp, Homo sapiens
tccacggcgattcttcccgca

SEQ ID NO: 36009 - DNA, 19 bp, Homo sapiens
caagccagccctctcctct

SEQ ID NO: 36010 - DNA, 22 bp, Homo sapiens
ccagacgcccacctgtgcctca

SEQ ID NO: 36011 - DNA, 18 bp, Homo sapiens
gactcacagcagcaccga

SEQ ID NO: 36012 - DNA, 18 bp, Homo sapiens
gccctgccaggcttgcca

SEQ ID NO: 36013 - DNA, 16 bp, Homo sapiens
gtaaaggatatttggc

SEQ ID NO: 36014 - DNA, 21 bp, Homo sapiens
cacagctgaccccagcgcagc

SEQ ID NO: 36015 - DNA, 19 bp, Homo sapiens
ggagcttattgtgagattg

SEQ ID NO: 36016 - DNA, 24 bp, Homo sapiens
gggtgatgctcagacagtgtgcca

SEQ ID NO: 36017 - DNA, 20 bp, Homo sapiens
tccagcccgctacgtgactg

SEQ ID NO: 36018 - DNA, 21 bp, Homo sapiens
aagggcctcgtgcagtgtgtt

SEQ ID NO: 36019 - DNA, 26 bp, Homo sapiens
aagtttgattcctaacactggagttg

SEQ ID NO: 36020 - DNA, 17 bp, Homo sapiens
actccacttcacatgcc

SEQ ID NO: 36021 - DNA, 21 bp, Homo sapiens
ccagggtcccttaacacctcg

SEQ ID NO: 36022 - DNA, 24 bp, Homo sapiens
cccggactctgcccctacatctca

SEQ ID NO: 36023 - DNA, 21 bp, Homo sapiens
ccctggcatcggtcctgcgga

SEQ ID NO: 36024 - DNA, 20 bp, Homo sapiens
cccttctcagccacacttcc

SEQ ID NO: 36025 - DNA, 23 bp, Homo sapiens
cgatgggcagtggctcaccccca

SEQ ID NO: 36026 - DNA, 20 bp, Homo sapiens
cttgacacagtcacagtgta

SEQ ID NO: 36027 - DNA, 21 bp, Homo sapiens
cttggggtgctctgcactcca

SEQ ID NO: 36028 - DNA, 17 bp, Homo sapiens
gcctaccgcgtgcccgg

SEQ ID NO: 36029 - DNA, 15 bp, Homo sapiens
gcctgcaggtgagct

SEQ ID NO: 36030 - DNA, 20 bp, Homo sapiens
gctgctcctccagaggtctg

SEQ ID NO: 36031 - DNA, 20 bp, Homo sapiens
ggggatggcgtcggagccgc

SEQ ID NO: 36032 - DNA, 18 bp, Homo sapiens
ttgagggctgtttggctc

SEQ ID NO: 36033 - DNA, 20 bp, Homo sapiens
acagaaaagaaagtaccatc

SEQ ID NO: 36034 - DNA, 23 bp, Homo sapiens
cccaggttacatttgttctagat

SEQ ID NO: 36035 - DNA, 19 bp, Homo sapiens
ctgggctgagattgttttt

SEQ ID NO: 36036 - DNA, 17 bp, Homo sapiens
ctgtgttttctctctta

SEQ ID NO: 36037 - DNA, 24 bp, Homo sapiens
ggtgggtgggtgtgtgtgtgtgtg

SEQ ID NO: 36038 - DNA, 18 bp, Homo sapiens
tatgtatttatttgtttt

SEQ ID NO: 36039 - DNA, 19 bp, Homo sapiens
tggcctcaatgtgaaatta

SEQ ID NO: 36040 - DNA, 17 bp, Homo sapiens
ttcttaattgataacac

SEQ ID NO: 36041 - DNA, 18 bp, Homo sapiens
cgacaggcagcgcggctg

SEQ ID NO: 36042 - DNA, 21 bp, Homo sapiens
cgcgcggcgcccgcaggaccc

SEQ ID NO: 36043 - DNA, 18 bp, Homo sapiens
cgatggaagtcgactttt

SEQ ID NO: 36044 - DNA, 22 bp, Homo sapiens
gtgtttttaccttggtgaatct

SEQ ID NO: 36045 - DNA, 19 bp, Homo sapiens
aaactcctgacctcaggtg

SEQ ID NO: 36046 - DNA, 19 bp, Homo sapiens
agaatacaagtatacgtca

SEQ ID NO: 36047 - DNA, 17 bp, Homo sapiens
atcctctcctttccagg

SEQ ID NO: 36048 - DNA, 18 bp, Homo sapiens
cctacaacctccacctcc

SEQ ID NO: 36049 - DNA, 18 bp, Homo sapiens
gagcttccactggaggct

SEQ ID NO: 36050 - DNA, 18 bp, Homo sapiens
tggacttccggtccctgc

SEQ ID NO: 36051 - DNA, 21 bp, Homo sapiens
ttttgagacgggagtctcgct

SEQ ID NO: 36052 - DNA, 19 bp, Homo sapiens
gcagagggaggcactttca

SEQ ID NO: 36053 - DNA, 20 bp, Homo sapiens
ggccacggcgcaccacgagt

SEQ ID NO: 36054 - DNA, 18 bp, Homo sapiens
aaacaaactcaaaacata

SEQ ID NO: 36055 - DNA, 24 bp, Homo sapiens
gtgttttggccacttggaggacct

SEQ ID NO: 36056 - DNA, 26 bp, Homo sapiens
ttttggccacttggaggacctgggag

SEQ ID NO: 36057 - DNA, 22 bp, Homo sapiens
ctattttttttaaagctcgtca

SEQ ID NO: 36058 - DNA, 28 bp, Homo sapiens
ggaattctgcaagacaactcttcttcca

SEQ ID NO: 36059 - DNA, 20 bp, Homo sapiens
tgctattttttttaaagctc

SEQ ID NO: 36060 - DNA, 23 bp, Homo sapiens
agtgaccctcctgcctcagcctc

SEQ ID NO: 36061 - DNA, 21 bp, Homo sapiens
cttaagcaatcttcctgcttt

SEQ ID NO: 36062 - DNA, 20 bp, Homo sapiens
tctgtggagaagggaagaga

SEQ ID NO: 36063 - DNA, 16 bp, Homo sapiens
aaacactgaatccatc

SEQ ID NO: 36064 - DNA, 22 bp, Homo sapiens
aacttaaacatctgtggaacca

SEQ ID NO: 36065 - DNA, 20 bp, Homo sapiens
cactttcacacttgcctcat

SEQ ID NO: 36066 - DNA, 24 bp, Homo sapiens
ggggacggcggcggcggcggcggc

SEQ ID NO: 36067 - DNA, 22 bp, Homo sapiens
atccaaccaactacacatttta

SEQ ID NO: 36068 - DNA, 19 bp, Homo sapiens
actgtgaaattgactgtgt

SEQ ID NO: 36069 - DNA, 18 bp, Homo sapiens
atggaactatacatagaa

SEQ ID NO: 36070 - DNA, 21 bp, Homo sapiens
cctctttgtggcaacagatct

SEQ ID NO: 36071 - DNA, 21 bp, Homo sapiens
gagtccatcactgtgaaattg

SEQ ID NO: 36072 - DNA, 25 bp, Homo sapiens
tctgactcctttcattcattcctcc

SEQ ID NO: 36073 - DNA, 19 bp, Homo sapiens
tgactgtgtccatgtgatg

SEQ ID NO: 36074 - DNA, 19 bp, Homo sapiens
tggctttttaaactccttt

SEQ ID NO: 36075 - DNA, 19 bp, Homo sapiens
agcctccagcctgacccca

SEQ ID NO: 36076 - DNA, 21 bp, Homo sapiens
atcctcacgtctcccactttt

SEQ ID NO: 36077 - DNA, 19 bp, Homo sapiens
ccagaccctgtgtccccca

SEQ ID NO: 36078 - DNA, 20 bp, Homo sapiens
cccagaccctgtgtccccca

SEQ ID NO: 36079 - DNA, 20 bp, Homo sapiens
ccctctgagctggcctgtgg

SEQ ID NO: 36080 - DNA, 22 bp, Homo sapiens
ctctctctctcctctctttctc

SEQ ID NO: 36081 - DNA, 21 bp, Homo sapiens
ctctttctctctctccctctc

SEQ ID NO: 36082 - DNA, 21 bp, Homo sapiens
gcccttcctccatgtgtttgt

SEQ ID NO: 36083 - DNA, 18 bp, Homo sapiens
gggccctggtgctgccac

SEQ ID NO: 36084 - DNA, 20 bp, Homo sapiens
ggtcctcccagcccttgcca

SEQ ID NO: 36085 - DNA, 20 bp, Homo sapiens
tctctcctgcaataactagg

SEQ ID NO: 36086 - DNA, 17 bp, Homo sapiens
tctctctctctcctctc

SEQ ID NO: 36087 - DNA, 17 bp, Homo sapiens
tctctctctctctcctc

SEQ ID NO: 36088 - DNA, 23 bp, Homo sapiens
accctaaaaagtcatttcttgga

SEQ ID NO: 36089 - DNA, 19 bp, Homo sapiens
tccaacatggcgcctggca

SEQ ID NO: 36090 - DNA, 18 bp, Homo sapiens
ctaagagcctggcctcca

SEQ ID NO: 36091 - DNA, 17 bp, Homo sapiens
gcctgcacaccaccaca

SEQ ID NO: 36092 - DNA, 17 bp, Homo sapiens
ggggcaaccactggcca

SEQ ID NO: 36093 - DNA, 22 bp, Homo sapiens
tgagtggcaggcgcatgagatt

SEQ ID NO: 36094 - DNA, 23 bp, Homo sapiens
cttcaaaggaccctatctgcaga

SEQ ID NO: 36095 - DNA, 20 bp, Homo sapiens
gaataattgcagaaaatctt

SEQ ID NO: 36096 - DNA, 20 bp, Homo sapiens
ggctgccggcgctcctcgga

SEQ ID NO: 36097 - DNA, 21 bp, Homo sapiens
tcatttgaccttgccagctga

SEQ ID NO: 36098 - DNA, 18 bp, Homo sapiens
tttgggttggcttggttt

SEQ ID NO: 36099 - DNA, 18 bp, Homo sapiens
atctaacaggacatatca

SEQ ID NO: 36100 - DNA, 22 bp, Homo sapiens
gaaagccaaaccaaacaacgaa

SEQ ID NO: 36101 - DNA, 18 bp, Homo sapiens
gtgtactggtccacttcc

SEQ ID NO: 36102 - DNA, 21 bp, Homo sapiens
tccctaccaggaggcagtcca

SEQ ID NO: 36103 - DNA, 20 bp, Homo sapiens
ttgcagggccagaacttctt

SEQ ID NO: 36104 - DNA, 23 bp, Homo sapiens
caccaggggcaatgctcattcca

SEQ ID NO: 36105 - DNA, 17 bp, Homo sapiens
gctgctgctgtgtttgc

SEQ ID NO: 36106 - DNA, 22 bp, Homo sapiens
ggaaggaggctgggactgtgcc

SEQ ID NO: 36107 - DNA, 22 bp, Homo sapiens
tcagcgctgccattttatttca

SEQ ID NO: 36108 - DNA, 18 bp, Homo sapiens
tccctctgacctaccagt

SEQ ID NO: 36109 - DNA, 19 bp, Homo sapiens
tgccaccaccgccgagcca

SEQ ID NO: 36110 - DNA, 19 bp, Homo sapiens
aaacttgtcaggactggct

SEQ ID NO: 36111 - DNA, 21 bp, Homo sapiens
gggccatatgggaagctgcac

SEQ ID NO: 36112 - DNA, 16 bp, Homo sapiens
aaacatgaaggactcc

SEQ ID NO: 36113 - DNA, 22 bp, Homo sapiens
agctacagaagttcagccatga

SEQ ID NO: 36114 - DNA, 20 bp, Homo sapiens
aggttgggattaccacacca

SEQ ID NO: 36115 - DNA, 17 bp, Homo sapiens
agtgagaaataagacct

SEQ ID NO: 36116 - DNA, 23 bp, Homo sapiens
caaaacattttataatatatatc

SEQ ID NO: 36117 - DNA, 17 bp, Homo sapiens
ctttttcatacattgca

SEQ ID NO: 36118 - DNA, 19 bp, Homo sapiens
tatttctggaaacatatca

SEQ ID NO: 36119 - DNA, 20 bp, Homo sapiens
tctggcctctgtttccccca

SEQ ID NO: 36120 - DNA, 24 bp, Homo sapiens
tgtggtttctgcctaaaattggca

SEQ ID NO: 36121 - DNA, 22 bp, Homo sapiens
tgttcttctactggctgtgatg

SEQ ID NO: 36122 - DNA, 21 bp, Homo sapiens
ttcaggtacattaagctttag

SEQ ID NO: 36123 - DNA, 17 bp, Homo sapiens
atctttttcccctctga

SEQ ID NO: 36124 - DNA, 23 bp, Homo sapiens
cgggcgcaccgcggcccccagga

SEQ ID NO: 36125 - DNA, 16 bp, Homo sapiens
ggcaggtggtaccgta

SEQ ID NO: 36126 - DNA, 20 bp, Homo sapiens
ggcccccaccctccactcct

SEQ ID NO: 36127 - DNA, 17 bp, Homo sapiens
tgcataccaacccctcc

SEQ ID NO: 36128 - DNA, 23 bp, Homo sapiens
gagttgtcattctcatctatcca

SEQ ID NO: 36129 - DNA, 19 bp, Homo sapiens
gactctataacacacgtgg

SEQ ID NO: 36130 - DNA, 22 bp, Homo sapiens
gcgcggagctaagcggctcgga

SEQ ID NO: 36131 - DNA, 17 bp, Homo sapiens
gcgaagtcctcgagcca

SEQ ID NO: 36132 - DNA, 16 bp, Homo sapiens
aactctcccttctcct

SEQ ID NO: 36133 - DNA, 19 bp, Homo sapiens
atggagcagatctgtgaca

SEQ ID NO: 36134 - DNA, 21 bp, Homo sapiens
caccacacccggccccccttc

SEQ ID NO: 36135 - DNA, 20 bp, Homo sapiens
cctctgcctcccaggttcaa

SEQ ID NO: 36136 - DNA, 19 bp, Homo sapiens
ctgcaacctctgcctccca

SEQ ID NO: 36137 - DNA, 21 bp, Homo sapiens
ctggtgacatggagcagatct

SEQ ID NO: 36138 - DNA, 19 bp, Homo sapiens
ggaacttaacttggggcta

SEQ ID NO: 36139 - DNA, 17 bp, Homo sapiens
taccccaccctacccca

SEQ ID NO: 36140 - DNA, 16 bp, Homo sapiens
tttctcaagctcctca

SEQ ID NO: 36141 - DNA, 22 bp, Homo sapiens
cgcgcgccgccaccgccgccgc

SEQ ID NO: 36142 - DNA, 20 bp, Homo sapiens
acctggagaaagttatctgt

SEQ ID NO: 36143 - DNA, 19 bp, Homo sapiens
agcttctagcatcagatca

SEQ ID NO: 36144 - DNA, 24 bp, Homo sapiens
ccatcagcaacctcagaccaaccc

SEQ ID NO: 36145 - DNA, 20 bp, Homo sapiens
tagttaccttgaattcctgg

SEQ ID NO: 36146 - DNA, 21 bp, Homo sapiens
tatttgaagattggcttttcc

SEQ ID NO: 36147 - DNA, 23 bp, Homo sapiens
tcccctgcttgtttttttttttt

SEQ ID NO: 36148 - DNA, 20 bp, Homo sapiens
tgtccatatttgagctttat

SEQ ID NO: 36149 - DNA, 21 bp, Homo sapiens
acctaggctatatggtatagt

SEQ ID NO: 36150 - DNA, 22 bp, Homo sapiens
actatcaaagggcccttcagga

SEQ ID NO: 36151 - DNA, 20 bp, Homo sapiens
ctcaaaatatgagttttgta

SEQ ID NO: 36152 - DNA, 18 bp, Homo sapiens
cttgaagtcttacagtca

SEQ ID NO: 36153 - DNA, 21 bp, Homo sapiens
gacttgtataaacactgcaca

SEQ ID NO: 36154 - DNA, 18 bp, Homo sapiens
ggtgccaacatgaagcta

SEQ ID NO: 36155 - DNA, 19 bp, Homo sapiens
tggatggtagcatgagctg

SEQ ID NO: 36156 - DNA, 16 bp, Homo sapiens
tggccaggcgtagtgg

SEQ ID NO: 36157 - DNA, 19 bp, Homo sapiens
tttaaaaatactgtcccag

SEQ ID NO: 36158 - DNA, 19 bp, Homo sapiens
aaaaagggcagaaatcacc

SEQ ID NO: 36159 - DNA, 22 bp, Homo sapiens
agcggtttctctgttctgtgat

SEQ ID NO: 36160 - DNA, 21 bp, Homo sapiens
attcttgaaatcaataaatca

SEQ ID NO: 36161 - DNA, 23 bp, Homo sapiens
ccataattccagaaagcaaaagg

SEQ ID NO: 36162 - DNA, 21 bp, Homo sapiens
cctttgatctgttttaacctt

SEQ ID NO: 36163 - DNA, 19 bp, Homo sapiens
gcctcctgtcacctctcag

SEQ ID NO: 36164 - DNA, 19 bp, Homo sapiens
gcttctgtgcctcattttg

SEQ ID NO: 36165 - DNA, 21 bp, Homo sapiens
gtaattgttattattgtcatt

SEQ ID NO: 36166 - DNA, 19 bp, Homo sapiens
tgggtggatcacttgaggc

SEQ ID NO: 36167 - DNA, 17 bp, Homo sapiens
ttttgagacagggtgtc

SEQ ID NO: 36168 - DNA, 17 bp, Homo sapiens
aggcagaaggatcactt

SEQ ID NO: 36169 - DNA, 21 bp, Homo sapiens
ctctctctctctttcatcctc

SEQ ID NO: 36170 - DNA, 17 bp, Homo sapiens
ctttctctctctctctc

SEQ ID NO: 36171 - DNA, 19 bp, Homo sapiens
gaaatggacagcattatca

SEQ ID NO: 36172 - DNA, 23 bp, Homo sapiens
ccatcccaccacctctacctgct

SEQ ID NO: 36173 - DNA, 23 bp, Homo sapiens
gcgtaaaacaggccatcccacca

SEQ ID NO: 36174 - DNA, 21 bp, Homo sapiens
ggcctctgcactgactcattt

SEQ ID NO: 36175 - DNA, 18 bp, Homo sapiens
tgctgttgtaaatactgt

SEQ ID NO: 36176 - DNA, 19 bp, Homo sapiens
aggaagatgtaaggtttac

SEQ ID NO: 36177 - DNA, 23 bp, Homo sapiens
ccagtcgtcagctccttccctca

SEQ ID NO: 36178 - DNA, 17 bp, Homo sapiens
cttcctgaccctccgcc

SEQ ID NO: 36179 - DNA, 22 bp, Homo sapiens
ccatacccccacatccacctcc

SEQ ID NO: 36180 - DNA, 18 bp, Homo sapiens
ctgctgcatgttgtacag

SEQ ID NO: 36181 - DNA, 19 bp, Homo sapiens
gtctccagccccctgccct

SEQ ID NO: 36182 - DNA, 18 bp, Homo sapiens
aggctggaggtcagccac

SEQ ID NO: 36183 - DNA, 18 bp, Homo sapiens
cgcggagtgcgagtggga

SEQ ID NO: 36184 - DNA, 18 bp, Homo sapiens
tgactgccagcgtgcgga

SEQ ID NO: 36185 - DNA, 17 bp, Homo sapiens
caacaacttagactgca

SEQ ID NO: 36186 - DNA, 18 bp, Homo sapiens
cagggtcccaatggcact

SEQ ID NO: 36187 - DNA, 23 bp, Homo sapiens
cggagcagctcagccctgcagtg

SEQ ID NO: 36188 - DNA, 21 bp, Homo sapiens
ctatgaattacagaactgtcc

SEQ ID NO: 36189 - DNA, 20 bp, Homo sapiens
ctgatgagtatccgatcctg

SEQ ID NO: 36190 - DNA, 19 bp, Homo sapiens
ctgcacctggaggatctca

SEQ ID NO: 36191 - DNA, 21 bp, Homo sapiens
ctgggcaaagtcctctgctag

SEQ ID NO: 36192 - DNA, 15 bp, Homo sapiens
gatgtgatgcccctt

SEQ ID NO: 36193 - DNA, 23 bp, Homo sapiens
gccctcgggtgattatttggctc

SEQ ID NO: 36194 - DNA, 20 bp, Homo sapiens
tccgcgctcggagcagctca

SEQ ID NO: 36195 - DNA, 18 bp, Homo sapiens
tgggatcaacagaaactg

SEQ ID NO: 36196 - DNA, 17 bp, Homo sapiens
ttggtggggaccgacat

SEQ ID NO: 36197 - DNA, 22 bp, Homo sapiens
ccaatgcaacccacccaattga

SEQ ID NO: 36198 - DNA, 21 bp, Homo sapiens
gctgcgcgggtgacctgtgaa

SEQ ID NO: 36199 - DNA, 21 bp, Homo sapiens
aaacatttgccaaatccaact

SEQ ID NO: 36200 - DNA, 20 bp, Homo sapiens
aacatttgccaaatccaact

SEQ ID NO: 36201 - DNA, 17 bp, Homo sapiens
gaactttcaaaatctca

SEQ ID NO: 36202 - DNA, 20 bp, Homo sapiens
tggacaaatatatttcattc

SEQ ID NO: 36203 - DNA, 17 bp, Homo sapiens
tgtaaacatttgccaaa

SEQ ID NO: 36204 - DNA, 17 bp, Homo sapiens
aaagttacatttcctga

SEQ ID NO: 36205 - DNA, 22 bp, Homo sapiens
aacaaaaatctattatgtacct

SEQ ID NO: 36206 - DNA, 24 bp, Homo sapiens
aaccagctgagcagcagcagtcta

SEQ ID NO: 36207 - DNA, 22 bp, Homo sapiens
acaactcaaaaaacatttagca

SEQ ID NO: 36208 - DNA, 23 bp, Homo sapiens
caatcttccagagggatggggca

SEQ ID NO: 36209 - DNA, 17 bp, Homo sapiens
ctccatggattcaggga

SEQ ID NO: 36210 - DNA, 20 bp, Homo sapiens
tcacctctggctctttgcca

SEQ ID NO: 36211 - DNA, 19 bp, Homo sapiens
tctgtccacacattatcac

SEQ ID NO: 36212 - DNA, 21 bp, Homo sapiens
atcttggtctccacaaactct

SEQ ID NO: 36213 - DNA, 19 bp, Homo sapiens
attctacctttttctaaca

SEQ ID NO: 36214 - DNA, 24 bp, Homo sapiens
cctaacacaggctgaaactaaaca

SEQ ID NO: 36215 - DNA, 16 bp, Homo sapiens
ggcaggggctttgtca

SEQ ID NO: 36216 - DNA, 24 bp, Homo sapiens
gtccacaccactcaccacacatac

SEQ ID NO: 36217 - DNA, 24 bp, Homo sapiens
tcagtaaaatcttaaatgattttt

SEQ ID NO: 36218 - DNA, 23 bp, Homo sapiens
tccttttctcccctcatttcctc

SEQ ID NO: 36219 - DNA, 22 bp, Homo sapiens
agtgacggtgggatccacaaca

SEQ ID NO: 36220 - DNA, 21 bp, Homo sapiens
gggttatgggtgacctacaca

SEQ ID NO: 36221 - DNA, 16 bp, Homo sapiens
cagctggatgtacaat

SEQ ID NO: 36222 - DNA, 17 bp, Homo sapiens
cccagagccgtgcccag

SEQ ID NO: 36223 - DNA, 15 bp, Homo sapiens
caaatggcaacacca

SEQ ID NO: 36224 - DNA, 23 bp, Homo sapiens
ccattaaaaacacagcaatcatt

SEQ ID NO: 36225 - DNA, 23 bp, Homo sapiens
cttacatagtcttaagcattttt

SEQ ID NO: 36226 - DNA, 20 bp, Homo sapiens
ttgatgactcttacatagtc

SEQ ID NO: 36227 - DNA, 26 bp, Homo sapiens
tttcttcaatctttggtcttagtttt

SEQ ID NO: 36228 - DNA, 19 bp, Homo sapiens
cctgctgagggagacacca

SEQ ID NO: 36229 - DNA, 22 bp, Homo sapiens
ctctgatggcagtgcttgacgg

SEQ ID NO: 36230 - DNA, 20 bp, Homo sapiens
ctgataactgagctaatcca

SEQ ID NO: 36231 - DNA, 18 bp, Homo sapiens
gacaaccccgcctcctct

SEQ ID NO: 36232 - DNA, 22 bp, Homo sapiens
tggtcttaaggcaaaaatttca

SEQ ID NO: 36233 - DNA, 21 bp, Homo sapiens
aaattttaagggagtttcgtt

SEQ ID NO: 36234 - DNA, 19 bp, Homo sapiens
aagatttcacatctttaca

SEQ ID NO: 36235 - DNA, 21 bp, Homo sapiens
acaaaccaattaagtgtactt

SEQ ID NO: 36236 - DNA, 23 bp, Homo sapiens
acaaatgcatctttcttttgtca

SEQ ID NO: 36237 - DNA, 21 bp, Homo sapiens
acattactgtaattttgtgta

SEQ ID NO: 36238 - DNA, 23 bp, Homo sapiens
agtcccggaggaaaaagagccag

SEQ ID NO: 36239 - DNA, 17 bp, Homo sapiens
cccccgtttcagggtca

SEQ ID NO: 36240 - DNA, 15 bp, Homo sapiens
gcaggacaaggctct

SEQ ID NO: 36241 - DNA, 17 bp, Homo sapiens
ggaaacagaaacacatt

SEQ ID NO: 36242 - DNA, 20 bp, Homo sapiens
gggcaccgccccgctccccc

SEQ ID NO: 36243 - DNA, 23 bp, Homo sapiens
tgcccaaggcagagctgttccag

SEQ ID NO: 36244 - DNA, 20 bp, Homo sapiens
tgcccagggtgccctgcccg

SEQ ID NO: 36245 - DNA, 20 bp, Homo sapiens
ccccactgtcccctcacagc

SEQ ID NO: 36246 - DNA, 19 bp, Homo sapiens
cctgagtggtctttttcat

SEQ ID NO: 36247 - DNA, 21 bp, Homo sapiens
gccgcggcggccgccaggctt

SEQ ID NO: 36248 - DNA, 19 bp, Homo sapiens
gtctttttcatctctttcg

SEQ ID NO: 36249 - DNA, 21 bp, Homo sapiens
aaagaatgataaaataggcca

SEQ ID NO: 36250 - DNA, 20 bp, Homo sapiens
agctaggggtggccgtgtca

SEQ ID NO: 36251 - DNA, 22 bp, Homo sapiens
gagccaagatcatgccactgca

SEQ ID NO: 36252 - DNA, 17 bp, Homo sapiens
tcacagccctgctgtct

SEQ ID NO: 36253 - DNA, 18 bp, Homo sapiens
tcacctccgttttgacca

SEQ ID NO: 36254 - DNA, 20 bp, Homo sapiens
tcccaggcccatagctgcaa

SEQ ID NO: 36255 - DNA, 21 bp, Homo sapiens
tgcagtgagcctagatcgtgc

SEQ ID NO: 36256 - DNA, 23 bp, Homo sapiens
tgcgaccatgagagaaaaacctg

SEQ ID NO: 36257 - DNA, 21 bp, Homo sapiens
aagtaactctcagatgtctta

SEQ ID NO: 36258 - DNA, 20 bp, Homo sapiens
aatagacatacactggaaca

SEQ ID NO: 36259 - DNA, 19 bp, Homo sapiens
cgaagctactgcgggttct

SEQ ID NO: 36260 - DNA, 17 bp, Homo sapiens
ggagtttctcaaaatct

SEQ ID NO: 36261 - DNA, 19 bp, Homo sapiens
ggtatctaaacttgcctca

SEQ ID NO: 36262 - DNA, 17 bp, Homo sapiens
tagatagaatttggaaa

SEQ ID NO: 36263 - DNA, 21 bp, Homo sapiens
gcgtccggagtcggtgagctt

SEQ ID NO: 36264 - DNA, 19 bp, Homo sapiens
ttccagaaacagaccccag

SEQ ID NO: 36265 - DNA, 18 bp, Homo sapiens
aatagtaatgaatcaatg

SEQ ID NO: 36266 - DNA, 19 bp, Homo sapiens
ggaaagtaaacagagagga

SEQ ID NO: 36267 - DNA, 15 bp, Homo sapiens
atatgatgtctatga

SEQ ID NO: 36268 - DNA, 20 bp, Homo sapiens
atcttgacacagtagatctt

SEQ ID NO: 36269 - DNA, 19 bp, Homo sapiens
caaatatctcagtgctact

SEQ ID NO: 36270 - DNA, 18 bp, Homo sapiens
gtatttgtggaaccaatt

SEQ ID NO: 36271 - DNA, 19 bp, Homo sapiens
gtgacaggggtacactctc

SEQ ID NO: 36272 - DNA, 19 bp, Homo sapiens
tagttttgaaactcgtgcc

SEQ ID NO: 36273 - DNA, 19 bp, Homo sapiens
tcacctatactctaccaat

SEQ ID NO: 36274 - DNA, 19 bp, Homo sapiens
tgtcttctcaaacacccca

SEQ ID NO: 36275 - DNA, 24 bp, Homo sapiens
ctccatggagaagcaaacatgtga

SEQ ID NO: 36276 - DNA, 20 bp, Homo sapiens
cagtcccagaacaccgccta

SEQ ID NO: 36277 - DNA, 18 bp, Homo sapiens
catttaaaaacaattact

SEQ ID NO: 36278 - DNA, 19 bp, Homo sapiens
ctgacacaccctctggtgc

SEQ ID NO: 36279 - DNA, 22 bp, Homo sapiens
gatattgctgcttggtctctct

SEQ ID NO: 36280 - DNA, 19 bp, Homo sapiens
ggtcgccaatggcaaaaca

SEQ ID NO: 36281 - DNA, 26 bp, Homo sapiens
gtggtcaaaggagagagtctttgtca

SEQ ID NO: 36282 - DNA, 18 bp, Homo sapiens
tccgcctcctgggttcaa

SEQ ID NO: 36283 - DNA, 20 bp, Homo sapiens
aaagtgctgcatggctcgca

SEQ ID NO: 36284 - DNA, 18 bp, Homo sapiens
acagcttcaactgttcga

SEQ ID NO: 36285 - DNA, 18 bp, Homo sapiens
cacccccaccttcgctca

SEQ ID NO: 36286 - DNA, 20 bp, Homo sapiens
ccaccctctaccccaccccc

SEQ ID NO: 36287 - DNA, 18 bp, Homo sapiens
cccaccctccccgcccca

SEQ ID NO: 36288 - DNA, 19 bp, Homo sapiens
tccccgccccagcaactgc

SEQ ID NO: 36289 - DNA, 18 bp, Homo sapiens
aaatgtaataaaatgtat

SEQ ID NO: 36290 - DNA, 19 bp, Homo sapiens
agacacactcacactctca

SEQ ID NO: 36291 - DNA, 20 bp, Homo sapiens
agagtgcagaaacccggtca

SEQ ID NO: 36292 - DNA, 24 bp, Homo sapiens
cagaaaaggaagaggggctgcaga

SEQ ID NO: 36293 - DNA, 21 bp, Homo sapiens
cagaaaccagctgtctgctga

SEQ ID NO: 36294 - DNA, 19 bp, Homo sapiens
cccagcggatgcctattcc

SEQ ID NO: 36295 - DNA, 23 bp, Homo sapiens
ccttcccccttacactcctctcc

SEQ ID NO: 36296 - DNA, 21 bp, Homo sapiens
gaccccgagtccattggccgc

SEQ ID NO: 36297 - DNA, 21 bp, Homo sapiens
tctacagtagcactgtggcca

SEQ ID NO: 36298 - DNA, 18 bp, Homo sapiens
tctgctgggcatcaccct

SEQ ID NO: 36299 - DNA, 18 bp, Homo sapiens
tttctagtctgcacaata

SEQ ID NO: 36300 - DNA, 23 bp, Homo sapiens
caagatcaaagatgtgggttcag

SEQ ID NO: 36301 - DNA, 21 bp, Homo sapiens
catcttaaagaagatcagaca

SEQ ID NO: 36302 - DNA, 17 bp, Homo sapiens
gaaaaagaacaacatca

SEQ ID NO: 36303 - DNA, 23 bp, Homo sapiens
agcttctgatcaacggtcctgaa

SEQ ID NO: 36304 - DNA, 21 bp, Homo sapiens
atgtctcaatggaaacactct

SEQ ID NO: 36305 - DNA, 22 bp, Homo sapiens
aaaatggtgatggcttatggaa

SEQ ID NO: 36306 - DNA, 21 bp, Homo sapiens
atgaaccatttcaccatggca

SEQ ID NO: 36307 - DNA, 15 bp, Homo sapiens
catttcaccatggca

SEQ ID NO: 36308 - DNA, 22 bp, Homo sapiens
gaaaccccaaatgtagtctctt

SEQ ID NO: 36309 - DNA, 23 bp, Homo sapiens
gatactacaaagccaatctttat

SEQ ID NO: 36310 - DNA, 20 bp, Homo sapiens
tccacttcacatgctggaga

SEQ ID NO: 36311 - DNA, 18 bp, Homo sapiens
actagtaggagactgtga

SEQ ID NO: 36312 - DNA, 18 bp, Homo sapiens
cccacttgcacctgccac

SEQ ID NO: 36313 - DNA, 23 bp, Homo sapiens
gctatgataggtattttgtgtta

SEQ ID NO: 36314 - DNA, 17 bp, Homo sapiens
tctgaacaatttcctca

SEQ ID NO: 36315 - DNA, 18 bp, Homo sapiens
tgtatgtgggtgtttctc

SEQ ID NO: 36316 - DNA, 19 bp, Homo sapiens
actggtggcaggctgtggc

SEQ ID NO: 36317 - DNA, 18 bp, Homo sapiens
gcctcagccgcctcactc

SEQ ID NO: 36318 - DNA, 18 bp, Homo sapiens
ggtgcgcggtgacggcta

SEQ ID NO: 36319 - DNA, 21 bp, Homo sapiens
tgtgggcagcgccctgaacaa

SEQ ID NO: 36320 - DNA, 20 bp, Homo sapiens
ctctgttcggagggtcgcgg

SEQ ID NO: 36321 - DNA, 18 bp, Homo sapiens
gaagagcttggaggagcc

SEQ ID NO: 36322 - DNA, 20 bp, Homo sapiens
ccagactgttagaaaatgga

SEQ ID NO: 36323 - DNA, 22 bp, Homo sapiens
acctcgacggtcgccgtggccc

SEQ ID NO: 36324 - DNA, 21 bp, Homo sapiens
cccccgcctccgccgccacta

SEQ ID NO: 36325 - DNA, 20 bp, Homo sapiens
cccgcctccgccgccactat

SEQ ID NO: 36326 - DNA, 19 bp, Homo sapiens
aagtggacacataaaatta

SEQ ID NO: 36327 - DNA, 18 bp, Homo sapiens
acctaatggtgaacccca

SEQ ID NO: 36328 - DNA, 18 bp, Homo sapiens
caccatctgtgttgcaag

SEQ ID NO: 36329 - DNA, 20 bp, Homo sapiens
catcatccgctggtgcttta

SEQ ID NO: 36330 - DNA, 15 bp, Homo sapiens
ccacagcgagcctcc

SEQ ID NO: 36331 - DNA, 18 bp, Homo sapiens
ccagcacccctgcaccca

SEQ ID NO: 36332 - DNA, 17 bp, Homo sapiens
ccagtgatttgatcgga

SEQ ID NO: 36333 - DNA, 18 bp, Homo sapiens
ccctgggtcagtacctca

SEQ ID NO: 36334 - DNA, 22 bp, Homo sapiens
ctctcccttcccgagccatctg

SEQ ID NO: 36335 - DNA, 21 bp, Homo sapiens
ctctgggagcaaagtggcctg

SEQ ID NO: 36336 - DNA, 18 bp, Homo sapiens
gatgggttcattgtggat

SEQ ID NO: 36337 - DNA, 22 bp, Homo sapiens
gccttttggtagtgatgaaata

SEQ ID NO: 36338 - DNA, 19 bp, Homo sapiens
tcattatccacactgcaaa

SEQ ID NO: 36339 - DNA, 19 bp, Homo sapiens
tgagtggacaccagtgaag

SEQ ID NO: 36340 - DNA, 22 bp, Homo sapiens
ttctggtcccggagacttgggg

SEQ ID NO: 36341 - DNA, 16 bp, Homo sapiens
ttcttctgctccatgt

SEQ ID NO: 36342 - DNA, 25 bp, Homo sapiens
gacccaggctcaggaggactgagaa

SEQ ID NO: 36343 - DNA, 22 bp, Homo sapiens
aagtcctctgtgggaaccccac

SEQ ID NO: 36344 - DNA, 22 bp, Homo sapiens
accccgagctgtccctgcctga

SEQ ID NO: 36345 - DNA, 21 bp, Homo sapiens
caccaccccctggccttgcaa

SEQ ID NO: 36346 - DNA, 19 bp, Homo sapiens
ccgccagcacttccacccc

SEQ ID NO: 36347 - DNA, 23 bp, Homo sapiens
gagccctccgggacctcgagcca

SEQ ID NO: 36348 - DNA, 19 bp, Homo sapiens
ttgagcacatcccaaaaga

SEQ ID NO: 36349 - DNA, 21 bp, Homo sapiens
ggttttggcttgtcacagcaa

SEQ ID NO: 36350 - DNA, 22 bp, Homo sapiens
gtcaggagctgccggcggctct

SEQ ID NO: 36351 - DNA, 25 bp, Homo sapiens
tctaccaggacaaggcccagtccca

SEQ ID NO: 36352 - DNA, 20 bp, Homo sapiens
tggccctccatgtgaggttg

SEQ ID NO: 36353 - DNA, 20 bp, Homo sapiens
aacacagcttctaaagtgtg

SEQ ID NO: 36354 - DNA, 18 bp, Homo sapiens
acaggttcatttttttta

SEQ ID NO: 36355 - DNA, 20 bp, Homo sapiens
agtaagaggcccatttctca

SEQ ID NO: 36356 - DNA, 18 bp, Homo sapiens
gggcggggcgcggcgccc

SEQ ID NO: 36357 - DNA, 17 bp, Homo sapiens
ttgatgtaataactgct

SEQ ID NO: 36358 - DNA, 22 bp, Homo sapiens
tttcagtagtagtcttgacttt

SEQ ID NO: 36359 - DNA, 18 bp, Homo sapiens
acttttcttcatgtcttc

SEQ ID NO: 36360 - DNA, 20 bp, Homo sapiens
taatcccataactaccctct

SEQ ID NO: 36361 - DNA, 22 bp, Homo sapiens
tctaatttagtaaagaccctga

SEQ ID NO: 36362 - DNA, 21 bp, Homo sapiens
acacaggagctgcagtgctgt

SEQ ID NO: 36363 - DNA, 19 bp, Homo sapiens
cttcccctactctgcctct

SEQ ID NO: 36364 - DNA, 20 bp, Homo sapiens
gcaaacaggcactgggtttt

SEQ ID NO: 36365 - DNA, 19 bp, Homo sapiens
ttaagtaccacattctcct

SEQ ID NO: 36366 - DNA, 24 bp, Homo sapiens
gtcagagatgtcccctgccatgca

SEQ ID NO: 36367 - DNA, 20 bp, Homo sapiens
tcagtcactccacgctcccc

SEQ ID NO: 36368 - DNA, 19 bp, Homo sapiens
tggggtccctcaggcctgg

SEQ ID NO: 36369 - DNA, 23 bp, Homo sapiens
gaggaaggctagtcaataagcta

SEQ ID NO: 36370 - DNA, 17 bp, Homo sapiens
gccccaccaccacctcc

SEQ ID NO: 36371 - DNA, 22 bp, Homo sapiens
tcccatcagtttgattcaatta

SEQ ID NO: 36372 - DNA, 21 bp, Homo sapiens
tgttattaggaataatcctta

SEQ ID NO: 36373 - DNA, 19 bp, Homo sapiens
cccggaaccccctgcagct

SEQ ID NO: 36374 - DNA, 22 bp, Homo sapiens
ccctgggctctgaacctgtgaa

SEQ ID NO: 36375 - DNA, 20 bp, Homo sapiens
cctgccccacacccacctcc

SEQ ID NO: 36376 - DNA, 22 bp, Homo sapiens
ctgtgaatgacaagaggagcca

SEQ ID NO: 36377 - DNA, 18 bp, Homo sapiens
gactcccccgccccctct

SEQ ID NO: 36378 - DNA, 18 bp, Homo sapiens
gcagtggctgcctgtccc

SEQ ID NO: 36379 - DNA, 22 bp, Homo sapiens
gcccagagtgaccgttgggctc

SEQ ID NO: 36380 - DNA, 21 bp, Homo sapiens
gcggtggcagagggtggtgag

SEQ ID NO: 36381 - DNA, 21 bp, Homo sapiens
gctcctccttcctctgcccct

SEQ ID NO: 36382 - DNA, 19 bp, Homo sapiens
gctctccccacgcccctgc

SEQ ID NO: 36383 - DNA, 19 bp, Homo sapiens
gggctcttgtcccggtgga

SEQ ID NO: 36384 - DNA, 21 bp, Homo sapiens
ttccaaagagcaggactctga

SEQ ID NO: 36385 - DNA, 16 bp, Homo sapiens
agctctgattcccaca

SEQ ID NO: 36386 - DNA, 18 bp, Homo sapiens
catcagcctgcctcagca

SEQ ID NO: 36387 - DNA, 16 bp, Homo sapiens
gaaagagggaaacatc

SEQ ID NO: 36388 - DNA, 23 bp, Homo sapiens
gcgccacggccgctgctgcctcc

SEQ ID NO: 36389 - DNA, 23 bp, Homo sapiens
ggtcaaagtgatgtgtcttttag

SEQ ID NO: 36390 - DNA, 18 bp, Homo sapiens
gtgggaccgtcatcacca

SEQ ID NO: 36391 - DNA, 20 bp, Homo sapiens
tgattactttcatccatcca

SEQ ID NO: 36392 - DNA, 17 bp, Homo sapiens
ctctacttttaaagggt

SEQ ID NO: 36393 - DNA, 17 bp, Homo sapiens
ctgaactatactttgaa

SEQ ID NO: 36394 - DNA, 21 bp, Homo sapiens
tctgctgataccagtgatagg

SEQ ID NO: 36395 - DNA, 25 bp, Homo sapiens
tctgtaaaaatggttgtcttaactt

SEQ ID NO: 36396 - DNA, 21 bp, Homo sapiens
tgccaggagccggcagacctg

SEQ ID NO: 36397 - DNA, 18 bp, Homo sapiens
catgaatcatcttcccca

SEQ ID NO: 36398 - DNA, 15 bp, Homo sapiens
ctcattgttatgatg

SEQ ID NO: 36399 - DNA, 23 bp, Homo sapiens
cttcaccgctgctcaccaccaca

SEQ ID NO: 36400 - DNA, 18 bp, Homo sapiens
aaggcgcttggcttggtt

SEQ ID NO: 36401 - DNA, 19 bp, Homo sapiens
atcttggtctgtacccctc

SEQ ID NO: 36402 - DNA, 24 bp, Homo sapiens
cgtccccgcttcctagctgcccac

SEQ ID NO: 36403 - DNA, 21 bp, Homo sapiens
atcccctcggccctgctgctc

SEQ ID NO: 36404 - DNA, 19 bp, Homo sapiens
ccacggccctggctgcccc

SEQ ID NO: 36405 - DNA, 21 bp, Homo sapiens
ccctgtgctgggggccttgag

SEQ ID NO: 36406 - DNA, 18 bp, Homo sapiens
ctgggcagggaggccaga

SEQ ID NO: 36407 - DNA, 18 bp, Homo sapiens
ttccacagtcctgggctg

SEQ ID NO: 36408 - DNA, 18 bp, Homo sapiens
acagtgctgcggctgctt

SEQ ID NO: 36409 - DNA, 24 bp, Homo sapiens
atgcctatagtccctgcaactctg

SEQ ID NO: 36410 - DNA, 20 bp, Homo sapiens
caaaattgcaccactgcact

SEQ ID NO: 36411 - DNA, 20 bp, Homo sapiens
cagctggtatttggacaaca

SEQ ID NO: 36412 - DNA, 16 bp, Homo sapiens
ccagaggcgccaggca

SEQ ID NO: 36413 - DNA, 20 bp, Homo sapiens
cctccagcacagcttcacca

SEQ ID NO: 36414 - DNA, 18 bp, Homo sapiens
ccttgtcaccatgttgag

SEQ ID NO: 36415 - DNA, 15 bp, Homo sapiens
ctcaggcagctgcag

SEQ ID NO: 36416 - DNA, 16 bp, Homo sapiens
ctccagcacagcttca

SEQ ID NO: 36417 - DNA, 20 bp, Homo sapiens
tggccaccccctccatctct

SEQ ID NO: 36418 - DNA, 18 bp, Homo sapiens
tgggcccaggttcccacc

SEQ ID NO: 36419 - DNA, 17 bp, Homo sapiens
acttccagcagcaccaa

SEQ ID NO: 36420 - DNA, 16 bp, Homo sapiens
aggccgctgtgtgtgg

SEQ ID NO: 36421 - DNA, 20 bp, Homo sapiens
gggcttcgaagccttcatca

SEQ ID NO: 36422 - DNA, 16 bp, Homo sapiens
tgaagattaccagtta

SEQ ID NO: 36423 - DNA, 20 bp, Homo sapiens
ttcacaaacagcctctgtca

SEQ ID NO: 36424 - DNA, 22 bp, Homo sapiens
aaatgcaatatctgggtactgt

SEQ ID NO: 36425 - DNA, 19 bp, Homo sapiens
aaggtggacatcttcacga

SEQ ID NO: 36426 - DNA, 22 bp, Homo sapiens
acctcactgtcatctgccagga

SEQ ID NO: 36427 - DNA, 16 bp, Homo sapiens
agcaacaaatatgtca

SEQ ID NO: 36428 - DNA, 18 bp, Homo sapiens
atgtatttattgcaatgt

SEQ ID NO: 36429 - DNA, 20 bp, Homo sapiens
ctttttgtaagtctttatta

SEQ ID NO: 36430 - DNA, 21 bp, Homo sapiens
gaaaaaggtttttccccttgt

SEQ ID NO: 36431 - DNA, 17 bp, Homo sapiens
gaaatatatactgcttt

SEQ ID NO: 36432 - DNA, 23 bp, Homo sapiens
gagccacggtgccaggaccatct

SEQ ID NO: 36433 - DNA, 19 bp, Homo sapiens
taatacagtcttgtttgtc

SEQ ID NO: 36434 - DNA, 20 bp, Homo sapiens
tactgaacacaataatgctg

SEQ ID NO: 36435 - DNA, 21 bp, Homo sapiens
tcaccaaatgaccttacctgt

SEQ ID NO: 36436 - DNA, 24 bp, Homo sapiens
tcttggtgagagaatgaatggtgt

SEQ ID NO: 36437 - DNA, 21 bp, Homo sapiens
tgatgggatggtgttgatata

SEQ ID NO: 36438 - DNA, 18 bp, Homo sapiens
ttcatctgccactggtta

SEQ ID NO: 36439 - DNA, 21 bp, Homo sapiens
gcgcagcggagcggggcagag

SEQ ID NO: 36440 - DNA, 19 bp, Homo sapiens
tggacccgccgcagagcca

SEQ ID NO: 36441 - DNA, 18 bp, Homo sapiens
ctttccagagtaccccag

SEQ ID NO: 36442 - DNA, 19 bp, Homo sapiens
gccagtggctgcttgttct

SEQ ID NO: 36443 - DNA, 19 bp, Homo sapiens
agacactgagttttcctta

SEQ ID NO: 36444 - DNA, 21 bp, Homo sapiens
caccacccaccaccccaccct

SEQ ID NO: 36445 - DNA, 17 bp, Homo sapiens
cacccaaacctgtctac

SEQ ID NO: 36446 - DNA, 19 bp, Homo sapiens
caccctctccaggcctcaa

SEQ ID NO: 36447 - DNA, 18 bp, Homo sapiens
ccagctggcccagcccct

SEQ ID NO: 36448 - DNA, 23 bp, Homo sapiens
ctcctacccaggcccaccactgg

SEQ ID NO: 36449 - DNA, 24 bp, Homo sapiens
gacccaccctgctctctggcccca

SEQ ID NO: 36450 - DNA, 22 bp, Homo sapiens
gtccttggacccagctggccca

SEQ ID NO: 36451 - DNA, 18 bp, Homo sapiens
ttccagagggcatgccag

SEQ ID NO: 36452 - DNA, 25 bp, Homo sapiens
aaggatcaggtcaacacggacctca

SEQ ID NO: 36453 - DNA, 23 bp, Homo sapiens
caggcatcagattgttttcgtca

SEQ ID NO: 36454 - DNA, 16 bp, Homo sapiens
ctgatccactccacct

SEQ ID NO: 36455 - DNA, 19 bp, Homo sapiens
ctgcaacctccgcctccca

SEQ ID NO: 36456 - DNA, 23 bp, Homo sapiens
gctgggtctcagatgcaacctca

SEQ ID NO: 36457 - DNA, 23 bp, Homo sapiens
gcttgagccactgcgcctggcct

SEQ ID NO: 36458 - DNA, 25 bp, Homo sapiens
tacctaagaaagctcaaggctgcca

SEQ ID NO: 36459 - DNA, 18 bp, Homo sapiens
tcagtggaatatcataca

SEQ ID NO: 36460 - DNA, 18 bp, Homo sapiens
tccgcctcccaggttcaa

SEQ ID NO: 36461 - DNA, 17 bp, Homo sapiens
tgatgcccctgatggca

SEQ ID NO: 36462 - DNA, 19 bp, Homo sapiens
agcatcgagggcgagggga

SEQ ID NO: 36463 - DNA, 18 bp, Homo sapiens
catgtgtacatcatgcga

SEQ ID NO: 36464 - DNA, 18 bp, Homo sapiens
cctccaggaaatcttgag

SEQ ID NO: 36465 - DNA, 24 bp, Homo sapiens
cgtgtgcaaatatgactcaattca

SEQ ID NO: 36466 - DNA, 19 bp, Homo sapiens
ctgaactgtcatcattcct

SEQ ID NO: 36467 - DNA, 18 bp, Homo sapiens
gggagcgccatctgtgtg

SEQ ID NO: 36468 - DNA, 21 bp, Homo sapiens
tccattctgacatctgggctg

SEQ ID NO: 36469 - DNA, 18 bp, Homo sapiens
tgtacccccattctctga

SEQ ID NO: 36470 - DNA, 22 bp, Homo sapiens
tttgtagtcattccaagtggta

SEQ ID NO: 36471 - DNA, 26 bp, Homo sapiens
cgggtaaagaagttaaagtaccacca

SEQ ID NO: 36472 - DNA, 18 bp, Homo sapiens
caccattctcctgcctca

SEQ ID NO: 36473 - DNA, 17 bp, Homo sapiens
cccggggcccccccagc

SEQ ID NO: 36474 - DNA, 19 bp, Homo sapiens
cctgggtcccgcctagcct

SEQ ID NO: 36475 - DNA, 19 bp, Homo sapiens
ctgcaagctccgcctccca

SEQ ID NO: 36476 - DNA, 19 bp, Homo sapiens
cttgatgagctgctgcgag

SEQ ID NO: 36477 - DNA, 22 bp, Homo sapiens
gcctcacggaagggcccggtgg

SEQ ID NO: 36478 - DNA, 22 bp, Homo sapiens
gcgccagggacaccaggaattc

SEQ ID NO: 36479 - DNA, 23 bp, Homo sapiens
gcgtcccaggacgcccgcttcct

SEQ ID NO: 36480 - DNA, 18 bp, Homo sapiens
gctatacgacttcacatc

SEQ ID NO: 36481 - DNA, 18 bp, Homo sapiens
ggcctgaccgccacccct

SEQ ID NO: 36482 - DNA, 22 bp, Homo sapiens
cagagagttaagaggcgcccaa

SEQ ID NO: 36483 - DNA, 15 bp, Homo sapiens
ctctaaatagagcca

SEQ ID NO: 36484 - DNA, 20 bp, Homo sapiens
gcagaggaccgtttcctttt

SEQ ID NO: 36485 - DNA, 24 bp, Homo sapiens
gctgcgggaggggacggcacccca

SEQ ID NO: 36486 - DNA, 23 bp, Homo sapiens
acctgacaaccatgtgtacacca

SEQ ID NO: 36487 - DNA, 22 bp, Homo sapiens
cagacagagccctctagctgct

SEQ ID NO: 36488 - DNA, 15 bp, Homo sapiens
ccatctacaacagca

SEQ ID NO: 36489 - DNA, 19 bp, Homo sapiens
ccgcggctggctgacacct

SEQ ID NO: 36490 - DNA, 21 bp, Homo sapiens
cgggacggtggctctgcagtg

SEQ ID NO: 36491 - DNA, 22 bp, Homo sapiens
agaagtctcatgttgcattttc

SEQ ID NO: 36492 - DNA, 19 bp, Homo sapiens
ggcaggcatggcggcccct

SEQ ID NO: 36493 - DNA, 26 bp, Homo sapiens
tgacatcctggctcctcatcttcttc

SEQ ID NO: 36494 - DNA, 17 bp, Homo sapiens
tttcctaacggcaggca

SEQ ID NO: 36495 - DNA, 23 bp, Homo sapiens
tttgtttttttgatttttgatgt

SEQ ID NO: 36496 - DNA, 21 bp, Homo sapiens
tatgactctcacccatgtcat

SEQ ID NO: 36497 - DNA, 18 bp, Homo sapiens
tgactctcacccatgtca

SEQ ID NO: 36498 - DNA, 21 bp, Homo sapiens
tttgtgaatgatagtttcaca

SEQ ID NO: 36499 - DNA, 21 bp, Homo sapiens
aaaacttttaaaaaatacatt

SEQ ID NO: 36500 - DNA, 18 bp, Homo sapiens
ccttaattacatttaatg

SEQ ID NO: 36501 - DNA, 21 bp, Homo sapiens
tgaagaactttgtttacatca

SEQ ID NO: 36502 - DNA, 21 bp, Homo sapiens
tgattatatttgcctctgata

SEQ ID NO: 36503 - DNA, 23 bp, Homo sapiens
cccagggcctggccctacctcct

SEQ ID NO: 36504 - DNA, 18 bp, Homo sapiens
cctgcaacctccacctcc

SEQ ID NO: 36505 - DNA, 19 bp, Homo sapiens
ctgcaacctccacctccca

SEQ ID NO: 36506 - DNA, 18 bp, Homo sapiens
tccacctcccaggttcaa

SEQ ID NO: 36507 - DNA, 17 bp, Homo sapiens
attacaaatagaagctt

SEQ ID NO: 36508 - DNA, 23 bp, Homo sapiens
cctgtacctctctctgctcctca

SEQ ID NO: 36509 - DNA, 17 bp, Homo sapiens
tgactgggaaggacata

SEQ ID NO: 36510 - DNA, 16 bp, Homo sapiens
cccagccccgcgcagc

SEQ ID NO: 36511 - DNA, 18 bp, Homo sapiens
aaagtaggaatctggcag

SEQ ID NO: 36512 - DNA, 23 bp, Homo sapiens
ggcacatgcctgtaatccgagtg

SEQ ID NO: 36513 - DNA, 21 bp, Homo sapiens
tgatctgtaccaggtcaccca

SEQ ID NO: 36514 - DNA, 20 bp, Homo sapiens
aaaaaggaaaatggtttccc

SEQ ID NO: 36515 - DNA, 21 bp, Homo sapiens
ttcagagcttgaagcatccaa

SEQ ID NO: 36516 - DNA, 23 bp, Homo sapiens
aaaaaaaaatttgctgggtgtca

SEQ ID NO: 36517 - DNA, 24 bp, Homo sapiens
agtgaatgggactcaaatgttgtg

SEQ ID NO: 36518 - DNA, 17 bp, Homo sapiens
ccacctccctcaccctc

SEQ ID NO: 36519 - DNA, 20 bp, Homo sapiens
cccccggagccgccgcgcca

SEQ ID NO: 36520 - DNA, 19 bp, Homo sapiens
cctcctgcccggggctgtt

SEQ ID NO: 36521 - DNA, 19 bp, Homo sapiens
ggcggacggcggcgacggc

SEQ ID NO: 36522 - DNA, 19 bp, Homo sapiens
tctgacacaatatccctca

SEQ ID NO: 36523 - DNA, 22 bp, Homo sapiens
tcttcttcacttgaactttgta

SEQ ID NO: 36524 - DNA, 22 bp, Homo sapiens
acttccaaaaccagccaccgct

SEQ ID NO: 36525 - DNA, 18 bp, Homo sapiens
ccacacacacacacacaa

SEQ ID NO: 36526 - DNA, 30 bp, Homo sapiens
atggatggagactttccaaatatggaacta

SEQ ID NO: 36527 - DNA, 21 bp, Homo sapiens
cacccagcagcagaccaacca

SEQ ID NO: 36528 - DNA, 21 bp, Homo sapiens
cctgtatacccagattacttt

SEQ ID NO: 36529 - DNA, 19 bp, Homo sapiens
gcccttcatggctctgcac

SEQ ID NO: 36530 - DNA, 18 bp, Homo sapiens
tatgtttgaccaaggcac

SEQ ID NO: 36531 - DNA, 25 bp, Homo sapiens
tctggtgtggttggaggtctgtgga

SEQ ID NO: 36532 - DNA, 17 bp, Homo sapiens
actgcagaattactatt

SEQ ID NO: 36533 - DNA, 21 bp, Homo sapiens
agttgtagtcatttttttccc

SEQ ID NO: 36534 - DNA, 21 bp, Homo sapiens
cagcatctaactaaatcctca

SEQ ID NO: 36535 - DNA, 20 bp, Homo sapiens
ggggctgtctggctcggtta

SEQ ID NO: 36536 - DNA, 21 bp, Homo sapiens
ttctgctgggcacggtggctc

SEQ ID NO: 36537 - DNA, 18 bp, Homo sapiens
caagaacacaaggagcat

SEQ ID NO: 36538 - DNA, 17 bp, Homo sapiens
cagttggatttatgata

SEQ ID NO: 36539 - DNA, 20 bp, Homo sapiens
gtcatgaaaaccagaacagt

SEQ ID NO: 36540 - DNA, 19 bp, Homo sapiens
tttctttaatatgtgacca

SEQ ID NO: 36541 - DNA, 17 bp, Homo sapiens
ctgtcactgacatcaca

SEQ ID NO: 36542 - DNA, 18 bp, Homo sapiens
ggagctctgcaagtctca

SEQ ID NO: 36543 - DNA, 18 bp, Homo sapiens
tccaagaatctgcactga

SEQ ID NO: 36544 - DNA, 16 bp, Homo sapiens
tcttgccccagattct

SEQ ID NO: 36545 - DNA, 20 bp, Homo sapiens
ccacctccacctccacctcc

SEQ ID NO: 36546 - DNA, 20 bp, Homo sapiens
ccgattccacctccacctcc

SEQ ID NO: 36547 - DNA, 17 bp, Homo sapiens
cctgccccgcccacttt

SEQ ID NO: 36548 - DNA, 18 bp, Homo sapiens
ggccagacaacctcaggg

SEQ ID NO: 36549 - DNA, 27 bp, Homo sapiens
tcccagagcgccccgagggggcagcga

SEQ ID NO: 36550 - DNA, 19 bp, Homo sapiens
tgcccaaggccaacctcct

SEQ ID NO: 36551 - DNA, 16 bp, Homo sapiens
aggtgaagaatcctcc

SEQ ID NO: 36552 - DNA, 22 bp, Homo sapiens
caaacaggatgcaactgcagtg

SEQ ID NO: 36553 - DNA, 23 bp, Homo sapiens
cctgccctcacctgtgggcaaca

SEQ ID NO: 36554 - DNA, 23 bp, Homo sapiens
tacattcaaaagctcaaaggcta

SEQ ID NO: 36555 - DNA, 18 bp, Homo sapiens
ttccttggatgtgtagtt

SEQ ID NO: 36556 - DNA, 18 bp, Homo sapiens
cccactgccactccgaca

SEQ ID NO: 36557 - DNA, 18 bp, Homo sapiens
cagaattcattctgctcc

SEQ ID NO: 36558 - DNA, 19 bp, Homo sapiens
gcctgctctggaccaggga

SEQ ID NO: 36559 - DNA, 22 bp, Homo sapiens
acctgggagcgctgcttggctc

SEQ ID NO: 36560 - DNA, 18 bp, Homo sapiens
cactctatctgccattca

SEQ ID NO: 36561 - DNA, 22 bp, Homo sapiens
gtagcttcagtatgtttcctca

SEQ ID NO: 36562 - DNA, 22 bp, Homo sapiens
tttggctggcagaaattatcta

SEQ ID NO: 36563 - DNA, 19 bp, Homo sapiens
aaggtcactagccttgcca

SEQ ID NO: 36564 - DNA, 18 bp, Homo sapiens
acaaaagttatcaaagag

SEQ ID NO: 36565 - DNA, 18 bp, Homo sapiens
ccccccccgctctttcca

SEQ ID NO: 36566 - DNA, 18 bp, Homo sapiens
cctccgcccggcagccgc

SEQ ID NO: 36567 - DNA, 23 bp, Homo sapiens
cctctccgcccagcagccacctc

SEQ ID NO: 36568 - DNA, 19 bp, Homo sapiens
cgctacaacctccacctcc

SEQ ID NO: 36569 - DNA, 18 bp, Homo sapiens
ctgcctggcaactgcccc

SEQ ID NO: 36570 - DNA, 18 bp, Homo sapiens
ctttctctctccttagtg

SEQ ID NO: 36571 - DNA, 17 bp, Homo sapiens
gattgccctttacagtt

SEQ ID NO: 36572 - DNA, 18 bp, Homo sapiens
tgcccggccgccatccca

SEQ ID NO: 36573 - DNA, 23 bp, Homo sapiens
tggtacctgagttatacccctgg

SEQ ID NO: 36574 - DNA, 26 bp, Homo sapiens
ccttttcactcccattccttagcttt

SEQ ID NO: 36575 - DNA, 21 bp, Homo sapiens
tgaggtttcaataaacagttt

SEQ ID NO: 36576 - DNA, 17 bp, Homo sapiens
acagggagaggcgaccc

SEQ ID NO: 36577 - DNA, 20 bp, Homo sapiens
gaccctgccgccttcttcgt

SEQ ID NO: 36578 - DNA, 21 bp, Homo sapiens
taggattgtgtttcttagtca

SEQ ID NO: 36579 - DNA, 21 bp, Homo sapiens
tcctgaacttcctgtaccaca

SEQ ID NO: 36580 - DNA, 20 bp, Homo sapiens
tctgagcagttttctgaatt

SEQ ID NO: 36581 - DNA, 23 bp, Homo sapiens
tgcaattttaaaacctgtgctgc

SEQ ID NO: 36582 - DNA, 23 bp, Homo sapiens
tgcaattttaaaacctgtgctgc

SEQ ID NO: 36583 - DNA, 18 bp, Homo sapiens
tgccctcaaatgcaccca

SEQ ID NO: 36584 - DNA, 19 bp, Homo sapiens
agtcttactcagctatcca

SEQ ID NO: 36585 - DNA, 22 bp, Homo sapiens
cgagattcaaatctccgattcc

SEQ ID NO: 36586 - DNA, 18 bp, Homo sapiens
taatgaaactgtgtgtac

SEQ ID NO: 36587 - DNA, 17 bp, Homo sapiens
tgcattccaagcttttt

SEQ ID NO: 36588 - DNA, 19 bp, Homo sapiens
tagagaaacacagattctt

SEQ ID NO: 36589 - DNA, 20 bp, Homo sapiens
tctgaagacaatggacccac

SEQ ID NO: 36590 - DNA, 16 bp, Homo sapiens
catgagggtgtggtca

SEQ ID NO: 36591 - DNA, 22 bp, Homo sapiens
ccaattaaaaggtggcccaaca

SEQ ID NO: 36592 - DNA, 23 bp, Homo sapiens
cccggctgtggcgcttctgtgga

SEQ ID NO: 36593 - DNA, 18 bp, Homo sapiens
cttccagaagcaacccag

SEQ ID NO: 36594 - DNA, 17 bp, Homo sapiens
tcattgaattctggtga

SEQ ID NO: 36595 - DNA, 17 bp, Homo sapiens
ttggttgtactatgaaa

SEQ ID NO: 36596 - DNA, 16 bp, Homo sapiens
tcaaacagatgttgta

SEQ ID NO: 36597 - DNA, 18 bp, Homo sapiens
tgctgaggtgactgttga

SEQ ID NO: 36598 - DNA, 20 bp, Homo sapiens
cagcaggactgtacgaggaa

SEQ ID NO: 36599 - DNA, 18 bp, Homo sapiens
gaagtgtggtgaaggtgg

SEQ ID NO: 36600 - DNA, 20 bp, Homo sapiens
gcagtttcaggggaggtgtc

SEQ ID NO: 36601 - DNA, 25 bp, Homo sapiens
aaaggccaatgtcttctagctgctt

SEQ ID NO: 36602 - DNA, 22 bp, Homo sapiens
cccactgccacatacctctgtt

SEQ ID NO: 36603 - DNA, 22 bp, Homo sapiens
gacggggtttcaccatgctggc

SEQ ID NO: 36604 - DNA, 19 bp, Homo sapiens
gcaatgcacagccacttcc

SEQ ID NO: 36605 - DNA, 19 bp, Homo sapiens
ggaaatcaaccaggaccaa

SEQ ID NO: 36606 - DNA, 19 bp, Homo sapiens
tgtgtatgagttttgtctg

SEQ ID NO: 36607 - DNA, 27 bp, Homo sapiens
atgtcacttcagaaacttcctgcccta

SEQ ID NO: 36608 - DNA, 20 bp, Homo sapiens
tcccaaacgtgttccaacaa

SEQ ID NO: 36609 - DNA, 18 bp, Homo sapiens
tgcagctgcacctaagca

SEQ ID NO: 36610 - DNA, 16 bp, Homo sapiens
tcaaacagatgttgta

SEQ ID NO: 36611 - DNA, 18 bp, Homo sapiens
tgctgaggtgactgttga

SEQ ID NO: 36612 - DNA, 16 bp, Homo sapiens
ctgctttggaggctgc

SEQ ID NO: 36613 - DNA, 23 bp, Homo sapiens
gaagccatcctgcagctctgaga

SEQ ID NO: 36614 - DNA, 18 bp, Homo sapiens
atttcaggggtctaccgg

SEQ ID NO: 36615 - DNA, 18 bp, Homo sapiens
agtcaaggtcaaggtcag

SEQ ID NO: 36616 - DNA, 20 bp, Homo sapiens
ttcaagaccagcctgaccaa

SEQ ID NO: 36617 - DNA, 21 bp, Homo sapiens
tcaggtataataatcattgtt

SEQ ID NO: 36618 - DNA, 23 bp, Homo sapiens
taaacctatgaaaaatccttgct

SEQ ID NO: 36619 - DNA, 20 bp, Homo sapiens
ttttggaagtaatcataact

SEQ ID NO: 36620 - DNA, 23 bp, Homo sapiens
gtcactgccaacttggtgactca

SEQ ID NO: 36621 - DNA, 21 bp, Homo sapiens
gcctgctgaggggaggggagc

SEQ ID NO: 36622 - DNA, 26 bp, Homo sapiens
ctccaatcttggtccgtatttccaaa

SEQ ID NO: 36623 - DNA, 16 bp, Homo sapiens
tcttggtccgtatttc

SEQ ID NO: 36624 - DNA, 24 bp, Homo sapiens
tgagtgggctgagcatgtagacta

SEQ ID NO: 36625 - DNA, 22 bp, Homo sapiens
atgtgaatatagaaatatttca

SEQ ID NO: 36626 - DNA, 19 bp, Homo sapiens
ccagtcatgttatttcttt

SEQ ID NO: 36627 - DNA, 21 bp, Homo sapiens
cacttgtgcccccagctcagc

SEQ ID NO: 36628 - DNA, 18 bp, Homo sapiens
cctggtgacggggctggc

SEQ ID NO: 36629 - DNA, 16 bp, Homo sapiens
gcgcctagggctgcgg

SEQ ID NO: 36630 - DNA, 23 bp, Homo sapiens
aaaaattacacaaaactagaata

SEQ ID NO: 36631 - DNA, 21 bp, Homo sapiens
atctgtgtgtgcgtgtttgtg

SEQ ID NO: 36632 - DNA, 20 bp, Homo sapiens
atgcataagctatatacttc

SEQ ID NO: 36633 - DNA, 20 bp, Homo sapiens
atgttacttgctatcattcc

SEQ ID NO: 36634 - DNA, 20 bp, Homo sapiens
attaaaggtatcacaaaata

SEQ ID NO: 36635 - DNA, 18 bp, Homo sapiens
caacatccagatctgaca

SEQ ID NO: 36636 - DNA, 18 bp, Homo sapiens
ccactggaaattattttg

SEQ ID NO: 36637 - DNA, 22 bp, Homo sapiens
ctatctctgggctacagtatta

SEQ ID NO: 36638 - DNA, 21 bp, Homo sapiens
cttctttggcattcttgacct

SEQ ID NO: 36639 - DNA, 20 bp, Homo sapiens
gacacagtgacctctgtgga

SEQ ID NO: 36640 - DNA, 18 bp, Homo sapiens
gacctcagaactatctct

SEQ ID NO: 36641 - DNA, 19 bp, Homo sapiens
taactgatgtaaccattga

SEQ ID NO: 36642 - DNA, 26 bp, Homo sapiens
tatctatgcagtttatataaactaca

SEQ ID NO: 36643 - DNA, 17 bp, Homo sapiens
tatgtattctgacctca

SEQ ID NO: 36644 - DNA, 20 bp, Homo sapiens
tcaaacagtgccaacactca

SEQ ID NO: 36645 - DNA, 22 bp, Homo sapiens
tcactcatgttgtggcttattt

SEQ ID NO: 36646 - DNA, 20 bp, Homo sapiens
tgttagctactttgagaacc

SEQ ID NO: 36647 - DNA, 18 bp, Homo sapiens
ccaaatacctatgtaata

SEQ ID NO: 36648 - DNA, 27 bp, Homo sapiens
ccatgaggataaatatctaacactttt

SEQ ID NO: 36649 - DNA, 22 bp, Homo sapiens
tctctttcattgttactttgta

SEQ ID NO: 36650 - DNA, 19 bp, Homo sapiens
cttggagctgtcttaatct

SEQ ID NO: 36651 - DNA, 24 bp, Homo sapiens
gtgggtggggggagcttggagctg

SEQ ID NO: 36652 - DNA, 20 bp, Homo sapiens
tcctagctggttccagcaaa

SEQ ID NO: 36653 - DNA, 21 bp, Homo sapiens
ggccgggcgcgcgccatcctg

SEQ ID NO: 36654 - DNA, 18 bp, Homo sapiens
ggcggcggcggccgcggc

SEQ ID NO: 36655 - DNA, 18 bp, Homo sapiens
gaacccacactgcagtgg

SEQ ID NO: 36656 - DNA, 20 bp, Homo sapiens
gccggtgctaccaggagtca

SEQ ID NO: 36657 - DNA, 18 bp, Homo sapiens
tcagcagtatatacatca

SEQ ID NO: 36658 - DNA, 22 bp, Homo sapiens
tgtgggggtggtggggtacagg

SEQ ID NO: 36659 - DNA, 17 bp, Homo sapiens
caaacctttagctcact

SEQ ID NO: 36660 - DNA, 21 bp, Homo sapiens
tttgcctacatggtgtattta

SEQ ID NO: 36661 - DNA, 22 bp, Homo sapiens
cacgtcctgctccccctggtga

SEQ ID NO: 36662 - DNA, 22 bp, Homo sapiens
agttttcactttactacagtga

SEQ ID NO: 36663 - DNA, 23 bp, Homo sapiens
atgttggtttgatactgttaaca

SEQ ID NO: 36664 - DNA, 22 bp, Homo sapiens
cttctgagtactcaatcaatca

SEQ ID NO: 36665 - DNA, 22 bp, Homo sapiens
gggaccgcggggcagccagggc

SEQ ID NO: 36666 - DNA, 19 bp, Homo sapiens
tgatactgttaacacacca

SEQ ID NO: 36667 - DNA, 21 bp, Homo sapiens
atcttacttacccagaactct

SEQ ID NO: 36668 - DNA, 15 bp, Homo sapiens
cctgaactcagcaga

SEQ ID NO: 36669 - DNA, 18 bp, Homo sapiens
acacttcctagataacgg

SEQ ID NO: 36670 - DNA, 17 bp, Homo sapiens
gcgattcacctgcctca

SEQ ID NO: 36671 - DNA, 20 bp, Homo sapiens
tggccaggctggtcttgaac

SEQ ID NO: 36672 - DNA, 19 bp, Homo sapiens
taccgttgaatttaccgtt

SEQ ID NO: 36673 - DNA, 18 bp, Homo sapiens
ggaatttggtatggaatt

SEQ ID NO: 36674 - DNA, 25 bp, Homo sapiens
acttgagcaatttctgtcttggcct

SEQ ID NO: 36675 - DNA, 18 bp, Homo sapiens
ccggcatttctccgcctc

SEQ ID NO: 36676 - DNA, 22 bp, Homo sapiens
ctcaaaaaagttcacttgcaca

SEQ ID NO: 36677 - DNA, 20 bp, Homo sapiens
cttagtggacagactccaca

SEQ ID NO: 36678 - DNA, 18 bp, Homo sapiens
gaaattcctgtccatcca

SEQ ID NO: 36679 - DNA, 16 bp, Homo sapiens
gaagacaacatctaca

SEQ ID NO: 36680 - DNA, 16 bp, Homo sapiens
tttgatttccaataca

SEQ ID NO: 36681 - DNA, 27 bp, Homo sapiens
gacgtgtcgcgaaatgcacacgaagtc

SEQ ID NO: 36682 - DNA, 22 bp, Homo sapiens
acctgagttctaggcctggctc

SEQ ID NO: 36683 - DNA, 18 bp, Homo sapiens
agagaggtatgggacctg

SEQ ID NO: 36684 - DNA, 17 bp, Homo sapiens
caggaacgccccgccgc

SEQ ID NO: 36685 - DNA, 19 bp, Homo sapiens
acatctttattcccttctt

SEQ ID NO: 36686 - DNA, 18 bp, Homo sapiens
agtcagtgacagacctca

SEQ ID NO: 36687 - DNA, 17 bp, Homo sapiens
atctcctaatgatgatg

SEQ ID NO: 36688 - DNA, 21 bp, Homo sapiens
catgtatttgtgtgacaggga

SEQ ID NO: 36689 - DNA, 21 bp, Homo sapiens
ccctcttctgcttctcagtga

SEQ ID NO: 36690 - DNA, 19 bp, Homo sapiens
gggatagaatggcggcctg

SEQ ID NO: 36691 - DNA, 21 bp, Homo sapiens
tgaagggacattctgccatga

SEQ ID NO: 36692 - DNA, 21 bp, Homo sapiens
tttgctaagcaatgcatgact

SEQ ID NO: 36693 - DNA, 19 bp, Homo sapiens
gttttggccaggcagtcaa

SEQ ID NO: 36694 - DNA, 22 bp, Homo sapiens
acggcgagaacccggccctgct

SEQ ID NO: 36695 - DNA, 20 bp, Homo sapiens
gaccccgatggcggcgccgg

SEQ ID NO: 36696 - DNA, 15 bp, Homo sapiens
acatgtaacatcaca

SEQ ID NO: 36697 - DNA, 23 bp, Homo sapiens
aggatcatttaatgactgtttta

SEQ ID NO: 36698 - DNA, 19 bp, Homo sapiens
atgtcactgagtgaatgat

SEQ ID NO: 36699 - DNA, 17 bp, Homo sapiens
catatcttcttcaccct

SEQ ID NO: 36700 - DNA, 22 bp, Homo sapiens
taaagttctccagatggagcta

SEQ ID NO: 36701 - DNA, 20 bp, Homo sapiens
tgactgttttctcatgtgcc

SEQ ID NO: 36702 - DNA, 18 bp, Homo sapiens
atcaaggaacaactatca

SEQ ID NO: 36703 - DNA, 20 bp, Homo sapiens
cagcaaaataagaaaaaata

SEQ ID NO: 36704 - DNA, 21 bp, Homo sapiens
ccaacaagatgtgccagttga

SEQ ID NO: 36705 - DNA, 21 bp, Homo sapiens
ccctttttccttacagtaaca

SEQ ID NO: 36706 - DNA, 20 bp, Homo sapiens
ctgactgtactatccactga

SEQ ID NO: 36707 - DNA, 19 bp, Homo sapiens
gctacaactgagcaaaata

SEQ ID NO: 36708 - DNA, 22 bp, Homo sapiens
gtagcatgggttcacttggcta

SEQ ID NO: 36709 - DNA, 22 bp, Homo sapiens
tcacttggctacaactgagcaa

SEQ ID NO: 36710 - DNA, 26 bp, Homo sapiens
actttcagaaagaataaactttctca

SEQ ID NO: 36711 - DNA, 19 bp, Homo sapiens
taatacagtgggtcaaata

SEQ ID NO: 36712 - DNA, 17 bp, Homo sapiens
tttctatattgaaatat

SEQ ID NO: 36713 - DNA, 21 bp, Homo sapiens
agcctggctacttttgcctca

SEQ ID NO: 36714 - DNA, 20 bp, Homo sapiens
cagctgaccttttcattata

SEQ ID NO: 36715 - DNA, 22 bp, Homo sapiens
tggccagaaacatacagagggg

SEQ ID NO: 36716 - DNA, 21 bp, Homo sapiens
accggagtcacagttcccgca

SEQ ID NO: 36717 - DNA, 19 bp, Homo sapiens
cttctactgctctgatttt

SEQ ID NO: 36718 - DNA, 18 bp, Homo sapiens
gttgaaagaattatgaaa

SEQ ID NO: 36719 - DNA, 22 bp, Homo sapiens
tttggagaggcagatgacatta

SEQ ID NO: 36720 - DNA, 22 bp, Homo sapiens
ccttccccagggctccttctca

SEQ ID NO: 36721 - DNA, 21 bp, Homo sapiens
ctgcaccaggcgtcctgggga

SEQ ID NO: 36722 - DNA, 17 bp, Homo sapiens
gtgaagacgacactggg

SEQ ID NO: 36723 - DNA, 17 bp, Homo sapiens
ctaagtgacagctgtta

SEQ ID NO: 36724 - DNA, 22 bp, Homo sapiens
ttaaaaatgaacggtgatttgg

SEQ ID NO: 36725 - DNA, 21 bp, Homo sapiens
aaacccaaacaaaacaaaaca

SEQ ID NO: 36726 - DNA, 18 bp, Homo sapiens
acaggcgccaccaccttg

SEQ ID NO: 36727 - DNA, 20 bp, Homo sapiens
agtctcactctgtcgcccag

SEQ ID NO: 36728 - DNA, 21 bp, Homo sapiens
atcttggcttactgcaacctc

SEQ ID NO: 36729 - DNA, 18 bp, Homo sapiens
cgcaagctccgcttccca

SEQ ID NO: 36730 - DNA, 19 bp, Homo sapiens
ctgcaacctccacctccca

SEQ ID NO: 36731 - DNA, 18 bp, Homo sapiens
tccacctcccaggttcaa

SEQ ID NO: 36732 - DNA, 20 bp, Homo sapiens
tggccaggctggtcttgaac

SEQ ID NO: 36733 - DNA, 29 bp, Homo sapiens
gcagacgcacaaaactttaccatgttaga

SEQ ID NO: 36734 - DNA, 18 bp, Homo sapiens
accttaatattgaaacta

SEQ ID NO: 36735 - DNA, 18 bp, Homo sapiens
tctggtgaagtttgtgaa

SEQ ID NO: 36736 - DNA, 16 bp, Homo sapiens
ccaacaagatgagaca

SEQ ID NO: 36737 - DNA, 20 bp, Homo sapiens
tgggtaaacttattacctta

SEQ ID NO: 36738 - DNA, 18 bp, Homo sapiens
ccaccaccagtctctgaa

SEQ ID NO: 36739 - DNA, 22 bp, Homo sapiens
ctggtgattaacaaagacctcg

SEQ ID NO: 36740 - DNA, 22 bp, Homo sapiens
caaacaggcagggagccacagt

SEQ ID NO: 36741 - DNA, 21 bp, Homo sapiens
gaaactgacacagggagctca

SEQ ID NO: 36742 - DNA, 17 bp, Homo sapiens
ttccttccctgcctttt

SEQ ID NO: 36743 - DNA, 19 bp, Homo sapiens
tgtgcccctcctggactcg

SEQ ID NO: 36744 - DNA, 19 bp, Homo sapiens
caacgtccagggtggcaga

SEQ ID NO: 36745 - DNA, 23 bp, Homo sapiens
ctttggtgaaccccacatgcgag

SEQ ID NO: 36746 - DNA, 18 bp, Homo sapiens
ggctggccatgtctagca

SEQ ID NO: 36747 - DNA, 17 bp, Homo sapiens
gtccagggtggcagata

SEQ ID NO: 36748 - DNA, 17 bp, Homo sapiens
tgcgaggcggctggcca

SEQ ID NO: 36749 - DNA, 20 bp, Homo sapiens
ccagcggcggcggaccctca

SEQ ID NO: 36750 - DNA, 22 bp, Homo sapiens
ccctccctttaacccccttcca

SEQ ID NO: 36751 - DNA, 18 bp, Homo sapiens
gagcctcagtttccctca

SEQ ID NO: 36752 - DNA, 22 bp, Homo sapiens
gtctgggctctggctggaacta

SEQ ID NO: 36753 - DNA, 20 bp, Homo sapiens
gcctgacttgtgtaaccact

SEQ ID NO: 36754 - DNA, 19 bp, Homo sapiens
gtcttccctccatgcacac

SEQ ID NO: 36755 - DNA, 19 bp, Homo sapiens
aaggaccagcaactcatgg

SEQ ID NO: 36756 - DNA, 22 bp, Homo sapiens
aatgggagcagtccatggtgca

SEQ ID NO: 36757 - DNA, 17 bp, Homo sapiens
catcgcccagtacacca

SEQ ID NO: 36758 - DNA, 19 bp, Homo sapiens
gattacataaatgcctggc

SEQ ID NO: 36759 - DNA, 20 bp, Homo sapiens
gggtagcaacaagtacatca

SEQ ID NO: 36760 - DNA, 17 bp, Homo sapiens
tcccgacacctgctcac

SEQ ID NO: 36761 - DNA, 19 bp, Homo sapiens
gcgattccctcctctactc

SEQ ID NO: 36762 - DNA, 21 bp, Homo sapiens
agggttcctgatggcttttta

SEQ ID NO: 36763 - DNA, 19 bp, Homo sapiens
caacaaaaaagaacaagag

SEQ ID NO: 36764 - DNA, 23 bp, Homo sapiens
gtctcctggggcagagtatgcca

SEQ ID NO: 36765 - DNA, 22 bp, Homo sapiens
acccagagaagcacagaccccg

SEQ ID NO: 36766 - DNA, 19 bp, Homo sapiens
ccagcccccacacccgtcc

SEQ ID NO: 36767 - DNA, 19 bp, Homo sapiens
cccggcctgcgcgcctgca

SEQ ID NO: 36768 - DNA, 22 bp, Homo sapiens
cctccaacctccgcttccacca

SEQ ID NO: 36769 - DNA, 21 bp, Homo sapiens
gccccctggcctgtgcaagcc

SEQ ID NO: 36770 - DNA, 18 bp, Homo sapiens
acctaggaggagatgcca

SEQ ID NO: 36771 - DNA, 23 bp, Homo sapiens
caccaccatcatcaccaccacca

SEQ ID NO: 36772 - DNA, 23 bp, Homo sapiens
catcatcaccaccaccatcacca

SEQ ID NO: 36773 - DNA, 20 bp, Homo sapiens
ctccagggcccagcatggca

SEQ ID NO: 36774 - DNA, 25 bp, Homo sapiens
gacttgcaccacagtccagcagcaa

SEQ ID NO: 36775 - DNA, 22 bp, Homo sapiens
ggcgtggaaatcaaggtccaga

SEQ ID NO: 36776 - DNA, 20 bp, Homo sapiens
tccagcttatggagatgtga

SEQ ID NO: 36777 - DNA, 19 bp, Homo sapiens
ggctcgggtgttgtagcaa

SEQ ID NO: 36778 - DNA, 24 bp, Homo sapiens
tgagtgggggcgagcacggggctg

SEQ ID NO: 36779 - DNA, 19 bp, Homo sapiens
acctcccatccatgcacac

SEQ ID NO: 36780 - DNA, 21 bp, Homo sapiens
agcacgatctgcagctttgaa

SEQ ID NO: 36781 - DNA, 18 bp, Homo sapiens
aggctgaggccccgggag

SEQ ID NO: 36782 - DNA, 21 bp, Homo sapiens
cacctgtgcccccaggctcaa

SEQ ID NO: 36783 - DNA, 20 bp, Homo sapiens
ccagcctccacccccactcc

SEQ ID NO: 36784 - DNA, 18 bp, Homo sapiens
ccccaagccaggacccca

SEQ ID NO: 36785 - DNA, 19 bp, Homo sapiens
tgcgggggtggggtggggg

SEQ ID NO: 36786 - DNA, 19 bp, Homo sapiens
acccctgagggcctggaga

SEQ ID NO: 36787 - DNA, 16 bp, Homo sapiens
gcgacctcacattcta

SEQ ID NO: 36788 - DNA, 18 bp, Homo sapiens
cctaagcaatcctcccac

SEQ ID NO: 36789 - DNA, 24 bp, Homo sapiens
cttgagtttttttgggtttttttt

SEQ ID NO: 36790 - DNA, 24 bp, Homo sapiens
catgcggaagatggcggcgtccaa

SEQ ID NO: 36791 - DNA, 18 bp, Homo sapiens
gcagttacctaccagtta

SEQ ID NO: 36792 - DNA, 19 bp, Homo sapiens
gggaagcggcggcggcggc

SEQ ID NO: 36793 - DNA, 20 bp, Homo sapiens
gggggcggcagggggctagc

SEQ ID NO: 36794 - DNA, 20 bp, Homo sapiens
tttaagaatttgccatcagt

SEQ ID NO: 36795 - DNA, 18 bp, Homo sapiens
aaaaacaaaacaaacaaa

SEQ ID NO: 36796 - DNA, 20 bp, Homo sapiens
accagggcggcacgctggcc

SEQ ID NO: 36797 - DNA, 20 bp, Homo sapiens
atctgtgacaaaatatttcg

SEQ ID NO: 36798 - DNA, 19 bp, Homo sapiens
ccttgagcaaaactgcaca

SEQ ID NO: 36799 - DNA, 20 bp, Homo sapiens
cgccaactcctccaagccac

SEQ ID NO: 36800 - DNA, 17 bp, Homo sapiens
gggcggcacgctggccg

SEQ ID NO: 36801 - DNA, 21 bp, Homo sapiens
catgagctggggatttgggga

SEQ ID NO: 36802 - DNA, 23 bp, Homo sapiens
tgagagtccctggggtccagtca

SEQ ID NO: 36803 - DNA, 23 bp, Homo sapiens
ggcaagaaagactacaccttcca

SEQ ID NO: 36804 - DNA, 20 bp, Homo sapiens
cagtgccttgccaggatccc

SEQ ID NO: 36805 - DNA, 21 bp, Homo sapiens
atctacacagaagccattgtg

SEQ ID NO: 36806 - DNA, 23 bp, Homo sapiens
caaccccagttttgtccgctgca

SEQ ID NO: 36807 - DNA, 20 bp, Homo sapiens
caggatcgtgaggaccagtc

SEQ ID NO: 36808 - DNA, 22 bp, Homo sapiens
catcctcttccaggagttccgg

SEQ ID NO: 36809 - DNA, 18 bp, Homo sapiens
cattctctgcactggaga

SEQ ID NO: 36810 - DNA, 21 bp, Homo sapiens
gcatcctcttccaggagttcc

SEQ ID NO: 36811 - DNA, 18 bp, Homo sapiens
gcgccacgaggtgccacc

SEQ ID NO: 36812 - DNA, 24 bp, Homo sapiens
gcgcctcttccgctggctggttct

SEQ ID NO: 36813 - DNA, 19 bp, Homo sapiens
ggagagcgggaggcggctg

SEQ ID NO: 36814 - DNA, 23 bp, Homo sapiens
tgaggcgtcccggcgaggagctg

SEQ ID NO: 36815 - DNA, 22 bp, Homo sapiens
ctccccgccctcctctgtccct

SEQ ID NO: 36816 - DNA, 17 bp, Homo sapiens
aggcaggataatcactt

SEQ ID NO: 36817 - DNA, 16 bp, Homo sapiens
agcccctcttcccaca

SEQ ID NO: 36818 - DNA, 17 bp, Homo sapiens
atgggctacttgtcata

SEQ ID NO: 36819 - DNA, 16 bp, Homo sapiens
cctcattcttgctgct

SEQ ID NO: 36820 - DNA, 20 bp, Homo sapiens
ctgcatgggttcaaatccca

SEQ ID NO: 36821 - DNA, 20 bp, Homo sapiens
ctgcatgggttcaaatccca

SEQ ID NO: 36822 - DNA, 20 bp, Homo sapiens
ctgcatgggttcaaatccca

SEQ ID NO: 36823 - DNA, 20 bp, Homo sapiens
gctctccctccagagcctgt

SEQ ID NO: 36824 - DNA, 21 bp, Homo sapiens
ggacagggctcacacacctca

SEQ ID NO: 36825 - DNA, 17 bp, Homo sapiens
tgacaagaactacttca

SEQ ID NO: 36826 - DNA, 17 bp, Homo sapiens
ttcctgtgctctccctc

SEQ ID NO: 36827 - DNA, 18 bp, Homo sapiens
ttcttgggttccgcgtgt

SEQ ID NO: 36828 - DNA, 18 bp, Homo sapiens
aagagacccgctcctcca

SEQ ID NO: 36829 - DNA, 20 bp, Homo sapiens
ccaaccctgggaaaccatcc

SEQ ID NO: 36830 - DNA, 20 bp, Homo sapiens
gctggaggggggtctttgtc

SEQ ID NO: 36831 - DNA, 18 bp, Homo sapiens
tcctccactttcaggtgt

SEQ ID NO: 36832 - DNA, 20 bp, Homo sapiens
tgccaagaccatcgccaagc

SEQ ID NO: 36833 - DNA, 21 bp, Homo sapiens
cccgtctctactaaaaatcca

SEQ ID NO: 36834 - DNA, 21 bp, Homo sapiens
ccctcccctctcttctcctcc

SEQ ID NO: 36835 - DNA, 21 bp, Homo sapiens
ccctgatcctcaaggacctgt

SEQ ID NO: 36836 - DNA, 22 bp, Homo sapiens
gaaccaagatcatgccactgca

SEQ ID NO: 36837 - DNA, 21 bp, Homo sapiens
gagaattcctgggtccaatca

SEQ ID NO: 36838 - DNA, 16 bp, Homo sapiens
gcacttgtacctccct

SEQ ID NO: 36839 - DNA, 17 bp, Homo sapiens
actcatctggagcccgg

SEQ ID NO: 36840 - DNA, 21 bp, Homo sapiens
ctccgagcaccggagctgcgg

SEQ ID NO: 36841 - DNA, 20 bp, Homo sapiens
gaggcgagaaccaagatccc

SEQ ID NO: 36842 - DNA, 17 bp, Homo sapiens
ggagacggcggtgtgcc

SEQ ID NO: 36843 - DNA, 20 bp, Homo sapiens
cccgctttctgaacctctca

SEQ ID NO: 36844 - DNA, 20 bp, Homo sapiens
cctttttgacctcttgacct

SEQ ID NO: 36845 - DNA, 18 bp, Homo sapiens
tccttccctccccgcttt

SEQ ID NO: 36846 - DNA, 19 bp, Homo sapiens
ggccacttccgagtggatc

SEQ ID NO: 36847 - DNA, 22 bp, Homo sapiens
tttcttctctggctgtggcctt

SEQ ID NO: 36848 - DNA, 17 bp, Homo sapiens
agaggacctattccttt

SEQ ID NO: 36849 - DNA, 23 bp, Homo sapiens
cccagtgttgcatccccacttcc

SEQ ID NO: 36850 - DNA, 20 bp, Homo sapiens
cctgccgctcccctgccaca

SEQ ID NO: 36851 - DNA, 19 bp, Homo sapiens
ctgcaacctccgcctccca

SEQ ID NO: 36852 - DNA, 25 bp, Homo sapiens
gacagtaggaggctacctttcctca

SEQ ID NO: 36853 - DNA, 17 bp, Homo sapiens
gctttaagaattttttg

SEQ ID NO: 36854 - DNA, 24 bp, Homo sapiens
gcttttcccccagttccccaagag

SEQ ID NO: 36855 - DNA, 26 bp, Homo sapiens
tacctttcctcatctccagcttctgc

SEQ ID NO: 36856 - DNA, 18 bp, Homo sapiens
tccgcctcccaggttcaa

SEQ ID NO: 36857 - DNA, 21 bp, Homo sapiens
tgactaaaagcctcccccagg

SEQ ID NO: 36858 - DNA, 22 bp, Homo sapiens
tggccccagagagctccttcac

SEQ ID NO: 36859 - DNA, 19 bp, Homo sapiens
ttgaggatgcagcaagaaa

SEQ ID NO: 36860 - DNA, 22 bp, Homo sapiens
ggccagaacccgtctacagagg

SEQ ID NO: 36861 - DNA, 18 bp, Homo sapiens
gcccttgcgatttctttt

SEQ ID NO: 36862 - DNA, 19 bp, Homo sapiens
gcttttcctgagggcactg

SEQ ID NO: 36863 - DNA, 19 bp, Homo sapiens
accccaccgccctccctct

SEQ ID NO: 36864 - DNA, 20 bp, Homo sapiens
catgcaccgaactgcgggga

SEQ ID NO: 36865 - DNA, 17 bp, Homo sapiens
ccccaccgccctccctc

SEQ ID NO: 36866 - DNA, 23 bp, Homo sapiens
acttgggtccctctgccttgcct

SEQ ID NO: 36867 - DNA, 17 bp, Homo sapiens
attctcctctcctctga

SEQ ID NO: 36868 - DNA, 18 bp, Homo sapiens
cctctcctctgacccctc

SEQ ID NO: 36869 - DNA, 24 bp, Homo sapiens
cgtcgcggtacaacgtgctggcca

SEQ ID NO: 36870 - DNA, 20 bp, Homo sapiens
ctgataacttgatgttcttc

SEQ ID NO: 36871 - DNA, 18 bp, Homo sapiens
gacggcccttctctctcc

SEQ ID NO: 36872 - DNA, 20 bp, Homo sapiens
gcctccctgaccgcttgctt

SEQ ID NO: 36873 - DNA, 18 bp, Homo sapiens
gggtgccccgtctccatc

SEQ ID NO: 36874 - DNA, 22 bp, Homo sapiens
tcttgggagtgaggacttgggg

SEQ ID NO: 36875 - DNA, 21 bp, Homo sapiens
tcttggggtggggatctgagg

SEQ ID NO: 36876 - DNA, 21 bp, Homo sapiens
tgaatggcttgagtgggactg

SEQ ID NO: 36877 - DNA, 22 bp, Homo sapiens
aactggtacccacacttgccct

SEQ ID NO: 36878 - DNA, 18 bp, Homo sapiens
caagtctcagtcccctca

SEQ ID NO: 36879 - DNA, 25 bp, Homo sapiens
ctctggtgctcctaacacctgtgag

SEQ ID NO: 36880 - DNA, 18 bp, Homo sapiens
tgaagcccttggtatcgc

SEQ ID NO: 36881 - DNA, 19 bp, Homo sapiens
acgtaatccccacatttga

SEQ ID NO: 36882 - DNA, 19 bp, Homo sapiens
atgggcagaaaaattcctt

SEQ ID NO: 36883 - DNA, 22 bp, Homo sapiens
ccccagcaagcaaaaacattta

SEQ ID NO: 36884 - DNA, 21 bp, Homo sapiens
gagggatgatatcatctctca

SEQ ID NO: 36885 - DNA, 18 bp, Homo sapiens
tggaacctggtatgagat

SEQ ID NO: 36886 - DNA, 23 bp, Homo sapiens
catcgtatccaaaaggctctttt

SEQ ID NO: 36887 - DNA, 20 bp, Homo sapiens
tgggaatctctaatgtgaaa

SEQ ID NO: 36888 - DNA, 21 bp, Homo sapiens
cctccagccagagatattcca

SEQ ID NO: 36889 - DNA, 19 bp, Homo sapiens
ggagacctgactggaactg

SEQ ID NO: 36890 - DNA, 22 bp, Homo sapiens
gtccagcttcttggccaccttt

SEQ ID NO: 36891 - DNA, 17 bp, Homo sapiens
ttaaaactgcagttcct

SEQ ID NO: 36892 - DNA, 22 bp, Homo sapiens
ttgcccaagaccactgctacct

SEQ ID NO: 36893 - DNA, 17 bp, Homo sapiens
aactccaggacaaggca

SEQ ID NO: 36894 - DNA, 19 bp, Homo sapiens
ggaggaggctaaggctgcc

SEQ ID NO: 36895 - DNA, 16 bp, Homo sapiens
ggagagaaaggcactt

SEQ ID NO: 36896 - DNA, 21 bp, Homo sapiens
agccaagattgtaccactgca

SEQ ID NO: 36897 - DNA, 18 bp, Homo sapiens
cagggctgcttttcctga

SEQ ID NO: 36898 - DNA, 17 bp, Homo sapiens
ctgctagtaactattgg

SEQ ID NO: 36899 - DNA, 18 bp, Homo sapiens
gaatacgctggcgctctc

SEQ ID NO: 36900 - DNA, 21 bp, Homo sapiens
gctttggagatttggaaagca

SEQ ID NO: 36901 - DNA, 19 bp, Homo sapiens
tgggaggaagcgtctgttt

SEQ ID NO: 36902 - DNA, 21 bp, Homo sapiens
tcctggaggaagtacacaagc

SEQ ID NO: 36903 - DNA, 20 bp, Homo sapiens
caccttcacccaccatgtga

SEQ ID NO: 36904 - DNA, 19 bp, Homo sapiens
ctgtggatgccctcacctt

SEQ ID NO: 36905 - DNA, 15 bp, Homo sapiens
gcctttcttgctgct

SEQ ID NO: 36906 - DNA, 20 bp, Homo sapiens
ctgcactgtgggtgtccacc

SEQ ID NO: 36907 - DNA, 19 bp, Homo sapiens
cttccctgtctctgcctct

SEQ ID NO: 36908 - DNA, 19 bp, Homo sapiens
gcaagatcctggtgggtga

SEQ ID NO: 36909 - DNA, 20 bp, Homo sapiens
gcctggaccgcggagacgcc

SEQ ID NO: 36910 - DNA, 28 bp, Homo sapiens
taggtgggccaagtcctggcaggagctg

SEQ ID NO: 36911 - DNA, 22 bp, Homo sapiens
acccggaaagccccccaggctg

SEQ ID NO: 36912 - DNA, 16 bp, Homo sapiens
gcgggggtggagcggg

SEQ ID NO: 36913 - DNA, 20 bp, Homo sapiens
tgacgatttcaacctcacac

SEQ ID NO: 36914 - DNA, 19 bp, Homo sapiens
tgttatttactacattgtg

SEQ ID NO: 36915 - DNA, 18 bp, Homo sapiens
caccattctcctgcctca

SEQ ID NO: 36916 - DNA, 22 bp, Homo sapiens
ccttattccttctctgcctcca

SEQ ID NO: 36917 - DNA, 17 bp, Homo sapiens
ctgcttgctatcccttt

SEQ ID NO: 36918 - DNA, 19 bp, Homo sapiens
cttattccttctctgcctc

SEQ ID NO: 36919 - DNA, 25 bp, Homo sapiens
tagatgggggttatggttgaaactg

SEQ ID NO: 36920 - DNA, 21 bp, Homo sapiens
cgtgtccaagaagttccacca

SEQ ID NO: 36921 - DNA, 18 bp, Homo sapiens
acactcaggcctgagaga

SEQ ID NO: 36922 - DNA, 17 bp, Homo sapiens
cacctccctcctttttc

SEQ ID NO: 36923 - DNA, 19 bp, Homo sapiens
ggggatagaacatctttca

SEQ ID NO: 36924 - DNA, 17 bp, Homo sapiens
aaaaggtgcaggtatga

SEQ ID NO: 36925 - DNA, 20 bp, Homo sapiens
aaagtagtcttgaacaggta

SEQ ID NO: 36926 - DNA, 16 bp, Homo sapiens
atgcctatactttttt

SEQ ID NO: 36927 - DNA, 22 bp, Homo sapiens
gtgttctcattttttctgggta

SEQ ID NO: 36928 - DNA, 21 bp, Homo sapiens
atcttggctcactgcaacctc

SEQ ID NO: 36929 - DNA, 22 bp, Homo sapiens
ccaaaccatacctgggcctgtt

SEQ ID NO: 36930 - DNA, 18 bp, Homo sapiens
cttagcccccttgcctct

SEQ ID NO: 36931 - DNA, 23 bp, Homo sapiens
ggcgttggtaagatgtgaccctc

SEQ ID NO: 36932 - DNA, 25 bp, Homo sapiens
gtacctgttggacaagattatgata

SEQ ID NO: 36933 - DNA, 21 bp, Homo sapiens
tggagcaataagattactttt

SEQ ID NO: 36934 - DNA, 17 bp, Homo sapiens
ccaaaccccgccaccat

SEQ ID NO: 36935 - DNA, 20 bp, Homo sapiens
gcctctgtccttgtaagtca

SEQ ID NO: 36936 - DNA, 27 bp, Homo sapiens
gtggggtccagcgctggctgggcccag

SEQ ID NO: 36937 - DNA, 20 bp, Homo sapiens
aaactctgaggctttggtga

SEQ ID NO: 36938 - DNA, 19 bp, Homo sapiens
aagcaattctcctgcccca

SEQ ID NO: 36939 - DNA, 17 bp, Homo sapiens
acatgtacgtgcacagg

SEQ ID NO: 36940 - DNA, 18 bp, Homo sapiens
ccagctggagaccatgcc

SEQ ID NO: 36941 - DNA, 21 bp, Homo sapiens
ccatctgtgtccccatgccca

SEQ ID NO: 36942 - DNA, 19 bp, Homo sapiens
cctgataataaaactctga

SEQ ID NO: 36943 - DNA, 19 bp, Homo sapiens
ctgcaacctccgcctccca

SEQ ID NO: 36944 - DNA, 24 bp, Homo sapiens
ggcacacacatacactcctgcgtg

SEQ ID NO: 36945 - DNA, 20 bp, Homo sapiens
gtacctgaatgtgagctcct

SEQ ID NO: 36946 - DNA, 23 bp, Homo sapiens
tcctgcgtgtgcacaagcacaca

SEQ ID NO: 36947 - DNA, 20 bp, Homo sapiens
tggtcaggctggtcttgaac

SEQ ID NO: 36948 - DNA, 19 bp, Homo sapiens
caagagcaggagcatctaa

SEQ ID NO: 36949 - DNA, 19 bp, Homo sapiens
cctccgcgcgcgccgcagc

SEQ ID NO: 36950 - DNA, 19 bp, Homo sapiens
aattgcccccatttgagaa

SEQ ID NO: 36951 - DNA, 21 bp, Homo sapiens
gcccccaaaaatgtctctaga

SEQ ID NO: 36952 - DNA, 23 bp, Homo sapiens
tggcagcacattgagatcggcta

SEQ ID NO: 36953 - DNA, 22 bp, Homo sapiens
tggctgaagattgacttagaga

SEQ ID NO: 36954 - DNA, 16 bp, Homo sapiens
ttggcgatgttctgga

SEQ ID NO: 36955 - DNA, 20 bp, Homo sapiens
caagtcctgcgatgctaagt

SEQ ID NO: 36956 - DNA, 23 bp, Homo sapiens
cataacacaggagacctgctccc

SEQ ID NO: 36957 - DNA, 22 bp, Homo sapiens
ccagggcgtcctccagctcagc

SEQ ID NO: 36958 - DNA, 19 bp, Homo sapiens
gaatgttctcagtgtccta

SEQ ID NO: 36959 - DNA, 20 bp, Homo sapiens
gagaaatatggatggggagc

SEQ ID NO: 36960 - DNA, 19 bp, Homo sapiens
ggagcactctgagatctca

SEQ ID NO: 36961 - DNA, 21 bp, Homo sapiens
taaaatgctggaaaactgtaa

SEQ ID NO: 36962 - DNA, 20 bp, Homo sapiens
tgcgatggcgttcacgtcca

SEQ ID NO: 36963 - DNA, 22 bp, Homo sapiens
atggcacagtgcatttgctgta

SEQ ID NO: 36964 - DNA, 22 bp, Homo sapiens
cccagataagtttggttttcaa

SEQ ID NO: 36965 - DNA, 23 bp, Homo sapiens
gccctgggagcagatggccctga

SEQ ID NO: 36966 - DNA, 18 bp, Homo sapiens
tcctttaatttacctgat

SEQ ID NO: 36967 - DNA, 16 bp, Homo sapiens
tgcaaaatacaagctc

SEQ ID NO: 36968 - DNA, 22 bp, Homo sapiens
ctctctctctcttctttctctc

SEQ ID NO: 36969 - DNA, 24 bp, Homo sapiens
caccaccaccaccctggctcccct

SEQ ID NO: 36970 - DNA, 25 bp, Homo sapiens
cgcccccacttccccatctacctct

SEQ ID NO: 36971 - DNA, 18 bp, Homo sapiens
ccaaaataggatgagatg

SEQ ID NO: 36972 - DNA, 20 bp, Homo sapiens
attctagagccaagtgttcc

SEQ ID NO: 36973 - DNA, 17 bp, Homo sapiens
cattgaactggatgcat

SEQ ID NO: 36974 - DNA, 19 bp, Homo sapiens
ggacactcctgcagagcca

SEQ ID NO: 36975 - DNA, 18 bp, Homo sapiens
tagagctgtgtgacttta

SEQ ID NO: 36976 - DNA, 18 bp, Homo sapiens
tccctcagtcccaaattc

SEQ ID NO: 36977 - DNA, 24 bp, Homo sapiens
tggcatagtaaacattttcttgga

SEQ ID NO: 36978 - DNA, 17 bp, Homo sapiens
gagctttgagtgtacat

SEQ ID NO: 36979 - DNA, 18 bp, Homo sapiens
gttgaacatatgtatacc

SEQ ID NO: 36980 - DNA, 17 bp, Homo sapiens
tactggtgacagtgtga

SEQ ID NO: 36981 - DNA, 20 bp, Homo sapiens
tcttctaccctagatctgat

SEQ ID NO: 36982 - DNA, 17 bp, Homo sapiens
tgaacaagcacttcaca

SEQ ID NO: 36983 - DNA, 21 bp, Homo sapiens
ctgcctgattctcctgcctca

SEQ ID NO: 36984 - DNA, 17 bp, Homo sapiens
atactattgcttccttt

SEQ ID NO: 36985 - DNA, 20 bp, Homo sapiens
tggcaaagcttaggcttcta

SEQ ID NO: 36986 - DNA, 18 bp, Homo sapiens
cagcagggcatgttacca

SEQ ID NO: 36987 - DNA, 23 bp, Homo sapiens
gtgtgtgccaccatacttggcta

SEQ ID NO: 36988 - DNA, 22 bp, Homo sapiens
gccgccccctggggatccagcg

SEQ ID NO: 36989 - DNA, 20 bp, Homo sapiens
tcctcccttggggtctagag

SEQ ID NO: 36990 - DNA, 19 bp, Homo sapiens
ggtccttgcgggcaccaca

SEQ ID NO: 36991 - DNA, 19 bp, Homo sapiens
aaggaccctaggcccagcg

SEQ ID NO: 36992 - DNA, 21 bp, Homo sapiens
ccccggagcctgcaaaagtgt

SEQ ID NO: 36993 - DNA, 18 bp, Homo sapiens
gcccctgcccccaccccc

SEQ ID NO: 36994 - DNA, 18 bp, Homo sapiens
aaaatgtactggtgtgat

SEQ ID NO: 36995 - DNA, 21 bp, Homo sapiens
aaagcatgtgacatattgcta

SEQ ID NO: 36996 - DNA, 21 bp, Homo sapiens
aagtgaaaatattagccttaa

SEQ ID NO: 36997 - DNA, 21 bp, Homo sapiens
atgtctggtgtctgtcatgcc

SEQ ID NO: 36998 - DNA, 17 bp, Homo sapiens
ctctttcactcagaagc

SEQ ID NO: 36999 - DNA, 19 bp, Homo sapiens
gctcccaagaggctcctga

SEQ ID NO: 37000 - DNA, 20 bp, Homo sapiens
ggagagggctggcctggtca

SEQ ID NO: 37001 - DNA, 21 bp, Homo sapiens
attctactgcaggtgtttcca

SEQ ID NO: 37002 - DNA, 19 bp, Homo sapiens
gtatgacccatcatttgat

SEQ ID NO: 37003 - DNA, 16 bp, Homo sapiens
tactgcaggtgtttcc

SEQ ID NO: 37004 - DNA, 21 bp, Homo sapiens
tggaatcgaaatcataagata

SEQ ID NO: 37005 - DNA, 21 bp, Homo sapiens
aaattgaactgagaccagtga

SEQ ID NO: 37006 - DNA, 19 bp, Homo sapiens
gctttgtataaaggtctgt

SEQ ID NO: 37007 - DNA, 24 bp, Homo sapiens
caaggataccaaggcaagcataca

SEQ ID NO: 37008 - DNA, 21 bp, Homo sapiens
tttaggaaataaatcctctcc

SEQ ID NO: 37009 - DNA, 22 bp, Homo sapiens
cggatgagatgacagctcgcca

SEQ ID NO: 37010 - DNA, 18 bp, Homo sapiens
ctcacccaagctgcagtt

SEQ ID NO: 37011 - DNA, 22 bp, Homo sapiens
ggaactgtgatggaccacttcc

SEQ ID NO: 37012 - DNA, 20 bp, Homo sapiens
aatacagtgtattttgttat

SEQ ID NO: 37013 - DNA, 20 bp, Homo sapiens
caaagaaagaaggaagaaca

SEQ ID NO: 37014 - DNA, 15 bp, Homo sapiens
agaggcaaaactgtc

SEQ ID NO: 37015 - DNA, 15 bp, Homo sapiens
cctgtgctttctgaa

SEQ ID NO: 37016 - DNA, 18 bp, Homo sapiens
cggtgtctctcctctaga

SEQ ID NO: 37017 - DNA, 25 bp, Homo sapiens
gagaagttggccttcaaggggctca

SEQ ID NO: 37018 - DNA, 18 bp, Homo sapiens
gcaaaactgtccattgaa

SEQ ID NO: 37019 - DNA, 22 bp, Homo sapiens
cttccgtatgctgtttgacttt

SEQ ID NO: 37020 - DNA, 18 bp, Homo sapiens
ctttctacctctgctcct

SEQ ID NO: 37021 - DNA, 20 bp, Homo sapiens
cacatctacactatttcctt

SEQ ID NO: 37022 - DNA, 20 bp, Homo sapiens
gtctggaacgcctgacctca

SEQ ID NO: 37023 - DNA, 17 bp, Homo sapiens
aggaagccggggagaca

SEQ ID NO: 37024 - DNA, 21 bp, Homo sapiens
cgaggcctgctgggcttggca

SEQ ID NO: 37025 - DNA, 23 bp, Homo sapiens
atctgtggcaaattgtatatgat

SEQ ID NO: 37026 - DNA, 21 bp, Homo sapiens
ccatccataggaaaatggata

SEQ ID NO: 37027 - DNA, 19 bp, Homo sapiens
tagcttgtgagctttctca

SEQ ID NO: 37028 - DNA, 19 bp, Homo sapiens
gtataaaaccaaatgctta

SEQ ID NO: 37029 - DNA, 18 bp, Homo sapiens
caaggataacctgggcca

SEQ ID NO: 37030 - DNA, 18 bp, Homo sapiens
ctaccaggacacctggca

SEQ ID NO: 37031 - DNA, 22 bp, Homo sapiens
ctggctcagctaatccttgtca

SEQ ID NO: 37032 - DNA, 18 bp, Homo sapiens
ggacctcagtgtgaagct

SEQ ID NO: 37033 - DNA, 18 bp, Homo sapiens
tcagtgtgaagcttattc

SEQ ID NO: 37034 - DNA, 21 bp, Homo sapiens
cctcccccacagcccctttcc

SEQ ID NO: 37035 - DNA, 22 bp, Homo sapiens
cgcggctctgcacccgcgccgc

SEQ ID NO: 37036 - DNA, 23 bp, Homo sapiens
tcctggccccagaagcctgcgga

SEQ ID NO: 37037 - DNA, 17 bp, Homo sapiens
aagttgacttttggctt

SEQ ID NO: 37038 - DNA, 21 bp, Homo sapiens
agcttatgcaacatgctcagc

SEQ ID NO: 37039 - DNA, 18 bp, Homo sapiens
aggcggaccctctggcgc

SEQ ID NO: 37040 - DNA, 17 bp, Homo sapiens
attttttgccaaagtgt

SEQ ID NO: 37041 - DNA, 19 bp, Homo sapiens
cactgctttccccaccagg

SEQ ID NO: 37042 - DNA, 16 bp, Homo sapiens
tcagtctccttttcta

SEQ ID NO: 37043 - DNA, 18 bp, Homo sapiens
tgtttgactaaatacaat

SEQ ID NO: 37044 - DNA, 19 bp, Homo sapiens
ccagagcctgtctgctata

SEQ ID NO: 37045 - DNA, 21 bp, Homo sapiens
ctcgggcagagctttgtgaga

SEQ ID NO: 37046 - DNA, 24 bp, Homo sapiens
gcctcaatacgatcatagaagcca

SEQ ID NO: 37047 - DNA, 20 bp, Homo sapiens
tgaacttcacatttcccaca

SEQ ID NO: 37048 - DNA, 23 bp, Homo sapiens
tgggtgggcaacttggggagctg

SEQ ID NO: 37049 - DNA, 24 bp, Homo sapiens
gcctgagctcacttgttgtggcct

SEQ ID NO: 37050 - DNA, 23 bp, Homo sapiens
tcagcactttgggcaagtggttg

SEQ ID NO: 37051 - DNA, 16 bp, Homo sapiens
tctgatagctggtgtt

SEQ ID NO: 37052 - DNA, 21 bp, Homo sapiens
cctatgtgaataaaattactc

SEQ ID NO: 37053 - DNA, 24 bp, Homo sapiens
gtagttttggaattgccttcctta

SEQ ID NO: 37054 - DNA, 18 bp, Homo sapiens
tccatctcccaggttcaa

SEQ ID NO: 37055 - DNA, 23 bp, Homo sapiens
tctattaggagtttggtaaaata

SEQ ID NO: 37056 - DNA, 17 bp, Homo sapiens
tcttcacctgtgttagg

SEQ ID NO: 37057 - DNA, 18 bp, Homo sapiens
tgatgttatgactattga

SEQ ID NO: 37058 - DNA, 23 bp, Homo sapiens
ttatagatgaatgctttcatttg

SEQ ID NO: 37059 - DNA, 26 bp, Homo sapiens
atataagaaatattggaaagatgctc

SEQ ID NO: 37060 - DNA, 21 bp, Homo sapiens
gtctgagcagttttgattaga

SEQ ID NO: 37061 - DNA, 18 bp, Homo sapiens
tctgctagtcactttttt

SEQ ID NO: 37062 - DNA, 19 bp, Homo sapiens
tttcatttcactgctgctg

SEQ ID NO: 37063 - DNA, 22 bp, Homo sapiens
cgggcgggacggaccgcggcca

SEQ ID NO: 37064 - DNA, 21 bp, Homo sapiens
ggctagacgctggcgctgagc

SEQ ID NO: 37065 - DNA, 19 bp, Homo sapiens
tgattttcagctggaatta

SEQ ID NO: 37066 - DNA, 18 bp, Homo sapiens
agtttttttgttgttttt

SEQ ID NO: 37067 - DNA, 20 bp, Homo sapiens
cctttctgcttctgaagtat

SEQ ID NO: 37068 - DNA, 21 bp, Homo sapiens
gcaaggagcatcgaaatttga

SEQ ID NO: 37069 - DNA, 20 bp, Homo sapiens
gcccaagcaatcctgcctca

SEQ ID NO: 37070 - DNA, 21 bp, Homo sapiens
gcctatgtggttttttttcag

SEQ ID NO: 37071 - DNA, 19 bp, Homo sapiens
tcaccactgcgcccgcaaa

SEQ ID NO: 37072 - DNA, 20 bp, Homo sapiens
tgactggctagttttgtttt

SEQ ID NO: 37073 - DNA, 20 bp, Homo sapiens
tgggcatttgaacagtgtga

SEQ ID NO: 37074 - DNA, 23 bp, Homo sapiens
ctgaggtagctggagaccacagc

SEQ ID NO: 37075 - DNA, 20 bp, Homo sapiens
gatggcttctttctgtcaca

SEQ ID NO: 37076 - DNA, 16 bp, Homo sapiens
aggttcaagtgtaaca

SEQ ID NO: 37077 - DNA, 23 bp, Homo sapiens
ggaccgtgcgcggcggccgcggc

SEQ ID NO: 37078 - DNA, 17 bp, Homo sapiens
gtctctcatcatttgct

SEQ ID NO: 37079 - DNA, 24 bp, Homo sapiens
ttagaaattagcaagtagtgcata

SEQ ID NO: 37080 - DNA, 17 bp, Homo sapiens
ttccagaagctgattcc

SEQ ID NO: 37081 - DNA, 22 bp, Homo sapiens
accaatattattgattaccaga

SEQ ID NO: 37082 - DNA, 21 bp, Homo sapiens
agcataattttcattaccaaa

SEQ ID NO: 37083 - DNA, 18 bp, Homo sapiens
agtatttgcctcctgtgt

SEQ ID NO: 37084 - DNA, 23 bp, Homo sapiens
ctggaaaaagaagccccagccca

SEQ ID NO: 37085 - DNA, 22 bp, Homo sapiens
cttcctttctgccatcatctca

SEQ ID NO: 37086 - DNA, 22 bp, Homo sapiens
gagccaagatcgtgccactgca

SEQ ID NO: 37087 - DNA, 24 bp, Homo sapiens
gtccatgatactataattgtgaga

SEQ ID NO: 37088 - DNA, 20 bp, Homo sapiens
tacgtttcactcaagttctc

SEQ ID NO: 37089 - DNA, 20 bp, Homo sapiens
tcagaaatgtgtgacccttc

SEQ ID NO: 37090 - DNA, 19 bp, Homo sapiens
aagcaattctcctgcctca

SEQ ID NO: 37091 - DNA, 21 bp, Homo sapiens
ctttatgtcgtgtagtttgta

SEQ ID NO: 37092 - DNA, 19 bp, Homo sapiens
ccaagttttattgaggcat

SEQ ID NO: 37093 - DNA, 18 bp, Homo sapiens
cccacaacctccgcctcc

SEQ ID NO: 37094 - DNA, 19 bp, Homo sapiens
gccataataaaaattacat

SEQ ID NO: 37095 - DNA, 18 bp, Homo sapiens
tccgcctcccaggttcaa

SEQ ID NO: 37096 - DNA, 19 bp, Homo sapiens
tggatggattcacaagaaa

SEQ ID NO: 37097 - DNA, 20 bp, Homo sapiens
tggtcaggctggtcttgaac

SEQ ID NO: 37098 - DNA, 18 bp, Homo sapiens
acacttggctaacaaaca

SEQ ID NO: 37099 - DNA, 19 bp, Homo sapiens
ctctggtaccctctgccct

SEQ ID NO: 37100 - DNA, 20 bp, Homo sapiens
gctggcctggtgatgtccca

SEQ ID NO: 37101 - DNA, 23 bp, Homo sapiens
agggagagcaaagacaaaataca

SEQ ID NO: 37102 - DNA, 20 bp, Homo sapiens
agttcaggttgggtttggtt

SEQ ID NO: 37103 - DNA, 17 bp, Homo sapiens
cagaggactctaggttt

SEQ ID NO: 37104 - DNA, 18 bp, Homo sapiens
aactccatctcaatcaat

SEQ ID NO: 37105 - DNA, 27 bp, Homo sapiens
agaagtaccgacactccctatccttca

SEQ ID NO: 37106 - DNA, 18 bp, Homo sapiens
agagccttccagggcctc

SEQ ID NO: 37107 - DNA, 19 bp, Homo sapiens
ggggagcgcaggcaggaca

SEQ ID NO: 37108 - DNA, 22 bp, Homo sapiens
gcctgggctccagctttggctc

SEQ ID NO: 37109 - DNA, 21 bp, Homo sapiens
accctgaactccccatgtgat

SEQ ID NO: 37110 - DNA, 19 bp, Homo sapiens
cacatcacgttcagtgttt

SEQ ID NO: 37111 - DNA, 19 bp, Homo sapiens
ctcactgctcacttgcaca

SEQ ID NO: 37112 - DNA, 18 bp, Homo sapiens
gtgtgttcgtactccagg

SEQ ID NO: 37113 - DNA, 25 bp, Homo sapiens
tgtggggattaaagtgctgcgggtg

SEQ ID NO: 37114 - DNA, 19 bp, Homo sapiens
gaaaagccctggctcccgc

SEQ ID NO: 37115 - DNA, 24 bp, Homo sapiens
atgtcatttcacctcctgttccta

SEQ ID NO: 37116 - DNA, 17 bp, Homo sapiens
tcgagaaactgatcgcc

SEQ ID NO: 37117 - DNA, 22 bp, Homo sapiens
tctaagaaaactatgcgtaaaa

SEQ ID NO: 37118 - DNA, 24 bp, Homo sapiens
tgtaacctcaaactcctggactca

SEQ ID NO: 37119 - DNA, 19 bp, Homo sapiens
ttgtactacacaagtaaaa

SEQ ID NO: 37120 - DNA, 19 bp, Homo sapiens
cgaggctgcgccgcgtgga

SEQ ID NO: 37121 - DNA, 18 bp, Homo sapiens
tcagcaggaggcggggat

SEQ ID NO: 37122 - DNA, 21 bp, Homo sapiens
caggctgccgtgcaccatcct

SEQ ID NO: 37123 - DNA, 25 bp, Homo sapiens
ggccaggctgccgtgcaccatcctg

SEQ ID NO: 37124 - DNA, 22 bp, Homo sapiens
tctctgagctgccagcagccaa

SEQ ID NO: 37125 - DNA, 17 bp, Homo sapiens
cgtcctccaggcacctc

SEQ ID NO: 37126 - DNA, 22 bp, Homo sapiens
ctccaggcacctcgcccacggc

SEQ ID NO: 37127 - DNA, 18 bp, Homo sapiens
ggtgccgctcctcactca

SEQ ID NO: 37128 - DNA, 18 bp, Homo sapiens
tcatcttcctggacgtca

SEQ ID NO: 37129 - DNA, 17 bp, Homo sapiens
acaggacaccctggcta

SEQ ID NO: 37130 - DNA, 21 bp, Homo sapiens
cctgtgccctacatccctgag

SEQ ID NO: 37131 - DNA, 24 bp, Homo sapiens
gcaggtttccaatgaagccccacc

SEQ ID NO: 37132 - DNA, 18 bp, Homo sapiens
tcccaggtgcaactgcag

SEQ ID NO: 37133 - DNA, 21 bp, Homo sapiens
gcataacaaggcctcccaacc

SEQ ID NO: 37134 - DNA, 21 bp, Homo sapiens
cagacctcattaactcattaa

SEQ ID NO: 37135 - DNA, 20 bp, Homo sapiens
cctctgcctcccaggttcaa

SEQ ID NO: 37136 - DNA, 19 bp, Homo sapiens
ctgcaacctctgcctccca

SEQ ID NO: 37137 - DNA, 16 bp, Homo sapiens
gagggcaagatccaag

SEQ ID NO: 37138 - DNA, 21 bp, Homo sapiens
accaagccttattcccactcc

SEQ ID NO: 37139 - DNA, 19 bp, Homo sapiens
taatgtataaatgttccct

SEQ ID NO: 37140 - DNA, 22 bp, Homo sapiens
ttttggaaataatcataacttg

SEQ ID NO: 37141 - DNA, 18 bp, Homo sapiens
agggagcccgagccaggc

SEQ ID NO: 37142 - DNA, 20 bp, Homo sapiens
ggcttataatcatgtgtttt

SEQ ID NO: 37143 - DNA, 17 bp, Homo sapiens
ggggggtgggcaaggtg

SEQ ID NO: 37144 - DNA, 24 bp, Homo sapiens
cagaagaatagcttgagcccagga

SEQ ID NO: 37145 - DNA, 21 bp, Homo sapiens
gaacctaaatttgaccatgcc

SEQ ID NO: 37146 - DNA, 17 bp, Homo sapiens
gaatggaattgtgaagc

SEQ ID NO: 37147 - DNA, 15 bp, Homo sapiens
gcttcaaggcagctg

SEQ ID NO: 37148 - DNA, 24 bp, Homo sapiens
tgaatggatggatgaatggaattg

SEQ ID NO: 37149 - DNA, 20 bp, Homo sapiens
tggatggatgaatggaattg

SEQ ID NO: 37150 - DNA, 22 bp, Homo sapiens
ttgaacctaaatttgaccatgc

SEQ ID NO: 37151 - DNA, 19 bp, Homo sapiens
actactactgcacagctga

SEQ ID NO: 37152 - DNA, 16 bp, Homo sapiens
tgaaggacattcagag

SEQ ID NO: 37153 - DNA, 19 bp, Homo sapiens
aactgctagaaaatgggag

SEQ ID NO: 37154 - DNA, 19 bp, Homo sapiens
aatatcattaggcattggc

SEQ ID NO: 37155 - DNA, 22 bp, Homo sapiens
agaagagagagtaaaggacctt

SEQ ID NO: 37156 - DNA, 21 bp, Homo sapiens
agggcatcatcagcgcacaac

SEQ ID NO: 37157 - DNA, 20 bp, Homo sapiens
catctgactcctgggttcaa

SEQ ID NO: 37158 - DNA, 22 bp, Homo sapiens
gtgtgtattggttcatttacta

SEQ ID NO: 37159 - DNA, 18 bp, Homo sapiens
tcagcaggattgcactga

SEQ ID NO: 37160 - DNA, 24 bp, Homo sapiens
ttgaggttgtgacacaagctgaca

SEQ ID NO: 37161 - DNA, 22 bp, Homo sapiens
ttgtctcctatttttccataac

SEQ ID NO: 37162 - DNA, 22 bp, Homo sapiens
aagtaataccaaagggctcctg

SEQ ID NO: 37163 - DNA, 20 bp, Homo sapiens
caaggaagcagctactggac

SEQ ID NO: 37164 - DNA, 23 bp, Homo sapiens
cagaaccacacctccaccctaac

SEQ ID NO: 37165 - DNA, 19 bp, Homo sapiens
ccaggctcacccatcaccc

SEQ ID NO: 37166 - DNA, 19 bp, Homo sapiens
cccagcttcctcccctttt

SEQ ID NO: 37167 - DNA, 21 bp, Homo sapiens
ccccactggcaccaaatccca

SEQ ID NO: 37168 - DNA, 21 bp, Homo sapiens
ccttgaagatgccccacccca

SEQ ID NO: 37169 - DNA, 23 bp, Homo sapiens
ctctgacggtgggagggtcacgg

SEQ ID NO: 37170 - DNA, 21 bp, Homo sapiens
cttccacgtgcagcacccagg

SEQ ID NO: 37171 - DNA, 23 bp, Homo sapiens
gagcactggaacctcagatccag

SEQ ID NO: 37172 - DNA, 19 bp, Homo sapiens
gctactggggattttgtat

SEQ ID NO: 37173 - DNA, 20 bp, Homo sapiens
taggtggacctcagagagga

SEQ ID NO: 37174 - DNA, 21 bp, Homo sapiens
agtttacatcgagcaaagtga

SEQ ID NO: 37175 - DNA, 23 bp, Homo sapiens
ggggacctggtggcagcggcggc

SEQ ID NO: 37176 - DNA, 20 bp, Homo sapiens
tatcactagagttcacctct

SEQ ID NO: 37177 - DNA, 17 bp, Homo sapiens
tgatggactgagtgaag

SEQ ID NO: 37178 - DNA, 16 bp, Homo sapiens
ttcagatgagaatcca

SEQ ID NO: 37179 - DNA, 19 bp, Homo sapiens
caaccctcctcccctgccc

SEQ ID NO: 37180 - DNA, 15 bp, Homo sapiens
cacagcccttggctg

SEQ ID NO: 37181 - DNA, 19 bp, Homo sapiens
ccaggcggtccatgttgaa

SEQ ID NO: 37182 - DNA, 21 bp, Homo sapiens
gaaagggcaacctccctttca

SEQ ID NO: 37183 - DNA, 19 bp, Homo sapiens
gacggctcccacttccttt

SEQ ID NO: 37184 - DNA, 20 bp, Homo sapiens
tctgctgggccctgaaggag

SEQ ID NO: 37185 - DNA, 21 bp, Homo sapiens
aataagcgaagccctgaagca

SEQ ID NO: 37186 - DNA, 18 bp, Homo sapiens
caggaagacaatggtgtt

SEQ ID NO: 37187 - DNA, 16 bp, Homo sapiens
cctcgccagcaccccg

SEQ ID NO: 37188 - DNA, 26 bp, Homo sapiens
cttcaccaaggagaccctggcatcac

SEQ ID NO: 37189 - DNA, 23 bp, Homo sapiens
tctctgcaggaagacaatggtgt

SEQ ID NO: 37190 - DNA, 23 bp, Homo sapiens
caggggagaactagatcctttca

SEQ ID NO: 37191 - DNA, 16 bp, Homo sapiens
acaagtccctgcctca

SEQ ID NO: 37192 - DNA, 22 bp, Homo sapiens
accacctcgctgctgttccact

SEQ ID NO: 37193 - DNA, 15 bp, Homo sapiens
atcatgggctttgga

SEQ ID NO: 37194 - DNA, 18 bp, Homo sapiens
caaccctgtggctgccct

SEQ ID NO: 37195 - DNA, 22 bp, Homo sapiens
tcttgttgatttgctgcctcca

SEQ ID NO: 37196 - DNA, 20 bp, Homo sapiens
tgtgtcttaggttggcattc

SEQ ID NO: 37197 - DNA, 19 bp, Homo sapiens
agcaaacccagaatactcc

SEQ ID NO: 37198 - DNA, 22 bp, Homo sapiens
cagccgctagtcagaaccacca

SEQ ID NO: 37199 - DNA, 23 bp, Homo sapiens
actttgggaaattcatctggtca

SEQ ID NO: 37200 - DNA, 17 bp, Homo sapiens
caacatatcaactcaca

SEQ ID NO: 37201 - DNA, 19 bp, Homo sapiens
gcagaattcctgccaaagc

SEQ ID NO: 37202 - DNA, 18 bp, Homo sapiens
ggggacagctgctgtggc

SEQ ID NO: 37203 - DNA, 22 bp, Homo sapiens
ggttctacttaacctcactgta

SEQ ID NO: 37204 - DNA, 18 bp, Homo sapiens
taattccagactctgatc

SEQ ID NO: 37205 - DNA, 16 bp, Homo sapiens
tgtcaagaagcattga

SEQ ID NO: 37206 - DNA, 21 bp, Homo sapiens
atatgtatcctgattgccagg

SEQ ID NO: 37207 - DNA, 17 bp, Homo sapiens
gacagggagggtcacct

SEQ ID NO: 37208 - DNA, 17 bp, Homo sapiens
caaaagctctctccctt

SEQ ID NO: 37209 - DNA, 19 bp, Homo sapiens
ggagaaaatgggtacatca

SEQ ID NO: 37210 - DNA, 20 bp, Homo sapiens
agaatgtgattatctggttg

SEQ ID NO: 37211 - DNA, 19 bp, Homo sapiens
gtgggtgggggaggaagtt

SEQ ID NO: 37212 - DNA, 19 bp, Homo sapiens
tataacaatccagtcctca

SEQ ID NO: 37213 - DNA, 18 bp, Homo sapiens
tccacctcctgggttcaa

SEQ ID NO: 37214 - DNA, 16 bp, Homo sapiens
tctaaatcggtagcat

SEQ ID NO: 37215 - DNA, 18 bp, Homo sapiens
tgaaaattctgccggcga

SEQ ID NO: 37216 - DNA, 21 bp, Homo sapiens
tgtctgtggaatgagaaggga

SEQ ID NO: 37217 - DNA, 16 bp, Homo sapiens
aatggactggaaattg

SEQ ID NO: 37218 - DNA, 20 bp, Homo sapiens
acattactttagaagatatg

SEQ ID NO: 37219 - DNA, 16 bp, Homo sapiens
agtgcattctgtgcta

SEQ ID NO: 37220 - DNA, 17 bp, Homo sapiens
tcatgatccatctctgg

SEQ ID NO: 37221 - DNA, 20 bp, Homo sapiens
gagtgctccttgctctgtaa

SEQ ID NO: 37222 - DNA, 19 bp, Homo sapiens
gggcatcaacctcacccca

SEQ ID NO: 37223 - DNA, 18 bp, Homo sapiens
cgcagacctcacaacatc

SEQ ID NO: 37224 - DNA, 15 bp, Homo sapiens
aaacagggccacttg

SEQ ID NO: 37225 - DNA, 21 bp, Homo sapiens
agccacagggaccccaggaag

SEQ ID NO: 37226 - DNA, 20 bp, Homo sapiens
caaccttagccctctcccct

SEQ ID NO: 37227 - DNA, 16 bp, Homo sapiens
cccaatgtctgctcca

SEQ ID NO: 37228 - DNA, 20 bp, Homo sapiens
cctgcttcctctccatctca

SEQ ID NO: 37229 - DNA, 19 bp, Homo sapiens
gtccaggaaagaacagcct

SEQ ID NO: 37230 - DNA, 21 bp, Homo sapiens
gtttctgcagccagtaagtca

SEQ ID NO: 37231 - DNA, 17 bp, Homo sapiens
tctacggaagatgtggc

SEQ ID NO: 37232 - DNA, 23 bp, Homo sapiens
ttgaacctatcttctccctgctt

SEQ ID NO: 37233 - DNA, 26 bp, Homo sapiens
gcctccatcctcccctagaggggtca

SEQ ID NO: 37234 - DNA, 29 bp, Homo sapiens
tattcaagtagaaaagttaactaaatggt

SEQ ID NO: 37235 - DNA, 20 bp, Homo sapiens
tgaaacgtggtgtctggttt

SEQ ID NO: 37236 - DNA, 22 bp, Homo sapiens
aaactaatccttagctatccaa

SEQ ID NO: 37237 - DNA, 18 bp, Homo sapiens
acaactcttaatttctca

SEQ ID NO: 37238 - DNA, 21 bp, Homo sapiens
accatatttctccccactctg

SEQ ID NO: 37239 - DNA, 21 bp, Homo sapiens
atgtggagcagggccacgtga

SEQ ID NO: 37240 - DNA, 23 bp, Homo sapiens
caaacagacctcctgcccatcca

SEQ ID NO: 37241 - DNA, 24 bp, Homo sapiens
cggggcgcaccccccactacctcc

SEQ ID NO: 37242 - DNA, 18 bp, Homo sapiens
gcagcacagggctgcatc

SEQ ID NO: 37243 - DNA, 17 bp, Homo sapiens
gcccagagtccgtccag

SEQ ID NO: 37244 - DNA, 22 bp, Homo sapiens
gcttctctgggtcccactctct

SEQ ID NO: 37245 - DNA, 30 bp, Homo sapiens
tacagccccacaaggtcagcatccacatca

SEQ ID NO: 37246 - DNA, 21 bp, Homo sapiens
tgaagagttttctgccaatga

SEQ ID NO: 37247 - DNA, 24 bp, Homo sapiens
tgagcactgacccacagcactaca

SEQ ID NO: 37248 - DNA, 18 bp, Homo sapiens
ttcctagtgaccatccag

SEQ ID NO: 37249 - DNA, 20 bp, Homo sapiens
tttccatgtcacagctccac

SEQ ID NO: 37250 - DNA, 21 bp, Homo sapiens
tgcccaggcaaaagcagggaa

SEQ ID NO: 37251 - DNA, 19 bp, Homo sapiens
cctggaggctgccaagggc

SEQ ID NO: 37252 - DNA, 20 bp, Homo sapiens
ctccaggccccgcacgtgct

SEQ ID NO: 37253 - DNA, 21 bp, Homo sapiens
tagacacaaacatatacgcct

SEQ ID NO: 37254 - DNA, 18 bp, Homo sapiens
tgttgtggatttatttac

SEQ ID NO: 37255 - DNA, 21 bp, Homo sapiens
tctacctcaccatcaatgtca

SEQ ID NO: 37256 - DNA, 19 bp, Homo sapiens
ggaaaggcaggcagaggga

SEQ ID NO: 37257 - DNA, 22 bp, Homo sapiens
ctttggtggttaaggtttgtga

SEQ ID NO: 37258 - DNA, 21 bp, Homo sapiens
gtttcttcctgttgatattca

SEQ ID NO: 37259 - DNA, 22 bp, Homo sapiens
ccctgtgcagggggttctgtgg

SEQ ID NO: 37260 - DNA, 22 bp, Homo sapiens
cgccattaccctcttctgcccc

SEQ ID NO: 37261 - DNA, 21 bp, Homo sapiens
gcaaagcactcaacagccacc

SEQ ID NO: 37262 - DNA, 21 bp, Homo sapiens
gcaggtggagggctcttcctc

SEQ ID NO: 37263 - DNA, 21 bp, Homo sapiens
gctcttcctccagtggctcgt

SEQ ID NO: 37264 - DNA, 17 bp, Homo sapiens
acggcaaacgcggagct

SEQ ID NO: 37265 - DNA, 19 bp, Homo sapiens
tctgatgaatgactgtccc

SEQ ID NO: 37266 - DNA, 19 bp, Homo sapiens
gctgcttgttcccatttta

SEQ ID NO: 37267 - DNA, 17 bp, Homo sapiens
aaacagaagccacactg

SEQ ID NO: 37268 - DNA, 18 bp, Homo sapiens
aaacatcctcaggcttct

SEQ ID NO: 37269 - DNA, 18 bp, Homo sapiens
cttctgtgaagctcccat

SEQ ID NO: 37270 - DNA, 21 bp, Homo sapiens
tcacactggttccatttcctt

SEQ ID NO: 37271 - DNA, 18 bp, Homo sapiens
gaatcagtgttgggactc

SEQ ID NO: 37272 - DNA, 17 bp, Homo sapiens
tcaagtgattctcctgc

SEQ ID NO: 37273 - DNA, 18 bp, Homo sapiens
tccgcctcctgggttcaa

SEQ ID NO: 37274 - DNA, 22 bp, Homo sapiens
ttgctccccacctcccatccct

SEQ ID NO: 37275 - DNA, 20 bp, Homo sapiens
gtggacggggagaactctga

SEQ ID NO: 37276 - DNA, 19 bp, Homo sapiens
caaggtatttggtggaagc

SEQ ID NO: 37277 - DNA, 17 bp, Homo sapiens
ccccctcccaggggtca

SEQ ID NO: 37278 - DNA, 17 bp, Homo sapiens
agggaagcccggggtct

SEQ ID NO: 37279 - DNA, 19 bp, Homo sapiens
cccgggctgcgccccagca

SEQ ID NO: 37280 - DNA, 21 bp, Homo sapiens
ccgcggaccttccacaacgac

SEQ ID NO: 37281 - DNA, 21 bp, Homo sapiens
cagacaggtcagagaccactg

SEQ ID NO: 37282 - DNA, 20 bp, Homo sapiens
cagggtccagctcctcctca

SEQ ID NO: 37283 - DNA, 22 bp, Homo sapiens
ccaacaagcttaacacccacca

SEQ ID NO: 37284 - DNA, 23 bp, Homo sapiens
ggacagggagggagcatccccct

SEQ ID NO: 37285 - DNA, 18 bp, Homo sapiens
ggaggaggaggccaggga

SEQ ID NO: 37286 - DNA, 20 bp, Homo sapiens
ggaggaggaggccagggaca

SEQ ID NO: 37287 - DNA, 20 bp, Homo sapiens
gtgcaaattgcaggcactga

SEQ ID NO: 37288 - DNA, 18 bp, Homo sapiens
tccttgtgaaggctgtta

SEQ ID NO: 37289 - DNA, 22 bp, Homo sapiens
tgaagaactcagactcagagtg

SEQ ID NO: 37290 - DNA, 21 bp, Homo sapiens
tttcggggctacaaaggatct

SEQ ID NO: 37291 - DNA, 20 bp, Homo sapiens
gatcattggcctttggacca

SEQ ID NO: 37292 - DNA, 20 bp, Homo sapiens
gcaatgctgccgggagctct

SEQ ID NO: 37293 - DNA, 25 bp, Homo sapiens
tgaagtttgcactggcacctaccac

SEQ ID NO: 37294 - DNA, 21 bp, Homo sapiens
ccagtggcaggagcgccgcgc

SEQ ID NO: 37295 - DNA, 19 bp, Homo sapiens
ccggctgcggggccagtgg

SEQ ID NO: 37296 - DNA, 20 bp, Homo sapiens
gagcattaatgttttctgaa

SEQ ID NO: 37297 - DNA, 25 bp, Homo sapiens
gcgcccacactgactagagccaacc

SEQ ID NO: 37298 - DNA, 22 bp, Homo sapiens
aagggagcgactgcctggggtc

SEQ ID NO: 37299 - DNA, 19 bp, Homo sapiens
ctattttccaccctgcaga

SEQ ID NO: 37300 - DNA, 20 bp, Homo sapiens
ctattttccaccctgcagag

SEQ ID NO: 37301 - DNA, 17 bp, Homo sapiens
actggtggccagcgtgg

SEQ ID NO: 37302 - DNA, 25 bp, Homo sapiens
agcggtgatgagctccacaccccca

SEQ ID NO: 37303 - DNA, 21 bp, Homo sapiens
agtggaggaaggtgtgctgtg

SEQ ID NO: 37304 - DNA, 20 bp, Homo sapiens
caacctcttcatcctgcccc

SEQ ID NO: 37305 - DNA, 19 bp, Homo sapiens
acacacaaacaaaataaac

SEQ ID NO: 37306 - DNA, 24 bp, Homo sapiens
acacttctagggtaaagcatttta

SEQ ID NO: 37307 - DNA, 17 bp, Homo sapiens
atggattcattctttca

SEQ ID NO: 37308 - DNA, 20 bp, Homo sapiens
ccacactgacacacaaacaa

SEQ ID NO: 37309 - DNA, 21 bp, Homo sapiens
ccaggcctggtccatgagaca

SEQ ID NO: 37310 - DNA, 18 bp, Homo sapiens
cccgcaacctccgcctcc

SEQ ID NO: 37311 - DNA, 18 bp, Homo sapiens
ctggccaaaacaaaaaca

SEQ ID NO: 37312 - DNA, 23 bp, Homo sapiens
gctcttttaggagtatctgggga

SEQ ID NO: 37313 - DNA, 23 bp, Homo sapiens
gtcactcttacacactttttaca

SEQ ID NO: 37314 - DNA, 20 bp, Homo sapiens
tcaaacatccgcattctcct

SEQ ID NO: 37315 - DNA, 21 bp, Homo sapiens
tgggctcaaatgctctcccca

SEQ ID NO: 37316 - DNA, 17 bp, Homo sapiens
ttctcctgcttctgcct

SEQ ID NO: 37317 - DNA, 19 bp, Homo sapiens
cctggccacaccttctcgg

SEQ ID NO: 37318 - DNA, 22 bp, Homo sapiens
cttgggctgcgtcaagtcactt

SEQ ID NO: 37319 - DNA, 20 bp, Homo sapiens
ggacattttcatagcctcct

SEQ ID NO: 37320 - DNA, 18 bp, Homo sapiens
ctttaaatggaccatcca

SEQ ID NO: 37321 - DNA, 17 bp, Homo sapiens
tccttgccttgatcagg

SEQ ID NO: 37322 - DNA, 19 bp, Homo sapiens
tcgccactttcttgctgct

SEQ ID NO: 37323 - DNA, 22 bp, Homo sapiens
ccaccccaatgccctcacctgc

SEQ ID NO: 37324 - DNA, 22 bp, Homo sapiens
ccaccccaatgccctcacctgc

SEQ ID NO: 37325 - DNA, 22 bp, Homo sapiens
ccaccccaatgccctcacctgc

SEQ ID NO: 37326 - DNA, 22 bp, Homo sapiens
agatctctggaatcgttgcagg

SEQ ID NO: 37327 - DNA, 18 bp, Homo sapiens
gccaagagaaaaatatac

SEQ ID NO: 37328 - DNA, 22 bp, Homo sapiens
tactacagttcccatgctctga

SEQ ID NO: 37329 - DNA, 19 bp, Homo sapiens
agtgctcatttggattgca

SEQ ID NO: 37330 - DNA, 17 bp, Homo sapiens
aacaacgtgttcaagca

SEQ ID NO: 37331 - DNA, 18 bp, Homo sapiens
actattttgttttatgac

SEQ ID NO: 37332 - DNA, 18 bp, Homo sapiens
agctcactaaatgtgctg

SEQ ID NO: 37333 - DNA, 17 bp, Homo sapiens
ggcttaacatgaaactg

SEQ ID NO: 37334 - DNA, 21 bp, Homo sapiens
ttgaaatatatttttgtgaga

SEQ ID NO: 37335 - DNA, 20 bp, Homo sapiens
ctggagctccacgcatccta

SEQ ID NO: 37336 - DNA, 18 bp, Homo sapiens
gacggtaccaccatccca

SEQ ID NO: 37337 - DNA, 23 bp, Homo sapiens
ggctgccatcaacacccacatca

SEQ ID NO: 37338 - DNA, 25 bp, Homo sapiens
taccaccatcccagctgtgaggctg

SEQ ID NO: 37339 - DNA, 20 bp, Homo sapiens
ccgtgtgggagatctgtgag

SEQ ID NO: 37340 - DNA, 15 bp, Homo sapiens
aatgtcatttactgg

SEQ ID NO: 37341 - DNA, 17 bp, Homo sapiens
attacaacatctgctga

SEQ ID NO: 37342 - DNA, 16 bp, Homo sapiens
ggcgctacggccgggt

SEQ ID NO: 37343 - DNA, 18 bp, Homo sapiens
gggatcacctgccttttt

SEQ ID NO: 37344 - DNA, 20 bp, Homo sapiens
ccctgaagccacaagccttg

SEQ ID NO: 37345 - DNA, 19 bp, Homo sapiens
ttttcttgggtgagcatga

SEQ ID NO: 37346 - DNA, 18 bp, Homo sapiens
gcgcttaaaacattgtga

SEQ ID NO: 37347 - DNA, 22 bp, Homo sapiens
actaattataagagaattcata

SEQ ID NO: 37348 - DNA, 22 bp, Homo sapiens
agttataacggcaaattgctga

SEQ ID NO: 37349 - DNA, 23 bp, Homo sapiens
ccaaacagtgtgcaaaactcaca

SEQ ID NO: 37350 - DNA, 19 bp, Homo sapiens
ttaaagttataacggcaaa

SEQ ID NO: 37351 - DNA, 22 bp, Homo sapiens
tttcttcttttgctataatttt

SEQ ID NO: 37352 - DNA, 25 bp, Homo sapiens
tttttttaacagttgtcttgttttt

SEQ ID NO: 37353 - DNA, 17 bp, Homo sapiens
tgaaggctggaaaagag

SEQ ID NO: 37354 - DNA, 21 bp, Homo sapiens
cagcacatgttaactctcctc

SEQ ID NO: 37355 - DNA, 18 bp, Homo sapiens
tatattgctattgtcact

SEQ ID NO: 37356 - DNA, 16 bp, Homo sapiens
ccccaactccctacca

SEQ ID NO: 37357 - DNA, 17 bp, Homo sapiens
tcttgctcaaaagatct

SEQ ID NO: 37358 - DNA, 19 bp, Homo sapiens
gtgtctagcacatactaca

SEQ ID NO: 37359 - DNA, 20 bp, Homo sapiens
ttcaagaccagcctgaccaa

SEQ ID NO: 37360 - DNA, 18 bp, Homo sapiens
aagctctgagttactttt

SEQ ID NO: 37361 - DNA, 19 bp, Homo sapiens
agaaggggacatacaggcc

SEQ ID NO: 37362 - DNA, 24 bp, Homo sapiens
ataaaacacatcaggtttgcttca

SEQ ID NO: 37363 - DNA, 20 bp, Homo sapiens
ccgaaagaggagcccctgga

SEQ ID NO: 37364 - DNA, 22 bp, Homo sapiens
gaaaggatttgagtacaggaca

SEQ ID NO: 37365 - DNA, 18 bp, Homo sapiens
gacaattccagcactcta

SEQ ID NO: 37366 - DNA, 17 bp, Homo sapiens
gtaactaaatctgctgc

SEQ ID NO: 37367 - DNA, 18 bp, Homo sapiens
tggcttcattttctacat

SEQ ID NO: 37368 - DNA, 19 bp, Homo sapiens
tgtttcagatgtgcaggga

SEQ ID NO: 37369 - DNA, 21 bp, Homo sapiens
atccccagcgccctgcgggcc

SEQ ID NO: 37370 - DNA, 17 bp, Homo sapiens
caggctcctcgtcaccc

SEQ ID NO: 37371 - DNA, 17 bp, Homo sapiens
agtgacaaacatgcctc

SEQ ID NO: 37372 - DNA, 21 bp, Homo sapiens
atcttggctcactgcaacctc

SEQ ID NO: 37373 - DNA, 18 bp, Homo sapiens
cctgcaacctccacctcc

SEQ ID NO: 37374 - DNA, 18 bp, Homo sapiens
tccacctcccgggttcaa

SEQ ID NO: 37375 - DNA, 23 bp, Homo sapiens
gtcaaaatagttttggggatcac

SEQ ID NO: 37376 - DNA, 22 bp, Homo sapiens
taaatgggaattcatgaaatta

SEQ ID NO: 37377 - DNA, 21 bp, Homo sapiens
agtaagatacccaagtcctca

SEQ ID NO: 37378 - DNA, 22 bp, Homo sapiens
caaggtgatgtcattgggccta

SEQ ID NO: 37379 - DNA, 22 bp, Homo sapiens
gaagaaacctggatgaacctaa

SEQ ID NO: 37380 - DNA, 18 bp, Homo sapiens
tgggagtacctcaggcgg

SEQ ID NO: 37381 - DNA, 21 bp, Homo sapiens
cttgtcaatgaaaacactctg

SEQ ID NO: 37382 - DNA, 21 bp, Homo sapiens
ctctgagtcacggtctgtgag

SEQ ID NO: 37383 - DNA, 17 bp, Homo sapiens
gcggctgtcggctggca

SEQ ID NO: 37384 - DNA, 17 bp, Homo sapiens
agaagccactccagtga

SEQ ID NO: 37385 - DNA, 21 bp, Homo sapiens
agtctcactctgtcacccagc

SEQ ID NO: 37386 - DNA, 18 bp, Homo sapiens
cctgaaactccttggctt

SEQ ID NO: 37387 - DNA, 17 bp, Homo sapiens
gagcctgagaaatctta

SEQ ID NO: 37388 - DNA, 18 bp, Homo sapiens
tcttggctctttgatctt

SEQ ID NO: 37389 - DNA, 18 bp, Homo sapiens
ttccagaagccactccag

SEQ ID NO: 37390 - DNA, 22 bp, Homo sapiens
cccactcaccgtccttgctgct

SEQ ID NO: 37391 - DNA, 20 bp, Homo sapiens
aagaatgctctttgtcttcc

SEQ ID NO: 37392 - DNA, 20 bp, Homo sapiens
aagaggtacccataaatgat

SEQ ID NO: 37393 - DNA, 22 bp, Homo sapiens
ccgagaggagccctctaccttg

SEQ ID NO: 37394 - DNA, 17 bp, Homo sapiens
agacctgaaactgcccc

SEQ ID NO: 37395 - DNA, 19 bp, Homo sapiens
atctgcatttggtgtatca

SEQ ID NO: 37396 - DNA, 17 bp, Homo sapiens
gcttcggcttttggcct

SEQ ID NO: 37397 - DNA, 20 bp, Homo sapiens
cctctcaagaaaacactgga

SEQ ID NO: 37398 - DNA, 23 bp, Homo sapiens
ctttttgaaattcgaggagctga

SEQ ID NO: 37399 - DNA, 18 bp, Homo sapiens
agctctcaaaattcctca

SEQ ID NO: 37400 - DNA, 19 bp, Homo sapiens
gtttcttgatgtcttttgg

SEQ ID NO: 37401 - DNA, 21 bp, Homo sapiens
tccttttttttttttaacccc

SEQ ID NO: 37402 - DNA, 23 bp, Homo sapiens
tcttcatgctactcttaacctcc

SEQ ID NO: 37403 - DNA, 18 bp, Homo sapiens
actcttatcgtcatctta

SEQ ID NO: 37404 - DNA, 18 bp, Homo sapiens
ctcaagttgttttagtct

SEQ ID NO: 37405 - DNA, 19 bp, Homo sapiens
gtttcttgatgtcttttgg

SEQ ID NO: 37406 - DNA, 19 bp, Homo sapiens
ttgggcattttctctctca

SEQ ID NO: 37407 - DNA, 19 bp, Homo sapiens
accatcccaagtcctttgt

SEQ ID NO: 37408 - DNA, 20 bp, Homo sapiens
cagtaaactttcaatgctgc

SEQ ID NO: 37409 - DNA, 20 bp, Homo sapiens
ggagtacaactactattgta

SEQ ID NO: 37410 - DNA, 17 bp, Homo sapiens
taacacctcaccattga

SEQ ID NO: 37411 - DNA, 22 bp, Homo sapiens
tttatttatggcagtattcata

SEQ ID NO: 37412 - DNA, 19 bp, Homo sapiens
aaggctggggctgcagcca

SEQ ID NO: 37413 - DNA, 19 bp, Homo sapiens
cctgaaccaatttcttcca

SEQ ID NO: 37414 - DNA, 18 bp, Homo sapiens
tttcacttgttttttaca

SEQ ID NO: 37415 - DNA, 21 bp, Homo sapiens
gtctccggctgcaccgagtgg

SEQ ID NO: 37416 - DNA, 21 bp, Homo sapiens
acctaaaaaatgcaaattcca

SEQ ID NO: 37417 - DNA, 20 bp, Homo sapiens
attgtgttcctcaaattcat

SEQ ID NO: 37418 - DNA, 25 bp, Homo sapiens
ccggggtaaaagaagcatgacctca

SEQ ID NO: 37419 - DNA, 24 bp, Homo sapiens
tttaggaaacaaagatggacttct

SEQ ID NO: 37420 - DNA, 22 bp, Homo sapiens
tttcatcaattgccttgacttt

SEQ ID NO: 37421 - DNA, 18 bp, Homo sapiens
ctgtgcaaaaatgtttgt

SEQ ID NO: 37422 - DNA, 27 bp, Homo sapiens
gcctgggcgctggagctgctgtggctc

SEQ ID NO: 37423 - DNA, 17 bp, Homo sapiens
aaaagcagcagctacta

SEQ ID NO: 37424 - DNA, 20 bp, Homo sapiens
acaaaagcagcagctactac

SEQ ID NO: 37425 - DNA, 23 bp, Homo sapiens
tctagtatgtctcaggtattttt

SEQ ID NO: 37426 - DNA, 19 bp, Homo sapiens
taccaatgagagcctcaca

SEQ ID NO: 37427 - DNA, 22 bp, Homo sapiens
actctttccccgccttctttgt

SEQ ID NO: 37428 - DNA, 19 bp, Homo sapiens
cctgaaaaggaccagtgga

SEQ ID NO: 37429 - DNA, 20 bp, Homo sapiens
tttgtttattccggacccac

SEQ ID NO: 37430 - DNA, 21 bp, Homo sapiens
cggggtcttggtgggtccagt

SEQ ID NO: 37431 - DNA, 18 bp, Homo sapiens
gcaggcctaagccggcca

SEQ ID NO: 37432 - DNA, 24 bp, Homo sapiens
gccccaggtcaagggctcttggga

SEQ ID NO: 37433 - DNA, 25 bp, Homo sapiens
gtctgggcctctggttgccttgtcc

SEQ ID NO: 37434 - DNA, 16 bp, Homo sapiens
tccagtggtaatggtg

SEQ ID NO: 37435 - DNA, 22 bp, Homo sapiens
agggtgcaccaggcccacccca

SEQ ID NO: 37436 - DNA, 22 bp, Homo sapiens
agggtgcaccaggcccgcccca

SEQ ID NO: 37437 - DNA, 22 bp, Homo sapiens
agggtgcaccaggcccgcccca

SEQ ID NO: 37438 - DNA, 22 bp, Homo sapiens
agggtgcaccagggccacccca

SEQ ID NO: 37439 - DNA, 24 bp, Homo sapiens
atagtgaataagatgcctcccaaa

SEQ ID NO: 37440 - DNA, 21 bp, Homo sapiens
ctatgtagtatatacacacat

SEQ ID NO: 37441 - DNA, 20 bp, Homo sapiens
aaagaatcacagagcataca

SEQ ID NO: 37442 - DNA, 21 bp, Homo sapiens
agcaccctggagactttgctc

SEQ ID NO: 37443 - DNA, 17 bp, Homo sapiens
attttaggcaaagaggt

SEQ ID NO: 37444 - DNA, 26 bp, Homo sapiens
cagggtggactgtgaccccttggcct

SEQ ID NO: 37445 - DNA, 18 bp, Homo sapiens
gaggcaggaaactacccc

SEQ ID NO: 37446 - DNA, 23 bp, Homo sapiens
gcctgaggccgctggtagacttt

SEQ ID NO: 37447 - DNA, 21 bp, Homo sapiens
tgcaaaaggaggtaagtttct

SEQ ID NO: 37448 - DNA, 21 bp, Homo sapiens
tctcaggccaagagctgcagg

SEQ ID NO: 37449 - DNA, 20 bp, Homo sapiens
caggtgcctgcactcgctgc

SEQ ID NO: 37450 - DNA, 19 bp, Homo sapiens
ccaggccgcccacgtccca

SEQ ID NO: 37451 - DNA, 19 bp, Homo sapiens
cgtgggagccgtgcgggtg

SEQ ID NO: 37452 - DNA, 21 bp, Homo sapiens
cttctagtggacattactgct

SEQ ID NO: 37453 - DNA, 23 bp, Homo sapiens
tgaaggagcttcagcgccagcca

SEQ ID NO: 37454 - DNA, 20 bp, Homo sapiens
gcttctctgggctgtgcctc

SEQ ID NO: 37455 - DNA, 22 bp, Homo sapiens
gtgtttttaccttggtgaatct

SEQ ID NO: 37456 - DNA, 16 bp, Homo sapiens
caagatttggctccaa

SEQ ID NO: 37457 - DNA, 18 bp, Homo sapiens
agctacagacaaaagcca

SEQ ID NO: 37458 - DNA, 23 bp, Homo sapiens
cagaggactttgtccaagtctca

SEQ ID NO: 37459 - DNA, 22 bp, Homo sapiens
ctgaagtgacactttttccaca

SEQ ID NO: 37460 - DNA, 22 bp, Homo sapiens
aaccaccacagtctctgtcaca

SEQ ID NO: 37461 - DNA, 20 bp, Homo sapiens
cctggcacacacaggcaccc

SEQ ID NO: 37462 - DNA, 19 bp, Homo sapiens
gacacatgcacacacatca

SEQ ID NO: 37463 - DNA, 21 bp, Homo sapiens
catcatcctgaggctgtgtca

SEQ ID NO: 37464 - DNA, 21 bp, Homo sapiens
ggtgatgctgactcgatggcc

SEQ ID NO: 37465 - DNA, 19 bp, Homo sapiens
taaatggacttattgaagc

SEQ ID NO: 37466 - DNA, 25 bp, Homo sapiens
ttccagacagaaccagtgtacatct

SEQ ID NO: 37467 - DNA, 19 bp, Homo sapiens
gttttacaggttactaaca

SEQ ID NO: 37468 - DNA, 21 bp, Homo sapiens
tctgaaataagattttatgaa

SEQ ID NO: 37469 - DNA, 19 bp, Homo sapiens
aaggcatccctcacctctg

SEQ ID NO: 37470 - DNA, 18 bp, Homo sapiens
catcatctggctgtgatg

SEQ ID NO: 37471 - DNA, 20 bp, Homo sapiens
cccgaagcatatggtggagc

SEQ ID NO: 37472 - DNA, 19 bp, Homo sapiens
cttaaagctcatcatgaaa

SEQ ID NO: 37473 - DNA, 19 bp, Homo sapiens
cttcttggtgtggtttgta

SEQ ID NO: 37474 - DNA, 24 bp, Homo sapiens
gcccatgagtccctgtgcagacca

SEQ ID NO: 37475 - DNA, 20 bp, Homo sapiens
agtcctaaaattggatccaa

SEQ ID NO: 37476 - DNA, 24 bp, Homo sapiens
gaaactccgtctcaaaacaaaaca

SEQ ID NO: 37477 - DNA, 16 bp, Homo sapiens
ttcttccttcaggtgt

SEQ ID NO: 37478 - DNA, 20 bp, Homo sapiens
tttgtcatctcatgataaca

SEQ ID NO: 37479 - DNA, 24 bp, Homo sapiens
agaacgggacagagcagctgccca

SEQ ID NO: 37480 - DNA, 17 bp, Homo sapiens
cagcaaatgccagcaat

SEQ ID NO: 37481 - DNA, 19 bp, Homo sapiens
cctttccactaaggactca

SEQ ID NO: 37482 - DNA, 22 bp, Homo sapiens
tctcttcagcaccctcagcctt

SEQ ID NO: 37483 - DNA, 20 bp, Homo sapiens
tgacacgggagctagcagca

SEQ ID NO: 37484 - DNA, 19 bp, Homo sapiens
tgcccagagtcattcccag

SEQ ID NO: 37485 - DNA, 19 bp, Homo sapiens
agaagaaacacttcccaca

SEQ ID NO: 37486 - DNA, 22 bp, Homo sapiens
cctgtgactgattttagtgata

SEQ ID NO: 37487 - DNA, 18 bp, Homo sapiens
cttggtatcccctggtct

SEQ ID NO: 37488 - DNA, 19 bp, Homo sapiens
gcagagtgaaggcatgtca

SEQ ID NO: 37489 - DNA, 19 bp, Homo sapiens
ttgatgaagaagaagatga

SEQ ID NO: 37490 - DNA, 21 bp, Homo sapiens
agggaagaaaacacatcccac

SEQ ID NO: 37491 - DNA, 17 bp, Homo sapiens
accttcacagtagtgat

SEQ ID NO: 37492 - DNA, 20 bp, Homo sapiens
cctctgcctcccaggttcaa

SEQ ID NO: 37493 - DNA, 19 bp, Homo sapiens
ctgcaacctctgcctccca

SEQ ID NO: 37494 - DNA, 21 bp, Homo sapiens
gtacttgataggattatgata

SEQ ID NO: 37495 - DNA, 18 bp, Homo sapiens
gttgtaacagaagagtga

SEQ ID NO: 37496 - DNA, 20 bp, Homo sapiens
taggtggacctgcttgaggt

SEQ ID NO: 37497 - DNA, 17 bp, Homo sapiens
tcaagtgattctcctgc

SEQ ID NO: 37498 - DNA, 19 bp, Homo sapiens
ctggcaggaaatttgcaaa

SEQ ID NO: 37499 - DNA, 26 bp, Homo sapiens
tcctataaacagaatgggcgaccaat

SEQ ID NO: 37500 - DNA, 18 bp, Homo sapiens
gtgaaaattattgcgtgc

SEQ ID NO: 37501 - DNA, 17 bp, Homo sapiens
tgatcaagtccttgcta

SEQ ID NO: 37502 - DNA, 21 bp, Homo sapiens
tgtctctcctgcacacatagc

SEQ ID NO: 37503 - DNA, 18 bp, Homo sapiens
atgtggatgaaaaacaga

SEQ ID NO: 37504 - DNA, 19 bp, Homo sapiens
caaagaaacgtggaatcca

SEQ ID NO: 37505 - DNA, 18 bp, Homo sapiens
ctacttccctctccacct

SEQ ID NO: 37506 - DNA, 19 bp, Homo sapiens
ctctccttcaagctgtctg

SEQ ID NO: 37507 - DNA, 19 bp, Homo sapiens
gggaggagggtgacaccca

SEQ ID NO: 37508 - DNA, 19 bp, Homo sapiens
tctgtcccttgctctcctt

SEQ ID NO: 37509 - DNA, 22 bp, Homo sapiens
aagaagagggaaaagccataga

SEQ ID NO: 37510 - DNA, 19 bp, Homo sapiens
atgttactgttgtcacacc

SEQ ID NO: 37511 - DNA, 17 bp, Homo sapiens
caacacctctatagtga

SEQ ID NO: 37512 - DNA, 19 bp, Homo sapiens
gaagtaaaatatggcacag

SEQ ID NO: 37513 - DNA, 18 bp, Homo sapiens
gctggagtactctggtga

SEQ ID NO: 37514 - DNA, 19 bp, Homo sapiens
tatggcacagagcattgaa

SEQ ID NO: 37515 - DNA, 19 bp, Homo sapiens
tccaatggccaaaatctgc

SEQ ID NO: 37516 - DNA, 24 bp, Homo sapiens
tgcctttgaccatcctcaaagcca

SEQ ID NO: 37517 - DNA, 22 bp, Homo sapiens
gccaaacctactaacaacactg

SEQ ID NO: 37518 - DNA, 22 bp, Homo sapiens
gagcaccctccctgcccgtctt

SEQ ID NO: 37519 - DNA, 22 bp, Homo sapiens
aactcttctaaggaaggacaca

SEQ ID NO: 37520 - DNA, 19 bp, Homo sapiens
cctgtctcaactaataata

SEQ ID NO: 37521 - DNA, 22 bp, Homo sapiens
gagccaagatcgtaccactgca

SEQ ID NO: 37522 - DNA, 24 bp, Homo sapiens
tagatggtttcccagtgtgagatt

SEQ ID NO: 37523 - DNA, 20 bp, Homo sapiens
actggtgcagctgctggcca

SEQ ID NO: 37524 - DNA, 21 bp, Homo sapiens
cacatcgccgccttgttcctc

SEQ ID NO: 37525 - DNA, 18 bp, Homo sapiens
gtgggcacgtttttggaa

SEQ ID NO: 37526 - DNA, 18 bp, Homo sapiens
tccctgcagggatttcac

SEQ ID NO: 37527 - DNA, 19 bp, Homo sapiens
aggtctcgccatattgctc

SEQ ID NO: 37528 - DNA, 23 bp, Homo sapiens
atgggcacgtgcccagaacacac

SEQ ID NO: 37529 - DNA, 21 bp, Homo sapiens
cgaggctgcagtgagctgtga

SEQ ID NO: 37530 - DNA, 17 bp, Homo sapiens
ccttaattacatttttg

SEQ ID NO: 37531 - DNA, 20 bp, Homo sapiens
tatccatttgtttgattaca

SEQ ID NO: 37532 - DNA, 18 bp, Homo sapiens
acccacctcgctttctca

SEQ ID NO: 37533 - DNA, 20 bp, Homo sapiens
agatcaccgcaggcgggttt

SEQ ID NO: 37534 - DNA, 21 bp, Homo sapiens
atagcaagtgatcctgcgata

SEQ ID NO: 37535 - DNA, 18 bp, Homo sapiens
acggtgacggcctggccc

SEQ ID NO: 37536 - DNA, 19 bp, Homo sapiens
acccagaaacaaaaatctc

SEQ ID NO: 37537 - DNA, 17 bp, Homo sapiens
catactactattccttt

SEQ ID NO: 37538 - DNA, 17 bp, Homo sapiens
cagtaagccaagaaaaa

SEQ ID NO: 37539 - DNA, 23 bp, Homo sapiens
cagtgagactgtacataattgca

SEQ ID NO: 37540 - DNA, 17 bp, Homo sapiens
ctactgatgttgttgat

SEQ ID NO: 37541 - DNA, 20 bp, Homo sapiens
cagatcccatcctgctcctc

SEQ ID NO: 37542 - DNA, 20 bp, Homo sapiens
cagatcccatcctgctcctc

SEQ ID NO: 37543 - DNA, 20 bp, Homo sapiens
cagatcccatcctgctcctc

SEQ ID NO: 37544 - DNA, 21 bp, Homo sapiens
cgaggctgcagtgagctgtga

SEQ ID NO: 37545 - DNA, 18 bp, Homo sapiens
gcctattgtgggacttca

SEQ ID NO: 37546 - DNA, 18 bp, Homo sapiens
taagtttttagtgagtgt

SEQ ID NO: 37547 - DNA, 20 bp, Homo sapiens
tgtgattgcaccactgcact

SEQ ID NO: 37548 - DNA, 20 bp, Homo sapiens
atctcttaaaatgaaatgaa

SEQ ID NO: 37549 - DNA, 19 bp, Homo sapiens
atctgagttaggcttggcc

SEQ ID NO: 37550 - DNA, 22 bp, Homo sapiens
gcactttaagggatgattatgt

SEQ ID NO: 37551 - DNA, 19 bp, Homo sapiens
tatagagactatttaacca

SEQ ID NO: 37552 - DNA, 19 bp, Homo sapiens
tatagttactggcattagg

SEQ ID NO: 37553 - DNA, 23 bp, Homo sapiens
tctgctgatgtcctgaccatgga

SEQ ID NO: 37554 - DNA, 19 bp, Homo sapiens
gtaatcagatgtgtagcaa

SEQ ID NO: 37555 - DNA, 23 bp, Homo sapiens
tccagcagaggacctcccaccca

SEQ ID NO: 37556 - DNA, 21 bp, Homo sapiens
ttcctattgacatctactgct

SEQ ID NO: 37557 - DNA, 21 bp, Homo sapiens
tttttatgccttcttaacttt

SEQ ID NO: 37558 - DNA, 18 bp, Homo sapiens
acccatctccgtagcagt

SEQ ID NO: 37559 - DNA, 18 bp, Homo sapiens
caaacagaagggaaaaca

SEQ ID NO: 37560 - DNA, 22 bp, Homo sapiens
ggaattcagtctttatcattga

SEQ ID NO: 37561 - DNA, 20 bp, Homo sapiens
cagttctttggaatcaccct

SEQ ID NO: 37562 - DNA, 21 bp, Homo sapiens
ctttgggttgtctttggcctt

SEQ ID NO: 37563 - DNA, 20 bp, Homo sapiens
gagacagtgtctgaaacagg

SEQ ID NO: 37564 - DNA, 22 bp, Homo sapiens
cttgccatctccttttcacttc

SEQ ID NO: 37565 - DNA, 17 bp, Homo sapiens
atcttgatctttggctt

SEQ ID NO: 37566 - DNA, 18 bp, Homo sapiens
attctttagaatccccca

SEQ ID NO: 37567 - DNA, 22 bp, Homo sapiens
ctggcctcaagtgatccttcca

SEQ ID NO: 37568 - DNA, 20 bp, Homo sapiens
gaaaatttgtaaagccacat

SEQ ID NO: 37569 - DNA, 21 bp, Homo sapiens
tgcacaggtcatcccgctccc

SEQ ID NO: 37570 - DNA, 18 bp, Homo sapiens
agactatatgctggtgct

SEQ ID NO: 37571 - DNA, 19 bp, Homo sapiens
agtgagtgggggagaaatg

SEQ ID NO: 37572 - DNA, 19 bp, Homo sapiens
ccagagcaagaaaagctga

SEQ ID NO: 37573 - DNA, 20 bp, Homo sapiens
ccgtgtgcagcaccttcctc

SEQ ID NO: 37574 - DNA, 19 bp, Homo sapiens
gagtacagcagctaagaaa

SEQ ID NO: 37575 - DNA, 24 bp, Homo sapiens
gaggaaataatacagattttggct

SEQ ID NO: 37576 - DNA, 21 bp, Homo sapiens
tgctctctgtacatgatactg

SEQ ID NO: 37577 - DNA, 18 bp, Homo sapiens
acgttccaaatacattat

SEQ ID NO: 37578 - DNA, 25 bp, Homo sapiens
agctacctcctctccacactgggga

SEQ ID NO: 37579 - DNA, 18 bp, Homo sapiens
ctgccttgccagcctgct

SEQ ID NO: 37580 - DNA, 21 bp, Homo sapiens
ggttctgactctgtcacccag

SEQ ID NO: 37581 - DNA, 22 bp, Homo sapiens
gtccagagacaggccctcctcc

SEQ ID NO: 37582 - DNA, 19 bp, Homo sapiens
tcagtggggttcaccttca

SEQ ID NO: 37583 - DNA, 20 bp, Homo sapiens
aaacactgtcaaggatttca

SEQ ID NO: 37584 - DNA, 18 bp, Homo sapiens
acgttccaaatacattat

SEQ ID NO: 37585 - DNA, 25 bp, Homo sapiens
agctacctcctctccacactgggga

SEQ ID NO: 37586 - DNA, 18 bp, Homo sapiens
ctgccttgccagcctgct

SEQ ID NO: 37587 - DNA, 21 bp, Homo sapiens
ggttctgactctgtcacccag

SEQ ID NO: 37588 - DNA, 19 bp, Homo sapiens
tcagtggggttcaccttca

SEQ ID NO: 37589 - DNA, 25 bp, Homo sapiens
tgagctctctattctgtttcattga

SEQ ID NO: 37590 - DNA, 18 bp, Homo sapiens
tttgctatttattcttgt

SEQ ID NO: 37591 - DNA, 16 bp, Homo sapiens
tcaaacagatgttgta

SEQ ID NO: 37592 - DNA, 18 bp, Homo sapiens
tgctgaggtgactgttga

SEQ ID NO: 37593 - DNA, 18 bp, Homo sapiens
aagtggtgatttttggtt

SEQ ID NO: 37594 - DNA, 18 bp, Homo sapiens
actcaggcccaggtccca

SEQ ID NO: 37595 - DNA, 19 bp, Homo sapiens
ccaactcagtcttcagtga

SEQ ID NO: 37596 - DNA, 19 bp, Homo sapiens
cctccactcccttgttgct

SEQ ID NO: 37597 - DNA, 19 bp, Homo sapiens
ctagggctgcctttgcttt

SEQ ID NO: 37598 - DNA, 23 bp, Homo sapiens
gtttgaattgcccaaagttgccc

SEQ ID NO: 37599 - DNA, 23 bp, Homo sapiens
tcccacaacaatggctaaccaat

SEQ ID NO: 37600 - DNA, 21 bp, Homo sapiens
tcctggtggtggaggtggggg

SEQ ID NO: 37601 - DNA, 21 bp, Homo sapiens
ccttggcgactttttctttgt

SEQ ID NO: 37602 - DNA, 22 bp, Homo sapiens
ttgtggtggggagaaaaagcta

SEQ ID NO: 37603 - DNA, 19 bp, Homo sapiens
aaagggtggaagaaccatc

SEQ ID NO: 37604 - DNA, 18 bp, Homo sapiens
agggtggaagaaccatca

SEQ ID NO: 37605 - DNA, 21 bp, Homo sapiens
atccatcatcttcaaaggcta

SEQ ID NO: 37606 - DNA, 23 bp, Homo sapiens
catctgcaatggttgtggacctg

SEQ ID NO: 37607 - DNA, 24 bp, Homo sapiens
cttttttgtccttgcttttacctt

SEQ ID NO: 37608 - DNA, 17 bp, Homo sapiens
gcccagaagtggcccag

SEQ ID NO: 37609 - DNA, 23 bp, Homo sapiens
gggtgatgcttccaagctgacca

SEQ ID NO: 37610 - DNA, 21 bp, Homo sapiens
tcactattaaataaacagtcc

SEQ ID NO: 37611 - DNA, 17 bp, Homo sapiens
acttcggctgtctgcct

SEQ ID NO: 37612 - DNA, 23 bp, Homo sapiens
atccaagtgactttaaatctgcc

SEQ ID NO: 37613 - DNA, 22 bp, Homo sapiens
cctctgagcacttgggcagcca

SEQ ID NO: 37614 - DNA, 20 bp, Homo sapiens
cccattcctgccgccggcga

SEQ ID NO: 37615 - DNA, 21 bp, Homo sapiens
aacaatgtttgagaacctctg

SEQ ID NO: 37616 - DNA, 20 bp, Homo sapiens
agtgatgctgtgatacctta

SEQ ID NO: 37617 - DNA, 18 bp, Homo sapiens
cagtgctgctgtaactga

SEQ ID NO: 37618 - DNA, 19 bp, Homo sapiens
cctatagttgacaattctg

SEQ ID NO: 37619 - DNA, 17 bp, Homo sapiens
gaaaaagaacaacatca

SEQ ID NO: 37620 - DNA, 17 bp, Homo sapiens
gccacacctcagcctcc

SEQ ID NO: 37621 - DNA, 22 bp, Homo sapiens
gcgttagcaacactgctcacca

SEQ ID NO: 37622 - DNA, 20 bp, Homo sapiens
gcacctctgttttcccttct

SEQ ID NO: 37623 - DNA, 19 bp, Homo sapiens
acttcagagcccgccctct

SEQ ID NO: 37624 - DNA, 24 bp, Homo sapiens
agattctagttctcaacctctcca

SEQ ID NO: 37625 - DNA, 21 bp, Homo sapiens
gcccccccacaccctccttca

SEQ ID NO: 37626 - DNA, 19 bp, Homo sapiens
ggactgtgatccctggccc

SEQ ID NO: 37627 - DNA, 20 bp, Homo sapiens
ggcttccgtgatcccgtttt

SEQ ID NO: 37628 - DNA, 19 bp, Homo sapiens
ccttcccagtttctcccca

SEQ ID NO: 37629 - DNA, 20 bp, Homo sapiens
taaaaacaggtaagctgcta

SEQ ID NO: 37630 - DNA, 18 bp, Homo sapiens
attaagaatgaagctgat

SEQ ID NO: 37631 - DNA, 24 bp, Homo sapiens
aacatacccacaaatgcctatgat

SEQ ID NO: 37632 - DNA, 22 bp, Homo sapiens
caagctttgtagtggttgcaca

SEQ ID NO: 37633 - DNA, 21 bp, Homo sapiens
tttgcagggagatttctgatg

SEQ ID NO: 37634 - DNA, 19 bp, Homo sapiens
ccttgtcaagactgtcaaa

SEQ ID NO: 37635 - DNA, 21 bp, Homo sapiens
gatggctttgccacaccaggc

SEQ ID NO: 37636 - DNA, 21 bp, Homo sapiens
gcctgcacagatctctggttc

SEQ ID NO: 37637 - DNA, 18 bp, Homo sapiens
tgaagagagatcttagag

SEQ ID NO: 37638 - DNA, 21 bp, Homo sapiens
cacggccaccatggcgtatca

SEQ ID NO: 37639 - DNA, 20 bp, Homo sapiens
ccttcttgcaacctcttccc

SEQ ID NO: 37640 - DNA, 18 bp, Homo sapiens
ctgggtaccgccagaaga

SEQ ID NO: 37641 - DNA, 19 bp, Homo sapiens
gaagtttaacaaaacccga

SEQ ID NO: 37642 - DNA, 23 bp, Homo sapiens
gcttacgttgccatgatccctca

SEQ ID NO: 37643 - DNA, 24 bp, Homo sapiens
aatctttttcttgaaattacctcc

SEQ ID NO: 37644 - DNA, 16 bp, Homo sapiens
cctggactatcagcag

SEQ ID NO: 37645 - DNA, 22 bp, Homo sapiens
gaatgatgcaatgaaagaattt

SEQ ID NO: 37646 - DNA, 20 bp, Homo sapiens
tagcaaaatgcatttaaata

SEQ ID NO: 37647 - DNA, 19 bp, Homo sapiens
tattactcatttttcttga

SEQ ID NO: 37648 - DNA, 20 bp, Homo sapiens
ttgaaaagattttatcagga

SEQ ID NO: 37649 - DNA, 19 bp, Homo sapiens
aaacttctgacctcaggtg

SEQ ID NO: 37650 - DNA, 20 bp, Homo sapiens
cctccaaaccttcagacctc

SEQ ID NO: 37651 - DNA, 20 bp, Homo sapiens
gcaatgattgaaccacttct

SEQ ID NO: 37652 - DNA, 22 bp, Homo sapiens
ggtagtggggaggcaagttgtg

SEQ ID NO: 37653 - DNA, 23 bp, Homo sapiens
taggaaacaggattgggcctgtt

SEQ ID NO: 37654 - DNA, 18 bp, Homo sapiens
tcctttctgaacactgga

SEQ ID NO: 37655 - DNA, 21 bp, Homo sapiens
tgtgaaaaatgtgtttttgga

SEQ ID NO: 37656 - DNA, 22 bp, Homo sapiens
aaaatgataggtaaaaagatct

SEQ ID NO: 37657 - DNA, 21 bp, Homo sapiens
aaacatttcaggatttaaatt

SEQ ID NO: 37658 - DNA, 20 bp, Homo sapiens
aacatttcaggatttaaatt

SEQ ID NO: 37659 - DNA, 17 bp, Homo sapiens
aatttttggattctggg

SEQ ID NO: 37660 - DNA, 22 bp, Homo sapiens
gccgagtcatatcatgatgcca

SEQ ID NO: 37661 - DNA, 22 bp, Homo sapiens
tactttttatgtatcattgcta

SEQ ID NO: 37662 - DNA, 20 bp, Homo sapiens
tcaaatgtgcacattcttta

SEQ ID NO: 37663 - DNA, 24 bp, Homo sapiens
tgtgatgatgtataccaactataa

SEQ ID NO: 37664 - DNA, 23 bp, Homo sapiens
aatattttttaaagcactactca

SEQ ID NO: 37665 - DNA, 22 bp, Homo sapiens
agacaatacagttattaacata

SEQ ID NO: 37666 - DNA, 19 bp, Homo sapiens
caaccttagaaaagacaat

SEQ ID NO: 37667 - DNA, 26 bp, Homo sapiens
ccaaatctatctgagttgtataccca

SEQ ID NO: 37668 - DNA, 19 bp, Homo sapiens
ccccgccccccgtcactgc

SEQ ID NO: 37669 - DNA, 25 bp, Homo sapiens
cctcttacaagctgcttttggcttt

SEQ ID NO: 37670 - DNA, 21 bp, Homo sapiens
gagcaagctgtcctgagccca

SEQ ID NO: 37671 - DNA, 20 bp, Homo sapiens
gtatgctataggcatcattc

SEQ ID NO: 37672 - DNA, 20 bp, Homo sapiens
tacaagctgcttttggcttt

SEQ ID NO: 37673 - DNA, 18 bp, Homo sapiens
cttgcctgcacttcttga

SEQ ID NO: 37674 - DNA, 21 bp, Homo sapiens
ttcacttgctccttcacttcc

SEQ ID NO: 37675 - DNA, 25 bp, Homo sapiens
caagaagtctgggctgggtccagtc

SEQ ID NO: 37676 - DNA, 18 bp, Homo sapiens
acaccgtcagcgctccca

SEQ ID NO: 37677 - DNA, 19 bp, Homo sapiens
cccccaagggtcttcccac

SEQ ID NO: 37678 - DNA, 17 bp, Homo sapiens
cctggaaggtgatggtg

SEQ ID NO: 37679 - DNA, 17 bp, Homo sapiens
ctcccctttttcatctg

SEQ ID NO: 37680 - DNA, 21 bp, Homo sapiens
ctcccctttttcatctgcaca

SEQ ID NO: 37681 - DNA, 21 bp, Homo sapiens
gaggagggggctccaatgaca

SEQ ID NO: 37682 - DNA, 21 bp, Homo sapiens
agaagaacttagggagcgaga

SEQ ID NO: 37683 - DNA, 19 bp, Homo sapiens
aagcaattctcctgcctca

SEQ ID NO: 37684 - DNA, 18 bp, Homo sapiens
cccgcaacctccgccccc

SEQ ID NO: 37685 - DNA, 18 bp, Homo sapiens
gattctcttttgtccaca

SEQ ID NO: 37686 - DNA, 22 bp, Homo sapiens
tgaattttcattctgccattga

SEQ ID NO: 37687 - DNA, 19 bp, Homo sapiens
atcctgaaacaccaggaga

SEQ ID NO: 37688 - DNA, 18 bp, Homo sapiens
atttgaagttttgttcca

SEQ ID NO: 37689 - DNA, 20 bp, Homo sapiens
cacgcatcacagccatttga

SEQ ID NO: 37690 - DNA, 19 bp, Homo sapiens
cagctttcaagaaacattg

SEQ ID NO: 37691 - DNA, 18 bp, Homo sapiens
ccaatccaggcagtgagg

SEQ ID NO: 37692 - DNA, 18 bp, Homo sapiens
ccaccctcctccacctcc

SEQ ID NO: 37693 - DNA, 20 bp, Homo sapiens
cggcctcccgtctttcctga

SEQ ID NO: 37694 - DNA, 21 bp, Homo sapiens
ggacccaggccagctgccaca

SEQ ID NO: 37695 - DNA, 17 bp, Homo sapiens
ggagtcaggatgggaca

SEQ ID NO: 37696 - DNA, 20 bp, Homo sapiens
gggcggggtgggatttttgc

SEQ ID NO: 37697 - DNA, 20 bp, Homo sapiens
tcctctcctccgggcccctc

SEQ ID NO: 37698 - DNA, 21 bp, Homo sapiens
tgaggaactgaggccacgtca

SEQ ID NO: 37699 - DNA, 20 bp, Homo sapiens
tgttcccttccctgacctca

SEQ ID NO: 37700 - DNA, 18 bp, Homo sapiens
cctgcaacctccacctcc

SEQ ID NO: 37701 - DNA, 17 bp, Homo sapiens
ttctcctgccttagcct

SEQ ID NO: 37702 - DNA, 18 bp, Homo sapiens
aaaaggtacctgaggatg

SEQ ID NO: 37703 - DNA, 18 bp, Homo sapiens
aaacacctgaagatctca

SEQ ID NO: 37704 - DNA, 20 bp, Homo sapiens
ctttctctctcatagtctta

SEQ ID NO: 37705 - DNA, 20 bp, Homo sapiens
gaaaggataaatgctccttt

SEQ ID NO: 37706 - DNA, 20 bp, Homo sapiens
tcagttgcacacgtgtacgt

SEQ ID NO: 37707 - DNA, 18 bp, Homo sapiens
aagtgcagcatgggacta

SEQ ID NO: 37708 - DNA, 18 bp, Homo sapiens
acattggatggcaataca

SEQ ID NO: 37709 - DNA, 22 bp, Homo sapiens
cctagttgggaggtctgacgga

SEQ ID NO: 37710 - DNA, 21 bp, Homo sapiens
ggagtttgaggacatgcaata

SEQ ID NO: 37711 - DNA, 22 bp, Homo sapiens
tcatctttgaggccagaacagc

SEQ ID NO: 37712 - DNA, 22 bp, Homo sapiens
tgtaggggtggtgccaagggtg

SEQ ID NO: 37713 - DNA, 18 bp, Homo sapiens
actttgaccctttggccc

SEQ ID NO: 37714 - DNA, 16 bp, Homo sapiens
cctggcccttcccact

SEQ ID NO: 37715 - DNA, 17 bp, Homo sapiens
gaccccgggtggggctg

SEQ ID NO: 37716 - DNA, 18 bp, Homo sapiens
gagcccccaaatgttcca

SEQ ID NO: 37717 - DNA, 20 bp, Homo sapiens
ctctgatggcaatctttgga

SEQ ID NO: 37718 - DNA, 22 bp, Homo sapiens
gcagtgtctagaatttttgtta

SEQ ID NO: 37719 - DNA, 17 bp, Homo sapiens
gcccagacgcttgtccc

SEQ ID NO: 37720 - DNA, 17 bp, Homo sapiens
aaacgcaaaggtttgca

SEQ ID NO: 37721 - DNA, 20 bp, Homo sapiens
ctcaaaaacgcaaaggtttg

SEQ ID NO: 37722 - DNA, 17 bp, Homo sapiens
gacaaagacttggctca

SEQ ID NO: 37723 - DNA, 23 bp, Homo sapiens
gatgcccctctgagccttcctcc

SEQ ID NO: 37724 - DNA, 17 bp, Homo sapiens
gggacggctgccactcc

SEQ ID NO: 37725 - DNA, 20 bp, Homo sapiens
tgagccttcctcccccctca

SEQ ID NO: 37726 - DNA, 18 bp, Homo sapiens
atcctgaatgaacagtgg

SEQ ID NO: 37727 - DNA, 17 bp, Homo sapiens
cttcccctcctccttcc

SEQ ID NO: 37728 - DNA, 21 bp, Homo sapiens
gagaaaggggccgtggtcagc

SEQ ID NO: 37729 - DNA, 23 bp, Homo sapiens
gcctggatttgtatccttggctt

SEQ ID NO: 37730 - DNA, 18 bp, Homo sapiens
cttttgcggctccggcgt

SEQ ID NO: 37731 - DNA, 22 bp, Homo sapiens
tcctctaacttaataggactta

SEQ ID NO: 37732 - DNA, 20 bp, Homo sapiens
agcatctgttccttctgaga

SEQ ID NO: 37733 - DNA, 19 bp, Homo sapiens
aagtaggcctggagcctca

SEQ ID NO: 37734 - DNA, 17 bp, Homo sapiens
agcttctgtaaatctca

SEQ ID NO: 37735 - DNA, 22 bp, Homo sapiens
ccaagtttcttgagttgctgct

SEQ ID NO: 37736 - DNA, 16 bp, Homo sapiens
cggtcttctgaagtat

SEQ ID NO: 37737 - DNA, 22 bp, Homo sapiens
gataggaggtaagtgaccatta

SEQ ID NO: 37738 - DNA, 18 bp, Homo sapiens
gcttctgtaaatctcatt

SEQ ID NO: 37739 - DNA, 18 bp, Homo sapiens
tgctgttagctgaactgt

SEQ ID NO: 37740 - DNA, 17 bp, Homo sapiens
tttaagcagtctatgca

SEQ ID NO: 37741 - DNA, 24 bp, Homo sapiens
ttttcatgttgtatcacactgtca

SEQ ID NO: 37742 - DNA, 20 bp, Homo sapiens
cttcagggcttcttggtttt

SEQ ID NO: 37743 - DNA, 18 bp, Homo sapiens
gcaaggaagatgctgcca

SEQ ID NO: 37744 - DNA, 18 bp, Homo sapiens
aaagatcccctccttcct

SEQ ID NO: 37745 - DNA, 21 bp, Homo sapiens
cacagtgatttagccaaataa

SEQ ID NO: 37746 - DNA, 19 bp, Homo sapiens
cctccttcctaacgttttt

SEQ ID NO: 37747 - DNA, 22 bp, Homo sapiens
cgggattcctggggtccagcca

SEQ ID NO: 37748 - DNA, 20 bp, Homo sapiens
ggatgttggtactcctccca

SEQ ID NO: 37749 - DNA, 17 bp, Homo sapiens
tttgtttgaggctttct

SEQ ID NO: 37750 - DNA, 24 bp, Homo sapiens
acacagtgtcgtccaacaacctga

SEQ ID NO: 37751 - DNA, 19 bp, Homo sapiens
cctctgtcacacaggagca

SEQ ID NO: 37752 - DNA, 21 bp, Homo sapiens
ctctgcagtgtcccatccacc

SEQ ID NO: 37753 - DNA, 20 bp, Homo sapiens
ttcaagaccagcctgaccaa

SEQ ID NO: 37754 - DNA, 17 bp, Homo sapiens
aaagggtgtggcccctt

SEQ ID NO: 37755 - DNA, 18 bp, Homo sapiens
aagaacacctacctctat

SEQ ID NO: 37756 - DNA, 16 bp, Homo sapiens
agcttcctgagatctc

SEQ ID NO: 37757 - DNA, 18 bp, Homo sapiens
agtcgatgatatgagaaa

SEQ ID NO: 37758 - DNA, 18 bp, Homo sapiens
atccaggacatctcttta

SEQ ID NO: 37759 - DNA, 19 bp, Homo sapiens
ccaccctcaccctgccaga

SEQ ID NO: 37760 - DNA, 20 bp, Homo sapiens
gtgagaagtgagagatctga

SEQ ID NO: 37761 - DNA, 20 bp, Homo sapiens
tcttgccacctcctctgcac

SEQ ID NO: 37762 - DNA, 20 bp, Homo sapiens
cttgtttgaagacttgtgga

SEQ ID NO: 37763 - DNA, 21 bp, Homo sapiens
aacttcagcacacgtgtgtta

SEQ ID NO: 37764 - DNA, 19 bp, Homo sapiens
ccttcccagtttctcccca

SEQ ID NO: 37765 - DNA, 21 bp, Homo sapiens
ctgtgtattacccttgctttt

SEQ ID NO: 37766 - DNA, 17 bp, Homo sapiens
gcaacctcagccaatga

SEQ ID NO: 37767 - DNA, 17 bp, Homo sapiens
aggcaggataatcactt

SEQ ID NO: 37768 - DNA, 21 bp, Homo sapiens
acttgggtttcatgcctgccc

SEQ ID NO: 37769 - DNA, 25 bp, Homo sapiens
ctctgcgcctccggcactctggtga

SEQ ID NO: 37770 - DNA, 21 bp, Homo sapiens
tgcccagggcttctgctccgg

SEQ ID NO: 37771 - DNA, 20 bp, Homo sapiens
ttgcaatttgcaagcttctt

SEQ ID NO: 37772 - DNA, 23 bp, Homo sapiens
aagccaggaaggcccagtccctc

SEQ ID NO: 37773 - DNA, 18 bp, Homo sapiens
ctctccttccgtttctga

SEQ ID NO: 37774 - DNA, 17 bp, Homo sapiens
gacagccaggcccatct

SEQ ID NO: 37775 - DNA, 18 bp, Homo sapiens
ggctttattaaatttgta

SEQ ID NO: 37776 - DNA, 18 bp, Homo sapiens
tactttgatggaaacatg

SEQ ID NO: 37777 - DNA, 19 bp, Homo sapiens
ctcttgaccagtagtgtca

SEQ ID NO: 37778 - DNA, 15 bp, Homo sapiens
gaactgagagcatga

SEQ ID NO: 37779 - DNA, 18 bp, Homo sapiens
tagccaaaggcccaaggg

SEQ ID NO: 37780 - DNA, 19 bp, Homo sapiens
ttccagaggctccccccag

SEQ ID NO: 37781 - DNA, 18 bp, Homo sapiens
ttctcctgcctcagcctt

SEQ ID NO: 37782 - DNA, 21 bp, Homo sapiens
acagaaaattttgtctcagta

SEQ ID NO: 37783 - DNA, 18 bp, Homo sapiens
attgtaaataccatgatg

SEQ ID NO: 37784 - DNA, 20 bp, Homo sapiens
ggtgctgctgtctgcagcaa

SEQ ID NO: 37785 - DNA, 20 bp, Homo sapiens
ttctgtgtgtgtttttttag

SEQ ID NO: 37786 - DNA, 25 bp, Homo sapiens
ccaggtgctttctcattactcttca

SEQ ID NO: 37787 - DNA, 19 bp, Homo sapiens
agactgacagcagatctct

SEQ ID NO: 37788 - DNA, 17 bp, Homo sapiens
tcaagtgattctcctgc

SEQ ID NO: 37789 - DNA, 18 bp, Homo sapiens
tgtctgtgaggagcaaga

SEQ ID NO: 37790 - DNA, 25 bp, Homo sapiens
accagggggcggcgcagctcccaca

SEQ ID NO: 37791 - DNA, 18 bp, Homo sapiens
gccagggagcccaggctc

SEQ ID NO: 37792 - DNA, 20 bp, Homo sapiens
ggacttcaacgagcattaca

SEQ ID NO: 37793 - DNA, 19 bp, Homo sapiens
gggatgctggtgatttcca

SEQ ID NO: 37794 - DNA, 21 bp, Homo sapiens
gcgggccagggacctttcgtc

SEQ ID NO: 37795 - DNA, 20 bp, Homo sapiens
aggagcagatgaaatgtcat

SEQ ID NO: 37796 - DNA, 18 bp, Homo sapiens
cggctagtggactgagtt

SEQ ID NO: 37797 - DNA, 17 bp, Homo sapiens
gccacacctcagcctcc

SEQ ID NO: 37798 - DNA, 22 bp, Homo sapiens
gccttagcaacactgctcacca

SEQ ID NO: 37799 - DNA, 24 bp, Homo sapiens
aagaagacatttcagtgtgagatt

SEQ ID NO: 37800 - DNA, 18 bp, Homo sapiens
aaggccacgccggcagct

SEQ ID NO: 37801 - DNA, 25 bp, Homo sapiens
acccacgccgcacctcatccgtgca

SEQ ID NO: 37802 - DNA, 22 bp, Homo sapiens
atgtggatgccacatgctgctg

SEQ ID NO: 37803 - DNA, 17 bp, Homo sapiens
cacatgtacgcaccaca

SEQ ID NO: 37804 - DNA, 18 bp, Homo sapiens
cccgtcacctcgtcctca

SEQ ID NO: 37805 - DNA, 22 bp, Homo sapiens
ctgccctgaggtccttgtgtgg

SEQ ID NO: 37806 - DNA, 22 bp, Homo sapiens
ctgggatgaagagtccccctcc

SEQ ID NO: 37807 - DNA, 21 bp, Homo sapiens
cttgtgtggccgccctggctt

SEQ ID NO: 37808 - DNA, 20 bp, Homo sapiens
tgcacacacatatacacaca

SEQ ID NO: 37809 - DNA, 21 bp, Homo sapiens
acaatgtgggacgctgcaata

SEQ ID NO: 37810 - DNA, 18 bp, Homo sapiens
tggcctatttagattcct

SEQ ID NO: 37811 - DNA, 22 bp, Homo sapiens
aactaactgatgcagccactga

SEQ ID NO: 37812 - DNA, 19 bp, Homo sapiens
agagaataaatttgtcata

SEQ ID NO: 37813 - DNA, 19 bp, Homo sapiens
agaaggctaaaggagctca

SEQ ID NO: 37814 - DNA, 21 bp, Homo sapiens
atcttgtgatgccaccatcgc

SEQ ID NO: 37815 - DNA, 20 bp, Homo sapiens
attgtgaataaaatttttct

SEQ ID NO: 37816 - DNA, 18 bp, Homo sapiens
cccacaacccccacctcc

SEQ ID NO: 37817 - DNA, 22 bp, Homo sapiens
ccttcccccaaacttatctcca

SEQ ID NO: 37818 - DNA, 21 bp, Homo sapiens
ctatttcttttacacacatac

SEQ ID NO: 37819 - DNA, 16 bp, Homo sapiens
ctttggagtgtttata

SEQ ID NO: 37820 - DNA, 19 bp, Homo sapiens
tctacgtttggttcaatta

SEQ ID NO: 37821 - DNA, 22 bp, Homo sapiens
tgtctctcccaactgttaagtt

SEQ ID NO: 37822 - DNA, 16 bp, Homo sapiens
tgttggtcctgctggt

SEQ ID NO: 37823 - DNA, 24 bp, Homo sapiens
tttcttttacacacataccaagga

SEQ ID NO: 37824 - DNA, 22 bp, Homo sapiens
tttgagacggaatttcacttca

SEQ ID NO: 37825 - DNA, 18 bp, Homo sapiens
aacatagcttctgttgac

SEQ ID NO: 37826 - DNA, 18 bp, Homo sapiens
agcccatctgctgtatta

SEQ ID NO: 37827 - DNA, 24 bp, Homo sapiens
caaataatgaagatctctccttca

SEQ ID NO: 37828 - DNA, 20 bp, Homo sapiens
ctctccttcagtctgctctg

SEQ ID NO: 37829 - DNA, 22 bp, Homo sapiens
taaatggacttcatgaggaaat

SEQ ID NO: 37830 - DNA, 22 bp, Homo sapiens
tccaaaacccggacaagctctt

SEQ ID NO: 37831 - DNA, 20 bp, Homo sapiens
aaatgctttattacctttct

SEQ ID NO: 37832 - DNA, 26 bp, Homo sapiens
aacacaatacttaatgtattgtacta

SEQ ID NO: 37833 - DNA, 19 bp, Homo sapiens
agtgttcctaagatatctc

SEQ ID NO: 37834 - DNA, 20 bp, Homo sapiens
atacaggcaaacaacctggt

SEQ ID NO: 37835 - DNA, 22 bp, Homo sapiens
taccccataggcagtgtaccca

SEQ ID NO: 37836 - DNA, 22 bp, Homo sapiens
ttttgtatatttttgtttcatc

SEQ ID NO: 37837 - DNA, 18 bp, Homo sapiens
gcatgatgacaatgacca

SEQ ID NO: 37838 - DNA, 22 bp, Homo sapiens
tctttagggcacaataaaggct

SEQ ID NO: 37839 - DNA, 19 bp, Homo sapiens
aagtaatttaccagttcta

SEQ ID NO: 37840 - DNA, 19 bp, Homo sapiens
aagtaatttaccagttcta

SEQ ID NO: 37841 - DNA, 16 bp, Homo sapiens
accctaggggttctgg

SEQ ID NO: 37842 - DNA, 17 bp, Homo sapiens
acctatgccacatcaca

SEQ ID NO: 37843 - DNA, 19 bp, Homo sapiens
agacctatgccacatcaca

SEQ ID NO: 37844 - DNA, 21 bp, Homo sapiens
cacgacacccctcttccctca

SEQ ID NO: 37845 - DNA, 18 bp, Homo sapiens
ccaggcacgccacctgct

SEQ ID NO: 37846 - DNA, 20 bp, Homo sapiens
cttctctttctctgacccct

SEQ ID NO: 37847 - DNA, 19 bp, Homo sapiens
ggataagaacctcacttcc

SEQ ID NO: 37848 - DNA, 19 bp, Homo sapiens
gggataaaaagtcacctcc

SEQ ID NO: 37849 - DNA, 18 bp, Homo sapiens
ggtggcctggggcatgtc

SEQ ID NO: 37850 - DNA, 18 bp, Homo sapiens
tggctccaatctgtggac

SEQ ID NO: 37851 - DNA, 21 bp, Homo sapiens
agcctctgatcttcccttgaa

SEQ ID NO: 37852 - DNA, 16 bp, Homo sapiens
agggacccagattctt

SEQ ID NO: 37853 - DNA, 22 bp, Homo sapiens
agtccatcccctccgcccttca

SEQ ID NO: 37854 - DNA, 21 bp, Homo sapiens
atcttggcttactgcaacctc

SEQ ID NO: 37855 - DNA, 18 bp, Homo sapiens
ccagattcttttttatcc

SEQ ID NO: 37856 - DNA, 19 bp, Homo sapiens
ctgcaacctccgcctccca

SEQ ID NO: 37857 - DNA, 20 bp, Homo sapiens
gcaggtagccgactttgcca

SEQ ID NO: 37858 - DNA, 22 bp, Homo sapiens
gcggaggagaggctgagccttc

SEQ ID NO: 37859 - DNA, 18 bp, Homo sapiens
tccgcctcccaggttcaa

SEQ ID NO: 37860 - DNA, 20 bp, Homo sapiens
acaaagggctaatagccaga

SEQ ID NO: 37861 - DNA, 26 bp, Homo sapiens
gaccgaccagcccaagaaacatctca

SEQ ID NO: 37862 - DNA, 17 bp, Homo sapiens
gccagtgccttgctctt

SEQ ID NO: 37863 - DNA, 20 bp, Homo sapiens
aagagagggtcgcagacctg

SEQ ID NO: 37864 - DNA, 21 bp, Homo sapiens
ctgtgtttctgccttgtttta

SEQ ID NO: 37865 - DNA, 21 bp, Homo sapiens
gcaagagctcatgggccatga

SEQ ID NO: 37866 - DNA, 16 bp, Homo sapiens
gtcctttaaaagcatt

SEQ ID NO: 37867 - DNA, 20 bp, Homo sapiens
agaacatggaaagaaaattt

SEQ ID NO: 37868 - DNA, 19 bp, Homo sapiens
gaccttgttagtgacatgt

SEQ ID NO: 37869 - DNA, 18 bp, Homo sapiens
gtgctttgaggcttcttc

SEQ ID NO: 37870 - DNA, 19 bp, Homo sapiens
tgagagattattcgttata

SEQ ID NO: 37871 - DNA, 20 bp, Homo sapiens
actacctccaggagatggaa

SEQ ID NO: 37872 - DNA, 19 bp, Homo sapiens
cagcactgctctgccaagc

SEQ ID NO: 37873 - DNA, 28 bp, Homo sapiens
gatgagaaatttttcaccactggacaaa

SEQ ID NO: 37874 - DNA, 21 bp, Homo sapiens
ggatgcccccagatgagattg

SEQ ID NO: 37875 - DNA, 19 bp, Homo sapiens
gtgcctgtctcctacttca

SEQ ID NO: 37876 - DNA, 22 bp, Homo sapiens
aaaagagacttaatggtatgat

SEQ ID NO: 37877 - DNA, 19 bp, Homo sapiens
gcaggattgggggtttcgg

SEQ ID NO: 37878 - DNA, 21 bp, Homo sapiens
tgtgtaacagtttttgggata

SEQ ID NO: 37879 - DNA, 20 bp, Homo sapiens
aagtaattgccatgaacaca

SEQ ID NO: 37880 - DNA, 19 bp, Homo sapiens
agaatacaagtaattgcca

SEQ ID NO: 37881 - DNA, 19 bp, Homo sapiens
cagcactccagcctgggca

SEQ ID NO: 37882 - DNA, 18 bp, Homo sapiens
ccggcatgcccaacctca

SEQ ID NO: 37883 - DNA, 21 bp, Homo sapiens
ggatgccagtggccctcgcga

SEQ ID NO: 37884 - DNA, 19 bp, Homo sapiens
tcacctaagctgcacttca

SEQ ID NO: 37885 - DNA, 18 bp, Homo sapiens
tcccatgtcatgctgcca

SEQ ID NO: 37886 - DNA, 19 bp, Homo sapiens
aggacttttatatctatca

SEQ ID NO: 37887 - DNA, 18 bp, Homo sapiens
catagcaccaaactcctt

SEQ ID NO: 37888 - DNA, 21 bp, Homo sapiens
ttcagcatcaccaagatgaca

SEQ ID NO: 37889 - DNA, 20 bp, Homo sapiens
cgccagagtcctcctcctcc

SEQ ID NO: 37890 - DNA, 19 bp, Homo sapiens
gcgcgccggccggccgctg

SEQ ID NO: 37891 - DNA, 18 bp, Homo sapiens
atcttggccatgaaactg

SEQ ID NO: 37892 - DNA, 21 bp, Homo sapiens
ctggtctagcccaggttgcca

SEQ ID NO: 37893 - DNA, 20 bp, Homo sapiens
gacccaggggccccggcctc

SEQ ID NO: 37894 - DNA, 19 bp, Homo sapiens
gagatcacccttgcagtga

SEQ ID NO: 37895 - DNA, 22 bp, Homo sapiens
tcaaggatcttgatgccaagtg

SEQ ID NO: 37896 - DNA, 18 bp, Homo sapiens
tcatttgactccagccaa

SEQ ID NO: 37897 - DNA, 19 bp, Homo sapiens
ctggggtccacccttgcca

SEQ ID NO: 37898 - DNA, 20 bp, Homo sapiens
gaggatgtttcaatgatgct

SEQ ID NO: 37899 - DNA, 19 bp, Homo sapiens
gtcttgattagatccagtt

SEQ ID NO: 37900 - DNA, 23 bp, Homo sapiens
tccagttgaatgctggccagtga

SEQ ID NO: 37901 - DNA, 23 bp, Homo sapiens
tgcaggttctctctcattctcta

SEQ ID NO: 37902 - DNA, 18 bp, Homo sapiens
gtgtgtgtgagtgtgagc

SEQ ID NO: 37903 - DNA, 20 bp, Homo sapiens
aattgcctctgggtgtgtgt

SEQ ID NO: 37904 - DNA, 18 bp, Homo sapiens
agactggataaagccaca

SEQ ID NO: 37905 - DNA, 22 bp, Homo sapiens
agggttccttcagcccaacata

SEQ ID NO: 37906 - DNA, 22 bp, Homo sapiens
agggttccttcagcccaacata

SEQ ID NO: 37907 - DNA, 22 bp, Homo sapiens
ctctgatggtgagacttgagga

SEQ ID NO: 37908 - DNA, 16 bp, Homo sapiens
ctgaaaagactgtgga

SEQ ID NO: 37909 - DNA, 17 bp, Homo sapiens
cttctttcatcacatca

SEQ ID NO: 37910 - DNA, 23 bp, Homo sapiens
gaggaagagtactctttggcttg

SEQ ID NO: 37911 - DNA, 19 bp, Homo sapiens
gaggagggggcataaagac

SEQ ID NO: 37912 - DNA, 19 bp, Homo sapiens
gtcataaaaaaaaagcttt

SEQ ID NO: 37913 - DNA, 18 bp, Homo sapiens
gtgatgaccatatccagt

SEQ ID NO: 37914 - DNA, 22 bp, Homo sapiens
gtgtccggaattggtgggttct

SEQ ID NO: 37915 - DNA, 19 bp, Homo sapiens
tctgatggtaagcctggag

SEQ ID NO: 37916 - DNA, 27 bp, Homo sapiens
ttatgtcacagaagaaaaaacaaataa

SEQ ID NO: 37917 - DNA, 18 bp, Homo sapiens
acacttttagctcagtta

SEQ ID NO: 37918 - DNA, 18 bp, Homo sapiens
tgggtggatcacctgagg

SEQ ID NO: 37919 - DNA, 19 bp, Homo sapiens
ttttgggaagcgaggtgtc

SEQ ID NO: 37920 - DNA, 17 bp, Homo sapiens
gaagaaagatgaatcta

SEQ ID NO: 37921 - DNA, 18 bp, Homo sapiens
tgctgcattgctccagca

SEQ ID NO: 37922 - DNA, 18 bp, Homo sapiens
caaagctgcagcatgcac

SEQ ID NO: 37923 - DNA, 17 bp, Homo sapiens
cgcccacctccacccca

SEQ ID NO: 37924 - DNA, 20 bp, Homo sapiens
tgtaccccacgcccacctcc

SEQ ID NO: 37925 - DNA, 18 bp, Homo sapiens
aacaccgctcaggcctga

SEQ ID NO: 37926 - DNA, 18 bp, Homo sapiens
accaccatcacctcctcc

SEQ ID NO: 37927 - DNA, 18 bp, Homo sapiens
accctggctcccaaggct

SEQ ID NO: 37928 - DNA, 22 bp, Homo sapiens
agccaaggtgctggtgttgcca

SEQ ID NO: 37929 - DNA, 25 bp, Homo sapiens
atctgagcagggatcgatctggcct

SEQ ID NO: 37930 - DNA, 25 bp, Homo sapiens
cagcacttgcatggcacttccctct

SEQ ID NO: 37931 - DNA, 17 bp, Homo sapiens
cagctggatcctgctgc

SEQ ID NO: 37932 - DNA, 19 bp, Homo sapiens
cagctggtgctgacccaca

SEQ ID NO: 37933 - DNA, 21 bp, Homo sapiens
cccagacatggccttctgcct

SEQ ID NO: 37934 - DNA, 21 bp, Homo sapiens
ctattgtgggaccttgtgatt

SEQ ID NO: 37935 - DNA, 18 bp, Homo sapiens
gacctggccgcctccatc

SEQ ID NO: 37936 - DNA, 22 bp, Homo sapiens
gcttctctgggtcccactctct

SEQ ID NO: 37937 - DNA, 30 bp, Homo sapiens; identical to SEQ ID NO: 37245

SEQ ID NO: 37938 - DNA, 21 bp, Homo sapiens
tgaagagttttctgccaatga

SEQ ID NO: 37939 - DNA, 24 bp, Homo sapiens
tggatatccctccaggtggggctg

SEQ ID NO: 37940 - DNA, 20 bp, Homo sapiens
tgtctgtggagctagctgag

SEQ ID NO: 37941 - DNA, 25 bp, Homo sapiens
ttaatactgagtgtcaacttgattg

SEQ ID NO: 37942 - DNA, 21 bp, Homo sapiens
ttccagtgcgccccactgtca

SEQ ID NO: 37943 - DNA, 20 bp, Homo sapiens
aagacacctgtcaaatgtca

SEQ ID NO: 37944 - DNA, 16 bp, Homo sapiens
acatcacagggcaagc

SEQ ID NO: 37945 - DNA, 22 bp, Homo sapiens
actcgcctctgctcctgtggtc

SEQ ID NO: 37946 - DNA, 18 bp, Homo sapiens
cactctccagccatttgg

SEQ ID NO: 37947 - DNA, 19 bp, Homo sapiens
ccagctccacacacccccc

SEQ ID NO: 37948 - DNA, 17 bp, Homo sapiens
ccccctgggatggctca

SEQ ID NO: 37949 - DNA, 18 bp, Homo sapiens
ccgggtgggggattttgg

SEQ ID NO: 37950 - DNA, 24 bp, Homo sapiens
gcaggcatcaaactttacatccca

SEQ ID NO: 37951 - DNA, 17 bp, Homo sapiens
tgccaccaccaagccca

SEQ ID NO: 37952 - DNA, 20 bp, Homo sapiens
aagacacctgtcaaatgtca

SEQ ID NO: 37953 - DNA, 16 bp, Homo sapiens
acatcacagggcaagc

SEQ ID NO: 37954 - DNA, 22 bp, Homo sapiens
actcgcctctgctcctgtggtc

SEQ ID NO: 37955 - DNA, 18 bp, Homo sapiens
cactctccagccatttgg

SEQ ID NO: 37956 - DNA, 19 bp, Homo sapiens
ccagctccacacacccccc

SEQ ID NO: 37957 - DNA, 17 bp, Homo sapiens
ccccctgggatggctca

SEQ ID NO: 37958 - DNA, 18 bp, Homo sapiens
ccgggtgggggattttgg

SEQ ID NO: 37959 - DNA, 24 bp, Homo sapiens
gcaggcatcaaactttacatccca

SEQ ID NO: 37960 - DNA, 17 bp, Homo sapiens
tgccaccaccaagccca

SEQ ID NO: 37961 - DNA, 22 bp, Homo sapiens
ctgtctcctgttcatcatccca

SEQ ID NO: 37962 - DNA, 17 bp, Homo sapiens
gttccatcatcctctga

SEQ ID NO: 37963 - DNA, 18 bp, Homo sapiens
taattttgcattagtctc

SEQ ID NO: 37964 - DNA, 21 bp, Homo sapiens
tcaagttatttctccttctct

SEQ ID NO: 37965 - DNA, 20 bp, Homo sapiens
ttcccaaaatctcaatttca

SEQ ID NO: 37966 - DNA, 20 bp, Homo sapiens
ttgctacagtatttactgtt

SEQ ID NO: 37967 - DNA, 18 bp, Homo sapiens
aagttgttgctttggaat

SEQ ID NO: 37968 - DNA, 19 bp, Homo sapiens
acttcatcaaacttcaaca

SEQ ID NO: 37969 - DNA, 21 bp, Homo sapiens
agctgctcccgggttgccaga

SEQ ID NO: 37970 - DNA, 21 bp, Homo sapiens
cagcccctcccagtcccctca

SEQ ID NO: 37971 - DNA, 19 bp, Homo sapiens
cattttaaccacaacttca

SEQ ID NO: 37972 - DNA, 25 bp, Homo sapiens
cccaggtgcaaaaccccacatccca

SEQ ID NO: 37973 - DNA, 20 bp, Homo sapiens
cctctgcctcccaggttcaa

SEQ ID NO: 37974 - DNA, 17 bp, Homo sapiens
tcaagtgattctcctgc

SEQ ID NO: 37975 - DNA, 26 bp, Homo sapiens
taaatgttgattttaatatggagcta

SEQ ID NO: 37976 - DNA, 19 bp, Homo sapiens
agattttcttgaatggcag

SEQ ID NO: 37977 - DNA, 17 bp, Homo sapiens
attgaatgcagcattac

SEQ ID NO: 37978 - DNA, 21 bp, Homo sapiens
gaaaaggtgggaaatattttc

SEQ ID NO: 37979 - DNA, 20 bp, Homo sapiens
gaatataaaacagtttatga

SEQ ID NO: 37980 - DNA, 19 bp, Homo sapiens
tgactactgcatgcatgtg

SEQ ID NO: 37981 - DNA, 17 bp, Homo sapiens
acaagaagcatgggcac

SEQ ID NO: 37982 - DNA, 19 bp, Homo sapiens
cttctcgtgtcaccaagga

SEQ ID NO: 37983 - DNA, 19 bp, Homo sapiens
ggctattactgtttaccca

SEQ ID NO: 37984 - DNA, 20 bp, Homo sapiens
tcgctgcattcaggattgtt

SEQ ID NO: 37985 - DNA, 21 bp, Homo sapiens
tgaaaggcttttatcttcttc

SEQ ID NO: 37986 - DNA, 18 bp, Homo sapiens
gaaactccgaacacatgc

SEQ ID NO: 37987 - DNA, 19 bp, Homo sapiens
atcaggatagtagatctat

SEQ ID NO: 37988 - DNA, 19 bp, Homo sapiens
atggatacagagaaatgta

SEQ ID NO: 37989 - DNA, 19 bp, Homo sapiens
attcggaactttcaacaaa

SEQ ID NO: 37990 - DNA, 21 bp, Homo sapiens
atttgggttgtttccaggttt

SEQ ID NO: 37991 - DNA, 23 bp, Homo sapiens
gtatataaataaaatcattcgac

SEQ ID NO: 37992 - DNA, 18 bp, Homo sapiens
tatctatctatcccatca

SEQ ID NO: 37993 - DNA, 20 bp, Homo sapiens
tgctgttaagtgtcttctga

SEQ ID NO: 37994 - DNA, 24 bp, Homo sapiens
tttgaactttctccccactcctca

SEQ ID NO: 37995 - DNA, 19 bp, Homo sapiens
accatgtgaataatagaga

SEQ ID NO: 37996 - DNA, 22 bp, Homo sapiens
agctgggtattgtaaaatctca

SEQ ID NO: 37997 - DNA, 18 bp, Homo sapiens
ctttgactggaagagtca

SEQ ID NO: 37998 - DNA, 21 bp, Homo sapiens
tatcagtgaacccccatgttt

SEQ ID NO: 37999 - DNA, 18 bp, Homo sapiens
acctcttctttctgtgac

SEQ ID NO: 38000 - DNA, 18 bp, Homo sapiens
gaggttaagtttacttca

SEQ ID NO: 38001 - DNA, 23 bp, Homo sapiens
gtttattgggggggcttttttta

SEQ ID NO: 38002 - DNA, 21 bp, Homo sapiens
taaaggattttaacaagaccc

SEQ ID NO: 38003 - DNA, 22 bp, Homo sapiens
tgattccaggctgggctcggtt

SEQ ID NO: 38004 - DNA, 23 bp, Homo sapiens
acaaagcatattaaatggcaata

SEQ ID NO: 38005 - DNA, 21 bp, Homo sapiens
atcccacctcatcccattttt

SEQ ID NO: 38006 - DNA, 19 bp, Homo sapiens
cataatacaaagcatatta

SEQ ID NO: 38007 - DNA, 16 bp, Homo sapiens
ctctttgatcatggcg

SEQ ID NO: 38008 - DNA, 21 bp, Homo sapiens
cttgaacattctaaattactt

SEQ ID NO: 38009 - DNA, 17 bp, Homo sapiens
ttccaaattttaagctg

SEQ ID NO: 38010 - DNA, 20 bp, Homo sapiens
aaagttgcctgctctggcag

SEQ ID NO: 38011 - DNA, 15 bp, Homo sapiens
aggaaaagaaagcaa

SEQ ID NO: 38012 - DNA, 19 bp, Homo sapiens
cagcaggagccaagaggaa

SEQ ID NO: 38013 - DNA, 18 bp, Homo sapiens
ggagctttttaaatttca

SEQ ID NO: 38014 - DNA, 19 bp, Homo sapiens
tctgtcttcctcttcctac

SEQ ID NO: 38015 - DNA, 17 bp, Homo sapiens
caagattggctcagtca

SEQ ID NO: 38016 - DNA, 17 bp, Homo sapiens
agtggtcaacaatgaca

SEQ ID NO: 38017 - DNA, 20 bp, Homo sapiens
tggggtcaacacatgtgatg

SEQ ID NO: 38018 - DNA, 19 bp, Homo sapiens
aataattgcctatatcctt

SEQ ID NO: 38019 - DNA, 19 bp, Homo sapiens
agcgcctccagtacgtctt

SEQ ID NO: 38020 - DNA, 22 bp, Homo sapiens
atcttggctcagtgcaatctct

SEQ ID NO: 38021 - DNA, 22 bp, Homo sapiens
cagaggtaacaaaagtctgtgg

SEQ ID NO: 38022 - DNA, 20 bp, Homo sapiens
cttatacctgttgcttacta

SEQ ID NO: 38023 - DNA, 23 bp, Homo sapiens
ggcatgagccacctcgcccagcc

SEQ ID NO: 38024 - DNA, 22 bp, Homo sapiens
gtagctttaggatgtgtttgca

SEQ ID NO: 38025 - DNA, 18 bp, Homo sapiens
gtcccattgtgttcctcc

SEQ ID NO: 38026 - DNA, 19 bp, Homo sapiens
gttttgccatagagtgtga

SEQ ID NO: 38027 - DNA, 21 bp, Homo sapiens
tccatttgcaaataccatact

SEQ ID NO: 38028 - DNA, 21 bp, Homo sapiens
tctgggttgagatcctggccc

SEQ ID NO: 38029 - DNA, 18 bp, Homo sapiens
ttataaaacaatagcgta

SEQ ID NO: 38030 - DNA, 21 bp, Homo sapiens
ttgtaaatatgttttctgcct

SEQ ID NO: 38031 - DNA, 20 bp, Homo sapiens
ccacctcccacctccacccc

SEQ ID NO: 38032 - DNA, 18 bp, Homo sapiens
gaaaaaaatctgaagcca

SEQ ID NO: 38033 - DNA, 24 bp, Homo sapiens
ggatttggtcaaatagactgagaa

SEQ ID NO: 38034 - DNA, 16 bp, Homo sapiens
aattagctgcagccaa

SEQ ID NO: 38035 - DNA, 18 bp, Homo sapiens
caagtcctcctccgcctc

SEQ ID NO: 38036 - DNA, 21 bp, Homo sapiens
ccaccccacaatggcagaaga

SEQ ID NO: 38037 - DNA, 21 bp, Homo sapiens
ctgcagcagttgcactctttt

SEQ ID NO: 38038 - DNA, 22 bp, Homo sapiens
gagccaagatcacgccactgca

SEQ ID NO: 38039 - DNA, 21 bp, Homo sapiens
gcctttcctccattttctgtg

SEQ ID NO: 38040 - DNA, 20 bp, Homo sapiens
gctcgctgggatttggctga

SEQ ID NO: 38041 - DNA, 17 bp, Homo sapiens
ggagctttctaaatctc

SEQ ID NO: 38042 - DNA, 25 bp, Homo sapiens
tctcccccaagtcctcctccgcctc

SEQ ID NO: 38043 - DNA, 21 bp, Homo sapiens
tggatggactgttgggtactg

SEQ ID NO: 38044 - DNA, 19 bp, Homo sapiens
tttttcttttttcatttca

SEQ ID NO: 38045 - DNA, 18 bp, Homo sapiens
aagaaagtaacatgatca

SEQ ID NO: 38046 - DNA, 21 bp, Homo sapiens
cctgaagagtcattgatcaga

SEQ ID NO: 38047 - DNA, 19 bp, Homo sapiens
ccttgtgtttgctgccaaa

SEQ ID NO: 38048 - DNA, 19 bp, Homo sapiens
gtaccctccctggagttca

SEQ ID NO: 38049 - DNA, 21 bp, Homo sapiens
tggaactccagcctggagctg

SEQ ID NO: 38050 - DNA, 24 bp, Homo sapiens
agcaaccacatcaggatcggaatc

SEQ ID NO: 38051 - DNA, 19 bp, Homo sapiens
agtggccacatttaagaaa

SEQ ID NO: 38052 - DNA, 24 bp, Homo sapiens
atcttgggagtctacattttctta

SEQ ID NO: 38053 - DNA, 20 bp, Homo sapiens
agtctcactctgtcgtccag

SEQ ID NO: 38054 - DNA, 18 bp, Homo sapiens
cttatactgaagtgtgaa

SEQ ID NO: 38055 - DNA, 23 bp, Homo sapiens
gcagaaacaatgaaaaccttata

SEQ ID NO: 38056 - DNA, 17 bp, Homo sapiens
tcaagtgattctcctgc

SEQ ID NO: 38057 - DNA, 18 bp, Homo sapiens
tctgaatttcgtctgtct

SEQ ID NO: 38058 - DNA, 23 bp, Homo sapiens
ggggacgaggcggcggcggcggc

SEQ ID NO: 38059 - DNA, 21 bp, Homo sapiens
acctgggccgtgattgggcgc

SEQ ID NO: 38060 - DNA, 26 bp, Homo sapiens
acttggagagcaagctgtttgagtct

SEQ ID NO: 38061 - DNA, 21 bp, Homo sapiens
caccatgcccagcctccttct

SEQ ID NO: 38062 - DNA, 19 bp, Homo sapiens
cctgctagcaaggttccca

SEQ ID NO: 38063 - DNA, 22 bp, Homo sapiens
taagtgggcctgcttgaagttg

SEQ ID NO: 38064 - DNA, 22 bp, Homo sapiens
tccctctcatccatgcattcta

SEQ ID NO: 38065 - DNA, 18 bp, Homo sapiens
atccctggagcctccaga

SEQ ID NO: 38066 - DNA, 18 bp, Homo sapiens
gcgcgcccgcccgccccc

SEQ ID NO: 38067 - DNA, 25 bp, Homo sapiens
gggcccccccgcatcgcgccgccca

SEQ ID NO: 38068 - DNA, 21 bp, Homo sapiens
ggtcagccgccccacctgaca

SEQ ID NO: 38069 - DNA, 17 bp, Homo sapiens
tggagaagctgggcagg

SEQ ID NO: 38070 - DNA, 18 bp, Homo sapiens
tggcctgccgcaccccca

SEQ ID NO: 38071 - DNA, 23 bp, Homo sapiens
gcccgcccgcaccaaccctctga

SEQ ID NO: 38072 - DNA, 22 bp, Homo sapiens
gtgccttggtttcctggcctct

SEQ ID NO: 38073 - DNA, 21 bp, Homo sapiens
tcagcacatagcaagtgctca

SEQ ID NO: 38074 - DNA, 19 bp, Homo sapiens
tctgactccctccacctca

SEQ ID NO: 38075 - DNA, 27 bp, Homo sapiens
gtaaaagctcctctgttccttgtaata

SEQ ID NO: 38076 - DNA, 19 bp, Homo sapiens
ctgtctgcaacatccctca

SEQ ID NO: 38077 - DNA, 19 bp, Homo sapiens
ttttatgcaaagtaggcag

SEQ ID NO: 38078 - DNA, 17 bp, Homo sapiens
tctggctaggctcggcg

SEQ ID NO: 38079 - DNA, 17 bp, Homo sapiens
ctgggtctggcctggcc

SEQ ID NO: 38080 - DNA, 21 bp, Homo sapiens
actctgcctccctcccacctc

SEQ ID NO: 38081 - DNA, 17 bp, Homo sapiens
atcaccaccgccggcgt

SEQ ID NO: 38082 - DNA, 22 bp, Homo sapiens
caatcttgaattttattttctg

SEQ ID NO: 38083 - DNA, 17 bp, Homo sapiens
caccaccatcatcacca

SEQ ID NO: 38084 - DNA, 19 bp, Homo sapiens
caccaccatcatcaccacc

SEQ ID NO: 38085 - DNA, 22 bp, Homo sapiens
caccaccatcatcaccaccgcc

SEQ ID NO: 38086 - DNA, 20 bp, Homo sapiens
caccatcatcaccaccgccg

SEQ ID NO: 38087 - DNA, 20 bp, Homo sapiens
catttctgttcctccaatga

SEQ ID NO: 38088 - DNA, 21 bp, Homo sapiens
ctccccataaataccaccttg

SEQ ID NO: 38089 - DNA, 17 bp, Homo sapiens
gcaggtaacagaggtga

SEQ ID NO: 38090 - DNA, 25 bp, Homo sapiens
aagaggagaattttcccgttaattt

SEQ ID NO: 38091 - DNA, 18 bp, Homo sapiens
aattttcccagccctaaa

SEQ ID NO: 38092 - DNA, 22 bp, Homo sapiens
acatttaatgggcacctatggg

SEQ ID NO: 38093 - DNA, 21 bp, Homo sapiens
agtggtagtcccagctactca

SEQ ID NO: 38094 - DNA, 19 bp, Homo sapiens
attagtctctcctctgtga

SEQ ID NO: 38095 - DNA, 19 bp, Homo sapiens
caccatggaaaccagttcc

SEQ ID NO: 38096 - DNA, 20 bp, Homo sapiens
ccattaaaaaaattaacttg

SEQ ID NO: 38097 - DNA, 20 bp, Homo sapiens
gcaagacacacacacatcaa

SEQ ID NO: 38098 - DNA, 18 bp, Homo sapiens
gccataaattttgccttg

SEQ ID NO: 38099 - DNA, 21 bp, Homo sapiens
atcttactggttgttaggcct

SEQ ID NO: 38100 - DNA, 21 bp, Homo sapiens
gccccgagcaggcccaccttt

SEQ ID NO: 38101 - DNA, 21 bp, Homo sapiens
gcctgaataggctcctggccc

SEQ ID NO: 38102 - DNA, 24 bp, Homo sapiens
gcctgaattgcagttcctgtgccc

SEQ ID NO: 38103 - DNA, 19 bp, Homo sapiens
aaactcctgacctcaggtg

SEQ ID NO: 38104 - DNA, 21 bp, Homo sapiens
aggcacccaccatcccatcca

SEQ ID NO: 38105 - DNA, 19 bp, Homo sapiens
aggcgcccacctccacacc

SEQ ID NO: 38106 - DNA, 18 bp, Homo sapiens
aggtgtgtatatctctca

SEQ ID NO: 38107 - DNA, 16 bp, Homo sapiens
agtaagtgggtgtcag

SEQ ID NO: 38108 - DNA, 16 bp, Homo sapiens
cagctggatgacctca

SEQ ID NO: 38109 - DNA, 18 bp, Homo sapiens
cctgcaacctccacctcc

SEQ ID NO: 38110 - DNA, 22 bp, Homo sapiens
gagccaagatggcgccactaca

SEQ ID NO: 38111 - DNA, 24 bp, Homo sapiens
gccaccttttcctgggaacctgga

SEQ ID NO: 38112 - DNA, 19 bp, Homo sapiens
ggccagactgtgtttgtta

SEQ ID NO: 38113 - DNA, 18 bp, Homo sapiens
gttcttccccttctggtg

SEQ ID NO: 38114 - DNA, 18 bp, Homo sapiens
tagtgaatctgtacagta

SEQ ID NO: 38115 - DNA, 23 bp, Homo sapiens
tattcagtgaatgccagctctca

SEQ ID NO: 38116 - DNA, 18 bp, Homo sapiens
tccacctcccgggttcaa

SEQ ID NO: 38117 - DNA, 19 bp, Homo sapiens
tctagaatcatattgtcta

SEQ ID NO: 38118 - DNA, 19 bp, Homo sapiens
tgcaatgccatcctcgcca

SEQ ID NO: 38119 - DNA, 22 bp, Homo sapiens
cgtttccatcctgtttctgtga

SEQ ID NO: 38120 - DNA, 17 bp, Homo sapiens
cccgccctcccccagct

SEQ ID NO: 38121 - DNA, 24 bp, Homo sapiens
ccctgcttcccaccacttccctca

SEQ ID NO: 38122 - DNA, 18 bp, Homo sapiens
cctgcttcccaccacttc

SEQ ID NO: 38123 - DNA, 19 bp, Homo sapiens
cctgggcaatcttaacatc

SEQ ID NO: 38124 - DNA, 16 bp, Homo sapiens
gacccacgcctcccgc

SEQ ID NO: 38125 - DNA, 22 bp, Homo sapiens
tccttaacaccctattcttcct

SEQ ID NO: 38126 - DNA, 19 bp, Homo sapiens
ttgggcctgggtggctttt

SEQ ID NO: 38127 - DNA, 21 bp, Homo sapiens
cacaggtacaggtggctgcag

SEQ ID NO: 38128 - DNA, 21 bp, Homo sapiens
cttaccctttcacacagatca

SEQ ID NO: 38129 - DNA, 21 bp, Homo sapiens
taaaacacaaaaaattagcca

SEQ ID NO: 38130 - DNA, 19 bp, Homo sapiens
tctgagccaggcctgtgag

SEQ ID NO: 38131 - DNA, 19 bp, Homo sapiens
tgcactcatgcaagcttct

SEQ ID NO: 38132 - DNA, 19 bp, Homo sapiens
acctcagaatgcaaccttc

SEQ ID NO: 38133 - DNA, 23 bp, Homo sapiens
tggccttgaactcttgggctcaa

SEQ ID NO: 38134 - DNA, 21 bp, Homo sapiens
tgggcactgacagtgaggctg

SEQ ID NO: 38135 - DNA, 19 bp, Homo sapiens
ctccccaaagccatctggt

SEQ ID NO: 38136 - DNA, 20 bp, Homo sapiens
cttctgcctcctaggttcaa

SEQ ID NO: 38137 - DNA, 18 bp, Homo sapiens
gccttccaaagtgcatta

SEQ ID NO: 38138 - DNA, 17 bp, Homo sapiens
tctaactgcaccccttc

SEQ ID NO: 38139 - DNA, 21 bp, Homo sapiens
ggtaagtgggaaagccttttg

SEQ ID NO: 38140 - DNA, 18 bp, Homo sapiens
gcaacagctaggctgctg

SEQ ID NO: 38141 - DNA, 18 bp, Homo sapiens
gggccgagaactttgcca

SEQ ID NO: 38142 - DNA, 16 bp, Homo sapiens
ctgttttggagactgc

SEQ ID NO: 38143 - DNA, 24 bp, Homo sapiens
ggaagagacgtcgcctccccttca

SEQ ID NO: 38144 - DNA, 24 bp, Homo sapiens
gttttggagactgcctataagtta

SEQ ID NO: 38145 - DNA, 24 bp, Homo sapiens
cccgccttttttgcggccaccatt

SEQ ID NO: 38146 - DNA, 20 bp, Homo sapiens
gaggttcccccagctgccac

SEQ ID NO: 38147 - DNA, 21 bp, Homo sapiens
cttgcggccaccgccccccgg

SEQ ID NO: 38148 - DNA, 22 bp, Homo sapiens
ccgctctgtgacagtccatgac

SEQ ID NO: 38149 - DNA, 20 bp, Homo sapiens
gcacgccaccacccagctca

SEQ ID NO: 38150 - DNA, 17 bp, Homo sapiens
ttttgggacagagtctc

SEQ ID NO: 38151 - DNA, 20 bp, Homo sapiens
gggagcccggcggcttcggc

SEQ ID NO: 38152 - DNA, 18 bp, Homo sapiens
aaatcacaaaccttgaaa

SEQ ID NO: 38153 - DNA, 25 bp, Homo sapiens
acctgagcacgtcttgcctgagtcc

SEQ ID NO: 38154 - DNA, 18 bp, Homo sapiens
aagtcaattctatgtagt

SEQ ID NO: 38155 - DNA, 19 bp, Homo sapiens
agcatcatcaacatcacca

SEQ ID NO: 38156 - DNA, 22 bp, Homo sapiens
atctcggctcactgcaatctct

SEQ ID NO: 38157 - DNA, 21 bp, Homo sapiens
ccgagatggagtcttactctg

SEQ ID NO: 38158 - DNA, 18 bp, Homo sapiens
gctttgactatttggcct

SEQ ID NO: 38159 - DNA, 20 bp, Homo sapiens
tctctgcctctcgggttcaa

SEQ ID NO: 38160 - DNA, 20 bp, Homo sapiens
tttgcttgccctgcccccga

SEQ ID NO: 38161 - DNA, 23 bp, Homo sapiens
ataatctcaagactcctccctta

SEQ ID NO: 38162 - DNA, 17 bp, Homo sapiens
atcaaatgaatatgtgt

SEQ ID NO: 38163 - DNA, 19 bp, Homo sapiens
caacaacattctataactg

SEQ ID NO: 38164 - DNA, 19 bp, Homo sapiens
ctctggtgatggctgtgag

SEQ ID NO: 38165 - DNA, 17 bp, Homo sapiens
gctgtcggcagtactca

SEQ ID NO: 38166 - DNA, 16 bp, Homo sapiens
aggagcctgagctggc

SEQ ID NO: 38167 - DNA, 22 bp, Homo sapiens
ccacctcggtcacctccacctc

SEQ ID NO: 38168 - DNA, 16 bp, Homo sapiens
cctaccacggctccgg

SEQ ID NO: 38169 - DNA, 19 bp, Homo sapiens
ctaccgtcaggatgcttca

SEQ ID NO: 38170 - DNA, 17 bp, Homo sapiens
ctctgggaggaagctgc

SEQ ID NO: 38171 - DNA, 19 bp, Homo sapiens
ctgaggctctggtaggctg

SEQ ID NO: 38172 - DNA, 19 bp, Homo sapiens
tgaccaacatcctagagca

SEQ ID NO: 38173 - DNA, 15 bp, Homo sapiens
tgagcagcaacagca

SEQ ID NO: 38174 - DNA, 22 bp, Homo sapiens
agctgggtgcaccctgacccca

SEQ ID NO: 38175 - DNA, 22 bp, Homo sapiens
aggaaaatcggttccaaggaca

SEQ ID NO: 38176 - DNA, 22 bp, Homo sapiens
ctgagcctgtcagtgggtcaga

SEQ ID NO: 38177 - DNA, 18 bp, Homo sapiens
agaaatactccatgtgat

SEQ ID NO: 38178 - DNA, 19 bp, Homo sapiens
ccatcccccacccacctgc

SEQ ID NO: 38179 - DNA, 21 bp, Homo sapiens
cctgtgccccacaaggagctg

SEQ ID NO: 38180 - DNA, 23 bp, Homo sapiens
ggcaatgacagatactacctgct

SEQ ID NO: 38181 - DNA, 17 bp, Homo sapiens
atcccaaagccattcca

SEQ ID NO: 38182 - DNA, 20 bp, Homo sapiens
gagtaaagataacctagtcg

SEQ ID NO: 38183 - DNA, 16 bp, Homo sapiens
aacaacaaacaaagaa

SEQ ID NO: 38184 - DNA, 19 bp, Homo sapiens
acattcactgctatcacca

SEQ ID NO: 38185 - DNA, 24 bp, Homo sapiens
caaggaaaacaaacaacaaataca

SEQ ID NO: 38186 - DNA, 18 bp, Homo sapiens
ggaggaggagggatgcca

SEQ ID NO: 38187 - DNA, 23 bp, Homo sapiens
ggaggagggatgccacacagaca

SEQ ID NO: 38188 - DNA, 20 bp, Homo sapiens
tacagctgcgaagaaggcag

SEQ ID NO: 38189 - DNA, 20 bp, Homo sapiens
tgcccgtttgcccgtgccag

SEQ ID NO: 38190 - DNA, 20 bp, Homo sapiens
tgggctatttcattcctggt

SEQ ID NO: 38191 - DNA, 17 bp, Homo sapiens
aatctcattgtactaca

SEQ ID NO: 38192 - DNA, 17 bp, Homo sapiens
ccactgagaagaccgct

SEQ ID NO: 38193 - DNA, 17 bp, Homo sapiens
ctgactcagcctctgat

SEQ ID NO: 38194 - DNA, 19 bp, Homo sapiens
ggtttttgaattgcagcag

SEQ ID NO: 38195 - DNA, 17 bp, Homo sapiens
gtcctttgagcgcagct

SEQ ID NO: 38196 - DNA, 25 bp, Homo sapiens
tttttgtttggttggttttggcttt

SEQ ID NO: 38197 - DNA, 22 bp, Homo sapiens
acctggattcctagcttggctc

SEQ ID NO: 38198 - DNA, 19 bp, Homo sapiens
cagacatcattacatttca

SEQ ID NO: 38199 - DNA, 20 bp, Homo sapiens
gtaagctgagatggctccat

SEQ ID NO: 38200 - DNA, 24 bp, Homo sapiens
tacatttcacttctaaacacttca

SEQ ID NO: 38201 - DNA, 20 bp, Homo sapiens
tctgcctgccctatcctgac

SEQ ID NO: 38202 - DNA, 20 bp, Homo sapiens
actgacattatttagtgtca

SEQ ID NO: 38203 - DNA, 21 bp, Homo sapiens
atcttggctcaccacaacctc

SEQ ID NO: 38204 - DNA, 22 bp, Homo sapiens
cccatggcccagtatgaggcca

SEQ ID NO: 38205 - DNA, 18 bp, Homo sapiens
ctggctgctgcttggccc

SEQ ID NO: 38206 - DNA, 22 bp, Homo sapiens
gaaaaaaactctcttcctgtgt

SEQ ID NO: 38207 - DNA, 16 bp, Homo sapiens
gcgtgaaaaccttgcc

SEQ ID NO: 38208 - DNA, 23 bp, Homo sapiens
ggcgtgagccaccgcgcccggcc

SEQ ID NO: 38209 - DNA, 20 bp, Homo sapiens
gtttattttccatcactgta

SEQ ID NO: 38210 - DNA, 17 bp, Homo sapiens
tcaagtgattctcctgc

SEQ ID NO: 38211 - DNA, 20 bp, Homo sapiens
tcaccacaacctccacctcc

SEQ ID NO: 38212 - DNA, 18 bp, Homo sapiens
tccacctcccaggttcaa

SEQ ID NO: 38213 - DNA, 20 bp, Homo sapiens
tggtcaggctggtcttgaac

SEQ ID NO: 38214 - DNA, 20 bp, Homo sapiens
aactagaatcagcaacgaga

SEQ ID NO: 38215 - DNA, 19 bp, Homo sapiens
acatagtggacagcattgt

SEQ ID NO: 38216 - DNA, 21 bp, Homo sapiens
caggatcatgcacccttgtta

SEQ ID NO: 38217 - DNA, 20 bp, Homo sapiens
aaaaataagctgggtgtggt

SEQ ID NO: 38218 - DNA, 20 bp, Homo sapiens
ccaaaagctgcagagtctga

SEQ ID NO: 38219 - DNA, 20 bp, Homo sapiens
gagctttttggaaatactca

SEQ ID NO: 38220 - DNA, 19 bp, Homo sapiens
tcttcctccttattcctca

SEQ ID NO: 38221 - DNA, 19 bp, Homo sapiens
tgggtgacagtgtgagatt

SEQ ID NO: 38222 - DNA, 23 bp, Homo sapiens
cgagtgtgaggttaggtccagca

SEQ ID NO: 38223 - DNA, 18 bp, Homo sapiens
ctaactggtagcatttgc

SEQ ID NO: 38224 - DNA, 20 bp, Homo sapiens
ctgctgatgaatgaccgagt

SEQ ID NO: 38225 - DNA, 20 bp, Homo sapiens
gcttgggcccaggtctgtct

SEQ ID NO: 38226 - DNA, 18 bp, Homo sapiens
gggcttgagaagctcctt

SEQ ID NO: 38227 - DNA, 22 bp, Homo sapiens
acaaaataatggcattcacagc

SEQ ID NO: 38228 - DNA, 18 bp, Homo sapiens
atacattgggtacagtgt

SEQ ID NO: 38229 - DNA, 18 bp, Homo sapiens
gggtgcaccaaaatctca

SEQ ID NO: 38230 - DNA, 23 bp, Homo sapiens
ccaccctctctctacctgtcacc

SEQ ID NO: 38231 - DNA, 19 bp, Homo sapiens
ctgccaccaccctctctct

SEQ ID NO: 38232 - DNA, 20 bp, Homo sapiens
tgccctccaatgtggggctg

SEQ ID NO: 38233 - DNA, 19 bp, Homo sapiens
catgtaccaggtgtcccag

SEQ ID NO: 38234 - DNA, 26 bp, Homo sapiens
gccagccaccgtgtgaactctttgga

SEQ ID NO: 38235 - DNA, 20 bp, Homo sapiens
ggagccagggccgagtcctc

SEQ ID NO: 38236 - DNA, 23 bp, Homo sapiens
gtgccagccaccgtgtgaactct

SEQ ID NO: 38237 - DNA, 18 bp, Homo sapiens
cctgcaacctccacctcc

SEQ ID NO: 38238 - DNA, 19 bp, Homo sapiens
ctgcaacctccacctccca

SEQ ID NO: 38239 - DNA, 22 bp, Homo sapiens
tcacaccatttcctgtttcttt

SEQ ID NO: 38240 - DNA, 18 bp, Homo sapiens
tccacctcccaggttcaa

SEQ ID NO: 38241 - DNA, 21 bp, Homo sapiens
ttctgacccctgtgcctccca

SEQ ID NO: 38242 - DNA, 18 bp, Homo sapiens
agttgtgaatgaaatgtc

SEQ ID NO: 38243 - DNA, 19 bp, Homo sapiens
atggcttggaccaggccag

SEQ ID NO: 38244 - DNA, 22 bp, Homo sapiens
gcccccctcgcccagcctgaga

SEQ ID NO: 38245 - DNA, 21 bp, Homo sapiens
agctggagttttcttctgtga

SEQ ID NO: 38246 - DNA, 15 bp, Homo sapiens
atggcggagttctga

SEQ ID NO: 38247 - DNA, 19 bp, Homo sapiens
gtggacactttgaaccact

SEQ ID NO: 38248 - DNA, 21 bp, Homo sapiens
tggtcatccgccgtggggctg

SEQ ID NO: 38249 - DNA, 19 bp, Homo sapiens
cacaaaaatactcagctcc

SEQ ID NO: 38250 - DNA, 20 bp, Homo sapiens
tcacgtgtgttctttgtcat

SEQ ID NO: 38251 - DNA, 18 bp, Homo sapiens
gaaatatactttatctga

SEQ ID NO: 38252 - DNA, 26 bp, Homo sapiens
gctcttgcacaaatttttgggttttg

SEQ ID NO: 38253 - DNA, 18 bp, Homo sapiens
gaaatatactttatctga

SEQ ID NO: 38254 - DNA, 26 bp, Homo sapiens
gctcttgcacaaatttttgggttttg

SEQ ID NO: 38255 - DNA, 20 bp, Homo sapiens
gcttctttttcatgatgcca

SEQ ID NO: 38256 - DNA, 17 bp, Homo sapiens
aacaacatcccttcatc

SEQ ID NO: 38257 - DNA, 20 bp, Homo sapiens
agctttctccctttgtctca

SEQ ID NO: 38258 - DNA, 22 bp, Homo sapiens
cgggcgctctccgccggtgcct

SEQ ID NO: 38259 - DNA, 22 bp, Homo sapiens
ctatgtttggtattttgtctta

SEQ ID NO: 38260 - DNA, 22 bp, Homo sapiens
ctctttcttaaatgtggtttgt

SEQ ID NO: 38261 - DNA, 23 bp, Homo sapiens
cttcatcccaaccgggcatcaca

SEQ ID NO: 38262 - DNA, 18 bp, Homo sapiens
gaggtcaatgtggagctg

SEQ ID NO: 38263 - DNA, 20 bp, Homo sapiens
tgagaaactaggtgaaactg

SEQ ID NO: 38264 - DNA, 21 bp, Homo sapiens
atcttggctcactgcaacctc

SEQ ID NO: 38265 - DNA, 18 bp, Homo sapiens
caccattctcctgcctca

SEQ ID NO: 38266 - DNA, 19 bp, Homo sapiens
ctgcaagctccgcctccca

SEQ ID NO: 38267 - DNA, 22 bp, Homo sapiens
ctgggattacaggcacccatca

SEQ ID NO: 38268 - DNA, 18 bp, Homo sapiens
tccgcctcctgggttcaa

SEQ ID NO: 38269 - DNA, 17 bp, Homo sapiens
tctgacctcatgatcca

SEQ ID NO: 38270 - DNA, 20 bp, Homo sapiens
tgccatgttcccccatcttt

SEQ ID NO: 38271 - DNA, 20 bp, Homo sapiens
tggccaggctggtcttgaac

SEQ ID NO: 38272 - DNA, 20 bp, Homo sapiens
tgtctctaacacaggcccca

SEQ ID NO: 38273 - DNA, 20 bp, Homo sapiens
ttctcctgcctcagctttcc

SEQ ID NO: 38274 - DNA, 20 bp, Homo sapiens
ttctgatcctttatttctgc

SEQ ID NO: 38275 - DNA, 17 bp, Homo sapiens
gcgcgccaggaaccagc

SEQ ID NO: 38276 - DNA, 18 bp, Homo sapiens
ttgcaattgcttccctca

SEQ ID NO: 38277 - DNA, 22 bp, Homo sapiens
ccctggggcagagatttgtgag

SEQ ID NO: 38278 - DNA, 19 bp, Homo sapiens
ctcagcctctcctgcctct

SEQ ID NO: 38279 - DNA, 23 bp, Homo sapiens
gcctctctgcccaggctctcctc

SEQ ID NO: 38280 - DNA, 17 bp, Homo sapiens
gctgagctctcacctca

SEQ ID NO: 38281 - DNA, 22 bp, Homo sapiens
tcctgcctctgcaggcctggca

SEQ ID NO: 38282 - DNA, 19 bp, Homo sapiens
tgcccaggctctcctcctc

SEQ ID NO: 38283 - DNA, 21 bp, Homo sapiens
tgtaaactccaaatgtttaca

SEQ ID NO: 38284 - DNA, 18 bp, Homo sapiens
ttgcccacctccacttcc

SEQ ID NO: 38285 - DNA, 17 bp, Homo sapiens
aaactgcgtagcaacga

SEQ ID NO: 38286 - DNA, 17 bp, Homo sapiens
aggaggggacggggaga

SEQ ID NO: 38287 - DNA, 18 bp, Homo sapiens
acctgactggagctcaga

SEQ ID NO: 38288 - DNA, 18 bp, Homo sapiens
caagctcctgcatttggc

SEQ ID NO: 38289 - DNA, 18 bp, Homo sapiens
aagggaaggcaaagtcca

SEQ ID NO: 38290 - DNA, 17 bp, Homo sapiens
gaaaaaggaagccactg

SEQ ID NO: 38291 - DNA, 18 bp, Homo sapiens
ggtgcagcacttaaactg

SEQ ID NO: 38292 - DNA, 25 bp, Homo sapiens
taaattgacttcagtggtgagactg

SEQ ID NO: 38293 - DNA, 19 bp, Homo sapiens
taagatcatggtttagggt

SEQ ID NO: 38294 - DNA, 18 bp, Homo sapiens
tcacactggctccagaca

SEQ ID NO: 38295 - DNA, 21 bp, Homo sapiens
ttcaagctgctgactcacttt

SEQ ID NO: 38296 - DNA, 19 bp, Homo sapiens
ttgcaaaacattgctgcct

SEQ ID NO: 38297 - DNA, 18 bp, Homo sapiens
ttgtggctggtctggctt

SEQ ID NO: 38298 - DNA, 20 bp, Homo sapiens
aacccagacccacctcctgc

SEQ ID NO: 38299 - DNA, 21 bp, Homo sapiens
catcctcctcttcctcagatg

SEQ ID NO: 38300 - DNA, 22 bp, Homo sapiens
cccagacccacctcctgcccca

SEQ ID NO: 38301 - DNA, 19 bp, Homo sapiens
ccccgttgcaggcctggca

SEQ ID NO: 38302 - DNA, 17 bp, Homo sapiens
cccctcttgcctcagga

SEQ ID NO: 38303 - DNA, 21 bp, Homo sapiens
ccttgatgggcaggcttggaa

SEQ ID NO: 38304 - DNA, 19 bp, Homo sapiens
cttcttcatggctgcgttg

SEQ ID NO: 38305 - DNA, 24 bp, Homo sapiens
gtttgaactgctcctccctggcct

SEQ ID NO: 38306 - DNA, 18 bp, Homo sapiens
tatggtgtcgcttggcta

SEQ ID NO: 38307 - DNA, 16 bp, Homo sapiens
caagaatgtgctggac

SEQ ID NO: 38308 - DNA, 21 bp, Homo sapiens
ctccgtgggggaggagctgta

SEQ ID NO: 38309 - DNA, 22 bp, Homo sapiens
ttcctggtcaccctgcctcgga

SEQ ID NO: 38310 - DNA, 19 bp, Homo sapiens
tagtgtttgactactgcta

SEQ ID NO: 38311 - DNA, 25 bp, Homo sapiens
tcaccctcctgtcccccccacctcc

SEQ ID NO: 38312 - DNA, 19 bp, Homo sapiens
aagcaattctcctgcctca

SEQ ID NO: 38313 - DNA, 20 bp, Homo sapiens
tatctgtgactgtcatacta

SEQ ID NO: 38314 - DNA, 19 bp, Homo sapiens
gcaagaaaggagtttgcca

SEQ ID NO: 38315 - DNA, 20 bp, Homo sapiens
accctgcagtctccttgcca

SEQ ID NO: 38316 - DNA, 19 bp, Homo sapiens
ccgcctgcatgccgcctca

SEQ ID NO: 38317 - DNA, 19 bp, Homo sapiens
ctaaaggcaccgcaagctg

SEQ ID NO: 38318 - DNA, 22 bp, Homo sapiens
ctgtgaactcaaggccttccct

SEQ ID NO: 38319 - DNA, 22 bp, Homo sapiens
gcgaggccccagctctgctgct

SEQ ID NO: 38320 - DNA, 21 bp, Homo sapiens
ggaggggactgcatgggcatc

SEQ ID NO: 38321 - DNA, 18 bp, Homo sapiens
tagaaaatacagatccta

SEQ ID NO: 38322 - DNA, 19 bp, Homo sapiens
tccctgccccaggcgtgca

SEQ ID NO: 38323 - DNA, 19 bp, Homo sapiens
tggccctggtgagaggcta

SEQ ID NO: 38324 - DNA, 18 bp, Homo sapiens
aatctcaaagatttgcag

SEQ ID NO: 38325 - DNA, 23 bp, Homo sapiens
attcaagtgaaaacagatgtgtg

SEQ ID NO: 38326 - DNA, 18 bp, Homo sapiens
cttgaaacagacctcttc

SEQ ID NO: 38327 - DNA, 22 bp, Homo sapiens
ctacttcggtgatggagatggg

SEQ ID NO: 38328 - DNA, 20 bp, Homo sapiens
acagacacagcgctgcccag

SEQ ID NO: 38329 - DNA, 18 bp, Homo sapiens
catggcctcacctgctca

SEQ ID NO: 38330 - DNA, 18 bp, Homo sapiens
ccaggcccacgctcaaca

SEQ ID NO: 38331 - DNA, 25 bp, Homo sapiens
cctgtttctggactcagtggactca

SEQ ID NO: 38332 - DNA, 22 bp, Homo sapiens
cgccatggcctcacctgctcac

SEQ ID NO: 38333 - DNA, 17 bp, Homo sapiens
tcacctgctcacgggca

SEQ ID NO: 38334 - DNA, 18 bp, Homo sapiens
tctaagaaatattttctt

SEQ ID NO: 38335 - DNA, 28 bp, Homo sapiens
aggcacctacaggaaaaatttcatacca

SEQ ID NO: 38336 - DNA, 21 bp, Homo sapiens
atcctggctcactgcaatctc

SEQ ID NO: 38337 - DNA, 19 bp, Homo sapiens
caggaaaaatttcatacca

SEQ ID NO: 38338 - DNA, 18 bp, Homo sapiens
tccatctcccgggttcaa

SEQ ID NO: 38339 - DNA, 18 bp, Homo sapiens
tctgccagccaagtggca

SEQ ID NO: 38340 - DNA, 22 bp, Homo sapiens
aggacaaggcgccccgggccca

SEQ ID NO: 38341 - DNA, 26 bp, Homo sapiens
cacgaagtcaagaaccaaacagctca

SEQ ID NO: 38342 - DNA, 24 bp, Homo sapiens
tgctattcaaagatggactattga

SEQ ID NO: 38343 - DNA, 19 bp, Homo sapiens
aagctacaagaagtcccca

SEQ ID NO: 38344 - DNA, 18 bp, Homo sapiens
atctcaccaactgcaaac

SEQ ID NO: 38345 - DNA, 23 bp, Homo sapiens
cctttcataattactttagcttt

SEQ ID NO: 38346 - DNA, 21 bp, Homo sapiens
ggcctgatctgcaaagctgca

SEQ ID NO: 38347 - DNA, 17 bp, Homo sapiens
ggctttctctaaatcct

SEQ ID NO: 38348 - DNA, 19 bp, Homo sapiens
gagaggaggacagagatga

SEQ ID NO: 38349 - DNA, 22 bp, Homo sapiens
aatgtggcaaatttttcagaca

SEQ ID NO: 38350 - DNA, 18 bp, Homo sapiens
tccgcctcctgggttcaa

SEQ ID NO: 38351 - DNA, 18 bp, Homo sapiens
atttcacacagagcccct

SEQ ID NO: 38352 - DNA, 22 bp, Homo sapiens
caagatcgtgccattccactcc

SEQ ID NO: 38353 - DNA, 16 bp, Homo sapiens
tgcccagaccagttcc

SEQ ID NO: 38354 - DNA, 17 bp, Homo sapiens
ggttttggctctaccgg

SEQ ID NO: 38355 - DNA, 17 bp, Homo sapiens
ccaacctttgtgccaat

SEQ ID NO: 38356 - DNA, 21 bp, Homo sapiens
gagaggttaagttgcttgcca

SEQ ID NO: 38357 - DNA, 19 bp, Homo sapiens
catcttaaaacagatcaga

SEQ ID NO: 38358 - DNA, 22 bp, Homo sapiens
ccagcagcagccagggcctgct

SEQ ID NO: 38359 - DNA, 19 bp, Homo sapiens
gtggagcgcggggccctga

SEQ ID NO: 38360 - DNA, 21 bp, Homo sapiens
tcccaattctttctctgcccc

SEQ ID NO: 38361 - DNA, 21 bp, Homo sapiens
agaagggcctcttgagtgcga

SEQ ID NO: 38362 - DNA, 18 bp, Homo sapiens
tctgacagcagtaactca

SEQ ID NO: 38363 - DNA, 19 bp, Homo sapiens
tgcatttgcctccagccca

SEQ ID NO: 38364 - DNA, 22 bp, Homo sapiens
tggactgccctgtatctaagtc

SEQ ID NO: 38365 - DNA, 21 bp, Homo sapiens
ttttttgtccagcctgccgct

SEQ ID NO: 38366 - DNA, 22 bp, Homo sapiens
agacggctcgcactgcgacccg

SEQ ID NO: 38367 - DNA, 17 bp, Homo sapiens
caagaacgcagcgtgca

SEQ ID NO: 38368 - DNA, 23 bp, Homo sapiens
cgagatggaccctgggctcggcg

SEQ ID NO: 38369 - DNA, 20 bp, Homo sapiens
tcccaggaggccacactgca

SEQ ID NO: 38370 - DNA, 24 bp, Homo sapiens
cctcccagtccataggttgctttt

SEQ ID NO: 38371 - DNA, 18 bp, Homo sapiens
cctggctgggctggcgga

SEQ ID NO: 38372 - DNA, 19 bp, Homo sapiens
ctgcaagctccgcctccca

SEQ ID NO: 38373 - DNA, 18 bp, Homo sapiens
ttctacagtatttatctt

SEQ ID NO: 38374 - DNA, 19 bp, Homo sapiens
aaaccttttctcccctttc

SEQ ID NO: 38375 - DNA, 19 bp, Homo sapiens
agaggagaaataaaacctt

SEQ ID NO: 38376 - DNA, 18 bp, Homo sapiens
cacacaggcacccaccca

SEQ ID NO: 38377 - DNA, 19 bp, Homo sapiens
cattggtgtgtttagagat

SEQ ID NO: 38378 - DNA, 17 bp, Homo sapiens
gggaagggggcattgac

SEQ ID NO: 38379 - DNA, 16 bp, Homo sapiens
ttggatgctgccttac

SEQ ID NO: 38380 - DNA, 18 bp, Homo sapiens
caagaatggcttgaatca

SEQ ID NO: 38381 - DNA, 19 bp, Homo sapiens
aggtgggcctgggaacagg

SEQ ID NO: 38382 - DNA, 18 bp, Homo sapiens
ctggtcgcaattgcttct

SEQ ID NO: 38383 - DNA, 21 bp, Homo sapiens
ccatacggtgaggcaatgagg

SEQ ID NO: 38384 - DNA, 18 bp, Homo sapiens
cctgcaacctccacctcc

SEQ ID NO: 38385 - DNA, 19 bp, Homo sapiens
ctgcaacctccacctccca

SEQ ID NO: 38386 - DNA, 21 bp, Homo sapiens
ctgtgtatccaccatgcagac

SEQ ID NO: 38387 - DNA, 23 bp, Homo sapiens
gagctgcgcacaccccaaggcca

SEQ ID NO: 38388 - DNA, 17 bp, Homo sapiens
tcaagtgattctcctgc

SEQ ID NO: 38389 - DNA, 18 bp, Homo sapiens
tccacctcccaggttcaa

SEQ ID NO: 38390 - DNA, 19 bp, Homo sapiens
acctctgtcacacacacaa

SEQ ID NO: 38391 - DNA, 18 bp, Homo sapiens
agcagaaaaactctgtga

SEQ ID NO: 38392 - DNA, 17 bp, Homo sapiens
aggcaggataatcactt

SEQ ID NO: 38393 - DNA, 22 bp, Homo sapiens
gagccaagatcgcgccactgca

SEQ ID NO: 38394 - DNA, 19 bp, Homo sapiens
taaaaatgacatatttggt

SEQ ID NO: 38395 - DNA, 15 bp, Homo sapiens
tcatgaaatatctca

SEQ ID NO: 38396 - DNA, 20 bp, Homo sapiens
cagaaaactcagtcttttca

SEQ ID NO: 38397 - DNA, 19 bp, Homo sapiens
gcccaccccactcacactc

SEQ ID NO: 38398 - DNA, 20 bp, Homo sapiens
gacggtgccgagaagcagct

SEQ ID NO: 38399 - DNA, 21 bp, Homo sapiens
gggcgccacgagcaggtggtg

SEQ ID NO: 38400 - DNA, 20 bp, Homo sapiens
actcccagggactctgggga

SEQ ID NO: 38401 - DNA, 17 bp, Homo sapiens
cagattctggcatccca

SEQ ID NO: 38402 - DNA, 18 bp, Homo sapiens
gcccgcatcccaccctcc

SEQ ID NO: 38403 - DNA, 24 bp, Homo sapiens
tccccaccgtgacctgcctggcct

SEQ ID NO: 38404 - DNA, 21 bp, Homo sapiens
ttttggcggctgtagttgtgg

SEQ ID NO: 38405 - DNA, 21 bp, Homo sapiens
ccctggctagcttcccagaga

SEQ ID NO: 38406 - DNA, 27 bp, Homo sapiens
agggatttgcggccgggacccaccccc

SEQ ID NO: 38407 - DNA, 18 bp, Homo sapiens
agaaacgttcccaaactc

SEQ ID NO: 38408 - DNA, 21 bp, Homo sapiens
agccacgtcccaagccacctg

SEQ ID NO: 38409 - DNA, 22 bp, Homo sapiens
catctgcacacacccccaaggt

SEQ ID NO: 38410 - DNA, 18 bp, Homo sapiens
ccaccgtcccactccaca

SEQ ID NO: 38411 - DNA, 20 bp, Homo sapiens
cccccgcaggccaccaggca

SEQ ID NO: 38412 - DNA, 22 bp, Homo sapiens
cgaggttatgctcacctggtca

SEQ ID NO: 38413 - DNA, 18 bp, Homo sapiens
cgtagctgctcacaccag

SEQ ID NO: 38414 - DNA, 18 bp, Homo sapiens
gatagaaacataggcacc

SEQ ID NO: 38415 - DNA, 15 bp, Homo sapiens
ggacatcgtctgtgt

SEQ ID NO: 38416 - DNA, 22 bp, Homo sapiens
tccagtgccctccctctgttcc

SEQ ID NO: 38417 - DNA, 20 bp, Homo sapiens
tgagattcagggtggggctg

SEQ ID NO: 38418 - DNA, 23 bp, Homo sapiens
gggggaggaggctggggaaagcc

SEQ ID NO: 38419 - DNA, 21 bp, Homo sapiens
cacttgtgcagagacacgcgc

SEQ ID NO: 38420 - DNA, 17 bp, Homo sapiens
cgcgtgtgcaccacagg

SEQ ID NO: 38421 - DNA, 18 bp, Homo sapiens
gccaaggccccgcaccca

SEQ ID NO: 38422 - DNA, 21 bp, Homo sapiens
atatttctggaatccacctct

SEQ ID NO: 38423 - DNA, 19 bp, Homo sapiens
ttaaagcacacattcttca

SEQ ID NO: 38424 - DNA, 22 bp, Homo sapiens
cattccaagatgtggccattga

SEQ ID NO: 38425 - DNA, 22 bp, Homo sapiens
cccagaaatctgaacgttcgac

SEQ ID NO: 38426 - DNA, 19 bp, Homo sapiens
gtatcctcacacagagcca

SEQ ID NO: 38427 - DNA, 18 bp, Homo sapiens
gtgtggaccattgcttga

SEQ ID NO: 38428 - DNA, 20 bp, Homo sapiens
tcatagtgccagagacacca

SEQ ID NO: 38429 - DNA, 18 bp, Homo sapiens
tccctcactatgccttca

SEQ ID NO: 38430 - DNA, 19 bp, Homo sapiens
tccctgttccctctggtgt

SEQ ID NO: 38431 - DNA, 22 bp, Homo sapiens
tgtacaagctcatgatcagcca

SEQ ID NO: 38432 - DNA, 20 bp, Homo sapiens
gctgtttcccttgtaccaga

SEQ ID NO: 38433 - DNA, 23 bp, Homo sapiens
aaagtattatattttctacgtca

SEQ ID NO: 38434 - DNA, 16 bp, Homo sapiens
atgtaccagatattcc

SEQ ID NO: 38435 - DNA, 21 bp, Homo sapiens
catcactagcaattttcctga

SEQ ID NO: 38436 - DNA, 22 bp, Homo sapiens
gttggcgatacctcacatccta

SEQ ID NO: 38437 - DNA, 18 bp, Homo sapiens
tgagcctcagtttccaca

SEQ ID NO: 38438 - DNA, 19 bp, Homo sapiens
tgtaccagatattcctgga

SEQ ID NO: 38439 - DNA, 20 bp, Homo sapiens
cgcccccgcgcggggcctta

SEQ ID NO: 38440 - DNA, 17 bp, Homo sapiens
gatgccctgcccacctc

SEQ ID NO: 38441 - DNA, 19 bp, Homo sapiens
tgacgggagcctctgcgaa

SEQ ID NO: 38442 - DNA, 19 bp, Homo sapiens
ttgtattaagagccaatga

SEQ ID NO: 38443 - DNA, 18 bp, Homo sapiens
caggcccccagtcccctc

SEQ ID NO: 38444 - DNA, 22 bp, Homo sapiens
cctcccagaaatatgagctcag

SEQ ID NO: 38445 - DNA, 15 bp, Homo sapiens
ctccttcggcctggt

SEQ ID NO: 38446 - DNA, 17 bp, Homo sapiens
ggactagggtgaggctg

SEQ ID NO: 38447 - DNA, 16 bp, Homo sapiens
ggagtctccatcctca

SEQ ID NO: 38448 - DNA, 22 bp, Homo sapiens
tgcccagagcctcttgccccag

SEQ ID NO: 38449 - DNA, 23 bp, Homo sapiens
atgacacactcctcggtcattcc

SEQ ID NO: 38450 - DNA, 22 bp, Homo sapiens
ccctgcagtggggacttcgtgg

SEQ ID NO: 38451 - DNA, 23 bp, Homo sapiens
cgagcagccgctgggacgccatg

SEQ ID NO: 38452 - DNA, 24 bp, Homo sapiens
gcagatgccccacaccaccagtct

SEQ ID NO: 38453 - DNA, 20 bp, Homo sapiens
gtcgcaggatccggctgtgg

SEQ ID NO: 38454 - DNA, 18 bp, Homo sapiens
aagccctggccaagatga

SEQ ID NO: 38455 - DNA, 24 bp, Homo sapiens
ccaaaggagcaagccaaaacctca

SEQ ID NO: 38456 - DNA, 21 bp, Homo sapiens
ccttgggggccgggcacacta

SEQ ID NO: 38457 - DNA, 19 bp, Homo sapiens
gcaagggcctctcgagcca

SEQ ID NO: 38458 - DNA, 19 bp, Homo sapiens
gccatgtcaaggcccccca

SEQ ID NO: 38459 - DNA, 21 bp, Homo sapiens
gcgagttctgtggtgagttct

SEQ ID NO: 38460 - DNA, 22 bp, Homo sapiens
tgggtgggggccagtggggttg

SEQ ID NO: 38461 - DNA, 18 bp, Homo sapiens
aactgtcatctctaccct

SEQ ID NO: 38462 - DNA, 23 bp, Homo sapiens
ggtaaaatgtcaggaacaacttt

SEQ ID NO: 38463 - DNA, 22 bp, Homo sapiens
ggcaagaagggcaggctcacca

SEQ ID NO: 38464 - DNA, 19 bp, Homo sapiens
attctccgcctgagttgca

SEQ ID NO: 38465 - DNA, 23 bp, Homo sapiens
cacccaagccccccaggccccaa

SEQ ID NO: 38466 - DNA, 19 bp, Homo sapiens
cctccacccaagcccccca

SEQ ID NO: 38467 - DNA, 19 bp, Homo sapiens
gccagcggctgtttgttcc

SEQ ID NO: 38468 - DNA, 17 bp, Homo sapiens
ggcagggtcagggtggc

SEQ ID NO: 38469 - DNA, 22 bp, Homo sapiens
tgacctcagtgggcaggtagct

SEQ ID NO: 38470 - DNA, 20 bp, Homo sapiens
cagcttgttggccctggtca

SEQ ID NO: 38471 - DNA, 21 bp, Homo sapiens
tggatgccagtggtgaggctg

SEQ ID NO: 38472 - DNA, 20 bp, Homo sapiens
tggggagctggttgtgggtg

SEQ ID NO: 38473 - DNA, 22 bp, Homo sapiens
tggggtccaggctgggcccagt

SEQ ID NO: 38474 - DNA, 21 bp, Homo sapiens
agctacaagtactcaaggcca

SEQ ID NO: 38475 - DNA, 22 bp, Homo sapiens
cgcagctcactgcaatctctgc

SEQ ID NO: 38476 - DNA, 22 bp, Homo sapiens
gagccaagatcgcgccactgca

SEQ ID NO: 38477 - DNA, 21 bp, Homo sapiens
gcagctcactgcaatctctgc

SEQ ID NO: 38478 - DNA, 19 bp, Homo sapiens
accagacagtggaatatta

SEQ ID NO: 38479 - DNA, 22 bp, Homo sapiens
agaaaaaagaaagagagattcc

SEQ ID NO: 38480 - DNA, 21 bp, Homo sapiens
agccaccccaggcgcccatca

SEQ ID NO: 38481 - DNA, 18 bp, Homo sapiens
ggcacagctcctccctca

SEQ ID NO: 38482 - DNA, 17 bp, Homo sapiens
aacctcagttctgtgaa

SEQ ID NO: 38483 - DNA, 20 bp, Homo sapiens
atttaattgatttccaagtt

SEQ ID NO: 38484 - DNA, 18 bp, Homo sapiens
cctgcaacctccacctcc

SEQ ID NO: 38485 - DNA, 17 bp, Homo sapiens
tcaagcgattcttatgc

SEQ ID NO: 38486 - DNA, 18 bp, Homo sapiens
tccacctcctgggttcaa

SEQ ID NO: 38487 - DNA, 22 bp, Homo sapiens
ttggacccccgggctggctgca

SEQ ID NO: 38488 - DNA, 21 bp, Homo sapiens
tttctaattattcatcattac

SEQ ID NO: 38489 - DNA, 18 bp, Homo sapiens
ggcactgttgcagaccca

SEQ ID NO: 38490 - DNA, 17 bp, Homo sapiens
accccacaagtgtgaaa

SEQ ID NO: 38491 - DNA, 22 bp, Homo sapiens
gagccaagattgtaccactgca

SEQ ID NO: 38492 - DNA, 19 bp, Homo sapiens
ggccgggtgcggtggctta

SEQ ID NO: 38493 - DNA, 20 bp, Homo sapiens
aagtggctttgacgtggggc

SEQ ID NO: 38494 - DNA, 22 bp, Homo sapiens
aggcactcgcctgtccacttct

SEQ ID NO: 38495 - DNA, 23 bp, Homo sapiens
gggtgttgacacaggcgcccctc

SEQ ID NO: 38496 - DNA, 17 bp, Homo sapiens
cgcagagcagagcctgg

SEQ ID NO: 38497 - DNA, 18 bp, Homo sapiens
ctgtcttgcctgctgtcc

SEQ ID NO: 38498 - DNA, 19 bp, Homo sapiens
caccaccaccaccagcacc

SEQ ID NO: 38499 - DNA, 19 bp, Homo sapiens
caccaccaccaccagcacc

SEQ ID NO: 38500 - DNA, 21 bp, Homo sapiens
ctatgtgagaacaaatacctt

SEQ ID NO: 38501 - DNA, 19 bp, Homo sapiens
cttcctcagacatctccat

SEQ ID NO: 38502 - DNA, 22 bp, Homo sapiens
gagccaagatcacaccactgca

SEQ ID NO: 38503 - DNA, 21 bp, Homo sapiens
gcaagtaggttcaagttttat

SEQ ID NO: 38504 - DNA, 20 bp, Homo sapiens
gtaagtcatcgctgagcttt

SEQ ID NO: 38505 - DNA, 20 bp, Homo sapiens
tccagattcttattcctgcc

SEQ ID NO: 38506 - DNA, 24 bp, Homo sapiens
ttgctgtttgtctttgcttgtgat

SEQ ID NO: 38507 - DNA, 21 bp, Homo sapiens
acacaccccaccccgtttttc

SEQ ID NO: 38508 - DNA, 23 bp, Homo sapiens
cctgcctccaccctttccaacaa

SEQ ID NO: 38509 - DNA, 21 bp, Homo sapiens
ctcagctgcgacctctggcct

SEQ ID NO: 38510 - DNA, 19 bp, Homo sapiens
ctccgcctcccctgccctc

SEQ ID NO: 38511 - DNA, 20 bp, Homo sapiens
taaacgggctgagcgttcca

SEQ ID NO: 38512 - DNA, 19 bp, Homo sapiens
agctttcattaaaatgtca

SEQ ID NO: 38513 - DNA, 21 bp, Homo sapiens
cagaagcaaagcctcattgca

SEQ ID NO: 38514 - DNA, 23 bp, Homo sapiens
gtagtaagatagtgagcattcat

SEQ ID NO: 38515 - DNA, 19 bp, Homo sapiens
taaaatatgttgaaaggca

SEQ ID NO: 38516 - DNA, 21 bp, Homo sapiens
caaggaaatggacaaactaca

SEQ ID NO: 38517 - DNA, 17 bp, Homo sapiens
cccgatccttcttctga

SEQ ID NO: 38518 - DNA, 19 bp, Homo sapiens
cttctaggtatttgcccaa

SEQ ID NO: 38519 - DNA, 22 bp, Homo sapiens
tgctgtgaaaagcttcattcca

SEQ ID NO: 38520 - DNA, 21 bp, Homo sapiens
ctggagcagagcgggctgcga

SEQ ID NO: 38521 - DNA, 17 bp, Homo sapiens
aggctgagacctgggaa

SEQ ID NO: 38522 - DNA, 18 bp, Homo sapiens
aggattatgcttcactca

SEQ ID NO: 38523 - DNA, 22 bp, Homo sapiens
ccaggacattccatgtgcctca

SEQ ID NO: 38524 - DNA, 17 bp, Homo sapiens
ccctttttcctttactc

SEQ ID NO: 38525 - DNA, 19 bp, Homo sapiens
acgtagattcgggcaagtc

SEQ ID NO: 38526 - DNA, 20 bp, Homo sapiens
ccaagctgggagtctgggga

SEQ ID NO: 38527 - DNA, 23 bp, Homo sapiens
cccaggcagctggacagcaccca

SEQ ID NO: 38528 - DNA, 22 bp, Homo sapiens
ccctggtgacaaagcctttgga

SEQ ID NO: 38529 - DNA, 21 bp, Homo sapiens
ggcacacacgtgttatgaccg

SEQ ID NO: 38530 - DNA, 20 bp, Homo sapiens
caaggagatgacgggggcta

SEQ ID NO: 38531 - DNA, 22 bp, Homo sapiens
acctggccagacactgcactca

SEQ ID NO: 38532 - DNA, 19 bp, Homo sapiens
cagaaggaatgaaggcctg

SEQ ID NO: 38533 - DNA, 19 bp, Homo sapiens
ccccacccccagccccagc

SEQ ID NO: 38534 - DNA, 19 bp, Homo sapiens
cccttccccacccccatcc

SEQ ID NO: 38535 - DNA, 19 bp, Homo sapiens
cttccccacccccatccca

SEQ ID NO: 38536 - DNA, 18 bp, Homo sapiens
ggggccagccagtgtctg

SEQ ID NO: 38537 - DNA, 20 bp, Homo sapiens
tgttgaaatgtttctttgga

SEQ ID NO: 38538 - DNA, 19 bp, Homo sapiens
agccaacacatatggtcaa

SEQ ID NO: 38539 - DNA, 27 bp, Homo sapiens
cccgggcggccccgctccagcatccca

SEQ ID NO: 38540 - DNA, 18 bp, Homo sapiens
ctggcgaggaggctgcga

SEQ ID NO: 38541 - DNA, 19 bp, Homo sapiens
gcatcccagctcctgcact

SEQ ID NO: 38542 - DNA, 20 bp, Homo sapiens
gcttgaaccgtaatttggct

SEQ ID NO: 38543 - DNA, 21 bp, Homo sapiens
tgtgactttagaatggaactg

SEQ ID NO: 38544 - DNA, 21 bp, Homo sapiens
ttgtctcttcctttcacctca

SEQ ID NO: 38545 - DNA, 24 bp, Homo sapiens
atgcctcaggcttgctcctgctgt

SEQ ID NO: 38546 - DNA, 22 bp, Homo sapiens
cgaacagccacaagcagccatg

SEQ ID NO: 38547 - DNA, 18 bp, Homo sapiens
aacttcattactacccag

SEQ ID NO: 38548 - DNA, 18 bp, Homo sapiens
gatgtcttttctgccttt

SEQ ID NO: 38549 - DNA, 19 bp, Homo sapiens
gctcttaacatttgttgta

SEQ ID NO: 38550 - DNA, 20 bp, Homo sapiens
ttcagacatgcaatcaccta

SEQ ID NO: 38551 - DNA, 20 bp, Homo sapiens
ttctgcctttcttttgcctt

SEQ ID NO: 38552 - DNA, 21 bp, Homo sapiens
attgaacaggacaactgagga

SEQ ID NO: 38553 - DNA, 17 bp, Homo sapiens
catgttcttgctgaaaa

SEQ ID NO: 38554 - DNA, 18 bp, Homo sapiens
ggaaagtggtttgaaata

SEQ ID NO: 38555 - DNA, 18 bp, Homo sapiens
actagacaatgatcatta

SEQ ID NO: 38556 - DNA, 17 bp, Homo sapiens
cccacccacacctgtga

SEQ ID NO: 38557 - DNA, 21 bp, Homo sapiens
ctgccaattctcagtgtggta

SEQ ID NO: 38558 - DNA, 20 bp, Homo sapiens
ctttttaattggagaattga

SEQ ID NO: 38559 - DNA, 24 bp, Homo sapiens
gagctcaacattccattccatcca

SEQ ID NO: 38560 - DNA, 18 bp, Homo sapiens
gagctttggcgggggatg

SEQ ID NO: 38561 - DNA, 21 bp, Homo sapiens
tggatggatctttgcaggagc

SEQ ID NO: 38562 - DNA, 19 bp, Homo sapiens
accctaaaactgaggcact

SEQ ID NO: 38563 - DNA, 21 bp, Homo sapiens
atttgaacaaattcctggctc

SEQ ID NO: 38564 - DNA, 22 bp, Homo sapiens
ccaacaggatgaacgtgtgcaa

SEQ ID NO: 38565 - DNA, 18 bp, Homo sapiens
attcagggatattggaga

SEQ ID NO: 38566 - DNA, 26 bp, Homo sapiens
tattggagaagatattccactagaca

SEQ ID NO: 38567 - DNA, 21 bp, Homo sapiens
gaagtgcccaagtcttccttc

SEQ ID NO: 38568 - DNA, 25 bp, Homo sapiens
accttggctgtgattggcttggttc

SEQ ID NO: 38569 - DNA, 19 bp, Homo sapiens
ccaatcactacaaccacta

SEQ ID NO: 38570 - DNA, 19 bp, Homo sapiens
aatgatggttgtctggttt

SEQ ID NO: 38571 - DNA, 20 bp, Homo sapiens
atagcactcaaagcttatca

SEQ ID NO: 38572 - DNA, 19 bp, Homo sapiens
gcaatggatgagtgctgga

SEQ ID NO: 38573 - DNA, 22 bp, Homo sapiens
gcccaccccatctaacttctga

SEQ ID NO: 38574 - DNA, 19 bp, Homo sapiens
ggagcccacctgcctttcc

SEQ ID NO: 38575 - DNA, 17 bp, Homo sapiens
tgcttctgtgcttgctg

SEQ ID NO: 38576 - DNA, 17 bp, Homo sapiens
tggttttgttgttttta

SEQ ID NO: 38577 - DNA, 19 bp, Homo sapiens
aaagtgctgcagtaaacca

SEQ ID NO: 38578 - DNA, 17 bp, Homo sapiens
caccacagcgtcctcct

SEQ ID NO: 38579 - DNA, 20 bp, Homo sapiens
cactccactgcctgctcctc

SEQ ID NO: 38580 - DNA, 19 bp, Homo sapiens
cagaaatgtaactcaccca

SEQ ID NO: 38581 - DNA, 18 bp, Homo sapiens
cagaataagcctttcaaa

SEQ ID NO: 38582 - DNA, 22 bp, Homo sapiens
cctgtatcagaaatgtaactca

SEQ ID NO: 38583 - DNA, 16 bp, Homo sapiens
gcacccagtgctgctg

SEQ ID NO: 38584 - DNA, 18 bp, Homo sapiens
tacatttacacctgtaaa

SEQ ID NO: 38585 - DNA, 17 bp, Homo sapiens
ttctcctgcttcagcct

SEQ ID NO: 38586 - DNA, 19 bp, Homo sapiens
acacaggggtccccacgca

SEQ ID NO: 38587 - DNA, 24 bp, Homo sapiens
aggtatgccctctcctcttcctca

SEQ ID NO: 38588 - DNA, 25 bp, Homo sapiens
aagcgttttcccttctcataacccc

SEQ ID NO: 38589 - DNA, 19 bp, Homo sapiens
agtccacagaatacccatg

SEQ ID NO: 38590 - DNA, 21 bp, Homo sapiens
agtgaatgggatggatgtttg

SEQ ID NO: 38591 - DNA, 25 bp, Homo sapiens
aacagaatgagagcaaaggcacaga

SEQ ID NO: 38592 - DNA, 26 bp, Homo sapiens
atctgagtttctttggcttctggctc

SEQ ID NO: 38593 - DNA, 22 bp, Homo sapiens
cagcctggccaacacagtgaaa

SEQ ID NO: 38594 - DNA, 17 bp, Homo sapiens
ctggcagtcctgcctcc

SEQ ID NO: 38595 - DNA, 22 bp, Homo sapiens
cttctttgatgggtcttggctt

SEQ ID NO: 38596 - DNA, 23 bp, Homo sapiens
tcacagcacagagaagcaaccca

SEQ ID NO: 38597 - DNA, 18 bp, Homo sapiens
acattgtaaaacattgcc

SEQ ID NO: 38598 - DNA, 25 bp, Homo sapiens
cctgcatctctccccttactcttca

SEQ ID NO: 38599 - DNA, 25 bp, Homo sapiens
gaaacttttgatcaaaaccacattg

SEQ ID NO: 38600 - DNA, 18 bp, Homo sapiens
tcaccactggcatctaca

SEQ ID NO: 38601 - DNA, 23 bp, Homo sapiens
ttatttcactgcttcaccttcca

SEQ ID NO: 38602 - DNA, 19 bp, Homo sapiens
aagtacctaccctacctca

SEQ ID NO: 38603 - DNA, 21 bp, Homo sapiens
aatagcttatctatattctca

SEQ ID NO: 38604 - DNA, 21 bp, Homo sapiens
agtctcactctgttgccaggc

SEQ ID NO: 38605 - DNA, 18 bp, Homo sapiens
agtgctgtgattcacacg

SEQ ID NO: 38606 - DNA, 18 bp, Homo sapiens
cactgctagtaatcaagg

SEQ ID NO: 38607 - DNA, 17 bp, Homo sapiens
tactgacattgactagc

SEQ ID NO: 38608 - DNA, 21 bp, Homo sapiens
atcatggagctgagaatttca

SEQ ID NO: 38609 - DNA, 19 bp, Homo sapiens
ccacacctggcccactttt

SEQ ID NO: 38610 - DNA, 20 bp, Homo sapiens
tcattttctttcctttattc

SEQ ID NO: 38611 - DNA, 23 bp, Homo sapiens
tttgcatgtatgtgaagtttata

SEQ ID NO: 38612 - DNA, 21 bp, Homo sapiens
tgggtgggggcagcgtggggc

SEQ ID NO: 38613 - DNA, 21 bp, Homo sapiens
tccgctgcccacctcttgcca

SEQ ID NO: 38614 - DNA, 17 bp, Homo sapiens
tgatggaaattagtgag

SEQ ID NO: 38615 - DNA, 21 bp, Homo sapiens
ttcccctgaagacgttacagc

SEQ ID NO: 38616 - DNA, 16 bp, Homo sapiens
accaacctctgtcttg

SEQ ID NO: 38617 - DNA, 18 bp, Homo sapiens
agccccagggtttccctc

SEQ ID NO: 38618 - DNA, 23 bp, Homo sapiens
cccctgcccatcaacccctctca

SEQ ID NO: 38619 - DNA, 17 bp, Homo sapiens
ccttctcctttccttca

SEQ ID NO: 38620 - DNA, 17 bp, Homo sapiens
tctgtcttgccaccttt

SEQ ID NO: 38621 - DNA, 24 bp, Homo sapiens
tcttagaagcctcccctgacttca

SEQ ID NO: 38622 - DNA, 24 bp, Homo sapiens
ttggtgtcttaactccaccactca

SEQ ID NO: 38623 - DNA, 19 bp, Homo sapiens
atccaatatcatgccccac

SEQ ID NO: 38624 - DNA, 18 bp, Homo sapiens
gtcttgtctcccatccca

SEQ ID NO: 38625 - DNA, 19 bp, Homo sapiens
tcctgagccaagcatccaa

SEQ ID NO: 38626 - DNA, 21 bp, Homo sapiens
tgtccagggcctcacagggag

SEQ ID NO: 38627 - DNA, 20 bp, Homo sapiens
ccaaagttattttaatctat

SEQ ID NO: 38628 - DNA, 18 bp, Homo sapiens
gaccctcaggtgagacta

SEQ ID NO: 38629 - DNA, 20 bp, Homo sapiens
tcagcattatcatgatatca

SEQ ID NO: 38630 - DNA, 21 bp, Homo sapiens
ttctgcctcaatgtttactgt

SEQ ID NO: 38631 - DNA, 21 bp, Homo sapiens
agaagtctccacctggtcttc

SEQ ID NO: 38632 - DNA, 21 bp, Homo sapiens
ctgactcattccagcactaca

SEQ ID NO: 38633 - DNA, 20 bp, Homo sapiens
tctgaagacaatggacccac

SEQ ID NO: 38634 - DNA, 21 bp, Homo sapiens
tggatggtggtgacatggact

SEQ ID NO: 38635 - DNA, 17 bp, Homo sapiens
tcccagcttgggaagca

SEQ ID NO: 38636 - DNA, 22 bp, Homo sapiens
actcatctatatattctgtatc

SEQ ID NO: 38637 - DNA, 22 bp, Homo sapiens
agccccctacatccccccggga

SEQ ID NO: 38638 - DNA, 22 bp, Homo sapiens
gttttgaatattaactgtgtta

SEQ ID NO: 38639 - DNA, 20 bp, Homo sapiens
tggactccatcaagacaatc

SEQ ID NO: 38640 - DNA, 19 bp, Homo sapiens
atgggagcccccataccca

SEQ ID NO: 38641 - DNA, 25 bp, Homo sapiens
tctctgacaccttgactttaacctt

SEQ ID NO: 38642 - DNA, 20 bp, Homo sapiens
ttcaagaccagcctagccaa

SEQ ID NO: 38643 - DNA, 21 bp, Homo sapiens
aggcacagctccatcgttaca

SEQ ID NO: 38644 - DNA, 18 bp, Homo sapiens
aggccctgaacattctca

SEQ ID NO: 38645 - DNA, 22 bp, Homo sapiens
tctaccatgaaagacttgtgaa

SEQ ID NO: 38646 - DNA, 19 bp, Homo sapiens
aacactagacctctcctga

SEQ ID NO: 38647 - DNA, 20 bp, Homo sapiens
accatgcacatcatcagaga

SEQ ID NO: 38648 - DNA, 19 bp, Homo sapiens
ctttcttccaagccatggc

SEQ ID NO: 38649 - DNA, 23 bp, Homo sapiens
atgttttgtataaatttgtcatg

SEQ ID NO: 38650 - DNA, 19 bp, Homo sapiens
caactgcacgggacattgt

SEQ ID NO: 38651 - DNA, 21 bp, Homo sapiens
cattattccaactgcacggga

SEQ ID NO: 38652 - DNA, 23 bp, Homo sapiens
ccagattactggttaaaatccaa

SEQ ID NO: 38653 - DNA, 20 bp, Homo sapiens
tcaccatctcagtcttcaaa

SEQ ID NO: 38654 - DNA, 19 bp, Homo sapiens
aaagccggtttctcagtga

SEQ ID NO: 38655 - DNA, 18 bp, Homo sapiens
cttcagaagaacgacaaa

SEQ ID NO: 38656 - DNA, 15 bp, Homo sapiens
gaagaacgacaaaag

SEQ ID NO: 38657 - DNA, 20 bp, Homo sapiens
caatcctaagcaaaaataac

SEQ ID NO: 38658 - DNA, 18 bp, Homo sapiens
ccagcggcaatgttccag

SEQ ID NO: 38659 - DNA, 19 bp, Homo sapiens
aatatgaactggtattctc

SEQ ID NO: 38660 - DNA, 21 bp, Homo sapiens
cttctagttttgaactctgca

SEQ ID NO: 38661 - DNA, 15 bp, Homo sapiens
ggcctccttcccaca

SEQ ID NO: 38662 - DNA, 19 bp, Homo sapiens
gttttgaactctgcagcag

SEQ ID NO: 38663 - DNA, 20 bp, Homo sapiens
tcccaggtcagaggtcagca

SEQ ID NO: 38664 - DNA, 19 bp, Homo sapiens
tggggttcagctgaggttg

SEQ ID NO: 38665 - DNA, 26 bp, Homo sapiens
tgggtgggccgtcaggcatgggcctg

SEQ ID NO: 38666 - DNA, 22 bp, Homo sapiens
ccttgccctggagggttttgag

SEQ ID NO: 38667 - DNA, 20 bp, Homo sapiens
gctcctggaggccctgggga

SEQ ID NO: 38668 - DNA, 17 bp, Homo sapiens
tcgagtgattctcctgc

SEQ ID NO: 38669 - DNA, 20 bp, Homo sapiens
ctctggtggtgggcacctgt

SEQ ID NO: 38670 - DNA, 22 bp, Homo sapiens
gcccagttccttccaggagtca

SEQ ID NO: 38671 - DNA, 17 bp, Homo sapiens
gtccccgtactggctca

SEQ ID NO: 38672 - DNA, 21 bp, Homo sapiens
aaataccattacctctattca

SEQ ID NO: 38673 - DNA, 18 bp, Homo sapiens
acacctaaatggaaccca

SEQ ID NO: 38674 - DNA, 20 bp, Homo sapiens
actcagtcatcatcaaccca

SEQ ID NO: 38675 - DNA, 21 bp, Homo sapiens
agaacattcaccatctctaca

SEQ ID NO: 38676 - DNA, 21 bp, Homo sapiens
attaagtgctcaataaattta

SEQ ID NO: 38677 - DNA, 18 bp, Homo sapiens
atttttctcagggccctc

SEQ ID NO: 38678 - DNA, 23 bp, Homo sapiens
caaaacctccaagctttctggaa

SEQ ID NO: 38679 - DNA, 19 bp, Homo sapiens
caggtggccatttttctca

SEQ ID NO: 38680 - DNA, 18 bp, Homo sapiens
ccaagtgattgctggtcc

SEQ ID NO: 38681 - DNA, 20 bp, Homo sapiens
gatgctcagcactgcagacc

SEQ ID NO: 38682 - DNA, 20 bp, Homo sapiens
gtagatgtaacatttctgga

SEQ ID NO: 38683 - DNA, 19 bp, Homo sapiens
tgagctccagatggagcta

SEQ ID NO: 38684 - DNA, 18 bp, Homo sapiens
tgggtggatcacctgagg

SEQ ID NO: 38685 - DNA, 17 bp, Homo sapiens
ttgcaaagcaaagcctc

SEQ ID NO: 38686 - DNA, 22 bp, Homo sapiens
aaacccaaaaaaaacaaaaaca

SEQ ID NO: 38687 - DNA, 15 bp, Homo sapiens
agccttctttcccca

SEQ ID NO: 38688 - DNA, 19 bp, Homo sapiens
aggtatatacatagaatgt

SEQ ID NO: 38689 - DNA, 22 bp, Homo sapiens
caggcttcactttacatgtgat

SEQ ID NO: 38690 - DNA, 21 bp, Homo sapiens
ccatctcctccatctaagtaa

SEQ ID NO: 38691 - DNA, 21 bp, Homo sapiens
tcaaacagatgttgcatttca

SEQ ID NO: 38692 - DNA, 21 bp, Homo sapiens
tcagtcttcagatgttacata

SEQ ID NO: 38693 - DNA, 20 bp, Homo sapiens
caccaccacccaggcctcct

SEQ ID NO: 38694 - DNA, 21 bp, Homo sapiens
ccactgctacagtcaccacca

SEQ ID NO: 38695 - DNA, 22 bp, Homo sapiens
ctcccactagttacccacccca

SEQ ID NO: 38696 - DNA, 15 bp, Homo sapiens
tgcagctcaatctgc

SEQ ID NO: 38697 - DNA, 21 bp, Homo sapiens
aagaatcttctgttccacatc

SEQ ID NO: 38698 - DNA, 18 bp, Homo sapiens
cagaagaacaaagagccc

SEQ ID NO: 38699 - DNA, 23 bp, Homo sapiens
gactaacctctaacaacaaatta

SEQ ID NO: 38700 - DNA, 20 bp, Homo sapiens
tctttaacatcttctttcct

SEQ ID NO: 38701 - DNA, 21 bp, Homo sapiens
ttcctatgccctctctgtgga

SEQ ID NO: 38702 - DNA, 16 bp, Homo sapiens
agcctgaaggagttct

SEQ ID NO: 38703 - DNA, 22 bp, Homo sapiens
catctaggtactctgctgttca

SEQ ID NO: 38704 - DNA, 20 bp, Homo sapiens
cgtggcagcccagcatttgg

SEQ ID NO: 38705 - DNA, 18 bp, Homo sapiens
ctgacccaagtttctttt

SEQ ID NO: 38706 - DNA, 20 bp, Homo sapiens
ctgtggctgccattgccaga

SEQ ID NO: 38707 - DNA, 23 bp, Homo sapiens
gacatttgccatctaggtactct

SEQ ID NO: 38708 - DNA, 25 bp, Homo sapiens
gcctgggctactctcctcctggttc

SEQ ID NO: 38709 - DNA, 20 bp, Homo sapiens
tctgaagacaatggacccac

SEQ ID NO: 38710 - DNA, 21 bp, Homo sapiens
tggatggtggtgacatggact

SEQ ID NO: 38711 - DNA, 23 bp, Homo sapiens
acctgacaaccatgtgtacacca

SEQ ID NO: 38712 - DNA, 15 bp, Homo sapiens
ccacctgctgcctca

SEQ ID NO: 38713 - DNA, 18 bp, Homo sapiens
tgggtggatcacctgagg

SEQ ID NO: 38714 - DNA, 16 bp, Homo sapiens
gcccccaccatgccac

SEQ ID NO: 38715 - DNA, 22 bp, Homo sapiens
gcgcccagcccccaccatgcca

SEQ ID NO: 38716 - DNA, 16 bp, Homo sapiens
aggccatgtctatgta

SEQ ID NO: 38717 - DNA, 19 bp, Homo sapiens
actagggatcccacttctc

SEQ ID NO: 38718 - DNA, 17 bp, Homo sapiens
agccgaacagtagctca

SEQ ID NO: 38719 - DNA, 18 bp, Homo sapiens
cctgctcacactgccaga

SEQ ID NO: 38720 - DNA, 18 bp, Homo sapiens
tcctgctcacactgccag

SEQ ID NO: 38721 - DNA, 18 bp, Homo sapiens
ttccagagtgagccgttc

SEQ ID NO: 38722 - DNA, 19 bp, Homo sapiens
tttttctgctgttgacctt

SEQ ID NO: 38723 - DNA, 19 bp, Homo sapiens
atccaccatcgaattccat

SEQ ID NO: 38724 - DNA, 22 bp, Homo sapiens
atttggtggcagctcttggtcc

SEQ ID NO: 38725 - DNA, 20 bp, Homo sapiens
caccatcgaattccataaca

SEQ ID NO: 38726 - DNA, 19 bp, Homo sapiens
catagaaagtaacacccca

SEQ ID NO: 38727 - DNA, 16 bp, Homo sapiens
cccatttctcctccct

SEQ ID NO: 38728 - DNA, 18 bp, Homo sapiens
ccttcccccatcacatcc

SEQ ID NO: 38729 - DNA, 21 bp, Homo sapiens
cgacagaagtccaattttctt

SEQ ID NO: 38730 - DNA, 22 bp, Homo sapiens
gatgcgggcactgcagaccagg

SEQ ID NO: 38731 - DNA, 21 bp, Homo sapiens
ggttcgggaaggtgactgctt

SEQ ID NO: 38732 - DNA, 24 bp, Homo sapiens
tacatataaatgatatcaagatga

SEQ ID NO: 38733 - DNA, 22 bp, Homo sapiens
ttttgagggatcagaaaagtga

SEQ ID NO: 38734 - DNA, 23 bp, Homo sapiens
acagcacttgttatttattgagc

SEQ ID NO: 38735 - DNA, 18 bp, Homo sapiens
acatgccctgcctgtttc

SEQ ID NO: 38736 - DNA, 20 bp, Homo sapiens
agcttcccttacaatgtaat

SEQ ID NO: 38737 - DNA, 21 bp, Homo sapiens
atggctcgctctctcactgct

SEQ ID NO: 38738 - DNA, 20 bp, Homo sapiens
tatgtgggcatatttggttg

SEQ ID NO: 38739 - DNA, 18 bp, Homo sapiens
tgcccaactctgaagcca

SEQ ID NO: 38740 - DNA, 19 bp, Homo sapiens
accaattatggaaagcaac

SEQ ID NO: 38741 - DNA, 21 bp, Homo sapiens
ctactgacaaccagtcctcca

SEQ ID NO: 38742 - DNA, 20 bp, Homo sapiens
taagaggcagtatctgcact

SEQ ID NO: 38743 - DNA, 22 bp, Homo sapiens
ccaaacaaacaaaacaaacaaa

SEQ ID NO: 38744 - DNA, 19 bp, Homo sapiens
cttgggccgcccagcctca

SEQ ID NO: 38745 - DNA, 22 bp, Homo sapiens
atctgcattgattacctggtct

SEQ ID NO: 38746 - DNA, 19 bp, Homo sapiens
aacacactggaacctcatg

SEQ ID NO: 38747 - DNA, 20 bp, Homo sapiens
agtcatcagcacttaagaaa

SEQ ID NO: 38748 - DNA, 22 bp, Homo sapiens
atcactgatacagtctatgtca

SEQ ID NO: 38749 - DNA, 20 bp, Homo sapiens
tggaaagattttacctgtga

SEQ ID NO: 38750 - DNA, 22 bp, Homo sapiens
cctccaccccaaccccttctca

SEQ ID NO: 38751 - DNA, 21 bp, Homo sapiens
cgtgtttctcatttccgtgga

SEQ ID NO: 38752 - DNA, 20 bp, Homo sapiens
ctcctcaccctacgcaccgc

SEQ ID NO: 38753 - DNA, 19 bp, Homo sapiens
gcaccgcattctgctcctc

SEQ ID NO: 38754 - DNA, 25 bp, Homo sapiens
gcgccggaagaaccgttgtctgcca

SEQ ID NO: 38755 - DNA, 17 bp, Homo sapiens
tcaagcgattctcgtgc

SEQ ID NO: 38756 - DNA, 20 bp, Homo sapiens
tcatttccgtggacacccac

SEQ ID NO: 38757 - DNA, 18 bp, Homo sapiens
gtacagaaaaccagttcc

SEQ ID NO: 38758 - DNA, 17 bp, Homo sapiens
aatgagtaccaggccca

SEQ ID NO: 38759 - DNA, 19 bp, Homo sapiens
cataatattatgcataata

SEQ ID NO: 38760 - DNA, 18 bp, Homo sapiens
atctgagacccagatcct

SEQ ID NO: 38761 - DNA, 18 bp, Homo sapiens
cccacagctcactccact

SEQ ID NO: 38762 - DNA, 19 bp, Homo sapiens
cccccgaccccacagctca

SEQ ID NO: 38763 - DNA, 19 bp, Homo sapiens
caccctcactctgcctgtc

SEQ ID NO: 38764 - DNA, 21 bp, Homo sapiens
cacttttacccgctcactgcc

SEQ ID NO: 38765 - DNA, 26 bp, Homo sapiens
ccatccctcccctccttttcaggtaa

SEQ ID NO: 38766 - DNA, 19 bp, Homo sapiens
gcccaggcccatgacccca

SEQ ID NO: 38767 - DNA, 21 bp, Homo sapiens
tctggttatcttcctgttcct

SEQ ID NO: 38768 - DNA, 18 bp, Homo sapiens
tgccactgccatcactgc

SEQ ID NO: 38769 - DNA, 18 bp, Homo sapiens
ttcctgttcctgtagcat

SEQ ID NO: 38770 - DNA, 22 bp, Homo sapiens
aaagctagcacaacggagctca

SEQ ID NO: 38771 - DNA, 19 bp, Homo sapiens
acctccgcacctaagcact

SEQ ID NO: 38772 - DNA, 19 bp, Homo sapiens
tgttcctcagcatccccca

SEQ ID NO: 38773 - DNA, 19 bp, Homo sapiens
ccaccccttagttgaggga

SEQ ID NO: 38774 - DNA, 23 bp, Homo sapiens
tcctgatgtatttgtatcactta

SEQ ID NO: 38775 - DNA, 17 bp, Homo sapiens
aagagactcccgtctca

SEQ ID NO: 38776 - DNA, 19 bp, Homo sapiens
cgagacgaaaacggccccg

SEQ ID NO: 38777 - DNA, 17 bp, Homo sapiens
tggacttccccgccctg

SEQ ID NO: 38778 - DNA, 18 bp, Homo sapiens
tgggtggatcacctgagg

SEQ ID NO: 38779 - DNA, 22 bp, Homo sapiens
tctgagcgagcgcggtgctttt

SEQ ID NO: 38780 - DNA, 19 bp, Homo sapiens
agcctaaacgccaccacca

SEQ ID NO: 38781 - DNA, 23 bp, Homo sapiens
ccaccctcaccatcagtactccc

SEQ ID NO: 38782 - DNA, 20 bp, Homo sapiens
ccatcccaccaccatgtgcc

SEQ ID NO: 38783 - DNA, 22 bp, Homo sapiens
ggacatagaaaaagaggctggc

SEQ ID NO: 38784 - DNA, 20 bp, Homo sapiens
tctgacctatgcacaagaaa

SEQ ID NO: 38785 - DNA, 20 bp, Homo sapiens
tggatgggtcctttggaact

SEQ ID NO: 38786 - DNA, 18 bp, Homo sapiens
tgtggatgccaccggctt

SEQ ID NO: 38787 - DNA, 18 bp, Homo sapiens
ttaggagaggaagaaatc

SEQ ID NO: 38788 - DNA, 23 bp, Homo sapiens
ctgaagtatgggaggcttctgag

SEQ ID NO: 38789 - DNA, 17 bp, Homo sapiens
atatagaaaaaggaatt

SEQ ID NO: 38790 - DNA, 17 bp, Homo sapiens
cagtcctggtctgctca

SEQ ID NO: 38791 - DNA, 22 bp, Homo sapiens
cctcatgggaagcttccaataa

SEQ ID NO: 38792 - DNA, 19 bp, Homo sapiens
ccccccggtggtgtcctca

SEQ ID NO: 38793 - DNA, 23 bp, Homo sapiens
ccgtgttacaggaggcttgtgag

SEQ ID NO: 38794 - DNA, 17 bp, Homo sapiens
gggctcataattgttgc

SEQ ID NO: 38795 - DNA, 21 bp, Homo sapiens
taaccccgtcttctttttcac

SEQ ID NO: 38796 - DNA, 20 bp, Homo sapiens
tcctgagataagtcaggtaa

SEQ ID NO: 38797 - DNA, 20 bp, Homo sapiens
tctttttcacactagctctg

SEQ ID NO: 38798 - DNA, 15 bp, Homo sapiens
tggttttccttcctc

SEQ ID NO: 38799 - DNA, 20 bp, Homo sapiens
aaaaggaaaacaaaggcatt

SEQ ID NO: 38800 - DNA, 27 bp, Homo sapiens
gcttggagtctaccgactgtctgtctc

SEQ ID NO: 38801 - DNA, 21 bp, Homo sapiens
tggatcaccgggatgaagctg

SEQ ID NO: 38802 - DNA, 20 bp, Homo sapiens
ttccagaataggccacccag

SEQ ID NO: 38803 - DNA, 19 bp, Homo sapiens
tgaagaaataagttcagag

SEQ ID NO: 38804 - DNA, 20 bp, Homo sapiens
gaagccactcaaaccattcc

SEQ ID NO: 38805 - DNA, 19 bp, Homo sapiens
gggcatccttgggccaact

SEQ ID NO: 38806 - DNA, 21 bp, Homo sapiens
tctctcacttgtcttggtttt

SEQ ID NO: 38807 - DNA, 22 bp, Homo sapiens
ttggaagaggaagagaagttga

SEQ ID NO: 38808 - DNA, 15 bp, Homo sapiens
agtccattacaaact

SEQ ID NO: 38809 - DNA, 21 bp, Homo sapiens
cacaggtcaagaactaaactc

SEQ ID NO: 38810 - DNA, 21 bp, Homo sapiens
ccacctctgtccacgtgcacc

SEQ ID NO: 38811 - DNA, 23 bp, Homo sapiens
gtgtgtgtgtcctcatgtggctg

SEQ ID NO: 38812 - DNA, 19 bp, Homo sapiens
tcccacaacaacgcaatga

SEQ ID NO: 38813 - DNA, 17 bp, Homo sapiens
tctcagtcatatgccca

SEQ ID NO: 38814 - DNA, 19 bp, Homo sapiens
tctgtccacgtgcaccttt

SEQ ID NO: 38815 - DNA, 21 bp, Homo sapiens
atttggactctggttttgcct

SEQ ID NO: 38816 - DNA, 21 bp, Homo sapiens
cgctcttcatcagacttgtca

SEQ ID NO: 38817 - DNA, 16 bp, Homo sapiens
ctgacggcccagcgga

SEQ ID NO: 38818 - DNA, 24 bp, Homo sapiens
tagagctgcttctgagtgaggctg

SEQ ID NO: 38819 - DNA, 21 bp, Homo sapiens
tctccctgacataagcaagga

SEQ ID NO: 38820 - DNA, 19 bp, Homo sapiens
cacatagtcatttagatga

SEQ ID NO: 38821 - DNA, 18 bp, Homo sapiens
cctatggaagatcctgat

SEQ ID NO: 38822 - DNA, 24 bp, Homo sapiens
cgcctttcttgcaacctggtacca

SEQ ID NO: 38823 - DNA, 18 bp, Homo sapiens
tcagcaagaggcgttcga

SEQ ID NO: 38824 - DNA, 21 bp, Homo sapiens
atcctgggtactcaggcctct

SEQ ID NO: 38825 - DNA, 22 bp, Homo sapiens
aaatactgtaaaatcctactca

SEQ ID NO: 38826 - DNA, 23 bp, Homo sapiens
ccatcttgtgttctgttatgaaa

SEQ ID NO: 38827 - DNA, 24 bp, Homo sapiens
gagacagaatctttagttacttca

SEQ ID NO: 38828 - DNA, 22 bp, Homo sapiens
tacttcctcactgtcagcctaa

SEQ ID NO: 38829 - DNA, 17 bp, Homo sapiens
tcttccctgtcagtgtt

SEQ ID NO: 38830 - DNA, 18 bp, Homo sapiens
aagacttcttggtaccta

SEQ ID NO: 38831 - DNA, 21 bp, Homo sapiens
caacccttcttgcctactcct

SEQ ID NO: 38832 - DNA, 18 bp, Homo sapiens
caccagagctcttggata

SEQ ID NO: 38833 - DNA, 19 bp, Homo sapiens
cacttgggcacttcacagc

SEQ ID NO: 38834 - DNA, 20 bp, Homo sapiens
cagacacgttgagaagctgc

SEQ ID NO: 38835 - DNA, 20 bp, Homo sapiens
cccactgtctcaatctgcaa

SEQ ID NO: 38836 - DNA, 21 bp, Homo sapiens
ccctccccttctcctccagta

SEQ ID NO: 38837 - DNA, 20 bp, Homo sapiens
cccttcttgtggtgagactg

SEQ ID NO: 38838 - DNA, 23 bp, Homo sapiens
gactcaaggagacaaccacctca

SEQ ID NO: 38839 - DNA, 16 bp, Homo sapiens
ttctgccttgggggcg

SEQ ID NO: 38840 - DNA, 22 bp, Homo sapiens
gcctgagctgtgacgggtgccc

SEQ ID NO: 38841 - DNA, 20 bp, Homo sapiens
tgcccagaacatgatctcag

SEQ ID NO: 38842 - DNA, 19 bp, Homo sapiens
cagctggtctacaccaaca

SEQ ID NO: 38843 - DNA, 22 bp, Homo sapiens
atccaaacacatgtacaccaaa

SEQ ID NO: 38844 - DNA, 18 bp, Homo sapiens
tcagtataattgttccag

SEQ ID NO: 38845 - DNA, 21 bp, Homo sapiens
ccttcccccttccctccttcc

SEQ ID NO: 38846 - DNA, 21 bp, Homo sapiens
gcctggcaggtcacctggccc

SEQ ID NO: 38847 - DNA, 21 bp, Homo sapiens
aacccagaacaccacctctca

SEQ ID NO: 38848 - DNA, 21 bp, Homo sapiens
aatctggagaccagaaatcca

SEQ ID NO: 38849 - DNA, 20 bp, Homo sapiens
agaaaacgaatacaggcaac

SEQ ID NO: 38850 - DNA, 21 bp, Homo sapiens
ccacctctcacgaaaacggct

SEQ ID NO: 38851 - DNA, 18 bp, Homo sapiens
cgaaggaaggcctgagaa

SEQ ID NO: 38852 - DNA, 17 bp, Homo sapiens
cttcttctgttttgact

SEQ ID NO: 38853 - DNA, 22 bp, Homo sapiens
gcaagagcactggctgttgtga

SEQ ID NO: 38854 - DNA, 15 bp, Homo sapiens
ggccatgctgcctct

SEQ ID NO: 38855 - DNA, 23 bp, Homo sapiens
tcacatcctgaccccgccggcga

SEQ ID NO: 38856 - DNA, 17 bp, Homo sapiens
accgtttaggctaaaac

SEQ ID NO: 38857 - DNA, 18 bp, Homo sapiens
cctggaattttttggccc

SEQ ID NO: 38858 - DNA, 19 bp, Homo sapiens
gcgaggcttcagtgagctg

SEQ ID NO: 38859 - DNA, 17 bp, Homo sapiens
ggaatagtttccagata

SEQ ID NO: 38860 - DNA, 19 bp, Homo sapiens
tcaaacatgggttttgttg

SEQ ID NO: 38861 - DNA, 18 bp, Homo sapiens
tccagggtgaaaagggag

SEQ ID NO: 38862 - DNA, 16 bp, Homo sapiens
gatgatggtgttgaag

SEQ ID NO: 38863 - DNA, 20 bp, Homo sapiens
tctaagatctaaatcatttt

SEQ ID NO: 38864 - DNA, 17 bp, Homo sapiens
tgtgttccggatatttt

SEQ ID NO: 38865 - DNA, 21 bp, Homo sapiens
cagcagcagcaggagcccatg

SEQ ID NO: 38866 - DNA, 24 bp, Homo sapiens
ccgtccccctaccttgcctgctga

SEQ ID NO: 38867 - DNA, 18 bp, Homo sapiens
acttgacatccgtggtgt

SEQ ID NO: 38868 - DNA, 20 bp, Homo sapiens
agaagaagtcattcccaaca

SEQ ID NO: 38869 - DNA, 18 bp, Homo sapiens
agacccagggtgcgtgcc

SEQ ID NO: 38870 - DNA, 20 bp, Homo sapiens
agggcatcctccagctcagc

SEQ ID NO: 38871 - DNA, 20 bp, Homo sapiens
caagtcctgcgatgctaagt

SEQ ID NO: 38872 - DNA, 23 bp, Homo sapiens
cataacacaggagacctgctccc

SEQ ID NO: 38873 - DNA, 19 bp, Homo sapiens
gaatgttctcagtgtccta

SEQ ID NO: 38874 - DNA, 19 bp, Homo sapiens
ggagcactctgagatctca

SEQ ID NO: 38875 - DNA, 20 bp, Homo sapiens
tgcgatggcgttcacgtcca

SEQ ID NO: 38876 - DNA, 20 bp, Homo sapiens
caccgtcgctctcctaccca

SEQ ID NO: 38877 - DNA, 22 bp, Homo sapiens
ccacagtttctgtcccatgaca

SEQ ID NO: 38878 - DNA, 23 bp, Homo sapiens
gcctggcgccagggacgctgcca

SEQ ID NO: 38879 - DNA, 20 bp, Homo sapiens
tcagctgccaccagcactca

SEQ ID NO: 38880 - DNA, 20 bp, Homo sapiens
tcatgagaccgtgctgcaca

SEQ ID NO: 38881 - DNA, 20 bp, Homo sapiens
tcccaggcacctccaacaga

SEQ ID NO: 38882 - DNA, 22 bp, Homo sapiens
tgtctcttccttcactaccttc

SEQ ID NO: 38883 - DNA, 18 bp, Homo sapiens
aggttgagcacttcagga

SEQ ID NO: 38884 - DNA, 16 bp, Homo sapiens
gatgatggtgttgaag

SEQ ID NO: 38885 - DNA, 20 bp, Homo sapiens
tctaagatctaaatcatttt

SEQ ID NO: 38886 - DNA, 17 bp, Homo sapiens
tgtgttccggatatttt

SEQ ID NO: 38887 - DNA, 18 bp, Homo sapiens
aggttgagcacttcagga

SEQ ID NO: 38888 - DNA, 16 bp, Homo sapiens
gatgatggtgttgaag

SEQ ID NO: 38889 - DNA, 20 bp, Homo sapiens
tctaagatctaaatcatttt

SEQ ID NO: 38890 - DNA, 17 bp, Homo sapiens
tgtgttccggatatttt

SEQ ID NO: 38891 - DNA, 16 bp, Homo sapiens
cccccactctgcctcc

SEQ ID NO: 38892 - DNA, 17 bp, Homo sapiens
ccttgcggtagccggca

SEQ ID NO: 38893 - DNA, 18 bp, Homo sapiens
cgcccccactctgcctcc

SEQ ID NO: 38894 - DNA, 18 bp, Homo sapiens
gacacccctttcttcttc

SEQ ID NO: 38895 - DNA, 20 bp, Homo sapiens
gatgccacctcctgccacca

SEQ ID NO: 38896 - DNA, 20 bp, Homo sapiens
gcacctgcccctctgcctcc

SEQ ID NO: 38897 - DNA, 21 bp, Homo sapiens
tctcctgctctgcccaccctt

SEQ ID NO: 38898 - DNA, 20 bp, Homo sapiens
tgctggcacttctccatcct

SEQ ID NO: 38899 - DNA, 19 bp, Homo sapiens
cctgtgggctagtctccag

SEQ ID NO: 38900 - DNA, 20 bp, Homo sapiens
tgcttgaacaggcctctcct

SEQ ID NO: 38901 - DNA, 19 bp, Homo sapiens
ttaaaggcatatcctgata

SEQ ID NO: 38902 - DNA, 18 bp, Homo sapiens
ttccagaaagttgttcta

SEQ ID NO: 38903 - DNA, 20 bp, Homo sapiens
ctgtctccccagcagtgaca

SEQ ID NO: 38904 - DNA, 20 bp, Homo sapiens
caagtcctgcgatgctaagt

SEQ ID NO: 38905 - DNA, 20 bp, Homo sapiens
gagaaatatggatggggagc

SEQ ID NO: 38906 - DNA, 18 bp, Homo sapiens
gcaaccgacggttcccca

SEQ ID NO: 38907 - DNA, 20 bp, Homo sapiens
tgcgatggcgttcacgtcca

SEQ ID NO: 38908 - DNA, 19 bp, Homo sapiens
aagccccactgatgctctg

SEQ ID NO: 38909 - DNA, 17 bp, Homo sapiens
cacgaggagggccccca

SEQ ID NO: 38910 - DNA, 20 bp, Homo sapiens
gccctgcggcctccacgtca

SEQ ID NO: 38911 - DNA, 21 bp, Homo sapiens
gagactgtcacaggcttgcca

SEQ ID NO: 38912 - DNA, 19 bp, Homo sapiens
acgcgagtccactttgcca

SEQ ID NO: 38913 - DNA, 21 bp, Homo sapiens
tgagcttctgttatgaagctg

SEQ ID NO: 38914 - DNA, 18 bp, Homo sapiens
aggttgagcacttcagga

SEQ ID NO: 38915 - DNA, 16 bp, Homo sapiens
gatgatggtgttgaag

SEQ ID NO: 38916 - DNA, 20 bp, Homo sapiens
tctaagatctaaatcatttt

SEQ ID NO: 38917 - DNA, 17 bp, Homo sapiens
tgtgttccggatatttt

SEQ ID NO: 38918 - DNA, 20 bp, Homo sapiens
aacagaacgttctgagtctg

SEQ ID NO: 38919 - DNA, 21 bp, Homo sapiens
tttgttgggcaaagactctga

SEQ ID NO: 38920 - DNA, 19 bp, Homo sapiens
cctaaggcaccttctgtgg

SEQ ID NO: 38921 - DNA, 19 bp, Homo sapiens
catccttgaagcccagaca

SEQ ID NO: 38922 - DNA, 19 bp, Homo sapiens
ccagtcctcccccacctcc

SEQ ID NO: 38923 - DNA, 20 bp, Homo sapiens
gatgtgaggtggctattcca

SEQ ID NO: 38924 - DNA, 17 bp, Homo sapiens
gcggctgcctctgcccc

SEQ ID NO: 38925 - DNA, 17 bp, Homo sapiens
accccaaggatatgcaa

SEQ ID NO: 38926 - DNA, 23 bp, Homo sapiens
cctaagggatatgaattgttttt

SEQ ID NO: 38927 - DNA, 20 bp, Homo sapiens
cgcgtaagctagggctgcaa

SEQ ID NO: 38928 - DNA, 23 bp, Homo sapiens
taggcattttccagaattcctca

SEQ ID NO: 38929 - DNA, 20 bp, Homo sapiens
atcttttctttcttccagat

SEQ ID NO: 38930 - DNA, 17 bp, Homo sapiens
gagattgggggcctgtc

SEQ ID NO: 38931 - DNA, 23 bp, Homo sapiens
ccctgggagcatcagtgtcctca

SEQ ID NO: 38932 - DNA, 25 bp, Homo sapiens
cctccccaaaaacagattgacccag

SEQ ID NO: 38933 - DNA, 19 bp, Homo sapiens
gctattcctttctgcgacg

SEQ ID NO: 38934 - DNA, 21 bp, Homo sapiens
tgggactacagatgtttgcca

SEQ ID NO: 38935 - DNA, 16 bp, Homo sapiens
aagatctgccagcagc

SEQ ID NO: 38936 - DNA, 21 bp, Homo sapiens
caccaaggctttcccatcttg

SEQ ID NO: 38937 - DNA, 19 bp, Homo sapiens
cccctctggtggacagaga

SEQ ID NO: 38938 - DNA, 20 bp, Homo sapiens
ctggcgtgggaggtctgggg

SEQ ID NO: 38939 - DNA, 19 bp, Homo sapiens
cttcaagactcgtccttca

SEQ ID NO: 38940 - DNA, 19 bp, Homo sapiens
gatctgccagcagccccaa

SEQ ID NO: 38941 - DNA, 23 bp, Homo sapiens
gcctgctgaagccctccttgcca

SEQ ID NO: 38942 - DNA, 19 bp, Homo sapiens
ggcgggggcccagaactaa

SEQ ID NO: 38943 - DNA, 21 bp, Homo sapiens
tggcaggaggacagtcagtga

SEQ ID NO: 38944 - DNA, 18 bp, Homo sapiens
cactgtaggtggctgcaa

SEQ ID NO: 38945 - DNA, 24 bp, Homo sapiens
catgaaggaatgaataaagagttt

SEQ ID NO: 38946 - DNA, 19 bp, Homo sapiens
tacccgacgttctccctgg

SEQ ID NO: 38947 - DNA, 18 bp, Homo sapiens
tcccactgcttgcctgct

SEQ ID NO: 38948 - DNA, 18 bp, Homo sapiens
aaggtcatggcaacagtt

SEQ ID NO: 38949 - DNA, 21 bp, Homo sapiens
atgatcagaactgttgttgta

SEQ ID NO: 38950 - DNA, 22 bp, Homo sapiens
ccaaggcaacccctcagggctg

SEQ ID NO: 38951 - DNA, 17 bp, Homo sapiens
gtaatcctcctccctct

SEQ ID NO: 38952 - DNA, 21 bp, Homo sapiens
gtggttttaagagagaggatc

SEQ ID NO: 38953 - DNA, 20 bp, Homo sapiens
tcctgcaggactgtcagcaa

SEQ ID NO: 38954 - DNA, 19 bp, Homo sapiens
tgttactcagaacacttca

SEQ ID NO: 38955 - DNA, 18 bp, Homo sapiens
ttccaggaactagcccag

SEQ ID NO: 38956 - DNA, 19 bp, Homo sapiens
aaacagaaacccagaatgg

SEQ ID NO: 38957 - DNA, 16 bp, Homo sapiens
acagaaaatatgttcc

SEQ ID NO: 38958 - DNA, 16 bp, Homo sapiens
actccgcctggcttac

SEQ ID NO: 38959 - DNA, 20 bp, Homo sapiens
catctcactcacgtgtatca

SEQ ID NO: 38960 - DNA, 19 bp, Homo sapiens
ccagggagcttgaagagct

SEQ ID NO: 38961 - DNA, 22 bp, Homo sapiens
ccgttgttgacggagcagggaa

SEQ ID NO: 38962 - DNA, 18 bp, Homo sapiens
tccgcctcccgggttcaa

SEQ ID NO: 38963 - DNA, 21 bp, Homo sapiens
tctgagtggtagggagtcact

SEQ ID NO: 38964 - DNA, 17 bp, Homo sapiens
gccatggctcttggcct

SEQ ID NO: 38965 - DNA, 19 bp, Homo sapiens
tctgctgagtgtaaatgga

SEQ ID NO: 38966 - DNA, 18 bp, Homo sapiens
aacatagcttctgttgac

SEQ ID NO: 38967 - DNA, 24 bp, Homo sapiens
caaataatgaagatctctccttca

SEQ ID NO: 38968 - DNA, 20 bp, Homo sapiens
ctctccttcagtctgctctg

SEQ ID NO: 38969 - DNA, 22 bp, Homo sapiens
taaatggacttcatgaggaaat

SEQ ID NO: 38970 - DNA, 22 bp, Homo sapiens
tccaaaacccggacaagctctt

SEQ ID NO: 38971 - DNA, 21 bp, Homo sapiens
acttttcctgctgcctggcct

SEQ ID NO: 38972 - DNA, 26 bp, Homo sapiens
tttgatcaaatttgaacttcattttg

SEQ ID NO: 38973 - DNA, 21 bp, Homo sapiens
gccttctcggccgcctggtcc

SEQ ID NO: 38974 - DNA, 19 bp, Homo sapiens
aaacaaacccaaatattaa

SEQ ID NO: 38975 - DNA, 23 bp, Homo sapiens
tccagccaagtttgtatacctca

SEQ ID NO: 38976 - DNA, 22 bp, Homo sapiens
tgaatggaccttgacagatggc

SEQ ID NO: 38977 - DNA, 22 bp, Homo sapiens
ttccccagaaccattttctgaa

SEQ ID NO: 38978 - DNA, 17 bp, Homo sapiens
aagtaatacagtagctg

SEQ ID NO: 38979 - DNA, 20 bp, Homo sapiens
gagacactggacacaaccca

SEQ ID NO: 38980 - DNA, 22 bp, Homo sapiens
gagccaagatcgcatcactgca

SEQ ID NO: 38981 - DNA, 17 bp, Homo sapiens
gagggccgggattgatc

SEQ ID NO: 38982 - DNA, 16 bp, Homo sapiens
gcatcactgcattcca

SEQ ID NO: 38983 - DNA, 21 bp, Homo sapiens
ttgatcaatacccgagaagta

SEQ ID NO: 38984 - DNA, 20 bp, Homo sapiens
ccctcccactacctccttcc

SEQ ID NO: 38985 - DNA, 23 bp, Homo sapiens
taagtttgtgaaaatctacatta

SEQ ID NO: 38986 - DNA, 20 bp, Homo sapiens
tgcaaaccatgtttgccaaa

SEQ ID NO: 38987 - DNA, 24 bp, Homo sapiens
agttaaatattgggacactaacca

SEQ ID NO: 38988 - DNA, 18 bp, Homo sapiens
tcttctttctctgtctca

SEQ ID NO: 38989 - DNA, 22 bp, Homo sapiens
tgaagaaatcagagggaacgca

SEQ ID NO: 38990 - DNA, 17 bp, Homo sapiens
ccacggccccgcccgtt

SEQ ID NO: 38991 - DNA, 15 bp, Homo sapiens
ccgtggaatcttgtt

SEQ ID NO: 38992 - DNA, 21 bp, Homo sapiens
cggggcggccctgctgccagc

SEQ ID NO: 38993 - DNA, 19 bp, Homo sapiens
tgccttgttgaaaatttca

SEQ ID NO: 38994 - DNA, 21 bp, Homo sapiens
actgttgaggatcactctgaa

SEQ ID NO: 38995 - DNA, 20 bp, Homo sapiens
acagtgggcactataagcca

SEQ ID NO: 38996 - DNA, 21 bp, Homo sapiens
gaaactgaacaagccacctgc

SEQ ID NO: 38997 - DNA, 28 bp, Homo sapiens
tctccaccttcaggacaaaagcatttca

SEQ ID NO: 38998 - DNA, 21 bp, Homo sapiens
ttcagaaccatcctaacaata

SEQ ID NO: 38999 - DNA, 18 bp, Homo sapiens
aattctttttctgtacct

SEQ ID NO: 39000 - DNA, 17 bp, Homo sapiens
tattttgtggcatatgc

SEQ ID NO: 39001 - DNA, 22 bp, Homo sapiens
tcttgtttttttatcttgccca

SEQ ID NO: 39002 - DNA, 23 bp, Homo sapiens
ttctggtgagtaagacctgggga

SEQ ID NO: 39003 - DNA, 24 bp, Homo sapiens
acctgagctggagccacttggctt

SEQ ID NO: 39004 - DNA, 21 bp, Homo sapiens
caccaccaccatcaccacgct

SEQ ID NO: 39005 - DNA, 19 bp, Homo sapiens
cctaccccggctggagtag

SEQ ID NO: 39006 - DNA, 20 bp, Homo sapiens
cggcgccgcacctgctgcac

SEQ ID NO: 39007 - DNA, 22 bp, Homo sapiens
gctcgacgccgccgcctggccc

SEQ ID NO: 39008 - DNA, 22 bp, Homo sapiens
ggtcatcagcagcagctgtggc

SEQ ID NO: 39009 - DNA, 18 bp, Homo sapiens
gtagagctgctggcctca

SEQ ID NO: 39010 - DNA, 19 bp, Homo sapiens
tcctccagaggcctggaag

SEQ ID NO: 39011 - DNA, 17 bp, Homo sapiens
tttgcttgctgggaggc

SEQ ID NO: 39012 - DNA, 27 bp, Homo sapiens
ccagtcatggagttaagaagtgagtca

SEQ ID NO: 39013 - DNA, 23 bp, Homo sapiens
ccatacaacaggactatgtgatg

SEQ ID NO: 39014 - DNA, 21 bp, Homo sapiens
tccacagacactacccaaagc

SEQ ID NO: 39015 - DNA, 19 bp, Homo sapiens
gcttgggctgtggcaagct

SEQ ID NO: 39016 - DNA, 19 bp, Homo sapiens
ctatcatccaagctttgtg

SEQ ID NO: 39017 - DNA, 18 bp, Homo sapiens
agcaggggctggggctca

SEQ ID NO: 39018 - DNA, 17 bp, Homo sapiens
ccaggtccccactggca

SEQ ID NO: 39019 - DNA, 20 bp, Homo sapiens
gcacgtgagagcggccaggg

SEQ ID NO: 39020 - DNA, 19 bp, Homo sapiens
ggccgggtgcggtggctca

SEQ ID NO: 39021 - DNA, 23 bp, Homo sapiens
tcctggtgatgacatcttgagag

SEQ ID NO: 39022 - DNA, 21 bp, Homo sapiens
aaatggaagcaaacaacatca

SEQ ID NO: 39023 - DNA, 18 bp, Homo sapiens
cccctgtacttcatttca

SEQ ID NO: 39024 - DNA, 17 bp, Homo sapiens
agagagaaggcactctt

SEQ ID NO: 39025 - DNA, 20 bp, Homo sapiens
caaactataaccatataata

SEQ ID NO: 39026 - DNA, 19 bp, Homo sapiens
cactgaattaatttttaca

SEQ ID NO: 39027 - DNA, 19 bp, Homo sapiens
taactccttaaaacagtta

SEQ ID NO: 39028 - DNA, 16 bp, Homo sapiens
tggccaggtgtagtgg

SEQ ID NO: 39029 - DNA, 21 bp, Homo sapiens
atcttggctcgctgcaacctc

SEQ ID NO: 39030 - DNA, 17 bp, Homo sapiens
cctcacccaacgatccc

SEQ ID NO: 39031 - DNA, 18 bp, Homo sapiens
tccgcctcccaggttcaa

SEQ ID NO: 39032 - DNA, 16 bp, Homo sapiens
tgaagagactgagagt

SEQ ID NO: 39033 - DNA, 19 bp, Homo sapiens
acagtgtcagggttagatg

SEQ ID NO: 39034 - DNA, 21 bp, Homo sapiens
agatgggaggaggtgtgcgtg

SEQ ID NO: 39035 - DNA, 23 bp, Homo sapiens
ccaccaccagtagccttgggctg

SEQ ID NO: 39036 - DNA, 18 bp, Homo sapiens
ccagatctttctaaccca

SEQ ID NO: 39037 - DNA, 19 bp, Homo sapiens
ggttaaatgacagttgcca

SEQ ID NO: 39038 - DNA, 20 bp, Homo sapiens
tcataattcaacccatgaca

SEQ ID NO: 39039 - DNA, 19 bp, Homo sapiens
aatcatttccattcccata

SEQ ID NO: 39040 - DNA, 22 bp, Homo sapiens
cctactcctccaggttgttgct

SEQ ID NO: 39041 - DNA, 24 bp, Homo sapiens
gagagaggaaagtagactccatca

SEQ ID NO: 39042 - DNA, 23 bp, Homo sapiens
tcatttccattcccataaaactt

SEQ ID NO: 39043 - DNA, 20 bp, Homo sapiens
tgcccaggctcccaacccag

SEQ ID NO: 39044 - DNA, 20 bp, Homo sapiens
tgccttgattaaatgtatta

SEQ ID NO: 39045 - DNA, 19 bp, Homo sapiens
tgaacaatgagcacacatg

SEQ ID NO: 39046 - DNA, 24 bp, Homo sapiens
acaaaccagtcaccaaattcccag

SEQ ID NO: 39047 - DNA, 20 bp, Homo sapiens
ttcccacctgtgaatatgta

SEQ ID NO: 39048 - DNA, 20 bp, Homo sapiens
aaaacactcctcagtaaatg

SEQ ID NO: 39049 - DNA, 19 bp, Homo sapiens
tctgaaatgaagactcctc

SEQ ID NO: 39050 - DNA, 23 bp, Homo sapiens
aaaggggggattgtgacatatca

SEQ ID NO: 39051 - DNA, 17 bp, Homo sapiens
actggggtaattgtgac

SEQ ID NO: 39052 - DNA, 18 bp, Homo sapiens
gaggaactttcctactca

SEQ ID NO: 39053 - DNA, 18 bp, Homo sapiens
tcctggtcctgttctctg

SEQ ID NO: 39054 - DNA, 17 bp, Homo sapiens
tctgcatccatcatcac

SEQ ID NO: 39055 - DNA, 19 bp, Homo sapiens
aaacaaaggcagtacatgc

SEQ ID NO: 39056 - DNA, 18 bp, Homo sapiens
atcttaccaacggatcac

SEQ ID NO: 39057 - DNA, 22 bp, Homo sapiens
cgtgaacgtggactgtaacctt

SEQ ID NO: 39058 - DNA, 19 bp, Homo sapiens
tccaactgggtgtattcta

SEQ ID NO: 39059 - DNA, 22 bp, Homo sapiens
tgggtgtattctagtgtggaac

SEQ ID NO: 39060 - DNA, 24 bp, Homo sapiens
ccaccgccgccgctgctaccgcca

SEQ ID NO: 39061 - DNA, 20 bp, Homo sapiens
cgcgcccgcggcccgcgcgc

SEQ ID NO: 39062 - DNA, 22 bp, Homo sapiens
tgggcttagttggctgggattg

SEQ ID NO: 39063 - DNA, 18 bp, Homo sapiens
agaatcatcagtatgtca

SEQ ID NO: 39064 - DNA, 23 bp, Homo sapiens
tttgctcaaaaggagaccattct

SEQ ID NO: 39065 - DNA, 22 bp, Homo sapiens
atcactctcggggccgccattc

SEQ ID NO: 39066 - DNA, 19 bp, Homo sapiens
tccagcttcaccgacctcc

SEQ ID NO: 39067 - DNA, 18 bp, Homo sapiens
aagttcaaccactgcact

SEQ ID NO: 39068 - DNA, 21 bp, Homo sapiens
accactgcactccactaagca

SEQ ID NO: 39069 - DNA, 22 bp, Homo sapiens
agatggggtcagcgcctgccct

SEQ ID NO: 39070 - DNA, 21 bp, Homo sapiens
atctcctgtctctggacaaca

SEQ ID NO: 39071 - DNA, 20 bp, Homo sapiens
cctgtctctggacaacaatc

SEQ ID NO: 39072 - DNA, 18 bp, Homo sapiens
ggcgttctgttacagcag

SEQ ID NO: 39073 - DNA, 19 bp, Homo sapiens
aagttgacttaaacatttt

SEQ ID NO: 39074 - DNA, 18 bp, Homo sapiens
gaagtattgacttcgtgg

SEQ ID NO: 39075 - DNA, 16 bp, Homo sapiens
ccacctttcctgctca

SEQ ID NO: 39076 - DNA, 17 bp, Homo sapiens
cttagaaaggcttttaa

SEQ ID NO: 39077 - DNA, 21 bp, Homo sapiens
aaaaacgcaaatcctgttcac

SEQ ID NO: 39078 - DNA, 17 bp, Homo sapiens
atacacctgtcaatgcc

SEQ ID NO: 39079 - DNA, 19 bp, Homo sapiens
cacaaacacctccatctca

SEQ ID NO: 39080 - DNA, 19 bp, Homo sapiens
tttctttataaatcaccca

SEQ ID NO: 39081 - DNA, 18 bp, Homo sapiens
aatgccagagactgttga

SEQ ID NO: 39082 - DNA, 21 bp, Homo sapiens
aatggaaatgaggtgtattta

SEQ ID NO: 39083 - DNA, 20 bp, Homo sapiens
acaaaaacaaaaacatttta

SEQ ID NO: 39084 - DNA, 17 bp, Homo sapiens
acatcatccagattcca

SEQ ID NO: 39085 - DNA, 21 bp, Homo sapiens
agcaagtttcacagttaaaca

SEQ ID NO: 39086 - DNA, 23 bp, Homo sapiens
ccaattataaactcattactcca

SEQ ID NO: 39087 - DNA, 27 bp, Homo sapiens
ctatctatctatatcttcatcccatca

SEQ ID NO: 39088 - DNA, 22 bp, Homo sapiens
gagccaagatcgcgccactgca

SEQ ID NO: 39089 - DNA, 17 bp, Homo sapiens
gcgtatctatggtaata

SEQ ID NO: 39090 - DNA, 18 bp, Homo sapiens
tttggcatctacattaca

SEQ ID NO: 39091 - DNA, 17 bp, Homo sapiens
gtaaaaatacagcattg

SEQ ID NO: 39092 - DNA, 18 bp, Homo sapiens
aggccccaagttattttt

SEQ ID NO: 39093 - DNA, 20 bp, Homo sapiens
aagaataaggatgatctcct

SEQ ID NO: 39094 - DNA, 18 bp, Homo sapiens
tctatagaatgttgcaca

SEQ ID NO: 39095 - DNA, 24 bp, Homo sapiens
tttttttatggcagtttttatttt

SEQ ID NO: 39096 - DNA, 27 bp, Homo sapiens
ggccgtcccaaaacacccatttcctct

SEQ ID NO: 39097 - DNA, 20 bp, Homo sapiens
tgaggggcaccccagcctca

SEQ ID NO: 39098 - DNA, 19 bp, Homo sapiens
aaacaggatgaccaaattg

SEQ ID NO: 39099 - DNA, 19 bp, Homo sapiens
agacaataaaattgtatta

SEQ ID NO: 39100 - DNA, 22 bp, Homo sapiens
gagccaagatcgtgccactgca

SEQ ID NO: 39101 - DNA, 27 bp, Homo sapiens
ccagtcatggagctaagaagtgagtca

SEQ ID NO: 39102 - DNA, 23 bp, Homo sapiens
ccatacaacaggactatgtgatg

SEQ ID NO: 39103 - DNA, 21 bp, Homo sapiens
tccacagacactacccaaagc

SEQ ID NO: 39104 - DNA, 18 bp, Homo sapiens
aagataatttggaacagg

SEQ ID NO: 39105 - DNA, 19 bp, Homo sapiens
ctgaaaactgcttttgctg

SEQ ID NO: 39106 - DNA, 21 bp, Homo sapiens
tcagaaaaagaaagtccttca

SEQ ID NO: 39107 - DNA, 20 bp, Homo sapiens
agctcaagtgtaagatttat

SEQ ID NO: 39108 - DNA, 23 bp, Homo sapiens
agttttctttccttgcttgaagt

SEQ ID NO: 39109 - DNA, 21 bp, Homo sapiens
atcctgaatggcagccagtga

SEQ ID NO: 39110 - DNA, 22 bp, Homo sapiens
gaacactaatagcccccctgga

SEQ ID NO: 39111 - DNA, 17 bp, Homo sapiens
gtttcctaacaatatca

SEQ ID NO: 39112 - DNA, 24 bp, Homo sapiens
tcaatggccttcaaattggtgtta

SEQ ID NO: 39113 - DNA, 21 bp, Homo sapiens
tctgaagataaattatgtgaa

SEQ ID NO: 39114 - DNA, 22 bp, Homo sapiens
cccacggcttctaatagagcta

SEQ ID NO: 39115 - DNA, 19 bp, Homo sapiens
gagaacacgaggcttgcca

SEQ ID NO: 39116 - DNA, 23 bp, Homo sapiens
gcttgaattggatttgttggttt

SEQ ID NO: 39117 - DNA, 20 bp, Homo sapiens
aaacacatgttgtatgtttt

SEQ ID NO: 39118 - DNA, 18 bp, Homo sapiens
atacttaatattacctcc

SEQ ID NO: 39119 - DNA, 17 bp, Homo sapiens
ctccctcctctatctct

SEQ ID NO: 39120 - DNA, 19 bp, Homo sapiens
cttaatattacctccaatg

SEQ ID NO: 39121 - DNA, 18 bp, Homo sapiens
gtaactggcactgtcatt

SEQ ID NO: 39122 - DNA, 20 bp, Homo sapiens
gtttgtacagttgtgtgttg

SEQ ID NO: 39123 - DNA, 21 bp, Homo sapiens
ttaaggactacatacattcta

SEQ ID NO: 39124 - DNA, 25 bp, Homo sapiens
tttctactcacaatttgatcatcac

SEQ ID NO: 39125 - DNA, 16 bp, Homo sapiens
aacaactgctccatct

SEQ ID NO: 39126 - DNA, 17 bp, Homo sapiens
gcaactgttcacagtga

SEQ ID NO: 39127 - DNA, 24 bp, Homo sapiens
ttctgacggttccttctctgtgaa

SEQ ID NO: 39128 - DNA, 20 bp, Homo sapiens
ctggaaccctcctctgcctc

SEQ ID NO: 39129 - DNA, 19 bp, Homo sapiens
cttaaaaaagaccatttct

SEQ ID NO: 39130 - DNA, 20 bp, Homo sapiens
ttcgagaggccccgttttcc

SEQ ID NO: 39131 - DNA, 18 bp, Homo sapiens
tcacctgcgcggcacgtg

SEQ ID NO: 39132 - DNA, 25 bp, Homo sapiens
caaaaacatggttgtacttaatttt

SEQ ID NO: 39133 - DNA, 18 bp, Homo sapiens
ggaataatcgcaagttcc

SEQ ID NO: 39134 - DNA, 18 bp, Homo sapiens
ccagacctctttttcaga

SEQ ID NO: 39135 - DNA, 22 bp, Homo sapiens
ctgcacaagggccagtccccaa

SEQ ID NO: 39136 - DNA, 23 bp, Homo sapiens
gggatggccctcctggcttcagc

SEQ ID NO: 39137 - DNA, 19 bp, Homo sapiens
gtctgcatcatcctggtgg

SEQ ID NO: 39138 - DNA, 22 bp, Homo sapiens
tcactttcccctcacccatccc

SEQ ID NO: 39139 - DNA, 16 bp, Homo sapiens
ttgttacagctatgtg

SEQ ID NO: 39140 - DNA, 24 bp, Homo sapiens
taagtgggtctccaaagtggggct

SEQ ID NO: 39141 - DNA, 22 bp, Homo sapiens
atggtgcaaaacaagcactgca

SEQ ID NO: 39142 - DNA, 19 bp, Homo sapiens
aatacagtgagttctgcca

SEQ ID NO: 39143 - DNA, 19 bp, Homo sapiens
atctcgtgaaggctgtagg

SEQ ID NO: 39144 - DNA, 18 bp, Homo sapiens
attttcaggttatgtcat

SEQ ID NO: 39145 - DNA, 16 bp, Homo sapiens
caaaatctttgtagta

SEQ ID NO: 39146 - DNA, 16 bp, Homo sapiens
cagaaattaagacttt

SEQ ID NO: 39147 - DNA, 20 bp, Homo sapiens
gatagtggcaagcaccaagt

SEQ ID NO: 39148 - DNA, 20 bp, Homo sapiens
tcttttgcatgctttaatct

SEQ ID NO: 39149 - DNA, 17 bp, Homo sapiens
tgtcagtaaatgtagta

SEQ ID NO: 39150 - DNA, 18 bp, Homo sapiens
tgactcctaaatgtgata

SEQ ID NO: 39151 - DNA, 17 bp, Homo sapiens
tttgcttgccttgcgca

SEQ ID NO: 39152 - DNA, 18 bp, Homo sapiens
aaatggaaccagaggtta

SEQ ID NO: 39153 - DNA, 16 bp, Homo sapiens
aaaattcatcctgctg

SEQ ID NO: 39154 - DNA, 19 bp, Homo sapiens
caaaaacatagtttctgca

SEQ ID NO: 39155 - DNA, 20 bp, Homo sapiens
cttctgtgttagccatctta

SEQ ID NO: 39156 - DNA, 18 bp, Homo sapiens
gtttccctacttctgtga

SEQ ID NO: 39157 - DNA, 25 bp, Homo sapiens
tccaaagggtcctcattctgttcct

SEQ ID NO: 39158 - DNA, 19 bp, Homo sapiens
tctgagtcctgattggctt

SEQ ID NO: 39159 - DNA, 19 bp, Homo sapiens
tgttggcgtaatttttgaa

SEQ ID NO: 39160 - DNA, 17 bp, Homo sapiens
tttatttcattgaatta

SEQ ID NO: 39161 - DNA, 16 bp, Homo sapiens
atcaccaccaccgggt

SEQ ID NO: 39162 - DNA, 21 bp, Homo sapiens
ccaccgggtctgcctcagcca

SEQ ID NO: 39163 - DNA, 17 bp, Homo sapiens
caaggggagctggaagc

SEQ ID NO: 39164 - DNA, 20 bp, Homo sapiens
gaaacaggaacagccagtgg

SEQ ID NO: 39165 - DNA, 19 bp, Homo sapiens
ctaaagcagttagttgtga

SEQ ID NO: 39166 - DNA, 19 bp, Homo sapiens
tccgcctcctgaggttcaa

SEQ ID NO: 39167 - DNA, 18 bp, Homo sapiens
tttatacagcatgttgta

SEQ ID NO: 39168 - DNA, 19 bp, Homo sapiens
cccggcaggccggtgcaca

SEQ ID NO: 39169 - DNA, 19 bp, Homo sapiens
cttctttgtagccccagcc

SEQ ID NO: 39170 - DNA, 19 bp, Homo sapiens
ccgaggtgtacccacagtg

SEQ ID NO: 39171 - DNA, 19 bp, Homo sapiens
taagtccatgagggatgtc

SEQ ID NO: 39172 - DNA, 20 bp, Homo sapiens
tccagcccctccacccctcc

SEQ ID NO: 39173 - DNA, 23 bp, Homo sapiens
gcttctctgttgcgcttgcccct

SEQ ID NO: 39174 - DNA, 25 bp, Homo sapiens
tgccctgactccgatggtgaaactg

SEQ ID NO: 39175 - DNA, 27 bp, Homo sapiens
ctctgataatgtgtcgtgtggtttgtg

SEQ ID NO: 39176 - DNA, 19 bp, Homo sapiens
agcaagtcaccttccttct

SEQ ID NO: 39177 - DNA, 18 bp, Homo sapiens
caagatgtggtgggtttt

SEQ ID NO: 39178 - DNA, 22 bp, Homo sapiens
cgtacccttctgcctccccctc

SEQ ID NO: 39179 - DNA, 18 bp, Homo sapiens
ctcagctttgtgctctga

SEQ ID NO: 39180 - DNA, 19 bp, Homo sapiens
ctccgtacccttctgcctc

SEQ ID NO: 39181 - DNA, 22 bp, Homo sapiens
gagccaagatcgcaccattaca

SEQ ID NO: 39182 - DNA, 17 bp, Homo sapiens
ggactatttccatgaca

SEQ ID NO: 39183 - DNA, 18 bp, Homo sapiens
gggtgttggacacagctt

SEQ ID NO: 39184 - DNA, 19 bp, Homo sapiens
taggttttcatctacttta

SEQ ID NO: 39185 - DNA, 21 bp, Homo sapiens
tccattcagaagacaacattt

SEQ ID NO: 39186 - DNA, 25 bp, Homo sapiens
tcttggcaattaggggatttgggaa

SEQ ID NO: 39187 - DNA, 19 bp, Homo sapiens
tgagtgttaaatatggagc

SEQ ID NO: 39188 - DNA, 21 bp, Homo sapiens
ttgatctctcctataatcagt

SEQ ID NO: 39189 - DNA, 22 bp, Homo sapiens
taggcgtgagacaccgcgcctg

SEQ ID NO: 39190 - DNA, 22 bp, Homo sapiens
aacgatagatttgaaacaagct

SEQ ID NO: 39191 - DNA, 18 bp, Homo sapiens
ttagagcctgacacctct

SEQ ID NO: 39192 - DNA, 22 bp, Homo sapiens
ttttgggacatggccactgctt

SEQ ID NO: 39193 - DNA, 17 bp, Homo sapiens
cataagaaaacttatct

SEQ ID NO: 39194 - DNA, 18 bp, Homo sapiens
ccgggcaggtcactgtgc

SEQ ID NO: 39195 - DNA, 22 bp, Homo sapiens
gaggtcgagatcagcctgggaa

SEQ ID NO: 39196 - DNA, 16 bp, Homo sapiens
ggaagactcattccaa

SEQ ID NO: 39197 - DNA, 19 bp, Homo sapiens
ggtggaagagcaaaactca

SEQ ID NO: 39198 - DNA, 19 bp, Homo sapiens
acatgcctatctagcagca

SEQ ID NO: 39199 - DNA, 23 bp, Homo sapiens
cctaaggagtccagattgttttt

SEQ ID NO: 39200 - DNA, 21 bp, Homo sapiens
gctgctgaatttaaatagtaa

SEQ ID NO: 39201 - DNA, 23 bp, Homo sapiens
aaataattttgtcccaagtctta

SEQ ID NO: 39202 - DNA, 18 bp, Homo sapiens
catgctttgcactctcct

SEQ ID NO: 39203 - DNA, 21 bp, Homo sapiens
ggcaaagatgagaacttccca

SEQ ID NO: 39204 - DNA, 21 bp, Homo sapiens
ttaaggactgtataattcatt

SEQ ID NO: 39205 - DNA, 18 bp, Homo sapiens
actgcttctctgctctga

SEQ ID NO: 39206 - DNA, 21 bp, Homo sapiens
ccccagttgaggctcagatga

SEQ ID NO: 39207 - DNA, 20 bp, Homo sapiens
gaactgagtggactctgcca

SEQ ID NO: 39208 - DNA, 21 bp, Homo sapiens
ggagcaaaacggggctgtggc

SEQ ID NO: 39209 - DNA, 18 bp, Homo sapiens
tccagggaagttaatgga

SEQ ID NO: 39210 - DNA, 21 bp, Homo sapiens
ttctgcctcaaccatgagata

SEQ ID NO: 39211 - DNA, 19 bp, Homo sapiens
cttgacttaagacttggaa

SEQ ID NO: 39212 - DNA, 17 bp, Homo sapiens
gcgccggctgctggcca

SEQ ID NO: 39213 - DNA, 17 bp, Homo sapiens
ggcctcaaaaaatatta

SEQ ID NO: 39214 - DNA, 18 bp, Homo sapiens
acacagtctccacagttt

SEQ ID NO: 39215 - DNA, 23 bp, Homo sapiens
accactagacttcagtgcaggga

SEQ ID NO: 39216 - DNA, 19 bp, Homo sapiens
agaagaggcctggatgcac

SEQ ID NO: 39217 - DNA, 20 bp, Homo sapiens
atacagaggtaaaagaattg

SEQ ID NO: 39218 - DNA, 16 bp, Homo sapiens
cacgtgcacagatgcc

SEQ ID NO: 39219 - DNA, 18 bp, Homo sapiens
cagctgacaaatcatctc

SEQ ID NO: 39220 - DNA, 20 bp, Homo sapiens
ggatcagggcaaaacaactt

SEQ ID NO: 39221 - DNA, 16 bp, Homo sapiens
ttcagagaggataaat

SEQ ID NO: 39222 - DNA, 24 bp, Homo sapiens
cgcgagccctgccggccggacttt

SEQ ID NO: 39223 - DNA, 23 bp, Homo sapiens
taaattaattcaacatgaagttg

SEQ ID NO: 39224 - DNA, 18 bp, Homo sapiens
aataagcaatcctatgat

SEQ ID NO: 39225 - DNA, 20 bp, Homo sapiens
ttgcctaaaacagtagcttt

SEQ ID NO: 39226 - DNA, 20 bp, Homo sapiens
aaaagaaaacagtaaatgaa

SEQ ID NO: 39227 - DNA, 22 bp, Homo sapiens
agcatcaggattccaggaggat

SEQ ID NO: 39228 - DNA, 20 bp, Homo sapiens
tcaacatggagtccaagtaa

SEQ ID NO: 39229 - DNA, 27 bp, Homo sapiens
aggcacagcacttacaagggtgtgaag

SEQ ID NO: 39230 - DNA, 20 bp, Homo sapiens
caagcacagggccctcctca

SEQ ID NO: 39231 - DNA, 17 bp, Homo sapiens
gggagggcagggctgga

SEQ ID NO: 39232 - DNA, 18 bp, Homo sapiens
ggtaactgtcggcaatgt

SEQ ID NO: 39233 - DNA, 17 bp, Homo sapiens
tacagacagacgtcctg

SEQ ID NO: 39234 - DNA, 19 bp, Homo sapiens
taccataagcaccctgcac

SEQ ID NO: 39235 - DNA, 23 bp, Homo sapiens
tcctgctcacagcctggcacaga

SEQ ID NO: 39236 - DNA, 23 bp, Homo sapiens
tctggactttcctttctgttcct

SEQ ID NO: 39237 - DNA, 19 bp, Homo sapiens
aaacacatatcaagatcca

SEQ ID NO: 39238 - DNA, 19 bp, Homo sapiens
agtcatttccacagcctca

SEQ ID NO: 39239 - DNA, 22 bp, Homo sapiens
gaggccacaagaagaaaactga

SEQ ID NO: 39240 - DNA, 19 bp, Homo sapiens
gcgccacggcagacacacc

SEQ ID NO: 39241 - DNA, 22 bp, Homo sapiens
ttgcccaagtattttgtgcttt

SEQ ID NO: 39242 - DNA, 18 bp, Homo sapiens
gaactttgaacgatccca

SEQ ID NO: 39243 - DNA, 18 bp, Homo sapiens
tgaccttcctgggcctca

SEQ ID NO: 39244 - DNA, 21 bp, Homo sapiens
tgtttaattctagatataggg

SEQ ID NO: 39245 - DNA, 23 bp, Homo sapiens
agcttctggaggaatgcatgtca

SEQ ID NO: 39246 - DNA, 18 bp, Homo sapiens
caggaatacaggttttct

SEQ ID NO: 39247 - DNA, 22 bp, Homo sapiens
gctggctgcattccaccatagc

SEQ ID NO: 39248 - DNA, 17 bp, Homo sapiens
agctctttggcccctga

SEQ ID NO: 39249 - DNA, 22 bp, Homo sapiens
agtctcactttgtcacccaggc

SEQ ID NO: 39250 - DNA, 20 bp, Homo sapiens
cctgtattggaaatcttgca

SEQ ID NO: 39251 - DNA, 19 bp, Homo sapiens
ctgcaagctctgcctctca

SEQ ID NO: 39252 - DNA, 17 bp, Homo sapiens
tcaagtgattctcctgc

SEQ ID NO: 39253 - DNA, 21 bp, Homo sapiens
tgttagtgttttttaatggag

SEQ ID NO: 39254 - DNA, 18 bp, Homo sapiens
caagctttgcaacaatga

SEQ ID NO: 39255 - DNA, 24 bp, Homo sapiens
actccaggctctaacctggagctg

SEQ ID NO: 39256 - DNA, 19 bp, Homo sapiens
cataaccatgagtatatca

SEQ ID NO: 39257 - DNA, 18 bp, Homo sapiens
gtgtcttcctggactccg

SEQ ID NO: 39258 - DNA, 22 bp, Homo sapiens
tcagctgccgtcatccacacca

SEQ ID NO: 39259 - DNA, 19 bp, Homo sapiens
aagcaattctcctgcctca

SEQ ID NO: 39260 - DNA, 18 bp, Homo sapiens
accagcattgcttggctt

SEQ ID NO: 39261 - DNA, 18 bp, Homo sapiens
agtgatcattccacctca

SEQ ID NO: 39262 - DNA, 15 bp, Homo sapiens
gcaaaacatgttttt

SEQ ID NO: 39263 - DNA, 18 bp, Homo sapiens
gtccattttttaatcagg

SEQ ID NO: 39264 - DNA, 18 bp, Homo sapiens
tccgcctcccaggttcaa

SEQ ID NO: 39265 - DNA, 19 bp, Homo sapiens
accagaaatcctctgaaga

SEQ ID NO: 39266 - DNA, 21 bp, Homo sapiens
gacagaagttcctggttctcc

SEQ ID NO: 39267 - DNA, 23 bp, Homo sapiens
gggtgcaccagatgacaggacca

SEQ ID NO: 39268 - DNA, 20 bp, Homo sapiens
tggttctccagcaggaactg

SEQ ID NO: 39269 - DNA, 19 bp, Homo sapiens
agctcttctttgttcatct

SEQ ID NO: 39270 - DNA, 19 bp, Homo sapiens
cagtggtgcagcggtccat

SEQ ID NO: 39271 - DNA, 20 bp, Homo sapiens
gcagagttgacggattatcc

SEQ ID NO: 39272 - DNA, 22 bp, Homo sapiens
tgaccctgcagtgtgcaggcga

SEQ ID NO: 39273 - DNA, 17 bp, Homo sapiens
tgaccaaatcctgtgta

SEQ ID NO: 39274 - DNA, 18 bp, Homo sapiens
tcgtggaataactgttcc

SEQ ID NO: 39275 - DNA, 20 bp, Homo sapiens
caaaaacacagcaagtggga

SEQ ID NO: 39276 - DNA, 22 bp, Homo sapiens
gaggctgtcatccagcctgaga

SEQ ID NO: 39277 - DNA, 21 bp, Homo sapiens
gcctgagaggtttcttggctc

SEQ ID NO: 39278 - DNA, 20 bp, Homo sapiens
cccagagaaattcaccatga

SEQ ID NO: 39279 - DNA, 22 bp, Homo sapiens
cctctcccagactgtgacctta

SEQ ID NO: 39280 - DNA, 18 bp, Homo sapiens
aagctgaagcacgcccca

SEQ ID NO: 39281 - DNA, 17 bp, Homo sapiens
ggagctcccggaatctc

SEQ ID NO: 39282 - DNA, 22 bp, Homo sapiens
aaaagctttaaacttctgcagt

SEQ ID NO: 39283 - DNA, 16 bp, Homo sapiens
ccccaggaggctcagt

SEQ ID NO: 39284 - DNA, 24 bp, Homo sapiens
ctttgaaaatggctgttttacctt

SEQ ID NO: 39285 - DNA, 19 bp, Homo sapiens
gcattagttaaatccctta

SEQ ID NO: 39286 - DNA, 20 bp, Homo sapiens
gtgcaacagtagtaggatat

SEQ ID NO: 39287 - DNA, 17 bp, Homo sapiens
caggtggagccctgctc

SEQ ID NO: 39288 - DNA, 18 bp, Homo sapiens
ctacatgtttctttttca

SEQ ID NO: 39289 - DNA, 19 bp, Homo sapiens
gtttgactttaaagttgca

SEQ ID NO: 39290 - DNA, 18 bp, Homo sapiens
tcctgaaggcgacagtct

SEQ ID NO: 39291 - DNA, 18 bp, Homo sapiens
acagaaaataatattcct

SEQ ID NO: 39292 - DNA, 20 bp, Homo sapiens
actcacttcaattctatgaa

SEQ ID NO: 39293 - DNA, 18 bp, Homo sapiens
agatagtgattcctctga

SEQ ID NO: 39294 - DNA, 19 bp, Homo sapiens
ggttcaagacttcagtgga

SEQ ID NO: 39295 - DNA, 23 bp, Homo sapiens
gttcattattatcacacctgtta

SEQ ID NO: 39296 - DNA, 20 bp, Homo sapiens
taagttgaagccaatatgaa

SEQ ID NO: 39297 - DNA, 21 bp, Homo sapiens
tatcaacattaatagtacttt

SEQ ID NO: 39298 - DNA, 21 bp, Homo sapiens
tccatagatagtgattcctct

SEQ ID NO: 39299 - DNA, 20 bp, Homo sapiens
gccttctggaaggtaggctt

SEQ ID NO: 39300 - DNA, 19 bp, Homo sapiens
tgaatgtgttgtttggttc

SEQ ID NO: 39301 - DNA, 18 bp, Homo sapiens
aaatatttcaatgtaata

SEQ ID NO: 39302 - DNA, 21 bp, Homo sapiens
aggcctcggtgattcagccac

SEQ ID NO: 39303 - DNA, 23 bp, Homo sapiens
attctcaccaaaatagatggtgt

SEQ ID NO: 39304 - DNA, 19 bp, Homo sapiens
agtcgctgagaagctgctg

SEQ ID NO: 39305 - DNA, 21 bp, Homo sapiens
cctccgcccaagttgaagtct

SEQ ID NO: 39306 - DNA, 23 bp, Homo sapiens
ctcttccgctctctgcactgctt

SEQ ID NO: 39307 - DNA, 21 bp, Homo sapiens
gctctctgcactgcttctcga

SEQ ID NO: 39308 - DNA, 18 bp, Homo sapiens
ttttcacttctggaccgc

SEQ ID NO: 39309 - DNA, 18 bp, Homo sapiens
aaaggaaggagggtatca

SEQ ID NO: 39310 - DNA, 18 bp, Homo sapiens
aaaggaaggagggtatca

SEQ ID NO: 39311 - DNA, 19 bp, Homo sapiens
aataactgtgcactgagct

SEQ ID NO: 39312 - DNA, 21 bp, Homo sapiens
aggttaagaacatgcccagga

SEQ ID NO: 39313 - DNA, 16 bp, Homo sapiens
atgtttctactcagac

SEQ ID NO: 39314 - DNA, 18 bp, Homo sapiens
ctatggggcccagtgcca

SEQ ID NO: 39315 - DNA, 20 bp, Homo sapiens
ctctggcatttggggtctgc

SEQ ID NO: 39316 - DNA, 19 bp, Homo sapiens
ctgcccagaggtctaagag

SEQ ID NO: 39317 - DNA, 24 bp, Homo sapiens
gcactgagctccaattttgttcca

SEQ ID NO: 39318 - DNA, 18 bp, Homo sapiens
ggttaagaacatgcccag

SEQ ID NO: 39319 - DNA, 19 bp, Homo sapiens
gtctcctccttgttctcca

SEQ ID NO: 39320 - DNA, 19 bp, Homo sapiens
ctgcaacctctacctccca

SEQ ID NO: 39321 - DNA, 18 bp, Homo sapiens
tctacctcccaggttcaa

SEQ ID NO: 39322 - DNA, 22 bp, Homo sapiens
tgagactacaggcacgcaccac

SEQ ID NO: 39323 - DNA, 23 bp, Homo sapiens
gccaagtgaggcggttctgggga

SEQ ID NO: 39324 - DNA, 19 bp, Homo sapiens
ggccttcgcgctccgggtg

SEQ ID NO: 39325 - DNA, 22 bp, Homo sapiens
gggctgtgaagagaaaactcac

SEQ ID NO: 39326 - DNA, 19 bp, Homo sapiens
tggaggttgatgtgagctg

SEQ ID NO: 39327 - DNA, 19 bp, Homo sapiens
tccttcttgtctgtgactg

SEQ ID NO: 39328 - DNA, 19 bp, Homo sapiens
tgtacacaacctgtacaac

SEQ ID NO: 39329 - DNA, 22 bp, Homo sapiens
atctcggcttactccaacctct

SEQ ID NO: 39330 - DNA, 22 bp, Homo sapiens
cagtggcacattacaaacagta

SEQ ID NO: 39331 - DNA, 20 bp, Homo sapiens
cctctgcctcccaggttcaa

SEQ ID NO: 39332 - DNA, 22 bp, Homo sapiens
ctcttccttttcaggaccttga

SEQ ID NO: 39333 - DNA, 19 bp, Homo sapiens
gtcaccacaaagtataaga

SEQ ID NO: 39334 - DNA, 20 bp, Homo sapiens
tagtttctttttttgttgtt

SEQ ID NO: 39335 - DNA, 18 bp, Homo sapiens
tatgtgcaccacgagtga

SEQ ID NO: 39336 - DNA, 17 bp, Homo sapiens
tcaagtgattcttatgc

SEQ ID NO: 39337 - DNA, 21 bp, Homo sapiens
tctgtaaactaaaaaccaggt

SEQ ID NO: 39338 - DNA, 19 bp, Homo sapiens
tgttatgctacatacatta

SEQ ID NO: 39339 - DNA, 20 bp, Homo sapiens
agacttctccctctccatct

SEQ ID NO: 39340 - DNA, 22 bp, Homo sapiens
atttttttccagacttccctaa

SEQ ID NO: 39341 - DNA, 24 bp, Homo sapiens
cttaggcagctatgggtttctttt

SEQ ID NO: 39342 - DNA, 17 bp, Homo sapiens
gctttgactgcttgctt

SEQ ID NO: 39343 - DNA, 21 bp, Homo sapiens
aaaagatccagtctgtggtat

SEQ ID NO: 39344 - DNA, 20 bp, Homo sapiens
gtaagctcccggtgaatttt

SEQ ID NO: 39345 - DNA, 19 bp, Homo sapiens
gtgggagacttaactttag

SEQ ID NO: 39346 - DNA, 18 bp, Homo sapiens
tctgtctttctttatacc

SEQ ID NO: 39347 - DNA, 18 bp, Homo sapiens
actcataatttcctgaca

SEQ ID NO: 39348 - DNA, 21 bp, Homo sapiens
ataatttcctgacatgggcca

SEQ ID NO: 39349 - DNA, 18 bp, Homo sapiens
atgggccactctaagtgg

SEQ ID NO: 39350 - DNA, 23 bp, Homo sapiens
gcccccagctgactgcctggctt

SEQ ID NO: 39351 - DNA, 18 bp, Homo sapiens
tgtccgacgcctgcccca

SEQ ID NO: 39352 - DNA, 17 bp, Homo sapiens
actcctttttacccata

SEQ ID NO: 39353 - DNA, 22 bp, Homo sapiens
atcaaagatatttatttcctca

SEQ ID NO: 39354 - DNA, 23 bp, Homo sapiens
ccttgatggcgataatctgtgag

SEQ ID NO: 39355 - DNA, 19 bp, Homo sapiens
cttcccaatggccatgtca

SEQ ID NO: 39356 - DNA, 20 bp, Homo sapiens
aaatagtggtatgcatgtgt

SEQ ID NO: 39357 - DNA, 20 bp, Homo sapiens
cccacatttaaagacctagt

SEQ ID NO: 39358 - DNA, 17 bp, Homo sapiens
ggatcaggcctgtgaac

SEQ ID NO: 39359 - DNA, 17 bp, Homo sapiens
gtgaattaatcagtttt

SEQ ID NO: 39360 - DNA, 22 bp, Homo sapiens
gattttccttgtcacctttaag

SEQ ID NO: 39361 - DNA, 16 bp, Homo sapiens
ccagaatggctctcca

SEQ ID NO: 39362 - DNA, 16 bp, Homo sapiens
gacggtaaaatgtgaa

SEQ ID NO: 39363 - DNA, 22 bp, Homo sapiens
tggctctccaacttacatttca

SEQ ID NO: 39364 - DNA, 22 bp, Homo sapiens
gaacaggtgcgacttctgagaa

SEQ ID NO: 39365 - DNA, 19 bp, Homo sapiens
tgcgatgagtcagcctcca

SEQ ID NO: 39366 - DNA, 22 bp, Homo sapiens
aaaatgattctgtagaagacct

SEQ ID NO: 39367 - DNA, 18 bp, Homo sapiens
taaaacaaaaacaattta

SEQ ID NO: 39368 - DNA, 19 bp, Homo sapiens
tcacttgtatatggcacac

SEQ ID NO: 39369 - DNA, 24 bp, Homo sapiens
ttagcttattgtagtatacttcca

SEQ ID NO: 39370 - DNA, 21 bp, Homo sapiens
gctgcagtggcccctgcgtta

SEQ ID NO: 39371 - DNA, 19 bp, Homo sapiens
accagtatctgactgtggc

SEQ ID NO: 39372 - DNA, 22 bp, Homo sapiens
atgcccagctttctcaccccag

SEQ ID NO: 39373 - DNA, 18 bp, Homo sapiens
ccatgcccagctttctca

SEQ ID NO: 39374 - DNA, 20 bp, Homo sapiens
ccatgaaggagcaccttatc

SEQ ID NO: 39375 - DNA, 24 bp, Homo sapiens
tatccgtgtatgtatatatacaca

SEQ ID NO: 39376 - DNA, 21 bp, Homo sapiens
tcggaaaattaagcgacccaa

SEQ ID NO: 39377 - DNA, 19 bp, Homo sapiens
tggctgaaagcctgtggac

SEQ ID NO: 39378 - DNA, 18 bp, Homo sapiens
gatagagcactggacaaa

SEQ ID NO: 39379 - DNA, 25 bp, Homo sapiens
cgcgcgccgccgccccgcgctgctg

SEQ ID NO: 39380 - DNA, 19 bp, Homo sapiens
gaaaagtccacaatttccc

SEQ ID NO: 39381 - DNA, 19 bp, Homo sapiens
cctgaacgccacctggccc

SEQ ID NO: 39382 - DNA, 23 bp, Homo sapiens
cgcgcgccgcctgtgtgctgctg

SEQ ID NO: 39383 - DNA, 15 bp, Homo sapiens
gcttcacgctgcagt

SEQ ID NO: 39384 - DNA, 22 bp, Homo sapiens
tgctcatgttggcctttctcga

SEQ ID NO: 39385 - DNA, 20 bp, Homo sapiens
aaggcatgactagtatttct

SEQ ID NO: 39386 - DNA, 20 bp, Homo sapiens
aatactgtaggaagtcagtg

SEQ ID NO: 39387 - DNA, 20 bp, Homo sapiens
acagacagtgaacctgactg

SEQ ID NO: 39388 - DNA, 21 bp, Homo sapiens
atgtggagcaaatggaatggt

SEQ ID NO: 39389 - DNA, 18 bp, Homo sapiens
caacccatgactgctcct

SEQ ID NO: 39390 - DNA, 21 bp, Homo sapiens
caaggggagccctggaagctg

SEQ ID NO: 39391 - DNA, 19 bp, Homo sapiens
cagatggggatttttgtca

SEQ ID NO: 39392 - DNA, 18 bp, Homo sapiens
gaaaatggcccagattct

SEQ ID NO: 39393 - DNA, 16 bp, Homo sapiens
gagaggtcagaagtgg

SEQ ID NO: 39394 - DNA, 20 bp, Homo sapiens
taagtgcaataatatgaaat

SEQ ID NO: 39395 - DNA, 18 bp, Homo sapiens
tcatttccatcttcccac

SEQ ID NO: 39396 - DNA, 17 bp, Homo sapiens
tcccatcaggcctctgt

SEQ ID NO: 39397 - DNA, 21 bp, Homo sapiens
tctaagtattggatctctttt

SEQ ID NO: 39398 - DNA, 27 bp, Homo sapiens
tgaatgggcagctgatggttggagttg

SEQ ID NO: 39399 - DNA, 20 bp, Homo sapiens
ttcaagactggtcagtccaa

SEQ ID NO: 39400 - DNA, 22 bp, Homo sapiens
aaaagcaggctcatcgaataca

SEQ ID NO: 39401 - DNA, 25 bp, Homo sapiens
ctctgatgttcagtgaagagtacca

SEQ ID NO: 39402 - DNA, 21 bp, Homo sapiens
caccaggactaaaggccgcca

SEQ ID NO: 39403 - DNA, 22 bp, Homo sapiens
cagcctggctaacacagtgaaa

SEQ ID NO: 39404 - DNA, 21 bp, Homo sapiens
caggactcatctgccatttca

SEQ ID NO: 39405 - DNA, 25 bp, Homo sapiens
gccaccggggaacggggatcggtga

SEQ ID NO: 39406 - DNA, 17 bp, Homo sapiens
gcgccggccgagacctg

SEQ ID NO: 39407 - DNA, 18 bp, Homo sapiens
ccagaaacaaatacccaa

SEQ ID NO: 39408 - DNA, 20 bp, Homo sapiens
ctacggtcacctgtgtggtt

SEQ ID NO: 39409 - DNA, 22 bp, Homo sapiens
tctagccctagtttgctcctga

SEQ ID NO: 39410 - DNA, 20 bp, Homo sapiens
aataggcagaggctggaaca

SEQ ID NO: 39411 - DNA, 18 bp, Homo sapiens
ccatttgcaacaggaaca

SEQ ID NO: 39412 - DNA, 28 bp, Homo sapiens
tataattggcaacaggaacatttaccca

SEQ ID NO: 39413 - DNA, 19 bp, Homo sapiens
tggatgtgagacatggaat

SEQ ID NO: 39414 - DNA, 18 bp, Homo sapiens
cccgccgcctgcgttctc

SEQ ID NO: 39415 - DNA, 23 bp, Homo sapiens
ccctgcatcagaatgcctgcgaa

SEQ ID NO: 39416 - DNA, 19 bp, Homo sapiens
ctgcaagctccgcctccca

SEQ ID NO: 39417 - DNA, 23 bp, Homo sapiens
gcctgggcttccaggcctggttc

SEQ ID NO: 39418 - DNA, 16 bp, Homo sapiens
gtctcacgggggctct

SEQ ID NO: 39419 - DNA, 20 bp, Homo sapiens
tggaagccagagtggggctg

SEQ ID NO: 39420 - DNA, 20 bp, Homo sapiens
cccacagtcccgagactggg

SEQ ID NO: 39421 - DNA, 21 bp, Homo sapiens
ccccagggggccccctgcggc

SEQ ID NO: 39422 - DNA, 17 bp, Homo sapiens
gccccgcccctccccct

SEQ ID NO: 39423 - DNA, 18 bp, Homo sapiens
ggcgacggcggcggtggc

SEQ ID NO: 39424 - DNA, 20 bp, Homo sapiens
ggggatgtagaggcggcggc

SEQ ID NO: 39425 - DNA, 21 bp, Homo sapiens
tagttgctttttgttgttttt

SEQ ID NO: 39426 - DNA, 23 bp, Homo sapiens
agggcattcatgaaagaacaact

SEQ ID NO: 39427 - DNA, 18 bp, Homo sapiens
ctttccagagctacccag

SEQ ID NO: 39428 - DNA, 19 bp, Homo sapiens
ttaaaaatctaagatgtgg

SEQ ID NO: 39429 - DNA, 17 bp, Homo sapiens
atgaagttgtctgtaca

SEQ ID NO: 39430 - DNA, 23 bp, Homo sapiens
tcaaagtcatttttgacacatca

SEQ ID NO: 39431 - DNA, 18 bp, Homo sapiens
tccaccctgcaggttcaa

SEQ ID NO: 39432 - DNA, 16 bp, Homo sapiens
tctcagttcactgcaa

SEQ ID NO: 39433 - DNA, 23 bp, Homo sapiens
ttagaaaatgtgaaactgttctt

SEQ ID NO: 39434 - DNA, 18 bp, Homo sapiens
acctgggctgcgacgtgg

SEQ ID NO: 39435 - DNA, 18 bp, Homo sapiens
actgacaacacactaggc

SEQ ID NO: 39436 - DNA, 19 bp, Homo sapiens
agctttaaggtgttaccct

SEQ ID NO: 39437 - DNA, 17 bp, Homo sapiens
tactgacactgtcagct

SEQ ID NO: 39438 - DNA, 19 bp, Homo sapiens
cagctggcaccagcatcta

SEQ ID NO: 39439 - DNA, 20 bp, Homo sapiens
cccagaagaatggtgtccca

SEQ ID NO: 39440 - DNA, 17 bp, Homo sapiens
gaatggattaatggaac

SEQ ID NO: 39441 - DNA, 22 bp, Homo sapiens
tctggagtgcagtggtacaata

SEQ ID NO: 39442 - DNA, 21 bp, Homo sapiens
aaaccctgctactactcctct

SEQ ID NO: 39443 - DNA, 23 bp, Homo sapiens
aacagctcaaatccattttttac

SEQ ID NO: 39444 - DNA, 20 bp, Homo sapiens
acacttgtaagttcacaggt

SEQ ID NO: 39445 - DNA, 22 bp, Homo sapiens
atccaaacaccttgctgaccaa

SEQ ID NO: 39446 - DNA, 22 bp, Homo sapiens
ctcagaacacaagatccagtca

SEQ ID NO: 39447 - DNA, 24 bp, Homo sapiens
ctcctgaaaaagtgctgcctcctg

SEQ ID NO: 39448 - DNA, 21 bp, Homo sapiens
tgaaggaaacactaattcctc

SEQ ID NO: 39449 - DNA, 24 bp, Homo sapiens
ttgccatcaccggtgaacagctca

SEQ ID NO: 39450 - DNA, 24 bp, Homo sapiens
acataatgctcagtgaaaatagca

SEQ ID NO: 39451 - DNA, 18 bp, Homo sapiens
atattttcattgccccca

SEQ ID NO: 39452 - DNA, 27 bp, Homo sapiens
atttggatcagattggctgttaggctt

SEQ ID NO: 39453 - DNA, 21 bp, Homo sapiens
cattttatagtatcactgcta

SEQ ID NO: 39454 - DNA, 17 bp, Homo sapiens
gcaagtcaactgccatg

SEQ ID NO: 39455 - DNA, 24 bp, Homo sapiens
gcacctacagaggaatccatacca

SEQ ID NO: 39456 - DNA, 20 bp, Homo sapiens
tgcttagttcatagtatgct

SEQ ID NO: 39457 - DNA, 18 bp, Homo sapiens
tgtaaattaaacatgaat

SEQ ID NO: 39458 - DNA, 18 bp, Homo sapiens
ccgagcgcgcacgctctg

SEQ ID NO: 39459 - DNA, 18 bp, Homo sapiens
ctgcctggctcctgcccc

SEQ ID NO: 39460 - DNA, 18 bp, Homo sapiens
tggggtggtgttgttata

SEQ ID NO: 39461 - DNA, 24 bp, Homo sapiens
tttaagtgtagcagctttgacttt

SEQ ID NO: 39462 - DNA, 20 bp, Homo sapiens
aagtgaaagaagccagccat

SEQ ID NO: 39463 - DNA, 22 bp, Homo sapiens
ggcagaaacaactccagagcca

SEQ ID NO: 39464 - DNA, 23 bp, Homo sapiens
tggcccaaaagagacaagtaaca

SEQ ID NO: 39465 - DNA, 18 bp, Homo sapiens
ttccattactgtgtttgc

SEQ ID NO: 39466 - DNA, 20 bp, Homo sapiens
acgatcacggacaggtatgc

SEQ ID NO: 39467 - DNA, 18 bp, Homo sapiens
actctgcacctccttcca

SEQ ID NO: 39468 - DNA, 19 bp, Homo sapiens
atgggagcccccataccca

SEQ ID NO: 39469 - DNA, 25 bp, Homo sapiens
cttctgacaccttgactttagcctt

SEQ ID NO: 39470 - DNA, 20 bp, Homo sapiens
ttcaagaccagcctagccaa

SEQ ID NO: 39471 - DNA, 16 bp, Homo sapiens
ccgtaatgctcacaac

SEQ ID NO: 39472 - DNA, 19 bp, Homo sapiens
ccgtaatgctcacaacaac

SEQ ID NO: 39473 - DNA, 20 bp, Homo sapiens
gcccctcgatcctaacctca

SEQ ID NO: 39474 - DNA, 17 bp, Homo sapiens
cacgtggtgaggctgca

SEQ ID NO: 39475 - DNA, 19 bp, Homo sapiens
cctctgtccccttggaagt

SEQ ID NO: 39476 - DNA, 18 bp, Homo sapiens
ggtggcctggacaatcca

SEQ ID NO: 39477 - DNA, 18 bp, Homo sapiens
cccacaacctccgcctcc

SEQ ID NO: 39478 - DNA, 18 bp, Homo sapiens
tccgcctcccaggttcaa

SEQ ID NO: 39479 - DNA, 21 bp, Homo sapiens
atctccagttgttaaagctca

SEQ ID NO: 39480 - DNA, 19 bp, Homo sapiens
tctgttggtgatctcataa

SEQ ID NO: 39481 - DNA, 21 bp, Homo sapiens
tgcacttctttactctggtaa

SEQ ID NO: 39482 - DNA, 16 bp, Homo sapiens
tttcttccttatatta

SEQ ID NO: 39483 - DNA, 21 bp, Homo sapiens
caccaaagctcatccctctcc

SEQ ID NO: 39484 - DNA, 23 bp, Homo sapiens
ctctttctctccaccaaagctca

SEQ ID NO: 39485 - DNA, 17 bp, Homo sapiens
aatacgtgggcttgact

SEQ ID NO: 39486 - DNA, 25 bp, Homo sapiens
accaactagctttagtagtgctgct

SEQ ID NO: 39487 - DNA, 22 bp, Homo sapiens
agagaaaccctgaacaaagctg

SEQ ID NO: 39488 - DNA, 20 bp, Homo sapiens
tgaagagacattgttcagag

SEQ ID NO: 39489 - DNA, 21 bp, Homo sapiens
acatagccgccagacctcttc

SEQ ID NO: 39490 - DNA, 19 bp, Homo sapiens
ccaggggctgccctgctgt

SEQ ID NO: 39491 - DNA, 17 bp, Homo sapiens
gctggtgtcgacggagt

SEQ ID NO: 39492 - DNA, 17 bp, Homo sapiens
ccaatggtgctgcatgg

SEQ ID NO: 39493 - DNA, 20 bp, Homo sapiens
aggaagggctgggtgagaca

SEQ ID NO: 39494 - DNA, 22 bp, Homo sapiens
caccttttggagatttaaccat

SEQ ID NO: 39495 - DNA, 20 bp, Homo sapiens
cagaagaagggttgggtctg

SEQ ID NO: 39496 - DNA, 18 bp, Homo sapiens
ccaccttttggagattta

SEQ ID NO: 39497 - DNA, 17 bp, Homo sapiens
ctatctcatgtgttaga

SEQ ID NO: 39498 - DNA, 19 bp, Homo sapiens
cttgtttgctcaaatgcaa

SEQ ID NO: 39499 - DNA, 22 bp, Homo sapiens
gcttgcggcctgcaggcactcc

SEQ ID NO: 39500 - DNA, 23 bp, Homo sapiens
tactgcatttccttcttgctctg

SEQ ID NO: 39501 - DNA, 23 bp, Homo sapiens
tggagcatggcagggcttggtta

SEQ ID NO: 39502 - DNA, 19 bp, Homo sapiens
agaatgtagaaaagccatt

SEQ ID NO: 39503 - DNA, 18 bp, Homo sapiens
aggattttactgtgttgg

SEQ ID NO: 39504 - DNA, 16 bp, Homo sapiens
ccacaaatatgaagaa

SEQ ID NO: 39505 - DNA, 20 bp, Homo sapiens
cctctgccttccaggttcaa

SEQ ID NO: 39506 - DNA, 21 bp, Homo sapiens
tgaaatgatccatacacctct

SEQ ID NO: 39507 - DNA, 16 bp, Homo sapiens
ccacaaatatgaagaa

SEQ ID NO: 39508 - DNA, 16 bp, Homo sapiens
cgtcctcttactccta

SEQ ID NO: 39509 - DNA, 19 bp, Homo sapiens
tggagcaaaaccttacaaa

SEQ ID NO: 39510 - DNA, 20 bp, Homo sapiens
agcccctccagattggcact

SEQ ID NO: 39511 - DNA, 24 bp, Homo sapiens
caggtttgtttgtttcccactttt

SEQ ID NO: 39512 - DNA, 21 bp, Homo sapiens
cgatcctttttaacactctca

SEQ ID NO: 39513 - DNA, 18 bp, Homo sapiens
ctgtagggacactgtgtt

SEQ ID NO: 39514 - DNA, 19 bp, Homo sapiens
gaaagccacagaggatggg

SEQ ID NO: 39515 - DNA, 22 bp, Homo sapiens
gcccatagactacagttcttca

SEQ ID NO: 39516 - DNA, 15 bp, Homo sapiens
gtctgatctgtggac

SEQ ID NO: 39517 - DNA, 19 bp, Homo sapiens
ttcagatctttgtacctta

SEQ ID NO: 39518 - DNA, 19 bp, Homo sapiens
atgggagcccccataccca

SEQ ID NO: 39519 - DNA, 25 bp, Homo sapiens
cctctgacaccttgactttagcctt

SEQ ID NO: 39520 - DNA, 20 bp, Homo sapiens
ttcaagaccagcctagccaa

SEQ ID NO: 39521 - DNA, 18 bp, Homo sapiens
ggcacagctcctccctca

SEQ ID NO: 39522 - DNA, 21 bp, Homo sapiens
aagcaagtgcataaccttctc

SEQ ID NO: 39523 - DNA, 19 bp, Homo sapiens
ccatcttcacccccacctc

SEQ ID NO: 39524 - DNA, 23 bp, Homo sapiens
cctccccggctcatcactcccca

SEQ ID NO: 39525 - DNA, 20 bp, Homo sapiens
ctgaagagattgcctggttc

SEQ ID NO: 39526 - DNA, 22 bp, Homo sapiens
gagccaagatcatgccactgca

SEQ ID NO: 39527 - DNA, 18 bp, Homo sapiens
ggagcctccatttttctc

SEQ ID NO: 39528 - DNA, 17 bp, Homo sapiens
cctccgggagcctgggt

SEQ ID NO: 39529 - DNA, 21 bp, Homo sapiens
cttaaaaaactgtccatttaa

SEQ ID NO: 39530 - DNA, 17 bp, Homo sapiens
gggccgcccgctccctc

SEQ ID NO: 39531 - DNA, 18 bp, Homo sapiens
gtttccatcaacaccgct

SEQ ID NO: 39532 - DNA, 20 bp, Homo sapiens
tgagactacagtggggctga

SEQ ID NO: 39533 - DNA, 20 bp, Homo sapiens
atgagtcttggaggttctga

SEQ ID NO: 39534 - DNA, 18 bp, Homo sapiens
tttcaagacagtggtgtt

SEQ ID NO: 39535 - DNA, 19 bp, Homo sapiens
catgagtggggaagagcaa

SEQ ID NO: 39536 - DNA, 21 bp, Homo sapiens
gagagcccgcccggcctgaga

SEQ ID NO: 39537 - DNA, 21 bp, Homo sapiens
gagcgcctccagccccatagc

SEQ ID NO: 39538 - DNA, 21 bp, Homo sapiens
tgttaaaataaaacctaacca

SEQ ID NO: 39539 - DNA, 25 bp, Homo sapiens
ggccattttacttaaatctgtatta

SEQ ID NO: 39540 - DNA, 21 bp, Homo sapiens
ggctcccgcctgtaatcccat

SEQ ID NO: 39541 - DNA, 19 bp, Homo sapiens
cctacactccctctctgag

SEQ ID NO: 39542 - DNA, 17 bp, Homo sapiens
agaagaacctggaccat

SEQ ID NO: 39543 - DNA, 24 bp, Homo sapiens
cagaaaaaaacataattctggtga

SEQ ID NO: 39544 - DNA, 20 bp, Homo sapiens
ctggaccattcttgatggag

SEQ ID NO: 39545 - DNA, 18 bp, Homo sapiens
cttttcatcctaaatctt

SEQ ID NO: 39546 - DNA, 20 bp, Homo sapiens
tctgtattattatatgtgct

SEQ ID NO: 39547 - DNA, 22 bp, Homo sapiens
gggtgcccccgatgggaggctg

SEQ ID NO: 39548 - DNA, 19 bp, Homo sapiens
gtgtgtgtgtgtctggctg

SEQ ID NO: 39549 - DNA, 25 bp, Homo sapiens
gttctcctccacatctcccatccca

SEQ ID NO: 39550 - DNA, 22 bp, Homo sapiens
aaccaggatttgctcgatctca

SEQ ID NO: 39551 - DNA, 19 bp, Homo sapiens
acaggccagaaaccagcag

SEQ ID NO: 39552 - DNA, 20 bp, Homo sapiens
agcagccacaggagatgtca

SEQ ID NO: 39553 - DNA, 20 bp, Homo sapiens
agtgtccagtgcccatctct

SEQ ID NO: 39554 - DNA, 21 bp, Homo sapiens
caggacccgccccaccctgcg

SEQ ID NO: 39555 - DNA, 20 bp, Homo sapiens
caggtccccaaatgatctta

SEQ ID NO: 39556 - DNA, 20 bp, Homo sapiens
cccgccccaccctgcggttc

SEQ ID NO: 39557 - DNA, 20 bp, Homo sapiens
gaggaggctctgcatgtcca

SEQ ID NO: 39558 - DNA, 21 bp, Homo sapiens
gcagcaaagctgtatctgcta

SEQ ID NO: 39559 - DNA, 20 bp, Homo sapiens
gctgtctccccagcgtgtcc

SEQ ID NO: 39560 - DNA, 23 bp, Homo sapiens
tcccgtggctcggattctctgag

SEQ ID NO: 39561 - DNA, 21 bp, Homo sapiens
tgagtgacctgactgagacta

SEQ ID NO: 39562 - DNA, 20 bp, Homo sapiens
aggagggcgagtggcgagca

SEQ ID NO: 39563 - DNA, 23 bp, Homo sapiens
acagagaagaggagaccccaaca

SEQ ID NO: 39564 - DNA, 19 bp, Homo sapiens
ttctggatcccagcagtgt

SEQ ID NO: 39565 - DNA, 21 bp, Homo sapiens
acagctgcgttggagtggtga

SEQ ID NO: 39566 - DNA, 19 bp, Homo sapiens
accaaaacaaactgaagag

SEQ ID NO: 39567 - DNA, 22 bp, Homo sapiens
accactcagtacccactgggca

SEQ ID NO: 39568 - DNA, 22 bp, Homo sapiens
acggatcctgtttgggccttca

SEQ ID NO: 39569 - DNA, 18 bp, Homo sapiens
cagcagattctgcttctt

SEQ ID NO: 39570 - DNA, 19 bp, Homo sapiens
cctggcagccctctggcct

SEQ ID NO: 39571 - DNA, 20 bp, Homo sapiens
acttttccacataccccaca

SEQ ID NO: 39572 - DNA, 18 bp, Homo sapiens
caacagagtcatttccta

SEQ ID NO: 39573 - DNA, 21 bp, Homo sapiens
ccatcccagggcattgtgacc

SEQ ID NO: 39574 - DNA, 20 bp, Homo sapiens
ccttcatctccttactctcg

SEQ ID NO: 39575 - DNA, 23 bp, Homo sapiens
gaaagaccttttggaccacccct

SEQ ID NO: 39576 - DNA, 16 bp, Homo sapiens
tgcaacctccaccccc

SEQ ID NO: 39577 - DNA, 21 bp, Homo sapiens
tgggcctggtacatggcaatg

SEQ ID NO: 39578 - DNA, 18 bp, Homo sapiens
tggtggtaaaggatgtac

SEQ ID NO: 39579 - DNA, 23 bp, Homo sapiens
tcaggagtgagcctggcactcca

SEQ ID NO: 39580 - DNA, 19 bp, Homo sapiens
catgaaacggctttcccgg

SEQ ID NO: 39581 - DNA, 21 bp, Homo sapiens
cctgttcacccctctgaccgc

SEQ ID NO: 39582 - DNA, 18 bp, Homo sapiens
cttgcccctggtcagcgt

SEQ ID NO: 39583 - DNA, 24 bp, Homo sapiens
atctggattgtgcagagcctgcct

SEQ ID NO: 39584 - DNA, 23 bp, Homo sapiens
ttctggtacaagatgcctgtgga

SEQ ID NO: 39585 - DNA, 23 bp, Homo sapiens
tcatgacttttttatgtgtacca

SEQ ID NO: 39586 - DNA, 22 bp, Homo sapiens
acaatgggagcaaccctttgca

SEQ ID NO: 39587 - DNA, 21 bp, Homo sapiens
catgcctgtgtgggtatctga

SEQ ID NO: 39588 - DNA, 17 bp, Homo sapiens
ccagcagcccctgcccc

SEQ ID NO: 39589 - DNA, 22 bp, Homo sapiens
ccccacccgcacccctgcacct

SEQ ID NO: 39590 - DNA, 16 bp, Homo sapiens
cccctgcacctgccac

SEQ ID NO: 39591 - DNA, 16 bp, Homo sapiens
cccctgcacctgccac

SEQ ID NO: 39592 - DNA, 16 bp, Homo sapiens
cccctgcacctgccac

SEQ ID NO: 39593 - DNA, 18 bp, Homo sapiens
ctctgcccctgcgcccct

SEQ ID NO: 39594 - DNA, 18 bp, Homo sapiens
ctgagcattactctgata

SEQ ID NO: 39595 - DNA, 19 bp, Homo sapiens
ctgcgcccctcctgcctct

SEQ ID NO: 39596 - DNA, 25 bp, Homo sapiens
gaacgccttcttcaggccctgtctt

SEQ ID NO: 39597 - DNA, 24 bp, Homo sapiens
gcccatggaggccttttctaatcc

SEQ ID NO: 39598 - DNA, 24 bp, Homo sapiens
gccccggaaccagaggtctgggga

SEQ ID NO: 39599 - DNA, 17 bp, Homo sapiens
tgaccagccctcctgcc

SEQ ID NO: 39600 - DNA, 18 bp, Homo sapiens
ggaaacacagccagctca

SEQ ID NO: 39601 - DNA, 20 bp, Homo sapiens
tcagcaggaagcaagatggg

SEQ ID NO: 39602 - DNA, 22 bp, Homo sapiens
tggatggactcttatctagaat

SEQ ID NO: 39603 - DNA, 24 bp, Homo sapiens
aaaggagctcaacagcgttactta

SEQ ID NO: 39604 - DNA, 19 bp, Homo sapiens
atgaaggaaagggacacaa

SEQ ID NO: 39605 - DNA, 22 bp, Homo sapiens
gaaagaactgtaaaagtctgca

SEQ ID NO: 39606 - DNA, 19 bp, Homo sapiens
gtatgaggtcaggagcagg

SEQ ID NO: 39607 - DNA, 18 bp, Homo sapiens
tatccaagtgtccagcaa

SEQ ID NO: 39608 - DNA, 21 bp, Homo sapiens
acctggaccgctccatttggt

SEQ ID NO: 39609 - DNA, 20 bp, Homo sapiens
atccgtgtgcacacgtgtga

SEQ ID NO: 39610 - DNA, 21 bp, Homo sapiens
tgagtctgccaagtggaactg

SEQ ID NO: 39611 - DNA, 20 bp, Homo sapiens
ggctttgaagaactttgcca

SEQ ID NO: 39612 - DNA, 18 bp, Homo sapiens
ggaaaaataattctgata

SEQ ID NO: 39613 - DNA, 21 bp, Homo sapiens
taatcgcaaacttcctccctt

SEQ ID NO: 39614 - DNA, 18 bp, Homo sapiens
ctaatacaaacaggaact

SEQ ID NO: 39615 - DNA, 19 bp, Homo sapiens
cttgcaggaaggctgtgag

SEQ ID NO: 39616 - DNA, 22 bp, Homo sapiens
gcttgggctctgggtttgaccc

SEQ ID NO: 39617 - DNA, 20 bp, Homo sapiens
tctactctatgctctgtgaa

SEQ ID NO: 39618 - DNA, 18 bp, Homo sapiens
aatgaggtgtccgagtga

SEQ ID NO: 39619 - DNA, 16 bp, Homo sapiens
caccactgccatcaca

SEQ ID NO: 39620 - DNA, 18 bp, Homo sapiens
ggcatattttttacttca

SEQ ID NO: 39621 - DNA, 20 bp, Homo sapiens
tatgcaccactgccatcaca

SEQ ID NO: 39622 - DNA, 16 bp, Homo sapiens
tttagtatcttctctc

SEQ ID NO: 39623 - DNA, 19 bp, Homo sapiens
ccctgtccggggacctgtg

SEQ ID NO: 39624 - DNA, 22 bp, Homo sapiens
aatcattccccaacttgtagca

SEQ ID NO: 39625 - DNA, 20 bp, Homo sapiens
cctttaatgcctaaaactcc

SEQ ID NO: 39626 - DNA, 25 bp, Homo sapiens
tcctgacatcactgagatctgagga

SEQ ID NO: 39627 - DNA, 21 bp, Homo sapiens
tgcagactgcacattcggaca

SEQ ID NO: 39628 - DNA, 18 bp, Homo sapiens
ttgcaaaaacactgcctc

SEQ ID NO: 39629 - DNA, 20 bp, Homo sapiens
tttggacatggcagaaacca

SEQ ID NO: 39630 - DNA, 18 bp, Homo sapiens
actccaaacttgctcttc

SEQ ID NO: 39631 - DNA, 19 bp, Homo sapiens
agcagtccctgggcaccca

SEQ ID NO: 39632 - DNA, 19 bp, Homo sapiens
caggctcatcatccatcca

SEQ ID NO: 39633 - DNA, 22 bp, Homo sapiens
ccatctacaaattcagactctt

SEQ ID NO: 39634 - DNA, 19 bp, Homo sapiens
gcctgctgaagggaagcca

SEQ ID NO: 39635 - DNA, 23 bp, Homo sapiens
tctctttccagtgtcttagactt

SEQ ID NO: 39636 - DNA, 23 bp, Homo sapiens
tgcccagcagtccctgggcaccc

SEQ ID NO: 39637 - DNA, 21 bp, Homo sapiens
acatcactcttatgtaatccc

SEQ ID NO: 39638 - DNA, 19 bp, Homo sapiens
caagatagtagtattatta

SEQ ID NO: 39639 - DNA, 22 bp, Homo sapiens
tctaagcatttacccttttgat

SEQ ID NO: 39640 - DNA, 20 bp, Homo sapiens
ttttgatatgcatcaagtgg

SEQ ID NO: 39641 - DNA, 18 bp, Homo sapiens
cactaattattttttaca

SEQ ID NO: 39642 - DNA, 22 bp, Homo sapiens
caggctggtaatcccaaattga

SEQ ID NO: 39643 - DNA, 20 bp, Homo sapiens
ctattctatttcctcatctc

SEQ ID NO: 39644 - DNA, 16 bp, Homo sapiens
ctcagtgatggtctaa

SEQ ID NO: 39645 - DNA, 19 bp, Homo sapiens
gatctgaaaaggctacaca

SEQ ID NO: 39646 - DNA, 21 bp, Homo sapiens
tactcttacctgtaggatcca

SEQ ID NO: 39647 - DNA, 19 bp, Homo sapiens
ttccaactctgtaacactg

SEQ ID NO: 39648 - DNA, 21 bp, Homo sapiens
cgaggcggttaccccgccgca

SEQ ID NO: 39649 - DNA, 20 bp, Homo sapiens
taagtgggttaaattgagac

SEQ ID NO: 39650 - DNA, 20 bp, Homo sapiens
tttcttatttgcctcttaaa

SEQ ID NO: 39651 - DNA, 18 bp, Homo sapiens
acgcaaactctccaccga

SEQ ID NO: 39652 - DNA, 20 bp, Homo sapiens
atctccaaagagcctcttca

SEQ ID NO: 39653 - DNA, 19 bp, Homo sapiens
catgactcagcaacattga

SEQ ID NO: 39654 - DNA, 18 bp, Homo sapiens
gctgttgctgtcctctaa

SEQ ID NO: 39655 - DNA, 17 bp, Homo sapiens
ggagacctgggttccca

SEQ ID NO: 39656 - DNA, 22 bp, Homo sapiens
tctgagctattttgctcggttt

SEQ ID NO: 39657 - DNA, 20 bp, Homo sapiens
tctggggtcatacggcatgg

SEQ ID NO: 39658 - DNA, 18 bp, Homo sapiens
tgccataaacatccttga

SEQ ID NO: 39659 - DNA, 21 bp, Homo sapiens
tgtaaattctggcgtgtgctg

SEQ ID NO: 39660 - DNA, 19 bp, Homo sapiens
cctgagtcatgattggctc

SEQ ID NO: 39661 - DNA, 22 bp, Homo sapiens
gctggttctcacaccagcagca

SEQ ID NO: 39662 - DNA, 19 bp, Homo sapiens
ggccaagcaacgagcactt

SEQ ID NO: 39663 - DNA, 18 bp, Homo sapiens
tctggtgtgcttccaggt

SEQ ID NO: 39664 - DNA, 23 bp, Homo sapiens
agattctgatttatatgttccca

SEQ ID NO: 39665 - DNA, 21 bp, Homo sapiens
caccgtgtccagccttgcaaa

SEQ ID NO: 39666 - DNA, 18 bp, Homo sapiens
cctaggagcagtgtttca

SEQ ID NO: 39667 - DNA, 20 bp, Homo sapiens
tcactcctcattatttgtgc

SEQ ID NO: 39668 - DNA, 22 bp, Homo sapiens
ttgtcattggagaatttctggt

SEQ ID NO: 39669 - DNA, 22 bp, Homo sapiens
caccaaccagacaccaaacttc

SEQ ID NO: 39670 - DNA, 24 bp, Homo sapiens
ttctgatgagactgagactttgaa

SEQ ID NO: 39671 - DNA, 22 bp, Homo sapiens
acccagagagaaaaagcatccc

SEQ ID NO: 39672 - DNA, 18 bp, Homo sapiens
cctggctgcagcctgcgg

SEQ ID NO: 39673 - DNA, 19 bp, Homo sapiens
cttcccctccccttcccca

SEQ ID NO: 39674 - DNA, 22 bp, Homo sapiens
aaagaaatgttgacaccagtga

SEQ ID NO: 39675 - DNA, 16 bp, Homo sapiens
aggaacacaggtcctt

SEQ ID NO: 39676 - DNA, 23 bp, Homo sapiens
cttatcatgtaatgacagattca

SEQ ID NO: 39677 - DNA, 16 bp, Homo sapiens
ggtggatggtgtgtcg

SEQ ID NO: 39678 - DNA, 21 bp, Homo sapiens
caatcctttttctgtacctca

SEQ ID NO: 39679 - DNA, 21 bp, Homo sapiens
tccaatcctttttctgtacct

SEQ ID NO: 39680 - DNA, 19 bp, Homo sapiens
agctgtgggcaagaggtca

SEQ ID NO: 39681 - DNA, 23 bp, Homo sapiens
agtgcctgaccctgacctgtcct

SEQ ID NO: 39682 - DNA, 22 bp, Homo sapiens
ccccaccccacccagccgtgta

SEQ ID NO: 39683 - DNA, 17 bp, Homo sapiens
ctctcctgccctgcctt

SEQ ID NO: 39684 - DNA, 16 bp, Homo sapiens
agaccccatcccctca

SEQ ID NO: 39685 - DNA, 22 bp, Homo sapiens
gctgcacctctgcagtccccaa

SEQ ID NO: 39686 - DNA, 22 bp, Homo sapiens
cgggcgcatcacgaggtcagga

SEQ ID NO: 39687 - DNA, 20 bp, Homo sapiens
taagggttgacaccattctc

SEQ ID NO: 39688 - DNA, 19 bp, Homo sapiens
ataatggttttctgtctac

SEQ ID NO: 39689 - DNA, 21 bp, Homo sapiens
atcttccaaaagactattaca

SEQ ID NO: 39690 - DNA, 18 bp, Homo sapiens
attctaagcattcatacc

SEQ ID NO: 39691 - DNA, 18 bp, Homo sapiens
cctccggagtaactggca

SEQ ID NO: 39692 - DNA, 20 bp, Homo sapiens
cttttttgtatgttgacctt

SEQ ID NO: 39693 - DNA, 17 bp, Homo sapiens
gagtaactggcattaca

SEQ ID NO: 39694 - DNA, 19 bp, Homo sapiens
ggagatccattgaaactca

SEQ ID NO: 39695 - DNA, 20 bp, Homo sapiens
tcataaaatcttatagtcaa

SEQ ID NO: 39696 - DNA, 18 bp, Homo sapiens
tgagccaaatgcactagt

SEQ ID NO: 39697 - DNA, 21 bp, Homo sapiens
ttccaaaagactattacaata

SEQ ID NO: 39698 - DNA, 25 bp, Homo sapiens
tttaatgctttcttgaataattttt

SEQ ID NO: 39699 - DNA, 19 bp, Homo sapiens
gatacaaatgcaggaattg

SEQ ID NO: 39700 - DNA, 20 bp, Homo sapiens
gtgccatcagaaagctgtat

SEQ ID NO: 39701 - DNA, 18 bp, Homo sapiens
acagcggcttctgttggc

SEQ ID NO: 39702 - DNA, 21 bp, Homo sapiens
atctggtgcaaagctctgtga

SEQ ID NO: 39703 - DNA, 22 bp, Homo sapiens
cttcagtccggctgacgtggca

SEQ ID NO: 39704 - DNA, 21 bp, Homo sapiens
ctttttcaacttccttagtct

SEQ ID NO: 39705 - DNA, 21 bp, Homo sapiens
gcaccagggccaatctgctca

SEQ ID NO: 39706 - DNA, 18 bp, Homo sapiens
ggcttctgttggctccta

SEQ ID NO: 39707 - DNA, 20 bp, Homo sapiens
tggtgcttgctgtgagactg

SEQ ID NO: 39708 - DNA, 22 bp, Homo sapiens
cagacgagaccactgtgagcca

SEQ ID NO: 39709 - DNA, 23 bp, Homo sapiens
cgcacactgtgcctccctcctca

SEQ ID NO: 39710 - DNA, 18 bp, Homo sapiens
gaattagcacagatcctt

SEQ ID NO: 39711 - DNA, 23 bp, Homo sapiens
ttgaaaattaattccaccatcct

SEQ ID NO: 39712 - DNA, 21 bp, Homo sapiens
accacaggccaaggccacttt

SEQ ID NO: 39713 - DNA, 18 bp, Homo sapiens
ctacagctggctccgaga

SEQ ID NO: 39714 - DNA, 16 bp, Homo sapiens
ctggacccccaaggct

SEQ ID NO: 39715 - DNA, 17 bp, Homo sapiens
gagtgggtctgaggctg

SEQ ID NO: 39716 - DNA, 24 bp, Homo sapiens
gcgtcgtgggtctggacgacctca

SEQ ID NO: 39717 - DNA, 24 bp, Homo sapiens
gctccgagacagggcaggggccgc

SEQ ID NO: 39718 - DNA, 18 bp, Homo sapiens
ggagcttccaccttctca

SEQ ID NO: 39719 - DNA, 19 bp, Homo sapiens
gtgcagctgctgctgggca

SEQ ID NO: 39720 - DNA, 21 bp, Homo sapiens
tcttgcctgcggggacctgtg

SEQ ID NO: 39721 - DNA, 24 bp, Homo sapiens
agtcataagacagaacatttggca

SEQ ID NO: 39722 - DNA, 22 bp, Homo sapiens
cctgtaaaagttttataaatca

SEQ ID NO: 39723 - DNA, 17 bp, Homo sapiens
ggtagcacacaggacca

SEQ ID NO: 39724 - DNA, 21 bp, Homo sapiens
taagcctttcaacagcagcat

SEQ ID NO: 39725 - DNA, 17 bp, Homo sapiens
tatcaggaagcccagtg

SEQ ID NO: 39726 - DNA, 17 bp, Homo sapiens
tcttgttatagttgtat

SEQ ID NO: 39727 - DNA, 22 bp, Homo sapiens
ttttttggtgctgtagtatatg

SEQ ID NO: 39728 - DNA, 18 bp, Homo sapiens
gcggcctcaaagttctga

SEQ ID NO: 39729 - DNA, 17 bp, Homo sapiens
gggcggttcctgaagtg

SEQ ID NO: 39730 - DNA, 21 bp, Homo sapiens
ctctccaggcttccttgcaca

SEQ ID NO: 39731 - DNA, 21 bp, Homo sapiens
aacaggggcacactgacacct

SEQ ID NO: 39732 - DNA, 22 bp, Homo sapiens
acaagactatatcccacacctg

SEQ ID NO: 39733 - DNA, 21 bp, Homo sapiens
agccaaactcgccgggcctcc

SEQ ID NO: 39734 - DNA, 21 bp, Homo sapiens
gcaggtggccccgtccttcca

SEQ ID NO: 39735 - DNA, 17 bp, Homo sapiens
agaacctgcattgcttc

SEQ ID NO: 39736 - DNA, 20 bp, Homo sapiens
agagtggcacatcctactga

SEQ ID NO: 39737 - DNA, 20 bp, Homo sapiens
agtaagaagggattctcatc

SEQ ID NO: 39738 - DNA, 21 bp, Homo sapiens
ccacaaagtcagcatttaaat

SEQ ID NO: 39739 - DNA, 23 bp, Homo sapiens
ccttggcacctcagattctgtgg

SEQ ID NO: 39740 - DNA, 18 bp, Homo sapiens
ctcaaaggccttgcagcc

SEQ ID NO: 39741 - DNA, 20 bp, Homo sapiens
ctctattgaagacatctgat

SEQ ID NO: 39742 - DNA, 20 bp, Homo sapiens
ggaaacatgtaaagccacat

SEQ ID NO: 39743 - DNA, 21 bp, Homo sapiens
ggttttggtgcagttgcacaa

SEQ ID NO: 39744 - DNA, 19 bp, Homo sapiens
aagacgccggtgctgctca

SEQ ID NO: 39745 - DNA, 21 bp, Homo sapiens
acagagccatcatcatgttcc

SEQ ID NO: 39746 - DNA, 25 bp, Homo sapiens
acctgaactgtggctgatttggtcc

SEQ ID NO: 39747 - DNA, 19 bp, Homo sapiens
aggaggactgggcttagca

SEQ ID NO: 39748 - DNA, 26 bp, Homo sapiens
atggatcgcgactctgtgtggggcta

SEQ ID NO: 39749 - DNA, 18 bp, Homo sapiens
cacacactgacaactacc

SEQ ID NO: 39750 - DNA, 23 bp, Homo sapiens
cacacccgcaccatgtactccca

SEQ ID NO: 39751 - DNA, 22 bp, Homo sapiens
catgtgttgtgggaaggaccca

SEQ ID NO: 39752 - DNA, 18 bp, Homo sapiens
ctctgtgtggggctacga

SEQ ID NO: 39753 - DNA, 22 bp, Homo sapiens
ctggtgatagtgaatagatctc

SEQ ID NO: 39754 - DNA, 17 bp, Homo sapiens
ggatcagaagacaggaa

SEQ ID NO: 39755 - DNA, 21 bp, Homo sapiens
taaatgagaggacatgagatt

SEQ ID NO: 39756 - DNA, 18 bp, Homo sapiens
tccaaatatcaccttaaa

SEQ ID NO: 39757 - DNA, 20 bp, Homo sapiens
aaagccttggagatccccca

SEQ ID NO: 39758 - DNA, 20 bp, Homo sapiens
gagacactggacacaaccca

SEQ ID NO: 39759 - DNA, 21 bp, Homo sapiens
ttgatcaataccggagaagta

SEQ ID NO: 39760 - DNA, 18 bp, Homo sapiens
ttgcatcactgcattcca

SEQ ID NO: 39761 - DNA, 24 bp, Homo sapiens
caggtgtggggctgggcatggtca

SEQ ID NO: 39762 - DNA, 18 bp, Homo sapiens
cctatggaatggcattct

SEQ ID NO: 39763 - DNA, 23 bp, Homo sapiens
gttttatcatgcccgaatagagt

SEQ ID NO: 39764 - DNA, 18 bp, Homo sapiens
ttttaggaatttttctta

SEQ ID NO: 39765 - DNA, 21 bp, Homo sapiens
ccaaattcggcaagccatcca

SEQ ID NO: 39766 - DNA, 17 bp, Homo sapiens
ctttccacctccctcct

SEQ ID NO: 39767 - DNA, 22 bp, Homo sapiens
tgaagtctcttgtaacattcca

SEQ ID NO: 39768 - DNA, 21 bp, Homo sapiens
ttgcaggagggcaagcccctt

SEQ ID NO: 39769 - DNA, 16 bp, Homo sapiens
acacttagtgagaagg

SEQ ID NO: 39770 - DNA, 22 bp, Homo sapiens
accagggcagaccccactaagc

SEQ ID NO: 39771 - DNA, 17 bp, Homo sapiens
agcaggaccttgtcatg

SEQ ID NO: 39772 - DNA, 22 bp, Homo sapiens
agttgccctggccgcccagtga

SEQ ID NO: 39773 - DNA, 18 bp, Homo sapiens
cagcaggaccttgtcatg

SEQ ID NO: 39774 - DNA, 17 bp, Homo sapiens
ccaccgcctcccctttc

SEQ ID NO: 39775 - DNA, 17 bp, Homo sapiens
cccctggaggccacgcc

SEQ ID NO: 39776 - DNA, 19 bp, Homo sapiens
ccgtggaagcctctgcctc

SEQ ID NO: 39777 - DNA, 18 bp, Homo sapiens
cgcagagcatggtcagga

SEQ ID NO: 39778 - DNA, 18 bp, Homo sapiens
ctaacgtgtctgtgtgat

SEQ ID NO: 39779 - DNA, 16 bp, Homo sapiens
ctgagacgtgctggcc

SEQ ID NO: 39780 - DNA, 19 bp, Homo sapiens
gacgcccaccggctccctc

SEQ ID NO: 39781 - DNA, 18 bp, Homo sapiens
gccctggttgtgagattg

SEQ ID NO: 39782 - DNA, 23 bp, Homo sapiens
gccggtcaccaggccactgtgca

SEQ ID NO: 39783 - DNA, 24 bp, Homo sapiens
gctgcctcactctgtggtgtcagg

SEQ ID NO: 39784 - DNA, 19 bp, Homo sapiens
ggaccttgtcatgggactg

SEQ ID NO: 39785 - DNA, 20 bp, Homo sapiens
gttacggacttcccggccgc

SEQ ID NO: 39786 - DNA, 20 bp, Homo sapiens
tccaaaaacctcactcacca

SEQ ID NO: 39787 - DNA, 17 bp, Homo sapiens
tctgaaaggtccctctg

SEQ ID NO: 39788 - DNA, 19 bp, Homo sapiens
tcttcactcggatacctct

SEQ ID NO: 39789 - DNA, 20 bp, Homo sapiens
tgtgcaacaaccacatgcca

SEQ ID NO: 39790 - DNA, 18 bp, Homo sapiens
aatatcacacctccactc

SEQ ID NO: 39791 - DNA, 17 bp, Homo sapiens
agctcctgaattcctca

SEQ ID NO: 39792 - DNA, 24 bp, Homo sapiens
catccctggtggtcatctcaggtg

SEQ ID NO: 39793 - DNA, 19 bp, Homo sapiens
ctatcaccctggatggtat

SEQ ID NO: 39794 - DNA, 22 bp, Homo sapiens
ggtccttgtgataggcaccaca

SEQ ID NO: 39795 - DNA, 24 bp, Homo sapiens
tcccacagcactcggtgcctgtca

SEQ ID NO: 39796 - DNA, 18 bp, Homo sapiens
acagctggtttctattgc

SEQ ID NO: 39797 - DNA, 25 bp, Homo sapiens
atctcctgactccaaatccatagca

SEQ ID NO: 39798 - DNA, 18 bp, Homo sapiens
ccactggggtgcctggat

SEQ ID NO: 39799 - DNA, 25 bp, Homo sapiens
ggttggagggcagggggcgctggcc

SEQ ID NO: 39800 - DNA, 19 bp, Homo sapiens
tgtttgatgcatctttgaa

SEQ ID NO: 39801 - DNA, 16 bp, Homo sapiens
ttctggtcccccatcc

SEQ ID NO: 39802 - DNA, 20 bp, Homo sapiens
ctttacagaagcaaatagta

SEQ ID NO: 39803 - DNA, 18 bp, Homo sapiens
gccacaggctggcagcct

SEQ ID NO: 39804 - DNA, 18 bp, Homo sapiens
tggacagttgggttctga

SEQ ID NO: 39805 - DNA, 15 bp, Homo sapiens
accacacccatgtgt

SEQ ID NO: 39806 - DNA, 19 bp, Homo sapiens
gcaaccagcactgccctgg

SEQ ID NO: 39807 - DNA, 16 bp, Homo sapiens
ttcactttcagcagtt

SEQ ID NO: 39808 - DNA, 21 bp, Homo sapiens
aaggcctgtagttgaacataa

SEQ ID NO: 39809 - DNA, 23 bp, Homo sapiens
accattgagaagacattccgctt

SEQ ID NO: 39810 - DNA, 22 bp, Homo sapiens
ggaccgtgtaagaggacaccac

SEQ ID NO: 39811 - DNA, 20 bp, Homo sapiens
ggcgtcggcggcggcggcga

SEQ ID NO: 39812 - DNA, 21 bp, Homo sapiens
taaatgctgacctaatgtgga

SEQ ID NO: 39813 - DNA, 25 bp, Homo sapiens
acttctctccaccctctttttgcat

SEQ ID NO: 39814 - DNA, 18 bp, Homo sapiens
attccagagttcattcca

SEQ ID NO: 39815 - DNA, 24 bp, Homo sapiens
cgagaggcatagtgacctgcctca

SEQ ID NO: 39816 - DNA, 17 bp, Homo sapiens
ctgcctggccccacctc

SEQ ID NO: 39817 - DNA, 20 bp, Homo sapiens
ctgtttagtaactccacctc

SEQ ID NO: 39818 - DNA, 17 bp, Homo sapiens
gactgagtcatgtgcca

SEQ ID NO: 39819 - DNA, 18 bp, Homo sapiens
tcctatattcagagtact

SEQ ID NO: 39820 - DNA, 18 bp, Homo sapiens
tgcaagatagcttttccg

SEQ ID NO: 39821 - DNA, 19 bp, Homo sapiens
ttatatagtttacaaaata

SEQ ID NO: 39822 - DNA, 19 bp, Homo sapiens
acctgtcaaaaaaatgaca

SEQ ID NO: 39823 - DNA, 24 bp, Homo sapiens
ctacttgtgtgagatactcttcca

SEQ ID NO: 39824 - DNA, 21 bp, Homo sapiens
taatcaaggcatgggtattgc

SEQ ID NO: 39825 - DNA, 18 bp, Homo sapiens
tcctggtaatggacctgc

SEQ ID NO: 39826 - DNA, 23 bp, Homo sapiens
tggacctgccagcgtgtgaactg

SEQ ID NO: 39827 - DNA, 16 bp, Homo sapiens
aggcctcaaagcattg

SEQ ID NO: 39828 - DNA, 20 bp, Homo sapiens
atctgtgatcaaaatgtgaa

SEQ ID NO: 39829 - DNA, 22 bp, Homo sapiens
cctttagtttgctaaacaccca

SEQ ID NO: 39830 - DNA, 21 bp, Homo sapiens
gatataagcaaaaacaagtga

SEQ ID NO: 39831 - DNA, 20 bp, Homo sapiens
gcacctttcatatctgctgt

SEQ ID NO: 39832 - DNA, 21 bp, Homo sapiens
tcttgtaggcagtgttcctca

SEQ ID NO: 39833 - DNA, 22 bp, Homo sapiens
ttaagagtaacaataatttcta

SEQ ID NO: 39834 - DNA, 17 bp, Homo sapiens
tcatttgacctttcaga

SEQ ID NO: 39835 - DNA, 22 bp, Homo sapiens
tccctcaaatgctgtaactagg

SEQ ID NO: 39836 - DNA, 18 bp, Homo sapiens
cacctaccaactttgcct

SEQ ID NO: 39837 - DNA, 19 bp, Homo sapiens
gtatgaattcttaatacct

SEQ ID NO: 39838 - DNA, 18 bp, Homo sapiens
atgcaaagacttgccaaa

SEQ ID NO: 39839 - DNA, 19 bp, Homo sapiens
caattttgtcggtgccaat

SEQ ID NO: 39840 - DNA, 19 bp, Homo sapiens
ggaaagactcaagattgta

SEQ ID NO: 39841 - DNA, 20 bp, Homo sapiens
caaggcagcattcactaagc

SEQ ID NO: 39842 - DNA, 17 bp, Homo sapiens
ggttatcaaagctgaca

SEQ ID NO: 39843 - DNA, 24 bp, Homo sapiens
tattattggcactctctaactgaa

SEQ ID NO: 39844 - DNA, 21 bp, Homo sapiens
tctactgctttttctactcct

SEQ ID NO: 39845 - DNA, 22 bp, Homo sapiens
tgaatataaaaatcagctcttg

SEQ ID NO: 39846 - DNA, 18 bp, Homo sapiens
ttctacatagatgtggta

SEQ ID NO: 39847 - DNA, 16 bp, Homo sapiens
agtaccatggttctga

SEQ ID NO: 39848 - DNA, 25 bp, Homo sapiens
ccatcccatgtcaccacctggctga

SEQ ID NO: 39849 - DNA, 21 bp, Homo sapiens
ccatggttctgacagagactg

SEQ ID NO: 39850 - DNA, 17 bp, Homo sapiens
cctccaacttgacatca

SEQ ID NO: 39851 - DNA, 19 bp, Homo sapiens
gcctctggcccaggagtta

SEQ ID NO: 39852 - DNA, 20 bp, Homo sapiens
caaggcagcattcactaagc

SEQ ID NO: 39853 - DNA, 17 bp, Homo sapiens
ggttatcaaagctgaca

SEQ ID NO: 39854 - DNA, 24 bp, Homo sapiens
tattattggcactctctaactgaa

SEQ ID NO: 39855 - DNA, 21 bp, Homo sapiens
tctactgctttttctactcct

SEQ ID NO: 39856 - DNA, 22 bp, Homo sapiens
tgaatataaaaatcagctcttg

SEQ ID NO: 39857 - DNA, 18 bp, Homo sapiens
ttctacatagatgtggta

SEQ ID NO: 39858 - DNA, 23 bp, Homo sapiens
gcactgaaggagaagatctgcca

SEQ ID NO: 39859 - DNA, 18 bp, Homo sapiens
ttcacccaaatggtctca

SEQ ID NO: 39860 - DNA, 18 bp, Homo sapiens
acctcatcctggacttca

SEQ ID NO: 39861 - DNA, 19 bp, Homo sapiens
gatctcactcactatcatg

SEQ ID NO: 39862 - DNA, 22 bp, Homo sapiens
gcggaagcaggaatgccttaca

SEQ ID NO: 39863 - DNA, 19 bp, Homo sapiens
gtttccacttctgcagcaa

SEQ ID NO: 39864 - DNA, 23 bp, Homo sapiens
tgaagatctctgacatggtgctg

SEQ ID NO: 39865 - DNA, 18 bp, Homo sapiens
tttaaagttccacagatc

SEQ ID NO: 39866 - DNA, 21 bp, Homo sapiens
aagtagcttcaaccaaagcta

SEQ ID NO: 39867 - DNA, 22 bp, Homo sapiens
agccatgctttcttagctttat

SEQ ID NO: 39868 - DNA, 22 bp, Homo sapiens
cagaaaggaggtggcccagtca

SEQ ID NO: 39869 - DNA, 21 bp, Homo sapiens
gcaatggaatggacattggca

SEQ ID NO: 39870 - DNA, 22 bp, Homo sapiens
gcctgaaccagagctatggctc

SEQ ID NO: 39871 - DNA, 19 bp, Homo sapiens
tttatacattttcacttag

SEQ ID NO: 39872 - DNA, 19 bp, Homo sapiens
tcaccattcactcaacaaa

SEQ ID NO: 39873 - DNA, 19 bp, Homo sapiens
actcaagcttccatgtgac

SEQ ID NO: 39874 - DNA, 19 bp, Homo sapiens
agagaggcgacagctgtgg

SEQ ID NO: 39875 - DNA, 19 bp, Homo sapiens
cacagccttctggctgcaa

SEQ ID NO: 39876 - DNA, 18 bp, Homo sapiens
ccaagagaggcgacagct

SEQ ID NO: 39877 - DNA, 18 bp, Homo sapiens
cctagcccagggactgga

SEQ ID NO: 39878 - DNA, 17 bp, Homo sapiens
gaggcgacagctgtggc

SEQ ID NO: 39879 - DNA, 17 bp, Homo sapiens
aaacactgaaaaacatc

SEQ ID NO: 39880 - DNA, 18 bp, Homo sapiens
taccagaaaataatacat

SEQ ID NO: 39881 - DNA, 21 bp, Homo sapiens
ttgttatataaatgtcatcat

SEQ ID NO: 39882 - DNA, 24 bp, Homo sapiens
ggttggctggtgatgctctttcaa

SEQ ID NO: 39883 - DNA, 21 bp, Homo sapiens
gtgtgtgtttctggttggctg

SEQ ID NO: 39884 - DNA, 17 bp, Homo sapiens
ctacatgccagcaacca

SEQ ID NO: 39885 - DNA, 19 bp, Homo sapiens
gcccttcatggtggtgaat

SEQ ID NO: 39886 - DNA, 22 bp, Homo sapiens
tgaaactgctggtagagtcata

SEQ ID NO: 39887 - DNA, 20 bp, Homo sapiens
ttgaggatggaatctttgag

SEQ ID NO: 39888 - DNA, 18 bp, Homo sapiens
agcttctgagctaccttt

SEQ ID NO: 39889 - DNA, 23 bp, Homo sapiens
ctactcctgaccactgtatttaa

SEQ ID NO: 39890 - DNA, 22 bp, Homo sapiens
tcacttccctcttcttccctca

SEQ ID NO: 39891 - DNA, 18 bp, Homo sapiens
aatgacttcagacactga

SEQ ID NO: 39892 - DNA, 16 bp, Homo sapiens
caaacattccatctgg

SEQ ID NO: 39893 - DNA, 17 bp, Homo sapiens
tcagacactgaaggctt

SEQ ID NO: 39894 - DNA, 16 bp, Homo sapiens
cactagccctcactca

SEQ ID NO: 39895 - DNA, 22 bp, Homo sapiens
tatttcctggcatcacccctta

SEQ ID NO: 39896 - DNA, 18 bp, Homo sapiens
tgagtcctgcttcctaca

SEQ ID NO: 39897 - DNA, 19 bp, Homo sapiens
tgtctctccttctctagct

SEQ ID NO: 39898 - DNA, 22 bp, Homo sapiens
atctcggctcactgcaatctct

SEQ ID NO: 39899 - DNA, 20 bp, Homo sapiens
tctctgcctcccgggttcaa

SEQ ID NO: 39900 - DNA, 17 bp, Homo sapiens
ttgaatttgttgcacaa

SEQ ID NO: 39901 - DNA, 20 bp, Homo sapiens
tttgcttgccccgcccccga

SEQ ID NO: 39902 - DNA, 23 bp, Homo sapiens
aggtacagcacataggccaggag

SEQ ID NO: 39903 - DNA, 21 bp, Homo sapiens
atctcccagcaggtagagcag

SEQ ID NO: 39904 - DNA, 19 bp, Homo sapiens
catttccccatgcctctga

SEQ ID NO: 39905 - DNA, 20 bp, Homo sapiens
ccccaccaccacccccagct

SEQ ID NO: 39906 - DNA, 21 bp, Homo sapiens
ctcggctcgggaggcctggga

SEQ ID NO: 39907 - DNA, 18 bp, Homo sapiens
ctgcagccccctgagata

SEQ ID NO: 39908 - DNA, 21 bp, Homo sapiens
gcatcagacacaggtacagca

SEQ ID NO: 39909 - DNA, 20 bp, Homo sapiens
gcctctgtgatcttctccat

SEQ ID NO: 39910 - DNA, 19 bp, Homo sapiens
ggggtctaataacaaacta

SEQ ID NO: 39911 - DNA, 21 bp, Homo sapiens
ggtagagcagagccggagcca

SEQ ID NO: 39912 - DNA, 21 bp, Homo sapiens
taaaccaatggaaagaagggg

SEQ ID NO: 39913 - DNA, 19 bp, Homo sapiens
tctgggaaaggacctgggg

SEQ ID NO: 39914 - DNA, 20 bp, Homo sapiens
tgccaagtaccctgctccag

SEQ ID NO: 39915 - DNA, 27 bp, Homo sapiens
tggggtggcagctgattaggcccagca

SEQ ID NO: 39916 - DNA, 20 bp, Homo sapiens
ttggagagaaggtctccttg

SEQ ID NO: 39917 - DNA, 21 bp, Homo sapiens
agctccttttttttcacctca

SEQ ID NO: 39918 - DNA, 21 bp, Homo sapiens
atttgggttgttaccaggttt

SEQ ID NO: 39919 - DNA, 21 bp, Homo sapiens
caacccctctttcctgctcct

SEQ ID NO: 39920 - DNA, 22 bp, Homo sapiens
ccccaccgccactgcttggctt

SEQ ID NO: 39921 - DNA, 18 bp, Homo sapiens
cctcccccataatcaaga

SEQ ID NO: 39922 - DNA, 18 bp, Homo sapiens
gccatgacaaataaagct

SEQ ID NO: 39923 - DNA, 21 bp, Homo sapiens
gttgcaaataaggaagatgta

SEQ ID NO: 39924 - DNA, 20 bp, Homo sapiens
tgggaagtgcttgggttcgg

SEQ ID NO: 39925 - DNA, 24 bp, Homo sapiens
acgtttgttctgtattgatgagta

SEQ ID NO: 39926 - DNA, 22 bp, Homo sapiens
agatttcagcaatgctatttca

SEQ ID NO: 39927 - DNA, 22 bp, Homo sapiens
aggtttcatccctcaccctccc

SEQ ID NO: 39928 - DNA, 20 bp, Homo sapiens
atacacagcatagggtacgt

SEQ ID NO: 39929 - DNA, 24 bp, Homo sapiens
cctagggtttgtaaaagaaatcca

SEQ ID NO: 39930 - DNA, 22 bp, Homo sapiens
cctttatcctaacggctgttca

SEQ ID NO: 39931 - DNA, 21 bp, Homo sapiens
tccatcaaagccaccacctca

SEQ ID NO: 39932 - DNA, 19 bp, Homo sapiens
tctagcaaaatccatgtcc

SEQ ID NO: 39933 - DNA, 18 bp, Homo sapiens
agggcaatctgtctttaa

SEQ ID NO: 39934 - DNA, 18 bp, Homo sapiens
catcacccgcctcacggg

SEQ ID NO: 39935 - DNA, 18 bp, Homo sapiens
ggggccagccctgcagtg

SEQ ID NO: 39936 - DNA, 22 bp, Homo sapiens
gtggacgagaacacgttctcca

SEQ ID NO: 39937 - DNA, 20 bp, Homo sapiens
ttccaggaatagcgctccag

SEQ ID NO: 39938 - DNA, 20 bp, Homo sapiens
accctctgtcctcctccctc

SEQ ID NO: 39939 - DNA, 20 bp, Homo sapiens
ccccgcccccgtccccaagc

SEQ ID NO: 39940 - DNA, 17 bp, Homo sapiens
aaccaggaaggacgtag

SEQ ID NO: 39941 - DNA, 21 bp, Homo sapiens
cttgtgttacctttgcagcca

SEQ ID NO: 39942 - DNA, 17 bp, Homo sapiens
aaccaggaaggacgtag

SEQ ID NO: 39943 - DNA, 21 bp, Homo sapiens
cttgtgttacctttgcagcca

SEQ ID NO: 39944 - DNA, 20 bp, Homo sapiens
actcctgtctctgtagaata

SEQ ID NO: 39945 - DNA, 18 bp, Homo sapiens
tggatgaaactgagattg

SEQ ID NO: 39946 - DNA, 18 bp, Homo sapiens
tggatgaaactgagattg

SEQ ID NO: 39947 - DNA, 20 bp, Homo sapiens
tggcattccagcaggagcta

SEQ ID NO: 39948 - DNA, 24 bp, Homo sapiens
gatcagtaatatcaaagagcacct

SEQ ID NO: 39949 - DNA, 22 bp, Homo sapiens
acccagagcatctcccacttcc

SEQ ID NO: 39950 - DNA, 20 bp, Homo sapiens
acctggactgtggtgggctc

SEQ ID NO: 39951 - DNA, 18 bp, Homo sapiens
caccaccaccgcctcctc

SEQ ID NO: 39952 - DNA, 22 bp, Homo sapiens
ctccaggccctggacaccctgc

SEQ ID NO: 39953 - DNA, 21 bp, Homo sapiens
gaggcccaggccctcgagcca

SEQ ID NO: 39954 - DNA, 23 bp, Homo sapiens
gatgcccattattctcaaacgta

SEQ ID NO: 39955 - DNA, 19 bp, Homo sapiens
ggaatcttcccagacccca

SEQ ID NO: 39956 - DNA, 23 bp, Homo sapiens
caccatcagatccatcagcgctg

SEQ ID NO: 39957 - DNA, 22 bp, Homo sapiens
aaaacaaattgttttaaatgtt

SEQ ID NO: 39958 - DNA, 20 bp, Homo sapiens
aggaccctgaaaataagcac

SEQ ID NO: 39959 - DNA, 17 bp, Homo sapiens
agtaaagcatcatcctc

SEQ ID NO: 39960 - DNA, 21 bp, Homo sapiens
cctgaggagttattggcaaga

SEQ ID NO: 39961 - DNA, 19 bp, Homo sapiens
gatttcatacaactgagtt

SEQ ID NO: 39962 - DNA, 18 bp, Homo sapiens
tctgagaatgcctgcgga

SEQ ID NO: 39963 - DNA, 19 bp, Homo sapiens
agcgtgtcccactccaact

SEQ ID NO: 39964 - DNA, 19 bp, Homo sapiens
caacggatgccactattgg

SEQ ID NO: 39965 - DNA, 17 bp, Homo sapiens
gatcactcccttggctt

SEQ ID NO: 39966 - DNA, 16 bp, Homo sapiens
gcctgtcaccatggca

SEQ ID NO: 39967 - DNA, 22 bp, Homo sapiens
ccactgtggtttgccacactga

SEQ ID NO: 39968 - DNA, 20 bp, Homo sapiens
ccctgggcagcagcacttca

SEQ ID NO: 39969 - DNA, 19 bp, Homo sapiens
aaggacatcagaaatagca

SEQ ID NO: 39970 - DNA, 17 bp, Homo sapiens
agctcccctgagtctca

SEQ ID NO: 39971 - DNA, 20 bp, Homo sapiens
ccagagccacttcctctgaa

SEQ ID NO: 39972 - DNA, 21 bp, Homo sapiens
cctgttcacctcttgggtctc

SEQ ID NO: 39973 - DNA, 23 bp, Homo sapiens
tcacctcttgggtctctatcctg

SEQ ID NO: 39974 - DNA, 20 bp, Homo sapiens
tcctgtgtaacctctggtgt

SEQ ID NO: 39975 - DNA, 19 bp, Homo sapiens
tagttatggagtttttgca

SEQ ID NO: 39976 - DNA, 19 bp, Homo sapiens
acttgctcacaactgtgac

SEQ ID NO: 39977 - DNA, 18 bp, Homo sapiens
aataaggagcctttatta

SEQ ID NO: 39978 - DNA, 24 bp, Homo sapiens
acttggaagcgtatggcctggccc

SEQ ID NO: 39979 - DNA, 22 bp, Homo sapiens
ccagacactgagggttccatcc

SEQ ID NO: 39980 - DNA, 26 bp, Homo sapiens
ccaggacgactgggagggcggcctca

SEQ ID NO: 39981 - DNA, 21 bp, Homo sapiens
cctgctccccgaggccggcga

SEQ ID NO: 39982 - DNA, 20 bp, Homo sapiens
gcggaagtgaggagttctgg

SEQ ID NO: 39983 - DNA, 18 bp, Homo sapiens
ggacggcccaccgcctct

SEQ ID NO: 39984 - DNA, 15 bp, Homo sapiens
gaacccccttggctt

SEQ ID NO: 39985 - DNA, 23 bp, Homo sapiens
attaatacctggtttagcggcaa

SEQ ID NO: 39986 - DNA, 22 bp, Homo sapiens
cttaaacacccagaagcagtaa

SEQ ID NO: 39987 - DNA, 24 bp, Homo sapiens
gcccatgaacaagttagtttctca

SEQ ID NO: 39988 - DNA, 22 bp, Homo sapiens
tggtaatcattttcttcaggga

SEQ ID NO: 39989 - DNA, 24 bp, Homo sapiens
accaatatcttggcacatggcaga

SEQ ID NO: 39990 - DNA, 25 bp, Homo sapiens
agcctcctctcctatcggcactgtt

SEQ ID NO: 39991 - DNA, 21 bp, Homo sapiens
atgcctccagcctttgctgct

SEQ ID NO: 39992 - DNA, 21 bp, Homo sapiens
tttgagctcattaatgctgct

SEQ ID NO: 39993 - DNA, 23 bp, Homo sapiens
cccacagccttggccctgctgct

SEQ ID NO: 39994 - DNA, 20 bp, Homo sapiens
ccccgcaccctccccacagc

SEQ ID NO: 39995 - DNA, 18 bp, Homo sapiens
tttcccctcaatgccccg

SEQ ID NO: 39996 - DNA, 18 bp, Homo sapiens
cttggagaagcttgtgaa

SEQ ID NO: 39997 - DNA, 21 bp, Homo sapiens
gtgtgtatgaagtgtttattg

SEQ ID NO: 39998 - DNA, 22 bp, Homo sapiens
tcctgatggacaactatgtgag

SEQ ID NO: 39999 - DNA, 20 bp, Homo sapiens
acagggtaaaatcctgcagc

SEQ ID NO: 40000 - DNA, 22 bp, Homo sapiens
acattaattgggaatcatatgt

SEQ ID NO: 40001 - DNA, 18 bp, Homo sapiens
cctggcaacattgtgaga

SEQ ID NO: 40002 - DNA, 19 bp, Homo sapiens
gacggagtctcggtctgtc

SEQ ID NO: 40003 - DNA, 22 bp, Homo sapiens
gaggtcctctcccccatccctc

SEQ ID NO: 40004 - DNA, 18 bp, Homo sapiens
gcacccagtcctgtacgc

SEQ ID NO: 40005 - DNA, 18 bp, Homo sapiens
tccgcctcccaggttcaa

SEQ ID NO: 40006 - DNA, 19 bp, Homo sapiens
cctgaggagattctgtgag

SEQ ID NO: 40007 - DNA, 20 bp, Homo sapiens
cgcagaatcatctccgttga

SEQ ID NO: 40008 - DNA, 18 bp, Homo sapiens
gaggtgtttggcatccca

SEQ ID NO: 40009 - DNA, 19 bp, Homo sapiens
ggaaaggaacaagcacctt

SEQ ID NO: 40010 - DNA, 17 bp, Homo sapiens
gtgatgcattttaccag

SEQ ID NO: 40011 - DNA, 17 bp, Homo sapiens
aaaatgtcaaaatgata

SEQ ID NO: 40012 - DNA, 16 bp, Homo sapiens
cgccatacactgcttc

SEQ ID NO: 40013 - DNA, 18 bp, Homo sapiens
gttgcaagaaaggaaaac

SEQ ID NO: 40014 - DNA, 23 bp, Homo sapiens
gctctgggagcaagagaagccga

SEQ ID NO: 40015 - DNA, 19 bp, Homo sapiens
cctgctcaccttttgctgc

SEQ ID NO: 40016 - DNA, 18 bp, Homo sapiens
aaaacctcactgtaaaca

SEQ ID NO: 40017 - DNA, 20 bp, Homo sapiens
aaagattcaccaggcactgg

SEQ ID NO: 40018 - DNA, 18 bp, Homo sapiens
catcatggaagtataact

SEQ ID NO: 40019 - DNA, 19 bp, Homo sapiens
cttccacacacagatttaa

SEQ ID NO: 40020 - DNA, 20 bp, Homo sapiens
tggcattccagcaggagcta

SEQ ID NO: 40021 - DNA, 22 bp, Homo sapiens
acgaaacaaggggaagttctga

SEQ ID NO: 40022 - DNA, 24 bp, Homo sapiens
catttgatgacaactataatacta

SEQ ID NO: 40023 - DNA, 20 bp, Homo sapiens
attgacaaaagaaccattga

SEQ ID NO: 40024 - DNA, 19 bp, Homo sapiens
ttatatcaacattgtcatc

SEQ ID NO: 40025 - DNA, 20 bp, Homo sapiens
aactgacaacattgtgtata

SEQ ID NO: 40026 - DNA, 24 bp, Homo sapiens
agggataaagttgagaagtgtgcc

SEQ ID NO: 40027 - DNA, 19 bp, Homo sapiens
gtaaaagcttcatgttgag

SEQ ID NO: 40028 - DNA, 17 bp, Homo sapiens
tggtattcaaccagcaa

SEQ ID NO: 40029 - DNA, 21 bp, Homo sapiens
acgtgtcttcaactgactcac

SEQ ID NO: 40030 - DNA, 17 bp, Homo sapiens
atcaagttcctgccata

SEQ ID NO: 40031 - DNA, 21 bp, Homo sapiens
attagtgatcataaaatttca

SEQ ID NO: 40032 - DNA, 19 bp, Homo sapiens
cagcactccagcctgggca

SEQ ID NO: 40033 - DNA, 18 bp, Homo sapiens
cagcactttgggaagcca

SEQ ID NO: 40034 - DNA, 18 bp, Homo sapiens
ctttaatcagactccctt

SEQ ID NO: 40035 - DNA, 19 bp, Homo sapiens
aagcaattctcctgcctca

SEQ ID NO: 40036 - DNA, 26 bp, Homo sapiens
gaagttgttttttgggcatgagattg

SEQ ID NO: 40037 - DNA, 19 bp, Homo sapiens
gcatggaccccagcagtga

SEQ ID NO: 40038 - DNA, 18 bp, Homo sapiens
gcgtggagcgtcccgaga

SEQ ID NO: 40039 - DNA, 18 bp, Homo sapiens
gtgactaccatttcctca

SEQ ID NO: 40040 - DNA, 18 bp, Homo sapiens
tccgcctcccgggttcaa

SEQ ID NO: 40041 - DNA, 22 bp, Homo sapiens
tgagattgtgaatgtggaacta

SEQ ID NO: 40042 - DNA, 19 bp, Homo sapiens
tctgggggttgctttgctt

SEQ ID NO: 40043 - DNA, 19 bp, Homo sapiens
cgcggtggtggtgggcttt

SEQ ID NO: 40044 - DNA, 22 bp, Homo sapiens
gactgcgacggcgtgctgtggc

SEQ ID NO: 40045 - DNA, 18 bp, Homo sapiens
tcttcgtagagcccaagt

SEQ ID NO: 40046 - DNA, 18 bp, Homo sapiens
cagcaaacacaggctgca

SEQ ID NO: 40047 - DNA, 19 bp, Homo sapiens
ggacaaggagggcagcgac

SEQ ID NO: 40048 - DNA, 20 bp, Homo sapiens
tccacagccagccttccctc

SEQ ID NO: 40049 - DNA, 16 bp, Homo sapiens
ataactgtcaactgtt

SEQ ID NO: 40050 - DNA, 25 bp, Homo sapiens
gaatctcctgggaatctatccctaa

SEQ ID NO: 40051 - DNA, 19 bp, Homo sapiens
gcaaccaaaaactggcttt

SEQ ID NO: 40052 - DNA, 20 bp, Homo sapiens
ggatcccatgagaacattat

SEQ ID NO: 40053 - DNA, 25 bp, Homo sapiens
gggtaccacatgaattgtctagcaa

SEQ ID NO: 40054 - DNA, 23 bp, Homo sapiens
tctgttaccaaaatattgtgtaa

SEQ ID NO: 40055 - DNA, 20 bp, Homo sapiens
tttccatactaaacatcaca

SEQ ID NO: 40056 - DNA, 20 bp, Homo sapiens
aaacacatgtcctcactgaa

SEQ ID NO: 40057 - DNA, 22 bp, Homo sapiens
cccacaacacatgataaacaca

SEQ ID NO: 40058 - DNA, 25 bp, Homo sapiens
accgcgaccccacactatttctgtg

SEQ ID NO: 40059 - DNA, 22 bp, Homo sapiens
catcctgcgccccaatacctca

SEQ ID NO: 40060 - DNA, 22 bp, Homo sapiens
ccatcctgcgccccaatacctc

SEQ ID NO: 40061 - DNA, 23 bp, Homo sapiens
cccttccccacttcttacactcc

SEQ ID NO: 40062 - DNA, 18 bp, Homo sapiens
cctgcgccccaatacctc

SEQ ID NO: 40063 - DNA, 18 bp, Homo sapiens
cggctcagacgcacatca

SEQ ID NO: 40064 - DNA, 21 bp, Homo sapiens
gtgctgtccacactctcttgc

SEQ ID NO: 40065 - DNA, 21 bp, Homo sapiens
ttacaactataaaggaggtga

SEQ ID NO: 40066 - DNA, 18 bp, Homo sapiens
catccagcctcttgacaa

SEQ ID NO: 40067 - DNA, 21 bp, Homo sapiens
ccttattcctcactccatcca

SEQ ID NO: 40068 - DNA, 19 bp, Homo sapiens
tgaagcttacagtactgca

SEQ ID NO: 40069 - DNA, 19 bp, Homo sapiens
tgaataaaattctgttagt

SEQ ID NO: 40070 - DNA, 22 bp, Homo sapiens
ttttggtggtgggggggttgcg

SEQ ID NO: 40071 - DNA, 19 bp, Homo sapiens
acctgtaacaaaaatctca

SEQ ID NO: 40072 - DNA, 21 bp, Homo sapiens
aacccagccccagcgaccagg

SEQ ID NO: 40073 - DNA, 22 bp, Homo sapiens
tccccgccaccaccgtccgcgt

SEQ ID NO: 40074 - DNA, 22 bp, Homo sapiens
aaaaactacaatcagtattctc

SEQ ID NO: 40075 - DNA, 19 bp, Homo sapiens
aatgagatcagccagatga

SEQ ID NO: 40076 - DNA, 18 bp, Homo sapiens
aatttaagtatagattct

SEQ ID NO: 40077 - DNA, 18 bp, Homo sapiens
atccaccaagataccaga

SEQ ID NO: 40078 - DNA, 21 bp, Homo sapiens
cacatttcctaaaaaaacagg

SEQ ID NO: 40079 - DNA, 20 bp, Homo sapiens
cccaatcaggagatttgtgg

SEQ ID NO: 40080 - DNA, 19 bp, Homo sapiens
cccacaaaaacatgagata

SEQ ID NO: 40081 - DNA, 20 bp, Homo sapiens
cctctgtgactgcttcgccc

SEQ ID NO: 40082 - DNA, 18 bp, Homo sapiens
cctgaaactacgtagaga

SEQ ID NO: 40083 - DNA, 21 bp, Homo sapiens
gctatggtgtagagacaaaga

SEQ ID NO: 40084 - DNA, 23 bp, Homo sapiens
tgctgaaccctgtcttcttgaca

SEQ ID NO: 40085 - DNA, 18 bp, Homo sapiens
agaagaaaaaccctatca

SEQ ID NO: 40086 - DNA, 18 bp, Homo sapiens
agagaacacacacagggg

SEQ ID NO: 40087 - DNA, 19 bp, Homo sapiens
tcagtattgattctgcatc

SEQ ID NO: 40088 - DNA, 19 bp, Homo sapiens
accagagaattcacactgg

SEQ ID NO: 40089 - DNA, 18 bp, Homo sapiens
ttattcaacatttattca

SEQ ID NO: 40090 - DNA, 21 bp, Homo sapiens
cacttacagggtgcctacccc

SEQ ID NO: 40091 - DNA, 21 bp, Homo sapiens
aacctcttcactctctcccac

SEQ ID NO: 40092 - DNA, 25 bp, Homo sapiens
accacagggacaacatgtccacttt

SEQ ID NO: 40093 - DNA, 21 bp, Homo sapiens
acccacacactcagtacaatg

SEQ ID NO: 40094 - DNA, 21 bp, Homo sapiens
actgtcagccagtcattcacc

SEQ ID NO: 40095 - DNA, 21 bp, Homo sapiens
agccacacattcaccacagtg

SEQ ID NO: 40096 - DNA, 21 bp, Homo sapiens
agccactcattcaccacagtg

SEQ ID NO: 40097 - DNA, 17 bp, Homo sapiens
atgactcagtttcagtt

SEQ ID NO: 40098 - DNA, 18 bp, Homo sapiens
catgtaccaaatgcaggg

SEQ ID NO: 40099 - DNA, 18 bp, Homo sapiens
ccacatgagaaccagttc

SEQ ID NO: 40100 - DNA, 20 bp, Homo sapiens
tcactctcacccactcattc

SEQ ID NO: 40101 - DNA, 20 bp, Homo sapiens
tcactctctcccactcattc

SEQ ID NO: 40102 - DNA, 17 bp, Homo sapiens
tctccttcatcatatca

SEQ ID NO: 40103 - DNA, 20 bp, Homo sapiens
tgtcctggacagatgtgtta

SEQ ID NO: 40104 - DNA, 19 bp, Homo sapiens
agaaaattcatacgggtgt

SEQ ID NO: 40105 - DNA, 19 bp, Homo sapiens
agaaaattcatactgatgt

SEQ ID NO: 40106 - DNA, 20 bp, Homo sapiens
agaaaattcatactggtgta

SEQ ID NO: 40107 - DNA, 16 bp, Homo sapiens
caaagccagatgtgat

SEQ ID NO: 40108 - DNA, 18 bp, Homo sapiens
ggccagctggtttgttat

SEQ ID NO: 40109 - DNA, 22 bp, Homo sapiens
tggaagccctcattgccagtca

SEQ ID NO: 40110 - DNA, 21 bp, Homo sapiens
tccaaaatgggacgcttgcca

SEQ ID NO: 40111 - DNA, 25 bp, Homo sapiens
aaatcaccatctgaagcttttgaaa

SEQ ID NO: 40112 - DNA, 19 bp, Homo sapiens
ctaaatccaaactgtcaaa

SEQ ID NO: 40113 - DNA, 15 bp, Homo sapiens
gtctgggctgtgaac

SEQ ID NO: 40114 - DNA, 18 bp, Homo sapiens
ttcttactaaaaatcacc

SEQ ID NO: 40115 - DNA, 18 bp, Homo sapiens
cctctgattttagatcac

SEQ ID NO: 40116 - DNA, 21 bp, Homo sapiens
acacggtgttcctggtcagcc

SEQ ID NO: 40117 - DNA, 18 bp, Homo sapiens
gctcactgccttcctaca

SEQ ID NO: 40118 - DNA, 20 bp, Homo sapiens
gcatgtgtattgtatcatcc

SEQ ID NO: 40119 - DNA, 18 bp, Homo sapiens
tcaaaaataccttcagga

SEQ ID NO: 40120 - DNA, 22 bp, Homo sapiens
tccaaaaatgttgcctctacca

SEQ ID NO: 40121 - DNA, 21 bp, Homo sapiens
tgcccttttataatacataat

SEQ ID NO: 40122 - DNA, 20 bp, Homo sapiens
tgtgttaactgaaagaacat

SEQ ID NO: 40123 - DNA, 21 bp, Homo sapiens
gccacagccacaagcacctca

SEQ ID NO: 40124 - DNA, 17 bp, Homo sapiens
tcctggcccaggttctc

SEQ ID NO: 40125 - DNA, 17 bp, Homo sapiens
acttggctgtatggctt

SEQ ID NO: 40126 - DNA, 18 bp, Homo sapiens
agccttcccagtagctca

SEQ ID NO: 40127 - DNA, 19 bp, Homo sapiens
tggggaaaaactcgtgcca

SEQ ID NO: 40128 - DNA, 19 bp, Homo sapiens
ccagcggagcggagcctgg

SEQ ID NO: 40129 - DNA, 19 bp, Homo sapiens
gccctccggcggaccctca

SEQ ID NO: 40130 - DNA, 17 bp, Homo sapiens
gtctccggggcaagcca

SEQ ID NO: 40131 - DNA, 23 bp, Homo sapiens
acgaagctccagaatcctggcca

SEQ ID NO: 40132 - DNA, 18 bp, Homo sapiens
atgttgtccttcatcagc

SEQ ID NO: 40133 - DNA, 19 bp, Homo sapiens
taggctcagaacttttaca

SEQ ID NO: 40134 - DNA, 18 bp, Homo sapiens
cctgtctccctctctgaa

SEQ ID NO: 40135 - DNA, 23 bp, Homo sapiens
taaaaaagctggtgggtgaaaga

SEQ ID NO: 40136 - DNA, 21 bp, Homo sapiens
tttcaataacgaagttgggca

SEQ ID NO: 40137 - DNA, 22 bp, Homo sapiens
tttccaaaaaccatgtctccca

SEQ ID NO: 40138 - DNA, 20 bp, Homo sapiens
catgcttgggaagcaacttt

SEQ ID NO: 40139 - DNA, 21 bp, Homo sapiens
ttctgctaaaactactctttt

SEQ ID NO: 40140 - DNA, 19 bp, Homo sapiens
cagcactgggaacttagca

SEQ ID NO: 40141 - DNA, 19 bp, Homo sapiens
ccagtacggcaagtgcctg

SEQ ID NO: 40142 - DNA, 18 bp, Homo sapiens
cggctgttccacctgcca

SEQ ID NO: 40143 - DNA, 22 bp, Homo sapiens
tcagaggagaacggctgttcca

SEQ ID NO: 40144 - DNA, 19 bp, Homo sapiens
agaactaatcattcagcaa

SEQ ID NO: 40145 - DNA, 20 bp, Homo sapiens
taggtgccccaagaaattac

SEQ ID NO: 40146 - DNA, 22 bp, Homo sapiens
tctgctgggaccaggcacaact

SEQ ID NO: 40147 - DNA, 19 bp, Homo sapiens
acagcatcctcatcagtgt

SEQ ID NO: 40148 - DNA, 19 bp, Homo sapiens
accaccaactcctcactca

SEQ ID NO: 40149 - DNA, 20 bp, Homo sapiens
caagagggtgcaagatgtga

SEQ ID NO: 40150 - DNA, 18 bp, Homo sapiens
catccaggcagtcaagca

SEQ ID NO: 40151 - DNA, 20 bp, Homo sapiens
cgcctggtccctccatgaga

SEQ ID NO: 40152 - DNA, 21 bp, Homo sapiens
ctgtggacctagacaatgggg

SEQ ID NO: 40153 - DNA, 16 bp, Homo sapiens
gccatcttcaacttca

SEQ ID NO: 40154 - DNA, 17 bp, Homo sapiens
ggtggctctgcacttga

SEQ ID NO: 40155 - DNA, 18 bp, Homo sapiens
tgggaccaacttcccaca

SEQ ID NO: 40156 - DNA, 22 bp, Homo sapiens
aggcatcgtcaccagccacggc

SEQ ID NO: 40157 - DNA, 24 bp, Homo sapiens
acgccctccacggcgtcgtcgcta

SEQ ID NO: 40158 - DNA, 21 bp, Homo sapiens
aacaaataaaagcatgataaa

SEQ ID NO: 40159 - DNA, 21 bp, Homo sapiens
agtaatttggttgacattggg

SEQ ID NO: 40160 - DNA, 23 bp, Homo sapiens
cctgtcttcccatcctcattcaa

SEQ ID NO: 40161 - DNA, 20 bp, Homo sapiens
tatatgaataggctatggta

SEQ ID NO: 40162 - DNA, 18 bp, Homo sapiens
tgcccagagcctatgtcc

SEQ ID NO: 40163 - DNA, 19 bp, Homo sapiens
aacagattcagaagacatt

SEQ ID NO: 40164 - DNA, 24 bp, Homo sapiens
accaatattacctgaagtgtcaga

SEQ ID NO: 40165 - DNA, 18 bp, Homo sapiens
gatgtacagtgaagtatc

SEQ ID NO: 40166 - DNA, 21 bp, Homo sapiens
gtgcctcttcgtgtgaatttt

SEQ ID NO: 40167 - DNA, 19 bp, Homo sapiens
tgtgcttatcttcactgta

SEQ ID NO: 40168 - DNA, 21 bp, Homo sapiens
atcttggctcactgcaaactc

SEQ ID NO: 40169 - DNA, 24 bp, Homo sapiens
cccactggtgctgagaccccaccc

SEQ ID NO: 40170 - DNA, 20 bp, Homo sapiens
gcttagttgaaggagtttcg

SEQ ID NO: 40171 - DNA, 22 bp, Homo sapiens
ttccttaaaaaactcatggaat

SEQ ID NO: 40172 - DNA, 17 bp, Homo sapiens
ttctcctgcttcagcct

SEQ ID NO: 40173 - DNA, 20 bp, Homo sapiens
ttttgctttgggggtttgtg

SEQ ID NO: 40174 - DNA, 25 bp, Homo sapiens
cttttggctggaattgatcatgaaa

SEQ ID NO: 40175 - DNA, 19 bp, Homo sapiens
gaccttttggctggaattg

SEQ ID NO: 40176 - DNA, 18 bp, Homo sapiens
gggatcgcccgcttcctt

SEQ ID NO: 40177 - DNA, 19 bp, Homo sapiens
cctatggaagtatttccga

SEQ ID NO: 40178 - DNA, 20 bp, Homo sapiens
cagtatggggacatgttcca

SEQ ID NO: 40179 - DNA, 19 bp, Homo sapiens
ggaggttgagcttccagaa

SEQ ID NO: 40180 - DNA, 20 bp, Homo sapiens
cagtatggggacatgttcca

SEQ ID NO: 40181 - DNA, 19 bp, Homo sapiens
ggaggttgagcttccagaa

SEQ ID NO: 40182 - DNA, 19 bp, Homo sapiens
cctaaggtggacctgtgag

SEQ ID NO: 40183 - DNA, 18 bp, Homo sapiens
cctggttgggcggccctg

SEQ ID NO: 40184 - DNA, 19 bp, Homo sapiens
gcctaggcatcttcttata

SEQ ID NO: 40185 - DNA, 19 bp, Homo sapiens
gttgttcaaatataatata

SEQ ID NO: 40186 - DNA, 20 bp, Homo sapiens
caggcaagagagatgcctgc

SEQ ID NO: 40187 - DNA, 15 bp, Homo sapiens
gccacttttggcaga

SEQ ID NO: 40188 - DNA, 21 bp, Homo sapiens
ggctccctcgttctgcagcaa

SEQ ID NO: 40189 - DNA, 17 bp, Homo sapiens
tgcaataccagctcctt

SEQ ID NO: 40190 - DNA, 19 bp, Homo sapiens
ttccagaacaaaagtgtga

SEQ ID NO: 40191 - DNA, 20 bp, Homo sapiens
ctccacgttccctctcctct

SEQ ID NO: 40192 - DNA, 21 bp, Homo sapiens
tgctgtgcccttgggcacccc

SEQ ID NO: 40193 - DNA, 20 bp, Homo sapiens
ccagagtgtccctctaccca

SEQ ID NO: 40194 - DNA, 18 bp, Homo sapiens
gccaactggacacagcgt

SEQ ID NO: 40195 - DNA, 17 bp, Homo sapiens
tcagcaatcagcatgtc

SEQ ID NO: 40196 - DNA, 20 bp, Homo sapiens
tcttggtggcaagagctgtg

SEQ ID NO: 40197 - DNA, 23 bp, Homo sapiens
atcttcagttaggcctgacacca

SEQ ID NO: 40198 - DNA, 23 bp, Homo sapiens
cgctccaggagaaggcaccctta

SEQ ID NO: 40199 - DNA, 19 bp, Homo sapiens
cttagatctccaaatgcag

SEQ ID NO: 40200 - DNA, 18 bp, Homo sapiens
cttttgggattccgggga

SEQ ID NO: 40201 - DNA, 19 bp, Homo sapiens
gaaggaaaacattccaaca

SEQ ID NO: 40202 - DNA, 22 bp, Homo sapiens
aaggatttgttttatattatga

SEQ ID NO: 40203 - DNA, 24 bp, Homo sapiens
agttggaggcttttgctgttttta

SEQ ID NO: 40204 - DNA, 21 bp, Homo sapiens
catttgtaaattatattttca

SEQ ID NO: 40205 - DNA, 21 bp, Homo sapiens
gctttttatttttttacttca

SEQ ID NO: 40206 - DNA, 23 bp, Homo sapiens
tgaatgggctttctaaatagcta

SEQ ID NO: 40207 - DNA, 19 bp, Homo sapiens
tgtctggtaagtctttgaa

SEQ ID NO: 40208 - DNA, 19 bp, Homo sapiens
gccccggcccccattcccg

SEQ ID NO: 40209 - DNA, 16 bp, Homo sapiens
ttgtctctgcagttca

SEQ ID NO: 40210 - DNA, 19 bp, Homo sapiens
caaggcaccctccagactg

SEQ ID NO: 40211 - DNA, 18 bp, Homo sapiens
cacacaggagcacctgga

SEQ ID NO: 40212 - DNA, 21 bp, Homo sapiens
ccctccccctattcacacccc

SEQ ID NO: 40213 - DNA, 16 bp, Homo sapiens
tgttgagaacatggcc

SEQ ID NO: 40214 - DNA, 21 bp, Homo sapiens
atgttaccttcttgaattgcc

SEQ ID NO: 40215 - DNA, 18 bp, Homo sapiens
cagtatttcaaaaagaaa

SEQ ID NO: 40216 - DNA, 19 bp, Homo sapiens
gaatattaggaaactgcca

SEQ ID NO: 40217 - DNA, 24 bp, Homo sapiens
cttttttattactgttatgatttt

SEQ ID NO: 40218 - DNA, 19 bp, Homo sapiens
gaaaaatccccactcttcc

SEQ ID NO: 40219 - DNA, 17 bp, Homo sapiens
gaaaatgaagctcactt

SEQ ID NO: 40220 - DNA, 22 bp, Homo sapiens
tccactgtagggtcatccgcaa

SEQ ID NO: 40221 - DNA, 23 bp, Homo sapiens
tctgatggtctgggctcattttt

SEQ ID NO: 40222 - DNA, 19 bp, Homo sapiens
ctgttttgctgagttccca

SEQ ID NO: 40223 - DNA, 19 bp, Homo sapiens
gccgggtgcgatggactcc

SEQ ID NO: 40224 - DNA, 15 bp, Homo sapiens
agcttctttcccaca

SEQ ID NO: 40225 - DNA, 21 bp, Homo sapiens
agactgacttagacctgggaa

SEQ ID NO: 40226 - DNA, 23 bp, Homo sapiens
ccccaagagccacttcccttcca

SEQ ID NO: 40227 - DNA, 19 bp, Homo sapiens
ttgccccaagagccacttc

SEQ ID NO: 40228 - DNA, 16 bp, Homo sapiens
tttaatctgtccttca

SEQ ID NO: 40229 - DNA, 20 bp, Homo sapiens
agaatacatgttcacttcca

SEQ ID NO: 40230 - DNA, 21 bp, Homo sapiens
tcaaagggtggtgaagaacta

SEQ ID NO: 40231 - DNA, 17 bp, Homo sapiens
aagtggattttatttgg

SEQ ID NO: 40232 - DNA, 18 bp, Homo sapiens
attttgttaactattaca

SEQ ID NO: 40233 - DNA, 18 bp, Homo sapiens
catactaatagtcactca

SEQ ID NO: 40234 - DNA, 22 bp, Homo sapiens
taatgcgcccccccctcttctc

SEQ ID NO: 40235 - DNA, 19 bp, Homo sapiens
ttcttgttcttaaattcaa

SEQ ID NO: 40236 - DNA, 18 bp, Homo sapiens
tttatgcttgaatatgaa

SEQ ID NO: 40237 - DNA, 21 bp, Homo sapiens
cgcgaaagccaacggacagga

SEQ ID NO: 40238 - DNA, 19 bp, Homo sapiens
gcacgcatgacatttcagt

SEQ ID NO: 40239 - DNA, 20 bp, Homo sapiens
cgttatatcaatgaaaacct

SEQ ID NO: 40240 - DNA, 20 bp, Homo sapiens
taacggtggtgcaccatcct

SEQ ID NO: 40241 - DNA, 19 bp, Homo sapiens
aaagagtgggaatcagtca

SEQ ID NO: 40242 - DNA, 18 bp, Homo sapiens
ccaaaacctcatgtaata

SEQ ID NO: 40243 - DNA, 23 bp, Homo sapiens
cccagcacaaccaggtatctgct

SEQ ID NO: 40244 - DNA, 18 bp, Homo sapiens
ggcacagacccctgcctc

SEQ ID NO: 40245 - DNA, 24 bp, Homo sapiens
catagccactctggatgcatatca

SEQ ID NO: 40246 - DNA, 21 bp, Homo sapiens
attttatttatggccagtttt

SEQ ID NO: 40247 - DNA, 24 bp, Homo sapiens
cagaagaattgaggatctgatgga

SEQ ID NO: 40248 - DNA, 21 bp, Homo sapiens
tggcaatggcagaagccctga

SEQ ID NO: 40249 - DNA, 19 bp, Homo sapiens
aagagactttctgctttca

SEQ ID NO: 40250 - DNA, 18 bp, Homo sapiens
cctcatctgcaggagtca

SEQ ID NO: 40251 - DNA, 20 bp, Homo sapiens
atatacgaggtgaaacatta

SEQ ID NO: 40252 - DNA, 18 bp, Homo sapiens
tatacgaggtgaaacatt

SEQ ID NO: 40253 - DNA, 20 bp, Homo sapiens
ggcaacgctggctggtggcc

SEQ ID NO: 40254 - DNA, 19 bp, Homo sapiens
ggccaggcccacctccatc

SEQ ID NO: 40255 - DNA, 22 bp, Homo sapiens
ggtcttgggaggcctgcagcag

SEQ ID NO: 40256 - DNA, 21 bp, Homo sapiens
agaagcccattcccgcccagt

SEQ ID NO: 40257 - DNA, 19 bp, Homo sapiens
agcttccaggtgtgtctca

SEQ ID NO: 40258 - DNA, 21 bp, Homo sapiens
cctcacagtatagtctttcca

SEQ ID NO: 40259 - DNA, 21 bp, Homo sapiens
acaaaaacattcgagttgacc

SEQ ID NO: 40260 - DNA, 17 bp, Homo sapiens
accccattcctgtgaaa

SEQ ID NO: 40261 - DNA, 18 bp, Homo sapiens
acctaccaacaacactga

SEQ ID NO: 40262 - DNA, 16 bp, Homo sapiens
agcctcattttccaca

SEQ ID NO: 40263 - DNA, 22 bp, Homo sapiens
agcttccgcttttatctttgaa

SEQ ID NO: 40264 - DNA, 24 bp, Homo sapiens
ccgtggggatgtaactatcggcaa

SEQ ID NO: 40265 - DNA, 24 bp, Homo sapiens
ctgcactcatcaacctgtcatcta

SEQ ID NO: 40266 - DNA, 24 bp, Homo sapiens
ggcaatgactctgaggctatatct

SEQ ID NO: 40267 - DNA, 19 bp, Homo sapiens
tcatagaaaataaggaacc

SEQ ID NO: 40268 - DNA, 19 bp, Homo sapiens
tctgtatgctaacgccaca

SEQ ID NO: 40269 - DNA, 21 bp, Homo sapiens
tgcagctcacccacgtgtgct

SEQ ID NO: 40270 - DNA, 19 bp, Homo sapiens
ttgcaaagagacaagcctc

SEQ ID NO: 40271 - DNA, 20 bp, Homo sapiens
acataaatgaaagtctcata

SEQ ID NO: 40272 - DNA, 24 bp, Homo sapiens
gtctcataaaatatcataaagata

SEQ ID NO: 40273 - DNA, 20 bp, Homo sapiens
aaatgggagaaatcacatca

SEQ ID NO: 40274 - DNA, 18 bp, Homo sapiens
ctctaaaaagccattgat

SEQ ID NO: 40275 - DNA, 22 bp, Homo sapiens
gaaaactctaaaaagccattga

SEQ ID NO: 40276 - DNA, 24 bp, Homo sapiens
caacatcatcctcatcagcagtga

SEQ ID NO: 40277 - DNA, 20 bp, Homo sapiens
gacacccaacatttgagaga

SEQ ID NO: 40278 - DNA, 21 bp, Homo sapiens
gcaaactgcaggacctgagtt

SEQ ID NO: 40279 - DNA, 18 bp, Homo sapiens
tggagttcaatgagctca

SEQ ID NO: 40280 - DNA, 21 bp, Homo sapiens
cctcctcgtacatcgcgctca

SEQ ID NO: 40281 - DNA, 18 bp, Homo sapiens
cgcgctcatcaccatggc

SEQ ID NO: 40282 - DNA, 18 bp, Homo sapiens
ggaggaggcggcgagcca

SEQ ID NO: 40283 - DNA, 18 bp, Homo sapiens
atccagaagagcaaaggc

SEQ ID NO: 40284 - DNA, 19 bp, Homo sapiens
aaactcctgacctcaggtg

SEQ ID NO: 40285 - DNA, 22 bp, Homo sapiens
gtagagacaggatttcaccatg

SEQ ID NO: 40286 - DNA, 17 bp, Homo sapiens
tcaagtgattctcctgc

SEQ ID NO: 40287 - DNA, 18 bp, Homo sapiens
tccgcctcccgggttcaa

SEQ ID NO: 40288 - DNA, 17 bp, Homo sapiens
tctagctttctgctttt

SEQ ID NO: 40289 - DNA, 17 bp, Homo sapiens
ttctcctgccttagcct

SEQ ID NO: 40290 - DNA, 20 bp, Homo sapiens
agggaaatgcaaatcaaagc

SEQ ID NO: 40291 - DNA, 16 bp, Homo sapiens
gcattactgcactcca

SEQ ID NO: 40292 - DNA, 22 bp, Homo sapiens
aaagagaggtcccatttcattt

SEQ ID NO: 40293 - DNA, 18 bp, Homo sapiens
cctccagagtatttgaca

SEQ ID NO: 40294 - DNA, 16 bp, Homo sapiens
gaggactatctaacca

SEQ ID NO: 40295 - DNA, 21 bp, Homo sapiens
ggacaaccacctcgttcctct

SEQ ID NO: 40296 - DNA, 18 bp, Homo sapiens
tcctcttgcaatttgtgc

SEQ ID NO: 40297 - DNA, 18 bp, Homo sapiens
aaatcctaccagttatgt

SEQ ID NO: 40298 - DNA, 20 bp, Homo sapiens
actccaggtagatttccaca

SEQ ID NO: 40299 - DNA, 19 bp, Homo sapiens
gattgttgtgtgttttgtt

SEQ ID NO: 40300 - DNA, 19 bp, Homo sapiens
tctgctgatatggaatgga

SEQ ID NO: 40301 - DNA, 21 bp, Homo sapiens
aacatgtattccatcgtgctg

SEQ ID NO: 40302 - DNA, 18 bp, Homo sapiens
atgtattccatcgtgctg

SEQ ID NO: 40303 - DNA, 22 bp, Homo sapiens
ccaataaattgtgcctttctca

SEQ ID NO: 40304 - DNA, 18 bp, Homo sapiens
ccagcttcctatgcaagg

SEQ ID NO: 40305 - DNA, 21 bp, Homo sapiens
ggaacggcgtgaagccactgg

SEQ ID NO: 40306 - DNA, 21 bp, Homo sapiens
tcctggagtgagacaagggct

SEQ ID NO: 40307 - DNA, 21 bp, Homo sapiens
tgctgaggctggaagaaaaac

SEQ ID NO: 40308 - DNA, 23 bp, Homo sapiens
ggactttccagtgatgccactga

SEQ ID NO: 40309 - DNA, 20 bp, Homo sapiens
aaggcgccaacagagtagtc

SEQ ID NO: 40310 - DNA, 25 bp, Homo sapiens
ttttggtttctaggaaggtctttgg

SEQ ID NO: 40311 - DNA, 18 bp, Homo sapiens
acaaggaagaaaaacctg

SEQ ID NO: 40312 - DNA, 22 bp, Homo sapiens
ctgcctggtcctgcccacctca

SEQ ID NO: 40313 - DNA, 22 bp, Homo sapiens
ctctgttcggggaccctgtgag

SEQ ID NO: 40314 - DNA, 18 bp, Homo sapiens
gcatatgaaatttttgat

SEQ ID NO: 40315 - DNA, 23 bp, Homo sapiens
tacaataaatcagggatttttcc

SEQ ID NO: 40316 - DNA, 20 bp, Homo sapiens
tgtccttcaaaatgaaactg

SEQ ID NO: 40317 - DNA, 22 bp, Homo sapiens
ttcaacagcataaaatcacgca

SEQ ID NO: 40318 - DNA, 23 bp, Homo sapiens
acctccacgtgactgtttggtgc

SEQ ID NO: 40319 - DNA, 22 bp, Homo sapiens
tcttgccctggggggcttggaa

SEQ ID NO: 40320 - DNA, 24 bp, Homo sapiens
aaaaacacagtccttttattctca

SEQ ID NO: 40321 - DNA, 21 bp, Homo sapiens
tgaaccactagggtgttgaaa

SEQ ID NO: 40322 - DNA, 17 bp, Homo sapiens
catgtggtttgcagcaa

SEQ ID NO: 40323 - DNA, 17 bp, Homo sapiens
tctcaggtcagtggcag

SEQ ID NO: 40324 - DNA, 20 bp, Homo sapiens
ttaaaatagaaatcctgaca

SEQ ID NO: 40325 - DNA, 21 bp, Homo sapiens
cagtgctctgtgtctagctta

SEQ ID NO: 40326 - DNA, 19 bp, Homo sapiens
gtcctggggaaaacatgga

SEQ ID NO: 40327 - DNA, 19 bp, Homo sapiens
agcaacagattctccagct

SEQ ID NO: 40328 - DNA, 21 bp, Homo sapiens
tgagtgggttccacaggaaac

SEQ ID NO: 40329 - DNA, 18 bp, Homo sapiens
aacactcctaacctctgt

SEQ ID NO: 40330 - DNA, 17 bp, Homo sapiens
ccagttgaccccacctt

SEQ ID NO: 40331 - DNA, 20 bp, Homo sapiens
acaccccccaaaatagacta

SEQ ID NO: 40332 - DNA, 18 bp, Homo sapiens
agagctttgacaaacctc

SEQ ID NO: 40333 - DNA, 21 bp, Homo sapiens
cagaaggagcgactccattaa

SEQ ID NO: 40334 - DNA, 22 bp, Homo sapiens
ccatctttgaccctaacacttt

SEQ ID NO: 40335 - DNA, 23 bp, Homo sapiens
ccttggtggcacctctcctggaa

SEQ ID NO: 40336 - DNA, 22 bp, Homo sapiens
gactgacttctaccacacactc

SEQ ID NO: 40337 - DNA, 21 bp, Homo sapiens
gcataatggttattgtcacta

SEQ ID NO: 40338 - DNA, 19 bp, Homo sapiens
gcccctgtcccctctgtca

SEQ ID NO: 40339 - DNA, 24 bp, Homo sapiens
gctttagtacaacaaataaaggtc

SEQ ID NO: 40340 - DNA, 22 bp, Homo sapiens
tcaaggaacagatggaatccca

SEQ ID NO: 40341 - DNA, 20 bp, Homo sapiens
tcatgagtgagcgtgaccag

SEQ ID NO: 40342 - DNA, 20 bp, Homo sapiens
tggaacctcaatgggggctg

SEQ ID NO: 40343 - DNA, 20 bp, Homo sapiens
agattcaatcaccttaccca

SEQ ID NO: 40344 - DNA, 22 bp, Homo sapiens
ccagattcaatcaccttaccca

SEQ ID NO: 40345 - DNA, 21 bp, Homo sapiens
gaggaaggggccgcggctgga

SEQ ID NO: 40346 - DNA, 19 bp, Homo sapiens
acaaattagaaccagagtt

SEQ ID NO: 40347 - DNA, 19 bp, Homo sapiens
cagtttgctgagcctgcca

SEQ ID NO: 40348 - DNA, 23 bp, Homo sapiens
tgccactcattgggccacacgct

SEQ ID NO: 40349 - DNA, 18 bp, Homo sapiens
tggctaggaaaaaactgc

SEQ ID NO: 40350 - DNA, 21 bp, Homo sapiens
ttccagaatatatgcatccag

SEQ ID NO: 40351 - DNA, 20 bp, Homo sapiens
aagaaattaaccctaaccca

SEQ ID NO: 40352 - DNA, 18 bp, Homo sapiens
aagggaaagggagtgtca

SEQ ID NO: 40353 - DNA, 19 bp, Homo sapiens
atcctgaaagagatgatgg

SEQ ID NO: 40354 - DNA, 22 bp, Homo sapiens
caagagaactctggcctagtca

SEQ ID NO: 40355 - DNA, 19 bp, Homo sapiens
tacttttgatagcagacca

SEQ ID NO: 40356 - DNA, 21 bp, Homo sapiens
tcctgaaagagatgatggact

SEQ ID NO: 40357 - DNA, 23 bp, Homo sapiens
caaaaccgtaggaattctgtgaa

SEQ ID NO: 40358 - DNA, 23 bp, Homo sapiens
acggagtctgcccaggccacacc

SEQ ID NO: 40359 - DNA, 19 bp, Homo sapiens
aaaggatagagtgtgtgca

SEQ ID NO: 40360 - DNA, 20 bp, Homo sapiens
aggatagagtgtgtgcatca

SEQ ID NO: 40361 - DNA, 19 bp, Homo sapiens
ccactgtgattctcaacaa

SEQ ID NO: 40362 - DNA, 22 bp, Homo sapiens
ctatgtatgtatatacacacat

SEQ ID NO: 40363 - DNA, 20 bp, Homo sapiens
gcttcatgtcaaacatgtca

SEQ ID NO: 40364 - DNA, 21 bp, Homo sapiens
tctaggtggttttgtttactt

SEQ ID NO: 40365 - DNA, 21 bp, Homo sapiens
tgagtggatcctggtaaatac

SEQ ID NO: 40366 - DNA, 16 bp, Homo sapiens
tggccaggtgtagtgg

SEQ ID NO: 40367 - DNA, 19 bp, Homo sapiens
tttggtggcattttgttca

SEQ ID NO: 40368 - DNA, 16 bp, Homo sapiens
accagagattgtaata

SEQ ID NO: 40369 - DNA, 19 bp, Homo sapiens
cttgccttctaggtcactt

SEQ ID NO: 40370 - DNA, 19 bp, Homo sapiens
gagataaagagcagctggg

SEQ ID NO: 40371 - DNA, 18 bp, Homo sapiens
tcctgaggatgccgcgca

SEQ ID NO: 40372 - DNA, 19 bp, Homo sapiens
aaggtgctgtgtctagtca

SEQ ID NO: 40373 - DNA, 18 bp, Homo sapiens
cctcgcccctgtccctct

SEQ ID NO: 40374 - DNA, 18 bp, Homo sapiens
ttctgcactcaaattcca

SEQ ID NO: 40375 - DNA, 20 bp, Homo sapiens
ggctcagcaaagtgacccta

SEQ ID NO: 40376 - DNA, 22 bp, Homo sapiens
atcttcagcagctctggatgct

SEQ ID NO: 40377 - DNA, 23 bp, Homo sapiens
cggaattcatctcgctgctgctg

SEQ ID NO: 40378 - DNA, 15 bp, Homo sapiens
gcatcatatttgcat

SEQ ID NO: 40379 - DNA, 23 bp, Homo sapiens
ggcaaaatgatgaaggagttctc

SEQ ID NO: 40380 - DNA, 19 bp, Homo sapiens
tccaatcatatattcatca

SEQ ID NO: 40381 - DNA, 19 bp, Homo sapiens
agcacacccacaaatgcca

SEQ ID NO: 40382 - DNA, 21 bp, Homo sapiens
cagtagggcataattcagagc

SEQ ID NO: 40383 - DNA, 21 bp, Homo sapiens
gttgttttcattgcctgcaga

SEQ ID NO: 40384 - DNA, 19 bp, Homo sapiens
tctgtggtaaccctgccca

SEQ ID NO: 40385 - DNA, 19 bp, Homo sapiens
ttgtgccagacccgttgaa

SEQ ID NO: 40386 - DNA, 19 bp, Homo sapiens
agcccacgcctcccaggga

SEQ ID NO: 40387 - DNA, 18 bp, Homo sapiens
cccaaacttaacctttga

SEQ ID NO: 40388 - DNA, 20 bp, Homo sapiens
cgagaactcagcagctgcca

SEQ ID NO: 40389 - DNA, 24 bp, Homo sapiens
ttctgaaagaaagaattttgcccc

SEQ ID NO: 40390 - DNA, 24 bp, Homo sapiens
catctccccaaaaactaaatgtga

SEQ ID NO: 40391 - DNA, 17 bp, Homo sapiens
ccccaacaaactcctct

SEQ ID NO: 40392 - DNA, 19 bp, Homo sapiens
ctctttctcccttctgctc

SEQ ID NO: 40393 - DNA, 17 bp, Homo sapiens
gcctgctgctctcagga

SEQ ID NO: 40394 - DNA, 19 bp, Homo sapiens
gcctgctgtataagtaaca

SEQ ID NO: 40395 - DNA, 21 bp, Homo sapiens
tcctgggagcccacaagatcc

SEQ ID NO: 40396 - DNA, 21 bp, Homo sapiens
tgccctgggccatatgtgcta

SEQ ID NO: 40397 - DNA, 18 bp, Homo sapiens
tcccacccatcctctttt

SEQ ID NO: 40398 - DNA, 21 bp, Homo sapiens
tttaggggccaagaaatttca

SEQ ID NO: 40399 - DNA, 19 bp, Homo sapiens
cctgagccgggatctgggg

SEQ ID NO: 40400 - DNA, 19 bp, Homo sapiens
cttgagcccaggctggtct

SEQ ID NO: 40401 - DNA, 25 bp, Homo sapiens
ggctgactgccacccgccccatggg

SEQ ID NO: 40402 - DNA, 16 bp, Homo sapiens
tacaaaaatatgtaga

SEQ ID NO: 40403 - DNA, 20 bp, Homo sapiens
aacctgggtgtagctcattt

SEQ ID NO: 40404 - DNA, 19 bp, Homo sapiens
accctgagtacacccctct

SEQ ID NO: 40405 - DNA, 20 bp, Homo sapiens
atcacccccgttcgccctca

SEQ ID NO: 40406 - DNA, 19 bp, Homo sapiens
gacagcattgggtctggtt

SEQ ID NO: 40407 - DNA, 24 bp, Homo sapiens
gcaccatgttccgttcctttttca

SEQ ID NO: 40408 - DNA, 18 bp, Homo sapiens
ttgcaaaaaccaaccttc

SEQ ID NO: 40409 - DNA, 19 bp, Homo sapiens
tttccctcaacacctgctc

SEQ ID NO: 40410 - DNA, 22 bp, Homo sapiens
tgtctttgtggtttttggaata

SEQ ID NO: 40411 - DNA, 18 bp, Homo sapiens
agagccttactctttcca

SEQ ID NO: 40412 - DNA, 17 bp, Homo sapiens
cagcactagcagtacca

SEQ ID NO: 40413 - DNA, 26 bp, Homo sapiens
gcgctaccaagaaccaccactgggga

SEQ ID NO: 40414 - DNA, 19 bp, Homo sapiens
taccaagaaccaccactgg

SEQ ID NO: 40415 - DNA, 19 bp, Homo sapiens
tcctcttttcccccttttc

SEQ ID NO: 40416 - DNA, 22 bp, Homo sapiens
aaagtaggcggtcagcctttca

SEQ ID NO: 40417 - DNA, 21 bp, Homo sapiens
caagattatgattttcaggct

SEQ ID NO: 40418 - DNA, 24 bp, Homo sapiens
gtgccttggttgggctttgattct

SEQ ID NO: 40419 - DNA, 22 bp, Homo sapiens
cactgtaccacagcctgagcaa

SEQ ID NO: 40420 - DNA, 16 bp, Homo sapiens
tcccagcaggctgcaa

SEQ ID NO: 40421 - DNA, 16 bp, Homo sapiens
accagaagctgagcaa

SEQ ID NO: 40422 - DNA, 19 bp, Homo sapiens
accagcctcccactgcaca

SEQ ID NO: 40423 - DNA, 16 bp, Homo sapiens
cctccaggcctgtggg

SEQ ID NO: 40424 - DNA, 20 bp, Homo sapiens
ccttccccttcctccctcca

SEQ ID NO: 40425 - DNA, 21 bp, Homo sapiens
ctgggcccatcccaggcctca

SEQ ID NO: 40426 - DNA, 20 bp, Homo sapiens
ctggtcaatcaggctgatca

SEQ ID NO: 40427 - DNA, 22 bp, Homo sapiens
ctttggtgcaccaggccttgga

SEQ ID NO: 40428 - DNA, 22 bp, Homo sapiens
tcaactccctgggagtggaagc

SEQ ID NO: 40429 - DNA, 24 bp, Homo sapiens
ccccttggtcacatgaaccaggga

SEQ ID NO: 40430 - DNA, 19 bp, Homo sapiens
gacttctagtgtggaagtg

SEQ ID NO: 40431 - DNA, 17 bp, Homo sapiens
gagtgcaagcatggaac

SEQ ID NO: 40432 - DNA, 19 bp, Homo sapiens
aaactcctgaactcaggtg

SEQ ID NO: 40433 - DNA, 18 bp, Homo sapiens
cctgcaacctccacctcc

SEQ ID NO: 40434 - DNA, 18 bp, Homo sapiens
taagtggatcacctgagg

SEQ ID NO: 40435 - DNA, 20 bp, Homo sapiens
ttcaagtgattctcctgcgc

SEQ ID NO: 40436 - DNA, 21 bp, Homo sapiens
agaatgaaccctcaccctccc

SEQ ID NO: 40437 - DNA, 20 bp, Homo sapiens
ataaagttcctcccagttcc

SEQ ID NO: 40438 - DNA, 19 bp, Homo sapiens
ctctcctttggctaatctg

SEQ ID NO: 40439 - DNA, 20 bp, Homo sapiens
tcaaagactactcatttcca

SEQ ID NO: 40440 - DNA, 18 bp, Homo sapiens
atctattccaaatcatta

SEQ ID NO: 40441 - DNA, 19 bp, Homo sapiens
ctcctgctttaacctttcc

SEQ ID NO: 40442 - DNA, 19 bp, Homo sapiens
tcatttttgtgccaaatga

SEQ ID NO: 40443 - DNA, 18 bp, Homo sapiens
tcctttaatcctggctca

SEQ ID NO: 40444 - DNA, 20 bp, Homo sapiens
tgcaacatgccccttgctcc

SEQ ID NO: 40445 - DNA, 18 bp, Homo sapiens
atctctcagaccagctca

SEQ ID NO: 40446 - DNA, 23 bp, Homo sapiens
ccacgaacaccagcccaaactga

SEQ ID NO: 40447 - DNA, 20 bp, Homo sapiens
ctccaacctgggacatccca

SEQ ID NO: 40448 - DNA, 19 bp, Homo sapiens
gccccggccgggcccagcc

SEQ ID NO: 40449 - DNA, 23 bp, Homo sapiens
aagcaccagacaccatgcagctg

SEQ ID NO: 40450 - DNA, 16 bp, Homo sapiens
acagagaggaaatcct

SEQ ID NO: 40451 - DNA, 20 bp, Homo sapiens
gctcccagcctgctgagcac

SEQ ID NO: 40452 - DNA, 19 bp, Homo sapiens
tgcttactcagggatccgg

SEQ ID NO: 40453 - DNA, 25 bp, Homo sapiens
aagtgcggccccatctcctctccgt

SEQ ID NO: 40454 - DNA, 18 bp, Homo sapiens
agtgaaggagataaacac

SEQ ID NO: 40455 - DNA, 19 bp, Homo sapiens
ggtagagggaacaccatga

SEQ ID NO: 40456 - DNA, 18 bp, Homo sapiens
atttaaggtcctttgata

SEQ ID NO: 40457 - DNA, 22 bp, Homo sapiens
atttgagttgtgaaaaaggtct

SEQ ID NO: 40458 - DNA, 22 bp, Homo sapiens
cgccaggctgagaacttgcaaa

SEQ ID NO: 40459 - DNA, 19 bp, Homo sapiens
ctctccctcagaaaccgct

SEQ ID NO: 40460 - DNA, 19 bp, Homo sapiens
gagactccatgaagccaca

SEQ ID NO: 40461 - DNA, 20 bp, Homo sapiens
gggcagggagactgccgcca

SEQ ID NO: 40462 - DNA, 18 bp, Homo sapiens
taatttccttctgttcct

SEQ ID NO: 40463 - DNA, 18 bp, Homo sapiens
tctgaacaatattgtctt

SEQ ID NO: 40464 - DNA, 19 bp, Homo sapiens
actctcaatgtgatgatta

SEQ ID NO: 40465 - DNA, 19 bp, Homo sapiens
ataacgagtatgcaatttg

SEQ ID NO: 40466 - DNA, 17 bp, Homo sapiens
gaggtaactgggcttag

SEQ ID NO: 40467 - DNA, 21 bp, Homo sapiens
gaaacacaaattatagcataa

SEQ ID NO: 40468 - DNA, 19 bp, Homo sapiens
ccctggtgatgggcgttgc

SEQ ID NO: 40469 - DNA, 19 bp, Homo sapiens
cctagccacagctgttgta

SEQ ID NO: 40470 - DNA, 21 bp, Homo sapiens
gcgttgcaaagttttcactga

SEQ ID NO: 40471 - DNA, 18 bp, Homo sapiens
gtaaccggttttgttgca

SEQ ID NO: 40472 - DNA, 20 bp, Homo sapiens
taccatgaaaaaactacata

SEQ ID NO: 40473 - DNA, 22 bp, Homo sapiens
tttaggagtctatttcttacca

SEQ ID NO: 40474 - DNA, 19 bp, Homo sapiens
accacctgtcttttgcata

SEQ ID NO: 40475 - DNA, 18 bp, Homo sapiens
ccaggatactgatactcc

SEQ ID NO: 40476 - DNA, 18 bp, Homo sapiens
ccagttatcctctcctct

SEQ ID NO: 40477 - DNA, 19 bp, Homo sapiens
ccttcaaaccatctgccag

SEQ ID NO: 40478 - DNA, 18 bp, Homo sapiens
ccttttttccttttcacc

SEQ ID NO: 40479 - DNA, 15 bp, Homo sapiens
tatcctctcctctga

SEQ ID NO: 40480 - DNA, 18 bp, Homo sapiens
ttacttggaaatccatgc

SEQ ID NO: 40481 - DNA, 21 bp, Homo sapiens
aaaacaaaagcaaaaacaaac

SEQ ID NO: 40482 - DNA, 20 bp, Homo sapiens
accttgtacatgtgaaacct

SEQ ID NO: 40483 - DNA, 21 bp, Homo sapiens
tgccatcaatattttagactg

SEQ ID NO: 40484 - DNA, 21 bp, Homo sapiens
atatccttttcaagcataaca

SEQ ID NO: 40485 - DNA, 21 bp, Homo sapiens
atttgagtagcactgtttggt

SEQ ID NO: 40486 - DNA, 20 bp, Homo sapiens
ccacctaaccctacctactg

SEQ ID NO: 40487 - DNA, 23 bp, Homo sapiens
cctttggttctggcatggcatta

SEQ ID NO: 40488 - DNA, 22 bp, Homo sapiens
gagccaagatcacaccactgca

SEQ ID NO: 40489 - DNA, 19 bp, Homo sapiens
tgtcttttagtcatttctt

SEQ ID NO: 40490 - DNA, 20 bp, Homo sapiens
ttatacattaaaaatagtgt

SEQ ID NO: 40491 - DNA, 18 bp, Homo sapiens
ttgataccatgcactttt

SEQ ID NO: 40492 - DNA, 24 bp, Homo sapiens
cccaccaaactccgcctcatccca

SEQ ID NO: 40493 - DNA, 23 bp, Homo sapiens
tccacggccagggctctcctccc

SEQ ID NO: 40494 - DNA, 27 bp, Homo sapiens
tgacatccccctgcctctatcttcttc

SEQ ID NO: 40495 - DNA, 19 bp, Homo sapiens
tgggtggatcacctgagat

SEQ ID NO: 40496 - DNA, 19 bp, Homo sapiens
tgtcctgtcggtgtgctct

SEQ ID NO: 40497 - DNA, 19 bp, Homo sapiens
agatccttcagaaatgtca

SEQ ID NO: 40498 - DNA, 21 bp, Homo sapiens
tcaccttctttttgctttcta

SEQ ID NO: 40499 - DNA, 21 bp, Homo sapiens
aactcaggaccttactgtgaa

SEQ ID NO: 40500 - DNA, 18 bp, Homo sapiens
aatcattgagtcattttt

SEQ ID NO: 40501 - DNA, 23 bp, Homo sapiens
cttcagcgttttaaattgttttt

SEQ ID NO: 40502 - DNA, 24 bp, Homo sapiens
gcagaactgtacacccctgtcata

SEQ ID NO: 40503 - DNA, 21 bp, Homo sapiens
cacagcccctcggcgatctca

SEQ ID NO: 40504 - DNA, 17 bp, Homo sapiens
acctttcttctttgtag

SEQ ID NO: 40505 - DNA, 20 bp, Homo sapiens
cctctcctgcctttgacctc

SEQ ID NO: 40506 - DNA, 26 bp, Homo sapiens
gccccaactctgctcccagcaagcca

SEQ ID NO: 40507 - DNA, 21 bp, Homo sapiens
gggcacctccacatctggctg

SEQ ID NO: 40508 - DNA, 17 bp, Homo sapiens
tctcctgcctttgacct

SEQ ID NO: 40509 - DNA, 19 bp, Homo sapiens
tgggaggacgagagccgga

SEQ ID NO: 40510 - DNA, 20 bp, Homo sapiens
ttcaagaccagcctgaccaa

SEQ ID NO: 40511 - DNA, 23 bp, Homo sapiens
aggaacacatctcctgcacttct

SEQ ID NO: 40512 - DNA, 20 bp, Homo sapiens
cacagcctggcctgctcctc

SEQ ID NO: 40513 - DNA, 19 bp, Homo sapiens
ccacctgagcaccatcctg

SEQ ID NO: 40514 - DNA, 24 bp, Homo sapiens
ccttcccatgcaggatgactgctc

SEQ ID NO: 40515 - DNA, 26 bp, Homo sapiens
gcctgaaccatgctcacttctggtcc

SEQ ID NO: 40516 - DNA, 19 bp, Homo sapiens
tactcttaccctcaactct

SEQ ID NO: 40517 - DNA, 21 bp, Homo sapiens
tgaaggaggaaaacaaggcaa

SEQ ID NO: 40518 - DNA, 19 bp, Homo sapiens
aggcaggcgaattacttca

SEQ ID NO: 40519 - DNA, 20 bp, Homo sapiens
gccccaccttcatttttcca

SEQ ID NO: 40520 - DNA, 24 bp, Homo sapiens
tacagcaaccataggaagctaata

SEQ ID NO: 40521 - DNA, 22 bp, Homo sapiens
tatccatttccgagtccctgga

SEQ ID NO: 40522 - DNA, 19 bp, Homo sapiens
tgggtgacagtgtgaaact

SEQ ID NO: 40523 - DNA, 20 bp, Homo sapiens
tgggtgggtccttagggagc

SEQ ID NO: 40524 - DNA, 20 bp, Homo sapiens
cccaaactcctcccagcaag

SEQ ID NO: 40525 - DNA, 19 bp, Homo sapiens
cccactttgtcctgtgaca

SEQ ID NO: 40526 - DNA, 21 bp, Homo sapiens
ctgctccatctaggtgtccca

SEQ ID NO: 40527 - DNA, 15 bp, Homo sapiens
agcagaaacatcctc

SEQ ID NO: 40528 - DNA, 20 bp, Homo sapiens
ctctcccaacccctgctcca

SEQ ID NO: 40529 - DNA, 19 bp, Homo sapiens
agtgctgaaggactcctca

SEQ ID NO: 40530 - DNA, 24 bp, Homo sapiens
ctctgtgactgaagggcctgcgga

SEQ ID NO: 40531 - DNA, 27 bp, Homo sapiens
gtggtggggaccaggggatcttcgtca

SEQ ID NO: 40532 - DNA, 18 bp, Homo sapiens
cagggttgggaggcctag

SEQ ID NO: 40533 - DNA, 18 bp, Homo sapiens
gcccacctcataaccata

SEQ ID NO: 40534 - DNA, 18 bp, Homo sapiens
tttttgtctccactggct

SEQ ID NO: 40535 - DNA, 23 bp, Homo sapiens
gccacccctctagggacccagga

SEQ ID NO: 40536 - DNA, 22 bp, Homo sapiens
gccgggggcggctgtttggcct

SEQ ID NO: 40537 - DNA, 20 bp, Homo sapiens
gcgcccgcccgccccgccct

SEQ ID NO: 40538 - DNA, 24 bp, Homo sapiens
ggcgcggccttcagcgtggggctg

SEQ ID NO: 40539 - DNA, 19 bp, Homo sapiens
tatgattgtgccactgcac

SEQ ID NO: 40540 - DNA, 19 bp, Homo sapiens
cagacagccccctgtgcaa

SEQ ID NO: 40541 - DNA, 21 bp, Homo sapiens
acctggaaatcagcctggctt

SEQ ID NO: 40542 - DNA, 20 bp, Homo sapiens
tcacttattttgctaaataa

SEQ ID NO: 40543 - DNA, 22 bp, Homo sapiens
caacactgctgtctttaagctt

SEQ ID NO: 40544 - DNA, 21 bp, Homo sapiens
ccagcatcttcacttgtcata

SEQ ID NO: 40545 - DNA, 24 bp, Homo sapiens
gggaggagaggttggaagctgcca

SEQ ID NO: 40546 - DNA, 17 bp, Homo sapiens
tagatagatagatacat

SEQ ID NO: 40547 - DNA, 21 bp, Homo sapiens
tcattgtgtcaattcctgcaa

SEQ ID NO: 40548 - DNA, 17 bp, Homo sapiens
tctgcactgatcctcta

SEQ ID NO: 40549 - DNA, 23 bp, Homo sapiens
ttgacacaaccccttcccattca

SEQ ID NO: 40550 - DNA, 21 bp, Homo sapiens
tttctgatcatggtatgtgct

SEQ ID NO: 40551 - DNA, 18 bp, Homo sapiens
gtatgaggccgggtgcag

SEQ ID NO: 40552 - DNA, 22 bp, Homo sapiens
acttgaaaggtgtgcttggttt

SEQ ID NO: 40553 - DNA, 22 bp, Homo sapiens
agattcaactttaccatccaca

SEQ ID NO: 40554 - DNA, 20 bp, Homo sapiens
cagatggctgagaagccact

SEQ ID NO: 40555 - DNA, 18 bp, Homo sapiens
ccagccaatgagatgtaa

SEQ ID NO: 40556 - DNA, 20 bp, Homo sapiens
tggtcctaagagtgaaggaa

SEQ ID NO: 40557 - DNA, 21 bp, Homo sapiens
gctgtcccgggaccccgagga

SEQ ID NO: 40558 - DNA, 19 bp, Homo sapiens
tgctgtccgcgctgcccgc

SEQ ID NO: 40559 - DNA, 21 bp, Homo sapiens
actttttttccacaacttttt

SEQ ID NO: 40560 - DNA, 24 bp, Homo sapiens
agtcccatcaccaggcagccatga

SEQ ID NO: 40561 - DNA, 20 bp, Homo sapiens
catcatcctgggcacgccgt

SEQ ID NO: 40562 - DNA, 24 bp, Homo sapiens
ccagctgatcgggtcaggcaagtc

SEQ ID NO: 40563 - DNA, 23 bp, Homo sapiens
cccttccagcccctcttttccag

SEQ ID NO: 40564 - DNA, 19 bp, Homo sapiens
cctctaaacacatccctcc

SEQ ID NO: 40565 - DNA, 20 bp, Homo sapiens
ctctccaactgccagctgat

SEQ ID NO: 40566 - DNA, 17 bp, Homo sapiens
gcccccttcttctgtga

SEQ ID NO: 40567 - DNA, 20 bp, Homo sapiens
gttacacagctacagtatgt

SEQ ID NO: 40568 - DNA, 18 bp, Homo sapiens
ccctggaggatctggaga

SEQ ID NO: 40569 - DNA, 21 bp, Homo sapiens
actttttttccacaacttttt

SEQ ID NO: 40570 - DNA, 24 bp, Homo sapiens
agtcccatcaccaggcagccatga

SEQ ID NO: 40571 - DNA, 20 bp, Homo sapiens
catcatcctgggcacgccgt

SEQ ID NO: 40572 - DNA, 24 bp, Homo sapiens
ccagctgatcgggtcaggcaagtc

SEQ ID NO: 40573 - DNA, 19 bp, Homo sapiens
cctctaaacacatccctcc

SEQ ID NO: 40574 - DNA, 23 bp, Homo sapiens
cctttccagcccctcttttccag

SEQ ID NO: 40575 - DNA, 17 bp, Homo sapiens
ctcccctttcctttcca

SEQ ID NO: 40576 - DNA, 20 bp, Homo sapiens
ctctccaactgccagctgat

SEQ ID NO: 40577 - DNA, 17 bp, Homo sapiens
gcccccttcttctgtga

SEQ ID NO: 40578 - DNA, 20 bp, Homo sapiens
gttacacagctacagtatgt

SEQ ID NO: 40579 - DNA, 20 bp, Homo sapiens
gcgggtcgcgagtcgccggt

SEQ ID NO: 40580 - DNA, 17 bp, Homo sapiens
ttggacttagataaggg

SEQ ID NO: 40581 - DNA, 20 bp, Homo sapiens
atctcgtgtgtgttaagatg

SEQ ID NO: 40582 - DNA, 21 bp, Homo sapiens
caaccttcattctctgactcc

SEQ ID NO: 40583 - DNA, 22 bp, Homo sapiens
cccgagttgggggatttgagag

SEQ ID NO: 40584 - DNA, 20 bp, Homo sapiens
gagacacagtgaaaaggggt

SEQ ID NO: 40585 - DNA, 18 bp, Homo sapiens
ggccctggcaggagatta

SEQ ID NO: 40586 - DNA, 21 bp, Homo sapiens
tttccctcaccgcagctctca

SEQ ID NO: 40587 - DNA, 18 bp, Homo sapiens
gttcacactagcactgtt

SEQ ID NO: 40588 - DNA, 21 bp, Homo sapiens
tcccaatcacatttcacaata

SEQ ID NO: 40589 - DNA, 18 bp, Homo sapiens
acagtctgtatacaaata

SEQ ID NO: 40590 - DNA, 19 bp, Homo sapiens
caattcagatcgtgtcaca

SEQ ID NO: 40591 - DNA, 18 bp, Homo sapiens
cttaagttctgcagatca

SEQ ID NO: 40592 - DNA, 22 bp, Homo sapiens
gtagcctaccaaaattatacac

SEQ ID NO: 40593 - DNA, 24 bp, Homo sapiens
tttgcatcagtttgtcttggcttt

SEQ ID NO: 40594 - DNA, 19 bp, Homo sapiens
agacatgcagtttgcttgc

SEQ ID NO: 40595 - DNA, 23 bp, Homo sapiens
atctgggacctgcagtttggctt

SEQ ID NO: 40596 - DNA, 20 bp, Homo sapiens
aacttgtttaccaggatcag

SEQ ID NO: 40597 - DNA, 19 bp, Homo sapiens
aatcccagataatcatatc

SEQ ID NO: 40598 - DNA, 20 bp, Homo sapiens
ccactgcacctggtccccca

SEQ ID NO: 40599 - DNA, 21 bp, Homo sapiens
tggcccacgctggtcttgaac

SEQ ID NO: 40600 - DNA, 25 bp, Homo sapiens
accgtgttcgtggccgacctggcct

SEQ ID NO: 40601 - DNA, 26 bp, Homo sapiens
acctctgggtatccctttgtctggga

SEQ ID NO: 40602 - DNA, 19 bp, Homo sapiens
atgcttcagaaacacctca

SEQ ID NO: 40603 - DNA, 19 bp, Homo sapiens
cctcttttccccccatgct

SEQ ID NO: 40604 - DNA, 23 bp, Homo sapiens
ccttgatggtggaatgaccgggt

SEQ ID NO: 40605 - DNA, 17 bp, Homo sapiens
gaatggcttgccagtgg

SEQ ID NO: 40606 - DNA, 19 bp, Homo sapiens
gacgaagatctggtttaca

SEQ ID NO: 40607 - DNA, 18 bp, Homo sapiens
tgttcctctgtgttgtca

SEQ ID NO: 40608 - DNA, 18 bp, Homo sapiens
tttctggtcaacattgtt

SEQ ID NO: 40609 - DNA, 19 bp, Homo sapiens
atctgaattcttgtctggt

SEQ ID NO: 40610 - DNA, 20 bp, Homo sapiens
tgtgggggattttgttggtg

SEQ ID NO: 40611 - DNA, 24 bp, Homo sapiens
catgaaccagagcctcatctttca

SEQ ID NO: 40612 - DNA, 18 bp, Homo sapiens
cgttttaaaattccctaa

SEQ ID NO: 40613 - DNA, 21 bp, Homo sapiens
tttttttgttggaaccctgca

SEQ ID NO: 40614 - DNA, 19 bp, Homo sapiens
gggcaaacgctccgaccaa

SEQ ID NO: 40615 - DNA, 20 bp, Homo sapiens
aacatgtcgtcaggaaactt

SEQ ID NO: 40616 - DNA, 22 bp, Homo sapiens
ccttttcatttaggtttacttt

SEQ ID NO: 40617 - DNA, 17 bp, Homo sapiens
tctaatattgaaatatg

SEQ ID NO: 40618 - DNA, 15 bp, Homo sapiens
tctaggcatgctgcc

SEQ ID NO: 40619 - DNA, 22 bp, Homo sapiens
tgtctccattcctgccatctct

SEQ ID NO: 40620 - DNA, 23 bp, Homo sapiens
tgaaatctcacatgtctagttca

SEQ ID NO: 40621 - DNA, 23 bp, Homo sapiens
cggcattttcccatctgcctttt

SEQ ID NO: 40622 - DNA, 22 bp, Homo sapiens
tatctgtgtagaaatacaactc

SEQ ID NO: 40623 - DNA, 20 bp, Homo sapiens
catgaagtttcagtcactca

SEQ ID NO: 40624 - DNA, 17 bp, Homo sapiens
gggttgactgggtccag

SEQ ID NO: 40625 - DNA, 17 bp, Homo sapiens
tgaacagcgagttttga

SEQ ID NO: 40626 - DNA, 18 bp, Homo sapiens
ggcttggcacccgccaaa

SEQ ID NO: 40627 - DNA, 17 bp, Homo sapiens
aaaaacaaacaaacaaa

SEQ ID NO: 40628 - DNA, 20 bp, Homo sapiens
agaaaatcatcatcccatct

SEQ ID NO: 40629 - DNA, 19 bp, Homo sapiens
atttttcagaaaacttcca

SEQ ID NO: 40630 - DNA, 24 bp, Homo sapiens
cagggcacgtgtttttgagcctct

SEQ ID NO: 40631 - DNA, 18 bp, Homo sapiens
cttgctgtgagaccattt

SEQ ID NO: 40632 - DNA, 20 bp, Homo sapiens
gcccctgtccttggccagtc

SEQ ID NO: 40633 - DNA, 23 bp, Homo sapiens
ggggaataagagtaggctcagtt

SEQ ID NO: 40634 - DNA, 19 bp, Homo sapiens
ggtcttggcgcgctggccg

SEQ ID NO: 40635 - DNA, 21 bp, Homo sapiens
gtttcagaaccaatttaaaat

SEQ ID NO: 40636 - DNA, 19 bp, Homo sapiens
tcatagatacaatacttta

SEQ ID NO: 40637 - DNA, 21 bp, Homo sapiens
tctaagacaatgaatcatttt

SEQ ID NO: 40638 - DNA, 21 bp, Homo sapiens
tctgatgagtatctctctgca

SEQ ID NO: 40639 - DNA, 19 bp, Homo sapiens
tgggtcaaacattgttgta

SEQ ID NO: 40640 - DNA, 16 bp, Homo sapiens
ttccagaagcttgttc

SEQ ID NO: 40641 - DNA, 17 bp, Homo sapiens
agtgctctcttacctca

SEQ ID NO: 40642 - DNA, 16 bp, Homo sapiens
atcattagctatccca

SEQ ID NO: 40643 - DNA, 19 bp, Homo sapiens
atctctgtccccagcctct

SEQ ID NO: 40644 - DNA, 19 bp, Homo sapiens
cagctcactagttagctgt

SEQ ID NO: 40645 - DNA, 18 bp, Homo sapiens
gtgactgttgtggactct

SEQ ID NO: 40646 - DNA, 24 bp, Homo sapiens
tgggtgggcttcaggctggggctg

SEQ ID NO: 40647 - DNA, 22 bp, Homo sapiens
ttccctgctcacattctctgga

SEQ ID NO: 40648 - DNA, 19 bp, Homo sapiens
ccaaagctgtgggatcaca

SEQ ID NO: 40649 - DNA, 17 bp, Homo sapiens
ctaggctgctgctcttt

SEQ ID NO: 40650 - DNA, 20 bp, Homo sapiens
ggacgaccctgcctccgtct

SEQ ID NO: 40651 - DNA, 19 bp, Homo sapiens
tccttagctaccctgtttt

SEQ ID NO: 40652 - DNA, 17 bp, Homo sapiens
gctgagggcatatctca

SEQ ID NO: 40653 - DNA, 21 bp, Homo sapiens
cacgtggccaacctgccgcaa

SEQ ID NO: 40654 - DNA, 23 bp, Homo sapiens
ccatagctggaccaatcatgaca

SEQ ID NO: 40655 - DNA, 21 bp, Homo sapiens
cctctttgtagctctgtgctt

SEQ ID NO: 40656 - DNA, 19 bp, Homo sapiens
gcacagagggcggagctgg

SEQ ID NO: 40657 - DNA, 21 bp, Homo sapiens
tcccaggtcagagaggagagt

SEQ ID NO: 40658 - DNA, 21 bp, Homo sapiens
tgggacttgcccaactttaaa

SEQ ID NO: 40659 - DNA, 18 bp, Homo sapiens
ttgaaatactgtgcctca

SEQ ID NO: 40660 - DNA, 21 bp, Homo sapiens
cacttagtgggctgcactttt

SEQ ID NO: 40661 - DNA, 21 bp, Homo sapiens
cctcattaggcctggccacct

SEQ ID NO: 40662 - DNA, 21 bp, Homo sapiens
atcttcatgtggacattgaga

SEQ ID NO: 40663 - DNA, 20 bp, Homo sapiens
ctctcggctcattttgcaca

SEQ ID NO: 40664 - DNA, 19 bp, Homo sapiens
acagatattaaactgatca

SEQ ID NO: 40665 - DNA, 19 bp, Homo sapiens
caccaccaccaccaccttc

SEQ ID NO: 40666 - DNA, 17 bp, Homo sapiens
ctctccctgctgcctct

SEQ ID NO: 40667 - DNA, 22 bp, Homo sapiens
cttggaaacagaaggcctgtgg

SEQ ID NO: 40668 - DNA, 19 bp, Homo sapiens
gctgagagaagttcctcat

SEQ ID NO: 40669 - DNA, 20 bp, Homo sapiens
ggacttttccccacctcctc

SEQ ID NO: 40670 - DNA, 22 bp, Homo sapiens
ggcaagcccagggacccctgga

SEQ ID NO: 40671 - DNA, 17 bp, Homo sapiens
ggtgaagctgtgacatc

SEQ ID NO: 40672 - DNA, 19 bp, Homo sapiens
tgacatgtgtcgtcttctc

SEQ ID NO: 40673 - DNA, 22 bp, Homo sapiens
acacaggccccagatccagtca

SEQ ID NO: 40674 - DNA, 19 bp, Homo sapiens
acccccactcctatcctga

SEQ ID NO: 40675 - DNA, 22 bp, Homo sapiens
ccaactgagaagacttggccca

SEQ ID NO: 40676 - DNA, 19 bp, Homo sapiens
cccgccgcctggaagttct

SEQ ID NO: 40677 - DNA, 18 bp, Homo sapiens
ctttagtttgcctttaaa

SEQ ID NO: 40678 - DNA, 18 bp, Homo sapiens
gccgcctggaagttctga

SEQ ID NO: 40679 - DNA, 18 bp, Homo sapiens
tcctttaatctgtactgt

SEQ ID NO: 40680 - DNA, 19 bp, Homo sapiens
tgcaaaatcactgcacctt

SEQ ID NO: 40681 - DNA, 19 bp, Homo sapiens
tgcaggaccagagcccctt

SEQ ID NO: 40682 - DNA, 21 bp, Homo sapiens
aattatctcctgtgcacatga

SEQ ID NO: 40683 - DNA, 18 bp, Homo sapiens
ctgaaaactttcctactg

SEQ ID NO: 40684 - DNA, 18 bp, Homo sapiens
gcaattcaaaattatctc

SEQ ID NO: 40685 - DNA, 20 bp, Homo sapiens
ggacaagataattcaagtca

SEQ ID NO: 40686 - DNA, 22 bp, Homo sapiens
taatcatacaaatcagacttta

SEQ ID NO: 40687 - DNA, 19 bp, Homo sapiens
ttcaagatgacagatccaa

SEQ ID NO: 40688 - DNA, 22 bp, Homo sapiens
agtctatactgccaggcactat

SEQ ID NO: 40689 - DNA, 18 bp, Homo sapiens
ctcctcgagctctttgaa

SEQ ID NO: 40690 - DNA, 19 bp, Homo sapiens
gcacttatccaagtcgtgc

SEQ ID NO: 40691 - DNA, 16 bp, Homo sapiens
tgtctctctcctctga

SEQ ID NO: 40692 - DNA, 21 bp, Homo sapiens
tcagccctaaccccagtgtga

SEQ ID NO: 40693 - DNA, 16 bp, Homo sapiens
tccaaaacctaccact

SEQ ID NO: 40694 - DNA, 17 bp, Homo sapiens
gtctcagcaggatctct

SEQ ID NO: 40695 - DNA, 19 bp, Homo sapiens
cccacccaggttcctgcct

SEQ ID NO: 40696 - DNA, 20 bp, Homo sapiens
gacggctcaggaactgggaa

SEQ ID NO: 40697 - DNA, 22 bp, Homo sapiens
agagcaagcaaagcgaccctga

SEQ ID NO: 40698 - DNA, 15 bp, Homo sapiens
tggatctggcctggc

SEQ ID NO: 40699 - DNA, 22 bp, Homo sapiens
tgggttgacgtgcatggagctg

SEQ ID NO: 40700 - DNA, 21 bp, Homo sapiens
tggtgacaccaggtctgtcca

SEQ ID NO: 40701 - DNA, 17 bp, Homo sapiens
ttgcagacttctggcct

SEQ ID NO: 40702 - DNA, 21 bp, Homo sapiens
accagaaggaaccagccctgt

SEQ ID NO: 40703 - DNA, 21 bp, Homo sapiens
ccctgcaaatggagacctgtg

SEQ ID NO: 40704 - DNA, 19 bp, Homo sapiens
cctggcacacagtaggagc

SEQ ID NO: 40705 - DNA, 24 bp, Homo sapiens
ctgtaaactaataaatgtgtgttg

SEQ ID NO: 40706 - DNA, 21 bp, Homo sapiens
gcttggagagccatctggtcc

SEQ ID NO: 40707 - DNA, 24 bp, Homo sapiens
ggaaactcaagacggcggcctggc

SEQ ID NO: 40708 - DNA, 17 bp, Homo sapiens
atcaaacaccctgcatt

SEQ ID NO: 40709 - DNA, 22 bp, Homo sapiens
ccttgatgcccgtgcctgtgaa

SEQ ID NO: 40710 - DNA, 20 bp, Homo sapiens
acatgtgtacacagatctca

SEQ ID NO: 40711 - DNA, 21 bp, Homo sapiens
tctctaggagaaatcccgtca

SEQ ID NO: 40712 - DNA, 20 bp, Homo sapiens
gtgacagcatcatttgagtg

SEQ ID NO: 40713 - DNA, 19 bp, Homo sapiens
aaaaaaaagcacttaatgc

SEQ ID NO: 40714 - DNA, 21 bp, Homo sapiens
gcatgtggcgtgctctgggta

SEQ ID NO: 40715 - DNA, 18 bp, Homo sapiens
ggataccagctcagttcc

SEQ ID NO: 40716 - DNA, 21 bp, Homo sapiens
tcccccatggatgagcccaaa

SEQ ID NO: 40717 - DNA, 18 bp, Homo sapiens
tcggaaggagcccccagg

SEQ ID NO: 40718 - DNA, 24 bp, Homo sapiens
tctcttcgctaggtcctgggtttt

SEQ ID NO: 40719 - DNA, 23 bp, Homo sapiens
cagccctagcatgttgttgcata

SEQ ID NO: 40720 - DNA, 24 bp, Homo sapiens
ccacagaggcggaagaccagcgag

SEQ ID NO: 40721 - DNA, 17 bp, Homo sapiens
gaaccaggagggtggcc

SEQ ID NO: 40722 - DNA, 19 bp, Homo sapiens
ggccgccagaactgcctct

SEQ ID NO: 40723 - DNA, 19 bp, Homo sapiens
gatcggcacacatgtgtga

SEQ ID NO: 40724 - DNA, 20 bp, Homo sapiens
gccaggtccccggggggttc

SEQ ID NO: 40725 - DNA, 18 bp, Homo sapiens
acactccatcttcaccct

SEQ ID NO: 40726 - DNA, 16 bp, Homo sapiens
aggtcagtgaagctca

SEQ ID NO: 40727 - DNA, 21 bp, Homo sapiens
ccctcccccactcccccacct

SEQ ID NO: 40728 - DNA, 20 bp, Homo sapiens
cccttccccacttcacctcc

SEQ ID NO: 40729 - DNA, 19 bp, Homo sapiens
ccttccccacttcacctcc

SEQ ID NO: 40730 - DNA, 19 bp, Homo sapiens
gcttcatgatctcatttta

SEQ ID NO: 40731 - DNA, 21 bp, Homo sapiens
gtgaagctcagtgcagctgca

SEQ ID NO: 40732 - DNA, 22 bp, Homo sapiens
tccatcttcaccctccattcca

SEQ ID NO: 40733 - DNA, 18 bp, Homo sapiens
caacaggagagccacttt

SEQ ID NO: 40734 - DNA, 18 bp, Homo sapiens
ccttggggttttgatcag

SEQ ID NO: 40735 - DNA, 19 bp, Homo sapiens
ctgagtctgggtctgggtc

SEQ ID NO: 40736 - DNA, 17 bp, Homo sapiens
ctgttttgctccatccc

SEQ ID NO: 40737 - DNA, 22 bp, Homo sapiens
gctcctgccaggagctctgaga

SEQ ID NO: 40738 - DNA, 21 bp, Homo sapiens
gcttgggtctgagtctgggtc

SEQ ID NO: 40739 - DNA, 19 bp, Homo sapiens
ggacagggaaagggccacc

SEQ ID NO: 40740 - DNA, 24 bp, Homo sapiens
tgaatgtgagccgatatgcagctg

SEQ ID NO: 40741 - DNA, 20 bp, Homo sapiens
ctgagatcctcctctgccct

SEQ ID NO: 40742 - DNA, 19 bp, Homo sapiens
gctacaggatgaacagtga

SEQ ID NO: 40743 - DNA, 19 bp, Homo sapiens
ggccgggtgcggtggctca

SEQ ID NO: 40744 - DNA, 17 bp, Homo sapiens
gtaaaatctggaaaagg

SEQ ID NO: 40745 - DNA, 19 bp, Homo sapiens
atatgatacaccagagctg

SEQ ID NO: 40746 - DNA, 19 bp, Homo sapiens
cctgacagtcccttggttc

SEQ ID NO: 40747 - DNA, 26 bp, Homo sapiens
ctcagcaggcacaggaagcgctgcca

SEQ ID NO: 40748 - DNA, 17 bp, Homo sapiens
gacaattctgccttcaa

SEQ ID NO: 40749 - DNA, 20 bp, Homo sapiens
gcttcctgtacatttcctca

SEQ ID NO: 40750 - DNA, 23 bp, Homo sapiens
tcctcttctcctacaaatacctc

SEQ ID NO: 40751 - DNA, 23 bp, Homo sapiens
ttcatgatgcttctagcattgga

SEQ ID NO: 40752 - DNA, 18 bp, Homo sapiens
catggtaaaacatttaac

SEQ ID NO: 40753 - DNA, 18 bp, Homo sapiens
cccacaacctccgcctcc

SEQ ID NO: 40754 - DNA, 20 bp, Homo sapiens
ctctttctctctttttcctc

SEQ ID NO: 40755 - DNA, 17 bp, Homo sapiens
gacccgaaatgaggcta

SEQ ID NO: 40756 - DNA, 22 bp, Homo sapiens
gcctgatggtgactgttggttt

SEQ ID NO: 40757 - DNA, 19 bp, Homo sapiens
ttgtttaactgcactggct

SEQ ID NO: 40758 - DNA, 24 bp, Homo sapiens
tttaagtagtcttactttttattt

SEQ ID NO: 40759 - DNA, 18 bp, Homo sapiens
ccccgccccacccccgca

SEQ ID NO: 40760 - DNA, 20 bp, Homo sapiens
tggcccagctcttaggccaa

SEQ ID NO: 40761 - DNA, 20 bp, Homo sapiens
tggctgtggtcctgcagcaa

SEQ ID NO: 40762 - DNA, 19 bp, Homo sapiens
cgtggtgtctctgatctcc

SEQ ID NO: 40763 - DNA, 18 bp, Homo sapiens
ctgaaagtacactctttt

SEQ ID NO: 40764 - DNA, 23 bp, Homo sapiens
acacaggagggctgctaatcaca

SEQ ID NO: 40765 - DNA, 22 bp, Homo sapiens
tacacaggagggctgctaatca

SEQ ID NO: 40766 - DNA, 17 bp, Homo sapiens
agaaaagaaagcaaacg

SEQ ID NO: 40767 - DNA, 19 bp, Homo sapiens
ctgcaacctccacctctca

SEQ ID NO: 40768 - DNA, 22 bp, Homo sapiens
cttgagctacttagtcactttt

SEQ ID NO: 40769 - DNA, 18 bp, Homo sapiens
tccacctctcaggttcaa

SEQ ID NO: 40770 - DNA, 21 bp, Homo sapiens
aatacaaaaagtatgtttgta

SEQ ID NO: 40771 - DNA, 23 bp, Homo sapiens
acagcgctgcctgcaaaatagac

SEQ ID NO: 40772 - DNA, 17 bp, Homo sapiens
gctccttaacaccaaca

SEQ ID NO: 40773 - DNA, 18 bp, Homo sapiens
gtgactagactcatttcc

SEQ ID NO: 40774 - DNA, 19 bp, Homo sapiens
tcaccaccacaccatgcca

SEQ ID NO: 40775 - DNA, 20 bp, Homo sapiens
tcaccatgtccttaaaccat

SEQ ID NO: 40776 - DNA, 23 bp, Homo sapiens
gcctggaccgttggagtgggtcc

SEQ ID NO: 40777 - DNA, 17 bp, Homo sapiens
caggcctcctctccccc

SEQ ID NO: 40778 - DNA, 20 bp, Homo sapiens
cgcttctagcccctctctca

SEQ ID NO: 40779 - DNA, 20 bp, Homo sapiens
ctggttctctccattcctcc

SEQ ID NO: 40780 - DNA, 21 bp, Homo sapiens
agctcctcctgcagctcaaca

SEQ ID NO: 40781 - DNA, 22 bp, Homo sapiens
ttgaatgtaacttcctcactca

SEQ ID NO: 40782 - DNA, 22 bp, Homo sapiens
caaaggattaataattaaccta

SEQ ID NO: 40783 - DNA, 24 bp, Homo sapiens
ccttcccctgtgcccttcgcccca

SEQ ID NO: 40784 - DNA, 21 bp, Homo sapiens
gcttgagtcgtgagggcctgg

SEQ ID NO: 40785 - DNA, 19 bp, Homo sapiens
tgccggacctggtggggag

SEQ ID NO: 40786 - DNA, 22 bp, Homo sapiens
aggaaaccccatcaaggaccga

SEQ ID NO: 40787 - DNA, 24 bp, Homo sapiens
tccagtgagcctccttcaactcct

SEQ ID NO: 40788 - DNA, 19 bp, Homo sapiens
cacacgcaggtgtgcaagg

SEQ ID NO: 40789 - DNA, 24 bp, Homo sapiens
ccctggtgacaccttgatcttgga

SEQ ID NO: 40790 - DNA, 18 bp, Homo sapiens
ccgtggaagagttgtctt

SEQ ID NO: 40791 - DNA, 21 bp, Homo sapiens
ctgtaggacacacacacacac

SEQ ID NO: 40792 - DNA, 19 bp, Homo sapiens
ctgtctcatcactgccaga

SEQ ID NO: 40793 - DNA, 19 bp, Homo sapiens
gcacgtgcgcacacacaca

SEQ ID NO: 40794 - DNA, 21 bp, Homo sapiens
gccccagctgttgcctggctt

SEQ ID NO: 40795 - DNA, 20 bp, Homo sapiens
gtcacccggcagcaaacacg

SEQ ID NO: 40796 - DNA, 16 bp, Homo sapiens
acaagtgatcaaacct

SEQ ID NO: 40797 - DNA, 18 bp, Homo sapiens
caccattctcctgcctca

SEQ ID NO: 40798 - DNA, 20 bp, Homo sapiens
aggctctgaagcactcccca

SEQ ID NO: 40799 - DNA, 17 bp, Homo sapiens
caggttcaatgacttgc

SEQ ID NO: 40800 - DNA, 19 bp, Homo sapiens
ccagctgagcccctccttt

SEQ ID NO: 40801 - DNA, 21 bp, Homo sapiens
cctcttcacctcatgctgtct

SEQ ID NO: 40802 - DNA, 19 bp, Homo sapiens
ctttgcaacaacctaccca

SEQ ID NO: 40803 - DNA, 22 bp, Homo sapiens
gcacaaggtcacatagctttta

SEQ ID NO: 40804 - DNA, 18 bp, Homo sapiens
gtaagtttataagaggag

SEQ ID NO: 40805 - DNA, 21 bp, Homo sapiens
tcagttcctttctctgttcct

SEQ ID NO: 40806 - DNA, 20 bp, Homo sapiens
tggttttctcttaggtccaa

SEQ ID NO: 40807 - DNA, 17 bp, Homo sapiens
caaatgccccacggtag

SEQ ID NO: 40808 - DNA, 23 bp, Homo sapiens
cgcggggtgccgcagctccacca

SEQ ID NO: 40809 - DNA, 17 bp, Homo sapiens
ctggggtgtgactttga

SEQ ID NO: 40810 - DNA, 23 bp, Homo sapiens
gcttgagccgccgggccttgtcc

SEQ ID NO: 40811 - DNA, 21 bp, Homo sapiens
tggatgggccccaccgcgggg

SEQ ID NO: 40812 - DNA, 19 bp, Homo sapiens
actgaggatgaactgtgtt

SEQ ID NO: 40813 - DNA, 21 bp, Homo sapiens
cccactttccagaccattcca

SEQ ID NO: 40814 - DNA, 25 bp, Homo sapiens
ctgtgttttgcagcattttgtttta

SEQ ID NO: 40815 - DNA, 21 bp, Homo sapiens
tcctggcaggaggacctggag

SEQ ID NO: 40816 - DNA, 24 bp, Homo sapiens
gacagaccatgattaggtctgtca

SEQ ID NO: 40817 - DNA, 18 bp, Homo sapiens
tcaccccatggcttccca

SEQ ID NO: 40818 - DNA, 24 bp, Homo sapiens
tgctgtctacaggagctcatccca

SEQ ID NO: 40819 - DNA, 20 bp, Homo sapiens
ttgaaacccagatttacctc

SEQ ID NO: 40820 - DNA, 16 bp, Homo sapiens
aggcaatgaattactt

SEQ ID NO: 40821 - DNA, 20 bp, Homo sapiens
ccgtgttttggtcaaacgta

SEQ ID NO: 40822 - DNA, 19 bp, Homo sapiens
cctgtatcatgaaaactga

SEQ ID NO: 40823 - DNA, 19 bp, Homo sapiens
tatcgtgcatgttcgtggt

SEQ ID NO: 40824 - DNA, 23 bp, Homo sapiens
tgtaccatatgtgaaacattctg

SEQ ID NO: 40825 - DNA, 19 bp, Homo sapiens
aatttcgcagaatgtgata

SEQ ID NO: 40826 - DNA, 19 bp, Homo sapiens
cattaaacaggggtagcgt

SEQ ID NO: 40827 - DNA, 22 bp, Homo sapiens
gcgctgtgacccttctgcctcc

SEQ ID NO: 40828 - DNA, 21 bp, Homo sapiens
tctttttcaccttttcttgta

SEQ ID NO: 40829 - DNA, 19 bp, Homo sapiens
tttcctcttaaaacgggtg

SEQ ID NO: 40830 - DNA, 21 bp, Homo sapiens
accatcatgtcttcctttgtg

SEQ ID NO: 40831 - DNA, 19 bp, Homo sapiens
cacttccctccccaagtaa

SEQ ID NO: 40832 - DNA, 18 bp, Homo sapiens
tatatgcatttgtctatg

SEQ ID NO: 40833 - DNA, 17 bp, Homo sapiens
accgtggcctctggttt

SEQ ID NO: 40834 - DNA, 24 bp, Homo sapiens
ctccgtggtgtaatgaagtcccag

SEQ ID NO: 40835 - DNA, 23 bp, Homo sapiens
ctttacttggttgccataatttt

SEQ ID NO: 40836 - DNA, 19 bp, Homo sapiens
gctatgtgcaaatgtagta

SEQ ID NO: 40837 - DNA, 15 bp, Homo sapiens
taccagtgtcagata

SEQ ID NO: 40838 - DNA, 17 bp, Homo sapiens
tgttaataagagcattg

SEQ ID NO: 40839 - DNA, 21 bp, Homo sapiens
ccgcctccgccaggcctcctg

SEQ ID NO: 40840 - DNA, 20 bp, Homo sapiens
ttgcgtggaaaagtatctgt

SEQ ID NO: 40841 - DNA, 24 bp, Homo sapiens
tttccaaaccaggattccttacta

SEQ ID NO: 40842 - DNA, 17 bp, Homo sapiens
caatcctctgaccactg

SEQ ID NO: 40843 - DNA, 23 bp, Homo sapiens
cctgggccagttgatttgacctt

SEQ ID NO: 40844 - DNA, 23 bp, Homo sapiens
cctcttcgtcactccctggcttt

SEQ ID NO: 40845 - DNA, 16 bp, Homo sapiens
gctttggctgttttgt

SEQ ID NO: 40846 - DNA, 18 bp, Homo sapiens
gctttggctgttttgtct

SEQ ID NO: 40847 - DNA, 24 bp, Homo sapiens
ccactgctgggtatctgtcagcaa

SEQ ID NO: 40848 - DNA, 20 bp, Homo sapiens
tcccactgctgggtatctgt

SEQ ID NO: 40849 - DNA, 23 bp, Homo sapiens
aatggtatctaactctgttcctt

SEQ ID NO: 40850 - DNA, 18 bp, Homo sapiens
agaaattgtaacagcatg

SEQ ID NO: 40851 - DNA, 21 bp, Homo sapiens
tctgtactgattgatgtgctt

SEQ ID NO: 40852 - DNA, 25 bp, Homo sapiens
ttagtgtggtctttaagttgctttt

SEQ ID NO: 40853 - DNA, 20 bp, Homo sapiens
caccaccaccatccccctct

SEQ ID NO: 40854 - DNA, 22 bp, Homo sapiens
cgcctcctgggcaagctcccca

SEQ ID NO: 40855 - DNA, 19 bp, Homo sapiens
tccagaagctggactgcag

SEQ ID NO: 40856 - DNA, 18 bp, Homo sapiens
tcccatacatctgtccaa

SEQ ID NO: 40857 - DNA, 23 bp, Homo sapiens
atgctgagtgtggccgcgcctta

SEQ ID NO: 40858 - DNA, 24 bp, Homo sapiens
ctcccacccctcctccccgcgcca

SEQ ID NO: 40859 - DNA, 21 bp, Homo sapiens
tgcccctgggctcccatctct

SEQ ID NO: 40860 - DNA, 24 bp, Homo sapiens
aagagaggcaagagaaagctctgg

SEQ ID NO: 40861 - DNA, 19 bp, Homo sapiens
gggaggtggtggccacggc

SEQ ID NO: 40862 - DNA, 20 bp, Homo sapiens
aaataacttttgtgtttatt

SEQ ID NO: 40863 - DNA, 22 bp, Homo sapiens
gattgttttgtgaaacttttaa

SEQ ID NO: 40864 - DNA, 21 bp, Homo sapiens
ttaacttattccatttattta

SEQ ID NO: 40865 - DNA, 25 bp, Homo sapiens
cactcctgacctcagactcacttcc

SEQ ID NO: 40866 - DNA, 17 bp, Homo sapiens
ccccactcctgacctca

SEQ ID NO: 40867 - DNA, 15 bp, Homo sapiens
aggattatatcttga

SEQ ID NO: 40868 - DNA, 20 bp, Homo sapiens
tgcccatggtgtcctcaagc

SEQ ID NO: 40869 - DNA, 22 bp, Homo sapiens
cgcagagcaagggcggcaagga

SEQ ID NO: 40870 - DNA, 19 bp, Homo sapiens
aagcaattctcctgcctca

SEQ ID NO: 40871 - DNA, 21 bp, Homo sapiens
agaaataatcttgctctgtca

SEQ ID NO: 40872 - DNA, 17 bp, Homo sapiens
aggaaataatgattggc

SEQ ID NO: 40873 - DNA, 18 bp, Homo sapiens
cctcctcctctttcttca

SEQ ID NO: 40874 - DNA, 21 bp, Homo sapiens
ccttttcatagagcgctgttt

SEQ ID NO: 40875 - DNA, 19 bp, Homo sapiens
ctttcttttaaaagaggta

SEQ ID NO: 40876 - DNA, 19 bp, Homo sapiens
gactttggctgtttaatca

SEQ ID NO: 40877 - DNA, 26 bp, Homo sapiens
gccctctcctctaacctataaactga

SEQ ID NO: 40878 - DNA, 23 bp, Homo sapiens
gcttcccttttctcctctcctct

SEQ ID NO: 40879 - DNA, 24 bp, Homo sapiens
tatttatagatatattctatgaga

SEQ ID NO: 40880 - DNA, 16 bp, Homo sapiens
ttgagtcataagtacc

SEQ ID NO: 40881 - DNA, 19 bp, Homo sapiens
cggatccaaggtcctgcct

SEQ ID NO: 40882 - DNA, 24 bp, Homo sapiens
tgggtggactccagcctccccagc

SEQ ID NO: 40883 - DNA, 20 bp, Homo sapiens
aaggatcacctcacttcctg

SEQ ID NO: 40884 - DNA, 21 bp, Homo sapiens
aacatatgaatattcacacca

SEQ ID NO: 40885 - DNA, 20 bp, Homo sapiens
tctgtctttcccatgagcct

SEQ ID NO: 40886 - DNA, 22 bp, Homo sapiens
cctgggcatttcaagtgctttt

SEQ ID NO: 40887 - DNA, 19 bp, Homo sapiens
taccagctactgtgccaga

SEQ ID NO: 40888 - DNA, 26 bp, Homo sapiens
tccaccgacacctgcttcttccctca

SEQ ID NO: 40889 - DNA, 18 bp, Homo sapiens
aatcacatcctctctcct

SEQ ID NO: 40890 - DNA, 24 bp, Homo sapiens
gacaaagaggcctcttccaaccca

SEQ ID NO: 40891 - DNA, 17 bp, Homo sapiens
tccattctatgcacctc

SEQ ID NO: 40892 - DNA, 19 bp, Homo sapiens
cacgggtctgacacgtctg

SEQ ID NO: 40893 - DNA, 18 bp, Homo sapiens
gcaagaaggtagggttgc

SEQ ID NO: 40894 - DNA, 23 bp, Homo sapiens
ctctgtagtgtgagggtctgtgg

SEQ ID NO: 40895 - DNA, 23 bp, Homo sapiens
tgcttggcaatgctctccatctc

SEQ ID NO: 40896 - DNA, 18 bp, Homo sapiens
cctctgtgaaaggagtta

SEQ ID NO: 40897 - DNA, 23 bp, Homo sapiens
gtattaacattctccatctaata

SEQ ID NO: 40898 - DNA, 17 bp, Homo sapiens
tcagcaagccttggttg

SEQ ID NO: 40899 - DNA, 17 bp, Homo sapiens
ggtcgcgcggtacctgc

SEQ ID NO: 40900 - DNA, 18 bp, Homo sapiens
tccccggactccggccag

SEQ ID NO: 40901 - DNA, 21 bp, Homo sapiens
acacactcaaattctttaatc

SEQ ID NO: 40902 - DNA, 23 bp, Homo sapiens
cactgagtacctaccatgtgcca

SEQ ID NO: 40903 - DNA, 25 bp, Homo sapiens
cctggcactatgatccagttgctgc

SEQ ID NO: 40904 - DNA, 21 bp, Homo sapiens
ctcccaaaggcagcccaccac

SEQ ID NO: 40905 - DNA, 24 bp, Homo sapiens
aaatgtagatgcctccatgagttc

SEQ ID NO: 40906 - DNA, 20 bp, Homo sapiens
agaagggatgaatgttaagc

SEQ ID NO: 40907 - DNA, 18 bp, Homo sapiens
agtaagatgcatttcaca

SEQ ID NO: 40908 - DNA, 21 bp, Homo sapiens
catggtaagaaaggaatgcaa

SEQ ID NO: 40909 - DNA, 18 bp, Homo sapiens
gttttacctttttgctta

SEQ ID NO: 40910 - DNA, 21 bp, Homo sapiens
tttgtttgtttcctttgtggt

SEQ ID NO: 40911 - DNA, 19 bp, Homo sapiens
tggatgcccagggcgctga

SEQ ID NO: 40912 - DNA, 19 bp, Homo sapiens
tgggtgggctctgccagag

SEQ ID NO: 40913 - DNA, 20 bp, Homo sapiens
tggtcaggctggtcttgaac

SEQ ID NO: 40914 - DNA, 17 bp, Homo sapiens
acagaagggcgccaagc

SEQ ID NO: 40915 - DNA, 24 bp, Homo sapiens
actgaggtgtgactgtttggaccc

SEQ ID NO: 40916 - DNA, 20 bp, Homo sapiens
attgcagaaaataacattgt

SEQ ID NO: 40917 - DNA, 21 bp, Homo sapiens
caaccccagctctctctgctc

SEQ ID NO: 40918 - DNA, 17 bp, Homo sapiens
gacctggctcctggctt

SEQ ID NO: 40919 - DNA, 21 bp, Homo sapiens
gctttttttgccactctgata

SEQ ID NO: 40920 - DNA, 18 bp, Homo sapiens
gtctcctggaagcagagc

SEQ ID NO: 40921 - DNA, 16 bp, Homo sapiens
tcaagacttcctccag

SEQ ID NO: 40922 - DNA, 17 bp, Homo sapiens
agcctctgtaatcatgt

SEQ ID NO: 40923 - DNA, 22 bp, Homo sapiens
catgcgttgtgggagggaccca

SEQ ID NO: 40924 - DNA, 20 bp, Homo sapiens
gtgacttgctcctcattgcc

SEQ ID NO: 40925 - DNA, 20 bp, Homo sapiens
tcctgattctgaggctttgg

SEQ ID NO: 40926 - DNA, 25 bp, Homo sapiens
tctctgcacaagctgtctttgtctt

SEQ ID NO: 40927 - DNA, 24 bp, Homo sapiens
tgggtggaatgatagggtttggtt

SEQ ID NO: 40928 - DNA, 19 bp, Homo sapiens
tgtctctttggcgaaccct

SEQ ID NO: 40929 - DNA, 17 bp, Homo sapiens
agcctctgtaatcatgt

SEQ ID NO: 40930 - DNA, 22 bp, Homo sapiens
catgcgttgtgggagggaccca

SEQ ID NO: 40931 - DNA, 20 bp, Homo sapiens
gtgacttgctcctcattgcc

SEQ ID NO: 40932 - DNA, 20 bp, Homo sapiens
tcctgattctgagactttgg

SEQ ID NO: 40933 - DNA, 25 bp, Homo sapiens
tctctgcacaagctgtctttgtctt

SEQ ID NO: 40934 - DNA, 24 bp, Homo sapiens
tgggtggaatgatagggtttggtt

SEQ ID NO: 40935 - DNA, 25 bp, Homo sapiens
aaagtaatgtcgtattatttcccca

SEQ ID NO: 40936 - DNA, 18 bp, Homo sapiens
caccaccgcctccgctct

SEQ ID NO: 40937 - DNA, 21 bp, Homo sapiens
cattcatggaacttattagtg

SEQ ID NO: 40938 - DNA, 18 bp, Homo sapiens
ccaccaccgcctccgctc

SEQ ID NO: 40939 - DNA, 21 bp, Homo sapiens
ctcatgtcatcctcctctatc

SEQ ID NO: 40940 - DNA, 20 bp, Homo sapiens
ggaacgagcaatgattgcca

SEQ ID NO: 40941 - DNA, 22 bp, Homo sapiens
tattccagaagctcttttctga

SEQ ID NO: 40942 - DNA, 22 bp, Homo sapiens
ccctctgacgggagatctgggg

SEQ ID NO: 40943 - DNA, 22 bp, Homo sapiens
aactcatttgggcaaaactcaa

SEQ ID NO: 40944 - DNA, 25 bp, Homo sapiens
cctttttgtgtggtgcccttggttt

SEQ ID NO: 40945 - DNA, 25 bp, Homo sapiens
aagagctattcccccgagtccacca

SEQ ID NO: 40946 - DNA, 16 bp, Homo sapiens
gtgggccaggatggca

SEQ ID NO: 40947 - DNA, 22 bp, Homo sapiens
tgggtgggccaggatggcactg

SEQ ID NO: 40948 - DNA, 18 bp, Homo sapiens
acacgagcactctgggtg

SEQ ID NO: 40949 - DNA, 23 bp, Homo sapiens
ccttcaaaacatactcatctcca

SEQ ID NO: 40950 - DNA, 18 bp, Homo sapiens
gagtggagtatggggctg

SEQ ID NO: 40951 - DNA, 19 bp, Homo sapiens
taaaaacatcgtgaatgaa

SEQ ID NO: 40952 - DNA, 20 bp, Homo sapiens
ttgcatgcttccaagccttc

SEQ ID NO: 40953 - DNA, 22 bp, Homo sapiens
atctcggctcactgcgacctct

SEQ ID NO: 40954 - DNA, 21 bp, Homo sapiens
ccttaatgaaacagtatccaa

SEQ ID NO: 40955 - DNA, 21 bp, Homo sapiens
tcctccaaaccaaatacagca

SEQ ID NO: 40956 - DNA, 25 bp, Homo sapiens
acagaggggtccacacccagtgcac

SEQ ID NO: 40957 - DNA, 20 bp, Homo sapiens
cgtctgtgatgtgggcacct

SEQ ID NO: 40958 - DNA, 22 bp, Homo sapiens
ctgtgaccatgaggcccagctg

SEQ ID NO: 40959 - DNA, 21 bp, Homo sapiens
gaagaaatgtccggcattttt

SEQ ID NO: 40960 - DNA, 27 bp, Homo sapiens
tgccacgtctgtgatgtgggcacctca

SEQ ID NO: 40961 - DNA, 26 bp, Homo sapiens
aaaccatttagaaaataccaataacc

SEQ ID NO: 40962 - DNA, 19 bp, Homo sapiens
attgactggatttttccca

SEQ ID NO: 40963 - DNA, 19 bp, Homo sapiens
caactgatgataactgtga

SEQ ID NO: 40964 - DNA, 18 bp, Homo sapiens
ccagtcaacatgaatggg

SEQ ID NO: 40965 - DNA, 19 bp, Homo sapiens
gagtcacagatctgagaaa

SEQ ID NO: 40966 - DNA, 18 bp, Homo sapiens
tgggcattggtatggaat

SEQ ID NO: 40967 - DNA, 19 bp, Homo sapiens
aagccatcaaatctcgtga

SEQ ID NO: 40968 - DNA, 18 bp, Homo sapiens
accgcccccatgattcaa

SEQ ID NO: 40969 - DNA, 18 bp, Homo sapiens
acttgggcctggagtctg

SEQ ID NO: 40970 - DNA, 20 bp, Homo sapiens
ctgctctgggaatgctgctt

SEQ ID NO: 40971 - DNA, 26 bp, Homo sapiens
gcgtcccagaaccacccgctctctct

SEQ ID NO: 40972 - DNA, 19 bp, Homo sapiens
tgggtggggcacatgggac

SEQ ID NO: 40973 - DNA, 22 bp, Homo sapiens
aacacaaaatgtgggcattctg

SEQ ID NO: 40974 - DNA, 24 bp, Homo sapiens
acccaggatgagcaaaaggatccc

SEQ ID NO: 40975 - DNA, 18 bp, Homo sapiens
cctcctactcagcacaca

SEQ ID NO: 40976 - DNA, 19 bp, Homo sapiens
gctgatgctggtgggcttt

SEQ ID NO: 40977 - DNA, 26 bp, Homo sapiens
tctgaatgttgtgtatgtggctgata

SEQ ID NO: 40978 - DNA, 18 bp, Homo sapiens
tctgatttggttttgtgg

SEQ ID NO: 40979 - DNA, 20 bp, Homo sapiens
cgcgcgggcccccgcgctgc

SEQ ID NO: 40980 - DNA, 22 bp, Homo sapiens
acctgaattttatttctggctt

SEQ ID NO: 40981 - DNA, 21 bp, Homo sapiens
gcctgacatggtccctggctc

SEQ ID NO: 40982 - DNA, 22 bp, Homo sapiens
tttctggctttgcctcttacca

SEQ ID NO: 40983 - DNA, 21 bp, Homo sapiens
tttgggtgatcctgattttat

SEQ ID NO: 40984 - DNA, 17 bp, Homo sapiens
acaacgccatccgctcc

SEQ ID NO: 40985 - DNA, 22 bp, Homo sapiens
agggaaatgcaaatcaaaacta

SEQ ID NO: 40986 - DNA, 17 bp, Homo sapiens
gtgtgttggactttcca

SEQ ID NO: 40987 - DNA, 20 bp, Homo sapiens
tataatccagagactgagaa

SEQ ID NO: 40988 - DNA, 19 bp, Homo sapiens
atcaccccctgctacatca

SEQ ID NO: 40989 - DNA, 22 bp, Homo sapiens
acaaaacaaaacaaaaccctca

SEQ ID NO: 40990 - DNA, 17 bp, Homo sapiens
tccctcccaccacccca

SEQ ID NO: 40991 - DNA, 18 bp, Homo sapiens
tgaatttcttctgccagt

SEQ ID NO: 40992 - DNA, 24 bp, Homo sapiens
gccagggaagctgtgaccccagta

SEQ ID NO: 40993 - DNA, 20 bp, Homo sapiens
gccctggcaggcagccaggg

SEQ ID NO: 40994 - DNA, 24 bp, Homo sapiens
tcatcatcatcatcatcctcatcc

SEQ ID NO: 40995 - DNA, 18 bp, Homo sapiens
tgggtggatcacctgagg

SEQ ID NO: 40996 - DNA, 21 bp, Homo sapiens
tgggtggattgcttgagtcta

SEQ ID NO: 40997 - DNA, 22 bp, Homo sapiens
tttcccactggagttctctgaa

SEQ ID NO: 40998 - DNA, 21 bp, Homo sapiens
tgcagtcagccaagatcgtgc

SEQ ID NO: 40999 - DNA, 16 bp, Homo sapiens
actgacaccagtgtgc

SEQ ID NO: 41000 - DNA, 18 bp, Homo sapiens
actgcaacttccacctcc

SEQ ID NO: 41001 - DNA, 18 bp, Homo sapiens
agacagaggtttccccct

SEQ ID NO: 41002 - DNA, 25 bp, Homo sapiens
aggcttttaatcccttaatccctct

SEQ ID NO: 41003 - DNA, 16 bp, Homo sapiens
atttgcctccatccca

SEQ ID NO: 41004 - DNA, 23 bp, Homo sapiens
catttttctccaccccaacttca

SEQ ID NO: 41005 - DNA, 18 bp, Homo sapiens
ccaaaagccacctctgaa

SEQ ID NO: 41006 - DNA, 20 bp, Homo sapiens
cctctgcctcctgggttcaa

SEQ ID NO: 41007 - DNA, 23 bp, Homo sapiens
cgggttcaagcgatcctgcctca

SEQ ID NO: 41008 - DNA, 24 bp, Homo sapiens
ctctggcgataatcaccctgagag

SEQ ID NO: 41009 - DNA, 22 bp, Homo sapiens
gcaagaagagcagcgcctggca

SEQ ID NO: 41010 - DNA, 19 bp, Homo sapiens
ggccaacacacatggccaa

SEQ ID NO: 41011 - DNA, 21 bp, Homo sapiens
tcccatttaataactataata

SEQ ID NO: 41012 - DNA, 20 bp, Homo sapiens
aacgttcacccaacttgtca

SEQ ID NO: 41013 - DNA, 22 bp, Homo sapiens
acagctcagaaaggagaggtga

SEQ ID NO: 41014 - DNA, 23 bp, Homo sapiens
acagtatcagattgagtgagctt

SEQ ID NO: 41015 - DNA, 20 bp, Homo sapiens
ccatgctcaggcccacctcc

SEQ ID NO: 41016 - DNA, 22 bp, Homo sapiens
gatcctgggccccaggtggtga

SEQ ID NO: 41017 - DNA, 22 bp, Homo sapiens
tcagttcattgaccagatgaca

SEQ ID NO: 41018 - DNA, 18 bp, Homo sapiens
tggtttctcaacatgagg

SEQ ID NO: 41019 - DNA, 21 bp, Homo sapiens
tgtagcttgtgcctgtgggtg

SEQ ID NO: 41020 - DNA, 19 bp, Homo sapiens
aagcaattctcctgcccca

SEQ ID NO: 41021 - DNA, 18 bp, Homo sapiens
catgcacttctgcagggg

SEQ ID NO: 41022 - DNA, 20 bp, Homo sapiens
cctgccctcccagccacacc

SEQ ID NO: 41023 - DNA, 17 bp, Homo sapiens
tcaagtgattctcctgc

SEQ ID NO: 41024 - DNA, 20 bp, Homo sapiens
tcaccacaacctccacctcc

SEQ ID NO: 41025 - DNA, 18 bp, Homo sapiens
tccacctcccaggttcaa

SEQ ID NO: 41026 - DNA, 18 bp, Homo sapiens
tccatatacagtcacatc

SEQ ID NO: 41027 - DNA, 18 bp, Homo sapiens
atcattataacatcttca

SEQ ID NO: 41028 - DNA, 20 bp, Homo sapiens
tctctacatgaagtctgtgg

SEQ ID NO: 41029 - DNA, 20 bp, Homo sapiens
cgaggccgcctgacgcctca

SEQ ID NO: 41030 - DNA, 20 bp, Homo sapiens
ggcttctgtaggtgctccca

SEQ ID NO: 41031 - DNA, 21 bp, Homo sapiens
tccggctgtcatgtcctgtga

SEQ ID NO: 41032 - DNA, 21 bp, Homo sapiens
ccaggacccaggcccgcctcc

SEQ ID NO: 41033 - DNA, 26 bp, Homo sapiens
ccgcctggctttgggggtcccggagg

SEQ ID NO: 41034 - DNA, 21 bp, Homo sapiens
ctgtggtgcaccgcctggctt

SEQ ID NO: 41035 - DNA, 19 bp, Homo sapiens
tgggatttccgaggcccag

SEQ ID NO: 41036 - DNA, 17 bp, Homo sapiens
tgtttgtattttggtgt

SEQ ID NO: 41037 - DNA, 19 bp, Homo sapiens
tgacgggagatttgctgag

SEQ ID NO: 41038 - DNA, 22 bp, Homo sapiens
caagagtcttgaggttcagtca

SEQ ID NO: 41039 - DNA, 18 bp, Homo sapiens
caagagttgggccaggtt

SEQ ID NO: 41040 - DNA, 18 bp, Homo sapiens
tcattgcttcttggcctt

SEQ ID NO: 41041 - DNA, 17 bp, Homo sapiens
tggatgggtccctgaaa

SEQ ID NO: 41042 - DNA, 18 bp, Homo sapiens
gataaattgtaagtgcta

SEQ ID NO: 41043 - DNA, 18 bp, Homo sapiens
gttcatgatctgcacctg

SEQ ID NO: 41044 - DNA, 21 bp, Homo sapiens
tctgaatatacattatatgaa

SEQ ID NO: 41045 - DNA, 21 bp, Homo sapiens
tgaatgggtattttgtgaaat

SEQ ID NO: 41046 - DNA, 19 bp, Homo sapiens
ttttgataaattgtaagtg

SEQ ID NO: 41047 - DNA, 24 bp, Homo sapiens
atctgagttggccaagccaggctc

SEQ ID NO: 41048 - DNA, 19 bp, Homo sapiens
cttcctctcccctgcctct

SEQ ID NO: 41049 - DNA, 18 bp, Homo sapiens
gggctccagcagaggctg

SEQ ID NO: 41050 - DNA, 19 bp, Homo sapiens
gttatcaaatctcatccaa

SEQ ID NO: 41051 - DNA, 19 bp, Homo sapiens
aaagcaatattctgtgtca

SEQ ID NO: 41052 - DNA, 21 bp, Homo sapiens
agccaagactatgccactgca

SEQ ID NO: 41053 - DNA, 18 bp, Homo sapiens
gctgctgctgtggattct

SEQ ID NO: 41054 - DNA, 21 bp, Homo sapiens
taactgtgttgcatcatcctc

SEQ ID NO: 41055 - DNA, 18 bp, Homo sapiens
tccaacattcatgtaata

SEQ ID NO: 41056 - DNA, 20 bp, Homo sapiens
aacagggcagagcctggctg

SEQ ID NO: 41057 - DNA, 20 bp, Homo sapiens
agggcagagcctggctgtcc

SEQ ID NO: 41058 - DNA, 22 bp, Homo sapiens
ccaagggatgggggtttgggga

SEQ ID NO: 41059 - DNA, 21 bp, Homo sapiens
cccatacctcctcctcccttc

SEQ ID NO: 41060 - DNA, 22 bp, Homo sapiens
gagccaggagagcgccttctct

SEQ ID NO: 41061 - DNA, 19 bp, Homo sapiens
gcccagagctcactctttt

SEQ ID NO: 41062 - DNA, 25 bp, Homo sapiens
agaccccgaggtctgctggattcca

SEQ ID NO: 41063 - DNA, 21 bp, Homo sapiens
cccgaggtctgctggattcca

SEQ ID NO: 41064 - DNA, 18 bp, Homo sapiens
tctacctcccaggttcaa

SEQ ID NO: 41065 - DNA, 19 bp, Homo sapiens
aaacataaaccagtacctc

SEQ ID NO: 41066 - DNA, 19 bp, Homo sapiens
aaactcctgacctcaggtg

SEQ ID NO: 41067 - DNA, 18 bp, Homo sapiens
aaggttctaaggttcagt

SEQ ID NO: 41068 - DNA, 23 bp, Homo sapiens
aatattgaatgatgttactttga

SEQ ID NO: 41069 - DNA, 25 bp, Homo sapiens
agtaatttttaaatatttcatctta

SEQ ID NO: 41070 - DNA, 20 bp, Homo sapiens
cagctgccaccctgatctga

SEQ ID NO: 41071 - DNA, 18 bp, Homo sapiens
gacctcacaaacatctca

SEQ ID NO: 41072 - DNA, 25 bp, Homo sapiens
gtcaaaaaaggtttctgcccacgca

SEQ ID NO: 41073 - DNA, 22 bp, Homo sapiens
tacattcatgtttccacccacc

SEQ ID NO: 41074 - DNA, 22 bp, Homo sapiens
tcaaagccagtaattcatagca

SEQ ID NO: 41075 - DNA, 17 bp, Homo sapiens
tcaagtgattctcctgc

SEQ ID NO: 41076 - DNA, 20 bp, Homo sapiens
tgggacctgacttgaaacta

SEQ ID NO: 41077 - DNA, 20 bp, Homo sapiens
aaccttaacatcccctacag

SEQ ID NO: 41078 - DNA, 19 bp, Homo sapiens
acactgccaccaccctgca

SEQ ID NO: 41079 - DNA, 19 bp, Homo sapiens
actgccaccaccctgcaca

SEQ ID NO: 41080 - DNA, 18 bp, Homo sapiens
ctttgaaggaatggtgtt

SEQ ID NO: 41081 - DNA, 24 bp, Homo sapiens
gaaccaggagaagatggttgtggg

SEQ ID NO: 41082 - DNA, 20 bp, Homo sapiens
gatgggattgtcagccacca

SEQ ID NO: 41083 - DNA, 18 bp, Homo sapiens
gcttctgtggatttctat

SEQ ID NO: 41084 - DNA, 18 bp, Homo sapiens
atgtaaacgcccacctta

SEQ ID NO: 41085 - DNA, 18 bp, Homo sapiens
gttttaaataggctttaa

SEQ ID NO: 41086 - DNA, 20 bp, Homo sapiens
ctccccatacctctgtctct

SEQ ID NO: 41087 - DNA, 19 bp, Homo sapiens
ggcagcaagcactaagctg

SEQ ID NO: 41088 - DNA, 18 bp, Homo sapiens
agagaggtgtcaattctg

SEQ ID NO: 41089 - DNA, 17 bp, Homo sapiens
agcagcagcaactagtc

SEQ ID NO: 41090 - DNA, 16 bp, Homo sapiens
catatcccacattctc

SEQ ID NO: 41091 - DNA, 17 bp, Homo sapiens
gacatttcctagtgctt

SEQ ID NO: 41092 - DNA, 17 bp, Homo sapiens
tccaacccataggtcac

SEQ ID NO: 41093 - DNA, 21 bp, Homo sapiens
tccaggttccaatatcaaaca

SEQ ID NO: 41094 - DNA, 22 bp, Homo sapiens
atcccaagtgggcccaaagcta

SEQ ID NO: 41095 - DNA, 24 bp, Homo sapiens
tgagagatgaacatacacatctct

SEQ ID NO: 41096 - DNA, 19 bp, Homo sapiens
actctctgacctcctcacc

SEQ ID NO: 41097 - DNA, 18 bp, Homo sapiens
agccttcaacaatggcac

SEQ ID NO: 41098 - DNA, 22 bp, Homo sapiens
agccttcaacaatggcaccatc

SEQ ID NO: 41099 - DNA, 22 bp, Homo sapiens
ctgtgaatgtataattttgatt

SEQ ID NO: 41100 - DNA, 23 bp, Homo sapiens
gtcatggaaatcccagctatgca

SEQ ID NO: 41101 - DNA, 19 bp, Homo sapiens
tcccctctgtttcccacta

SEQ ID NO: 41102 - DNA, 21 bp, Homo sapiens
tctgaaaatggggccccgtgc

SEQ ID NO: 41103 - DNA, 22 bp, Homo sapiens
tgccatgtcccctctcatccta

SEQ ID NO: 41104 - DNA, 23 bp, Homo sapiens
agctaaggtcagctgttacctca

SEQ ID NO: 41105 - DNA, 16 bp, Homo sapiens
ctttctctctgtctca

SEQ ID NO: 41106 - DNA, 23 bp, Homo sapiens
gactctgggcacccctctcacca

SEQ ID NO: 41107 - DNA, 20 bp, Homo sapiens
gccaccttcaagagcccaga

SEQ ID NO: 41108 - DNA, 19 bp, Homo sapiens
gtctcttggttttgacaga

SEQ ID NO: 41109 - DNA, 19 bp, Homo sapiens
ctgcaagctccgcctccca

SEQ ID NO: 41110 - DNA, 22 bp, Homo sapiens
ttgtgtagtaaaccttactttg

SEQ ID NO: 41111 - DNA, 18 bp, Homo sapiens
agtagtcaaggtgtcaga

SEQ ID NO: 41112 - DNA, 17 bp, Homo sapiens
actgctgtctcaccctc

SEQ ID NO: 41113 - DNA, 20 bp, Homo sapiens
catctggccccacctgctca

SEQ ID NO: 41114 - DNA, 16 bp, Homo sapiens
cccgacttggagggca

SEQ ID NO: 41115 - DNA, 17 bp, Homo sapiens
gctcccagaacaggcac

SEQ ID NO: 41116 - DNA, 18 bp, Homo sapiens
gtggcctccaatacccca

SEQ ID NO: 41117 - DNA, 20 bp, Homo sapiens
tctggtcagggccaggacac

SEQ ID NO: 41118 - DNA, 22 bp, Homo sapiens
tgcacctatgcaacttaacgtg

SEQ ID NO: 41119 - DNA, 19 bp, Homo sapiens
ccagaccctgtggtccctc

SEQ ID NO: 41120 - DNA, 23 bp, Homo sapiens
tgctcccagaatctggtgctctg

SEQ ID NO: 41121 - DNA, 18 bp, Homo sapiens
gaaggaagaattcccccc

SEQ ID NO: 41122 - DNA, 18 bp, Homo sapiens
actagctgcttctagtca

SEQ ID NO: 41123 - DNA, 18 bp, Homo sapiens
ggctccataccaatccca

SEQ ID NO: 41124 - DNA, 21 bp, Homo sapiens
atcttggtgacaaagagccct

SEQ ID NO: 41125 - DNA, 17 bp, Homo sapiens
cctaaaatttccaacaa

SEQ ID NO: 41126 - DNA, 17 bp, Homo sapiens
tcaagtgattctcctgc

SEQ ID NO: 41127 - DNA, 18 bp, Homo sapiens
ttctcctgcctcagcctt

SEQ ID NO: 41128 - DNA, 23 bp, Homo sapiens
cctgggccagttgatttgacctt

SEQ ID NO: 41129 - DNA, 19 bp, Homo sapiens
aggaccgttggttccagtt

SEQ ID NO: 41130 - DNA, 21 bp, Homo sapiens
gggtccttggcgccgtccaca

SEQ ID NO: 41131 - DNA, 17 bp, Homo sapiens
ggtgagcatggccagac

SEQ ID NO: 41132 - DNA, 18 bp, Homo sapiens
tctctccacggcttccgg

SEQ ID NO: 41133 - DNA, 20 bp, Homo sapiens
accgcgtggccacttggctt

SEQ ID NO: 41134 - DNA, 21 bp, Homo sapiens
ccacaaaaagtcattccccca

SEQ ID NO: 41135 - DNA, 17 bp, Homo sapiens
cctgtcccctgcccact

SEQ ID NO: 41136 - DNA, 19 bp, Homo sapiens
ccttggataaaagatttgc

SEQ ID NO: 41137 - DNA, 17 bp, Homo sapiens
ggactccaacgtgggct

SEQ ID NO: 41138 - DNA, 21 bp, Homo sapiens
tctggctgaatatccactgga

SEQ ID NO: 41139 - DNA, 24 bp, Homo sapiens
accgctcaactacatggaaaccga

SEQ ID NO: 41140 - DNA, 22 bp, Homo sapiens
acctttgctagctgcctggtcc

SEQ ID NO: 41141 - DNA, 22 bp, Homo sapiens
cagcagtgtggctcaggtgcca

SEQ ID NO: 41142 - DNA, 19 bp, Homo sapiens
cccccaaccttccacctca

SEQ ID NO: 41143 - DNA, 19 bp, Homo sapiens
ctgctcccttcacctttga

SEQ ID NO: 41144 - DNA, 24 bp, Homo sapiens
gaggcctagacggcacatgccata

SEQ ID NO: 41145 - DNA, 18 bp, Homo sapiens
tccagaaaatgaaattcc

SEQ ID NO: 41146 - DNA, 20 bp, Homo sapiens
tgctcccagagcctgagcat

SEQ ID NO: 41147 - DNA, 25 bp, Homo sapiens
ctgctattaggtattgctctcttcc

SEQ ID NO: 41148 - DNA, 24 bp, Homo sapiens
gcctgagcccaccgtgcctggcct

SEQ ID NO: 41149 - DNA, 22 bp, Homo sapiens
aggctgggagggacatactttc

SEQ ID NO: 41150 - DNA, 23 bp, Homo sapiens
acctagcctagaggcggctgcca

SEQ ID NO: 41151 - DNA, 17 bp, Homo sapiens
agagaggctggcatctt

SEQ ID NO: 41152 - DNA, 23 bp, Homo sapiens
gcagcacccagagcttattgtta

SEQ ID NO: 41153 - DNA, 23 bp, Homo sapiens
acctagcctagaggcggctgcca

SEQ ID NO: 41154 - DNA, 23 bp, Homo sapiens
acctagcctagaggcggctgcca

SEQ ID NO: 41155 - DNA, 19 bp, Homo sapiens
acggtgaccgcctcctgct

SEQ ID NO: 41156 - DNA, 18 bp, Homo sapiens
actgctacttgctctgct

SEQ ID NO: 41157 - DNA, 20 bp, Homo sapiens
tcaggcagataactgctgta

SEQ ID NO: 41158 - DNA, 22 bp, Homo sapiens
cagaaaccagccccctcggtga

SEQ ID NO: 41159 - DNA, 21 bp, Homo sapiens
acatcaggaagggcaattccc

SEQ ID NO: 41160 - DNA, 21 bp, Homo sapiens
atgcccagcatgcagaccagg

SEQ ID NO: 41161 - DNA, 17 bp, Homo sapiens
ctgaagcacctttgtga

SEQ ID NO: 41162 - DNA, 22 bp, Homo sapiens
gagccaagaccacaccactgca

SEQ ID NO: 41163 - DNA, 21 bp, Homo sapiens
gtgtctcccctgagcccggtg

SEQ ID NO: 41164 - DNA, 19 bp, Homo sapiens
tagttacagctacttggca

SEQ ID NO: 41165 - DNA, 19 bp, Homo sapiens
tgcccaggccactctccag

SEQ ID NO: 41166 - DNA, 18 bp, Homo sapiens
agaattctggattcctga

SEQ ID NO: 41167 - DNA, 17 bp, Homo sapiens
caggtggcaccttctca

SEQ ID NO: 41168 - DNA, 24 bp, Homo sapiens
ccttggacagggctccttggcctt

SEQ ID NO: 41169 - DNA, 16 bp, Homo sapiens
gaatttcctctggtgc

SEQ ID NO: 41170 - DNA, 19 bp, Homo sapiens
gacaccattcagttcttaa

SEQ ID NO: 41171 - DNA, 18 bp, Homo sapiens
gagattgtgtgcctagca

SEQ ID NO: 41172 - DNA, 16 bp, Homo sapiens
gcctgtccccattttg

SEQ ID NO: 41173 - DNA, 21 bp, Homo sapiens
taggaaatgtcattgctcctt

SEQ ID NO: 41174 - DNA, 20 bp, Homo sapiens
tccagaggagacagtcccag

SEQ ID NO: 41175 - DNA, 22 bp, Homo sapiens
tcccgggtgctgacagcaagct

SEQ ID NO: 41176 - DNA, 19 bp, Homo sapiens
tggcctggacttctctttg

SEQ ID NO: 41177 - DNA, 22 bp, Homo sapiens
tttttttggctctctggacttt

SEQ ID NO: 41178 - DNA, 25 bp, Homo sapiens
atgaatgcacggccgtcgctccgtc

SEQ ID NO: 41179 - DNA, 20 bp, Homo sapiens
gacctcccccgtggctcctt

SEQ ID NO: 41180 - DNA, 23 bp, Homo sapiens
atctttgtcaatctccccacttt

SEQ ID NO: 41181 - DNA, 20 bp, Homo sapiens
ccaataatcttatccactcc

SEQ ID NO: 41182 - DNA, 17 bp, Homo sapiens
cggcactccagcctggc

SEQ ID NO: 41183 - DNA, 22 bp, Homo sapiens
tgaatgcactttgatgtgagac

SEQ ID NO: 41184 - DNA, 24 bp, Homo sapiens
aaacacccctaggctgtggaagca

SEQ ID NO: 41185 - DNA, 20 bp, Homo sapiens
aaagcccccgagacctccca

SEQ ID NO: 41186 - DNA, 22 bp, Homo sapiens
actttgtgatgggcttctctca

SEQ ID NO: 41187 - DNA, 20 bp, Homo sapiens
cagaagccagttgtcagcta

SEQ ID NO: 41188 - DNA, 17 bp, Homo sapiens
cctccagggttgcacca

SEQ ID NO: 41189 - DNA, 21 bp, Homo sapiens
gcaggtggcccacacatgtgc

SEQ ID NO: 41190 - DNA, 23 bp, Homo sapiens
ggttgtgtaaaagcctgtggcac

SEQ ID NO: 41191 - DNA, 20 bp, Homo sapiens
tctgagcaatccttttgctt

SEQ ID NO: 41192 - DNA, 19 bp, Homo sapiens
tctgctgacgatgaggcag

SEQ ID NO: 41193 - DNA, 16 bp, Homo sapiens
tgcattacatattcca

SEQ ID NO: 41194 - DNA, 17 bp, Homo sapiens
tgtaaatcaatgttttg

SEQ ID NO: 41195 - DNA, 20 bp, Homo sapiens
accattattctcatcaccat

SEQ ID NO: 41196 - DNA, 21 bp, Homo sapiens
acctgcgaaagaaagcccaca

SEQ ID NO: 41197 - DNA, 18 bp, Homo sapiens
catcatcaccatcaccat

SEQ ID NO: 41198 - DNA, 19 bp, Homo sapiens
cgcccgagtccacagacaa

SEQ ID NO: 41199 - DNA, 24 bp, Homo sapiens
tcatcaccatcaccgtcaccgtca

SEQ ID NO: 41200 - DNA, 22 bp, Homo sapiens
cacatgcgcgcacacacacagg

SEQ ID NO: 41201 - DNA, 20 bp, Homo sapiens
ctctcagagcctctgcttct

SEQ ID NO: 41202 - DNA, 17 bp, Homo sapiens
gttcccagggtgagtgg

SEQ ID NO: 41203 - DNA, 18 bp, Homo sapiens
ttgccccccaccacccca

SEQ ID NO: 41204 - DNA, 21 bp, Homo sapiens
ctgggtatggagggtcttgag

SEQ ID NO: 41205 - DNA, 21 bp, Homo sapiens
gcctgggtctaagccaggtct

SEQ ID NO: 41206 - DNA, 23 bp, Homo sapiens
aaaatattttcaaagtgaagctg

SEQ ID NO: 41207 - DNA, 18 bp, Homo sapiens
aggactaccattgacctc

SEQ ID NO: 41208 - DNA, 21 bp, Homo sapiens
gccattgattttggtgaccca

SEQ ID NO: 41209 - DNA, 18 bp, Homo sapiens
gcctggagtctcaggtgg

SEQ ID NO: 41210 - DNA, 21 bp, Homo sapiens
tcgctggtcctttttctttcc

SEQ ID NO: 41211 - DNA, 19 bp, Homo sapiens
tttcgatgtcaatcatcac

SEQ ID NO: 41212 - DNA, 23 bp, Homo sapiens
acttggattaaacatgtctgcct

SEQ ID NO: 41213 - DNA, 20 bp, Homo sapiens
tagattgaacacatggaatg

SEQ ID NO: 41214 - DNA, 17 bp, Homo sapiens
aaacacagaaggcggtg

SEQ ID NO: 41215 - DNA, 23 bp, Homo sapiens
atttgggctctgacatctggcct

SEQ ID NO: 41216 - DNA, 19 bp, Homo sapiens
cacaatggcaagtgtctta

SEQ ID NO: 41217 - DNA, 23 bp, Homo sapiens
caccatcgtaccactgcactcca

SEQ ID NO: 41218 - DNA, 19 bp, Homo sapiens
cagaactagaagcaaaacc

SEQ ID NO: 41219 - DNA, 19 bp, Homo sapiens
ccctaaacctcagactctt

SEQ ID NO: 41220 - DNA, 24 bp, Homo sapiens
cgtgttcactttgaaaacacgtca

SEQ ID NO: 41221 - DNA, 21 bp, Homo sapiens
ctctttctctctctctctctc

SEQ ID NO: 41222 - DNA, 21 bp, Homo sapiens
ggtgcgttaagaaggcatgtc

SEQ ID NO: 41223 - DNA, 21 bp, Homo sapiens
taaacctcagactcttccagc

SEQ ID NO: 41224 - DNA, 19 bp, Homo sapiens
tacaactcccaccccacca

SEQ ID NO: 41225 - DNA, 18 bp, Homo sapiens
tcattgttgttttaattt

SEQ ID NO: 41226 - DNA, 17 bp, Homo sapiens
tcatttccacctgcaaa

SEQ ID NO: 41227 - DNA, 23 bp, Homo sapiens
acacaggacccctcagcacactg

SEQ ID NO: 41228 - DNA, 17 bp, Homo sapiens
agcttaatgtatctgaa

SEQ ID NO: 41229 - DNA, 19 bp, Homo sapiens
caccaacgggtgcatcaca

SEQ ID NO: 41230 - DNA, 18 bp, Homo sapiens
cgagcagggaaactgtgt

SEQ ID NO: 41231 - DNA, 18 bp, Homo sapiens
gctccccatggcactgtt

SEQ ID NO: 41232 - DNA, 17 bp, Homo sapiens
acaattcaagctttcga

SEQ ID NO: 41233 - DNA, 19 bp, Homo sapiens
actttcagagcaattatct

SEQ ID NO: 41234 - DNA, 17 bp, Homo sapiens
ctcaggggacaattcaa

SEQ ID NO: 41235 - DNA, 19 bp, Homo sapiens
gtctaccagggccaacgta

SEQ ID NO: 41236 - DNA, 17 bp, Homo sapiens
aactaaaacaactccat

SEQ ID NO: 41237 - DNA, 23 bp, Homo sapiens
aatgcacaatgggaagaatctta

SEQ ID NO: 41238 - DNA, 19 bp, Homo sapiens
cagtccagccccttactca

SEQ ID NO: 41239 - DNA, 20 bp, Homo sapiens
ccttaatagcataccctcca

SEQ ID NO: 41240 - DNA, 21 bp, Homo sapiens
gcctcagtttcagattctttt

SEQ ID NO: 41241 - DNA, 23 bp, Homo sapiens
ggcgtgagccaccgcgcccggcc

SEQ ID NO: 41242 - DNA, 20 bp, Homo sapiens
tcagtgctgcagcaaatggc

SEQ ID NO: 41243 - DNA, 21 bp, Homo sapiens
tctgtattgagaagttattct

SEQ ID NO: 41244 - DNA, 20 bp, Homo sapiens
ttcaagaccagcctgaccaa

SEQ ID NO: 41245 - DNA, 15 bp, Homo sapiens
aatttcctttcccca

SEQ ID NO: 41246 - DNA, 18 bp, Homo sapiens
catggtcacaggatgcac

SEQ ID NO: 41247 - DNA, 18 bp, Homo sapiens
tccctatgtgaggtttgt

SEQ ID NO: 41248 - DNA, 27 bp, Homo sapiens
tctgtggcaaaatttcagactattttt

SEQ ID NO: 41249 - DNA, 22 bp, Homo sapiens
ttttgggggtgggggttgcgga

SEQ ID NO: 41250 - DNA, 19 bp, Homo sapiens
acaaagcataaacaattta

SEQ ID NO: 41251 - DNA, 19 bp, Homo sapiens
agaaataattatttggtta

SEQ ID NO: 41252 - DNA, 17 bp, Homo sapiens
agggattgaccagagta

SEQ ID NO: 41253 - DNA, 22 bp, Homo sapiens
ataatgaataattttggctgag

SEQ ID NO: 41254 - DNA, 23 bp, Homo sapiens
gccagtcacttttccctcttaga

SEQ ID NO: 41255 - DNA, 18 bp, Homo sapiens
taatgcttcagtagaata

SEQ ID NO: 41256 - DNA, 16 bp, Homo sapiens
tagttctactgcttga

SEQ ID NO: 41257 - DNA, 22 bp, Homo sapiens
tagttctactgcttgattactt

SEQ ID NO: 41258 - DNA, 18 bp, Homo sapiens
tcaccatatgttatttgc

SEQ ID NO: 41259 - DNA, 19 bp, Homo sapiens
tggttttcagatgaaattg

SEQ ID NO: 41260 - DNA, 22 bp, Homo sapiens
tgttttttcttctgcccaggca

SEQ ID NO: 41261 - DNA, 20 bp, Homo sapiens
ttcctcatttataacaggga

SEQ ID NO: 41262 - DNA, 21 bp, Homo sapiens
ttggacctcacaaatcttgta

SEQ ID NO: 41263 - DNA, 21 bp, Homo sapiens
tttctttcctgtcttaaactt

SEQ ID NO: 41264 - DNA, 19 bp, Homo sapiens
ctgctaatggggatggggt

SEQ ID NO: 41265 - DNA, 19 bp, Homo sapiens
ggcattgccaggcctctca

SEQ ID NO: 41266 - DNA, 22 bp, Homo sapiens
taaacaaaaatgtaccttcaca

SEQ ID NO: 41267 - DNA, 18 bp, Homo sapiens
tttacaaaaaccagctca

SEQ ID NO: 41268 - DNA, 21 bp, Homo sapiens
tgaatgtgaccgctgtggttt

SEQ ID NO: 41269 - DNA, 19 bp, Homo sapiens
aaagttgtttttctggcag

SEQ ID NO: 41270 - DNA, 20 bp, Homo sapiens
aggaggtgagggcaatactc

SEQ ID NO: 41271 - DNA, 17 bp, Homo sapiens
cttgtggccatgccgaa

SEQ ID NO: 41272 - DNA, 19 bp, Homo sapiens
taagtgggtcttttaaact

SEQ ID NO: 41273 - DNA, 18 bp, Homo sapiens
tggttgatttttgttgtt

SEQ ID NO: 41274 - DNA, 18 bp, Homo sapiens
ttaaagagaattacctca

SEQ ID NO: 41275 - DNA, 19 bp, Homo sapiens
agtcacctcaccaagcatc

SEQ ID NO: 41276 - DNA, 17 bp, Homo sapiens
atgaaacctatctgatg

SEQ ID NO: 41277 - DNA, 18 bp, Homo sapiens
catgggctattcatcctc

SEQ ID NO: 41278 - DNA, 23 bp, Homo sapiens
cccagaagcaggtcctccagtga

SEQ ID NO: 41279 - DNA, 18 bp, Homo sapiens
ccctccccaaccacctca

SEQ ID NO: 41280 - DNA, 20 bp, Homo sapiens
gagcctttttcccacgcttc

SEQ ID NO: 41281 - DNA, 19 bp, Homo sapiens
gtgtttggagggtgttgtg

SEQ ID NO: 41282 - DNA, 17 bp, Homo sapiens
tgggtttggaaaaagga

SEQ ID NO: 41283 - DNA, 18 bp, Homo sapiens
ttgagtagtctgcatttt

SEQ ID NO: 41284 - DNA, 21 bp, Homo sapiens
ttgtattaccatgggtttgga

SEQ ID NO: 41285 - DNA, 18 bp, Homo sapiens
aggtaaaagactggaacg

SEQ ID NO: 41286 - DNA, 23 bp, Homo sapiens
ccgaagccattagtttaatagca

SEQ ID NO: 41287 - DNA, 19 bp, Homo sapiens
tagagagaccccatctctg

SEQ ID NO: 41288 - DNA, 22 bp, Homo sapiens
tgggtggagagatgtgtaactg

SEQ ID NO: 41289 - DNA, 21 bp, Homo sapiens
aggagggcgagccgattgcca

SEQ ID NO: 41290 - DNA, 18 bp, Homo sapiens
ataccaaggtcatcactg

SEQ ID NO: 41291 - DNA, 20 bp, Homo sapiens
ccgcacgcatagctgcccca

SEQ ID NO: 41292 - DNA, 20 bp, Homo sapiens
acctccacttcctcatttca

SEQ ID NO: 41293 - DNA, 20 bp, Homo sapiens
cctctgcctcctgggttcaa

SEQ ID NO: 41294 - DNA, 21 bp, Homo sapiens
gaatttttaatgtgaactgga

SEQ ID NO: 41295 - DNA, 17 bp, Homo sapiens
tcaagtgattctcctgc

SEQ ID NO: 41296 - DNA, 18 bp, Homo sapiens
caaccctcatctccctcc

SEQ ID NO: 41297 - DNA, 22 bp, Homo sapiens
ctccaagttttgaaggtataat

SEQ ID NO: 41298 - DNA, 21 bp, Homo sapiens
aaatcttcctcaaccaaataa

SEQ ID NO: 41299 - DNA, 16 bp, Homo sapiens
accccgagatcagtgc

SEQ ID NO: 41300 - DNA, 18 bp, Homo sapiens
cagagacggatggtgttt

SEQ ID NO: 41301 - DNA, 19 bp, Homo sapiens
ccagtggccaaagctgaca

SEQ ID NO: 41302 - DNA, 20 bp, Homo sapiens
cgagaatctcatttaacagg

SEQ ID NO: 41303 - DNA, 20 bp, Homo sapiens
tggcctctgatgtgaaagtg

SEQ ID NO: 41304 - DNA, 18 bp, Homo sapiens
gcccaagtgccctcctct

SEQ ID NO: 41305 - DNA, 20 bp, Homo sapiens
cctcctgtcctcagggatca

SEQ ID NO: 41306 - DNA, 18 bp, Homo sapiens
ctacaggctggggtggcc

SEQ ID NO: 41307 - DNA, 22 bp, Homo sapiens
gaaaaccaaccccaccctgcca

SEQ ID NO: 41308 - DNA, 19 bp, Homo sapiens
gggactgctggttgccaac

SEQ ID NO: 41309 - DNA, 17 bp, Homo sapiens
tagcacagtgcttggca

SEQ ID NO: 41310 - DNA, 17 bp, Homo sapiens
cgcagccccaccgccct

SEQ ID NO: 41311 - DNA, 21 bp, Homo sapiens
gcgcagagcagggctggcagg

SEQ ID NO: 41312 - DNA, 23 bp, Homo sapiens
gcttctctgctggccccgcgcct

SEQ ID NO: 41313 - DNA, 22 bp, Homo sapiens
cagggcctggctgggtccagcg

SEQ ID NO: 41314 - DNA, 21 bp, Homo sapiens
cctgctgaggaagagttaacc

SEQ ID NO: 41315 - DNA, 19 bp, Homo sapiens
cctggaggccatcatgggc

SEQ ID NO: 41316 - DNA, 17 bp, Homo sapiens
ctaaccgtgttctacct

SEQ ID NO: 41317 - DNA, 22 bp, Homo sapiens
gaggccatcatgggcctggaga

SEQ ID NO: 41318 - DNA, 25 bp, Homo sapiens
tctgtgaaatctgtaacaatggaga

SEQ ID NO: 41319 - DNA, 20 bp, Homo sapiens
aattcacacaaacttacatg

SEQ ID NO: 41320 - DNA, 18 bp, Homo sapiens
atttttcttgctattttt

SEQ ID NO: 41321 - DNA, 18 bp, Homo sapiens
cctgcaacctccacctcc

SEQ ID NO: 41322 - DNA, 24 bp, Homo sapiens
tgaattctctttagcataaagctg

SEQ ID NO: 41323 - DNA, 19 bp, Homo sapiens
tgtaaaatacctctggata

SEQ ID NO: 41324 - DNA, 19 bp, Homo sapiens
tgtaaaatacctctggata

SEQ ID NO: 41325 - DNA, 23 bp, Homo sapiens
tgtgtccttaaactatttctgaa

SEQ ID NO: 41326 - DNA, 23 bp, Homo sapiens
ttctaagctgtcttaattgtcta

SEQ ID NO: 41327 - DNA, 24 bp, Homo sapiens
ttctcattgtgtaggatttgtgaa

SEQ ID NO: 41328 - DNA, 18 bp, Homo sapiens
tttgcccgcctctgcctc

SEQ ID NO: 41329 - DNA, 22 bp, Homo sapiens
cctcttttttgttttcaacttt

SEQ ID NO: 41330 - DNA, 21 bp, Homo sapiens
gccacgcaccggttagtgaga

SEQ ID NO: 41331 - DNA, 22 bp, Homo sapiens
gcctttggccgactgtctgctc

SEQ ID NO: 41332 - DNA, 21 bp, Homo sapiens
tagctttggcacaaagcagca

SEQ ID NO: 41333 - DNA, 16 bp, Homo sapiens
tcaatacatgccccaa

SEQ ID NO: 41334 - DNA, 16 bp, Homo sapiens
ttcataccataactct

SEQ ID NO: 41335 - DNA, 19 bp, Homo sapiens
caagcttctgatcctccca

SEQ ID NO: 41336 - DNA, 21 bp, Homo sapiens
cctgttcatctttcagggctt

SEQ ID NO: 41337 - DNA, 23 bp, Homo sapiens
acacaggtagcatccctctagtc

SEQ ID NO: 41338 - DNA, 21 bp, Homo sapiens
acttcttcatgacaccaaatc

SEQ ID NO: 41339 - DNA, 18 bp, Homo sapiens
gtagtttcaaactctttg

SEQ ID NO: 41340 - DNA, 23 bp, Homo sapiens
tagatgggctttagtaaagactg

SEQ ID NO: 41341 - DNA, 19 bp, Homo sapiens
cggccctcccacggtggac

SEQ ID NO: 41342 - DNA, 20 bp, Homo sapiens
ctgggagcagagaggctgga

SEQ ID NO: 41343 - DNA, 17 bp, Homo sapiens
cttgctccaggtcactt

SEQ ID NO: 41344 - DNA, 25 bp, Homo sapiens
tccaaaaattgtacagatgattcaa

SEQ ID NO: 41345 - DNA, 18 bp, Homo sapiens
tctgctgggctctgcctc

SEQ ID NO: 41346 - DNA, 18 bp, Homo sapiens
caacaggaggccggggaa

SEQ ID NO: 41347 - DNA, 17 bp, Homo sapiens
cctgcaggccaattcaa

SEQ ID NO: 41348 - DNA, 17 bp, Homo sapiens
gaaggcagggtctgctt

SEQ ID NO: 41349 - DNA, 21 bp, Homo sapiens
gcctgccctgattgcctgccc

SEQ ID NO: 41350 - DNA, 18 bp, Homo sapiens
tcagcaggaggagtttgg

SEQ ID NO: 41351 - DNA, 22 bp, Homo sapiens
attagtgatgtgtacacctgca

SEQ ID NO: 41352 - DNA, 20 bp, Homo sapiens
tgaatggcaggatatgaagc

SEQ ID NO: 41353 - DNA, 19 bp, Homo sapiens
aggccacactgccctccca

SEQ ID NO: 41354 - DNA, 20 bp, Homo sapiens
cctctgcctcctgggttcaa

SEQ ID NO: 41355 - DNA, 18 bp, Homo sapiens
cctgcaacctccacctcc

SEQ ID NO: 41356 - DNA, 19 bp, Homo sapiens
ctgcaacctccacctccca

SEQ ID NO: 41357 - DNA, 17 bp, Homo sapiens
ctgcctcatgactccca

SEQ ID NO: 41358 - DNA, 22 bp, Homo sapiens
ggtgaatgtgtgggtgtgtgtg

SEQ ID NO: 41359 - DNA, 21 bp, Homo sapiens
gtgtgtgtgagtgggtatgat

SEQ ID NO: 41360 - DNA, 18 bp, Homo sapiens
tccacctcccaggttcaa

SEQ ID NO: 41361 - DNA, 17 bp, Homo sapiens
ttctcctgccttagcct

SEQ ID NO: 41362 - DNA, 19 bp, Homo sapiens
gtcaccctcacctgtcgca

SEQ ID NO: 41363 - DNA, 19 bp, Homo sapiens
gttggtgagctgttcttcc

SEQ ID NO: 41364 - DNA, 20 bp, Homo sapiens
tcacctgccaggtgaggaca

SEQ ID NO: 41365 - DNA, 19 bp, Homo sapiens
aaggactgccccaccttta

SEQ ID NO: 41366 - DNA, 20 bp, Homo sapiens
cacacttccactccacctca

SEQ ID NO: 41367 - DNA, 24 bp, Homo sapiens
ccccacacttccactccacctcac

SEQ ID NO: 41368 - DNA, 26 bp, Homo sapiens
cctaaactcttctctcccccagcaaa

SEQ ID NO: 41369 - DNA, 19 bp, Homo sapiens
cttttcctagtattgtgag

SEQ ID NO: 41370 - DNA, 21 bp, Homo sapiens
gcccaacatccctttacctct

SEQ ID NO: 41371 - DNA, 20 bp, Homo sapiens
cagggggcttgggtctcgtt

SEQ ID NO: 41372 - DNA, 17 bp, Homo sapiens
ctgtatcagtgcaggga

SEQ ID NO: 41373 - DNA, 23 bp, Homo sapiens
cttgcctttgatgattattctta

SEQ ID NO: 41374 - DNA, 15 bp, Homo sapiens
agtctttttcccaca

SEQ ID NO: 41375 - DNA, 18 bp, Homo sapiens
ccagagagaacaatgtat

SEQ ID NO: 41376 - DNA, 20 bp, Homo sapiens
ccatacagcaaaggagaagc

SEQ ID NO: 41377 - DNA, 20 bp, Homo sapiens
tatgtgctacccttccttca

SEQ ID NO: 41378 - DNA, 21 bp, Homo sapiens
cactccccgcagtccccctga

SEQ ID NO: 41379 - DNA, 20 bp, Homo sapiens
tcaaggactactcatttcca

SEQ ID NO: 41380 - DNA, 19 bp, Homo sapiens
aaacacatatcaagatcca

SEQ ID NO: 41381 - DNA, 17 bp, Homo sapiens
gcaacctcagccaatga

SEQ ID NO: 41382 - DNA, 20 bp, Homo sapiens
ctccctctcgcttctgcctc

SEQ ID NO: 41383 - DNA, 20 bp, Homo sapiens
tttgggaccccgtgcctcct

SEQ ID NO: 41384 - DNA, 19 bp, Homo sapiens
cagagcctcacctgcctca

SEQ ID NO: 41385 - DNA, 16 bp, Homo sapiens
ccatgctcaggtttaa

SEQ ID NO: 41386 - DNA, 16 bp, Homo sapiens
ggcaagaatctgcaat

SEQ ID NO: 41387 - DNA, 21 bp, Homo sapiens
tttcttctgtcccttgacctt

SEQ ID NO: 41388 - DNA, 19 bp, Homo sapiens
accctttctgcagaaagta

SEQ ID NO: 41389 - DNA, 18 bp, Homo sapiens
tgagcacatcacacatca

SEQ ID NO: 41390 - DNA, 19 bp, Homo sapiens
tcaggcctggacagcctca

SEQ ID NO: 41391 - DNA, 16 bp, Homo sapiens
tcccactgcgcccctg

SEQ ID NO: 41392 - DNA, 18 bp, Homo sapiens
atttttttccccattcat

SEQ ID NO: 41393 - DNA, 18 bp, Homo sapiens
ccaaagctcgccatcttg

SEQ ID NO: 41394 - DNA, 20 bp, Homo sapiens
ccaaatgatcttcccacccc

SEQ ID NO: 41395 - DNA, 17 bp, Homo sapiens
ctgacccagggttttga

SEQ ID NO: 41396 - DNA, 19 bp, Homo sapiens
cttgacacactgttactgt

SEQ ID NO: 41397 - DNA, 19 bp, Homo sapiens
tcttgatggtatcatttgc

SEQ ID NO: 41398 - DNA, 17 bp, Homo sapiens
tgtctgccttgggttcc

SEQ ID NO: 41399 - DNA, 19 bp, Homo sapiens
ttgtggaaaaatgtctgtt

SEQ ID NO: 41400 - DNA, 19 bp, Homo sapiens
aactgatgtcaaaaccaga

SEQ ID NO: 41401 - DNA, 23 bp, Homo sapiens
acaccagccccaaaggcaattct

SEQ ID NO: 41402 - DNA, 18 bp, Homo sapiens
accagaaagacattgggc

SEQ ID NO: 41403 - DNA, 21 bp, Homo sapiens
accagagagttcacactaggg

SEQ ID NO: 41404 - DNA, 19 bp, Homo sapiens
atctccaaggtagacctca

SEQ ID NO: 41405 - DNA, 23 bp, Homo sapiens
tcctggccccaaggggcctgtgg

SEQ ID NO: 41406 - DNA, 19 bp, Homo sapiens
ttcactgaccccatctcca

SEQ ID NO: 41407 - DNA, 19 bp, Homo sapiens
gagacacctgggttcagtc

SEQ ID NO: 41408 - DNA, 19 bp, Homo sapiens
gccctggcctagagaccag

SEQ ID NO: 41409 - DNA, 18 bp, Homo sapiens
tctgaccgactaacatct

SEQ ID NO: 41410 - DNA, 18 bp, Homo sapiens
tgggctgatttggaactg

SEQ ID NO: 41411 - DNA, 21 bp, Homo sapiens
aggtctccacgtctgcccagg

SEQ ID NO: 41412 - DNA, 27 bp, Homo sapiens
catggacacaatttccacaacctttca

SEQ ID NO: 41413 - DNA, 22 bp, Homo sapiens
cccagacccagagcgtcacaaa

SEQ ID NO: 41414 - DNA, 18 bp, Homo sapiens
gcaggcgacacgggggta

SEQ ID NO: 41415 - DNA, 19 bp, Homo sapiens
gtgatctggaaatctacca

SEQ ID NO: 41416 - DNA, 18 bp, Homo sapiens
tggccaggtcagaagcat

SEQ ID NO: 41417 - DNA, 17 bp, Homo sapiens
tgtgatctggaaatcta

SEQ ID NO: 41418 - DNA, 23 bp, Homo sapiens
ttgcctcttcctttctcccatca

SEQ ID NO: 41419 - DNA, 18 bp, Homo sapiens
acagtgtaacacttctca

SEQ ID NO: 41420 - DNA, 18 bp, Homo sapiens
ccctccaacctcccccaa

SEQ ID NO: 41421 - DNA, 21 bp, Homo sapiens
gattgatgagtgttcttttaa

SEQ ID NO: 41422 - DNA, 22 bp, Homo sapiens
tatttcatactccccgcttcca

SEQ ID NO: 41423 - DNA, 20 bp, Homo sapiens
tgcactctgatatcagactg

SEQ ID NO: 41424 - DNA, 18 bp, Homo sapiens
tggtgagagcttgtgaac

SEQ ID NO: 41425 - DNA, 18 bp, Homo sapiens
catggcgcagcgtacgta

SEQ ID NO: 41426 - DNA, 17 bp, Homo sapiens
ctgtctcccatcacccc

SEQ ID NO: 41427 - DNA, 18 bp, Homo sapiens
taccctgactctcacctg

SEQ ID NO: 41428 - DNA, 19 bp, Homo sapiens
tagtggaagacacagattc

SEQ ID NO: 41429 - DNA, 22 bp, Homo sapiens
cttcagtctgcctggcgtcaca

SEQ ID NO: 41430 - DNA, 17 bp, Homo sapiens
tcactgccagaattcaa

SEQ ID NO: 41431 - DNA, 24 bp, Homo sapiens
attcttaatgaggtgatataatca

SEQ ID NO: 41432 - DNA, 23 bp, Homo sapiens
ccagatgccaacagccaccattc

SEQ ID NO: 41433 - DNA, 18 bp, Homo sapiens
tctttagggtctacccca

SEQ ID NO: 41434 - DNA, 19 bp, Homo sapiens
tgtcatctaggttaatcca

SEQ ID NO: 41435 - DNA, 18 bp, Homo sapiens
ttgtgtatatataccaca

SEQ ID NO: 41436 - DNA, 20 bp, Homo sapiens
aatgtggcctggccaagctg

SEQ ID NO: 41437 - DNA, 23 bp, Homo sapiens
actccagatctcagactttctca

SEQ ID NO: 41438 - DNA, 19 bp, Homo sapiens
atgctgggacctacggtga

SEQ ID NO: 41439 - DNA, 18 bp, Homo sapiens
ctggccaagctgacgtcc

SEQ ID NO: 41440 - DNA, 23 bp, Homo sapiens
agtttcactttgtataaaagtta

SEQ ID NO: 41441 - DNA, 23 bp, Homo sapiens
ccttcccccattaacttcccccc

SEQ ID NO: 41442 - DNA, 17 bp, Homo sapiens
ctcaacaaagggctttt

SEQ ID NO: 41443 - DNA, 19 bp, Homo sapiens
ctctatatagtttcacttt

SEQ ID NO: 41444 - DNA, 15 bp, Homo sapiens
cttcttcccattttg

SEQ ID NO: 41445 - DNA, 23 bp, Homo sapiens
cttgctccttttgagttgctttt

SEQ ID NO: 41446 - DNA, 19 bp, Homo sapiens
tgactgcctggcacatagt

SEQ ID NO: 41447 - DNA, 21 bp, Homo sapiens
tttgagatgttgagttacttt

SEQ ID NO: 41448 - DNA, 19 bp, Homo sapiens
caaaatttagaatttggcc

SEQ ID NO: 41449 - DNA, 21 bp, Homo sapiens
cagcatagcagccacaagcca

SEQ ID NO: 41450 - DNA, 24 bp, Homo sapiens
ccacaggtttctctctccatccct

SEQ ID NO: 41451 - DNA, 20 bp, Homo sapiens
gatattccggtaatctttta

SEQ ID NO: 41452 - DNA, 20 bp, Homo sapiens
gactgcaccactgcattcca

SEQ ID NO: 41453 - DNA, 24 bp, Homo sapiens
ggcaatgacccaagaccatcatct

SEQ ID NO: 41454 - DNA, 24 bp, Homo sapiens
tgaagtcttgggttggacatttca

SEQ ID NO: 41455 - DNA, 17 bp, Homo sapiens
tgcaccactgcattcca

SEQ ID NO: 41456 - DNA, 22 bp, Homo sapiens
tggaaacagatgagagacaaca

SEQ ID NO: 41457 - DNA, 19 bp, Homo sapiens
cgtcccagtccttcaacac

SEQ ID NO: 41458 - DNA, 17 bp, Homo sapiens
ggcaaaggcaaaatacc

SEQ ID NO: 41459 - DNA, 21 bp, Homo sapiens
tctattttcttcttctgttcc

SEQ ID NO: 41460 - DNA, 17 bp, Homo sapiens
atctacttgctacttct

SEQ ID NO: 41461 - DNA, 18 bp, Homo sapiens
caaccccccattccctcc

SEQ ID NO: 41462 - DNA, 26 bp, Homo sapiens
gtttgagcttccccactgcctgaccc

SEQ ID NO: 41463 - DNA, 19 bp, Homo sapiens
tttggtcctttaaccgaca

SEQ ID NO: 41464 - DNA, 21 bp, Homo sapiens
atctgagctgcgggagggccc

SEQ ID NO: 41465 - DNA, 17 bp, Homo sapiens
cactgagcctcatacca

SEQ ID NO: 41466 - DNA, 20 bp, Homo sapiens
ccagtttcatgttccctgaa

SEQ ID NO: 41467 - DNA, 23 bp, Homo sapiens
gccagtcaagacctttctccaga

SEQ ID NO: 41468 - DNA, 18 bp, Homo sapiens
tataccagcacattaaca

SEQ ID NO: 41469 - DNA, 20 bp, Homo sapiens
tgggtcagacccgggtcaca

SEQ ID NO: 41470 - DNA, 18 bp, Homo sapiens
aatggatgacttagaagg

SEQ ID NO: 41471 - DNA, 21 bp, Homo sapiens
agctgttttccataaatctca

SEQ ID NO: 41472 - DNA, 19 bp, Homo sapiens
agtagcatccctgctccca

SEQ ID NO: 41473 - DNA, 18 bp, Homo sapiens
caatccttctttgttcct

SEQ ID NO: 41474 - DNA, 19 bp, Homo sapiens
catcttaagtagccgaaca

SEQ ID NO: 41475 - DNA, 20 bp, Homo sapiens
ctggggacaaaatcactcct

SEQ ID NO: 41476 - DNA, 21 bp, Homo sapiens
ctgtactcactagatgccagt

SEQ ID NO: 41477 - DNA, 18 bp, Homo sapiens
tcatgagaacagcaccaa

SEQ ID NO: 41478 - DNA, 19 bp, Homo sapiens
tccccgctcccagttgtga

SEQ ID NO: 41479 - DNA, 19 bp, Homo sapiens
tccctgctcccagttgtga

SEQ ID NO: 41480 - DNA, 20 bp, Homo sapiens
tctaagcggtctccctgctt

SEQ ID NO: 41481 - DNA, 21 bp, Homo sapiens
tgactcagagcttctcaccca

SEQ ID NO: 41482 - DNA, 23 bp, Homo sapiens
aggatgcacacatactcattcaa

SEQ ID NO: 41483 - DNA, 23 bp, Homo sapiens
ttagaaattgagacctgtacata

SEQ ID NO: 41484 - DNA, 21 bp, Homo sapiens
acgaggattacatcgtcctca

SEQ ID NO: 41485 - DNA, 19 bp, Homo sapiens
ctctgggaaggtggccaga

SEQ ID NO: 41486 - DNA, 23 bp, Homo sapiens
ggaggaggaagccatggatgaca

SEQ ID NO: 41487 - DNA, 23 bp, Homo sapiens
ggaggaggaggctgtggatgaca

SEQ ID NO: 41488 - DNA, 19 bp, Homo sapiens
tgacatcttttttcccctt

SEQ ID NO: 41489 - DNA, 17 bp, Homo sapiens
ttttgaatgtgtttgtt

SEQ ID NO: 41490 - DNA, 18 bp, Homo sapiens
aagaggtgcagagcattg

SEQ ID NO: 41491 - DNA, 18 bp, Homo sapiens
atctgctaccacacctct

SEQ ID NO: 41492 - DNA, 21 bp, Homo sapiens
ccagagagccacaccactaca

SEQ ID NO: 41493 - DNA, 22 bp, Homo sapiens
ccagagagcctgaagttgctca

SEQ ID NO: 41494 - DNA, 17 bp, Homo sapiens
gacgttaagtccagaga

SEQ ID NO: 41495 - DNA, 20 bp, Homo sapiens
atgcagaccctgatattcca

SEQ ID NO: 41496 - DNA, 18 bp, Homo sapiens
catcctcctcctatggcc

SEQ ID NO: 41497 - DNA, 23 bp, Homo sapiens
ctccaggttctgcaaaagtttga

SEQ ID NO: 41498 - DNA, 21 bp, Homo sapiens
ctggccaaacccagtcttcca

SEQ ID NO: 41499 - DNA, 22 bp, Homo sapiens
gagccaagatcgcgctactgca

SEQ ID NO: 41500 - DNA, 18 bp, Homo sapiens
gcttcgactgtctcgccc

SEQ ID NO: 41501 - DNA, 20 bp, Homo sapiens
tgggaattggcaatgatgaa

SEQ ID NO: 41502 - DNA, 18 bp, Homo sapiens
tggctttcttgtccctta

SEQ ID NO: 41503 - DNA, 27 bp, Homo sapiens
tttgggcgaaaatcttggatcattttt

SEQ ID NO: 41504 - DNA, 24 bp, Homo sapiens
agaggaacaggtcagggtcagaca

SEQ ID NO: 41505 - DNA, 29 bp, Homo sapiens
gtcctgacaaggattgagaggatttgtgg

SEQ ID NO: 41506 - DNA, 22 bp, Homo sapiens
tctgaactgccatactctgccc

SEQ ID NO: 41507 - DNA, 20 bp, Homo sapiens
tggcatactctaacatactc

SEQ ID NO: 41508 - DNA, 21 bp, Homo sapiens
aaatatctcatccttaccatc

SEQ ID NO: 41509 - DNA, 20 bp, Homo sapiens
cctctgcctcctgggttcaa

SEQ ID NO: 41510 - DNA, 22 bp, Homo sapiens
tatctccaaaaaccatcttcat

SEQ ID NO: 41511 - DNA, 23 bp, Homo sapiens
tctgcttcaagatctttgcatgg

SEQ ID NO: 41512 - DNA, 18 bp, Homo sapiens
tggggtcaaaggatgcac

SEQ ID NO: 41513 - DNA, 23 bp, Homo sapiens
tggtcttgaactcttgggctcaa

SEQ ID NO: 41514 - DNA, 17 bp, Homo sapiens
ttctcctgccttagcct

SEQ ID NO: 41515 - DNA, 19 bp, Homo sapiens
agaaatagacaacgatctg

SEQ ID NO: 41516 - DNA, 23 bp, Homo sapiens
agtctctgctggacaacgctagc

SEQ ID NO: 41517 - DNA, 19 bp, Homo sapiens
cctttaatcgtctttgata

SEQ ID NO: 41518 - DNA, 19 bp, Homo sapiens
ctaggatcacagccacagg

SEQ ID NO: 41519 - DNA, 18 bp, Homo sapiens
gcagcaaactgtacaaca

SEQ ID NO: 41520 - DNA, 21 bp, Homo sapiens
tttcccaacaatggtcatgac

SEQ ID NO: 41521 - DNA, 18 bp, Homo sapiens
atcttaaggaaaagagga

SEQ ID NO: 41522 - DNA, 18 bp, Homo sapiens
ctacctgcctccccatca

SEQ ID NO: 41523 - DNA, 18 bp, Homo sapiens
gtgcaacgaggacttgga

SEQ ID NO: 41524 - DNA, 18 bp, Homo sapiens
tggtcgttgctgttttta

SEQ ID NO: 41525 - DNA, 24 bp, Homo sapiens
ttcttcctgacgtggcagtttatg

SEQ ID NO: 41526 - DNA, 15 bp, Homo sapiens
aacacaaatgtgaca

SEQ ID NO: 41527 - DNA, 20 bp, Homo sapiens
aacgtgtggtcgggccgagc

SEQ ID NO: 41528 - DNA, 19 bp, Homo sapiens
aaggaccagaatcctcaga

SEQ ID NO: 41529 - DNA, 18 bp, Homo sapiens
cagtttaggattgttata

SEQ ID NO: 41530 - DNA, 19 bp, Homo sapiens
ctgtttcaggtctgactca

SEQ ID NO: 41531 - DNA, 15 bp, Homo sapiens
tgtttagccattcta

SEQ ID NO: 41532 - DNA, 22 bp, Homo sapiens
cccaggcagctgccactgccca

SEQ ID NO: 41533 - DNA, 21 bp, Homo sapiens
gatggcgagccggacatacca

SEQ ID NO: 41534 - DNA, 20 bp, Homo sapiens
gttgcccctgcgccaaggga

SEQ ID NO: 41535 - DNA, 22 bp, Homo sapiens
tgcgtatgagtacttgtgtgtg

SEQ ID NO: 41536 - DNA, 20 bp, Homo sapiens
agtgtaactcaattatgtca

SEQ ID NO: 41537 - DNA, 21 bp, Homo sapiens
attatttcacttaccatggca

SEQ ID NO: 41538 - DNA, 17 bp, Homo sapiens
ccttctattaactgtat

SEQ ID NO: 41539 - DNA, 17 bp, Homo sapiens
tccccactccacacttt

SEQ ID NO: 41540 - DNA, 20 bp, Homo sapiens
ttgtttcttcatgacataca

SEQ ID NO: 41541 - DNA, 22 bp, Homo sapiens
tttcacttacattatttcactt

SEQ ID NO: 41542 - DNA, 19 bp, Homo sapiens
aagcaattctcctgcctca

SEQ ID NO: 41543 - DNA, 20 bp, Homo sapiens
cctctgcctcccgggttcaa

SEQ ID NO: 41544 - DNA, 24 bp, Homo sapiens
cttctaatggtgacttccatctca

SEQ ID NO: 41545 - DNA, 17 bp, Homo sapiens
gaagacaccacatttca

SEQ ID NO: 41546 - DNA, 18 bp, Homo sapiens
ttctgatcatcactgctg

SEQ ID NO: 41547 - DNA, 21 bp, Homo sapiens
gcaccttccgccagcgcccct

SEQ ID NO: 41548 - DNA, 20 bp, Homo sapiens
ctatcaataaaacagtatta

SEQ ID NO: 41549 - DNA, 20 bp, Homo sapiens
gaataagatgcagttctgaa

SEQ ID NO: 41550 - DNA, 23 bp, Homo sapiens
gatttattccagtgaccttgcta

SEQ ID NO: 41551 - DNA, 22 bp, Homo sapiens
tatgtctaatgttagacatttt

SEQ ID NO: 41552 - DNA, 19 bp, Homo sapiens
ttgccaaagtaattacact

SEQ ID NO: 41553 - DNA, 19 bp, Homo sapiens
gactcaaggaaacggaatt

SEQ ID NO: 41554 - DNA, 18 bp, Homo sapiens
ggtggtaaatgacacact

SEQ ID NO: 41555 - DNA, 21 bp, Homo sapiens
cctttttgtctgctcttggcc

SEQ ID NO: 41556 - DNA, 19 bp, Homo sapiens
ggccgggtgcggtggctca

SEQ ID NO: 41557 - DNA, 19 bp, Homo sapiens
taagtgggcctcctgaaac

SEQ ID NO: 41558 - DNA, 18 bp, Homo sapiens
tggatggatcacctgagg

SEQ ID NO: 41559 - DNA, 20 bp, Homo sapiens
aaagccagaggctttggcaa

SEQ ID NO: 41560 - DNA, 19 bp, Homo sapiens
ctgttttgtgtttaacctc

SEQ ID NO: 41561 - DNA, 23 bp, Homo sapiens
aagcaagttggtgaccttcctct

SEQ ID NO: 41562 - DNA, 20 bp, Homo sapiens
tggcttttccgatatggaac

SEQ ID NO: 41563 - DNA, 24 bp, Homo sapiens
tgggtgggttttctctgcagacta

SEQ ID NO: 41564 - DNA, 19 bp, Homo sapiens
tggttggggggcatcagca

SEQ ID NO: 41565 - DNA, 22 bp, Homo sapiens
tttttatatattctttaacctt

SEQ ID NO: 41566 - DNA, 22 bp, Homo sapiens
atgttctgctgtgataactgcc

SEQ ID NO: 41567 - DNA, 22 bp, Homo sapiens
acatttttaacacgcttactta

SEQ ID NO: 41568 - DNA, 23 bp, Homo sapiens
tcaaaaaacattatttttccttt

SEQ ID NO: 41569 - DNA, 20 bp, Homo sapiens
tcatatatagcatctctgct

SEQ ID NO: 41570 - DNA, 18 bp, Homo sapiens
tccgcctcctgggttcaa

SEQ ID NO: 41571 - DNA, 20 bp, Homo sapiens
tggccaggctggtcttgaac

SEQ ID NO: 41572 - DNA, 19 bp, Homo sapiens
ttgatacattctcacaaac

SEQ ID NO: 41573 - DNA, 22 bp, Homo sapiens
atggtctggagtgctctgtaga

SEQ ID NO: 41574 - DNA, 19 bp, Homo sapiens
tgtactatacagaaggaca

SEQ ID NO: 41575 - DNA, 22 bp, Homo sapiens
tttctttattccatgttctata

SEQ ID NO: 41576 - DNA, 15 bp, Homo sapiens
agggaaaaaaagcaa

SEQ ID NO: 41577 - DNA, 18 bp, Homo sapiens
cctcctcccagatacctc

SEQ ID NO: 41578 - DNA, 17 bp, Homo sapiens
tgaatgagacctgagtg

SEQ ID NO: 41579 - DNA, 24 bp, Homo sapiens
agaaagatgctctttctccaagac

SEQ ID NO: 41580 - DNA, 18 bp, Homo sapiens
atgaaagagtaacctgtc

SEQ ID NO: 41581 - DNA, 20 bp, Homo sapiens
cagaatatatactagaagct

SEQ ID NO: 41582 - DNA, 25 bp, Homo sapiens
tctatgattcagtttatgtaaaata

SEQ ID NO: 41583 - DNA, 19 bp, Homo sapiens
tgtgctgtggacactgact

SEQ ID NO: 41584 - DNA, 23 bp, Homo sapiens
aaagctgccccacccactctccc

SEQ ID NO: 41585 - DNA, 22 bp, Homo sapiens
aagaccagctctctccaggaca

SEQ ID NO: 41586 - DNA, 21 bp, Homo sapiens
accccatttaacaatgtgaag

SEQ ID NO: 41587 - DNA, 22 bp, Homo sapiens
actccccagcatctagatctaa

SEQ ID NO: 41588 - DNA, 19 bp, Homo sapiens
agtatccactccatcctca

SEQ ID NO: 41589 - DNA, 26 bp, Homo sapiens
cccttctgcaagcctggagactggac

SEQ ID NO: 41590 - DNA, 18 bp, Homo sapiens
ctcctgctcttactgttt

SEQ ID NO: 41591 - DNA, 23 bp, Homo sapiens
gttcgcctgatgagggctctcga

SEQ ID NO: 41592 - DNA, 24 bp, Homo sapiens
tccacgagactcttttctgtccct

SEQ ID NO: 41593 - DNA, 15 bp, Homo sapiens
tctaagcatttggcc

SEQ ID NO: 41594 - DNA, 20 bp, Homo sapiens
tggttcctaccttcacatct

SEQ ID NO: 41595 - DNA, 20 bp, Homo sapiens
tgtggtggagcatcctgctg

SEQ ID NO: 41596 - DNA, 22 bp, Homo sapiens
tttctatgactgtgttagcttt

SEQ ID NO: 41597 - DNA, 18 bp, Homo sapiens
ccaagcacgtagcccttt

SEQ ID NO: 41598 - DNA, 27 bp, Homo sapiens
tctctttatctctttgtcttgtgtctt

SEQ ID NO: 41599 - DNA, 17 bp, Homo sapiens
tgctccaccagcttctt

SEQ ID NO: 41600 - DNA, 21 bp, Homo sapiens
ccaaaatcaagcgacatttta

SEQ ID NO: 41601 - DNA, 19 bp, Homo sapiens
gaaaaatggtgactccaca

SEQ ID NO: 41602 - DNA, 20 bp, Homo sapiens
gacattttaaaaagaaaaca

SEQ ID NO: 41603 - DNA, 18 bp, Homo sapiens
acttaataaatgacgtcc

SEQ ID NO: 41604 - DNA, 17 bp, Homo sapiens
cataccccttctccctg

SEQ ID NO: 41605 - DNA, 21 bp, Homo sapiens
ggacatcaccggctgcacgca

SEQ ID NO: 41606 - DNA, 27 bp, Homo sapiens
aagagagatactctgcacaggttttgg

SEQ ID NO: 41607 - DNA, 18 bp, Homo sapiens
aagatatttattgtacac

SEQ ID NO: 41608 - DNA, 19 bp, Homo sapiens
atttggccatctcgctcct

SEQ ID NO: 41609 - DNA, 18 bp, Homo sapiens
cactgctaactatgcagg

SEQ ID NO: 41610 - DNA, 20 bp, Homo sapiens
ccaaccaaaagatcatgcta

SEQ ID NO: 41611 - DNA, 23 bp, Homo sapiens
ccactgctaactatgcagggcca

SEQ ID NO: 41612 - DNA, 18 bp, Homo sapiens
ttttctgacagggcagca

SEQ ID NO: 41613 - DNA, 19 bp, Homo sapiens
cagctattaattcatcata

SEQ ID NO: 41614 - DNA, 23 bp, Homo sapiens
taatctccaaaatctgaaatgct

SEQ ID NO: 41615 - DNA, 18 bp, Homo sapiens
tgggggaaaatttgtgga

SEQ ID NO: 41616 - DNA, 23 bp, Homo sapiens
tgttcctttctttgtgtccttga

SEQ ID NO: 41617 - DNA, 18 bp, Homo sapiens
ctgtgcacacatacacac

SEQ ID NO: 41618 - DNA, 20 bp, Homo sapiens
gtagggggcattatttatta

SEQ ID NO: 41619 - DNA, 17 bp, Homo sapiens
tttctctgtcttacctt

SEQ ID NO: 41620 - DNA, 22 bp, Homo sapiens
aactttttttgcgacttgtttt

SEQ ID NO: 41621 - DNA, 18 bp, Homo sapiens
agcttctgactctttctt

SEQ ID NO: 41622 - DNA, 20 bp, Homo sapiens
atagttgtgtgccaagcact

SEQ ID NO: 41623 - DNA, 18 bp, Homo sapiens
atgaactgatctgcattc

SEQ ID NO: 41624 - DNA, 22 bp, Homo sapiens
cacagttatcttactgaaaatg

SEQ ID NO: 41625 - DNA, 22 bp, Homo sapiens
cactcaaatctatatgtgccag

SEQ ID NO: 41626 - DNA, 20 bp, Homo sapiens
cctctggctcgcaccggctc

SEQ ID NO: 41627 - DNA, 23 bp, Homo sapiens
gctttgtttgtaaacttaccagt

SEQ ID NO: 41628 - DNA, 18 bp, Homo sapiens
tagcacatggcaatacca

SEQ ID NO: 41629 - DNA, 20 bp, Homo sapiens
tattttccaagagcacacct

SEQ ID NO: 41630 - DNA, 22 bp, Homo sapiens
tccattggattgcacctttaaa

SEQ ID NO: 41631 - DNA, 22 bp, Homo sapiens
tgacaagggccataaattgcta

SEQ ID NO: 41632 - DNA, 18 bp, Homo sapiens
tttttcagcatcacttca

SEQ ID NO: 41633 - DNA, 22 bp, Homo sapiens
aacagatttttaaaaacattga

SEQ ID NO: 41634 - DNA, 24 bp, Homo sapiens
taaacagatttttaaaaacattga

SEQ ID NO: 41635 - DNA, 18 bp, Homo sapiens
cagcaggatttttatgaa

SEQ ID NO: 41636 - DNA, 23 bp, Homo sapiens
tcttggctagagaaaacctgtgg

SEQ ID NO: 41637 - DNA, 21 bp, Homo sapiens
cagaaagttacattgctttgt

SEQ ID NO: 41638 - DNA, 20 bp, Homo sapiens
ccacccccacccccaccccc

SEQ ID NO: 41639 - DNA, 22 bp, Homo sapiens
cggccttcacggcgcaggcggc

SEQ ID NO: 41640 - DNA, 20 bp, Homo sapiens
gcgcacaccaccggcatgac

SEQ ID NO: 41641 - DNA, 20 bp, Homo sapiens
acacggtgcctggaagacca

SEQ ID NO: 41642 - DNA, 17 bp, Homo sapiens
aggaagcctggatccca

SEQ ID NO: 41643 - DNA, 18 bp, Homo sapiens
ccctgaggaggggcctgc

SEQ ID NO: 41644 - DNA, 17 bp, Homo sapiens
cctgcaggacgctggca

SEQ ID NO: 41645 - DNA, 18 bp, Homo sapiens
gatacaacatactgcaca

SEQ ID NO: 41646 - DNA, 25 bp, Homo sapiens
gccccttgctggagggttctgggga

SEQ ID NO: 41647 - DNA, 22 bp, Homo sapiens
tggccaccgtcacccacagggg

SEQ ID NO: 41648 - DNA, 18 bp, Homo sapiens
ctccccttcatatataca

SEQ ID NO: 41649 - DNA, 24 bp, Homo sapiens
taatattgagtgtcaacttgattg

SEQ ID NO: 41650 - DNA, 18 bp, Homo sapiens
gatatccttgatattgga

SEQ ID NO: 41651 - DNA, 18 bp, Homo sapiens
aacatcaaggccaccaca

SEQ ID NO: 41652 - DNA, 17 bp, Homo sapiens
aggaacagaacgaggca

SEQ ID NO: 41653 - DNA, 22 bp, Homo sapiens
caaagaaaacattcaatatcca

SEQ ID NO: 41654 - DNA, 18 bp, Homo sapiens
caaggcctggccaattgg

SEQ ID NO: 41655 - DNA, 19 bp, Homo sapiens
cagaggacacaccttgtca

SEQ ID NO: 41656 - DNA, 20 bp, Homo sapiens
catcatcatgtaccaagcca

SEQ ID NO: 41657 - DNA, 17 bp, Homo sapiens
cattcattatcacgatg

SEQ ID NO: 41658 - DNA, 18 bp, Homo sapiens
cctgcaacctccacctcc

SEQ ID NO: 41659 - DNA, 20 bp, Homo sapiens
ctcccggcccctctgcccct

SEQ ID NO: 41660 - DNA, 20 bp, Homo sapiens
gtggagatctagccaggtca

SEQ ID NO: 41661 - DNA, 21 bp, Homo sapiens
tcctggctcaggcctggcgag

SEQ ID NO: 41662 - DNA, 19 bp, Homo sapiens
tgtctcccagcagagacta

SEQ ID NO: 41663 - DNA, 23 bp, Homo sapiens
ttccatgtattgaaatatccaga

SEQ ID NO: 41664 - DNA, 22 bp, Homo sapiens
tttgacagggggagaaacagaa

SEQ ID NO: 41665 - DNA, 26 bp, Homo sapiens
acgaaaacagccagcatctttgctta

SEQ ID NO: 41666 - DNA, 16 bp, Homo sapiens
agccaggatttccctc

SEQ ID NO: 41667 - DNA, 21 bp, Homo sapiens
attaaactcattatttcttaa

SEQ ID NO: 41668 - DNA, 23 bp, Homo sapiens
cttcaggttgaacagtagcttca

SEQ ID NO: 41669 - DNA, 20 bp, Homo sapiens
cttctgttagactcactttt

SEQ ID NO: 41670 - DNA, 22 bp, Homo sapiens
tgcgggggtggggacggcggtg

SEQ ID NO: 41671 - DNA, 19 bp, Homo sapiens
agattttgtatcatgccat

SEQ ID NO: 41672 - DNA, 17 bp, Homo sapiens
aggcagaaggatcactt

SEQ ID NO: 41673 - DNA, 19 bp, Homo sapiens
agtcttatcatccatatca

SEQ ID NO: 41674 - DNA, 17 bp, Homo sapiens
gccttgctgtctggctt

SEQ ID NO: 41675 - DNA, 19 bp, Homo sapiens
gtaatcatatacatagtca

SEQ ID NO: 41676 - DNA, 19 bp, Homo sapiens
tcagcaggtcactgatgaa

SEQ ID NO: 41677 - DNA, 19 bp, Homo sapiens
tcataagtccatggaccaa

SEQ ID NO: 41678 - DNA, 18 bp, Homo sapiens
tgtgttgtgatactggaa

SEQ ID NO: 41679 - DNA, 23 bp, Homo sapiens
aagcaacatgatttccccatcca

SEQ ID NO: 41680 - DNA, 18 bp, Homo sapiens
catatccctcctgtgctc

SEQ ID NO: 41681 - DNA, 22 bp, Homo sapiens
gagccaagatcgtgccactgca

SEQ ID NO: 41682 - DNA, 21 bp, Homo sapiens
tgcccagaagtcaaagtccag

SEQ ID NO: 41683 - DNA, 18 bp, Homo sapiens
tgtgccaggggtgtgctg

SEQ ID NO: 41684 - DNA, 19 bp, Homo sapiens
gttgccagaatcagactgc

SEQ ID NO: 41685 - DNA, 18 bp, Homo sapiens
tattgcgtttggattctt

SEQ ID NO: 41686 - DNA, 21 bp, Homo sapiens
cagacataataactacactca

SEQ ID NO: 41687 - DNA, 22 bp, Homo sapiens
tttctttattccatgttctata

SEQ ID NO: 41688 - DNA, 17 bp, Homo sapiens
aaaccatccattcactg

SEQ ID NO: 41689 - DNA, 18 bp, Homo sapiens
aagaaaaccatccattca

SEQ ID NO: 41690 - DNA, 21 bp, Homo sapiens
accacaaaaaaccctccatcc

SEQ ID NO: 41691 - DNA, 18 bp, Homo sapiens
ctggggactgcctgtttc

SEQ ID NO: 41692 - DNA, 17 bp, Homo sapiens
gcacccgctcatgtgct

SEQ ID NO: 41693 - DNA, 21 bp, Homo sapiens
tctaagaaaaccatccattca

SEQ ID NO: 41694 - DNA, 24 bp, Homo sapiens
tggagcaatttccagcagaagttg

SEQ ID NO: 41695 - DNA, 22 bp, Homo sapiens
aacaaaaaggaggaccacgcaa

SEQ ID NO: 41696 - DNA, 21 bp, Homo sapiens
agactacctctctagatttct

SEQ ID NO: 41697 - DNA, 16 bp, Homo sapiens
caaaggtcaacaacat

SEQ ID NO: 41698 - DNA, 18 bp, Homo sapiens
cctgcaacctccacctcc

SEQ ID NO: 41699 - DNA, 19 bp, Homo sapiens
ctgcaacctccacctccca

SEQ ID NO: 41700 - DNA, 23 bp, Homo sapiens
gttcatctgattgggactggtta

SEQ ID NO: 41701 - DNA, 18 bp, Homo sapiens
tccacctcccaggttcaa

SEQ ID NO: 41702 - DNA, 20 bp, Homo sapiens
gccagctctgccccacaggg

SEQ ID NO: 41703 - DNA, 17 bp, Homo sapiens
gtggctccagccagctc

SEQ ID NO: 41704 - DNA, 20 bp, Homo sapiens
attaaattcactgtggttcc

SEQ ID NO: 41705 - DNA, 21 bp, Homo sapiens
ccttgactgcaggcttgggag

SEQ ID NO: 41706 - DNA, 18 bp, Homo sapiens
ctcaaaagaattaactct

SEQ ID NO: 41707 - DNA, 17 bp, Homo sapiens
tagggaaacacgaagat

SEQ ID NO: 41708 - DNA, 20 bp, Homo sapiens
tgcgatgggccgcacatttt

SEQ ID NO: 41709 - DNA, 19 bp, Homo sapiens
tttatatgcctgtgtcagc

SEQ ID NO: 41710 - DNA, 18 bp, Homo sapiens
aaatggattctcagtttg

SEQ ID NO: 41711 - DNA, 16 bp, Homo sapiens
aatctgggcaagagga

SEQ ID NO: 41712 - DNA, 21 bp, Homo sapiens
aggaaagagaaataggccctt

SEQ ID NO: 41713 - DNA, 24 bp, Homo sapiens
aggataatttgcatatccatcacc

SEQ ID NO: 41714 - DNA, 18 bp, Homo sapiens
agtattgcataactttaa

SEQ ID NO: 41715 - DNA, 19 bp, Homo sapiens
atcctggtggtaggtctct

SEQ ID NO: 41716 - DNA, 20 bp, Homo sapiens
caaaggatataaatgactaa

SEQ ID NO: 41717 - DNA, 23 bp, Homo sapiens
ccctagaagcagagctggagtaa

SEQ ID NO: 41718 - DNA, 18 bp, Homo sapiens
cctgagcctgcatggcct

SEQ ID NO: 41719 - DNA, 18 bp, Homo sapiens
gccatatcactgagggta

SEQ ID NO: 41720 - DNA, 17 bp, Homo sapiens
ggatcaggcagctccaa

SEQ ID NO: 41721 - DNA, 17 bp, Homo sapiens
gtgtgatattttcatac

SEQ ID NO: 41722 - DNA, 20 bp, Homo sapiens
taccctgaatcctgcacttt

SEQ ID NO: 41723 - DNA, 19 bp, Homo sapiens
ttgggcagttgcattattt

SEQ ID NO: 41724 - DNA, 19 bp, Homo sapiens
ctggcaggaaatttgcaaa

SEQ ID NO: 41725 - DNA, 18 bp, Homo sapiens
gtgaaaattattgcgtgc

SEQ ID NO: 41726 - DNA, 17 bp, Homo sapiens
tgatcaagtccttgcta

SEQ ID NO: 41727 - DNA, 18 bp, Homo sapiens
aaaagggggtggtgatga

SEQ ID NO: 41728 - DNA, 21 bp, Homo sapiens
taatttccttatattgtgata

SEQ ID NO: 41729 - DNA, 17 bp, Homo sapiens
ggcgcctggagctgggc

SEQ ID NO: 41730 - DNA, 26 bp, Homo sapiens
agatgtgcatgtgagcaagcttgtta

SEQ ID NO: 41731 - DNA, 21 bp, Homo sapiens
caccgaccggtcagctttcca

SEQ ID NO: 41732 - DNA, 21 bp, Homo sapiens
gctttccaacaccaacactga

SEQ ID NO: 41733 - DNA, 20 bp, Homo sapiens
agaagggtatttctccaccg

SEQ ID NO: 41734 - DNA, 19 bp, Homo sapiens
ccagaagggtatttctcca

SEQ ID NO: 41735 - DNA, 20 bp, Homo sapiens
cgacagaagctgggcgcttt

SEQ ID NO: 41736 - DNA, 17 bp, Homo sapiens
ctccgccaccgggctag

SEQ ID NO: 41737 - DNA, 19 bp, Homo sapiens
gagcctcggctgaaatccg

SEQ ID NO: 41738 - DNA, 22 bp, Homo sapiens
aggatggcctggaccacacaca

SEQ ID NO: 41739 - DNA, 18 bp, Homo sapiens
caccattctcctgcctca

SEQ ID NO: 41740 - DNA, 18 bp, Homo sapiens
cagcacccgcctcacagg

SEQ ID NO: 41741 - DNA, 21 bp, Homo sapiens
cctatctgggtcgcttggcct

SEQ ID NO: 41742 - DNA, 22 bp, Homo sapiens
ctgggattacaggcatctgcca

SEQ ID NO: 41743 - DNA, 24 bp, Homo sapiens
gcttctctgccctagttttgcctt

SEQ ID NO: 41744 - DNA, 19 bp, Homo sapiens
gtgccacaaaataaagctc

SEQ ID NO: 41745 - DNA, 24 bp, Homo sapiens
tcctgattcagctcttcttaccca

SEQ ID NO: 41746 - DNA, 18 bp, Homo sapiens
tctacctcctgggttcaa

SEQ ID NO: 41747 - DNA, 20 bp, Homo sapiens
tggccaggctggtcttgaac

SEQ ID NO: 41748 - DNA, 18 bp, Homo sapiens
tccccgacgttctagtta

SEQ ID NO: 41749 - DNA, 18 bp, Homo sapiens
tctttagacaacagtgtt

SEQ ID NO: 41750 - DNA, 21 bp, Homo sapiens
tgtctctcctgcacacatagc

SEQ ID NO: 41751 - DNA, 21 bp, Homo sapiens
tggttcctagctgtggggctg

SEQ ID NO: 41752 - DNA, 21 bp, Homo sapiens
catccagtaagaagacctgcc

SEQ ID NO: 41753 - DNA, 20 bp, Homo sapiens
ccacttggctagagttcaga

SEQ ID NO: 41754 - DNA, 21 bp, Homo sapiens
gcttgagtctggtctgagtct

SEQ ID NO: 41755 - DNA, 19 bp, Homo sapiens
cctgtgggtcttttggttt

SEQ ID NO: 41756 - DNA, 21 bp, Homo sapiens
ctttgagctaggtcttgtgag

SEQ ID NO: 41757 - DNA, 23 bp, Homo sapiens
gctagtctcaggtgttctgggga

SEQ ID NO: 41758 - DNA, 25 bp, Homo sapiens
aaaagaaagaaattgccttatgtca

SEQ ID NO: 41759 - DNA, 17 bp, Homo sapiens
ccttcttccccttatcc

SEQ ID NO: 41760 - DNA, 18 bp, Homo sapiens
ctctcctttggatatctg

SEQ ID NO: 41761 - DNA, 17 bp, Homo sapiens
ctgcatggtgcttcgtc

SEQ ID NO: 41762 - DNA, 20 bp, Homo sapiens
tcctcctttcccctctcctt

SEQ ID NO: 41763 - DNA, 22 bp, Homo sapiens
cccccagttggggggcctagac

SEQ ID NO: 41764 - DNA, 18 bp, Homo sapiens
cgagccagcagccgagct

SEQ ID NO: 41765 - DNA, 21 bp, Homo sapiens
cgggcggggccggagcccggc

SEQ ID NO: 41766 - DNA, 23 bp, Homo sapiens
tctgcccagccggcccccacctc

SEQ ID NO: 41767 - DNA, 20 bp, Homo sapiens
tgcttcacagatgtgccagc

SEQ ID NO: 41768 - DNA, 18 bp, Homo sapiens
tggtgaagacactcctgc

SEQ ID NO: 41769 - DNA, 21 bp, Homo sapiens
ttgagacataatagtagctca

SEQ ID NO: 41770 - DNA, 23 bp, Homo sapiens
agctgtatgcgttctagctgtat

SEQ ID NO: 41771 - DNA, 18 bp, Homo sapiens
cactggtagctcctgtcc

SEQ ID NO: 41772 - DNA, 22 bp, Homo sapiens
tctgagctgattctgtttgctc

SEQ ID NO: 41773 - DNA, 19 bp, Homo sapiens
agaagatatacaaatatta

SEQ ID NO: 41774 - DNA, 18 bp, Homo sapiens
atacaaatgttcatagca

SEQ ID NO: 41775 - DNA, 19 bp, Homo sapiens
catgaatgagcctcagaaa

SEQ ID NO: 41776 - DNA, 19 bp, Homo sapiens
acaaaatgacattccctca

SEQ ID NO: 41777 - DNA, 18 bp, Homo sapiens
agagattgagacaaaatg

SEQ ID NO: 41778 - DNA, 20 bp, Homo sapiens
ataaagttcctcccagttcc

SEQ ID NO: 41779 - DNA, 21 bp, Homo sapiens
acttgaactctggtttggctt

SEQ ID NO: 41780 - DNA, 18 bp, Homo sapiens
atgaccttctaccagttg

SEQ ID NO: 41781 - DNA, 21 bp, Homo sapiens
atgtaaggccttggtaagtga

SEQ ID NO: 41782 - DNA, 21 bp, Homo sapiens
cactgttgtgggagggaccca

SEQ ID NO: 41783 - DNA, 18 bp, Homo sapiens
ctcattgagtcatccaac

SEQ ID NO: 41784 - DNA, 18 bp, Homo sapiens
ctttttccattggtctaa

SEQ ID NO: 41785 - DNA, 16 bp, Homo sapiens
gcctctcccttgctgt

SEQ ID NO: 41786 - DNA, 26 bp, Homo sapiens
ggcaaagtgcaactgcagccagctca

SEQ ID NO: 41787 - DNA, 18 bp, Homo sapiens
gtatttatagagcaaccg

SEQ ID NO: 41788 - DNA, 17 bp, Homo sapiens
tgaatgttagtgtcctt

SEQ ID NO: 41789 - DNA, 18 bp, Homo sapiens
ccaaagtgcaaagtgaca

SEQ ID NO: 41790 - DNA, 19 bp, Homo sapiens
ctaatcattcaccacagca

SEQ ID NO: 41791 - DNA, 23 bp, Homo sapiens
taagtgggctctaggggaaggta

SEQ ID NO: 41792 - DNA, 19 bp, Homo sapiens
tataacaaggggaaaaaac

SEQ ID NO: 41793 - DNA, 17 bp, Homo sapiens
aggtagttcagtccact

SEQ ID NO: 41794 - DNA, 23 bp, Homo sapiens
cccaccaagcttatatgctgcca

SEQ ID NO: 41795 - DNA, 21 bp, Homo sapiens
ggacttggcacctggaataca

SEQ ID NO: 41796 - DNA, 20 bp, Homo sapiens
ttgatataaatgtattttta

SEQ ID NO: 41797 - DNA, 19 bp, Homo sapiens
agaaacatgcagcagtctc

SEQ ID NO: 41798 - DNA, 19 bp, Homo sapiens
agagagaatcaggtacctt

SEQ ID NO: 41799 - DNA, 24 bp, Homo sapiens
cagaactacagttccattgtctcg

SEQ ID NO: 41800 - DNA, 15 bp, Homo sapiens
cagcagcagcagcca

SEQ ID NO: 41801 - DNA, 23 bp, Homo sapiens
ccaaggctttgcctctttacagc

SEQ ID NO: 41802 - DNA, 21 bp, Homo sapiens
ccagtcttcacctccacaccc

SEQ ID NO: 41803 - DNA, 20 bp, Homo sapiens
cccgaatcctccccaacaag

SEQ ID NO: 41804 - DNA, 17 bp, Homo sapiens
ccctaccagcagcagca

SEQ ID NO: 41805 - DNA, 18 bp, Homo sapiens
cgagaacaaagactctga

SEQ ID NO: 41806 - DNA, 17 bp, Homo sapiens
ctccagaatctccagtc

SEQ ID NO: 41807 - DNA, 20 bp, Homo sapiens
gaaatttaccatacatatca

SEQ ID NO: 41808 - DNA, 22 bp, Homo sapiens
gcaccagcagcccatccacccc

SEQ ID NO: 41809 - DNA, 18 bp, Homo sapiens
gctgtggcctccacgtca

SEQ ID NO: 41810 - DNA, 22 bp, Homo sapiens
ggctttgagggcaaacacctca

SEQ ID NO: 41811 - DNA, 20 bp, Homo sapiens
actgtcagcaggcagtgacc

SEQ ID NO: 41812 - DNA, 18 bp, Homo sapiens
caaatagcacgctgaatt

SEQ ID NO: 41813 - DNA, 24 bp, Homo sapiens
cctcaggaggttgtacttaatttt

SEQ ID NO: 41814 - DNA, 20 bp, Homo sapiens
cctgctcccaaatggcaagg

SEQ ID NO: 41815 - DNA, 23 bp, Homo sapiens
tagaaacatgaaaccatgcactt

SEQ ID NO: 41816 - DNA, 18 bp, Homo sapiens
tgtaaatatatatattca

SEQ ID NO: 41817 - DNA, 23 bp, Homo sapiens
gctttctattcccccctgcctct

SEQ ID NO: 41818 - DNA, 22 bp, Homo sapiens
tgaccgctccagttctcatcat

SEQ ID NO: 41819 - DNA, 25 bp, Homo sapiens
aatggactaagacacacattgtcaa

SEQ ID NO: 41820 - DNA, 22 bp, Homo sapiens
acctggatttaaatcctggctt

SEQ ID NO: 41821 - DNA, 17 bp, Homo sapiens
cctgaccagttttgcgg

SEQ ID NO: 41822 - DNA, 23 bp, Homo sapiens
cctggcatcgtacaccagcacca

SEQ ID NO: 41823 - DNA, 18 bp, Homo sapiens
gtccttcaagaggacctc

SEQ ID NO: 41824 - DNA, 17 bp, Homo sapiens
cgttttacaaataatta

SEQ ID NO: 41825 - DNA, 18 bp, Homo sapiens
tggatggactccagaggg

SEQ ID NO: 41826 - DNA, 19 bp, Homo sapiens
ccagcaagattttaagctg

SEQ ID NO: 41827 - DNA, 21 bp, Homo sapiens
tgagtttcaaatgtggaactg

SEQ ID NO: 41828 - DNA, 19 bp, Homo sapiens
ttggctgtaactcactttt

SEQ ID NO: 41829 - DNA, 19 bp, Homo sapiens
ggcataggtcatcactgca

SEQ ID NO: 41830 - DNA, 27 bp, Homo sapiens
gtggttgggcaagagagtgtctttgtt

SEQ ID NO: 41831 - DNA, 18 bp, Homo sapiens
gattaaaagaagagttga

SEQ ID NO: 41832 - DNA, 18 bp, Homo sapiens
gggacaatttggttttaa

SEQ ID NO: 41833 - DNA, 20 bp, Homo sapiens
tcatatgtttgttcttgcaa

SEQ ID NO: 41834 - DNA, 25 bp, Homo sapiens
atctccatgacgatggtgttaagga

SEQ ID NO: 41835 - DNA, 20 bp, Homo sapiens
cgtgtggagtgagaaacccg

SEQ ID NO: 41836 - DNA, 19 bp, Homo sapiens
gcatacaagaaaactgcca

SEQ ID NO: 41837 - DNA, 22 bp, Homo sapiens
gcttgagctgggacttggcacc

SEQ ID NO: 41838 - DNA, 17 bp, Homo sapiens
tccatgacgatggtgtt

SEQ ID NO: 41839 - DNA, 19 bp, Homo sapiens
tgaggttatgggtgttggt

SEQ ID NO: 41840 - DNA, 20 bp, Homo sapiens
tgggaggtgactaggcttag

SEQ ID NO: 41841 - DNA, 19 bp, Homo sapiens
ttccactgaaacctctgtt

SEQ ID NO: 41842 - DNA, 19 bp, Homo sapiens
ccgcaccctgcactgcgta

SEQ ID NO: 41843 - DNA, 24 bp, Homo sapiens
gcaccttgtttcactcctgcctcc

SEQ ID NO: 41844 - DNA, 17 bp, Homo sapiens
tgtatgcaacaagcttc

SEQ ID NO: 41845 - DNA, 18 bp, Homo sapiens
agttgtattgagtacagc

SEQ ID NO: 41846 - DNA, 19 bp, Homo sapiens
atctcgatctcttgatctc

SEQ ID NO: 41847 - DNA, 23 bp, Homo sapiens
atcttcataacttcctgctctta

SEQ ID NO: 41848 - DNA, 19 bp, Homo sapiens
ctgcaacctccgcctccca

SEQ ID NO: 41849 - DNA, 21 bp, Homo sapiens
gaatttcattctttgtcatta

SEQ ID NO: 41850 - DNA, 22 bp, Homo sapiens
gattgttctgtgaattgttgtt

SEQ ID NO: 41851 - DNA, 21 bp, Homo sapiens
taagaaatagcattttactct

SEQ ID NO: 41852 - DNA, 18 bp, Homo sapiens
tccgcctcccaggttcaa

SEQ ID NO: 41853 - DNA, 18 bp, Homo sapiens
tgatccagcagtgtcgaa

SEQ ID NO: 41854 - DNA, 19 bp, Homo sapiens
aatcaactattaaacagtg

SEQ ID NO: 41855 - DNA, 18 bp, Homo sapiens
cactctgttactcatttt

SEQ ID NO: 41856 - DNA, 18 bp, Homo sapiens
tactggatgggtcaaact

SEQ ID NO: 41857 - DNA, 17 bp, Homo sapiens
tgccttggagtggactt

SEQ ID NO: 41858 - DNA, 25 bp, Homo sapiens
atctctctctgtggctgttgggccc

SEQ ID NO: 41859 - DNA, 18 bp, Homo sapiens
ctgtcctctgagaagcca

SEQ ID NO: 41860 - DNA, 22 bp, Homo sapiens
gctcgtcgtctgacatcagcta

SEQ ID NO: 41861 - DNA, 21 bp, Homo sapiens
tcctggtgatggggggttcct

SEQ ID NO: 41862 - DNA, 23 bp, Homo sapiens
tccttagcttttgaagctcctca

SEQ ID NO: 41863 - DNA, 22 bp, Homo sapiens
ttcccagtcacacaaccaggga

SEQ ID NO: 41864 - DNA, 20 bp, Homo sapiens
acagtctcaggtgctgtgtt

SEQ ID NO: 41865 - DNA, 18 bp, Homo sapiens
ccacgggagctctgggga

SEQ ID NO: 41866 - DNA, 22 bp, Homo sapiens
cctgggtaatttttgtattttt

SEQ ID NO: 41867 - DNA, 18 bp, Homo sapiens
ctgcctcaggttgacaga

SEQ ID NO: 41868 - DNA, 18 bp, Homo sapiens
gacatattatatgccttt

SEQ ID NO: 41869 - DNA, 17 bp, Homo sapiens
tcaagtgattctcctgc

SEQ ID NO: 41870 - DNA, 18 bp, Homo sapiens
tctccttgcgtttcagtg

SEQ ID NO: 41871 - DNA, 20 bp, Homo sapiens
aaagcaaaggcaaatagtgc

SEQ ID NO: 41872 - DNA, 22 bp, Homo sapiens
aacagaccttaaaaggtattga

SEQ ID NO: 41873 - DNA, 23 bp, Homo sapiens
aactagcatgggatgcactgcac

SEQ ID NO: 41874 - DNA, 24 bp, Homo sapiens
acaccactgggttttggtgtgaga

SEQ ID NO: 41875 - DNA, 21 bp, Homo sapiens
acagagtcagcccctgggcca

SEQ ID NO: 41876 - DNA, 18 bp, Homo sapiens
acattatattacattata

SEQ ID NO: 41877 - DNA, 18 bp, Homo sapiens
accactgaaatcattcta

SEQ ID NO: 41878 - DNA, 19 bp, Homo sapiens
actcatctctccaagcagg

SEQ ID NO: 41879 - DNA, 20 bp, Homo sapiens
aggctatacaatgtgtgtga

SEQ ID NO: 41880 - DNA, 19 bp, Homo sapiens
cagcagcagcaacagcagc

SEQ ID NO: 41881 - DNA, 20 bp, Homo sapiens
cagtgcccacccctgttata

SEQ ID NO: 41882 - DNA, 20 bp, Homo sapiens
cgaactgcaataaatgtgaa

SEQ ID NO: 41883 - DNA, 19 bp, Homo sapiens
ggccgggtgcggtggctca

SEQ ID NO: 41884 - DNA, 20 bp, Homo sapiens
taaggtcctgtgggcctagt

SEQ ID NO: 41885 - DNA, 20 bp, Homo sapiens
taggcttcatcatgcatttc

SEQ ID NO: 41886 - DNA, 21 bp, Homo sapiens
tccaaaagctaaatgatttaa

SEQ ID NO: 41887 - DNA, 19 bp, Homo sapiens
tttatttgtacagcagtta

SEQ ID NO: 41888 - DNA, 20 bp, Homo sapiens
ctgtggtgggcctctggccc

SEQ ID NO: 41889 - DNA, 24 bp, Homo sapiens
cttctcacctcgcccccttgcaca

SEQ ID NO: 41890 - DNA, 17 bp, Homo sapiens
tatatatcgtgttcgac

SEQ ID NO: 41891 - DNA, 23 bp, Homo sapiens
tccacggatggcttcttccttca

SEQ ID NO: 41892 - DNA, 18 bp, Homo sapiens
acaacccatcaagcggag

SEQ ID NO: 41893 - DNA, 19 bp, Homo sapiens
agctgtgggcaagaggtca

SEQ ID NO: 41894 - DNA, 23 bp, Homo sapiens
agtgcctgaccctgacctgtcct

SEQ ID NO: 41895 - DNA, 22 bp, Homo sapiens
ccccaccccacccagccgtgta

SEQ ID NO: 41896 - DNA, 17 bp, Homo sapiens
ctctcctgccctgcctt

SEQ ID NO: 41897 - DNA, 23 bp, Homo sapiens
cttagcatcctttgatcattttt

SEQ ID NO: 41898 - DNA, 19 bp, Homo sapiens
ggtggggttggagccccca

SEQ ID NO: 41899 - DNA, 17 bp, Homo sapiens
tccactccaaagtgggt

SEQ ID NO: 41900 - DNA, 20 bp, Homo sapiens
tgcgcgtctgtgcatgtgtg

SEQ ID NO: 41901 - DNA, 23 bp, Homo sapiens
tgtttacaagatgactaattcta

SEQ ID NO: 41902 - DNA, 23 bp, Homo sapiens
ccctcccccacttgccaccatcc

SEQ ID NO: 41903 - DNA, 23 bp, Homo sapiens
gccatttcatctggagctttcaa

SEQ ID NO: 41904 - DNA, 18 bp, Homo sapiens
tcatcgcaaacagtatta

SEQ ID NO: 41905 - DNA, 18 bp, Homo sapiens
tcccagagttgctgcaag

SEQ ID NO: 41906 - DNA, 18 bp, Homo sapiens
tgggaaggatgtgtctgc

SEQ ID NO: 41907 - DNA, 22 bp, Homo sapiens
gcctgggctcagagtcaggctt

SEQ ID NO: 41908 - DNA, 17 bp, Homo sapiens
aatcaagacctcattac

SEQ ID NO: 41909 - DNA, 22 bp, Homo sapiens
agagcatctcttccatccctca

SEQ ID NO: 41910 - DNA, 19 bp, Homo sapiens
gtcccactgctaacaagcc

SEQ ID NO: 41911 - DNA, 25 bp, Homo sapiens
tgaactttagcacttgaagaactga

SEQ ID NO: 41912 - DNA, 19 bp, Homo sapiens
tgaagatgacacctcctct

SEQ ID NO: 41913 - DNA, 26 bp, Homo sapiens
tgccatttctctgtgcccttttgaca

SEQ ID NO: 41914 - DNA, 22 bp, Homo sapiens
cccctccaagtgtctgttccag

SEQ ID NO: 41915 - DNA, 18 bp, Homo sapiens
tccaagtgtctgttccag

SEQ ID NO: 41916 - DNA, 18 bp, Homo sapiens
tgaaaagacatcagagta

SEQ ID NO: 41917 - DNA, 22 bp, Homo sapiens
gagccaagatcgcgccactgca

SEQ ID NO: 41918 - DNA, 20 bp, Homo sapiens
gcatatttggtggtaaccta

SEQ ID NO: 41919 - DNA, 19 bp, Homo sapiens
aattatacaatacttgtcc

SEQ ID NO: 41920 - DNA, 19 bp, Homo sapiens
acgtacagaaaatttgcca

SEQ ID NO: 41921 - DNA, 19 bp, Homo sapiens
atattgctgtcagttcctc

SEQ ID NO: 41922 - DNA, 17 bp, Homo sapiens
caaaatgtcatcaccct

SEQ ID NO: 41923 - DNA, 19 bp, Homo sapiens
cttctccttcccttcccct

SEQ ID NO: 41924 - DNA, 20 bp, Homo sapiens
cttcctgtgtcccctctgcc

SEQ ID NO: 41925 - DNA, 23 bp, Homo sapiens
ttcaggagcttacattttactca

SEQ ID NO: 41926 - DNA, 20 bp, Homo sapiens
catcttccagggcaaaacca

SEQ ID NO: 41927 - DNA, 19 bp, Homo sapiens
ccagtaagaccatctttca

SEQ ID NO: 41928 - DNA, 19 bp, Homo sapiens
catgtggctcgtgctggga

SEQ ID NO: 41929 - DNA, 17 bp, Homo sapiens
ctcacctctctgcctct

SEQ ID NO: 41930 - DNA, 22 bp, Homo sapiens
acccagaggaggagagaacccg

SEQ ID NO: 41931 - DNA, 17 bp, Homo sapiens
agaaaatgattaaaata

SEQ ID NO: 41932 - DNA, 17 bp, Homo sapiens
aggcagaagaatcactt

SEQ ID NO: 41933 - DNA, 19 bp, Homo sapiens
ccagaaatgctgtgatcag

SEQ ID NO: 41934 - DNA, 21 bp, Homo sapiens
gtactactgtttactaccata

SEQ ID NO: 41935 - DNA, 22 bp, Homo sapiens
tactaccaccaaattttaccat

SEQ ID NO: 41936 - DNA, 16 bp, Homo sapiens
agaatgagaagccagt

SEQ ID NO: 41937 - DNA, 19 bp, Homo sapiens
attatcatggcatcatcat

SEQ ID NO: 41938 - DNA, 18 bp, Homo sapiens
catcatcctctgatgttt

SEQ ID NO: 41939 - DNA, 21 bp, Homo sapiens
tgataagactcccatttagac

SEQ ID NO: 41940 - DNA, 23 bp, Homo sapiens
atctgccctgtgccgcctggttc

SEQ ID NO: 41941 - DNA, 22 bp, Homo sapiens
gccctggttattgctgagctct

SEQ ID NO: 41942 - DNA, 20 bp, Homo sapiens
tggcctccagcatgagcctg

SEQ ID NO: 41943 - DNA, 18 bp, Homo sapiens
caccaccacaccctgcta

SEQ ID NO: 41944 - DNA, 20 bp, Homo sapiens
ccagaaccaaacccccctca

SEQ ID NO: 41945 - DNA, 18 bp, Homo sapiens
ccctcagtcaacgtttca

SEQ ID NO: 41946 - DNA, 22 bp, Homo sapiens
gaaaacattggcggcagcaggt

SEQ ID NO: 41947 - DNA, 21 bp, Homo sapiens
gcctggaaacatgcttggctc

SEQ ID NO: 41948 - DNA, 22 bp, Homo sapiens
tccccgccaccccacgcactca

SEQ ID NO: 41949 - DNA, 17 bp, Homo sapiens
tcctccccgccacccca

SEQ ID NO: 41950 - DNA, 16 bp, Homo sapiens
ttaagtgatccaccca

SEQ ID NO: 41951 - DNA, 18 bp, Homo sapiens
ttctcctgcctcagcctt

SEQ ID NO: 41952 - DNA, 21 bp, Homo sapiens
atatgtgcatgtctataactc

SEQ ID NO: 41953 - DNA, 18 bp, Homo sapiens
tagaggtactatttcaat

SEQ ID NO: 41954 - DNA, 21 bp, Homo sapiens
tccacattacttatgtactca

SEQ ID NO: 41955 - DNA, 19 bp, Homo sapiens
tgggcattctcttgagaga

SEQ ID NO: 41956 - DNA, 19 bp, Homo sapiens
gaatggaagccaggagctc

SEQ ID NO: 41957 - DNA, 21 bp, Homo sapiens
gtcatggtcgcctagcgctca

SEQ ID NO: 41958 - DNA, 18 bp, Homo sapiens
tcattctaggcaatccac

SEQ ID NO: 41959 - DNA, 16 bp, Homo sapiens
ttctaggcaatccacc

SEQ ID NO: 41960 - DNA, 22 bp, Homo sapiens
gattgcatcaagagccatggta

SEQ ID NO: 41961 - DNA, 25 bp, Homo sapiens
ttgaccactgagttatcacatccca

SEQ ID NO: 41962 - DNA, 20 bp, Homo sapiens
aatataatcattccatccca

SEQ ID NO: 41963 - DNA, 18 bp, Homo sapiens
aatctaggtggaagccac

SEQ ID NO: 41964 - DNA, 17 bp, Homo sapiens
cctgagcctgtcctcca

SEQ ID NO: 41965 - DNA, 23 bp, Homo sapiens
ccttaaagctatgagcctttaaa

SEQ ID NO: 41966 - DNA, 21 bp, Homo sapiens
cttttccccattgccttaact

SEQ ID NO: 41967 - DNA, 16 bp, Homo sapiens
ggccaggagtttgtta

SEQ ID NO: 41968 - DNA, 19 bp, Homo sapiens
tctcctgaaaatgcttttt

SEQ ID NO: 41969 - DNA, 26 bp, Homo sapiens
tggggatcaaatttcaacatgaggtt

SEQ ID NO: 41970 - DNA, 20 bp, Homo sapiens
agctcctcctgctcgttgat

SEQ ID NO: 41971 - DNA, 24 bp, Homo sapiens
cagctgtgactcaagggcccagga

SEQ ID NO: 41972 - DNA, 19 bp, Homo sapiens
ccagggaatctgtgctcac

SEQ ID NO: 41973 - DNA, 23 bp, Homo sapiens
cccatggccatggaataaatgcc

SEQ ID NO: 41974 - DNA, 19 bp, Homo sapiens
ccatgacccttccaagcca

SEQ ID NO: 41975 - DNA, 16 bp, Homo sapiens
cctactgtaactttaa

SEQ ID NO: 41976 - DNA, 18 bp, Homo sapiens
tatagctcttagccatga

SEQ ID NO: 41977 - DNA, 19 bp, Homo sapiens
tgccaataccacctactgt

SEQ ID NO: 41978 - DNA, 18 bp, Homo sapiens
ttagagcctttgtcctct

SEQ ID NO: 41979 - DNA, 23 bp, Homo sapiens
ttctttgggtccgtgggcttgtg

SEQ ID NO: 41980 - DNA, 21 bp, Homo sapiens
aagtgtgaaatcaagatgtca

SEQ ID NO: 41981 - DNA, 18 bp, Homo sapiens
aggagagaacccagaata

SEQ ID NO: 41982 - DNA, 20 bp, Homo sapiens
agttggactcgtaggtactg

SEQ ID NO: 41983 - DNA, 22 bp, Homo sapiens
cagcacggtggcaatttccctc

SEQ ID NO: 41984 - DNA, 25 bp, Homo sapiens
gaacaaatatcaaacactgacctca

SEQ ID NO: 41985 - DNA, 21 bp, Homo sapiens
gaacccagaataaaccactgg

SEQ ID NO: 41986 - DNA, 22 bp, Homo sapiens
gtggcttccttggcttgtcgtc

SEQ ID NO: 41987 - DNA, 21 bp, Homo sapiens
tgcctgggcctcctgctccag

SEQ ID NO: 41988 - DNA, 22 bp, Homo sapiens
ttcaagtgtcaactttacttca

SEQ ID NO: 41989 - DNA, 18 bp, Homo sapiens
ttgttgaaaacaataggg

SEQ ID NO: 41990 - DNA, 20 bp, Homo sapiens
tttgaaacaagaccacttct

SEQ ID NO: 41991 - DNA, 18 bp, Homo sapiens
acccaaaaggaaaatctt

SEQ ID NO: 41992 - DNA, 16 bp, Homo sapiens
cagctcgagttgtggg

SEQ ID NO: 41993 - DNA, 19 bp, Homo sapiens
aagcaattctcctgcctca

SEQ ID NO: 41994 - DNA, 20 bp, Homo sapiens
acataatcctgaatgttgaa

SEQ ID NO: 41995 - DNA, 20 bp, Homo sapiens
acttcctcagtaaaggaaga

SEQ ID NO: 41996 - DNA, 21 bp, Homo sapiens
agtttcaacaaaagcttagca

SEQ ID NO: 41997 - DNA, 20 bp, Homo sapiens
atttcagatgactgcagtta

SEQ ID NO: 41998 - DNA, 21 bp, Homo sapiens
ctccaaaaggatagctgccat

SEQ ID NO: 41999 - DNA, 20 bp, Homo sapiens
ctttgactagcaaggcttgt

SEQ ID NO: 42000 - DNA, 24 bp, Homo sapiens
gtgtatgtgagtctcagtggacta

SEQ ID NO: 42001 - DNA, 20 bp, Homo sapiens
tggccaggctggtcttgaac

SEQ ID NO: 42002 - DNA, 23 bp, Homo sapiens
ttgaggggtccagctcctcatca

SEQ ID NO: 42003 - DNA, 15 bp, Homo sapiens
aagcaattctccttc

SEQ ID NO: 42004 - DNA, 18 bp, Homo sapiens
aattaagaatgaagaggg

SEQ ID NO: 42005 - DNA, 22 bp, Homo sapiens
ccaggaaccagttccttaatga

SEQ ID NO: 42006 - DNA, 23 bp, Homo sapiens
cctttttatggctaaatgatgtt

SEQ ID NO: 42007 - DNA, 18 bp, Homo sapiens
gacgtgttttaacagcaa

SEQ ID NO: 42008 - DNA, 21 bp, Homo sapiens
gagccatgacgcctggcctca

SEQ ID NO: 42009 - DNA, 19 bp, Homo sapiens
gcatctaatgaaaatttca

SEQ ID NO: 42010 - DNA, 21 bp, Homo sapiens
gttttactttagattaactaa

SEQ ID NO: 42011 - DNA, 18 bp, Homo sapiens
tccgcctcctgggttcaa

SEQ ID NO: 42012 - DNA, 19 bp, Homo sapiens
tcttggcggcggggggatc

SEQ ID NO: 42013 - DNA, 17 bp, Homo sapiens
ttcttaatattagtcac

SEQ ID NO: 42014 - DNA, 19 bp, Homo sapiens
cacaggcattgtttgcttt

SEQ ID NO: 42015 - DNA, 18 bp, Homo sapiens
gattacatcataagactg

SEQ ID NO: 42016 - DNA, 24 bp, Homo sapiens
tccagggcatggccttaaatctca

SEQ ID NO: 42017 - DNA, 18 bp, Homo sapiens
agaaagtgaccctgatca

SEQ ID NO: 42018 - DNA, 20 bp, Homo sapiens
agataatagttgttgaaagc

SEQ ID NO: 42019 - DNA, 20 bp, Homo sapiens
caatacataccaatcatcac

SEQ ID NO: 42020 - DNA, 15 bp, Homo sapiens
ccaggaaaacatgga

SEQ ID NO: 42021 - DNA, 19 bp, Homo sapiens
ctaatgcattattaatata

SEQ ID NO: 42022 - DNA, 18 bp, Homo sapiens
aggcagcaaactaagctg

SEQ ID NO: 42023 - DNA, 22 bp, Homo sapiens
gagccaagattttgccactgca

SEQ ID NO: 42024 - DNA, 24 bp, Homo sapiens
acacacagacccctccccaatctg

SEQ ID NO: 42025 - DNA, 17 bp, Homo sapiens
cctctgttgagcagtca

SEQ ID NO: 42026 - DNA, 22 bp, Homo sapiens
gagccaagatcgtgccactgca

SEQ ID NO: 42027 - DNA, 22 bp, Homo sapiens
ggatgttggcaagtgcctctta

SEQ ID NO: 42028 - DNA, 19 bp, Homo sapiens
gttctttacctttacttgg

SEQ ID NO: 42029 - DNA, 21 bp, Homo sapiens
tgcagtgagccaagatcgtgc

SEQ ID NO: 42030 - DNA, 17 bp, Homo sapiens
aacagtctgcaagattc

SEQ ID NO: 42031 - DNA, 23 bp, Homo sapiens
gtcatagtcactatggtgactca

SEQ ID NO: 42032 - DNA, 19 bp, Homo sapiens
tcctgaagccatctgtgga

SEQ ID NO: 42033 - DNA, 18 bp, Homo sapiens
cccccacacccctcccca

SEQ ID NO: 42034 - DNA, 19 bp, Homo sapiens
cctgagccccgctcggcct

SEQ ID NO: 42035 - DNA, 20 bp, Homo sapiens
tccctgcccaggggcacctc

SEQ ID NO: 42036 - DNA, 20 bp, Homo sapiens
ttaagcataacatactgaca

SEQ ID NO: 42037 - DNA, 16 bp, Homo sapiens
acgattggaattcatc

SEQ ID NO: 42038 - DNA, 20 bp, Homo sapiens
cctctgcctcctgggttcaa

SEQ ID NO: 42039 - DNA, 20 bp, Homo sapiens
tggccaggctggtcttgaac

SEQ ID NO: 42040 - DNA, 22 bp, Homo sapiens
acatgcttcaaataaatcagct

SEQ ID NO: 42041 - DNA, 21 bp, Homo sapiens
gaaaggatatagatgatgaca

SEQ ID NO: 42042 - DNA, 21 bp, Homo sapiens
cagaggactccaggttgctca

SEQ ID NO: 42043 - DNA, 19 bp, Homo sapiens
cggagcggccaggacacag

SEQ ID NO: 42044 - DNA, 24 bp, Homo sapiens
ctgatacatggaacaggcacatct

SEQ ID NO: 42045 - DNA, 21 bp, Homo sapiens
caaagactgtgccactgcact

SEQ ID NO: 42046 - DNA, 21 bp, Homo sapiens
cctccagcagcacggatgctg

SEQ ID NO: 42047 - DNA, 16 bp, Homo sapiens
ctcgatgagtgctctg

SEQ ID NO: 42048 - DNA, 20 bp, Homo sapiens
cttcgctaatcagcatatca

SEQ ID NO: 42049 - DNA, 19 bp, Homo sapiens
gctgaggaaaaagtaaaca

SEQ ID NO: 42050 - DNA, 20 bp, Homo sapiens
tctgaaaactacgaaactgg

SEQ ID NO: 42051 - DNA, 23 bp, Homo sapiens
tgaatggactcctctgaaaacta

SEQ ID NO: 42052 - DNA, 18 bp, Homo sapiens
cagcactttgggaagcca

SEQ ID NO: 42053 - DNA, 22 bp, Homo sapiens
cgaaggaggaggacacactttt

SEQ ID NO: 42054 - DNA, 22 bp, Homo sapiens
gagccaagatcgtgacactgca

SEQ ID NO: 42055 - DNA, 19 bp, Homo sapiens
ttctctactaaaaatacaa

SEQ ID NO: 42056 - DNA, 17 bp, Homo sapiens
aacagtctgcaagattc

SEQ ID NO: 42057 - DNA, 23 bp, Homo sapiens
gtcatagtcactatggtgactca

SEQ ID NO: 42058 - DNA, 19 bp, Homo sapiens
tcctgaagccatctgtgga

SEQ ID NO: 42059 - DNA, 21 bp, Homo sapiens
aaaacaaaaaccccacaaaac

SEQ ID NO: 42060 - DNA, 21 bp, Homo sapiens
ctgtttcattgtcactattga

SEQ ID NO: 42061 - DNA, 19 bp, Homo sapiens
tttcctgttttcttcattt

SEQ ID NO: 42062 - DNA, 21 bp, Homo sapiens
caccctgactcattccgatta

SEQ ID NO: 42063 - DNA, 23 bp, Homo sapiens
gtcaaaggttgccagcgggctct

SEQ ID NO: 42064 - DNA, 18 bp, Homo sapiens
taagaacctcctctcctc

SEQ ID NO: 42065 - DNA, 21 bp, Homo sapiens
tctcacctccttcatccccta

SEQ ID NO: 42066 - DNA, 18 bp, Homo sapiens
ttgctgtgcctcccacca

SEQ ID NO: 42067 - DNA, 23 bp, Homo sapiens
aaaggatctgcagaatttgtcag

SEQ ID NO: 42068 - DNA, 22 bp, Homo sapiens
agaatgtgcttccaactccatc

SEQ ID NO: 42069 - DNA, 26 bp, Homo sapiens
atttggacttgcctttgtcttggttc

SEQ ID NO: 42070 - DNA, 21 bp, Homo sapiens
ccacatttgtgtcctctttta

SEQ ID NO: 42071 - DNA, 20 bp, Homo sapiens
ggacacagagtttgagcagc

SEQ ID NO: 42072 - DNA, 17 bp, Homo sapiens
ggggagtgttgcgagtg

SEQ ID NO: 42073 - DNA, 19 bp, Homo sapiens
tctggaaaactcctggttt

SEQ ID NO: 42074 - DNA, 23 bp, Homo sapiens
aaaggatctgcagaatttgtcag

SEQ ID NO: 42075 - DNA, 22 bp, Homo sapiens
agaatgtgcttccaactccatc

SEQ ID NO: 42076 - DNA, 26 bp, Homo sapiens
atttggacttgcctttgtcttggttc

SEQ ID NO: 42077 - DNA, 21 bp, Homo sapiens
ccacatttgtgtcctctttta

SEQ ID NO: 42078 - DNA, 20 bp, Homo sapiens
ggacacagagtttgagcagc

SEQ ID NO: 42079 - DNA, 17 bp, Homo sapiens
ggggagtgttgcgagtg

SEQ ID NO: 42080 - DNA, 19 bp, Homo sapiens
tctggaaaactcctggttt

SEQ ID NO: 42081 - DNA, 21 bp, Homo sapiens
aaggaccgtaagccccatgag

SEQ ID NO: 42082 - DNA, 20 bp, Homo sapiens
acaaagatcccctactgcct

SEQ ID NO: 42083 - DNA, 21 bp, Homo sapiens
accagagaatggaagccaggc

SEQ ID NO: 42084 - DNA, 19 bp, Homo sapiens
agggtcagcagctcagtca

SEQ ID NO: 42085 - DNA, 20 bp, Homo sapiens
cacgcagcccatgcagtgaa

SEQ ID NO: 42086 - DNA, 21 bp, Homo sapiens
cactgcagtgcacgtgtgcca

SEQ ID NO: 42087 - DNA, 23 bp, Homo sapiens
caggaaagggccagcagccccaa

SEQ ID NO: 42088 - DNA, 21 bp, Homo sapiens
cagtcccaccagagtggctca

SEQ ID NO: 42089 - DNA, 25 bp, Homo sapiens
cccacccacagccagctctgccaga

SEQ ID NO: 42090 - DNA, 20 bp, Homo sapiens
ccctgccagaggccctgtgg

SEQ ID NO: 42091 - DNA, 20 bp, Homo sapiens
cgcacgcagcccatgcagtg

SEQ ID NO: 42092 - DNA, 24 bp, Homo sapiens
gcaccagaggccttcgaagcccca

SEQ ID NO: 42093 - DNA, 21 bp, Homo sapiens
gcatcaacaccgccacccaca

SEQ ID NO: 42094 - DNA, 18 bp, Homo sapiens
gcccccaggagctccacc

SEQ ID NO: 42095 - DNA, 19 bp, Homo sapiens
gcctgctgaaagagcctcc

SEQ ID NO: 42096 - DNA, 19 bp, Homo sapiens
gcgaccgctgggtgccagg

SEQ ID NO: 42097 - DNA, 18 bp, Homo sapiens
ggtcctgggtctgccaca

SEQ ID NO: 42098 - DNA, 20 bp, Homo sapiens
gtccagctcctgggcccacc

SEQ ID NO: 42099 - DNA, 19 bp, Homo sapiens
gtggtgccgcctcctgcca

SEQ ID NO: 42100 - DNA, 19 bp, Homo sapiens
ggcggtaccaggacagctt

SEQ ID NO: 42101 - DNA, 20 bp, Homo sapiens
ctgaaccaagagcacccact

SEQ ID NO: 42102 - DNA, 19 bp, Homo sapiens
acattgggaatggccacaa

SEQ ID NO: 42103 - DNA, 24 bp, Homo sapiens
ctttgatggccatgacttcgtgga

SEQ ID NO: 42104 - DNA, 17 bp, Homo sapiens
ggccatgacttcgtgga

SEQ ID NO: 42105 - DNA, 26 bp, Homo sapiens
tagttttggtgtcccacaattactta

SEQ ID NO: 42106 - DNA, 18 bp, Homo sapiens
tggggaccccgctcacca

SEQ ID NO: 42107 - DNA, 20 bp, Homo sapiens
gcgctcactggacaccctcc

SEQ ID NO: 42108 - DNA, 18 bp, Homo sapiens
tccctctggtcactgtga

SEQ ID NO: 42109 - DNA, 17 bp, Homo sapiens
ggacagcagtaacctct

SEQ ID NO: 42110 - DNA, 20 bp, Homo sapiens
ggttattaacactgctttga

SEQ ID NO: 42111 - DNA, 21 bp, Homo sapiens
ttggaacagattttatcatca

SEQ ID NO: 42112 - DNA, 22 bp, Homo sapiens
tgtaattgtgtctcgtttgtgt

SEQ ID NO: 42113 - DNA, 19 bp, Homo sapiens
cctccaggtacacttggca

SEQ ID NO: 42114 - DNA, 18 bp, Homo sapiens
gacttcagcgagaaactg

SEQ ID NO: 42115 - DNA, 16 bp, Homo sapiens
ggctgctgcaccatcc

SEQ ID NO: 42116 - DNA, 20 bp, Homo sapiens
ttttagaactcttcatctta

SEQ ID NO: 42117 - DNA, 24 bp, Homo sapiens
tcaggtgcccctgagtccacctta

SEQ ID NO: 42118 - DNA, 23 bp, Homo sapiens
aaatggaaaaagatgaagaatca

SEQ ID NO: 42119 - DNA, 22 bp, Homo sapiens
aagaaaggcatcatttaggttc

SEQ ID NO: 42120 - DNA, 19 bp, Homo sapiens
aagaggttggtgtcaatgc

SEQ ID NO: 42121 - DNA, 22 bp, Homo sapiens
acaggtgctaacagggcactga

SEQ ID NO: 42122 - DNA, 17 bp, Homo sapiens
acagtcacaaaaacttc

SEQ ID NO: 42123 - DNA, 18 bp, Homo sapiens
agagaaggacagaggtgg

SEQ ID NO: 42124 - DNA, 23 bp, Homo sapiens
atttatagccatccgaatcctga

SEQ ID NO: 42125 - DNA, 19 bp, Homo sapiens
attttccagagaactttca

SEQ ID NO: 42126 - DNA, 18 bp, Homo sapiens
caccccatcaccaaccct

SEQ ID NO: 42127 - DNA, 18 bp, Homo sapiens
cgccctcgaggtgcactg

SEQ ID NO: 42128 - DNA, 16 bp, Homo sapiens
ctgagcaaactctgta

SEQ ID NO: 42129 - DNA, 21 bp, Homo sapiens
gaagcagaagatactacttta

SEQ ID NO: 42130 - DNA, 21 bp, Homo sapiens
gaatcagacagcattcaccaa

SEQ ID NO: 42131 - DNA, 21 bp, Homo sapiens
gggcaatttgtccttagtgga

SEQ ID NO: 42132 - DNA, 19 bp, Homo sapiens
gggcacccagcctccccca

SEQ ID NO: 42133 - DNA, 23 bp, Homo sapiens
gttctggccctagaccacgtcca

SEQ ID NO: 42134 - DNA, 24 bp, Homo sapiens
tacaactacttttacaacactctg

SEQ ID NO: 42135 - DNA, 25 bp, Homo sapiens
tcttggtgccgtgaagacctgtgag

SEQ ID NO: 42136 - DNA, 18 bp, Homo sapiens
tgacagagccaagttggc

SEQ ID NO: 42137 - DNA, 24 bp, Homo sapiens
tgcctaccccagttcctatccaca

SEQ ID NO: 42138 - DNA, 17 bp, Homo sapiens
tggagtgaagtctgtga

SEQ ID NO: 42139 - DNA, 23 bp, Homo sapiens
tggttcattcacgtgtgagactg

SEQ ID NO: 42140 - DNA, 18 bp, Homo sapiens
tgtctaatcaacatccta

SEQ ID NO: 42141 - DNA, 20 bp, Homo sapiens
ttattacaacgatctcctgg

SEQ ID NO: 42142 - DNA, 21 bp, Homo sapiens
ttctgctgggcaaaggttgtc

SEQ ID NO: 42143 - DNA, 21 bp, Homo sapiens
ttgtcaatgtcatcgacttca

SEQ ID NO: 42144 - DNA, 16 bp, Homo sapiens
agaaatgggcagatcc

SEQ ID NO: 42145 - DNA, 17 bp, Homo sapiens
atgtgaacctgagctcc

SEQ ID NO: 42146 - DNA, 20 bp, Homo sapiens
caaggggacatggagaaagc

SEQ ID NO: 42147 - DNA, 21 bp, Homo sapiens
cggggtccaacgggggtctgg

SEQ ID NO: 42148 - DNA, 17 bp, Homo sapiens
cttccctgcttctgcct

SEQ ID NO: 42149 - DNA, 21 bp, Homo sapiens
gactttgccaacatggagctg

SEQ ID NO: 42150 - DNA, 24 bp, Homo sapiens
tggatgaattcaacaatggggttg

SEQ ID NO: 42151 - DNA, 20 bp, Homo sapiens
ctttgggacccagggcctgc

SEQ ID NO: 42152 - DNA, 24 bp, Homo sapiens
cgccgggaccccacctctacctcc

SEQ ID NO: 42153 - DNA, 24 bp, Homo sapiens
ccttggcctctcggaggcctctgg

SEQ ID NO: 42154 - DNA, 20 bp, Homo sapiens
acagcagcagcccccgcttc

SEQ ID NO: 42155 - DNA, 25 bp, Homo sapiens
cctgagctgcctgccacctgccaga

SEQ ID NO: 42156 - DNA, 25 bp, Homo sapiens
ggcatccgcctcagagctccctgga

SEQ ID NO: 42157 - DNA, 18 bp, Homo sapiens
ctcagatgtggccctgaa

SEQ ID NO: 42158 - DNA, 18 bp, Homo sapiens
ttctgaccacaatgccag

SEQ ID NO: 42159 - DNA, 21 bp, Homo sapiens
aagcaaaacaaaacaataaca

SEQ ID NO: 42160 - DNA, 20 bp, Homo sapiens
accaaggagggatttgggga

SEQ ID NO: 42161 - DNA, 19 bp, Homo sapiens
accccttatgcctgtgacg

SEQ ID NO: 42162 - DNA, 23 bp, Homo sapiens
accctcagtctccctgtctgtgg

SEQ ID NO: 42163 - DNA, 21 bp, Homo sapiens
acttccacctacagcttgcca

SEQ ID NO: 42164 - DNA, 19 bp, Homo sapiens
ccaaggagggatttgggga

SEQ ID NO: 42165 - DNA, 21 bp, Homo sapiens
gaaagagctattacccctttc

SEQ ID NO: 42166 - DNA, 18 bp, Homo sapiens
tgtgacggtggcaagaaa

SEQ ID NO: 42167 - DNA, 18 bp, Homo sapiens
atcctgaaactatgacgg

SEQ ID NO: 42168 - DNA, 18 bp, Homo sapiens
ggagatggcgaggcctgc

SEQ ID NO: 42169 - DNA, 23 bp, Homo sapiens
gtgggacatcttcctggatttca

SEQ ID NO: 42170 - DNA, 21 bp, Homo sapiens
tacacccaagcacatccgtca

SEQ ID NO: 42171 - DNA, 18 bp, Homo sapiens
agaagccctgtggcagct

SEQ ID NO: 42172 - DNA, 18 bp, Homo sapiens
cgcggcccctcgtgctgc

SEQ ID NO: 42173 - DNA, 19 bp, Homo sapiens
agccacaggaaccgtgagt

SEQ ID NO: 42174 - DNA, 18 bp, Homo sapiens
atccagcatcctcaagtg

SEQ ID NO: 42175 - DNA, 20 bp, Homo sapiens
cactgaggcccaggctccca

SEQ ID NO: 42176 - DNA, 17 bp, Homo sapiens
cagatgctgaaccacta

SEQ ID NO: 42177 - DNA, 20 bp, Homo sapiens
ccgatgtacacttctccgtc

SEQ ID NO: 42178 - DNA, 19 bp, Homo sapiens
cgccggcgcccctgtgcga

SEQ ID NO: 42179 - DNA, 16 bp, Homo sapiens
cggatccagatctgcc

SEQ ID NO: 42180 - DNA, 20 bp, Homo sapiens
cgtgttggccttttctgctg

SEQ ID NO: 42181 - DNA, 22 bp, Homo sapiens
gcaagaacagctttgagctcta

SEQ ID NO: 42182 - DNA, 17 bp, Homo sapiens
gggaggaggccgggagc

SEQ ID NO: 42183 - DNA, 19 bp, Homo sapiens
tccagccccgcccacttcc

SEQ ID NO: 42184 - DNA, 21 bp, Homo sapiens
atgtcttccaacaactaccca

SEQ ID NO: 42185 - DNA, 20 bp, Homo sapiens
aatttgttgggtatacactg

SEQ ID NO: 42186 - DNA, 22 bp, Homo sapiens
caattttaacctttttctggta

SEQ ID NO: 42187 - DNA, 18 bp, Homo sapiens
ctgtaatatgcaatttta

SEQ ID NO: 42188 - DNA, 23 bp, Homo sapiens
tctataaatatgtaatatcatca

SEQ ID NO: 42189 - DNA, 18 bp, Homo sapiens
aacccggaaaaggaagct

SEQ ID NO: 42190 - DNA, 17 bp, Homo sapiens
agaggcgtcccgactcc

SEQ ID NO: 42191 - DNA, 20 bp, Homo sapiens
gcctctctgagccctggctc

SEQ ID NO: 42192 - DNA, 23 bp, Homo sapiens
gctgattcaggagagcctgcgtt

SEQ ID NO: 42193 - DNA, 20 bp, Homo sapiens
ttgaaacagcacatgaagaa

SEQ ID NO: 42194 - DNA, 18 bp, Homo sapiens
gagtcagttttgagcttc

SEQ ID NO: 42195 - DNA, 20 bp, Homo sapiens
gcagagtcagttttgagctt

SEQ ID NO: 42196 - DNA, 21 bp, Homo sapiens
tccagggcagacctagactca

SEQ ID NO: 42197 - DNA, 19 bp, Homo sapiens
gcggaccgccctcgcctcc

SEQ ID NO: 42198 - DNA, 21 bp, Homo sapiens
ccctggcagggggcttctgga

SEQ ID NO: 42199 - DNA, 17 bp, Homo sapiens
cgggcaccacgagctca

SEQ ID NO: 42200 - DNA, 18 bp, Homo sapiens
cctggccccacccagctc

SEQ ID NO: 42201 - DNA, 18 bp, Homo sapiens
gagaaggaagaaaggtga

SEQ ID NO: 42202 - DNA, 21 bp, Homo sapiens
tccccaaggggccccttgaca

SEQ ID NO: 42203 - DNA, 21 bp, Homo sapiens
aactgacagcaagggcactga

SEQ ID NO: 42204 - DNA, 22 bp, Homo sapiens
acctgggcccagcgtcaggctt

SEQ ID NO: 42205 - DNA, 21 bp, Homo sapiens
tggtcctcgtcatctgtggac

SEQ ID NO: 42206 - DNA, 18 bp, Homo sapiens
agagagagacccagcatc

SEQ ID NO: 42207 - DNA, 23 bp, Homo sapiens
tcaatttccctcccatcacctca

SEQ ID NO: 42208 - DNA, 19 bp, Homo sapiens
tccagcactcatgatgcca

SEQ ID NO: 42209 - DNA, 19 bp, Homo sapiens
gggagcccgccccgcttcc

SEQ ID NO: 42210 - DNA, 20 bp, Homo sapiens
cctctttgtggcctggacct

SEQ ID NO: 42211 - DNA, 16 bp, Homo sapiens
aactctcccttctcct

SEQ ID NO: 42212 - DNA, 19 bp, Homo sapiens
atggagcagatctgtgaca

SEQ ID NO: 42213 - DNA, 21 bp, Homo sapiens
caccacacccggccccccttc

SEQ ID NO: 42214 - DNA, 20 bp, Homo sapiens
cctctgcctcccaggttcaa

SEQ ID NO: 42215 - DNA, 19 bp, Homo sapiens
ctgcaacctctgcctccca

SEQ ID NO: 42216 - DNA, 21 bp, Homo sapiens
ctggtgacatggagcagatct

SEQ ID NO: 42217 - DNA, 19 bp, Homo sapiens
ggaacttaacttggggcta

SEQ ID NO: 42218 - DNA, 17 bp, Homo sapiens
taccccaccctacccca

SEQ ID NO: 42219 - DNA, 16 bp, Homo sapiens
aactctcccttctcct

SEQ ID NO: 42220 - DNA, 21 bp, Homo sapiens
caccacacccggccccccttc

SEQ ID NO: 42221 - DNA, 20 bp, Homo sapiens
cctctgcctcccaggttcaa

SEQ ID NO: 42222 - DNA, 19 bp, Homo sapiens
ctgcaacctctgcctccca

SEQ ID NO: 42223 - DNA, 21 bp, Homo sapiens
ctggtgacatggagcagatct

SEQ ID NO: 42224 - DNA, 22 bp, Homo sapiens
gagccaagattgcaccactgca

SEQ ID NO: 42225 - DNA, 22 bp, Homo sapiens
gcccccatcccaccctacccca

SEQ ID NO: 42226 - DNA, 19 bp, Homo sapiens
ggaacttaacttggggcta

SEQ ID NO: 42227 - DNA, 17 bp, Homo sapiens
taccccaccctacccca

SEQ ID NO: 42228 - DNA, 19 bp, Homo sapiens
aggggccacactggaccat

SEQ ID NO: 42229 - DNA, 20 bp, Homo sapiens
ccccgccctatcccctacgc

SEQ ID NO: 42230 - DNA, 22 bp, Homo sapiens
ctcgtggccctgctctgcctct

SEQ ID NO: 42231 - DNA, 19 bp, Homo sapiens
gttcaggctgcttcggtgt

SEQ ID NO: 42232 - DNA, 19 bp, Homo sapiens
acccacctgctccgcggcg

SEQ ID NO: 42233 - DNA, 21 bp, Homo sapiens
cgcacactcccagttgttcac

SEQ ID NO: 42234 - DNA, 19 bp, Homo sapiens
cgcacgctacaaacacaca

SEQ ID NO: 42235 - DNA, 19 bp, Homo sapiens
ctttctctctctctctctc

SEQ ID NO: 42236 - DNA, 19 bp, Homo sapiens
aaactcctgacctcaggtg

SEQ ID NO: 42237 - DNA, 19 bp, Homo sapiens
acaaggacattcactgctg

SEQ ID NO: 42238 - DNA, 18 bp, Homo sapiens
agaggtgtcatgctttgg

SEQ ID NO: 42239 - DNA, 21 bp, Homo sapiens
atcttggctcactgcaacctc

SEQ ID NO: 42240 - DNA, 21 bp, Homo sapiens
ccactgcacctgacctgctga

SEQ ID NO: 42241 - DNA, 23 bp, Homo sapiens
ctgaaccctgctccgttggtcag

SEQ ID NO: 42242 - DNA, 19 bp, Homo sapiens
ctgcaacctccgcctctca

SEQ ID NO: 42243 - DNA, 18 bp, Homo sapiens
ctgggattacaggcacct

SEQ ID NO: 42244 - DNA, 16 bp, Homo sapiens
gaaccacgtgaaactg

SEQ ID NO: 42245 - DNA, 19 bp, Homo sapiens
gaattcttctgttctctgg

SEQ ID NO: 42246 - DNA, 18 bp, Homo sapiens
tccgcctctcaggttcaa

SEQ ID NO: 42247 - DNA, 19 bp, Homo sapiens
caggcctctggcgccccca

SEQ ID NO: 42248 - DNA, 18 bp, Homo sapiens
tccgactcctgggttcaa

SEQ ID NO: 42249 - DNA, 21 bp, Homo sapiens
aacaaaaacagcagtttgtga

SEQ ID NO: 42250 - DNA, 16 bp, Homo sapiens
agcctgtaaacggtgc

SEQ ID NO: 42251 - DNA, 18 bp, Homo sapiens
caatttggaaggcattga

SEQ ID NO: 42252 - DNA, 20 bp, Homo sapiens
ccatggatacgcttgtgatc

SEQ ID NO: 42253 - DNA, 22 bp, Homo sapiens
gtttctccattaatagtaactc

SEQ ID NO: 42254 - DNA, 18 bp, Homo sapiens
ataatacacctggaagtt

SEQ ID NO: 42255 - DNA, 21 bp, Homo sapiens
attagcattaaaatagctaaa

SEQ ID NO: 42256 - DNA, 22 bp, Homo sapiens
tagatggatgtatacgaagctg

SEQ ID NO: 42257 - DNA, 22 bp, Homo sapiens
tgcaaagatggaaaagcttctt

SEQ ID NO: 42258 - DNA, 24 bp, Homo sapiens
gacaatcagaattccactgcccaa

SEQ ID NO: 42259 - DNA, 21 bp, Homo sapiens
taaagaatcaaagtcattttt

SEQ ID NO: 42260 - DNA, 23 bp, Homo sapiens
tggttacggtggagacattgaca

SEQ ID NO: 42261 - DNA, 22 bp, Homo sapiens
actcgtcaatactcctgtgatc

SEQ ID NO: 42262 - DNA, 19 bp, Homo sapiens
atgtggactggacactcca

SEQ ID NO: 42263 - DNA, 22 bp, Homo sapiens
taaccaagtaaatgttttctat

SEQ ID NO: 42264 - DNA, 17 bp, Homo sapiens
ttccagaggtgacattc

SEQ ID NO: 42265 - DNA, 21 bp, Homo sapiens
accaaagccaatctgctctag

SEQ ID NO: 42266 - DNA, 21 bp, Homo sapiens
caccattacccacccccgttc

SEQ ID NO: 42267 - DNA, 18 bp, Homo sapiens
cagggtgtgcaccctctc

SEQ ID NO: 42268 - DNA, 20 bp, Homo sapiens
ccaatggcatctctccatct

SEQ ID NO: 42269 - DNA, 20 bp, Homo sapiens
cccactactgctttccctgt

SEQ ID NO: 42270 - DNA, 24 bp, Homo sapiens
gctgagcaaactcatattccagtt

SEQ ID NO: 42271 - DNA, 17 bp, Homo sapiens
tctcttcatcaccaggt

SEQ ID NO: 42272 - DNA, 21 bp, Homo sapiens
tctgtattgattgtgtctttt

SEQ ID NO: 42273 - DNA, 18 bp, Homo sapiens
gtctgaaccgatatttct

SEQ ID NO: 42274 - DNA, 19 bp, Homo sapiens
tgtgctggagttgtctgaa

SEQ ID NO: 42275 - DNA, 20 bp, Homo sapiens
aagacctgaaaatatgtctg

SEQ ID NO: 42276 - DNA, 27 bp, Homo sapiens
taaaaaagtgatcttaggtttgttttt

SEQ ID NO: 42277 - DNA, 19 bp, Homo sapiens
tcatttgcaattcatgtaa

SEQ ID NO: 42278 - DNA, 18 bp, Homo sapiens
tttctcctctgctatgca

SEQ ID NO: 42279 - DNA, 23 bp, Homo sapiens
aaataattttgtcccaagtctta

SEQ ID NO: 42280 - DNA, 18 bp, Homo sapiens
catgctttgcactctcct

SEQ ID NO: 42281 - DNA, 21 bp, Homo sapiens
ggcaaagatgaaaacttccca

SEQ ID NO: 42282 - DNA, 19 bp, Homo sapiens
caaggccagaaccagcagg

SEQ ID NO: 42283 - DNA, 16 bp, Homo sapiens
gcacatccttgctgct

SEQ ID NO: 42284 - DNA, 25 bp, Homo sapiens
gggctattatagatgaaaactgcac

SEQ ID NO: 42285 - DNA, 23 bp, Homo sapiens
ggtagatggggagggtctgtgtg

SEQ ID NO: 42286 - DNA, 22 bp, Homo sapiens
aggcctgcgccggcatcctccg

SEQ ID NO: 42287 - DNA, 19 bp, Homo sapiens
ctttgatggttgcctgctt

SEQ ID NO: 42288 - DNA, 19 bp, Homo sapiens
cgcccgcagccctgcctcc

SEQ ID NO: 42289 - DNA, 18 bp, Homo sapiens
gaggtggtcatgcccggg

SEQ ID NO: 42290 - DNA, 17 bp, Homo sapiens
tgcaaatcaacattcca

SEQ ID NO: 42291 - DNA, 18 bp, Homo sapiens
actgcagttctcctctga

SEQ ID NO: 42292 - DNA, 20 bp, Homo sapiens
agcacctcttcaccttgctc

SEQ ID NO: 42293 - DNA, 22 bp, Homo sapiens
atctccaagtttctgggcgcca

SEQ ID NO: 42294 - DNA, 22 bp, Homo sapiens
cccagacctaggagctccccaa

SEQ ID NO: 42295 - DNA, 18 bp, Homo sapiens
tcattcttcctggactca

SEQ ID NO: 42296 - DNA, 18 bp, Homo sapiens
tcccaggcacagctgcag

SEQ ID NO: 42297 - DNA, 20 bp, Homo sapiens
gccagtggggatcctggggg

SEQ ID NO: 42298 - DNA, 17 bp, Homo sapiens
aaacaggctcgctgcag

SEQ ID NO: 42299 - DNA, 18 bp, Homo sapiens
cagggcattttccgcaac

SEQ ID NO: 42300 - DNA, 20 bp, Homo sapiens
ccacctccactcccgcctcc

SEQ ID NO: 42301 - DNA, 16 bp, Homo sapiens
cccagagaactgttcc

SEQ ID NO: 42302 - DNA, 19 bp, Homo sapiens
tctgagccaggacttggag

SEQ ID NO: 42303 - DNA, 21 bp, Homo sapiens
tgcacaggctccctgctgccc

SEQ ID NO: 42304 - DNA, 21 bp, Homo sapiens
caccaccaccttttttctttt

SEQ ID NO: 42305 - DNA, 20 bp, Homo sapiens
gtctaccagatgtcttttga

SEQ ID NO: 42306 - DNA, 21 bp, Homo sapiens
gtgtgtatgtcctgcttcatt

SEQ ID NO: 42307 - DNA, 18 bp, Homo sapiens
ttgagaccagcctggccc

SEQ ID NO: 42308 - DNA, 21 bp, Homo sapiens
tttcttcattacactaacctt

SEQ ID NO: 42309 - DNA, 18 bp, Homo sapiens
ccacacaagcaagccaaa

SEQ ID NO: 42310 - DNA, 23 bp, Homo sapiens
cctcttactgtgcctttagcctt

SEQ ID NO: 42311 - DNA, 21 bp, Homo sapiens
gtggcagattgtacactgcta

SEQ ID NO: 42312 - DNA, 21 bp, Homo sapiens
ttctgtctcaaaacactttga

SEQ ID NO: 42313 - DNA, 21 bp, Homo sapiens
ttgttaaagatttatttttac

SEQ ID NO: 42314 - DNA, 21 bp, Homo sapiens
aaaccctacaaaacaaaaaca

SEQ ID NO: 42315 - DNA, 18 bp, Homo sapiens
cgaatggtgtttaaagac

SEQ ID NO: 42316 - DNA, 23 bp, Homo sapiens
gcctctccctctccctcccccct

SEQ ID NO: 42317 - DNA, 23 bp, Homo sapiens
caggctcgggggagcctcctcca

SEQ ID NO: 42318 - DNA, 18 bp, Homo sapiens
tgtcaggtggtgagctct

SEQ ID NO: 42319 - DNA, 18 bp, Homo sapiens
tttatggattctccgcac

SEQ ID NO: 42320 - DNA, 17 bp, Homo sapiens
aggagttacacagatct

SEQ ID NO: 42321 - DNA, 21 bp, Homo sapiens
ccaggagttacacagatctca

SEQ ID NO: 42322 - DNA, 18 bp, Homo sapiens
tgtgggaattgatacaca

SEQ ID NO: 42323 - DNA, 18 bp, Homo sapiens
ttgagatcaccaggcctc

SEQ ID NO: 42324 - DNA, 15 bp, Homo sapiens
ggcgacggcggcggc

SEQ ID NO: 42325 - DNA, 18 bp, Homo sapiens
ctgtggactgtctgactc

SEQ ID NO: 42326 - DNA, 15 bp, Homo sapiens
cttttgttctggtgt

SEQ ID NO: 42327 - DNA, 22 bp, Homo sapiens
actgtaaatgatgtgtacaaca

SEQ ID NO: 42328 - DNA, 19 bp, Homo sapiens
taagaaaaaattggaaatc

SEQ ID NO: 42329 - DNA, 19 bp, Homo sapiens
tgaccaccaaaagcagtca

SEQ ID NO: 42330 - DNA, 22 bp, Homo sapiens
acttctcctttgtattctctca

SEQ ID NO: 42331 - DNA, 21 bp, Homo sapiens
agtctcactctgtcgccaggc

SEQ ID NO: 42332 - DNA, 18 bp, Homo sapiens
atcccattaaatgaggaa

SEQ ID NO: 42333 - DNA, 22 bp, Homo sapiens
atcttggctcactgcaacctct

SEQ ID NO: 42334 - DNA, 20 bp, Homo sapiens
cctctgcctcctgggttcaa

SEQ ID NO: 42335 - DNA, 21 bp, Homo sapiens
cctgagcaaaaagatactttt

SEQ ID NO: 42336 - DNA, 21 bp, Homo sapiens
gacaggaaacatcccattcca

SEQ ID NO: 42337 - DNA, 17 bp, Homo sapiens
tcaagcgattcttgtgc

SEQ ID NO: 42338 - DNA, 21 bp, Homo sapiens
tttcacttgtattgtttttca

SEQ ID NO: 42339 - DNA, 18 bp, Homo sapiens
catgtatcagtcctctga

SEQ ID NO: 42340 - DNA, 23 bp, Homo sapiens
tcaacaaaaagtaagctgtacta

SEQ ID NO: 42341 - DNA, 20 bp, Homo sapiens
tgccatggtatatgtgggtg

SEQ ID NO: 42342 - DNA, 18 bp, Homo sapiens
tgggaattttgcaatttg

SEQ ID NO: 42343 - DNA, 18 bp, Homo sapiens
ttcagagtgactgctcca

SEQ ID NO: 42344 - DNA, 18 bp, Homo sapiens
cttgtcagttttctctca

SEQ ID NO: 42345 - DNA, 19 bp, Homo sapiens
gaaaaagggctgcccatgt

SEQ ID NO: 42346 - DNA, 20 bp, Homo sapiens
ggcctcaatggttgcagcaa

SEQ ID NO: 42347 - DNA, 18 bp, Homo sapiens
aacatccagacgatttca

SEQ ID NO: 42348 - DNA, 17 bp, Homo sapiens
agacatcctccaccata

SEQ ID NO: 42349 - DNA, 18 bp, Homo sapiens
agcatctgccctggaaat

SEQ ID NO: 42350 - DNA, 18 bp, Homo sapiens
cactttcacaccacttgg

SEQ ID NO: 42351 - DNA, 18 bp, Homo sapiens
catccacacatttgcacc

SEQ ID NO: 42352 - DNA, 18 bp, Homo sapiens
cctggcggtgagcgcgga

SEQ ID NO: 42353 - DNA, 25 bp, Homo sapiens
cctttgagctaatgactgtctccag

SEQ ID NO: 42354 - DNA, 23 bp, Homo sapiens
ctaatgcaaggagggctagttca

SEQ ID NO: 42355 - DNA, 21 bp, Homo sapiens
ctggcaggctgaccattacca

SEQ ID NO: 42356 - DNA, 16 bp, Homo sapiens
tcagctgtaaccacag

SEQ ID NO: 42357 - DNA, 17 bp, Homo sapiens
atgaacgaattcatgcc

SEQ ID NO: 42358 - DNA, 18 bp, Homo sapiens
cctgcaggattccatcca

SEQ ID NO: 42359 - DNA, 18 bp, Homo sapiens
gctgcaacaactgctgca

SEQ ID NO: 42360 - DNA, 19 bp, Homo sapiens
tctgagcaggttctggccc

SEQ ID NO: 42361 - DNA, 19 bp, Homo sapiens
tctggtgaggagctgcgaa

SEQ ID NO: 42362 - DNA, 22 bp, Homo sapiens
tgccttcagttcctcccacctc

SEQ ID NO: 42363 - DNA, 17 bp, Homo sapiens
ccatggaacccttgttt

SEQ ID NO: 42364 - DNA, 18 bp, Homo sapiens
gtatactaaaagccttaa

SEQ ID NO: 42365 - DNA, 17 bp, Homo sapiens
tcaagtgattctcctgc

SEQ ID NO: 42366 - DNA, 18 bp, Homo sapiens
tccgcctcccgggttcaa

SEQ ID NO: 42367 - DNA, 22 bp, Homo sapiens
ttgctgctgaaagatgtctgtg

SEQ ID NO: 42368 - DNA, 17 bp, Homo sapiens
aaacgcaaaggtttgca

SEQ ID NO: 42369 - DNA, 20 bp, Homo sapiens
ctcaaaaacgcaaaggtttg

SEQ ID NO: 42370 - DNA, 20 bp, Homo sapiens
agttaatgtgctttcttgga

SEQ ID NO: 42371 - DNA, 19 bp, Homo sapiens
agttggaagtcatcagcca

SEQ ID NO: 42372 - DNA, 23 bp, Homo sapiens
gaaagccacagagaaatctccca

SEQ ID NO: 42373 - DNA, 18 bp, Homo sapiens
tttttcaggctttagctt

SEQ ID NO: 42374 - DNA, 22 bp, Homo sapiens
gctcctcccagctctggcccct

SEQ ID NO: 42375 - DNA, 24 bp, Homo sapiens
ggaagaagagcagtgggattgcca

SEQ ID NO: 42376 - DNA, 18 bp, Homo sapiens
tgaagttgcttctgtgga

SEQ ID NO: 42377 - DNA, 19 bp, Homo sapiens
tggaactgatttgaggcta

SEQ ID NO: 42378 - DNA, 20 bp, Homo sapiens
cctagttggaaacttgtgga

SEQ ID NO: 42379 - DNA, 18 bp, Homo sapiens
cctgaatgacaatggagt

SEQ ID NO: 42380 - DNA, 21 bp, Homo sapiens
ccagtcgcgtcccacttgaca

SEQ ID NO: 42381 - DNA, 21 bp, Homo sapiens
gttttcttgctcctgtggatg

SEQ ID NO: 42382 - DNA, 21 bp, Homo sapiens
taaaccaggggcacaatgcac

SEQ ID NO: 42383 - DNA, 18 bp, Homo sapiens
tgttggcagtagtgctgc

SEQ ID NO: 42384 - DNA, 18 bp, Homo sapiens
acccacctcgtttccgca

SEQ ID NO: 42385 - DNA, 16 bp, Homo sapiens
atgttggggtgcagcc

SEQ ID NO: 42386 - DNA, 18 bp, Homo sapiens
cacactcacctccacctt

SEQ ID NO: 42387 - DNA, 17 bp, Homo sapiens
ccattctctggacttca

SEQ ID NO: 42388 - DNA, 17 bp, Homo sapiens
ccccaccatgccccgca

SEQ ID NO: 42389 - DNA, 22 bp, Homo sapiens
cgcccgccccccacccgctcca

SEQ ID NO: 42390 - DNA, 18 bp, Homo sapiens
ctctctccctcatgaaca

SEQ ID NO: 42391 - DNA, 22 bp, Homo sapiens
gttcaaggccatcgggagctct

SEQ ID NO: 42392 - DNA, 20 bp, Homo sapiens
aaaccaatggaggactcagg

SEQ ID NO: 42393 - DNA, 18 bp, Homo sapiens
ccatcaaaccaatggagg

SEQ ID NO: 42394 - DNA, 21 bp, Homo sapiens
ccctgcttgagaaggttttgg

SEQ ID NO: 42395 - DNA, 21 bp, Homo sapiens
ctgtcctgcttttgcttccca

SEQ ID NO: 42396 - DNA, 20 bp, Homo sapiens
gctggggcccaggaagagta

SEQ ID NO: 42397 - DNA, 20 bp, Homo sapiens
acacaccaaagtctctgcca

SEQ ID NO: 42398 - DNA, 23 bp, Homo sapiens
agaaggtgcagtattacacatca

SEQ ID NO: 42399 - DNA, 20 bp, Homo sapiens
ctcagattttagaggctttt

SEQ ID NO: 42400 - DNA, 18 bp, Homo sapiens
gcctagcagtctacttca

SEQ ID NO: 42401 - DNA, 19 bp, Homo sapiens
tatcacccggaaaacctca

SEQ ID NO: 42402 - DNA, 22 bp, Homo sapiens
tttagcatattgaaacattaga

SEQ ID NO: 42403 - DNA, 24 bp, Homo sapiens
tttccccatgccatccacagtgtt

SEQ ID NO: 42404 - DNA, 20 bp, Homo sapiens
atgtctaataaccagacttc

SEQ ID NO: 42405 - DNA, 22 bp, Homo sapiens
ccactggctcattatgagtcat

SEQ ID NO: 42406 - DNA, 21 bp, Homo sapiens
ctctttcaccttgaacttgta

SEQ ID NO: 42407 - DNA, 24 bp, Homo sapiens
tcattttcctttagcttctgctca

SEQ ID NO: 42408 - DNA, 20 bp, Homo sapiens
ttatacattccaggagtagc

SEQ ID NO: 42409 - DNA, 22 bp, Homo sapiens
gcggtttttttggtttgttgtt

SEQ ID NO: 42410 - DNA, 22 bp, Homo sapiens
ggtatcctaggtaagagcccct

SEQ ID NO: 42411 - DNA, 18 bp, Homo sapiens
tccacctcccgggttcaa

SEQ ID NO: 42412 - DNA, 20 bp, Homo sapiens
tggccaggctggtcttgaac

SEQ ID NO: 42413 - DNA, 19 bp, Homo sapiens
agccactggtcaggaccac

SEQ ID NO: 42414 - DNA, 19 bp, Homo sapiens
aggatttgggtcctggtga

SEQ ID NO: 42415 - DNA, 20 bp, Homo sapiens
cacatcccccacaggtgctg

SEQ ID NO: 42416 - DNA, 24 bp, Homo sapiens
ggagctggtctggggagcattgac

SEQ ID NO: 42417 - DNA, 18 bp, Homo sapiens
gacccgagtcctcactca

SEQ ID NO: 42418 - DNA, 22 bp, Homo sapiens
tggctgccctccccacaggggg

SEQ ID NO: 42419 - DNA, 21 bp, Homo sapiens
ttctggcggtggggaaacggc

SEQ ID NO: 42420 - DNA, 19 bp, Homo sapiens
catccctgtaattccagca

SEQ ID NO: 42421 - DNA, 22 bp, Homo sapiens
gagccaagattgtgccactgca

SEQ ID NO: 42422 - DNA, 24 bp, Homo sapiens
taaatatgactctagtgtaaatta

SEQ ID NO: 42423 - DNA, 27 bp, Homo sapiens
tttttgtgtgtgtgcgtggggtttgtg

SEQ ID NO: 42424 - DNA, 20 bp, Homo sapiens
aagacacctgtcaaatgtca

SEQ ID NO: 42425 - DNA, 19 bp, Homo sapiens
aagacctatcatgccaaga

SEQ ID NO: 42426 - DNA, 16 bp, Homo sapiens
acatcacagggcaagc

SEQ ID NO: 42427 - DNA, 22 bp, Homo sapiens
actcgcctctgctcctgtggtc

SEQ ID NO: 42428 - DNA, 18 bp, Homo sapiens
cactctccagccatttgg

SEQ ID NO: 42429 - DNA, 17 bp, Homo sapiens
ccccctgggatggctca

SEQ ID NO: 42430 - DNA, 18 bp, Homo sapiens
ccgggtgggggattttgg

SEQ ID NO: 42431 - DNA, 24 bp, Homo sapiens
gcaggcatcaaactttacatccca

SEQ ID NO: 42432 - DNA, 17 bp, Homo sapiens
tgccaccaccaagccca

SEQ ID NO: 42433 - DNA, 20 bp, Homo sapiens
aagacacctgtcaaatgtca

SEQ ID NO: 42434 - DNA, 19 bp, Homo sapiens
aagacctatcatgccaaga

SEQ ID NO: 42435 - DNA, 16 bp, Homo sapiens
acatcacagggcaagc

SEQ ID NO: 42436 - DNA, 22 bp, Homo sapiens
actcgcctctgctcctgtggtc

SEQ ID NO: 42437 - DNA, 18 bp, Homo sapiens
cactctccagccatttgg

SEQ ID NO: 42438 - DNA, 17 bp, Homo sapiens
ccccctgggatggctca

SEQ ID NO: 42439 - DNA, 18 bp, Homo sapiens
ccgggtgggggattttgg

SEQ ID NO: 42440 - DNA, 24 bp, Homo sapiens
gcaggcatcaaactttacatccca

SEQ ID NO: 42441 - DNA, 17 bp, Homo sapiens
tgccaccaccaagccca

SEQ ID NO: 42442 - DNA, 21 bp, Homo sapiens
acccaccgcccaggctcatct

SEQ ID NO: 42443 - DNA, 20 bp, Homo sapiens
atggatacaatagaaatgta

SEQ ID NO: 42444 - DNA, 21 bp, Homo sapiens
gcctggcctgagtcaccagtg

SEQ ID NO: 42445 - DNA, 19 bp, Homo sapiens
caaattaaactcaatctct

SEQ ID NO: 42446 - DNA, 21 bp, Homo sapiens
ccttttcataaactctggttt

SEQ ID NO: 42447 - DNA, 18 bp, Homo sapiens
gaacaatcagatttaaac

SEQ ID NO: 42448 - DNA, 17 bp, Homo sapiens
gactgtatcttattttg

SEQ ID NO: 42449 - DNA, 16 bp, Homo sapiens
tgcagaaaccatgcaa

SEQ ID NO: 42450 - DNA, 19 bp, Homo sapiens
tttgtttaaaggcctggct

SEQ ID NO: 42451 - DNA, 20 bp, Homo sapiens
aagacacctgtcaaatgtca

SEQ ID NO: 42452 - DNA, 19 bp, Homo sapiens
aagacctatcatgccaaga

SEQ ID NO: 42453 - DNA, 16 bp, Homo sapiens
acatcacagggcaagc

SEQ ID NO: 42454 - DNA, 22 bp, Homo sapiens
actcgcctctgctcctgtggtc

SEQ ID NO: 42455 - DNA, 18 bp, Homo sapiens
cactctccagccatttgg

SEQ ID NO: 42456 - DNA, 17 bp, Homo sapiens
ccccctgggatggctca

SEQ ID NO: 42457 - DNA, 18 bp, Homo sapiens
ccgggtgggggattttgg

SEQ ID NO: 42458 - DNA, 24 bp, Homo sapiens
gcaggcatcaaactttacatccca

SEQ ID NO: 42459 - DNA, 17 bp, Homo sapiens
tgccaccaccaagccca

SEQ ID NO: 42460 - DNA, 18 bp, Homo sapiens
agacgccctctgaagcca

SEQ ID NO: 42461 - DNA, 17 bp, Homo sapiens
caagaaatcttgtgtca

SEQ ID NO: 42462 - DNA, 22 bp, Homo sapiens
gatctgatgaaaatacaacctc

SEQ ID NO: 42463 - DNA, 19 bp, Homo sapiens
gcttcctacctgacatgtt

SEQ ID NO: 42464 - DNA, 19 bp, Homo sapiens
ggccgggtgcggtggctca

SEQ ID NO: 42465 - DNA, 22 bp, Homo sapiens
tctggaaaacaacacacggtga

SEQ ID NO: 42466 - DNA, 20 bp, Homo sapiens
tgggtggatctcccagaaat

SEQ ID NO: 42467 - DNA, 19 bp, Homo sapiens
gcgtctgcaccacacattc

SEQ ID NO: 42468 - DNA, 18 bp, Homo sapiens
tcagtcctgcgtctgcac

SEQ ID NO: 42469 - DNA, 18 bp, Homo sapiens
tctgcaccacacattcaa

SEQ ID NO: 42470 - DNA, 18 bp, Homo sapiens
aatgaagtctctttcccc

SEQ ID NO: 42471 - DNA, 21 bp, Homo sapiens
accagaagaaccactcaagca

SEQ ID NO: 42472 - DNA, 18 bp, Homo sapiens
ttccattccgcggagctg

SEQ ID NO: 42473 - DNA, 22 bp, Homo sapiens
aaagtttagtttttcccattcg

SEQ ID NO: 42474 - DNA, 21 bp, Homo sapiens
aagtttagtttttcccattcg

SEQ ID NO: 42475 - DNA, 23 bp, Homo sapiens
acttctcttcattactgatagta

SEQ ID NO: 42476 - DNA, 17 bp, Homo sapiens
cctgggcagttttattc

SEQ ID NO: 42477 - DNA, 17 bp, Homo sapiens
cttggcaccagcaccca

SEQ ID NO: 42478 - DNA, 24 bp, Homo sapiens
ttttttcctggtttgtttgatctt

SEQ ID NO: 42479 - DNA, 23 bp, Homo sapiens
ccagcatctcattttcccccata

SEQ ID NO: 42480 - DNA, 18 bp, Homo sapiens
ctatgacctcgtgtcctc

SEQ ID NO: 42481 - DNA, 19 bp, Homo sapiens
ctagaaggtatgtgtgatt

SEQ ID NO: 42482 - DNA, 24 bp, Homo sapiens
tccagggctccaagctgagtctga

SEQ ID NO: 42483 - DNA, 20 bp, Homo sapiens
ttccagagggagccctccag

SEQ ID NO: 42484 - DNA, 18 bp, Homo sapiens
ttccaggggtctgcccag

SEQ ID NO: 42485 - DNA, 23 bp, Homo sapiens
aagtggtggcggggggcctgtgg

SEQ ID NO: 42486 - DNA, 18 bp, Homo sapiens
cactgcctacctcctgcc

SEQ ID NO: 42487 - DNA, 21 bp, Homo sapiens
gaactgagcacctgcactgca

SEQ ID NO: 42488 - DNA, 20 bp, Homo sapiens
ggggctgtcccagcccaaga

SEQ ID NO: 42489 - DNA, 19 bp, Homo sapiens
tcagcagggtggctgatga

SEQ ID NO: 42490 - DNA, 20 bp, Homo sapiens
tggatggcggcagcgtggag

SEQ ID NO: 42491 - DNA, 19 bp, Homo sapiens
acccccggtatccccccca

SEQ ID NO: 42492 - DNA, 18 bp, Homo sapiens
acctcagctttgttgtca

SEQ ID NO: 42493 - DNA, 17 bp, Homo sapiens
acctggacccacatttg

SEQ ID NO: 42494 - DNA, 21 bp, Homo sapiens
atctcggctcactgcaatctc

SEQ ID NO: 42495 - DNA, 18 bp, Homo sapiens
cccccgcctcgtcctcca

SEQ ID NO: 42496 - DNA, 24 bp, Homo sapiens
cctttttatggctgagcagtatct

SEQ ID NO: 42497 - DNA, 19 bp, Homo sapiens
ctgcaatctccgcctccca

SEQ ID NO: 42498 - DNA, 17 bp, Homo sapiens
gcacgccaccacttcct

SEQ ID NO: 42499 - DNA, 21 bp, Homo sapiens
ggagatggagccgggtgcggc

SEQ ID NO: 42500 - DNA, 18 bp, Homo sapiens
tccgcctcccaggttcaa

SEQ ID NO: 42501 - DNA, 22 bp, Homo sapiens
tctggtgccacctgagcactca

SEQ ID NO: 42502 - DNA, 27 bp, Homo sapiens
tggatggatttgccgattctgaaattg

SEQ ID NO: 42503 - DNA, 19 bp, Homo sapiens
ctgagcggctgccgggccc

SEQ ID NO: 42504 - DNA, 21 bp, Homo sapiens
gcctgagccggcccccggtcc

SEQ ID NO: 42505 - DNA, 19 bp, Homo sapiens
acagaagtctgacctctct

SEQ ID NO: 42506 - DNA, 23 bp, Homo sapiens
caaataatgatcatacatcttca

SEQ ID NO: 42507 - DNA, 22 bp, Homo sapiens
cagctagcccacacagacccca

SEQ ID NO: 42508 - DNA, 23 bp, Homo sapiens
gaaaaaaatccaaatggacatca

SEQ ID NO: 42509 - DNA, 22 bp, Homo sapiens
gaacatcgccaataatgggaca

SEQ ID NO: 42510 - DNA, 20 bp, Homo sapiens
gctcagctggaagcttttga

SEQ ID NO: 42511 - DNA, 21 bp, Homo sapiens
tgcaggagtggtccaggcagg

SEQ ID NO: 42512 - DNA, 17 bp, Homo sapiens
tggacatcaacagcttt

SEQ ID NO: 42513 - DNA, 21 bp, Homo sapiens
caccttcatagtcacattcga

SEQ ID NO: 42514 - DNA, 17 bp, Homo sapiens
cgccaccgtctgtctca

SEQ ID NO: 42515 - DNA, 17 bp, Homo sapiens
gtctcccctgtgtttca

SEQ ID NO: 42516 - DNA, 22 bp, Homo sapiens
tgactgtgtggaacgcaggtga

SEQ ID NO: 42517 - DNA, 24 bp, Homo sapiens
cccgccttttttgcggccaccatt

SEQ ID NO: 42518 - DNA, 20 bp, Homo sapiens
acagatgaccaaagtccctt

SEQ ID NO: 42519 - DNA, 16 bp, Homo sapiens
agcccaccaggagcac

SEQ ID NO: 42520 - DNA, 20 bp, Homo sapiens
ccaggggagaatgcagccca

SEQ ID NO: 42521 - DNA, 22 bp, Homo sapiens
cccaggccctcccaccacccca

SEQ ID NO: 42522 - DNA, 18 bp, Homo sapiens
cccttcgacatgctgcca

SEQ ID NO: 42523 - DNA, 19 bp, Homo sapiens
ccgctgcccaccagccatc

SEQ ID NO: 42524 - DNA, 20 bp, Homo sapiens
tcaccacccccactggcgag

SEQ ID NO: 42525 - DNA, 18 bp, Homo sapiens
tgaggtccgggtattcca

SEQ ID NO: 42526 - DNA, 20 bp, Homo sapiens
aaaattcaattgaagctgta

SEQ ID NO: 42527 - DNA, 21 bp, Homo sapiens
acgccagtgccaagctcttca

SEQ ID NO: 42528 - DNA, 17 bp, Homo sapiens
acttcatcatcttgtca

SEQ ID NO: 42529 - DNA, 20 bp, Homo sapiens
cctccctgcgggctgctgtg

SEQ ID NO: 42530 - DNA, 18 bp, Homo sapiens
gcccggccgggcttttaa

SEQ ID NO: 42531 - DNA, 19 bp, Homo sapiens
ggcacgactggggttggtt

SEQ ID NO: 42532 - DNA, 20 bp, Homo sapiens
tacagtctccttgtccctca

SEQ ID NO: 42533 - DNA, 19 bp, Homo sapiens
ccaccgccggctccgccca

SEQ ID NO: 42534 - DNA, 17 bp, Homo sapiens
cactgtgctctctgtca

SEQ ID NO: 42535 - DNA, 21 bp, Homo sapiens
tggggtccttgggctttgtca

SEQ ID NO: 42536 - DNA, 17 bp, Homo sapiens
agatccaaatagtcata

SEQ ID NO: 42537 - DNA, 21 bp, Homo sapiens
tggagtttggcaatgaaactg

SEQ ID NO: 42538 - DNA, 23 bp, Homo sapiens
agctcgtgtgtcttctcaactga

SEQ ID NO: 42539 - DNA, 17 bp, Homo sapiens
aggcctgtaggcattct

SEQ ID NO: 42540 - DNA, 19 bp, Homo sapiens
caatgaagtaaatatatca

SEQ ID NO: 42541 - DNA, 19 bp, Homo sapiens
cacacccagcagtctgcca

SEQ ID NO: 42542 - DNA, 15 bp, Homo sapiens
ccctcctctgctcct

SEQ ID NO: 42543 - DNA, 17 bp, Homo sapiens
gccccgccccctcctct

SEQ ID NO: 42544 - DNA, 21 bp, Homo sapiens
gcctgtccaagcctctgtgca

SEQ ID NO: 42545 - DNA, 19 bp, Homo sapiens
tgttaaaatgcaggtttga

SEQ ID NO: 42546 - DNA, 20 bp, Homo sapiens
ttccagaaagaagacgccag

SEQ ID NO: 42547 - DNA, 19 bp, Homo sapiens
gtgaacttttcctcctgga

SEQ ID NO: 42548 - DNA, 19 bp, Homo sapiens
acaacctgcacacggagct

SEQ ID NO: 42549 - DNA, 22 bp, Homo sapiens
caccaccaccacgcgcctgcct

SEQ ID NO: 42550 - DNA, 23 bp, Homo sapiens
gggcaccggacgatgtgcctctc

SEQ ID NO: 42551 - DNA, 22 bp, Homo sapiens
gtgcagcctgcccgctaccaca

SEQ ID NO: 42552 - DNA, 23 bp, Homo sapiens
ccaccctctctctacctgtcacc

SEQ ID NO: 42553 - DNA, 19 bp, Homo sapiens
ctgccaccaccctctctct

SEQ ID NO: 42554 - DNA, 20 bp, Homo sapiens
tgccctccaatgtggggctg

SEQ ID NO: 42555 - DNA, 25 bp, Homo sapiens
agctacaggaatccaagaaccagtg

SEQ ID NO: 42556 - DNA, 20 bp, Homo sapiens
gagctccagaaatctgcaca

SEQ ID NO: 42557 - DNA, 17 bp, Homo sapiens
tccagaaatctgcacag

SEQ ID NO: 42558 - DNA, 22 bp, Homo sapiens
gccgtcatctcccctctgcctc

SEQ ID NO: 42559 - DNA, 18 bp, Homo sapiens
caagagcataggagtttt

SEQ ID NO: 42560 - DNA, 19 bp, Homo sapiens
catgagaactagaaaggaa

SEQ ID NO: 42561 - DNA, 16 bp, Homo sapiens
agggggagacagattc

SEQ ID NO: 42562 - DNA, 20 bp, Homo sapiens
atcttggcctcctgggtctc

SEQ ID NO: 42563 - DNA, 17 bp, Homo sapiens
gcacacgacagcactga

SEQ ID NO: 42564 - DNA, 20 bp, Homo sapiens
gcgtgtgcaccgtgcgcgag

SEQ ID NO: 42565 - DNA, 21 bp, Homo sapiens
atcttggctcactgcaacctc

SEQ ID NO: 42566 - DNA, 25 bp, Homo sapiens
ccagcatgccaggcaacaggcggtg

SEQ ID NO: 42567 - DNA, 23 bp, Homo sapiens
gcctccctgcctgctcctctgcc

SEQ ID NO: 42568 - DNA, 17 bp, Homo sapiens
ggacggggagcttgcca

SEQ ID NO: 42569 - DNA, 18 bp, Homo sapiens
tccgcctcctgggttcaa

SEQ ID NO: 42570 - DNA, 23 bp, Homo sapiens
atgtatgtcatatatatgtcttt

SEQ ID NO: 42571 - DNA, 21 bp, Homo sapiens
gtcttgaactcctgggttcaa

SEQ ID NO: 42572 - DNA, 19 bp, Homo sapiens
gttcccagtaattacagta

SEQ ID NO: 42573 - DNA, 21 bp, Homo sapiens
ccctgatctttgggtcttgga

SEQ ID NO: 42574 - DNA, 19 bp, Homo sapiens
gaatttttttttccctgga

SEQ ID NO: 42575 - DNA, 18 bp, Homo sapiens
gcgcttaaatccaagact

SEQ ID NO: 42576 - DNA, 22 bp, Homo sapiens
acatcatatattttgatgttat

SEQ ID NO: 42577 - DNA, 25 bp, Homo sapiens
gaaaacatcatatattttgatgtta

SEQ ID NO: 42578 - DNA, 19 bp, Homo sapiens
gcctgcccccagcactcta

SEQ ID NO: 42579 - DNA, 21 bp, Homo sapiens
ttgtaaatatgcatatatgca

SEQ ID NO: 42580 - DNA, 21 bp, Homo sapiens
acaactcaaaaagagcagagc

SEQ ID NO: 42581 - DNA, 18 bp, Homo sapiens
actactcgagtaaatgaa

SEQ ID NO: 42582 - DNA, 19 bp, Homo sapiens
tgacaacccatacaactca

SEQ ID NO: 42583 - DNA, 18 bp, Homo sapiens
gggccacgggagttccgg

SEQ ID NO: 42584 - DNA, 19 bp, Homo sapiens
acagctgtcggcctccatg

SEQ ID NO: 42585 - DNA, 20 bp, Homo sapiens
atgacactgccgcacactca

SEQ ID NO: 42586 - DNA, 18 bp, Homo sapiens
cagcagatgtcactctga

SEQ ID NO: 42587 - DNA, 18 bp, Homo sapiens
aatgtgaagaatgtgata

SEQ ID NO: 42588 - DNA, 25 bp, Homo sapiens
actcatactggagagaaacattaca

SEQ ID NO: 42589 - DNA, 19 bp, Homo sapiens
caatcacgttaccatatca

SEQ ID NO: 42590 - DNA, 19 bp, Homo sapiens
gaatgtgaagaatgtgaca

SEQ ID NO: 42591 - DNA, 21 bp, Homo sapiens
gcagcaggcagaccttccaca

SEQ ID NO: 42592 - DNA, 22 bp, Homo sapiens
tgcttgactctgcttcttgcca

SEQ ID NO: 42593 - DNA, 19 bp, Homo sapiens
aaactcctggcctcaggtg

SEQ ID NO: 42594 - DNA, 19 bp, Homo sapiens
ccgagagacacagtgatga

SEQ ID NO: 42595 - DNA, 26 bp, Homo sapiens
cctcgtgatctgcctgccttggcctt

SEQ ID NO: 42596 - DNA, 24 bp, Homo sapiens
gtgctttggtcattgctcctctct

SEQ ID NO: 42597 - DNA, 16 bp, Homo sapiens
tgccattctcctgtct

SEQ ID NO: 42598 - DNA, 18 bp, Homo sapiens
aacacatcagaaatctca

SEQ ID NO: 42599 - DNA, 20 bp, Homo sapiens
atcagaaatctcactggaga

SEQ ID NO: 42600 - DNA, 19 bp, Homo sapiens
ccctgtctccaccttgata

SEQ ID NO: 42601 - DNA, 21 bp, Homo sapiens
ttttgatgatctggctgtgga

SEQ ID NO: 42602 - DNA, 17 bp, Homo sapiens
gtgacaatgtctagtaa

SEQ ID NO: 42603 - DNA, 17 bp, Homo sapiens
tcaccatccccagtaaa

SEQ ID NO: 42604 - DNA, 17 bp, Homo sapiens
tctcccttctgctgtca

SEQ ID NO: 42605 - DNA, 19 bp, Homo sapiens
tctggagagggcctctgag

SEQ ID NO: 42606 - DNA, 17 bp, Homo sapiens
gatcatatgctgccttt

SEQ ID NO: 42607 - DNA, 19 bp, Homo sapiens
cagacagaaccaggaactg

SEQ ID NO: 42608 - DNA, 20 bp, Homo sapiens
ccctgatgctggcctgtgag

SEQ ID NO: 42609 - DNA, 18 bp, Homo sapiens
ctgctgtccagacaactc

SEQ ID NO: 42610 - DNA, 19 bp, Homo sapiens
gggggcggtggcggtgaca

SEQ ID NO: 42611 - DNA, 24 bp, Homo sapiens
tcctggtgccgcagaggcctcgga

SEQ ID NO: 42612 - DNA, 22 bp, Homo sapiens
gaccccgacagagggcgacggc

SEQ ID NO: 42613 - DNA, 20 bp, Homo sapiens
gcggctgctcacggcgcacg

SEQ ID NO: 42614 - DNA, 17 bp, Homo sapiens
cctacaaacgtgaagaa

SEQ ID NO: 42615 - DNA, 21 bp, Homo sapiens
gaagaatgtggaaaagccatt

SEQ ID NO: 42616 - DNA, 21 bp, Homo sapiens
ttttttcagtggctttaacct

SEQ ID NO: 42617 - DNA, 23 bp, Homo sapiens
ccccgccccccaaccccacagct

SEQ ID NO: 42618 - DNA, 21 bp, Homo sapiens
cctgtctcaaaaaacaaaatc

SEQ ID NO: 42619 - DNA, 22 bp, Homo sapiens
cctttccacctatttccctcca

SEQ ID NO: 42620 - DNA, 24 bp, Homo sapiens
gacaagcttttaccgacttcctct

SEQ ID NO: 42621 - DNA, 18 bp, Homo sapiens
tccgcctcccgggttcaa

SEQ ID NO: 42622 - DNA, 19 bp, Homo sapiens
tgcccaccgccttctccag

SEQ ID NO: 42623 - DNA, 20 bp, Homo sapiens
tggtcaggctggtcttgaac

SEQ ID NO: 42624 - DNA, 23 bp, Homo sapiens
gctgtgtctgcaccgcttggttt

SEQ ID NO: 42625 - DNA, 16 bp, Homo sapiens
tccagatctgcactgg

SEQ ID NO: 42626 - DNA, 24 bp, Homo sapiens
caagcacagaaagcacagtcatca

SEQ ID NO: 42627 - DNA, 22 bp, Homo sapiens
ccccgcccaaccccaactcact

SEQ ID NO: 42628 - DNA, 17 bp, Homo sapiens
aaaaacaaacaaacaaa

SEQ ID NO: 42629 - DNA, 18 bp, Homo sapiens
atcacccctagtgaccca

SEQ ID NO: 42630 - DNA, 23 bp, Homo sapiens
atttgagagacaactcttggcct

SEQ ID NO: 42631 - DNA, 23 bp, Homo sapiens
atttgggtgtattactctggccc

SEQ ID NO: 42632 - DNA, 18 bp, Homo sapiens
cagcttgcagacatccta

SEQ ID NO: 42633 - DNA, 22 bp, Homo sapiens
ccaaggcactcactttacagct

SEQ ID NO: 42634 - DNA, 19 bp, Homo sapiens
ccatcatggtattccacac

SEQ ID NO: 42635 - DNA, 18 bp, Homo sapiens
cctggctgtgtctgtgag

SEQ ID NO: 42636 - DNA, 21 bp, Homo sapiens
cgtgttggctccctgactggt

SEQ ID NO: 42637 - DNA, 21 bp, Homo sapiens
ctattgtgggaccctgtgatt

SEQ ID NO: 42638 - DNA, 20 bp, Homo sapiens
gcaacaggtccaggctgctg

SEQ ID NO: 42639 - DNA, 18 bp, Homo sapiens
gggaggctgtaattgtca

SEQ ID NO: 42640 - DNA, 21 bp, Homo sapiens
ggtattcttaactgccttttt

SEQ ID NO: 42641 - DNA, 23 bp, Homo sapiens
ggtccagtgggtccccagactca

SEQ ID NO: 42642 - DNA, 19 bp, Homo sapiens
tcacatcccaactccaatg

SEQ ID NO: 42643 - DNA, 17 bp, Homo sapiens
tctgaatcagcatccaa

SEQ ID NO: 42644 - DNA, 20 bp, Homo sapiens
tggatggacctctctgagtg

SEQ ID NO: 42645 - DNA, 19 bp, Homo sapiens
tgggctttggtggaaactg

SEQ ID NO: 42646 - DNA, 25 bp, Homo sapiens
ttaatactgagtgtcaacttgattg

SEQ ID NO: 42647 - DNA, 19 bp, Homo sapiens
ctgattgttttatgtgatt

SEQ ID NO: 42648 - DNA, 23 bp, Homo sapiens
aaagtatcatcagaatcatccca

SEQ ID NO: 42649 - DNA, 22 bp, Homo sapiens
acctggcccataaattgtcata

SEQ ID NO: 42650 - DNA, 17 bp, Homo sapiens
atgatgcagaaaggatc

SEQ ID NO: 42651 - DNA, 18 bp, Homo sapiens
caaagactgtgcctaaaa

SEQ ID NO: 42652 - DNA, 21 bp, Homo sapiens
catacatatgtgcaaggttag

SEQ ID NO: 42653 - DNA, 23 bp, Homo sapiens
gtgtgtgtgtcagtgctcagcta

SEQ ID NO: 42654 - DNA, 28 bp, Homo sapiens
taagtgttagagactttaatgtaagcta

SEQ ID NO: 42655 - DNA, 23 bp, Homo sapiens
ttttaacataacctgggagaaga

SEQ ID NO: 42656 - DNA, 21 bp, Homo sapiens
acttgatcagtcgtttgacct

SEQ ID NO: 42657 - DNA, 18 bp, Homo sapiens
agctggataaaaatgtca

SEQ ID NO: 42658 - DNA, 17 bp, Homo sapiens
tcaagtgattctcttgc

SEQ ID NO: 42659 - DNA, 22 bp, Homo sapiens
aaatgactctttgagcaactca

SEQ ID NO: 42660 - DNA, 20 bp, Homo sapiens
ctgggacatcacactttttt

SEQ ID NO: 42661 - DNA, 19 bp, Homo sapiens
ctgtttctcccccctagga

SEQ ID NO: 42662 - DNA, 24 bp, Homo sapiens
ttttgagatggtggaatctgtgga

SEQ ID NO: 42663 - DNA, 19 bp, Homo sapiens
aaaaacaaaaacaaacaaa

SEQ ID NO: 42664 - DNA, 17 bp, Homo sapiens
aaaaacaaacaaacaaa

SEQ ID NO: 42665 - DNA, 18 bp, Homo sapiens
acttcccagaagttatat

SEQ ID NO: 42666 - DNA, 18 bp, Homo sapiens
caacgtcctcctctccct

SEQ ID NO: 42667 - DNA, 23 bp, Homo sapiens
caactgcctgcaaccgccgctga

SEQ ID NO: 42668 - DNA, 17 bp, Homo sapiens
cccctgtgcagatgaca

SEQ ID NO: 42669 - DNA, 22 bp, Homo sapiens
gcacccgcttcaactgcctgca

SEQ ID NO: 42670 - DNA, 24 bp, Homo sapiens
gccattctgctggggttctggaga

SEQ ID NO: 42671 - DNA, 23 bp, Homo sapiens
caaacacaaatagagatttcata

SEQ ID NO: 42672 - DNA, 18 bp, Homo sapiens
caagcaccagatcagaca

SEQ ID NO: 42673 - DNA, 23 bp, Homo sapiens
cagacaggctgtgaagaagctct

SEQ ID NO: 42674 - DNA, 22 bp, Homo sapiens
gaattttgcaatgctctctgga

SEQ ID NO: 42675 - DNA, 19 bp, Homo sapiens
ggccaaggtcaccaccctg

SEQ ID NO: 42676 - DNA, 24 bp, Homo sapiens
gtataatattagcttatttgacta

SEQ ID NO: 42677 - DNA, 20 bp, Homo sapiens
cttaccccacccccacctcc

SEQ ID NO: 42678 - DNA, 19 bp, Homo sapiens
ctgcttctgctgtgtggtg

SEQ ID NO: 42679 - DNA, 18 bp, Homo sapiens
actcacatattgtgtaca

SEQ ID NO: 42680 - DNA, 23 bp, Homo sapiens
ccctgagtcatggaggcctgggg

SEQ ID NO: 42681 - DNA, 17 bp, Homo sapiens
gaccgtagtcgtctgtg

SEQ ID NO: 42682 - DNA, 18 bp, Homo sapiens
gagttctgtttccgtgga

SEQ ID NO: 42683 - DNA, 21 bp, Homo sapiens
gcaccacgcccacgcaggccc

SEQ ID NO: 42684 - DNA, 22 bp, Homo sapiens
gcccacgcaggcccactgtgca

SEQ ID NO: 42685 - DNA, 19 bp, Homo sapiens
tgtgtgtcaaagttgtcca

SEQ ID NO: 42686 - DNA, 19 bp, Homo sapiens
aacacaaatacagtatcca

SEQ ID NO: 42687 - DNA, 22 bp, Homo sapiens
aagacctaccatgctgggtagg

SEQ ID NO: 42688 - DNA, 18 bp, Homo sapiens
accgcacccggctggcca

SEQ ID NO: 42689 - DNA, 19 bp, Homo sapiens
cgctgcaacccccacctcc

SEQ ID NO: 42690 - DNA, 17 bp, Homo sapiens
cggctggccaatcttat

SEQ ID NO: 42691 - DNA, 25 bp, Homo sapiens
ctgggattacaggcacccaccacta

SEQ ID NO: 42692 - DNA, 22 bp, Homo sapiens
gctctaaaggtttctcctttgc

SEQ ID NO: 42693 - DNA, 18 bp, Homo sapiens
ggttcctaacccaaccta

SEQ ID NO: 42694 - DNA, 18 bp, Homo sapiens
tcctgacctcatgatcca

SEQ ID NO: 42695 - DNA, 19 bp, Homo sapiens
tctatcttcaggaaaccct

SEQ ID NO: 42696 - DNA, 20 bp, Homo sapiens
tcttgtgctttgcacccctg

SEQ ID NO: 42697 - DNA, 23 bp, Homo sapiens
tttcagtctgctgctttgctctt

SEQ ID NO: 42698 - DNA, 23 bp, Homo sapiens
gaatacttggaaagttgtttaca

SEQ ID NO: 42699 - DNA, 21 bp, Homo sapiens
atatattttgttataagacat

SEQ ID NO: 42700 - DNA, 17 bp, Homo sapiens
atttttttaaacactaa

SEQ ID NO: 42701 - DNA, 21 bp, Homo sapiens
ttcatttgccagacgcttttt

SEQ ID NO: 42702 - DNA, 23 bp, Homo sapiens
ttctggcggtgctgtgcttggaa

SEQ ID NO: 42703 - DNA, 19 bp, Homo sapiens
tgcaaagcaaaggctcctt

SEQ ID NO: 42704 - DNA, 19 bp, Homo sapiens
ccccagcccctgtgccagg

SEQ ID NO: 42705 - DNA, 22 bp, Homo sapiens
gggacagccaggcacctgctcc

SEQ ID NO: 42706 - DNA, 20 bp, Homo sapiens
tgcctgtggagggactggag

SEQ ID NO: 42707 - DNA, 21 bp, Homo sapiens
ccttttcgtcaggtttgactt

SEQ ID NO: 42708 - DNA, 21 bp, Homo sapiens
ttacggtgcggttgagaagta

SEQ ID NO: 42709 - DNA, 20 bp, Homo sapiens
agaaaattagcaatgctgta

SEQ ID NO: 42710 - DNA, 19 bp, Homo sapiens
tggctatataccctgacca

SEQ ID NO: 42711 - DNA, 24 bp, Homo sapiens
cctacacagtcagctaagcatgaa

SEQ ID NO: 42712 - DNA, 18 bp, Homo sapiens
ggagagaaaaaacacttt

SEQ ID NO: 42713 - DNA, 20 bp, Homo sapiens
tttgtatttgttacctctga

SEQ ID NO: 42714 - DNA, 18 bp, Homo sapiens
cgtgtactggctcctctg

SEQ ID NO: 42715 - DNA, 20 bp, Homo sapiens
aaagcctttttcaacatatc

SEQ ID NO: 42716 - DNA, 18 bp, Homo sapiens
aaataccccaaacatgaa

SEQ ID NO: 42717 - DNA, 23 bp, Homo sapiens
aacttaatctcatctaatgtaaa

SEQ ID NO: 42718 - DNA, 18 bp, Homo sapiens
accaaactctggatttaa

SEQ ID NO: 42719 - DNA, 18 bp, Homo sapiens
atattgatacctctgata

SEQ ID NO: 42720 - DNA, 18 bp, Homo sapiens
atggagttcgtgaacaca

SEQ ID NO: 42721 - DNA, 20 bp, Homo sapiens
atttatactctttggactcc

SEQ ID NO: 42722 - DNA, 18 bp, Homo sapiens
gaataacaactcagtgaa

SEQ ID NO: 42723 - DNA, 21 bp, Homo sapiens
gttcttcacctctaagatggg

SEQ ID NO: 42724 - DNA, 21 bp, Homo sapiens
tacactctgattcctataata

SEQ ID NO: 42725 - DNA, 23 bp, Homo sapiens
taggtggaatgcatctgagacta

SEQ ID NO: 42726 - DNA, 21 bp, Homo sapiens
tccctcgtgtcgcccctcgga

SEQ ID NO: 42727 - DNA, 21 bp, Homo sapiens
tctgtatttcccatttctttt

SEQ ID NO: 42728 - DNA, 23 bp, Homo sapiens
ttctcctgcttgtctcagcttca

SEQ ID NO: 42729 - DNA, 20 bp, Homo sapiens
agccacatgccagagattca

SEQ ID NO: 42730 - DNA, 18 bp, Homo sapiens
aggtgccttctccaccca

SEQ ID NO: 42731 - DNA, 18 bp, Homo sapiens
tccccaccaggtgatccg

SEQ ID NO: 42732 - DNA, 17 bp, Homo sapiens
tgtctaccaactagaca

SEQ ID NO: 42733 - DNA, 16 bp, Homo sapiens
ttcatcagagctcggc

SEQ ID NO: 42734 - DNA, 23 bp, Homo sapiens
acccactggcttcccccttccca

SEQ ID NO: 42735 - DNA, 24 bp, Homo sapiens
ccatgtttccccacctctgttcct

SEQ ID NO: 42736 - DNA, 21 bp, Homo sapiens
cccatgctggaggcttgtgga

SEQ ID NO: 42737 - DNA, 18 bp, Homo sapiens
gcccatctcccatgtttc

SEQ ID NO: 42738 - DNA, 20 bp, Homo sapiens
ttgttttctccctggacttc

SEQ ID NO: 42739 - DNA, 19 bp, Homo sapiens
caccctgctgcccaacagc

SEQ ID NO: 42740 - DNA, 19 bp, Homo sapiens
gaaccgtggccaacagttc

SEQ ID NO: 42741 - DNA, 20 bp, Homo sapiens
aaaccaatggaggactcagg

SEQ ID NO: 42742 - DNA, 18 bp, Homo sapiens
ccatcaaaccaatggagg

SEQ ID NO: 42743 - DNA, 21 bp, Homo sapiens
ccctgcttgagaaggttttgg

SEQ ID NO: 42744 - DNA, 21 bp, Homo sapiens
ctgtcctgcttttgcttccca

SEQ ID NO: 42745 - DNA, 20 bp, Homo sapiens
gctggggcccaggaagagta

SEQ ID NO: 42746 - DNA, 17 bp, Homo sapiens
cttgttctctgccttca

SEQ ID NO: 42747 - DNA, 18 bp, Homo sapiens
gcttgctgatccaacaaa

SEQ ID NO: 42748 - DNA, 19 bp, Homo sapiens
tgaagaaataagttcagag

SEQ ID NO: 42749 - DNA, 22 bp, Homo sapiens
ccgacttcctttttttgctcct

SEQ ID NO: 42750 - DNA, 18 bp, Homo sapiens
gacccgccaggcacacct

SEQ ID NO: 42751 - DNA, 20 bp, Homo sapiens
gcaaggcagctgcacatcca

SEQ ID NO: 42752 - DNA, 23 bp, Homo sapiens
tgatcactgtgtgccacacccca

SEQ ID NO: 42753 - DNA, 21 bp, Homo sapiens
tgcaagcccagtcctcactca

SEQ ID NO: 42754 - DNA, 18 bp, Homo sapiens
cacgcccaccctccttct

SEQ ID NO: 42755 - DNA, 22 bp, Homo sapiens
cagcctgaccaacacgatgaaa

SEQ ID NO: 42756 - DNA, 22 bp, Homo sapiens
gagccaagatcacaccactgca

SEQ ID NO: 42757 - DNA, 20 bp, Homo sapiens
aaaatcagacatttgaatat

SEQ ID NO: 42758 - DNA, 18 bp, Homo sapiens
ccgtccccagatcaccta

SEQ ID NO: 42759 - DNA, 23 bp, Homo sapiens
ccgtggctttctgacacgtgaca

SEQ ID NO: 42760 - DNA, 18 bp, Homo sapiens
cttccctttctctacctt

SEQ ID NO: 42761 - DNA, 18 bp, Homo sapiens
tcaggtgcctactactaa

SEQ ID NO: 42762 - DNA, 18 bp, Homo sapiens
ttaaaatcagacatttga

SEQ ID NO: 42763 - DNA, 18 bp, Homo sapiens
gaaaatttaaggaaatat

SEQ ID NO: 42764 - DNA, 21 bp, Homo sapiens
tgtgactacaagtacacacta

SEQ ID NO: 42765 - DNA, 18 bp, Homo sapiens
agggcagatgccatcaca

SEQ ID NO: 42766 - DNA, 18 bp, Homo sapiens
cacttcttcctacattga

SEQ ID NO: 42767 - DNA, 18 bp, Homo sapiens
ccatccagtgcctcgtca

SEQ ID NO: 42768 - DNA, 22 bp, Homo sapiens
ccctgatgaccagagcctcgag

SEQ ID NO: 42769 - DNA, 15 bp, Homo sapiens
cttctgccatgactg

SEQ ID NO: 42770 - DNA, 22 bp, Homo sapiens
gcccagcaagtcaatacatact

SEQ ID NO: 42771 - DNA, 16 bp, Homo sapiens
ggccgccccttcctct

SEQ ID NO: 42772 - DNA, 19 bp, Homo sapiens
gtgtcgtgggaaggaccca

SEQ ID NO: 42773 - DNA, 24 bp, Homo sapiens
tgaataagttaatttctgccagtg

SEQ ID NO: 42774 - DNA, 20 bp, Homo sapiens
tttccgtctgttcctttaaa

SEQ ID NO: 42775 - DNA, 20 bp, Homo sapiens
aacacagaagacttctgtga

SEQ ID NO: 42776 - DNA, 21 bp, Homo sapiens
agaaactctaagttcctggga

SEQ ID NO: 42777 - DNA, 21 bp, Homo sapiens
cctgaggccttcaaacagtgg

SEQ ID NO: 42778 - DNA, 17 bp, Homo sapiens
tctacctggagatagtg

SEQ ID NO: 42779 - DNA, 18 bp, Homo sapiens
acctccaacccttaagca

SEQ ID NO: 42780 - DNA, 17 bp, Homo sapiens
atgagagagacacagaa

SEQ ID NO: 42781 - DNA, 18 bp, Homo sapiens
attggaggatctgtgaca

SEQ ID NO: 42782 - DNA, 21 bp, Homo sapiens
ggttcacctgtgttgtagcaa

SEQ ID NO: 42783 - DNA, 25 bp, Homo sapiens
gtctcccctagaaacacatccatgg

SEQ ID NO: 42784 - DNA, 20 bp, Homo sapiens
gtttagaagaaaacattaga

SEQ ID NO: 42785 - DNA, 22 bp, Homo sapiens
ttctcctgcttctttgctttcc

SEQ ID NO: 42786 - DNA, 18 bp, Homo sapiens
ccaagcagaatgcctctc

SEQ ID NO: 42787 - DNA, 23 bp, Homo sapiens
cccatcttcagaaccaatggagg

SEQ ID NO: 42788 - DNA, 20 bp, Homo sapiens
ctggacggtggaggacctgc

SEQ ID NO: 42789 - DNA, 18 bp, Homo sapiens
gagctactcctccaactc

SEQ ID NO: 42790 - DNA, 22 bp, Homo sapiens
gcctgagtgtgcactttggctc

SEQ ID NO: 42791 - DNA, 18 bp, Homo sapiens
gcttgtatgttcttttgg

SEQ ID NO: 42792 - DNA, 19 bp, Homo sapiens
gcttgtctcggcagctaag

SEQ ID NO: 42793 - DNA, 18 bp, Homo sapiens
ggttacagggaaaaccac

SEQ ID NO: 42794 - DNA, 19 bp, Homo sapiens
tccaggagctactcctcca

SEQ ID NO: 42795 - DNA, 20 bp, Homo sapiens
agtttcactctgtcgcccag

SEQ ID NO: 42796 - DNA, 20 bp, Homo sapiens
tggccaggctggtcttgaac

SEQ ID NO: 42797 - DNA, 18 bp, Homo sapiens
acaccacgccttgagcaa

SEQ ID NO: 42798 - DNA, 18 bp, Homo sapiens
accagactccatctcaaa

SEQ ID NO: 42799 - DNA, 22 bp, Homo sapiens
tgcgtgattgccaaagaccact

SEQ ID NO: 42800 - DNA, 20 bp, Homo sapiens
ttctgtctccctgccctctg

SEQ ID NO: 42801 - DNA, 17 bp, Homo sapiens
acgcttgtaatcgcagc

SEQ ID NO: 42802 - DNA, 19 bp, Homo sapiens
ccgtggaggcagctagctc

SEQ ID NO: 42803 - DNA, 21 bp, Homo sapiens
gaacttaataataatgagaca

SEQ ID NO: 42804 - DNA, 18 bp, Homo sapiens
gatatgtgcagccgggta

SEQ ID NO: 42805 - DNA, 23 bp, Homo sapiens
aaagtaaagaatatgatgagtac

SEQ ID NO: 42806 - DNA, 22 bp, Homo sapiens
acaggcaagctaaagaaacctc

SEQ ID NO: 42807 - DNA, 17 bp, Homo sapiens
gtgatgacaactttggt

SEQ ID NO: 42808 - DNA, 18 bp, Homo sapiens
tgagtggatcctgaaatg

SEQ ID NO: 42809 - DNA, 27 bp, Homo sapiens
ccagtcatggagttaagaagtgagtca

SEQ ID NO: 42810 - DNA, 23 bp, Homo sapiens
ccatacaacaggactatgtgatg

SEQ ID NO: 42811 - DNA, 21 bp, Homo sapiens
tccacagacactacccaaagc

SEQ ID NO: 42812 - DNA, 19 bp, Homo sapiens
tcctcaacaaaatactggc

SEQ ID NO: 42813 - DNA, 19 bp, Homo sapiens
catgtctcccagcccctga

SEQ ID NO: 42814 - DNA, 19 bp, Homo sapiens
ctcagtggcttcttggagt

SEQ ID NO: 42815 - DNA, 16 bp, Homo sapiens
ggacacacctgccaag

SEQ ID NO: 42816 - DNA, 21 bp, Homo sapiens
ccaatatccagaaaacattct

SEQ ID NO: 42817 - DNA, 23 bp, Homo sapiens
acaaaacaccatgtggagactca

SEQ ID NO: 42818 - DNA, 21 bp, Homo sapiens
gccaggaaaatgccctgtgtg

SEQ ID NO: 42819 - DNA, 16 bp, Homo sapiens
gcatttatatgtgcat

SEQ ID NO: 42820 - DNA, 19 bp, Homo sapiens
ttttttgttgccttgcctt

SEQ ID NO: 42821 - DNA, 18 bp, Homo sapiens
ccttgtcaaatcgtctta

SEQ ID NO: 42822 - DNA, 18 bp, Homo sapiens
ccctgtgggcagccgtgc

SEQ ID NO: 42823 - DNA, 19 bp, Homo sapiens
accaaggacctgctcacca

SEQ ID NO: 42824 - DNA, 22 bp, Homo sapiens
gcctgggccgtggcagccgcct

SEQ ID NO: 42825 - DNA, 20 bp, Homo sapiens
ggaggaggctgggcagggcc

SEQ ID NO: 42826 - DNA, 17 bp, Homo sapiens
tctgtcctgggcgctgc

SEQ ID NO: 42827 - DNA, 19 bp, Homo sapiens
agagattcattgcagctca

SEQ ID NO: 42828 - DNA, 21 bp, Homo sapiens
aagatgcacaatggctagtca

SEQ ID NO: 42829 - DNA, 18 bp, Homo sapiens
atacttttgaatcactta

SEQ ID NO: 42830 - DNA, 20 bp, Homo sapiens
atgtggaaatagctctgatg

SEQ ID NO: 42831 - DNA, 20 bp, Homo sapiens
attttatttatatttctggt

SEQ ID NO: 42832 - DNA, 18 bp, Homo sapiens
caaactgtgactctgtgt

SEQ ID NO: 42833 - DNA, 18 bp, Homo sapiens
ccctccaccgccagaaga

SEQ ID NO: 42834 - DNA, 18 bp, Homo sapiens
cctgatccagtctgtgaa

SEQ ID NO: 42835 - DNA, 28 bp, Homo sapiens
tccaccgccagaagactgaattgaccaa

SEQ ID NO: 42836 - DNA, 21 bp, Homo sapiens
tggggttgtttaacatgaaac

SEQ ID NO: 42837 - DNA, 18 bp, Homo sapiens
tgtttgcatttcaactgc

SEQ ID NO: 42838 - DNA, 24 bp, Homo sapiens
ttaacagctttttggttattttta

SEQ ID NO: 42839 - DNA, 19 bp, Homo sapiens
aaagccaaatttcccatgt

SEQ ID NO: 42840 - DNA, 20 bp, Homo sapiens
gccacggaggaggcttctaa

SEQ ID NO: 42841 - DNA, 20 bp, Homo sapiens
tactattaacaatctgtaac

SEQ ID NO: 42842 - DNA, 19 bp, Homo sapiens
tcccatgtaagctgcagtt

SEQ ID NO: 42843 - DNA, 19 bp, Homo sapiens
tctgctgcggcgccctctt

SEQ ID NO: 42844 - DNA, 22 bp, Homo sapiens
ttcaactgcattgcatcctctt

SEQ ID NO: 42845 - DNA, 24 bp, Homo sapiens
tttctatctttagcccatcatcat

SEQ ID NO: 42846 - DNA, 24 bp, Homo sapiens
accgttccccatctctctccctct

SEQ ID NO: 42847 - DNA, 23 bp, Homo sapiens
cccacagaccgttccccatctct

SEQ ID NO: 42848 - DNA, 27 bp, Homo sapiens
ttctgaaaacaaatggagggtttgtgg

SEQ ID NO: 42849 - DNA, 23 bp, Homo sapiens
aacaaaaaaggcagatgtgcaag

SEQ ID NO: 42850 - DNA, 17 bp, Homo sapiens
cctggtataaaactaca

SEQ ID NO: 42851 - DNA, 20 bp, Homo sapiens
ctctacaatgctaattctgg

SEQ ID NO: 42852 - DNA, 20 bp, Homo sapiens
gatctggttttaatgatgaa

SEQ ID NO: 42853 - DNA, 19 bp, Homo sapiens
ggaacctggtataaaacta

SEQ ID NO: 42854 - DNA, 23 bp, Homo sapiens
tttctccccaataccaccaacga

SEQ ID NO: 42855 - DNA, 20 bp, Homo sapiens
agttgtattggattacatta

SEQ ID NO: 42856 - DNA, 17 bp, Homo sapiens
atgatacagaaagtatc

SEQ ID NO: 42857 - DNA, 21 bp, Homo sapiens
ctcaaaaacatgaaagggcat

SEQ ID NO: 42858 - DNA, 17 bp, Homo sapiens
ggaaaaaagacaagcaa

SEQ ID NO: 42859 - DNA, 19 bp, Homo sapiens
gtgccttaaaatggtgaac

SEQ ID NO: 42860 - DNA, 21 bp, Homo sapiens
gtgtaaatgttttttaggata

SEQ ID NO: 42861 - DNA, 20 bp, Homo sapiens
tggatttaattatgaggcta

SEQ ID NO: 42862 - DNA, 18 bp, Homo sapiens
aaataccattctgatgta

SEQ ID NO: 42863 - DNA, 22 bp, Homo sapiens
ctcttgaagacgcatcactgga

SEQ ID NO: 42864 - DNA, 18 bp, Homo sapiens
tccgcctctcgggttcaa

SEQ ID NO: 42865 - DNA, 19 bp, Homo sapiens
tgtttctttctatgcatat

SEQ ID NO: 42866 - DNA, 18 bp, Homo sapiens
atgcatgcgaggtgcttc

SEQ ID NO: 42867 - DNA, 22 bp, Homo sapiens
gcctggattccagtcctggctc

SEQ ID NO: 42868 - DNA, 23 bp, Homo sapiens
gctctgaagttgcagggctgcga

SEQ ID NO: 42869 - DNA, 18 bp, Homo sapiens
tctgcccttctttttgca

SEQ ID NO: 42870 - DNA, 16 bp, Homo sapiens
tccatgcctgtcccag

SEQ ID NO: 42871 - DNA, 21 bp, Homo sapiens
ctggagttgaccaggcctacc

SEQ ID NO: 42872 - DNA, 21 bp, Homo sapiens
tctacactgctggttgtatga

SEQ ID NO: 42873 - DNA, 22 bp, Homo sapiens
ttgggttaggggagcctttgtc

SEQ ID NO: 42874 - DNA, 19 bp, Homo sapiens
aatgagagaggcggccggc

SEQ ID NO: 42875 - DNA, 21 bp, Homo sapiens
ttcctgcctacccgcactgtc

SEQ ID NO: 42876 - DNA, 18 bp, Homo sapiens
caggcttcctgtttgtaa

SEQ ID NO: 42877 - DNA, 16 bp, Homo sapiens
gagctcctggatctca

SEQ ID NO: 42878 - DNA, 20 bp, Homo sapiens
tgtaaaatagacagaattcc

SEQ ID NO: 42879 - DNA, 17 bp, Homo sapiens
ctgtgtggttttgtttt

SEQ ID NO: 42880 - DNA, 22 bp, Homo sapiens
gccccgcgggacctgtgcaagc

SEQ ID NO: 42881 - DNA, 21 bp, Homo sapiens
tgactagacggtccgcagggg

SEQ ID NO: 42882 - DNA, 22 bp, Homo sapiens
accaaaacaaacttttcaatga

SEQ ID NO: 42883 - DNA, 24 bp, Homo sapiens
gccttttttcctcccccatcccct

SEQ ID NO: 42884 - DNA, 17 bp, Homo sapiens
gtgcttgactgcatgct

SEQ ID NO: 42885 - DNA, 22 bp, Homo sapiens
tttcacagcaccattctcagaa

SEQ ID NO: 42886 - DNA, 20 bp, Homo sapiens
gcggaggaggagagctagac

SEQ ID NO: 42887 - DNA, 21 bp, Homo sapiens
accttatccagaaggaactca

SEQ ID NO: 42888 - DNA, 21 bp, Homo sapiens
gatgtcttcgttatgaaactg

SEQ ID NO: 42889 - DNA, 19 bp, Homo sapiens
gtacaaatgaacacagttt

SEQ ID NO: 42890 - DNA, 21 bp, Homo sapiens
tcaaagcttatatgtaaactt

SEQ ID NO: 42891 - DNA, 21 bp, Homo sapiens
tcttcaggtttcagttcttca

SEQ ID NO: 42892 - DNA, 20 bp, Homo sapiens
tggccaggctggtcttgaac

SEQ ID NO: 42893 - DNA, 20 bp, Homo sapiens
aacagtagcaaaagatgcca

SEQ ID NO: 42894 - DNA, 16 bp, Homo sapiens
aaggcatctagtatta

SEQ ID NO: 42895 - DNA, 22 bp, Homo sapiens
atttgaaagaaatcgtttgcct

SEQ ID NO: 42896 - DNA, 18 bp, Homo sapiens
cagggtagaaagactgta

SEQ ID NO: 42897 - DNA, 19 bp, Homo sapiens
tcttatgagagacttgtgg

SEQ ID NO: 42898 - DNA, 20 bp, Homo sapiens
tgagactgtgtctcaacaaa

SEQ ID NO: 42899 - DNA, 22 bp, Homo sapiens
tgcaagtgattgtcctgcctca

SEQ ID NO: 42900 - DNA, 20 bp, Homo sapiens
cctctgactcctgggttcaa

SEQ ID NO: 42901 - DNA, 18 bp, Homo sapiens
ctccctccctctgccttt

SEQ ID NO: 42902 - DNA, 21 bp, Homo sapiens
gcgcctccttctgcggactct

SEQ ID NO: 42903 - DNA, 20 bp, Homo sapiens
tgggaggcctgaggttctga

SEQ ID NO: 42904 - DNA, 21 bp, Homo sapiens
atcaaatttaaatgatgtgat

SEQ ID NO: 42905 - DNA, 21 bp, Homo sapiens
gggtcacacaacattcactaa

SEQ ID NO: 42906 - DNA, 20 bp, Homo sapiens
cacatgttatgctcttttca

SEQ ID NO: 42907 - DNA, 25 bp, Homo sapiens
cttcacaagggttgcaaaaagtaga

SEQ ID NO: 42908 - DNA, 18 bp, Homo sapiens
gtggcaatgaaatgccat

SEQ ID NO: 42909 - DNA, 18 bp, Homo sapiens
tgaaatgccatagtatta

SEQ ID NO: 42910 - DNA, 25 bp, Homo sapiens
gcccccgacgccgccgagcacgtca

SEQ ID NO: 42911 - DNA, 20 bp, Homo sapiens
aagaactaatgttctcctca

SEQ ID NO: 42912 - DNA, 19 bp, Homo sapiens
catggaaaagacaccaaac

SEQ ID NO: 42913 - DNA, 18 bp, Homo sapiens
catggccaggtctggtca

SEQ ID NO: 42914 - DNA, 23 bp, Homo sapiens
ccatacaatgaaagctataacta

SEQ ID NO: 42915 - DNA, 20 bp, Homo sapiens
ctaatgttctcctcagctga

SEQ ID NO: 42916 - DNA, 19 bp, Homo sapiens
ctctccttggatacctgat

SEQ ID NO: 42917 - DNA, 19 bp, Homo sapiens
ctttctctctttaggtatc

SEQ ID NO: 42918 - DNA, 25 bp, Homo sapiens
tgtaggtaggaagtatgtgcaggtg

SEQ ID NO: 42919 - DNA, 20 bp, Homo sapiens
aaacactgatgttgatttca

SEQ ID NO: 42920 - DNA, 20 bp, Homo sapiens
tgaatgcagaacttgccagt

SEQ ID NO: 42921 - DNA, 19 bp, Homo sapiens
atgggagcccccataccca

SEQ ID NO: 42922 - DNA, 25 bp, Homo sapiens
cctctgacaccttgactttagcctt

SEQ ID NO: 42923 - DNA, 20 bp, Homo sapiens
ttcaagaccagcctagccaa

SEQ ID NO: 42924 - DNA, 22 bp, Homo sapiens
accagagagtgggtcctcagca

SEQ ID NO: 42925 - DNA, 22 bp, Homo sapiens
agaaaattagaaccacgctgta

SEQ ID NO: 42926 - DNA, 22 bp, Homo sapiens
gaaccaagatcgcaccactgca

SEQ ID NO: 42927 - DNA, 22 bp, Homo sapiens
gataggtttttaaattgctttt

SEQ ID NO: 42928 - DNA, 18 bp, Homo sapiens
tgggtggatcacttgagg

SEQ ID NO: 42929 - DNA, 18 bp, Homo sapiens
ccttggtcaaatccttca

SEQ ID NO: 42930 - DNA, 16 bp, Homo sapiens
tgctgttagcactgtt

SEQ ID NO: 42931 - DNA, 19 bp, Homo sapiens
agctaaatagtttgaatta

SEQ ID NO: 42932 - DNA, 24 bp, Homo sapiens
cctctgggccgctgccttcgcttt

SEQ ID NO: 42933 - DNA, 24 bp, Homo sapiens
ctttttgtagtttcttttaatttt

SEQ ID NO: 42934 - DNA, 21 bp, Homo sapiens
gtcatctgtttaacactccca

SEQ ID NO: 42935 - DNA, 19 bp, Homo sapiens
tactccatagtgcaatcca

SEQ ID NO: 42936 - DNA, 19 bp, Homo sapiens
tgtgggtagtatttgtggt

SEQ ID NO: 42937 - DNA, 16 bp, Homo sapiens
acacccatctgcagta

SEQ ID NO: 42938 - DNA, 24 bp, Homo sapiens
agtgtgtctcaaggggcatttgtg

SEQ ID NO: 42939 - DNA, 18 bp, Homo sapiens
agttctccggatattcac

SEQ ID NO: 42940 - DNA, 18 bp, Homo sapiens
cttcccgcctctgcccct

SEQ ID NO: 42941 - DNA, 24 bp, Homo sapiens
gaccgcgcgtccgccccagtccca

SEQ ID NO: 42942 - DNA, 22 bp, Homo sapiens
ggagctgagccccgccctgcca

SEQ ID NO: 42943 - DNA, 27 bp, Homo sapiens
gtgtctcaaggggcatttgtgagcttt

SEQ ID NO: 42944 - DNA, 21 bp, Homo sapiens
ttcacaaaactgccttccatg

SEQ ID NO: 42945 - DNA, 18 bp, Homo sapiens
aatgaacaagaaaaagta

SEQ ID NO: 42946 - DNA, 18 bp, Homo sapiens
acagcttaaaaatgtgaa

SEQ ID NO: 42947 - DNA, 18 bp, Homo sapiens
agtagaagtgttatcccc

SEQ ID NO: 42948 - DNA, 17 bp, Homo sapiens
atagtgctttttcctga

SEQ ID NO: 42949 - DNA, 20 bp, Homo sapiens
gattccagtagatggaattg

SEQ ID NO: 42950 - DNA, 19 bp, Homo sapiens
tctggagagagcctgtgaa

SEQ ID NO: 42951 - DNA, 18 bp, Homo sapiens
tgaccattgctacatgtg

SEQ ID NO: 42952 - DNA, 22 bp, Homo sapiens
tgaccctgtctgagccaaatga

SEQ ID NO: 42953 - DNA, 21 bp, Homo sapiens
gctggcgcgccggcggacttt

SEQ ID NO: 42954 - DNA, 20 bp, Homo sapiens
gggcttctgagctttcttca

SEQ ID NO: 42955 - DNA, 17 bp, Homo sapiens
tattgcctttgcctttg

SEQ ID NO: 42956 - DNA, 20 bp, Homo sapiens
aaggcctcttcagtataagg

SEQ ID NO: 42957 - DNA, 16 bp, Homo sapiens
aattcaaaactgtcaa

SEQ ID NO: 42958 - DNA, 21 bp, Homo sapiens
gctttaaaactaattacttca

SEQ ID NO: 42959 - DNA, 19 bp, Homo sapiens
gcttctgtgggatattttg

SEQ ID NO: 42960 - DNA, 22 bp, Homo sapiens
agtaccacaaaaactgtgttgt

SEQ ID NO: 42961 - DNA, 21 bp, Homo sapiens
agtgttagccacaaaaggcta

SEQ ID NO: 42962 - DNA, 20 bp, Homo sapiens
atctccaaagaaaagttcat

SEQ ID NO: 42963 - DNA, 15 bp, Homo sapiens
attacagattttatc

SEQ ID NO: 42964 - DNA, 18 bp, Homo sapiens
aaatgggaaaatggcttt

SEQ ID NO: 42965 - DNA, 20 bp, Homo sapiens
atcgacaaaagaaccattga

SEQ ID NO: 42966 - DNA, 18 bp, Homo sapiens
tgcggggcccaagtcctt

SEQ ID NO: 42967 - DNA, 22 bp, Homo sapiens
aagcaagaacaccaacttgaac

SEQ ID NO: 42968 - DNA, 18 bp, Homo sapiens
gcagtggactgtgtgatt

SEQ ID NO: 42969 - DNA, 19 bp, Homo sapiens
ggcgtctgtgaaaacccca

SEQ ID NO: 42970 - DNA, 22 bp, Homo sapiens
aaaatcgacaagaaaaccttga

SEQ ID NO: 42971 - DNA, 21 bp, Homo sapiens
agaaatgacagccagcacctc

SEQ ID NO: 42972 - DNA, 18 bp, Homo sapiens
ataacaaatggattgatg

SEQ ID NO: 42973 - DNA, 25 bp, Homo sapiens
gccaccagctccgacgatgggactg

SEQ ID NO: 42974 - DNA, 20 bp, Homo sapiens
tccatcagcatacgatatca

SEQ ID NO: 42975 - DNA, 19 bp, Homo sapiens
tggagaacaattgcttagg

SEQ ID NO: 42976 - DNA, 18 bp, Homo sapiens
ttcttcatatttcacctt

SEQ ID NO: 42977 - DNA, 16 bp, Homo sapiens
ttgttaattttggtgt

SEQ ID NO: 42978 - DNA, 21 bp, Homo sapiens
tttcgagatcttctccgcccc

SEQ ID NO: 42979 - DNA, 22 bp, Homo sapiens
acacacaaggaataaaacaaac

SEQ ID NO: 42980 - DNA, 21 bp, Homo sapiens
agtgatttattccataaggaa

SEQ ID NO: 42981 - DNA, 21 bp, Homo sapiens
cagccgcacagcaggaggtga

SEQ ID NO: 42982 - DNA, 22 bp, Homo sapiens
ccttccctggtgattctttcca

SEQ ID NO: 42983 - DNA, 18 bp, Homo sapiens
gaaaggtgatgacagagg

SEQ ID NO: 42984 - DNA, 18 bp, Homo sapiens
gacctaaataactgggaa

SEQ ID NO: 42985 - DNA, 23 bp, Homo sapiens
tatgctgctccaatttcataaca

SEQ ID NO: 42986 - DNA, 24 bp, Homo sapiens
gcgcggaggaggagcagcgcggga

SEQ ID NO: 42987 - DNA, 17 bp, Homo sapiens
agaagaacctggaccat

SEQ ID NO: 42988 - DNA, 24 bp, Homo sapiens
cagaaaaaaacataattctggtga

SEQ ID NO: 42989 - DNA, 20 bp, Homo sapiens
ctggaccattcttgatggag

SEQ ID NO: 42990 - DNA, 18 bp, Homo sapiens
cttttcatcctaaatctt

SEQ ID NO: 42991 - DNA, 19 bp, Homo sapiens
aagggtaacaccttcatga

SEQ ID NO: 42992 - DNA, 16 bp, Homo sapiens
cctgctgtgctccaca

SEQ ID NO: 42993 - DNA, 19 bp, Homo sapiens
aagcaattctcctgcctca

SEQ ID NO: 42994 - DNA, 19 bp, Homo sapiens
agttgaccactgcagcagt

SEQ ID NO: 42995 - DNA, 22 bp, Homo sapiens
ccaccggtcccagaacccgcca

SEQ ID NO: 42996 - DNA, 17 bp, Homo sapiens
ccagttgaagcacctgt

SEQ ID NO: 42997 - DNA, 20 bp, Homo sapiens
ggtctccaaccacagggcca

SEQ ID NO: 42998 - DNA, 17 bp, Homo sapiens
tcaagtgattctcctgc

SEQ ID NO: 42999 - DNA, 18 bp, Homo sapiens
aactccatctcaatcaat

SEQ ID NO: 43000 - DNA, 27 bp, Homo sapiens
agaagtaccgacactccctatccttca

SEQ ID NO: 43001 - DNA, 20 bp, Homo sapiens
ggggacgccgagggcggctg

SEQ ID NO: 43002 - DNA, 19 bp, Homo sapiens
ctgttcgcctcccattcta

SEQ ID NO: 43003 - DNA, 19 bp, Homo sapiens
ctgaacgtagtggagatga

SEQ ID NO: 43004 - DNA, 18 bp, Homo sapiens
atttcctcatttgcctta

SEQ ID NO: 43005 - DNA, 21 bp, Homo sapiens
acttggatcacggcttggttc

SEQ ID NO: 43006 - DNA, 21 bp, Homo sapiens
tctttccagtcgctgtatgta

SEQ ID NO: 43007 - DNA, 17 bp, Homo sapiens
aaggatccccagccccc

SEQ ID NO: 43008 - DNA, 24 bp, Homo sapiens
acacagccaaccctgctgctctct

SEQ ID NO: 43009 - DNA, 24 bp, Homo sapiens
caaccctgctgctctctgcctcct

SEQ ID NO: 43010 - DNA, 19 bp, Homo sapiens
ctcccccatattttgtgaa

SEQ ID NO: 43011 - DNA, 18 bp, Homo sapiens
tccttgtttgacatctca

SEQ ID NO: 43012 - DNA, 27 bp, Homo sapiens
tgcaaattgctttccaaactcacttga

SEQ ID NO: 43013 - DNA, 20 bp, Homo sapiens
tggccaagctggtcttgaac

SEQ ID NO: 43014 - DNA, 18 bp, Homo sapiens
ttcaagtgattctcatgc

SEQ ID NO: 43015 - DNA, 22 bp, Homo sapiens
acctgggtttgcctcttggctc

SEQ ID NO: 43016 - DNA, 23 bp, Homo sapiens
acttggtatcctttagagaaaaa

SEQ ID NO: 43017 - DNA, 20 bp, Homo sapiens
cacatgtgtgacctctctga

SEQ ID NO: 43018 - DNA, 22 bp, Homo sapiens
ccctccccgactcccacttcca

SEQ ID NO: 43019 - DNA, 21 bp, Homo sapiens
tagatgagatagctgaggcta

SEQ ID NO: 43020 - DNA, 19 bp, Homo sapiens
tctctgacttctcttcctc

SEQ ID NO: 43021 - DNA, 21 bp, Homo sapiens
tttccggcttgctttgacttt

SEQ ID NO: 43022 - DNA, 18 bp, Homo sapiens
cataaccacttctgcccc

SEQ ID NO: 43023 - DNA, 17 bp, Homo sapiens
ccagctggacccccttt

SEQ ID NO: 43024 - DNA, 19 bp, Homo sapiens
ccttttttcccttatcccc

SEQ ID NO: 43025 - DNA, 18 bp, Homo sapiens
gcggcctcaaagttctga

SEQ ID NO: 43026 - DNA, 17 bp, Homo sapiens
gctgttttccatgaccg

SEQ ID NO: 43027 - DNA, 17 bp, Homo sapiens
gggcggttcctgaagtg

SEQ ID NO: 43028 - DNA, 22 bp, Homo sapiens
cgggcgcatcacgaggtcagga

SEQ ID NO: 43029 - DNA, 20 bp, Homo sapiens
taagggttgacaccattctc

SEQ ID NO: 43030 - DNA, 17 bp, Homo sapiens
cgactgtgtgcctgtca

SEQ ID NO: 43031 - DNA, 16 bp, Homo sapiens
aaattctttggattgc

SEQ ID NO: 43032 - DNA, 23 bp, Homo sapiens
ggcgtgagccaccacgcccggcc

SEQ ID NO: 43033 - DNA, 22 bp, Homo sapiens
gttcaaaagagagctccctgga

SEQ ID NO: 43034 - DNA, 24 bp, Homo sapiens
gtaagcctgtggtagtttttttga

SEQ ID NO: 43035 - DNA, 19 bp, Homo sapiens
aaggaccagcaactcatgg

SEQ ID NO: 43036 - DNA, 22 bp, Homo sapiens
aatgggagcagtccatggtgca

SEQ ID NO: 43037 - DNA, 17 bp, Homo sapiens
catcgcccagtacacca

SEQ ID NO: 43038 - DNA, 19 bp, Homo sapiens
gattacataaatgcctggc

SEQ ID NO: 43039 - DNA, 20 bp, Homo sapiens
gggtagcaacaagtacatca

SEQ ID NO: 43040 - DNA, 17 bp, Homo sapiens
tcccgacacctgctcac

SEQ ID NO: 43041 - DNA, 19 bp, Homo sapiens
ccccacggagacgcgccaa

SEQ ID NO: 43042 - DNA, 19 bp, Homo sapiens
gcgcttggtgacgatccca

SEQ ID NO: 43043 - DNA, 20 bp, Homo sapiens
catttgacacacatactcaa

SEQ ID NO: 43044 - DNA, 23 bp, Homo sapiens
cgggcggggcctggggcccgcca

SEQ ID NO: 43045 - DNA, 22 bp, Homo sapiens
gggcggggcctggggcccgcca

SEQ ID NO: 43046 - DNA, 24 bp, Homo sapiens
aaaagaaattgggagagtatatca

SEQ ID NO: 43047 - DNA, 25 bp, Homo sapiens
actacatgatgacagaattatatca

SEQ ID NO: 43048 - DNA, 18 bp, Homo sapiens
cagcaccaatgcaagtgc

SEQ ID NO: 43049 - DNA, 20 bp, Homo sapiens
catggctgaagcaagcatca

SEQ ID NO: 43050 - DNA, 20 bp, Homo sapiens
catggctggagcaagtatca

SEQ ID NO: 43051 - DNA, 20 bp, Homo sapiens
ggtcagtgtctgttgcacaa

SEQ ID NO: 43052 - DNA, 20 bp, Homo sapiens
agaaaatttcatttgtgctg

SEQ ID NO: 43053 - DNA, 21 bp, Homo sapiens
gaaactatgcaaaacaaaaca

SEQ ID NO: 43054 - DNA, 20 bp, Homo sapiens
ggagcttccagatgggcatc

SEQ ID NO: 43055 - DNA, 23 bp, Homo sapiens
atgcatcatttgtgcagtttgaa

SEQ ID NO: 43056 - DNA, 19 bp, Homo sapiens
cccaactcattgaatgtga

SEQ ID NO: 43057 - DNA, 24 bp, Homo sapiens
cctttttgtagtatttttagtctt

SEQ ID NO: 43058 - DNA, 26 bp, Homo sapiens
tctgggggaaatcttgggatgctttt

SEQ ID NO: 43059 - DNA, 18 bp, Homo sapiens
accacctctacccctttc

SEQ ID NO: 43060 - DNA, 17 bp, Homo sapiens
acccagatttgcactca

SEQ ID NO: 43061 - DNA, 21 bp, Homo sapiens
caccttttggattttccacat

SEQ ID NO: 43062 - DNA, 21 bp, Homo sapiens
catgtatgatacagtgagtca

SEQ ID NO: 43063 - DNA, 17 bp, Homo sapiens
gacctcaaaccagctta

SEQ ID NO: 43064 - DNA, 26 bp, Homo sapiens
ttctactgcagcagctgctactcttt

SEQ ID NO: 43065 - DNA, 18 bp, Homo sapiens
tttctacataatatggta

SEQ ID NO: 43066 - DNA, 21 bp, Homo sapiens
tttgtgttattgtgattgctg

SEQ ID NO: 43067 - DNA, 22 bp, Homo sapiens
ccgaggcccccaagccatccca

SEQ ID NO: 43068 - DNA, 21 bp, Homo sapiens
cgcaggccgaccctgctgcct

SEQ ID NO: 43069 - DNA, 18 bp, Homo sapiens
ctgcctgcagagcgctgc

SEQ ID NO: 43070 - DNA, 22 bp, Homo sapiens
gcctgggccgcggtcgtggtcc

SEQ ID NO: 43071 - DNA, 18 bp, Homo sapiens
ggatcaggcagcacccag

SEQ ID NO: 43072 - DNA, 24 bp, Homo sapiens
ggggaggagatctgggcccagtca

SEQ ID NO: 43073 - DNA, 21 bp, Homo sapiens
taggttcttcagcagcagcca

SEQ ID NO: 43074 - DNA, 19 bp, Homo sapiens
tccagagaagacatcccag

SEQ ID NO: 43075 - DNA, 23 bp, Homo sapiens
tgagttctccgacgcccacatga

SEQ ID NO: 43076 - DNA, 17 bp, Homo sapiens
accgcatgtcactgcta

SEQ ID NO: 43077 - DNA, 20 bp, Homo sapiens
ggggaggaagctgccagtca

SEQ ID NO: 43078 - DNA, 20 bp, Homo sapiens
aaatcccaaaagtcacactt

SEQ ID NO: 43079 - DNA, 20 bp, Homo sapiens
cccccttcagcaggcacctc

SEQ ID NO: 43080 - DNA, 25 bp, Homo sapiens
tccccagggcaggcccagcgtgctg

SEQ ID NO: 43081 - DNA, 17 bp, Homo sapiens
caccagtgggcacatcg

SEQ ID NO: 43082 - DNA, 22 bp, Homo sapiens
ggcaggtcatgccattgttgtc

SEQ ID NO: 43083 - DNA, 21 bp, Homo sapiens
agctgagcaaccgctctgtct

SEQ ID NO: 43084 - DNA, 18 bp, Homo sapiens
cccatgggactttcctca

SEQ ID NO: 43085 - DNA, 21 bp, Homo sapiens
gagctgatgtacaaacacagc

SEQ ID NO: 43086 - DNA, 22 bp, Homo sapiens
ggaaatctccttcacacagcta

SEQ ID NO: 43087 - DNA, 18 bp, Homo sapiens
tcactgaccttcacttcg

SEQ ID NO: 43088 - DNA, 19 bp, Homo sapiens
tcatcaactcctttacatc

SEQ ID NO: 43089 - DNA, 22 bp, Homo sapiens
tgacaaacctctctacacccca

SEQ ID NO: 43090 - DNA, 21 bp, Homo sapiens
tctggccagaaagacatttca

SEQ ID NO: 43091 - DNA, 21 bp, Homo sapiens
ttccagaatatacagttccag

SEQ ID NO: 43092 - DNA, 22 bp, Homo sapiens
ctgttctctttggtttggaata

SEQ ID NO: 43093 - DNA, 21 bp, Homo sapiens
gcctttcctccattttctgtg

SEQ ID NO: 43094 - DNA, 18 bp, Homo sapiens
ggagctttttaaatctca

SEQ ID NO: 43095 - DNA, 18 bp, Homo sapiens
tgagctcttccttagctc

SEQ ID NO: 43096 - DNA, 21 bp, Homo sapiens
ttgcccaaaactgttctcttt

SEQ ID NO: 43097 - DNA, 18 bp, Homo sapiens
actgccacctccacctcc

SEQ ID NO: 43098 - DNA, 22 bp, Homo sapiens
acttggatttctgacttggctc

SEQ ID NO: 43099 - DNA, 22 bp, Homo sapiens
ccctgatcctggggtctgggga

SEQ ID NO: 43100 - DNA, 21 bp, Homo sapiens
gggtccttgttctgctgccca

SEQ ID NO: 43101 - DNA, 17 bp, Homo sapiens
acaaggtgatgtcccct

SEQ ID NO: 43102 - DNA, 21 bp, Homo sapiens
cagcaacccaaagagaaggga

SEQ ID NO: 43103 - DNA, 23 bp, Homo sapiens
agaattatattttaatgactcca

SEQ ID NO: 43104 - DNA, 18 bp, Homo sapiens
catcaaggaaataaatca

SEQ ID NO: 43105 - DNA, 24 bp, Homo sapiens
gcttgagcccaggctgtgtggttc

SEQ ID NO: 43106 - DNA, 17 bp, Homo sapiens
taattgtgtttgtgact

SEQ ID NO: 43107 - DNA, 22 bp, Homo sapiens
tctttttggtgttttaacactt

SEQ ID NO: 43108 - DNA, 22 bp, Homo sapiens
cccggcttcccggactccagca

SEQ ID NO: 43109 - DNA, 22 bp, Homo sapiens
ccattctgccatctacatccca

SEQ ID NO: 43110 - DNA, 25 bp, Homo sapiens
tgaaacttcagctgcacccacacac

SEQ ID NO: 43111 - DNA, 18 bp, Homo sapiens
aatacaacaaacaaagaa

SEQ ID NO: 43112 - DNA, 19 bp, Homo sapiens
gtgttggttgggccttgaa

SEQ ID NO: 43113 - DNA, 21 bp, Homo sapiens
aagacctggaacaagattctg

SEQ ID NO: 43114 - DNA, 17 bp, Homo sapiens
acggtgtttgtgaaggg

SEQ ID NO: 43115 - DNA, 16 bp, Homo sapiens
agacccccattcttca

SEQ ID NO: 43116 - DNA, 21 bp, Homo sapiens
atgtggctttttcctgacgca

SEQ ID NO: 43117 - DNA, 21 bp, Homo sapiens
ccatcctctccacagcatccc

SEQ ID NO: 43118 - DNA, 19 bp, Homo sapiens
ggtgtttaaccacctccca

SEQ ID NO: 43119 - DNA, 18 bp, Homo sapiens
gttttctttcccctcatc

SEQ ID NO: 43120 - DNA, 18 bp, Homo sapiens
tccactccagagttgggt

SEQ ID NO: 43121 - DNA, 17 bp, Homo sapiens
tcctgttctatcccttc

SEQ ID NO: 43122 - DNA, 20 bp, Homo sapiens
ccagatttgcttcctactca

SEQ ID NO: 43123 - DNA, 23 bp, Homo sapiens
ctttgatggcaccaagatcgtgg

SEQ ID NO: 43124 - DNA, 24 bp, Homo sapiens
agagaaaagtttgcgactcccaca

SEQ ID NO: 43125 - DNA, 18 bp, Homo sapiens
ggaagtggcttcttggaa

SEQ ID NO: 43126 - DNA, 26 bp, Homo sapiens
aaggccctgtggacactttgcagtca

SEQ ID NO: 43127 - DNA, 18 bp, Homo sapiens
atcttaaaatgtaggctc

SEQ ID NO: 43128 - DNA, 19 bp, Homo sapiens
cctttttgtcccttaattt

SEQ ID NO: 43129 - DNA, 24 bp, Homo sapiens
gtgagcccagatcccgcaactgca

SEQ ID NO: 43130 - DNA, 23 bp, Homo sapiens
ttttttcattgctttgtgacttt

SEQ ID NO: 43131 - DNA, 19 bp, Homo sapiens
aatattttgattaatacta

SEQ ID NO: 43132 - DNA, 22 bp, Homo sapiens
acctggattctagttctggctt

SEQ ID NO: 43133 - DNA, 21 bp, Homo sapiens
ccctgatgataaggttggtgg

SEQ ID NO: 43134 - DNA, 17 bp, Homo sapiens
cctccctgctctagtag

SEQ ID NO: 43135 - DNA, 17 bp, Homo sapiens
ctgtattacattgcttt

SEQ ID NO: 43136 - DNA, 15 bp, Homo sapiens
gaagctcatagatat

SEQ ID NO: 43137 - DNA, 20 bp, Homo sapiens
taatccatgccctcctctct

SEQ ID NO: 43138 - DNA, 24 bp, Homo sapiens
tctgagcaatacggagatcctttt

SEQ ID NO: 43139 - DNA, 23 bp, Homo sapiens
tctttttgttgtctttaaacttt

SEQ ID NO: 43140 - DNA, 18 bp, Homo sapiens
ttcaaaactagtatctaa

SEQ ID NO: 43141 - DNA, 18 bp, Homo sapiens
ttccagactctgttacag

SEQ ID NO: 43142 - DNA, 19 bp, Homo sapiens
aaactcctgacctcaggtg

SEQ ID NO: 43143 - DNA, 19 bp, Homo sapiens
aggagcgccaagattgcca

SEQ ID NO: 43144 - DNA, 19 bp, Homo sapiens
ctgcaacctccgcctccca

SEQ ID NO: 43145 - DNA, 23 bp, Homo sapiens
gcagcctccaaggggagcctttg

SEQ ID NO: 43146 - DNA, 20 bp, Homo sapiens
gctgcagggtctggcatcag

SEQ ID NO: 43147 - DNA, 18 bp, Homo sapiens
tccgcctcccaggttcaa

SEQ ID NO: 43148 - DNA, 16 bp, Homo sapiens
tcttagcggattactt

SEQ ID NO: 43149 - DNA, 22 bp, Homo sapiens
aggagcatggacacaggaccag

SEQ ID NO: 43150 - DNA, 22 bp, Homo sapiens
gaatacagaacagctcctggca

SEQ ID NO: 43151 - DNA, 21 bp, Homo sapiens
gcagaggactccagaggctca

SEQ ID NO: 43152 - DNA, 19 bp, Homo sapiens
ttctctactaaaaatacaa

SEQ ID NO: 43153 - DNA, 21 bp, Homo sapiens
ctctggtggtttggctttgaa

SEQ ID NO: 43154 - DNA, 24 bp, Homo sapiens
accgctcaactacatggaaaccga

SEQ ID NO: 43155 - DNA, 19 bp, Homo sapiens
ctgctcccttcacctttga

SEQ ID NO: 43156 - DNA, 18 bp, Homo sapiens
tccagaaaatgaaattcc

SEQ ID NO: 43157 - DNA, 20 bp, Homo sapiens
tgctcccagagcctgagcat

SEQ ID NO: 43158 - DNA, 22 bp, Homo sapiens
cccatctttgagcccggcccca

SEQ ID NO: 43159 - DNA, 22 bp, Homo sapiens
atagtcagaaaaccataccatt

SEQ ID NO: 43160 - DNA, 22 bp, Homo sapiens
actctggtcccaactactttcc

SEQ ID NO: 43161 - DNA, 20 bp, Homo sapiens
agcttcaaagaggccaaaag

SEQ ID NO: 43162 - DNA, 16 bp, Homo sapiens
caaacagcatattggc

SEQ ID NO: 43163 - DNA, 19 bp, Homo sapiens
caacctcagtgtctgagca

SEQ ID NO: 43164 - DNA, 18 bp, Homo sapiens
ccaatacaactttattga

SEQ ID NO: 43165 - DNA, 23 bp, Homo sapiens
ccaggacacaatctgggaagcca

SEQ ID NO: 43166 - DNA, 19 bp, Homo sapiens
ggagcttcctgcaatctca

SEQ ID NO: 43167 - DNA, 18 bp, Homo sapiens
gggccagccgtgaggcta

SEQ ID NO: 43168 - DNA, 19 bp, Homo sapiens
tacttgaatacataagctg

SEQ ID NO: 43169 - DNA, 17 bp, Homo sapiens
tctacattctgatcaga

SEQ ID NO: 43170 - DNA, 23 bp, Homo sapiens
tgcaaatttggtcatctactcga

SEQ ID NO: 43171 - DNA, 18 bp, Homo sapiens
ccagacggagcctccgga

SEQ ID NO: 43172 - DNA, 17 bp, Homo sapiens
tcaagtgattcttctgc

SEQ ID NO: 43173 - DNA, 21 bp, Homo sapiens
aaacatgcaaactgccacttt

SEQ ID NO: 43174 - DNA, 22 bp, Homo sapiens
aaggcatctttccaagtactca

SEQ ID NO: 43175 - DNA, 18 bp, Homo sapiens
acagaagtgctttctatt

SEQ ID NO: 43176 - DNA, 18 bp, Homo sapiens
agagccttggaatctact

SEQ ID NO: 43177 - DNA, 20 bp, Homo sapiens
cagggagtttgggcttggtt

SEQ ID NO: 43178 - DNA, 20 bp, Homo sapiens
cagtctaaactatccagtca

SEQ ID NO: 43179 - DNA, 22 bp, Homo sapiens
ggttgttttggtggtctttttt

SEQ ID NO: 43180 - DNA, 16 bp, Homo sapiens
tccctcagccctttca

SEQ ID NO: 43181 - DNA, 20 bp, Homo sapiens
tccttccctcccccaccccg

SEQ ID NO: 43182 - DNA, 18 bp, Homo sapiens
tgaatgggcttcaagtgg

SEQ ID NO: 43183 - DNA, 17 bp, Homo sapiens
tggatgtccttggaatg

SEQ ID NO: 43184 - DNA, 24 bp, Homo sapiens
agtcccatcaccagggagccatga

SEQ ID NO: 43185 - DNA, 20 bp, Homo sapiens
catcatcctgggcacgccgt

SEQ ID NO: 43186 - DNA, 24 bp, Homo sapiens
ccagctgattgggtcaggcaagtc

SEQ ID NO: 43187 - DNA, 23 bp, Homo sapiens
cccttccagcccctcttttccag

SEQ ID NO: 43188 - DNA, 20 bp, Homo sapiens
ctctccaactgccagctgat

SEQ ID NO: 43189 - DNA, 17 bp, Homo sapiens
gcccccttcttctgtga

SEQ ID NO: 43190 - DNA, 20 bp, Homo sapiens
gttacacagctacagtatgt

SEQ ID NO: 43191 - DNA, 24 bp, Homo sapiens
acagagaatgtgtcctctgctggc

SEQ ID NO: 43192 - DNA, 21 bp, Homo sapiens
actttttttccacaacttttt

SEQ ID NO: 43193 - DNA, 24 bp, Homo sapiens
agtcccatcaccaggcagccatga

SEQ ID NO: 43194 - DNA, 20 bp, Homo sapiens
catcatcctggacacgccgt

SEQ ID NO: 43195 - DNA, 21 bp, Homo sapiens
gaaaaggtcacacccttttca

SEQ ID NO: 43196 - DNA, 17 bp, Homo sapiens
gcccccttcttctgtga

SEQ ID NO: 43197 - DNA, 20 bp, Homo sapiens
gttacacagctacagtatgt

SEQ ID NO: 43198 - DNA, 20 bp, Homo sapiens
aggctgcttggatgacctca

SEQ ID NO: 43199 - DNA, 17 bp, Homo sapiens
atcccagctacgtggga

SEQ ID NO: 43200 - DNA, 18 bp, Homo sapiens
atttgtctgaacatcaca

SEQ ID NO: 43201 - DNA, 20 bp, Homo sapiens
ccagcagcagggttacctcc

SEQ ID NO: 43202 - DNA, 18 bp, Homo sapiens
gccctggcagacaagcca

SEQ ID NO: 43203 - DNA, 19 bp, Homo sapiens
tggacatcagctggggctg

SEQ ID NO: 43204 - DNA, 23 bp, Homo sapiens
tgattggagttccggatatgaca

SEQ ID NO: 43205 - DNA, 18 bp, Homo sapiens
aactgtgggaaaatatca

SEQ ID NO: 43206 - DNA, 18 bp, Homo sapiens
accaccaccatccactct

SEQ ID NO: 43207 - DNA, 16 bp, Homo sapiens
ggcgtacacacacggg

SEQ ID NO: 43208 - DNA, 20 bp, Homo sapiens
gtcctggctgggctgagtca

SEQ ID NO: 43209 - DNA, 19 bp, Homo sapiens
ccagcccccagtcccctct

SEQ ID NO: 43210 - DNA, 16 bp, Homo sapiens
atgagtcaccagccca

SEQ ID NO: 43211 - DNA, 18 bp, Homo sapiens
ccagcccactttgtgacc

SEQ ID NO: 43212 - DNA, 22 bp, Homo sapiens
tctttatcctgcctgtggtttt

SEQ ID NO: 43213 - DNA, 22 bp, Homo sapiens
agggacagaggacaccacttcc

SEQ ID NO: 43214 - DNA, 18 bp, Homo sapiens
ccaagccaggactccctt

SEQ ID NO: 43215 - DNA, 21 bp, Homo sapiens
cgagattggaaaggttcatca

SEQ ID NO: 43216 - DNA, 18 bp, Homo sapiens
cttgggctagcctggtcc

SEQ ID NO: 43217 - DNA, 23 bp, Homo sapiens
cacctccattgggccctttttca

SEQ ID NO: 43218 - DNA, 20 bp, Homo sapiens
ctagtggctttgccattcaa

SEQ ID NO: 43219 - DNA, 19 bp, Homo sapiens
tgagccttcttgctccaca

SEQ ID NO: 43220 - DNA, 22 bp, Homo sapiens
cccaaggcacagagacacgggc

SEQ ID NO: 43221 - DNA, 23 bp, Homo sapiens
ctctggtggtgtgtgcttgcgga

SEQ ID NO: 43222 - DNA, 24 bp, Homo sapiens
gcgtctttggggacccccgtgcga

SEQ ID NO: 43223 - DNA, 23 bp, Homo sapiens
ccctcccctctcttttcttgcca

SEQ ID NO: 43224 - DNA, 20 bp, Homo sapiens
cccatggcttggctgaagcc

SEQ ID NO: 43225 - DNA, 18 bp, Homo sapiens
tcttcctggccatggctg

SEQ ID NO: 43226 - DNA, 20 bp, Homo sapiens
agctttttaaattattttca

SEQ ID NO: 43227 - DNA, 20 bp, Homo sapiens
cagggactgaaccgtgctgc

SEQ ID NO: 43228 - DNA, 19 bp, Homo sapiens
tgaccatgaccatgtgatg

SEQ ID NO: 43229 - DNA, 22 bp, Homo sapiens
tttaagctttttaaattatttt

SEQ ID NO: 43230 - DNA, 26 bp, Homo sapiens
gcgtctcctccgagctgttgggcttt

SEQ ID NO: 43231 - DNA, 19 bp, Homo sapiens
aagcaattctcctgcctca

SEQ ID NO: 43232 - DNA, 17 bp, Homo sapiens
agtgcttgggtgggaga

SEQ ID NO: 43233 - DNA, 21 bp, Homo sapiens
atgtgtgattagaaacgatga

SEQ ID NO: 43234 - DNA, 19 bp, Homo sapiens
cgtcctcaagagcggctgg

SEQ ID NO: 43235 - DNA, 18 bp, Homo sapiens
ctgatcttacacatataa

SEQ ID NO: 43236 - DNA, 20 bp, Homo sapiens
tccagcagaagatgctgctt

SEQ ID NO: 43237 - DNA, 18 bp, Homo sapiens
tgactgccaatgtgtgat

SEQ ID NO: 43238 - DNA, 23 bp, Homo sapiens
ttgatagtgttagcattcttgga

SEQ ID NO: 43239 - DNA, 25 bp, Homo sapiens
ttttgatcactgggaagactgtgaa

SEQ ID NO: 43240 - DNA, 16 bp, Homo sapiens
aaagtaaagaaagtac

SEQ ID NO: 43241 - DNA, 23 bp, Homo sapiens
atcccctagcaggtgccacacag

SEQ ID NO: 43242 - DNA, 22 bp, Homo sapiens
ccattagtaagaattactaata

SEQ ID NO: 43243 - DNA, 17 bp, Homo sapiens
tcaagtgattctcctgc

SEQ ID NO: 43244 - DNA, 19 bp, Homo sapiens
tttgcctgttgatctctaa

SEQ ID NO: 43245 - DNA, 21 bp, Homo sapiens
cccatggtgggggtctgtgag

SEQ ID NO: 43246 - DNA, 23 bp, Homo sapiens
gggctatgattgcaccactgcac

SEQ ID NO: 43247 - DNA, 16 bp, Homo sapiens
tcagcaagaaacattg

SEQ ID NO: 43248 - DNA, 23 bp, Homo sapiens
acttgccctgcattgcctggccc

SEQ ID NO: 43249 - DNA, 23 bp, Homo sapiens
ccccgccccatttccccacgctt

SEQ ID NO: 43250 - DNA, 19 bp, Homo sapiens
agtagttattatttttgga

SEQ ID NO: 43251 - DNA, 18 bp, Homo sapiens
cggtgccttccccggtgg

SEQ ID NO: 43252 - DNA, 18 bp, Homo sapiens
tcccaggcacagctgcag

SEQ ID NO: 43253 - DNA, 17 bp, Homo sapiens
agcaacccagacactga

SEQ ID NO: 43254 - DNA, 24 bp, Homo sapiens
cacaccaccctgtccagtgtcttg

SEQ ID NO: 43255 - DNA, 17 bp, Homo sapiens
gaaaaagaagccattga

SEQ ID NO: 43256 - DNA, 19 bp, Homo sapiens
gcacctccctcctgcctcc

SEQ ID NO: 43257 - DNA, 18 bp, Homo sapiens
cctcagcgcccagccctt

SEQ ID NO: 43258 - DNA, 23 bp, Homo sapiens
aagcaagcatatattctctctct

SEQ ID NO: 43259 - DNA, 27 bp, Homo sapiens
actgtttactaacctgtgaaaatacca

SEQ ID NO: 43260 - DNA, 19 bp, Homo sapiens
atcatgaacacaattctaa

SEQ ID NO: 43261 - DNA, 19 bp, Homo sapiens
ctagtccttcaactcacag

SEQ ID NO: 43262 - DNA, 17 bp, Homo sapiens
tacattcctacgttctc

SEQ ID NO: 43263 - DNA, 23 bp, Homo sapiens
aaaccagggtgaaccctcaggtg

SEQ ID NO: 43264 - DNA, 20 bp, Homo sapiens
aaccagggtgaaccctcagg

SEQ ID NO: 43265 - DNA, 18 bp, Homo sapiens
acagcccgcaactttaaa

SEQ ID NO: 43266 - DNA, 19 bp, Homo sapiens
ggaaaagcaccacatcagc

SEQ ID NO: 43267 - DNA, 18 bp, Homo sapiens
gccctgggagggcccagg

SEQ ID NO: 43268 - DNA, 21 bp, Homo sapiens
caccgaagccgcctgtggaca

SEQ ID NO: 43269 - DNA, 18 bp, Homo sapiens
agaactccagtcccctca

SEQ ID NO: 43270 - DNA, 16 bp, Homo sapiens
ccctctccacccttca

SEQ ID NO: 43271 - DNA, 19 bp, Homo sapiens
gaaagactcagccactgga

SEQ ID NO: 43272 - DNA, 18 bp, Homo sapiens
gccagggtccagaaagac

SEQ ID NO: 43273 - DNA, 21 bp, Homo sapiens
gcccaggggaagacccaggga

SEQ ID NO: 43274 - DNA, 17 bp, Homo sapiens
ggtaattgttcgtggca

SEQ ID NO: 43275 - DNA, 21 bp, Homo sapiens
gcagtatcaagaagatctcca

SEQ ID NO: 43276 - DNA, 20 bp, Homo sapiens
gtctctcccgaggatctggc

SEQ ID NO: 43277 - DNA, 21 bp, Homo sapiens
catgaatttacccaggagagt

SEQ ID NO: 43278 - DNA, 19 bp, Homo sapiens
cttctctgtccttctccct

SEQ ID NO: 43279 - DNA, 20 bp, Homo sapiens
gaagagacagatctcctcca

SEQ ID NO: 43280 - DNA, 19 bp, Homo sapiens
tgcctgggccccattccag

SEQ ID NO: 43281 - DNA, 18 bp, Homo sapiens
tttttaaagctgctttag

SEQ ID NO: 43282 - DNA, 23 bp, Homo sapiens
acctgggtgctttccgtttgtga

SEQ ID NO: 43283 - DNA, 22 bp, Homo sapiens
atcttggctcactgcaacctct

SEQ ID NO: 43284 - DNA, 20 bp, Homo sapiens
cctctgcctcctgggttcaa

SEQ ID NO: 43285 - DNA, 22 bp, Homo sapiens
gacatgtcactgagctccccca

SEQ ID NO: 43286 - DNA, 17 bp, Homo sapiens
tcaagcgattcttgtgc

SEQ ID NO: 43287 - DNA, 20 bp, Homo sapiens
caccaccacccaccgctgca

SEQ ID NO: 43288 - DNA, 19 bp, Homo sapiens
cctgagatcttcctgccca

SEQ ID NO: 43289 - DNA, 19 bp, Homo sapiens
cctgggggtggcctggtcc

SEQ ID NO: 43290 - DNA, 18 bp, Homo sapiens
ctacaacaccaccaccca

SEQ ID NO: 43291 - DNA, 21 bp, Homo sapiens
gggctgagactacagtggcca

SEQ ID NO: 43292 - DNA, 21 bp, Homo sapiens
atcttggctcactgcaacctc

SEQ ID NO: 43293 - DNA, 18 bp, Homo sapiens
cctgcaacctccacctcc

SEQ ID NO: 43294 - DNA, 20 bp, Homo sapiens
gtctgttcaaaaatctgata

SEQ ID NO: 43295 - DNA, 18 bp, Homo sapiens
tccacctcccgggttcaa

SEQ ID NO: 43296 - DNA, 22 bp, Homo sapiens
atcttggctcactgcaacctct

SEQ ID NO: 43297 - DNA, 18 bp, Homo sapiens
attctagagaggcatcca

SEQ ID NO: 43298 - DNA, 19 bp, Homo sapiens
ctgcaacctctgcctccca

SEQ ID NO: 43299 - DNA, 17 bp, Homo sapiens
tacctaaatgtaagcta

SEQ ID NO: 43300 - DNA, 17 bp, Homo sapiens
tcttccacttttggtgt

SEQ ID NO: 43301 - DNA, 19 bp, Homo sapiens
tgcaaggtcttccgttata

SEQ ID NO: 43302 - DNA, 19 bp, Homo sapiens
tgcaaggtgttccattata

SEQ ID NO: 43303 - DNA, 23 bp, Homo sapiens
ttgcaaggtcttccgttataact

SEQ ID NO: 43304 - DNA, 18 bp, Homo sapiens
tcatgctgttgcagcagt

SEQ ID NO: 43305 - DNA, 18 bp, Homo sapiens
tgtttgattttctggtgt

SEQ ID NO: 43306 - DNA, 18 bp, Homo sapiens
gccccaaggctctgggga

SEQ ID NO: 43307 - DNA, 19 bp, Homo sapiens
gccgctctgcccccgggga

SEQ ID NO: 43308 - DNA, 23 bp, Homo sapiens
gcctgagccgtgaccagaggtcc

SEQ ID NO: 43309 - DNA, 22 bp, Homo sapiens
gcgtctgcagagcggcctgctc

SEQ ID NO: 43310 - DNA, 18 bp, Homo sapiens
tgcagagcggcctgctca

SEQ ID NO: 43311 - DNA, 23 bp, Homo sapiens
tttgtcggttctgagtcattttt

SEQ ID NO: 43312 - DNA, 21 bp, Homo sapiens
ctatccagcacgtgcaccaag

SEQ ID NO: 43313 - DNA, 24 bp, Homo sapiens
ctcaggtccacaccaaagcttgaa

SEQ ID NO: 43314 - DNA, 27 bp, Homo sapiens
tagatgccacatttgactgtgaaatta

SEQ ID NO: 43315 - DNA, 19 bp, Homo sapiens
tccaactatggttaactgt

SEQ ID NO: 43316 - DNA, 20 bp, Homo sapiens
tgtctgcagaaagatggaga

SEQ ID NO: 43317 - DNA, 20 bp, Homo sapiens
ttctgctacttacactgtca

SEQ ID NO: 43318 - DNA, 22 bp, Homo sapiens
aattgatattagatttgtctca

SEQ ID NO: 43319 - DNA, 23 bp, Homo sapiens
tctttttaaacagttctgacctt

SEQ ID NO: 43320 - DNA, 18 bp, Homo sapiens
tttcagaaacagaacaaa

SEQ ID NO: 43321 - DNA, 19 bp, Homo sapiens
aaaacacagagtcagtgtt

SEQ ID NO: 43322 - DNA, 20 bp, Homo sapiens
acacagagtcagtgttaaat

SEQ ID NO: 43323 - DNA, 18 bp, Homo sapiens
atacccagtttcacagca

SEQ ID NO: 43324 - DNA, 19 bp, Homo sapiens
atgatctacaagagactca

SEQ ID NO: 43325 - DNA, 18 bp, Homo sapiens
atgtttttgtggtaaaat

SEQ ID NO: 43326 - DNA, 23 bp, Homo sapiens
catcttaacctgagtccctctca

SEQ ID NO: 43327 - DNA, 18 bp, Homo sapiens
ccgtggacatgttgttca

SEQ ID NO: 43328 - DNA, 17 bp, Homo sapiens
ctgctgatctgttttgt

SEQ ID NO: 43329 - DNA, 22 bp, Homo sapiens
ctttttcaagattgctttggct

SEQ ID NO: 43330 - DNA, 22 bp, Homo sapiens
gtatatctgttacagctagttg

SEQ ID NO: 43331 - DNA, 19 bp, Homo sapiens
taagttttgttatgttgta

SEQ ID NO: 43332 - DNA, 18 bp, Homo sapiens
taatccatgaatatactt

SEQ ID NO: 43333 - DNA, 17 bp, Homo sapiens
tcaaatcaagattcttt

SEQ ID NO: 43334 - DNA, 18 bp, Homo sapiens
tccaactattactgtaga

SEQ ID NO: 43335 - DNA, 25 bp, Homo sapiens
tccatagaaatatttcaattcctct

SEQ ID NO: 43336 - DNA, 23 bp, Homo sapiens
tctagtaagtgtgttttaacttt

SEQ ID NO: 43337 - DNA, 17 bp, Homo sapiens
tctccccatccccaggg

SEQ ID NO: 43338 - DNA, 17 bp, Homo sapiens
tgtgattggcttagtta

SEQ ID NO: 43339 - DNA, 16 bp, Homo sapiens
tgttacagctagttga

SEQ ID NO: 43340 - DNA, 21 bp, Homo sapiens
ttggtatgagagtcttaggga

SEQ ID NO: 43341 - DNA, 19 bp, Homo sapiens
tgcctccatctccatacca

SEQ ID NO: 43342 - DNA, 16 bp, Homo sapiens
ggttccgtgggcagcc

SEQ ID NO: 43343 - DNA, 19 bp, Homo sapiens
ggttgggggcaatgatgaa

SEQ ID NO: 43344 - DNA, 24 bp, Homo sapiens
tccagaccccggtaaatcccatca

SEQ ID NO: 43345 - DNA, 17 bp, Homo sapiens
tggtctcggattcctga

SEQ ID NO: 43346 - DNA, 19 bp, Homo sapiens
agaagaacaaagctgcaga

SEQ ID NO: 43347 - DNA, 18 bp, Homo sapiens
tgtcaccaatgtctgtga

SEQ ID NO: 43348 - DNA, 18 bp, Homo sapiens
tctttccccaaacaccta

SEQ ID NO: 43349 - DNA, 24 bp, Homo sapiens
tgagtgggttctggctgctggctg

SEQ ID NO: 43350 - DNA, 21 bp, Homo sapiens
tttctttataggcaatggcct

SEQ ID NO: 43351 - DNA, 21 bp, Homo sapiens
tttggctcctcccccacccca

SEQ ID NO: 43352 - DNA, 21 bp, Homo sapiens
atcttggttcactgcaacctc

SEQ ID NO: 43353 - DNA, 18 bp, Homo sapiens
cctgcaacctccacctcc

SEQ ID NO: 43354 - DNA, 19 bp, Homo sapiens
ctgcaacctccacctccca

SEQ ID NO: 43355 - DNA, 23 bp, Homo sapiens
gcaggtggaggccatgtcatttc

SEQ ID NO: 43356 - DNA, 17 bp, Homo sapiens
tcaagtgattctcctgc

SEQ ID NO: 43357 - DNA, 18 bp, Homo sapiens
tccacctcccaggttcaa

SEQ ID NO: 43358 - DNA, 17 bp, Homo sapiens
ttcccagcctcatgaaa

SEQ ID NO: 43359 - DNA, 19 bp, Homo sapiens
aaacacatatcaagatcca

SEQ ID NO: 43360 - DNA, 17 bp, Homo sapiens
gcaacctcagccaatga

SEQ ID NO: 43361 - DNA, 23 bp, Homo sapiens
aagtatttattgtgtatttgata

SEQ ID NO: 43362 - DNA, 24 bp, Homo sapiens
gcctcaatatttaacaacaagcca

SEQ ID NO: 43363 - DNA, 22 bp, Homo sapiens
gctgtatgtatgttttgtttta

SEQ ID NO: 43364 - DNA, 21 bp, Homo sapiens
tcaatatttaacaacaagcca

SEQ ID NO: 43365 - DNA, 23 bp, Homo sapiens
ttcagcactaatgactgctccag

SEQ ID NO: 43366 - DNA, 18 bp, Homo sapiens
acagcgggaggcctggga

SEQ ID NO: 43367 - DNA, 19 bp, Homo sapiens
cacagtggacacgagctga

SEQ ID NO: 43368 - DNA, 18 bp, Homo sapiens
tgggtgggcttggtgggg

SEQ ID NO: 43369 - DNA, 17 bp, Homo sapiens
ttagcccccctccacct

SEQ ID NO: 43370 - DNA, 23 bp, Homo sapiens
aaggggtttctaacaaatgaaga

SEQ ID NO: 43371 - DNA, 19 bp, Homo sapiens
acccaaatgtcacccccca

SEQ ID NO: 43372 - DNA, 20 bp, Homo sapiens
caacagggccctctgctcct

SEQ ID NO: 43373 - DNA, 19 bp, Homo sapiens
ccaagtatttctccatgtc

SEQ ID NO: 43374 - DNA, 24 bp, Homo sapiens
ccattgttacaacccaaatgtcac

SEQ ID NO: 43375 - DNA, 20 bp, Homo sapiens
gacagggagaggccactcct

SEQ ID NO: 43376 - DNA, 19 bp, Homo sapiens
ggacagcttcacttcctct

SEQ ID NO: 43377 - DNA, 19 bp, Homo sapiens
ggctgtcccctgcctttcc

SEQ ID NO: 43378 - DNA, 23 bp, Homo sapiens
tgccctgagctccacattctcct

SEQ ID NO: 43379 - DNA, 19 bp, Homo sapiens
tggcatgaaatctgtgaat

SEQ ID NO: 43380 - DNA, 19 bp, Homo sapiens
ccaccccctcctttgggga

SEQ ID NO: 43381 - DNA, 22 bp, Homo sapiens
ctctctctctttctctgcctca

SEQ ID NO: 43382 - DNA, 18 bp, Homo sapiens
cttagactttatcccaaa

SEQ ID NO: 43383 - DNA, 20 bp, Homo sapiens
agaataagaaagcagccagc

SEQ ID NO: 43384 - DNA, 20 bp, Homo sapiens
aggcctttcccaacatgcca

SEQ ID NO: 43385 - DNA, 17 bp, Homo sapiens
cagctaagattatgcca

SEQ ID NO: 43386 - DNA, 22 bp, Homo sapiens
gtaggaaaagagggtcttgtca

SEQ ID NO: 43387 - DNA, 22 bp, Homo sapiens
gtcataccctactaaacaccca

SEQ ID NO: 43388 - DNA, 18 bp, Homo sapiens
taccctactaaacaccca

SEQ ID NO: 43389 - DNA, 19 bp, Homo sapiens
caagagggcgcgggagcta

SEQ ID NO: 43390 - DNA, 19 bp, Homo sapiens
ccacagcccgcttcccgca

SEQ ID NO: 43391 - DNA, 20 bp, Homo sapiens
ttcaagaccagcctgaccaa

SEQ ID NO: 43392 - DNA, 22 bp, Homo sapiens
ttctccgggggggacttgcgga

SEQ ID NO: 43393 - DNA, 21 bp, Homo sapiens
aaccactgtgcctctcacaca

SEQ ID NO: 43394 - DNA, 21 bp, Homo sapiens
ctgttttgcagcagatctcca

SEQ ID NO: 43395 - DNA, 18 bp, Homo sapiens
gcctcttccacccaccca

SEQ ID NO: 43396 - DNA, 21 bp, Homo sapiens
ttccctcagttcctgctgcca

SEQ ID NO: 43397 - DNA, 16 bp, Homo sapiens
ttgaaagctaaaggca

SEQ ID NO: 43398 - DNA, 19 bp, Homo sapiens
aagcaattctcctgcctca

SEQ ID NO: 43399 - DNA, 19 bp, Homo sapiens
attccaagacctcgggctg

SEQ ID NO: 43400 - DNA, 18 bp, Homo sapiens
attggcaatctgtgatca

SEQ ID NO: 43401 - DNA, 20 bp, Homo sapiens
cccattacatgttatcatag

SEQ ID NO: 43402 - DNA, 19 bp, Homo sapiens
ctgcaacctccgcctccca

SEQ ID NO: 43403 - DNA, 24 bp, Homo sapiens
gactgacattcctggaaaatatca

SEQ ID NO: 43404 - DNA, 19 bp, Homo sapiens
gtgaatgtgtgtgtgtgtg

SEQ ID NO: 43405 - DNA, 18 bp, Homo sapiens
tccgcctcccaggttcaa

SEQ ID NO: 43406 - DNA, 22 bp, Homo sapiens
cagcctggccaacacagtgaaa

SEQ ID NO: 43407 - DNA, 24 bp, Homo sapiens
gcctgggctgtgtggttctgggcc

SEQ ID NO: 43408 - DNA, 17 bp, Homo sapiens
ggccgggtgcactggct

SEQ ID NO: 43409 - DNA, 19 bp, Homo sapiens
tccctaccatgcctctgca

SEQ ID NO: 43410 - DNA, 19 bp, Homo sapiens
actccaggagttcttggga

SEQ ID NO: 43411 - DNA, 20 bp, Homo sapiens
atcacagttgtctgacctga

SEQ ID NO: 43412 - DNA, 21 bp, Homo sapiens
tacagcgtgccttggcactgg

SEQ ID NO: 43413 - DNA, 18 bp, Homo sapiens
caaacaggcatttttgca

SEQ ID NO: 43414 - DNA, 21 bp, Homo sapiens
tgcagctacaaggccactggc

SEQ ID NO: 43415 - DNA, 18 bp, Homo sapiens
tgggtggatcacctgagg

SEQ ID NO: 43416 - DNA, 20 bp, Homo sapiens
acaaccacctgctccaacac

SEQ ID NO: 43417 - DNA, 19 bp, Homo sapiens
acgtacagaatgttccaca

SEQ ID NO: 43418 - DNA, 19 bp, Homo sapiens
cgtcccttccagcacccca

SEQ ID NO: 43419 - DNA, 19 bp, Homo sapiens
cagtgtctgtggcaatatg

SEQ ID NO: 43420 - DNA, 23 bp, Homo sapiens
tctttaaagaccctgtttccaaa

SEQ ID NO: 43421 - DNA, 18 bp, Homo sapiens
caatacagtacaattata

SEQ ID NO: 43422 - DNA, 23 bp, Homo sapiens
aagcaagcatatattctctctct

SEQ ID NO: 43423 - DNA, 27 bp, Homo sapiens
actgtttactaacctgtgaaaatacca

SEQ ID NO: 43424 - DNA, 16 bp, Homo sapiens
agaaaacgaaacaaac

SEQ ID NO: 43425 - DNA, 19 bp, Homo sapiens
atcatgaacacaattctaa

SEQ ID NO: 43426 - DNA, 19 bp, Homo sapiens
ctagtccttcaactcacag

SEQ ID NO: 43427 - DNA, 17 bp, Homo sapiens
tacattcctacgttctc

SEQ ID NO: 43428 - DNA, 20 bp, Homo sapiens
tttccattcacatattacaa

SEQ ID NO: 43429 - DNA, 19 bp, Homo sapiens
aaagaggggagccctgtgt

SEQ ID NO: 43430 - DNA, 17 bp, Homo sapiens
cagccaaggtccatcat

SEQ ID NO: 43431 - DNA, 17 bp, Homo sapiens
gcttctgagccattttg

SEQ ID NO: 43432 - DNA, 23 bp, Homo sapiens
tgcgctgtttctgcttatgtggt

SEQ ID NO: 43433 - DNA, 18 bp, Homo sapiens
agaaaaatttttgatggt

SEQ ID NO: 43434 - DNA, 23 bp, Homo sapiens
aaacaatgtgatagaatatccag

SEQ ID NO: 43435 - DNA, 17 bp, Homo sapiens
accaccaacaactgttc

SEQ ID NO: 43436 - DNA, 18 bp, Homo sapiens
caacaactgttcgtactg

SEQ ID NO: 43437 - DNA, 22 bp, Homo sapiens
ccacccttttcaaccaccaaca

SEQ ID NO: 43438 - DNA, 18 bp, Homo sapiens
gaaaaaacaagtcactta

SEQ ID NO: 43439 - DNA, 17 bp, Homo sapiens
gccttggctcctggctt

SEQ ID NO: 43440 - DNA, 18 bp, Homo sapiens
gtggttctcaaactttag

SEQ ID NO: 43441 - DNA, 21 bp, Homo sapiens
tttccaacttctacctttaag

SEQ ID NO: 43442 - DNA, 19 bp, Homo sapiens
aaggttactcaacctgtaa

SEQ ID NO: 43443 - DNA, 24 bp, Homo sapiens
atgttttctggttgttttagtctt

SEQ ID NO: 43444 - DNA, 19 bp, Homo sapiens
attactctgcggtacacta

SEQ ID NO: 43445 - DNA, 25 bp, Homo sapiens
aaaagaaagaaattgccttatgtca

SEQ ID NO: 43446 - DNA, 17 bp, Homo sapiens
ccttcttccccttatcc

SEQ ID NO: 43447 - DNA, 18 bp, Homo sapiens
ctctcctttggatatctg

SEQ ID NO: 43448 - DNA, 17 bp, Homo sapiens
ctgcatggtgctttgtc

SEQ ID NO: 43449 - DNA, 20 bp, Homo sapiens
ctgcctgcctgcctgcctca

SEQ ID NO: 43450 - DNA, 20 bp, Homo sapiens
tcctcctttcccctctcctt

SEQ ID NO: 43451 - DNA, 19 bp, Homo sapiens
aagcaattctcctgcctca

SEQ ID NO: 43452 - DNA, 19 bp, Homo sapiens
atacaacttaccctcatca

SEQ ID NO: 43453 - DNA, 20 bp, Homo sapiens
atcatggaggcaggtatttc

SEQ ID NO: 43454 - DNA, 21 bp, Homo sapiens
cagcaatgtagaactgtaagt

SEQ ID NO: 43455 - DNA, 22 bp, Homo sapiens
cagtggtatagtctgcatatga

SEQ ID NO: 43456 - DNA, 20 bp, Homo sapiens
cctctgcctcccaggttcaa

SEQ ID NO: 43457 - DNA, 21 bp, Homo sapiens
cctttttacagcttttgactt

SEQ ID NO: 43458 - DNA, 23 bp, Homo sapiens
ctgcagaagctctatctttgatt

SEQ ID NO: 43459 - DNA, 19 bp, Homo sapiens
ctgcttttgctgtatccca

SEQ ID NO: 43460 - DNA, 21 bp, Homo sapiens
gaattattgtgcttctttgga

SEQ ID NO: 43461 - DNA, 20 bp, Homo sapiens
gcctctaatgatccttttta

SEQ ID NO: 43462 - DNA, 21 bp, Homo sapiens
ggcgtttcctcaggcctctca

SEQ ID NO: 43463 - DNA, 24 bp, Homo sapiens
ggtctgatggttttgaaaagggta

SEQ ID NO: 43464 - DNA, 24 bp, Homo sapiens
gtgtctgaactaccagtgagtttt

SEQ ID NO: 43465 - DNA, 20 bp, Homo sapiens
gttcttttgcttcccaatgt

SEQ ID NO: 43466 - DNA, 19 bp, Homo sapiens
tcactgacagcttgcactg

SEQ ID NO: 43467 - DNA, 19 bp, Homo sapiens
ttgtcttttgacaatttta

SEQ ID NO: 43468 - DNA, 23 bp, Homo sapiens
tttagctactcctgattattttt

SEQ ID NO: 43469 - DNA, 20 bp, Homo sapiens
ttttgggagactttttgtta

SEQ ID NO: 43470 - DNA, 24 bp, Homo sapiens
gagacataacgatttggattgcta

SEQ ID NO: 43471 - DNA, 18 bp, Homo sapiens
ggaagccaaggaccagct

SEQ ID NO: 43472 - DNA, 21 bp, Homo sapiens
gttttcttgctcctgtggatg

SEQ ID NO: 43473 - DNA, 21 bp, Homo sapiens
taaaccagggacacaatgcac

SEQ ID NO: 43474 - DNA, 18 bp, Homo sapiens
tgttggcagtaatgctgc

SEQ ID NO: 43475 - DNA, 19 bp, Homo sapiens
ggccgggtgttggatacca

SEQ ID NO: 43476 - DNA, 19 bp, Homo sapiens
aaacacatatcaagatcca

SEQ ID NO: 43477 - DNA, 19 bp, Homo sapiens
ccccagcaacctcagccaa

SEQ ID NO: 43478 - DNA, 17 bp, Homo sapiens
gcaacctcagccaatga

SEQ ID NO: 43479 - DNA, 21 bp, Homo sapiens
tgggtgggcctcaccctgctg

SEQ ID NO: 43480 - DNA, 24 bp, Homo sapiens
aggataatttgcatatccatcacc

SEQ ID NO: 43481 - DNA, 18 bp, Homo sapiens
agtattgcataactttaa

SEQ ID NO: 43482 - DNA, 19 bp, Homo sapiens
atcctggtggtaggtctct

SEQ ID NO: 43483 - DNA, 20 bp, Homo sapiens
caaaggatataaatgactaa

SEQ ID NO: 43484 - DNA, 18 bp, Homo sapiens
cctgagcctgcatggcct

SEQ ID NO: 43485 - DNA, 22 bp, Homo sapiens
gacaagcctgagcaacatatca

SEQ ID NO: 43486 - DNA, 19 bp, Homo sapiens
gacgcaggcgccattgcac

SEQ ID NO: 43487 - DNA, 18 bp, Homo sapiens
gccatatcactgagggta

SEQ ID NO: 43488 - DNA, 16 bp, Homo sapiens
gctgggcactcaggga

SEQ ID NO: 43489 - DNA, 17 bp, Homo sapiens
ggatcaggcagctccaa

SEQ ID NO: 43490 - DNA, 18 bp, Homo sapiens
ttacaccttctttctgta

SEQ ID NO: 43491 - DNA, 20 bp, Homo sapiens
ttatacatatttgtagggta

SEQ ID NO: 43492 - DNA, 18 bp, Homo sapiens
aaatgtagacctccatga

SEQ ID NO: 43493 - DNA, 18 bp, Homo sapiens
aatatactggtatagctt

SEQ ID NO: 43494 - DNA, 18 bp, Homo sapiens
attggatgaccctggaca

SEQ ID NO: 43495 - DNA, 18 bp, Homo sapiens
ccccacaagaagcacctc

SEQ ID NO: 43496 - DNA, 21 bp, Homo sapiens
gcttagaaccagtatgcccaa

SEQ ID NO: 43497 - DNA, 20 bp, Homo sapiens
tcagcaggaggcactgtgaa

SEQ ID NO: 43498 - DNA, 18 bp, Homo sapiens
tgtaaatagatggtcccg

SEQ ID NO: 43499 - DNA, 22 bp, Homo sapiens
acctcaccgtgcaggaatccca

SEQ ID NO: 43500 - DNA, 21 bp, Homo sapiens
aggacctaggaaaataccaga

SEQ ID NO: 43501 - DNA, 24 bp, Homo sapiens
caggtgtggggctgggtatggtca

SEQ ID NO: 43502 - DNA, 22 bp, Homo sapiens
tcaatgccaaggccacgttcaa

SEQ ID NO: 43503 - DNA, 20 bp, Homo sapiens
tgggagcccatcacacatcc

SEQ ID NO: 43504 - DNA, 24 bp, Homo sapiens
aggataatttgcatatccatcacc

SEQ ID NO: 43505 - DNA, 18 bp, Homo sapiens
agtattgcataactttaa

SEQ ID NO: 43506 - DNA, 19 bp, Homo sapiens
atcctggtggtaggtctct

SEQ ID NO: 43507 - DNA, 20 bp, Homo sapiens
caaaggatataaatgactaa

SEQ ID NO: 43508 - DNA, 18 bp, Homo sapiens
cctgagcctgcatggcct

SEQ ID NO: 43509 - DNA, 22 bp, Homo sapiens
gacaagcctgagcaacatatca

SEQ ID NO: 43510 - DNA, 19 bp, Homo sapiens
gacgcaggcgccattgcac

SEQ ID NO: 43511 - DNA, 18 bp, Homo sapiens
gccatatcactgagggta

SEQ ID NO: 43512 - DNA, 16 bp, Homo sapiens
gctgggcactcaggga

SEQ ID NO: 43513 - DNA, 17 bp, Homo sapiens
ggatcaggcagctccaa

SEQ ID NO: 43514 - DNA, 18 bp, Homo sapiens
ttacaccttctttctgta

SEQ ID NO: 43515 - DNA, 20 bp, Homo sapiens
ttatacatatttgtagggta

SEQ ID NO: 43516 - DNA, 24 bp, Homo sapiens
aatgtgacaatattttcatcaccg

SEQ ID NO: 43517 - DNA, 21 bp, Homo sapiens
ccacagcccgtggtccccctc

SEQ ID NO: 43518 - DNA, 21 bp, Homo sapiens
ccatccgtgaccgcgtggcct

SEQ ID NO: 43519 - DNA, 18 bp, Homo sapiens
ccccgcagcccctgcagc

SEQ ID NO: 43520 - DNA, 16 bp, Homo sapiens
ctcagctgaagcccct

SEQ ID NO: 43521 - DNA, 20 bp, Homo sapiens
ctgcaagacgcgccgcctca

SEQ ID NO: 43522 - DNA, 18 bp, Homo sapiens
gagcgtgatgcttggctc

SEQ ID NO: 43523 - DNA, 16 bp, Homo sapiens
gatcctgaaatcaagg

SEQ ID NO: 43524 - DNA, 20 bp, Homo sapiens
ccactgcctcccaggttcaa

SEQ ID NO: 43525 - DNA, 16 bp, Homo sapiens
gtcaaggagggtaagt

SEQ ID NO: 43526 - DNA, 23 bp, Homo sapiens
tagggaggtcaattgtggggcta

SEQ ID NO: 43527 - DNA, 20 bp, Homo sapiens
tcggcagatctgaattttct

SEQ ID NO: 43528 - DNA, 18 bp, Homo sapiens
acttcctgtctctgtgac

SEQ ID NO: 43529 - DNA, 20 bp, Homo sapiens
agtctcactctgttgcccag

SEQ ID NO: 43530 - DNA, 18 bp, Homo sapiens
agtttgacatggctcact

SEQ ID NO: 43531 - DNA, 23 bp, Homo sapiens
caatgcctagaacaaataagcaa

SEQ ID NO: 43532 - DNA, 18 bp, Homo sapiens
cagcactttgggaagcca

SEQ ID NO: 43533 - DNA, 20 bp, Homo sapiens
cctacagaacggcagtttga

SEQ ID NO: 43534 - DNA, 19 bp, Homo sapiens
ctgcaacctccgcctccca

SEQ ID NO: 43535 - DNA, 23 bp, Homo sapiens
ggaccgtgaattaacagtggcca

SEQ ID NO: 43536 - DNA, 19 bp, Homo sapiens
ggccaaccatttaacctca

SEQ ID NO: 43537 - DNA, 20 bp, Homo sapiens
gttgaaccccaggtctgcct

SEQ ID NO: 43538 - DNA, 18 bp, Homo sapiens
tccgcctcccaggttcaa

SEQ ID NO: 43539 - DNA, 21 bp, Homo sapiens
tgcctcgatttcttcatctct

SEQ ID NO: 43540 - DNA, 20 bp, Homo sapiens
cctcctgtcctcagggatca

SEQ ID NO: 43541 - DNA, 18 bp, Homo sapiens
ctacaggctggggtggcc

SEQ ID NO: 43542 - DNA, 22 bp, Homo sapiens
gaaaaccaaccccaccctgcca

SEQ ID NO: 43543 - DNA, 19 bp, Homo sapiens
gggactgctggttgccaac

SEQ ID NO: 43544 - DNA, 17 bp, Homo sapiens
tagcacagtgcttggca

SEQ ID NO: 43545 - DNA, 20 bp, Homo sapiens
aacagtctcacttcattctt

SEQ ID NO: 43546 - DNA, 18 bp, Homo sapiens
agcaattctcctgtctta

SEQ ID NO: 43547 - DNA, 19 bp, Homo sapiens
aggagatgggaagaagcaa

SEQ ID NO: 43548 - DNA, 23 bp, Homo sapiens
atttgaacctgtgttcttggttc

SEQ ID NO: 43549 - DNA, 16 bp, Homo sapiens
cattcccacttggctt

SEQ ID NO: 43550 - DNA, 19 bp, Homo sapiens
ccataatatacacactcta

SEQ ID NO: 43551 - DNA, 20 bp, Homo sapiens
cctctgcctcccgggttcaa

SEQ ID NO: 43552 - DNA, 17 bp, Homo sapiens
cggcaacctctgcctcc

SEQ ID NO: 43553 - DNA, 22 bp, Homo sapiens
gaaccaagatcatgccactgca

SEQ ID NO: 43554 - DNA, 23 bp, Homo sapiens
gcgtgaacaagccagtcccgcta

SEQ ID NO: 43555 - DNA, 28 bp, Homo sapiens
ggccgtcccagaagcgcctgctccccct

SEQ ID NO: 43556 - DNA, 19 bp, Homo sapiens
gttttcttgccagccatga

SEQ ID NO: 43557 - DNA, 22 bp, Homo sapiens
tatgggagagaagaagctatga

SEQ ID NO: 43558 - DNA, 18 bp, Homo sapiens
tctcacctcttcttcagg

SEQ ID NO: 43559 - DNA, 20 bp, Homo sapiens
tgagcaccaacatgacacta

SEQ ID NO: 43560 - DNA, 22 bp, Homo sapiens
tggtgttttccccaggctgcta

SEQ ID NO: 43561 - DNA, 15 bp, Homo sapiens
ttagcctccatgttt

SEQ ID NO: 43562 - DNA, 20 bp, Homo sapiens
ttcctgtgccaggccctgga

SEQ ID NO: 43563 - DNA, 21 bp, Homo sapiens
aagacatgcagttaaacttga

SEQ ID NO: 43564 - DNA, 27 bp, Homo sapiens
aagtgactaagggcaataactcattaa

SEQ ID NO: 43565 - DNA, 19 bp, Homo sapiens
attgtaaacatgtgcttca

SEQ ID NO: 43566 - DNA, 20 bp, Homo sapiens
tagtgttatttatggattag

SEQ ID NO: 43567 - DNA, 26 bp, Homo sapiens
atggacccaggtcctgaatgaagctg

SEQ ID NO: 43568 - DNA, 21 bp, Homo sapiens
ccctccccacctcttctctcc

SEQ ID NO: 43569 - DNA, 17 bp, Homo sapiens
ctccccagtcttctcca

SEQ ID NO: 43570 - DNA, 21 bp, Homo sapiens
ctggtccccccaacagatctc

SEQ ID NO: 43571 - DNA, 17 bp, Homo sapiens
cttctctacctcccctc

SEQ ID NO: 43572 - DNA, 24 bp, Homo sapiens
gcccaagggtagggaatctgggga

SEQ ID NO: 43573 - DNA, 21 bp, Homo sapiens
tccagggacagagtgatccaa

SEQ ID NO: 43574 - DNA, 17 bp, Homo sapiens
tgctgattgcatgtgtg

SEQ ID NO: 43575 - DNA, 23 bp, Homo sapiens
gctctggggaggagaggctggga

SEQ ID NO: 43576 - DNA, 21 bp, Homo sapiens
acccgtggagcgcacattctg

SEQ ID NO: 43577 - DNA, 21 bp, Homo sapiens
gaagaggcaaatgacatttca

SEQ ID NO: 43578 - DNA, 22 bp, Homo sapiens
acctggcccatcgccgtggcct

SEQ ID NO: 43579 - DNA, 18 bp, Homo sapiens
ccctggaggccttgggga

SEQ ID NO: 43580 - DNA, 18 bp, Homo sapiens
ccttggggattcggagga

SEQ ID NO: 43581 - DNA, 19 bp, Homo sapiens
gccctggaggccttgggga

SEQ ID NO: 43582 - DNA, 20 bp, Homo sapiens
ccagagctggagtccacctt

SEQ ID NO: 43583 - DNA, 18 bp, Homo sapiens
ccccagccagaaaatcca

SEQ ID NO: 43584 - DNA, 25 bp, Homo sapiens
ttttgacgtgtcttggagcctgtgg

SEQ ID NO: 43585 - DNA, 17 bp, Homo sapiens
gcctgctccatcaggga

SEQ ID NO: 43586 - DNA, 21 bp, Homo sapiens
gctcccctgaggatcccagga

SEQ ID NO: 43587 - DNA, 20 bp, Homo sapiens
aaccaaaaggattgggtttg

SEQ ID NO: 43588 - DNA, 15 bp, Homo sapiens
atgatgtaatcagtt

SEQ ID NO: 43589 - DNA, 19 bp, Homo sapiens
gacactgggctgtctgctt

SEQ ID NO: 43590 - DNA, 18 bp, Homo sapiens
taatcagtgaatcataga

SEQ ID NO: 43591 - DNA, 20 bp, Homo sapiens
tggaattaattatgagactg

SEQ ID NO: 43592 - DNA, 19 bp, Homo sapiens
tgtggtggacagatataga

SEQ ID NO: 43593 - DNA, 18 bp, Homo sapiens
catcgggaagcccctggg

SEQ ID NO: 43594 - DNA, 19 bp, Homo sapiens
gcccttcctccaggcttct

SEQ ID NO: 43595 - DNA, 22 bp, Homo sapiens
tgtcctcaagttgttcctgcta

SEQ ID NO: 43596 - DNA, 20 bp, Homo sapiens
ttcagaacccctagagcaat

SEQ ID NO: 43597 - DNA, 15 bp, Homo sapiens
ctgttatttttgctg

SEQ ID NO: 43598 - DNA, 19 bp, Homo sapiens
gcccagatcagctgtccag

SEQ ID NO: 43599 - DNA, 22 bp, Homo sapiens
aaaactggctgcggtgagctct

SEQ ID NO: 43600 - DNA, 22 bp, Homo sapiens
acatgcccaccctcttatctca

SEQ ID NO: 43601 - DNA, 22 bp, Homo sapiens
agaagcccctcacagcccagga

SEQ ID NO: 43602 - DNA, 19 bp, Homo sapiens
ccacctcccgggcccccct

SEQ ID NO: 43603 - DNA, 20 bp, Homo sapiens
ccccagaagcccctcacagc

SEQ ID NO: 43604 - DNA, 22 bp, Homo sapiens
ggcgtacacgtagaggcatgtg

SEQ ID NO: 43605 - DNA, 19 bp, Homo sapiens
ccatgggaacaaccccgtc

SEQ ID NO: 43606 - DNA, 18 bp, Homo sapiens
ccgtcctcacacacgaca

SEQ ID NO: 43607 - DNA, 19 bp, Homo sapiens
ccacagcagctccactttt

SEQ ID NO: 43608 - DNA, 20 bp, Homo sapiens
caatggccatccctgctcct

SEQ ID NO: 43609 - DNA, 22 bp, Homo sapiens
atccttccagaaattacctatc

SEQ ID NO: 43610 - DNA, 18 bp, Homo sapiens
attcctggggccctggca

SEQ ID NO: 43611 - DNA, 20 bp, Homo sapiens
tcctggtttggcgctttgtg

SEQ ID NO: 43612 - DNA, 20 bp, Homo sapiens
gaccaggcacagaaagctga

SEQ ID NO: 43613 - DNA, 18 bp, Homo sapiens
agagccagacagaggaga

SEQ ID NO: 43614 - DNA, 21 bp, Homo sapiens
tctctgacaccactctggaga

SEQ ID NO: 43615 - DNA, 15 bp, Homo sapiens
agcctagtctcctca

SEQ ID NO: 43616 - DNA, 23 bp, Homo sapiens
tactgcagtgaatgagcttctga

SEQ ID NO: 43617 - DNA, 18 bp, Homo sapiens
ggagctttttaaatctca

SEQ ID NO: 43618 - DNA, 18 bp, Homo sapiens
tgagctcttcattagctc

SEQ ID NO: 43619 - DNA, 20 bp, Homo sapiens
aagacacctgtcaaatgtca

SEQ ID NO: 43620 - DNA, 22 bp, Homo sapiens
actcgcctctgctcctgtggtc

SEQ ID NO: 43621 - DNA, 17 bp, Homo sapiens
actgtgctcagattccc

SEQ ID NO: 43622 - DNA, 17 bp, Homo sapiens
ccccctgggatggctca

SEQ ID NO: 43623 - DNA, 21 bp, Homo sapiens
ggcccctctctgggcagtcag

SEQ ID NO: 43624 - DNA, 17 bp, Homo sapiens
tgctagcagctgtgatg

SEQ ID NO: 43625 - DNA, 19 bp, Homo sapiens
agacccactaatttgcaca

SEQ ID NO: 43626 - DNA, 20 bp, Homo sapiens
catgacaaccccactgtaca

SEQ ID NO: 43627 - DNA, 18 bp, Homo sapiens
ggagctttttaaatctca

SEQ ID NO: 43628 - DNA, 18 bp, Homo sapiens
tgagctcttcattagctc

SEQ ID NO: 43629 - DNA, 19 bp, Homo sapiens
aaacttgtcaggactggct

SEQ ID NO: 43630 - DNA, 19 bp, Homo sapiens
aattcctttagatgttatc

SEQ ID NO: 43631 - DNA, 24 bp, Homo sapiens
agaaagataaccttaaccaggaca

SEQ ID NO: 43632 - DNA, 21 bp, Homo sapiens
cattatgatggtggtagaagc

SEQ ID NO: 43633 - DNA, 20 bp, Homo sapiens
cctcctcggcttcctcctca

SEQ ID NO: 43634 - DNA, 21 bp, Homo sapiens
ctcctcctcctcctcctcctc

SEQ ID NO: 43635 - DNA, 21 bp, Homo sapiens
gggccgtatgggaagctgcac

SEQ ID NO: 43636 - DNA, 18 bp, Homo sapiens
tttttctataccaatcgc

SEQ ID NO: 43637 - DNA, 22 bp, Homo sapiens
cccttccagggcctctgctcca

SEQ ID NO: 43638 - DNA, 19 bp, Homo sapiens
ttccagggcctctgctcca

SEQ ID NO: 43639 - DNA, 23 bp, Homo sapiens
ccttagttgctggctttgacctt

SEQ ID NO: 43640 - DNA, 22 bp, Homo sapiens
ctgtaatgattagtctgtatgt

SEQ ID NO: 43641 - DNA, 22 bp, Homo sapiens
accagagaacaaattctggcca

SEQ ID NO: 43642 - DNA, 20 bp, Homo sapiens
ctctccccagagcatttgat

SEQ ID NO: 43643 - DNA, 21 bp, Homo sapiens
ggacaaaaagtgaaatacttt

SEQ ID NO: 43644 - DNA, 19 bp, Homo sapiens
tgagtgggttccggagagc

SEQ ID NO: 43645 - DNA, 17 bp, Homo sapiens
aaacccagcccaaacat

SEQ ID NO: 43646 - DNA, 18 bp, Homo sapiens
accatcacaaataacaga

SEQ ID NO: 43647 - DNA, 20 bp, Homo sapiens
acttaggcagctctgctcct

SEQ ID NO: 43648 - DNA, 19 bp, Homo sapiens
cagcaaccatcacaaataa

SEQ ID NO: 43649 - DNA, 22 bp, Homo sapiens
caggattataataggcctgtta

SEQ ID NO: 43650 - DNA, 20 bp, Homo sapiens
catggatatttctgctatgc

SEQ ID NO: 43651 - DNA, 17 bp, Homo sapiens
ccacttgatgcacaaat

SEQ ID NO: 43652 - DNA, 22 bp, Homo sapiens
gaagtcttctcctggaactcaa

SEQ ID NO: 43653 - DNA, 16 bp, Homo sapiens
gataaacaagatgctg

SEQ ID NO: 43654 - DNA, 21 bp, Homo sapiens
gatgaaaaaagagctttcaag

SEQ ID NO: 43655 - DNA, 19 bp, Homo sapiens
tagcattaacatctgcaag

SEQ ID NO: 43656 - DNA, 18 bp, Homo sapiens
tcctaaaattttccaaca

SEQ ID NO: 43657 - DNA, 20 bp, Homo sapiens
tcctggaactcaagacttgc

SEQ ID NO: 43658 - DNA, 22 bp, Homo sapiens
gagaagtaacagggaagctaca

SEQ ID NO: 43659 - DNA, 19 bp, Homo sapiens
tggcagggcctagctgcta

SEQ ID NO: 43660 - DNA, 20 bp, Homo sapiens
agctacaaaaatctgtatta

SEQ ID NO: 43661 - DNA, 22 bp, Homo sapiens
ccctccttccttctttccctac

SEQ ID NO: 43662 - DNA, 24 bp, Homo sapiens
gcaaagagagctcccctggttcca

SEQ ID NO: 43663 - DNA, 22 bp, Homo sapiens
ggacttggacagagggcccaca

SEQ ID NO: 43664 - DNA, 19 bp, Homo sapiens
tctaccttcccactcacct

SEQ ID NO: 43665 - DNA, 21 bp, Homo sapiens
cagggggagctgggcctggtc

SEQ ID NO: 43666 - DNA, 18 bp, Homo sapiens
catgctcctcttccccag

SEQ ID NO: 43667 - DNA, 19 bp, Homo sapiens
cctgagcagtccttggcct

SEQ ID NO: 43668 - DNA, 19 bp, Homo sapiens
ctcccccaccgttgtctca

SEQ ID NO: 43669 - DNA, 21 bp, Homo sapiens
gggcaatgttaatttagtgga

SEQ ID NO: 43670 - DNA, 20 bp, Homo sapiens
ttgcaggtggccaagttcct

SEQ ID NO: 43671 - DNA, 17 bp, Homo sapiens
aacccctgatttatata

SEQ ID NO: 43672 - DNA, 21 bp, Homo sapiens
aggatgttttatgaagtcaca

SEQ ID NO: 43673 - DNA, 23 bp, Homo sapiens
gcttcaagatggccgcttggctc

SEQ ID NO: 43674 - DNA, 21 bp, Homo sapiens
ggaggaggaggccgaggcgcc

SEQ ID NO: 43675 - DNA, 17 bp, Homo sapiens
gtagccatgtcactgtg

SEQ ID NO: 43676 - DNA, 19 bp, Homo sapiens
tgtggatatctaattctaa

SEQ ID NO: 43677 - DNA, 21 bp, Homo sapiens
tgttaaggaaaaaaattttaa

SEQ ID NO: 43678 - DNA, 22 bp, Homo sapiens
tttatatagatatcttcatgcc

SEQ ID NO: 43679 - DNA, 17 bp, Homo sapiens
agatgccttctaagcta

SEQ ID NO: 43680 - DNA, 19 bp, Homo sapiens
cctttggaaaacttgtgaa

SEQ ID NO: 43681 - DNA, 20 bp, Homo sapiens
ataaaaatcatgtgttatta

SEQ ID NO: 43682 - DNA, 19 bp, Homo sapiens
gcatttgtgaatttaatag

SEQ ID NO: 43683 - DNA, 18 bp, Homo sapiens
tagcacagttgcttagta

SEQ ID NO: 43684 - DNA, 22 bp, Homo sapiens
tccaaaataacctaactgcagc

SEQ ID NO: 43685 - DNA, 22 bp, Homo sapiens
tcctacgttagaaaccattctt

SEQ ID NO: 43686 - DNA, 21 bp, Homo sapiens
tcttttatctgttgtagcttt

SEQ ID NO: 43687 - DNA, 23 bp, Homo sapiens
actagggatccctcatctgtccc

SEQ ID NO: 43688 - DNA, 22 bp, Homo sapiens
ctgggggtgccaggaccagtca

SEQ ID NO: 43689 - DNA, 21 bp, Homo sapiens
cttgtaatccgaatctctttt

SEQ ID NO: 43690 - DNA, 16 bp, Homo sapiens
gagcttccctgactca

SEQ ID NO: 43691 - DNA, 23 bp, Homo sapiens
gggcagggccccaggcattgcca

SEQ ID NO: 43692 - DNA, 20 bp, Homo sapiens
tctgtctcatccatcatcat

SEQ ID NO: 43693 - DNA, 22 bp, Homo sapiens
gatggctttggttggtccgtga

SEQ ID NO: 43694 - DNA, 21 bp, Homo sapiens
ctgaaatgaatgtatttctcc

SEQ ID NO: 43695 - DNA, 22 bp, Homo sapiens
tctgggtgatccaatcattttt

SEQ ID NO: 43696 - DNA, 20 bp, Homo sapiens
tcctcttctcccctcacttt

SEQ ID NO: 43697 - DNA, 19 bp, Homo sapiens
tgaagttacaaacctgtaa

SEQ ID NO: 43698 - DNA, 22 bp, Homo sapiens
attctgatgatgactcctactc

SEQ ID NO: 43699 - DNA, 19 bp, Homo sapiens
actgtctgttgtttaccta

SEQ ID NO: 43700 - DNA, 21 bp, Homo sapiens
ccctgaaactgagtctgtgga

SEQ ID NO: 43701 - DNA, 19 bp, Homo sapiens
gcctgacccgcaatgggca

SEQ ID NO: 43702 - DNA, 19 bp, Homo sapiens
tgggccggcctgacccgca

SEQ ID NO: 43703 - DNA, 22 bp, Homo sapiens
aacttactgattattttcttca

SEQ ID NO: 43704 - DNA, 16 bp, Homo sapiens
atgggttaggcattaa

SEQ ID NO: 43705 - DNA, 18 bp, Homo sapiens
tcagatattattgcttta

SEQ ID NO: 43706 - DNA, 19 bp, Homo sapiens
tgtttctgcatgaatatca

SEQ ID NO: 43707 - DNA, 18 bp, Homo sapiens
aaaactctcctctgctgc

SEQ ID NO: 43708 - DNA, 22 bp, Homo sapiens
acctgattgtgtctcttggtcc

SEQ ID NO: 43709 - DNA, 18 bp, Homo sapiens
cctttgtccccaccgcag

SEQ ID NO: 43710 - DNA, 18 bp, Homo sapiens
ctgtgctgccctgcccac

SEQ ID NO: 43711 - DNA, 19 bp, Homo sapiens
gagtactacagtcctccca

SEQ ID NO: 43712 - DNA, 18 bp, Homo sapiens
gctcccaggcattcccca

SEQ ID NO: 43713 - DNA, 20 bp, Homo sapiens
gttctacccaggtgctagga

SEQ ID NO: 43714 - DNA, 21 bp, Homo sapiens
tggtgacatgtcttttcttgc

SEQ ID NO: 43715 - DNA, 21 bp, Homo sapiens
ctctaacccatcctctgcctc

SEQ ID NO: 43716 - DNA, 17 bp, Homo sapiens
tcaagtgattctcttgc

SEQ ID NO: 43717 - DNA, 20 bp, Homo sapiens
tggccaggctggtcttgaac

SEQ ID NO: 43718 - DNA, 20 bp, Homo sapiens
agaaggccacaggccactgc

SEQ ID NO: 43719 - DNA, 19 bp, Homo sapiens
atgaccaatcctatgtcat

SEQ ID NO: 43720 - DNA, 20 bp, Homo sapiens
cactgcaaaccctgctgcct

SEQ ID NO: 43721 - DNA, 22 bp, Homo sapiens
gcccctccccacccctgccttt

SEQ ID NO: 43722 - DNA, 18 bp, Homo sapiens
gctggggtgacactgctc

SEQ ID NO: 43723 - DNA, 24 bp, Homo sapiens
tttttttatttcttgttttagtct

SEQ ID NO: 43724 - DNA, 21 bp, Homo sapiens
cagagctcagcgagaagctgt

SEQ ID NO: 43725 - DNA, 21 bp, Homo sapiens
cccaagtatcagcatatttct

SEQ ID NO: 43726 - DNA, 21 bp, Homo sapiens
ctgaagacttctaagatatta

SEQ ID NO: 43727 - DNA, 19 bp, Homo sapiens
ctgaatcagggttccttga

SEQ ID NO: 43728 - DNA, 19 bp, Homo sapiens
gttaacatcccacaacaac

SEQ ID NO: 43729 - DNA, 16 bp, Homo sapiens
tctggacatgacacat

SEQ ID NO: 43730 - DNA, 21 bp, Homo sapiens
gcttttccaacaaatctttga

SEQ ID NO: 43731 - DNA, 16 bp, Homo sapiens
gtaatgaaagcactta

SEQ ID NO: 43732 - DNA, 23 bp, Homo sapiens
tcattattcttgcagctaagcaa

SEQ ID NO: 43733 - DNA, 23 bp, Homo sapiens
ttgaaagaacaaagtttacttca

SEQ ID NO: 43734 - DNA, 19 bp, Homo sapiens
ggccactttgtagaaatca

SEQ ID NO: 43735 - DNA, 23 bp, Homo sapiens
tcaccaggcaaatacctgttctg

SEQ ID NO: 43736 - DNA, 24 bp, Homo sapiens
tttgggggcccattacacacccca

SEQ ID NO: 43737 - DNA, 22 bp, Homo sapiens
ccttatggcttaaaattcctta

SEQ ID NO: 43738 - DNA, 18 bp, Homo sapiens
tggttgtgttttcagaat

SEQ ID NO: 43739 - DNA, 23 bp, Homo sapiens
ggggacgcgagtggcggccgcgg

SEQ ID NO: 43740 - DNA, 26 bp, Homo sapiens
agggacagctgctgggacccacctcc

SEQ ID NO: 43741 - DNA, 22 bp, Homo sapiens
ccaccccccacgtctgtcctcc

SEQ ID NO: 43742 - DNA, 18 bp, Homo sapiens
ccgggacagtgttgtaca

SEQ ID NO: 43743 - DNA, 23 bp, Homo sapiens
gacccacctccccctccccggcc

SEQ ID NO: 43744 - DNA, 19 bp, Homo sapiens
gcaaaagacttgagccatc

SEQ ID NO: 43745 - DNA, 23 bp, Homo sapiens
gcgttcagacccagacgatgcca

SEQ ID NO: 43746 - DNA, 24 bp, Homo sapiens
tccaaagaaacactaagctctctg

SEQ ID NO: 43747 - DNA, 19 bp, Homo sapiens
tgaaatcactttacctgca

SEQ ID NO: 43748 - DNA, 22 bp, Homo sapiens
acagcagcacctcctccatgca

SEQ ID NO: 43749 - DNA, 22 bp, Homo sapiens
agcatttgctttcctctgagat

SEQ ID NO: 43750 - DNA, 19 bp, Homo sapiens
atgcaggccttaactttcc

SEQ ID NO: 43751 - DNA, 24 bp, Homo sapiens
aagaatctttccaaagttgtctca

SEQ ID NO: 43752 - DNA, 18 bp, Homo sapiens
agcccaaggagcgctcca

SEQ ID NO: 43753 - DNA, 20 bp, Homo sapiens
tcaaatgcatcaattctcta

SEQ ID NO: 43754 - DNA, 21 bp, Homo sapiens
agccaagacctcacacacaca

SEQ ID NO: 43755 - DNA, 18 bp, Homo sapiens
agccgcaacgccacccgc

SEQ ID NO: 43756 - DNA, 20 bp, Homo sapiens
ggtcccggctctgtgggtga

SEQ ID NO: 43757 - DNA, 22 bp, Homo sapiens
gtgtccagcattgctggactct

SEQ ID NO: 43758 - DNA, 19 bp, Homo sapiens
aagagactctcctgcctca

SEQ ID NO: 43759 - DNA, 18 bp, Homo sapiens
actagctatgaaatactc

SEQ ID NO: 43760 - DNA, 17 bp, Homo sapiens
agtgaagatttacctcg

SEQ ID NO: 43761 - DNA, 19 bp, Homo sapiens
attcaacaagcacctagta

SEQ ID NO: 43762 - DNA, 20 bp, Homo sapiens
cagaaaagacaaacagtaga

SEQ ID NO: 43763 - DNA, 17 bp, Homo sapiens
ccaattatagtttgaca

SEQ ID NO: 43764 - DNA, 21 bp, Homo sapiens
ctcatggagtcatcttgcaca

SEQ ID NO: 43765 - DNA, 18 bp, Homo sapiens
gctttaacagtggagctg

SEQ ID NO: 43766 - DNA, 22 bp, Homo sapiens
taaacttaaaaagaaaacctca

SEQ ID NO: 43767 - DNA, 18 bp, Homo sapiens
tccgcctcctgggttcaa

SEQ ID NO: 43768 - DNA, 18 bp, Homo sapiens
ttgatgatcactgtgaaa

SEQ ID NO: 43769 - DNA, 18 bp, Homo sapiens
gaagttcattttggttta

SEQ ID NO: 43770 - DNA, 18 bp, Homo sapiens
atgctgatttggtgacca

SEQ ID NO: 43771 - DNA, 22 bp, Homo sapiens
tccaaccttcccaaacgcctcc

SEQ ID NO: 43772 - DNA, 23 bp, Homo sapiens
tgggggacccaatgtaggagctg

SEQ ID NO: 43773 - DNA, 22 bp, Homo sapiens
tatttcaaaaacatgcttttcc

SEQ ID NO: 43774 - DNA, 17 bp, Homo sapiens
tggtctatataaccaca

SEQ ID NO: 43775 - DNA, 20 bp, Homo sapiens
acccaaaattcaccacagca

SEQ ID NO: 43776 - DNA, 24 bp, Homo sapiens
cattgctgctccttatttattgta

SEQ ID NO: 43777 - DNA, 19 bp, Homo sapiens
aattgtgttgggtgtgggt

SEQ ID NO: 43778 - DNA, 19 bp, Homo sapiens
cagctggatccatccatca

SEQ ID NO: 43779 - DNA, 19 bp, Homo sapiens
catggggccagcactgtca

SEQ ID NO: 43780 - DNA, 20 bp, Homo sapiens
gttgggttgtagctaggctt

SEQ ID NO: 43781 - DNA, 18 bp, Homo sapiens
taaaacacatctagacaa

SEQ ID NO: 43782 - DNA, 22 bp, Homo sapiens
ttttttgtttagctacatgatt

SEQ ID NO: 43783 - DNA, 19 bp, Homo sapiens
catgcatacctgcactgca

SEQ ID NO: 43784 - DNA, 18 bp, Homo sapiens
ccctgcccagaatgccca

SEQ ID NO: 43785 - DNA, 26 bp, Homo sapiens
tgagtggggcccacatcgtggagctg

SEQ ID NO: 43786 - DNA, 24 bp, Homo sapiens
ttgagcccctgctggtgtgctgca

SEQ ID NO: 43787 - DNA, 20 bp, Homo sapiens
ttctgtctttctgttctcac

SEQ ID NO: 43788 - DNA, 24 bp, Homo sapiens
acacacagttggataaacatatca

SEQ ID NO: 43789 - DNA, 19 bp, Homo sapiens
cccttctatttagagtaga

SEQ ID NO: 43790 - DNA, 20 bp, Homo sapiens
ctagagagctggcccagcca

SEQ ID NO: 43791 - DNA, 18 bp, Homo sapiens
tgtgccctcacagcaccg

SEQ ID NO: 43792 - DNA, 20 bp, Homo sapiens
aattcacataataaacgatg

SEQ ID NO: 43793 - DNA, 20 bp, Homo sapiens
aagacacctgtcaaatgtca

SEQ ID NO: 43794 - DNA, 19 bp, Homo sapiens
aagacctatcatgccaaga

SEQ ID NO: 43795 - DNA, 22 bp, Homo sapiens
actcgcctctgctcctgtggtc

SEQ ID NO: 43796 - DNA, 19 bp, Homo sapiens
cccagtggcctcgtcccag

SEQ ID NO: 43797 - DNA, 17 bp, Homo sapiens
ccccctgggatggctca

SEQ ID NO: 43798 - DNA, 18 bp, Homo sapiens
ccgggtgggggattttgg

SEQ ID NO: 43799 - DNA, 19 bp, Homo sapiens
gcagagggaaccagcttca

SEQ ID NO: 43800 - DNA, 19 bp, Homo sapiens
acaggaagcaaatgcctca

SEQ ID NO: 43801 - DNA, 19 bp, Homo sapiens
agtttcaggcaatgaagtg

SEQ ID NO: 43802 - DNA, 25 bp, Homo sapiens
ccttattaatacggggatctgtgag

SEQ ID NO: 43803 - DNA, 17 bp, Homo sapiens
ttctggcaaacagtgtt

SEQ ID NO: 43804 - DNA, 18 bp, Homo sapiens
ccaccgccgccgacagcg

SEQ ID NO: 43805 - DNA, 19 bp, Homo sapiens
cgccgcctgcgccgcgaga

SEQ ID NO: 43806 - DNA, 23 bp, Homo sapiens
aaaacaaacaattataatgttgt

SEQ ID NO: 43807 - DNA, 20 bp, Homo sapiens
actggtgcagctgctggcca

SEQ ID NO: 43808 - DNA, 20 bp, Homo sapiens
aggccctgtgcacgtcctca

SEQ ID NO: 43809 - DNA, 21 bp, Homo sapiens
cacatcaccgccttgttcctc

SEQ ID NO: 43810 - DNA, 20 bp, Homo sapiens
gatcccaccattagcctgta

SEQ ID NO: 43811 - DNA, 20 bp, Homo sapiens
ggtgttgatgccaataacca

SEQ ID NO: 43812 - DNA, 20 bp, Homo sapiens
tctactaatgttgtgtgatt

SEQ ID NO: 43813 - DNA, 20 bp, Homo sapiens
agagaaacggacagaggcga

SEQ ID NO: 43814 - DNA, 22 bp, Homo sapiens
agtgagggtttctgtgctgtca

SEQ ID NO: 43815 - DNA, 19 bp, Homo sapiens
catcccagcgggcatctca

SEQ ID NO: 43816 - DNA, 22 bp, Homo sapiens
cccctagcacctgccgtcctca

SEQ ID NO: 43817 - DNA, 20 bp, Homo sapiens
cgtgaatacttcctgtccta

SEQ ID NO: 43818 - DNA, 25 bp, Homo sapiens
gctggcgatgatccacactgggata

SEQ ID NO: 43819 - DNA, 19 bp, Homo sapiens
gtagtcttaaatcatgtga

SEQ ID NO: 43820 - DNA, 19 bp, Homo sapiens
aagcaattctcctgcctca

SEQ ID NO: 43821 - DNA, 21 bp, Homo sapiens
atcttggttcactgcaacctc

SEQ ID NO: 43822 - DNA, 18 bp, Homo sapiens
cctgcaacctccacctcc

SEQ ID NO: 43823 - DNA, 22 bp, Homo sapiens
gagccaagattgcgccgctaca

SEQ ID NO: 43824 - DNA, 19 bp, Homo sapiens
ggatttctaaaagatttcc

SEQ ID NO: 43825 - DNA, 18 bp, Homo sapiens
tccacttcctaggttcaa

SEQ ID NO: 43826 - DNA, 18 bp, Homo sapiens
tctctactaaaaatacaa

SEQ ID NO: 43827 - DNA, 18 bp, Homo sapiens
cctgagcctgtatggccc

SEQ ID NO: 43828 - DNA, 22 bp, Homo sapiens
gcaggaaggaggatggctgtgt

SEQ ID NO: 43829 - DNA, 17 bp, Homo sapiens
gctttgattcttggttc

SEQ ID NO: 43830 - DNA, 19 bp, Homo sapiens
gggcagagctgggcctgtc

SEQ ID NO: 43831 - DNA, 18 bp, Homo sapiens
agacattcaggcatcaga

SEQ ID NO: 43832 - DNA, 21 bp, Homo sapiens
taggtgggcccaccacttgag

SEQ ID NO: 43833 - DNA, 22 bp, Homo sapiens
ctttggggccgggaacttgcgg

SEQ ID NO: 43834 - DNA, 20 bp, Homo sapiens
gcagtaacattgggtcctgg

SEQ ID NO: 43835 - DNA, 21 bp, Homo sapiens
ggttttggtgtcctgctacaa

SEQ ID NO: 43836 - DNA, 20 bp, Homo sapiens
tctcccatggcttaatgctt

SEQ ID NO: 43837 - DNA, 26 bp, Homo sapiens
gaagaaaacacagagaaagccgttga

SEQ ID NO: 43838 - DNA, 15 bp, Homo sapiens
cctttaagaggcgga

SEQ ID NO: 43839 - DNA, 19 bp, Homo sapiens
catgccttcacatcacaac

SEQ ID NO: 43840 - DNA, 24 bp, Homo sapiens
cccgccgcccgccgcggcccggta

SEQ ID NO: 43841 - DNA, 23 bp, Homo sapiens
gcgccggcttcttcccagcgcga

SEQ ID NO: 43842 - DNA, 16 bp, Homo sapiens
tcaaaggccatttcca

SEQ ID NO: 43843 - DNA, 17 bp, Homo sapiens
caaaaccaagatggtga

SEQ ID NO: 43844 - DNA, 19 bp, Homo sapiens
ccctgccagcacccgtgca

SEQ ID NO: 43845 - DNA, 19 bp, Homo sapiens
ctccccttacatacataca

SEQ ID NO: 43846 - DNA, 22 bp, Homo sapiens
tggtgtcatcagctgtttctcc

SEQ ID NO: 43847 - DNA, 23 bp, Homo sapiens
acctaattttcctgggactgcca

SEQ ID NO: 43848 - DNA, 22 bp, Homo sapiens
acctcttttagaaaacttgaca

SEQ ID NO: 43849 - DNA, 20 bp, Homo sapiens
catgtcctctcaccccatga

SEQ ID NO: 43850 - DNA, 20 bp, Homo sapiens
ctttttacgtttgcagatgc

SEQ ID NO: 43851 - DNA, 20 bp, Homo sapiens
gcagatgccaaaataatgtc

SEQ ID NO: 43852 - DNA, 19 bp, Homo sapiens
gcaggtctctcagcactga

SEQ ID NO: 43853 - DNA, 20 bp, Homo sapiens
caggatacgataccttgcca

SEQ ID NO: 43854 - DNA, 19 bp, Homo sapiens
acagaggcacagggcaggc

SEQ ID NO: 43855 - DNA, 24 bp, Homo sapiens
acagaaaccatcatcgtctttgta

SEQ ID NO: 43856 - DNA, 17 bp, Homo sapiens
agcaaaccatttctctc

SEQ ID NO: 43857 - DNA, 17 bp, Homo sapiens
agcttggaactccatca

SEQ ID NO: 43858 - DNA, 21 bp, Homo sapiens
cagtcactgtcccagacggca

SEQ ID NO: 43859 - DNA, 17 bp, Homo sapiens
catcacaatctcaccca

SEQ ID NO: 43860 - DNA, 18 bp, Homo sapiens
ctgcatcctaccccacct

SEQ ID NO: 43861 - DNA, 22 bp, Homo sapiens
gaaaaaggacaagagtctgtgt

SEQ ID NO: 43862 - DNA, 18 bp, Homo sapiens
ggacacccacttccctct

SEQ ID NO: 43863 - DNA, 22 bp, Homo sapiens
ggtgtacacccaaccaaagtga

SEQ ID NO: 43864 - DNA, 20 bp, Homo sapiens
tcctgcttggggactggtgg

SEQ ID NO: 43865 - DNA, 20 bp, Homo sapiens
tgcaaccatctctgggctca

SEQ ID NO: 43866 - DNA, 20 bp, Homo sapiens
atcattcgtttgttgagcaa

SEQ ID NO: 43867 - DNA, 19 bp, Homo sapiens
ccacggggccccttccctc

SEQ ID NO: 43868 - DNA, 17 bp, Homo sapiens
ccctcagtatccacctt

SEQ ID NO: 43869 - DNA, 25 bp, Homo sapiens
tcaccaacctggctctcccacctcc

SEQ ID NO: 43870 - DNA, 18 bp, Homo sapiens
aagatagctgggcccagt

SEQ ID NO: 43871 - DNA, 17 bp, Homo sapiens
agtgaccttgccagtga

SEQ ID NO: 43872 - DNA, 18 bp, Homo sapiens
catagatgttaaaatttc

SEQ ID NO: 43873 - DNA, 18 bp, Homo sapiens
ccagcgtgtctgttccag

SEQ ID NO: 43874 - DNA, 19 bp, Homo sapiens
ctgcggaggggggccgcga

SEQ ID NO: 43875 - DNA, 20 bp, Homo sapiens
ctttccttcccctctgcctc

SEQ ID NO: 43876 - DNA, 19 bp, Homo sapiens
gttaaatgacagcataaca

SEQ ID NO: 43877 - DNA, 15 bp, Homo sapiens
tctctgtcccttgcc

SEQ ID NO: 43878 - DNA, 22 bp, Homo sapiens
tgagctgttcagcaggtagcca

SEQ ID NO: 43879 - DNA, 22 bp, Homo sapiens
tgggcggcgtgcctgtgccaac

SEQ ID NO: 43880 - DNA, 21 bp, Homo sapiens
ttttttactatgctttggtct

SEQ ID NO: 43881 - DNA, 23 bp, Homo sapiens
tacaaaatttaatgcagtattta

SEQ ID NO: 43882 - DNA, 23 bp, Homo sapiens
gaattaaatgctttacaacatga

SEQ ID NO: 43883 - DNA, 18 bp, Homo sapiens
gattgctctcattttctt

SEQ ID NO: 43884 - DNA, 24 bp, Homo sapiens
gcactgctaacttaatgcatccca

SEQ ID NO: 43885 - DNA, 19 bp, Homo sapiens
tcctaaaactattatctga

SEQ ID NO: 43886 - DNA, 19 bp, Homo sapiens
ttgctcgacatgtaacatg

SEQ ID NO: 43887 - DNA, 17 bp, Homo sapiens
aaaaacaaacaagcaaa

SEQ ID NO: 43888 - DNA, 20 bp, Homo sapiens
atatactaggcataatatca

SEQ ID NO: 43889 - DNA, 19 bp, Homo sapiens
gaaaacaggaaaccattga

SEQ ID NO: 43890 - DNA, 18 bp, Homo sapiens
tgatgatcatggagaaac

SEQ ID NO: 43891 - DNA, 20 bp, Homo sapiens
aaatgcagtaagcatgtgtt

SEQ ID NO: 43892 - DNA, 20 bp, Homo sapiens
tttgtaaatatataaatata

SEQ ID NO: 43893 - DNA, 25 bp, Homo sapiens
atgggccccgattccagcatggggc

SEQ ID NO: 43894 - DNA, 25 bp, Homo sapiens
tcagcgtgcatgtggaatccatcca

SEQ ID NO: 43895 - DNA, 22 bp, Homo sapiens
aggattacaaaggatttagcct

SEQ ID NO: 43896 - DNA, 17 bp, Homo sapiens
aggcagaagaatcactt

SEQ ID NO: 43897 - DNA, 25 bp, Homo sapiens
cctacagctaacattatccttgatg

SEQ ID NO: 43898 - DNA, 18 bp, Homo sapiens
ggcaaaactattgagcca

SEQ ID NO: 43899 - DNA, 20 bp, Homo sapiens
gttcactgatgtgtttttga

SEQ ID NO: 43900 - DNA, 19 bp, Homo sapiens
taagattatacagtctagt

SEQ ID NO: 43901 - DNA, 20 bp, Homo sapiens
tgggtgacagaatgagactg

SEQ ID NO: 43902 - DNA, 19 bp, Homo sapiens
tgtgaagattgtacactat

SEQ ID NO: 43903 - DNA, 21 bp, Homo sapiens
tgatcccaccacagcattcca

SEQ ID NO: 43904 - DNA, 18 bp, Homo sapiens
atatccccaaatgcttat

SEQ ID NO: 43905 - DNA, 26 bp, Homo sapiens
cttgggtagccatagaaatcattttt

SEQ ID NO: 43906 - DNA, 21 bp, Homo sapiens
tgagattttagaggcctagtt

SEQ ID NO: 43907 - DNA, 18 bp, Homo sapiens
aaggtgcacactgctgtg

SEQ ID NO: 43908 - DNA, 17 bp, Homo sapiens
cacagggccccacgcag

SEQ ID NO: 43909 - DNA, 18 bp, Homo sapiens
ctgggatccactgtttcc

SEQ ID NO: 43910 - DNA, 19 bp, Homo sapiens
gcattaaaaacagctaaat

SEQ ID NO: 43911 - DNA, 18 bp, Homo sapiens
gcggagttgggagccttt

SEQ ID NO: 43912 - DNA, 22 bp, Homo sapiens
ggcctgctccacttgtctggga

SEQ ID NO: 43913 - DNA, 22 bp, Homo sapiens
ggtgggtggaggggacagtgtt

SEQ ID NO: 43914 - DNA, 16 bp, Homo sapiens
tctctctctgtcccgg

SEQ ID NO: 43915 - DNA, 21 bp, Homo sapiens
aacccctggcacctactgctt

SEQ ID NO: 43916 - DNA, 21 bp, Homo sapiens
ccttggcaggaggatttgggg

SEQ ID NO: 43917 - DNA, 19 bp, Homo sapiens
ggaacctgcctgaagccac

SEQ ID NO: 43918 - DNA, 20 bp, Homo sapiens
acccaaagagggttcacttt

SEQ ID NO: 43919 - DNA, 21 bp, Homo sapiens
atcttaaattgttgtatcata

SEQ ID NO: 43920 - DNA, 20 bp, Homo sapiens
caaagagggttcacttttgc

SEQ ID NO: 43921 - DNA, 19 bp, Homo sapiens
cgtatgattttatttcata

SEQ ID NO: 43922 - DNA, 22 bp, Homo sapiens
ttcacagaaaccctccctcatg

SEQ ID NO: 43923 - DNA, 20 bp, Homo sapiens
ttgaaaatttgacctttaaa

SEQ ID NO: 43924 - DNA, 17 bp, Homo sapiens
tttcccagaggtcttga

SEQ ID NO: 43925 - DNA, 21 bp, Homo sapiens
agaaatcttaactctttgaaa

SEQ ID NO: 43926 - DNA, 21 bp, Homo sapiens
gggaggagaatctgatttcca

SEQ ID NO: 43927 - DNA, 24 bp, Homo sapiens
gtgttttgttgttttgggaatttt

SEQ ID NO: 43928 - DNA, 21 bp, Homo sapiens
acctccccgactgctgggccc

SEQ ID NO: 43929 - DNA, 18 bp, Homo sapiens
ccttctggaacaatacag

SEQ ID NO: 43930 - DNA, 19 bp, Homo sapiens
ccaagaatgtcttgtcata

SEQ ID NO: 43931 - DNA, 23 bp, Homo sapiens
tagtatctgttacgtccaaaata

SEQ ID NO: 43932 - DNA, 21 bp, Homo sapiens
tccatgaattcataatactca

SEQ ID NO: 43933 - DNA, 20 bp, Homo sapiens
acgtacgggccgctgcagct

SEQ ID NO: 43934 - DNA, 24 bp, Homo sapiens
catctgcactggcccccaaggtca

SEQ ID NO: 43935 - DNA, 19 bp, Homo sapiens
ctaggccgggggtttgagg

SEQ ID NO: 43936 - DNA, 16 bp, Homo sapiens
gccgggggtttgagga

SEQ ID NO: 43937 - DNA, 21 bp, Homo sapiens
gcctggctgcctcaggagcca

SEQ ID NO: 43938 - DNA, 21 bp, Homo sapiens
gcggctctgccggggacaaag

SEQ ID NO: 43939 - DNA, 20 bp, Homo sapiens
ggtgtcccgcccgccgcctc

SEQ ID NO: 43940 - DNA, 22 bp, Homo sapiens
agaaacctcacgccatgctgta

SEQ ID NO: 43941 - DNA, 19 bp, Homo sapiens
cctgagggtgcggtggtga

SEQ ID NO: 43942 - DNA, 19 bp, Homo sapiens
ctgtctcctgctggcattc

SEQ ID NO: 43943 - DNA, 18 bp, Homo sapiens
gaccctggttgagtggca

SEQ ID NO: 43944 - DNA, 17 bp, Homo sapiens
tcaagtgattctcctgc

SEQ ID NO: 43945 - DNA, 19 bp, Homo sapiens
tgttggattatatatcaaa

SEQ ID NO: 43946 - DNA, 19 bp, Homo sapiens
agaatacaacaggtagcca

SEQ ID NO: 43947 - DNA, 18 bp, Homo sapiens
gtagagctgatgatctca

SEQ ID NO: 43948 - DNA, 22 bp, Homo sapiens
aaacaccagatagaagatctta

SEQ ID NO: 43949 - DNA, 18 bp, Homo sapiens
aaacagaaaccaatcggt

SEQ ID NO: 43950 - DNA, 18 bp, Homo sapiens
cagcaggggagctttcgt

SEQ ID NO: 43951 - DNA, 21 bp, Homo sapiens
cgcgcgcagccgtggctgctg

SEQ ID NO: 43952 - DNA, 18 bp, Homo sapiens
gggggcccccccgctccc

SEQ ID NO: 43953 - DNA, 18 bp, Homo sapiens
gtggccaacttcactttg

SEQ ID NO: 43954 - DNA, 20 bp, Homo sapiens
tgagttttcagtgttaaact

SEQ ID NO: 43955 - DNA, 18 bp, Homo sapiens
acagaagacttcaagcca

SEQ ID NO: 43956 - DNA, 24 bp, Homo sapiens
ccttatgcagttgcatttaacctt

SEQ ID NO: 43957 - DNA, 26 bp, Homo sapiens
ctcattctttagtccctgtcaaggtt

SEQ ID NO: 43958 - DNA, 19 bp, Homo sapiens
tatgtttgacttgctagta

SEQ ID NO: 43959 - DNA, 24 bp, Homo sapiens
tgagctcttcaagtgattctgata

SEQ ID NO: 43960 - DNA, 21 bp, Homo sapiens
ttcaagtgattctgataacac

SEQ ID NO: 43961 - DNA, 20 bp, Homo sapiens
aaacaaacaactaccacttt

SEQ ID NO: 43962 - DNA, 17 bp, Homo sapiens
aacagctaatactacca

SEQ ID NO: 43963 - DNA, 22 bp, Homo sapiens
agaaaacaataagcctctgaaa

SEQ ID NO: 43964 - DNA, 17 bp, Homo sapiens
catctgtcagttataga

SEQ ID NO: 43965 - DNA, 21 bp, Homo sapiens
catttcccttatcaaagatgt

SEQ ID NO: 43966 - DNA, 16 bp, Homo sapiens
tgccctcaacagcccc

SEQ ID NO: 43967 - DNA, 21 bp, Homo sapiens
tgtgtcaaaactacttagcaa

SEQ ID NO: 43968 - DNA, 24 bp, Homo sapiens
acagcctctgaatttattgcacca

SEQ ID NO: 43969 - DNA, 20 bp, Homo sapiens
ttttgctatctcccatccca

SEQ ID NO: 43970 - DNA, 19 bp, Homo sapiens
tccttgtggacagttgtta

SEQ ID NO: 43971 - DNA, 22 bp, Homo sapiens
tggtttatcactctagattcaa

SEQ ID NO: 43972 - DNA, 21 bp, Homo sapiens
cagctagaggagcacactcca

SEQ ID NO: 43973 - DNA, 19 bp, Homo sapiens
cttgaaacagtgtctgtct

SEQ ID NO: 43974 - DNA, 25 bp, Homo sapiens
gagatgaactctgagtatgaagctg

SEQ ID NO: 43975 - DNA, 19 bp, Homo sapiens
gtgacaatgtgtccagcaa

SEQ ID NO: 43976 - DNA, 17 bp, Homo sapiens
gttccactgtattgtca

SEQ ID NO: 43977 - DNA, 19 bp, Homo sapiens
gttgggctgcggtgagtcc

SEQ ID NO: 43978 - DNA, 24 bp, Homo sapiens
taggcagcgccctaattggaattg

SEQ ID NO: 43979 - DNA, 21 bp, Homo sapiens
aaactttactactatcagata

SEQ ID NO: 43980 - DNA, 18 bp, Homo sapiens
ctgtattggactaattct

SEQ ID NO: 43981 - DNA, 25 bp, Homo sapiens
tcctgaggtcgcgggaggctgcgag

SEQ ID NO: 43982 - DNA, 21 bp, Homo sapiens
tgcagtttactgatggattaa

SEQ ID NO: 43983 - DNA, 21 bp, Homo sapiens
aagagctttccatcttcatga

SEQ ID NO: 43984 - DNA, 15 bp, Homo sapiens
ctctcctctctcctc

SEQ ID NO: 43985 - DNA, 19 bp, Homo sapiens
ctgagcctgaggtttgctc

SEQ ID NO: 43986 - DNA, 20 bp, Homo sapiens
ctgttttgcccttactctca

SEQ ID NO: 43987 - DNA, 22 bp, Homo sapiens
ggaggagcccggtgtctctata

SEQ ID NO: 43988 - DNA, 17 bp, Homo sapiens
actccaggaaaacttgc

SEQ ID NO: 43989 - DNA, 19 bp, Homo sapiens
aggaaattggtaatagcca

SEQ ID NO: 43990 - DNA, 20 bp, Homo sapiens
cagagcagtgcaaaagtaga

SEQ ID NO: 43991 - DNA, 18 bp, Homo sapiens
ctctcgggcattgcattc

SEQ ID NO: 43992 - DNA, 18 bp, Homo sapiens
gggccagaacttctctct

SEQ ID NO: 43993 - DNA, 18 bp, Homo sapiens
tcatatctttctttttca

SEQ ID NO: 43994 - DNA, 24 bp, Homo sapiens
tttgtatgttactaactcactttt

SEQ ID NO: 43995 - DNA, 25 bp, Homo sapiens
acagtcttctctgtgcatttcccca

SEQ ID NO: 43996 - DNA, 17 bp, Homo sapiens
ctctttattgaacatta

SEQ ID NO: 43997 - DNA, 23 bp, Homo sapiens
gggcaagacaatggaaacttcca

SEQ ID NO: 43998 - DNA, 21 bp, Homo sapiens
cccagacccgccaccgcaccc

SEQ ID NO: 43999 - DNA, 20 bp, Homo sapiens
gccatgcggtgagcgcccca

SEQ ID NO: 44000 - DNA, 17 bp, Homo sapiens
tccctcagccgctccca

SEQ ID NO: 44001 - DNA, 17 bp, Homo sapiens
tgcctgacaacccttct

SEQ ID NO: 44002 - DNA, 19 bp, Homo sapiens
ttctcacctcccaagtccc

SEQ ID NO: 44003 - DNA, 20 bp, Homo sapiens
cctgcaccaccgtttttgaa

SEQ ID NO: 44004 - DNA, 21 bp, Homo sapiens
tcccctttcccttcccactcg

SEQ ID NO: 44005 - DNA, 18 bp, Homo sapiens
ggccctcccgcttcccct

SEQ ID NO: 44006 - DNA, 17 bp, Homo sapiens
ggcgtcggggccagcgg

SEQ ID NO: 44007 - DNA, 25 bp, Homo sapiens
acctgcaaccatttgcatgtgtaca

SEQ ID NO: 44008 - DNA, 21 bp, Homo sapiens
agtaaacttttgaagtgtcat

SEQ ID NO: 44009 - DNA, 21 bp, Homo sapiens
catcaagagagaaataaatta

SEQ ID NO: 44010 - DNA, 19 bp, Homo sapiens
agctgtctcagaattcctc

SEQ ID NO: 44011 - DNA, 22 bp, Homo sapiens
ccaaaagagccacagaatctca

SEQ ID NO: 44012 - DNA, 23 bp, Homo sapiens
ggacattcaaagtgccctgtgga

SEQ ID NO: 44013 - DNA, 20 bp, Homo sapiens
catcttgttgtgtcccaaga

SEQ ID NO: 44014 - DNA, 21 bp, Homo sapiens
cattagattgggggttctggg

SEQ ID NO: 44015 - DNA, 22 bp, Homo sapiens
gaaaggacccctgacccctttc

SEQ ID NO: 44016 - DNA, 20 bp, Homo sapiens
gctgcaatatagtgtgtgtt

SEQ ID NO: 44017 - DNA, 24 bp, Homo sapiens
gcttctctgggccctcctctcctc

SEQ ID NO: 44018 - DNA, 18 bp, Homo sapiens
gttggtgtcctgccctcc

SEQ ID NO: 44019 - DNA, 23 bp, Homo sapiens
taaagccagccccatagctgctt

SEQ ID NO: 44020 - DNA, 20 bp, Homo sapiens
tggtccccggcattagattg

SEQ ID NO: 44021 - DNA, 21 bp, Homo sapiens
aaccaaaacttgttcatctca

SEQ ID NO: 44022 - DNA, 18 bp, Homo sapiens
acaacgtttgggaaagta

SEQ ID NO: 44023 - DNA, 18 bp, Homo sapiens
actgcaacttccacctcc

SEQ ID NO: 44024 - DNA, 23 bp, Homo sapiens
agatgggacgcaggacaccagct

SEQ ID NO: 44025 - DNA, 21 bp, Homo sapiens
atcaatgtaactagaacagct

SEQ ID NO: 44026 - DNA, 18 bp, Homo sapiens
cacgttttgccaaaaatg

SEQ ID NO: 44027 - DNA, 17 bp, Homo sapiens
cccaaaataggacaata

SEQ ID NO: 44028 - DNA, 19 bp, Homo sapiens
ctgcaacttccacctccca

SEQ ID NO: 44029 - DNA, 23 bp, Homo sapiens
gaaactcattgaaaacaatgaca

SEQ ID NO: 44030 - DNA, 21 bp, Homo sapiens
gaataattgcagtacttctct

SEQ ID NO: 44031 - DNA, 22 bp, Homo sapiens
gagacccaagagccacaactaa

SEQ ID NO: 44032 - DNA, 23 bp, Homo sapiens
gattatagttggtgaataaacta

SEQ ID NO: 44033 - DNA, 20 bp, Homo sapiens
gggttacgccacctgctttg

SEQ ID NO: 44034 - DNA, 22 bp, Homo sapiens
gtgtaagggtgacatttggtta

SEQ ID NO: 44035 - DNA, 21 bp, Homo sapiens
tatgtatttctcattgtttta

SEQ ID NO: 44036 - DNA, 17 bp, Homo sapiens
tcaagcgattcttatgc

SEQ ID NO: 44037 - DNA, 18 bp, Homo sapiens
tccacctcccaggttcaa

SEQ ID NO: 44038 - DNA, 16 bp, Homo sapiens
ttgtcggcatgtaata

SEQ ID NO: 44039 - DNA, 18 bp, Homo sapiens
tttcatatctttgcctaa

SEQ ID NO: 44040 - DNA, 19 bp, Homo sapiens
agtcagcatcggaatctca

SEQ ID NO: 44041 - DNA, 17 bp, Homo sapiens
atgaactagaagatcca

SEQ ID NO: 44042 - DNA, 23 bp, Homo sapiens
atgtttagaccggacacaactca

SEQ ID NO: 44043 - DNA, 22 bp, Homo sapiens
ctgcaaagcactgatccctacc

SEQ ID NO: 44044 - DNA, 20 bp, Homo sapiens
cttccaaatgtaaccatgga

SEQ ID NO: 44045 - DNA, 19 bp, Homo sapiens
gaaaggatccatatgccaa

SEQ ID NO: 44046 - DNA, 18 bp, Homo sapiens
gtcagcatcggaatctca

SEQ ID NO: 44047 - DNA, 20 bp, Homo sapiens
cattgcttcacctggcccca

SEQ ID NO: 44048 - DNA, 18 bp, Homo sapiens
ctttcactggtttatgaa

SEQ ID NO: 44049 - DNA, 17 bp, Homo sapiens
gaccactctgcagctca

SEQ ID NO: 44050 - DNA, 21 bp, Homo sapiens
ggctgtggacttcctctactt

SEQ ID NO: 44051 - DNA, 16 bp, Homo sapiens
caggccagacacccca

SEQ ID NO: 44052 - DNA, 18 bp, Homo sapiens
cagttttcagaattctca

SEQ ID NO: 44053 - DNA, 18 bp, Homo sapiens
gaattctcactgaagcca

SEQ ID NO: 44054 - DNA, 18 bp, Homo sapiens
taagttcatctagatctc

SEQ ID NO: 44055 - DNA, 21 bp, Homo sapiens
tatgcccaatatgctgcctca

SEQ ID NO: 44056 - DNA, 17 bp, Homo sapiens
ttctgtcccctaacctc

SEQ ID NO: 44057 - DNA, 20 bp, Homo sapiens
cctgggctgccctcacccca

SEQ ID NO: 44058 - DNA, 19 bp, Homo sapiens
aagattgtggggccgggcg

SEQ ID NO: 44059 - DNA, 16 bp, Homo sapiens
agtggagctggagctg

SEQ ID NO: 44060 - DNA, 16 bp, Homo sapiens
ccctgcacttgctcga

SEQ ID NO: 44061 - DNA, 17 bp, Homo sapiens
aacaatggcaacatggt

SEQ ID NO: 44062 - DNA, 19 bp, Homo sapiens
acccaacaccagaatccca

SEQ ID NO: 44063 - DNA, 17 bp, Homo sapiens
agaacacaagttttgtc

SEQ ID NO: 44064 - DNA, 18 bp, Homo sapiens
caaaaagatactggttgc

SEQ ID NO: 44065 - DNA, 22 bp, Homo sapiens
cctgttcatctcctcctttctc

SEQ ID NO: 44066 - DNA, 21 bp, Homo sapiens
gcacctctatagccttactca

SEQ ID NO: 44067 - DNA, 21 bp, Homo sapiens
gcctgagccctctcagaagca

SEQ ID NO: 44068 - DNA, 21 bp, Homo sapiens
ggatagagaaagtgtctccca

SEQ ID NO: 44069 - DNA, 19 bp, Homo sapiens
gtgagaacgagcactgcac

SEQ ID NO: 44070 - DNA, 21 bp, Homo sapiens
tgcagtcttgtatttgtggtg

SEQ ID NO: 44071 - DNA, 19 bp, Homo sapiens
tggcaggatcattcttgga

SEQ ID NO: 44072 - DNA, 18 bp, Homo sapiens
ttgcggctgctgctggcc

SEQ ID NO: 44073 - DNA, 20 bp, Homo sapiens
acgaactctctcttactccg

SEQ ID NO: 44074 - DNA, 21 bp, Homo sapiens
catgagccataattattaaca

SEQ ID NO: 44075 - DNA, 20 bp, Homo sapiens
ctgtcctgtctgtgctccca

SEQ ID NO: 44076 - DNA, 21 bp, Homo sapiens
cttctcatctgccttggtcct

SEQ ID NO: 44077 - DNA, 17 bp, Homo sapiens
tgaagaaatattaaaca

SEQ ID NO: 44078 - DNA, 23 bp, Homo sapiens
ttagcttcctatcagtgggcttt

SEQ ID NO: 44079 - DNA, 17 bp, Homo sapiens
agattctgtattatcct

SEQ ID NO: 44080 - DNA, 20 bp, Homo sapiens
gtatcagtgctactcggcta

SEQ ID NO: 44081 - DNA, 18 bp, Homo sapiens
gtggctgggcctcagtta

SEQ ID NO: 44082 - DNA, 24 bp, Homo sapiens
tgtactgtgtagcataataccaaa

SEQ ID NO: 44083 - DNA, 17 bp, Homo sapiens
gcggcgcgaccgcctca

SEQ ID NO: 44084 - DNA, 19 bp, Homo sapiens
caccaccaccaccaccatc

SEQ ID NO: 44085 - DNA, 23 bp, Homo sapiens
ccacttcatcatccccaccacca

SEQ ID NO: 44086 - DNA, 19 bp, Homo sapiens
cttgaaccggggtctggag

SEQ ID NO: 44087 - DNA, 22 bp, Homo sapiens
agagaagagaggagtcaaccca

SEQ ID NO: 44088 - DNA, 19 bp, Homo sapiens
caaggaagagaatctgtca

SEQ ID NO: 44089 - DNA, 23 bp, Homo sapiens
catgtactgcaggtgtgcagtga

SEQ ID NO: 44090 - DNA, 18 bp, Homo sapiens
cctaaaccatctacctca

SEQ ID NO: 44091 - DNA, 19 bp, Homo sapiens
ggaggggccacagaagaca

SEQ ID NO: 44092 - DNA, 20 bp, Homo sapiens
ggaggaggaagctgaagacg

SEQ ID NO: 44093 - DNA, 20 bp, Homo sapiens
ccaggaggacgcagaggcta

SEQ ID NO: 44094 - DNA, 24 bp, Homo sapiens
gaagaaaacccaggaggacgcaga

SEQ ID NO: 44095 - DNA, 18 bp, Homo sapiens
ggtattcaaacagctctt

SEQ ID NO: 44096 - DNA, 20 bp, Homo sapiens
tctgaagatgcatgtttcca

SEQ ID NO: 44097 - DNA, 24 bp, Homo sapiens
acttacctgaggaaagacagcaca

SEQ ID NO: 44098 - DNA, 23 bp, Homo sapiens
ctccaaagatatttgcactgctt

SEQ ID NO: 44099 - DNA, 18 bp, Homo sapiens
ctcttgaaaagagagctc

SEQ ID NO: 44100 - DNA, 23 bp, Homo sapiens
cttgtctttcagaataattttta

SEQ ID NO: 44101 - DNA, 20 bp, Homo sapiens
cttttggacatcagtttgtg

SEQ ID NO: 44102 - DNA, 22 bp, Homo sapiens
tgatgtaggattaaacattcca

SEQ ID NO: 44103 - DNA, 18 bp, Homo sapiens
ctgaacccattttcctcc

SEQ ID NO: 44104 - DNA, 20 bp, Homo sapiens
tttaagtaatcaccactttc

SEQ ID NO: 44105 - DNA, 21 bp, Homo sapiens
ggaagagaaagatcaactcac

SEQ ID NO: 44106 - DNA, 19 bp, Homo sapiens
tgctttggtggagaatttt

SEQ ID NO: 44107 - DNA, 19 bp, Homo sapiens
tggctctttatctaccttt

SEQ ID NO: 44108 - DNA, 17 bp, Homo sapiens
cgagagccgctgttgac

SEQ ID NO: 44109 - DNA, 22 bp, Homo sapiens
ctttttgtgtgtgttttgcttt

SEQ ID NO: 44110 - DNA, 18 bp, Homo sapiens
tgtaattcatggtctgga

SEQ ID NO: 44111 - DNA, 16 bp, Homo sapiens
ttttcacagctttgta

SEQ ID NO: 44112 - DNA, 19 bp, Homo sapiens
agaaagagtggaagcactt

SEQ ID NO: 44113 - DNA, 18 bp, Homo sapiens
acttactcatcgtttcaa

SEQ ID NO: 44114 - DNA, 19 bp, Homo sapiens
cgccagggtcgcccaccca

SEQ ID NO: 44115 - DNA, 22 bp, Homo sapiens
ggacaatgctgatggaagacca

SEQ ID NO: 44116 - DNA, 19 bp, Homo sapiens
ggcaattatggtcactgga

SEQ ID NO: 44117 - DNA, 20 bp, Homo sapiens
ccaccatcagcaccacctcc

SEQ ID NO: 44118 - DNA, 21 bp, Homo sapiens
ccaccgccgccgccgccgcca

SEQ ID NO: 44119 - DNA, 20 bp, Homo sapiens
ccaccgccggcggcggcagc

SEQ ID NO: 44120 - DNA, 19 bp, Homo sapiens
cctcgcggctcggtccggc

SEQ ID NO: 44121 - DNA, 18 bp, Homo sapiens
gcctcgccaccatcagca

SEQ ID NO: 44122 - DNA, 21 bp, Homo sapiens
aaatggtctcatacacgtaca

SEQ ID NO: 44123 - DNA, 19 bp, Homo sapiens
cagtagcagttacttggca

SEQ ID NO: 44124 - DNA, 20 bp, Homo sapiens
cggggcagcggctcctgcag

SEQ ID NO: 44125 - DNA, 19 bp, Homo sapiens
ggccgggtgcggtggctca

SEQ ID NO: 44126 - DNA, 19 bp, Homo sapiens
gggcattgttaaagttcca

SEQ ID NO: 44127 - DNA, 18 bp, Homo sapiens
ttatatgcctgccacagt

SEQ ID NO: 44128 - DNA, 20 bp, Homo sapiens
tttccacacaccaacatgtg

SEQ ID NO: 44129 - DNA, 18 bp, Homo sapiens
tattcaccattttccctg

SEQ ID NO: 44130 - DNA, 19 bp, Homo sapiens
ccagatcccttcctgccca

SEQ ID NO: 44131 - DNA, 23 bp, Homo sapiens
ggtagcgagccagctggattccg

SEQ ID NO: 44132 - DNA, 20 bp, Homo sapiens
tgtgcctctcactccgtgga

SEQ ID NO: 44133 - DNA, 18 bp, Homo sapiens
tgcaaaacactaggcttt

SEQ ID NO: 44134 - DNA, 22 bp, Homo sapiens
gctgtaatgttttgccatgttg

SEQ ID NO: 44135 - DNA, 17 bp, Homo sapiens
ggagatgatgtctgctt

SEQ ID NO: 44136 - DNA, 21 bp, Homo sapiens
tattaattcagccagtgtatc

SEQ ID NO: 44137 - DNA, 20 bp, Homo sapiens
aaatcaaattacctttggaa

SEQ ID NO: 44138 - DNA, 18 bp, Homo sapiens
caaagttaccctggaaca

SEQ ID NO: 44139 - DNA, 23 bp, Homo sapiens
cctttgtaagttggtttgatctt

SEQ ID NO: 44140 - DNA, 20 bp, Homo sapiens
agtgattttcttaatacctt

SEQ ID NO: 44141 - DNA, 23 bp, Homo sapiens
caaaatttaatgtgttccatgaa

SEQ ID NO: 44142 - DNA, 18 bp, Homo sapiens
cccagcccctcacagctt

SEQ ID NO: 44143 - DNA, 21 bp, Homo sapiens
ctcccgagtggaggtcgtgag

SEQ ID NO: 44144 - DNA, 19 bp, Homo sapiens
gaaactcccatctacccct

SEQ ID NO: 44145 - DNA, 18 bp, Homo sapiens
ggaaaatttattgaatca

SEQ ID NO: 44146 - DNA, 18 bp, Homo sapiens
cctatatatagacagtag

SEQ ID NO: 44147 - DNA, 23 bp, Homo sapiens
cttcaccagaccactggcacaca

SEQ ID NO: 44148 - DNA, 21 bp, Homo sapiens
tcaaagagatatctgcactcc

SEQ ID NO: 44149 - DNA, 17 bp, Homo sapiens
ttccttttctcatgaaa

SEQ ID NO: 44150 - DNA, 22 bp, Homo sapiens
tttgtgaccagaacacatttaa

SEQ ID NO: 44151 - DNA, 21 bp, Homo sapiens
acccatcccagaactactcca

SEQ ID NO: 44152 - DNA, 23 bp, Homo sapiens
atcctattgaccgaagctgtcaa

SEQ ID NO: 44153 - DNA, 18 bp, Homo sapiens
aatcctcaaaaatagtca

SEQ ID NO: 44154 - DNA, 21 bp, Homo sapiens
atcttggctcactccaacctc

SEQ ID NO: 44155 - DNA, 22 bp, Homo sapiens
atgatcctgaagaaaaaggtga

SEQ ID NO: 44156 - DNA, 16 bp, Homo sapiens
atgtcagtctacctta

SEQ ID NO: 44157 - DNA, 16 bp, Homo sapiens
caaccaaaaactgcct

SEQ ID NO: 44158 - DNA, 17 bp, Homo sapiens
cacagtaccacccatct

SEQ ID NO: 44159 - DNA, 22 bp, Homo sapiens
ctcagcagagctcacagtacca

SEQ ID NO: 44160 - DNA, 20 bp, Homo sapiens
gatcctgaagaaaaaggtga

SEQ ID NO: 44161 - DNA, 19 bp, Homo sapiens
gggactgagcggcggcggc

SEQ ID NO: 44162 - DNA, 21 bp, Homo sapiens
gtattacacaaaatctggact

SEQ ID NO: 44163 - DNA, 17 bp, Homo sapiens
tcaagtgattctcctgc

SEQ ID NO: 44164 - DNA, 18 bp, Homo sapiens
tccaccttccaggttcaa

SEQ ID NO: 44165 - DNA, 18 bp, Homo sapiens
tgaagaaaaaggtgacaa

SEQ ID NO: 44166 - DNA, 18 bp, Homo sapiens
tgcaccttttaaagcact

SEQ ID NO: 44167 - DNA, 18 bp, Homo sapiens
cctgcaacctccacctcc

SEQ ID NO: 44168 - DNA, 18 bp, Homo sapiens
ctgcaccctgtttccttt

SEQ ID NO: 44169 - DNA, 22 bp, Homo sapiens
gacggggtttcaccatgctggc

SEQ ID NO: 44170 - DNA, 16 bp, Homo sapiens
tacttgtaagccaagc

SEQ ID NO: 44171 - DNA, 18 bp, Homo sapiens
tccacctcccgggttcaa

SEQ ID NO: 44172 - DNA, 24 bp, Homo sapiens
tgcccttgggaatactcctgcaca

SEQ ID NO: 44173 - DNA, 18 bp, Homo sapiens
aagaaatctggaaatcta

SEQ ID NO: 44174 - DNA, 20 bp, Homo sapiens
gagatggaagaacttgcaaa

SEQ ID NO: 44175 - DNA, 22 bp, Homo sapiens
gccaaggtcctgctcaactcta

SEQ ID NO: 44176 - DNA, 20 bp, Homo sapiens
ttgctcccaacccattcact

SEQ ID NO: 44177 - DNA, 20 bp, Homo sapiens
tcttggcggcgggagaggcg

SEQ ID NO: 44178 - DNA, 19 bp, Homo sapiens
agctgttcactgccagctc

SEQ ID NO: 44179 - DNA, 18 bp, Homo sapiens
caggcctcccccgcctca

SEQ ID NO: 44180 - DNA, 20 bp, Homo sapiens
cctgcgcatgtacccctgaa

SEQ ID NO: 44181 - DNA, 26 bp, Homo sapiens
gaaagaacaagatcatgccctttgca

SEQ ID NO: 44182 - DNA, 22 bp, Homo sapiens
aaataattgttatgtttctgtt

SEQ ID NO: 44183 - DNA, 18 bp, Homo sapiens
gaaatatgatcctcctga

SEQ ID NO: 44184 - DNA, 24 bp, Homo sapiens
gctcaaaaatggaaactgaaagca

SEQ ID NO: 44185 - DNA, 17 bp, Homo sapiens
tatgtcattagatccaa

SEQ ID NO: 44186 - DNA, 19 bp, Homo sapiens
cacgtggccctgagccaca

SEQ ID NO: 44187 - DNA, 22 bp, Homo sapiens
cgcgcgcctccttcctcgccgc

SEQ ID NO: 44188 - DNA, 21 bp, Homo sapiens
atgtctagcggcgaacacttc

SEQ ID NO: 44189 - DNA, 16 bp, Homo sapiens
cccaggagccccccag

SEQ ID NO: 44190 - DNA, 22 bp, Homo sapiens
ggactaatccatcgatgactgg

SEQ ID NO: 44191 - DNA, 19 bp, Homo sapiens
tcgatgactggaaaagagg

SEQ ID NO: 44192 - DNA, 19 bp, Homo sapiens
tttctttagatctgtgcag

SEQ ID NO: 44193 - DNA, 21 bp, Homo sapiens
ttgaagacaccccacattcca

SEQ ID NO: 44194 - DNA, 21 bp, Homo sapiens
aagctccagaaggttctatta

SEQ ID NO: 44195 - DNA, 18 bp, Homo sapiens
ggccgggtgtggtggttc

SEQ ID NO: 44196 - DNA, 18 bp, Homo sapiens
ttgctattacttctttca

SEQ ID NO: 44197 - DNA, 21 bp, Homo sapiens
accctgatcaaaggagggtga

SEQ ID NO: 44198 - DNA, 24 bp, Homo sapiens
acctgccggggactgccgtggctt

SEQ ID NO: 44199 - DNA, 21 bp, Homo sapiens
accttctggcagctctgggga

SEQ ID NO: 44200 - DNA, 17 bp, Homo sapiens
caaccctccagtcccct

SEQ ID NO: 44201 - DNA, 18 bp, Homo sapiens
gccacatgtggcaagtgg

SEQ ID NO: 44202 - DNA, 20 bp, Homo sapiens
gggagtctccccaggacggc

SEQ ID NO: 44203 - DNA, 17 bp, Homo sapiens
gttactcacctgtcatt

SEQ ID NO: 44204 - DNA, 20 bp, Homo sapiens
tggagagaggtggcaggtga

SEQ ID NO: 44205 - DNA, 22 bp, Homo sapiens
tgggagcctgccctggactcca

SEQ ID NO: 44206 - DNA, 25 bp, Homo sapiens
tgtagggcaggtagggtgtgtgctg

SEQ ID NO: 44207 - DNA, 21 bp, Homo sapiens
agtaactgccctgtgttgtca

SEQ ID NO: 44208 - DNA, 23 bp, Homo sapiens
ccacatttctctcttctccctca

SEQ ID NO: 44209 - DNA, 22 bp, Homo sapiens
cctcctttcccctcttccctgg

SEQ ID NO: 44210 - DNA, 25 bp, Homo sapiens
gcctctttccctcctcctctccctc

SEQ ID NO: 44211 - DNA, 19 bp, Homo sapiens
ctccccatccccatctggt

SEQ ID NO: 44212 - DNA, 24 bp, Homo sapiens
aataagtatctttgggaaatcttt

SEQ ID NO: 44213 - DNA, 18 bp, Homo sapiens
aatagtggaaatgatgaa

SEQ ID NO: 44214 - DNA, 18 bp, Homo sapiens
accgtacgttgccaaata

SEQ ID NO: 44215 - DNA, 18 bp, Homo sapiens
agtaaccacaaattgcca

SEQ ID NO: 44216 - DNA, 20 bp, Homo sapiens
atgtgaatacagatatcaca

SEQ ID NO: 44217 - DNA, 17 bp, Homo sapiens
gtttttattctcactta

SEQ ID NO: 44218 - DNA, 22 bp, Homo sapiens
tgaaagaagagacaggcaatga

SEQ ID NO: 44219 - DNA, 18 bp, Homo sapiens
aaggttatccagttcagt

SEQ ID NO: 44220 - DNA, 20 bp, Homo sapiens
aatcttccccagattcatct

SEQ ID NO: 44221 - DNA, 19 bp, Homo sapiens
agggaatgaatcgatttgc

SEQ ID NO: 44222 - DNA, 18 bp, Homo sapiens
atgagaaagctgggcaaa

SEQ ID NO: 44223 - DNA, 22 bp, Homo sapiens
gcccaatgaccgggttttcgca

SEQ ID NO: 44224 - DNA, 24 bp, Homo sapiens
ggcatgagccaccgcacccggcca

SEQ ID NO: 44225 - DNA, 23 bp, Homo sapiens
tcaatacgatcatgattcaagat

SEQ ID NO: 44226 - DNA, 18 bp, Homo sapiens
tcatgattcaagatccaa

SEQ ID NO: 44227 - DNA, 23 bp, Homo sapiens
tcctcaaatacctcaaatacctc

SEQ ID NO: 44228 - DNA, 24 bp, Homo sapiens
aaatctccatctgaccctacataa

SEQ ID NO: 44229 - DNA, 22 bp, Homo sapiens
agaaattgcaagatgtaatata

SEQ ID NO: 44230 - DNA, 19 bp, Homo sapiens
ctttacctgtcatcagtta

SEQ ID NO: 44231 - DNA, 19 bp, Homo sapiens
gagctcctgcatagtatgc

SEQ ID NO: 44232 - DNA, 23 bp, Homo sapiens
ttcaagataaacttctgtaacct

SEQ ID NO: 44233 - DNA, 17 bp, Homo sapiens
ttcagctacaatactca

SEQ ID NO: 44234 - DNA, 19 bp, Homo sapiens
acagaaatattttcaaacc

SEQ ID NO: 44235 - DNA, 19 bp, Homo sapiens
atgaggctgtagtgtaaga

SEQ ID NO: 44236 - DNA, 19 bp, Homo sapiens
ggatcccaggctactagtg

SEQ ID NO: 44237 - DNA, 18 bp, Homo sapiens
tttgtataaaacaatagg

SEQ ID NO: 44238 - DNA, 17 bp, Homo sapiens
agaagaaaagagcacct

SEQ ID NO: 44239 - DNA, 17 bp, Homo sapiens
cctcacaggctgttgtg

SEQ ID NO: 44240 - DNA, 20 bp, Homo sapiens
gttggacttagtgcctgtct

SEQ ID NO: 44241 - DNA, 17 bp, Homo sapiens
tctggcgagggctgcgg

SEQ ID NO: 44242 - DNA, 22 bp, Homo sapiens
ttcctgtcctctgctctgtgga

SEQ ID NO: 44243 - DNA, 24 bp, Homo sapiens
atctgaatagcaactgtctgactt

SEQ ID NO: 44244 - DNA, 21 bp, Homo sapiens
atgactgagtaagagttttga

SEQ ID NO: 44245 - DNA, 17 bp, Homo sapiens
gcccgagacccatacca

SEQ ID NO: 44246 - DNA, 23 bp, Homo sapiens
ggcgtccactccaaaacatatca

SEQ ID NO: 44247 - DNA, 22 bp, Homo sapiens
ggggatggcaacagcattggtg

SEQ ID NO: 44248 - DNA, 18 bp, Homo sapiens
aactgccagctcagaata

SEQ ID NO: 44249 - DNA, 21 bp, Homo sapiens
acttgaatggcctgtttgtct

SEQ ID NO: 44250 - DNA, 17 bp, Homo sapiens
actttggcctctggttc

SEQ ID NO: 44251 - DNA, 19 bp, Homo sapiens
atgtccataagaaaccctt

SEQ ID NO: 44252 - DNA, 18 bp, Homo sapiens
cactggtcatgccattgc

SEQ ID NO: 44253 - DNA, 16 bp, Homo sapiens
cctccaccaccacaat

SEQ ID NO: 44254 - DNA, 22 bp, Homo sapiens
gagccaagattgtgccacttca

SEQ ID NO: 44255 - DNA, 19 bp, Homo sapiens
gcagtggggaccattgagc

SEQ ID NO: 44256 - DNA, 15 bp, Homo sapiens
ggcagagcttatcct

SEQ ID NO: 44257 - DNA, 21 bp, Homo sapiens
ggctgattaaagaagttcttg

SEQ ID NO: 44258 - DNA, 19 bp, Homo sapiens
taatataaagctgtgtgtt

SEQ ID NO: 44259 - DNA, 19 bp, Homo sapiens
tcatgttgttaagcagtta

SEQ ID NO: 44260 - DNA, 24 bp, Homo sapiens
tctctgtgggtctcatgaacagca

SEQ ID NO: 44261 - DNA, 19 bp, Homo sapiens
tctttctctgtgggtctca

SEQ ID NO: 44262 - DNA, 21 bp, Homo sapiens
agtgggtggagacctgctgtc

SEQ ID NO: 44263 - DNA, 21 bp, Homo sapiens
ccacagtgctggcttcttccc

SEQ ID NO: 44264 - DNA, 18 bp, Homo sapiens
ccctgagggtagccatgc

SEQ ID NO: 44265 - DNA, 20 bp, Homo sapiens
agtgacccttctccaccccc

SEQ ID NO: 44266 - DNA, 24 bp, Homo sapiens
atgcctcatttgcctctcgcttct

SEQ ID NO: 44267 - DNA, 23 bp, Homo sapiens
cccttctccacccccatatccta

SEQ ID NO: 44268 - DNA, 23 bp, Homo sapiens
cgaaaggtggagagatctgtgag

SEQ ID NO: 44269 - DNA, 18 bp, Homo sapiens
tccagggccacgttccag

SEQ ID NO: 44270 - DNA, 23 bp, Homo sapiens
tgcaggaggcccctgtgcaggtg

SEQ ID NO: 44271 - DNA, 16 bp, Homo sapiens
aagggctgggttttga

SEQ ID NO: 44272 - DNA, 18 bp, Homo sapiens
aattgaatctggagagtc

SEQ ID NO: 44273 - DNA, 21 bp, Homo sapiens
agaaatcttaactctttgaaa

SEQ ID NO: 44274 - DNA, 22 bp, Homo sapiens
ctgctttgttgcatgtatccta

SEQ ID NO: 44275 - DNA, 20 bp, Homo sapiens
tggtcctccagcgtgagcta

SEQ ID NO: 44276 - DNA, 24 bp, Homo sapiens
cctccccctcccaatctccttcca

SEQ ID NO: 44277 - DNA, 22 bp, Homo sapiens
ccttttctccactcccagcccc

SEQ ID NO: 44278 - DNA, 19 bp, Homo sapiens
ctccaaactttcaacttca

SEQ ID NO: 44279 - DNA, 20 bp, Homo sapiens
gatttttcggtgtttctctg

SEQ ID NO: 44280 - DNA, 20 bp, Homo sapiens
gcttcctggccccctccccc

SEQ ID NO: 44281 - DNA, 18 bp, Homo sapiens
ccccctccgttttttcca

SEQ ID NO: 44282 - DNA, 24 bp, Homo sapiens
agacccctcctcagaccctcccca

SEQ ID NO: 44283 - DNA, 21 bp, Homo sapiens
caggcctccacccccaccccc

SEQ ID NO: 44284 - DNA, 21 bp, Homo sapiens
ccaggcctccacccccacccc

SEQ ID NO: 44285 - DNA, 24 bp, Homo sapiens
cctgccctcccagtctcccacccc

SEQ ID NO: 44286 - DNA, 20 bp, Homo sapiens
gcaggtggagccaagctctc

SEQ ID NO: 44287 - DNA, 19 bp, Homo sapiens
gtctcccaccccggcccca

SEQ ID NO: 44288 - DNA, 19 bp, Homo sapiens
ttacagtgtctgttggtgg

SEQ ID NO: 44289 - DNA, 17 bp, Homo sapiens
gaccgcccacacattcc

SEQ ID NO: 44290 - DNA, 21 bp, Homo sapiens
aagaatgtgcagtgaacctca

SEQ ID NO: 44291 - DNA, 20 bp, Homo sapiens
acagatagtgtgggcttcac

SEQ ID NO: 44292 - DNA, 21 bp, Homo sapiens
agccatgtttttcttctgtga

SEQ ID NO: 44293 - DNA, 18 bp, Homo sapiens
cagtttaataatatctca

SEQ ID NO: 44294 - DNA, 21 bp, Homo sapiens
gcttctaggtattttgtattg

SEQ ID NO: 44295 - DNA, 20 bp, Homo sapiens
aacagggcacagagatgcca

SEQ ID NO: 44296 - DNA, 18 bp, Homo sapiens
catttaactctgctagat

SEQ ID NO: 44297 - DNA, 19 bp, Homo sapiens
ctctgacggtggcagctgt

SEQ ID NO: 44298 - DNA, 23 bp, Homo sapiens
gcccctgttctgtccagcagcca

SEQ ID NO: 44299 - DNA, 21 bp, Homo sapiens
gcccgccttcacggctctgaa

SEQ ID NO: 44300 - DNA, 22 bp, Homo sapiens
tgcaaattaaagaactacttga

SEQ ID NO: 44301 - DNA, 19 bp, Homo sapiens
actatagggagagcatgga

SEQ ID NO: 44302 - DNA, 22 bp, Homo sapiens
atggaggagaaggaacttctca

SEQ ID NO: 44303 - DNA, 23 bp, Homo sapiens
caagatacagctaaatacattta

SEQ ID NO: 44304 - DNA, 19 bp, Homo sapiens
cctggaagatttctggttt

SEQ ID NO: 44305 - DNA, 17 bp, Homo sapiens
cctggcataagattgca

SEQ ID NO: 44306 - DNA, 20 bp, Homo sapiens
ccttgagacacactctttcc

SEQ ID NO: 44307 - DNA, 20 bp, Homo sapiens
ctctcctcagtcttatctga

SEQ ID NO: 44308 - DNA, 18 bp, Homo sapiens
tcctttcgtattcatgga

SEQ ID NO: 44309 - DNA, 18 bp, Homo sapiens
ttacaagttggcaaaata

SEQ ID NO: 44310 - DNA, 19 bp, Homo sapiens
acccttccaccccgcctca

SEQ ID NO: 44311 - DNA, 22 bp, Homo sapiens
accgcagatgccctcctccctc

SEQ ID NO: 44312 - DNA, 19 bp, Homo sapiens
agccccctcctcccccggg

SEQ ID NO: 44313 - DNA, 23 bp, Homo sapiens
agttttccactctgccccgggga

SEQ ID NO: 44314 - DNA, 16 bp, Homo sapiens
cacaacatctgctctt

SEQ ID NO: 44315 - DNA, 19 bp, Homo sapiens
cctgcaaggctcttggcct

SEQ ID NO: 44316 - DNA, 19 bp, Homo sapiens
ctccagggcagggactcga

SEQ ID NO: 44317 - DNA, 17 bp, Homo sapiens
gactccattagttccga

SEQ ID NO: 44318 - DNA, 22 bp, Homo sapiens
gcagaggacctgtcccctctca

SEQ ID NO: 44319 - DNA, 18 bp, Homo sapiens
cctccacctcccacctcc

SEQ ID NO: 44320 - DNA, 18 bp, Homo sapiens
atgcgcaccctgttccag

SEQ ID NO: 44321 - DNA, 20 bp, Homo sapiens
caccagtttccctttcctga

SEQ ID NO: 44322 - DNA, 18 bp, Homo sapiens
ctcacccaacctgtgatg

SEQ ID NO: 44323 - DNA, 17 bp, Homo sapiens
ctcctttggggatggcc

SEQ ID NO: 44324 - DNA, 19 bp, Homo sapiens
tagatgggcttgacggagc

SEQ ID NO: 44325 - DNA, 16 bp, Homo sapiens
tcccactgtcccctgt

SEQ ID NO: 44326 - DNA, 19 bp, Homo sapiens
tctggaggaacccattgct

SEQ ID NO: 44327 - DNA, 16 bp, Homo sapiens
actggggaactgtgac

SEQ ID NO: 44328 - DNA, 19 bp, Homo sapiens
agcacttgaatgcttagct

SEQ ID NO: 44329 - DNA, 29 bp, Homo sapiens
cgttccagcctctccctactcccatccca

SEQ ID NO: 44330 - DNA, 20 bp, Homo sapiens
gggcaagatgaaggcttcca

SEQ ID NO: 44331 - DNA, 18 bp, Homo sapiens
ggtgaatggggaagggtc

SEQ ID NO: 44332 - DNA, 23 bp, Homo sapiens
taagaaggggctggtgcccagtc

SEQ ID NO: 44333 - DNA, 22 bp, Homo sapiens
tattaaattcataccatcccta

SEQ ID NO: 44334 - DNA, 27 bp, Homo sapiens
tctatctcccccgacttctaccaggga

SEQ ID NO: 44335 - DNA, 21 bp, Homo sapiens
tgttccagagctcagccttct

SEQ ID NO: 44336 - DNA, 21 bp, Homo sapiens
tttcacttgcatccaactcct

SEQ ID NO: 44337 - DNA, 18 bp, Homo sapiens
ccatagctcagtcctcca

SEQ ID NO: 44338 - DNA, 24 bp, Homo sapiens
aatgcaactgaccctttcaatcag

SEQ ID NO: 44339 - DNA, 18 bp, Homo sapiens
acttagagggctttccaa

SEQ ID NO: 44340 - DNA, 18 bp, Homo sapiens
attattatgtaccacaca

SEQ ID NO: 44341 - DNA, 17 bp, Homo sapiens
gttgggctgtggttggc

SEQ ID NO: 44342 - DNA, 23 bp, Homo sapiens
tgagcctgtctaaggtggggcta

SEQ ID NO: 44343 - DNA, 27 bp, Homo sapiens
tttttttatggcaagacttttggcttt

SEQ ID NO: 44344 - DNA, 22 bp, Homo sapiens
aaccaccacaacttcttataca

SEQ ID NO: 44345 - DNA, 18 bp, Homo sapiens
tcttgtgccaaactgaca

SEQ ID NO: 44346 - DNA, 19 bp, Homo sapiens
tgacacaacttcccagctc

SEQ ID NO: 44347 - DNA, 20 bp, Homo sapiens
agcaagtcatattgatatta

SEQ ID NO: 44348 - DNA, 22 bp, Homo sapiens
cagcctgcccagtatagtgaaa

SEQ ID NO: 44349 - DNA, 21 bp, Homo sapiens
tcactaagagaactttttaca

SEQ ID NO: 44350 - DNA, 24 bp, Homo sapiens
acccagtctgcccttgggattcca

SEQ ID NO: 44351 - DNA, 22 bp, Homo sapiens
acccctttccagccaaagtccc

SEQ ID NO: 44352 - DNA, 18 bp, Homo sapiens
agaagggggcctgagaga

SEQ ID NO: 44353 - DNA, 21 bp, Homo sapiens
caccctggaagccactgtcaa

SEQ ID NO: 44354 - DNA, 20 bp, Homo sapiens
ccaagcccactcttccctca

SEQ ID NO: 44355 - DNA, 20 bp, Homo sapiens
ccctccccaagcccttccca

SEQ ID NO: 44356 - DNA, 24 bp, Homo sapiens
cctcatcatgagcctcaactgcct

SEQ ID NO: 44357 - DNA, 20 bp, Homo sapiens
cctcctccgacccctttcca

SEQ ID NO: 44358 - DNA, 19 bp, Homo sapiens
ctgggcctgctccttgcca

SEQ ID NO: 44359 - DNA, 18 bp, Homo sapiens
gccaaacagaatgtaaca

SEQ ID NO: 44360 - DNA, 20 bp, Homo sapiens
gcccttcggagattcgggga

SEQ ID NO: 44361 - DNA, 15 bp, Homo sapiens
tctctgtccttccct

SEQ ID NO: 44362 - DNA, 21 bp, Homo sapiens
ttccagaagtggaggctccag

SEQ ID NO: 44363 - DNA, 20 bp, Homo sapiens
ttccctcagctcacccttca

SEQ ID NO: 44364 - DNA, 19 bp, Homo sapiens
atgtgacttgctcctcttt

SEQ ID NO: 44365 - DNA, 18 bp, Homo sapiens
gatgtgacttgctcctct

SEQ ID NO: 44366 - DNA, 17 bp, Homo sapiens
tttcctgtgctgttctc

SEQ ID NO: 44367 - DNA, 20 bp, Homo sapiens
aagagaaaggagtcaggttt

SEQ ID NO: 44368 - DNA, 24 bp, Homo sapiens
agtaaccctggacagagtggcagg

SEQ ID NO: 44369 - DNA, 25 bp, Homo sapiens
agtgactttcttcaatgccacaccc

SEQ ID NO: 44370 - DNA, 20 bp, Homo sapiens
gagaagtaaccctggacaga

SEQ ID NO: 44371 - DNA, 21 bp, Homo sapiens
gccaccctgcgcaaccagccc

SEQ ID NO: 44372 - DNA, 19 bp, Homo sapiens
gccagctggagctggccca

SEQ ID NO: 44373 - DNA, 23 bp, Homo sapiens
tcctcttttcccctggaaacctc

SEQ ID NO: 44374 - DNA, 23 bp, Homo sapiens
tggacaccagccagctggagctg

SEQ ID NO: 44375 - DNA, 19 bp, Homo sapiens
ttgcacgtgtaccaagctt

SEQ ID NO: 44376 - DNA, 23 bp, Homo sapiens
aacagaaagcctgagaaccagct

SEQ ID NO: 44377 - DNA, 22 bp, Homo sapiens
acagaaagcctgagaaccagct

SEQ ID NO: 44378 - DNA, 18 bp, Homo sapiens
aggcctgctctcacttta

SEQ ID NO: 44379 - DNA, 22 bp, Homo sapiens
cttccgagccgcatgttactca

SEQ ID NO: 44380 - DNA, 24 bp, Homo sapiens
gctgggtgattctcccctgcctct

SEQ ID NO: 44381 - DNA, 18 bp, Homo sapiens
gtgtaggagttttttgga

SEQ ID NO: 44382 - DNA, 22 bp, Homo sapiens
tatgattaggataaccatataa

SEQ ID NO: 44383 - DNA, 22 bp, Homo sapiens
tggaaactgaaaacagaggtga

SEQ ID NO: 44384 - DNA, 17 bp, Homo sapiens
ttggggcaagtcacttt

SEQ ID NO: 44385 - DNA, 24 bp, Homo sapiens
gaaacccctttttttctgtccctt

SEQ ID NO: 44386 - DNA, 21 bp, Homo sapiens
gaaccaagattcctactgaca

SEQ ID NO: 44387 - DNA, 16 bp, Homo sapiens
atgcttcctcctctga

SEQ ID NO: 44388 - DNA, 22 bp, Homo sapiens
ctctttccctcccaattttcca

SEQ ID NO: 44389 - DNA, 17 bp, Homo sapiens
gagtggaactgtggaac

SEQ ID NO: 44390 - DNA, 23 bp, Homo sapiens
tgcaatttttattcttaaactaa

SEQ ID NO: 44391 - DNA, 18 bp, Homo sapiens
ttatactccaggtagtgt

SEQ ID NO: 44392 - DNA, 17 bp, Homo sapiens
caaaaacatgtgttgta

SEQ ID NO: 44393 - DNA, 21 bp, Homo sapiens
taaaccagaggcacaatgtac

SEQ ID NO: 44394 - DNA, 21 bp, Homo sapiens
tctcctgctacattccttttt

SEQ ID NO: 44395 - DNA, 18 bp, Homo sapiens
aaaccaaattggactatt

SEQ ID NO: 44396 - DNA, 18 bp, Homo sapiens
tacttttccctcactgcc

SEQ ID NO: 44397 - DNA, 19 bp, Homo sapiens
caccaccgccatcgcctca

SEQ ID NO: 44398 - DNA, 19 bp, Homo sapiens
catttctggggttcccgat

SEQ ID NO: 44399 - DNA, 16 bp, Homo sapiens
ctgctcgctttgtttt

SEQ ID NO: 44400 - DNA, 17 bp, Homo sapiens
ctttcagggcctgtgag

SEQ ID NO: 44401 - DNA, 19 bp, Homo sapiens
gacagtgcatcgatgctcc

SEQ ID NO: 44402 - DNA, 22 bp, Homo sapiens
gacagtgcatcgatgctccccc

SEQ ID NO: 44403 - DNA, 22 bp, Homo sapiens
gctctgaagacccaggcctcac

SEQ ID NO: 44404 - DNA, 20 bp, Homo sapiens
tctaatcagcctgtgtgatt

SEQ ID NO: 44405 - DNA, 18 bp, Homo sapiens
agccacatgccccagcca

SEQ ID NO: 44406 - DNA, 19 bp, Homo sapiens
ccctttttcctgtattgta

SEQ ID NO: 44407 - DNA, 22 bp, Homo sapiens
cttcctaatcaaattcttctca

SEQ ID NO: 44408 - DNA, 19 bp, Homo sapiens
tgtcgccaacatggggatg

SEQ ID NO: 44409 - DNA, 17 bp, Homo sapiens
agcatccagcttctgtg

SEQ ID NO: 44410 - DNA, 19 bp, Homo sapiens
agtttaatcccccattcca

SEQ ID NO: 44411 - DNA, 19 bp, Homo sapiens
ccagcaagcgccgatctcc

SEQ ID NO: 44412 - DNA, 22 bp, Homo sapiens
ctagaagcccgttccccagtgg

SEQ ID NO: 44413 - DNA, 22 bp, Homo sapiens
ctgttctacaaaaagtagggtg

SEQ ID NO: 44414 - DNA, 24 bp, Homo sapiens
gcctgggccgcggagtttgtgtcc

SEQ ID NO: 44415 - DNA, 18 bp, Homo sapiens
gtttaatcccccattcca

SEQ ID NO: 44416 - DNA, 22 bp, Homo sapiens
tgagctctttacgggagcatca

SEQ ID NO: 44417 - DNA, 21 bp, Homo sapiens
tttgaaaggagaaggaattgg
